United States Patent 8,461,315 (MICRORNAS AND USES THEREOF) - sequence listing, part 18

SEQ ID NO: 498367 - RNA, 64 nt, Homo Sapiens
ucuccacauagacucuugaaauagccauuucaggggaggaaaggguugggguuuucuuuguuug

SEQ ID NO: 498368 - RNA, 64 nt, Homo Sapiens
aguuaaaaagcauuauacuguggguaaugaaaagggaggaaaaaaaaagaaggaaaaggaauua

SEQ ID NO: 498369 - RNA, 64 nt, Homo Sapiens
caggagaaaauuaaaguguuuucuuuauaucagaggaggaaauaguagaggucagugaaggucu

SEQ ID NO: 498370 - RNA, 64 nt, Homo Sapiens
cuagguuuuuguguguggacaugcuguuauugugggaggaaaugucuugcuguguguucuacaa

SEQ ID NO: 498371 - RNA, 64 nt, Homo Sapiens
ugacuaaggacugagcccccgugagauucugcauggaggaaaaaacagccucuccaaguucaga

SEQ ID NO: 498372 - RNA, 64 nt, Homo Sapiens
gguuuugggguccaggccauuuuuuuuaccccuuggaggaaauaagaugagggagaaaggagaa

SEQ ID NO: 498373 - RNA, 64 nt, Homo Sapiens
uuggaggaaauaagaugagggagaaaggagaaggggaggaaacuucuccccucccaccuucacc

SEQ ID NO: 498374 - RNA, 64 nt, Homo Sapiens
cuggggccagccagggcagggcagggaucuuucuggaggaaaaguucuucuuggcuaauucuug

SEQ ID NO: 498375 - RNA, 64 nt, Homo Sapiens
cgucccucuuggcccuccccggcaggcauggaggggaggaaagguuccugagggccaggucggg

SEQ ID NO: 498376 - RNA, 64 nt, Homo Sapiens; identical to SEQ ID NO: 76873

SEQ ID NO: 498377 - RNA, 64 nt, Homo Sapiens; identical to SEQ ID NO: 76874

SEQ ID NO: 498378 - RNA, 64 nt, Homo Sapiens; identical to SEQ ID NO: 76875

SEQ ID NO: 498379 - RNA, 64 nt, Homo Sapiens; identical to SEQ ID NO: 76876

SEQ ID NO: 498380 - RNA, 64 nt, Homo Sapiens; identical to SEQ ID NO: 76877

SEQ ID NO: 498381 - RNA, 64 nt, Homo Sapiens; identical to SEQ ID NO: 76878

SEQ ID NO: 498382 - RNA, 64 nt, Homo Sapiens; identical to SEQ ID NO: 76879

SEQ ID NO: 498383 - RNA, 64 nt, Homo Sapiens; identical to SEQ ID NO: 76880

SEQ ID NO: 498384 - RNA, 64 nt, Homo Sapiens; identical to SEQ ID NO: 76881

SEQ ID NO: 498385 - RNA, 64 nt, Homo Sapiens; identical to SEQ ID NO: 76882

SEQ ID NO: 498386 - RNA, 64 nt, Homo Sapiens; identical to SEQ ID NO: 76883

SEQ ID NO: 498387 - RNA, 64 nt, Homo Sapiens; identical to SEQ ID NO: 76884

SEQ ID NO: 498388 - RNA, 64 nt, Homo Sapiens; identical to SEQ ID NO: 76885

SEQ ID NO: 498389 - RNA, 64 nt, Homo Sapiens; identical to SEQ ID NO: 76886

SEQ ID NO: 498390 - RNA, 64 nt, Homo Sapiens; identical to SEQ ID NO: 76887

SEQ ID NO: 498391 - RNA, 64 nt, Homo Sapiens; identical to SEQ ID NO: 76888

SEQ ID NO: 498392 - RNA, 64 nt, Homo Sapiens; identical to SEQ ID NO: 76889

SEQ ID NO: 498393 - RNA, 64 nt, Homo Sapiens; identical to SEQ ID NO: 76890

SEQ ID NO: 498394 - RNA, 64 nt, Homo Sapiens; identical to SEQ ID NO: 76891

SEQ ID NO: 498395 - RNA, 64 nt, Homo Sapiens; identical to SEQ ID NO: 76892

SEQ ID NO: 498396 - RNA, 64 nt, Homo Sapiens; identical to SEQ ID NO: 76893

SEQ ID NO: 498397 - RNA, 64 nt, Homo Sapiens; identical to SEQ ID NO: 76894

SEQ ID NO: 498398 - RNA, 64 nt, Homo Sapiens; identical to SEQ ID NO: 76895

SEQ ID NO: 498399 - RNA, 64 nt, Homo Sapiens; identical to SEQ ID NO: 76896

SEQ ID NO: 498400 - RNA, 64 nt, Homo Sapiens; identical to SEQ ID NO: 76897

SEQ ID NO: 498401 - RNA, 64 nt, Homo Sapiens; identical to SEQ ID NO: 392288

SEQ ID NO: 498402 - RNA, 64 nt, Homo Sapiens; identical to SEQ ID NO: 392289

SEQ ID NO: 498403 - RNA, 64 nt, Homo Sapiens; identical to SEQ ID NO: 392290

SEQ ID NO: 498404 - RNA, 64 nt, Homo Sapiens; identical to SEQ ID NO: 392291

SEQ ID NO: 498405 - RNA, 64 nt, Homo Sapiens; identical to SEQ ID NO: 392292

SEQ ID NO: 498406 - RNA, 64 nt, Homo Sapiens; identical to SEQ ID NO: 392293

SEQ ID NO: 498407 - RNA, 64 nt, Homo Sapiens; identical to SEQ ID NO: 413813

SEQ ID NO: 498408 - RNA, 64 nt, Homo Sapiens; identical to SEQ ID NO: 413814

SEQ ID NO: 498409 - RNA, 64 nt, Homo Sapiens; identical to SEQ ID NO: 413815

SEQ ID NO: 498410 - RNA, 64 nt, Homo Sapiens; identical to SEQ ID NO: 413816

SEQ ID NO: 498411 - RNA, 64 nt, Homo Sapiens; identical to SEQ ID NO: 413817

SEQ ID NO: 498412 - RNA, 64 nt, Homo Sapiens; identical to SEQ ID NO: 413818

SEQ ID NO: 498413 - RNA, 64 nt, Homo Sapiens; identical to SEQ ID NO: 413819

SEQ ID NO: 498414 - RNA, 64 nt, Homo Sapiens; identical to SEQ ID NO: 413820

SEQ ID NO: 498415 - RNA, 64 nt, Homo Sapiens; identical to SEQ ID NO: 413821

SEQ ID NO: 498416 - RNA, 64 nt, Homo Sapiens; identical to SEQ ID NO: 413822

SEQ ID NO: 498417 - RNA, 64 nt, Homo Sapiens; identical to SEQ ID NO: 413823

SEQ ID NO: 498418 - RNA, 64 nt, Homo Sapiens; identical to SEQ ID NO: 413824

SEQ ID NO: 498419 - RNA, 64 nt, Homo Sapiens; identical to SEQ ID NO: 413825

SEQ ID NO: 498420 - RNA, 64 nt, Homo Sapiens; identical to SEQ ID NO: 413826

SEQ ID NO: 498421 - RNA, 64 nt, Homo Sapiens; identical to SEQ ID NO: 413827

SEQ ID NO: 498422 - RNA, 64 nt, Homo Sapiens; identical to SEQ ID NO: 413828

SEQ ID NO: 498423 - RNA, 64 nt, Homo Sapiens; identical to SEQ ID NO: 413829

SEQ ID NO: 498424 - RNA, 64 nt, Homo Sapiens; identical to SEQ ID NO: 413830

SEQ ID NO: 498425 - RNA, 64 nt, Homo Sapiens; identical to SEQ ID NO: 413831

SEQ ID NO: 498426 - RNA, 64 nt, Homo Sapiens; identical to SEQ ID NO: 413832

SEQ ID NO: 498427 - RNA, 64 nt, Homo Sapiens; identical to SEQ ID NO: 413833

SEQ ID NO: 498428 - RNA, 64 nt, Homo Sapiens; identical to SEQ ID NO: 413834

SEQ ID NO: 498429 - RNA, 64 nt, Homo Sapiens; identical to SEQ ID NO: 413835

SEQ ID NO: 498430 - RNA, 64 nt, Homo Sapiens; identical to SEQ ID NO: 413836

SEQ ID NO: 498431 - RNA, 64 nt, Homo Sapiens; identical to SEQ ID NO: 413837

SEQ ID NO: 498432 - RNA, 64 nt, Homo Sapiens; identical to SEQ ID NO: 413838

SEQ ID NO: 498433 - RNA, 64 nt, Homo Sapiens; identical to SEQ ID NO: 413839

SEQ ID NO: 498434 - RNA, 64 nt, Homo Sapiens; identical to SEQ ID NO: 413840

SEQ ID NO: 498435 - RNA, 64 nt, Homo Sapiens; identical to SEQ ID NO: 413841

SEQ ID NO: 498436 - RNA, 64 nt, Homo Sapiens; identical to SEQ ID NO: 413842

SEQ ID NO: 498437 - RNA, 64 nt, Homo Sapiens; identical to SEQ ID NO: 413843

SEQ ID NO: 498438 - RNA, 64 nt, Homo Sapiens; identical to SEQ ID NO: 413844

SEQ ID NO: 498439 - RNA, 64 nt, Homo Sapiens; identical to SEQ ID NO: 413845

SEQ ID NO: 498440 - RNA, 64 nt, Homo Sapiens; identical to SEQ ID NO: 413846

SEQ ID NO: 498441 - RNA, 64 nt, Homo Sapiens; identical to SEQ ID NO: 413847

SEQ ID NO: 498442 - RNA, 64 nt, Homo Sapiens; identical to SEQ ID NO: 413848

SEQ ID NO: 498443 - RNA, 64 nt, Homo Sapiens; identical to SEQ ID NO: 413849

SEQ ID NO: 498444 - RNA, 64 nt, Homo Sapiens; identical to SEQ ID NO: 413850

SEQ ID NO: 498445 - RNA, 64 nt, Homo Sapiens; identical to SEQ ID NO: 413851

SEQ ID NO: 498446 - RNA, 64 nt, Homo Sapiens; identical to SEQ ID NO: 413852

SEQ ID NO: 498447 - RNA, 64 nt, Homo Sapiens; identical to SEQ ID NO: 413853

SEQ ID NO: 498448 - RNA, 64 nt, Homo Sapiens; identical to SEQ ID NO: 413854

SEQ ID NO: 498449 - RNA, 64 nt, Homo Sapiens; identical to SEQ ID NO: 413855

SEQ ID NO: 498450 - RNA, 64 nt, Homo Sapiens; identical to SEQ ID NO: 413856

SEQ ID NO: 498451 - RNA, 64 nt, Homo Sapiens; identical to SEQ ID NO: 413857

SEQ ID NO: 498452 - RNA, 64 nt, Homo Sapiens; identical to SEQ ID NO: 413858

SEQ ID NO: 498453 - RNA, 64 nt, Homo Sapiens; identical to SEQ ID NO: 413859

SEQ ID NO: 498454 - RNA, 64 nt, Homo Sapiens; identical to SEQ ID NO: 413860

SEQ ID NO: 498455 - RNA, 64 nt, Homo Sapiens; identical to SEQ ID NO: 413861

SEQ ID NO: 498456 - RNA, 64 nt, Homo Sapiens; identical to SEQ ID NO: 413862

SEQ ID NO: 498457 - RNA, 64 nt, Homo Sapiens; identical to SEQ ID NO: 413863

SEQ ID NO: 498458 - RNA, 64 nt, Homo Sapiens; identical to SEQ ID NO: 413864

SEQ ID NO: 498459 - RNA, 64 nt, Homo Sapiens; identical to SEQ ID NO: 413865

SEQ ID NO: 498460 - RNA, 64 nt, Homo Sapiens; identical to SEQ ID NO: 413866

SEQ ID NO: 498461 - RNA, 64 nt, Homo Sapiens; identical to SEQ ID NO: 413867

SEQ ID NO: 498462 - RNA, 64 nt, Homo Sapiens; identical to SEQ ID NO: 413868

SEQ ID NO: 498463 - RNA, 64 nt, Homo Sapiens; identical to SEQ ID NO: 413869

SEQ ID NO: 498464 - RNA, 64 nt, Homo Sapiens; identical to SEQ ID NO: 413870

SEQ ID NO: 498465 - RNA, 64 nt, Homo Sapiens; identical to SEQ ID NO: 413871

SEQ ID NO: 498466 - RNA, 64 nt, Homo Sapiens; identical to SEQ ID NO: 413872

SEQ ID NO: 498467 - RNA, 64 nt, Homo Sapiens; identical to SEQ ID NO: 413873

SEQ ID NO: 498468 - RNA, 64 nt, Homo Sapiens; identical to SEQ ID NO: 413874

SEQ ID NO: 498469 - RNA, 64 nt, Homo Sapiens; identical to SEQ ID NO: 413875

SEQ ID NO: 498470 - RNA, 64 nt, Homo Sapiens; identical to SEQ ID NO: 413876

SEQ ID NO: 498471 - RNA, 64 nt, Homo Sapiens; identical to SEQ ID NO: 413877

SEQ ID NO: 498472 - RNA, 64 nt, Homo Sapiens; identical to SEQ ID NO: 413878

SEQ ID NO: 498473 - RNA, 64 nt, Homo Sapiens; identical to SEQ ID NO: 413879

SEQ ID NO: 498474 - RNA, 64 nt, Homo Sapiens; identical to SEQ ID NO: 413880

SEQ ID NO: 498475 - RNA, 64 nt, Homo Sapiens; identical to SEQ ID NO: 413881

SEQ ID NO: 498476 - RNA, 64 nt, Homo Sapiens; identical to SEQ ID NO: 413882

SEQ ID NO: 498477 - RNA, 64 nt, Homo Sapiens; identical to SEQ ID NO: 413883

SEQ ID NO: 498478 - RNA, 64 nt, Homo Sapiens; identical to SEQ ID NO: 413884

SEQ ID NO: 498479 - RNA, 64 nt, Homo Sapiens; identical to SEQ ID NO: 413885

SEQ ID NO: 498480 - RNA, 64 nt, Homo Sapiens; identical to SEQ ID NO: 413886

SEQ ID NO: 498481 - RNA, 64 nt, Homo Sapiens; identical to SEQ ID NO: 413887

SEQ ID NO: 498482 - RNA, 64 nt, Homo Sapiens; identical to SEQ ID NO: 413888

SEQ ID NO: 498483 - RNA, 64 nt, Homo Sapiens; identical to SEQ ID NO: 413889

SEQ ID NO: 498484 - RNA, 64 nt, Homo Sapiens; identical to SEQ ID NO: 413890

SEQ ID NO: 498485 - RNA, 64 nt, Homo Sapiens; identical to SEQ ID NO: 413891

SEQ ID NO: 498486 - RNA, 64 nt, Homo Sapiens; identical to SEQ ID NO: 413892

SEQ ID NO: 498487 - RNA, 64 nt, Homo Sapiens; identical to SEQ ID NO: 413893

SEQ ID NO: 498488 - RNA, 53 nt, Homo Sapiens; identical to SEQ ID NO: 413894

SEQ ID NO: 498489 - RNA, 64 nt, Homo Sapiens; identical to SEQ ID NO: 413895

SEQ ID NO: 498490 - RNA, 64 nt, Homo Sapiens; identical to SEQ ID NO: 413896

SEQ ID NO: 498491 - RNA, 64 nt, Homo Sapiens; identical to SEQ ID NO: 413897

SEQ ID NO: 498492 - RNA, 64 nt, Homo Sapiens; identical to SEQ ID NO: 413898

SEQ ID NO: 498493 - RNA, 64 nt, Homo Sapiens; identical to SEQ ID NO: 413899

SEQ ID NO: 498494 - RNA, 64 nt, Homo Sapiens; identical to SEQ ID NO: 413900

SEQ ID NO: 498495 - RNA, 64 nt, Homo Sapiens; identical to SEQ ID NO: 413901

SEQ ID NO: 498496 - RNA, 64 nt, Homo Sapiens; identical to SEQ ID NO: 413902

SEQ ID NO: 498497 - RNA, 64 nt, Homo Sapiens; identical to SEQ ID NO: 413903

SEQ ID NO: 498498 - RNA, 64 nt, Homo Sapiens; identical to SEQ ID NO: 413904

SEQ ID NO: 498499 - RNA, 64 nt, Homo Sapiens; identical to SEQ ID NO: 413905

SEQ ID NO: 498500 - RNA, 64 nt, Homo Sapiens; identical to SEQ ID NO: 413906

SEQ ID NO: 498501 - RNA, 64 nt, Homo Sapiens; identical to SEQ ID NO: 413907

SEQ ID NO: 498502 - RNA, 64 nt, Homo Sapiens; identical to SEQ ID NO: 413908

SEQ ID NO: 498503 - RNA, 64 nt, Homo Sapiens; identical to SEQ ID NO: 413909

SEQ ID NO: 498504 - RNA, 64 nt, Homo Sapiens; identical to SEQ ID NO: 413910

SEQ ID NO: 498505 - RNA, 64 nt, Homo Sapiens; identical to SEQ ID NO: 413911

SEQ ID NO: 498506 - RNA, 64 nt, Homo Sapiens; identical to SEQ ID NO: 413912

SEQ ID NO: 498507 - RNA, 64 nt, Homo Sapiens; identical to SEQ ID NO: 413913

SEQ ID NO: 498508 - RNA, 64 nt, Homo Sapiens; identical to SEQ ID NO: 413914

SEQ ID NO: 498509 - RNA, 64 nt, Homo Sapiens; identical to SEQ ID NO: 413915

SEQ ID NO: 498510 - RNA, 64 nt, Homo Sapiens; identical to SEQ ID NO: 413916

SEQ ID NO: 498511 - RNA, 64 nt, Homo Sapiens; identical to SEQ ID NO: 413917

SEQ ID NO: 498512 - RNA, 64 nt, Homo Sapiens; identical to SEQ ID NO: 413918

SEQ ID NO: 498513 - RNA, 64 nt, Homo Sapiens; identical to SEQ ID NO: 413919

SEQ ID NO: 498514 - RNA, 64 nt, Homo Sapiens; identical to SEQ ID NO: 413920

SEQ ID NO: 498515 - RNA, 64 nt, Homo Sapiens; identical to SEQ ID NO: 413921

SEQ ID NO: 498516 - RNA, 64 nt, Homo Sapiens; identical to SEQ ID NO: 413922

SEQ ID NO: 498517 - RNA, 64 nt, Homo Sapiens; identical to SEQ ID NO: 413923

SEQ ID NO: 498518 - RNA, 64 nt, Homo Sapiens; identical to SEQ ID NO: 413924

SEQ ID NO: 498519 - RNA, 64 nt, Homo Sapiens; identical to SEQ ID NO: 413925

SEQ ID NO: 498520 - RNA, 64 nt, Homo Sapiens; identical to SEQ ID NO: 413926

SEQ ID NO: 498521 - RNA, 64 nt, Homo Sapiens; identical to SEQ ID NO: 413927

SEQ ID NO: 498522 - RNA, 64 nt, Homo Sapiens; identical to SEQ ID NO: 413928

SEQ ID NO: 498523 - RNA, 64 nt, Homo Sapiens; identical to SEQ ID NO: 413928

SEQ ID NO: 498524 - RNA, 64 nt, Homo Sapiens; identical to SEQ ID NO: 413930

SEQ ID NO: 498525 - RNA, 64 nt, Homo Sapiens; identical to SEQ ID NO: 413931

SEQ ID NO: 498526 - RNA, 64 nt, Homo Sapiens; identical to SEQ ID NO: 413932

SEQ ID NO: 498527 - RNA, 64 nt, Homo Sapiens; identical to SEQ ID NO: 413933

SEQ ID NO: 498528 - RNA, 64 nt, Homo Sapiens; identical to SEQ ID NO: 413934

SEQ ID NO: 498529 - RNA, 64 nt, Homo Sapiens; identical to SEQ ID NO: 413935

SEQ ID NO: 498530 - RNA, 64 nt, Homo Sapiens; identical to SEQ ID NO: 413936

SEQ ID NO: 498531 - RNA, 64 nt, Homo Sapiens; identical to SEQ ID NO: 413937

SEQ ID NO: 498532 - RNA, 64 nt, Homo Sapiens; identical to SEQ ID NO: 103765

SEQ ID NO: 498533 - RNA, 64 nt, Homo Sapiens; identical to SEQ ID NO: 103766

SEQ ID NO: 498534 - RNA, 53 nt, Homo Sapiens; identical to SEQ ID NO: 103767

SEQ ID NO: 498535 - RNA, 64 nt, Homo Sapiens; identical to SEQ ID NO: 103768

SEQ ID NO: 498536 - RNA, 64 nt, Homo Sapiens; identical to SEQ ID NO: 103769

SEQ ID NO: 498537 - RNA, 64 nt, Homo Sapiens; identical to SEQ ID NO: 103770

SEQ ID NO: 498538 - RNA, 53 nt, Homo Sapiens; identical to SEQ ID NO: 103771

SEQ ID NO: 498539 - RNA, 64 nt, Homo Sapiens; identical to SEQ ID NO: 103772

SEQ ID NO: 498540 - RNA, 64 nt, Homo Sapiens; identical to SEQ ID NO: 103773

SEQ ID NO: 498541 - RNA, 64 nt, Homo Sapiens; identical to SEQ ID NO: 103774

SEQ ID NO: 498542 - RNA, 64 nt, Homo Sapiens; identical to SEQ ID NO: 103775

SEQ ID NO: 498543 - RNA, 64 nt, Homo Sapiens; identical to SEQ ID NO: 103776

SEQ ID NO: 498544 - RNA, 64 nt, Homo Sapiens; identical to SEQ ID NO: 286003

SEQ ID NO: 498545 - RNA, 64 nt, Homo Sapiens; identical to SEQ ID NO: 286004

SEQ ID NO: 498546 - RNA, 64 nt, Homo Sapiens; identical to SEQ ID NO: 286005

SEQ ID NO: 498547 - RNA, 64 nt, Homo Sapiens; identical to SEQ ID NO: 286006

SEQ ID NO: 498548 - RNA, 64 nt, Homo Sapiens; identical to SEQ ID NO: 286007

SEQ ID NO: 498549 - RNA, 64 nt, Homo Sapiens; identical to SEQ ID NO: 286008

SEQ ID NO: 498550 - RNA, 64 nt, Homo Sapiens; identical to SEQ ID NO: 286009

SEQ ID NO: 498551 - RNA, 64 nt, Homo Sapiens; identical to SEQ ID NO: 286010

SEQ ID NO: 498552 - RNA, 64 nt, Homo Sapiens; identical to SEQ ID NO: 286011

SEQ ID NO: 498553 - RNA, 64 nt, Homo Sapiens; identical to SEQ ID NO: 286012

SEQ ID NO: 498554 - RNA, 64 nt, Homo Sapiens; identical to SEQ ID NO: 286013

SEQ ID NO: 498555 - RNA, 64 nt, Homo Sapiens; identical to SEQ ID NO: 286014

SEQ ID NO: 498556 - RNA, 64 nt, Homo Sapiens; identical to SEQ ID NO: 286015

SEQ ID NO: 498557 - RNA, 64 nt, Homo Sapiens; identical to SEQ ID NO: 286016

SEQ ID NO: 498558 - RNA, 64 nt, Homo Sapiens; identical to SEQ ID NO: 286017

SEQ ID NO: 498559 - RNA, 64 nt, Homo Sapiens; identical to SEQ ID NO: 286018

SEQ ID NO: 498560 - RNA, 64 nt, Homo Sapiens; identical to SEQ ID NO: 286019

SEQ ID NO: 498561 - RNA, 64 nt, Homo Sapiens; identical to SEQ ID NO: 286020

SEQ ID NO: 498562 - RNA, 64 nt, Homo Sapiens; identical to SEQ ID NO: 286021

SEQ ID NO: 498563 - RNA, 64 nt, Homo Sapiens; identical to SEQ ID NO: 286022

SEQ ID NO: 498564 - RNA, 64 nt, Homo Sapiens; identical to SEQ ID NO: 286023

SEQ ID NO: 498565 - RNA, 64 nt, Homo Sapiens; identical to SEQ ID NO: 286024

SEQ ID NO: 498566 - RNA, 64 nt, Homo Sapiens
cccugaacccuuuuaaagaaugugcagccugauuuaaaaccaaaugucagauugauuugaaagg

SEQ ID NO: 498567 - RNA, 64 nt, Homo Sapiens
aaugaugccuagugaguaugaaaaaucccugguuuaaaaccaacguuuuuugagauuaaaaaaa

SEQ ID NO: 498568 - RNA, 64 nt, Homo Sapiens
auauucaguaguugaagaaacucacuccaucauuuaaaaccagugucagcaagagccucuuugu

SEQ ID NO: 498569 - RNA, 64 nt, Homo Sapiens
cagaaucaaagcagcaaccaugcaaggaguaaaguaaaaccaucuacuggggugggggaaucua

SEQ ID NO: 498570 - RNA, 64 nt, Homo Sapiens
aaggacauacuucauaauauauaagugugcacuguaaaaccauccagccauuugacacccuuua

SEQ ID NO: 498571 - RNA, 64 nt, Homo Sapiens
aauuuaucauguuuaaaaauuauucaagcacucuuaaaaccacuuaaacagccuccagucauaa

SEQ ID NO: 498572 - RNA, 64 nt, Homo Sapiens
uugcuuccuugcuuuuauguuuguacacaacaccuaaaaccaguuuugcugcuauaauucuaua

SEQ ID NO: 498573 - RNA, 64 nt, Homo Sapiens
aagaagucucuuaauucugaugcuagguuguuuuuaaaaccacuaugcaaagaacucaccacaa

SEQ ID NO: 498574 - RNA, 64 nt, Homo Sapiens
cauaacuuuacucugaagcaaggaaagaaaaaauuaaaaccaccaaaaagaggauuaaaucuaa

SEQ ID NO: 498575 - RNA, 64 nt, Homo Sapiens
aauacccucagacugaaagggccacugcuuauaauaaaaccaacuucuuucuguguguguguaa

SEQ ID NO: 498576 - RNA, 64 nt, Homo Sapiens
ggagagagagcuugugcagggaaacucccauuuuuaaaaccaucagaucucaugaggcuuacua

SEQ ID NO: 498577 - RNA, 64 nt, Homo Sapiens
ccuuaaggucauggucauauagcuaguuaucuuguaaaaccaauguuucuuaguucauacuuac

SEQ ID NO: 498578 - RNA, 64 nt, Homo Sapiens
ccaccuuuagacaaaggugacuccacaauuuuauuaaaaccacuuauugagggcuacuaucugc

SEQ ID NO: 498579 - RNA, 64 nt, Homo Sapiens
gguuauauacaauuuaaauuccacaauuuaaaaauaaaaccagauauuaggauuuaaauuuaug

SEQ ID NO: 498580 - RNA, 64 nt, Homo Sapiens
agaauuuguguuugucugauuuggaaguaaagauuaaaaccaaaagaaacaagauuguuuggga

SEQ ID NO: 498581 - RNA, 64 nt, Homo Sapiens
auacaguuuggcuuuuuucaagggucggagucuguaaaaccagcagacaagaagacugucagga

SEQ ID NO: 498582 - RNA, 64 nt, Homo Sapiens
auuugaaaguuuaauucuuugaaacaaacuuauuuaaaaccaucguuuaguaaguucagaagua

SEQ ID NO: 498583 - RNA, 64 nt, Homo Sapiens
cuauacagcaaguaucguuuaccauaucaaguauuaaaaccauuuacccuacagacuggccgag

SEQ ID NO: 498584 - RNA, 64 nt, Homo Sapiens
uuuuugucucauuguguuauugucugacuaaaucuaaaaccaaacccauguugaaacuaguacu

SEQ ID NO: 498585 - RNA, 64 nt, Homo Sapiens
ugagucucuuuuugguggcuaaguagaaucuuccuaaaaccauugucauaaaagcaguuaaagg

SEQ ID NO: 498586 - RNA, 64 nt, Homo Sapiens
cagauauaaacaccaaagacucagagagaccugcuaaaaccagagaggagcugugggucaggaa

SEQ ID NO: 498587 - RNA, 64 nt, Homo Sapiens
uuuaccauguaauuuguuuuaaagccuaugaauuuaaaaccaggauuuccgggaauuauuauug

SEQ ID NO: 498588 - RNA, 64 nt, Homo Sapiens
gauaauaacaaaccuuauacccccaguggaugucuaaaaccacaguggauaucuaaaaccagac

SEQ ID NO: 498589 - RNA, 64 nt, Homo Sapiens
cccccaguggaugucuaaaaauacaguggauaucuaaaaccagauacccccuuauccacagggg

SEQ ID NO: 498590 - RNA, 64 nt, Homo Sapiens
gaaauaaaaauaaauucaaguaggaaauauucauuaaaaccauuaaugaguauugugaacuuuc

SEQ ID NO: 498591 - RNA, 64 nt, Homo Sapiens
aacucuaaaguagcacaagcugcaaagcugugaauaaaaccacauggaagcuggugacuuuauu

SEQ ID NO: 498592 - RNA, 64 nt, Homo Sapiens
ugaaacacaaagcuuccaaucuuaaggaugugaauaaaaccaccaaauggcauuucuagacagu

SEQ ID NO: 498593 - RNA, 64 nt, Homo Sapiens
auauggaaaacauuuugauaaaauuuuuuccuguuaaaaccaugaacauuggcuaugaugaaga

SEQ ID NO: 498594 - RNA, 64 nt, Homo Sapiens
auauuuucaaacgaaacguaagagaagucaacaauaaaaccaagaaaagugaguauuuuuauac

SEQ ID NO: 498595 - RNA, 64 nt, Homo Sapiens
cucaaccucuccccuuguacagaagccauuuuuguaaaaccacacugaccuaaauucagcugcc

SEQ ID NO: 498596 - RNA, 64 nt, Homo Sapiens
aacgugcugcucaaggaccauaccauaaagccuuuaaaaccaguaaugaaaagcaauacaacuu

SEQ ID NO: 498597 - RNA, 64 nt, Homo Sapiens
gaaucuuaaggucuaacuguuuuaacaauugucuuaaaaccagacucagagcuuuaaaaguauc

SEQ ID NO: 498598 - RNA, 64 nt, Homo Sapiens
aaaaagaaacucauuuuuacgaaaaaaaaaagauuaaaaccauuugguacaagccuuggggacu

SEQ ID NO: 498599 - RNA, 64 nt, Homo Sapiens
gaaaucaauggaacccuugcagaucuaucguguuuaaaaccaaauauauauauuuagguaaaau

SEQ ID NO: 498600 - RNA, 64 nt, Homo Sapiens
ucaauuugagaaaauagaaauagauauuuuuaaauaaaaccauucacaguuuacuuugucuuga

SEQ ID NO: 498601 - RNA, 64 nt, Homo Sapiens
auaauacagccuguugucuaaagccaaggagucauaaaaccaugagaaauaaauaggaaucaau

SEQ ID NO: 498602 - RNA, 64 nt, Homo Sapiens
agagccugccaaggaccucauuuaguuuguguauuaaaaccaaaaagcuuuugucuuuaagaaa

SEQ ID NO: 498603 - RNA, 64 nt, Homo Sapiens
guauuaaaaccaaaaagcuuuugucuuuaagaaauaaaaccauuuuuuuaagccccaaaagguu

SEQ ID NO: 498604 - RNA, 64 nt, Homo Sapiens
uaugacaugaguuuugagaaaaaaccaucaucuguaaaaccaucacagcauugacaucaucugu

SEQ ID NO: 498605 - RNA, 64 nt, Homo Sapiens
aucuguaaaaccaucuaugaauugacaucaucuguaaaaccauccuucagugauuuuaaacagc

SEQ ID NO: 498606 - RNA, 64 nt, Homo Sapiens
uucagaaauguguauuuccauaauccagagguuguaaaaccacuaguguuuuagugguuacagc

SEQ ID NO: 498607 - RNA, 64 nt, Homo Sapiens
cauuugugugugugugauuccacuuagaaauucuuaaaaccagauuuuucuuucauuccguuug

SEQ ID NO: 498608 - RNA, 64 nt, Homo Sapiens
uuuaucuaacagcuauuaaauaccuguuguaaccuaaaaccaguacaaaccuaguugcuaaaac

SEQ ID NO: 498609 - RNA, 64 nt, Homo Sapiens
aaaguacuuuuuuaauuaaaaacauuauuaaguguaaaaccagcuaauggggaaaauagaaaau

SEQ ID NO: 498610 - RNA, 64 nt, Homo Sapiens
cagauugaaauucuaauuagaauuggcuuuaaaauaaaaccauuuugaaacaauauuauuuuga

SEQ ID NO: 498611 - RNA, 64 nt, Homo Sapiens
gaucaauuuaaauugcugaucacuugauuaguaauaaaaccagacccucagauaucacauggua

SEQ ID NO: 498612 - RNA, 64 nt, Homo Sapiens
gggcuuuacuaucuuuucaucucauuaauucaauuaaaaccauuaccuuaaaauuuuuuucuuu

SEQ ID NO: 498613 - RNA, 64 nt, Homo Sapiens
uuuaacuagacugcguguuguuuuucccguauaauaaaaccaaagaauaguuugguucuucaaa

SEQ ID NO: 498614 - RNA, 64 nt, Homo Sapiens
guuggcaauugguaucaucaaugacugaauaauguaaaaccaguucaucuuucuauucuguuuc

SEQ ID NO: 498615 - RNA, 64 nt, Homo Sapiens
cauccccuucuugauuguauaggugguauagucauaaaaccauugauuuuaaucuugaaguagu

SEQ ID NO: 498616 - RNA, 64 nt, Homo Sapiens
auuuaagaaugauuaaaaauaagcuuuuacuuuuuaaaaccacuugagguuucauaaagcuugg

SEQ ID NO: 498617 - RNA, 64 nt, Homo Sapiens
ugccuagaaagugguugaaggauucuugaugcccuaaaaccaucuuguaagcuaaauggucuug

SEQ ID NO: 498618 - RNA, 64 nt, Homo Sapiens
auaauacuuuaauggaaugcuuuuuaaaaaaauauaaaaccaagguaaauuauuguuucaucuu

SEQ ID NO: 498619 - RNA, 64 nt, Homo Sapiens
uuguuuuacugcuguuaaguuuguuauuuggguauaaaaccagauguuuacaccuguaaaucuu

SEQ ID NO: 498620 - RNA, 64 nt, Homo Sapiens
aaugguguuuaacuaaugcugcuggcggacauccuaaaaccagaugcauccucagaggacgagu

SEQ ID NO: 498621 - RNA, 64 nt, Homo Sapiens
cugggcaaaauaauauuaaauggauuaaagaaucuaaaaccagugggaaaacugucugauuucu

SEQ ID NO: 498622 - RNA, 64 nt, Homo Sapiens
uuuuguggauucuaucaaagugauaagugauccuuaaaaccagccuucuaaaauaauugcauuc

SEQ ID NO: 498623 - RNA, 64 nt, Homo Sapiens
cacuuugauguuaaaucuauugcuacuucaguuguaaaaccagccaaaaguuucuggaugaagg

SEQ ID NO: 498624 - RNA, 64 nt, Homo Sapiens
uguucagguuaauccaagcaacacgcauuggguuuaaaaccagcaccgaggcccagugggggaa

SEQ ID NO: 498625 - RNA, 64 nt, Homo Sapiens
cgugugguuagaucagcuuuguuacugaauuaccuaaaaccagaccacagcacagccagggagc

SEQ ID NO: 498626 - RNA, 64 nt, Homo Sapiens
ugagcaguuugcauauauuuauuuaugaucuucuuaaaaccauuccaugaaauaggaacuguaa

SEQ ID NO: 498627 - RNA, 64 nt, Homo Sapiens
ugguacugauucucaaaacaaggagcucauagucuaaaaccauuuuucuuucuuuuuuuucccc

SEQ ID NO: 498628 - RNA, 64 nt, Homo Sapiens
cuacagcuuugaguuggaaagaagucacggguuguaaaaccauuuggauuuuuuuaaaacaaaa

SEQ ID NO: 498629 - RNA, 64 nt, Homo Sapiens
uacagugauuucaauugcaccaugacuucuucacuaaaaccacaaaguccugcuuaaaacuaug

SEQ ID NO: 498630 - RNA, 64 nt, Homo Sapiens
uuuuguucuuagaacugcucccauuucugggaacuaaaaccaguuuuauuugccccaccccuug

SEQ ID NO: 498631 - RNA, 64 nt, Homo Sapiens
agaauauuggcccuuucuaaccuaugugcauaauuaaaaccagcuucauuuguugcuccgagag

SEQ ID NO: 498632 - RNA, 57 nt, Homo Sapiens
cacuuguucuuaaagacuagagcagcgaacugcgacgaucacuuagagaaacaggcc

SEQ ID NO: 498633 - RNA, 64 nt, Homo Sapiens
ccuagggcggggcugggugggagaugggagggccaacugcgagcugcuccacuucucagcucuc

SEQ ID NO: 498634 - RNA, 64 nt, Homo Sapiens
cucuuuaguaaauuuagaacuguagaggcuaauaaacugcgaugagacauuuaagcucugcucc

SEQ ID NO: 498635 - RNA, 64 nt, Homo Sapiens
cagucucuguccugugguagaccaucuuuuuguaaacugcgagcuuccucuucccuguacccuc

SEQ ID NO: 498636 - RNA, 64 nt, Homo Sapiens
gcuugcugaggggugggagaaaggaucaugugguaacugcgagaaauggaaggcaagaaacacg

SEQ ID NO: 498637 - RNA, 64 nt, Homo Sapiens
ccucauuccaugccacuaugagucaacucaggaaaacugcgagugcauuugaggcuuaggggua

SEQ ID NO: 498638 - RNA, 64 nt, Homo Sapiens
uucucucucacugccaucaaacuguaaaagauuaaacugcgaagucaagcucaacagauuauuu

SEQ ID NO: 498639 - RNA, 64 nt, Homo Sapiens
uccuuaaagcucuaucuagcaguauaagggacgaaacugcgaacaagauccauucucuauuccc

SEQ ID NO: 498640 - RNA, 64 nt, Homo Sapiens
gaagcaauauaccacuaaccuaaaggcccauaguaacugcgaaugggacuuuucugggagaacu

SEQ ID NO: 498641 - RNA, 64 nt, Homo Sapiens
agacauuuugacaaaaacuacgucagagaacuuaaacugcgaaaagugggcccacaucagucaa

SEQ ID NO: 498642 - RNA, 64 nt, Homo Sapiens
uuauccuuaguuugcaaaugaaaaaaggcacaucaacugcgaagaaauagcacuuuuaauagca

SEQ ID NO: 498643 - RNA, 64 nt, Homo Sapiens
gagcugcagaaaaccagauugcuggucccuggagaacugcgaacaaagcgcccccucucgagag

SEQ ID NO: 498644 - RNA, 64 nt, Homo Sapiens
gauuuaaaaauguguuuuguuucuacuauucagaaacugcgaacuagggaaagguugguaugaa

SEQ ID NO: 498645 - RNA, 64 nt, Homo Sapiens
ggugccuuggcacccuugccuggaacucguuagcaacugcgagcagaagcuuuccagucacaca

SEQ ID NO: 498646 - RNA, 64 nt, Homo Sapiens
gaacguggaauccuaguaaauucuaacuuuaauaaacugcgacuuaggggguggauggagacac

SEQ ID NO: 498647 - RNA, 64 nt, Homo Sapiens
gaagcuaaacguguuuauuuacuuaccaccacuaaacugcgagagcaaagaagcuacagccugg

SEQ ID NO: 498648 - RNA, 64 nt, Homo Sapiens
uuuuaugacuuccauuuggcaauuguugaauuauaacugcgacugaaacaaacagguucauaga

SEQ ID NO: 498649 - RNA, 64 nt, Homo Sapiens
uccauagugggcucuggcuucaaagcucuuauucaacugcgaauacauuaccaaaagcagggaa

SEQ ID NO: 498650 - RNA, 64 nt, Homo Sapiens
uuucacuccuaaagaaauaggcuguuaauacuuaaacugcgauacaagaagaacagauaacaaa

SEQ ID NO: 498651 - RNA, 64 nt, Homo Sapiens
uugugagcaaaacauacuugagguacugugaaauaacugcgauuucgugaaaagaauuacuaua

SEQ ID NO: 498652 - RNA, 64 nt, Homo Sapiens
ccaacaucacuuccuucaugcaagagugaggcuaaacugcgaccagugugugugacucaaagau

SEQ ID NO: 498653 - RNA, 64 nt, Homo Sapiens
uuggaacaccugugagagagguccacgcggagauaacugcgauacggggucgguuuaauggagu

SEQ ID NO: 498654 - RNA, 64 nt, Homo Sapiens
aaagagaugugcuguuuaacgagucuucuugcugaacugcgaauaugcgacagugucagcacug

SEQ ID NO: 498655 - RNA, 64 nt, Homo Sapiens
aacgccuuucggcuuugggcuuuuauuuuuuuggaacugcgaguggcuuaggucuagccucauu

SEQ ID NO: 498656 - RNA, 64 nt, Homo Sapiens
auuacauuaccuuguuucauaauaaauacaugcuaacugcgauccuggcauauacuaaacgcua

SEQ ID NO: 498657 - RNA, 64 nt, Homo Sapiens
acaugauccagauguuccaguggcucagcagcgcaacugcgaggcaccgccaagcucugcgaug

SEQ ID NO: 498658 - RNA, 64 nt, Homo Sapiens
gugaccuagagacuucaccccagccagcauccccaacugcgacucugucucugccccccuuccc

SEQ ID NO: 498659 - RNA, 64 nt, Homo Sapiens
aauacuaaauguaguugagaaaaaaaaaaucuaaaacugcgaaggagugguuuucgcuuaaagg

SEQ ID NO: 498660 - RNA, 64 nt, Homo Sapiens
agcucacaguccaggucucucgugccacaaggcaaacugcgaugccaggcucaaacaugucccc

SEQ ID NO: 498661 - RNA, 64 nt, Homo Sapiens
accccaacaauguguguaucuuuugcacagcaaaaacugcgaggccagaacuaguuuaucugaa

SEQ ID NO: 498662 - RNA, 64 nt, Homo Sapiens
acugagaaacucuuaccaguugaaaauguuuuggaacugcgauaaaaaaaaaaaaaagcuaucu

SEQ ID NO: 498663 - RNA, 64 nt, Homo Sapiens
uccgagccauggaagggugguuauuccuagauggaacugcgacuuccaggcaucuagguucuuu

SEQ ID NO: 498664 - RNA, 64 nt, Homo Sapiens
ccuuuuccucccuuuuccuguccaaugacuggacaacugcgaugcugagugacguacuucaucc

SEQ ID NO: 498665 - RNA, 64 nt, Homo Sapiens
acguccugguuauggaaaauucaacacaguucucaacugcgaucgcugaccaucgcccaccgcc

SEQ ID NO: 498666 - RNA, 64 nt, Homo Sapiens
acaucaaagugguaaauacugauacauuuaauaaaacugcgaggaggcaaaguuuuacagagag

SEQ ID NO: 498667 - RNA, 64 nt, Homo Sapiens
uuauagcuggagaucugaacaaagggagaaagaaaacugcgauuguucucccccuccugauuaa

SEQ ID NO: 498668 - RNA, 64 nt, Homo Sapiens
aaacauuuugaaggaaaauuucuuggcugugagcaacugcgacacccgaagcucuugugaacug

SEQ ID NO: 498669 - RNA, 64 nt, Homo Sapiens
caguuuccuccccugugaaaugagaacacgggguaacugcgaucauugcacuugguguucacag

SEQ ID NO: 498670 - RNA, 64 nt, Homo Sapiens
ccaguuccuuggagggacaugagggggucucagaaacugcgaggcaggagccauugcucuccua

SEQ ID NO: 498671 - RNA, 64 nt, Homo Sapiens
agagugcuuauuuaaguguuaauacuuuuaagagaacugcgacgauuaauuguggaucuccccc

SEQ ID NO: 498672 - RNA, 64 nt, Homo Sapiens
uguauuugauauuugugaucagugaucauuguucaacugcgaaauagaguguuugcuuuugaua

SEQ ID NO: 498673 - RNA, 64 nt, Homo Sapiens
aauuacacugugcuuaaugacugauuuuuuuuuaaacugcgagucccuuaagaucacguuuguc

SEQ ID NO: 498674 - RNA, 64 nt, Homo Sapiens
cuccuuucuuuaucucuaucucagaugguuguuuaacugcgaguuuaaauguguuuguccugga

SEQ ID NO: 498675 - RNA, 64 nt, Homo Sapiens
cccauucccagcucuucuccauccuccgugggcgaacugcgagcacccgacucgguuucuggau

SEQ ID NO: 498676 - RNA, 63 nt, Homo Sapiens
aggcccugaucugcgcuguggcugucccuggacgugcugcagcccuccugucccuucccccca

SEQ ID NO: 498677 - RNA, 63 nt, Homo Sapiens
ccgcuggggcggccggggcgggagagaaagguggugcugcagugguggcccuggggggccauu

SEQ ID NO: 498678 - RNA, 63 nt, Homo Sapiens
gagccugaggccuuccagaaagcaggagcagcugugcugcaccccaugugggugaccaggucc

SEQ ID NO: 498679 - RNA, 63 nt, Homo Sapiens
augcccguguaaaguaugugaaucgcaaggccugugcugcaugcgacagcguccgggguggug

SEQ ID NO: 498680 - RNA, 63 nt, Homo Sapiens
uuaguuacauauguauacaugugccaugcuggugugcugcacccauuaacucgucauuuauca

SEQ ID NO: 498681 - RNA, 63 nt, Homo Sapiens
uggguugguuccaagucuuugcuauugugaauagugcugcaauaaacauacgugugcaugugu

SEQ ID NO: 498682 - RNA, 63 nt, Homo Sapiens
agccugcaggcuuuggaaguggcccugucacccgugcugcacgggauucacagccccagcccc

SEQ ID NO: 498683 - RNA, 63 nt, Homo Sapiens
uucccgaguugucugccucuccucaaaugcugugugcugcaauuguccaggcgaugacaaugg

SEQ ID NO: 498684 - RNA, 63 nt, Homo Sapiens
uguggggagcccggaaacacacccggcccacgcgugcugcagagauguggggagucuggaaac

SEQ ID NO: 498685 - RNA, 63 nt, Homo Sapiens
uguggggagucuggaaacacacccggcccacgcgugcugcagagauguggggagccuggaaac

SEQ ID NO: 498686 - RNA, 63 nt, Homo Sapiens
uguggggagccuggaaacacacccggcccacgcgugcugcagagauguggggagccuggaaac

SEQ ID NO: 498687 - RNA, 63 nt, Homo Sapiens
uguggggagccuggaaacacacccggcccacgcgugcugcagagacguggggagccuggaaac

SEQ ID NO: 498688 - RNA, 63 nt, Homo Sapiens
ccuggggggugugauuugugugcgugcuugcaugugcugcagguguaagagagugggagcagg

SEQ ID NO: 498689 - RNA, 63 nt, Homo Sapiens
ccagagacucugaaacuauagaauaaagccucugugcugcacaacaaaggggcaggcucugcu

SEQ ID NO: 498690 - RNA, 63 nt, Homo Sapiens
cccaccgcccagcuucucccggcccaccagccugugcugcauaccgcccagcuucucccugag

SEQ ID NO: 498691 - RNA, 63 nt, Homo Sapiens
cccaccgcccagcuucucccggcccaccagccugugcugcauagccccugcccugccucugag

SEQ ID NO: 498692 - RNA, 63 nt, Homo Sapiens
ucaggccagagugucucaaacuggacaagaaaugugcugcauugccgaguucuuauuuucacc

SEQ ID NO: 498693 - RNA, 63 nt, Homo Sapiens
cuaggcccucuccuguugcucugucauccuaaugugcugcauccaccucauggaccaagaugg

SEQ ID NO: 498694 - RNA, 63 nt, Homo Sapiens
gcuucagcccagagggcccucaccucuggagcugugcugcacuggggucugccccucccuucu

SEQ ID NO: 498695 - RNA, 63 nt, Homo Sapiens
gucuugaacaaggcagaaguacagcugaagugggugcugcaaccucucaggcaugccccauuc

SEQ ID NO: 498696 - RNA, 63 nt, Homo Sapiens
ggaaagggccugaggccucacaaggcagaccuggugcugcaaaguuuccuccugggaugcgug

SEQ ID NO: 498697 - RNA, 63 nt, Homo Sapiens
ccgcagcagcauacaggccuggucuccccaccagugcugcaccccugugugugggguggugag

SEQ ID NO: 498698 - RNA, 63 nt, Homo Sapiens
guccucagggagggagugaccucgacccuggcugugcugcaagcugacuccagccuugguacu

SEQ ID NO: 498699 - RNA, 63 nt, Homo Sapiens
agaccugccccaagggugaugcagaggccacaggugcugcacgcuccagcgcccacucuagac

SEQ ID NO: 498700 - RNA, 63 nt, Homo Sapiens
agggagagcugggcagaagccccugcagugccagugcugcagcccgccguggcugggaagguu

SEQ ID NO: 498701 - RNA, 63 nt, Homo Sapiens
ucugugcuggccacgugcccgcgccuggugcgcgugcugcagauuuagggccaccauggcgca

SEQ ID NO: 498702 - RNA, 64 nt, Homo Sapiens; identical to SEQ ID NO: 79940

SEQ ID NO: 498703 - RNA, 64 nt, Homo Sapiens; identical to SEQ ID NO: 79941

SEQ ID NO: 498704 - RNA, 64 nt, Homo Sapiens; identical to SEQ ID NO: 79942

SEQ ID NO: 498705 - RNA, 64 nt, Homo Sapiens; identical to SEQ ID NO: 79943

SEQ ID NO: 498706 - RNA, 64 nt, Homo Sapiens; identical to SEQ ID NO: 79944

SEQ ID NO: 498707 - RNA, 64 nt, Homo Sapiens; identical to SEQ ID NO: 79945

SEQ ID NO: 498708 - RNA, 64 nt, Homo Sapiens; identical to SEQ ID NO: 79946

SEQ ID NO: 498709 - RNA, 64 nt, Homo Sapiens; identical to SEQ ID NO: 79947

SEQ ID NO: 498710 - RNA, 57 nt, Homo Sapiens
uuuuagccaguauuugcccuuucuauccagccuuaugaauaauagcaguaaaaucac

SEQ ID NO: 498711 - RNA, 57 nt, Homo Sapiens
guauacucuugaugguuagaacucuuacagccuuauuuauuuuuaaguuuguuacag

SEQ ID NO: 498712 - RNA, 57 nt, Homo Sapiens
ucagucaagacucccuuugguaaacaacagccuuaauucauuauaucuggcuuccua

SEQ ID NO: 498713 - RNA, 57 nt, Homo Sapiens
gugucuaagugcuucucuugugguucccagccuuacacacuggugguuauuacagca

SEQ ID NO: 498714 - RNA, 57 nt, Homo Sapiens
gcccucauucucauuucggguuuucggcagccuuaaguugcuauuuccacccauuug

SEQ ID NO: 498715 - RNA, 57 nt, Homo Sapiens
cagguugguuuugcuguugaccuuauucagccuuaucaguuguuugggcuuuaacau

SEQ ID NO: 498716 - RNA, 57 nt, Homo Sapiens
ggcuagugugggggagggaggcuuccccagccuuaagagacccucucagcccaguga

SEQ ID NO: 498717 - RNA, 57 nt, Homo Sapiens
caacccgggcacccucggcccucccugcagccuuaacauucucuuccccugcuccuc

SEQ ID NO: 498718 - RNA, 64 nt, Homo Sapiens
uacauaauaaaacuuuagaucacucguccugaaaaucugcaagucuucugccauuuuccuccuu

SEQ ID NO: 498719 - RNA, 64 nt, Homo Sapiens
gagacuuuuugucaggaaaaacuaauugagguacaucugcaagugaaagaaaaaaaaaguuugc

SEQ ID NO: 498720 - RNA, 64 nt, Homo Sapiens
aacugaaaucaucuaaagaguuaaaauuucagugaucugcaauuaauuacauuguggaagauua

SEQ ID NO: 498721 - RNA, 64 nt, Homo Sapiens
uaccauuuauguggcagaaguucuguucccuauaaucugcaaugcugaaguaucucuauucaau

SEQ ID NO: 498722 - RNA, 64 nt, Homo Sapiens; identical to SEQ ID NO: 243856

SEQ ID NO: 498723 - RNA, 64 nt, Homo Sapiens; identical to SEQ ID NO: 243857

SEQ ID NO: 498724 - RNA, 64 nt, Homo Sapiens; identical to SEQ ID NO: 243858

SEQ ID NO: 498725 - RNA, 64 nt, Homo Sapiens; identical to SEQ ID NO: 243859

SEQ ID NO: 498726 - RNA, 64 nt, Homo Sapiens; identical to SEQ ID NO: 98228

SEQ ID NO: 498727 - RNA, 64 nt, Homo Sapiens; identical to SEQ ID NO: 98229

SEQ ID NO: 498728 - RNA, 64 nt, Homo Sapiens; identical to SEQ ID NO: 98230

SEQ ID NO: 498729 - RNA, 64 nt, Homo Sapiens; identical to SEQ ID NO: 98231

SEQ ID NO: 498730 - RNA, 64 nt, Homo Sapiens; identical to SEQ ID NO: 98232

SEQ ID NO: 498731 - RNA, 64 nt, Homo Sapiens; identical to SEQ ID NO: 98233

SEQ ID NO: 498732 - RNA, 64 nt, Homo Sapiens; identical to SEQ ID NO: 98234

SEQ ID NO: 498733 - RNA, 64 nt, Homo Sapiens; identical to SEQ ID NO: 98235

SEQ ID NO: 498734 - RNA, 64 nt, Homo Sapiens; identical to SEQ ID NO: 98236

SEQ ID NO: 498735 - RNA, 64 nt, Homo Sapiens; identical to SEQ ID NO: 98237

SEQ ID NO: 498736 - RNA, 64 nt, Homo Sapiens; identical to SEQ ID NO: 98238

SEQ ID NO: 498737 - RNA, 64 nt, Homo Sapiens; identical to SEQ ID NO: 98239

SEQ ID NO: 498738 - RNA, 64 nt, Homo Sapiens; identical to SEQ ID NO: 98240

SEQ ID NO: 498739 - RNA, 64 nt, Homo Sapiens; identical to SEQ ID NO: 98241

SEQ ID NO: 498740 - RNA, 64 nt, Homo Sapiens; identical to SEQ ID NO: 98242

SEQ ID NO: 498741 - RNA, 64 nt, Homo Sapiens; identical to SEQ ID NO: 98243

SEQ ID NO: 498742 - RNA, 64 nt, Homo Sapiens; identical to SEQ ID NO: 98244

SEQ ID NO: 498743 - RNA, 64 nt, Homo Sapiens; identical to SEQ ID NO: 98245

SEQ ID NO: 498744 - RNA, 64 nt, Homo Sapiens; identical to SEQ ID NO: 98246

SEQ ID NO: 498745 - RNA, 64 nt, Homo Sapiens; identical to SEQ ID NO: 98247

SEQ ID NO: 498746 - RNA, 64 nt, Homo Sapiens; identical to SEQ ID NO: 98248

SEQ ID NO: 498747 - RNA, 64 nt, Homo Sapiens; identical to SEQ ID NO: 98249

SEQ ID NO: 498748 - RNA, 64 nt, Homo Sapiens; identical to SEQ ID NO: 98250

SEQ ID NO: 498749 - RNA, 64 nt, Homo Sapiens; identical to SEQ ID NO: 98251

SEQ ID NO: 498750 - RNA, 64 nt, Homo Sapiens; identical to SEQ ID NO: 98252

SEQ ID NO: 498751 - RNA, 64 nt, Homo Sapiens; identical to SEQ ID NO: 98253

SEQ ID NO: 498752 - RNA, 64 nt, Homo Sapiens; identical to SEQ ID NO: 98254

SEQ ID NO: 498753 - RNA, 64 nt, Homo Sapiens; identical to SEQ ID NO: 98255

SEQ ID NO: 498754 - RNA, 64 nt, Homo Sapiens; identical to SEQ ID NO: 98256

SEQ ID NO: 498755 - RNA, 64 nt, Homo Sapiens; identical to SEQ ID NO: 98257

SEQ ID NO: 498756 - RNA, 64 nt, Homo Sapiens; identical to SEQ ID NO: 98258

SEQ ID NO: 498757 - RNA, 64 nt, Homo Sapiens; identical to SEQ ID NO: 98259

SEQ ID NO: 498758 - RNA, 64 nt, Homo Sapiens; identical to SEQ ID NO: 98260

SEQ ID NO: 498759 - RNA, 64 nt, Homo Sapiens; identical to SEQ ID NO: 98261

SEQ ID NO: 498760 - RNA, 64 nt, Homo Sapiens; identical to SEQ ID NO: 98262

SEQ ID NO: 498761 - RNA, 64 nt, Homo Sapiens; identical to SEQ ID NO: 98263

SEQ ID NO: 498762 - RNA, 64 nt, Homo Sapiens; identical to SEQ ID NO: 98264

SEQ ID NO: 498763 - RNA, 64 nt, Homo Sapiens
ugcacauguguguucauguauccacauauacaaccauacauacucacacacgcucaaaccccug

SEQ ID NO: 498764 - RNA, 64 nt, Homo Sapiens
cacaagacacacacgcucaaccaauccauccaugcauacauagagcaaagcauacacacacacu

SEQ ID NO: 498765 - RNA, 64 nt, Homo Sapiens
aauguagccugccuuacauaauaaugaaagaaaucauacauaaauuauaacuaaaaaucuuacu

SEQ ID NO: 498766 - RNA, 64 nt, Homo Sapiens
uuuagguuaucauuauccuuguugucuuuccauucauacauaauaaugccuuggauauuucugu

SEQ ID NO: 498767 - RNA, 64 nt, Homo Sapiens
cuucuaauuauaguuugaaaauagauucccuacacauacauacauauguaugcacagauagggu

SEQ ID NO: 498768 - RNA, 64 nt, Homo Sapiens
uaauuauaguuugaaaauagauucccuacacauacauacauauguaugcacagauagggucuug

SEQ ID NO: 498769 - RNA, 64 nt, Homo Sapiens
aaaugaaacauuuugaguacugauggcauguuaucauacauaaaguaggucauuuaggaaaaaa

SEQ ID NO: 498770 - RNA, 64 nt, Homo Sapiens
uucauuauucugauagauuguauacauauguacacauacauauacacauaugcacagucaaggu

SEQ ID NO: 498771 - RNA, 64 nt, Homo Sapiens
uguauguauacacacauauacauauauauauacacauacauacacauacauacauacauacaua

SEQ ID NO: 498772 - RNA, 64 nt, Homo Sapiens
cacacauauacauauauauauacacauacauacacauacauacauacauacauauauaucugau

SEQ ID NO: 498773 - RNA, 64 nt, Homo Sapiens
cauauacauauauauauacacauacauacacauacauacauacauacauauauaucugauaaaa

SEQ ID NO: 498774 - RNA, 64 nt, Homo Sapiens
uacauauauauauacacauacauacacauacauacauacauacauauauaucugauaaaauugu

SEQ ID NO: 498775 - RNA, 64 nt, Homo Sapiens
uauauauauacacauacauacacauacauacauacauacauauauaucugauaaaauugugaug

SEQ ID NO: 498776 - RNA, 64 nt, Homo Sapiens
aaccugugugccaagugacacauauauauauacacauacauacaacccacaccauacauacaua

SEQ ID NO: 498777 - RNA, 64 nt, Homo Sapiens
uauauacacauacauacaaaccacaccauacauacauacauauauaauuuuuaagacuauguac

SEQ ID NO: 498778 - RNA, 64 nt, Homo Sapiens
uauauauauacacauacauaguacccacaccauacauacauacauggguaauuuuuaagacuau

SEQ ID NO: 498779 - RNA, 64 nt, Homo Sapiens
uacauauauauauacacauacuauguacccacaccauacauacauuacuggguaauuuuuaaga

SEQ ID NO: 498780 - RNA, 64 nt, Homo Sapiens
caauguucgccauucacuaguacugaauagcauacauacauagaucagaucucuucuacuguau

SEQ ID NO: 498781 - RNA, 64 nt, Homo Sapiens
uagacaauguucgccauucaguauuacugaauagcauacauacauaucucagaucucuucuacu

SEQ ID NO: 498782 - RNA, 64 nt, Homo Sapiens
aaacaucauuauaauuaauaacugauauuuuggacauacauaagggccagagauuagagauuuc

SEQ ID NO: 498783 - RNA, 56 nt, Homo Sapiens
uguucuccauugauauaucucagugucauacauauuuucuuagaaucuggaauuaa

SEQ ID NO: 498784 - RNA, 64 nt, Homo Sapiens
auuuuuuuuuuuuuugagauuauauacauacacacauacauauauauauauauauauauacaua

SEQ ID NO: 498785 - RNA, 64 nt, Homo Sapiens
uauauauauauacauauauacacacacauacauacauacauauacacacacacacacacacaca

SEQ ID NO: 498786 - RNA, 64 nt, Homo Sapiens
uauauauauauauauacauacacacacacacauacauacauacauacacacacacacacacaca

SEQ ID NO: 498787 - RNA, 64 nt, Homo Sapiens
uacauauauauauauauauacacacacacacacacauacauacauauauacacacacacacaca

SEQ ID NO: 498788 - RNA, 64 nt, Homo Sapiens
acacuugcaggagcagagcuggucaucgucuuagcauacauauccuacacugaguaaaccguaa

SEQ ID NO: 498789 - RNA, 64 nt, Homo Sapiens
gucaucagcaugcuggguugucauggguuugcugcauacauaguucacccuaauuuauacuuac

SEQ ID NO: 498790 - RNA, 64 nt, Homo Sapiens
uauacacacacauaauuugaugcaugcacacauacauacauaugacacauaauacaaacauaca

SEQ ID NO: 498791 - RNA, 64 nt, Homo Sapiens
uauguauacacacacauaauuacaugcaugcacacauacauacaaaauacacauaauacaaaca

SEQ ID NO: 498792 - RNA, 64 nt, Homo Sapiens
uuauagagcugcaaaacacacacaugcguauagacauacauacauguacaccauacauagacaa

SEQ ID NO: 498793 - RNA, 64 nt, Homo Sapiens
acacacaugcguauagacauacauacauguacaccauacauagacaagcaucauaaaggcacaa

SEQ ID NO: 498794 - RNA, 64 nt, Homo Sapiens
aacugacauuccuuuaaaaauauaaauauaaauacauacauacauagauauauacccagacuug

SEQ ID NO: 498795 - RNA, 64 nt, Homo Sapiens
gacauuccuuuaaaaauauaaauauaaauacauacauacauagauauauacccagacuugggug

SEQ ID NO: 498796 - RNA, 64 nt, Homo Sapiens
uacuauuugaauagaaauguguauguauaauauacauacauacauaagcauauaugugugugug

SEQ ID NO: 498797 - RNA, 64 nt, Homo Sapiens
auuugaauagaaauguguauguauaauauacauacauacauaagcauauaugugugugugugug

SEQ ID NO: 498798 - RNA, 64 nt, Homo Sapiens
cuuugaacuauauguauguguauaaggguauacacauacauauauggcauauaacaaguguaca

SEQ ID NO: 498799 - RNA, 64 nt, Homo Sapiens
cauauacacauaacaaguguagaaguauauauuacauacauacacucacucugucugguauagg

SEQ ID NO: 498800 - RNA, 64 nt, Homo Sapiens
ugucucaaaaguauaaaaaacuuuaauacaaguacauacauauuauauauacacauacauauau

SEQ ID NO: 498801 - RNA, 64 nt, Homo Sapiens
acuuuaauacaaguacauacauauuauauauacacauacauauauauacuauauauggaugaaa

SEQ ID NO: 498802 - RNA, 64 nt, Homo Sapiens
auaaaaccgaaugagcugguaaaauaaauacauacauacauacaacagagugagauucugucuc

SEQ ID NO: 498803 - RNA, 64 nt, Homo Sapiens
uacaauaaaaccgaaugagcucucaaaauaaauacauacauacagacgacagagugagauucug

SEQ ID NO: 498804 - RNA, 64 nt, Homo Sapiens
aauauauguauauauauucuuacacacauacauacauacauacacugaagaaauuauacguaca

SEQ ID NO: 498805 - RNA, 64 nt, Homo Sapiens
uacaaauauauguauauauauacauacacacauacauacauacaugagcugaagaaauuauacg

SEQ ID NO: 498806 - RNA, 64 nt, Homo Sapiens
uacauacaaauauauguauauacguacauacacacauacauacaaugcugagcugaagaaauua

SEQ ID NO: 498807 - RNA, 64 nt, Homo Sapiens
uguuguguauaaauguacacuauaugcacacauacauacauauaccuaacccauaguuuauaug

SEQ ID NO: 498808 - RNA, 64 nt, Homo Sapiens
uauauguuguguauaaauguuauguauaugcacacauacauacaccagccuaacccauaguuua

SEQ ID NO: 498809 - RNA, 64 nt, Homo Sapiens
agaaauuuuauaaauguguauuucuguguauucacauacauauauauauacacacauauauaug

SEQ ID NO: 498810 - RNA, 64 nt, Homo Sapiens
cauauauauauacacacauauauauguacauacacauacauacauauuaccauacugaagggaa

SEQ ID NO: 498811 - RNA, 64 nt, Homo Sapiens
uauauauacacacauauauauguacauacacauacauacauauuaccauacugaagggaaaugg

SEQ ID NO: 498812 - RNA, 64 nt, Homo Sapiens; identical to SEQ ID NO: 167088

SEQ ID NO: 498813 - RNA, 64 nt, Homo Sapiens; identical to SEQ ID NO: 167089

SEQ ID NO: 498814 - RNA, 64 nt, Homo Sapiens; identical to SEQ ID NO: 167090

SEQ ID NO: 498815 - RNA, 64 nt, Homo Sapiens; identical to SEQ ID NO: 167091

SEQ ID NO: 498816 - RNA, 64 nt, Homo Sapiens; identical to SEQ ID NO: 167092

SEQ ID NO: 498817 - RNA, 64 nt, Homo Sapiens; identical to SEQ ID NO: 167093

SEQ ID NO: 498818 - RNA, 64 nt, Homo Sapiens; identical to SEQ ID NO: 167094

SEQ ID NO: 498819 - RNA, 64 nt, Homo Sapiens; identical to SEQ ID NO: 167095

SEQ ID NO: 498820 - RNA, 64 nt, Homo Sapiens; identical to SEQ ID NO: 167096

SEQ ID NO: 498821 - RNA, 64 nt, Homo Sapiens; identical to SEQ ID NO: 167097

SEQ ID NO: 498822 - RNA, 64 nt, Homo Sapiens; identical to SEQ ID NO: 167098

SEQ ID NO: 498823 - RNA, 64 nt, Homo Sapiens; identical to SEQ ID NO: 167099

SEQ ID NO: 498824 - RNA, 64 nt, Homo Sapiens; identical to SEQ ID NO: 167100

SEQ ID NO: 498825 - RNA, 64 nt, Homo Sapiens; identical to SEQ ID NO: 167101

SEQ ID NO: 498826 - RNA, 64 nt, Homo Sapiens; identical to SEQ ID NO: 167102

SEQ ID NO: 498827 - RNA, 64 nt, Homo Sapiens; identical to SEQ ID NO: 167103

SEQ ID NO: 498828 - RNA, 64 nt, Homo Sapiens; identical to SEQ ID NO: 167104

SEQ ID NO: 498829 - RNA, 64 nt, Homo Sapiens; identical to SEQ ID NO: 167105

SEQ ID NO: 498830 - RNA, 64 nt, Homo Sapiens; identical to SEQ ID NO: 167106

SEQ ID NO: 498831 - RNA, 64 nt, Homo Sapiens; identical to SEQ ID NO: 167107

SEQ ID NO: 498832 - RNA, 64 nt, Homo Sapiens; identical to SEQ ID NO: 167108

SEQ ID NO: 498833 - RNA, 64 nt, Homo Sapiens; identical to SEQ ID NO: 167109

SEQ ID NO: 498834 - RNA, 64 nt, Homo Sapiens; identical to SEQ ID NO: 167110

SEQ ID NO: 498835 - RNA, 64 nt, Homo Sapiens; identical to SEQ ID NO: 167111

SEQ ID NO: 498836 - RNA, 64 nt, Homo Sapiens; identical to SEQ ID NO: 167112

SEQ ID NO: 498837 - RNA, 64 nt, Homo Sapiens; identical to SEQ ID NO: 167113

SEQ ID NO: 498838 - RNA, 64 nt, Homo Sapiens; identical to SEQ ID NO: 167114

SEQ ID NO: 498839 - RNA, 64 nt, Homo Sapiens; identical to SEQ ID NO: 167115

SEQ ID NO: 498840 - RNA, 64 nt, Homo Sapiens; identical to SEQ ID NO: 167116

SEQ ID NO: 498841 - RNA, 64 nt, Homo Sapiens; identical to SEQ ID NO: 167117

SEQ ID NO: 498842 - RNA, 64 nt, Homo Sapiens; identical to SEQ ID NO: 167118

SEQ ID NO: 498843 - RNA, 64 nt, Homo Sapiens; identical to SEQ ID NO: 167119

SEQ ID NO: 498844 - RNA, 64 nt, Homo Sapiens; identical to SEQ ID NO: 167120

SEQ ID NO: 498845 - RNA, 64 nt, Homo Sapiens; identical to SEQ ID NO: 167121

SEQ ID NO: 498846 - RNA, 64 nt, Homo Sapiens; identical to SEQ ID NO: 167122

SEQ ID NO: 498847 - RNA, 64 nt, Homo Sapiens; identical to SEQ ID NO: 167123

SEQ ID NO: 498848 - RNA, 64 nt, Homo Sapiens; identical to SEQ ID NO: 167124

SEQ ID NO: 498849 - RNA, 64 nt, Homo Sapiens; identical to SEQ ID NO: 167125

SEQ ID NO: 498850 - RNA, 64 nt, Homo Sapiens; identical to SEQ ID NO: 167126

SEQ ID NO: 498851 - RNA, 64 nt, Homo Sapiens; identical to SEQ ID NO: 167127

SEQ ID NO: 498852 - RNA, 64 nt, Homo Sapiens; identical to SEQ ID NO: 167128

SEQ ID NO: 498853 - RNA, 64 nt, Homo Sapiens; identical to SEQ ID NO: 167129

SEQ ID NO: 498854 - RNA, 64 nt, Homo Sapiens; identical to SEQ ID NO: 167130

SEQ ID NO: 498855 - RNA, 64 nt, Homo Sapiens; identical to SEQ ID NO: 167131

SEQ ID NO: 498856 - RNA, 64 nt, Homo Sapiens; identical to SEQ ID NO: 167132

SEQ ID NO: 498857 - RNA, 64 nt, Homo Sapiens; identical to SEQ ID NO: 167133

SEQ ID NO: 498858 - RNA, 64 nt, Homo Sapiens; identical to SEQ ID NO: 167134

SEQ ID NO: 498859 - RNA, 64 nt, Homo Sapiens; identical to SEQ ID NO: 167135

SEQ ID NO: 498860 - RNA, 64 nt, Homo Sapiens; identical to SEQ ID NO: 167136

SEQ ID NO: 498861 - RNA, 64 nt, Homo Sapiens; identical to SEQ ID NO: 167137

SEQ ID NO: 498862 - RNA, 64 nt, Homo Sapiens; identical to SEQ ID NO: 167138

SEQ ID NO: 498863 - RNA, 64 nt, Homo Sapiens; identical to SEQ ID NO: 167139

SEQ ID NO: 498864 - RNA, 64 nt, Homo Sapiens; identical to SEQ ID NO: 167140

SEQ ID NO: 498865 - RNA, 64 nt, Homo Sapiens; identical to SEQ ID NO: 167141

SEQ ID NO: 498866 - RNA, 64 nt, Homo Sapiens; identical to SEQ ID NO: 167142

SEQ ID NO: 498867 - RNA, 64 nt, Homo Sapiens; identical to SEQ ID NO: 167143

SEQ ID NO: 498868 - RNA, 64 nt, Homo Sapiens; identical to SEQ ID NO: 167144

SEQ ID NO: 498869 - RNA, 64 nt, Homo Sapiens; identical to SEQ ID NO: 167145

SEQ ID NO: 498870 - RNA, 64 nt, Homo Sapiens; identical to SEQ ID NO: 167146

SEQ ID NO: 498871 - RNA, 64 nt, Homo Sapiens; identical to SEQ ID NO: 167147

SEQ ID NO: 498872 - RNA, 64 nt, Homo Sapiens; identical to SEQ ID NO: 167148

SEQ ID NO: 498873 - RNA, 64 nt, Homo Sapiens; identical to SEQ ID NO: 167149

SEQ ID NO: 498874 - RNA, 64 nt, Homo Sapiens; identical to SEQ ID NO: 167150

SEQ ID NO: 498875 - RNA, 64 nt, Homo Sapiens; identical to SEQ ID NO: 167151

SEQ ID NO: 498876 - RNA, 64 nt, Homo Sapiens; identical to SEQ ID NO: 167152

SEQ ID NO: 498877 - RNA, 64 nt, Homo Sapiens; identical to SEQ ID NO: 167153

SEQ ID NO: 498878 - RNA, 64 nt, Homo Sapiens; identical to SEQ ID NO: 167154

SEQ ID NO: 498879 - RNA, 64 nt, Homo Sapiens; identical to SEQ ID NO: 167155

SEQ ID NO: 498880 - RNA, 64 nt, Homo Sapiens; identical to SEQ ID NO: 167156

SEQ ID NO: 498881 - RNA, 64 nt, Homo Sapiens; identical to SEQ ID NO: 167157

SEQ ID NO: 498882 - RNA, 64 nt, Homo Sapiens; identical to SEQ ID NO: 167158

SEQ ID NO: 498883 - RNA, 64 nt, Homo Sapiens; identical to SEQ ID NO: 167159

SEQ ID NO: 498884 - RNA, 64 nt, Homo Sapiens; identical to SEQ ID NO: 167160

SEQ ID NO: 498885 - RNA, 64 nt, Homo Sapiens; identical to SEQ ID NO: 167161

SEQ ID NO: 498886 - RNA, 64 nt, Homo Sapiens; identical to SEQ ID NO: 167162

SEQ ID NO: 498887 - RNA, 64 nt, Homo Sapiens; identical to SEQ ID NO: 167163

SEQ ID NO: 498888 - RNA, 64 nt, Homo Sapiens; identical to SEQ ID NO: 167164

SEQ ID NO: 498889 - RNA, 64 nt, Homo Sapiens; identical to SEQ ID NO: 167165

SEQ ID NO: 498890 - RNA, 64 nt, Homo Sapiens; identical to SEQ ID NO: 167166

SEQ ID NO: 498891 - RNA, 64 nt, Homo Sapiens; identical to SEQ ID NO: 167167

SEQ ID NO: 498892 - RNA, 64 nt, Homo Sapiens; identical to SEQ ID NO: 167168

SEQ ID NO: 498893 - RNA, 64 nt, Homo Sapiens; identical to SEQ ID NO: 473932

SEQ ID NO: 498894 - RNA, 64 nt, Homo Sapiens; identical to SEQ ID NO: 473933

SEQ ID NO: 498895 - RNA, 64 nt, Homo Sapiens; identical to SEQ ID NO: 473934

SEQ ID NO: 498896 - RNA, 64 nt, Homo Sapiens; identical to SEQ ID NO: 473935

SEQ ID NO: 498897 - RNA, 64 nt, Homo Sapiens; identical to SEQ ID NO: 473936

SEQ ID NO: 498898 - RNA, 64 nt, Homo Sapiens; identical to SEQ ID NO: 473937

SEQ ID NO: 498899 - RNA, 64 nt, Homo Sapiens; identical to SEQ ID NO: 473938

SEQ ID NO: 498900 - RNA, 64 nt, Homo Sapiens; identical to SEQ ID NO: 473939

SEQ ID NO: 498901 - RNA, 64 nt, Homo Sapiens; identical to SEQ ID NO: 473940

SEQ ID NO: 498902 - RNA, 64 nt, Homo Sapiens; identical to SEQ ID NO: 473941

SEQ ID NO: 498903 - RNA, 64 nt, Homo Sapiens; identical to SEQ ID NO: 473942

SEQ ID NO: 498904 - RNA, 64 nt, Homo Sapiens; identical to SEQ ID NO: 473943

SEQ ID NO: 498905 - RNA, 64 nt, Homo Sapiens; identical to SEQ ID NO: 473944

SEQ ID NO: 498906 - RNA, 64 nt, Homo Sapiens; identical to SEQ ID NO: 473945

SEQ ID NO: 498907 - RNA, 64 nt, Homo Sapiens; identical to SEQ ID NO: 473946

SEQ ID NO: 498908 - RNA, 64 nt, Homo Sapiens; identical to SEQ ID NO: 473947

SEQ ID NO: 498909 - RNA, 64 nt, Homo Sapiens; identical to SEQ ID NO: 473948

SEQ ID NO: 498910 - RNA, 64 nt, Homo Sapiens; identical to SEQ ID NO: 473949

SEQ ID NO: 498911 - RNA, 64 nt, Homo Sapiens; identical to SEQ ID NO: 473950

SEQ ID NO: 498912 - RNA, 64 nt, Homo Sapiens; identical to SEQ ID NO: 473951

SEQ ID NO: 498913 - RNA, 64 nt, Homo Sapiens; identical to SEQ ID NO: 473952

SEQ ID NO: 498914 - RNA, 64 nt, Homo Sapiens; identical to SEQ ID NO: 473953

SEQ ID NO: 498915 - RNA, 64 nt, Homo Sapiens; identical to SEQ ID NO: 473954

SEQ ID NO: 498916 - RNA, 64 nt, Homo Sapiens; identical to SEQ ID NO: 473955

SEQ ID NO: 498917 - RNA, 64 nt, Homo Sapiens; identical to SEQ ID NO: 473956

SEQ ID NO: 498918 - RNA, 64 nt, Homo Sapiens; identical to SEQ ID NO: 473957

SEQ ID NO: 498919 - RNA, 64 nt, Homo Sapiens; identical to SEQ ID NO: 473958

SEQ ID NO: 498920 - RNA, 64 nt, Homo Sapiens; identical to SEQ ID NO: 473959

SEQ ID NO: 498921 - RNA, 64 nt, Homo Sapiens; identical to SEQ ID NO: 473960

SEQ ID NO: 498922 - RNA, 64 nt, Homo Sapiens; identical to SEQ ID NO: 473961

SEQ ID NO: 498923 - RNA, 64 nt, Homo Sapiens; identical to SEQ ID NO: 473962

SEQ ID NO: 498924 - RNA, 64 nt, Homo Sapiens; identical to SEQ ID NO: 473963

SEQ ID NO: 498925 - RNA, 64 nt, Homo Sapiens; identical to SEQ ID NO: 473964

SEQ ID NO: 498926 - RNA, 64 nt, Homo Sapiens; identical to SEQ ID NO: 473965

SEQ ID NO: 498927 - RNA, 64 nt, Homo Sapiens; identical to SEQ ID NO: 473966

SEQ ID NO: 498928 - RNA, 64 nt, Homo Sapiens; identical to SEQ ID NO: 473967

SEQ ID NO: 498929 - RNA, 64 nt, Homo Sapiens; identical to SEQ ID NO: 473968

SEQ ID NO: 498930 - RNA, 64 nt, Homo Sapiens; identical to SEQ ID NO: 473969

SEQ ID NO: 498931 - RNA, 64 nt, Homo Sapiens; identical to SEQ ID NO: 473970

SEQ ID NO: 498932 - RNA, 64 nt, Homo Sapiens; identical to SEQ ID NO: 473971

SEQ ID NO: 498933 - RNA, 64 nt, Homo Sapiens; identical to SEQ ID NO: 473972

SEQ ID NO: 498934 - RNA, 64 nt, Homo Sapiens; identical to SEQ ID NO: 473973

SEQ ID NO: 498935 - RNA, 64 nt, Homo Sapiens; identical to SEQ ID NO: 473974

SEQ ID NO: 498936 - RNA, 64 nt, Homo Sapiens; identical to SEQ ID NO: 473975

SEQ ID NO: 498937 - RNA, 64 nt, Homo Sapiens; identical to SEQ ID NO: 473976

SEQ ID NO: 498938 - RNA, 64 nt, Homo Sapiens; identical to SEQ ID NO: 473977

SEQ ID NO: 498939 - RNA, 64 nt, Homo Sapiens; identical to SEQ ID NO: 473978

SEQ ID NO: 498940 - RNA, 64 nt, Homo Sapiens; identical to SEQ ID NO: 473979

SEQ ID NO: 498941 - RNA, 64 nt, Homo Sapiens; identical to SEQ ID NO: 473980

SEQ ID NO: 498942 - RNA, 64 nt, Homo Sapiens; identical to SEQ ID NO: 473981

SEQ ID NO: 498943 - RNA, 64 nt, Homo Sapiens; identical to SEQ ID NO: 473982

SEQ ID NO: 498944 - RNA, 64 nt, Homo Sapiens; identical to SEQ ID NO: 473983

SEQ ID NO: 498945 - RNA, 64 nt, Homo Sapiens; identical to SEQ ID NO: 473984

SEQ ID NO: 498946 - RNA, 64 nt, Homo Sapiens; identical to SEQ ID NO: 473985

SEQ ID NO: 498947 - RNA, 64 nt, Homo Sapiens; identical to SEQ ID NO: 473986

SEQ ID NO: 498948 - RNA, 64 nt, Homo Sapiens; identical to SEQ ID NO: 473987

SEQ ID NO: 498949 - RNA, 64 nt, Homo Sapiens; identical to SEQ ID NO: 473988

SEQ ID NO: 498950 - RNA, 64 nt, Homo Sapiens; identical to SEQ ID NO: 473989

SEQ ID NO: 498951 - RNA, 64 nt, Homo Sapiens; identical to SEQ ID NO: 473990

SEQ ID NO: 498952 - RNA, 64 nt, Homo Sapiens; identical to SEQ ID NO: 473991

SEQ ID NO: 498953 - RNA, 64 nt, Homo Sapiens; identical to SEQ ID NO: 473992

SEQ ID NO: 498954 - RNA, 64 nt, Homo Sapiens; identical to SEQ ID NO: 473993

SEQ ID NO: 498955 - RNA, 64 nt, Homo Sapiens; identical to SEQ ID NO: 473994

SEQ ID NO: 498956 - RNA, 64 nt, Homo Sapiens; identical to SEQ ID NO: 473995

SEQ ID NO: 498957 - RNA, 64 nt, Homo Sapiens; identical to SEQ ID NO: 473996

SEQ ID NO: 498958 - RNA, 64 nt, Homo Sapiens; identical to SEQ ID NO: 473997

SEQ ID NO: 498959 - RNA, 64 nt, Homo Sapiens; identical to SEQ ID NO: 473998

SEQ ID NO: 498960 - RNA, 64 nt, Homo Sapiens; identical to SEQ ID NO: 473999

SEQ ID NO: 498961 - RNA, 64 nt, Homo Sapiens; identical to SEQ ID NO: 474000

SEQ ID NO: 498962 - RNA, 64 nt, Homo Sapiens; identical to SEQ ID NO: 474001

SEQ ID NO: 498963 - RNA, 64 nt, Homo Sapiens; identical to SEQ ID NO: 474002

SEQ ID NO: 498964 - RNA, 64 nt, Homo Sapiens; identical to SEQ ID NO: 474003

SEQ ID NO: 498965 - RNA, 64 nt, Homo Sapiens; identical to SEQ ID NO: 474004

SEQ ID NO: 498966 - RNA, 64 nt, Homo Sapiens; identical to SEQ ID NO: 474005

SEQ ID NO: 498967 - RNA, 64 nt, Homo Sapiens; identical to SEQ ID NO: 474006

SEQ ID NO: 498968 - RNA, 64 nt, Homo Sapiens; identical to SEQ ID NO: 474007

SEQ ID NO: 498969 - RNA, 64 nt, Homo Sapiens; identical to SEQ ID NO: 474008

SEQ ID NO: 498970 - RNA, 64 nt, Homo Sapiens; identical to SEQ ID NO: 474009

SEQ ID NO: 498971 - RNA, 64 nt, Homo Sapiens; identical to SEQ ID NO: 474010

SEQ ID NO: 498972 - RNA, 64 nt, Homo Sapiens; identical to SEQ ID NO: 474011

SEQ ID NO: 498973 - RNA, 64 nt, Homo Sapiens; identical to SEQ ID NO: 474012

SEQ ID NO: 498974 - RNA, 64 nt, Homo Sapiens; identical to SEQ ID NO: 474013

SEQ ID NO: 498975 - RNA, 64 nt, Homo Sapiens; identical to SEQ ID NO: 474014

SEQ ID NO: 498976 - RNA, 64 nt, Homo Sapiens; identical to SEQ ID NO: 474015

SEQ ID NO: 498977 - RNA, 64 nt, Homo Sapiens; identical to SEQ ID NO: 474016

SEQ ID NO: 498978 - RNA, 64 nt, Homo Sapiens; identical to SEQ ID NO: 474017

SEQ ID NO: 498979 - RNA, 64 nt, Homo Sapiens; identical to SEQ ID NO: 474018

SEQ ID NO: 498980 - RNA, 64 nt, Homo Sapiens; identical to SEQ ID NO: 474019

SEQ ID NO: 498981 - RNA, 64 nt, Homo Sapiens; identical to SEQ ID NO: 474020

SEQ ID NO: 498982 - RNA, 64 nt, Homo Sapiens; identical to SEQ ID NO: 474021

SEQ ID NO: 498983 - RNA, 64 nt, Homo Sapiens; identical to SEQ ID NO: 474022

SEQ ID NO: 498984 - RNA, 64 nt, Homo Sapiens; identical to SEQ ID NO: 474023

SEQ ID NO: 498985 - RNA, 64 nt, Homo Sapiens; identical to SEQ ID NO: 474024

SEQ ID NO: 498986 - RNA, 64 nt, Homo Sapiens; identical to SEQ ID NO: 474025

SEQ ID NO: 498987 - RNA, 64 nt, Homo Sapiens; identical to SEQ ID NO: 474026

SEQ ID NO: 498988 - RNA, 64 nt, Homo Sapiens; identical to SEQ ID NO: 474027

SEQ ID NO: 498989 - RNA, 64 nt, Homo Sapiens; identical to SEQ ID NO: 474028

SEQ ID NO: 498990 - RNA, 64 nt, Homo Sapiens; identical to SEQ ID NO: 474029

SEQ ID NO: 498991 - RNA, 64 nt, Homo Sapiens; identical to SEQ ID NO: 474030

SEQ ID NO: 498992 - RNA, 64 nt, Homo Sapiens; identical to SEQ ID NO: 474031

SEQ ID NO: 498993 - RNA, 64 nt, Homo Sapiens; identical to SEQ ID NO: 474032

SEQ ID NO: 498994 - RNA, 64 nt, Homo Sapiens; identical to SEQ ID NO: 474033

SEQ ID NO: 498995 - RNA, 61 nt, Homo Sapiens
aggccggaaaauugugcucuagaagaauaaaacugaaaaacucuagagaauuuuuuuuccc

SEQ ID NO: 498996 - RNA, 61 nt, Homo Sapiens
agauuucuucuuugaaaggucaagaccgugaacugaaaaaaguguuggccuuuuugcggga

SEQ ID NO: 498997 - RNA, 61 nt, Homo Sapiens
guauucugauugcccuucaucccaaguguuuacugaaaauuccauucuagauauucuuguu

SEQ ID NO: 498998 - RNA, 61 nt, Homo Sapiens
auuuccaggggcacacaaugcuauugaaauuacugaaaacaaaauaucugacaucuuauuu

SEQ ID NO: 498999 - RNA, 61 nt, Homo Sapiens
agguuuuuauauaaauagugaaauuugaauuacugaaaaccauguuaauuuuuagaacuca

SEQ ID NO: 499000 - RNA, 61 nt, Homo Sapiens
aagaacuuuguuacacauauuuugauaaggcacugaaaauauaaaaggacugguaguuuac

SEQ ID NO: 499001 - RNA, 61 nt, Homo Sapiens
uuaaguaucuuccauguuaauguguuaagagacugaaaauaccagccaucagaaacuggcc

SEQ ID NO: 499002 - RNA, 61 nt, Homo Sapiens
gacaucaguuuuaaaucaauggagagaaaaaacugaaaaagaugcugcuaaguaguucucu

SEQ ID NO: 499003 - RNA, 61 nt, Homo Sapiens
uuuuaugcuccuuuuuuuucgcacucuuaagacugaaaauuggcguugaguguuauaguga

SEQ ID NO: 499004 - RNA, 61 nt, Homo Sapiens
agugugauuggacugccagccagguuaauaaacugaaaaaugugauuggcuuccucucgcc

SEQ ID NO: 499005 - RNA, 61 nt, Homo Sapiens
auuuagacaauuaaaacauuucuaaagugagacugaaaauaauauagaaaaucucauugcu

SEQ ID NO: 499006 - RNA, 58 nt, Homo Sapiens
ggcuucauaacggauucuaacggaagacacugaaaagcgccauggcuacuuauucugc

SEQ ID NO: 499007 - RNA, 61 nt, Homo Sapiens
guaaagauggguuuuuaaugauacuaagauaacugaaaauaggcauauagauauauuccaa

SEQ ID NO: 499008 - RNA, 61 nt, Homo Sapiens
caucuggccaacauggugaaacccugucucuacugaaaauaaaaaaaacuagcugggcaug

SEQ ID NO: 499009 - RNA, 61 nt, Homo Sapiens
cuuuguaugauauuuauuaggaggaaagaggacugaaaauguucuuguguagaaacagaag

SEQ ID NO: 499010 - RNA, 61 nt, Homo Sapiens
acuaaugaagaaaugaauaauaaauuuugacacugaaaaacauuuuauuaauaaagaauau

SEQ ID NO: 499011 - RNA, 61 nt, Homo Sapiens
guauaguaugugcauaauggaaaguuaccuuacugaaaaaaaaaaaagaaggaaaaauaag

SEQ ID NO: 499012 - RNA, 61 nt, Homo Sapiens
ucugauuuuucauugcucuauaauucuuuuuacugaaaauacuauguuaugaaugguauua

SEQ ID NO: 499013 - RNA, 61 nt, Homo Sapiens
uuugaaaacguuacauuuuuuaaaucuuaaaacugaaaacuuguuuuuaguauuucuauuu

SEQ ID NO: 499014 - RNA, 61 nt, Homo Sapiens
guucucuuauuuuaaagauacagugcuccccacugaaaauuaaaccuaaaaaaugucacau

SEQ ID NO: 499015 - RNA, 61 nt, Homo Sapiens
gcuuuaucauggaccagaggaaaaccagaaaacugaaaacauuccucugucuuguggccag

SEQ ID NO: 499016 - RNA, 61 nt, Homo Sapiens
ccauuucacuacuagaaauugacgcaagugaacugaaaacuuauguucacacaaaaacucg

SEQ ID NO: 499017 - RNA, 61 nt, Homo Sapiens
uacuuuggcucuugugcauaaaaacaagaacacugaaaauugggaauaugcacaaacuugg

SEQ ID NO: 499018 - RNA, 61 nt, Homo Sapiens
uugcaguagugugaaaauacauuuuuuacaaacugaaaauacaguagauaagcugucgaaa

SEQ ID NO: 499019 - RNA, 61 nt, Homo Sapiens
uugauauuuuuguaacagaauauagcucuuaacugaaaauccagaaccagaaacauaaauc

SEQ ID NO: 499020 - RNA, 61 nt, Homo Sapiens
aucuuuugacucuguauuuaaauucuaugauacugaaaauaaaggcauucuggaaaaauac

SEQ ID NO: 499021 - RNA, 61 nt, Homo Sapiens
aauugcuggcugcuuuuacuuccugaccaagacugaaaaauuauuuacugaaaucuguaaa

SEQ ID NO: 499022 - RNA, 61 nt, Homo Sapiens
gugugucauggugccucaucauucuggggagacugaaaauaccuucaucacugaccuggug

SEQ ID NO: 499023 - RNA, 61 nt, Homo Sapiens
uccacccccaacucaugaaaagauucuauggacugaaaaagccccaggcugaaaggacugg

SEQ ID NO: 499024 - RNA, 61 nt, Homo Sapiens
auauuuuuguuauauacaauauugcugaugaacugaaaauuaacaaguaaaaugcacaugc

SEQ ID NO: 499025 - RNA, 61 nt, Homo Sapiens
gagcaaauggaagaagauacaguccugauagacugaaaauuaaacucaagcuggagaaaug

SEQ ID NO: 499026 - RNA, 61 nt, Homo Sapiens
uuucaaagcugaguuacuuguuucucuccccacugaaaacaacagcccugggagggggcua

SEQ ID NO: 499027 - RNA, 61 nt, Homo Sapiens
uaguuuuuuuguugguagauuauguucacacacugaaaacucagagguuuaauuugaaguu

SEQ ID NO: 499028 - RNA, 61 nt, Homo Sapiens
auuuucucuuugaaaauccccuuccugcucgacugaaaaaaaaagccuccuggcaccaggc

SEQ ID NO: 499029 - RNA, 61 nt, Homo Sapiens
cacaucacagcuggcauucuuagcuuggacaacugaaaaguucuuggaguuucagaaaugc

SEQ ID NO: 499030 - RNA, 61 nt, Homo Sapiens
ugaguguucggugaaacaagaauguaaaaucacugaaaaaagaccccgucucuaaaaauaa

SEQ ID NO: 499031 - RNA, 61 nt, Homo Sapiens
gaguuugcagaaaccuugggagacuccacagacugaaaaguccccagaggcugcauugagg

SEQ ID NO: 499032 - RNA, 61 nt, Homo Sapiens
aagauuuauuuucaugcucagguggguaauaacugaaaauagaaccuaacuuucucuuauu

SEQ ID NO: 499033 - RNA, 61 nt, Homo Sapiens
ucuuaaauauuuagcaaucagacaggccauaacugaaaaacuaaucauacuuccucuguga

SEQ ID NO: 499034 - RNA, 61 nt, Homo Sapiens
aauaaugguguaaugguucuuuagacuuuuuacugaaaaugcaauauuugucacuguucua

SEQ ID NO: 499035 - RNA, 61 nt, Homo Sapiens
aaaaaaaucccaaagugccuugcccugaggcacugaaaaaaauaauuggaguucauacuga

SEQ ID NO: 499036 - RNA, 61 nt, Homo Sapiens
aucucuuuuaaaaagaaauuaguaacuuagaacugaaaaugaauaauagaauaaaggguug

SEQ ID NO: 499037 - RNA, 61 nt, Homo Sapiens
auucaauccacuuuugggguuccauuuguggacugaaaaguauuaaguggggucacugaau

SEQ ID NO: 499038 - RNA, 61 nt, Homo Sapiens
uuggguucccauuuauccuguaauuggugauacugaaaacuuuuuuuuucuuuuuaagcca

SEQ ID NO: 499039 - RNA, 61 nt, Homo Sapiens
ggagcccaaugaagcuaagcauggaauuuaaacugaaaaaagaagagacuuagagaugcua

SEQ ID NO: 499040 - RNA, 61 nt, Homo Sapiens
ggcucuucuugggucuugaguucagacgcaaacugaaaaaugggacauaaguuuuucugcu

SEQ ID NO: 499041 - RNA, 61 nt, Homo Sapiens
gaagaggaugguauuacaucuagucucccagacugaaaaagugccuaaccuuuuggagccu

SEQ ID NO: 499042 - RNA, 61 nt, Homo Sapiens
ugcauuaagugccuuguagaucagcuuccucacugaaaauguguuacucuuucucucucca

SEQ ID NO: 499043 - RNA, 61 nt, Homo Sapiens
gaauguuuuuuggguccacaauucauugauuacugaaaauugggugugggacccucaccga

SEQ ID NO: 499044 - RNA, 61 nt, Homo Sapiens
augucuacaguccacagcuuccaggacaaggacugaaaauacagcaucugguaugcagcca

SEQ ID NO: 499045 - RNA, 61 nt, Homo Sapiens
cucaguguucccuuuccuacgacggccuucaacugaaaagaaucaaaguccagcaggcaag

SEQ ID NO: 499046 - RNA, 61 nt, Homo Sapiens
aggccugaggggcugguccucauaugcaaauacugaaaagaaccuguccuacccucaaagc

SEQ ID NO: 499047 - RNA, 61 nt, Homo Sapiens
acuuuagaguucaguugaucugaaauaauaaacugaaaaaacaguguuugacuagggauca

SEQ ID NO: 499048 - RNA, 61 nt, Homo Sapiens
ugugauguauuugauccuguggucaaaaaggacugaaaaauuugguggcucugauccauau

SEQ ID NO: 499049 - RNA, 61 nt, Homo Sapiens
uguuacaagaaaaauaugagaaauuauacaaacugaaaaugcaaacauaggucugggcauu

SEQ ID NO: 499050 - RNA, 61 nt, Homo Sapiens
ugagauggagauauguucaaagagccaaccaacugaaaaccguacuugggcuucagaagua

SEQ ID NO: 499051 - RNA, 61 nt, Homo Sapiens
aauauggauuaauugccucauuuuuuuccuuacugaaaacauugacgggaagagguacauc

SEQ ID NO: 499052 - RNA, 61 nt, Homo Sapiens
cagauuguuuuguaguccuucuuuaauuacaacugaaaaauuuaaaauaagaaaaggagca

SEQ ID NO: 499053 - RNA, 61 nt, Homo Sapiens
ugaaaagaguggagcagguggcaaccuugugacugaaaacuugaaacgaugagaguaaguu

SEQ ID NO: 499054 - RNA, 61 nt, Homo Sapiens
cagucagucaaaaacuggaaacacacaguucacugaaaauuucucucaaagcuucaguuag

SEQ ID NO: 499055 - RNA, 61 nt, Homo Sapiens
gguuuuaaagaacauaaaugaauaaaggaagacugaaaaaacuaaauuccccauucugucu

SEQ ID NO: 499056 - RNA, 61 nt, Homo Sapiens
agaaaauccccaacuaugcaaaccccuugguacugaaaauggagaagagaugcugccauuu

SEQ ID NO: 499057 - RNA, 61 nt, Homo Sapiens
auuccuggacaucaccagucuucaauuuauuacugaaaaugucugcuacuucacugucauc

SEQ ID NO: 499058 - RNA, 61 nt, Homo Sapiens
ccuacugcaggaucccucggcucuuccccaaacugaaaauaugcucaauugcucucccuug

SEQ ID NO: 499059 - RNA, 61 nt, Homo Sapiens
auuaggaaaaacugaauuucccaacaggugaacugaaaaguuauuuuaacuauuauacaua

SEQ ID NO: 499060 - RNA, 61 nt, Homo Sapiens
uuauggaaaaauaauucagaaucuaaacaccacugaaaacuuauaaaaaauguuuagauac

SEQ ID NO: 499061 - RNA, 61 nt, Homo Sapiens
agagaaauccaucuuuucccaggucuccuucacugaaaacaaaaaucuacuuacauacacu

SEQ ID NO: 499062 - RNA, 61 nt, Homo Sapiens
ugauuagaggagagagaacuugauucaagauacugaaaaauagagcugggacugagccugu

SEQ ID NO: 499063 - RNA, 61 nt, Homo Sapiens
ugggucggucagugacauguagguaggaagcacugaaaauaguguucccagagcacuuugc

SEQ ID NO: 499064 - RNA, 61 nt, Homo Sapiens
gggcauuuuacccuugcaguuuuacuaaaacacugaaaaauauuccaagcuucauauuaac

SEQ ID NO: 499065 - RNA, 61 nt, Homo Sapiens
aaaaaaaucaagauuuaauuuuuuuauuuguacugaaaaacuaaucauaacuguuaauucu

SEQ ID NO: 499066 - RNA, 61 nt, Homo Sapiens
acaacaaaaaaaaaucuuuauaagaaagagaacugaaaaguagcgugcuauucguccugua

SEQ ID NO: 499067 - RNA, 61 nt, Homo Sapiens
gccugaccaacauggagaaacccccaucucuacugaaaauacagaauuagccaggcauggu

SEQ ID NO: 499068 - RNA, 61 nt, Homo Sapiens
gagauuguuucaaauggguguaguagauauuacugaaaaccaaaaaagagugagauuguca

SEQ ID NO: 499069 - RNA, 61 nt, Homo Sapiens
uuuccacuuccaguucuaguaaggaagaaaaacugaaaauguuuuaguuuauuacccagua

SEQ ID NO: 499070 - RNA, 61 nt, Homo Sapiens
uucuugacaauuagauaccuauccuguaguuacugaaaaucuggguaguaaaucuacccaa

SEQ ID NO: 499071 - RNA, 61 nt, Homo Sapiens
uacugagaaaaaucccuucagcucuaagaacacugaaaaauccaccgauuuuuuggguaag

SEQ ID NO: 499072 - RNA, 61 nt, Homo Sapiens
caguugacaggucauccuugccaguuguauaacugaaaaaggacuuuucuaccagguauga

SEQ ID NO: 499073 - RNA, 61 nt, Homo Sapiens
uugagauugauuggauucgaccucuuguugaacugaaaacuuaauuuuuucucuguauuuu

SEQ ID NO: 499074 - RNA, 61 nt, Homo Sapiens
gcauuagcaaauauucaugcagcagcaguugacugaaaauuuauucuuaugagacguauag

SEQ ID NO: 499075 - RNA, 61 nt, Homo Sapiens
uauauucucuaaauauuucuugaauuaaugaacugaaaaauguguguuaaaguugcuaagu

SEQ ID NO: 499076 - RNA, 61 nt, Homo Sapiens
uauaacaacucuggauuacauuuuccucucaacugaaaacccucaguaaugcaaagaaagg

SEQ ID NO: 499077 - RNA, 61 nt, Homo Sapiens
agcuaaaacccacucuaugagaaggaagauuacugaaaagcaugugacauauugcuacaaa

SEQ ID NO: 499078 - RNA, 61 nt, Homo Sapiens
acuucugauuaaugcaaggggaaauuuuuauacugaaaacaaacaaacaaacuagcagcua

SEQ ID NO: 499079 - RNA, 61 nt, Homo Sapiens
auuuuauaaaauguuuucuguauggcaauaaacugaaaacauggaucaacccuucuuuuga

SEQ ID NO: 499080 - RNA, 61 nt, Homo Sapiens
guuagcuacuaugaauggugccagugaagacacugaaaaauaagugauuucaguaaccuuc

SEQ ID NO: 499081 - RNA, 61 nt, Homo Sapiens
caguugugggaauaauuaucagagacaugcaacugaaaaugucucaccuuucaucuuuuuu

SEQ ID NO: 499082 - RNA, 61 nt, Homo Sapiens
aaauugcaaauauaaacaaaagaaaaauccaacugaaaauaacacuaaguauuuuugaguu

SEQ ID NO: 499083 - RNA, 61 nt, Homo Sapiens
acuaaauaaugacauaauccucagcugacugacugaaaaugugacuggacgcauucccugu

SEQ ID NO: 499084 - RNA, 61 nt, Homo Sapiens
uuucuuauagcuaugugugguuucugggucaacugaaaaccuaccauuugcuuuucuauuc

SEQ ID NO: 499085 - RNA, 61 nt, Homo Sapiens
ugaaaagaaauauggaggcuuuaaaccgcaaacugaaaaagcugaguagaacaaaggcagu

SEQ ID NO: 499086 - RNA, 61 nt, Homo Sapiens
cuaaaagguauuuuuauaagcaguucaaguuacugaaaaccuuuuaaaccuuucugaaguu

SEQ ID NO: 499087 - RNA, 61 nt, Homo Sapiens
acuuaucagaauccucguucuuuuucagacuacugaaaaaugacauuuacucuguuaaaug

SEQ ID NO: 499088 - RNA, 61 nt, Homo Sapiens
agugcuuuuuauguauguugucuucuucaauacugaaaauuuguccuugguucuuaaaagc

SEQ ID NO: 499089 - RNA, 61 nt, Homo Sapiens
guccgggaggugccugugguuugcacccaccacugaaaaagccgcggagaugcgcagcgcg

SEQ ID NO: 499090 - RNA, 61 nt, Homo Sapiens
uguuuagaagggauggcuugaaaggaaggagacugaaaaacacucugagagcauacacugu

SEQ ID NO: 499091 - RNA, 61 nt, Homo Sapiens
acugaggucucucuuggccuggaagaauaacacugaaaaaaccugacgcugcggucacuua

SEQ ID NO: 499092 - RNA, 61 nt, Homo Sapiens
acuccagccggggugacagagugagacuccgacugaaaauaaauaaauaaauaaauaaaua

SEQ ID NO: 499093 - RNA, 61 nt, Homo Sapiens
agcuacuuauucagauacugaagaccaacggacugaaaaaaagaacaaacauuagcuauuu

SEQ ID NO: 499094 - RNA, 61 nt, Homo Sapiens
gaauggaagcccugaagucaugggcugcuuuacugaaaacaggcccucucuagcaaaguua

SEQ ID NO: 499095 - RNA, 61 nt, Homo Sapiens
caaaagauaaguaaaugaguggggauuucaaacugaaaaucgauaucagugugaaaagucu

SEQ ID NO: 499096 - RNA, 61 nt, Homo Sapiens
caaaaauuagacgggcaugguccccgucucuacugaaaacaagccuggccaacguggugaa

SEQ ID NO: 499097 - RNA, 61 nt, Homo Sapiens
uauuuuugggauaagagaauauuuuggaguuacugaaaaaugcuaagagguacaugugggu

SEQ ID NO: 499098 - RNA, 61 nt, Homo Sapiens
gaauuugauagcucagcauugaaaaggggccacugaaaaguaguaggaaccagauagagau

SEQ ID NO: 499099 - RNA, 61 nt, Homo Sapiens
uuaaaucuaccaguuuaugucuguugaaauaacugaaaaugguaauuuacauauuuucuuu

SEQ ID NO: 499100 - RNA, 61 nt, Homo Sapiens
guaucugcaugaaggcuccuguguauggagaacugaaaagguugugaccacuugugaaugg

SEQ ID NO: 499101 - RNA, 61 nt, Homo Sapiens
gcaaauugcaaucauauaaaugauguagauuacugaaaaauaaacuugaaaggucugagga

SEQ ID NO: 499102 - RNA, 61 nt, Homo Sapiens
gcagacagaggggcacgucuugcaggcagagacugaaaauuaaugccucccucaaaggacc

SEQ ID NO: 499103 - RNA, 61 nt, Homo Sapiens
uagaauuuauuugcuaauaaacuuuucagugacugaaaagauuucauaccaaugaaaucuu

SEQ ID NO: 499104 - RNA, 61 nt, Homo Sapiens
aggaaagaugguuaaacauuaagagagaaacacugaaaagaguggggggaugguaagagaa

SEQ ID NO: 499105 - RNA, 61 nt, Homo Sapiens
cuccacugcauggacccugguucugcaagauacugaaaauuaggaaaaucacccagaaugc

SEQ ID NO: 499106 - RNA, 61 nt, Homo Sapiens
uggcaguuaugguuuucuuuuacaagauucaacugaaaaguaucaguggcggaucaaaacc

SEQ ID NO: 499107 - RNA, 61 nt, Homo Sapiens
ugaaauuuaauggguggugaccagaacaauuacugaaaagcuugcacaacuagaacacauc

SEQ ID NO: 499108 - RNA, 61 nt, Homo Sapiens
aaucucuaugagcuaaaugugaauagauagcacugaaaaaaggauuaacccucuauagaca

SEQ ID NO: 499109 - RNA, 61 nt, Homo Sapiens
uccacuacauguaacuuucuuuaauguucagacugaaaaucguugccaaacuuuggaaaug

SEQ ID NO: 499110 - RNA, 61 nt, Homo Sapiens
uuuauugguaggauuuauauuaaaacuuaaaacugaaaaauuuuguuuuuaaaucaaacug

SEQ ID NO: 499111 - RNA, 61 nt, Homo Sapiens
uuaauauuuaauguuuuaauguauauguugcacugaaaaggaacuccuuacucugaugucu

SEQ ID NO: 499112 - RNA, 61 nt, Homo Sapiens
caacuccucuucuuagucuuagagagagaguacugaaaaagaucuagugguucacacagag

SEQ ID NO: 499113 - RNA, 61 nt, Homo Sapiens
uauacugauuagaaaugucuauguguugcugacugaaaagcgacuucuacauuaaugaugu

SEQ ID NO: 499114 - RNA, 61 nt, Homo Sapiens
uuaauucagauaguagcuuucaggcuuuuaaacugaaaagcgucuucuaaggauggucuuc

SEQ ID NO: 499115 - RNA, 61 nt, Homo Sapiens
aaggcuaguguacuacaaaaaaaauucgaaaacugaaaaauacugugagcaacuuagagua

SEQ ID NO: 499116 - RNA, 61 nt, Homo Sapiens
ugcuuuagggggaaaaucagcaaguugcaugacugaaaaaaaagcgagguuguaaaaauua

SEQ ID NO: 499117 - RNA, 61 nt, Homo Sapiens
cagaacccauuaauaucgugaagucagugccacugaaaauagugcauuauaccaaagagcg

SEQ ID NO: 499118 - RNA, 61 nt, Homo Sapiens
uauaagcucagauuauuuaacuuuaauuaagacugaaaauaugcucucuuuaaaucaaguc

SEQ ID NO: 499119 - RNA, 61 nt, Homo Sapiens
gcuauuuacaaagcaguaaacccaguuauaaacugaaaacaacccugauguaaagaucagu

SEQ ID NO: 499120 - RNA, 61 nt, Homo Sapiens
aaaccucuuccacccaccccuaucucucuacacugaaaauauauccacucggaccaucugu

SEQ ID NO: 499121 - RNA, 61 nt, Homo Sapiens
ccacuuucuucaucuuguuucuguauuuucgacugaaaauugauacgaucuugugaaaaca

SEQ ID NO: 499122 - RNA, 61 nt, Homo Sapiens
cuggggggaaaaaaaaaaaauguuguaaucaacugaaaaaucuagaaagucuacuugagca

SEQ ID NO: 499123 - RNA, 61 nt, Homo Sapiens
caggcauuacaccagcuguuggcuacaugguacugaaaauguagaaaacuauuaacagugc

SEQ ID NO: 499124 - RNA, 61 nt, Homo Sapiens
gguuuuuagucucuggaaaacaguugaucagacugaaaaaccucuaaaguugguguagcag

SEQ ID NO: 499125 - RNA, 61 nt, Homo Sapiens
ugcuuuaaagcuuuaccugaauaaacauugcacugaaaacuguaucuuaaaagaaggaacu

SEQ ID NO: 499126 - RNA, 61 nt, Homo Sapiens
aauuuuacagcuacugaauuaauguuuugaaacugaaaaaauuggaauuaauaaguauuga

SEQ ID NO: 499127 - RNA, 61 nt, Homo Sapiens
aacaacgcugaguuuaucaaguuuucuugucacugaaaacauggguccccuuuccauguau

SEQ ID NO: 499128 - RNA, 61 nt, Homo Sapiens
gaacagcauggauuaacucagacuuggcuguacugaaaaguugcuucaagucugugcaguu

SEQ ID NO: 499129 - RNA, 61 nt, Homo Sapiens
cuuaggaaggauccgcauaauuuuuuaaaaaacugaaaauauugugauguggcaauaaauu

SEQ ID NO: 499130 - RNA, 61 nt, Homo Sapiens
uuggccauuuggccuuaucucuacccacauaacugaaaauaaaaagguuacucaaguugua

SEQ ID NO: 499131 - RNA, 61 nt, Homo Sapiens
cuuuaaggauuuguaagguuugguucauguuacugaaaagaaggaacuugucaagagauca

SEQ ID NO: 499132 - RNA, 61 nt, Homo Sapiens
aacaaaaacaaaaacacaaaacccugucucuacugaaaaacaggcuggccaacaugguaaa

SEQ ID NO: 499133 - RNA, 61 nt, Homo Sapiens
gguuauauuaaagcaaauuaauuugugaucuacugaaaagaaaaaaguaguuuguaaacuc

SEQ ID NO: 499134 - RNA, 61 nt, Homo Sapiens
cauugcaauuagggaacgcaauuauuuaaagacugaaaauuguuuauuuugaaucguuaac

SEQ ID NO: 499135 - RNA, 61 nt, Homo Sapiens
cuggucacacaaaauguuuaugugaugcugcacugaaaaaaugguuggagauugcuggcga

SEQ ID NO: 499136 - RNA, 61 nt, Homo Sapiens
ucauucuuggguuaacaguacaaauuacauuacugaaaacuagaugauaaaggccagauua

SEQ ID NO: 499137 - RNA, 61 nt, Homo Sapiens
caggcuuucguagugauuagcuuacuaaggaacugaaaaugggccccuuguacaagcugag

SEQ ID NO: 499138 - RNA, 61 nt, Homo Sapiens
agccuggccaacauagugaaaccccaucucuacugaaaauacaaaaauuagcugggugugg

SEQ ID NO: 499139 - RNA, 61 nt, Homo Sapiens
uugauauguaagagauauucagaaugcucacacugaaaaugccucaacuuuuuaaagugua

SEQ ID NO: 499140 - RNA, 61 nt, Homo Sapiens
aaaaacauuuuuacugcugcuuaguuuuuggacugaaaagauauuaaaacucaagaaggac

SEQ ID NO: 499141 - RNA, 61 nt, Homo Sapiens
cuuggucugacuuguaccaauucuagcacccacugaaaaacaaguugaguagagaguguag

SEQ ID NO: 499142 - RNA, 61 nt, Homo Sapiens
cauuagcuguuuguaaauaaugcauuugcauacugaaaaaggaaugccaccugccacaguu

SEQ ID NO: 499143 - RNA, 61 nt, Homo Sapiens
uuucaaucaaaacucaguaucauaaguagagacugaaaacuugccguuauugauuguuguu

SEQ ID NO: 499144 - RNA, 61 nt, Homo Sapiens
ccugcugucccauggagaaaaaguuuuaagcacugaaaaaauuugauuaauguauuuaaau

SEQ ID NO: 499145 - RNA, 61 nt, Homo Sapiens
uuauuaguauugcuuuucauaauucugucucacugaaaaccuuauuugauggaagcaacau

SEQ ID NO: 499146 - RNA, 61 nt, Homo Sapiens
guaaaaacaaaguuugggcucugaaaauuuaacugaaaaagauuuccuuguuuuuguaaua

SEQ ID NO: 499147 - RNA, 61 nt, Homo Sapiens
uuuuuuaaaagccagucaaaacaaaaacuuuacugaaaauggacagaaauaggaaauggac

SEQ ID NO: 499148 - RNA, 61 nt, Homo Sapiens
aguucuuuuuaaaaugacacuuaaaacaaucacugaaaacuugauccacaucacacccugu

SEQ ID NO: 499149 - RNA, 61 nt, Homo Sapiens
ugaaauucaugaguuuauuuaugucuaaaacacugaaaacuguguccaauaucguucaguu

SEQ ID NO: 499150 - RNA, 61 nt, Homo Sapiens
aaaucaugaguaaaauuggaaaacacuuuuaacugaaaaaaacaaaagcacaacaaaccaa

SEQ ID NO: 499151 - RNA, 61 nt, Homo Sapiens
cuucuguuguaauaguccauggacaauauaaacugaaaaaugucagucugguuuauauaag

SEQ ID NO: 499152 - RNA, 61 nt, Homo Sapiens
cacaccaucgaucauagcaccaccuaucagcacugaaaacucuuuuguaaguuguuuaaaa

SEQ ID NO: 499153 - RNA, 61 nt, Homo Sapiens
ucucccaguuaugaaucagugggcaggauaaacugaaaacucccauuuacgugucugaauc

SEQ ID NO: 499154 - RNA, 61 nt, Homo Sapiens
agaaaucucugaagaaaccaaaagagcugaaacugaaaaaagagcucccucccuuuuuuca

SEQ ID NO: 499155 - RNA, 61 nt, Homo Sapiens
agccuuuaaacagcaguuuguaaacuaugcaacugaaaaacugaggaugauuguuagcucc

SEQ ID NO: 499156 - RNA, 61 nt, Homo Sapiens
uagucauguccauucagacauaaccugaacuacugaaaagaucaauuuccagaagguuuau

SEQ ID NO: 499157 - RNA, 61 nt, Homo Sapiens
uuuaaaaaaaaucuauaguuuccaauaaacaacugaaaaauuaucaugagauguguauuua

SEQ ID NO: 499158 - RNA, 61 nt, Homo Sapiens
uagucaaugaacuggcugccacuuuaauauaacugaaaauucauuuugagaccaagcagga

SEQ ID NO: 499159 - RNA, 61 nt, Homo Sapiens
acauccacuuaggaugauacaaagcaguguaacugaaaauguuucuuuuaauugauuuaaa

SEQ ID NO: 499160 - RNA, 61 nt, Homo Sapiens
acaaaauuggaaagaaauuaacaagugcaagacugaaaacuauaggaaucaacuuaacaaa

SEQ ID NO: 499161 - RNA, 61 nt, Homo Sapiens
gaccugccuuucacugaauuguuuuuuucuuacugaaaaugucucugaauugacugauuuu

SEQ ID NO: 499162 - RNA, 61 nt, Homo Sapiens
auggggguuguauguauguguugacauauacacugaaaaaaggucuugaggucuugacauc

SEQ ID NO: 499163 - RNA, 61 nt, Homo Sapiens
cccagcccugcugcacacuaguuuaauagucacugaaaacucucccugcaguuggcugggu

SEQ ID NO: 499164 - RNA, 61 nt, Homo Sapiens
accugggaucauaguguuucgaaauuuuaaaacugaaaacucuguacuuacuuuacaggaa

SEQ ID NO: 499165 - RNA, 61 nt, Homo Sapiens
uagguugaaagcucucuguauuaguuuaaugacugaaaaagaacuggacuugguuggcauu

SEQ ID NO: 499166 - RNA, 61 nt, Homo Sapiens
auguagaaauauauguaaaguacuuuguuuaacugaaaaaacauuguugcagaguuaucug

SEQ ID NO: 499167 - RNA, 61 nt, Homo Sapiens
agccuuuuucaccauggcaaggccaggacacacugaaaagcgugugagccucggccuggcu

SEQ ID NO: 499168 - RNA, 61 nt, Homo Sapiens
uccacaggguuuggagaauaaagacacgggaacugaaaaacgacuggaccaagagcaggca

SEQ ID NO: 499169 - RNA, 61 nt, Homo Sapiens
cauguguauuuuccuauguguaaaaauguagacugaaaagcgaccgaaucucuuuucucug

SEQ ID NO: 499170 - RNA, 61 nt, Homo Sapiens
caggccacaaaugugucccacacaauguugcacugaaaaccgcuuauuuagcacauuuuga

SEQ ID NO: 499171 - RNA, 61 nt, Homo Sapiens
cuuaaaucuguguuuucuggaggcaagaaucacugaaaaauggaagaaaaggggaggggga

SEQ ID NO: 499172 - RNA, 61 nt, Homo Sapiens
uuuuauaguucaaaaauuaaaauaauuuugcacugaaaacucauugcuauuuaucaauagc

SEQ ID NO: 499173 - RNA, 61 nt, Homo Sapiens
aaauucucaggcuuuacagccagaagaaccaacugaaaaaauugcagguaucacagccuug

SEQ ID NO: 499174 - RNA, 61 nt, Homo Sapiens
aaaaaaaagcucauauuaauacauaggcagcacugaaaaaacauucuaccagcacaaggaa

SEQ ID NO: 499175 - RNA, 61 nt, Homo Sapiens
caauaaucagaaaaguaauuuaauuuugcauacugaaaaucaagccccuuauuuuuagcca

SEQ ID NO: 499176 - RNA, 61 nt, Homo Sapiens
ugaaaguaaccauaucugacaucaaguaacaacugaaaaugcauauacggcuuuggagaca

SEQ ID NO: 499177 - RNA, 61 nt, Homo Sapiens
uuugguccugggaauuuauucuaauacaaaaacugaaaaccguguggucuuugggaggagu

SEQ ID NO: 499178 - RNA, 61 nt, Homo Sapiens
augaaaaugucacucaagcuucaugugagcuacugaaaaaauaucuagaguucucuaauuu

SEQ ID NO: 499179 - RNA, 61 nt, Homo Sapiens
gauauuauuuuccuuuucuuuaaauaauaguacugaaaauuaacuggaggggcucuagugc

SEQ ID NO: 499180 - RNA, 61 nt, Homo Sapiens
aauaagaaagaaagaguuggacuguagguaaacugaaaaaaaagaaaggauugguacugca

SEQ ID NO: 499181 - RNA, 61 nt, Homo Sapiens
auccucaaaaugaguuauagcugugaaaugcacugaaaaaagauucccuuguucauuuuug

SEQ ID NO: 499182 - RNA, 61 nt, Homo Sapiens
aagccaagccucugcccugccuaaaauguccacugaaaacagauuuuccacaaagaaugug

SEQ ID NO: 499183 - RNA, 61 nt, Homo Sapiens
aaauauuuuuauggauuuuagccauuuucauacugaaaauuccucaaacucaaauuaguau

SEQ ID NO: 499184 - RNA, 61 nt, Homo Sapiens
gucacuaacucucuuuucccauccccccaagacugaaaagauuuucuuccucuaccuccac

SEQ ID NO: 499185 - RNA, 61 nt, Homo Sapiens
caaaaacuauuuuauuaugaugugugauuguacugaaaaauaguacuaauaaucccugauc

SEQ ID NO: 499186 - RNA, 61 nt, Homo Sapiens
gaaauguucucaauaucaaccuguuagcaaaacugaaaacuguuaugauuaagcuuaaacc

SEQ ID NO: 499187 - RNA, 61 nt, Homo Sapiens
gaaucauuuuucacuguacaggauacacaggacugaaaaggacccaaagcccugguaaaag

SEQ ID NO: 499188 - RNA, 61 nt, Homo Sapiens
guaaauacaaaauaaaauuauugcauuagaaacugaaaacuccaagucuucagcgagaccc

SEQ ID NO: 499189 - RNA, 61 nt, Homo Sapiens
ccuaaucgauauauauauucagacugauuagacugaaaauggaauuaaaugauaaacuuag

SEQ ID NO: 499190 - RNA, 61 nt, Homo Sapiens
guuauguguaaaugccaccuauuaauacgggacugaaaacguuagagacacacugcauugc

SEQ ID NO: 499191 - RNA, 61 nt, Homo Sapiens
cucagauuugugaugcuaggaacaugagcaaacugaaaauuacuaugcacuugucagaaac

SEQ ID NO: 499192 - RNA, 61 nt, Homo Sapiens
uaaagacaauuugcaggggguugggagaaggacugaaaagguacauuaagugugcuguaag

SEQ ID NO: 499193 - RNA, 61 nt, Homo Sapiens
uauauauaaucaauucaucaagccaguuauuacugaaaaaucauugaaaugagacaguuua

SEQ ID NO: 499194 - RNA, 61 nt, Homo Sapiens
uguuggagaggggaaaaguugugcauaaagaacugaaaaggguucuggaguguucauucag

SEQ ID NO: 499195 - RNA, 61 nt, Homo Sapiens
auuuccuaucacuauuucagugucagaacaaacugaaaauaauggcucguguuuauguuga

SEQ ID NO: 499196 - RNA, 61 nt, Homo Sapiens
gccuaaugauguuaucuaggcaccauuggagacugaaaaaaaaaaaucccugcucuguaaa

SEQ ID NO: 499197 - RNA, 61 nt, Homo Sapiens
guugccucauagcuuuguacagauuaugaggacugaaaauaauugggcauuuacccaucuu

SEQ ID NO: 499198 - RNA, 61 nt, Homo Sapiens
uauuauauguauguauauuucaaaguaccacacugaaaauuagacauuuauuaaccaaauu

SEQ ID NO: 499199 - RNA, 61 nt, Homo Sapiens
cauccugucucuggcuguggcccggcaaagcacugaaaaccccucuggucucagagacagu

SEQ ID NO: 499200 - RNA, 61 nt, Homo Sapiens
cuauaauaccuaugccucagcaauacauagaacugaaaaaacagggcgggagugguaugug

SEQ ID NO: 499201 - RNA, 61 nt, Homo Sapiens
cuuuagaaacacaagaguauagauuuuucucacugaaaagugagaguuacgcauugcagcc

SEQ ID NO: 499202 - RNA, 61 nt, Homo Sapiens
guguaagccaaaggcccacagaggagcauauacugaaaagaaggcaguaucacagaauuua

SEQ ID NO: 499203 - RNA, 61 nt, Homo Sapiens
uuucauucagaaucaaaauuaagaaaguuggacugaaaauaugaaaaaugcuuaacuauug

SEQ ID NO: 499204 - RNA, 61 nt, Homo Sapiens
cugcccugcucagcagucaccauagcagcugacugaaaaucagcacugccugaguaguuuu

SEQ ID NO: 499205 - RNA, 61 nt, Homo Sapiens
uuuugaucaguuuaacuugaaucacuaacugacugaaaauugaaugggcaaauaagugcuu

SEQ ID NO: 499206 - RNA, 61 nt, Homo Sapiens
uaaagacaaaguaauucuauuaaaugaacuaacugaaaauaauaauuauaggaagugauua

SEQ ID NO: 499207 - RNA, 61 nt, Homo Sapiens
uagaaccugucauacauucaugauaaguagcacugaaaaauuacucauucaaauuuccccu

SEQ ID NO: 499208 - RNA, 61 nt, Homo Sapiens
cugguuuuuaagugcacugcacuucuggaauacugaaaaagaaugaaaacaauauguuaga

SEQ ID NO: 499209 - RNA, 61 nt, Homo Sapiens
aaucucauuucuggacucuuuaaguuuuaccacugaaaaccagagucgauuuuucuccuaa

SEQ ID NO: 499210 - RNA, 61 nt, Homo Sapiens
uuuauuucuucuaaaaaucuguauaccaggaacugaaaaucuuugaacagauauuaaaauc

SEQ ID NO: 499211 - RNA, 61 nt, Homo Sapiens
accuaccuacugacaaguaaauuuauacaggacugaaaaccgccugaaaccugcugcaacu

SEQ ID NO: 499212 - RNA, 61 nt, Homo Sapiens
aaaaaaagauuuuuucuggauaaacuauuucacugaaaaaaaugucucuauaugaaggaac

SEQ ID NO: 499213 - RNA, 61 nt, Homo Sapiens
cauccauuuuagagccaggauuuacacugacacugaaaauuaaagaaaguaacaagauguc

SEQ ID NO: 499214 - RNA, 61 nt, Homo Sapiens
aaacuagaaauguccuaauuuuuacauuucaacugaaaaagccugucuuaaauuccaaagc

SEQ ID NO: 499215 - RNA, 61 nt, Homo Sapiens
aggagguguaauaaaauguuaaaacucaaggacugaaaaucaauaaacaaggggagaaaau

SEQ ID NO: 499216 - RNA, 61 nt, Homo Sapiens
gcacacgcaugacaaaaugugucauucuaacacugaaaaguguuucugacuggaaaaucuu

SEQ ID NO: 499217 - RNA, 61 nt, Homo Sapiens
uguauaaaguaauuaaaaguuuuagaugaugacugaaaauguuuguggcuauaaaugauua

SEQ ID NO: 499218 - RNA, 61 nt, Homo Sapiens
uauaucauauggguacacaaaacuuggugaaacugaaaaagauuaagaaucaucauuacau

SEQ ID NO: 499219 - RNA, 61 nt, Homo Sapiens
aggugugauccuguuacugaauccugguguuacugaaaaacgcguagggacagauguauuc

SEQ ID NO: 499220 - RNA, 61 nt, Homo Sapiens
guccugcucagugccaaggucuggccgccacacugaaaacuacuccagagacuucugccac

SEQ ID NO: 499221 - RNA, 61 nt, Homo Sapiens
aaucugcaagauaauguaacagauaauguaaacugaaaaaauuuccaucaaaucaauguag

SEQ ID NO: 499222 - RNA, 61 nt, Homo Sapiens
aaauaucuaagcuguacauguauuuuuuuuaacugaaaaaguaucagauauguuuuugcac

SEQ ID NO: 499223 - RNA, 61 nt, Homo Sapiens
cuugcaaugacaagagguuuuagaaacaugaacugaaaaguuaagaauuaaaacugggaaa

SEQ ID NO: 499224 - RNA, 61 nt, Homo Sapiens
ccuaaaucaaagacuauuucaagucaacaacacugaaaacugcuuuucgccuccacucuua

SEQ ID NO: 499225 - RNA, 61 nt, Homo Sapiens
uggugaagaauggacuuaauuaugcuaacaaacugaaaaaucuagacauagauccucugau

SEQ ID NO: 499226 - RNA, 61 nt, Homo Sapiens
gaagaaacaagguuuucaguccccacagauaacugaaaauuauuuaaaccgcuaaaagaaa

SEQ ID NO: 499227 - RNA, 61 nt, Homo Sapiens
ccaguauaugcuauucaaugaucuuagaaguacugaaaaaaaaagacguuuuuaaaacgua

SEQ ID NO: 499228 - RNA, 61 nt, Homo Sapiens
auauugagcucuaaaugcaaaacucuuuuauacugaaaaaacacuuaaaguaguuuugugu

SEQ ID NO: 499229 - RNA, 61 nt, Homo Sapiens
uggaauaaaggauguuuucuguuggacauguacugaaaauuaacacauguaguagccuuaa

SEQ ID NO: 499230 - RNA, 61 nt, Homo Sapiens
gacauucagugaauuauuucaguggugacccacugaaaauuaauaaugguacuuaugauua

SEQ ID NO: 499231 - RNA, 61 nt, Homo Sapiens
ugggacugcuuugagaaccaucuuucaaugcacugaaaagucaucugaaaaaauagcuucu

SEQ ID NO: 499232 - RNA, 61 nt, Homo Sapiens
agacauuuuguuucaaaugaaacuuuaaaagacugaaaaauuuuguaaauagguuugauuc

SEQ ID NO: 499233 - RNA, 61 nt, Homo Sapiens
uacuaaaucucuguuaauauucucucuuuuaacugaaaagggaugggauagaaggguuugc

SEQ ID NO: 499234 - RNA, 61 nt, Homo Sapiens
ugagagguucuaaaaucaugaaacuuguuucacugaaaauuggacagauugccuguuucug

SEQ ID NO: 499235 - RNA, 61 nt, Homo Sapiens
gauguggccaaccuuuguccauaugcaaaccacugaaaaaugaucuggauuucuauagcaa

SEQ ID NO: 499236 - RNA, 61 nt, Homo Sapiens
aaaucugaacucucaaaagucuauuuuuuuaacugaaaauguaaauuuauaaauauauuca

SEQ ID NO: 499237 - RNA, 61 nt, Homo Sapiens
cuguuacuaaguaaaaagcugucaaacauuuacugaaaauagaauuggccccauggcuuga

SEQ ID NO: 499238 - RNA, 61 nt, Homo Sapiens
uauccuuuguauuuauaggcacaguuaucuuacugaaaaugcaugcauggugaauuaaaau

SEQ ID NO: 499239 - RNA, 61 nt, Homo Sapiens
uuuuuuuuuuaaagcggguaaaagagaaaacacugaaaauugaauucuuaucuuccagagg

SEQ ID NO: 499240 - RNA, 61 nt, Homo Sapiens
auccccuuucuacagugaguccacuacccucacugaaaaucauuuuguaccacuuacauuu

SEQ ID NO: 499241 - RNA, 61 nt, Homo Sapiens
uagcucuuaaaacauacgaaguguugccuaaacugaaaauauuuaucuuuuauuuaaaauc

SEQ ID NO: 499242 - RNA, 61 nt, Homo Sapiens
cugugcugaaauuugaagaccagauaaugaaacugaaaagcaaacaauuuuacugaaucug

SEQ ID NO: 499243 - RNA, 61 nt, Homo Sapiens
gauucuuuauuccuauucgacacuggcuucuacugaaaaugaaacggauugcagagggaau

SEQ ID NO: 499244 - RNA, 61 nt, Homo Sapiens
gcgaaaaaguauugaagauuagcuuuuaaaaacugaaaaaaaaaaaugaaugacucacaua

SEQ ID NO: 499245 - RNA, 61 nt, Homo Sapiens
caaacaacaaagcagaagaccuucaaccucuacugaaaacaaaaggagggcaacuucuacu

SEQ ID NO: 499246 - RNA, 61 nt, Homo Sapiens
uucaucugaugccucugagcaaaagaacacgacugaaaaagugguugaauaauuauugaaa

SEQ ID NO: 499247 - RNA, 61 nt, Homo Sapiens
uaaguugcauagcugcuuugcauauaugaguacugaaaaauuggcuuuuccuccauuaaua

SEQ ID NO: 499248 - RNA, 61 nt, Homo Sapiens
acauauccaaaauaaugagggaaugccuucaacugaaaaaaguuucaccuguauugaauca

SEQ ID NO: 499249 - RNA, 61 nt, Homo Sapiens
uucacagagaugaaguggggacuguaaaggaacugaaaaucaauugaaauaauuucaaaua

SEQ ID NO: 499250 - RNA, 61 nt, Homo Sapiens
gaaguaauauaaauuuuguguacgagggaaaacugaaaaaguguaaugacuucacaaguuu

SEQ ID NO: 499251 - RNA, 61 nt, Homo Sapiens
caacauacugugaugauacgauuaacuucguacugaaaaagguuaaacagcaggaaagccc

SEQ ID NO: 499252 - RNA, 61 nt, Homo Sapiens
uaguccuaacgucuuugccucucugccucagacugaaaagccuugcucugcuauaucucca

SEQ ID NO: 499253 - RNA, 61 nt, Homo Sapiens
cuuuuuaaaauuuuauguauaugcauuauaaacugaaaagcuggggcaggggacuguuagg

SEQ ID NO: 499254 - RNA, 61 nt, Homo Sapiens
gcuuuuuaguacuuuuucauuaccuaaaaguacugaaaaauguguuuaguuggauuaaucu

SEQ ID NO: 499255 - RNA, 61 nt, Homo Sapiens
auuuugguccuuaaaaggagaaaaugguuagacugaaaauauuuaaauaagcgcuuuaaug

SEQ ID NO: 499256 - RNA, 61 nt, Homo Sapiens
aaauuuauucuuucgaagauaaauacaguggacugaaaagcuuggugauaaucaauuuuga

SEQ ID NO: 499257 - RNA, 61 nt, Homo Sapiens
uaguugcucuccuuuuuucuggaugugaugcacugaaaagugccauacauuuuauccucau

SEQ ID NO: 499258 - RNA, 61 nt, Homo Sapiens
agggcaauguuggucgccuuagguaauuuuuacugaaaauugggggaaagguaggaagaag

SEQ ID NO: 499259 - RNA, 61 nt, Homo Sapiens
uugaugugauucuugaaagguggacugauggacugaaaacauagaguugcuccauucauau

SEQ ID NO: 499260 - RNA, 61 nt, Homo Sapiens
aaaacaaaacaaaacaaaaaccucggguaacacugaaaaacaaacuagcucuucagagaag

SEQ ID NO: 499261 - RNA, 61 nt, Homo Sapiens
ugaaagaaaagccuauaaaacuuacagaaugacugaaaauuaauucuucuguugccuuuuu

SEQ ID NO: 499262 - RNA, 61 nt, Homo Sapiens
aaaacuagccuuuggcuuguguauacaauaaacugaaaaaaaccaccagugaaaugugugu

SEQ ID NO: 499263 - RNA, 61 nt, Homo Sapiens
uguuaaggcuauaguuuagccccaggaucaaacugaaaacauucagggcauauuuuuucuu

SEQ ID NO: 499264 - RNA, 61 nt, Homo Sapiens
auuuagaaagaagcuauugguauuuuuuucuacugaaaacaacacuaaggucuccauauac

SEQ ID NO: 499265 - RNA, 61 nt, Homo Sapiens
aaaaagaagaagaagaaggacaggaucuuugacugaaaaaacgguuaaauuccauaugcuc

SEQ ID NO: 499266 - RNA, 61 nt, Homo Sapiens
uaauauuaaaaauauggaacuguaauagaaaacugaaaauccaagguggccaaauuauuug

SEQ ID NO: 499267 - RNA, 61 nt, Homo Sapiens
agcagauguuuaaauagauuacaaaacaaucacugaaaaacaaaauguugcuuccacauua

SEQ ID NO: 499268 - RNA, 61 nt, Homo Sapiens
ugaauugucacuuuaucuuuauuuccauauaacugaaaaacuggcugccauuuugccauag

SEQ ID NO: 499269 - RNA, 61 nt, Homo Sapiens
gggaaaaccucuaccaugccacagucuagucacugaaaaauaaauucaucuguaaauauuc

SEQ ID NO: 499270 - RNA, 61 nt, Homo Sapiens
augacuuugaaguaaaaccuuuuuucuugcuacugaaaaaaauggaguuguuuuggguggu

SEQ ID NO: 499271 - RNA, 61 nt, Homo Sapiens
gaagauggcauccugugaaguccuucaccucacugaaaacaucuggaaggggaucccaccc

SEQ ID NO: 499272 - RNA, 61 nt, Homo Sapiens
ccuucugagcugguggaauauuuuauuucagacugaaaacagagagcacucuccuugggaa

SEQ ID NO: 499273 - RNA, 61 nt, Homo Sapiens
gguccuuggaagaccuauauucucuguaguuacugaaaaccgaaagucaauucuaauuauu

SEQ ID NO: 499274 - RNA, 61 nt, Homo Sapiens
cauauucgaagugguugucucugcacuauuuacugaaaaguucauccuuuccccagugauu

SEQ ID NO: 499275 - RNA, 61 nt, Homo Sapiens
uucaaagaaucaguguaagccacuaaaaggaacugaaaaccuaggugucacaauaaacagu

SEQ ID NO: 499276 - RNA, 61 nt, Homo Sapiens
cugccaugaacuggaggccaggaaucuccucacugaaaauuacaguaugguaacuuugcaa

SEQ ID NO: 499277 - RNA, 61 nt, Homo Sapiens
ugucuuuuacccccacaggguuccugagcucacugaaaagacuauugugccuuaggaaaag

SEQ ID NO: 499278 - RNA, 61 nt, Homo Sapiens
gcuaaaacaggaugauugcuuuugucuguuuacugaaaaaugaguuuagaaaggcuagccc

SEQ ID NO: 499279 - RNA, 61 nt, Homo Sapiens
uuuucacaccaucucagagguugaggagcauacugaaaauugcccuggggggugcugggug

SEQ ID NO: 499280 - RNA, 61 nt, Homo Sapiens
gacuuuuguguauggguaguaaaucuagcucacugaaaaucagagugaaacgccuuuacau

SEQ ID NO: 499281 - RNA, 61 nt, Homo Sapiens
ggaaggagaggggugcaacaggaccgccugcacugaaaacucacugcugccaugcccuggg

SEQ ID NO: 499282 - RNA, 59 nt, Homo Sapiens
agacacugauauccaaauaaguugucuuuacugaaaaaugaagugaagacccauauaug

SEQ ID NO: 499283 - RNA, 61 nt, Homo Sapiens
aaugaugugugauuggauggaauugaaucaaacugaaaaaguauuuccuuauagcuuaaug

SEQ ID NO: 499284 - RNA, 61 nt, Homo Sapiens
gaaagaaaaauauagauuaaaauugcugggcacugaaaaggggugggaguuggaaaucaga

SEQ ID NO: 499285 - RNA, 61 nt, Homo Sapiens
uccacucucaaguuuucuacuuugucuuugaacugaaaauaaacauggaucuagaaaacca

SEQ ID NO: 499286 - RNA, 61 nt, Homo Sapiens
guuuccaacagcacuucucaccuauucaauaacugaaaaagacauuaccauagugcuuuac

SEQ ID NO: 499287 - RNA, 61 nt, Homo Sapiens
agaaucugaauauaaauuugcuuacuucccuacugaaaauacgugcacugagcugcaacuu

SEQ ID NO: 499288 - RNA, 61 nt, Homo Sapiens
aagagagagagagaucugggacagcaaaaaaacugaaaauauuuuauuaauuaucuggaua

SEQ ID NO: 499289 - RNA, 61 nt, Homo Sapiens
ugcugagccagccaucuuuggaaugauccauacugaaaaaaugaaucucguugaggccaag

SEQ ID NO: 499290 - RNA, 61 nt, Homo Sapiens
gucucauacauauuuugcagaaugcuuacagacugaaaaauaaauggaaaacagucauaua

SEQ ID NO: 499291 - RNA, 61 nt, Homo Sapiens
caaauuuuaacuagcaaaugaaaacuagaggacugaaaaaaguagcugaugugcaguugag

SEQ ID NO: 499292 - RNA, 61 nt, Homo Sapiens
cuaguuaccugauuauugcauacauuuuuuaacugaaaaacucuagcuuauauaaggucau

SEQ ID NO: 499293 - RNA, 61 nt, Homo Sapiens
acauuagcaagcauagucuauuacaaaacagacugaaaaagacauugacacuaguauuauu

SEQ ID NO: 499294 - RNA, 61 nt, Homo Sapiens
ugacauggcauguuucuuucucaauaaaacuacugaaaauuugaaacaaaagaggcauuuu

SEQ ID NO: 499295 - RNA, 52 nt, Homo Sapiens
uacaauuaucauuuaggcuaaaacugaaaaugaagauugggaaggaaauuaa

SEQ ID NO: 499296 - RNA, 61 nt, Homo Sapiens
aaagggucuguuugugucauugauuaaaugcacugaaaaguuugaccuauuuauucauucu

SEQ ID NO: 499297 - RNA, 61 nt, Homo Sapiens
cuauguguuuuuuuaauugguaggccaaaauacugaaaagcgacucauuugaacaaaaauc

SEQ ID NO: 499298 - RNA, 61 nt, Homo Sapiens
augaauuucaagauucucaauguuuuauucuacugaaaaaauacguuuucaugcugcuuau

SEQ ID NO: 499299 - RNA, 61 nt, Homo Sapiens
ugcugggguuuguucugcugugcugugauccacugaaaaugcuguuacacuuucucugauc

SEQ ID NO: 499300 - RNA, 61 nt, Homo Sapiens
ucuuaaagaaaaagcauuugguggaaggagcacugaaaaccuagaucauguuuacuuccca

SEQ ID NO: 499301 - RNA, 61 nt, Homo Sapiens
uaagguuauuugaauguucuuugauuguaaaacugaaaaacauagcaucuaguccaacucc

SEQ ID NO: 499302 - RNA, 61 nt, Homo Sapiens
uguccugcugaagcagcuaucuuacugugauacugaaaagcugauccuguauugggcugua

SEQ ID NO: 499303 - RNA, 61 nt, Homo Sapiens
aaauuuacuuugaucucuguuagacgcagagacugaaaaaaagaaaacauugauuugagca

SEQ ID NO: 499304 - RNA, 61 nt, Homo Sapiens
ugauguucugcuuauuuggaaauauauaaauacugaaaauguguuuaaagacuuccacugc

SEQ ID NO: 499305 - RNA, 61 nt, Homo Sapiens
agaaugaucaauuuaaucugugagaaugcugacugaaaaauggauaggugccauuuggugg

SEQ ID NO: 499306 - RNA, 61 nt, Homo Sapiens
uuauguugaagccauaucccuuauggaccgaacugaaaauuguagcaaggaauugguggua

SEQ ID NO: 499307 - RNA, 61 nt, Homo Sapiens
aaaacaaugaaaauauucauugcaucuugcuacugaaaacaagacaguuauuuguuucuuc

SEQ ID NO: 499308 - RNA, 61 nt, Homo Sapiens
gaaugaacaaagguaauaugucuagcacugcacugaaaaaggacuucugcauuucugacau

SEQ ID NO: 499309 - RNA, 61 nt, Homo Sapiens
ggaauuuuuuuguacuguaauuuugaauggaacugaaaaauuaugcacgaauaaaguacuu

SEQ ID NO: 499310 - RNA, 61 nt, Homo Sapiens
aaggauacaaggauuauuucaauguuacugcacugaaaaacguguauguauuagugugcua

SEQ ID NO: 499311 - RNA, 61 nt, Homo Sapiens
uauugaucgugauaugacuuguuacuaggguacugaaaaaaaugucuaaggccuuuacaga

SEQ ID NO: 499312 - RNA, 61 nt, Homo Sapiens
uggaauuuuuugaauaugccuuaauuuagaaacugaaaaauaucugguuauaucauucugg

SEQ ID NO: 499313 - RNA, 61 nt, Homo Sapiens
gaggaggaacaaauuacaaguguacccaauaacugaaaauguuuuaacucacucucauuug

SEQ ID NO: 499314 - RNA, 61 nt, Homo Sapiens
aauccucaaaccucacuaaacauaagauaauacugaaaacuuuacaaaccugaaugaugug

SEQ ID NO: 499315 - RNA, 61 nt, Homo Sapiens
caauucucaaaucuuacuaaacaaaauuaauacugaaaauguuacaaaccagaaaaaugug

SEQ ID NO: 499316 - RNA, 61 nt, Homo Sapiens
agaauuacaaugaauaauaauuugcuuugucacugaaaaccaccagugaagugcaauuugg

SEQ ID NO: 499317 - RNA, 61 nt, Homo Sapiens
acgauggcgaggaagccagccccaaggaaacacugaaaacacauaucacgccaaugccgug

SEQ ID NO: 499318 - RNA, 61 nt, Homo Sapiens
caucucaaaaaaaaaaaaaagaaagaaagaaacugaaaagugagguguggaacuccaggca

SEQ ID NO: 499319 - RNA, 61 nt, Homo Sapiens
ugagguuuguaaacuguccuuuuuaaaucaaacugaaaacaaaaagcuuuaaccuuucaac

SEQ ID NO: 499320 - RNA, 61 nt, Homo Sapiens
caauauaaaaacauucauuuggaauguacauacugaaaaauacagguuuuuuugaccaaaa

SEQ ID NO: 499321 - RNA, 61 nt, Homo Sapiens
gauauaguuuuacuuuuaaacuguguacauaacugaaaaugugcuauacugcauacuuuuu

SEQ ID NO: 499322 - RNA, 61 nt, Homo Sapiens
guuuaaaaauaaaguuccugauaauaaagugacugaaaauggcauccccaaagugucuccg

SEQ ID NO: 499323 - RNA, 61 nt, Homo Sapiens
ugugaccaauucauuauaacauuuggauauuacugaaaauguaaggaagcaggaaaaauua

SEQ ID NO: 499324 - RNA, 61 nt, Homo Sapiens
cgagugaugauguugugaaucgagugaaacuacugaaaaucuagcuacugaauccuggggg

SEQ ID NO: 499325 - RNA, 61 nt, Homo Sapiens
augugcaugaucugucacuuaauauuuaaaaacugaaaaaacuaguauuugcacuuagcaa

SEQ ID NO: 499326 - RNA, 61 nt, Homo Sapiens
ggagcuauuuauagauggagugugguaccaaacugaaaauaaacauuuuggggcaguuuaa

SEQ ID NO: 499327 - RNA, 61 nt, Homo Sapiens
uauccaucuacacagcacccauauacugugcacugaaaaaaguuaacuccuggacacaagu

SEQ ID NO: 499328 - RNA, 61 nt, Homo Sapiens
aaauugcuaucaagaauaaacuuuugcuugcacugaaaauuuuacagugggcagguauuug

SEQ ID NO: 499329 - RNA, 61 nt, Homo Sapiens
aaauugcuaucaagagcaaacuuuugcuugcacugaaaauuagugagcagguauguguuug

SEQ ID NO: 499330 - RNA, 61 nt, Homo Sapiens
aacuguaaaugcuccuagagguuauuugaugacugaaaaugacguuuuggaagugauguau

SEQ ID NO: 499331 - RNA, 61 nt, Homo Sapiens
aaggaaggguuugcagaggacuucucagagcacugaaaagaauuugaggcuuuucuauaua

SEQ ID NO: 499332 - RNA, 61 nt, Homo Sapiens
aaaaucuguaaacgcgaaaacauccggcaaaacugaaaaaaacagugauuuagguuuguaa

SEQ ID NO: 499333 - RNA, 60 nt, Homo Sapiens
acucuuacggguugagucugguuaauaaaauacugaaaacguccucuugccagcucauuu

SEQ ID NO: 499334 - RNA, 61 nt, Homo Sapiens
gcuuuuuuuccagauauauguuggcagcagaacugaaaaagaaaccugcuuccaggcuacu

SEQ ID NO: 499335 - RNA, 60 nt, Homo Sapiens
ccagaauuucagauaaucuacaaugaagugacugaaaaauacuuggcugccauagcauaa

SEQ ID NO: 499336 - RNA, 61 nt, Homo Sapiens
aaagcuagaauuuauuuauuguuuuuaagacacugaaaagagcucaugucuguuuugcuuu

SEQ ID NO: 499337 - RNA, 61 nt, Homo Sapiens
gugauuacuccugaagugagcaaggggaauuacugaaaaagcaaagaaacuugugcuuuac

SEQ ID NO: 499338 - RNA, 61 nt, Homo Sapiens
cuauguagugaaauguauuuauuaaauaauaacugaaaagacacuggaggucauuacugcc

SEQ ID NO: 499339 - RNA, 61 nt, Homo Sapiens
gacauccucugaaaauuccaaaugcaaauauacugaaaauuaugcuucaaaagaucuaaga

SEQ ID NO: 499340 - RNA, 61 nt, Homo Sapiens
uauuaaagcuccaaauuuuagauuuugcagcacugaaaaucucucacaagucaaaaaugaa

SEQ ID NO: 499341 - RNA, 61 nt, Homo Sapiens
aaguuuaagcccaccaaugcauauacacauaacugaaaaccucaggaagagauuuaucugu

SEQ ID NO: 499342 - RNA, 61 nt, Homo Sapiens
gcauauugccccaagguuacagcaguggugaacugaaaaggaacaucuuugccaaaagcua

SEQ ID NO: 499343 - RNA, 61 nt, Homo Sapiens
auucauguguaaagcuuuuuaaguucggaaaacugaaaaagagaaaggaauucauaugggg

SEQ ID NO: 499344 - RNA, 61 nt, Homo Sapiens
gccuguccugcugguaacugcugaaaagcccacugaaaauuuuugucauggcaaccagcuu

SEQ ID NO: 499345 - RNA, 61 nt, Homo Sapiens
uguugguucauccagaagugacauaccuuagacugaaaaacaaaaauugaauucguuucug

SEQ ID NO: 499346 - RNA, 61 nt, Homo Sapiens
aauuccuuucagauugggguuauuaucuuauacugaaaaaaaguuuucuguauaugauaua

SEQ ID NO: 499347 - RNA, 61 nt, Homo Sapiens
cuuaaaucugagggaccaugcuuugaaauagacugaaaauuaagggucaccaccuaauuuu

SEQ ID NO: 499348 - RNA, 61 nt, Homo Sapiens
gaucccagaggagggaagaaaauuugcagugacugaaaacaguaaaaaaaaaaaaaaaaaa

SEQ ID NO: 499349 - RNA, 61 nt, Homo Sapiens
uuggcuguaaucacuccucgccgugucuggcacugaaaauaaggaaaaaaaaccuacuacu

SEQ ID NO: 499350 - RNA, 61 nt, Homo Sapiens
cuucuucccuccuccccccauuaauauguauacugaaaaaugugcauuugucugaggaauu

SEQ ID NO: 499351 - RNA, 61 nt, Homo Sapiens
auagguuuuggggcuuccauaucaucaaaagacugaaaaauuauaauuuuagaauuaaacu

SEQ ID NO: 499352 - RNA, 61 nt, Homo Sapiens
gaugugauacagaacaaaguguucguuuuugacugaaaauaguagaucagaaaucucaguu

SEQ ID NO: 499353 - RNA, 61 nt, Homo Sapiens
uaguuuacaauuuuuaaaaaguucuuaaaauacugaaaaugcaguugacacuuguguaugg

SEQ ID NO: 499354 - RNA, 61 nt, Homo Sapiens
cauuuuuaucauguaacauuguaaacagccuacugaaaaugaccuuggaauuggaauuacu

SEQ ID NO: 499355 - RNA, 61 nt, Homo Sapiens
acaguauugcuuuguaauagaaaucauuucaacugaaaagacaaagauuuacauugcugcc

SEQ ID NO: 499356 - RNA, 61 nt, Homo Sapiens
uguagcuuuuaugugauauguacacauuaucacugaaaaaaguuuuucugucauuguuaaa

SEQ ID NO: 499357 - RNA, 61 nt, Homo Sapiens
agaaaacaaaaaucaaaugcgaaacugacaaacugaaaauaaaaaaaauaaugguaguaaa

SEQ ID NO: 499358 - RNA, 61 nt, Homo Sapiens
caaaguuuaucuuggccuuaguacucugcagacugaaaagaccuuuucauuuuauguuuuu

SEQ ID NO: 499359 - RNA, 61 nt, Homo Sapiens
gagcagagaauauaacaugauucuuuagagaacugaaaagaguggauaacaaagauaucuu

SEQ ID NO: 499360 - RNA, 61 nt, Homo Sapiens
ugguguugguauccaacuauaacuucgaccuacugaaaagggcucuuagcgguuauccacg

SEQ ID NO: 499361 - RNA, 61 nt, Homo Sapiens
agucaggaaaacuacaggugcucuccuguuuacugaaaaggguuuccugcugacuacaacc

SEQ ID NO: 499362 - RNA, 61 nt, Homo Sapiens
cacauuuuucuacauacagccagagaaaacaacugaaaaacauuuuguuuaaauaguacca

SEQ ID NO: 499363 - RNA, 61 nt, Homo Sapiens
aaaagauuaaaaccauuaaaaagccuuggggacugaaaaaaacauuuguacugagugguac

SEQ ID NO: 499364 - RNA, 61 nt, Homo Sapiens
auuauuauuauaaaucaccauaaacauaaugacugaaaaaaaaauauuuuggucuagccac

SEQ ID NO: 499365 - RNA, 61 nt, Homo Sapiens
uuuuaaaauuauuugucuaugccauuuaaaaacugaaaauaugugccagcuaaaauugugu

SEQ ID NO: 499366 - RNA, 61 nt, Homo Sapiens
caguggcuuuucuacaguaccauuuggaacuacugaaaagaagugaaauauuguauaacac

SEQ ID NO: 499367 - RNA, 61 nt, Homo Sapiens
caacauuagcaaagagguggucaauuguguuacugaaaauguuccuaacaaugcaguauuc

SEQ ID NO: 499368 - RNA, 61 nt, Homo Sapiens
guaaaacaggcugcuuagauccacguaagucacugaaaacacagagauuagucuuagguuu

SEQ ID NO: 499369 - RNA, 61 nt, Homo Sapiens
gcaggcaaugugggacuuaaaaggcccaagcacugaaaauggaaccuggcgaaagcagagg

SEQ ID NO: 499370 - RNA, 61 nt, Homo Sapiens
aagacaguuaaucagcauuauugugagagggacugaaaagaaauucuccauuaugaggaau

SEQ ID NO: 499371 - RNA, 61 nt, Homo Sapiens
ucuuaguuauaauuagauugugaaucagccaacugaaaauccuuuuugcauauuucaaugu

SEQ ID NO: 499372 - RNA, 61 nt, Homo Sapiens
uucuaacaagucauagguuaauauuuaagacacugaaaaaucuaagugauauaaaucagau

SEQ ID NO: 499373 - RNA, 61 nt, Homo Sapiens
cagccuggccaacauggugaaacccuucucuacugaaaauacaaaaauuagccaggugugg

SEQ ID NO: 499374 - RNA, 61 nt, Homo Sapiens
guugaauaaagaaacagaaaaaauagaacauacugaaaauaaucuaaguuccaaccauaga

SEQ ID NO: 499375 - RNA, 61 nt, Homo Sapiens
auuuugagcuaauaauugcaaaaauuagaagacugaaaauggacccaugagaguauauuuu

SEQ ID NO: 499376 - RNA, 61 nt, Homo Sapiens
aagcuugauuucagugcuuauugugucuucaacugaaaaauacaaucuguggauuaugacu

SEQ ID NO: 499377 - RNA, 61 nt, Homo Sapiens
agccuagccaacaugacgaaaccccaucucuacugaaaauagaaaaaaaaaauuagccagg

SEQ ID NO: 499378 - RNA, 61 nt, Homo Sapiens
gcuucuacggccaugagacugaucccuggccacugaaaagcuuuccugacaauaaaaaugu

SEQ ID NO: 499379 - RNA, 61 nt, Homo Sapiens
acuggagaaaguuugucauccucauuuucaaacugaaaacuaaucaaauauagugccuauu

SEQ ID NO: 499380 - RNA, 61 nt, Homo Sapiens
gaguccugauacaucuaauagaaccauaguuacugaaaagguaaguuauccaggacuccaa

SEQ ID NO: 499381 - RNA, 61 nt, Homo Sapiens
gacguaguaaauuaaauagauauuuauugguacugaaaagaagaaauacagcagacgaaca

SEQ ID NO: 499382 - RNA, 61 nt, Homo Sapiens
aaguaaguuuauuuuugagguaguaacuaaaacugaaaacuguccuuuuauaggcaggcac

SEQ ID NO: 499383 - RNA, 61 nt, Homo Sapiens
agagccuuuaaaugauuucauucugcaaucaacugaaaacuguguagaauuacuguaauac

SEQ ID NO: 499384 - RNA, 61 nt, Homo Sapiens
aagagggaagaggugaggaaggaaagcugagacugaaaauccugguuugggggaggggacu

SEQ ID NO: 499385 - RNA, 61 nt, Homo Sapiens
uguuucacagguguuugcuuuacgguuucagacugaaaacaucagguccuaugaagaaaga

SEQ ID NO: 499386 - RNA, 61 nt, Homo Sapiens
aaacacuuuacuacaguugucuugguuauauacugaaaaucuuauuacuguucagcaucau

SEQ ID NO: 499387 - RNA, 61 nt, Homo Sapiens
ugucuugauguuucaguuauauguugcuuucacugaaaaagcauuaaaauuuguaauugaa

SEQ ID NO: 499388 - RNA, 61 nt, Homo Sapiens
cuggcuaaugcucuuguguauaccuguucucacugaaaaguaagugcuggugccagccugu

SEQ ID NO: 499389 - RNA, 61 nt, Homo Sapiens
gugaaauguacuaaauaaaaagggacugaauacugaaaacuaugacuauaaaauguucaug

SEQ ID NO: 499390 - RNA, 61 nt, Homo Sapiens
uguauuaaaaauaaaauuaaaaaugccccuuacugaaaaucaauagaaccaauuagguuga

SEQ ID NO: 499391 - RNA, 61 nt, Homo Sapiens
ucagccauggccaggcccccuaccugcaggaacugaaaacacauagagaaaugaagaugcu

SEQ ID NO: 499392 - RNA, 61 nt, Homo Sapiens
uuuucugagacuuagaguaauccauauccugacugaaaaccacccuugaggaccaggagcc

SEQ ID NO: 499393 - RNA, 61 nt, Homo Sapiens
caaaaauuagcugggcguggacuccaucucuacugaaaauaaucuuugccaacauggugaa

SEQ ID NO: 499394 - RNA, 61 nt, Homo Sapiens
cagaaaaguuagccaggcguacccagucucuacugaaaauaagccugaccaacauggagaa

SEQ ID NO: 499395 - RNA, 61 nt, Homo Sapiens
uaugguuucaugaaauuggagcucuguauaaacugaaaaagacaaaauaaguaaagcacuu

SEQ ID NO: 499396 - RNA, 61 nt, Homo Sapiens
ucauuuaaugauagacggaaaaugugugguuacugaaaacuguauaugauacagaauuuca

SEQ ID NO: 499397 - RNA, 61 nt, Homo Sapiens
agccuggccaucauggugaaacccugucucuacugaaaauacaaaaauuagccgggcgugg

SEQ ID NO: 499398 - RNA, 61 nt, Homo Sapiens
ugaguaaccaucaacacgauuaguuuacagaacugaaaaggaaucugagaucuguacugua

SEQ ID NO: 499399 - RNA, 61 nt, Homo Sapiens
uuucuuuuuuaugugacauggagcacaaagaacugaaaauauguuuugagggagcaugaca

SEQ ID NO: 499400 - RNA, 61 nt, Homo Sapiens
cauaguagguauauaugaguuuucacagaagacugaaaaauaaugcaugauauuuguuugu

SEQ ID NO: 499401 - RNA, 61 nt, Homo Sapiens
aagucauuuaacuucaguaaaccucgguaugacugaaaagggaguuuucuguauggccguc

SEQ ID NO: 499402 - RNA, 61 nt, Homo Sapiens
gauaaaacaccaugaaaauaaacuugaauaaacugaaaauggaccuuuuuuuuuuuaaugg

SEQ ID NO: 499403 - RNA, 61 nt, Homo Sapiens
caggcuuuguuugagguccuguauauacagcacugaaaagagagauaaagucccugccugc

SEQ ID NO: 499404 - RNA, 61 nt, Homo Sapiens
cacucauucaaaauauuuaauauguucccucacugaaaaauagauguaaggguuauuuaga

SEQ ID NO: 499405 - RNA, 61 nt, Homo Sapiens
auuaaauguuagucuuuagugaagggcuguaacugaaaauuuuuaucucaaagcuuucacu

SEQ ID NO: 499406 - RNA, 61 nt, Homo Sapiens
uccugugucuugauagcaugcucaugaggcaacugaaaaaacugccaagcccagguugccu

SEQ ID NO: 499407 - RNA, 61 nt, Homo Sapiens
uuguagugaugacuaccaaaagguaaccaacacugaaaacucugucuaguacuugucuuau

SEQ ID NO: 499408 - RNA, 61 nt, Homo Sapiens
aauuuaucaguaauuuuuaaauaaucagagaacugaaaaguagaauguguaucuguuggau

SEQ ID NO: 499409 - RNA, 61 nt, Homo Sapiens
caguggcaaggaaaagcacaauguucucuuuacugaaaagacugugcagggggcuggcugg

SEQ ID NO: 499410 - RNA, 61 nt, Homo Sapiens
uuuaauaaaauaaccuuuaaugaaaccuugaacugaaaauaccuucauagcuuuguuacaa

SEQ ID NO: 499411 - RNA, 54 nt, Homo Sapiens
auggagauuauuuuuauugggaagacugaaaaccuaaaaccuuuguaucuauaa

SEQ ID NO: 499412 - RNA, 61 nt, Homo Sapiens
acuagagggauuaguacaaaacacacaaccaacugaaaaaguuuaagugcuagggcugguc

SEQ ID NO: 499413 - RNA, 61 nt, Homo Sapiens
gucccagaaugaccccaucgugacaguggcaacugaaaacaaauauugcuaauauaauaga

SEQ ID NO: 499414 - RNA, 61 nt, Homo Sapiens
uaacaguauccccuucucauuuuuaaauuccacugaaaauuauaaggaguugguguaauca

SEQ ID NO: 499415 - RNA, 61 nt, Homo Sapiens
ugaaacgacacuguauugcucaugaguugcgacugaaaaugaguguccaaaccuaguuucc

SEQ ID NO: 499416 - RNA, 61 nt, Homo Sapiens
aaaaacaaaaaaacgaaagcagugccucaugacugaaaacauucagcacaacucauucuuc

SEQ ID NO: 499417 - RNA, 61 nt, Homo Sapiens
guagguuugggcagaagaauuaguuuuaaggacugaaaaugacuucagacuuuagccuguu

SEQ ID NO: 499418 - RNA, 61 nt, Homo Sapiens
gggacaacccccuuccuuauggggacauuagacugaaaacuacaugggucugucauagaau

SEQ ID NO: 499419 - RNA, 61 nt, Homo Sapiens
cuccaugggaccccaaagaagcagauggaaaacugaaaaagaaaaccccucaagugagcca

SEQ ID NO: 499420 - RNA, 61 nt, Homo Sapiens
aaauauaaaaauaaauauuguucugauuauuacugaaaagaugucagccauuucaaugucu

SEQ ID NO: 499421 - RNA, 61 nt, Homo Sapiens
uuugaccucacagugacccuucccaaucagcacugaaaauaccaucaggccuaaucucaua

SEQ ID NO: 499422 - RNA, 61 nt, Homo Sapiens
ucucauaccucugaccaacaggcuguucugcacugaaaagguucuucaucccuuuccaguu

SEQ ID NO: 499423 - RNA, 61 nt, Homo Sapiens
aaauggcucuuuuugcaauaaguagauacauacugaaaaaaucuaaacuuacaauguuuau

SEQ ID NO: 499424 - RNA, 61 nt, Homo Sapiens
guggaagauacacauguuugcauccuaagauacugaaaaaagggcaccuuugucacuugaa

SEQ ID NO: 499425 - RNA, 61 nt, Homo Sapiens
uccuuggcgaaucgauaaucauugcauagugacugaaaagccuaagugcaaaaaaaaaaaa

SEQ ID NO: 499426 - RNA, 61 nt, Homo Sapiens
cuuacuagaaaacuauuuucuaaauauuaacacugaaaauguuuuguuagcuuuuccuucu

SEQ ID NO: 499427 - RNA, 61 nt, Homo Sapiens
cgggacuucccgaacuaauuuuuuuaaggauacugaaaaaugagagagaguggucgaaugc

SEQ ID NO: 499428 - RNA, 61 nt, Homo Sapiens
gaggcccagacaggcucacucaagcucuuuaacugaaaagcaacaagccacuccaggacaa

SEQ ID NO: 499429 - RNA, 61 nt, Homo Sapiens
uuuagccuaaguauaagaguccuacagauggacugaaaaaaaucagucugagaguauuagu

SEQ ID NO: 499430 - RNA, 61 nt, Homo Sapiens
cuacaugcuggcaaaggugaaggaucagaggacugaaaaaugauucugcaacucucuuaaa

SEQ ID NO: 499431 - RNA, 61 nt, Homo Sapiens
ccuccagacccacacucacagucugugaaaaacugaaaauccccuggugggcacucccugg

SEQ ID NO: 499432 - RNA, 61 nt, Homo Sapiens
gccuuuuucuuugguugcuccuguggaaaauacugaaaagauuacuuuguuuuauuuuguu

SEQ ID NO: 499433 - RNA, 61 nt, Homo Sapiens
guguuaaauaucagcuccuaauaagauguggacugaaaacacuaucacaacacuaugagaa

SEQ ID NO: 499434 - RNA, 61 nt, Homo Sapiens
gccugccccucccccagcuguuuuuaaugaaacugaaaaaauagacuugaucccggcagga

SEQ ID NO: 499435 - RNA, 61 nt, Homo Sapiens
uugaagggcagcaggcccaagugcugcucugacugaaaacugaguuaacaagaugaaaucu

SEQ ID NO: 499436 - RNA, 61 nt, Homo Sapiens
acaugccuucuauauggaacauggcagaaagacugaaaaauaacaguaauuaauuguguaa

SEQ ID NO: 499437 - RNA, 61 nt, Homo Sapiens
aaaugaaaacuguuugugaucuuccguauucacugaaaaauaaaugcuuguuuaguaucaa

SEQ ID NO: 499438 - RNA, 61 nt, Homo Sapiens
ugcacaaggaaggaucuucagauauucaugcacugaaaaaugcuguuaucuuuuguuuuua

SEQ ID NO: 499439 - RNA, 61 nt, Homo Sapiens
ccacagcauuuguacuguuccuuuuuaauauacugaaaauauaaaaggaaggguguguguu

SEQ ID NO: 499440 - RNA, 61 nt, Homo Sapiens
auccuggcuaacacggugaaaccccgucucuacugaaaauacaaaaaauuagccaggcaug

SEQ ID NO: 499441 - RNA, 61 nt, Homo Sapiens
auccuggcuaacauggugaaaccccgucucuacugaaaauacaaaaaauuagccgggugug

SEQ ID NO: 499442 - RNA, 61 nt, Homo Sapiens
uagaauacuucaacgugcauaaguuuaagugacugaaaauguguagccaucugagagagga

SEQ ID NO: 499443 - RNA, 61 nt, Homo Sapiens
uaaaaaguuaaaaaaaauaacguugccaagaacugaaaacaauaauguugugguuuguugc

SEQ ID NO: 499444 - RNA, 61 nt, Homo Sapiens
auguauauguuguaaauauucaauguaaagaacugaaaacaaaaaguuugucuuugagauu

SEQ ID NO: 499445 - RNA, 61 nt, Homo Sapiens
acuaaaccgguggaaucugacuggcuccuccacugaaaacuccaaaugagcccaaauucca

SEQ ID NO: 499446 - RNA, 61 nt, Homo Sapiens
uguaugauucaaauuuguuuaauuaaaugauacugaaaauuauguccccaaaguauuaaag

SEQ ID NO: 499447 - RNA, 61 nt, Homo Sapiens
uguuagacaagccacaaagucccaacucuuaacugaaaaugagggaacgguagauuuauuc

SEQ ID NO: 499448 - RNA, 61 nt, Homo Sapiens
aaaauaaaaauauguauucuccaucucaaaaacugaaaauacugggugacagagugagacu

SEQ ID NO: 499449 - RNA, 61 nt, Homo Sapiens
ucuacaacaaucuucaggaauccuugaaaacacugaaaaccuuuuuaagcugaaaagggga

SEQ ID NO: 499450 - RNA, 61 nt, Homo Sapiens
uuuggcagucuuguaugcaacgaauauuuugacugaaaaauuuucuuuuuaaaguuuuaaa

SEQ ID NO: 499451 - RNA, 61 nt, Homo Sapiens
acggcagguggccuaaggcuuugcaggggauacugaaaaaucucauuuucaauuucuaaau

SEQ ID NO: 499452 - RNA, 61 nt, Homo Sapiens
ugagaacuauuuaccuaucagggggggaugcacugaaaaucgugggaugaaacauguuuug

SEQ ID NO: 499453 - RNA, 61 nt, Homo Sapiens
aucacugaauggaauguucacuuauuggaaaacugaaaagauccccucccuucaggaauaa

SEQ ID NO: 499454 - RNA, 61 nt, Homo Sapiens
gacucucuuugugacaaagaaacauauggaaacugaaaaugcuugagaaaauuacuucaua

SEQ ID NO: 499455 - RNA, 61 nt, Homo Sapiens
ugacuucauggaauggacauccuguauaagcacugaaaaacaacaacacaauaacacuaaa

SEQ ID NO: 499456 - RNA, 61 nt, Homo Sapiens
aguguaccuguguacauaacucuguaaaaacacugaaaaauuauacuaacuuauuuauguu

SEQ ID NO: 499457 - RNA, 61 nt, Homo Sapiens
augaaucugcucauguggagacuggcuauaaacugaaaaguguauuccaaauugcagaaca

SEQ ID NO: 499458 - RNA, 61 nt, Homo Sapiens
acuacagaacagggcuaaauuagccaccaccacugaaaacucagccgaauuuuuuuauacc

SEQ ID NO: 499459 - RNA, 61 nt, Homo Sapiens
caccacccccccgcccccccgaagccaugucacugaaaaggccugggggggaugguauaug

SEQ ID NO: 499460 - RNA, 61 nt, Homo Sapiens
cucuuaagucccaguauaccucauuuuucauacugaaaaaaaaagcuuguggccaauggaa

SEQ ID NO: 499461 - RNA, 61 nt, Homo Sapiens
caguucucaugagaacuugguaguaagcuaaacugaaaauaaggugggcuucacuggagaa

SEQ ID NO: 499462 - RNA, 61 nt, Homo Sapiens
ugcgugggaccaugccugaacuccccgaauaacugaaaaauggcugaauauuuuuaugguu

SEQ ID NO: 499463 - RNA, 61 nt, Homo Sapiens
aacaguucucauuacaaaggaccaauucagaacugaaaagcuaugcauaggacaaggaaga

SEQ ID NO: 499464 - RNA, 61 nt, Homo Sapiens
agccuggccaacauggugaaacccuguagcuacugaaaauacaaaaauaagccaggcgugg

SEQ ID NO: 499465 - RNA, 61 nt, Homo Sapiens
caguguagggaagacauuuguaauaaugaaaacugaaaauggaguaauugugaguaacuca

SEQ ID NO: 499466 - RNA, 61 nt, Homo Sapiens
cuguuaacguauuugccaguuacgaaguuccacugaaaauuuuccuauuaauucuuaagua

SEQ ID NO: 499467 - RNA, 61 nt, Homo Sapiens
ccagguuuuuagaucccacugagcccagcugacugaaaacaaggacagucagggugaaacu

SEQ ID NO: 499468 - RNA, 61 nt, Homo Sapiens
gaaauuauauagcagauucuuuguugggaagacugaaaaaaauaaagauagguauaggaua

SEQ ID NO: 499469 - RNA, 61 nt, Homo Sapiens
gugucugccagaguuuaguucuuuauaccuuacugaaaaaugccucguggucuucgcagag

SEQ ID NO: 499470 - RNA, 61 nt, Homo Sapiens
cguguccuuuucucuaaaugguuuucuguggacugaaaaaucugggacugcucuggguuag

SEQ ID NO: 499471 - RNA, 61 nt, Homo Sapiens
agaaaauacauuagcaagcuuuuguauguaaacugaaaauaugugaagcaaacaaaaaaaa

SEQ ID NO: 499472 - RNA, 61 nt, Homo Sapiens
uuuaaacugaauuuuuugacuuuuuauuaaaacugaaaaaaauuugcuucuaggcccauua

SEQ ID NO: 499473 - RNA, 61 nt, Homo Sapiens
uuugagugugaaucuacugaaaauguaugacacugaaaagaucauaacuuuauggcuuaau

SEQ ID NO: 499474 - RNA, 61 nt, Homo Sapiens
uuaaaagugagagcugaaaauaaggaaaauaacugaaaagacuuugguggcuaaguuuuac

SEQ ID NO: 499475 - RNA, 61 nt, Homo Sapiens
cggcucauguuaaugaguuacagccuggggcacugaaaauacuucucucagacugccuggc

SEQ ID NO: 499476 - RNA, 61 nt, Homo Sapiens
auacauaacugugauugaaaauguaccauuaacugaaaauccugcaaagugcaauuucaac

SEQ ID NO: 499477 - RNA, 61 nt, Homo Sapiens
aggggucuggguacuucuugacccucauucuacugaaaaggccugaagaaccagucccccc

SEQ ID NO: 499478 - RNA, 61 nt, Homo Sapiens
uccagaugagcucuucuuuccagguugggauacugaaaauuccacugggucuaccaguaug

SEQ ID NO: 499479 - RNA, 61 nt, Homo Sapiens
uaugaaaccaaaaguacaaauacugaaauuaacugaaaaaaccuuuuauauauuauguuuu

SEQ ID NO: 499480 - RNA, 61 nt, Homo Sapiens
ugcgauucuucuuaguuuucgacaucacccuacugaaaacugcaccagaucaaguaguuug

SEQ ID NO: 499481 - RNA, 61 nt, Homo Sapiens
uguguguugagcagcucugauuaaccaacccacugaaaacugcccacugaccaggaauuau

SEQ ID NO: 499482 - RNA, 61 nt, Homo Sapiens
aaucacuuccuugaaaauuuuccaauggaauacugaaaagaacacacauucacccuaagga

SEQ ID NO: 499483 - RNA, 61 nt, Homo Sapiens
gguaucaagaaaguccacuguuauccauucaacugaaaauuuagcucucugugaauguguu

SEQ ID NO: 499484 - RNA, 61 nt, Homo Sapiens
ccauccauuugggaaagaagaggggaaggguacugaaaacacuggagccaaagaugacaca

SEQ ID NO: 499485 - RNA, 61 nt, Homo Sapiens
auaaaggaagagacccaucuaagauuaugugacugaaaaacaugugauaacuauggaaauc

SEQ ID NO: 499486 - RNA, 61 nt, Homo Sapiens
gauuggcacugucucacuugugugacaacagacugaaaaagcugguuaccucuuugcuggc

SEQ ID NO: 499487 - RNA, 61 nt, Homo Sapiens
uauugcuuuuuauacuacugacuguuuacagacugaaaaauaaaggagaaaaaucacgacu

SEQ ID NO: 499488 - RNA, 61 nt, Homo Sapiens
ggucuuucagucuuggcauuuuggaaaggucacugaaaaugugucucuugguccacaguau

SEQ ID NO: 499489 - RNA, 61 nt, Homo Sapiens
gccuccuccaucucucaccuacccacacacaacugaaaauucagccaaagccuuaaaucaa

SEQ ID NO: 499490 - RNA, 61 nt, Homo Sapiens
gcgaggagucuuucuagaacacuguuuaaaaacugaaaacacugggggagauggagauuug

SEQ ID NO: 499491 - RNA, 61 nt, Homo Sapiens
aaaagagaaaguucauccucgaggaggugaaacugaaaauaaaaauaagaaagcugagacu

SEQ ID NO: 499492 - RNA, 61 nt, Homo Sapiens
acggagcugaccaucuuuaccugguccuggaacugaaaaacuguagcuugugugaaaauga

SEQ ID NO: 499493 - RNA, 61 nt, Homo Sapiens
agcccaaccaacauggugaaacccugucuccacugaaaauacauaaaauuagccgggugca

SEQ ID NO: 499494 - RNA, 61 nt, Homo Sapiens
ugagaaaggggcaggcaaaaugaagcuggccacugaaaacuguaagauggucaaaagcuga

SEQ ID NO: 499495 - RNA, 61 nt, Homo Sapiens
agccuggccaacauggugaaaccccuucucuacugaaaauacaaaaauuagccagacguga

SEQ ID NO: 499496 - RNA, 61 nt, Homo Sapiens
agccuggccaacauggugaaaccccaucucuacugaaaauacaaaaauuaggcauaguggu

SEQ ID NO: 499497 - RNA, 61 nt, Homo Sapiens
uuaaagcugcuugcaaaguguuggugauuuuacugaaaacuuuugagaucuucauuuuaca

SEQ ID NO: 499498 - RNA, 61 nt, Homo Sapiens
acacuuuaaaaauaugucuuuuuucaaucuaacugaaaaccuucuuaacuucuaauauauu

SEQ ID NO: 499499 - RNA, 61 nt, Homo Sapiens
auuuauauaacugcauuuaagcaguaccaagacugaaaaaaaagguaauaaaugaaauguu

SEQ ID NO: 499500 - RNA, 61 nt, Homo Sapiens
uuaauuauaaguguuauggcuaaaguuauuuacugaaaauuucaguaaaaugugugaaugu

SEQ ID NO: 499501 - RNA, 61 nt, Homo Sapiens
uuucucuguaccucuaagaagaaagaaucuaacugaaaauaccaaaaaaaaaaaaaaaaaa

SEQ ID NO: 499502 - RNA, 61 nt, Homo Sapiens
uauucagaaauggaaaauuucaauauauaauacugaaaaagcuaacuuauuagacagcaag

SEQ ID NO: 499503 - RNA, 61 nt, Homo Sapiens
ucacauucuauuuuggguaugauggccuuacacugaaaauguuagguugucuccaggccau

SEQ ID NO: 499504 - RNA, 61 nt, Homo Sapiens
uagccagaguuagguugucuuaguaagaugcacugaaaacugcccauacuuuuggcuccuc

SEQ ID NO: 499505 - RNA, 61 nt, Homo Sapiens
ccaaaaauuuagaugccuuauaaaauuauauacugaaaacaaaaagaauaaaaaguagcag

SEQ ID NO: 499506 - RNA, 60 nt, Homo Sapiens
acuugguguuuuguguucaagugaauaaacuacugaaaacauaagcagagaaaaaaaaau

SEQ ID NO: 499507 - RNA, 61 nt, Homo Sapiens
cuccugaguacucccuuggcauguauuuaggacugaaaauauucuuguuuccugauaauaa

SEQ ID NO: 499508 - RNA, 61 nt, Homo Sapiens
auauccaguuagaaaauuguggauuagagugacugaaaaacggaaaguaagaaaguuucau

SEQ ID NO: 499509 - RNA, 61 nt, Homo Sapiens
uuuuugucauauucuuguauugccuguuuccacugaaaacaagugcgauuucacagucuac

SEQ ID NO: 499510 - RNA, 61 nt, Homo Sapiens
gucucauaggaguccucuugauauuucauauacugaaaaguaucauucaaggauuauagua

SEQ ID NO: 499511 - RNA, 61 nt, Homo Sapiens
auugcaagcauugacuauaaugaugagacaaacugaaaauuaugaauaggcucugcuaacg

SEQ ID NO: 499512 - RNA, 61 nt, Homo Sapiens
accauucuacagaguuguacucaagacagauacugaaaaaaucuaauaccuucccuuguau

SEQ ID NO: 499513 - RNA, 61 nt, Homo Sapiens
gacuauguugcaagucuguuucaucuaguaaacugaaaauuauugcuuaaucaaacugccg

SEQ ID NO: 499514 - RNA, 61 nt, Homo Sapiens
ccauguaugaagccaaauauuaggcuuaaaaacugaaaaaucugguucauucuucagauau

SEQ ID NO: 499515 - RNA, 61 nt, Homo Sapiens
uccucauggccucuaaauuaguauguagaacacugaaaaguucuuaacauuuuuguguaau

SEQ ID NO: 499516 - RNA, 61 nt, Homo Sapiens
caaaccgaagacucuuugaagacaucguaacacugaaaaguacacuuucuacuaaagaugc

SEQ ID NO: 499517 - RNA, 61 nt, Homo Sapiens
aucuuugaaaaaauuacccucuagcucuaacacugaaaauaauaauaaauuguagaucucu

SEQ ID NO: 499518 - RNA, 61 nt, Homo Sapiens
acaaaauaaauugugaaaggaaguguaguugacugaaaacuacaguuguaauaagucuucc

SEQ ID NO: 499519 - RNA, 61 nt, Homo Sapiens
caagccugaugguuugucuuauuucauucauacugaaaauucuuugcauauuuuuuuucug

SEQ ID NO: 499520 - RNA, 61 nt, Homo Sapiens
gcagguaucacuuugauccuaugugggagcgacugaaaauagaaugagcuugguuaagcac

SEQ ID NO: 499521 - RNA, 61 nt, Homo Sapiens
gaauugagauggccuuuuuuucacauuguagacugaaaagagacuuaaugguaugaugugu

SEQ ID NO: 499522 - RNA, 61 nt, Homo Sapiens
aauguagcgggauuuuuaaggaaucagagagacugaaaaaaaaaaaaaaauuaaugauggu

SEQ ID NO: 499523 - RNA, 61 nt, Homo Sapiens
cccacacacccuacaaguugaucaugcaggaacugaaaaccagucuucucccuguccccuc

SEQ ID NO: 499524 - RNA, 61 nt, Homo Sapiens
uuuguuuaguauaaauugucauagcugguuuacugaaaacaaacacauuuaaaauugguuu

SEQ ID NO: 499525 - RNA, 61 nt, Homo Sapiens
uguuugcuuaaaguuaaugaaaaaccaauuuacugaaaacucaccuaaagcuagaucucuu

SEQ ID NO: 499526 - RNA, 61 nt, Homo Sapiens
cauuguaauacuacaaguauauaaauacuggacugaaaaaagcugcagccgagugaccucc

SEQ ID NO: 499527 - RNA, 61 nt, Homo Sapiens
cuuuucagggcugugugaauugguaguuggcacugaaaaaaauucacguuucaugaccaac

SEQ ID NO: 499528 - RNA, 61 nt, Homo Sapiens
auguuuucuuacuguuuaauaggcgcuaugaacugaaaaauuaauguauauguuucucuuc

SEQ ID NO: 499529 - RNA, 61 nt, Homo Sapiens
aucuggaaauuccuaauguccuacaaaugcuacugaaaaaaauuuguuaccaaaagugguu

SEQ ID NO: 499530 - RNA, 61 nt, Homo Sapiens
gaccaaggccugugcacaggaggucccccauacugaaaacugcugauguacaauaaccuug

SEQ ID NO: 499531 - RNA, 61 nt, Homo Sapiens
caggggaugaguuccaucaguauucucuuuuacugaaaaagguggggaucuugcaaauuuc

SEQ ID NO: 499532 - RNA, 61 nt, Homo Sapiens
gccguugcaaucugcucaaaccuaacaccaaacugaaaacauaaauacugaccacuccuau

SEQ ID NO: 499533 - RNA, 61 nt, Homo Sapiens
ucaacugcuguuauuagaagaaaaguacuguacugaaaauucagaaaaaaaaucucaaccu

SEQ ID NO: 499534 - RNA, 61 nt, Homo Sapiens
cagccuggccaacaugugaaaccccgucuccacugaaaauagaaaaauuagcugggcaugg

SEQ ID NO: 499535 - RNA, 61 nt, Homo Sapiens
uuuuuuaguaaucaagaaaggcuggaaaacuacugaaaaacugaucaagcuggacuugugc

SEQ ID NO: 499536 - RNA, 61 nt, Homo Sapiens
augauuuauauaucacuuaguguguagagggacugaaaauauuuauuuuguuauaaauaau

SEQ ID NO: 499537 - RNA, 61 nt, Homo Sapiens
acauuucuuaaaacacaugauaccagcagcaacugaaaaugaaugccgaauuugguacaca

SEQ ID NO: 499538 - RNA, 61 nt, Homo Sapiens
uuaacuuuugaaaugugugagaguguuacuuacugaaaacugaaaggauaugacaugcugg

SEQ ID NO: 499539 - RNA, 61 nt, Homo Sapiens
ugggauuguaggcaaacccaccuguggcaucacugaaaauaaauuugaucauaccuaagag

SEQ ID NO: 499540 - RNA, 61 nt, Homo Sapiens
ccuuuuuugucacuuuuauccuuuuuuuaaaacugaaaauauuuuucucuugcuauuuaua

SEQ ID NO: 499541 - RNA, 61 nt, Homo Sapiens
uuaaaauaagaaaaggagcacuuuaauuacaacugaaaaaucagauuguuuugcaguccuu

SEQ ID NO: 499542 - RNA, 61 nt, Homo Sapiens
ugcucuacaucucguauggaacauuucaaucacugaaaaugagugacacguuuggccagug

SEQ ID NO: 499543 - RNA, 61 nt, Homo Sapiens
aacuuuuaccaacauggcuaguuacccauguacugaaaauguaaugggaaagggccugggu

SEQ ID NO: 499544 - RNA, 61 nt, Homo Sapiens
uauguggccagacacagugguguugaauugaacugaaaauuaaugaaacccaguagauguu

SEQ ID NO: 499545 - RNA, 61 nt, Homo Sapiens
cccugcauuuaaaaauguuugaacucuuuuuacugaaaauguggggacagaagguuuucau

SEQ ID NO: 499546 - RNA, 61 nt, Homo Sapiens
cauuuuuaaagagaaaguacuccagugaguuacugaaaauacgaaauaagaacccauuauu

SEQ ID NO: 499547 - RNA, 61 nt, Homo Sapiens
cuggguuggggacagggaguccauggaggacacugaaaagggagcuauucugguaccuucc

SEQ ID NO: 499548 - RNA, 61 nt, Homo Sapiens
accuucguuuucaagguucuauacaagcuccacugaaaaccauaaauaccuucuauuuuua

SEQ ID NO: 499549 - RNA, 61 nt, Homo Sapiens
aggcccuguugccuuuuaagucaucaucgccacugaaaaccucccugacugucauagagaa

SEQ ID NO: 499550 - RNA, 61 nt, Homo Sapiens
cacgcauuuuguaauccaaacaaccauaugaacugaaaaaaaucuuucauaagggcuguug

SEQ ID NO: 499551 - RNA, 61 nt, Homo Sapiens
uaauaaaauugcaaguuaagaagguaagaguacugaaaaauauuuucuuaguaguauauaa

SEQ ID NO: 499552 - RNA, 61 nt, Homo Sapiens
aggugcagaggcagcagaggauuggcauaaaacugaaaaggaguucugucugcaugagaaa

SEQ ID NO: 499553 - RNA, 61 nt, Homo Sapiens
auacugucagaaguccagguauacugauaacacugaaaauucuauuagcaaccuucugggu

SEQ ID NO: 499554 - RNA, 61 nt, Homo Sapiens
gccugaccaaacauggcgaaaccccaucuguacugaaaauacaaaaauuaggcaugguggu

SEQ ID NO: 499555 - RNA, 61 nt, Homo Sapiens
gaaucagccagcaauauuuuaguugcaaaucacugaaaacccaacucaaagugacuuaagu

SEQ ID NO: 499556 - RNA, 61 nt, Homo Sapiens
caucaugaaggcagaggcaugcacauuccucacugaaaaagaaaacacacacccacccaca

SEQ ID NO: 499557 - RNA, 61 nt, Homo Sapiens
ccuucccccugacccugacuccuugaacgucacugaaaacggcagcuauugcaaggagugg

SEQ ID NO: 499558 - RNA, 61 nt, Homo Sapiens
uucaagccuuacacaauagcagagaauauaaacugaaaaaauccauacaaauauuaaaaau

SEQ ID NO: 499559 - RNA, 61 nt, Homo Sapiens
ggguucagaaaaggcaaacucaugaaaugccacugaaaagaacuuucaacacagcauacuu

SEQ ID NO: 499560 - RNA, 61 nt, Homo Sapiens
ugagaagucaagauccucccuggaggacaggacugaaaaccuugccaagcuguacacaguu

SEQ ID NO: 499561 - RNA, 61 nt, Homo Sapiens
ccuuuucucaucuuaccccuuuaugccaccuacugaaaagaaaaacaaauagcuagguuug

SEQ ID NO: 499562 - RNA, 61 nt, Homo Sapiens
gauggaggaaugugggcaguuugacuucagcacugaaaaccucuccaccugggccaggguu

SEQ ID NO: 499563 - RNA, 61 nt, Homo Sapiens
cuaucagggcaaaaucucacuggauuucuccacugaaaaccuacuugagguuucuggucug

SEQ ID NO: 499564 - RNA, 61 nt, Homo Sapiens
gaguacagcgggagaaacacaaaauaguauaacugaaaacauuaacauucagacacacucc

SEQ ID NO: 499565 - RNA, 61 nt, Homo Sapiens
uuuuuuaauguuaaauguguaacucaguauuacugaaaagguacccacauuuugaauagua

SEQ ID NO: 499566 - RNA, 61 nt, Homo Sapiens
agccuggccaacaugaugaaauguugucucuacugaaaaugcaaaaauuagccagguauag

SEQ ID NO: 499567 - RNA, 61 nt, Homo Sapiens
caggcaucuagguucuuuuuggaccuuuuguacugaaaauccuuuucccuuucauguucuu

SEQ ID NO: 499568 - RNA, 61 nt, Homo Sapiens
gacuggcagagucccgagaacgccuuugugaacugaaaagaugcacccagcgcuccauaga

SEQ ID NO: 499569 - RNA, 61 nt, Homo Sapiens
gagagcuauguaacagauacuucagaaauggacugaaaaugaaaggcuaugcgauaugaau

SEQ ID NO: 499570 - RNA, 61 nt, Homo Sapiens
uaacaccgacugcccgccccaacacugacgaacugaaaagcggggauuucguguaaaugug

SEQ ID NO: 499571 - RNA, 61 nt, Homo Sapiens
agcagcuucucuauccaggauugugucauuaacugaaaagucauaugaugcaaaaaagguu

SEQ ID NO: 499572 - RNA, 61 nt, Homo Sapiens
accuuccaaauuugccaagaaacaaaaugcaacugaaaaauuuaccaaaauacuaaaaccc

SEQ ID NO: 499573 - RNA, 61 nt, Homo Sapiens
caacuggcuacaaagaaggaaauaaagguaaacugaaaagaaucaucaggucuuaaaaaaa

SEQ ID NO: 499574 - RNA, 61 nt, Homo Sapiens
caacuccaggagcuauggcaucaaugaagucacugaaaaucccauagaaacguuuuaauuu

SEQ ID NO: 499575 - RNA, 61 nt, Homo Sapiens
uauauguauauacacccaagaacaguaaaccacugaaaaaaaauauauuuaaaaauaaguc

SEQ ID NO: 499576 - RNA, 61 nt, Homo Sapiens
aaccaacaaaaaugaguuguaaaaauaaaacacugaaaagaaacuuaaauuguauauuuug

SEQ ID NO: 499577 - RNA, 61 nt, Homo Sapiens
auuauuuuguaacuaagauucaagaaagacuacugaaaagugcugguuuuuaaaugugcau

SEQ ID NO: 499578 - RNA, 61 nt, Homo Sapiens
aaaauuuuaaaaaaggcuguaaauuuaauguacugaaaauauuuagaauguuuuuaugagu

SEQ ID NO: 499579 - RNA, 61 nt, Homo Sapiens
cauuugaggucuagaucuaggcacuguggacacugaaaaacaguugggaaaucuuucgagc

SEQ ID NO: 499580 - RNA, 61 nt, Homo Sapiens
guagucugggacugggcauuuaucuucucugacugaaaaucucuccuuggucuuaaggaaa

SEQ ID NO: 499581 - RNA, 61 nt, Homo Sapiens
cacaagucucaagccucagugcuaaaguacuacugaaaaggaacuaggaaguuuggccaau

SEQ ID NO: 499582 - RNA, 61 nt, Homo Sapiens
augacccagccaucuacaagaucugaauucuacugaaaauaucuagaaauguggaagagac

SEQ ID NO: 499583 - RNA, 61 nt, Homo Sapiens
uuuuaauucuucccuuggauuaauauuuucuacugaaaagaaaugaaaucucaguuccacu

SEQ ID NO: 499584 - RNA, 61 nt, Homo Sapiens
uuuuaaguaaccacucaaaacuuuucauuucacugaaaaaauaugaaaaaccaugacaaua

SEQ ID NO: 499585 - RNA, 61 nt, Homo Sapiens
aaacuccaaagcuuugaacauucaugacugaacugaaaacaagccaugacuugagaaacaa

SEQ ID NO: 499586 - RNA, 61 nt, Homo Sapiens
cuuggacuaguguaacuccuucaugcaauaaacugaaaagagccaugcugucuagucuuga

SEQ ID NO: 499587 - RNA, 61 nt, Homo Sapiens
accagucaccagugcgauucuggauaaagccacugaaaauucgaaccaggaaauggaaccc

SEQ ID NO: 499588 - RNA, 61 nt, Homo Sapiens
uuucagaacauguguuaauaguauauaugccacugaaaacuuagguccuguaucauacuuu

SEQ ID NO: 499589 - RNA, 61 nt, Homo Sapiens
guaucauccgggcuccuuccgggcagaaacaacugaaaaugcacuucagacccacuuauuu

SEQ ID NO: 499590 - RNA, 61 nt, Homo Sapiens
cugaucauuaucuccuucucuuugagaccugacugaaaaaauuaggugugcacaccuguaa

SEQ ID NO: 499591 - RNA, 61 nt, Homo Sapiens
agggcccugugguuggacuucaccucucagcacugaaaacccaaaacccagcuggccuuaa

SEQ ID NO: 499592 - RNA, 61 nt, Homo Sapiens
cauucccauacauugcgugugcaaagagacuacugaaaaaaaaaaauaagacccaauauug

SEQ ID NO: 499593 - RNA, 61 nt, Homo Sapiens
uccccaaacaauagcaaaucuaauucaacuuacugaaaauuaacuaaaaauagaugguucu

SEQ ID NO: 499594 - RNA, 61 nt, Homo Sapiens
cuccuccccaauuuggggggcuggggguuggacugaaaaccaaucucuggccucaccccug

SEQ ID NO: 499595 - RNA, 61 nt, Homo Sapiens
auuguucagggggaguugggaaaaauauaauacugaaaaggaauaauaacauaauaauaau

SEQ ID NO: 499596 - RNA, 61 nt, Homo Sapiens
ucgcuuuuauaguaggaagguucagaaaugaacugaaaauuauuuauugaccaauuuauuu

SEQ ID NO: 499597 - RNA, 61 nt, Homo Sapiens
acagugacauguuugaaaagguguccucccaacugaaaacaccagaaaaaugugcucugca

SEQ ID NO: 499598 - RNA, 61 nt, Homo Sapiens
uuuaaggugggaggguggcacuucuuuugauacugaaaacuacucggguggccugcgcuag

SEQ ID NO: 499599 - RNA, 61 nt, Homo Sapiens
ucuccucauguucugcuuucuugucacagggacugaaaaccacgagcuuguucuuuguucu

SEQ ID NO: 499600 - RNA, 59 nt, Homo Sapiens
uugaauaugauucuuauucuauucuauuggcacugaaaaauguaccaaaauaaaccucu

SEQ ID NO: 499601 - RNA, 61 nt, Homo Sapiens
uaauuauaggagcauuuguuuaagccauguaacugaaaaucgaaggcaagccuccccaacu

SEQ ID NO: 499602 - RNA, 61 nt, Homo Sapiens
aaugugaaacuaggaaauaacucucuccuagacugaaaaugcagaguuguacagcagaagc

SEQ ID NO: 499603 - RNA, 61 nt, Homo Sapiens
uacuaccuauaggaaagucugguuuuucaacacugaaaaaaagggagaaaggagaaauuuu

SEQ ID NO: 499604 - RNA, 61 nt, Homo Sapiens
gguaccgaauagguuguguguugggugggccacugaaaagggucgauggcaggaggggguu

SEQ ID NO: 499605 - RNA, 61 nt, Homo Sapiens
gcuggguaagcaagucaaggcccguguagcuacugaaaaugcgcccaguguucugugacca

SEQ ID NO: 499606 - RNA, 61 nt, Homo Sapiens
uuuuuuaauuugagaauuuuuauuucuuuugacugaaaacacauuagaaccuaugaguaaa

SEQ ID NO: 499607 - RNA, 61 nt, Homo Sapiens
aaaagcauggaaaggaagagaacugauuccuacugaaaauucaaauucuauuaccauucua

SEQ ID NO: 499608 - RNA, 61 nt, Homo Sapiens
gacuacugcucacaaacgucgcaaagcagaaacugaaaacugguagguacacuuuccuacc

SEQ ID NO: 499609 - RNA, 61 nt, Homo Sapiens
aaacaaaugugcccaccccacuuuccgcuuaacugaaaagcuuaaaauaaauuucugaauu

SEQ ID NO: 499610 - RNA, 61 nt, Homo Sapiens
auucuucagaggcagggcuaagacuuucaagacugaaaagagacuagcauaaggagacuua

SEQ ID NO: 499611 - RNA, 61 nt, Homo Sapiens
uuuaucugcugcuuuuuuuaaauaaaauuugacugaaaauguuuaauuggcauuuuuuaau

SEQ ID NO: 499612 - RNA, 61 nt, Homo Sapiens
acucacuuuuauauacaagaaaaaccuuuccacugaaaaaucccucugauuuaaaaguaac

SEQ ID NO: 499613 - RNA, 61 nt, Homo Sapiens
gaagagagaggaagaagucaaaccauaugaaacugaaaaaauaugacguacgaaauggaca

SEQ ID NO: 499614 - RNA, 61 nt, Homo Sapiens
guauuuccauauugaagcagcuugaguuucuacugaaaaugagcccgaauuauuucacuau

SEQ ID NO: 499615 - RNA, 61 nt, Homo Sapiens
aauugacagcuaguguuuuugaaaaccaauuacugaaaaaaauugaaaaaaaaaaagcacu

SEQ ID NO: 499616 - RNA, 61 nt, Homo Sapiens
aauuacugaaaaaaaauugaaaaaaaaaagcacugaaaacccaccuucucaucagauugaa

SEQ ID NO: 499617 - RNA, 61 nt, Homo Sapiens
cuuaauauacaucuuuaaucauauguaugguacugaaaaauuuauaguaggacuucuuugc

SEQ ID NO: 499618 - RNA, 61 nt, Homo Sapiens
aaugcaaggacuauggucucguucauaguggacugaaaacuuuuacaugcagcagauaauu

SEQ ID NO: 499619 - RNA, 61 nt, Homo Sapiens
ugaccuucaauggauugagguccuuuaaaagacugaaaagcaaggagacagaaugcuuugu

SEQ ID NO: 499620 - RNA, 61 nt, Homo Sapiens
uguauaaaaucuagcaauucuuuacauuugaacugaaaauaguaucauuaaaaugguuaag

SEQ ID NO: 499621 - RNA, 61 nt, Homo Sapiens
aaaguguuaauuuuaccuugaaauagcaauaacugaaaaugaaagugguaauccucuucua

SEQ ID NO: 499622 - RNA, 61 nt, Homo Sapiens
cacauaguuugucaaaagugguggucccuacacugaaaacgaaguacccuaaaauugaaag

SEQ ID NO: 499623 - RNA, 61 nt, Homo Sapiens
uuacauuuugagucagguuuaaauuaagucuacugaaaaauuuauuaaauaugcaaguuag

SEQ ID NO: 499624 - RNA, 61 nt, Homo Sapiens
uuuccaagccucuuuuuuccaaggaaaccauacugaaaaccuaacugcuaaaucuuauuau

SEQ ID NO: 499625 - RNA, 61 nt, Homo Sapiens
ucagcuucuuacaaauacauaagagacucacacugaaaaaaguuguaugaauauaaaaaug

SEQ ID NO: 499626 - RNA, 61 nt, Homo Sapiens
ugguugcuuaauuguucugugauugaggaccacugaaaaauaagucuuaauaaauguuggu

SEQ ID NO: 499627 - RNA, 61 nt, Homo Sapiens
aucucagaaaaaaaaaaaaaagauaauucauacugaaaagaaacucuacaaacuugaaaga

SEQ ID NO: 499628 - RNA, 61 nt, Homo Sapiens
cccucucagcagacgcuucaugauaggaaggacugaaaagucuuguggacaccuggucuuu

SEQ ID NO: 499629 - RNA, 61 nt, Homo Sapiens
acaagacaucagaacuuauuccucuugucuaacugaaaaugcaugccugaugaccaaacuc

SEQ ID NO: 499630 - RNA, 61 nt, Homo Sapiens
uuacacuauugcccuaggcuugcuaggaaagacugaaaaaauuuuugugccuaacuuugug

SEQ ID NO: 499631 - RNA, 61 nt, Homo Sapiens
auuuuuauaucauuggcuuuuacccagagccacugaaaacucucauccacacaccuuucuu

SEQ ID NO: 499632 - RNA, 61 nt, Homo Sapiens
aaaugagaacaacaaaaaaaaggagauugaaacugaaaacaugucuuuucaucuguucaag

SEQ ID NO: 499633 - RNA, 61 nt, Homo Sapiens
aaaaaacuuuuaaaaaauguucucuacaaaaacugaaaaauggcaacauggugagaccuca

SEQ ID NO: 499634 - RNA, 61 nt, Homo Sapiens
caaaaaauuuagccagguguaccuugucucuacugaaaauaacccuggccaacauggugaa

SEQ ID NO: 499635 - RNA, 61 nt, Homo Sapiens
gaaauaaacugcuugaaaagucaacauuagaacugaaaaugggugaauauuuaugaaaaag

SEQ ID NO: 499636 - RNA, 61 nt, Homo Sapiens
acagcacuuuuaacaccuuucagucugucauacugaaaauguagcaauaugauagauaauu

SEQ ID NO: 499637 - RNA, 61 nt, Homo Sapiens
auauaauacugccauccauauuucaguaaguacugaaaaguaguagccuuaauaacguuag

SEQ ID NO: 499638 - RNA, 61 nt, Homo Sapiens
acgagagaaaagagaguggugagugagucugacugaaaaauaugauucauuucaaaauccu

SEQ ID NO: 499639 - RNA, 61 nt, Homo Sapiens
gacuacucagauauguuggaguguuuaaaaaacugaaaaguuccaaaucuauuuuucucac

SEQ ID NO: 499640 - RNA, 61 nt, Homo Sapiens
cgugccugaugaccaaacucccucuugucaaacugaaaaugacaggacaucagaacuuauu

SEQ ID NO: 499641 - RNA, 61 nt, Homo Sapiens
uucauaaggggcaguuggugguguugcagugacugaaaagcugagauaauuggugucggga

SEQ ID NO: 499642 - RNA, 61 nt, Homo Sapiens
aggcagggcuggacucaggaacccacagcuuacugaaaaagccagaggccaugacugcccc

SEQ ID NO: 499643 - RNA, 61 nt, Homo Sapiens
uaaugaccauuuccuggaaucaguuuauuauacugaaaacugggggugggaguagggagcu

SEQ ID NO: 499644 - RNA, 61 nt, Homo Sapiens
gagaccuuccuagagugaaugaagguagaaaacugaaaagggaguaaauuaaggaaugauu

SEQ ID NO: 499645 - RNA, 61 nt, Homo Sapiens
aaacuagcugaagccuuuucuuguuuuagcaacugaaaauuguacuuggucacuuuugugc

SEQ ID NO: 499646 - RNA, 61 nt, Homo Sapiens
agugauaaacuaagucacauacagauaaagcacugaaaacaccacagugacccucccaccc

SEQ ID NO: 499647 - RNA, 61 nt, Homo Sapiens
ugcuuuguauuguauauuacaaugaucaccgacugaaaauauuguuuuacaauaguucugu

SEQ ID NO: 499648 - RNA, 61 nt, Homo Sapiens
cuguccuggaaacuguagaauugaauaaaucacugaaaauagaacacuucuuggaggcuuu

SEQ ID NO: 499649 - RNA, 61 nt, Homo Sapiens
uccaaagcuccugaucuuucccaagauuguaacugaaaacugcugucucuuguuuuguucg

SEQ ID NO: 499650 - RNA, 61 nt, Homo Sapiens
uugcaaacucaaucggggacuaaaauuucccacugaaaauguuaaacauuuuagauaacug

SEQ ID NO: 499651 - RNA, 61 nt, Homo Sapiens
agcaauguacuguacauuuguggaaaaagagacugaaaaaaccuguucuacugcaaaacac

SEQ ID NO: 499652 - RNA, 61 nt, Homo Sapiens
gguaauuguugcuaaucuucuuuugauuuguacugaaaaaugagccugaauuuuguugcug

SEQ ID NO: 499653 - RNA, 61 nt, Homo Sapiens
aucaaucagauguaucuucaguuaaaucaugacugaaaaaaugagcaucucaaagaagucu

SEQ ID NO: 499654 - RNA, 61 nt, Homo Sapiens
uggugcucaauaaagaagccuggcaacuuguacugaaaaucaaucugaaacccuccuucug

SEQ ID NO: 499655 - RNA, 61 nt, Homo Sapiens
agguccguucagcuccgccugugugaacaagacugaaaagggagaccuggcccucaaaaag

SEQ ID NO: 499656 - RNA, 61 nt, Homo Sapiens
acuacugaauuuuaucaaauuuauagcuacuacugaaaauguaagccuauuuccuauccau

SEQ ID NO: 499657 - RNA, 61 nt, Homo Sapiens
aaugaaguugauguauguccuuuuuuaagguacugaaaagaugucccagaacugauguuuu

SEQ ID NO: 499658 - RNA, 61 nt, Homo Sapiens
cugaaacugcuuugaaaauuccaacauauauacugaaaauaccaugaaccauuauaaaauc

SEQ ID NO: 499659 - RNA, 61 nt, Homo Sapiens
aucucuguuuuuccugucagagauuuaaaaaacugaaaagguauaccucaacccaaaaaua

SEQ ID NO: 499660 - RNA, 61 nt, Homo Sapiens
agaauauguuuaauccauguauugguacuuuacugaaaaccagguuauauucuaaagaaga

SEQ ID NO: 499661 - RNA, 61 nt, Homo Sapiens
aauuuuguuuuauagauaugauaggcaacagacugaaaaccauaaucuuuacuguauucua

SEQ ID NO: 499662 - RNA, 61 nt, Homo Sapiens
acaaauguuguaaauucccuccaauguguuuacugaaaauacauagacuuuuaaacuucaa

SEQ ID NO: 499663 - RNA, 61 nt, Homo Sapiens
cuauuugcuugauuaccauuagaucuaugagacugaaaaacgucuuugaucgaaggaaaau

SEQ ID NO: 499664 - RNA, 61 nt, Homo Sapiens
caacgggaaaugugguccuaauaacacaucuacugaaaaaguuucaaauugaaaugacggu

SEQ ID NO: 499665 - RNA, 61 nt, Homo Sapiens
aaaauccugucuguuuuugucuauaccaaagacugaaaaaauaagaggaggagaaagcucu

SEQ ID NO: 499666 - RNA, 61 nt, Homo Sapiens
cuaaugggaugccuuuuacuccuugacuaagacugaaaagagauugauucaugauaauugu

SEQ ID NO: 499667 - RNA, 61 nt, Homo Sapiens
caugguaaaauaggauuucuagcuuuuucgaacugaaaauuuuccauuuuacuuaggaaua

SEQ ID NO: 499668 - RNA, 61 nt, Homo Sapiens
gcugccuaaggaaguuuggagcggggaagucacugaaaagucguggcagggaaagcagcgu

SEQ ID NO: 499669 - RNA, 61 nt, Homo Sapiens
uuacugaaagucacuuuuauuccauuuuuauacugaaaauguuccagaaaugaaauguaaa

SEQ ID NO: 499670 - RNA, 61 nt, Homo Sapiens
aauaggaaagauaacgggaagaugccaguugacugaaaauucaaagccuuucaauuugaag

SEQ ID NO: 499671 - RNA, 61 nt, Homo Sapiens
aaaaaaaaaaaaccagacugaauuaauuuuaacugaaaauuucucuuauguuccaaguaca

SEQ ID NO: 499672 - RNA, 61 nt, Homo Sapiens
guaaaagcccaguuugcuaggaggucugcuuacugaaaacaaggagaccuggggugggugu

SEQ ID NO: 499673 - RNA, 61 nt, Homo Sapiens
aaaauuauuuucucuuaacaagacuuuuuguacugaaaacaauuuuuuugaaucuuucgua

SEQ ID NO: 499674 - RNA, 61 nt, Homo Sapiens
aauuguacugaaauuaacuuaugacagcuacacugaaaaauaggaaauuuaaacucuaauu

SEQ ID NO: 499675 - RNA, 61 nt, Homo Sapiens
uaucuuaaacugacccuuccagaaggaguucacugaaaacuaagacaccuucccgggugga

SEQ ID NO: 499676 - RNA, 61 nt, Homo Sapiens
gccaaacaaguggugucuguccauaguuuuaacugaaaagguaauuugaacuguacuggac

SEQ ID NO: 499677 - RNA, 61 nt, Homo Sapiens
acauggccuugggugacaaaccuuccuuuccacugaaaagcgcggccuuagagguuucccu

SEQ ID NO: 499678 - RNA, 61 nt, Homo Sapiens
aguuuagagacugggggaggacagaaaauuaacugaaaagccauauacagcaggcaaagag

SEQ ID NO: 499679 - RNA, 61 nt, Homo Sapiens
aguuuagacauugggggaggccagaaaauuaacugaaaagccauauauaguagacaaagag

SEQ ID NO: 499680 - RNA, 61 nt, Homo Sapiens
aaaaaacugaagaacuuugguaauuuaaaaaacugaaaaaacaaagcuuuuuauuacuuug

SEQ ID NO: 499681 - RNA, 61 nt, Homo Sapiens
aaccauuuuagugucaggcucuccccccguuacugaaaaaucacacucugccuccccacuu

SEQ ID NO: 499682 - RNA, 61 nt, Homo Sapiens
uaagggcuugauuccuagcccuguuuuucuaacugaaaagcauguauauauuuuucaaggu

SEQ ID NO: 499683 - RNA, 61 nt, Homo Sapiens
uugguuugguuuggcuuugacuaauucugguacugaaaaguuagcuauacacacacacaca

SEQ ID NO: 499684 - RNA, 61 nt, Homo Sapiens
uuaaguuuuaucguguaaauacauuagcuaaacugaaaaguauaaguaacaugcuuuguug

SEQ ID NO: 499685 - RNA, 61 nt, Homo Sapiens
agacuguguucauguguaaagacugagcagaacugaaaaauuacuuauuggauauucauuc

SEQ ID NO: 499686 - RNA, 61 nt, Homo Sapiens
cuugaaauuacuugaauuuucuugucuuaaaacugaaaaaaaaauguaguuacacguuaaa

SEQ ID NO: 499687 - RNA, 61 nt, Homo Sapiens
caguuuguccucauaaacguuguagguugaaacugaaaaauaaguuaaaaugaucaaucaa

SEQ ID NO: 499688 - RNA, 61 nt, Homo Sapiens
ugaaauuuaauucuauuuugauaaaacuaagacugaaaauaaccacuuguaaacauuccua

SEQ ID NO: 499689 - RNA, 61 nt, Homo Sapiens
agccuggccaagauggugaaaccccgucucuacugaaaauacaaaaauuagccaggugugg

SEQ ID NO: 499690 - RNA, 61 nt, Homo Sapiens
cacacauggcugaugucacauugaaaaugugacugaaaauuugaaaauucucucaauaaag

SEQ ID NO: 499691 - RNA, 61 nt, Homo Sapiens
aacuuaaaaaguaguuagccaauaugcaaucacugaaaacuaugcaagagaaauuccaacc

SEQ ID NO: 499692 - RNA, 61 nt, Homo Sapiens
uucuugcuguugaaaaaaggaacaaagcguuacugaaaagaagguaaccuuuguuggaugu

SEQ ID NO: 499693 - RNA, 61 nt, Homo Sapiens
gaagcagauaucaacucacacuauucacacaacugaaaauauugggcaucaaauagauuag

SEQ ID NO: 499694 - RNA, 61 nt, Homo Sapiens
ccuaggagcccuguaacucccaggagagaccacugaaaauacuggagcaacaaugccccug

SEQ ID NO: 499695 - RNA, 61 nt, Homo Sapiens
agugauaaacuaacaaacaaauauaacaacaacugaaaaggcacucuaaauuguggcuggc

SEQ ID NO: 499696 - RNA, 61 nt, Homo Sapiens
aucauuuuguggaugccaaaugaauaucaaaacugaaaacacauuuguugauauuugucuu

SEQ ID NO: 499697 - RNA, 61 nt, Homo Sapiens
gauaugaguauccuuugcuuaucuuuguaguacugaaaauuugccgaaguaacuggcugug

SEQ ID NO: 499698 - RNA, 61 nt, Homo Sapiens
aacauaucaguaaguuucuauauguaucaaaacugaaaaaauaguguuccaggcuaacaua

SEQ ID NO: 499699 - RNA, 61 nt, Homo Sapiens
acuuaauauuuaugaguuggaaacauaagucacugaaaaacugaucagcacuaccacaucc

SEQ ID NO: 499700 - RNA, 61 nt, Homo Sapiens
uauaugaccggguaucaguguugcagaaagaacugaaaagguuucuacaccuggaggaaug

SEQ ID NO: 499701 - RNA, 61 nt, Homo Sapiens
agauuucuuaugugacuuuuauuugcaguuuacugaaaaguuuauagguugaagcacacau

SEQ ID NO: 499702 - RNA, 61 nt, Homo Sapiens
guacaggugaaaugauauguuagagaaguauacugaaaaauuuuaaaaaaugauuaucuuu

SEQ ID NO: 499703 - RNA, 61 nt, Homo Sapiens
aucacuucauuugauacuguccuucccuuucacugaaaauguuucuuuguauuguguucua

SEQ ID NO: 499704 - RNA, 61 nt, Homo Sapiens
uauuugugacuuuaaucgugagaccucuuguacugaaaacauuuaugaauaccaaauaaau

SEQ ID NO: 499705 - RNA, 61 nt, Homo Sapiens
aauagcccauauaccuauguugcucuaaaauacugaaaaacacauuuuaaguuggauggug

SEQ ID NO: 499706 - RNA, 61 nt, Homo Sapiens
ugagaccaagagcaaggaaguguuuauucaaacugaaaagcugcugaaaauugccuuucug

SEQ ID NO: 499707 - RNA, 61 nt, Homo Sapiens
cugugagaauuuguuuucaguaacagccaacacugaaaacauguucuauugaaugccuugu

SEQ ID NO: 499708 - RNA, 61 nt, Homo Sapiens
uuuucaaaggaagguaucagugugcauucuuacugaaaaugggaauauguuacuuaaaacg

SEQ ID NO: 499709 - RNA, 61 nt, Homo Sapiens
ucagaucauuuuguauuaauauuccagauuuacugaaaaugacaauaaaaauccagucuua

SEQ ID NO: 499710 - RNA, 61 nt, Homo Sapiens
uggcauagcuuaaaagaugacccaaagcgccacugaaaagaaaaggccuguacauacuucu

SEQ ID NO: 499711 - RNA, 61 nt, Homo Sapiens
uucauuccauaucuacuuacuuaccuacuaaacugaaaacacuguccauuguuugaggaug

SEQ ID NO: 499712 - RNA, 61 nt, Homo Sapiens
agaguccuacuuacauaguuuauauaccgugacugaaaacuaaaaauguaacaggggaaau

SEQ ID NO: 499713 - RNA, 61 nt, Homo Sapiens
aagagaaauaaauagaaucucuccuacuugaacugaaaaguuuuuauuuccaaaacaugcu

SEQ ID NO: 499714 - RNA, 61 nt, Homo Sapiens
gaggugcacgggccaccauagucacacuggcacugaaaagaaagcguugcccuggugauuc

SEQ ID NO: 499715 - RNA, 61 nt, Homo Sapiens
aagguggucgggcaaaguauugccaggagauacugaaaaucauccagaagcacugugauau

SEQ ID NO: 499716 - RNA, 63 nt, Homo Sapiens
acaggccggaaaauugugcucuagaagaauaaaacugaaaaacucuagagaauuuuuuuuccc

SEQ ID NO: 499717 - RNA, 63 nt, Homo Sapiens
aaagauuucuucuuugaaaggucaagaccgugaacugaaaaaaguguuggccuuuuugcggga

SEQ ID NO: 499718 - RNA, 63 nt, Homo Sapiens
uuguauucugauugcccuucaucccaaguguuuacugaaaauuccauucuagauauucuuguu

SEQ ID NO: 499719 - RNA, 63 nt, Homo Sapiens
uuauuuccaggggcacacaaugcuauugaaauuacugaaaacaaaauaucugacaucuuauuu

SEQ ID NO: 499720 - RNA, 63 nt, Homo Sapiens
cuagguuuuuauauaaauagugaaauuugaauuacugaaaaccauguuaauuuuuagaacuca

SEQ ID NO: 499721 - RNA, 63 nt, Homo Sapiens
ugaagaacuuuguuacacauauuuugauaaggcacugaaaauauaaaaggacugguaguuuac

SEQ ID NO: 499722 - RNA, 63 nt, Homo Sapiens
gguuaaguaucuuccauguuaauguguuaagagacugaaaauaccagccaucagaaacuggcc

SEQ ID NO: 499723 - RNA, 63 nt, Homo Sapiens
uugacaucaguuuuaaaucaauggagagaaaaaacugaaaaagaugcugcuaaguaguucucu

SEQ ID NO: 499724 - RNA, 63 nt, Homo Sapiens
uauuuuaugcuccuuuuuuuucgcacucuuaagacugaaaauuggcguugaguguuauaguga

SEQ ID NO: 499725 - RNA, 63 nt, Homo Sapiens
gcagugugauuggacugccagccagguuaauaaacugaaaaaugugauuggcuuccucucgcc

SEQ ID NO: 499726 - RNA, 63 nt, Homo Sapiens
aaauuuagacaauuaaaacauuucuaaagugagacugaaaauaauauagaaaaucucauugcu

SEQ ID NO: 499727 - RNA, 58 nt, Homo Sapiens; identical to SEQ ID NO: 499006

SEQ ID NO: 499728 - RNA, 63 nt, Homo Sapiens
ggguaaagauggguuuuuaaugauacuaagauaacugaaaauaggcauauagauauauuccaa

SEQ ID NO: 499729 - RNA, 63 nt, Homo Sapiens
accaucuggccaacauggugaaacccugucucuacugaaaauaaaaaaaacuagcugggcaug

SEQ ID NO: 499730 - RNA, 63 nt, Homo Sapiens
cucuuuguaugauauuuauuaggaggaaagaggacugaaaauguucuuguguagaaacagaag

SEQ ID NO: 499731 - RNA, 63 nt, Homo Sapiens
caacuaaugaagaaaugaauaauaaauuuugacacugaaaaacauuuuauuaauaaagaauau

SEQ ID NO: 499732 - RNA, 63 nt, Homo Sapiens
ugguauaguaugugcauaauggaaaguuaccuuacugaaaaaaaaaaaagaaggaaaaauaag

SEQ ID NO: 499733 - RNA, 63 nt, Homo Sapiens
cuucugauuuuucauugcucuauaauucuuuuuacugaaaauacuauguuaugaaugguauua

SEQ ID NO: 499734 - RNA, 63 nt, Homo Sapiens
guuuugaaaacguuacauuuuuuaaaucuuaaaacugaaaacuuguuuuuaguauuucuauuu

SEQ ID NO: 499735 - RNA, 63 nt, Homo Sapiens
auguucucuuauuuuaaagauacagugcuccccacugaaaauuaaaccuaaaaaaugucacau

SEQ ID NO: 499736 - RNA, 63 nt, Homo Sapiens
gagcuuuaucauggaccagaggaaaaccagaaaacugaaaacauuccucugucuuguggccag

SEQ ID NO: 499737 - RNA, 63 nt, Homo Sapiens
agccauuucacuacuagaaauugacgcaagugaacugaaaacuuauguucacacaaaaacucg

SEQ ID NO: 499738 - RNA, 63 nt, Homo Sapiens
acuacuuuggcucuugugcauaaaaacaagaacacugaaaauugggaauaugcacaaacuugg

SEQ ID NO: 499739 - RNA, 63 nt, Homo Sapiens
aauugcaguagugugaaaauacauuuuuuacaaacugaaaauacaguagauaagcugucgaaa

SEQ ID NO: 499740 - RNA, 63 nt, Homo Sapiens
uauugauauuuuuguaacagaauauagcucuuaacugaaaauccagaaccagaaacauaaauc

SEQ ID NO: 499741 - RNA, 63 nt, Homo Sapiens
ucaucuuuugacucuguauuuaaauucuaugauacugaaaauaaaggcauucuggaaaaauac

SEQ ID NO: 499742 - RNA, 63 nt, Homo Sapiens
ggaauugcuggcugcuuuuacuuccugaccaagacugaaaaauuauuuacugaaaucuguaaa

SEQ ID NO: 499743 - RNA, 63 nt, Homo Sapiens
uggugugucauggugccucaucauucuggggagacugaaaauaccuucaucacugaccuggug

SEQ ID NO: 499744 - RNA, 63 nt, Homo Sapiens
ccuccacccccaacucaugaaaagauucuauggacugaaaaagccccaggcugaaaggacugg

SEQ ID NO: 499745 - RNA, 63 nt, Homo Sapiens
acauauuuuuguuauauacaauauugcugaugaacugaaaauuaacaaguaaaaugcacaugc

SEQ ID NO: 499746 - RNA, 63 nt, Homo Sapiens
gagcaaauggaagaagauacugaguccugauagacugaaaauuauaaacucaagcuggagaaa

SEQ ID NO: 499747 - RNA, 63 nt, Homo Sapiens
uuucaaagcugaguuacuuguauuucucuccccacugaaaacagcacagcccugggagggggc

SEQ ID NO: 499748 - RNA, 63 nt, Homo Sapiens
uaguuuuuuuguugguagauuuuauguucacacacugaaaacuaucagagguuuaauuugaag

SEQ ID NO: 499749 - RNA, 63 nt, Homo Sapiens
auuuucucuuugaaaaucccgccuuccugcucgacugaaaaaaguaaagccuccuggcaccag

SEQ ID NO: 499750 - RNA, 63 nt, Homo Sapiens
cacaucacagcuggcauucugcuagcuuggacaacugaaaaguucucuuggaguuucagaaau

SEQ ID NO: 499751 - RNA, 63 nt, Homo Sapiens
ugaguguucggugaaacaagaaaauguaaaaucacugaaaaaagagaccccgucucuaaaaau

SEQ ID NO: 499752 - RNA, 63 nt, Homo Sapiens
gaguuugcagaaaccuugggggagacuccacagacugaaaagucuccccagaggcugcauuga

SEQ ID NO: 499753 - RNA, 63 nt, Homo Sapiens
aagauuuauuuucaugcucauugguggguaauaacugaaaauagugaaccuaacuuucucuua

SEQ ID NO: 499754 - RNA, 63 nt, Homo Sapiens
ucuuaaauauuuagcaaucagagacaggccauaacugaaaaacgauaaucauacuuccucugu

SEQ ID NO: 499755 - RNA, 63 nt, Homo Sapiens
aauaaugguguaaugguucuuauuagacuuuuuacugaaaaugcacaauauuugucacuguuc

SEQ ID NO: 499756 - RNA, 63 nt, Homo Sapiens
aaaaaaaucccaaagugccugaugcccugaggcacugaaaaaacaauaauuggaguucauacu

SEQ ID NO: 499757 - RNA, 63 nt, Homo Sapiens
aucucuuuuaaaaagaaauuugaguaacuuagaacugaaaaugguaauaauagaauaaagggu

SEQ ID NO: 499758 - RNA, 63 nt, Homo Sapiens
auucaauccacuuuugggguauuccauuuguggacugaaaaguugauuaaguggggucacuga

SEQ ID NO: 499759 - RNA, 63 nt, Homo Sapiens
uuggguucccauuuauccugcauaauuggugauacugaaaacucuuuuuuuuucuuuuuaagc

SEQ ID NO: 499760 - RNA, 63 nt, Homo Sapiens
ggagcccaaugaagcuaagcuaauggaauuuaaacugaaaaaacagaagagacuuagagaugc

SEQ ID NO: 499761 - RNA, 63 nt, Homo Sapiens
ggcucuucuugggucuugagcuuucagacgcaaacugaaaaaucugggacauaaguuuuucug

SEQ ID NO: 499762 - RNA, 63 nt, Homo Sapiens
gaagaggaugguauuacauccuuagucucccagacugaaaaagacugccuaaccuuuuggagc

SEQ ID NO: 499763 - RNA, 63 nt, Homo Sapiens
ugcauuaagugccuuguagacaucagcuuccucacugaaaaugcauguuacucuuucucucuc

SEQ ID NO: 499764 - RNA, 63 nt, Homo Sapiens
gaauguuuuuuggguccacagaauucauugauuacugaaaauugagggugugggacccucacc

SEQ ID NO: 499765 - RNA, 63 nt, Homo Sapiens
augucuacaguccacagcuucaccaggacaaggacugaaaauaagcagcaucugguaugcagc

SEQ ID NO: 499766 - RNA, 63 nt, Homo Sapiens
cucaguguucccuuuccuacaggacggccuucaacugaaaagaagaucaaaguccagcaggca

SEQ ID NO: 499767 - RNA, 63 nt, Homo Sapiens
aggccugaggggcugguccugccauaugcaaauacugaaaagauaaccuguccuacccucaaa

SEQ ID NO: 499768 - RNA, 63 nt, Homo Sapiens
acuuuagaguucaguugauccaugaaauaauaaacugaaaaaaaucaguguuugacuagggau

SEQ ID NO: 499769 - RNA, 63 nt, Homo Sapiens
ugugauguauuugauccuguauggucaaaaaggacugaaaaaucguugguggcucugauccau

SEQ ID NO: 499770 - RNA, 63 nt, Homo Sapiens
uguuacaagaaaaauaugaguuaaauuauacaaacugaaaaugggcaaacauaggucugggca

SEQ ID NO: 499771 - RNA, 63 nt, Homo Sapiens
ugagauggagauauguucaauaagagccaaccaacugaaaaccaaguacuugggcuucagaag

SEQ ID NO: 499772 - RNA, 63 nt, Homo Sapiens
aauauggauuaauugccucaucuuuuuuuccuuacugaaaacauauugacgggaagagguaca

SEQ ID NO: 499773 - RNA, 63 nt, Homo Sapiens
cagauuguuuuguaguccuucacuuuaauuacaacugaaaaauacuuaaaauaagaaaaggag

SEQ ID NO: 499774 - RNA, 63 nt, Homo Sapiens
ugaaaagaguggagcagguguugcaaccuugugacugaaaacuugugaaacgaugagaguaag

SEQ ID NO: 499775 - RNA, 63 nt, Homo Sapiens
cagucagucaaaaacuggaaagacacacaguucacugaaaauuucucucucaaagcuucaguu

SEQ ID NO: 499776 - RNA, 63 nt, Homo Sapiens
gguuuuaaagaacauaaaugcuaauaaaggaagacugaaaaaaagcuaaauuccccauucugu

SEQ ID NO: 499777 - RNA, 63 nt, Homo Sapiens
agaaaauccccaacuaugcauuaaccccuugguacugaaaauggggagaagagaugcugccau

SEQ ID NO: 499778 - RNA, 63 nt, Homo Sapiens
auuccuggacaucaccagucucuucaauuuauuacugaaaaugauucugcuacuucacuguca

SEQ ID NO: 499779 - RNA, 63 nt, Homo Sapiens
ccuacugcaggaucccucggugcucuuccccaaacugaaaauaggugcucaauugcucucccu

SEQ ID NO: 499780 - RNA, 63 nt, Homo Sapiens
uuauuaggaaaaacugaauuucccaacaggugaacugaaaaguuauuuuaacuauuauacaua

SEQ ID NO: 499781 - RNA, 63 nt, Homo Sapiens
aauuauggaaaaauaauucagaaucuaaacaccacugaaaacuuauaaaaaauguuuagauac

SEQ ID NO: 499782 - RNA, 63 nt, Homo Sapiens
agagagaaauccaucuuuucccaggucuccuucacugaaaacaaaaaucuacuuacauacacu

SEQ ID NO: 499783 - RNA, 63 nt, Homo Sapiens
caugauuagaggagagagaacuugauucaagauacugaaaaauagagcugggacugagccugu

SEQ ID NO: 499784 - RNA, 63 nt, Homo Sapiens
ucugggucggucagugacauguagguaggaagcacugaaaauaguguucccagagcacuuugc

SEQ ID NO: 499785 - RNA, 63 nt, Homo Sapiens
aagggcauuuuacccuugcaguuuuacuaaaacacugaaaaauauuccaagcuucauauuaac

SEQ ID NO: 499786 - RNA, 63 nt, Homo Sapiens
ccaaaaaaaucaagauuuaauuuuuuuauuuguacugaaaaacuaaucauaacuguuaauucu

SEQ ID NO: 499787 - RNA, 63 nt, Homo Sapiens
aaacaacaaaaaaaaaucuuuauaagaaagagaacugaaaaguagcgugcuauucguccugua

SEQ ID NO: 499788 - RNA, 63 nt, Homo Sapiens
cagccugaccaacauggagaaacccccaucucuacugaaaauacagaauuagccaggcauggu

SEQ ID NO: 499789 - RNA, 63 nt, Homo Sapiens
cagagauuguuucaaauggguguaguagauauuacugaaaaccaaaaaagagugagauuguca

SEQ ID NO: 499790 - RNA, 62 nt, Homo Sapiens
cuuuccacuuccaguucuaguaaggaagaaaaacugaaaauguuuuaguuuauuacccagua

SEQ ID NO: 499791 - RNA, 63 nt, Homo Sapiens
uuuucuugacaauuagauaccuauccuguaguuacugaaaaucuggguaguaaaucuacccaa

SEQ ID NO: 499792 - RNA, 63 nt, Homo Sapiens
aguacugagaaaaaucccuucagcucuaagaacacugaaaaauccaccgauuuuuuggguaag

SEQ ID NO: 499793 - RNA, 63 nt, Homo Sapiens
aacaguugacaggucauccuugccaguuguauaacugaaaaaggacuuuucuaccagguauga

SEQ ID NO: 499794 - RNA, 63 nt, Homo Sapiens
auuugagauugauuggauucgaccucuuguugaacugaaaacuuaauuuuuucucuguauuuu

SEQ ID NO: 499795 - RNA, 63 nt, Homo Sapiens
uugcauuagcaaauauucaugcagcagcaguugacugaaaauuuauucuuaugagacguauag

SEQ ID NO: 499796 - RNA, 63 nt, Homo Sapiens
uauauauucucuaaauauuucuugaauuaaugaacugaaaaauguguguuaaaguugcuaagu

SEQ ID NO: 499797 - RNA, 63 nt, Homo Sapiens
aauauaacaacucuggauuacauuuuccucucaacugaaaacccucaguaaugcaaagaaagg

SEQ ID NO: 499798 - RNA, 63 nt, Homo Sapiens
ugagcuaaaacccacucuaugagaaggaagauuacugaaaagcaugugacauauugcuacaaa

SEQ ID NO: 499799 - RNA, 63 nt, Homo Sapiens
guacuucugauuaaugcaaggggaaauuuuuauacugaaaacaaacaaacaaacuagcagcua

SEQ ID NO: 499800 - RNA, 63 nt, Homo Sapiens
uuauuuuauaaaauguuuucuguauggcaauaaacugaaaacauggaucaacccuucuuuuga

SEQ ID NO: 499801 - RNA, 63 nt, Homo Sapiens
auguuagcuacuaugaauggugccagugaagacacugaaaaauaagugauuucaguaaccuuc

SEQ ID NO: 499802 - RNA, 63 nt, Homo Sapiens
cucaguugugggaauaauuaucagagacaugcaacugaaaaugucucaccuuucaucuuuuuu

SEQ ID NO: 499803 - RNA, 63 nt, Homo Sapiens
caaaauugcaaauauaaacaaaagaaaaauccaacugaaaauaacacuaaguauuuuugaguu

SEQ ID NO: 499804 - RNA, 63 nt, Homo Sapiens
agacuaaauaaugacauaauccucagcugacugacugaaaaugugacuggacgcauucccugu

SEQ ID NO: 499805 - RNA, 63 nt, Homo Sapiens
uguuucuuauagcuaugugugguuucugggucaacugaaaaccuaccauuugcuuuucuauuc

SEQ ID NO: 499806 - RNA, 63 nt, Homo Sapiens
auugaaaagaaauauggaggcuuuaaaccgcaaacugaaaaagcugaguagaacaaaggcagu

SEQ ID NO: 499807 - RNA, 63 nt, Homo Sapiens
uucuaaaagguauuuuuauaagcaguucaaguuacugaaaaccuuuuaaaccuuucugaaguu

SEQ ID NO: 499808 - RNA, 63 nt, Homo Sapiens
aaacuuaucagaauccucguucuuuuucagacuacugaaaaaugacauuuacucuguuaaaug

SEQ ID NO: 499809 - RNA, 63 nt, Homo Sapiens
ggagugcuuuuuauguauguugucuucuucaauacugaaaauuuguccuugguucuuaaaagc

SEQ ID NO: 499810 - RNA, 63 nt, Homo Sapiens
gaguccgggaggugccugugguuugcacccaccacugaaaaagccgcggagaugcgcagcgcg

SEQ ID NO: 499811 - RNA, 63 nt, Homo Sapiens
gcuguuuagaagggauggcuugaaaggaaggagacugaaaaacacucugagagcauacacugu

SEQ ID NO: 499812 - RNA, 63 nt, Homo Sapiens
ugacugaggucucucuuggccuggaagaauaacacugaaaaaaccugacgcugcggucacuua

SEQ ID NO: 499813 - RNA, 63 nt, Homo Sapiens
gcacuccagccggggugacagagugagacuccgacugaaaauaaauaaauaaauaaauaaaua

SEQ ID NO: 499814 - RNA, 63 nt, Homo Sapiens
auagcuacuuauucagauacugaagaccaacggacugaaaaaaagaacaaacauuagcuauuu

SEQ ID NO: 499815 - RNA, 63 nt, Homo Sapiens
gaauggaagcccugaagucauaugggcugcuuuacugaaaacauaggcccucucuagcaaagu

SEQ ID NO: 499816 - RNA, 63 nt, Homo Sapiens
caaaagauaaguaaaugagucuggggauuucaaacugaaaauccagauaucagugugaaaagu

SEQ ID NO: 499817 - RNA, 63 nt, Homo Sapiens
caaaaauuagacgggcauggaauccccgucucuacugaaaacaccagccuggccaacguggug

SEQ ID NO: 499818 - RNA, 63 nt, Homo Sapiens
uauuuuugggauaagagaauguauuuuggaguuacugaaaaaucugcuaagagguacaugugg

SEQ ID NO: 499819 - RNA, 63 nt, Homo Sapiens
gaauuugauagcucagcauuaugaaaaggggccacugaaaaguaaaguaggaaccagauagag

SEQ ID NO: 499820 - RNA, 63 nt, Homo Sapiens
uuaaaucuaccaguuuauguuucuguugaaauaacugaaaaugagguaauuuacauauuuucu

SEQ ID NO: 499821 - RNA, 63 nt, Homo Sapiens
guaucugcaugaaggcuccuggguguauggagaacugaaaagguuuugugaccacuugugaau

SEQ ID NO: 499822 - RNA, 63 nt, Homo Sapiens
gcaaauugcaaucauauaaagaugauguagauuacugaaaaauggaaacuugaaaggucugag

SEQ ID NO: 499823 - RNA, 63 nt, Homo Sapiens
gcagacagaggggcacgucuccugcaggcagagacugaaaauuugaaugccucccucaaagga

SEQ ID NO: 499824 - RNA, 63 nt, Homo Sapiens
uagaauuuauuugcuaauaauuacuuuucagugacugaaaagauauuucauaccaaugaaauc

SEQ ID NO: 499825 - RNA, 63 nt, Homo Sapiens
aggaaagaugguuaaacauuaaaagagagaaacacugaaaagaggguggggggaugguaagag

SEQ ID NO: 499826 - RNA, 63 nt, Homo Sapiens
cuccacugcauggacccugggcuucugcaagauacugaaaauugaaggaaaaucacccagaau

SEQ ID NO: 499827 - RNA, 63 nt, Homo Sapiens
uggcaguuaugguuuucuuuccuacaagauucaacugaaaaguagaucaguggcggaucaaaa

SEQ ID NO: 499828 - RNA, 63 nt, Homo Sapiens
ugaaauuuaauggguggugaucccagaacaauuacugaaaagcauuugcacaacuagaacaca

SEQ ID NO: 499829 - RNA, 63 nt, Homo Sapiens
aaucucuaugagcuaaaugucagaauagauagcacugaaaaaauuggauuaacccucuauaga

SEQ ID NO: 499830 - RNA, 63 nt, Homo Sapiens
uccacuacauguaacuuucuuguuaauguucagacugaaaaucauguugccaaacuuuggaaa

SEQ ID NO: 499831 - RNA, 63 nt, Homo Sapiens
uuuauugguaggauuuauauuguaaaacuuaaaacugaaaaauguuuuguuuuuaaaucaaac

SEQ ID NO: 499832 - RNA, 63 nt, Homo Sapiens
uuaauauuuaauguuuuaaucuguauauguugcacugaaaaggagaacuccuuacucugaugu

SEQ ID NO: 499833 - RNA, 63 nt, Homo Sapiens
caacuccucuucuuagucuuagagagagagaguacugaaaaagagaucuagugguucacacag

SEQ ID NO: 499834 - RNA, 63 nt, Homo Sapiens
uauacugauuagaaaugucuguauguguugcugacugaaaagccagacuucuacauuaaugau

SEQ ID NO: 499835 - RNA, 63 nt, Homo Sapiens
uuaauucagauaguagcuuuuccaggcuuuuaaacugaaaagcaugucuucuaaggauggucu

SEQ ID NO: 499836 - RNA, 63 nt, Homo Sapiens
aaggcuaguguacuacaaaauaaaaauucgaaaacugaaaaauucacugugagcaacuuagag

SEQ ID NO: 499837 - RNA, 63 nt, Homo Sapiens
ugcuuuagggggaaaaucaguacaaguugcaugacugaaaaaauaaagcgagguuguaaaaau

SEQ ID NO: 499838 - RNA, 63 nt, Homo Sapiens
cagaacccauuaauaucgugcgaagucagugccacugaaaauacagugcauuauaccaaagag

SEQ ID NO: 499839 - RNA, 63 nt, Homo Sapiens
uauaagcucagauuauuuaauccuuuaauuaagacugaaaauaugugcucucuuuaaaucaag

SEQ ID NO: 499840 - RNA, 63 nt, Homo Sapiens
gcuauuuacaaagcaguaaagucccaguuauaaacugaaaacaaaacccugauguaaagauca

SEQ ID NO: 499841 - RNA, 63 nt, Homo Sapiens
aaaccucuuccacccaccccguuaucucucuacacugaaaauaaguauccacucggaccaucu

SEQ ID NO: 499842 - RNA, 63 nt, Homo Sapiens
ccacuuucuucaucuuguuucacuguauuuucgacugaaaauuuugauacgaucuugugaaaa

SEQ ID NO: 499843 - RNA, 63 nt, Homo Sapiens
cuggggggaaaaaaaaaaaacauguuguaaucaacugaaaaaugacuagaaagucuacuugag

SEQ ID NO: 499844 - RNA, 63 nt, Homo Sapiens
caggcauuacaccagcuguugcggcuacaugguacugaaaauggauagaaaacuauuaacagu

SEQ ID NO: 499845 - RNA, 63 nt, Homo Sapiens
gguuuuuagucucuggaaaaagcaguugaucagacugaaaaacggcucuaaaguugguguagc

SEQ ID NO: 499846 - RNA, 63 nt, Homo Sapiens
ugcuuuaaagcuuuaccugacuauaaacauugcacugaaaacuaaguaucuuaaaagaaggaa

SEQ ID NO: 499847 - RNA, 61 nt, Homo Sapiens; identical to SEQ ID NO: 499126

SEQ ID NO: 499848 - RNA, 63 nt, Homo Sapiens
aacaacgcugaguuuaucaaauguuuucuugucacugaaaacacuuggguccccuuuccaugu

SEQ ID NO: 499849 - RNA, 63 nt, Homo Sapiens
gaacagcauggauuaacucauugacuuggcuguacugaaaagugcugcuucaagucugugcag

SEQ ID NO: 499850 - RNA, 63 nt, Homo Sapiens
cuuaggaaggauccgcauaauuuuuuuuaaaaaacugaaaauaccuugugauguggcaauaaa

SEQ ID NO: 499851 - RNA, 63 nt, Homo Sapiens
uuggccauuuggccuuaucuuacuacccacauaacugaaaauaaaaaaagguuacucaaguug

SEQ ID NO: 499852 - RNA, 63 nt, Homo Sapiens
cuuuaaggauuuguaagguucaugguucauguuacugaaaagacaaggaacuugucaagagau

SEQ ID NO: 499853 - RNA, 63 nt, Homo Sapiens
aacaaaaacaaaaacacaaaaaacccugucucuacugaaaaacccaggcuggccaacauggua

SEQ ID NO: 499854 - RNA, 63 nt, Homo Sapiens
gguuauauuaaagcaaauuaucauuugugaucuacugaaaagaaaaaaaaguaguuuguaaac

SEQ ID NO: 499855 - RNA, 63 nt, Homo Sapiens
cauugcaauuagggaacgcaacauuauuuaaagacugaaaauuguguuuauuuugaaucguua

SEQ ID NO: 499856 - RNA, 63 nt, Homo Sapiens
cuggucacacaaaauguuuagaugugaugcugcacugaaaaaaaaugguuggagauugcuggc

SEQ ID NO: 499857 - RNA, 63 nt, Homo Sapiens
ucauucuuggguuaacaguauacaaauuacauuacugaaaacuguagaugauaaaggccagau

SEQ ID NO: 499858 - RNA, 63 nt, Homo Sapiens
cucaggcuuucguagugauuagcuuacuaaggaacugaaaaugggccccuuguacaagcugag

SEQ ID NO: 499859 - RNA, 63 nt, Homo Sapiens
ccagccuggccaacauagugaaaccccaucucuacugaaaauacaaaaauuagcugggugugg

SEQ ID NO: 499860 - RNA, 63 nt, Homo Sapiens
uuuugauauguaagagauauucagaaugcucacacugaaaaugccucaacuuuuuaaagugua

SEQ ID NO: 499861 - RNA, 63 nt, Homo Sapiens
gaaaaaacauuuuuacugcugcuuaguuuuuggacugaaaagauauuaaaacucaagaaggac

SEQ ID NO: 499862 - RNA, 63 nt, Homo Sapiens
cacuuggucugacuuguaccaauucuagcacccacugaaaaacaaguugaguagagaguguag

SEQ ID NO: 499863 - RNA, 63 nt, Homo Sapiens
ugcauuagcuguuuguaaauaaugcauuugcauacugaaaaaggaaugccaccugccacaguu

SEQ ID NO: 499864 - RNA, 63 nt, Homo Sapiens
ccuuucaaucaaaacucaguaucauaaguagagacugaaaacuugccguuauugauuguuguu

SEQ ID NO: 499865 - RNA, 63 nt, Homo Sapiens
agccugcugucccauggagaaaaaguuuuaagcacugaaaaaauuugauuaauguauuuaaau

SEQ ID NO: 499866 - RNA, 63 nt, Homo Sapiens
guuuauuaguauugcuuuucauaauucugucucacugaaaaccuuauuugauggaagcaacau

SEQ ID NO: 499867 - RNA, 63 nt, Homo Sapiens
guguaaaaacaaaguuugggcucugaaaauuuaacugaaaaagauuuccuuguuuuuguaaua

SEQ ID NO: 499868 - RNA, 63 nt, Homo Sapiens
aauuuuuuaaaagccagucaaaacaaaaacuuuacugaaaauggacagaaauaggaaauggac

SEQ ID NO: 499869 - RNA, 63 nt, Homo Sapiens
gaaguucuuuuuaaaaugacacuuaaaacaaucacugaaaacuugauccacaucacacccugu

SEQ ID NO: 499870 - RNA, 63 nt, Homo Sapiens
uaugaaauucaugaguuuauuuaugucuaaaacacugaaaacuguguccaauaucguucaguu

SEQ ID NO: 499871 - RNA, 63 nt, Homo Sapiens
agaaaucaugaguaaaauuggaaaacacuuuuaacugaaaaaaacaaaagcacaacaaaccaa

SEQ ID NO: 499872 - RNA, 63 nt, Homo Sapiens
ugcuucuguuguaauaguccauggacaauauaaacugaaaaaugucagucugguuuauauaag

SEQ ID NO: 499873 - RNA, 63 nt, Homo Sapiens
cccacaccaucgaucauagcaccaccuaucagcacugaaaacucuuuuguaaguuguuuaaaa

SEQ ID NO: 499874 - RNA, 63 nt, Homo Sapiens
ugucucccaguuaugaaucagugggcaggauaaacugaaaacucccauuuacgugucugaauc

SEQ ID NO: 499875 - RNA, 63 nt, Homo Sapiens
gaagaaaucucugaagaaaccaaaagagcugaaacugaaaaaagagcucccucccuuuuuuca

SEQ ID NO: 499876 - RNA, 63 nt, Homo Sapiens
cgagccuuuaaacagcaguuuguaaacuaugcaacugaaaaacugaggaugauuguuagcucc

SEQ ID NO: 499877 - RNA, 63 nt, Homo Sapiens
auuagucauguccauucagacauaaccugaacuacugaaaagaucaauuuccagaagguuuau

SEQ ID NO: 499878 - RNA, 63 nt, Homo Sapiens
aguuuaaaaaaaaucuauaguuuccaauaaacaacugaaaaauuaucaugagauguguauuua

SEQ ID NO: 499879 - RNA, 63 nt, Homo Sapiens
gguagucaaugaacuggcugccacuuuaauauaacugaaaauucauuuugagaccaagcagga

SEQ ID NO: 499880 - RNA, 63 nt, Homo Sapiens
ugacauccacuuaggaugauacaaagcaguguaacugaaaauguuucuuuuaauugauuuaaa

SEQ ID NO: 499881 - RNA, 63 nt, Homo Sapiens
acaaaauuggaaagaaauuaaaacaagugcaagacugaaaacuaaauaggaaucaacuuaaca

SEQ ID NO: 499882 - RNA, 63 nt, Homo Sapiens
gaccugccuuucacugaauuuuguuuuuuucuuacugaaaauguuucucugaauugacugauu

SEQ ID NO: 499883 - RNA, 63 nt, Homo Sapiens
auggggguuguauguaugugucuugacauauacacugaaaaaagaggucuugaggucuugaca

SEQ ID NO: 499884 - RNA, 63 nt, Homo Sapiens
cccagcccugcugcacacuaguguuuaauagucacugaaaacuggcucccugcaguuggcugg

SEQ ID NO: 499885 - RNA, 63 nt, Homo Sapiens
accugggaucauaguguuucaagaaauuuuaaaacugaaaacuaacuguacuuacuuuacagg

SEQ ID NO: 499886 - RNA, 63 nt, Homo Sapiens
uagguugaaagcucucuguauuuuaguuuaaugacugaaaaagugaacuggacuugguuggca

SEQ ID NO: 499887 - RNA, 63 nt, Homo Sapiens
auguagaaauauauguaaaguguacuuuguuuaacugaaaaaagccauuguugcagaguuauc

SEQ ID NO: 499888 - RNA, 63 nt, Homo Sapiens
agccuuuuucaccauggcaacuggccaggacacacugaaaagcucgugugagccucggccugg

SEQ ID NO: 499889 - RNA, 63 nt, Homo Sapiens
uccacaggguuuggagaauacaaagacacgggaacugaaaaacuggacuggaccaagagcagg

SEQ ID NO: 499890 - RNA, 63 nt, Homo Sapiens
cauguguauuuuccuauguguguaaaaauguagacugaaaagcaugaccgaaucucuuuucuc

SEQ ID NO: 499891 - RNA, 63 nt, Homo Sapiens
caggccacaaaugugucccagacacaauguugcacugaaaaccaagcuuauuuagcacauuuu

SEQ ID NO: 499892 - RNA, 63 nt, Homo Sapiens
cuuaaaucuguguuuucugggaaggcaagaaucacugaaaaauggggaagaaaaggggagggg

SEQ ID NO: 499893 - RNA, 63 nt, Homo Sapiens
uuuuauaguucaaaaauuaagcaauaauuuugcacugaaaacugucauugcuauuuaucaaua

SEQ ID NO: 499894 - RNA, 63 nt, Homo Sapiens
aaauucucaggcuuuacagcugcagaagaaccaacugaaaaaacuuugcagguaucacagccu

SEQ ID NO: 499895 - RNA, 63 nt, Homo Sapiens
aaaaaaaagcucauauuaauaaacauaggcagcacugaaaaaacacauucuaccagcacaagg

SEQ ID NO: 499896 - RNA, 63 nt, Homo Sapiens
caauaaucagaaaaguaauucauaauuuugcauacugaaaaucagaagccccuuauuuuuagc

SEQ ID NO: 499897 - RNA, 63 nt, Homo Sapiens
ugaaaguaaccauaucugaccaaucaaguaacaacugaaaauguacauauacggcuuuggaga

SEQ ID NO: 499898 - RNA, 63 nt, Homo Sapiens
uuugguccugggaauuuauugucuaauacaaaaacugaaaacccuguguggucuuugggagga

SEQ ID NO: 499899 - RNA, 63 nt, Homo Sapiens
augaaaaugucacucaagcuuuucaugugagcuacugaaaaaaaauaucuagaguucucuaau

SEQ ID NO: 499900 - RNA, 63 nt, Homo Sapiens
gauauuauuuuccuuuucuugcuaaauaauaguacugaaaauucuaacuggaggggcucuagu

SEQ ID NO: 499901 - RNA, 63 nt, Homo Sapiens
aauaagaaagaaagaguuggcaacuguagguaaacugaaaaaaucaagaaaggauugguacug

SEQ ID NO: 499902 - RNA, 63 nt, Homo Sapiens
auccucaaaaugaguuauagugcugugaaaugcacugaaaaaaaugauucccuuguucauuuu

SEQ ID NO: 499903 - RNA, 63 nt, Homo Sapiens
aagccaagccucugcccugcugcuaaaauguccacugaaaacagugauuuuccacaaagaaug

SEQ ID NO: 499904 - RNA, 63 nt, Homo Sapiens
aaauauuuuuauggauuuuaaugccauuuucauacugaaaauuuaccucaaacucaaauuagu

SEQ ID NO: 499905 - RNA, 63 nt, Homo Sapiens
gucacuaacucucuuuucccacauccccccaagacugaaaagaaguuuucuuccucuaccucc

SEQ ID NO: 499906 - RNA, 63 nt, Homo Sapiens
caaaaacuauuuuauuaugaucugugugauuguacugaaaaauccaguacuaauaaucccuga

SEQ ID NO: 499907 - RNA, 63 nt, Homo Sapiens
gaaauguucucaauaucaaccccuguuagcaaaacugaaaacuuuguuaugauuaagcuuaaa

SEQ ID NO: 499908 - RNA, 63 nt, Homo Sapiens
gaaucauuuuucacuguacaagggauacacaggacugaaaaggaaacccaaagcccugguaaa

SEQ ID NO: 499909 - RNA, 63 nt, Homo Sapiens
guaaauacaaaauaaaauuaccuugcauuagaaacugaaaacucuccaagucuucagcgagac

SEQ ID NO: 499910 - RNA, 63 nt, Homo Sapiens
ccuaaucgauauauauauucagagacugauuagacugaaaaugaagaauuaaaugauaaacuu

SEQ ID NO: 499911 - RNA, 63 nt, Homo Sapiens
guguuauguguaaaugccaccuauuaauacgggacugaaaacguuagagacacacugcauugc

SEQ ID NO: 499912 - RNA, 63 nt, Homo Sapiens
aacucagauuugugaugcuaggaacaugagcaaacugaaaauuacuaugcacuugucagaaac

SEQ ID NO: 499913 - RNA, 63 nt, Homo Sapiens
uuuaaagacaauuugcaggggguugggagaaggacugaaaagguacauuaagugugcuguaag

SEQ ID NO: 499914 - RNA, 63 nt, Homo Sapiens
acuauauauaaucaauucaucaagccaguuauuacugaaaaaucauugaaaugagacaguuua

SEQ ID NO: 499915 - RNA, 63 nt, Homo Sapiens
gcuguuggagaggggaaaaguugugcauaaagaacugaaaaggguucuggaguguucauucag

SEQ ID NO: 499916 - RNA, 63 nt, Homo Sapiens
caauuuccuaucacuauuucagugucagaacaaacugaaaauaauggcucguguuuauguuga

SEQ ID NO: 499917 - RNA, 63 nt, Homo Sapiens
uugccuaaugauguuaucuaggcaccauuggagacugaaaaaaaaaaaucccugcucuguaaa

SEQ ID NO: 499918 - RNA, 63 nt, Homo Sapiens
ugguugccucauagcuuuguacagauuaugaggacugaaaauaauugggcauuuacccaucuu

SEQ ID NO: 499919 - RNA, 63 nt, Homo Sapiens
cauauuauauguauguauauuucaaaguaccacacugaaaauuagacauuuauuaaccaaauu

SEQ ID NO: 499920 - RNA, 63 nt, Homo Sapiens
cucauccugucucuggcuguggcccggcaaagcacugaaaaccccucuggucucagagacagu

SEQ ID NO: 499921 - RNA, 63 nt, Homo Sapiens
agcuauaauaccuaugccucagcaauacauagaacugaaaaaacagggcgggagugguaugug

SEQ ID NO: 499922 - RNA, 63 nt, Homo Sapiens
uucuuuagaaacacaagaguauagauuuuucucacugaaaagugagaguuacgcauugcagcc

SEQ ID NO: 499923 - RNA, 63 nt, Homo Sapiens
ccguguaagccaaaggcccacagaggagcauauacugaaaagaaggcaguaucacagaauuua

SEQ ID NO: 499924 - RNA, 63 nt, Homo Sapiens
auuuucauucagaaucaaaauuaagaaaguuggacugaaaauaugaaaaaugcuuaacuauug

SEQ ID NO: 499925 - RNA, 63 nt, Homo Sapiens
aucugcccugcucagcagucaccauagcagcugacugaaaaucagcacugccugaguaguuuu

SEQ ID NO: 499926 - RNA, 63 nt, Homo Sapiens
aguuuugaucaguuuaacuugaaucacuaacugacugaaaauugaaugggcaaauaagugcuu

SEQ ID NO: 499927 - RNA, 63 nt, Homo Sapiens
uauaaagacaaaguaauucuauuaaaugaacuaacugaaaauaauaauuauaggaagugauua

SEQ ID NO: 499928 - RNA, 63 nt, Homo Sapiens
uauagaaccugucauacauucaugauaaguagcacugaaaaauuacucauucaaauuuccccu

SEQ ID NO: 499929 - RNA, 63 nt, Homo Sapiens
gacugguuuuuaagugcacugcacuucuggaauacugaaaaagaaugaaaacaauauguuaga

SEQ ID NO: 499930 - RNA, 63 nt, Homo Sapiens
uuaaucucauuucuggacucuuuaaguuuuaccacugaaaaccagagucgauuuuucuccuaa

SEQ ID NO: 499931 - RNA, 63 nt, Homo Sapiens
ucuuuauuucuucuaaaaaucuguauaccaggaacugaaaaucuuugaacagauauuaaaauc

SEQ ID NO: 499932 - RNA, 63 nt, Homo Sapiens
uaaccuaccuacugacaaguaaauuuauacaggacugaaaaccgccugaaaccugcugcaacu

SEQ ID NO: 499933 - RNA, 63 nt, Homo Sapiens
aaaaaaagauuuuuucuggaacuaaacuauuucacugaaaaaaauaugucucuauaugaagga

SEQ ID NO: 499934 - RNA, 63 nt, Homo Sapiens
cauccauuuuagagccaggaucuuuacacugacacugaaaauuuuaaagaaaguaacaagaug

SEQ ID NO: 499935 - RNA, 63 nt, Homo Sapiens
aaacuagaaauguccuaauugcuuuacauuucaacugaaaaagugccugucuuaaauuccaaa

SEQ ID NO: 499936 - RNA, 63 nt, Homo Sapiens
aggagguguaauaaaauguuauaaaacucaaggacugaaaauccaaauaaacaaggggagaaa

SEQ ID NO: 499937 - RNA, 63 nt, Homo Sapiens
gcacacgcaugacaaaauguuugucauucuaacacugaaaaguaaguuucugacuggaaaauc

SEQ ID NO: 499938 - RNA, 63 nt, Homo Sapiens
uguauaaaguaauuaaaaguuauuuagaugaugacugaaaaugaguuuguggcuauaaaugau

SEQ ID NO: 499939 - RNA, 63 nt, Homo Sapiens
uauaucauauggguacacaaauaacuuggugaaacugaaaaagcgauuaagaaucaucauuac

SEQ ID NO: 499940 - RNA, 63 nt, Homo Sapiens
aggugugauccuguuacugaucauccugguguuacugaaaaaccggcguagggacagauguau

SEQ ID NO: 499941 - RNA, 63 nt, Homo Sapiens
guccugcucagugccaagguaccuggccgccacacugaaaacuccacuccagagacuucugcc

SEQ ID NO: 499942 - RNA, 63 nt, Homo Sapiens
aaucugcaagauaauguaacagagauaauguaaacugaaaaaaucuuuccaucaaaucaaugu

SEQ ID NO: 499943 - RNA, 63 nt, Homo Sapiens
aaauaucuaagcuguacaugacuauuuuuuuuaacugaaaaagacuaucagauauguuuuugc

SEQ ID NO: 499944 - RNA, 63 nt, Homo Sapiens
cuugcaaugacaagagguuuaauagaaacaugaacugaaaaguuuuaagaauuaaaacuggga

SEQ ID NO: 499945 - RNA, 63 nt, Homo Sapiens
ugccuaaaucaaagacuauuucaagucaacaacacugaaaacugcuuuucgccuccacucuua

SEQ ID NO: 499946 - RNA, 63 nt, Homo Sapiens
aauggugaagaauggacuuaauuaugcuaacaaacugaaaaaucuagacauagauccucugau

SEQ ID NO: 499947 - RNA, 63 nt, Homo Sapiens
cagaagaaacaagguuuucaguccccacagauaacugaaaauuauuuaaaccgcuaaaagaaa

SEQ ID NO: 499948 - RNA, 63 nt, Homo Sapiens
acccaguauaugcuauucaaugaucuuagaaguacugaaaaaaaaagacguuuuuaaaacgua

SEQ ID NO: 499949 - RNA, 63 nt, Homo Sapiens
ugauauugagcucuaaaugcaaaacucuuuuauacugaaaaaacacuuaaaguaguuuugugu

SEQ ID NO: 499950 - RNA, 63 nt, Homo Sapiens
acuggaauaaaggauguuuucuguuggacauguacugaaaauuaacacauguaguagccuuaa

SEQ ID NO: 499951 - RNA, 63 nt, Homo Sapiens
augacauucagugaauuauuucaguggugacccacugaaaauuaauaaugguacuuaugauua

SEQ ID NO: 499952 - RNA, 63 nt, Homo Sapiens
auugggacugcuuugagaaccaucuuucaaugcacugaaaagucaucugaaaaaauagcuucu

SEQ ID NO: 499953 - RNA, 63 nt, Homo Sapiens
auagacauuuuguuucaaaugaaacuuuaaaagacugaaaaauuuuguaaauagguuugauuc

SEQ ID NO: 499954 - RNA, 63 nt, Homo Sapiens
auuacuaaaucucuguuaauauucucucuuuuaacugaaaagggaugggauagaaggguuugc

SEQ ID NO: 499955 - RNA, 63 nt, Homo Sapiens
guugagagguucuaaaaucaugaaacuuguuucacugaaaauuggacagauugccuguuucug

SEQ ID NO: 499956 - RNA, 63 nt, Homo Sapiens
cagauguggccaaccuuuguccauaugcaaaccacugaaaaaugaucuggauuucuauagcaa

SEQ ID NO: 499957 - RNA, 63 nt, Homo Sapiens
caaaaucugaacucucaaaagucuauuuuuuuaacugaaaauguaaauuuauaaauauauuca

SEQ ID NO: 499958 - RNA, 63 nt, Homo Sapiens
gacuguuacuaaguaaaaagcugucaaacauuuacugaaaauagaauuggccccauggcuuga

SEQ ID NO: 499959 - RNA, 63 nt, Homo Sapiens
guuauccuuuguauuuauaggcacaguuaucuuacugaaaaugcaugcauggugaauuaaaau

SEQ ID NO: 499960 - RNA, 63 nt, Homo Sapiens
uuuuuuuuuuuuaaagcggguaaaagagaaaacacugaaaauugaauucuuaucuuccagagg

SEQ ID NO: 499961 - RNA, 63 nt, Homo Sapiens
uaauccccuuucuacagugaguccacuacccucacugaaaaucauuuuguaccacuuacauuu

SEQ ID NO: 499962 - RNA, 63 nt, Homo Sapiens
uuuagcucuuaaaacauacgaaguguugccuaaacugaaaauauuuaucuuuuauuuaaaauc

SEQ ID NO: 499963 - RNA, 63 nt, Homo Sapiens
cucugugcugaaauuugaagaccagauaaugaaacugaaaagcaaacaauuuuacugaaucug

SEQ ID NO: 499964 - RNA, 63 nt, Homo Sapiens
cagauucuuuauuccuauucgacacuggcuucuacugaaaaugaaacggauugcagagggaau

SEQ ID NO: 499965 - RNA, 63 nt, Homo Sapiens
gugcgaaaaaguauugaagauuagcuuuuaaaaacugaaaaaaaaaaaugaaugacucacaua

SEQ ID NO: 499966 - RNA, 63 nt, Homo Sapiens
caaacaacaaagcagaagaccucuucaaccucuacugaaaacaagaaaggagggcaacuucua

SEQ ID NO: 499967 - RNA, 63 nt, Homo Sapiens
uucaucugaugccucugagcaaaaaagaacacgacugaaaaagguugguugaauaauuauuga

SEQ ID NO: 499968 - RNA, 63 nt, Homo Sapiens
uaaguugcauagcugcuuuguacauauaugaguacugaaaaauaguggcuuuuccuccauuaa

SEQ ID NO: 499969 - RNA, 63 nt, Homo Sapiens
acauauccaaaauaaugaggcagaaugccuucaacugaaaaaaaaguuucaccuguauugaau

SEQ ID NO: 499970 - RNA, 63 nt, Homo Sapiens
uucacagagaugaagugggguaacuguaaaggaacugaaaaucagaauugaaauaauuucaaa

SEQ ID NO: 499971 - RNA, 63 nt, Homo Sapiens
gaaguaauauaaauuuuguguuuacgagggaaaacugaaaaagcauguaaugacuucacaagu

SEQ ID NO: 499972 - RNA, 63 nt, Homo Sapiens
caacauacugugaugauacgccauuaacuucguacugaaaaagcaguuaaacagcaggaaagc

SEQ ID NO: 499973 - RNA, 63 nt, Homo Sapiens
uaguccuaacgucuuugccucacucugccucagacugaaaagccucuugcucugcuauaucuc

SEQ ID NO: 499974 - RNA, 63 nt, Homo Sapiens
cuuuuuaaaauuuuauguauggaugcauuauaaacugaaaagcgauggggcaggggacuguua

SEQ ID NO: 499975 - RNA, 63 nt, Homo Sapiens
gcuuuuuaguacuuuuucaucuuaccuaaaaguacugaaaaauuaguguuuaguuggauuaau

SEQ ID NO: 499976 - RNA, 63 nt, Homo Sapiens
auuuugguccuuaaaaggagugaaaaugguuagacugaaaauauuuuuaaauaagcgcuuuaa

SEQ ID NO: 499977 - RNA, 63 nt, Homo Sapiens
aaauuuauucuuucgaagaugaaaauacaguggacugaaaagcgcuuggugauaaucaauuuu

SEQ ID NO: 499978 - RNA, 63 nt, Homo Sapiens
uaguugcucuccuuuuuucuauggaugugaugcacugaaaagugugccauacauuuuauccuc

SEQ ID NO: 499979 - RNA, 63 nt, Homo Sapiens
agggcaauguuggucgccuuagagguaauuuuuacugaaaauucagggggaaagguaggaaga

SEQ ID NO: 499980 - RNA, 63 nt, Homo Sapiens
uugaugugauucuugaaaggauuggacugauggacugaaaacaaauagaguugcuccauucau

SEQ ID NO: 499981 - RNA, 63 nt, Homo Sapiens
aaaacaaaacaaaacaaaaaagccucggguaacacugaaaaacgaaaacuagcucuucagaga

SEQ ID NO: 499982 - RNA, 63 nt, Homo Sapiens
ugaaagaaaagccuauaaaauucuuacagaaugacugaaaauuugaauucuucuguugccuuu

SEQ ID NO: 499983 - RNA, 63 nt, Homo Sapiens
aaaacuagccuuuggcuuguguguauacaauaaacugaaaaaacaaccaccagugaaaugugu

SEQ ID NO: 499984 - RNA, 63 nt, Homo Sapiens
uguuaaggcuauaguuuagcuucccaggaucaaacugaaaacacauucagggcauauuuuuuc

SEQ ID NO: 499985 - RNA, 63 nt, Homo Sapiens
auuuagaaagaagcuauuggacuauuuuuuucuacugaaaacauuacacuaaggucuccauau

SEQ ID NO: 499986 - RNA, 63 nt, Homo Sapiens
aaaaagaagaagaagaaggauccaggaucuuugacugaaaaaagccgguuaaauuccauaugc

SEQ ID NO: 499987 - RNA, 63 nt, Homo Sapiens
uaauauuaaaaauauggaacuguguaauagaaaacugaaaaucuucaagguggccaaauuauu

SEQ ID NO: 499988 - RNA, 63 nt, Homo Sapiens
agcagauguuuaaauagauuuaacaaaacaaucacugaaaaacagaaaauguugcuuccacau

SEQ ID NO: 499989 - RNA, 63 nt, Homo Sapiens
ugaauugucacuuuaucuuuagauuuccauauaacugaaaaacaauggcugccauuuugccau

SEQ ID NO: 499990 - RNA, 63 nt, Homo Sapiens
gggaaaaccucuaccaugccucacagucuagucacugaaaaaugaaaauucaucuguaaauau

SEQ ID NO: 499991 - RNA, 63 nt, Homo Sapiens
gaaugacuuugaaguaaaaccuuuuuucuugcuacugaaaaaaauggaguuguuuuggguggu

SEQ ID NO: 499992 - RNA, 63 nt, Homo Sapiens
cugaagauggcauccugugaaguccuucaccucacugaaaacaucuggaaggggaucccaccc

SEQ ID NO: 499993 - RNA, 63 nt, Homo Sapiens
ggccuucugagcugguggaauauuuuauuucagacugaaaacagagagcacucuccuugggaa

SEQ ID NO: 499994 - RNA, 63 nt, Homo Sapiens
uugguccuuggaagaccuauauucucuguaguuacugaaaaccgaaagucaauucuaauuauu

SEQ ID NO: 499995 - RNA, 63 nt, Homo Sapiens
uucauauucgaagugguugucucugcacuauuuacugaaaaguucauccuuuccccagugauu

SEQ ID NO: 499996 - RNA, 63 nt, Homo Sapiens
gcuucaaagaaucaguguaagccacuaaaaggaacugaaaaccuaggugucacaauaaacagu

SEQ ID NO: 499997 - RNA, 63 nt, Homo Sapiens
cucugccaugaacuggaggccaggaaucuccucacugaaaauuacaguaugguaacuuugcaa

SEQ ID NO: 499998 - RNA, 63 nt, Homo Sapiens
cuugucuuuuacccccacaggguuccugagcucacugaaaagacuauugugccuuaggaaaag

SEQ ID NO: 499999 - RNA, 63 nt, Homo Sapiens
uggcuaaaacaggaugauugcuuuugucuguuuacugaaaaaugaguuuagaaaggcuagccc

SEQ ID NO: 500000 - RNA, 63 nt, Homo Sapiens
gcuuuucacaccaucucagagguugaggagcauacugaaaauugcccuggggggugcugggug

SEQ ID NO: 500001 - RNA, 63 nt, Homo Sapiens
uugacuuuuguguauggguaguaaaucuagcucacugaaaaucagagugaaacgccuuuacau

SEQ ID NO: 500002 - RNA, 63 nt, Homo Sapiens
ugggaaggagaggggugcaacaggaccgccugcacugaaaacucacugcugccaugcccuggg

SEQ ID NO: 500003 - RNA, 59 nt, Homo Sapiens; identical to SEQ ID NO: 499282

SEQ ID NO: 500004 - RNA, 63 nt, Homo Sapiens
auaaugaugugugauuggauggaauugaaucaaacugaaaaaguauuuccuuauagcuuaaug

SEQ ID NO: 500005 - RNA, 63 nt, Homo Sapiens
gugaaagaaaaauauagauuaaaauugcugggcacugaaaaggggugggaguuggaaaucaga

SEQ ID NO: 500006 - RNA, 63 nt, Homo Sapiens
uuuccacucucaaguuuucuacuuugucuuugaacugaaaauaaacauggaucuagaaaacca

SEQ ID NO: 500007 - RNA, 63 nt, Homo Sapiens
acguuuccaacagcacuucucaccuauucaauaacugaaaaagacauuaccauagugcuuuac

SEQ ID NO: 500008 - RNA, 63 nt, Homo Sapiens
agaaucugaauauaaauuuguucuuacuucccuacugaaaauauacgugcacugagcugcaac

SEQ ID NO: 500009 - RNA, 63 nt, Homo Sapiens
aagagagagagagaucuggguaacagcaaaaaaacugaaaauaguuuuuauuaauuaucugga

SEQ ID NO: 500010 - RNA, 63 nt, Homo Sapiens
ugcugagccagccaucuuugaggaaugauccauacugaaaaaaucugaaucucguugaggcca

SEQ ID NO: 500011 - RNA, 63 nt, Homo Sapiens
gucucauacauauuuugcaguaaaugcuuacagacugaaaaauuaaaauggaaaacagucaua

SEQ ID NO: 500012 - RNA, 63 nt, Homo Sapiens
caaauuuuaacuagcaaaugagaaaacuagaggacugaaaaaaaaguagcugaugugcaguug

SEQ ID NO: 500013 - RNA, 63 nt, Homo Sapiens
cuaguuaccugauuauugcaauuacauuuuuuaacugaaaaacaaucuagcuuauauaagguc

SEQ ID NO: 500014 - RNA, 63 nt, Homo Sapiens
acauuagcaagcauagucuauuuuacaaaacagacugaaaaagugacauugacacuaguauua

SEQ ID NO: 500015 - RNA, 63 nt, Homo Sapiens
ugacauggcauguuucuuucuuucaauaaaacuacugaaaauuucugaaacaaaagaggcauu

SEQ ID NO: 500016 - RNA, 52 nt, Homo Sapiens; identical to SEQ ID NO: 499295

SEQ ID NO: 500017 - RNA, 63 nt, Homo Sapiens
aaagggucuguuugugucaucuugauuaaaugcacugaaaaguaauugaccuauuuauucauu

SEQ ID NO: 500018 - RNA, 63 nt, Homo Sapiens
cuauguguuuuuuuaauuggucuaggccaaaauacugaaaagcuggacucauuugaacaaaaa

SEQ ID NO: 500019 - RNA, 63 nt, Homo Sapiens
augaauuucaagauucucaaauuguuuuauucuacugaaaaaauuuacguuuucaugcugcuu

SEQ ID NO: 500020 - RNA, 63 nt, Homo Sapiens
ugcugggguuuguucugcugucugcugugauccacugaaaaugagcuguuacacuuucucuga

SEQ ID NO: 500021 - RNA, 63 nt, Homo Sapiens
ucuuaaagaaaaagcauuugcaguggaaggagcacugaaaaccaguagaucauguuuacuucc

SEQ ID NO: 500022 - RNA, 63 nt, Homo Sapiens
uaagguuauuugaauguucuccuugauuguaaaacugaaaaacaaauagcaucuaguccaacu

SEQ ID NO: 500023 - RNA, 63 nt, Homo Sapiens
uguccugcugaagcagcuauuacuuacugugauacugaaaagcgaugauccuguauugggcug

SEQ ID NO: 500024 - RNA, 63 nt, Homo Sapiens
aaauuuacuuugaucucugucauagacgcagagacugaaaaaaucagaaaacauugauuugag

SEQ ID NO: 500025 - RNA, 63 nt, Homo Sapiens
ugauguucugcuuauuuggagcaauauauaaauacugaaaauggauguuuaaagacuuccacu

SEQ ID NO: 500026 - RNA, 63 nt, Homo Sapiens
agaaugaucaauuuaaucugggugagaaugcugacugaaaaauggggauaggugccauuuggu

SEQ ID NO: 500027 - RNA, 63 nt, Homo Sapiens
uuauguugaagccauaucccuauuauggaccgaacugaaaauuuaguagcaaggaauuggugg

SEQ ID NO: 500028 - RNA, 63 nt, Homo Sapiens
aaaacaaugaaaauauucauucugcaucuugcuacugaaaacauuagacaguuauuuguuucu

SEQ ID NO: 500029 - RNA, 63 nt, Homo Sapiens
augaaugaacaaagguaauaugucuagcacugcacugaaaaaggacuucugcauuucugacau

SEQ ID NO: 500030 - RNA, 63 nt, Homo Sapiens
agggaauuuuuuuguacuguaauuuugaauggaacugaaaaauuaugcacgaauaaaguacuu

SEQ ID NO: 500031 - RNA, 63 nt, Homo Sapiens
uaaaggauacaaggauuauuucaauguuacugcacugaaaaacguguauguauuagugugcua

SEQ ID NO: 500032 - RNA, 63 nt, Homo Sapiens
uuuauugaucgugauaugacuuguuacuaggguacugaaaaaaaugucuaaggccuuuacaga

SEQ ID NO: 500033 - RNA, 63 nt, Homo Sapiens
cauggaauuuuuugaauaugccuuaauuuagaaacugaaaaauaucugguuauaucauucugg

SEQ ID NO: 500034 - RNA, 63 nt, Homo Sapiens
cugaggaggaacaaauuacaaguguacccaauaacugaaaauguuuuaacucacucucauuug

SEQ ID NO: 500035 - RNA, 63 nt, Homo Sapiens
ccaauccucaaaccucacuaaacauaagauaauacugaaaacuuuacaaaccugaaugaugug

SEQ ID NO: 500036 - RNA, 63 nt, Homo Sapiens
accaauucucaaaucuuacuaaacaaaauuaauacugaaaauguuacaaaccagaaaaaugug

SEQ ID NO: 500037 - RNA, 63 nt, Homo Sapiens
ugagaauuacaaugaauaauaauuugcuuugucacugaaaaccaccagugaagugcaauuugg

SEQ ID NO: 500038 - RNA, 63 nt, Homo Sapiens
gcacgauggcgaggaagccagccccaaggaaacacugaaaacacauaucacgccaaugccgug

SEQ ID NO: 500039 - RNA, 63 nt, Homo Sapiens
uccaucucaaaaaaaaaaaaaagaaagaaagaaacugaaaagugagguguggaacuccaggca

SEQ ID NO: 500040 - RNA, 63 nt, Homo Sapiens
acugagguuuguaaacuguccuuuuuaaaucaaacugaaaacaaaaagcuuuaaccuuucaac

SEQ ID NO: 500041 - RNA, 63 nt, Homo Sapiens
cucaauauaaaaacauucauuuggaauguacauacugaaaaauacagguuuuuuugaccaaaa

SEQ ID NO: 500042 - RNA, 63 nt, Homo Sapiens
uggauauaguuuuacuuuuaaacuguguacauaacugaaaaugugcuauacugcauacuuuuu

SEQ ID NO: 500043 - RNA, 63 nt, Homo Sapiens
uaguuuaaaaauaaaguuccugauaauaaagugacugaaaauggcauccccaaagugucuccg

SEQ ID NO: 500044 - RNA, 63 nt, Homo Sapiens
acugugaccaauucauuauaacauuuggauauuacugaaaauguaaggaagcaggaaaaauua

SEQ ID NO: 500045 - RNA, 63 nt, Homo Sapiens
cgagugaugauguugugaauggcgagugaaacuacugaaaaucguuagcuacugaauccuggg

SEQ ID NO: 500046 - RNA, 63 nt, Homo Sapiens
augugcaugaucugucacuuaaaauauuuaaaaacugaaaaaaaucuaguauuugcacuuagc

SEQ ID NO: 500047 - RNA, 63 nt, Homo Sapiens
ggagcuauuuauagauggagaaugugguaccaaacugaaaauaagaacauuuuggggcaguuu

SEQ ID NO: 500048 - RNA, 63 nt, Homo Sapiens
uauccaucuacacagcacccguauauacugugcacugaaaaaaaaguuaacuccuggacacaa

SEQ ID NO: 500049 - RNA, 63 nt, Homo Sapiens
aaauugcuaucaagaauaaaugcuuuugcuugcacugaaaauuuauuacagugggcagguauu

SEQ ID NO: 500050 - RNA, 63 nt, Homo Sapiens
aaauugcuaucaagagcaaaugcuuuugcuugcacugaaaauugcagugagcagguauguguu

SEQ ID NO: 500051 - RNA, 63 nt, Homo Sapiens
aacuguaaaugcuccuagagauguuauuugaugacugaaaaugcuacguuuuggaagugaugu

SEQ ID NO: 500052 - RNA, 63 nt, Homo Sapiens
aaggaaggguuugcagaggauacuucucagagcacugaaaagaagauuugaggcuuuucuaua

SEQ ID NO: 500053 - RNA, 63 nt, Homo Sapiens
aaaaucuguaaacgcgaaaaaacauccggcaaaacugaaaaaaaaacagugauuuagguuugu

SEQ ID NO: 500054 - RNA, 62 nt, Homo Sapiens
acucuuacggguugagucuguuguuaauaaaauacugaaaacuuguccucuugccagcucau

SEQ ID NO: 500055 - RNA, 63 nt, Homo Sapiens
gcuuuuuuuccagauauaugcuuuggcagcagaacugaaaaagugaaaccugcuuccaggcua

SEQ ID NO: 500056 - RNA, 60 nt, Homo Sapiens; identical to SEQ ID NO: 499335

SEQ ID NO: 500057 - RNA, 63 nt, Homo Sapiens
aaagcuagaauuuauuuauuuuguuuuuaagacacugaaaagauugcucaugucuguuuugcu

SEQ ID NO: 500058 - RNA, 63 nt, Homo Sapiens
gugauuacuccugaagugagaccaaggggaauuacugaaaaagagcaaagaaacuugugcuuu

SEQ ID NO: 500059 - RNA, 63 nt, Homo Sapiens
cuauguagugaaauguauuuccauuaaauaauaacugaaaagauccacuggaggucauuacug

SEQ ID NO: 500060 - RNA, 63 nt, Homo Sapiens
gacauccucugaaaauuccagaaaugcaaauauacugaaaauuccaugcuucaaaagaucuaa

SEQ ID NO: 500061 - RNA, 63 nt, Homo Sapiens
uauuaaagcuccaaauuuuaaagauuuugcagcacugaaaaucuaucucacaagucaaaaaug

SEQ ID NO: 500062 - RNA, 63 nt, Homo Sapiens
aaguuuaagcccaccaaugcguauauacacauaacugaaaaccacucaggaagagauuuaucu

SEQ ID NO: 500063 - RNA, 63 nt, Homo Sapiens
gcauauugccccaagguuacuaagcaguggugaacugaaaaggcaaacaucuuugccaaaagc

SEQ ID NO: 500064 - RNA, 63 nt, Homo Sapiens
auucauguguaaagcuuuuuggaaguucggaaaacugaaaaagaaagaaaggaauucauaugg

SEQ ID NO: 500065 - RNA, 63 nt, Homo Sapiens
gccuguccugcugguaacuguucugaaaagcccacugaaaauuucuuugucauggcaaccagc

SEQ ID NO: 500066 - RNA, 63 nt, Homo Sapiens
uguugguucauccagaagugugacauaccuuagacugaaaaacauaaaaauugaauucguuuc

SEQ ID NO: 500067 - RNA, 63 nt, Homo Sapiens
aauuccuuucagauugggguuauauuaucuuauacugaaaaaauuaguuuucuguauaugaua

SEQ ID NO: 500068 - RNA, 63 nt, Homo Sapiens
uucuuaaaucugagggaccaugcuuugaaauagacugaaaauuaagggucaccaccuaauuuu

SEQ ID NO: 500069 - RNA, 63 nt, Homo Sapiens
uagaucccagaggagggaagaaaauuugcagugacugaaaacaguaaaaaaaaaaaaaaaaaa

SEQ ID NO: 500070 - RNA, 63 nt, Homo Sapiens
aguuggcuguaaucacuccucgccgugucuggcacugaaaauaaggaaaaaaaaccuacuacu

SEQ ID NO: 500071 - RNA, 63 nt, Homo Sapiens
uucuucuucccuccuccccccauuaauauguauacugaaaaaugugcauuugucugaggaauu

SEQ ID NO: 500072 - RNA, 63 nt, Homo Sapiens
auauagguuuuggggcuuccauaucaucaaaagacugaaaaauuauaauuuuagaauuaaacu

SEQ ID NO: 500073 - RNA, 63 nt, Homo Sapiens
gugaugugauacagaacaaaguguucguuuuugacugaaaauaguagaucagaaaucucaguu

SEQ ID NO: 500074 - RNA, 63 nt, Homo Sapiens
uuuaguuuacaauuuuuaaaaaguucuuaaaauacugaaaaugcaguugacacuuguguaugg

SEQ ID NO: 500075 - RNA, 63 nt, Homo Sapiens
cauuuuuaucauguaacauucuguaaacagccuacugaaaauguuaccuuggaauuggaauua

SEQ ID NO: 500076 - RNA, 63 nt, Homo Sapiens
acaguauugcuuuguaauagccaaaucauuucaacugaaaagaugcaaagauuuacauugcug

SEQ ID NO: 500077 - RNA, 63 nt, Homo Sapiens
uguagcuuuuaugugauaugaauacacauuaucacugaaaaaauaguuuuucugucauuguua

SEQ ID NO: 500078 - RNA, 63 nt, Homo Sapiens
agaaaacaaaaaucaaaugcaagaaacugacaaacugaaaauaagaaaaaaauaaugguagua

SEQ ID NO: 500079 - RNA, 63 nt, Homo Sapiens
caaaguuuaucuuggccuuauuguacucugcagacugaaaagaaaccuuuucauuuuauguuu

SEQ ID NO: 500080 - RNA, 63 nt, Homo Sapiens
gagcagagaauauaacaugauuuucuuuagagaacugaaaagauuguggauaacaaagauauc

SEQ ID NO: 500081 - RNA, 63 nt, Homo Sapiens
ugguguugguauccaacuaucgaacuucgaccuacugaaaaggaagcucuuagcgguuaucca

SEQ ID NO: 500082 - RNA, 63 nt, Homo Sapiens
agucaggaaaacuacaggugcccucuccuguuuacugaaaaggguguuuccugcugacuacaa

SEQ ID NO: 500083 - RNA, 63 nt, Homo Sapiens
cacauuuuucuacauacagccacagagaaaacaacugaaaaacuuauuuuguuuaaauaguac

SEQ ID NO: 500084 - RNA, 63 nt, Homo Sapiens
aaaagauuaaaaccauuaaaacaagccuuggggacugaaaaaaaaacauuuguacugaguggu

SEQ ID NO: 500085 - RNA, 63 nt, Homo Sapiens
auuauuauuauaaaucaccaacuaaacauaaugacugaaaaaaaaaaauauuuuggucuagcc

SEQ ID NO: 500086 - RNA, 63 nt, Homo Sapiens
uuuuaaaauuauuugucuaugugccauuuaaaaacugaaaauagaugugccagcuaaaauugu

SEQ ID NO: 500087 - RNA, 63 nt, Homo Sapiens
caguggcuuuucuacaguacaccauuuggaacuacugaaaagaccagugaaauauuguauaac

SEQ ID NO: 500088 - RNA, 63 nt, Homo Sapiens
caacauuagcaaagagguggucucaauuguguuacugaaaauguguuccuaacaaugcaguau

SEQ ID NO: 500089 - RNA, 63 nt, Homo Sapiens
guaaaacaggcugcuuagauuuccacguaagucacugaaaacauucagagauuagucuuaggu

SEQ ID NO: 500090 - RNA, 63 nt, Homo Sapiens
augcaggcaaugugggacuuaaaaggcccaagcacugaaaauggaaccuggcgaaagcagagg

SEQ ID NO: 500091 - RNA, 63 nt, Homo Sapiens
guaagacaguuaaucagcauuauugugagagggacugaaaagaaauucuccauuaugaggaau

SEQ ID NO: 500092 - RNA, 63 nt, Homo Sapiens
ugucuuaguuauaauuagauugugaaucagccaacugaaaauccuuuuugcauauuucaaugu

SEQ ID NO: 500093 - RNA, 63 nt, Homo Sapiens
aauucuaacaagucauagguuaauauuuaagacacugaaaaaucuaagugauauaaaucagau

SEQ ID NO: 500094 - RNA, 63 nt, Homo Sapiens
accagccuggccaacauggugaaacccuucucuacugaaaauacaaaaauuagccaggugugg

SEQ ID NO: 500095 - RNA, 63 nt, Homo Sapiens
agguugaauaaagaaacagaaaaaauagaacauacugaaaauaaucuaaguuccaaccauaga

SEQ ID NO: 500096 - RNA, 63 nt, Homo Sapiens
auauuuugagcuaauaauugcaaaaauuagaagacugaaaauggacccaugagaguauauuuu

SEQ ID NO: 500097 - RNA, 63 nt, Homo Sapiens
acaagcuugauuucagugcuuauugugucuucaacugaaaaauacaaucuguggauuaugacu

SEQ ID NO: 500098 - RNA, 63 nt, Homo Sapiens
ccagccuagccaacaugacgaaaccccaucucuacugaaaauagaaaaaaaaaauuagccagg

SEQ ID NO: 500099 - RNA, 63 nt, Homo Sapiens
cugcuucuacggccaugagacugaucccuggccacugaaaagcuuuccugacaauaaaaaugu

SEQ ID NO: 500100 - RNA, 63 nt, Homo Sapiens
aaacuggagaaaguuugucauccucauuuucaaacugaaaacuaaucaaauauagugccuauu

SEQ ID NO: 500101 - RNA, 63 nt, Homo Sapiens
gaguccugauacaucuaauaaagaaccauaguuacugaaaagguuuaaguuauccaggacucc

SEQ ID NO: 500102 - RNA, 63 nt, Homo Sapiens
gacguaguaaauuaaauagacauauuuauugguacugaaaagaacagaaauacagcagacgaa

SEQ ID NO: 500103 - RNA, 63 nt, Homo Sapiens
aaguaaguuuauuuuugaggacuaguaacuaaaacugaaaacuagguccuuuuauaggcaggc

SEQ ID NO: 500104 - RNA, 63 nt, Homo Sapiens
agagccuuuaaaugauuucaacuucugcaaucaacugaaaacuguguguagaauuacuguaau

SEQ ID NO: 500105 - RNA, 63 nt, Homo Sapiens
aagagggaagaggugaggaacuggaaagcugagacugaaaaucugcugguuugggggagggga

SEQ ID NO: 500106 - RNA, 63 nt, Homo Sapiens
uguuucacagguguuugcuugauacgguuucagacugaaaacaugucagguccuaugaagaaa

SEQ ID NO: 500107 - RNA, 63 nt, Homo Sapiens
aaacacuuuacuacaguuguaucuugguuauauacugaaaaucguuuauuacuguucagcauc

SEQ ID NO: 500108 - RNA, 63 nt, Homo Sapiens
ugucuugauguuucaguuauaaauguugcuuucacugaaaaagggcauuaaaauuuguaauug

SEQ ID NO: 500109 - RNA, 63 nt, Homo Sapiens
cuggcuaaugcucuuguguaguuaccuguucucacugaaaaguccaagugcuggugccagccu

SEQ ID NO: 500110 - RNA, 63 nt, Homo Sapiens
gugaaauguacuaaauaaaaugagggacugaauacugaaaacuagaugacuauaaaauguuca

SEQ ID NO: 500111 - RNA, 63 nt, Homo Sapiens
uguauuaaaaauaaaauuaagaaaaugccccuuacugaaaaucaaaauagaaccaauuagguu

SEQ ID NO: 500112 - RNA, 63 nt, Homo Sapiens
ucagccauggccaggccccccuuaccugcaggaacugaaaacaaucauagagaaaugaagaug

SEQ ID NO: 500113 - RNA, 63 nt, Homo Sapiens
uuuucugagacuuagaguaaccuccauauccugacugaaaaccucacccuugaggaccaggag

SEQ ID NO: 500114 - RNA, 63 nt, Homo Sapiens
caaaaauuagcugggcguggaaacuccaucucuacugaaaauaccaucuuugccaacauggug

SEQ ID NO: 500115 - RNA, 63 nt, Homo Sapiens
cagaaaaguuagccaggcguaaacccagucucuacugaaaauaccagccugaccaacauggag

SEQ ID NO: 500116 - RNA, 63 nt, Homo Sapiens
aguaugguuucaugaaauuggagcucuguauaaacugaaaaagacaaaauaaguaaagcacuu

SEQ ID NO: 500117 - RNA, 63 nt, Homo Sapiens
uuucauuuaaugauagacggaaaaugugugguuacugaaaacuguauaugauacagaauuuca

SEQ ID NO: 500118 - RNA, 63 nt, Homo Sapiens
ccagccuggccaucauggugaaacccugucucuacugaaaauacaaaaauuagccgggcgugg

SEQ ID NO: 500119 - RNA, 63 nt, Homo Sapiens
uuugaguaaccaucaacacgauuaguuuacagaacugaaaaggaaucugagaucuguacugua

SEQ ID NO: 500120 - RNA, 63 nt, Homo Sapiens
cauuucuuuuuuaugugacauggagcacaaagaacugaaaauauguuuugagggagcaugaca

SEQ ID NO: 500121 - RNA, 63 nt, Homo Sapiens
cucauaguagguauauaugaguuuucacagaagacugaaaaauaaugcaugauauuuguuugu

SEQ ID NO: 500122 - RNA, 63 nt, Homo Sapiens
ccaagucauuuaacuucaguaaaccucgguaugacugaaaagggaguuuucuguauggccguc

SEQ ID NO: 500123 - RNA, 63 nt, Homo Sapiens
gggauaaaacaccaugaaaauaaacuugaauaaacugaaaauggaccuuuuuuuuuuuaaugg

SEQ ID NO: 500124 - RNA, 63 nt, Homo Sapiens
cucaggcuuuguuugagguccuguauauacagcacugaaaagagagauaaagucccugccugc

SEQ ID NO: 500125 - RNA, 63 nt, Homo Sapiens
cacucauucaaaauauuuaagauauguucccucacugaaaaauagagauguaaggguuauuua

SEQ ID NO: 500126 - RNA, 63 nt, Homo Sapiens
auuaaauguuagucuuuagucugaagggcuguaacugaaaauugcuuuaucucaaagcuuuca

SEQ ID NO: 500127 - RNA, 63 nt, Homo Sapiens
uccugugucuugauagcaugcucucaugaggcaacugaaaaaaaacugccaagcccagguugc

SEQ ID NO: 500128 - RNA, 63 nt, Homo Sapiens
uuguagugaugacuaccaaaauagguaaccaacacugaaaacuuucugucuaguacuugucuu

SEQ ID NO: 500129 - RNA, 63 nt, Homo Sapiens
aauuuaucaguaauuuuuaaauauaaucagagaacugaaaagucaagaauguguaucuguugg

SEQ ID NO: 500130 - RNA, 63 nt, Homo Sapiens
caguggcaaggaaaagcacaggauguucucuuuacugaaaagagccugugcagggggcuggcu

SEQ ID NO: 500131 - RNA, 63 nt, Homo Sapiens
uuuaauaaaauaaccuuuaaaaugaaaccuugaacugaaaauaacccuucauagcuuuguuac

SEQ ID NO: 500132 - RNA, 54 nt, Homo Sapiens; identical to SEQ ID NO: 499411

SEQ ID NO: 500133 - RNA, 63 nt, Homo Sapiens
acuagagggauuaguacaaaucacacacaaccaacugaaaaaguauuuaagugcuagggcugg

SEQ ID NO: 500134 - RNA, 63 nt, Homo Sapiens
gucccagaaugaccccaucggaugacaguggcaacugaaaacaccaauauugcuaauauaaua

SEQ ID NO: 500135 - RNA, 63 nt, Homo Sapiens
uaacaguauccccuucucaucauuuuaaauuccacugaaaauuucauaaggaguugguguaau

SEQ ID NO: 500136 - RNA, 63 nt, Homo Sapiens
ugaaacgacacuguauugcucccaugaguugcgacugaaaauggcaguguccaaaccuaguuu

SEQ ID NO: 500137 - RNA, 63 nt, Homo Sapiens
aaaaacaaaaaaacgaaagcucagugccucaugacugaaaacaauuucagcacaacucauucu

SEQ ID NO: 500138 - RNA, 63 nt, Homo Sapiens
guagguuugggcagaagaauuuuaguuuuaaggacugaaaaugccacuucagacuuuagccug

SEQ ID NO: 500139 - RNA, 63 nt, Homo Sapiens
gggacaacccccuuccuuauauggggacauuagacugaaaacuagacaugggucugucauaga

SEQ ID NO: 500140 - RNA, 63 nt, Homo Sapiens
gacuccaugggaccccaaagaagcagauggaaaacugaaaaagaaaaccccucaagugagcca

SEQ ID NO: 500141 - RNA, 63 nt, Homo Sapiens
uuaaauauaaaaauaaauauuguucugauuauuacugaaaagaugucagccauuucaaugucu

SEQ ID NO: 500142 - RNA, 63 nt, Homo Sapiens
aguuugaccucacagugacccuucccaaucagcacugaaaauaccaucaggccuaaucucaua

SEQ ID NO: 500143 - RNA, 63 nt, Homo Sapiens
aaucucauaccucugaccaacaggcuguucugcacugaaaagguucuucaucccuuuccaguu

SEQ ID NO: 500144 - RNA, 63 nt, Homo Sapiens
aaaaauggcucuuuuugcaauaaguagauacauacugaaaaaaucuaaacuuacaauguuuau

SEQ ID NO: 500145 - RNA, 63 nt, Homo Sapiens
ccguggaagauacacauguuugcauccuaagauacugaaaaaagggcaccuuugucacuugaa

SEQ ID NO: 500146 - RNA, 63 nt, Homo Sapiens
uguccuuggcgaaucgauaaucauugcauagugacugaaaagccuaagugcaaaaaaaaaaaa

SEQ ID NO: 500147 - RNA, 63 nt, Homo Sapiens
cucuuacuagaaaacuauuuucuaaauauuaacacugaaaauguuuuguuagcuuuuccuucu

SEQ ID NO: 500148 - RNA, 63 nt, Homo Sapiens
cacgggacuucccgaacuaauuuuuuuaaggauacugaaaaaugagagagaguggucgaaugc

SEQ ID NO: 500149 - RNA, 63 nt, Homo Sapiens
cagaggcccagacaggcucacucaagcucuuuaacugaaaagcaacaagccacuccaggacaa

SEQ ID NO: 500150 - RNA, 63 nt, Homo Sapiens
uuuuuagccuaaguauaagaguccuacagauggacugaaaaaaaucagucugagaguauuagu

SEQ ID NO: 500151 - RNA, 63 nt, Homo Sapiens
uacuacaugcuggcaaaggugaaggaucagaggacugaaaaaugauucugcaacucucuuaaa

SEQ ID NO: 500152 - RNA, 63 nt, Homo Sapiens
ggccuccagacccacacucacagucugugaaaaacugaaaauccccuggugggcacucccugg

SEQ ID NO: 500153 - RNA, 63 nt, Homo Sapiens
cugccuuuuucuuugguugcuccuguggaaaauacugaaaagauuacuuuguuuuauuuuguu

SEQ ID NO: 500154 - RNA, 63 nt, Homo Sapiens
ugguguuaaauaucagcuccuaauaagauguggacugaaaacacuaucacaacacuaugagaa

SEQ ID NO: 500155 - RNA, 63 nt, Homo Sapiens
gugccugccccucccccagcuguuuuuaaugaaacugaaaaaauagacuugaucccggcagga

SEQ ID NO: 500156 - RNA, 63 nt, Homo Sapiens
ccuugaagggcagcaggcccaagugcugcucugacugaaaacugaguuaacaagaugaaaucu

SEQ ID NO: 500157 - RNA, 63 nt, Homo Sapiens
auacaugccuucuauauggaacauggcagaaagacugaaaaauaacaguaauuaauuguguaa

SEQ ID NO: 500158 - RNA, 63 nt, Homo Sapiens
ggaaaugaaaacuguuugugaucuuccguauucacugaaaaauaaaugcuuguuuaguaucaa

SEQ ID NO: 500159 - RNA, 63 nt, Homo Sapiens
cuugcacaaggaaggaucuucagauauucaugcacugaaaaaugcuguuaucuuuuguuuuua

SEQ ID NO: 500160 - RNA, 63 nt, Homo Sapiens
uaccacagcauuuguacuguuccuuuuuaauauacugaaaauauaaaaggaaggguguguguu

SEQ ID NO: 500161 - RNA, 63 nt, Homo Sapiens
ccauccuggcuaacacggugaaaccccgucucuacugaaaauacaaaaaauuagccaggcaug

SEQ ID NO: 500162 - RNA, 63 nt, Homo Sapiens
ccauccuggcuaacauggugaaaccccgucucuacugaaaauacaaaaaauuagccgggugug

SEQ ID NO: 500163 - RNA, 63 nt, Homo Sapiens
uagaauacuucaacgugcaugaaaguuuaagugacugaaaaugguuguagccaucugagagag

SEQ ID NO: 500164 - RNA, 63 nt, Homo Sapiens
uaaaaaguuaaaaaaaauaagccguugccaagaacugaaaacaugauaauguugugguuuguu

SEQ ID NO: 500165 - RNA, 63 nt, Homo Sapiens
auguauauguuguaaauauuuucaauguaaagaacugaaaacaaaaaaaguuugucuuugaga

SEQ ID NO: 500166 - RNA, 63 nt, Homo Sapiens
acuaaaccgguggaaucugacacuggcuccuccacugaaaacuuuccaaaugagcccaaauuc

SEQ ID NO: 500167 - RNA, 63 nt, Homo Sapiens
uguaugauucaaauuuguuuagaauuaaaugauacugaaaauuaaauguccccaaaguauuaa

SEQ ID NO: 500168 - RNA, 63 nt, Homo Sapiens
uguuagacaagccacaaaguuccccaacucuuaacugaaaaugccagggaacgguagauuuau

SEQ ID NO: 500169 - RNA, 63 nt, Homo Sapiens
aaaauaaaaauauguauucucuccaucucaaaaacugaaaauagccugggugacagagugaga

SEQ ID NO: 500170 - RNA, 63 nt, Homo Sapiens
ucuacaacaaucuucaggaagauccuugaaaacacugaaaaccuauuuuuaagcugaaaaggg

SEQ ID NO: 500171 - RNA, 63 nt, Homo Sapiens
uuuggcagucuuguaugcaaaacgaauauuuugacugaaaaaugauuucuuuuuaaaguuuua

SEQ ID NO: 500172 - RNA, 63 nt, Homo Sapiens
acggcagguggccuaaggcuauuugcaggggauacugaaaaaucacucauuuucaauuucuaa

SEQ ID NO: 500173 - RNA, 63 nt, Homo Sapiens
ugagaacuauuuaccuaucauggggggggaugcacugaaaaucgggugggaugaaacauguuu

SEQ ID NO: 500174 - RNA, 63 nt, Homo Sapiens
aucacugaauggaauguucaaacuuauuggaaaacugaaaagaucuccccucccuucaggaau

SEQ ID NO: 500175 - RNA, 63 nt, Homo Sapiens
gacucucuuugugacaaagauaaacauauggaaacugaaaaugaacuugagaaaauuacuuca

SEQ ID NO: 500176 - RNA, 63 nt, Homo Sapiens
gcugacuucauggaauggacauccuguauaagcacugaaaaacaacaacacaauaacacuaaa

SEQ ID NO: 500177 - RNA, 63 nt, Homo Sapiens
gaaguguaccuguguacauaacucuguaaaaacacugaaaaauuauacuaacuuauuuauguu

SEQ ID NO: 500178 - RNA, 63 nt, Homo Sapiens
guaugaaucugcucauguggagacuggcuauaaacugaaaaguguauuccaaauugcagaaca

SEQ ID NO: 500179 - RNA, 63 nt, Homo Sapiens
ccacuacagaacagggcuaaauuagccaccaccacugaaaacucagccgaauuuuuuuauacc

SEQ ID NO: 500180 - RNA, 63 nt, Homo Sapiens
cccaccacccccccgcccccccgaagccaugucacugaaaaggccugggggggaugguauaug

SEQ ID NO: 500181 - RNA, 63 nt, Homo Sapiens
accucuuaagucccaguauaccucauuuuucauacugaaaaaaaaagcuuguggccaauggaa

SEQ ID NO: 500182 - RNA, 63 nt, Homo Sapiens
aacaguucucaugagaacuugguaguaagcuaaacugaaaauaaggugggcuucacuggagaa

SEQ ID NO: 500183 - RNA, 63 nt, Homo Sapiens
ucugcgugggaccaugccugaacuccccgaauaacugaaaaauggcugaauauuuuuaugguu

SEQ ID NO: 500184 - RNA, 63 nt, Homo Sapiens
caaacaguucucauuacaaaggaccaauucagaacugaaaagcuaugcauaggacaaggaaga

SEQ ID NO: 500185 - RNA, 63 nt, Homo Sapiens
cgagccuggccaacauggugaaacccuguagcuacugaaaauacaaaaauaagccaggcgugg

SEQ ID NO: 500186 - RNA, 63 nt, Homo Sapiens
uucaguguagggaagacauuuguaauaaugaaaacugaaaauggaguaauugugaguaacuca

SEQ ID NO: 500187 - RNA, 63 nt, Homo Sapiens
ugcuguuaacguauuugccaguuacgaaguuccacugaaaauuuuccuauuaauucuuaagua

SEQ ID NO: 500188 - RNA, 63 nt, Homo Sapiens
ucccagguuuuuagaucccacugagcccagcugacugaaaacaaggacagucagggugaaacu

SEQ ID NO: 500189 - RNA, 63 nt, Homo Sapiens
uagaaauuauauagcagauucuuuguugggaagacugaaaaaaauaaagauagguauaggaua

SEQ ID NO: 500190 - RNA, 63 nt, Homo Sapiens
cagugucugccagaguuuaguucuuuauaccuuacugaaaaaugccucguggucuucgcagag

SEQ ID NO: 500191 - RNA, 63 nt, Homo Sapiens
cguguccuuuucucuaaaugagguuuucuguggacugaaaaaugacugggacugcucuggguu

SEQ ID NO: 500192 - RNA, 63 nt, Homo Sapiens
agaaaauacauuagcaagcuaauuuguauguaaacugaaaauaaaugugaagcaaacaaaaaa

SEQ ID NO: 500193 - RNA, 63 nt, Homo Sapiens
uuuaaacugaauuuuuugacuauuuuuauuaaaacugaaaaaaggauuugcuucuaggcccau

SEQ ID NO: 500194 - RNA, 63 nt, Homo Sapiens
uuugagugugaaucuacugaauaaauguaugacacugaaaagauuucauaacuuuauggcuua

SEQ ID NO: 500195 - RNA, 63 nt, Homo Sapiens
uuaaaagugagagcugaaaaacuaaggaaaauaacugaaaagauacuuugguggcuaaguuuu

SEQ ID NO: 500196 - RNA, 63 nt, Homo Sapiens
cggcucauguuaaugaguuagccagccuggggcacugaaaauagccuucucucagacugccug

SEQ ID NO: 500197 - RNA, 63 nt, Homo Sapiens
auacauaacugugauugaaaacauguaccauuaacugaaaaucaucugcaaagugcaauuuca

SEQ ID NO: 500198 - RNA, 63 nt, Homo Sapiens
aggggucuggguacuucuugccacccucauucuacugaaaagguuccugaagaaccagucccc

SEQ ID NO: 500199 - RNA, 63 nt, Homo Sapiens
uccagaugagcucuucuuucugcagguugggauacugaaaauuacccacugggucuaccagua

SEQ ID NO: 500200 - RNA, 63 nt, Homo Sapiens
uaugaaaccaaaaguacaaauuuacugaaauuaacugaaaaaaugccuuuuauauauuauguu

SEQ ID NO: 500201 - RNA, 63 nt, Homo Sapiens
ugcgauucuucuuaguuuucuggacaucacccuacugaaaacuccgcaccagaucaaguaguu

SEQ ID NO: 500202 - RNA, 63 nt, Homo Sapiens
uguguguugagcagcucugaauuuaaccaacccacugaaaacuuagcccacugaccaggaauu

SEQ ID NO: 500203 - RNA, 63 nt, Homo Sapiens
aaucacuuccuugaaaauuugauccaauggaauacugaaaagaacacacacauucacccuaag

SEQ ID NO: 500204 - RNA, 63 nt, Homo Sapiens
gguaucaagaaaguccacuguuuuauccauucaacugaaaauuccuagcucucugugaaugug

SEQ ID NO: 500205 - RNA, 63 nt, Homo Sapiens
ccauccauuugggaaagaagcaaggggaaggguacugaaaacagccuggagccaaagaugaca

SEQ ID NO: 500206 - RNA, 63 nt, Homo Sapiens
auaaaggaagagacccaucuucaagauuaugugacugaaaaacacaugugauaacuauggaaa

SEQ ID NO: 500207 - RNA, 63 nt, Homo Sapiens
gauuggcacugucucacuuggcugugacaacagacugaaaaagggcugguuaccucuuugcug

SEQ ID NO: 500208 - RNA, 63 nt, Homo Sapiens
uauugcuuuuuauacuacugcuacuguuuacagacugaaaaauggaaaggagaaaaaucacga

SEQ ID NO: 500209 - RNA, 63 nt, Homo Sapiens
ggucuuucagucuuggcauuauuuggaaaggucacugaaaauguuugucucuugguccacagu

SEQ ID NO: 500210 - RNA, 63 nt, Homo Sapiens
gccuccuccaucucucaccuaaacccacacacaacugaaaauucacagccaaagccuuaaauc

SEQ ID NO: 500211 - RNA, 63 nt, Homo Sapiens
gcgaggagucuuucuagaacugacuguuuaaaaacugaaaacauucugggggagauggagauu

SEQ ID NO: 500212 - RNA, 63 nt, Homo Sapiens
aaaagagaaaguucauccuccugaggaggugaaacugaaaauauuaaaauaagaaagcugaga

SEQ ID NO: 500213 - RNA, 63 nt, Homo Sapiens
ucacggagcugaccaucuuuaccugguccuggaacugaaaaacuguagcuugugugaaaauga

SEQ ID NO: 500214 - RNA, 63 nt, Homo Sapiens
ccagcccaaccaacauggugaaacccugucuccacugaaaauacauaaaauuagccgggugca

SEQ ID NO: 500215 - RNA, 63 nt, Homo Sapiens
gcugagaaaggggcaggcaaaaugaagcuggccacugaaaacuguaagauggucaaaagcuga

SEQ ID NO: 500216 - RNA, 63 nt, Homo Sapiens
ucagccuggccaacauggugaaaccccuucucuacugaaaauacaaaaauuagccagacguga

SEQ ID NO: 500217 - RNA, 63 nt, Homo Sapiens
ccagccuggccaacauggugaaaccccaucucuacugaaaauacaaaaauuaggcauaguggu

SEQ ID NO: 500218 - RNA, 63 nt, Homo Sapiens
uuuuaaagcugcuugcaaaguguuggugauuuuacugaaaacuuuugagaucuucauuuuaca

SEQ ID NO: 500219 - RNA, 63 nt, Homo Sapiens
acacacuuuaaaaauaugucuuuuuucaaucuaacugaaaaccuucuuaacuucuaauauauu

SEQ ID NO: 500220 - RNA, 63 nt, Homo Sapiens
uuauuuauauaacugcauuuaagcaguaccaagacugaaaaaaaagguaauaaaugaaauguu

SEQ ID NO: 500221 - RNA, 63 nt, Homo Sapiens
uuuuaauuauaaguguuauggcuaaaguuauuuacugaaaauuucaguaaaaugugugaaugu

SEQ ID NO: 500222 - RNA, 63 nt, Homo Sapiens
ccuuucucuguaccucuaagaagaaagaaucuaacugaaaauaccaaaaaaaaaaaaaaaaaa

SEQ ID NO: 500223 - RNA, 63 nt, Homo Sapiens
uauucagaaauggaaaauuuagcaauauauaauacugaaaaagaucuaacuuauuagacagca

SEQ ID NO: 500224 - RNA, 63 nt, Homo Sapiens
ucacauucuauuuuggguauaugauggccuuacacugaaaaugaguuagguugucuccaggcc

SEQ ID NO: 500225 - RNA, 63 nt, Homo Sapiens
uagccagaguuagguugucuucuaguaagaugcacugaaaacugagcccauacuuuuggcucc

SEQ ID NO: 500226 - RNA, 63 nt, Homo Sapiens
ccaaaaauuuagaugccuuaaguaaaauuauauacugaaaacaaaaaaagaauaaaaaguagc

SEQ ID NO: 500227 - RNA, 62 nt, Homo Sapiens
acuugguguuuuguguucaaaugugaauaaacuacugaaaacaaauaagcagagaaaaaaaa

SEQ ID NO: 500228 - RNA, 63 nt, Homo Sapiens
cuccugaguacucccuuggcaaauguauuuaggacugaaaauauuuucuuguuuccugauaau

SEQ ID NO: 500229 - RNA, 63 nt, Homo Sapiens
auauccaguuagaaaauuguauggauuagagugacugaaaaacuuggaaaguaagaaaguuuc

SEQ ID NO: 500230 - RNA, 63 nt, Homo Sapiens
uuuuugucauauucuuguauacugccuguuuccacugaaaacacuagugcgauuucacagucu

SEQ ID NO: 500231 - RNA, 63 nt, Homo Sapiens
gucucauaggaguccucuuguaauauuucauauacugaaaaguaaaucauucaaggauuauag

SEQ ID NO: 500232 - RNA, 63 nt, Homo Sapiens
auugcaagcauugacuauaacgugaugagacaaacugaaaauugcaugaauaggcucugcuaa

SEQ ID NO: 500233 - RNA, 63 nt, Homo Sapiens
ccaccauucuacagaguuguacucaagacagauacugaaaaaaucuaauaccuucccuuguau

SEQ ID NO: 500234 - RNA, 63 nt, Homo Sapiens
cagacuauguugcaagucuguuucaucuaguaaacugaaaauuauugcuuaaucaaacugccg

SEQ ID NO: 500235 - RNA, 63 nt, Homo Sapiens
ggccauguaugaagccaaauauuaggcuuaaaaacugaaaaaucugguucauucuucagauau

SEQ ID NO: 500236 - RNA, 63 nt, Homo Sapiens
aauccucauggccucuaaauuaguauguagaacacugaaaaguucuuaacauuuuuguguaau

SEQ ID NO: 500237 - RNA, 62 nt, Homo Sapiens
acaaaccgaagacucuuugaagacaucguaacacugaaaaguacacuuucuacuaaagaugc

SEQ ID NO: 500238 - RNA, 63 nt, Homo Sapiens
ccaucuuugaaaaaauuacccucuagcucuaacacugaaaauaauaauaaauuguagaucucu

SEQ ID NO: 500239 - RNA, 63 nt, Homo Sapiens
ggacaaaauaaauugugaaaggaaguguaguugacugaaaacuacaguuguaauaagucuucc

SEQ ID NO: 500240 - RNA, 63 nt, Homo Sapiens
agcaagccugaugguuugucuuauuucauucauacugaaaauucuuugcauauuuuuuuucug

SEQ ID NO: 500241 - RNA, 63 nt, Homo Sapiens
cugcagguaucacuuugauccuaugugggagcgacugaaaauagaaugagcuugguuaagcac

SEQ ID NO: 500242 - RNA, 63 nt, Homo Sapiens
uagaauugagauggccuuuuuuucacauuguagacugaaaagagacuuaaugguaugaugugu

SEQ ID NO: 500243 - RNA, 63 nt, Homo Sapiens
aaaauguagcgggauuuuuaaggaaucagagagacugaaaaaaaaaaaaaaauuaaugauggu

SEQ ID NO: 500244 - RNA, 63 nt, Homo Sapiens
aacccacacacccuacaaguugaucaugcaggaacugaaaaccagucuucucccuguccccuc

SEQ ID NO: 500245 - RNA, 63 nt, Homo Sapiens
aauuuguuuaguauaaauugucauagcugguuuacugaaaacaaacacauuuaaaauugguuu

SEQ ID NO: 500246 - RNA, 63 nt, Homo Sapiens
uguuugcuuaaaguuaaugauuaaaaccaauuuacugaaaacuuucaccuaaagcuagaucuc

SEQ ID NO: 500247 - RNA, 63 nt, Homo Sapiens
cauuguaauacuacaaguauccauaaauacuggacugaaaaaauugcugcagccgagugaccu

SEQ ID NO: 500248 - RNA, 63 nt, Homo Sapiens
cuuuucagggcugugugaauacugguaguuggcacugaaaaaaucauucacguuucaugacca

SEQ ID NO: 500249 - RNA, 63 nt, Homo Sapiens
auguuuucuuacuguuuaauucaggcgcuaugaacugaaaaauuuuaauguauauguuucucu

SEQ ID NO: 500250 - RNA, 63 nt, Homo Sapiens
aucuggaaauuccuaaugucuucuacaaaugcuacugaaaaaaguauuuguuaccaaaagugg

SEQ ID NO: 500251 - RNA, 63 nt, Homo Sapiens
gaccaaggccugugcacaggugaggucccccauacugaaaacuccgcugauguacaauaaccu

SEQ ID NO: 500252 - RNA, 63 nt, Homo Sapiens
caggggaugaguuccaucagucuauucucuuuuacugaaaaagggguggggaucuugcaaauu

SEQ ID NO: 500253 - RNA, 63 nt, Homo Sapiens
uggccguugcaaucugcucaaaccuaacaccaaacugaaaacauaaauacugaccacuccuau

SEQ ID NO: 500254 - RNA, 63 nt, Homo Sapiens
agucaacugcuguuauuagaagaaaaguacuguacugaaaauucagaaaaaaaaucucaaccu

SEQ ID NO: 500255 - RNA, 63 nt, Homo Sapiens
accagccuggccaacaugugaaaccccgucuccacugaaaauagaaaaauuagcugggcaugg

SEQ ID NO: 500256 - RNA, 63 nt, Homo Sapiens
uauuuuuuaguaaucaagaaaggcuggaaaacuacugaaaaacugaucaagcuggacuugugc

SEQ ID NO: 500257 - RNA, 63 nt, Homo Sapiens
uaaugauuuauauaucacuuaguguguagagggacugaaaauauuuauuuuguuauaaauaau

SEQ ID NO: 500258 - RNA, 63 nt, Homo Sapiens
acacauuucuuaaaacacaugauaccagcagcaacugaaaaugaaugccgaauuugguacaca

SEQ ID NO: 500259 - RNA, 63 nt, Homo Sapiens
uuuuaacuuuugaaaugugugagaguguuacuuacugaaaacugaaaggauaugacaugcugg

SEQ ID NO: 500260 - RNA, 63 nt, Homo Sapiens
ugugggauuguaggcaaacccaccuguggcaucacugaaaauaaauuugaucauaccuaagag

SEQ ID NO: 500261 - RNA, 63 nt, Homo Sapiens
uuccuuuuuugucacuuuuauccuuuuuuuaaaacugaaaauauuuuucucuugcuauuuaua

SEQ ID NO: 500262 - RNA, 63 nt, Homo Sapiens
acuuaaaauaagaaaaggagcacuuuaauuacaacugaaaaaucagauuguuuugcaguccuu

SEQ ID NO: 500263 - RNA, 63 nt, Homo Sapiens
ugcucuacaucucguauggaugacauuucaaucacugaaaaugacagugacacguuuggccag

SEQ ID NO: 500264 - RNA, 63 nt, Homo Sapiens
aacuuuuaccaacauggcuaguguuacccauguacugaaaauguauaaugggaaagggccugg

SEQ ID NO: 500265 - RNA, 63 nt, Homo Sapiens
uauguggccagacacagugguuuguugaauugaacugaaaauucuaaugaaacccaguagaug

SEQ ID NO: 500266 - RNA, 63 nt, Homo Sapiens
cccugcauuuaaaaauguuuaugaacucuuuuuacugaaaauggcuggggacagaagguuuuc

SEQ ID NO: 500267 - RNA, 63 nt, Homo Sapiens
cauuuuuaaagagaaaguacuuuccagugaguuacugaaaauacccgaaauaagaacccauua

SEQ ID NO: 500268 - RNA, 63 nt, Homo Sapiens
cuggguuggggacagggaguccccauggaggacacugaaaagguggagcuauucugguaccuu

SEQ ID NO: 500269 - RNA, 63 nt, Homo Sapiens
accuucguuuucaagguucuuaauacaagcuccacugaaaaccguauaaauaccuucuauuuu

SEQ ID NO: 500270 - RNA, 63 nt, Homo Sapiens
aggcccuguugccuuuuaagaaucaucaucgccacugaaaaccuuucccugacugucauagag

SEQ ID NO: 500271 - RNA, 63 nt, Homo Sapiens
cacgcauuuuguaauccaaaugcaaccauaugaacugaaaaaaauaucuuucauaagggcugu

SEQ ID NO: 500272 - RNA, 63 nt, Homo Sapiens
uaauaaaauugcaaguuaagaaaagguaagaguacugaaaaauaaauuuucuuaguaguauau

SEQ ID NO: 500273 - RNA, 63 nt, Homo Sapiens
ggaggugcagaggcagcagaggauuggcauaaaacugaaaaggaguucugucugcaugagaaa

SEQ ID NO: 500274 - RNA, 63 nt, Homo Sapiens
aaauacugucagaaguccagguauacugauaacacugaaaauucuauuagcaaccuucugggu

SEQ ID NO: 500275 - RNA, 63 nt, Homo Sapiens
cagccugaccaaacauggcgaaaccccaucuguacugaaaauacaaaaauuaggcaugguggu

SEQ ID NO: 500276 - RNA, 63 nt, Homo Sapiens
gugaaucagccagcaauauuuuaguugcaaaucacugaaaacccaacucaaagugacuuaagu

SEQ ID NO: 500277 - RNA, 63 nt, Homo Sapiens
cacaucaugaaggcagaggcaugcacauuccucacugaaaaagaaaacacacacccacccaca

SEQ ID NO: 500278 - RNA, 63 nt, Homo Sapiens
uuccuucccccugacccugacuccuugaacgucacugaaaacggcagcuauugcaaggagugg

SEQ ID NO: 500279 - RNA, 63 nt, Homo Sapiens
uuuucaagccuuacacaauagcagagaauauaaacugaaaaaauccauacaaauauuaaaaau

SEQ ID NO: 500280 - RNA, 63 nt, Homo Sapiens
caggguucagaaaaggcaaacucaugaaaugccacugaaaagaacuuucaacacagcauacuu

SEQ ID NO: 500281 - RNA, 63 nt, Homo Sapiens
acugagaagucaagauccucccuggaggacaggacugaaaaccuugccaagcuguacacaguu

SEQ ID NO: 500282 - RNA, 63 nt, Homo Sapiens
ucccuuuucucaucuuaccccuuuaugccaccuacugaaaagaaaaacaaauagcuagguuug

SEQ ID NO: 500283 - RNA, 63 nt, Homo Sapiens
aggauggaggaaugugggcaguuugacuucagcacugaaaaccucuccaccugggccaggguu

SEQ ID NO: 500284 - RNA, 63 nt, Homo Sapiens
aacuaucagggcaaaaucucacuggauuucuccacugaaaaccuacuugagguuucuggucug

SEQ ID NO: 500285 - RNA, 63 nt, Homo Sapiens
uggaguacagcgggagaaacacaaaauaguauaacugaaaacauuaacauucagacacacucc

SEQ ID NO: 500286 - RNA, 63 nt, Homo Sapiens
guuuuuuuaauguuaaauguguaacucaguauuacugaaaagguacccacauuuugaauagua

SEQ ID NO: 500287 - RNA, 63 nt, Homo Sapiens
ccagccuggccaacaugaugaaauguugucucuacugaaaaugcaaaaauuagccagguauag

SEQ ID NO: 500288 - RNA, 63 nt, Homo Sapiens
caggcaucuagguucuuuuuuuggaccuuuuguacugaaaaucaccuuuucccuuucauguuc

SEQ ID NO: 500289 - RNA, 63 nt, Homo Sapiens
gacuggcagagucccgagaagacgccuuugugaacugaaaagaugugcacccagcgcuccaua

SEQ ID NO: 500290 - RNA, 63 nt, Homo Sapiens
gagagcuauguaacagauacauuucagaaauggacugaaaaugcuaaaggcuaugcgauauga

SEQ ID NO: 500291 - RNA, 63 nt, Homo Sapiens
uaacaccgacugcccgccccugaacacugacgaacugaaaagcaaggggauuucguguaaaug

SEQ ID NO: 500292 - RNA, 63 nt, Homo Sapiens
agcagcuucucuauccaggauuuugugucauuaacugaaaagugucauaugaugcaaaaaagg

SEQ ID NO: 500293 - RNA, 63 nt, Homo Sapiens
accuuccaaauuugccaagaccaacaaaaugcaacugaaaaaucauuaccaaaauacuaaaac

SEQ ID NO: 500294 - RNA, 63 nt, Homo Sapiens
caacuggcuacaaagaaggaaaaauaaagguaaacugaaaagaauaucaucaggucuuaaaaa

SEQ ID NO: 500295 - RNA, 63 nt, Homo Sapiens
caacuccaggagcuauggcauuucaaugaagucacugaaaaucggccauagaaacguuuuaau

SEQ ID NO: 500296 - RNA, 63 nt, Homo Sapiens
uauauguauauacacccaagucaacaguaaaccacugaaaaaacuaauauauuuaaaaauaag

SEQ ID NO: 500297 - RNA, 63 nt, Homo Sapiens
aaccaacaaaaaugaguuguugaaaaauaaaacacugaaaagaaaaacuuaaauuguauauuu

SEQ ID NO: 500298 - RNA, 63 nt, Homo Sapiens
auuauuuuguaacuaagauuaucaagaaagacuacugaaaagugugcugguuuuuaaaugugc

SEQ ID NO: 500299 - RNA, 63 nt, Homo Sapiens
aaaauuuuaaaaaaggcuguguaaauuuaauguacugaaaauauuuuuagaauguuuuuauga

SEQ ID NO: 500300 - RNA, 63 nt, Homo Sapiens
uucauuugaggucuagaucuaggcacuguggacacugaaaaacaguugggaaaucuuucgagc

SEQ ID NO: 500301 - RNA, 63 nt, Homo Sapiens
caguagucugggacugggcauuuaucuucucugacugaaaaucucuccuuggucuuaaggaaa

SEQ ID NO: 500302 - RNA, 63 nt, Homo Sapiens
uccacaagucucaagccucagugcuaaaguacuacugaaaaggaacuaggaaguuuggccaau

SEQ ID NO: 500303 - RNA, 63 nt, Homo Sapiens
agaugacccagccaucuacaagaucugaauucuacugaaaauaucuagaaauguggaagagac

SEQ ID NO: 500304 - RNA, 63 nt, Homo Sapiens
uuuuuuaauucuucccuuggauuaauauuuucuacugaaaagaaaugaaaucucaguuccacu

SEQ ID NO: 500305 - RNA, 63 nt, Homo Sapiens
ccuuuuaaguaaccacucaaaacuuuucauuucacugaaaaaauaugaaaaaccaugacaaua

SEQ ID NO: 500306 - RNA, 63 nt, Homo Sapiens
ccaaacuccaaagcuuugaacauucaugacugaacugaaaacaagccaugacuugagaaacaa

SEQ ID NO: 500307 - RNA, 63 nt, Homo Sapiens
aacuuggacuaguguaacuccuucaugcaauaaacugaaaagagccaugcugucuagucuuga

SEQ ID NO: 500308 - RNA, 63 nt, Homo Sapiens
uaaccagucaccagugcgauucuggauaaagccacugaaaauucgaaccaggaaauggaaccc

SEQ ID NO: 500309 - RNA, 63 nt, Homo Sapiens
gauuucagaacauguguuaauaguauauaugccacugaaaacuuagguccuguaucauacuuu

SEQ ID NO: 500310 - RNA, 63 nt, Homo Sapiens
uuguaucauccgggcuccuuccgggcagaaacaacugaaaaugcacuucagacccacuuauuu

SEQ ID NO: 500311 - RNA, 63 nt, Homo Sapiens
aacugaucauuaucuccuucucuuugagaccugacugaaaaaauuaggugugcacaccuguaa

SEQ ID NO: 500312 - RNA, 63 nt, Homo Sapiens
gcagggcccugugguuggacuucaccucucagcacugaaaacccaaaacccagcuggccuuaa

SEQ ID NO: 500313 - RNA, 63 nt, Homo Sapiens
cauucccauacauugcguguuggcaaagagacuacugaaaaaaaaaaaaauaagacccaauau

SEQ ID NO: 500314 - RNA, 63 nt, Homo Sapiens
uccccaaacaauagcaaauccuuaauucaacuuacugaaaauuagaacuaaaaauagaugguu

SEQ ID NO: 500315 - RNA, 63 nt, Homo Sapiens
cuccuccccaauuuggggggugcuggggguuggacugaaaaccgaaaucucuggccucacccc

SEQ ID NO: 500316 - RNA, 63 nt, Homo Sapiens
auuguucagggggaguugggauaaaaauauaauacugaaaaggguaauaauaacauaauaaua

SEQ ID NO: 500317 - RNA, 63 nt, Homo Sapiens
ucgcuuuuauaguaggaagguuuucagaaaugaacugaaaauugaauuuauugaccaauuuau

SEQ ID NO: 500318 - RNA, 63 nt, Homo Sapiens
acagugacauguuugaaaagcaguguccucccaacugaaaacaugccagaaaaaugugcucug

SEQ ID NO: 500319 - RNA, 63 nt, Homo Sapiens
uuuaaggugggaggguggcaagcuucuuuugauacugaaaacuggacucggguggccugcgcu

SEQ ID NO: 500320 - RNA, 63 nt, Homo Sapiens
ucuccucauguucugcuuuccuuugucacagggacugaaaaccccacgagcuuguucuuuguu

SEQ ID NO: 500321 - RNA, 61 nt, Homo Sapiens
uugaauaugauucuuauucucuauucuauuggcacugaaaaccauguaccaaaauaaaccu

SEQ ID NO: 500322 - RNA, 63 nt, Homo Sapiens
uaauuauaggagcauuuguucuuaagccauguaacugaaaaucaagaaggcaagccuccccaa

SEQ ID NO: 500323 - RNA, 63 nt, Homo Sapiens
aaugugaaacuaggaaauaagccucucuccuagacugaaaauguccagaguuguacagcagaa

SEQ ID NO: 500324 - RNA, 63 nt, Homo Sapiens
uacuaccuauaggaaagucuuugguuuuucaacacugaaaaaaggagggagaaaggagaaauu

SEQ ID NO: 500325 - RNA, 63 nt, Homo Sapiens
gguaccgaauagguuguguguuuugggugggccacugaaaagggagucgauggcaggaggggg

SEQ ID NO: 500326 - RNA, 63 nt, Homo Sapiens
gcuggguaagcaagucaaggcacccguguagcuacugaaaauggccgcccaguguucugugac

SEQ ID NO: 500327 - RNA, 63 nt, Homo Sapiens
aauuuuuuaauuugagaauuuuuauuucuuuugacugaaaacacauuagaaccuaugaguaaa

SEQ ID NO: 500328 - RNA, 63 nt, Homo Sapiens
gaaaaagcauggaaaggaagagaacugauuccuacugaaaauucaaauucuauuaccauucua

SEQ ID NO: 500329 - RNA, 63 nt, Homo Sapiens
gugacuacugcucacaaacgucgcaaagcagaaacugaaaacugguagguacacuuuccuacc

SEQ ID NO: 500330 - RNA, 63 nt, Homo Sapiens
agaaacaaaugugcccaccccacuuuccgcuuaacugaaaagcuuaaaauaaauuucugaauu

SEQ ID NO: 500331 - RNA, 63 nt, Homo Sapiens
uaauucuucagaggcagggcuaagacuuucaagacugaaaagagacuagcauaaggagacuua

SEQ ID NO: 500332 - RNA, 63 nt, Homo Sapiens
uguuuaucugcugcuuuuuuuaaauaaaauuugacugaaaauguuuaauuggcauuuuuuaau

SEQ ID NO: 500333 - RNA, 63 nt, Homo Sapiens
ugacucacuuuuauauacaagaaaaaccuuuccacugaaaaaucccucugauuuaaaaguaac

SEQ ID NO: 500334 - RNA, 63 nt, Homo Sapiens
uggaagagagaggaagaagucaaaccauaugaaacugaaaaaauaugacguacgaaauggaca

SEQ ID NO: 500335 - RNA, 63 nt, Homo Sapiens
uuguauuuccauauugaagcagcuugaguuucuacugaaaaugagcccgaauuauuucacuau

SEQ ID NO: 500336 - RNA, 63 nt, Homo Sapiens
aauugacagcuaguguuuuucugaaaaccaauuacugaaaaaaagauugaaaaaaaaaaagca

SEQ ID NO: 500337 - RNA, 63 nt, Homo Sapiens
aauuacugaaaaaaaauugaaaaaaaaaaaagcacugaaaaccaucaccuucucaucagauug

SEQ ID NO: 500338 - RNA, 63 nt, Homo Sapiens
cuuaauauacaucuuuaaucgcauauguaugguacugaaaaaugcuuauaguaggacuucuuu

SEQ ID NO: 500339 - RNA, 63 nt, Homo Sapiens
aaugcaaggacuauggucucuuguucauaguggacugaaaacuuguuuacaugcagcagauaa

SEQ ID NO: 500340 - RNA, 63 nt, Homo Sapiens
ugaccuucaauggauugaggguuccuuuaaaagacugaaaagcgcaaggagacagaaugcuuu

SEQ ID NO: 500341 - RNA, 63 nt, Homo Sapiens
uguauaaaaucuagcaauucaguuuacauuugaacugaaaauacaguaucauuaaaaugguua

SEQ ID NO: 500342 - RNA, 63 nt, Homo Sapiens
aaaguguuaauuuuaccuuguaaaauagcaauaacugaaaaugugaaagugguaauccucuuc

SEQ ID NO: 500343 - RNA, 63 nt, Homo Sapiens
cacauaguuugucaaaagugagguggucccuacacugaaaacgacaaguacccuaaaauugaa

SEQ ID NO: 500344 - RNA, 63 nt, Homo Sapiens
uuacauuuugagucagguuuagaaauuaagucuacugaaaaauaauuauuaaauaugcaaguu

SEQ ID NO: 500345 - RNA, 63 nt, Homo Sapiens
uuuccaagccucuuuuuuccauaaggaaaccauacugaaaaccuuuaacugcuaaaucuuauu

SEQ ID NO: 500346 - RNA, 63 nt, Homo Sapiens
uuucagcuucuuacaaauacauaagagacucacacugaaaaaaguuguaugaauauaaaaaug

SEQ ID NO: 500347 - RNA, 63 nt, Homo Sapiens
uaugguugcuuaauuguucugugauugaggaccacugaaaaauaagucuuaauaaauguuggu

SEQ ID NO: 500348 - RNA, 63 nt, Homo Sapiens
ccaucucagaaaaaaaaaaaaaagauaauucauacugaaaagaaacucuacaaacuugaaaga

SEQ ID NO: 500349 - RNA, 63 nt, Homo Sapiens
gccccucucagcagacgcuucaugauaggaaggacugaaaagucuuguggacaccuggucuuu

SEQ ID NO: 500350 - RNA, 63 nt, Homo Sapiens
caacaagacaucagaacuuauuccucuugucuaacugaaaaugcaugccugaugaccaaacuc

SEQ ID NO: 500351 - RNA, 63 nt, Homo Sapiens
auuuacacuauugcccuaggcuugcuaggaaagacugaaaaaauuuuugugccuaacuuugug

SEQ ID NO: 500352 - RNA, 63 nt, Homo Sapiens
auuuuuauaucauuggcuuuuuuacccagagccacugaaaacuuccucauccacacaccuuuc

SEQ ID NO: 500353 - RNA, 63 nt, Homo Sapiens
aaaugagaacaacaaaaaaaagaggagauugaaacugaaaacaguugucuuuucaucuguuca

SEQ ID NO: 500354 - RNA, 63 nt, Homo Sapiens
aaaaaacuuuuaaaaaaugucaucucuacaaaaacugaaaaauagggcaacauggugagaccu

SEQ ID NO: 500355 - RNA, 63 nt, Homo Sapiens
caaaaaauuuagccagguguaaaccuugucucuacugaaaauaccacccuggccaacauggug

SEQ ID NO: 500356 - RNA, 63 nt, Homo Sapiens
gaaauaaacugcuugaaaagagucaacauuagaacugaaaaugcaggugaauauuuaugaaaa

SEQ ID NO: 500357 - RNA, 63 nt, Homo Sapiens
acagcacuuuuaacaccuuuuucagucugucauacugaaaaugucuagcaauaugauagauaa

SEQ ID NO: 500358 - RNA, 63 nt, Homo Sapiens
auauaauacugccauccauaaguuucaguaaguacugaaaagucaaguagccuuaauaacguu

SEQ ID NO: 500359 - RNA, 63 nt, Homo Sapiens
acgagagaaaagagaguggucugagugagucugacugaaaaauugaugauucauuucaaaauc

SEQ ID NO: 500360 - RNA, 63 nt, Homo Sapiens
gacuacucagauauguuggaacguguuuaaaaaacugaaaaguaauccaaaucuauuuuucuc

SEQ ID NO: 500361 - RNA, 63 nt, Homo Sapiens
cgugccugaugaccaaacucuuccucuugucaaacugaaaaugcaacaggacaucagaacuua

SEQ ID NO: 500362 - RNA, 63 nt, Homo Sapiens
uucauaaggggcaguugguggaguguugcagugacugaaaagcgaugagauaauuggugucgg

SEQ ID NO: 500363 - RNA, 63 nt, Homo Sapiens
ggaggcagggcuggacucaggaacccacagcuuacugaaaaagccagaggccaugacugcccc

SEQ ID NO: 500364 - RNA, 63 nt, Homo Sapiens
uuuaaugaccauuuccuggaaucaguuuauuauacugaaaacugggggugggaguagggagcu

SEQ ID NO: 500365 - RNA, 63 nt, Homo Sapiens
aagagaccuuccuagagugaaugaagguagaaaacugaaaagggaguaaauuaaggaaugauu

SEQ ID NO: 500366 - RNA, 63 nt, Homo Sapiens
ugaaacuagcugaagccuuuucuuguuuuagcaacugaaaauuguacuuggucacuuuugugc

SEQ ID NO: 500367 - RNA, 63 nt, Homo Sapiens
agagugauaaacuaagucacauacagauaaagcacugaaaacaccacagugacccucccaccc

SEQ ID NO: 500368 - RNA, 63 nt, Homo Sapiens
auugcuuuguauuguauauuacaaugaucaccgacugaaaauauuguuuuacaauaguucugu

SEQ ID NO: 500369 - RNA, 63 nt, Homo Sapiens
aucuguccuggaaacuguagaauugaauaaaucacugaaaauagaacacuucuuggaggcuuu

SEQ ID NO: 500370 - RNA, 63 nt, Homo Sapiens
uuuccaaagcuccugaucuuucccaagauuguaacugaaaacugcugucucuuguuuuguucg

SEQ ID NO: 500371 - RNA, 63 nt, Homo Sapiens
auuugcaaacucaaucggggacuaaaauuucccacugaaaauguuaaacauuuuagauaacug

SEQ ID NO: 500372 - RNA, 63 nt, Homo Sapiens
agcaauguacuguacauuugacuggaaaaagagacugaaaaaaacccuguucuacugcaaaac

SEQ ID NO: 500373 - RNA, 63 nt, Homo Sapiens
gguaauuguugcuaaucuucuguuuugauuuguacugaaaaaugugagccugaauuuuguugc

SEQ ID NO: 500374 - RNA, 63 nt, Homo Sapiens
aucaaucagauguaucuucacuguuaaaucaugacugaaaaaaaaugagcaucucaaagaagu

SEQ ID NO: 500375 - RNA, 63 nt, Homo Sapiens
uggugcucaauaaagaagccuguggcaacuuguacugaaaaucugaaucugaaacccuccuuc

SEQ ID NO: 500376 - RNA, 63 nt, Homo Sapiens
agguccguucagcuccgccuaggugugaacaagacugaaaagggagagaccuggcccucaaaa

SEQ ID NO: 500377 - RNA, 63 nt, Homo Sapiens
acuacugaauuuuaucaaauauuuauagcuacuacugaaaauguuuaagccuauuuccuaucc

SEQ ID NO: 500378 - RNA, 63 nt, Homo Sapiens
aaugaaguugauguauguccuuuuuuuuaagguacugaaaagauaugucccagaacugauguu

SEQ ID NO: 500379 - RNA, 63 nt, Homo Sapiens
cugaaacugcuuugaaaauuucccaacauauauacugaaaauaggccaugaaccauuauaaaa

SEQ ID NO: 500380 - RNA, 63 nt, Homo Sapiens
ugaucucuguuuuuccugucagagauuuaaaaaacugaaaagguauaccucaacccaaaaaua

SEQ ID NO: 500381 - RNA, 63 nt, Homo Sapiens
agagaauauguuuaauccauguauugguacuuuacugaaaaccagguuauauucuaaagaaga

SEQ ID NO: 500382 - RNA, 63 nt, Homo Sapiens
uuaauuuuguuuuauagauaugauaggcaacagacugaaaaccauaaucuuuacuguauucua

SEQ ID NO: 500383 - RNA, 63 nt, Homo Sapiens
acaaauguuguaaauucccuaaccaauguguuuacugaaaauacgcauagacuuuuaaacuuc

SEQ ID NO: 500384 - RNA, 63 nt, Homo Sapiens
cuauuugcuugauuaccauuauagaucuaugagacugaaaaacaagucuuugaucgaaggaaa

SEQ ID NO: 500385 - RNA, 63 nt, Homo Sapiens
caacgggaaaugugguccuaguauaacacaucuacugaaaaagacuuucaaauugaaaugacg

SEQ ID NO: 500386 - RNA, 63 nt, Homo Sapiens
aaaauccugucuguuuuugucucuauaccaaagacugaaaaaaaauaagaggaggagaaagcu

SEQ ID NO: 500387 - RNA, 63 nt, Homo Sapiens
cuaaugggaugccuuuuacuguccuugacuaagacugaaaagacagauugauucaugauaauu

SEQ ID NO: 500388 - RNA, 63 nt, Homo Sapiens
caugguaaaauaggauuucuuaagcuuuuucgaacugaaaauuuuuuccauuuuacuuaggaa

SEQ ID NO: 500389 - RNA, 63 nt, Homo Sapiens
gcugccuaaggaaguuuggagugcggggaagucacugaaaaguuucguggcagggaaagcagc

SEQ ID NO: 500390 - RNA, 63 nt, Homo Sapiens
uuacugaaagucacuuuuauaauccauuuuuauacugaaaauguuuuccagaaaugaaaugua

SEQ ID NO: 500391 - RNA, 63 nt, Homo Sapiens
guaauaggaaagauaacgggaagaugccaguugacugaaaauucaaagccuuucaauuugaag

SEQ ID NO: 500392 - RNA, 63 nt, Homo Sapiens
caaaaaaaaaaaaaccagacugaauuaauuuuaacugaaaauuucucuuauguuccaaguaca

SEQ ID NO: 500393 - RNA, 63 nt, Homo Sapiens
gaguaaaagcccaguuugcuaggaggucugcuuacugaaaacaaggagaccuggggugggugu

SEQ ID NO: 500394 - RNA, 63 nt, Homo Sapiens
aaaaaauuauuuucucuuaacaagacuuuuuguacugaaaacaauuuuuuugaaucuuucgua

SEQ ID NO: 500395 - RNA, 63 nt, Homo Sapiens
aauuguacugaaauuaacuuuuaugacagcuacacugaaaaauguaggaaauuuaaacucuaa

SEQ ID NO: 500396 - RNA, 63 nt, Homo Sapiens
uaucuuaaacugacccuuccgaagaaggaguucacugaaaacugaaagacaccuucccgggug

SEQ ID NO: 500397 - RNA, 63 nt, Homo Sapiens
gccaaacaaguggugucuguacccauaguuuuaacugaaaagguauaauuugaacuguacugg

SEQ ID NO: 500398 - RNA, 63 nt, Homo Sapiens
acauggccuugggugacaaacuccuuccuuuccacugaaaagcgugcggccuuagagguuucc

SEQ ID NO: 500399 - RNA, 63 nt, Homo Sapiens
aguuuagagacugggggaggagacagaaaauuaacugaaaagccucauauacagcaggcaaag

SEQ ID NO: 500400 - RNA, 63 nt, Homo Sapiens
aguuuagacauugggggaggagccagaaaauuaacugaaaagccucauauauaguagacaaag

SEQ ID NO: 500401 - RNA, 63 nt, Homo Sapiens
aaaaaacugaagaacuuugguguaauuuaaaaaacugaaaaaaagcaaagcuuuuuauuacuu

SEQ ID NO: 500402 - RNA, 63 nt, Homo Sapiens
aaccauuuuagugucaggcuuucuccccccguuacugaaaaauuucacacucugccuccccac

SEQ ID NO: 500403 - RNA, 63 nt, Homo Sapiens
uaagggcuugauuccuagccgucuguuuuucuaacugaaaagcuuauguauauauuuuucaag

SEQ ID NO: 500404 - RNA, 63 nt, Homo Sapiens
uuuugguuugguuuggcuuugacuaauucugguacugaaaaguuagcuauacacacacacaca

SEQ ID NO: 500405 - RNA, 63 nt, Homo Sapiens
gcuuaaguuuuaucguguaaauacauuagcuaaacugaaaaguauaaguaacaugcuuuguug

SEQ ID NO: 500406 - RNA, 63 nt, Homo Sapiens
agagacuguguucauguguaaagacugagcagaacugaaaaauuacuuauuggauauucauuc

SEQ ID NO: 500407 - RNA, 63 nt, Homo Sapiens
uacuugaaauuacuugaauuuucuugucuuaaaacugaaaaaaaaauguaguuacacguuaaa

SEQ ID NO: 500408 - RNA, 63 nt, Homo Sapiens
ugcaguuuguccucauaaacguuguagguugaaacugaaaaauaaguuaaaaugaucaaucaa

SEQ ID NO: 500409 - RNA, 63 nt, Homo Sapiens
ucugaaauuuaauucuauuuugauaaaacuaagacugaaaauaaccacuuguaaacauuccua

SEQ ID NO: 500410 - RNA, 63 nt, Homo Sapiens
gcagccuggccaagauggugaaaccccgucucuacugaaaauacaaaaauuagccaggugugg

SEQ ID NO: 500411 - RNA, 63 nt, Homo Sapiens
uacacacauggcugaugucacauugaaaaugugacugaaaauuugaaaauucucucaauaaag

SEQ ID NO: 500412 - RNA, 63 nt, Homo Sapiens
uuaacuuaaaaaguaguuagccaauaugcaaucacugaaaacuaugcaagagaaauuccaacc

SEQ ID NO: 500413 - RNA, 63 nt, Homo Sapiens
guuucuugcuguugaaaaaaggaacaaagcguuacugaaaagaagguaaccuuuguuggaugu

SEQ ID NO: 500414 - RNA, 63 nt, Homo Sapiens
gggaagcagauaucaacucacacuauucacacaacugaaaauauugggcaucaaauagauuag

SEQ ID NO: 500415 - RNA, 63 nt, Homo Sapiens
gcccuaggagcccuguaacucccaggagagaccacugaaaauacuggagcaacaaugccccug

SEQ ID NO: 500416 - RNA, 63 nt, Homo Sapiens
aaagugauaaacuaacaaacaaauauaacaacaacugaaaaggcacucuaaauuguggcuggc

SEQ ID NO: 500417 - RNA, 63 nt, Homo Sapiens
ggaucauuuuguggaugccaaaugaauaucaaaacugaaaacacauuuguugauauuugucuu

SEQ ID NO: 500418 - RNA, 63 nt, Homo Sapiens
uggauaugaguauccuuugcuuaucuuuguaguacugaaaauuugccgaaguaacuggcugug

SEQ ID NO: 500419 - RNA, 63 nt, Homo Sapiens
uaaacauaucaguaaguuucuauauguaucaaaacugaaaaaauaguguuccaggcuaacaua

SEQ ID NO: 500420 - RNA, 63 nt, Homo Sapiens
acuuaauauuuaugaguuggccaaacauaagucacugaaaaacccugaucagcacuaccacau

SEQ ID NO: 500421 - RNA, 63 nt, Homo Sapiens
uauaugaccggguaucaguguguugcagaaagaacugaaaaggacuuucuacaccuggaggaa

SEQ ID NO: 500422 - RNA, 63 nt, Homo Sapiens
agauuucuuaugugacuuuuauauuugcaguuuacugaaaaguuguuauagguugaagcacac

SEQ ID NO: 500423 - RNA, 63 nt, Homo Sapiens
guacaggugaaaugauauguuuuagagaaguauacugaaaaauguuuuaaaaaaugauuaucu

SEQ ID NO: 500424 - RNA, 63 nt, Homo Sapiens
aucacuucauuugauacuguuaccuucccuuucacugaaaaugguuuucuuuguauuguguuc

SEQ ID NO: 500425 - RNA, 63 nt, Homo Sapiens
uauuugugacuuuaaucgugauagaccucuuguacugaaaacaauuuuaugaauaccaaauaa

SEQ ID NO: 500426 - RNA, 63 nt, Homo Sapiens
aauagcccauauaccuauguugugcucuaaaauacugaaaaacccacauuuuaaguuggaugg

SEQ ID NO: 500427 - RNA, 63 nt, Homo Sapiens
ugagaccaagagcaaggaaguguguuuauucaaacugaaaagcaaugcugaaaauugccuuuc

SEQ ID NO: 500428 - RNA, 63 nt, Homo Sapiens
cugugagaauuuguuuucagguuaacagccaacacugaaaacaucuguucuauugaaugccuu

SEQ ID NO: 500429 - RNA, 63 nt, Homo Sapiens
uuuucaaaggaagguaucagcgugugcauucuuacugaaaaugauggaauauguuacuuaaaa

SEQ ID NO: 500430 - RNA, 63 nt, Homo Sapiens
ucagaucauuuuguauuaauuaauuccagauuuacugaaaaugcuacaauaaaaauccagucu

SEQ ID NO: 500431 - RNA, 63 nt, Homo Sapiens
uggcauagcuuaaaagaugacucccaaagcgccacugaaaagaaaaaaggccuguacauacuu

SEQ ID NO: 500432 - RNA, 63 nt, Homo Sapiens
uucauuccauaucuacuuacuguuaccuacuaaacugaaaacacgcuguccauuguuugagga

SEQ ID NO: 500433 - RNA, 63 nt, Homo Sapiens
agaguccuacuuacauaguuauuauauaccgugacugaaaacuacaaaaauguaacaggggaa

SEQ ID NO: 500434 - RNA, 63 nt, Homo Sapiens
aagagaaauaaauagaaucucucuccuacuugaacugaaaaguucuuuuauuuccaaaacaug

SEQ ID NO: 500435 - RNA, 63 nt, Homo Sapiens
aggaggugcacgggccaccauagucacacuggcacugaaaagaaagcguugcccuggugauuc

SEQ ID NO: 500436 - RNA, 63 nt, Homo Sapiens
ccaagguggucgggcaaaguauugccaggagauacugaaaaucauccagaagcacugugauau

SEQ ID NO: 500437 - RNA, 64 nt, Homo Sapiens
aacccaaaacaaauaauuacuauaauuauuucauguuacauaauaaaaaaauacugcauugaua

SEQ ID NO: 500438 - RNA, 64 nt, Homo Sapiens
gccaaguggaaaauauaucuaugcuaagguauguguuacauaugugauuuuggaauuuuauguc

SEQ ID NO: 500439 - RNA, 64 nt, Homo Sapiens
uaaacuauuucugcuauuaugcuaauguacuucuguuacauaauuuaucucaagacuaucuuaa

SEQ ID NO: 500440 - RNA, 64 nt, Homo Sapiens
uaauagagcagaugguugccaggcuugguuucagguuacauaaagauuccaggaaugaagaauu

SEQ ID NO: 500441 - RNA, 64 nt, Homo Sapiens
agcuaauuauuuuuucuuauaaaauccagccccgguuacauauaaucaucuguaucuuaucaug

SEQ ID NO: 500442 - RNA, 64 nt, Homo Sapiens
uggguuauuuuguccuuuuacuuuuuuaaaaaauguuacauauuguaugcacugugcugaugca

SEQ ID NO: 500443 - RNA, 64 nt, Homo Sapiens
uaaaauacauagcauugaaguugacacaguacaaguuacauagcgaaucuaauaagguucacug

SEQ ID NO: 500444 - RNA, 64 nt, Homo Sapiens
ucuauauuuuaagucuuggguguuuaaaguagaaguuacauaauacucaaaacauuuuucauuu

SEQ ID NO: 500445 - RNA, 64 nt, Homo Sapiens
cagucaauuaaauuuuaacagcagcaauugcacaguuacauacacuagacaguucugugagaaa

SEQ ID NO: 500446 - RNA, 64 nt, Homo Sapiens
uuuuguauuauuuuuuuuaugcucuuccacagcaguuacauaaggcuacauguccgagugaguu

SEQ ID NO: 500447 - RNA, 61 nt, Homo Sapiens
aaauacuugucuguuuuaaaaaccuguucaagucuaccaaccuguucaagucuaccaauua

SEQ ID NO: 500448 - RNA, 61 nt, Homo Sapiens
aaaaccuguucaagucuaccaaccuguucaagucuaccaauuauaagggcaaauuggagaa

SEQ ID NO: 500449 - RNA, 61 nt, Homo Sapiens
agucuguaaacauaaccuuaacaauucacaugucuaccacauucacauuauauuggaauga

SEQ ID NO: 500450 - RNA, 61 nt, Homo Sapiens
gaacacacugcauguaaaagucaacgauuaagucuaccaaaugcaaauucuguaauuucac

SEQ ID NO: 500451 - RNA, 62 nt, Homo Sapiens
cagcgaauugggaagucucaccaagcuagauugucuaccaucagcccagaacucuguaacuu

SEQ ID NO: 500452 - RNA, 62 nt, Homo Sapiens
cauaaacaauauugcuagagguggcauguuuagucuaccaaaaacaauacuuuucaggcacu

SEQ ID NO: 500453 - RNA, 58 nt, Homo Sapiens
cagccaguccagcaaaaugaacagcauugucuaccagaagcaguuccagucagccccu

SEQ ID NO: 500454 - RNA, 62 nt, Homo Sapiens
cacauucuguuuaggaugacaguaauucuguugucuaccauuaaugcuacuaccuacuccau

SEQ ID NO: 500455 - RNA, 62 nt, Homo Sapiens
cauuuccaacacugugugaauuaucuaaaugcgucuaccauuuugcacuagggaggaaggau

SEQ ID NO: 500456 - RNA, 62 nt, Homo Sapiens
uccccuggucagagccugagaucuggggucuugucuaccacccuauauguauauuuauauau

SEQ ID NO: 500457 - RNA, 62 nt, Homo Sapiens
ugguuggcaacuuucccaaugagaaccuaguggucuaccaagaggaaagggaagggaaaaca

SEQ ID NO: 500458 - RNA, 62 nt, Homo Sapiens
uccucauagugagccagaaggccaaagaaucugucuaccaacugaucuccaaacaaccuuca

SEQ ID NO: 500459 - RNA, 62 nt, Homo Sapiens
gggcugcuaguauaugucagauucugaaaucagucuaccaagaaauguucuauaugcauuua

SEQ ID NO: 500460 - RNA, 62 nt, Homo Sapiens
cuacuucugccuuauggcuagggaacugucaugucuaccauguauuguacauaugacuuuau

SEQ ID NO: 500461 - RNA, 62 nt, Homo Sapiens
ugauguuuuuacgugaauauguugaaguagaagucuaccauauuauuuuauaaaauguuuuc

SEQ ID NO: 500462 - RNA, 62 nt, Homo Sapiens
uuuugugauguacuaaggauacugguccugaagucuaccaaauauuauagugcauuuuagcc

SEQ ID NO: 500463 - RNA, 62 nt, Homo Sapiens
cccgugaaauggcagcucguggucacucaccugucuaccacuuuuuauuucuccccaggugu

SEQ ID NO: 500464 - RNA, 62 nt, Homo Sapiens
guacuuauaacuguuauuaauucuuuuucagugucuaccauuuuucuuuucuauuaaggguu

SEQ ID NO: 500465 - RNA, 62 nt, Homo Sapiens
uacuauggaguaaaagaauucgucuagaauuggucuaccaguggaggcaauuguaaaaugga

SEQ ID NO: 500466 - RNA, 62 nt, Homo Sapiens
cuuuuugcucaguaggagucauccuaaccucugucuaccaaccuuauaucuguauucuuuag

SEQ ID NO: 500467 - RNA, 62 nt, Homo Sapiens
uuuuuacauauuggaaaauacacuacuucauugucuaccaacuucucuccuaaaaauuugca

SEQ ID NO: 500468 - RNA, 62 nt, Homo Sapiens
acaaggacugugcaucuaagucacagugccgugucuaccacugcuucuaaaucaaacuuccu

SEQ ID NO: 500469 - RNA, 62 nt, Homo Sapiens
gugcuuaaggccagaugggcaugugcacuugggucuaccaauggaguugagugaugcccguc

SEQ ID NO: 500470 - RNA, 62 nt, Homo Sapiens
uagggaaauuucaugggauaauuagcaggcuggucuaccaccuggaccauguaacucuagug

SEQ ID NO: 500471 - RNA, 62 nt, Homo Sapiens
augccuggugcaguauaauucccaaguguacugucuaccagaaaaaaaaaacaaaacuaaua

SEQ ID NO: 500472 - RNA, 62 nt, Homo Sapiens
uaacuuccuaaagaauucaucuguuuauacaagucuaccacugccgauugacuaaaaaauac

SEQ ID NO: 500473 - RNA, 62 nt, Homo Sapiens
uaauauuacuguuuauuucuguuucucauauggucuaccaguuugcugaugucccuagaaaa

SEQ ID NO: 500474 - RNA, 62 nt, Homo Sapiens
ugaugaaugggaaauaaaauaacaacccaaaugucuaccaacuguaauagccaaaaagugga

SEQ ID NO: 500475 - RNA, 62 nt, Homo Sapiens
agccagaugcuuccagaguuucuguguaaaaugucuaccaguggauuggucagaaauugcua

SEQ ID NO: 500476 - RNA, 62 nt, Homo Sapiens
uggggaaguuucacccucucaaagaugguuucgucuaccaauuuaggagaauauauccaaua

SEQ ID NO: 500477 - RNA, 62 nt, Homo Sapiens
cagacgaagcucucuuacaagaaggucgaugugucuaccaggucaauaaaugcaccuuagca

SEQ ID NO: 500478 - RNA, 62 nt, Homo Sapiens
ggugaaugugugagaaaaacuaacuugauagggucuaccaauacaaaauguauuacgaaugc

SEQ ID NO: 500479 - RNA, 62 nt, Homo Sapiens
uuucuuuuggugcagaaccguugugcaguggggucuaccaugcaauuuucuuucagcacuga

SEQ ID NO: 500480 - RNA, 62 nt, Homo Sapiens
uucuuuuucuuuugugcuggucuugcaaguuugucuaccaguaagagagcaaaguuuccuuc

SEQ ID NO: 500481 - RNA, 62 nt, Homo Sapiens
cuacuuucaauuuggugaaaauguauuaaguugucuaccauguuuucuuuucuagcugaaua

SEQ ID NO: 500482 - RNA, 62 nt, Homo Sapiens
gaaaaauguugaaaaauaagcaaaauguuuuugucuaccaaaucuuggacacaucugaaaua

SEQ ID NO: 500483 - RNA, 62 nt, Homo Sapiens
ugaguaaugaagauaaaaaccaagcuagguuagucuaccauuaguucauauguuuuuguagc

SEQ ID NO: 500484 - RNA, 62 nt, Homo Sapiens
aaucugcugcauagcucuauuuuaaaguaaaagucuaccaccgaaucccuagucccccuguu

SEQ ID NO: 500485 - RNA, 62 nt, Homo Sapiens
uaacuaugacugacguccccagaaguuucugggucuaccacacuccccaaccccccacuccu

SEQ ID NO: 500486 - RNA, 53 nt, Homo Sapiens
agcagcaacaguuuguguagccagucuaccaccaccacagcaccccagacagc

SEQ ID NO: 500487 - RNA, 62 nt, Homo Sapiens
uguguuuugaaagcccaaggcuaggcgauuuugucuaccauugaguuggacuucagucuugc

SEQ ID NO: 500488 - RNA, 62 nt, Homo Sapiens
aaaauacuugucuguuuuaaaaaccuguucaagucuaccaaccuguucaagucuaccaauua

SEQ ID NO: 500489 - RNA, 62 nt, Homo Sapiens
aaaaaccuguucaagucuaccaaccuguucaagucuaccaauuauaagggcaaauuggagaa

SEQ ID NO: 500490 - RNA, 62 nt, Homo Sapiens
auuugccuacucauagggacuuugccuauuaagucuaccaaauuaaaagucuuaucauucag

SEQ ID NO: 500491 - RNA, 62 nt, Homo Sapiens
caugggguuugcuugcuuagaauacccacggggucuaccagcgggagcaguguugaugccaa

SEQ ID NO: 500492 - RNA, 62 nt, Homo Sapiens
agauccuggaaaucaggguuaguauuguccaggucuaccaaaaaucucaauauuucagauaa

SEQ ID NO: 500493 - RNA, 62 nt, Homo Sapiens
aacaccaaccagaugaacaagggucaagugcugucuaccaucguccucaucuggagccugaa

SEQ ID NO: 500494 - RNA, 62 nt, Homo Sapiens
uuuaauuuaugguucaacugauucaaaugugagucuaccauuuuuauauauaacuagcugcu

SEQ ID NO: 500495 - RNA, 62 nt, Homo Sapiens
agcuucuuuuuccaaauguaaagaggcccugugucuaccagggaacaaagaacaauauccca

SEQ ID NO: 500496 - RNA, 62 nt, Homo Sapiens
agcgguccuugcccauuuggacuuaccuaucugucuaccagugucuggccaaugauucuuuu

SEQ ID NO: 500497 - RNA, 62 nt, Homo Sapiens
cucccuugccccauuaucuuuucaccucccaggucuaccauuucaugguggucguugggucc

SEQ ID NO: 500498 - RNA, 62 nt, Homo Sapiens
agcagccagccagcagccucucccaggcgggagucuaccauccgagacggcgaugacaaaga

SEQ ID NO: 500499 - RNA, 62 nt, Homo Sapiens
ggaaggccaggagcccaguagccauguggccagucuaccauggggcccaggaguuggggaaa

SEQ ID NO: 500500 - RNA, 53 nt, Homo Sapiens
auuauuuuucuaagcugguuggugucuaccauguuauuagaagaaugaacuaa

SEQ ID NO: 500501 - RNA, 62 nt, Homo Sapiens
gucuagacacgggggcaggugaacuuaaacgagucuaccagucauggaggauugccugugag

SEQ ID NO: 500502 - RNA, 62 nt, Homo Sapiens
gaauuauuauccagacuggagagaauucuuuugucuaccauauccaggaaacccaagaggcu

SEQ ID NO: 500503 - RNA, 62 nt, Homo Sapiens
gauggcgcaugcaugggaggaauucaucuucagucuaccagcccccgcugugucggauacac

SEQ ID NO: 500504 - RNA, 62 nt, Homo Sapiens
uuuugugaaaagcagugguauguguacguguugucuaccaguacacaggcugcagaagacag

SEQ ID NO: 500505 - RNA, 62 nt, Homo Sapiens
ucuccgaguacugcagaacugacauuuugacggucuaccagcguggcggcugguguugguca

SEQ ID NO: 500506 - RNA, 62 nt, Homo Sapiens
cuccagucuccuggaggugggacuggacaggagucuaccagcuuguuuugagacucaugaaa

SEQ ID NO: 500507 - RNA, 62 nt, Homo Sapiens
aaaaguuuuaaacucaagcauuaacauucuaagucuaccaaaauauuuucuuuaucuaaaua

SEQ ID NO: 500508 - RNA, 62 nt, Homo Sapiens
gaugaauauuaacauggagggcuuugccugaugucuaccagaagcccuguguguggauggug

SEQ ID NO: 500509 - RNA, 62 nt, Homo Sapiens
agccaccccugcuuucuggccaucucuucuuugucuaccauuucaaauugacuugugaauac

SEQ ID NO: 500510 - RNA, 62 nt, Homo Sapiens
ugagguccucccaaaacugggggcagggagcugucuaccagcccauugcaaaggggagggag

SEQ ID NO: 500511 - RNA, 62 nt, Homo Sapiens
cguggagugagcaagacagggcuuaccauccugucuaccagaugaggaaauggcaguucuga

SEQ ID NO: 500512 - RNA, 62 nt, Homo Sapiens
aaauauuuuaggaguaucuugucuuaaucauagucuaccaucagguuuuuuuguaguguaau

SEQ ID NO: 500513 - RNA, 62 nt, Homo Sapiens
uaaaccaaaacugggaaggcccugguuuucuugucuaccagaggugguaaucaucugggggc

SEQ ID NO: 500514 - RNA, 62 nt, Homo Sapiens
agucuguaaacauaaccuuaaacaauucacaugucuaccacaauucacauuauauuggaaug

SEQ ID NO: 500515 - RNA, 62 nt, Homo Sapiens
gaacacacugcauguaaaagcucaacgauuaagucuaccaaauugcaaauucuguaauuuca

SEQ ID NO: 500516 - RNA, 62 nt, Homo Sapiens
acaaagaccccugagccccgagagccuucaaagucuaccagcagggguacgaaaguaggaug

SEQ ID NO: 500517 - RNA, 62 nt, Homo Sapiens
aacuguuaucaucagcugccauuucugauagggucuaccacaucuguaaugucuguccuuuc

SEQ ID NO: 500518 - RNA, 62 nt, Homo Sapiens
uuuuuaauugccuuugagaauaaacucauaaggucuaccaagaaaauaaauguuaugauguu

SEQ ID NO: 500519 - RNA, 62 nt, Homo Sapiens
augcagguugggauacugaaggcacccacugggucuaccagucagcccaccuuaaaggugua

SEQ ID NO: 500520 - RNA, 62 nt, Homo Sapiens
auugguuuuauuuuuuucuuaaaaaaaaaaaagucuaccaaaggaauuugcauccagcagca

SEQ ID NO: 500521 - RNA, 62 nt, Homo Sapiens
aaaugaauuggauaauccacauaacaggcuuugucuaccaagcaacacgucuuuuauucaaa

SEQ ID NO: 500522 - RNA, 62 nt, Homo Sapiens
caguccccuccugccugcuccuguccagccaggucuaccacccaccccaccccucuucuccg

SEQ ID NO: 500523 - RNA, 62 nt, Homo Sapiens
uguauguauucuugacaagcaugucuagcugugucuaccauguauucuuagaaggggugugu

SEQ ID NO: 500524 - RNA, 62 nt, Homo Sapiens
cugcagcucaaacaagaagcccagcuuccugcgucuaccacuauggcaccuagaaaugcaug

SEQ ID NO: 500525 - RNA, 62 nt, Homo Sapiens
aggccagccugggcaacauggugaaacccggugucuaccaaaaauacaaaauguauccagac

SEQ ID NO: 500526 - RNA, 62 nt, Homo Sapiens
gagaaggcgacagaugccucugucuccagacugucuaccaaaauagagcagaggguuucugc

SEQ ID NO: 500527 - RNA, 62 nt, Homo Sapiens
uggcucccaucaccucuaacauccuugucugggucuaccaggaacgcuucauuuccuugggg

SEQ ID NO: 500528 - RNA, 62 nt, Homo Sapiens
acccuccucgucugcaugguaacuccgucugagucuaccauuuucuugcucucccuccuucc

SEQ ID NO: 500529 - RNA, 62 nt, Homo Sapiens
uuuggggagcugcaggguucgugguugccaaagucuaccaacuacauagugucaugugcuca

SEQ ID NO: 500530 - RNA, 62 nt, Homo Sapiens
caccucucaccgcugccauuagcagcagggaugucuaccagcuguuccgagcacgaagaaac

SEQ ID NO: 500531 - RNA, 62 nt, Homo Sapiens
gucugggggucaggaggcaggguuuuaucucugucuaccaucucccucgaacccacacugca

SEQ ID NO: 500532 - RNA, 62 nt, Homo Sapiens
uacgaugucuucagacaacucucgacugcugcgucuaccaagacagugaaggguggacaaaa

SEQ ID NO: 500533 - RNA, 62 nt, Homo Sapiens
aagaaaccugcugcucucuuguagcaugagcugucuaccaagcacugcucacuuuguggaug

SEQ ID NO: 500534 - RNA, 62 nt, Homo Sapiens
uuuguaaugaaagucuacagccaauuuuacuugucuaccaccguguugugcucaaagagaca

SEQ ID NO: 500535 - RNA, 62 nt, Homo Sapiens
uuuugaaaauuagucaaaauggacucuuuucagucuaccauaaguuaauauaacugauaccu

SEQ ID NO: 500536 - RNA, 62 nt, Homo Sapiens
uaaaauauuuugacugaaauaaauaaauauuugucuaccaagauuauuuauagauuuucuac

SEQ ID NO: 500537 - RNA, 62 nt, Homo Sapiens
aaaugcaauuugugaccuguuguuuucuagaugucuaccaaugagauauauacacuuuugau

SEQ ID NO: 500538 - RNA, 62 nt, Homo Sapiens
ucauuuuguggcaagccuuaaguuaacaaugugucuaccaagaacaauugaguuuucuaaaa

SEQ ID NO: 500539 - RNA, 62 nt, Homo Sapiens
acugacaguuucugaggcagaagccguaucaugucuaccaccugugagguccacacagugug

SEQ ID NO: 500540 - RNA, 62 nt, Homo Sapiens
ggaaucuacucagagccugugugugcugcccagucuaccaaauaauuuauauacaucucagu

SEQ ID NO: 500541 - RNA, 62 nt, Homo Sapiens
uaguuggggaggguccccaggucaccaggcuggucuaccaggggguccggggaagggcagag

SEQ ID NO: 500542 - RNA, 62 nt, Homo Sapiens
ccugcuacuucuggggugccaauacuagugaugucuaccaguuacaugcacaacacauauac

SEQ ID NO: 500543 - RNA, 62 nt, Homo Sapiens
cauccaggcagugaaagaagcaugcuauucaagucuaccaaaauaaacucauaugcacuaaa

SEQ ID NO: 500544 - RNA, 62 nt, Homo Sapiens
aauucauacuugaggaccauacuccccuuauggucuaccaguaacaaugaaggaaacucuaa

SEQ ID NO: 500545 - RNA, 62 nt, Homo Sapiens
agcaacguggcuuuuuuuuuuucccuuccugggucuaccacucagagaaacaauggcuaaga

SEQ ID NO: 500546 - RNA, 62 nt, Homo Sapiens
uguucgggggccucuggcugcugaaggauucggucuaccacggagggcugugcuguuaggcu

SEQ ID NO: 500547 - RNA, 62 nt, Homo Sapiens
acacuaaugcacuuaggauguuucugcaucaugucuaccagggagcaggguuccccacaguu

SEQ ID NO: 500548 - RNA, 62 nt, Homo Sapiens
agcgccggguggacuggcuguuccgaggggccgucuaccacuccuaccucaccaucuucggg

SEQ ID NO: 500549 - RNA, 62 nt, Homo Sapiens
auaaacuaagacuuucuauguauaaaaagcaagucuaccaaaaaucacuuuaaaccaaugcc

SEQ ID NO: 500550 - RNA, 62 nt, Homo Sapiens
gcgugcacuugugauccuaaaagucauccuccgucuaccagacuucagccagaagacugaca

SEQ ID NO: 500551 - RNA, 62 nt, Homo Sapiens
uguucuuguucugugucacucggcccuggguagucuaccauuuacuucaccccaaguccugc

SEQ ID NO: 500552 - RNA, 62 nt, Homo Sapiens
agggacgcuucuucaagcugcggcacguggcugucuaccacauacagcaccucucagacagc

SEQ ID NO: 500553 - RNA, 62 nt, Homo Sapiens
uuuguaaauuauuuuaugucauaguuuaauuggucuaccaaguaagacaucucaaauacagu

SEQ ID NO: 500554 - RNA, 62 nt, Homo Sapiens
gcaagugugugccugugugccgaggagauggcgucuaccagaaggggauggacuucauuuug

SEQ ID NO: 500555 - RNA, 63 nt, Homo Sapiens
ccagcgaauugggaagucucaccaagcuagauugucuaccaucagcccagaacucuguaacuu

SEQ ID NO: 500556 - RNA, 63 nt, Homo Sapiens
gcauaaacaauauugcuagagguggcauguuuagucuaccaaaaacaauacuuuucaggcacu

SEQ ID NO: 500557 - RNA, 58 nt, Homo Sapiens; identical to SEQ ID NO: 500453

SEQ ID NO: 500558 - RNA, 63 nt, Homo Sapiens
ccacauucuguuuaggaugacaguaauucuguugucuaccauuaaugcuacuaccuacuccau

SEQ ID NO: 500559 - RNA, 63 nt, Homo Sapiens
acauuuccaacacugugugaauuaucuaaaugcgucuaccauuuugcacuagggaggaaggau

SEQ ID NO: 500560 - RNA, 63 nt, Homo Sapiens
uccccuggucagagccugaguaucuggggucuugucuaccaccccuauauguauauuuauaua

SEQ ID NO: 500561 - RNA, 63 nt, Homo Sapiens
ugguuggcaacuuucccaauagagaaccuaguggucuaccaagaaggaaagggaagggaaaac

SEQ ID NO: 500562 - RNA, 63 nt, Homo Sapiens
uccucauagugagccagaagagccaaagaaucugucuaccaacuugaucuccaaacaaccuuc

SEQ ID NO: 500563 - RNA, 63 nt, Homo Sapiens
gggcugcuaguauaugucagaauucugaaaucagucuaccaagaaaauguucuauaugcauuu

SEQ ID NO: 500564 - RNA, 63 nt, Homo Sapiens
gcuacuucugccuuauggcuagggaacugucaugucuaccauguauuguacauaugacuuuau

SEQ ID NO: 500565 - RNA, 63 nt, Homo Sapiens
gugauguuuuuacgugaauauguugaaguagaagucuaccauauuauuuuauaaaauguuuuc

SEQ ID NO: 500566 - RNA, 63 nt, Homo Sapiens
auuuugugauguacuaaggauacugguccugaagucuaccaaauauuauagugcauuuuagcc

SEQ ID NO: 500567 - RNA, 63 nt, Homo Sapiens
cccgugaaauggcagcucguuggucacucaccugucuaccacuuuuuuauuucuccccaggug

SEQ ID NO: 500568 - RNA, 63 nt, Homo Sapiens
guacuuauaacuguuauuaauuucuuuuucagugucuaccauuuuuucuuuucuauuaagggu

SEQ ID NO: 500569 - RNA, 63 nt, Homo Sapiens
uacuauggaguaaaagaauuacgucuagaauuggucuaccaguuggaggcaauuguaaaaugg

SEQ ID NO: 500570 - RNA, 63 nt, Homo Sapiens
cuuuuugcucaguaggagucgauccuaaccucugucuaccaacucuuauaucuguauucuuua

SEQ ID NO: 500571 - RNA, 63 nt, Homo Sapiens
uuuuuacauauuggaaaauaacacuacuucauugucuaccaacuuucucuccuaaaaauuugc

SEQ ID NO: 500572 - RNA, 63 nt, Homo Sapiens
acaaggacugugcaucuaaguucacagugccgugucuaccacuagcuucuaaaucaaacuucc

SEQ ID NO: 500573 - RNA, 63 nt, Homo Sapiens
gugcuuaaggccagaugggccaugugcacuugggucuaccaauuggaguugagugaugcccgu

SEQ ID NO: 500574 - RNA, 63 nt, Homo Sapiens
uuagggaaauuucaugggauaauuagcaggcuggucuaccaccuggaccauguaacucuagug

SEQ ID NO: 500575 - RNA, 63 nt, Homo Sapiens
uaugccuggugcaguauaauucccaaguguacugucuaccagaaaaaaaaaacaaaacuaaua

SEQ ID NO: 500576 - RNA, 63 nt, Homo Sapiens
uuaacuuccuaaagaauucaucuguuuauacaagucuaccacugccgauugacuaaaaaauac

SEQ ID NO: 500577 - RNA, 63 nt, Homo Sapiens
auaauauuacuguuuauuucuguuucucauauggucuaccaguuugcugaugucccuagaaaa

SEQ ID NO: 500578 - RNA, 63 nt, Homo Sapiens
ugaugaaugggaaauaaaauaaacaacccaaaugucuaccaacuuguaauagccaaaaagugg

SEQ ID NO: 500579 - RNA, 63 nt, Homo Sapiens
agccagaugcuuccagaguuaucuguguaaaaugucuaccaguuggauuggucagaaauugcu

SEQ ID NO: 500580 - RNA, 63 nt, Homo Sapiens
uggggaaguuucacccucucaaaagaugguuucgucuaccaauguuaggagaauauauccaau

SEQ ID NO: 500581 - RNA, 63 nt, Homo Sapiens
cagacgaagcucucuuacaaagaaggucgaugugucuaccagguucaauaaaugcaccuuagc

SEQ ID NO: 500582 - RNA, 63 nt, Homo Sapiens
uggugaaugugugagaaaaacuaacuugauagggucuaccaauacaaaauguauuacgaaugc

SEQ ID NO: 500583 - RNA, 63 nt, Homo Sapiens
uuuucuuuuggugcagaaccguugugcaguggggucuaccaugcaauuuucuuucagcacuga

SEQ ID NO: 500584 - RNA, 63 nt, Homo Sapiens
uuucuuuuucuuuugugcuggucuugcaaguuugucuaccaguaagagagcaaaguuuccuuc

SEQ ID NO: 500585 - RNA, 63 nt, Homo Sapiens
acuacuuucaauuuggugaaaauguauuaaguugucuaccauguuuucuuuucuagcugaaua

SEQ ID NO: 500586 - RNA, 63 nt, Homo Sapiens
gaaaaauguugaaaaauaagacaaaauguuuuugucuaccaaaaucuuggacacaucugaaau

SEQ ID NO: 500587 - RNA, 63 nt, Homo Sapiens
gugaguaaugaagauaaaaaccaagcuagguuagucuaccauuaguucauauguuuuuguagc

SEQ ID NO: 500588 - RNA, 63 nt, Homo Sapiens
gaaucugcugcauagcucuauuuuaaaguaaaagucuaccaccgaaucccuagucccccuguu

SEQ ID NO: 500589 - RNA, 63 nt, Homo Sapiens
guaacuaugacugacguccccagaaguuucugggucuaccacacuccccaaccccccacuccu

SEQ ID NO: 500590 - RNA, 53 nt, Homo Sapiens; identical to SEQ ID NO: 500486

SEQ ID NO: 500591 - RNA, 63 nt, Homo Sapiens
uguguuuugaaagcccaaggccuaggcgauuuugucuaccauuugaguuggacuucagucuug

SEQ ID NO: 500592 - RNA, 63 nt, Homo Sapiens
caaaauacuugucuguuuuaaaaaccuguucaagucuaccaaccuguucaagucuaccaauua

SEQ ID NO: 500593 - RNA, 63 nt, Homo Sapiens
uaaaaaccuguucaagucuaccaaccuguucaagucuaccaauuauaagggcaaauuggagaa

SEQ ID NO: 500594 - RNA, 63 nt, Homo Sapiens
gauuugccuacucauagggacuuugccuauuaagucuaccaaauuaaaagucuuaucauucag

SEQ ID NO: 500595 - RNA, 63 nt, Homo Sapiens
caugggguuugcuugcuuagaaauacccacggggucuaccagcggggagcaguguugaugcca

SEQ ID NO: 500596 - RNA, 63 nt, Homo Sapiens
cagauccuggaaaucaggguuaguauuguccaggucuaccaaaaaucucaauauuucagauaa

SEQ ID NO: 500597 - RNA, 63 nt, Homo Sapiens
aacaccaaccagaugaacaaagggucaagugcugucuaccaucuguccucaucuggagccuga

SEQ ID NO: 500598 - RNA, 63 nt, Homo Sapiens
uuuaauuuaugguucaacuguauucaaaugugagucuaccauuuuuuauauauaacuagcugc

SEQ ID NO: 500599 - RNA, 63 nt, Homo Sapiens
agcuucuuuuuccaaauguaaaagaggcccugugucuaccaggagaacaaagaacaauauccc

SEQ ID NO: 500600 - RNA, 63 nt, Homo Sapiens
agcgguccuugcccauuugguacuuaccuaucugucuaccagucgucuggccaaugauucuuu

SEQ ID NO: 500601 - RNA, 63 nt, Homo Sapiens
ccucccuugccccauuaucuuuucaccucccaggucuaccauuucaugguggucguugggucc

SEQ ID NO: 500602 - RNA, 63 nt, Homo Sapiens
cagcagccagccagcagccucucccaggcgggagucuaccauccgagacggcgaugacaaaga

SEQ ID NO: 500603 - RNA, 63 nt, Homo Sapiens
aggaaggccaggagcccaguagccauguggccagucuaccauggggcccaggaguuggggaaa

SEQ ID NO: 500604 - RNA, 53 nt, Homo Sapiens; identical to SEQ ID NO: 500500

SEQ ID NO: 500605 - RNA, 63 nt, Homo Sapiens
gucuagacacgggggcagguggaacuuaaacgagucuaccaguccauggaggauugccuguga

SEQ ID NO: 500606 - RNA, 63 nt, Homo Sapiens
gaauuauuauccagacuggaugagaauucuuuugucuaccauauuccaggaaacccaagaggc

SEQ ID NO: 500607 - RNA, 63 nt, Homo Sapiens
ggauggcgcaugcaugggaggaauucaucuucagucuaccagcccccgcugugucggauacac

SEQ ID NO: 500608 - RNA, 63 nt, Homo Sapiens
auuuugugaaaagcagugguauguguacguguugucuaccaguacacaggcugcagaagacag

SEQ ID NO: 500609 - RNA, 63 nt, Homo Sapiens
gucuccgaguacugcagaacugacauuuugacggucuaccagcguggcggcugguguugguca

SEQ ID NO: 500610 - RNA, 63 nt, Homo Sapiens
ucuccagucuccuggaggugggacuggacaggagucuaccagcuuguuuugagacucaugaaa

SEQ ID NO: 500611 - RNA, 63 nt, Homo Sapiens
aaaaguuuuaaacucaagcaauuaacauucuaagucuaccaaaaauauuuucuuuaucuaaau

SEQ ID NO: 500612 - RNA, 63 nt, Homo Sapiens
agaugaauauuaacauggagggcuuugccugaugucuaccagaagcccuguguguggauggug

SEQ ID NO: 500613 - RNA, 63 nt, Homo Sapiens
gagccaccccugcuuucuggccaucucuucuuugucuaccauuucaaauugacuugugaauac

SEQ ID NO: 500614 - RNA, 63 nt, Homo Sapiens
ugagguccucccaaaacuggggggcagggagcugucuaccagccccauugcaaaggggaggga

SEQ ID NO: 500615 - RNA, 63 nt, Homo Sapiens
acguggagugagcaagacagggcuuaccauccugucuaccagaugaggaaauggcaguucuga

SEQ ID NO: 500616 - RNA, 63 nt, Homo Sapiens
aaauauuuuaggaguaucuuugucuuaaucauagucuaccaucaagguuuuuuuguaguguaa

SEQ ID NO: 500617 - RNA, 63 nt, Homo Sapiens
uaaaccaaaacugggaaggccccugguuuucuugucuaccagacggugguaaucaucuggggg

SEQ ID NO: 500618 - RNA, 63 nt, Homo Sapiens
agucuguaaacauaaccuuagaacaauucacaugucuaccacaaauucacauuauauuggaau

SEQ ID NO: 500619 - RNA, 63 nt, Homo Sapiens
gaacacacugcauguaaaagacucaacgauuaagucuaccaaauuugcaaauucuguaauuuc

SEQ ID NO: 500620 - RNA, 63 nt, Homo Sapiens
acaaagaccccugagccccggagagccuucaaagucuaccagcuagggguacgaaaguaggau

SEQ ID NO: 500621 - RNA, 63 nt, Homo Sapiens
uaacuguuaucaucagcugccauuucugauagggucuaccacaucuguaaugucuguccuuuc

SEQ ID NO: 500622 - RNA, 63 nt, Homo Sapiens
uuuuuuaauugccuuugagaauaaacucauaaggucuaccaagaaaauaaauguuaugauguu

SEQ ID NO: 500623 - RNA, 63 nt, Homo Sapiens
augcagguugggauacugaaaggcacccacugggucuaccaguucagcccaccuuaaaggugu

SEQ ID NO: 500624 - RNA, 63 nt, Homo Sapiens
aauugguuuuauuuuuuucuuaaaaaaaaaaaagucuaccaaaggaauuugcauccagcagca

SEQ ID NO: 500625 - RNA, 63 nt, Homo Sapiens
aaaugaauuggauaauccacaauaacaggcuuugucuaccaagucaacacgucuuuuauucaa

SEQ ID NO: 500626 - RNA, 63 nt, Homo Sapiens
acaguccccuccugccugcuccuguccagccaggucuaccacccaccccaccccucuucuccg

SEQ ID NO: 500627 - RNA, 63 nt, Homo Sapiens
uguauguauucuugacaagcuaugucuagcugugucuaccaugauauucuuagaaggggugug

SEQ ID NO: 500628 - RNA, 63 nt, Homo Sapiens
cugcagcucaaacaagaagcgccagcuuccugcgucuaccacucauggcaccuagaaaugcau

SEQ ID NO: 500629 - RNA, 63 nt, Homo Sapiens
gaggccagccugggcaacauggugaaacccggugucuaccaaaaauacaaaauguauccagac

SEQ ID NO: 500630 - RNA, 63 nt, Homo Sapiens
gagaaggcgacagaugccuccugucuccagacugucuaccaaaaauagagcagaggguuucug

SEQ ID NO: 500631 - RNA, 63 nt, Homo Sapiens
cuggcucccaucaccucuaacauccuugucugggucuaccaggaacgcuucauuuccuugggg

SEQ ID NO: 500632 - RNA, 63 nt, Homo Sapiens
gacccuccucgucugcaugguaacuccgucugagucuaccauuuucuugcucucccuccuucc

SEQ ID NO: 500633 - RNA, 63 nt, Homo Sapiens
uuuggggagcugcaggguucagugguugccaaagucuaccaacauacauagugucaugugcuc

SEQ ID NO: 500634 - RNA, 63 nt, Homo Sapiens
caccucucaccgcugccauucagcagcagggaugucuaccagcuuguuccgagcacgaagaaa

SEQ ID NO: 500635 - RNA, 63 nt, Homo Sapiens
ggucugggggucaggaggcaggguuuuaucucugucuaccaucucccucgaacccacacugca

SEQ ID NO: 500636 - RNA, 63 nt, Homo Sapiens
uacgaugucuucagacaacuacucgacugcugcgucuaccaagcacagugaaggguggacaaa

SEQ ID NO: 500637 - RNA, 63 nt, Homo Sapiens
aagaaaccugcugcucucuugguagcaugagcugucuaccaagccacugcucacuuuguggau

SEQ ID NO: 500638 - RNA, 63 nt, Homo Sapiens
guuuguaaugaaagucuacagccaauuuuacuugucuaccaccguguugugcucaaagagaca

SEQ ID NO: 500639 - RNA, 63 nt, Homo Sapiens
auuuugaaaauuagucaaaauggacucuuuucagucuaccauaaguuaauauaacugauaccu

SEQ ID NO: 500640 - RNA, 63 nt, Homo Sapiens
uaaaauauuuugacugaaaucaaauaaauauuugucuaccaaguauuauuuauagauuuucua

SEQ ID NO: 500641 - RNA, 63 nt, Homo Sapiens
aaaugcaauuugugaccuguuuguuuucuagaugucuaccaauagagauauauacacuuuuga

SEQ ID NO: 500642 - RNA, 63 nt, Homo Sapiens
aucauuuuguggcaagccuuaaguuaacaaugugucuaccaagaacaauugaguuuucuaaaa

SEQ ID NO: 500643 - RNA, 63 nt, Homo Sapiens
cacugacaguuucugaggcagaagccguaucaugucuaccaccugugagguccacacagugug

SEQ ID NO: 500644 - RNA, 63 nt, Homo Sapiens
gggaaucuacucagagccugugugugcugcccagucuaccaaauaauuuauauacaucucagu

SEQ ID NO: 500645 - RNA, 63 nt, Homo Sapiens
uaguuggggaggguccccagggucaccaggcuggucuaccagggggguccggggaagggcaga

SEQ ID NO: 500646 - RNA, 63 nt, Homo Sapiens
ccugcuacuucuggggugcccaauacuagugaugucuaccaguauacaugcacaacacauaua

SEQ ID NO: 500647 - RNA, 63 nt, Homo Sapiens
cauccaggcagugaaagaagacaugcuauucaagucuaccaaagauaaacucauaugcacuaa

SEQ ID NO: 500648 - RNA, 63 nt, Homo Sapiens
aauucauacuugaggaccauaacuccccuuauggucuaccaguuaacaaugaaggaaacucua

SEQ ID NO: 500649 - RNA, 63 nt, Homo Sapiens
uagcaacguggcuuuuuuuuuuucccuuccugggucuaccacucagagaaacaauggcuaaga

SEQ ID NO: 500650 - RNA, 63 nt, Homo Sapiens
guguucgggggccucuggcugcugaaggauucggucuaccacggagggcugugcuguuaggcu

SEQ ID NO: 500651 - RNA, 63 nt, Homo Sapiens
uacacuaaugcacuuaggauguuucugcaucaugucuaccagggagcaggguuccccacaguu

SEQ ID NO: 500652 - RNA, 63 nt, Homo Sapiens
gagcgccggguggacuggcuguuccgaggggccgucuaccacuccuaccucaccaucuucggg

SEQ ID NO: 500653 - RNA, 63 nt, Homo Sapiens
auaaacuaagacuuucuaugcuauaaaaagcaagucuaccaaagaaucacuuuaaaccaaugc

SEQ ID NO: 500654 - RNA, 63 nt, Homo Sapiens
gcgugcacuugugauccuaaaaagucauccuccgucuaccagaccuucagccagaagacugac

SEQ ID NO: 500655 - RNA, 63 nt, Homo Sapiens
auguucuuguucugugucacucggcccuggguagucuaccauuuacuucaccccaaguccugc

SEQ ID NO: 500656 - RNA, 63 nt, Homo Sapiens
agggacgcuucuucaagcugccggcacguggcugucuaccacacuacagcaccucucagacag

SEQ ID NO: 500657 - RNA, 63 nt, Homo Sapiens
cuuuguaaauuauuuuaugucauaguuuaauuggucuaccaaguaagacaucucaaauacagu

SEQ ID NO: 500658 - RNA, 63 nt, Homo Sapiens
ggcaagugugugccugugugccgaggagauggcgucuaccagaaggggauggacuucauuuug

SEQ ID NO: 500659 - RNA, 64 nt, Homo Sapiens; identical to SEQ ID NO: 130660

SEQ ID NO: 500660 - RNA, 64 nt, Homo Sapiens; identical to SEQ ID NO: 130661

SEQ ID NO: 500661 - RNA, 64 nt, Homo Sapiens; identical to SEQ ID NO: 130662

SEQ ID NO: 500662 - RNA, 64 nt, Homo Sapiens; identical to SEQ ID NO: 130663

SEQ ID NO: 500663 - RNA, 64 nt, Homo Sapiens; identical to SEQ ID NO: 130664

SEQ ID NO: 500664 - RNA, 64 nt, Homo Sapiens; identical to SEQ ID NO: 130665

SEQ ID NO: 500665 - RNA, 64 nt, Homo Sapiens; identical to SEQ ID NO: 130666

SEQ ID NO: 500666 - RNA, 64 nt, Homo Sapiens; identical to SEQ ID NO: 130667

SEQ ID NO: 500667 - RNA, 64 nt, Homo Sapiens; identical to SEQ ID NO: 130668

SEQ ID NO: 500668 - RNA, 64 nt, Homo Sapiens; identical to SEQ ID NO: 130669

SEQ ID NO: 500669 - RNA, 64 nt, Homo Sapiens; identical to SEQ ID NO: 130670

SEQ ID NO: 500670 - RNA, 64 nt, Homo Sapiens; identical to SEQ ID NO: 130671

SEQ ID NO: 500671 - RNA, 64 nt, Homo Sapiens; identical to SEQ ID NO: 130672

SEQ ID NO: 500672 - RNA, 64 nt, Homo Sapiens; identical to SEQ ID NO: 130673

SEQ ID NO: 500673 - RNA, 64 nt, Homo Sapiens; identical to SEQ ID NO: 130674

SEQ ID NO: 500674 - RNA, 64 nt, Homo Sapiens; identical to SEQ ID NO: 130675

SEQ ID NO: 500675 - RNA, 64 nt, Homo Sapiens; identical to SEQ ID NO: 130676

SEQ ID NO: 500676 - RNA, 64 nt, Homo Sapiens; identical to SEQ ID NO: 130677

SEQ ID NO: 500677 - RNA, 64 nt, Homo Sapiens; identical to SEQ ID NO: 130678

SEQ ID NO: 500678 - RNA, 64 nt, Homo Sapiens; identical to SEQ ID NO: 130679

SEQ ID NO: 500679 - RNA, 64 nt, Homo Sapiens; identical to SEQ ID NO: 130680

SEQ ID NO: 500680 - RNA, 64 nt, Homo Sapiens; identical to SEQ ID NO: 130681

SEQ ID NO: 500681 - RNA, 64 nt, Homo Sapiens; identical to SEQ ID NO: 130682

SEQ ID NO: 500682 - RNA, 64 nt, Homo Sapiens; identical to SEQ ID NO: 130683

SEQ ID NO: 500683 - RNA, 64 nt, Homo Sapiens; identical to SEQ ID NO: 130684

SEQ ID NO: 500684 - RNA, 64 nt, Homo Sapiens; identical to SEQ ID NO: 130685

SEQ ID NO: 500685 - RNA, 64 nt, Homo Sapiens; identical to SEQ ID NO: 130686

SEQ ID NO: 500686 - RNA, 64 nt, Homo Sapiens; identical to SEQ ID NO: 130687

SEQ ID NO: 500687 - RNA, 64 nt, Homo Sapiens; identical to SEQ ID NO: 130688

SEQ ID NO: 500688 - RNA, 64 nt, Homo Sapiens; identical to SEQ ID NO: 130689

SEQ ID NO: 500689 - RNA, 64 nt, Homo Sapiens; identical to SEQ ID NO: 130690

SEQ ID NO: 500690 - RNA, 64 nt, Homo Sapiens; identical to SEQ ID NO: 130691

SEQ ID NO: 500691 - RNA, 64 nt, Homo Sapiens; identical to SEQ ID NO: 130692

SEQ ID NO: 500692 - RNA, 64 nt, Homo Sapiens; identical to SEQ ID NO: 130693

SEQ ID NO: 500693 - RNA, 64 nt, Homo Sapiens; identical to SEQ ID NO: 130694

SEQ ID NO: 500694 - RNA, 64 nt, Homo Sapiens; identical to SEQ ID NO: 130695

SEQ ID NO: 500695 - RNA, 64 nt, Homo Sapiens; identical to SEQ ID NO: 130696

SEQ ID NO: 500696 - RNA, 64 nt, Homo Sapiens; identical to SEQ ID NO: 130697

SEQ ID NO: 500697 - RNA, 64 nt, Homo Sapiens; identical to SEQ ID NO: 130698

SEQ ID NO: 500698 - RNA, 64 nt, Homo Sapiens; identical to SEQ ID NO: 130699

SEQ ID NO: 500699 - RNA, 64 nt, Homo Sapiens; identical to SEQ ID NO: 130700

SEQ ID NO: 500700 - RNA, 64 nt, Homo Sapiens; identical to SEQ ID NO: 130701

SEQ ID NO: 500701 - RNA, 64 nt, Homo Sapiens; identical to SEQ ID NO: 130702

SEQ ID NO: 500702 - RNA, 64 nt, Homo Sapiens; identical to SEQ ID NO: 130703

SEQ ID NO: 500703 - RNA, 64 nt, Homo Sapiens; identical to SEQ ID NO: 130704

SEQ ID NO: 500704 - RNA, 64 nt, Homo Sapiens; identical to SEQ ID NO: 130705

SEQ ID NO: 500705 - RNA, 64 nt, Homo Sapiens; identical to SEQ ID NO: 130706

SEQ ID NO: 500706 - RNA, 64 nt, Homo Sapiens; identical to SEQ ID NO: 130707

SEQ ID NO: 500707 - RNA, 64 nt, Homo Sapiens; identical to SEQ ID NO: 130708

SEQ ID NO: 500708 - RNA, 64 nt, Homo Sapiens; identical to SEQ ID NO: 130709

SEQ ID NO: 500709 - RNA, 63 nt, Homo Sapiens
ggugacgggagguguccuggcugcuccaggacaaaagacaaucgucucugugggugccgggug

SEQ ID NO: 500710 - RNA, 63 nt, Homo Sapiens
ccuguaaaaacaaaacaaacaaaacaaaacaaaaaagacaaaaccuaaaacugagcuaucuaa

SEQ ID NO: 500711 - RNA, 63 nt, Homo Sapiens
cauucgaaaucagcuguacugugugaacgaaauaaagacaauaauacgaaccccucucuggcu

SEQ ID NO: 500712 - RNA, 63 nt, Homo Sapiens
gcuuaggcaauacagcgagaccuugucucaaaaaaagacaaaaaaaacaaaaagaaauguaga

SEQ ID NO: 500713 - RNA, 63 nt, Homo Sapiens
uuuuugaauauacauucuauaaaagauuauuugaaagacaaaauucauagaaaauggagcaaa

SEQ ID NO: 500714 - RNA, 63 nt, Homo Sapiens
cucauccugggugggacgauggcuccugccuugaaagacaaaaaucccaccuugggcagagcu

SEQ ID NO: 500715 - RNA, 63 nt, Homo Sapiens
guacauauuggagcucugggagaugcuggaauaaaagacaagaguuacaucuggacuuggauu

SEQ ID NO: 500716 - RNA, 63 nt, Homo Sapiens
ugaaguacugcccaaguuaaauauugauagccuaaagacaaguuuauguaguacuuaauguac

SEQ ID NO: 500717 - RNA, 63 nt, Homo Sapiens
aauaaaacuuugcuauguauuuacucuuuuuuaaaagacaaaagcaaaaccagacuuucuacg

SEQ ID NO: 500718 - RNA, 63 nt, Homo Sapiens
acuccccucaggacccuaccccacccucuuugaaaagacaaagcucugccuacauagaagacu

SEQ ID NO: 500719 - RNA, 63 nt, Homo Sapiens
cauaguacuaauaauuaaauuuucaguauuuaaaaagacaaaguauuuuguccauuugagauu

SEQ ID NO: 500720 - RNA, 63 nt, Homo Sapiens
ggcuguuggguagaagugguggugggggggacaaaagacaaaaaaauccaccagagcuuugua

SEQ ID NO: 500721 - RNA, 63 nt, Homo Sapiens
aauauugugaaaagcuuuuaaaaguuguuuugaaaagacaaucauuuuuuguuuuuguuuuaa

SEQ ID NO: 500722 - RNA, 63 nt, Homo Sapiens
gcugaugaugcuaauggagaugaugguaaugauaaagacaacaacaaugauuaucaaguuccu

SEQ ID NO: 500723 - RNA, 63 nt, Homo Sapiens
gagaauucaaaaacauccuugcagaaugauucaaaagacaaaagccaggcucaacuuauagaa

SEQ ID NO: 500724 - RNA, 63 nt, Homo Sapiens
gauuggaaaggcugcgacagccccccaaacaggaaagacaaaaaacaaacaaaucaaccgacc

SEQ ID NO: 500725 - RNA, 63 nt, Homo Sapiens
uucuaggcagacccucuuucuccuucgggacagaaagacaaugugaguucauuuuccuccauc

SEQ ID NO: 500726 - RNA, 63 nt, Homo Sapiens
cuaauaucugagcaucuuuuagacaagagaggcaaagacaaacuggauuuaauggcccaacau

SEQ ID NO: 500727 - RNA, 63 nt, Homo Sapiens
uaaaggcugaauguaggauucuucaguauguggaaagacaaggauucaacguguggucauaug

SEQ ID NO: 500728 - RNA, 63 nt, Homo Sapiens
uuuaggcacagaaguuggagaagagauuucaugaaagacaacaucacugcauugagagaauag

SEQ ID NO: 500729 - RNA, 63 nt, Homo Sapiens
aaacuggucuacugugucucuaggguuaagccaaaagacaaaaaaaauuuuacuacuuuugag

SEQ ID NO: 500730 - RNA, 63 nt, Homo Sapiens
aaggccuuaaugaccucauaggcacucuuccaaaaagacaacagaacuggaaugagaggccug

SEQ ID NO: 500731 - RNA, 63 nt, Homo Sapiens
gaggaaugccuucuccuaagagucaguugaaagaaagacaagagagucacaucuuagcuuuug

SEQ ID NO: 500732 - RNA, 63 nt, Homo Sapiens
uggaagaccuaaggcagacaggaaggaagcacaaaagacaagcauugggucagacccauaaac

SEQ ID NO: 500733 - RNA, 63 nt, Homo Sapiens
aaauaugaaagaacaaagguuauuuccuggagaaaagacaauuuauucaacaccaacgaggga

SEQ ID NO: 500734 - RNA, 62 nt, Homo Sapiens
uaggaacugaccccaacaauaaacuuugauaauaaagacaauaggcuauggugauuuuauuu

SEQ ID NO: 500735 - RNA, 63 nt, Homo Sapiens
ggaaguccuauuuuauuuaaucaguaucaguaaaaagacaaaaauuacagugugaacaagaga

SEQ ID NO: 500736 - RNA, 63 nt, Homo Sapiens
uacagauuuuggcgggggaggggggaccuuuucaaagacaauagggggucuugacauguuugu

SEQ ID NO: 500737 - RNA, 63 nt, Homo Sapiens
acuugaaugauuuaggaaaugagugugugcaccaaagacaaaaagauauugucuauuguuugu

SEQ ID NO: 500738 - RNA, 63 nt, Homo Sapiens
aaggaucuggaccccaaagaauagacuggauggaaagacaaacugcacaggcagauguuugcc

SEQ ID NO: 500739 - RNA, 63 nt, Homo Sapiens
gcaauguaaaauauauauauauuuaccuuuuuuaaagacaauggaaauuccaaguagcuaaaa

SEQ ID NO: 500740 - RNA, 63 nt, Homo Sapiens
uuccaacugaucuauccauauuccuuaaguacuaaagacaaaauagagggcuucuuuuucucu

SEQ ID NO: 500741 - RNA, 63 nt, Homo Sapiens
aguaguaguauguuuguaagcuauucugacagaaaagacaaagguuacuaauuguaugauagu

SEQ ID NO: 500742 - RNA, 63 nt, Homo Sapiens
cuauccaaucugugaugacauucccugcuaauaaaagacaacauaacucaagucuggcagacu

SEQ ID NO: 500743 - RNA, 63 nt, Homo Sapiens
ccucagccugcaaggguccgauuugccaucgaaaaagacaaccucuacuuuuuucuuuuguau

SEQ ID NO: 500744 - RNA, 63 nt, Homo Sapiens
cuucugauuuuuaugugaccauagcuaugauguaaagacaauacuguccuucagagaacuggu

SEQ ID NO: 500745 - RNA, 63 nt, Homo Sapiens
cuguuugcaaugucuuauuaaaaaacaacaaaaaaagacaaauggaacaaagaagcugugacc

SEQ ID NO: 500746 - RNA, 63 nt, Homo Sapiens
ggcagugcagaguuuagcauucggacuucacgaaaagacaacucccugggcaguauagagacg

SEQ ID NO: 500747 - RNA, 63 nt, Homo Sapiens
guuugugugcacuucccgacuuaaccaaaaaggaaagacaacggauuacaaaguuuuucuucu

SEQ ID NO: 500748 - RNA, 57 nt, Homo Sapiens
aguuaagggagagaauaagacucccccaaagacaaugaggcaccuccuggugucuaa

SEQ ID NO: 500749 - RNA, 63 nt, Homo Sapiens
auugcaaguuuaaaagaaaguaaagaacaaaauaaagacaaacuucuuuucacuuugaaaaua

SEQ ID NO: 500750 - RNA, 63 nt, Homo Sapiens
gaaaaggcacauccuugucuaaauguaaaauaaaaagacaaauuagagcaauaaccacuuuuu

SEQ ID NO: 500751 - RNA, 63 nt, Homo Sapiens
cauccaggcagggcuucucuuuugaaaaggcaaaaagacaagagagugaggcugaaggcuggg

SEQ ID NO: 500752 - RNA, 63 nt, Homo Sapiens
aaaaucuuuuguacagagauaaaaaaguaaaacaaagacaaaaaccaucccaugaggaaaaaa

SEQ ID NO: 500753 - RNA, 63 nt, Homo Sapiens
guguagcugggcguggugguguuuauauuuuaaaaagacaacuagccauggcacccggucuug

SEQ ID NO: 500754 - RNA, 63 nt, Homo Sapiens
aaccauguuaacuguauugaaacuucuuuuugaaaagacaagcuugggaaucaaagaaaaugg

SEQ ID NO: 500755 - RNA, 63 nt, Homo Sapiens
aaaaaugguuuuguaugacuucuucucaguuugaaagacaaugagaagcgugcugaauaggau

SEQ ID NO: 500756 - RNA, 63 nt, Homo Sapiens
aagaccuccaaggguacuucagccuccauuuuuaaagacaauaccagccuugaggagagcaga

SEQ ID NO: 500757 - RNA, 63 nt, Homo Sapiens
aaaggaaaauggggaggcuugggauuugaugaaaaagacaaccuuuagguuuugugauagaau

SEQ ID NO: 500758 - RNA, 63 nt, Homo Sapiens
ucucaaagcacaacgugcuuagcuaauccuguuaaagacaacuaaagugaggcucgccugcau

SEQ ID NO: 500759 - RNA, 63 nt, Homo Sapiens
guaauagacaucuaaaauuccauuuuucuuuuaaaagacaaguugcucauucugaaauuuaag

SEQ ID NO: 500760 - RNA, 63 nt, Homo Sapiens
uuacauuuaaugcuucacuuaaauuuacacuaaaaagacaacucucucaaagggugagauuug

SEQ ID NO: 500761 - RNA, 63 nt, Homo Sapiens
gguaagauuaagaagccauuuuaaggaaagcaaaaagacaacuacauuauuccuagaaaagau

SEQ ID NO: 500762 - RNA, 63 nt, Homo Sapiens
caaaguaaaucugaaaggaguuuuauuacuuauaaagacaaacucuugugccauauucugucu

SEQ ID NO: 500763 - RNA, 63 nt, Homo Sapiens
uuguaaguuugcgcuucaguguugugguaacacaaagacaauugcugacuaaagacugugugu

SEQ ID NO: 500764 - RNA, 50 nt, Homo Sapiens
uagcagguagaagaaaaguuaaagacaauuacauccggcaagacuucuga

SEQ ID NO: 500765 - RNA, 63 nt, Homo Sapiens
uauuuuuauuuauguuagaaggugcaguuagaaaaagacaacccuuaaacauguggacccaua

SEQ ID NO: 500766 - RNA, 63 nt, Homo Sapiens
ugagaacaaguagacacacuuuaguaaguuuaaaaagacaaauuccaaauaaacccugaauau

SEQ ID NO: 500767 - RNA, 63 nt, Homo Sapiens
agaaagaauagagaacaggaagcugaacaggagaaagacaaacuggaaagagggagaaagaga

SEQ ID NO: 500768 - RNA, 63 nt, Homo Sapiens
acuuuggaagaauuauuuuaaaagaaaugcauaaaagacaagcuuuuuauauuauguuaaagu

SEQ ID NO: 500769 - RNA, 63 nt, Homo Sapiens
ccacuuguugaaauccagcguguugaacuuuaaaaagacaagaggagcuaauuguucaagaag

SEQ ID NO: 500770 - RNA, 63 nt, Homo Sapiens
uauguagcucacaaacugguuucugaagaugggaaagacaaaucauuguuaaugugagaacau

SEQ ID NO: 500771 - RNA, 63 nt, Homo Sapiens
aauccaucaugaaauucguuugaauucaucaugaaagacaagcagaaauaggaaagucaucua

SEQ ID NO: 500772 - RNA, 63 nt, Homo Sapiens
aagcagaaauauuuuuaccgcccggaugauccgaaagacaagagaucuuggguccuaucccuu

SEQ ID NO: 500773 - RNA, 63 nt, Homo Sapiens
acuaccugcccuaccccauccuucgauuuccucaaagacaacagagcuucugggccuuagcac

SEQ ID NO: 500774 - RNA, 63 nt, Homo Sapiens
uccucgagauucuuaugagucuacacaauaagaaaagacaaagggugaugcuuucuuaguauu

SEQ ID NO: 500775 - RNA, 63 nt, Homo Sapiens
gagccaugaggagagggcugcacauuuggagggaaagacaagaggugggggccucucuggaag

SEQ ID NO: 500776 - RNA, 63 nt, Homo Sapiens
gaaaguggaagugguauuccuuuuuuuaaagaaaaagacaaaacaccccugccuuuuuuuuuu

SEQ ID NO: 500777 - RNA, 63 nt, Homo Sapiens
ggaagggcagguacuaggugagaaaccacuauaaaagacaagaucuuugguauuucaaaaggg

SEQ ID NO: 500778 - RNA, 63 nt, Homo Sapiens
cuaugaaugaauuuuucaguauggucaauuuauaaagacaaauauaaugcaugcauaauuuaa

SEQ ID NO: 500779 - RNA, 63 nt, Homo Sapiens
uagugggagcugaucaaacgaauuggaaaagggaaagacaaaggaguguccgaggucauaagc

SEQ ID NO: 500780 - RNA, 63 nt, Homo Sapiens
aacuauauguaugguuuuguuauauuuaaauguaaagacaaaaacaaagcagaauaguauuuu

SEQ ID NO: 500781 - RNA, 63 nt, Homo Sapiens
uucuuuaccacacguuucacgggaccugaaagcaaagacaaugacggccagaaagggccaggu

SEQ ID NO: 500782 - RNA, 63 nt, Homo Sapiens
uuuugggcuggaugugguaguacauauuucacuaaagacaaguuauaaucaaagaauuuucug

SEQ ID NO: 500783 - RNA, 63 nt, Homo Sapiens
gccaagguguaugcucucaauaaauaaaugaauaaagacaaaagcacaaaaugaaugaauaaa

SEQ ID NO: 500784 - RNA, 63 nt, Homo Sapiens
gcauacuuggggugagaggguaauaagaauuacaaagacaauggaauuuuugcuuuaguauuu

SEQ ID NO: 500785 - RNA, 51 nt, Homo Sapiens
uuuuuucaaaugugcaauuuaaaagacaauugccaccguaaacuacauuag

SEQ ID NO: 500786 - RNA, 63 nt, Homo Sapiens
aaaaaccaaaaaaaaaaaacuaaacgcaaaaaaaaagacaaaaagggaauagcccaaauguuu

SEQ ID NO: 500787 - RNA, 63 nt, Homo Sapiens
ugaugagagauggggagaggcccugcuugagccaaagacaagggguccgguggagacugacca

SEQ ID NO: 500788 - RNA, 63 nt, Homo Sapiens
auuagcugggcgugguaguaccuguaucuauuaaaagacaaaaccuggccaacguggugaaag

SEQ ID NO: 500789 - RNA, 63 nt, Homo Sapiens
gguaggucagggagguggggcacugugcacggaaaagacaagauuuaucuagaauggauucaa

SEQ ID NO: 500790 - RNA, 63 nt, Homo Sapiens
acccacaggauuggaaugguaucauccuaguaaaaagacaacaucuguauuuccugcauuucc

SEQ ID NO: 500791 - RNA, 63 nt, Homo Sapiens
gauuccuuaauaauuagucacuagagacagcccaaagacaaauauugggcaggaaaucaguuc

SEQ ID NO: 500792 - RNA, 63 nt, Homo Sapiens
ugaccuugcuuuguuaauaauaucuuuaaaaacaaagacaauccuuaaagcuuugcuccucac

SEQ ID NO: 500793 - RNA, 63 nt, Homo Sapiens
uguuucuaauuuuuuuuuuguugucgugugagcaaagacaaacauaaauugaaaaacauccug

SEQ ID NO: 500794 - RNA, 63 nt, Homo Sapiens
uagagaauacaacaaagaguucuaagacuuagaaaagacaauuuuguggugucauuucaucca

SEQ ID NO: 500795 - RNA, 63 nt, Homo Sapiens
acauagcgaauacaaaauuggaagcugucauaaaaagacaacucagaggccaggcgcaggggc

SEQ ID NO: 500796 - RNA, 63 nt, Homo Sapiens
gacacagcagcuggugguuuuguguauaccuguaaagacaagcugagaagcuuacuuuuuggg

SEQ ID NO: 500797 - RNA, 63 nt, Homo Sapiens
uuuaaagagaaaaaauauguguauaucauggaaaaagacaaggauauuuuaauaaaacauuac

SEQ ID NO: 500798 - RNA, 63 nt, Homo Sapiens
cucgcauucuguuucuugcuuuaaaagaagaguaaagacaagaguguuggaccaguauugcag

SEQ ID NO: 500799 - RNA, 63 nt, Homo Sapiens
ucugauuuuuuuuuucagaaauaauguuuuuuaaaagacaaaaacaaagggaagaauauuuaa

SEQ ID NO: 500800 - RNA, 63 nt, Homo Sapiens
uuguaaacguuacuuaacacaguauaaagaugaaaagacaacaaaaguaucuucauacuuccu

SEQ ID NO: 500801 - RNA, 63 nt, Homo Sapiens
uggaggcaaaauuuagaccaguauacuaauucaaaagacaaauauuucagaggaaguggagua

SEQ ID NO: 500802 - RNA, 63 nt, Homo Sapiens
agguggaaaauggacuggcuuggccacaaccugaaagacaaaauaaacauuuuauuuucuaaa

SEQ ID NO: 500803 - RNA, 63 nt, Homo Sapiens
cuggccaacaugacgaaaccccaucucuacuaaaaagacaaaaaauuagcugggcaugguggc

SEQ ID NO: 500804 - RNA, 63 nt, Homo Sapiens
aggggcuuuucucugagccuccuucaucugcccaaagacaaauccucaaaaggaaauucaauc

SEQ ID NO: 500805 - RNA, 63 nt, Homo Sapiens
caaccaucuggcuuaugcuaugcaaaugaaguuaaagacaagggguggagucacuaauaaauu

SEQ ID NO: 500806 - RNA, 63 nt, Homo Sapiens
uuauuauuuuagaagaaaauucagaggcccaugaaagacaauuaaaaaaaggaaguuaaguca

SEQ ID NO: 500807 - RNA, 63 nt, Homo Sapiens
cccacauguucucaaggccggccaauggggcucaaagacaaaugacagaggaaaacaucacaa

SEQ ID NO: 500808 - RNA, 63 nt, Homo Sapiens
uuauaaaauggcacuuuaagcuggcuaauuaaaaaagacaacuauggauaaaauugggucuuu

SEQ ID NO: 500809 - RNA, 63 nt, Homo Sapiens
ccccacaaaacucuuccugcaacuugaccuuaaaaagacaaaauuaucaucccuaacuauugc

SEQ ID NO: 500810 - RNA, 63 nt, Homo Sapiens
guuggagagccccucacacauuuuauacuuuguaaagacaauuuccugggaucacugaugacu

SEQ ID NO: 500811 - RNA, 63 nt, Homo Sapiens
ggggcagguacucuaauauauucagacuauuacaaagacaacuuaccaugaacaguguguugc

SEQ ID NO: 500812 - RNA, 63 nt, Homo Sapiens
ugccauuaccacaugacucaucuuucuuuuuuuaaagacaaccgggcuucucuccuugaugcu

SEQ ID NO: 500813 - RNA, 63 nt, Homo Sapiens
uugaagaagaaauguagcccaugccaugcugaaaaagacaaaaagucccagggaaagagaacc

SEQ ID NO: 500814 - RNA, 63 nt, Homo Sapiens
ggacaucacucuuaucaaaugcaaauagaaauaaaagacaaaaauuuuaaagucaaguuguga

SEQ ID NO: 500815 - RNA, 63 nt, Homo Sapiens
gggaaaguauuucucuugaugaugggggagaaaaaagacaagacuuuuuuauaaaaaaagaga

SEQ ID NO: 500816 - RNA, 63 nt, Homo Sapiens
uuaauguuuacaacaauaaauucuuucuuugagaaagacaauucugauuuuuuuucugauaaa

SEQ ID NO: 500817 - RNA, 63 nt, Homo Sapiens
gucugauucagauugcaugguuuguaaccuaggaaagacaaaggaugguuggccauuugaguc

SEQ ID NO: 500818 - RNA, 63 nt, Homo Sapiens
ccuuauugucugaauguaaugcccugcaaauaaaaagacaauuacagauaaagauuuuguuuu

SEQ ID NO: 500819 - RNA, 63 nt, Homo Sapiens
uggaucuaaauauguauuucaaugcauauuuuuaaagacaauucaguggaaaacuccaguugu

SEQ ID NO: 500820 - RNA, 63 nt, Homo Sapiens
caugcauacaacuuuggucaugggaccaucccaaaagacaagcuuucuuuuaaaauaaacagc

SEQ ID NO: 500821 - RNA, 63 nt, Homo Sapiens
ucuguuucuugagaagagaagcuauuuaaagacaaagacaaauuuauuacaucuuucacauug

SEQ ID NO: 500822 - RNA, 63 nt, Homo Sapiens
acaaauucuguuucuugagaacauuggcuauuuaaagacaaaguguauuuuauuacaucuuuc

SEQ ID NO: 500823 - RNA, 63 nt, Homo Sapiens
cauuauucagugaauuacuauguaauuauggcuaaagacaaacguauaugcaagugguaugug

SEQ ID NO: 500824 - RNA, 63 nt, Homo Sapiens
guuuuaauaaaagauuuacauuuacuacuguggaaagacaacuuauacuguaugugccaaagc

SEQ ID NO: 500825 - RNA, 63 nt, Homo Sapiens
auuggaguaacguagaaugccagggccaaaccaaaagacaaaaugcgggagcaacaaacagcu

SEQ ID NO: 500826 - RNA, 63 nt, Homo Sapiens
cagagauguucagcauccugaccauccccuuggaaagacaaccaugauacaguggaccuggag

SEQ ID NO: 500827 - RNA, 63 nt, Homo Sapiens
gcaacauuuuaaggcaauggaccuggagcaauaaaagacaaauaagcaguggagaagaggaag

SEQ ID NO: 500828 - RNA, 63 nt, Homo Sapiens
uauaauuugaauuuuaugcucuuuaaacgaaacaaagacaauuucaggaggacauggcacuau

SEQ ID NO: 500829 - RNA, 63 nt, Homo Sapiens
gcgauuucuucccacuccuggcucaguugucggaaagacaaaacucccagccccagguggaag

SEQ ID NO: 500830 - RNA, 63 nt, Homo Sapiens
uucuuuuuaucuuuaguagacacuuuuaaaagaaaagacaaguuuguuguguuuaacucacca

SEQ ID NO: 500831 - RNA, 63 nt, Homo Sapiens
uggcgguggggaccaagauccggaaagaugaauaaagacaaacaugacaaacuaagaaaacac

SEQ ID NO: 500832 - RNA, 63 nt, Homo Sapiens
uuagauguacauuggcacuuggauuagauuccaaaagacaaaaguguugggugcuucuagcuu

SEQ ID NO: 500833 - RNA, 63 nt, Homo Sapiens
accaaaaaagugaaagagaaauugaaagggaaaaaagacaaaaagcauaaggcuccaaaacga

SEQ ID NO: 500834 - RNA, 63 nt, Homo Sapiens
uaugaugguucugcagccauugcaaacauuuuuaaagacaauuuaaugccauggggaaaugau

SEQ ID NO: 500835 - RNA, 63 nt, Homo Sapiens
agggggcgaugucugcuggcccaggggaagggaaaagacaaaugucuugacuguugaccucgg

SEQ ID NO: 500836 - RNA, 63 nt, Homo Sapiens
cccaggguucaggcccugucuaagguguugcuuaaagacaaaaaggcaacaugugccucacug

SEQ ID NO: 500837 - RNA, 63 nt, Homo Sapiens
aaccaggcaacuuggaaucccuaaauucuguaaaaagacaauucaucucauugugaguggaag

SEQ ID NO: 500838 - RNA, 63 nt, Homo Sapiens
acuguaauuuguguaguuuuucuuuuuuaacuuaaagacaacuuuaaaaaauacuuacauuaa

SEQ ID NO: 500839 - RNA, 63 nt, Homo Sapiens
uuuacaauuaauguuuucuacaugucugucuucaaagacaacaugcuuuggaaacauaugucc

SEQ ID NO: 500840 - RNA, 63 nt, Homo Sapiens
guugagugcaacaucauguauuaauaucaaaugaaagacaagggugcuguaucuuugauuauu

SEQ ID NO: 500841 - RNA, 63 nt, Homo Sapiens
uuaauuuuagaguggucuuggauuacuaaagauaaagacaaagcacauuuucuagaaugaacu

SEQ ID NO: 500842 - RNA, 63 nt, Homo Sapiens
gagguggcugaaaugugaugaaaagcaauacgaaaagacaauguaaacuuugaaaaggauuuu

SEQ ID NO: 500843 - RNA, 63 nt, Homo Sapiens
uaauucuuuuaguugauagagauucauuuagucaaagacaaaagcuuuaacugugagggcaca

SEQ ID NO: 500844 - RNA, 63 nt, Homo Sapiens
ucuuaaugccucucuaaagccaaaaaaaaaaaaaaagacaaagccucuuaauaaauuuaaugg

SEQ ID NO: 500845 - RNA, 63 nt, Homo Sapiens
uccuuuauaucuguuuacaaaacugugaaucaaaaagacaaaacuuucuuccuaguuuuugua

SEQ ID NO: 500846 - RNA, 63 nt, Homo Sapiens
acaauuuaugaugcaaauaauguaaaauguuuuaaagacaaauggcaaauaagauauggacca

SEQ ID NO: 500847 - RNA, 63 nt, Homo Sapiens
gcugccgcuuauucauugccuugauuuucuucaaaagacaacuauaaucauucaaaaauucca

SEQ ID NO: 500848 - RNA, 63 nt, Homo Sapiens
uacgugaauuuuuuagcuaagcuugacagauugaaagacaagugucauuuuuuuuuguagagg

SEQ ID NO: 500849 - RNA, 63 nt, Homo Sapiens
aaucagagagugucacagauuuaaccuugaucuaaagacaaguuguacccagaguaugugaaa

SEQ ID NO: 500850 - RNA, 63 nt, Homo Sapiens
aagacauccacauauugcauguuaaccagaagaaaagacaacauuuuccggaaauccacugca

SEQ ID NO: 500851 - RNA, 63 nt, Homo Sapiens
auguucgucuauacccuaaguaaaaugaggacgaaagacaaauauuuugaaagccuaguccau

SEQ ID NO: 500852 - RNA, 63 nt, Homo Sapiens
auaucaucaaugugacauuuacaccacacuuucaaagacaaucacugaaacaaaaauugucuu

SEQ ID NO: 500853 - RNA, 63 nt, Homo Sapiens
uauucucugaagacaaccaagagaaaauugcaaaaagacaaguaugacuuuuauaugaacccc

SEQ ID NO: 500854 - RNA, 63 nt, Homo Sapiens
aauuccuggucuaguuuccuuuuaaaacugaccaaagacaauuaugaaccagcaaguuguuca

SEQ ID NO: 500855 - RNA, 63 nt, Homo Sapiens
aaaaauugcauguauuuguaaaaaaaaaaaaaaaaagacaaauaagaucguuucucuaaaauu

SEQ ID NO: 500856 - RNA, 63 nt, Homo Sapiens
guuugcuucauccggggaugguuccagauggaaaaagacaaaaaugaucucaccacuuuaaga

SEQ ID NO: 500857 - RNA, 63 nt, Homo Sapiens
ugugcccacugugugcuuuuacuuccacuacccaaagacaaaacaaacacugacauuaccuac

SEQ ID NO: 500858 - RNA, 63 nt, Homo Sapiens
ugggaaggaaaggucuuugucuggccaaauagcaaagacaaccgaaguuacacagaaaugcug

SEQ ID NO: 500859 - RNA, 63 nt, Homo Sapiens
ucuauuacacccuccuuuauauuaugauuuauuaaagacaauugaaaaaugaggggaacuuca

SEQ ID NO: 500860 - RNA, 63 nt, Homo Sapiens
acaaccuaugacuggagcagucugaccaagaacaaagacaacccaugaagucuacuugcaggu

SEQ ID NO: 500861 - RNA, 63 nt, Homo Sapiens
accuuauuugucggggaagaauagagauauuuaaaagacaaaccuggaccucucuugugagcc

SEQ ID NO: 500862 - RNA, 63 nt, Homo Sapiens
aagaaacuaaguuacuugucaaguccuaguggaaaagacaaaaucaaccgacuuuguucuucc

SEQ ID NO: 500863 - RNA, 63 nt, Homo Sapiens
caugggaaagaaauauggcgacacauuauuuggaaagacaagcuugugacagacuuaaaaaca

SEQ ID NO: 500864 - RNA, 63 nt, Homo Sapiens
uuuguaccucucugugcuuaauucuuggguaauaaagacaaaccuucauuuguuccauuccug

SEQ ID NO: 500865 - RNA, 63 nt, Homo Sapiens
agaagcagcagcaguaucuuauuguauauuucaaaagacaaaaaagggcagagccuacaaaac

SEQ ID NO: 500866 - RNA, 63 nt, Homo Sapiens
aaggaaaucuggauucugagguggaagaaggaaaaagacaaaaucuauguuuucuuagaacau

SEQ ID NO: 500867 - RNA, 63 nt, Homo Sapiens
aaaucauaaauuaucgguccggccggacaaaggaaagacaauaaauuacagaaacauguuaaa

SEQ ID NO: 500868 - RNA, 63 nt, Homo Sapiens
ccuuacaaacucacuaugaaucuuucugcuuacaaagacaaagcaaaaaacaacacagucuac

SEQ ID NO: 500869 - RNA, 63 nt, Homo Sapiens
cacucaggcaucuucuuucuacacaacauaaucaaagacaacuaaauuuaaauaguaaauaaa

SEQ ID NO: 500870 - RNA, 63 nt, Homo Sapiens
gggagagaaaaagaggaaggaacaaaaaaaucgaaagacaaacuaacaaugaaaaaaugagca

SEQ ID NO: 500871 - RNA, 63 nt, Homo Sapiens
gcccguuuuccuccaguccacaguaguaaauuuaaagacaaauagcagaacuauucagauugu

SEQ ID NO: 500872 - RNA, 63 nt, Homo Sapiens
cuucaguauguugucaaagagugcauucuuuuaaaagacaagauguuucuuuuguauguaaau

SEQ ID NO: 500873 - RNA, 63 nt, Homo Sapiens
ccagguuggacugccagaauugcgggauuguguaaagacaaugauuguaaauacaaaauugca

SEQ ID NO: 500874 - RNA, 63 nt, Homo Sapiens
ggggaaagaagaccuaggacacagcuacaaaggaaagacaacuccccaacacuaaaccuaagg

SEQ ID NO: 500875 - RNA, 63 nt, Homo Sapiens
aacugcuagugacauuccucccugguugugaaaaaagacaaugguuugaaauaugugauagua

SEQ ID NO: 500876 - RNA, 63 nt, Homo Sapiens
uaacacccauuuuaaaauuuaaguuuuguccuuaaagacaacuucagugguuaauuauaaaag

SEQ ID NO: 500877 - RNA, 63 nt, Homo Sapiens
acagcucccagcugggagaaaccaacaugacgaaaagacaaagaauacuggagaagagagagg

SEQ ID NO: 500878 - RNA, 63 nt, Homo Sapiens
caaagagacucccacucagauucuaaagcauuuaaagacaauucuagcagaauuuaucaaaac

SEQ ID NO: 500879 - RNA, 63 nt, Homo Sapiens
ugaaagcaauguucauaaauauuuaagcaaauuaaagacaauguuaacaaauuuucuauuaaa

SEQ ID NO: 500880 - RNA, 63 nt, Homo Sapiens
cugugcuucagauuccuuauguguuguuguuuuaaagacaauuugcaggggguugggagaagg

SEQ ID NO: 500881 - RNA, 63 nt, Homo Sapiens
aucaguuuuauuacugcaccauguuuacuucaaaaagacaaaacaaaaaaaaaauuauuuuuc

SEQ ID NO: 500882 - RNA, 63 nt, Homo Sapiens
uguguguacuccuaaaucuuuaugcuguccucuaaagacaaacacaaacucucagacuuuuuu

SEQ ID NO: 500883 - RNA, 63 nt, Homo Sapiens
uacagacaacugcaacaggugccaccacccacaaaagacaacacuacccucguaacuacugcu

SEQ ID NO: 500884 - RNA, 63 nt, Homo Sapiens
uuuucuuuuguuuuuuuuuuaaaaaagacauuuaaagacaaagacauuauuucucauagcagg

SEQ ID NO: 500885 - RNA, 63 nt, Homo Sapiens
augugacuuccggagauaaaggauucaaaagauaaagacaaaguacgcucagaguuguuaacc

SEQ ID NO: 500886 - RNA, 63 nt, Homo Sapiens
ggagcacuuugauguaaaccagaauagcuuuaaaaagacaaaaaggaucguagaucugauuuu

SEQ ID NO: 500887 - RNA, 63 nt, Homo Sapiens
aguguaaacacaagccuaggacauggacuagguaaagacaaaguccuugcauucuugacauac

SEQ ID NO: 500888 - RNA, 63 nt, Homo Sapiens
cauacaauaaaauaaaagguaauucagggucccaaagacaaacuuacuaagaaaaaaucauua

SEQ ID NO: 500889 - RNA, 63 nt, Homo Sapiens
aucauggugguccuaccuggauaauuuaacuauaaagacaaaguaauucuauuaaaugaacua

SEQ ID NO: 500890 - RNA, 63 nt, Homo Sapiens
uugucaguguacagaaugcuaaaauaauuaaaaaaagacaaaauauaccucuuccuacaagau

SEQ ID NO: 500891 - RNA, 63 nt, Homo Sapiens
auuugaacuuauuuacacauaguuugaaaaaaaaaagacaaaaauaguauucaggugagcaau

SEQ ID NO: 500892 - RNA, 63 nt, Homo Sapiens
cugccuccacgugcccaaggggugcacccagccaaagacaaagcugcaucugggccaggcugg

SEQ ID NO: 500893 - RNA, 63 nt, Homo Sapiens
agagauuacaaaaggaaaaucguaccuuuuugcaaagacaaaauaugacauaugggaagggaa

SEQ ID NO: 500894 - RNA, 63 nt, Homo Sapiens
ggacccuuaagaauuuaugcuuuuuaaguaaagaaagacaauuaucaaagacaccagggcaga

SEQ ID NO: 500895 - RNA, 63 nt, Homo Sapiens
aaaucagcuuuggaaaguaacaguaaaaaaagaaaagacaaaacaucugagaguuucuuguuu

SEQ ID NO: 500896 - RNA, 63 nt, Homo Sapiens
aaugaaauugacagugaauaagugucaauuucaaaagacaagaaaguuucguaagucaggcca

SEQ ID NO: 500897 - RNA, 63 nt, Homo Sapiens
cucuggugacacaugucuagcuuccucugccacaaagacaauacaauuuaguguuugacauug

SEQ ID NO: 500898 - RNA, 63 nt, Homo Sapiens
uaaaggaggggcuaggggagacauaaggaaaaaaaagacaaauaacccagaaagguuuaaaaa

SEQ ID NO: 500899 - RNA, 63 nt, Homo Sapiens
aaguaaaaauaaaaacaaaauuguuuagaaaaaaaagacaaaagccucaaccaacuuagugac

SEQ ID NO: 500900 - RNA, 63 nt, Homo Sapiens
aauaugacagccguggugguugacuauuuucaaaaagacaaaaucaucucauccuaauuaagg

SEQ ID NO: 500901 - RNA, 63 nt, Homo Sapiens
ccuacaauuuuaaaauaacaaagauauguaaguaaagacaagcuuaagguaaggucuguaggc

SEQ ID NO: 500902 - RNA, 63 nt, Homo Sapiens
auaacuauuuagcagagaaugcaauuuacuuuuaaagacaaacgaaauuggauguaauuuuau

SEQ ID NO: 500903 - RNA, 63 nt, Homo Sapiens
acugccaaccccucuuucgugacgcugauccauaaagacaaucacccugaggucacugcuaga

SEQ ID NO: 500904 - RNA, 63 nt, Homo Sapiens
augaaagagacacaggguguuggagccaauagaaaagacaaaauaacuuuauggacacuaaac

SEQ ID NO: 500905 - RNA, 63 nt, Homo Sapiens
aaauauccagaaaggaacaaucuggaagccagaaaagacaaaguggaaagugugcauuggaca

SEQ ID NO: 500906 - RNA, 63 nt, Homo Sapiens
auaaaaucccagagagguggcccuacucaucagaaagacaaauaaauccaccuuucccaucau

SEQ ID NO: 500907 - RNA, 63 nt, Homo Sapiens
uagugaacaucaaugaacaucauauaauguauuaaagacaaagauaacucuggucuagauuuu

SEQ ID NO: 500908 - RNA, 63 nt, Homo Sapiens
gucugucuuuccugaaccaugguccaugcuaacaaagacaaaaugaacagagagacccuugug

SEQ ID NO: 500909 - RNA, 63 nt, Homo Sapiens
aaaucuucacaauaacuuuacuuugguaaaaauaaagacaauaaugcucaaacuaugggaaau

SEQ ID NO: 500910 - RNA, 63 nt, Homo Sapiens
auuaguaauaaaaccucaucucaauagccacaaaaagacaaauguggucaccacacacuugca

SEQ ID NO: 500911 - RNA, 63 nt, Homo Sapiens
aaaaauuuaaaaauuauuuuucuauuuuguuuaaaagacaaugcauggcuuuucaagugagua

SEQ ID NO: 500912 - RNA, 63 nt, Homo Sapiens
uuuaauuuccaaccacacuucuuauuuuuuugaaaagacaauuuuccauuucaguauuacauu

SEQ ID NO: 500913 - RNA, 63 nt, Homo Sapiens
auaaaauauguaaugucuuuuuuauaaagcaaaaaagacaauaauugcauuuaugagcucggc

SEQ ID NO: 500914 - RNA, 63 nt, Homo Sapiens
uuucuguagcuuuacaauuaauuuaaguacuaaaaagacaaggauuucuuuuaagaaauuuau

SEQ ID NO: 500915 - RNA, 63 nt, Homo Sapiens
guuuggacugaaucacaucuguaguacuuagccaaagacaauuuggaggagaauaucagccuu

SEQ ID NO: 500916 - RNA, 63 nt, Homo Sapiens
auaaaagcaaacaggcaaacaugaguguaaauuaaagacaaaaagaaaacucugguuuuauau

SEQ ID NO: 500917 - RNA, 63 nt, Homo Sapiens
uguugcugguuacuaaacuuuauggugucacaaaaagacaaaugauuguaggauccauggaag

SEQ ID NO: 500918 - RNA, 63 nt, Homo Sapiens
agccuaagcguacgagugaaaacaaugaugucaaaagacaauagcaaguauaggcuacuauuu

SEQ ID NO: 500919 - RNA, 63 nt, Homo Sapiens
cguuuugcacugauaaacaugagaaucuggaggaaagacaauuguuuucuuguuuaaaauaug

SEQ ID NO: 500920 - RNA, 63 nt, Homo Sapiens
uuagacuaauugguacaaggaaggcaagaaaacaaagacaaauaaacagcggaaguuaucagu

SEQ ID NO: 500921 - RNA, 63 nt, Homo Sapiens
uguaaguuacuuuaaagcuaauacaagaaaaacaaagacaagugaaaguaaggaaacagaaau

SEQ ID NO: 500922 - RNA, 63 nt, Homo Sapiens
ccauccuugaaaaaauggggaaaaaagaagaaaaaagacaaaaucgaccauaaaagaccaaaa

SEQ ID NO: 500923 - RNA, 63 nt, Homo Sapiens
aaagggggacccaggucuuccccacaauuacacaaagacaaaauggugaggcugagaaaccag

SEQ ID NO: 500924 - RNA, 63 nt, Homo Sapiens
cuugaaaaauguauucuugaaugaauacauuuuaaagacaaaaaguuuaaucugaauauguaa

SEQ ID NO: 500925 - RNA, 63 nt, Homo Sapiens
cuagauacuuuuggaaguuuggaguuuaguuuaaaagacaacagauugggcagugaggaaugg

SEQ ID NO: 500926 - RNA, 63 nt, Homo Sapiens
uucccuauguugcccagcuguuuuauuuuuugaaaagacaaggauaccgccacacccagcuaa

SEQ ID NO: 500927 - RNA, 63 nt, Homo Sapiens
ugauauaaaaguuaaaaagcuccauaaguuuccaaagacaagauuauuaguuuuggaagcuua

SEQ ID NO: 500928 - RNA, 63 nt, Homo Sapiens
uuauaacuaaaagucgaaaggcuaaaaaaagucaaagacaacacagcgcuaaacacuguggag

SEQ ID NO: 500929 - RNA, 63 nt, Homo Sapiens
agaaauagaagcugauuuaaagaaaaugggaggaaagacaagaaggaguagcauggcaacugg

SEQ ID NO: 500930 - RNA, 63 nt, Homo Sapiens
ggauuauagacuuaaaaauacagucuacuuuauaaagacaaauuggucauuuuacuuagaugc

SEQ ID NO: 500931 - RNA, 63 nt, Homo Sapiens
aaaaaagaauucauugauaacaagaaaauuuaaaaagacaaaaacaaauacauuuuuuaaaau

SEQ ID NO: 500932 - RNA, 63 nt, Homo Sapiens
aaaaaaaaaaaaaaaaaaaacucugcccuccaaaaagacaaaaguuugcuuuuccggacccca

SEQ ID NO: 500933 - RNA, 63 nt, Homo Sapiens
cuucucuuucugauguuaaggugcaacucuccuaaagacaaaaauauuuauugugcccuaaau

SEQ ID NO: 500934 - RNA, 63 nt, Homo Sapiens
agcuucagauggguaccccaguuaugucuuguaaaagacaagacagaauggacagugaggaca

SEQ ID NO: 500935 - RNA, 63 nt, Homo Sapiens
auaaaaauuccuuuuuauuccuacggcccaaaaaaagacaaaaaaucugaccauuuuacgucu

SEQ ID NO: 500936 - RNA, 63 nt, Homo Sapiens
gcauguugagauaacuucugaauuuuuuuaugaaaagacaaauuccugggggcauuuuuacgu

SEQ ID NO: 500937 - RNA, 63 nt, Homo Sapiens
aaaugggguggcuuccuuucgcggcccucgugaaaagacaagaaccaaggugauccccagccu

SEQ ID NO: 500938 - RNA, 63 nt, Homo Sapiens
uauuuauaaugacgacuguaagaguuaguuuuaaaagacaagaaaccuuuuauaaccaacacu

SEQ ID NO: 500939 - RNA, 63 nt, Homo Sapiens
auuaauacaauuaauauuaauauuaacuacagaaaagacaaacaguagagaacagcaaaaaaa

SEQ ID NO: 500940 - RNA, 63 nt, Homo Sapiens
uacagugcuaauguauaugguugcaguucacauaaagacaaaagcaucuguuaugaaaugagu

SEQ ID NO: 500941 - RNA, 63 nt, Homo Sapiens
uucuaaggaaugcacaaauugaaaacacacucaaaagacaaacaugcaaguaaagaaaaaaaa

SEQ ID NO: 500942 - RNA, 63 nt, Homo Sapiens
aauguagacuuuugacacuuuuaaaaaacaaaaaaagacaagagagaugaaaacguuugauua

SEQ ID NO: 500943 - RNA, 63 nt, Homo Sapiens
uguugcggcagagguuugagugaacccucuuucaaagacaauaaauagcacagaauuguccgu

SEQ ID NO: 500944 - RNA, 63 nt, Homo Sapiens
aucacaaacaaaagccugaauguacuauguuuaaaagacaaaccaaaaauuaacccaaacuug

SEQ ID NO: 500945 - RNA, 63 nt, Homo Sapiens
aauaguguuguaacuaugaaaaagaauacuuugaaagacaaagaacuuagacuaagcauguua

SEQ ID NO: 500946 - RNA, 63 nt, Homo Sapiens
aaaucaugaauuuuuuuucuacgugugaguauaaaagacaaaaguugaacagcauggaaucuc

SEQ ID NO: 500947 - RNA, 63 nt, Homo Sapiens
uugguuuuugaguuguucuugucauagacauaaaaagacaauucauuuucuuguuuuauuaac

SEQ ID NO: 500948 - RNA, 63 nt, Homo Sapiens
gccuaauauuuaugacuuucacauuuggaauuuaaagacaaaaauacaucaaggaguuaugcu

SEQ ID NO: 500949 - RNA, 63 nt, Homo Sapiens
caguagaacagaaaugaauauaugcuaaaucacaaagacaacucuccuugcaaaauacugcac

SEQ ID NO: 500950 - RNA, 63 nt, Homo Sapiens
uuuauuuuuaauuauuauuuccccgucccuuaaaaagacaaaaaaaauaaggcaaaaggaaag

SEQ ID NO: 500951 - RNA, 63 nt, Homo Sapiens
uacuucuacaauaacacaagauaccuguuccucaaagacaaugcauucugccauaauguucau

SEQ ID NO: 500952 - RNA, 63 nt, Homo Sapiens
uauguucaaagacguuuauucauguucaacaggaaagacaaaguguacgugaaugcucgcugu

SEQ ID NO: 500953 - RNA, 63 nt, Homo Sapiens
gaugguugucuugugugcuucucugcauuuuuaaaagacaagacauucuuguacauauuauca

SEQ ID NO: 500954 - RNA, 63 nt, Homo Sapiens
uaccagaauugaauauaccauaugggauuggagaaagacaaauguggaagaaaucauagagcu

SEQ ID NO: 500955 - RNA, 63 nt, Homo Sapiens
uuggcuagagagcgaguauugugauuuugcugaaaagacaaggugugaaggagcaacuucagu

SEQ ID NO: 500956 - RNA, 63 nt, Homo Sapiens
aaacagaauguucauacugauguguugugccuuaaagacaagacagcauuuguguguuacaau

SEQ ID NO: 500957 - RNA, 63 nt, Homo Sapiens
ugaaacuuuuccuagaugcaaaugcugacuaauaaagacaaagccacccugaaccugacgucu

SEQ ID NO: 500958 - RNA, 63 nt, Homo Sapiens
ggaaauaaauuagugcgguucucuuugacccccaaagacaagacaagcacuuauuuuuauuuu

SEQ ID NO: 500959 - RNA, 63 nt, Homo Sapiens
ggauuuugguuuaggaaaaaucucauagguauaaaagacaacugggaauguugaauguggauc

SEQ ID NO: 500960 - RNA, 63 nt, Homo Sapiens
gucaacaagccugacccuguaaaauggagguggaaagacaagcucaaguguucacaaccugga

SEQ ID NO: 500961 - RNA, 63 nt, Homo Sapiens
uuaaagagacuuaguugauugugugaacuucugaaagacaauaucugaucugugugugagugu

SEQ ID NO: 500962 - RNA, 63 nt, Homo Sapiens
aauaaaaagaaaagaaaaaguccaccuggcuccaaagacaaaaccagaguuaaaaaucaucug

SEQ ID NO: 500963 - RNA, 63 nt, Homo Sapiens
auuucuacuacgucggccauaaaaacuguaaacaaagacaaccuuucuuccauaaugcaucug

SEQ ID NO: 500964 - RNA, 63 nt, Homo Sapiens
ugguugcugagaugcaguuaugacuacaagaugaaagacaauuguuaaaacucagggauucug

SEQ ID NO: 500965 - RNA, 63 nt, Homo Sapiens
aacauuaagggccauauuguaauaggaacaaauaaagacaaacaagaaaaagagaaagaugaa

SEQ ID NO: 500966 - RNA, 63 nt, Homo Sapiens
gguccagucucauccaucucuuuggagacagaaaaagacaaaauucaaaaaugacaaagucag

SEQ ID NO: 500967 - RNA, 63 nt, Homo Sapiens
aacagcaauguuaaauugccccccauuuuucauaaagacaaagugacaaggaaccugaccuaa

SEQ ID NO: 500968 - RNA, 63 nt, Homo Sapiens
acacccacacgcagucuuugagauggaagacaaaaagacaaacugauuuaaauguaaaccaaa

SEQ ID NO: 500969 - RNA, 63 nt, Homo Sapiens
cauagccuguggucuccacagugaccucaccucaaagacaauuauugaagguccuucccaccu

SEQ ID NO: 500970 - RNA, 63 nt, Homo Sapiens
ugugaccaaaaaaaagcauggggauuacuagagaaagacaaaauuuuuaagggauguugcaaa

SEQ ID NO: 500971 - RNA, 63 nt, Homo Sapiens
gugcucuauguccuaguaacggggguggggagaaaagacaaauacagaagcaaaggagagcuu

SEQ ID NO: 500972 - RNA, 63 nt, Homo Sapiens
ggugggacagagggaaccuagaaggucuaauaaaaagacaagccguauuuaucuaguuucagg

SEQ ID NO: 500973 - RNA, 63 nt, Homo Sapiens
cauaaauaauuucuuaacccuugguagauuucuaaagacaacuaauuaugcacacaucuaaca

SEQ ID NO: 500974 - RNA, 63 nt, Homo Sapiens
aaauuguaauauaauaaauuuugauggaaagaaaaagacaauauaucuaguuaaucauaauau

SEQ ID NO: 500975 - RNA, 63 nt, Homo Sapiens
gaauuugguuauaaaagaaaucugcauucuuuaaaagacaagauucuuagcaaucaauauuuu

SEQ ID NO: 500976 - RNA, 63 nt, Homo Sapiens
gacuggauagcuuuucuaauauuaaaacuagcuaaagacaacaccaucauuuugaaaagauuu

SEQ ID NO: 500977 - RNA, 63 nt, Homo Sapiens
agcagaaagcauuuucugcaugacaaaguagccaaagacaaucacuguuucauauuuuucuuu

SEQ ID NO: 500978 - RNA, 63 nt, Homo Sapiens
guggguauccagauggucccuucugcucccuguaaagacaaggucugacacauaagaggugug

SEQ ID NO: 500979 - RNA, 63 nt, Homo Sapiens
uuucaguguaccguaaauguuguguuuucagaaaaagacaaaacgauggugcugacugguuuu

SEQ ID NO: 500980 - RNA, 63 nt, Homo Sapiens
ucauuuuaucaauguagcugugaaggccauuaaaaagacaaacuuaauguacagagcauuuau

SEQ ID NO: 500981 - RNA, 63 nt, Homo Sapiens
uguugugauugaacaauacaaauaacaaacaagaaagacaaugcauuccauuagucugcuauu

SEQ ID NO: 500982 - RNA, 63 nt, Homo Sapiens
augaauccaacugcuuaaaguugguauuaauaaaaagacaaccacauaguucguuuaccuuca

SEQ ID NO: 500983 - RNA, 63 nt, Homo Sapiens
gcuggcuguccgcugcugacuggauggcagcacaaagacaauaugagcagagggaggagaaga

SEQ ID NO: 500984 - RNA, 63 nt, Homo Sapiens
uguggagaagggucuugcauacaauaguuuaaaaaagacaaaaaaaaccuuugcuuaaauuca

SEQ ID NO: 500985 - RNA, 63 nt, Homo Sapiens
gugucacagagauggugccgucauugcuggcuuaaagacaaggggccaggagccaacaccaga

SEQ ID NO: 500986 - RNA, 59 nt, Homo Sapiens; identical to SEQ ID NO: 476518

SEQ ID NO: 500987 - RNA, 63 nt, Homo Sapiens
cuucucgucuugugagcuaaggcuugugucaugaaagacaagaggccucucuuaacagcccag

SEQ ID NO: 500988 - RNA, 63 nt, Homo Sapiens
auugugggaaucacaaagcaaauaguacuccagaaagacaaauaucagaagcuuccuauucuu

SEQ ID NO: 500989 - RNA, 63 nt, Homo Sapiens
auauggauacaaaaaggauacgccgagccaaucaaagacaagcuuuaacuuuacuuugaagug

SEQ ID NO: 500990 - RNA, 63 nt, Homo Sapiens
agcaaugugauuauaugaagagacacaaauuaaaaagacaaauuaaaccugaaauuauauuua

SEQ ID NO: 500991 - RNA, 63 nt, Homo Sapiens
gaggacauguuaaguaaaauaagccaggcuuagaaagacaaaugcugcauaaucucacugugg

SEQ ID NO: 500992 - RNA, 63 nt, Homo Sapiens
gaagaaaaaaucacuuuuaccuuccuaauuuaaaaagacaaaacagaaauguacguuccuucg

SEQ ID NO: 500993 - RNA, 63 nt, Homo Sapiens
aaauauauuagaaguuacuaugaagaaugccccaaagacaaguuaccagcauauccugaguca

SEQ ID NO: 500994 - RNA, 63 nt, Homo Sapiens
uagaaacaaauuuuuaugagcauaacccuauauaaagacaaaaugaauuucugaccuuaccau

SEQ ID NO: 500995 - RNA, 63 nt, Homo Sapiens
accuauaguagucuguguuuaaagugaauuuuuaaagacaaagcauucuaaaugaacucaaua

SEQ ID NO: 500996 - RNA, 63 nt, Homo Sapiens
uaggucauaaggucucuuccuuuucuaaaauugaaagacaagaaauuuagugccaauauugua

SEQ ID NO: 500997 - RNA, 63 nt, Homo Sapiens
acaacuccauuagaaaaauuagaaacucaauacaaagacaagugaaaaccaaaacggaagagg

SEQ ID NO: 500998 - RNA, 63 nt, Homo Sapiens
cccaaacaccuaguuaauugagcauuagguagaaaagacaaaauguaaauuuuuguacauagu

SEQ ID NO: 500999 - RNA, 63 nt, Homo Sapiens
guucaaaagaugcaaauggucacaauggaucccaaagacaauucucauucuucuagaugucau

SEQ ID NO: 501000 - RNA, 63 nt, Homo Sapiens
aaacgcugcaggggccacaguuuccauagugauaaagacaagguucgugcugugucucauggg

SEQ ID NO: 501001 - RNA, 63 nt, Homo Sapiens
uugugaagaucuaauuacaacaaaacacagugaaaagacaacuacaauuuaauuucacguuga

SEQ ID NO: 501002 - RNA, 63 nt, Homo Sapiens
acuuuugaaggaaguuaaaagauccuguauaagaaagacaacugcaaaagaggaggucagagu

SEQ ID NO: 501003 - RNA, 63 nt, Homo Sapiens
gugaaaaaggaaggagugaguuaugaguucuacaaagacaauauuaauuuccucuuaaacaug

SEQ ID NO: 501004 - RNA, 63 nt, Homo Sapiens
cagguuugccuuggcaucagcuugaaaauauaaaaagacaaaauuucacagauccaccugucu

SEQ ID NO: 501005 - RNA, 63 nt, Homo Sapiens
uaacuuuuuaugucuuuuauaauuauucucuuaaaagacaacaaacacaggugucugagcuag

SEQ ID NO: 501006 - RNA, 63 nt, Homo Sapiens
caaaaaauaaaccuuugcuuuaaaaauacaacaaaagacaaaguaucacagcaauucucaugc

SEQ ID NO: 501007 - RNA, 63 nt, Homo Sapiens
uaguaucaacacauuauaaauauguuaggaacaaaagacaaaaauaugauuuucuagugagug

SEQ ID NO: 501008 - RNA, 63 nt, Homo Sapiens
agucaaaacaaaaauauuuuuauauuaaaauuuaaagacaaaagcugguuaaaaaaaacagau

SEQ ID NO: 501009 - RNA, 63 nt, Homo Sapiens
aauuuacuuacuuuauguuauuuuccuaaauaaaaagacaaagacuugcuuuuagcaugauua

SEQ ID NO: 501010 - RNA, 63 nt, Homo Sapiens
aaacuauuuuguagaagauccaaccuuuauuaaaaagacaaauauccaggguggacauuuuuu

SEQ ID NO: 501011 - RNA, 63 nt, Homo Sapiens
ucaucuguaguaguaacugguggaaguugauggaaagacaaaucauuaagcaaaagaauguau

SEQ ID NO: 501012 - RNA, 63 nt, Homo Sapiens
uacaccaguaacauuugacccccaagggagagcaaagacaaaaaauaaaauauacaccuuaua

SEQ ID NO: 501013 - RNA, 63 nt, Homo Sapiens
cagacuauguacauaaucugccaguguuaggguaaagacaaaagggggacacuagaaugaaaa

SEQ ID NO: 501014 - RNA, 63 nt, Homo Sapiens
uguacggcagugccaucugguggcaagugguacaaagacaacgcugagggguagugacuccug

SEQ ID NO: 501015 - RNA, 63 nt, Homo Sapiens
ggagcccggggguugggagggacagggauaaauaaagacaaagacugaagacaaaaaaaaaau

SEQ ID NO: 501016 - RNA, 63 nt, Homo Sapiens
uaguaucaguuuuugaaccacaguaaugggaagaaagacaaauggauucccuuagaaguaaga

SEQ ID NO: 501017 - RNA, 63 nt, Homo Sapiens
aauaaaaaucgaaauaauuuuuuuaaaaaagaaaaagacaauaguauuacccaugggacaaaa

SEQ ID NO: 501018 - RNA, 63 nt, Homo Sapiens
aucaguacugagaaaccugguuugccacagaacaaagacaagaaguauacacuaacuuguaua

SEQ ID NO: 501019 - RNA, 63 nt, Homo Sapiens
ggugagggaagccagaaugacacaaagcaaugcaaagacaagauugccaugcaaauggauggu

SEQ ID NO: 501020 - RNA, 63 nt, Homo Sapiens
aacuacugaggagcuuaguaagcgaaacuuaaaaaagacaagaguugugcaaacugucgauuc

SEQ ID NO: 501021 - RNA, 63 nt, Homo Sapiens
cagauguaauauauuuuguggaguacuuagaaaaaagacaaacaaagacuuuuguauaaaguu

SEQ ID NO: 501022 - RNA, 63 nt, Homo Sapiens
cucauuaguagacauguuucuuucucuguggaaaaagacaaaauccagaaauauaguccaagc

SEQ ID NO: 501023 - RNA, 50 nt, Homo Sapiens
aacgugagugccgacaaggcaaagacaacccaccacaucgacuacuauaa

SEQ ID NO: 501024 - RNA, 63 nt, Homo Sapiens
augacuuacaauacagccuaguguuuggcuucuaaagacaagagucagguuucucgugucugu

SEQ ID NO: 501025 - RNA, 63 nt, Homo Sapiens
guuuaauuugcuaaauauuugcucacuuauuacaaagacaaacucauagaugcauacaaauga

SEQ ID NO: 501026 - RNA, 63 nt, Homo Sapiens
uauauguuaauacaaucucuauuugaauggcugaaagacaaaaguucacugaaauuaaguuga

SEQ ID NO: 501027 - RNA, 63 nt, Homo Sapiens
uugucaagcauuccguauuagcucugaugguuaaaagacaagaguauucauacugugaauugu

SEQ ID NO: 501028 - RNA, 63 nt, Homo Sapiens
ugcuuuauguuauaccuauaaaauagucuuacaaaagacaaugaauugaaaauucagguggau

SEQ ID NO: 501029 - RNA, 63 nt, Homo Sapiens
uuuaucuuggccuuacuguacucugcagacugaaaagacaaaguuucauuuuauguuuuugua

SEQ ID NO: 501030 - RNA, 63 nt, Homo Sapiens
ggucuuuucagucuucccucaucuccugaucauaaagacaagguacagaagcaauauccaaag

SEQ ID NO: 501031 - RNA, 63 nt, Homo Sapiens
agaauaucaagaaaauguauuaaugcauuguugaaagacaaccauaaaaagaauauuucucug

SEQ ID NO: 501032 - RNA, 63 nt, Homo Sapiens
aaaacaaaaaacaaaaaaacacaauaagcuagaaaagacaaaaguuagccuguuuuucuacca

SEQ ID NO: 501033 - RNA, 63 nt, Homo Sapiens
caaccaacgcgaaaccaauugaacugucggaggaaagacaacaccucgcuagacgugaacuca

SEQ ID NO: 501034 - RNA, 63 nt, Homo Sapiens
cauacuguccccauaucccaaaaauaaaaguauaaagacaaaugaaaacaaaaagauguuaga

SEQ ID NO: 501035 - RNA, 63 nt, Homo Sapiens
aaauuucacugugccacccaauguguaaaucauaaagacaaaucuuuuguguguuuaauuauu

SEQ ID NO: 501036 - RNA, 63 nt, Homo Sapiens
cuguguaaauguacaguugauugggcuucaugcaaagacaauucauuuuuaugcuguucccuc

SEQ ID NO: 501037 - RNA, 63 nt, Homo Sapiens
cuccccaccugaaucuguuggggcuuuuguuugaaagacaaaaauucuauugcaagcuucaag

SEQ ID NO: 501038 - RNA, 63 nt, Homo Sapiens
uuugcauauucucuauuuuaguaugccaaucuuaaagacaaauguacuguguuuuuaaauuuu

SEQ ID NO: 501039 - RNA, 63 nt, Homo Sapiens
uuaaacaauuuauuaauuuuaguaagguacaggaaagacaaaaagaaggauaugcaucacaca

SEQ ID NO: 501040 - RNA, 63 nt, Homo Sapiens
uacugacagucuaaucaucauuaaaaaaagaaaaaagacaauacauuuuaauaaaaaauguau

SEQ ID NO: 501041 - RNA, 63 nt, Homo Sapiens
caugcccuugccuaucaaagaguauguuguaagaaagacaagacauuguguguauuagagacu

SEQ ID NO: 501042 - RNA, 63 nt, Homo Sapiens
cgggaucccaaagaaugaggggaauuucuucagaaagacaaucucggcaugcauuauuucuuu

SEQ ID NO: 501043 - RNA, 63 nt, Homo Sapiens
aaucagcugcuacaagaaugcaaaaaaucuuccaaagacaagaaaagaggaaaaaaagccguu

SEQ ID NO: 501044 - RNA, 63 nt, Homo Sapiens
gcccuuaugugaagugaaauaagccaggcacagaaagacaaacaucacauguucucacuuauu

SEQ ID NO: 501045 - RNA, 63 nt, Homo Sapiens
aaacagcagcuaugaagccuugaauuuugaaaaaaagacaagaaggugcaaaagguaagacau

SEQ ID NO: 501046 - RNA, 63 nt, Homo Sapiens
cacucaaaacugaagacauagaggacucagaucaaagacaaaaucugauccauauauuggugc

SEQ ID NO: 501047 - RNA, 63 nt, Homo Sapiens
gaaauggcaaacaaaagacuuguguuuugguucaaagacaagggcuccaagcuuggaaagagc

SEQ ID NO: 501048 - RNA, 63 nt, Homo Sapiens
aaaguggcagaacugccucauuagucagccacaaaagacaaucgaaggccaaaguauccauca

SEQ ID NO: 501049 - RNA, 63 nt, Homo Sapiens
gcugcagugaaaauuuuggacaguucuuggcacaaagacaaaaucugaacuccccugugaaug

SEQ ID NO: 501050 - RNA, 63 nt, Homo Sapiens
ggcccucccucugcccuccccacuagacacuccaaagacaacaugguggucgaagucagcaga

SEQ ID NO: 501051 - RNA, 63 nt, Homo Sapiens
uugcacuuuaauguuuuuuguuguucagauguaaaagacaaaauuuuaaaaaugacagaacuu

SEQ ID NO: 501052 - RNA, 63 nt, Homo Sapiens
uuuauaguuucaggaguaaaagcaaagucagugaaagacaaucaaagaaacgaaagaaagcaa

SEQ ID NO: 501053 - RNA, 63 nt, Homo Sapiens
ucggauguaugaucucucuaauccuaaauaaaaaaagacaaauaaaugugacccccaaguccu

SEQ ID NO: 501054 - RNA, 63 nt, Homo Sapiens
uuuuucuuuucuugauuuuuuauaguagauuuuaaagacaaaacaucuccuuacagucacuaa

SEQ ID NO: 501055 - RNA, 63 nt, Homo Sapiens
aguaacuugggccaguuuggagagcugacucaaaaagacaaaaugagagaaaugaguuuauac

SEQ ID NO: 501056 - RNA, 63 nt, Homo Sapiens
cacauguuuguucucugugguaaagaauaauaaaaagacaaagagucacauugguaggaccaa

SEQ ID NO: 501057 - RNA, 63 nt, Homo Sapiens
uaaagguuaaagagggcauaguguuauagauguaaagacaaaaauguaaacaaugacuguaac

SEQ ID NO: 501058 - RNA, 63 nt, Homo Sapiens
aucaaagaacagauggggucaaugaggaauccaaaagacaaaagugaguggauaaucaggaaa

SEQ ID NO: 501059 - RNA, 63 nt, Homo Sapiens
uaucuaaaaaauguuuauagauuccuuugaaaaaaagacaaaacuuguuuuuuuguuacuauu

SEQ ID NO: 501060 - RNA, 63 nt, Homo Sapiens
ccggaugacacagggugagagacuugacagacgaaagacaagcaucagucacgcaggaggacu

SEQ ID NO: 501061 - RNA, 63 nt, Homo Sapiens
guuucaugaaauuggagcucuguauaaacugaaaaagacaaaauaaguaaagcacuuguugcu

SEQ ID NO: 501062 - RNA, 63 nt, Homo Sapiens
gcaagcuacagcaaagcccauuggccagaaaggaaagacaauaauuuuguuuuuucauuuuga

SEQ ID NO: 501063 - RNA, 63 nt, Homo Sapiens
cuucagucaacuacagcugaguccauaggccagaaagacaauaaauuuuuaucauuuugaaau

SEQ ID NO: 501064 - RNA, 63 nt, Homo Sapiens
cuggauguacuuagauaaugugaaauaaacauuaaagacaaggucuauuuuuaauagauuugc

SEQ ID NO: 501065 - RNA, 63 nt, Homo Sapiens
uaaucuaaacaauauauuccuuaaauuaagaggaaagacaagugucguauuucgauccuguuu

SEQ ID NO: 501066 - RNA, 63 nt, Homo Sapiens
acaagaaugaaaaacagaaauaaaagaaguagaaaagacaaagaaagaaagcccaaagucaaa

SEQ ID NO: 501067 - RNA, 63 nt, Homo Sapiens
agugagccacugaggaaagaauaugcuuauuacaaagacaaaauguggugcagaaacuaucuu

SEQ ID NO: 501068 - RNA, 63 nt, Homo Sapiens
auaauaaucccgggagaaugauuccccucauagaaagacaaaagcauccauccccucauaguu

SEQ ID NO: 501069 - RNA, 63 nt, Homo Sapiens
ucugcagggacucaaagcuguacccaaaucaagaaagacaaaauaacaauagaaaccauucac

SEQ ID NO: 501070 - RNA, 63 nt, Homo Sapiens
accacccaccacagaaaagcacaaaccucugggaaagacaacgucucucgggggccagggguc

SEQ ID NO: 501071 - RNA, 63 nt, Homo Sapiens
gcuacaaaguccagccgagucaaaggaaagagaaaagacaagucaagagagaaagugggacca

SEQ ID NO: 501072 - RNA, 63 nt, Homo Sapiens
uauaacugaauaagaaauuuuuuuaagcaagagaaagacaacuguucugcggguuggagaaaa

SEQ ID NO: 501073 - RNA, 63 nt, Homo Sapiens
guacaguuuuuauauuuuugauaucuuguaaauaaagacaaccagcuuuuccagguucauaau

SEQ ID NO: 501074 - RNA, 63 nt, Homo Sapiens
guccuaaaagcaaaauaaaaacuauucgaaugaaaagacaagaaaaucagguauuaaucuugg

SEQ ID NO: 501075 - RNA, 63 nt, Homo Sapiens
guuuagauagggcugggcaaggaaaaagaaaauaaagacaaccauauuuagcagugcaguuga

SEQ ID NO: 501076 - RNA, 63 nt, Homo Sapiens
uagauuguaugaguaagaaguauuaauuuuuuaaaagacaaaucaacuuugaagacacaaaag

SEQ ID NO: 501077 - RNA, 63 nt, Homo Sapiens
ccugauacaauuugcccaagguaaacaguuugaaaagacaaaugggccugccaaacuguacag

SEQ ID NO: 501078 - RNA, 63 nt, Homo Sapiens
ugugugcagaugcagaaugacaagcugcauucaaaagacaaacaauaugucuuuuuuuuuuuu

SEQ ID NO: 501079 - RNA, 63 nt, Homo Sapiens
ggcaggaggaaagcacaauguuucuuagccaggaaagacaaauaauccaacgcugcuagucuu

SEQ ID NO: 501080 - RNA, 63 nt, Homo Sapiens
ccugaugccucauucaccaggauggguaacuuuaaagacaaguuuuauaacuggcaucccauc

SEQ ID NO: 501081 - RNA, 63 nt, Homo Sapiens
auuuuguuuuucauuuugaaucggccggaaaagaaagacaauaguaagcuacagcuaagccca

SEQ ID NO: 501082 - RNA, 62 nt, Homo Sapiens
augagcauaccagcaguccuucuuuaaggaaaaaaagacaagggcaacagagcaagauccug

SEQ ID NO: 501083 - RNA, 63 nt, Homo Sapiens
auguugagaguugcuggugugaugacauaucugaaagacaaguuuugccuguuagacaugacu

SEQ ID NO: 501084 - RNA, 63 nt, Homo Sapiens
uguccgaagugcuaagaacuuacaaaguggggaaaagacaaauugaaugacacauaacagcug

SEQ ID NO: 501085 - RNA, 63 nt, Homo Sapiens
uaaugaagugcuccagucagguauagacuccugaaagacaauauacagagaccaccagaucag

SEQ ID NO: 501086 - RNA, 63 nt, Homo Sapiens
ugcucugcagccagcuucagggacucucagaagaaagacaagccucugcccucccucugagca

SEQ ID NO: 501087 - RNA, 63 nt, Homo Sapiens
caucauuugaaaauauauuacuuuggguuuuuaaaagacaaguaacucugggaaagauguuac

SEQ ID NO: 501088 - RNA, 63 nt, Homo Sapiens
aaaacugaugugcacuuuauguggggacagcaaaaagacaagcggagaugcugaucccuucaa

SEQ ID NO: 501089 - RNA, 63 nt, Homo Sapiens
aaagaaacaaaauuaaaauguguauauuugaggaaagacaaacacugagccaaggugauggac

SEQ ID NO: 501090 - RNA, 63 nt, Homo Sapiens
guuagucugaucuccagacccaguuccucuccuaaagacaaaggaaucugaguugugucacuu

SEQ ID NO: 501091 - RNA, 63 nt, Homo Sapiens
aggaagcuggaagaggcagccugcaacugacuuaaagacaaaaucuccaacgcugcucccugu

SEQ ID NO: 501092 - RNA, 63 nt, Homo Sapiens
gaauuccagucaggcauuauucaucuaaggaaaaaagacaaggaaggcauguuacuacuuuua

SEQ ID NO: 501093 - RNA, 63 nt, Homo Sapiens
ucaugggggccuccaguguccuacagaucuggaaaagacaaggagaccccaguugugccuuug

SEQ ID NO: 501094 - RNA, 63 nt, Homo Sapiens
accaaguuaucuguuuccuguauggacauguaaaaagacaaaagcugcauuaaaaaaauacaa

SEQ ID NO: 501095 - RNA, 63 nt, Homo Sapiens
cugacuacaaauuuugauauaaauaaagucaauaaagacaauuuucuuuauguacaaaaacua

SEQ ID NO: 501096 - RNA, 63 nt, Homo Sapiens
uguugggcaaggaugcugucauuuuuugaaccaaaagacaaacagguuaaaaggaaaaaaagu

SEQ ID NO: 501097 - RNA, 63 nt, Homo Sapiens
uguagauacugcauggcaggagagcuuuacgcuaaagacaaaagaaacagcuuugggggccgg

SEQ ID NO: 501098 - RNA, 63 nt, Homo Sapiens
uauggauauucauaagguuauuucaaaguuaauaaagacaaaguggcaacuguagaaaguguu

SEQ ID NO: 501099 - RNA, 63 nt, Homo Sapiens
cugcugggggacaugugagccucaaauccauagaaagacaaacggccaccuugggugcccagg

SEQ ID NO: 501100 - RNA, 63 nt, Homo Sapiens
cugagaccccauucuccacaaaaaggaaaaauaaaagacaaaaaaacaaacaaaaaaccaaaa

SEQ ID NO: 501101 - RNA, 63 nt, Homo Sapiens
acauguaaccggcauguuuccagcagaagacaaaaagacaaacaugaaagucuagaaauaaaa

SEQ ID NO: 501102 - RNA, 63 nt, Homo Sapiens
acuauguguaaguccucaucaaaugaaaagcagaaagacaagaacaauuagucaagagcagua

SEQ ID NO: 501103 - RNA, 63 nt, Homo Sapiens
cucagaugaaaacucacuuuuauuaaaaaaaaaaaagacaaggguuuauauucauauacacua

SEQ ID NO: 501104 - RNA, 63 nt, Homo Sapiens
ggaaauguacgauagguagaauugugguucccuaaagacaaguacauaaaggugacccugaug

SEQ ID NO: 501105 - RNA, 63 nt, Homo Sapiens
accugcucuccccagccuguuuucucuuuucuaaaagacaaauuaugguaccauaagcugcca

SEQ ID NO: 501106 - RNA, 63 nt, Homo Sapiens
gugaaauaaaauuguuucacucuuugugguuuuaaagacaacuuuauaugaagaacauaggug

SEQ ID NO: 501107 - RNA, 63 nt, Homo Sapiens
ccuccugucaguugcgugaauuaaugcaagaauaaagacaauucuuguagauuacauuuauca

SEQ ID NO: 501108 - RNA, 63 nt, Homo Sapiens
auuucuuucuccucucgaacaccauacccuguaaaagacaaauuuuugcugucugcggaaguu

SEQ ID NO: 501109 - RNA, 63 nt, Homo Sapiens
uugaaguaaacaaugaaauaugugcuuaguuuuaaagacaacuuucuaggcuuuguuucucug

SEQ ID NO: 501110 - RNA, 63 nt, Homo Sapiens
acagaaaauaagcaagauuucaacaacaaagaaaaagacaauuuaaauaagauaaagggucag

SEQ ID NO: 501111 - RNA, 63 nt, Homo Sapiens
auaaaaaggcucauuaaugggauuaaaaaaaaaaaagacaauaaggaccaguaagggaccuuc

SEQ ID NO: 501112 - RNA, 63 nt, Homo Sapiens
uguauaucaauaaacauuuucggaaguuuuauaaaagacaaaacaguggcccaauguggccaa

SEQ ID NO: 501113 - RNA, 63 nt, Homo Sapiens
caaaaaaccaacucugacuuucuggggggaaaaaaagacaaaagcggguguguuuuuuaauuu

SEQ ID NO: 501114 - RNA, 63 nt, Homo Sapiens
gucuucugugugucacagggagauugaccaggaaaagacaaguugcgcacccugcacaaguac

SEQ ID NO: 501115 - RNA, 63 nt, Homo Sapiens
aaaauaucuucauacuuccuaguauaaagaugaaaagacaacauuguaagcauuacuuaacac

SEQ ID NO: 501116 - RNA, 63 nt, Homo Sapiens
gcucaagcagcaaaauccuuggaauuacuccaaaaagacaaguguaacuugauggaagaaaau

SEQ ID NO: 501117 - RNA, 63 nt, Homo Sapiens
uauaagcuguaacagaauuuuuauaguccuacaaaagacaaugcuuacuuagaagguuuuuua

SEQ ID NO: 501118 - RNA, 63 nt, Homo Sapiens
cuauuacuacuucuuaucaaccuccagcuguuaaaagacaaugccaaagaguaugccugggag

SEQ ID NO: 501119 - RNA, 63 nt, Homo Sapiens
aaugcacaaaagauauaaacugccaaccuuagaaaagacaauaaauugcaaaauaaagaaaaa

SEQ ID NO: 501120 - RNA, 63 nt, Homo Sapiens
caguuauuaacauagaugaauuguauacccaucaaagacaauauaauuccaaaucuaucugag

SEQ ID NO: 501121 - RNA, 63 nt, Homo Sapiens
uuaaggggagcucuucaacaacugugcuagcuaaaagacaaauaaagcacuuacaccaguuug

SEQ ID NO: 501122 - RNA, 63 nt, Homo Sapiens
aaggaaaagaguaucaaaggauaggcaaggaugaaagacaaagaagaauccaucugugaggug

SEQ ID NO: 501123 - RNA, 63 nt, Homo Sapiens
uucugagcuccucaucaacuugucagcgagacuaaagacaaagcaugcagcugggcugaguga

SEQ ID NO: 501124 - RNA, 63 nt, Homo Sapiens
acaaaacaacaacaacaacacuaaauuuuuuaaaaagacaaaaccccgugguggccccgcucc

SEQ ID NO: 501125 - RNA, 63 nt, Homo Sapiens
uucugaaaagugaacaauucgcuucuuuaugauaaagacaauuucuauaaauuaaguagagua

SEQ ID NO: 501126 - RNA, 63 nt, Homo Sapiens
aaguaaauacaacccaaggcaucugucugggguaaagacaacaaaaugcuacaguugauccuc

SEQ ID NO: 501127 - RNA, 63 nt, Homo Sapiens
guuaaaagcaguauuuuuaauguauuuuauaagaaagacaaucaaauaaaccucaucaauuaa

SEQ ID NO: 501128 - RNA, 63 nt, Homo Sapiens
ucacuaauuccuaauaugaaauguaugauggccaaagacaaauuguauugauuauaauccuuu

SEQ ID NO: 501129 - RNA, 63 nt, Homo Sapiens
cagcuggaccaauuuucaaacuuggauaaagaaaaagacaaacagaaauagacacacacacca

SEQ ID NO: 501130 - RNA, 63 nt, Homo Sapiens
uguccaggggcugccuccugccuuuucuuuuguaaagacaagacccuugggaguuuuaauucu

SEQ ID NO: 501131 - RNA, 63 nt, Homo Sapiens
auuuucagugcaaaagagaugucauucaguuaaaaagacaaaccucuagauguguaauuacau

SEQ ID NO: 501132 - RNA, 63 nt, Homo Sapiens
uuuugucuguuaaaugaacuugauagcuaauaaaaagacaacuagccaucaaaaucauauguu

SEQ ID NO: 501133 - RNA, 63 nt, Homo Sapiens
uggauucucuucacuauaacugagugguaauuuaaagacaacaauuuaaugucacuaauuuuc

SEQ ID NO: 501134 - RNA, 63 nt, Homo Sapiens
aauggaaaagacuuucucuuuuccuuuaaagcuaaagacaagaauaucaugcuauacaggugc

SEQ ID NO: 501135 - RNA, 63 nt, Homo Sapiens
agcaagacccugucuuaaaagaaaaaugggaagaaagacaagguaacaugaagaaagaagaga

SEQ ID NO: 501136 - RNA, 63 nt, Homo Sapiens
aaagcugggaugcuugaggguauccaaguugaaaaagacaaaaucugaccaucagccagugac

SEQ ID NO: 501137 - RNA, 63 nt, Homo Sapiens
uucuguugggaaggcccucuugguuuuggagagaaagacaaguuaugaguagcugcuacccug

SEQ ID NO: 501138 - RNA, 63 nt, Homo Sapiens
cuguacccagcccaaaagcaguuuaaaaaaaaaaaagacaaaauauacaacucuugauaaaac

SEQ ID NO: 501139 - RNA, 63 nt, Homo Sapiens
aauaaaaagagaaacaaguauuuugcuauauauaaagacaacaaaagaaaucuccuaacaaaa

SEQ ID NO: 501140 - RNA, 63 nt, Homo Sapiens
acauggucaggcucuugucuauagaaguuaugaaaagacaaccaagaaaucaggggacauguu

SEQ ID NO: 501141 - RNA, 63 nt, Homo Sapiens
cuggcaacugggcucuaaucugggauggaaguaaaagacaaugucagcaugucacuaaauucc

SEQ ID NO: 501142 - RNA, 63 nt, Homo Sapiens
aaauuaagaauggagcuuaaaaaccacaguccaaaagacaagcuguuuaucaccuuagcagaa

SEQ ID NO: 501143 - RNA, 63 nt, Homo Sapiens
auccuuguugaaguuuuuuuuuauuacagccuuaaagacaaaauagaaauaaauguuaccuaa

SEQ ID NO: 501144 - RNA, 63 nt, Homo Sapiens
uguguaauuauguaaauacaagaaaaagaagucaaagacaaaggagcaaagaugguaaaaaga

SEQ ID NO: 501145 - RNA, 63 nt, Homo Sapiens
ucuagaguaguuuugaauggugcuauucugccaaaagacaauuuuauuuuuaacuuggauacc

SEQ ID NO: 501146 - RNA, 63 nt, Homo Sapiens
cuuacccaggauguuuccccuugccugaaaugcaaagacaacaggucccguuucguuggguca

SEQ ID NO: 501147 - RNA, 63 nt, Homo Sapiens
aaauacuguauuaauaagaugguuugacagagaaaagacaaauggggaacgugguuggcucag

SEQ ID NO: 501148 - RNA, 63 nt, Homo Sapiens
cacccccugcccuuuugcuuagguuuaaaauaaaaagacaaccgaguauuugguagggaaagc

SEQ ID NO: 501149 - RNA, 63 nt, Homo Sapiens
ccucaaagcguggacguguggggguugcagggaaaagacaaauuaaugaaugucggcggcgcu

SEQ ID NO: 501150 - RNA, 63 nt, Homo Sapiens
ccucccuguguugcacacuuucagaacuaaauuaaagacaaauuacauccauucaugccucuu

SEQ ID NO: 501151 - RNA, 63 nt, Homo Sapiens
cugauaauuauaccugucaaccagcacauaguaaaagacaacaugaaaccgugcuucagaauc

SEQ ID NO: 501152 - RNA, 63 nt, Homo Sapiens
aaaaacaguguuuuauagugcuuacauuuuuaaaaagacaaauagugacacuucaaaagugug

SEQ ID NO: 501153 - RNA, 63 nt, Homo Sapiens
uaguaagcaugaccuggggauauaaauguacauaaagacaaacuuaccuagcacuuaaauaug

SEQ ID NO: 501154 - RNA, 63 nt, Homo Sapiens
aaacaaaauggaaugugauguuuauuuucaugaaaagacaauauuaccaguuaggggaagacu

SEQ ID NO: 501155 - RNA, 63 nt, Homo Sapiens
auucaggcaguuuguagacagaaacuaacuagcaaagacaaaaucuuucuagcagugcagggu

SEQ ID NO: 501156 - RNA, 63 nt, Homo Sapiens
ucaugaagguauauuuugugugagagaugguuuaaagacaaauacaguucaaaagucaggugc

SEQ ID NO: 501157 - RNA, 63 nt, Homo Sapiens
uugcucuccgccuacacuagcuuccccagcugcaaagacaaugaaguuuaaauaccgugugcu

SEQ ID NO: 501158 - RNA, 63 nt, Homo Sapiens
ugaucagugcuucccacuccuccaauccccauuaaagacaaaucagggaaggaaacuguugug

SEQ ID NO: 501159 - RNA, 63 nt, Homo Sapiens
accuugggaccuguuuagagaagccggcucuucaaagacaauggaaacuguaccauacacauu

SEQ ID NO: 501160 - RNA, 62 nt, Homo Sapiens
guucagaacuuucuuuagacuaaaaaaaaaaaaaaagacaaaauacacguugaccauggacu

SEQ ID NO: 501161 - RNA, 63 nt, Homo Sapiens
ucuagguggccgagaagauuugauuuucuuuaaaaagacaagaauaaggucugguuagggaau

SEQ ID NO: 501162 - RNA, 63 nt, Homo Sapiens
cccacugggaaaaagacuuuuuguacauuuggaaaagacaagcgagagcacacuauucucauu

SEQ ID NO: 501163 - RNA, 63 nt, Homo Sapiens
gcauaaagaauauaauucugaaucccaaauuccaaagacaagaacucuguguuugaauucauu

SEQ ID NO: 501164 - RNA, 63 nt, Homo Sapiens
aacuccagauauaucagugucaaaagcccaagaaaagacaaaaaagaaaaaaacaauccccag

SEQ ID NO: 501165 - RNA, 63 nt, Homo Sapiens
augaacauuaacaucauaauguugacccauuuuaaagacaaacgccucugucccccuuuaaac

SEQ ID NO: 501166 - RNA, 63 nt, Homo Sapiens
uauuaaaaaggaaagguucuggaauuuauauuaaaagacaaguuauucugggauucggucauu

SEQ ID NO: 501167 - RNA, 59 nt, Homo Sapiens
uacagaauugaauacuguagaaaaccuuaaaagacaauaguaguagugagucugauuga

SEQ ID NO: 501168 - RNA, 63 nt, Homo Sapiens
uuccaauguaguaucuguagcaccugugugauuaaagacaacuuaaauuuauauugaguuuaa

SEQ ID NO: 501169 - RNA, 63 nt, Homo Sapiens
aaaucuuauuaauaaaguuaauacaguuucuuaaaagacaauacucagugugcccuugaaucc

SEQ ID NO: 501170 - RNA, 63 nt, Homo Sapiens
aauggaacagaagggaggcacaagaucaaauuaaaagacaauaauagaaggauaauacagagc

SEQ ID NO: 501171 - RNA, 63 nt, Homo Sapiens
uaaaacaaaacagaacaaaaaaacuagacaaauaaagacaaacacaaaccuaccaaccaccaa

SEQ ID NO: 501172 - RNA, 63 nt, Homo Sapiens
gcccaaagccaagaaagaaacuuuuaagguugaaaagacaauauaggaaaacaauaauuuuaa

SEQ ID NO: 501173 - RNA, 63 nt, Homo Sapiens
gguaaaguauuuacugacugcuuauaaacauuuaaagacaaagacauuucaaauaacugcaga

SEQ ID NO: 501174 - RNA, 63 nt, Homo Sapiens
uuugguuacuaaaauuuuguuugacuccuaacaaaagacaauggauggccuuagcaucagaau

SEQ ID NO: 501175 - RNA, 63 nt, Homo Sapiens
uguuuuaaaauaauaacauuuuuauauuuuuuaaaagacaaacuucauauuauccuguguucu

SEQ ID NO: 501176 - RNA, 63 nt, Homo Sapiens
cauuuucagucaaagaaccaugauuaaaaaaaaaaagacaacuuacaauuuaaauccuuaaaa

SEQ ID NO: 501177 - RNA, 63 nt, Homo Sapiens
uagguuuuaucaccugcugcuguauuuguaaacaaagacaaauguugcuuuaagaaguaauua

SEQ ID NO: 501178 - RNA, 63 nt, Homo Sapiens
gcucaauaaaauuguucagaagaucaaagugguaaagacaauguaaaauuuaacauuuuaaua

SEQ ID NO: 501179 - RNA, 63 nt, Homo Sapiens
cuauguaauuucagaguuuuuauuuuguuacaaaaagacaaaaaugaaauauauaacaacaau

SEQ ID NO: 501180 - RNA, 63 nt, Homo Sapiens
cucaggccuuacuaauccauaccaaauuagccuaaagacaaggcauuuuauauucauuucuau

SEQ ID NO: 501181 - RNA, 63 nt, Homo Sapiens
aguguuaccagcauucauguggaaaucaagagcaaagacaaaauaauguuaaacaauucugua

SEQ ID NO: 501182 - RNA, 63 nt, Homo Sapiens
aguaggaaucugugaagcaaaauguuugcugccaaagacaaaucagacugucagucauuaaaa

SEQ ID NO: 501183 - RNA, 63 nt, Homo Sapiens
gaucugugacugauugaaaugcaugcaaauaaaaaagacaauauuaaagucuguuaucaaacc

SEQ ID NO: 501184 - RNA, 63 nt, Homo Sapiens
agguguacguguuaaugucccauuucacgacgaaaagacaagacucuggggaugggaaugacu

SEQ ID NO: 501185 - RNA, 63 nt, Homo Sapiens
ccaacaggaggacaauucaugaacuucgcaucaaaagacaauucuuuauacaacagugcuaaa

SEQ ID NO: 501186 - RNA, 63 nt, Homo Sapiens
uauauaacuuaauguuaagugucuugaggcauaaaagacaaaauguggcuuauuuuaggaucu

SEQ ID NO: 501187 - RNA, 63 nt, Homo Sapiens
cugcuguuauauagcaagaccuuaaaaguauugaaagacaauaacaaguauacacuagaggcu

SEQ ID NO: 501188 - RNA, 63 nt, Homo Sapiens
ccaaaccaauuuuuuuccuguguauauuacuacaaagacaaccauuguauucaaaauucauug

SEQ ID NO: 501189 - RNA, 63 nt, Homo Sapiens
ucccuucuucaaaagugccacccaaacaacauaaaagacaauggggggaggcuuaccacuuuc

SEQ ID NO: 501190 - RNA, 63 nt, Homo Sapiens
acuaaacaauacaaccaugacauuugaaauaagaaagacaaacagaaaaacauccuuuuggac

SEQ ID NO: 501191 - RNA, 63 nt, Homo Sapiens
aaagcucugacuucguacuucucuuuacuauuaaaagacaagguggguuccaaugggaaauga

SEQ ID NO: 501192 - RNA, 63 nt, Homo Sapiens
gccuccaguuugggggcuccgagugguuaccucaaagacaauuggucucugaaaagcuggggu

SEQ ID NO: 501193 - RNA, 63 nt, Homo Sapiens
cauucauuugcauccauggggaaauucaagccuaaagacaauucccuaguugaguagccagau

SEQ ID NO: 501194 - RNA, 63 nt, Homo Sapiens
augaauauuacucucaaaauuagacugagguauaaagacaagugugacuuggccccagacgca

SEQ ID NO: 501195 - RNA, 63 nt, Homo Sapiens
aauuagcugggcgugguggcccgucucuacuaaaaagacaaaacuggccaacauggugaaacc

SEQ ID NO: 501196 - RNA, 63 nt, Homo Sapiens
acuugauguuuuugcauucuuugaguucaguuuaaagacaacuacgagcaucuguaaccaauc

SEQ ID NO: 501197 - RNA, 63 nt, Homo Sapiens
ccaccacuccuggagucccaaugacuucucuggaaagacaaagagguuaucacaaaaauuccu

SEQ ID NO: 501198 - RNA, 63 nt, Homo Sapiens
uuacauucugaguaccaaccaaacccuaaauugaaagacaaaacuaugguuucagucaacaua

SEQ ID NO: 501199 - RNA, 63 nt, Homo Sapiens
acugacccagagcaaagcuuucccuaugguuccaaagacaacuaguauucaacaaaccuugua

SEQ ID NO: 501200 - RNA, 63 nt, Homo Sapiens
uuucaugaacaguuacccucuguccccacaaccaaagacaacucauggccuccuuuggcccuu

SEQ ID NO: 501201 - RNA, 63 nt, Homo Sapiens
gacacugguauuccugccuccauauuuucuuuaaaagacaaaucaaagcagauauauuaagug

SEQ ID NO: 501202 - RNA, 63 nt, Homo Sapiens
agaaagucacuggggccugccaagcugccaccuaaagacaagagugagagggcugaguucuuc

SEQ ID NO: 501203 - RNA, 63 nt, Homo Sapiens
acgagcaucuguaaccaaucuugaguucaguuuaaagacaacuacuugauguuuuugcauucu

SEQ ID NO: 501204 - RNA, 63 nt, Homo Sapiens
uuggugcuaacagugaaguaugcauaugugagaaaagacaacaagaaacuaaauuauaacuuu

SEQ ID NO: 501205 - RNA, 63 nt, Homo Sapiens
aacaaaaaacaaaaaaaacacucuuccugcuaaaaagacaaaagauuucauuauauucucccc

SEQ ID NO: 501206 - RNA, 63 nt, Homo Sapiens
caaaaagccauucuuagaacccuuucuaaacuuaaagacaaguaagcgcauugcacacuuuuu

SEQ ID NO: 501207 - RNA, 63 nt, Homo Sapiens
uuucaagcaauccuuuaguugcuuuaucuugcuaaagacaauuucuugucuauaagucacucu

SEQ ID NO: 501208 - RNA, 63 nt, Homo Sapiens
cucgugggaagaugacacugagcacaaugagcaaaagacaaacuugacuuuauaguuuuccac

SEQ ID NO: 501209 - RNA, 63 nt, Homo Sapiens
aaggcaagcacgucuggaaaccuuaagacaagcaaagacaagcguauuggccugaaauagagu

SEQ ID NO: 501210 - RNA, 63 nt, Homo Sapiens
uuaaaccuuuauaaaccaguauuucacuuuuaaaaagacaaggcaucucuacccauuaacucu

SEQ ID NO: 501211 - RNA, 63 nt, Homo Sapiens
auguuuacucuuccaucauuuaaaaaaaauguaaaagacaaaaaaaaaauggaggaugauuua

SEQ ID NO: 501212 - RNA, 63 nt, Homo Sapiens
guuugcuacauucuuuuuucuauucaauaugugaaagacaauaaaacacuuuugacuugauuc

SEQ ID NO: 501213 - RNA, 63 nt, Homo Sapiens
uguacuguacuucccaauugccacauuuuaaauaaagacaaauuuuuauuucuucuaaaaugc

SEQ ID NO: 501214 - RNA, 63 nt, Homo Sapiens
caguaugcaccacagaauaagaguuugccguguaaagacaauauccccauucgucaugcucuu

SEQ ID NO: 501215 - RNA, 63 nt, Homo Sapiens
auggagguccagguagauguaaaaauggauuuaaaagacaaaauaauauacuuggcacagcga

SEQ ID NO: 501216 - RNA, 63 nt, Homo Sapiens
ggcuacaaagaaggaugucaaaagguaaacugaaaagacaacuaucaggucuuaaaaaaaaau

SEQ ID NO: 501217 - RNA, 63 nt, Homo Sapiens
aacuacaugugaagauagacaguuguacaaauuaaagacaaaggaaugaaaauaaccuuggug

SEQ ID NO: 501218 - RNA, 63 nt, Homo Sapiens
uuaugacuauuuaugcacauaugguagacuguuaaagacaauuuauuugcagaguacacuugu

SEQ ID NO: 501219 - RNA, 63 nt, Homo Sapiens
gcuggacccugcaugcaggggccuguuucccccaaagacaaugcuccauccuccacuuauucu

SEQ ID NO: 501220 - RNA, 63 nt, Homo Sapiens
ccuuuaguauuuaauggaaaauugguuccugcaaaagacaaagggugagaguuagcguccugu

SEQ ID NO: 501221 - RNA, 63 nt, Homo Sapiens
aauguaguggccuuggauauccuguuuguuaauaaagacaauucaaccagcucccaccaugca

SEQ ID NO: 501222 - RNA, 63 nt, Homo Sapiens
ccuuguagcugauacuuggcaaaagugucacugaaagacaagcuaaauguaguuauuuuaucc

SEQ ID NO: 501223 - RNA, 63 nt, Homo Sapiens
uuugugacgcagguugaagggggaggaauagaaaaagacaaacugccuuggaggagauaaacc

SEQ ID NO: 501224 - RNA, 63 nt, Homo Sapiens
gucaauauguaguggaaagaagcauguagcaaaaaagacaaccuugaucuuuaauaaaaaaga

SEQ ID NO: 501225 - RNA, 63 nt, Homo Sapiens
gguacccuuauuuccucgacacgcaacuggcucaaagacaauguuauuuuccuucccuuucuu

SEQ ID NO: 501226 - RNA, 63 nt, Homo Sapiens
acuuuuccugcacuggacaguaaaaaaauaauaaaagacaaaaacaaauuuaaaaaaaaauuu

SEQ ID NO: 501227 - RNA, 63 nt, Homo Sapiens
gaaugucccuuccaacuuuuauauuaaaaauaaaaagacaagaaaauugaagaucauuuuuca

SEQ ID NO: 501228 - RNA, 63 nt, Homo Sapiens
uaguucuuccagcccucauugagguaacaagauaaagacaaauccacuucuuuggccaaauuc

SEQ ID NO: 501229 - RNA, 63 nt, Homo Sapiens
uuuuguaauugagagcucauuucaaaagcagaaaaagacaacaaauauuaaagcaaggaaaag

SEQ ID NO: 501230 - RNA, 63 nt, Homo Sapiens
uccuggaaaaaacaaaaacaaaaaacugcagugaaagacaagcugcaaaucagccaugugcug

SEQ ID NO: 501231 - RNA, 63 nt, Homo Sapiens
aaaauaugggagcugagauuccguucguggaaaaaagacaaggccacccucucgcccucagag

SEQ ID NO: 501232 - RNA, 63 nt, Homo Sapiens
aguuucaaguuaguuagaagcauguugucaacuaaagacaacaaacuaucagauucauucauu

SEQ ID NO: 501233 - RNA, 63 nt, Homo Sapiens
ggcauaugaccaugcaagacugucagugccaacaaagacaacacuaaucagcacaucguacac

SEQ ID NO: 501234 - RNA, 63 nt, Homo Sapiens
gcuuggucaaacuuuuuccagcaaaauggaagcaaagacaaaagaaacuuaccaauugauguu

SEQ ID NO: 501235 - RNA, 63 nt, Homo Sapiens
ccagccuaaaugcccaucaagcaaugaguggauaaagacaaugcgguguacauauacaccaug

SEQ ID NO: 501236 - RNA, 63 nt, Homo Sapiens
gaaaaacuaccagacuguuuuuugucuucucacaaagacaagaaaaaucagggcauuuuguga

SEQ ID NO: 501237 - RNA, 63 nt, Homo Sapiens
ugcaugaaaaggguacagcugucaacccaucccaaagacaaacccuccuugagaagaccagaa

SEQ ID NO: 501238 - RNA, 63 nt, Homo Sapiens
cggguggcuagagggcuccuuuuuauaggcauuaaagacaaguuuuuccuccucugaacugga

SEQ ID NO: 501239 - RNA, 63 nt, Homo Sapiens
caaagcccgcauaauuuuaacgaccuaaacauaaaagacaagggucagccccuuccuuucccc

SEQ ID NO: 501240 - RNA, 63 nt, Homo Sapiens
uaugauguacccagggaccaaagaaaagcauggaaagacaauaaucugcuguccuccgggguc

SEQ ID NO: 501241 - RNA, 63 nt, Homo Sapiens
aaucaugaccgaaaggauguagacauuguuaauaaagacaaugucuguucuuccagaguccag

SEQ ID NO: 501242 - RNA, 63 nt, Homo Sapiens
gcugcgcccuuccccagagugcugaggaaaaauaaagacaaaucacugcugcugccuuuaguc

SEQ ID NO: 501243 - RNA, 63 nt, Homo Sapiens
gcccaugcucuuaguggggauaagacaguagggaaagacaagggaagagggugguagaggagg

SEQ ID NO: 501244 - RNA, 63 nt, Homo Sapiens
ugcaacuaggaagagacacauggaaagggagggaaagacaagagggggugggaacaagaugga

SEQ ID NO: 501245 - RNA, 63 nt, Homo Sapiens
gcccucauaguagugggaagauauuuucaggaaaaagacaaauggaaauccucagagaaggug

SEQ ID NO: 501246 - RNA, 63 nt, Homo Sapiens
aaaaaaaagccaagccgugacuuaguuuaaaaaaaagacaaaaaucagacauuauuuauaaaa

SEQ ID NO: 501247 - RNA, 63 nt, Homo Sapiens
cucagugaaaagcugaagugcaaaagagcuaucaaagacaagaggauaaaagacugggauagu

SEQ ID NO: 501248 - RNA, 63 nt, Homo Sapiens
aaccaccaaaaacugaaaccccagacccaccagaaagacaagugucuagcaaugccuugguac

SEQ ID NO: 501249 - RNA, 63 nt, Homo Sapiens
uucuucaucuucuucuuuuuuuuuuuuuuuuguaaagacaaguuuauuccuuuacgcuucuug

SEQ ID NO: 501250 - RNA, 63 nt, Homo Sapiens
uguuaacuucucccccuaacauaucagauauguaaagacaaagaacaaaagguuuaauauauu

SEQ ID NO: 501251 - RNA, 63 nt, Homo Sapiens
acuaucauuguagugugauuucuuuguauuagcaaagacaaaaacgcuaacauugaaaaagua

SEQ ID NO: 501252 - RNA, 63 nt, Homo Sapiens
uuuauuuuaguucuaaauuauguuucagaaacaaaagacaaugcuguacaguuuuauuccucu

SEQ ID NO: 501253 - RNA, 63 nt, Homo Sapiens
gcaacaaaguuagacugacuuauucuaacuuuaaaagacaaguaacgugcuaaaucuuuuaug

SEQ ID NO: 501254 - RNA, 63 nt, Homo Sapiens
ggacuugggcccuauucaggaaaauggucuuauaaagacaaguguauuaugucgucugauacu

SEQ ID NO: 501255 - RNA, 63 nt, Homo Sapiens
uauuuuguggugggagcagugaaacgauaaguaaaagacaaaacuuuaaugguacugauuucu

SEQ ID NO: 501256 - RNA, 63 nt, Homo Sapiens
aaaugauuauauucacagacccaucaucacuguaaagacaaauggggacaccuguacauucuu

SEQ ID NO: 501257 - RNA, 63 nt, Homo Sapiens
acauuuuaauuuguucacaguaaaccuuaaagcaaagacaacccauugauuugcaguuaagaa

SEQ ID NO: 501258 - RNA, 63 nt, Homo Sapiens
agggcuaauuccaaaaagcaggggaagugaaggaaagacaagcgaaaauggugaggagggugg

SEQ ID NO: 501259 - RNA, 63 nt, Homo Sapiens
cugauuuugaagagaguugccucauuaagaaaaaaagacaaggugaugaugguauaaaguuug

SEQ ID NO: 501260 - RNA, 53 nt, Homo Sapiens
aagaugcuuaccauauguaugccaaagacaaggauuuuggucaagaaggcuaa

SEQ ID NO: 501261 - RNA, 63 nt, Homo Sapiens
agcacuagaggcuauugccaucacaacugcacuaaagacaaauuuauggaucaugccgaagug

SEQ ID NO: 501262 - RNA, 63 nt, Homo Sapiens
aagaacaccccugccgacucccagcccggccaaaaagacaaaacacauagacgcacacacuca

SEQ ID NO: 501263 - RNA, 63 nt, Homo Sapiens
cagaauguaucucuccaagaugagagcucauuaaaagacaauuacaaagcuuaucacauccaa

SEQ ID NO: 501264 - RNA, 63 nt, Homo Sapiens
aggggacauccacccucugggguguggccaggaaaagacaagcucuucagcuuggggauccga

SEQ ID NO: 501265 - RNA, 63 nt, Homo Sapiens
cauugcaccuucccgugcuguaauuggcuugacaaagacaagcaggcuucucuguugagacuu

SEQ ID NO: 501266 - RNA, 63 nt, Homo Sapiens
ugguauuuugaugccaaggagcgggcagcagccaaagacaaguaucagcuagguaccugcuuc

SEQ ID NO: 501267 - RNA, 63 nt, Homo Sapiens
agcaaggacaaauucagagacccugagcuuuagaaagacaaguggguggcuuugauggacggu

SEQ ID NO: 501268 - RNA, 63 nt, Homo Sapiens
uguauaccuaaaggaauauaaucauuccaccauaaagacaaacacuuguauguucauugcagc

SEQ ID NO: 501269 - RNA, 63 nt, Homo Sapiens
ucuguucaucaaaugaugcuguuaagauagggaaaagacaagaaacaggacuggaagaagaug

SEQ ID NO: 501270 - RNA, 63 nt, Homo Sapiens
ggcaggcucaccauaguaaaaaugcugaaagccaaagacaaaauugggagaacaaaagaaaag

SEQ ID NO: 501271 - RNA, 63 nt, Homo Sapiens
gguccucuuccaucuugcugaacuguucgaggcaaagacaaaacccaacuuugaccaagaaga

SEQ ID NO: 501272 - RNA, 63 nt, Homo Sapiens
acuccacaugcuuuucuuuuggggccuuccucuaaagacaagggcaagucaaccagcaugcag

SEQ ID NO: 501273 - RNA, 63 nt, Homo Sapiens
aaaaaaaaaaaaccucaaaauacgauguuuuuaaaagacaaaagaacggccauguguuaaugu

SEQ ID NO: 501274 - RNA, 63 nt, Homo Sapiens
guguuuuuaaaaaaaagcaaauuaaaaaaaaaaaaagacaaaaugucuuuuaagaaaggggau

SEQ ID NO: 501275 - RNA, 63 nt, Homo Sapiens
aaaaaaaaaaaaagcgagcguaugaaaaguugaaaagacaaaauacaaguuacaaccaacuuc

SEQ ID NO: 501276 - RNA, 63 nt, Homo Sapiens
cuuccuguuuguggaacaaagagcuucaguauaaaagacaaaauuuuuuuuuugcuggugucu

SEQ ID NO: 501277 - RNA, 63 nt, Homo Sapiens
acacccuuucuucccccuucagaaggauucuuaaaagacaaauaaauguuacaugacacuucu

SEQ ID NO: 501278 - RNA, 63 nt, Homo Sapiens
aaaaaaaaaaaacccaacaaaaaagacaaaacaaaagacaaaauguaaaaaaaaaaaaaaaaa

SEQ ID NO: 501279 - RNA, 63 nt, Homo Sapiens
caaaagacaaaaaaaaaaaaaaaaaaaaaaaaaaaagacaaaagugauaaaaaacuguaaaaa

SEQ ID NO: 501280 - RNA, 63 nt, Homo Sapiens
aaaaaaaaagaaaauauuuuaaaaaacacaaaaaaagacaaaaggauucuugaacuugaaaaa

SEQ ID NO: 501281 - RNA, 63 nt, Homo Sapiens
aaaaaaaaaaagaaaagaaagaaaagaaaaaaaaaagacaaaaguaaauauuucaacgaaaug

SEQ ID NO: 501282 - RNA, 63 nt, Homo Sapiens
uugcauauguugauuaacuugcaaugcccacugaaagacaaacaucaaaaauauguuccgagu

SEQ ID NO: 501283 - RNA, 63 nt, Homo Sapiens
aguuaaaaaaaaaaaaaagauuuuucuaaagaaaaagacaaaaccaggggcauggacagagcc

SEQ ID NO: 501284 - RNA, 63 nt, Homo Sapiens
agagaagguuagauuuuuuuguuuccagaaaauaaagacaaauuaaauuaagucaaacauuug

SEQ ID NO: 501285 - RNA, 63 nt, Homo Sapiens
caggagcgugcacgcucucucagcccacacaggaaagacaaaggaggagacaauggaugcaaa

SEQ ID NO: 501286 - RNA, 63 nt, Homo Sapiens
uuuuuuuuuuuaagaaaaacaacaacaacaaaaaaagacaaugaaaaaaaaaacgucauguga

SEQ ID NO: 501287 - RNA, 63 nt, Homo Sapiens
cacaaaaauaccugguccaaacaagaaaaacaaaaagacaagcaaaacuaaagaacugcaguc

SEQ ID NO: 501288 - RNA, 63 nt, Homo Sapiens
guuuuuaaaaagaaccuuucggauuuuguuccaaaagacaagucgaaaucauggggacaauuu

SEQ ID NO: 501289 - RNA, 63 nt, Homo Sapiens
auuguccaagacauauacuccuggcauuuuccaaaagacaaaagaaaaugugcauauuccuca

SEQ ID NO: 501290 - RNA, 63 nt, Homo Sapiens
caaaaaacuucagcacugcucauuucucauuccaaagacaauguuaaguuaauguuaaguaau

SEQ ID NO: 501291 - RNA, 63 nt, Homo Sapiens
guuuuuauacaaaugaauuugguuuuaaacauuaaagacaaauugauauuucuaauaauauau

SEQ ID NO: 501292 - RNA, 63 nt, Homo Sapiens
aguuuuuaacuuuuuuuuauuuuaauaacugcaaaagacaaaaugacuauacagacuuuaguc

SEQ ID NO: 501293 - RNA, 63 nt, Homo Sapiens
agggguuaggguucuuuccccaaaggaacuuaaaaagacaagcguggccaggcacaguggcuc

SEQ ID NO: 501294 - RNA, 63 nt, Homo Sapiens
aguuaacucaaaaccaacacacagagugcaggaaaagacaauuagaaacuauuuuucuuauua

SEQ ID NO: 501295 - RNA, 63 nt, Homo Sapiens
ugaaaacaauuuuuuugaaucuuucguagccuaaaagacaauuuuccuuggaacacauaagaa

SEQ ID NO: 501296 - RNA, 63 nt, Homo Sapiens
uacauaauuugucuuucuuaguaauuuggcuucaaagacaaauuuuugaccacaccuccguuu

SEQ ID NO: 501297 - RNA, 63 nt, Homo Sapiens
caaagacuucacuucuguuuccugaaucuaaagaaagacaacaugcugcuuuuuaaucauagg

SEQ ID NO: 501298 - RNA, 63 nt, Homo Sapiens
uuaaacuuauaacccacuuuugacuucuauuuuaaagacaauggacaggcuggaagauagcug

SEQ ID NO: 501299 - RNA, 63 nt, Homo Sapiens
agcugucccugagggccugugcuugauuuggggaaagacaaaggcaggacuuuguaguuguau

SEQ ID NO: 501300 - RNA, 63 nt, Homo Sapiens
uugucuggaaaccagaguuggaugggcuucgagaaagacaaacggcuggcugcauucccccag

SEQ ID NO: 501301 - RNA, 63 nt, Homo Sapiens
uuugcagcucaaugcagccaugacaaggaaagaaaagacaaaggaaggccagagagccgcgca

SEQ ID NO: 501302 - RNA, 63 nt, Homo Sapiens
uaacuuaugaacacacgugaaguguugaguccaaaagacaaaggggcaucggcaugucagcgu

SEQ ID NO: 501303 - RNA, 63 nt, Homo Sapiens
uggggguggguuuccuggcaccuacaugaaaaaaaagacaaguuauaugggugaugaagaaaa

SEQ ID NO: 501304 - RNA, 63 nt, Homo Sapiens
aaaaaaaaagacguauuuuugcuuacucagauaaaagacaaccuguaaaaauauaauaauuaa

SEQ ID NO: 501305 - RNA, 63 nt, Homo Sapiens
uugugugugcccucuacccuuaaauucagaaauaaagacaauaaaaaauuaaaauaauugccc

SEQ ID NO: 501306 - RNA, 63 nt, Homo Sapiens
ccaucuuuuuuuuuaaauuuuuucugccuauuuaaagacaaauuaugggacguuuguagaacc

SEQ ID NO: 501307 - RNA, 63 nt, Homo Sapiens
cacuagggcuacuguggcaucuauguagacaggaaagacaaacguguuucauaaaauucguug

SEQ ID NO: 501308 - RNA, 63 nt, Homo Sapiens
aacuuuuaaaauauuaagccugaagacuucuaaaaagacaagaaacauggccuaaauaaccaa

SEQ ID NO: 501309 - RNA, 63 nt, Homo Sapiens
uaagggcucacacauuuacuguacucagaucugaaagacaauguugcuucuugauuuuuuucu

SEQ ID NO: 501310 - RNA, 63 nt, Homo Sapiens
gcaaaggaucaacuuuuagucaugauguucuguaaagacaacaaaucccuuuuuuuuucucaa

SEQ ID NO: 501311 - RNA, 63 nt, Homo Sapiens
aacgauaaaagacagugaaagaaaauaacaauaaaagacaaggaaaaaauaacaaugaaaguu

SEQ ID NO: 501312 - RNA, 63 nt, Homo Sapiens
auaccugcagcaucuuuagucaaguuggaggagaaagacaacacuuggucuaagacacggcag

SEQ ID NO: 501313 - RNA, 63 nt, Homo Sapiens
cccacugaugcagacauccagagaguccuaugaaaagacaaggccauuaugcacagguugaau

SEQ ID NO: 501314 - RNA, 63 nt, Homo Sapiens
uucuuauuccauauuagaaaacuuuguuaggccaaagacaaauaguaggcaagauggcacagg

SEQ ID NO: 501315 - RNA, 63 nt, Homo Sapiens
gaaaacccugacaccuuuaaaaagcaguuuuugaaagacaaaauuuagauuuaauuuacgucu

SEQ ID NO: 501316 - RNA, 63 nt, Homo Sapiens
guucuuggacuuugccccgaaagcacauccauaaaagacaaaaucugauauauuggacuucuu

SEQ ID NO: 501317 - RNA, 63 nt, Homo Sapiens
uggccaaggagagagcaucuaaaaaaauuguccaaagacaacaaaacuaugacucuguucaga

SEQ ID NO: 501318 - RNA, 63 nt, Homo Sapiens
uccugcaucaccacaguguauucaguccacuggaaagacaagugcaaacagagccaaguaucc

SEQ ID NO: 501319 - RNA, 63 nt, Homo Sapiens
gacauuuauugaauaucauggaaccuaguuaggaaagacaacuggcauaaccuagccugugag

SEQ ID NO: 501320 - RNA, 63 nt, Homo Sapiens
aaaucacgucaguaaaauacuuaacaaauauuuaaagacaaaauuugaguauaacaucaagcu

SEQ ID NO: 501321 - RNA, 63 nt, Homo Sapiens
uuuaugagaaauauuugaaguagaaaaaaugaaaaagacaagagggcagguguguauuuacuu

SEQ ID NO: 501322 - RNA, 63 nt, Homo Sapiens
aucuguguuuuggaaugaguaaccuguuacagaaaagacaagagagaacauaagagaaaagga

SEQ ID NO: 501323 - RNA, 63 nt, Homo Sapiens
gcaucagacaaaggaaaagauacagauuuagacaaagacaagaaggaaaaagaguuaugaaga

SEQ ID NO: 501324 - RNA, 63 nt, Homo Sapiens
aagaccccaggguuuuuaucuucuuuacagguuaaagacaaacaguuucuuggagaaucacau

SEQ ID NO: 501325 - RNA, 63 nt, Homo Sapiens
aaauuuaagugaaggucaugagcccauaauggcaaagacaacuuuuuuuuuuucuguaaucau

SEQ ID NO: 501326 - RNA, 63 nt, Homo Sapiens
uugauguuauuugugcucuucagauauuggaaaaaagacaacauuacccucugguaauugaua

SEQ ID NO: 501327 - RNA, 63 nt, Homo Sapiens
gaaauuuggccagauggggacccucccuccccaaaagacaagauaaggcucagugccacucac

SEQ ID NO: 501328 - RNA, 63 nt, Homo Sapiens
acaucugcccaaugauccagcuugaguaggaugaaagacaaacgcaaaucuuccagacuaugg

SEQ ID NO: 501329 - RNA, 63 nt, Homo Sapiens
aguaagggggauuuagaguugccagaaagaaagaaagacaaggugcauguaaaauuccuucca

SEQ ID NO: 501330 - RNA, 63 nt, Homo Sapiens
gacaggggcaauggaucucaucaauacccaaagaaagacaaguacuucagcagacuagucauu

SEQ ID NO: 501331 - RNA, 63 nt, Homo Sapiens
auguagaauguaauauacuguauaaacacauuaaaagacaaaucuaugcagaacaggcagaaa

SEQ ID NO: 501332 - RNA, 63 nt, Homo Sapiens
aaaacauggcaaauuucauucuucgugguuguaaaagacaaacugggguaauuaaauugccac

SEQ ID NO: 501333 - RNA, 63 nt, Homo Sapiens
cugcuuucuauuuuacauugaguaaaguuuuaaaaagacaacagucaaguugauuuugauuag

SEQ ID NO: 501334 - RNA, 63 nt, Homo Sapiens
ugaaugauaaccaugaggugaguuccacagaucaaagacaaacauacagcggcuguucccgcc

SEQ ID NO: 501335 - RNA, 64 nt, Homo Sapiens; identical to SEQ ID NO: 130660

SEQ ID NO: 501336 - RNA, 64 nt, Homo Sapiens; identical to SEQ ID NO: 130661

SEQ ID NO: 501337 - RNA, 64 nt, Homo Sapiens; identical to SEQ ID NO: 130662

SEQ ID NO: 501338 - RNA, 64 nt, Homo Sapiens; identical to SEQ ID NO: 130663

SEQ ID NO: 501339 - RNA, 64 nt, Homo Sapiens; identical to SEQ ID NO: 130664

SEQ ID NO: 501340 - RNA, 64 nt, Homo Sapiens; identical to SEQ ID NO: 130665

SEQ ID NO: 501341 - RNA, 64 nt, Homo Sapiens; identical to SEQ ID NO: 130666

SEQ ID NO: 501342 - RNA, 64 nt, Homo Sapiens; identical to SEQ ID NO: 130667

SEQ ID NO: 501343 - RNA, 64 nt, Homo Sapiens; identical to SEQ ID NO: 130668

SEQ ID NO: 501344 - RNA, 64 nt, Homo Sapiens; identical to SEQ ID NO: 130669

SEQ ID NO: 501345 - RNA, 64 nt, Homo Sapiens; identical to SEQ ID NO: 130670

SEQ ID NO: 501346 - RNA, 64 nt, Homo Sapiens; identical to SEQ ID NO: 130671

SEQ ID NO: 501347 - RNA, 64 nt, Homo Sapiens; identical to SEQ ID NO: 130672

SEQ ID NO: 501348 - RNA, 64 nt, Homo Sapiens; identical to SEQ ID NO: 130673

SEQ ID NO: 501349 - RNA, 64 nt, Homo Sapiens; identical to SEQ ID NO: 130674

SEQ ID NO: 501350 - RNA, 64 nt, Homo Sapiens; identical to SEQ ID NO: 130675

SEQ ID NO: 501351 - RNA, 64 nt, Homo Sapiens; identical to SEQ ID NO: 130676

SEQ ID NO: 501352 - RNA, 64 nt, Homo Sapiens; identical to SEQ ID NO: 130677

SEQ ID NO: 501353 - RNA, 64 nt, Homo Sapiens; identical to SEQ ID NO: 130678

SEQ ID NO: 501354 - RNA, 64 nt, Homo Sapiens; identical to SEQ ID NO: 130679

SEQ ID NO: 501355 - RNA, 64 nt, Homo Sapiens; identical to SEQ ID NO: 130680

SEQ ID NO: 501356 - RNA, 64 nt, Homo Sapiens; identical to SEQ ID NO: 130681

SEQ ID NO: 501357 - RNA, 64 nt, Homo Sapiens; identical to SEQ ID NO: 130682

SEQ ID NO: 501358 - RNA, 64 nt, Homo Sapiens; identical to SEQ ID NO: 130683

SEQ ID NO: 501359 - RNA, 64 nt, Homo Sapiens; identical to SEQ ID NO: 130684

SEQ ID NO: 501360 - RNA, 64 nt, Homo Sapiens; identical to SEQ ID NO: 130685

SEQ ID NO: 501361 - RNA, 64 nt, Homo Sapiens; identical to SEQ ID NO: 130686

SEQ ID NO: 501362 - RNA, 64 nt, Homo Sapiens; identical to SEQ ID NO: 130687

SEQ ID NO: 501363 - RNA, 64 nt, Homo Sapiens; identical to SEQ ID NO: 130688

SEQ ID NO: 501364 - RNA, 64 nt, Homo Sapiens; identical to SEQ ID NO: 130689

SEQ ID NO: 501365 - RNA, 64 nt, Homo Sapiens; identical to SEQ ID NO: 130690

SEQ ID NO: 501366 - RNA, 64 nt, Homo Sapiens; identical to SEQ ID NO: 130691

SEQ ID NO: 501367 - RNA, 64 nt, Homo Sapiens; identical to SEQ ID NO: 130692

SEQ ID NO: 501368 - RNA, 64 nt, Homo Sapiens; identical to SEQ ID NO: 130693

SEQ ID NO: 501369 - RNA, 64 nt, Homo Sapiens; identical to SEQ ID NO: 130694

SEQ ID NO: 501370 - RNA, 64 nt, Homo Sapiens; identical to SEQ ID NO: 130695

SEQ ID NO: 501371 - RNA, 64 nt, Homo Sapiens; identical to SEQ ID NO: 130696

SEQ ID NO: 501372 - RNA, 64 nt, Homo Sapiens; identical to SEQ ID NO: 130697

SEQ ID NO: 501373 - RNA, 64 nt, Homo Sapiens; identical to SEQ ID NO: 130698

SEQ ID NO: 501374 - RNA, 64 nt, Homo Sapiens; identical to SEQ ID NO: 130699

SEQ ID NO: 501375 - RNA, 64 nt, Homo Sapiens; identical to SEQ ID NO: 130700

SEQ ID NO: 501376 - RNA, 64 nt, Homo Sapiens; identical to SEQ ID NO: 130701

SEQ ID NO: 501377 - RNA, 64 nt, Homo Sapiens; identical to SEQ ID NO: 130702

SEQ ID NO: 501378 - RNA, 64 nt, Homo Sapiens; identical to SEQ ID NO: 130703

SEQ ID NO: 501379 - RNA, 64 nt, Homo Sapiens; identical to SEQ ID NO: 130704

SEQ ID NO: 501380 - RNA, 64 nt, Homo Sapiens; identical to SEQ ID NO: 130705

SEQ ID NO: 501381 - RNA, 64 nt, Homo Sapiens; identical to SEQ ID NO: 130706

SEQ ID NO: 501382 - RNA, 64 nt, Homo Sapiens; identical to SEQ ID NO: 130707

SEQ ID NO: 501383 - RNA, 64 nt, Homo Sapiens; identical to SEQ ID NO: 130708

SEQ ID NO: 501384 - RNA, 64 nt, Homo Sapiens; identical to SEQ ID NO: 130709

SEQ ID NO: 501385 - RNA, 63 nt, Homo Sapiens; identical to SEQ ID NO: 500709

SEQ ID NO: 501386 - RNA, 63 nt, Homo Sapiens; identical to SEQ ID NO: 500710

SEQ ID NO: 501387 - RNA, 63 nt, Homo Sapiens; identical to SEQ ID NO: 500711

SEQ ID NO: 501388 - RNA, 63 nt, Homo Sapiens; identical to SEQ ID NO: 500712

SEQ ID NO: 501389 - RNA, 63 nt, Homo Sapiens; identical to SEQ ID NO: 500713

SEQ ID NO: 501390 - RNA, 63 nt, Homo Sapiens; identical to SEQ ID NO: 500714

SEQ ID NO: 501391 - RNA, 63 nt, Homo Sapiens; identical to SEQ ID NO: 500715

SEQ ID NO: 501392 - RNA, 63 nt, Homo Sapiens; identical to SEQ ID NO: 500716

SEQ ID NO: 501393 - RNA, 63 nt, Homo Sapiens; identical to SEQ ID NO: 500717

SEQ ID NO: 501394 - RNA, 63 nt, Homo Sapiens; identical to SEQ ID NO: 500718

SEQ ID NO: 501395 - RNA, 63 nt, Homo Sapiens; identical to SEQ ID NO: 500719

SEQ ID NO: 501396 - RNA, 63 nt, Homo Sapiens; identical to SEQ ID NO: 500720

SEQ ID NO: 501397 - RNA, 63 nt, Homo Sapiens; identical to SEQ ID NO: 500721

SEQ ID NO: 501398 - RNA, 63 nt, Homo Sapiens; identical to SEQ ID NO: 500722

SEQ ID NO: 501399 - RNA, 63 nt, Homo Sapiens; identical to SEQ ID NO: 500723

SEQ ID NO: 501400 - RNA, 63 nt, Homo Sapiens; identical to SEQ ID NO: 500724

SEQ ID NO: 501401 - RNA, 63 nt, Homo Sapiens; identical to SEQ ID NO: 500725

SEQ ID NO: 501402 - RNA, 63 nt, Homo Sapiens; identical to SEQ ID NO: 500726

SEQ ID NO: 501403 - RNA, 63 nt, Homo Sapiens; identical to SEQ ID NO: 500727

SEQ ID NO: 501404 - RNA, 63 nt, Homo Sapiens; identical to SEQ ID NO: 500728

SEQ ID NO: 501405 - RNA, 63 nt, Homo Sapiens; identical to SEQ ID NO: 500729

SEQ ID NO: 501406 - RNA, 63 nt, Homo Sapiens; identical to SEQ ID NO: 500730

SEQ ID NO: 501407 - RNA, 63 nt, Homo Sapiens; identical to SEQ ID NO: 500731

SEQ ID NO: 501408 - RNA, 63 nt, Homo Sapiens; identical to SEQ ID NO: 500732

SEQ ID NO: 501409 - RNA, 63 nt, Homo Sapiens; identical to SEQ ID NO: 500733

SEQ ID NO: 501410 - RNA, 62 nt, Homo Sapiens; identical to SEQ ID NO: 500734

SEQ ID NO: 501411 - RNA, 63 nt, Homo Sapiens; identical to SEQ ID NO: 500735

SEQ ID NO: 501412 - RNA, 63 nt, Homo Sapiens; identical to SEQ ID NO: 500736

SEQ ID NO: 501413 - RNA, 63 nt, Homo Sapiens; identical to SEQ ID NO: 500737

SEQ ID NO: 501414 - RNA, 63 nt, Homo Sapiens; identical to SEQ ID NO: 500738

SEQ ID NO: 501415 - RNA, 63 nt, Homo Sapiens; identical to SEQ ID NO: 500739

SEQ ID NO: 501416 - RNA, 63 nt, Homo Sapiens; identical to SEQ ID NO: 500740

SEQ ID NO: 501417 - RNA, 63 nt, Homo Sapiens; identical to SEQ ID NO: 500741

SEQ ID NO: 501418 - RNA, 63 nt, Homo Sapiens; identical to SEQ ID NO: 500742

SEQ ID NO: 501419 - RNA, 63 nt, Homo Sapiens; identical to SEQ ID NO: 500743

SEQ ID NO: 501420 - RNA, 63 nt, Homo Sapiens; identical to SEQ ID NO: 500744

SEQ ID NO: 501421 - RNA, 63 nt, Homo Sapiens; identical to SEQ ID NO: 500745

SEQ ID NO: 501422 - RNA, 63 nt, Homo Sapiens; identical to SEQ ID NO: 500746

SEQ ID NO: 501423 - RNA, 63 nt, Homo Sapiens; identical to SEQ ID NO: 500747

SEQ ID NO: 501424 - RNA, 57 nt, Homo Sapiens; identical to SEQ ID NO: 500748

SEQ ID NO: 501425 - RNA, 63 nt, Homo Sapiens; identical to SEQ ID NO: 500749

SEQ ID NO: 501426 - RNA, 63 nt, Homo Sapiens; identical to SEQ ID NO: 500750

SEQ ID NO: 501427 - RNA, 63 nt, Homo Sapiens; identical to SEQ ID NO: 500751

SEQ ID NO: 501428 - RNA, 63 nt, Homo Sapiens; identical to SEQ ID NO: 500752

SEQ ID NO: 501429 - RNA, 63 nt, Homo Sapiens; identical to SEQ ID NO: 500753

SEQ ID NO: 501430 - RNA, 63 nt, Homo Sapiens; identical to SEQ ID NO: 500754

SEQ ID NO: 501431 - RNA, 63 nt, Homo Sapiens; identical to SEQ ID NO: 500755

SEQ ID NO: 501432 - RNA, 63 nt, Homo Sapiens; identical to SEQ ID NO: 500756

SEQ ID NO: 501433 - RNA, 63 nt, Homo Sapiens; identical to SEQ ID NO: 500757

SEQ ID NO: 501434 - RNA, 63 nt, Homo Sapiens; identical to SEQ ID NO: 500758

SEQ ID NO: 501435 - RNA, 63 nt, Homo Sapiens; identical to SEQ ID NO: 500759

SEQ ID NO: 501436 - RNA, 63 nt, Homo Sapiens; identical to SEQ ID NO: 500760

SEQ ID NO: 501437 - RNA, 63 nt, Homo Sapiens; identical to SEQ ID NO: 500761

SEQ ID NO: 501438 - RNA, 63 nt, Homo Sapiens; identical to SEQ ID NO: 500762

SEQ ID NO: 501439 - RNA, 63 nt, Homo Sapiens; identical to SEQ ID NO: 500763

SEQ ID NO: 501440 - RNA, 50 nt, Homo Sapiens; identical to SEQ ID NO: 500764

SEQ ID NO: 501441 - RNA, 63 nt, Homo Sapiens; identical to SEQ ID NO: 500765

SEQ ID NO: 501442 - RNA, 63 nt, Homo Sapiens; identical to SEQ ID NO: 500766

SEQ ID NO: 501443 - RNA, 63 nt, Homo Sapiens; identical to SEQ ID NO: 500767

SEQ ID NO: 501444 - RNA, 63 nt, Homo Sapiens; identical to SEQ ID NO: 500768

SEQ ID NO: 501445 - RNA, 63 nt, Homo Sapiens; identical to SEQ ID NO: 500769

SEQ ID NO: 501446 - RNA, 63 nt, Homo Sapiens; identical to SEQ ID NO: 500770

SEQ ID NO: 501447 - RNA, 63 nt, Homo Sapiens; identical to SEQ ID NO: 500771

SEQ ID NO: 501448 - RNA, 63 nt, Homo Sapiens; identical to SEQ ID NO: 500772

SEQ ID NO: 501449 - RNA, 63 nt, Homo Sapiens; identical to SEQ ID NO: 500773

SEQ ID NO: 501450 - RNA, 63 nt, Homo Sapiens; identical to SEQ ID NO: 500774

SEQ ID NO: 501451 - RNA, 63 nt, Homo Sapiens; identical to SEQ ID NO: 500775

SEQ ID NO: 501452 - RNA, 63 nt, Homo Sapiens; identical to SEQ ID NO: 500776

SEQ ID NO: 501453 - RNA, 63 nt, Homo Sapiens; identical to SEQ ID NO: 500777

SEQ ID NO: 501454 - RNA, 63 nt, Homo Sapiens; identical to SEQ ID NO: 500778

SEQ ID NO: 501455 - RNA, 63 nt, Homo Sapiens; identical to SEQ ID NO: 500779

SEQ ID NO: 501456 - RNA, 63 nt, Homo Sapiens; identical to SEQ ID NO: 500780

SEQ ID NO: 501457 - RNA, 63 nt, Homo Sapiens; identical to SEQ ID NO: 500781

SEQ ID NO: 501458 - RNA, 63 nt, Homo Sapiens; identical to SEQ ID NO: 500782

SEQ ID NO: 501459 - RNA, 63 nt, Homo Sapiens; identical to SEQ ID NO: 500783

SEQ ID NO: 501460 - RNA, 63 nt, Homo Sapiens; identical to SEQ ID NO: 500784

SEQ ID NO: 501461 - RNA, 51 nt, Homo Sapiens; identical to SEQ ID NO: 500785

SEQ ID NO: 501462 - RNA, 63 nt, Homo Sapiens; identical to SEQ ID NO: 500786

SEQ ID NO: 501463 - RNA, 63 nt, Homo Sapiens; identical to SEQ ID NO: 500787

SEQ ID NO: 501464 - RNA, 63 nt, Homo Sapiens; identical to SEQ ID NO: 500788

SEQ ID NO: 501465 - RNA, 63 nt, Homo Sapiens; identical to SEQ ID NO: 500789

SEQ ID NO: 501466 - RNA, 63 nt, Homo Sapiens; identical to SEQ ID NO: 500790

SEQ ID NO: 501467 - RNA, 63 nt, Homo Sapiens; identical to SEQ ID NO: 500791

SEQ ID NO: 501468 - RNA, 63 nt, Homo Sapiens; identical to SEQ ID NO: 500792

SEQ ID NO: 501469 - RNA, 63 nt, Homo Sapiens; identical to SEQ ID NO: 500793

SEQ ID NO: 501470 - RNA, 63 nt, Homo Sapiens; identical to SEQ ID NO: 500794

SEQ ID NO: 501471 - RNA, 63 nt, Homo Sapiens; identical to SEQ ID NO: 500795

SEQ ID NO: 501472 - RNA, 63 nt, Homo Sapiens; identical to SEQ ID NO: 500796

SEQ ID NO: 501473 - RNA, 63 nt, Homo Sapiens; identical to SEQ ID NO: 500797

SEQ ID NO: 501474 - RNA, 63 nt, Homo Sapiens; identical to SEQ ID NO: 500798

SEQ ID NO: 501475 - RNA, 63 nt, Homo Sapiens; identical to SEQ ID NO: 500799

SEQ ID NO: 501476 - RNA, 63 nt, Homo Sapiens; identical to SEQ ID NO: 500800

SEQ ID NO: 501477 - RNA, 63 nt, Homo Sapiens; identical to SEQ ID NO: 500801

SEQ ID NO: 501478 - RNA, 63 nt, Homo Sapiens; identical to SEQ ID NO: 500802

SEQ ID NO: 501479 - RNA, 63 nt, Homo Sapiens; identical to SEQ ID NO: 500803

SEQ ID NO: 501480 - RNA, 63 nt, Homo Sapiens; identical to SEQ ID NO: 500804

SEQ ID NO: 501481 - RNA, 63 nt, Homo Sapiens; identical to SEQ ID NO: 500805

SEQ ID NO: 501482 - RNA, 63 nt, Homo Sapiens; identical to SEQ ID NO: 500806

SEQ ID NO: 501483 - RNA, 63 nt, Homo Sapiens; identical to SEQ ID NO: 500807

SEQ ID NO: 501484 - RNA, 63 nt, Homo Sapiens; identical to SEQ ID NO: 500808

SEQ ID NO: 501485 - RNA, 63 nt, Homo Sapiens; identical to SEQ ID NO: 500809

SEQ ID NO: 501486 - RNA, 63 nt, Homo Sapiens; identical to SEQ ID NO: 500810

SEQ ID NO: 501487 - RNA, 63 nt, Homo Sapiens; identical to SEQ ID NO: 500811

SEQ ID NO: 501488 - RNA, 63 nt, Homo Sapiens; identical to SEQ ID NO: 500812

SEQ ID NO: 501489 - RNA, 63 nt, Homo Sapiens; identical to SEQ ID NO: 500813

SEQ ID NO: 501490 - RNA, 63 nt, Homo Sapiens; identical to SEQ ID NO: 500814

SEQ ID NO: 501491 - RNA, 63 nt, Homo Sapiens; identical to SEQ ID NO: 500815

SEQ ID NO: 501492 - RNA, 63 nt, Homo Sapiens; identical to SEQ ID NO: 500816

SEQ ID NO: 501493 - RNA, 63 nt, Homo Sapiens; identical to SEQ ID NO: 500817

SEQ ID NO: 501494 - RNA, 63 nt, Homo Sapiens; identical to SEQ ID NO: 500818

SEQ ID NO: 501495 - RNA, 63 nt, Homo Sapiens; identical to SEQ ID NO: 500819

SEQ ID NO: 501496 - RNA, 63 nt, Homo Sapiens; identical to SEQ ID NO: 500820

SEQ ID NO: 501497 - RNA, 63 nt, Homo Sapiens; identical to SEQ ID NO: 500821

SEQ ID NO: 501498 - RNA, 63 nt, Homo Sapiens; identical to SEQ ID NO: 500822

SEQ ID NO: 501499 - RNA, 63 nt, Homo Sapiens; identical to SEQ ID NO: 500823

SEQ ID NO: 501500 - RNA, 63 nt, Homo Sapiens; identical to SEQ ID NO: 500824

SEQ ID NO: 501501 - RNA, 63 nt, Homo Sapiens; identical to SEQ ID NO: 500825

SEQ ID NO: 501502 - RNA, 63 nt, Homo Sapiens; identical to SEQ ID NO: 500826

SEQ ID NO: 501503 - RNA, 63 nt, Homo Sapiens; identical to SEQ ID NO: 500827

SEQ ID NO: 501504 - RNA, 63 nt, Homo Sapiens; identical to SEQ ID NO: 500828

SEQ ID NO: 501505 - RNA, 63 nt, Homo Sapiens; identical to SEQ ID NO: 500829

SEQ ID NO: 501506 - RNA, 63 nt, Homo Sapiens; identical to SEQ ID NO: 500830

SEQ ID NO: 501507 - RNA, 63 nt, Homo Sapiens; identical to SEQ ID NO: 500831

SEQ ID NO: 501508 - RNA, 63 nt, Homo Sapiens; identical to SEQ ID NO: 500832

SEQ ID NO: 501509 - RNA, 63 nt, Homo Sapiens; identical to SEQ ID NO: 500833

SEQ ID NO: 501510 - RNA, 63 nt, Homo Sapiens; identical to SEQ ID NO: 500834

SEQ ID NO: 501511 - RNA, 63 nt, Homo Sapiens; identical to SEQ ID NO: 500835

SEQ ID NO: 501512 - RNA, 63 nt, Homo Sapiens; identical to SEQ ID NO: 500836

SEQ ID NO: 501513 - RNA, 63 nt, Homo Sapiens; identical to SEQ ID NO: 500837

SEQ ID NO: 501514 - RNA, 63 nt, Homo Sapiens; identical to SEQ ID NO: 500838

SEQ ID NO: 501515 - RNA, 63 nt, Homo Sapiens; identical to SEQ ID NO: 500839

SEQ ID NO: 501516 - RNA, 63 nt, Homo Sapiens; identical to SEQ ID NO: 500840

SEQ ID NO: 501517 - RNA, 63 nt, Homo Sapiens; identical to SEQ ID NO: 500841

SEQ ID NO: 501518 - RNA, 63 nt, Homo Sapiens; identical to SEQ ID NO: 500842

SEQ ID NO: 501519 - RNA, 63 nt, Homo Sapiens; identical to SEQ ID NO: 500843

SEQ ID NO: 501520 - RNA, 63 nt, Homo Sapiens; identical to SEQ ID NO: 500844

SEQ ID NO: 501521 - RNA, 63 nt, Homo Sapiens; identical to SEQ ID NO: 500845

SEQ ID NO: 501522 - RNA, 63 nt, Homo Sapiens; identical to SEQ ID NO: 500846

SEQ ID NO: 501523 - RNA, 63 nt, Homo Sapiens; identical to SEQ ID NO: 500847

SEQ ID NO: 501524 - RNA, 63 nt, Homo Sapiens; identical to SEQ ID NO: 500848

SEQ ID NO: 501525 - RNA, 63 nt, Homo Sapiens; identical to SEQ ID NO: 500849

SEQ ID NO: 501526 - RNA, 63 nt, Homo Sapiens; identical to SEQ ID NO: 500850

SEQ ID NO: 501527 - RNA, 63 nt, Homo Sapiens; identical to SEQ ID NO: 500851

SEQ ID NO: 501528 - RNA, 63 nt, Homo Sapiens; identical to SEQ ID NO: 500852

SEQ ID NO: 501529 - RNA, 63 nt, Homo Sapiens; identical to SEQ ID NO: 500853

SEQ ID NO: 501530 - RNA, 63 nt, Homo Sapiens; identical to SEQ ID NO: 500854

SEQ ID NO: 501531 - RNA, 63 nt, Homo Sapiens; identical to SEQ ID NO: 500855

SEQ ID NO: 501532 - RNA, 63 nt, Homo Sapiens; identical to SEQ ID NO: 500856

SEQ ID NO: 501533 - RNA, 63 nt, Homo Sapiens; identical to SEQ ID NO: 500857

SEQ ID NO: 501534 - RNA, 63 nt, Homo Sapiens; identical to SEQ ID NO: 500858

SEQ ID NO: 501535 - RNA, 63 nt, Homo Sapiens; identical to SEQ ID NO: 500859

SEQ ID NO: 501536 - RNA, 63 nt, Homo Sapiens; identical to SEQ ID NO: 500860

SEQ ID NO: 501537 - RNA, 63 nt, Homo Sapiens; identical to SEQ ID NO: 500861

SEQ ID NO: 501538 - RNA, 63 nt, Homo Sapiens; identical to SEQ ID NO: 500862

SEQ ID NO: 501539 - RNA, 63 nt, Homo Sapiens; identical to SEQ ID NO: 500863

SEQ ID NO: 501540 - RNA, 63 nt, Homo Sapiens; identical to SEQ ID NO: 500864

SEQ ID NO: 501541 - RNA, 63 nt, Homo Sapiens; identical to SEQ ID NO: 500865

SEQ ID NO: 501542 - RNA, 63 nt, Homo Sapiens; identical to SEQ ID NO: 500866

SEQ ID NO: 501543 - RNA, 63 nt, Homo Sapiens; identical to SEQ ID NO: 500867

SEQ ID NO: 501544 - RNA, 63 nt, Homo Sapiens; identical to SEQ ID NO: 500868

SEQ ID NO: 501545 - RNA, 63 nt, Homo Sapiens; identical to SEQ ID NO: 500869

SEQ ID NO: 501546 - RNA, 63 nt, Homo Sapiens; identical to SEQ ID NO: 500870

SEQ ID NO: 501547 - RNA, 63 nt, Homo Sapiens; identical to SEQ ID NO: 500871

SEQ ID NO: 501548 - RNA, 63 nt, Homo Sapiens; identical to SEQ ID NO: 500872

SEQ ID NO: 501549 - RNA, 63 nt, Homo Sapiens; identical to SEQ ID NO: 500873

SEQ ID NO: 501550 - RNA, 63 nt, Homo Sapiens; identical to SEQ ID NO: 500874

SEQ ID NO: 501551 - RNA, 63 nt, Homo Sapiens; identical to SEQ ID NO: 500875

SEQ ID NO: 501552 - RNA, 63 nt, Homo Sapiens; identical to SEQ ID NO: 500876

SEQ ID NO: 501553 - RNA, 63 nt, Homo Sapiens; identical to SEQ ID NO: 500877

SEQ ID NO: 501554 - RNA, 63 nt, Homo Sapiens; identical to SEQ ID NO: 500878

SEQ ID NO: 501555 - RNA, 63 nt, Homo Sapiens; identical to SEQ ID NO: 500879

SEQ ID NO: 501556 - RNA, 63 nt, Homo Sapiens; identical to SEQ ID NO: 500880

SEQ ID NO: 501557 - RNA, 63 nt, Homo Sapiens; identical to SEQ ID NO: 500881

SEQ ID NO: 501558 - RNA, 63 nt, Homo Sapiens; identical to SEQ ID NO: 500882

SEQ ID NO: 501559 - RNA, 63 nt, Homo Sapiens; identical to SEQ ID NO: 500883

SEQ ID NO: 501560 - RNA, 63 nt, Homo Sapiens; identical to SEQ ID NO: 500884

SEQ ID NO: 501561 - RNA, 63 nt, Homo Sapiens; identical to SEQ ID NO: 500885

SEQ ID NO: 501562 - RNA, 63 nt, Homo Sapiens; identical to SEQ ID NO: 500886

SEQ ID NO: 501563 - RNA, 63 nt, Homo Sapiens; identical to SEQ ID NO: 500887

SEQ ID NO: 501564 - RNA, 63 nt, Homo Sapiens; identical to SEQ ID NO: 500888

SEQ ID NO: 501565 - RNA, 63 nt, Homo Sapiens; identical to SEQ ID NO: 500889

SEQ ID NO: 501566 - RNA, 63 nt, Homo Sapiens; identical to SEQ ID NO: 500890

SEQ ID NO: 501567 - RNA, 63 nt, Homo Sapiens; identical to SEQ ID NO: 500891

SEQ ID NO: 501568 - RNA, 63 nt, Homo Sapiens; identical to SEQ ID NO: 500892

SEQ ID NO: 501569 - RNA, 63 nt, Homo Sapiens; identical to SEQ ID NO: 500893

SEQ ID NO: 501570 - RNA, 63 nt, Homo Sapiens; identical to SEQ ID NO: 500894

SEQ ID NO: 501571 - RNA, 63 nt, Homo Sapiens; identical to SEQ ID NO: 500895

SEQ ID NO: 501572 - RNA, 63 nt, Homo Sapiens; identical to SEQ ID NO: 500896

SEQ ID NO: 501573 - RNA, 63 nt, Homo Sapiens; identical to SEQ ID NO: 500897

SEQ ID NO: 501574 - RNA, 63 nt, Homo Sapiens; identical to SEQ ID NO: 500898

SEQ ID NO: 501575 - RNA, 63 nt, Homo Sapiens; identical to SEQ ID NO: 500899

SEQ ID NO: 501576 - RNA, 63 nt, Homo Sapiens; identical to SEQ ID NO: 500900

SEQ ID NO: 501577 - RNA, 63 nt, Homo Sapiens; identical to SEQ ID NO: 500901

SEQ ID NO: 501578 - RNA, 63 nt, Homo Sapiens; identical to SEQ ID NO: 500902

SEQ ID NO: 501579 - RNA, 63 nt, Homo Sapiens; identical to SEQ ID NO: 500903

SEQ ID NO: 501580 - RNA, 63 nt, Homo Sapiens; identical to SEQ ID NO: 500904

SEQ ID NO: 501581 - RNA, 63 nt, Homo Sapiens; identical to SEQ ID NO: 500905

SEQ ID NO: 501582 - RNA, 63 nt, Homo Sapiens; identical to SEQ ID NO: 500906

SEQ ID NO: 501583 - RNA, 63 nt, Homo Sapiens; identical to SEQ ID NO: 500907

SEQ ID NO: 501584 - RNA, 63 nt, Homo Sapiens; identical to SEQ ID NO: 500908

SEQ ID NO: 501585 - RNA, 63 nt, Homo Sapiens; identical to SEQ ID NO: 500909

SEQ ID NO: 501586 - RNA, 63 nt, Homo Sapiens; identical to SEQ ID NO: 500910

SEQ ID NO: 501587 - RNA, 63 nt, Homo Sapiens; identical to SEQ ID NO: 500911

SEQ ID NO: 501588 - RNA, 63 nt, Homo Sapiens; identical to SEQ ID NO: 500912

SEQ ID NO: 501589 - RNA, 63 nt, Homo Sapiens; identical to SEQ ID NO: 500913

SEQ ID NO: 501590 - RNA, 63 nt, Homo Sapiens; identical to SEQ ID NO: 500914

SEQ ID NO: 501591 - RNA, 63 nt, Homo Sapiens; identical to SEQ ID NO: 500915

SEQ ID NO: 501592 - RNA, 63 nt, Homo Sapiens; identical to SEQ ID NO: 500916

SEQ ID NO: 501593 - RNA, 63 nt, Homo Sapiens; identical to SEQ ID NO: 500917

SEQ ID NO: 501594 - RNA, 63 nt, Homo Sapiens; identical to SEQ ID NO: 500918

SEQ ID NO: 501595 - RNA, 63 nt, Homo Sapiens; identical to SEQ ID NO: 500919

SEQ ID NO: 501596 - RNA, 63 nt, Homo Sapiens; identical to SEQ ID NO: 500920

SEQ ID NO: 501597 - RNA, 63 nt, Homo Sapiens; identical to SEQ ID NO: 500921

SEQ ID NO: 501598 - RNA, 63 nt, Homo Sapiens; identical to SEQ ID NO: 500922

SEQ ID NO: 501599 - RNA, 63 nt, Homo Sapiens; identical to SEQ ID NO: 500923

SEQ ID NO: 501600 - RNA, 63 nt, Homo Sapiens; identical to SEQ ID NO: 500924

SEQ ID NO: 501601 - RNA, 63 nt, Homo Sapiens; identical to SEQ ID NO: 500925

SEQ ID NO: 501602 - RNA, 63 nt, Homo Sapiens; identical to SEQ ID NO: 500926

SEQ ID NO: 501603 - RNA, 63 nt, Homo Sapiens; identical to SEQ ID NO: 500927

SEQ ID NO: 501604 - RNA, 63 nt, Homo Sapiens; identical to SEQ ID NO: 500928

SEQ ID NO: 501605 - RNA, 63 nt, Homo Sapiens; identical to SEQ ID NO: 500929

SEQ ID NO: 501606 - RNA, 63 nt, Homo Sapiens; identical to SEQ ID NO: 500930

SEQ ID NO: 501607 - RNA, 63 nt, Homo Sapiens; identical to SEQ ID NO: 500931

SEQ ID NO: 501608 - RNA, 63 nt, Homo Sapiens; identical to SEQ ID NO: 500932

SEQ ID NO: 501609 - RNA, 63 nt, Homo Sapiens; identical to SEQ ID NO: 500933

SEQ ID NO: 501610 - RNA, 63 nt, Homo Sapiens; identical to SEQ ID NO: 500934

SEQ ID NO: 501611 - RNA, 63 nt, Homo Sapiens; identical to SEQ ID NO: 500935

SEQ ID NO: 501612 - RNA, 63 nt, Homo Sapiens; identical to SEQ ID NO: 500936

SEQ ID NO: 501613 - RNA, 63 nt, Homo Sapiens; identical to SEQ ID NO: 500937

SEQ ID NO: 501614 - RNA, 63 nt, Homo Sapiens; identical to SEQ ID NO: 500938

SEQ ID NO: 501615 - RNA, 63 nt, Homo Sapiens; identical to SEQ ID NO: 500939

SEQ ID NO: 501616 - RNA, 63 nt, Homo Sapiens; identical to SEQ ID NO: 500940

SEQ ID NO: 501617 - RNA, 63 nt, Homo Sapiens; identical to SEQ ID NO: 500941

SEQ ID NO: 501618 - RNA, 63 nt, Homo Sapiens; identical to SEQ ID NO: 500942

SEQ ID NO: 501619 - RNA, 63 nt, Homo Sapiens; identical to SEQ ID NO: 500943

SEQ ID NO: 501620 - RNA, 63 nt, Homo Sapiens; identical to SEQ ID NO: 500944

SEQ ID NO: 501621 - RNA, 63 nt, Homo Sapiens; identical to SEQ ID NO: 500945

SEQ ID NO: 501622 - RNA, 63 nt, Homo Sapiens; identical to SEQ ID NO: 500946

SEQ ID NO: 501623 - RNA, 63 nt, Homo Sapiens; identical to SEQ ID NO: 500947

SEQ ID NO: 501624 - RNA, 63 nt, Homo Sapiens; identical to SEQ ID NO: 500948

SEQ ID NO: 501625 - RNA, 63 nt, Homo Sapiens; identical to SEQ ID NO: 500949

SEQ ID NO: 501626 - RNA, 63 nt, Homo Sapiens; identical to SEQ ID NO: 500950

SEQ ID NO: 501627 - RNA, 63 nt, Homo Sapiens; identical to SEQ ID NO: 500951

SEQ ID NO: 501628 - RNA, 63 nt, Homo Sapiens; identical to SEQ ID NO: 500952

SEQ ID NO: 501629 - RNA, 63 nt, Homo Sapiens; identical to SEQ ID NO: 500953

SEQ ID NO: 501630 - RNA, 63 nt, Homo Sapiens; identical to SEQ ID NO: 500954

SEQ ID NO: 501631 - RNA, 63 nt, Homo Sapiens; identical to SEQ ID NO: 500955

SEQ ID NO: 501632 - RNA, 63 nt, Homo Sapiens; identical to SEQ ID NO: 500956

SEQ ID NO: 501633 - RNA, 63 nt, Homo Sapiens; identical to SEQ ID NO: 500957

SEQ ID NO: 501634 - RNA, 63 nt, Homo Sapiens; identical to SEQ ID NO: 500958

SEQ ID NO: 501635 - RNA, 63 nt, Homo Sapiens; identical to SEQ ID NO: 500959

SEQ ID NO: 501636 - RNA, 63 nt, Homo Sapiens; identical to SEQ ID NO: 500960

SEQ ID NO: 501637 - RNA, 63 nt, Homo Sapiens; identical to SEQ ID NO: 500961

SEQ ID NO: 501638 - RNA, 63 nt, Homo Sapiens; identical to SEQ ID NO: 500962

SEQ ID NO: 501639 - RNA, 63 nt, Homo Sapiens; identical to SEQ ID NO: 500963

SEQ ID NO: 501640 - RNA, 63 nt, Homo Sapiens; identical to SEQ ID NO: 500964

SEQ ID NO: 501641 - RNA, 63 nt, Homo Sapiens; identical to SEQ ID NO: 500965

SEQ ID NO: 501642 - RNA, 63 nt, Homo Sapiens; identical to SEQ ID NO: 500966

SEQ ID NO: 501643 - RNA, 63 nt, Homo Sapiens; identical to SEQ ID NO: 500967

SEQ ID NO: 501644 - RNA, 63 nt, Homo Sapiens; identical to SEQ ID NO: 500968

SEQ ID NO: 501645 - RNA, 63 nt, Homo Sapiens; identical to SEQ ID NO: 500969

SEQ ID NO: 501646 - RNA, 63 nt, Homo Sapiens; identical to SEQ ID NO: 500970

SEQ ID NO: 501647 - RNA, 63 nt, Homo Sapiens; identical to SEQ ID NO: 500971

SEQ ID NO: 501648 - RNA, 63 nt, Homo Sapiens; identical to SEQ ID NO: 500972

SEQ ID NO: 501649 - RNA, 63 nt, Homo Sapiens; identical to SEQ ID NO: 500973

SEQ ID NO: 501650 - RNA, 63 nt, Homo Sapiens; identical to SEQ ID NO: 500974

SEQ ID NO: 501651 - RNA, 63 nt, Homo Sapiens; identical to SEQ ID NO: 500975

SEQ ID NO: 501652 - RNA, 63 nt, Homo Sapiens; identical to SEQ ID NO: 500976

SEQ ID NO: 501653 - RNA, 63 nt, Homo Sapiens; identical to SEQ ID NO: 500977

SEQ ID NO: 501654 - RNA, 63 nt, Homo Sapiens; identical to SEQ ID NO: 500978

SEQ ID NO: 501655 - RNA, 63 nt, Homo Sapiens; identical to SEQ ID NO: 500979

SEQ ID NO: 501656 - RNA, 63 nt, Homo Sapiens; identical to SEQ ID NO: 500980

SEQ ID NO: 501657 - RNA, 63 nt, Homo Sapiens; identical to SEQ ID NO: 500981

SEQ ID NO: 501658 - RNA, 63 nt, Homo Sapiens; identical to SEQ ID NO: 500982

SEQ ID NO: 501659 - RNA, 63 nt, Homo Sapiens; identical to SEQ ID NO: 500983

SEQ ID NO: 501660 - RNA, 63 nt, Homo Sapiens; identical to SEQ ID NO: 500984

SEQ ID NO: 501661 - RNA, 63 nt, Homo Sapiens; identical to SEQ ID NO: 500985

SEQ ID NO: 501662 - RNA, 59 nt, Homo Sapiens; identical to SEQ ID NO: 476518

SEQ ID NO: 501663 - RNA, 63 nt, Homo Sapiens; identical to SEQ ID NO: 500987

SEQ ID NO: 501664 - RNA, 63 nt, Homo Sapiens; identical to SEQ ID NO: 500988

SEQ ID NO: 501665 - RNA, 63 nt, Homo Sapiens; identical to SEQ ID NO: 500989

SEQ ID NO: 501666 - RNA, 63 nt, Homo Sapiens; identical to SEQ ID NO: 500990

SEQ ID NO: 501667 - RNA, 63 nt, Homo Sapiens; identical to SEQ ID NO: 500991

SEQ ID NO: 501668 - RNA, 63 nt, Homo Sapiens; identical to SEQ ID NO: 500992

SEQ ID NO: 501669 - RNA, 63 nt, Homo Sapiens; identical to SEQ ID NO: 500993

SEQ ID NO: 501670 - RNA, 63 nt, Homo Sapiens; identical to SEQ ID NO: 500994

SEQ ID NO: 501671 - RNA, 63 nt, Homo Sapiens; identical to SEQ ID NO: 500995

SEQ ID NO: 501672 - RNA, 63 nt, Homo Sapiens; identical to SEQ ID NO: 500996

SEQ ID NO: 501673 - RNA, 63 nt, Homo Sapiens; identical to SEQ ID NO: 500997

SEQ ID NO: 501674 - RNA, 63 nt, Homo Sapiens; identical to SEQ ID NO: 500998

SEQ ID NO: 501675 - RNA, 63 nt, Homo Sapiens; identical to SEQ ID NO: 500999

SEQ ID NO: 501676 - RNA, 63 nt, Homo Sapiens; identical to SEQ ID NO: 501000

SEQ ID NO: 501677 - RNA, 63 nt, Homo Sapiens; identical to SEQ ID NO: 501001

SEQ ID NO: 501678 - RNA, 63 nt, Homo Sapiens; identical to SEQ ID NO: 501002

SEQ ID NO: 501679 - RNA, 63 nt, Homo Sapiens; identical to SEQ ID NO: 501003

SEQ ID NO: 501680 - RNA, 63 nt, Homo Sapiens; identical to SEQ ID NO: 501004

SEQ ID NO: 501681 - RNA, 63 nt, Homo Sapiens; identical to SEQ ID NO: 501005

SEQ ID NO: 501682 - RNA, 63 nt, Homo Sapiens; identical to SEQ ID NO: 501006

SEQ ID NO: 501683 - RNA, 63 nt, Homo Sapiens; identical to SEQ ID NO: 501007

SEQ ID NO: 501684 - RNA, 63 nt, Homo Sapiens; identical to SEQ ID NO: 501008

SEQ ID NO: 501685 - RNA, 63 nt, Homo Sapiens; identical to SEQ ID NO: 501009

SEQ ID NO: 501686 - RNA, 63 nt, Homo Sapiens; identical to SEQ ID NO: 501010

SEQ ID NO: 501687 - RNA, 63 nt, Homo Sapiens; identical to SEQ ID NO: 501011

SEQ ID NO: 501688 - RNA, 63 nt, Homo Sapiens; identical to SEQ ID NO: 501012

SEQ ID NO: 501689 - RNA, 63 nt, Homo Sapiens; identical to SEQ ID NO: 501013

SEQ ID NO: 501690 - RNA, 63 nt, Homo Sapiens; identical to SEQ ID NO: 501014

SEQ ID NO: 501691 - RNA, 63 nt, Homo Sapiens; identical to SEQ ID NO: 501015

SEQ ID NO: 501692 - RNA, 63 nt, Homo Sapiens; identical to SEQ ID NO: 501016

SEQ ID NO: 501693 - RNA, 63 nt, Homo Sapiens; identical to SEQ ID NO: 501017

SEQ ID NO: 501694 - RNA, 63 nt, Homo Sapiens; identical to SEQ ID NO: 501018

SEQ ID NO: 501695 - RNA, 63 nt, Homo Sapiens; identical to SEQ ID NO: 501019

SEQ ID NO: 501696 - RNA, 63 nt, Homo Sapiens; identical to SEQ ID NO: 501020

SEQ ID NO: 501697 - RNA, 63 nt, Homo Sapiens; identical to SEQ ID NO: 501021

SEQ ID NO: 501698 - RNA, 63 nt, Homo Sapiens; identical to SEQ ID NO: 501022

SEQ ID NO: 501699 - RNA, 50 nt, Homo Sapiens; identical to SEQ ID NO: 501023

SEQ ID NO: 501700 - RNA, 63 nt, Homo Sapiens; identical to SEQ ID NO: 501024

SEQ ID NO: 501701 - RNA, 63 nt, Homo Sapiens; identical to SEQ ID NO: 501025

SEQ ID NO: 501702 - RNA, 63 nt, Homo Sapiens; identical to SEQ ID NO: 501026

SEQ ID NO: 501703 - RNA, 63 nt, Homo Sapiens; identical to SEQ ID NO: 501027

SEQ ID NO: 501704 - RNA, 63 nt, Homo Sapiens; identical to SEQ ID NO: 501028

SEQ ID NO: 501705 - RNA, 63 nt, Homo Sapiens; identical to SEQ ID NO: 501029

SEQ ID NO: 501706 - RNA, 63 nt, Homo Sapiens; identical to SEQ ID NO: 501030

SEQ ID NO: 501707 - RNA, 63 nt, Homo Sapiens; identical to SEQ ID NO: 501031

SEQ ID NO: 501708 - RNA, 63 nt, Homo Sapiens; identical to SEQ ID NO: 501032

SEQ ID NO: 501709 - RNA, 63 nt, Homo Sapiens; identical to SEQ ID NO: 501033

SEQ ID NO: 501710 - RNA, 63 nt, Homo Sapiens; identical to SEQ ID NO: 501034

SEQ ID NO: 501711 - RNA, 63 nt, Homo Sapiens; identical to SEQ ID NO: 501035

SEQ ID NO: 501712 - RNA, 63 nt, Homo Sapiens; identical to SEQ ID NO: 501036

SEQ ID NO: 501713 - RNA, 63 nt, Homo Sapiens; identical to SEQ ID NO: 501037

SEQ ID NO: 501714 - RNA, 63 nt, Homo Sapiens; identical to SEQ ID NO: 501038

SEQ ID NO: 501715 - RNA, 63 nt, Homo Sapiens; identical to SEQ ID NO: 501039

SEQ ID NO: 501716 - RNA, 63 nt, Homo Sapiens; identical to SEQ ID NO: 501040

SEQ ID NO: 501717 - RNA, 63 nt, Homo Sapiens; identical to SEQ ID NO: 501041

SEQ ID NO: 501718 - RNA, 63 nt, Homo Sapiens; identical to SEQ ID NO: 501042

SEQ ID NO: 501719 - RNA, 63 nt, Homo Sapiens; identical to SEQ ID NO: 501043

SEQ ID NO: 501720 - RNA, 63 nt, Homo Sapiens; identical to SEQ ID NO: 501044

SEQ ID NO: 501721 - RNA, 63 nt, Homo Sapiens; identical to SEQ ID NO: 501045

SEQ ID NO: 501722 - RNA, 63 nt, Homo Sapiens; identical to SEQ ID NO: 501046

SEQ ID NO: 501723 - RNA, 63 nt, Homo Sapiens; identical to SEQ ID NO: 501047

SEQ ID NO: 501724 - RNA, 63 nt, Homo Sapiens; identical to SEQ ID NO: 501048

SEQ ID NO: 501725 - RNA, 63 nt, Homo Sapiens; identical to SEQ ID NO: 501049

SEQ ID NO: 501726 - RNA, 63 nt, Homo Sapiens; identical to SEQ ID NO: 501050

SEQ ID NO: 501727 - RNA, 63 nt, Homo Sapiens; identical to SEQ ID NO: 501051

SEQ ID NO: 501728 - RNA, 63 nt, Homo Sapiens; identical to SEQ ID NO: 501052

SEQ ID NO: 501729 - RNA, 63 nt, Homo Sapiens; identical to SEQ ID NO: 501053

SEQ ID NO: 501730 - RNA, 63 nt, Homo Sapiens; identical to SEQ ID NO: 501054

SEQ ID NO: 501731 - RNA, 63 nt, Homo Sapiens; identical to SEQ ID NO: 501055

SEQ ID NO: 501732 - RNA, 63 nt, Homo Sapiens; identical to SEQ ID NO: 501056

SEQ ID NO: 501733 - RNA, 63 nt, Homo Sapiens; identical to SEQ ID NO: 501057

SEQ ID NO: 501734 - RNA, 63 nt, Homo Sapiens; identical to SEQ ID NO: 501058

SEQ ID NO: 501735 - RNA, 63 nt, Homo Sapiens; identical to SEQ ID NO: 501059

SEQ ID NO: 501736 - RNA, 63 nt, Homo Sapiens; identical to SEQ ID NO: 501060

SEQ ID NO: 501737 - RNA, 63 nt, Homo Sapiens; identical to SEQ ID NO: 501061

SEQ ID NO: 501738 - RNA, 63 nt, Homo Sapiens; identical to SEQ ID NO: 501062

SEQ ID NO: 501739 - RNA, 63 nt, Homo Sapiens; identical to SEQ ID NO: 501063

SEQ ID NO: 501740 - RNA, 63 nt, Homo Sapiens; identical to SEQ ID NO: 501064

SEQ ID NO: 501741 - RNA, 63 nt, Homo Sapiens; identical to SEQ ID NO: 501065

SEQ ID NO: 501742 - RNA, 63 nt, Homo Sapiens; identical to SEQ ID NO: 501066

SEQ ID NO: 501743 - RNA, 63 nt, Homo Sapiens; identical to SEQ ID NO: 501067

SEQ ID NO: 501744 - RNA, 63 nt, Homo Sapiens; identical to SEQ ID NO: 501068

SEQ ID NO: 501745 - RNA, 63 nt, Homo Sapiens; identical to SEQ ID NO: 501069

SEQ ID NO: 501746 - RNA, 63 nt, Homo Sapiens; identical to SEQ ID NO: 501070

SEQ ID NO: 501747 - RNA, 63 nt, Homo Sapiens; identical to SEQ ID NO: 501071

SEQ ID NO: 501748 - RNA, 63 nt, Homo Sapiens; identical to SEQ ID NO: 501072

SEQ ID NO: 501749 - RNA, 63 nt, Homo Sapiens; identical to SEQ ID NO: 501073

SEQ ID NO: 501750 - RNA, 63 nt, Homo Sapiens; identical to SEQ ID NO: 501074

SEQ ID NO: 501751 - RNA, 63 nt, Homo Sapiens; identical to SEQ ID NO: 501075

SEQ ID NO: 501752 - RNA, 63 nt, Homo Sapiens; identical to SEQ ID NO: 501076

SEQ ID NO: 501753 - RNA, 63 nt, Homo Sapiens; identical to SEQ ID NO: 501077

SEQ ID NO: 501754 - RNA, 63 nt, Homo Sapiens; identical to SEQ ID NO: 501078

SEQ ID NO: 501755 - RNA, 63 nt, Homo Sapiens; identical to SEQ ID NO: 501079

SEQ ID NO: 501756 - RNA, 63 nt, Homo Sapiens; identical to SEQ ID NO: 501080

SEQ ID NO: 501757 - RNA, 63 nt, Homo Sapiens; identical to SEQ ID NO: 501081

SEQ ID NO: 501758 - RNA, 62 nt, Homo Sapiens; identical to SEQ ID NO: 501082

SEQ ID NO: 501759 - RNA, 63 nt, Homo Sapiens; identical to SEQ ID NO: 501083

SEQ ID NO: 501760 - RNA, 63 nt, Homo Sapiens; identical to SEQ ID NO: 501084

SEQ ID NO: 501761 - RNA, 63 nt, Homo Sapiens; identical to SEQ ID NO: 501085

SEQ ID NO: 501762 - RNA, 63 nt, Homo Sapiens; identical to SEQ ID NO: 501086

SEQ ID NO: 501763 - RNA, 63 nt, Homo Sapiens; identical to SEQ ID NO: 501087

SEQ ID NO: 501764 - RNA, 63 nt, Homo Sapiens; identical to SEQ ID NO: 501088

SEQ ID NO: 501765 - RNA, 63 nt, Homo Sapiens; identical to SEQ ID NO: 501089

SEQ ID NO: 501766 - RNA, 63 nt, Homo Sapiens; identical to SEQ ID NO: 501090

SEQ ID NO: 501767 - RNA, 63 nt, Homo Sapiens; identical to SEQ ID NO: 501091

SEQ ID NO: 501768 - RNA, 63 nt, Homo Sapiens; identical to SEQ ID NO: 501092

SEQ ID NO: 501769 - RNA, 63 nt, Homo Sapiens; identical to SEQ ID NO: 501093

SEQ ID NO: 501770 - RNA, 63 nt, Homo Sapiens; identical to SEQ ID NO: 501094

SEQ ID NO: 501771 - RNA, 63 nt, Homo Sapiens; identical to SEQ ID NO: 501095

SEQ ID NO: 501772 - RNA, 63 nt, Homo Sapiens; identical to SEQ ID NO: 501096

SEQ ID NO: 501773 - RNA, 63 nt, Homo Sapiens; identical to SEQ ID NO: 501097

SEQ ID NO: 501774 - RNA, 63 nt, Homo Sapiens; identical to SEQ ID NO: 501098

SEQ ID NO: 501775 - RNA, 63 nt, Homo Sapiens; identical to SEQ ID NO: 501099

SEQ ID NO: 501776 - RNA, 63 nt, Homo Sapiens; identical to SEQ ID NO: 501100

SEQ ID NO: 501777 - RNA, 63 nt, Homo Sapiens; identical to SEQ ID NO: 501101

SEQ ID NO: 501778 - RNA, 63 nt, Homo Sapiens; identical to SEQ ID NO: 501102

SEQ ID NO: 501779 - RNA, 63 nt, Homo Sapiens; identical to SEQ ID NO: 501103

SEQ ID NO: 501780 - RNA, 63 nt, Homo Sapiens; identical to SEQ ID NO: 501104

SEQ ID NO: 501781 - RNA, 63 nt, Homo Sapiens; identical to SEQ ID NO: 501105

SEQ ID NO: 501782 - RNA, 63 nt, Homo Sapiens; identical to SEQ ID NO: 501106

SEQ ID NO: 501783 - RNA, 63 nt, Homo Sapiens; identical to SEQ ID NO: 501107

SEQ ID NO: 501784 - RNA, 63 nt, Homo Sapiens; identical to SEQ ID NO: 501108

SEQ ID NO: 501785 - RNA, 63 nt, Homo Sapiens; identical to SEQ ID NO: 501109

SEQ ID NO: 501786 - RNA, 63 nt, Homo Sapiens; identical to SEQ ID NO: 501110

SEQ ID NO: 501787 - RNA, 63 nt, Homo Sapiens; identical to SEQ ID NO: 501111

SEQ ID NO: 501788 - RNA, 63 nt, Homo Sapiens; identical to SEQ ID NO: 501112

SEQ ID NO: 501789 - RNA, 63 nt, Homo Sapiens; identical to SEQ ID NO: 501113

SEQ ID NO: 501790 - RNA, 63 nt, Homo Sapiens; identical to SEQ ID NO: 501114

SEQ ID NO: 501791 - RNA, 63 nt, Homo Sapiens; identical to SEQ ID NO: 501115

SEQ ID NO: 501792 - RNA, 63 nt, Homo Sapiens; identical to SEQ ID NO: 501116

SEQ ID NO: 501793 - RNA, 63 nt, Homo Sapiens; identical to SEQ ID NO: 501117

SEQ ID NO: 501794 - RNA, 63 nt, Homo Sapiens; identical to SEQ ID NO: 501118

SEQ ID NO: 501795 - RNA, 63 nt, Homo Sapiens; identical to SEQ ID NO: 501119

SEQ ID NO: 501796 - RNA, 63 nt, Homo Sapiens; identical to SEQ ID NO: 501120

SEQ ID NO: 501797 - RNA, 63 nt, Homo Sapiens; identical to SEQ ID NO: 501121

SEQ ID NO: 501798 - RNA, 63 nt, Homo Sapiens; identical to SEQ ID NO: 501122

SEQ ID NO: 501799 - RNA, 63 nt, Homo Sapiens; identical to SEQ ID NO: 501123

SEQ ID NO: 501800 - RNA, 63 nt, Homo Sapiens; identical to SEQ ID NO: 501124

SEQ ID NO: 501801 - RNA, 63 nt, Homo Sapiens; identical to SEQ ID NO: 501125

SEQ ID NO: 501802 - RNA, 63 nt, Homo Sapiens; identical to SEQ ID NO: 501126

SEQ ID NO: 501803 - RNA, 63 nt, Homo Sapiens; identical to SEQ ID NO: 501127

SEQ ID NO: 501804 - RNA, 63 nt, Homo Sapiens; identical to SEQ ID NO: 501128

SEQ ID NO: 501805 - RNA, 63 nt, Homo Sapiens; identical to SEQ ID NO: 501129

SEQ ID NO: 501806 - RNA, 63 nt, Homo Sapiens; identical to SEQ ID NO: 501130

SEQ ID NO: 501807 - RNA, 63 nt, Homo Sapiens; identical to SEQ ID NO: 501131

SEQ ID NO: 501808 - RNA, 63 nt, Homo Sapiens; identical to SEQ ID NO: 501132

SEQ ID NO: 501809 - RNA, 63 nt, Homo Sapiens; identical to SEQ ID NO: 501133

SEQ ID NO: 501810 - RNA, 63 nt, Homo Sapiens; identical to SEQ ID NO: 501134

SEQ ID NO: 501811 - RNA, 63 nt, Homo Sapiens; identical to SEQ ID NO: 501135

SEQ ID NO: 501812 - RNA, 63 nt, Homo Sapiens; identical to SEQ ID NO: 501136

SEQ ID NO: 501813 - RNA, 63 nt, Homo Sapiens; identical to SEQ ID NO: 501137

SEQ ID NO: 501814 - RNA, 63 nt, Homo Sapiens; identical to SEQ ID NO: 501138

SEQ ID NO: 501815 - RNA, 63 nt, Homo Sapiens; identical to SEQ ID NO: 501139

SEQ ID NO: 501816 - RNA, 63 nt, Homo Sapiens; identical to SEQ ID NO: 501140

SEQ ID NO: 501817 - RNA, 63 nt, Homo Sapiens; identical to SEQ ID NO: 501141

SEQ ID NO: 501818 - RNA, 63 nt, Homo Sapiens; identical to SEQ ID NO: 501142

SEQ ID NO: 501819 - RNA, 63 nt, Homo Sapiens; identical to SEQ ID NO: 501143

SEQ ID NO: 501820 - RNA, 63 nt, Homo Sapiens; identical to SEQ ID NO: 501144

SEQ ID NO: 501821 - RNA, 63 nt, Homo Sapiens; identical to SEQ ID NO: 501145

SEQ ID NO: 501822 - RNA, 63 nt, Homo Sapiens; identical to SEQ ID NO: 501146

SEQ ID NO: 501823 - RNA, 63 nt, Homo Sapiens; identical to SEQ ID NO: 501147

SEQ ID NO: 501824 - RNA, 63 nt, Homo Sapiens; identical to SEQ ID NO: 501148

SEQ ID NO: 501825 - RNA, 63 nt, Homo Sapiens; identical to SEQ ID NO: 501149

SEQ ID NO: 501826 - RNA, 63 nt, Homo Sapiens; identical to SEQ ID NO: 501150

SEQ ID NO: 501827 - RNA, 63 nt, Homo Sapiens; identical to SEQ ID NO: 501151

SEQ ID NO: 501828 - RNA, 63 nt, Homo Sapiens; identical to SEQ ID NO: 501152

SEQ ID NO: 501829 - RNA, 63 nt, Homo Sapiens; identical to SEQ ID NO: 501153

SEQ ID NO: 501830 - RNA, 63 nt, Homo Sapiens; identical to SEQ ID NO: 501154

SEQ ID NO: 501831 - RNA, 63 nt, Homo Sapiens; identical to SEQ ID NO: 501155

SEQ ID NO: 501832 - RNA, 63 nt, Homo Sapiens; identical to SEQ ID NO: 501156

SEQ ID NO: 501833 - RNA, 63 nt, Homo Sapiens; identical to SEQ ID NO: 501157

SEQ ID NO: 501834 - RNA, 63 nt, Homo Sapiens; identical to SEQ ID NO: 501158

SEQ ID NO: 501835 - RNA, 63 nt, Homo Sapiens; identical to SEQ ID NO: 501159

SEQ ID NO: 501836 - RNA, 62 nt, Homo Sapiens; identical to SEQ ID NO: 501160

SEQ ID NO: 501837 - RNA, 63 nt, Homo Sapiens; identical to SEQ ID NO: 501161

SEQ ID NO: 501838 - RNA, 63 nt, Homo Sapiens; identical to SEQ ID NO: 501162

SEQ ID NO: 501839 - RNA, 63 nt, Homo Sapiens; identical to SEQ ID NO: 501163

SEQ ID NO: 501840 - RNA, 63 nt, Homo Sapiens; identical to SEQ ID NO: 501164

SEQ ID NO: 501841 - RNA, 63 nt, Homo Sapiens; identical to SEQ ID NO: 501165

SEQ ID NO: 501842 - RNA, 63 nt, Homo Sapiens; identical to SEQ ID NO: 501166

SEQ ID NO: 501843 - RNA, 59 nt, Homo Sapiens; identical to SEQ ID NO: 501167

SEQ ID NO: 501844 - RNA, 63 nt, Homo Sapiens; identical to SEQ ID NO: 501168

SEQ ID NO: 501845 - RNA, 63 nt, Homo Sapiens; identical to SEQ ID NO: 501169

SEQ ID NO: 501846 - RNA, 63 nt, Homo Sapiens; identical to SEQ ID NO: 501170

SEQ ID NO: 501847 - RNA, 63 nt, Homo Sapiens; identical to SEQ ID NO: 501171

SEQ ID NO: 501848 - RNA, 63 nt, Homo Sapiens; identical to SEQ ID NO: 501172

SEQ ID NO: 501849 - RNA, 63 nt, Homo Sapiens; identical to SEQ ID NO: 501173

SEQ ID NO: 501850 - RNA, 63 nt, Homo Sapiens; identical to SEQ ID NO: 501174

SEQ ID NO: 501851 - RNA, 63 nt, Homo Sapiens; identical to SEQ ID NO: 501175

SEQ ID NO: 501852 - RNA, 63 nt, Homo Sapiens; identical to SEQ ID NO: 501176

SEQ ID NO: 501853 - RNA, 63 nt, Homo Sapiens; identical to SEQ ID NO: 501177

SEQ ID NO: 501854 - RNA, 63 nt, Homo Sapiens; identical to SEQ ID NO: 501178

SEQ ID NO: 501855 - RNA, 63 nt, Homo Sapiens; identical to SEQ ID NO: 501179

SEQ ID NO: 501856 - RNA, 63 nt, Homo Sapiens; identical to SEQ ID NO: 501180

SEQ ID NO: 501857 - RNA, 63 nt, Homo Sapiens; identical to SEQ ID NO: 501181

SEQ ID NO: 501858 - RNA, 63 nt, Homo Sapiens; identical to SEQ ID NO: 501182

SEQ ID NO: 501859 - RNA, 63 nt, Homo Sapiens; identical to SEQ ID NO: 501183

SEQ ID NO: 501860 - RNA, 63 nt, Homo Sapiens; identical to SEQ ID NO: 501184

SEQ ID NO: 501861 - RNA, 63 nt, Homo Sapiens; identical to SEQ ID NO: 501185

SEQ ID NO: 501862 - RNA, 63 nt, Homo Sapiens; identical to SEQ ID NO: 501186

SEQ ID NO: 501863 - RNA, 63 nt, Homo Sapiens; identical to SEQ ID NO: 501187

SEQ ID NO: 501864 - RNA, 63 nt, Homo Sapiens; identical to SEQ ID NO: 501188

SEQ ID NO: 501865 - RNA, 63 nt, Homo Sapiens; identical to SEQ ID NO: 501189

SEQ ID NO: 501866 - RNA, 63 nt, Homo Sapiens; identical to SEQ ID NO: 501190

SEQ ID NO: 501867 - RNA, 63 nt, Homo Sapiens; identical to SEQ ID NO: 501191

SEQ ID NO: 501868 - RNA, 63 nt, Homo Sapiens; identical to SEQ ID NO: 501192

SEQ ID NO: 501869 - RNA, 63 nt, Homo Sapiens; identical to SEQ ID NO: 501193

SEQ ID NO: 501870 - RNA, 63 nt, Homo Sapiens; identical to SEQ ID NO: 501194

SEQ ID NO: 501871 - RNA, 63 nt, Homo Sapiens; identical to SEQ ID NO: 501195

SEQ ID NO: 501872 - RNA, 63 nt, Homo Sapiens; identical to SEQ ID NO: 501196

SEQ ID NO: 501873 - RNA, 63 nt, Homo Sapiens; identical to SEQ ID NO: 501197

SEQ ID NO: 501874 - RNA, 63 nt, Homo Sapiens; identical to SEQ ID NO: 501198

SEQ ID NO: 501875 - RNA, 63 nt, Homo Sapiens; identical to SEQ ID NO: 501199

SEQ ID NO: 501876 - RNA, 63 nt, Homo Sapiens; identical to SEQ ID NO: 501200

SEQ ID NO: 501877 - RNA, 63 nt, Homo Sapiens; identical to SEQ ID NO: 501201

SEQ ID NO: 501878 - RNA, 63 nt, Homo Sapiens; identical to SEQ ID NO: 501202

SEQ ID NO: 501879 - RNA, 63 nt, Homo Sapiens; identical to SEQ ID NO: 501203

SEQ ID NO: 501880 - RNA, 63 nt, Homo Sapiens; identical to SEQ ID NO: 501204

SEQ ID NO: 501881 - RNA, 63 nt, Homo Sapiens; identical to SEQ ID NO: 501205

SEQ ID NO: 501882 - RNA, 63 nt, Homo Sapiens; identical to SEQ ID NO: 501206

SEQ ID NO: 501883 - RNA, 63 nt, Homo Sapiens; identical to SEQ ID NO: 501207

SEQ ID NO: 501884 - RNA, 63 nt, Homo Sapiens; identical to SEQ ID NO: 501208

SEQ ID NO: 501885 - RNA, 63 nt, Homo Sapiens; identical to SEQ ID NO: 501209

SEQ ID NO: 501886 - RNA, 63 nt, Homo Sapiens; identical to SEQ ID NO: 501210

SEQ ID NO: 501887 - RNA, 63 nt, Homo Sapiens; identical to SEQ ID NO: 501211

SEQ ID NO: 501888 - RNA, 63 nt, Homo Sapiens; identical to SEQ ID NO: 501212

SEQ ID NO: 501889 - RNA, 63 nt, Homo Sapiens; identical to SEQ ID NO: 501213

SEQ ID NO: 501890 - RNA, 63 nt, Homo Sapiens; identical to SEQ ID NO: 501214

SEQ ID NO: 501891 - RNA, 63 nt, Homo Sapiens; identical to SEQ ID NO: 501215

SEQ ID NO: 501892 - RNA, 63 nt, Homo Sapiens; identical to SEQ ID NO: 501216

SEQ ID NO: 501893 - RNA, 63 nt, Homo Sapiens; identical to SEQ ID NO: 501217

SEQ ID NO: 501894 - RNA, 63 nt, Homo Sapiens; identical to SEQ ID NO: 501218

SEQ ID NO: 501895 - RNA, 63 nt, Homo Sapiens; identical to SEQ ID NO: 501219

SEQ ID NO: 501896 - RNA, 63 nt, Homo Sapiens; identical to SEQ ID NO: 501220

SEQ ID NO: 501897 - RNA, 63 nt, Homo Sapiens; identical to SEQ ID NO: 501221

SEQ ID NO: 501898 - RNA, 63 nt, Homo Sapiens; identical to SEQ ID NO: 501222

SEQ ID NO: 501899 - RNA, 63 nt, Homo Sapiens; identical to SEQ ID NO: 501223

SEQ ID NO: 501900 - RNA, 63 nt, Homo Sapiens; identical to SEQ ID NO: 501224

SEQ ID NO: 501901 - RNA, 63 nt, Homo Sapiens; identical to SEQ ID NO: 501225

SEQ ID NO: 501902 - RNA, 63 nt, Homo Sapiens; identical to SEQ ID NO: 501226

SEQ ID NO: 501903 - RNA, 63 nt, Homo Sapiens; identical to SEQ ID NO: 501227

SEQ ID NO: 501904 - RNA, 63 nt, Homo Sapiens; identical to SEQ ID NO: 501228

SEQ ID NO: 501905 - RNA, 63 nt, Homo Sapiens; identical to SEQ ID NO: 501229

SEQ ID NO: 501906 - RNA, 63 nt, Homo Sapiens; identical to SEQ ID NO: 501230

SEQ ID NO: 501907 - RNA, 63 nt, Homo Sapiens; identical to SEQ ID NO: 501231

SEQ ID NO: 501908 - RNA, 63 nt, Homo Sapiens; identical to SEQ ID NO: 501232

SEQ ID NO: 501909 - RNA, 63 nt, Homo Sapiens; identical to SEQ ID NO: 501233

SEQ ID NO: 501910 - RNA, 63 nt, Homo Sapiens; identical to SEQ ID NO: 501234

SEQ ID NO: 501911 - RNA, 63 nt, Homo Sapiens; identical to SEQ ID NO: 501235

SEQ ID NO: 501912 - RNA, 63 nt, Homo Sapiens; identical to SEQ ID NO: 501236

SEQ ID NO: 501913 - RNA, 63 nt, Homo Sapiens; identical to SEQ ID NO: 501237

SEQ ID NO: 501914 - RNA, 63 nt, Homo Sapiens; identical to SEQ ID NO: 501238

SEQ ID NO: 501915 - RNA, 63 nt, Homo Sapiens; identical to SEQ ID NO: 501239

SEQ ID NO: 501916 - RNA, 63 nt, Homo Sapiens; identical to SEQ ID NO: 501240

SEQ ID NO: 501917 - RNA, 63 nt, Homo Sapiens; identical to SEQ ID NO: 501241

SEQ ID NO: 501918 - RNA, 63 nt, Homo Sapiens; identical to SEQ ID NO: 501242

SEQ ID NO: 501919 - RNA, 63 nt, Homo Sapiens; identical to SEQ ID NO: 501243

SEQ ID NO: 501920 - RNA, 63 nt, Homo Sapiens; identical to SEQ ID NO: 501244

SEQ ID NO: 501921 - RNA, 63 nt, Homo Sapiens; identical to SEQ ID NO: 501245

SEQ ID NO: 501922 - RNA, 63 nt, Homo Sapiens; identical to SEQ ID NO: 501246

SEQ ID NO: 501923 - RNA, 63 nt, Homo Sapiens; identical to SEQ ID NO: 501247

SEQ ID NO: 501924 - RNA, 63 nt, Homo Sapiens; identical to SEQ ID NO: 501248

SEQ ID NO: 501925 - RNA, 63 nt, Homo Sapiens; identical to SEQ ID NO: 501249

SEQ ID NO: 501926 - RNA, 63 nt, Homo Sapiens; identical to SEQ ID NO: 501250

SEQ ID NO: 501927 - RNA, 63 nt, Homo Sapiens; identical to SEQ ID NO: 501251

SEQ ID NO: 501928 - RNA, 63 nt, Homo Sapiens; identical to SEQ ID NO: 501252

SEQ ID NO: 501929 - RNA, 63 nt, Homo Sapiens; identical to SEQ ID NO: 501253

SEQ ID NO: 501930 - RNA, 63 nt, Homo Sapiens; identical to SEQ ID NO: 501254

SEQ ID NO: 501931 - RNA, 63 nt, Homo Sapiens; identical to SEQ ID NO: 501255

SEQ ID NO: 501932 - RNA, 63 nt, Homo Sapiens; identical to SEQ ID NO: 501256

SEQ ID NO: 501933 - RNA, 63 nt, Homo Sapiens; identical to SEQ ID NO: 501257

SEQ ID NO: 501934 - RNA, 63 nt, Homo Sapiens; identical to SEQ ID NO: 501258

SEQ ID NO: 501935 - RNA, 63 nt, Homo Sapiens; identical to SEQ ID NO: 501259

SEQ ID NO: 501936 - RNA, 53 nt, Homo Sapiens; identical to SEQ ID NO: 501260

SEQ ID NO: 501937 - RNA, 63 nt, Homo Sapiens; identical to SEQ ID NO: 501261

SEQ ID NO: 501938 - RNA, 63 nt, Homo Sapiens; identical to SEQ ID NO: 501262

SEQ ID NO: 501939 - RNA, 63 nt, Homo Sapiens; identical to SEQ ID NO: 501263

SEQ ID NO: 501940 - RNA, 63 nt, Homo Sapiens; identical to SEQ ID NO: 501264

SEQ ID NO: 501941 - RNA, 63 nt, Homo Sapiens; identical to SEQ ID NO: 501265

SEQ ID NO: 501942 - RNA, 63 nt, Homo Sapiens; identical to SEQ ID NO: 501266

SEQ ID NO: 501943 - RNA, 63 nt, Homo Sapiens; identical to SEQ ID NO: 501267

SEQ ID NO: 501944 - RNA, 63 nt, Homo Sapiens; identical to SEQ ID NO: 501268

SEQ ID NO: 501945 - RNA, 63 nt, Homo Sapiens; identical to SEQ ID NO: 501269

SEQ ID NO: 501946 - RNA, 63 nt, Homo Sapiens; identical to SEQ ID NO: 501270

SEQ ID NO: 501947 - RNA, 63 nt, Homo Sapiens; identical to SEQ ID NO: 501271

SEQ ID NO: 501948 - RNA, 63 nt, Homo Sapiens; identical to SEQ ID NO: 501272

SEQ ID NO: 501949 - RNA, 63 nt, Homo Sapiens; identical to SEQ ID NO: 501273

SEQ ID NO: 501950 - RNA, 63 nt, Homo Sapiens; identical to SEQ ID NO: 501274

SEQ ID NO: 501951 - RNA, 63 nt, Homo Sapiens; identical to SEQ ID NO: 501275

SEQ ID NO: 501952 - RNA, 63 nt, Homo Sapiens; identical to SEQ ID NO: 501276

SEQ ID NO: 501953 - RNA, 63 nt, Homo Sapiens; identical to SEQ ID NO: 501277

SEQ ID NO: 501954 - RNA, 63 nt, Homo Sapiens; identical to SEQ ID NO: 501278

SEQ ID NO: 501955 - RNA, 63 nt, Homo Sapiens; identical to SEQ ID NO: 501279

SEQ ID NO: 501956 - RNA, 63 nt, Homo Sapiens; identical to SEQ ID NO: 501280

SEQ ID NO: 501957 - RNA, 63 nt, Homo Sapiens; identical to SEQ ID NO: 501281

SEQ ID NO: 501958 - RNA, 63 nt, Homo Sapiens; identical to SEQ ID NO: 501282

SEQ ID NO: 501959 - RNA, 63 nt, Homo Sapiens; identical to SEQ ID NO: 501283

SEQ ID NO: 501960 - RNA, 63 nt, Homo Sapiens; identical to SEQ ID NO: 501284

SEQ ID NO: 501961 - RNA, 63 nt, Homo Sapiens; identical to SEQ ID NO: 501285

SEQ ID NO: 501962 - RNA, 63 nt, Homo Sapiens; identical to SEQ ID NO: 501286

SEQ ID NO: 501963 - RNA, 63 nt, Homo Sapiens; identical to SEQ ID NO: 501287

SEQ ID NO: 501964 - RNA, 63 nt, Homo Sapiens; identical to SEQ ID NO: 501288

SEQ ID NO: 501965 - RNA, 63 nt, Homo Sapiens; identical to SEQ ID NO: 501289

SEQ ID NO: 501966 - RNA, 63 nt, Homo Sapiens; identical to SEQ ID NO: 501290

SEQ ID NO: 501967 - RNA, 63 nt, Homo Sapiens; identical to SEQ ID NO: 501291

SEQ ID NO: 501968 - RNA, 63 nt, Homo Sapiens; identical to SEQ ID NO: 501292

SEQ ID NO: 501969 - RNA, 63 nt, Homo Sapiens; identical to SEQ ID NO: 501293

SEQ ID NO: 501970 - RNA, 63 nt, Homo Sapiens; identical to SEQ ID NO: 501294

SEQ ID NO: 501971 - RNA, 63 nt, Homo Sapiens; identical to SEQ ID NO: 501295

SEQ ID NO: 501972 - RNA, 63 nt, Homo Sapiens; identical to SEQ ID NO: 501296

SEQ ID NO: 501973 - RNA, 63 nt, Homo Sapiens; identical to SEQ ID NO: 501297

SEQ ID NO: 501974 - RNA, 63 nt, Homo Sapiens; identical to SEQ ID NO: 501298

SEQ ID NO: 501975 - RNA, 63 nt, Homo Sapiens; identical to SEQ ID NO: 501299

SEQ ID NO: 501976 - RNA, 63 nt, Homo Sapiens; identical to SEQ ID NO: 501300

SEQ ID NO: 501977 - RNA, 63 nt, Homo Sapiens; identical to SEQ ID NO: 501301

SEQ ID NO: 501978 - RNA, 63 nt, Homo Sapiens; identical to SEQ ID NO: 501302

SEQ ID NO: 501979 - RNA, 63 nt, Homo Sapiens; identical to SEQ ID NO: 501303

SEQ ID NO: 501980 - RNA, 63 nt, Homo Sapiens; identical to SEQ ID NO: 501304

SEQ ID NO: 501981 - RNA, 63 nt, Homo Sapiens; identical to SEQ ID NO: 501305

SEQ ID NO: 501982 - RNA, 63 nt, Homo Sapiens; identical to SEQ ID NO: 501306

SEQ ID NO: 501983 - RNA, 63 nt, Homo Sapiens; identical to SEQ ID NO: 501307

SEQ ID NO: 501984 - RNA, 63 nt, Homo Sapiens; identical to SEQ ID NO: 501308

SEQ ID NO: 501985 - RNA, 63 nt, Homo Sapiens; identical to SEQ ID NO: 501309

SEQ ID NO: 501986 - RNA, 63 nt, Homo Sapiens; identical to SEQ ID NO: 501310

SEQ ID NO: 501987 - RNA, 63 nt, Homo Sapiens; identical to SEQ ID NO: 501311

SEQ ID NO: 501988 - RNA, 63 nt, Homo Sapiens; identical to SEQ ID NO: 501312

SEQ ID NO: 501989 - RNA, 63 nt, Homo Sapiens; identical to SEQ ID NO: 501313

SEQ ID NO: 501990 - RNA, 63 nt, Homo Sapiens; identical to SEQ ID NO: 501314

SEQ ID NO: 501991 - RNA, 63 nt, Homo Sapiens; identical to SEQ ID NO: 501315

SEQ ID NO: 501992 - RNA, 63 nt, Homo Sapiens; identical to SEQ ID NO: 501316

SEQ ID NO: 501993 - RNA, 63 nt, Homo Sapiens; identical to SEQ ID NO: 501317

SEQ ID NO: 501994 - RNA, 63 nt, Homo Sapiens; identical to SEQ ID NO: 501318

SEQ ID NO: 501995 - RNA, 63 nt, Homo Sapiens; identical to SEQ ID NO: 501319

SEQ ID NO: 501996 - RNA, 63 nt, Homo Sapiens; identical to SEQ ID NO: 501320

SEQ ID NO: 501997 - RNA, 63 nt, Homo Sapiens; identical to SEQ ID NO: 501321

SEQ ID NO: 501998 - RNA, 63 nt, Homo Sapiens; identical to SEQ ID NO: 501322

SEQ ID NO: 501999 - RNA, 63 nt, Homo Sapiens; identical to SEQ ID NO: 501323

SEQ ID NO: 502000 - RNA, 63 nt, Homo Sapiens; identical to SEQ ID NO: 501324

SEQ ID NO: 502001 - RNA, 63 nt, Homo Sapiens; identical to SEQ ID NO: 501325

SEQ ID NO: 502002 - RNA, 63 nt, Homo Sapiens; identical to SEQ ID NO: 501326

SEQ ID NO: 502003 - RNA, 63 nt, Homo Sapiens; identical to SEQ ID NO: 501327

SEQ ID NO: 502004 - RNA, 63 nt, Homo Sapiens; identical to SEQ ID NO: 501328

SEQ ID NO: 502005 - RNA, 63 nt, Homo Sapiens; identical to SEQ ID NO: 501329

SEQ ID NO: 502006 - RNA, 63 nt, Homo Sapiens; identical to SEQ ID NO: 501330

SEQ ID NO: 502007 - RNA, 63 nt, Homo Sapiens; identical to SEQ ID NO: 501331

SEQ ID NO: 502008 - RNA, 63 nt, Homo Sapiens; identical to SEQ ID NO: 501332

SEQ ID NO: 502009 - RNA, 63 nt, Homo Sapiens; identical to SEQ ID NO: 501333

SEQ ID NO: 502010 - RNA, 63 nt, Homo Sapiens; identical to SEQ ID NO: 501334

SEQ ID NO: 502011 - RNA, 64 nt, Homo Sapiens
guuguaaaccugcuuuaucuuuuaggauuauuccuaaaugcaucuucuuuauaaacuugacuug

SEQ ID NO: 502012 - RNA, 64 nt, Homo Sapiens
uguuacccugggguauaaucauguuguagguacuuaaaugcauuccgcaaaucaaaauaucuug

SEQ ID NO: 502013 - RNA, 64 nt, Homo Sapiens
guaggaagugaaaauagguauacaguggauuaauuaaaugcagcgaaccaauauuuguagaagg

SEQ ID NO: 502014 - RNA, 64 nt, Homo Sapiens
acaauugaacuuaaauaaaugucauuaaaauaaauaaaugcaauauguauuaauauucauugua

SEQ ID NO: 502015 - RNA, 64 nt, Homo Sapiens
aaauaagaguuaauagcuauugcaugcuucuuuauaaaugcauuaaguuuguuauauauuaaua

SEQ ID NO: 502016 - RNA, 64 nt, Homo Sapiens
aaauauauaggauuacaaaguaaaaucauguuuuuaaaugcauaaaagccuaugaaugccuucu

SEQ ID NO: 502017 - RNA, 64 nt, Homo Sapiens
aaaaaagcuaaucccuaaaauaguuagaucuuuguaaaugcauauuaaauaauaaaguaugacc

SEQ ID NO: 502018 - RNA, 64 nt, Homo Sapiens
caauguauugagaaccaaagcaaccacaaaugcauaaaugcauaauuuauggucuucaaccaag

SEQ ID NO: 502019 - RNA, 64 nt, Homo Sapiens
uauuuuaacugugugaacgcguuguucuguagguuaaaugcaggcuuuaauccgccuaauucuu

SEQ ID NO: 502020 - RNA, 64 nt, Homo Sapiens
cuucuuuucaaaacugcuaaacagcuaugcacuguaaaugcagccaacaauguucuuuuuuguu

SEQ ID NO: 502021 - RNA, 64 nt, Homo Sapiens
agauaucauuucaggugacucauuaaugagcauuuaaaugcaacuggauuuguucagccauuua

SEQ ID NO: 502022 - RNA, 64 nt, Homo Sapiens
gcuguuuuuuguauauacuggaaacaaucuuuuguaaaugcaaagccuggauuaaucaguaugg

SEQ ID NO: 502023 - RNA, 64 nt, Homo Sapiens
cuaacugauaagacaaauugaguuauugagcuauuaaaugcacauuuuaauauaaaugcagaaa

SEQ ID NO: 502024 - RNA, 64 nt, Homo Sapiens
ugaguuauugagcuauuaaaugcacauuuuaauauaaaugcagaaaucccaaauaaaaugcuaa

SEQ ID NO: 502025 - RNA, 64 nt, Homo Sapiens
uuacuuuuaagugugcuuuaugcuuuacaggaaguaaaugcaaaugcuaauugugaaauggaaa

SEQ ID NO: 502026 - RNA, 64 nt, Homo Sapiens
aagagacauagccuuuuaguuuuucuaacaaaaauaaaugcauguugauagcaccaugggacau

SEQ ID NO: 502027 - RNA, 64 nt, Homo Sapiens
ucuguguaaguauaugcaagcugaauuguauauguaaaugcauauuaaaacaaauuuucauggu

SEQ ID NO: 502028 - RNA, 64 nt, Homo Sapiens
ggcaaaguguagacaucugucucccacugcuagauaaaugcagaugcugucaccagaaaaugcu

SEQ ID NO: 502029 - RNA, 64 nt, Homo Sapiens
ggggaaagcagugguccuaguuacgugagauugcuaaaugcaugaguuugaaaaccagguucau

SEQ ID NO: 502030 - RNA, 64 nt, Homo Sapiens
aucaacugcagaaguuugaauaggaaagcucaaguaaaugcauuagaaaaugacgauuaaucua

SEQ ID NO: 502031 - RNA, 64 nt, Homo Sapiens
cuaccauucaagguuaucauuauucuaaguugaguaaaugcaucuuauaauaauaauagcgcca

SEQ ID NO: 502032 - RNA, 64 nt, Homo Sapiens
auguauaaaaguauuguuuucacauguuagcuacuaaaugcaaauuugagaauuguacugacau

SEQ ID NO: 502033 - RNA, 64 nt, Homo Sapiens
cgaauaagccauacuggauuugguagcuucaugguaaaugcauccucguagguugaauuucuuc

SEQ ID NO: 502034 - RNA, 64 nt, Homo Sapiens
aaggggguuggggcaggggaucuuuguaaaauuuuaaaugcauaccauuuaacuuuuuuacaag

SEQ ID NO: 502035 - RNA, 64 nt, Homo Sapiens
aaggaugggauggguuccagagguauuccucucuuaaaugcaagugccuagauuagguagacuu

SEQ ID NO: 502036 - RNA, 64 nt, Homo Sapiens
acugcacaugaaaguuuugcaaagggaaacaggcuaaaugcaccaagaaagcuucuucagagug

SEQ ID NO: 502037 - RNA, 64 nt, Homo Sapiens
uauuuuucaaaaucaaauuguaaucagaaaauauuaaaugcaugaaugaacacauauacuuuug

SEQ ID NO: 502038 - RNA, 64 nt, Homo Sapiens
cugagguuuugugcucacuguacgaaaaucaaaauaaaugcaaguucuuuucaacagugauacc

SEQ ID NO: 502039 - RNA, 64 nt, Homo Sapiens
uuaccugcuacuauuuauuacuuugggaucuuacuaaaugcauuauaaaugccuuaucuuuacc

SEQ ID NO: 502040 - RNA, 64 nt, Homo Sapiens
ccuccuaagguaaauagucucauuuuuaaaauucuaaaugcacaucuugcaagggcaaagaagg

SEQ ID NO: 502041 - RNA, 64 nt, Homo Sapiens
guauuuccccuauauuuuaguauucauuuuuauuuaaaugcacauugugauuucuuuuaaauac

SEQ ID NO: 502042 - RNA, 64 nt, Homo Sapiens
acagguucagauuucaucuucguacaucaaauuauaaaugcaaacaucccuauuuauguucaac

SEQ ID NO: 502043 - RNA, 64 nt, Homo Sapiens
uacuuauuaaaauuguucacuagacucuuauugauaaaugcaacuuacacuuuuuguuaccuug

SEQ ID NO: 502044 - RNA, 64 nt, Homo Sapiens
aauccuuauagucaauucuguuagggaagcauuauaaaugcauuauucucggccucugugggau

SEQ ID NO: 502045 - RNA, 64 nt, Homo Sapiens
uuuuagccacuuuagagaaauuuagacaacauauuaaaugcauaucuagaauuaaauguacuca

SEQ ID NO: 502046 - RNA, 64 nt, Homo Sapiens
auucauauuucuugaagcuuugauucucuggauuuaaaugcauuuaagauuuccuuuaauucua

SEQ ID NO: 502047 - RNA, 64 nt, Homo Sapiens
gcuugguaacaaauguuagcgguauccuuccaaauaaaugcauugcuuuugaugacugguaacu

SEQ ID NO: 502048 - RNA, 64 nt, Homo Sapiens
uuagcaaaucuaugucuuguaguccuuuggugauuaaaugcacaaaaaaagcccagacaucuuc

SEQ ID NO: 502049 - RNA, 64 nt, Homo Sapiens
agaaacagaaggagaccugggguccaauaauagguaaaugcaacagugagcugagcaauaaaau

SEQ ID NO: 502050 - RNA, 64 nt, Homo Sapiens
caugccaaguauuuuauaaaaaaauaucauauaguaaaugcaaauugaguauaugcacauuuaa

SEQ ID NO: 502051 - RNA, 64 nt, Homo Sapiens
auaggaucauuuguuggaauugcuuuuaaaugcauaaaugcauuuaugaggacuugugucucug

SEQ ID NO: 502052 - RNA, 64 nt, Homo Sapiens
aaugcauuauaggaucauuuugucucugugcuuuuaaaugcauaacuucauauaugaggacuug

SEQ ID NO: 502053 - RNA, 64 nt, Homo Sapiens
cgccggccucacccucccaaagugcugggauuacaggcaugagccaccaugccagacuucccau

SEQ ID NO: 502054 - RNA, 64 nt, Homo Sapiens
uuuacaauggggcuguugacagccauaauuagggaggcaugaauuaugcggcuauaaugcagag

SEQ ID NO: 502055 - RNA, 64 nt, Homo Sapiens
acuuucucuagggagaaaaauuaauuuacuagaaaggcaugaaaugaucaugggaagagugguu

SEQ ID NO: 502056 - RNA, 64 nt, Homo Sapiens
caccugccucggccucccaaagugcugcgauuacaggcaugagccaccgcgccuggccgcuuuc

SEQ ID NO: 502057 - RNA, 64 nt, Homo Sapiens
cucccaccucagcuucucaaaguucugggacuacaggcaugaaauacugugccuggccugggga

SEQ ID NO: 502058 - RNA, 64 nt, Homo Sapiens
uguuacugcuacuacacuuugcuccucuggcccaaggcaugaggagagaggcugugucagaaac

SEQ ID NO: 502059 - RNA, 64 nt, Homo Sapiens
cacccgccucgaccucccaaagugcugggauuacaggcaugagccaccaugcccagucgauauc

SEQ ID NO: 502060 - RNA, 64 nt, Homo Sapiens
cacccgccucggccucccaaagugcugggauuacaggcaugagccaucacaccuggucaacuuu

SEQ ID NO: 502061 - RNA, 64 nt, Homo Sapiens
cauugcacccagccauguucagugcuaggauuacaggcaugagccucccacaucagacucccca

SEQ ID NO: 502062 - RNA, 64 nt, Homo Sapiens
caccauguagccugaaguuuaguguugggauuacaggcaugagccucccaccucagccucccaa

SEQ ID NO: 502063 - RNA, 64 nt, Homo Sapiens
caccacacccagccccuuucagugcugggauuacaggcaugagccaccugccucagccucccaa

SEQ ID NO: 502064 - RNA, 61 nt, Homo Sapiens
acuguuuaugucugaaucaaacggaaacaucaggcaugaacccauaaaacccugcaaauaa

SEQ ID NO: 502065 - RNA, 64 nt, Homo Sapiens
cacugugcuugguccagaugagggcuaggauuacaggcaugagcucuccuaccucggccuucca

SEQ ID NO: 502066 - RNA, 64 nt, Homo Sapiens
uguaagauuugugaauccuacaguuucauauauuaggcaugaaaguaauggacgauccacuguu

SEQ ID NO: 502067 - RNA, 64 nt, Homo Sapiens
caccugccuuagccucccaaagugcugggauuacaggcaugagccacugcaccuggcuauauuu

SEQ ID NO: 502068 - RNA, 64 nt, Homo Sapiens
cacccgccuuggccucccaaagugcuggaauuacaggcaugagccaccgcgccuggccuguaua

SEQ ID NO: 502069 - RNA, 64 nt, Homo Sapiens
ggaaagccauuaagugggguuggagacccccccaaggcaugaggggcuuccuuccuccacccag

SEQ ID NO: 502070 - RNA, 64 nt, Homo Sapiens
acacagucaccuccacucccagagagcaagagagaggcaugaacgccauccagguauaauggug

SEQ ID NO: 502071 - RNA, 64 nt, Homo Sapiens
cacugcucccggcccuauuaagugcugggauugcaggcaugagccugcccguccagccucccaa

SEQ ID NO: 502072 - RNA, 64 nt, Homo Sapiens
gcagaggagaaaaucauuugagaaguuacucuguaggcaugacauauuuaaugugugaccuugg

SEQ ID NO: 502073 - RNA, 64 nt, Homo Sapiens
cgcccgccucagccucccaaaguguugggauuacaggcaugagccacugcgccuggccagcaaa

SEQ ID NO: 502074 - RNA, 64 nt, Homo Sapiens
caccugccucagccucccagacuguugggauuacaggcaugagccaccacgccuggccaguuuc

SEQ ID NO: 502075 - RNA, 64 nt, Homo Sapiens
cccccaaccuuggccuccaaagugcugggauuacaggcaugagccaccgcgccuggccucaagu

SEQ ID NO: 502076 - RNA, 64 nt, Homo Sapiens
cacacacuuguaaucccagcuacucaggaggcugaggcaugagaaucgcuuaaacccaggaggc

SEQ ID NO: 502077 - RNA, 64 nt, Homo Sapiens
cacugugcuuggcaagcuaaaauguugcaauuacaggcaugagccuccugccuuggccucccaa

SEQ ID NO: 502078 - RNA, 64 nt, Homo Sapiens
cacugugcuuggccuuuuaaggugcugauaguacaggcaugaacuugaacuccuggccucccaa

SEQ ID NO: 502079 - RNA, 64 nt, Homo Sapiens
uuguagccuuagccuccuaaagugcugggauuauaggcaugagucacuguacccggccugcucu

SEQ ID NO: 502080 - RNA, 64 nt, Homo Sapiens
uccuucucagccugagagggggcccuucggacucaggcaugacucagcccggcugaugccucug

SEQ ID NO: 502081 - RNA, 64 nt, Homo Sapiens
accaccaccucagaguauggagcucagagagggcaggcaugaaguuuccuuggcuggugcaccu

SEQ ID NO: 502082 - RNA, 64 nt, Homo Sapiens
gauuucuugaaaaggguguuagcuaaaggaucuuaggcaugacuguagaauuuguaguugcaau

SEQ ID NO: 502083 - RNA, 64 nt, Homo Sapiens
aacccugucucuacuaaaaauacaaaaauuagccaggcaugauggugcaugccuuuaaacccag

SEQ ID NO: 502084 - RNA, 64 nt, Homo Sapiens
ugcaugccuuuaaacccagcuacugaggaggcugaggcaugagaauugcuugaaccaggagacg

SEQ ID NO: 502085 - RNA, 64 nt, Homo Sapiens
acucagcagggaugacucagcaccgccccucaacaggcaugacucugcagagaugacucagcac

SEQ ID NO: 502086 - RNA, 64 nt, Homo Sapiens
acucagcagggaugacucagcaccgccccucaacaggcaugacucugcagagaugacuuaguac

SEQ ID NO: 502087 - RNA, 64 nt, Homo Sapiens; identical to SEQ ID NO: 502085

SEQ ID NO: 502088 - RNA, 64 nt, Homo Sapiens
caccaugccgggccaugauuagugcagggauuacaggcaugagccacccaccucagccucccaa

SEQ ID NO: 502089 - RNA, 64 nt, Homo Sapiens
cacugugcccggccuaugauagugcugggauuacaggcaugagccacccgccucagccucccaa

SEQ ID NO: 502090 - RNA, 64 nt, Homo Sapiens
ucccccaaggguucugcgaagaggcaguggaagaaggcaugaggagagggucucuugagaauuu

SEQ ID NO: 502091 - RNA, 64 nt, Homo Sapiens
cucccaccucagccugccaaagcacugggauuacaggcaugagccaccaugccuggccaggaca

SEQ ID NO: 502092 - RNA, 64 nt, Homo Sapiens
cuugugccccaaacuuccgaguagcugggacuacaggcaugagucaccacaccuggcugauuuu

SEQ ID NO: 502093 - RNA, 64 nt, Homo Sapiens
cacccgccuuggccucccaaaguguugggauuacaggcaugagccacugcgccugguugccugc

SEQ ID NO: 502094 - RNA, 64 nt, Homo Sapiens
caccacgccuguccgguuauagugcugggauuacaggcaugagcccccugccucggccucccaa

SEQ ID NO: 502095 - RNA, 64 nt, Homo Sapiens
caccgcacccagccugguuaagugcugggauuacaggcaugagccacccgccucagccucccaa

SEQ ID NO: 502096 - RNA, 64 nt, Homo Sapiens
aucgcuugaaccggggaggcuacucaggaggcugaggcaugagaugugugccuguaaugccagc

SEQ ID NO: 502097 - RNA, 64 nt, Homo Sapiens
cacuucgccuagccaagccuagugcuuggauugcaggcaugagcggcucaagcgauccucccaa

SEQ ID NO: 502098 - RNA, 64 nt, Homo Sapiens
gcuccacguccccuagugcacccaugcccugaacaggcaugagagcacgccugccuugcucugc

SEQ ID NO: 502099 - RNA, 64 nt, Homo Sapiens
uuggugagaucuuucuggaauuguuuuguuagggaggcaugauugguuuuuagaaaagcaggau

SEQ ID NO: 502100 - RNA, 64 nt, Homo Sapiens; identical to SEQ ID NO: 157786

SEQ ID NO: 502101 - RNA, 64 nt, Homo Sapiens; identical to SEQ ID NO: 157787

SEQ ID NO: 502102 - RNA, 64 nt, Homo Sapiens; identical to SEQ ID NO: 157788

SEQ ID NO: 502103 - RNA, 64 nt, Homo Sapiens; identical to SEQ ID NO: 157789

SEQ ID NO: 502104 - RNA, 64 nt, Homo Sapiens; identical to SEQ ID NO: 157790

SEQ ID NO: 502105 - RNA, 64 nt, Homo Sapiens; identical to SEQ ID NO: 157791

SEQ ID NO: 502106 - RNA, 64 nt, Homo Sapiens; identical to SEQ ID NO: 157792

SEQ ID NO: 502107 - RNA, 64 nt, Homo Sapiens; identical to SEQ ID NO: 157793

SEQ ID NO: 502108 - RNA, 64 nt, Homo Sapiens; identical to SEQ ID NO: 157794

SEQ ID NO: 502109 - RNA, 64 nt, Homo Sapiens; identical to SEQ ID NO: 157795

SEQ ID NO: 502110 - RNA, 64 nt, Homo Sapiens; identical to SEQ ID NO: 157796

SEQ ID NO: 502111 - RNA, 64 nt, Homo Sapiens; identical to SEQ ID NO: 157797

SEQ ID NO: 502112 - RNA, 64 nt, Homo Sapiens; identical to SEQ ID NO: 157798

SEQ ID NO: 502113 - RNA, 64 nt, Homo Sapiens; identical to SEQ ID NO: 157799

SEQ ID NO: 502114 - RNA, 64 nt, Homo Sapiens; identical to SEQ ID NO: 157800

SEQ ID NO: 502115 - RNA, 64 nt, Homo Sapiens; identical to SEQ ID NO: 157801

SEQ ID NO: 502116 - RNA, 61 nt, Homo Sapiens; identical to SEQ ID NO: 157802

SEQ ID NO: 502117 - RNA, 64 nt, Homo Sapiens; identical to SEQ ID NO: 157803

SEQ ID NO: 502118 - RNA, 64 nt, Homo Sapiens; identical to SEQ ID NO: 157804

SEQ ID NO: 502119 - RNA, 64 nt, Homo Sapiens; identical to SEQ ID NO: 157805

SEQ ID NO: 502120 - RNA, 64 nt, Homo Sapiens; identical to SEQ ID NO: 157806

SEQ ID NO: 502121 - RNA, 64 nt, Homo Sapiens; identical to SEQ ID NO: 157807

SEQ ID NO: 502122 - RNA, 64 nt, Homo Sapiens; identical to SEQ ID NO: 157808

SEQ ID NO: 502123 - RNA, 64 nt, Homo Sapiens; identical to SEQ ID NO: 157809

SEQ ID NO: 502124 - RNA, 64 nt, Homo Sapiens; identical to SEQ ID NO: 157810

SEQ ID NO: 502125 - RNA, 64 nt, Homo Sapiens; identical to SEQ ID NO: 157811

SEQ ID NO: 502126 - RNA, 64 nt, Homo Sapiens; identical to SEQ ID NO: 157812

SEQ ID NO: 502127 - RNA, 64 nt, Homo Sapiens; identical to SEQ ID NO: 157813

SEQ ID NO: 502128 - RNA, 64 nt, Homo Sapiens; identical to SEQ ID NO: 157814

SEQ ID NO: 502129 - RNA, 64 nt, Homo Sapiens
uuuagaggcuuuauauguuguacugaccaagguagguuuguauagcagcccuauacuuugggga

SEQ ID NO: 502130 - RNA, 64 nt, Homo Sapiens
gucauauuauuaguaugaaucucauuucccaaaggguuuguauucugcuaaaaggagaugccaa

SEQ ID NO: 502131 - RNA, 64 nt, Homo Sapiens
guuauuaaaagcauauuguagauuuauuuucucugguuuguacuucaccuaugcagccuuguuu

SEQ ID NO: 502132 - RNA, 64 nt, Homo Sapiens
auuuguguucauaaguucagaaugggacuugagugguuuguagaguggaaggagggaauuuaaa

SEQ ID NO: 502133 - RNA, 64 nt, Homo Sapiens
cuuugggaugcuacuuagugauacaugcuuaacugguuuguacaacuggauuaguacuaauuuu

SEQ ID NO: 502134 - RNA, 64 nt, Homo Sapiens; identical to SEQ ID NO: 279822

SEQ ID NO: 502135 - RNA, 64 nt, Homo Sapiens; identical to SEQ ID NO: 279823

SEQ ID NO: 502136 - RNA, 64 nt, Homo Sapiens; identical to SEQ ID NO: 279824

SEQ ID NO: 502137 - RNA, 64 nt, Homo Sapiens; identical to SEQ ID NO: 279825

SEQ ID NO: 502138 - RNA, 64 nt, Homo Sapiens; identical to SEQ ID NO: 279826

SEQ ID NO: 502139 - RNA, 64 nt, Homo Sapiens; identical to SEQ ID NO: 279827

SEQ ID NO: 502140 - RNA, 64 nt, Homo Sapiens; identical to SEQ ID NO: 279828

SEQ ID NO: 502141 - RNA, 64 nt, Homo Sapiens; identical to SEQ ID NO: 279829

SEQ ID NO: 502142 - RNA, 64 nt, Homo Sapiens; identical to SEQ ID NO: 279830

SEQ ID NO: 502143 - RNA, 64 nt, Homo Sapiens; identical to SEQ ID NO: 279831

SEQ ID NO: 502144 - RNA, 64 nt, Homo Sapiens; identical to SEQ ID NO: 279832

SEQ ID NO: 502145 - RNA, 62 nt, Homo Sapiens; identical to SEQ ID NO: 279833

SEQ ID NO: 502146 - RNA, 64 nt, Homo Sapiens; identical to SEQ ID NO: 279834

SEQ ID NO: 502147 - RNA, 64 nt, Homo Sapiens; identical to SEQ ID NO: 279835

SEQ ID NO: 502148 - RNA, 64 nt, Homo Sapiens; identical to SEQ ID NO: 279836

SEQ ID NO: 502149 - RNA, 64 nt, Homo Sapiens; identical to SEQ ID NO: 279837

SEQ ID NO: 502150 - RNA, 64 nt, Homo Sapiens; identical to SEQ ID NO: 279838

SEQ ID NO: 502151 - RNA, 64 nt, Homo Sapiens; identical to SEQ ID NO: 279839

SEQ ID NO: 502152 - RNA, 64 nt, Homo Sapiens
ggggugucugcaugucccuucacauaauugauaaugguaccaccuucuauaauaauaauauaaa

SEQ ID NO: 502153 - RNA, 64 nt, Homo Sapiens
caccugggggucccagggugguggggguggcaggugguaccacagcucugagagcagauaccag

SEQ ID NO: 502154 - RNA, 64 nt, Homo Sapiens
caaaggacacuuucagcgacagcuauggacagcaugguaccaaggaguuaaguugaggcuuuuu

SEQ ID NO: 502155 - RNA, 64 nt, Homo Sapiens
uaaugauauggaucaucacccagauucucucacuugguaccagcauuucuguagguauuagaga

SEQ ID NO: 502156 - RNA, 64 nt, Homo Sapiens
aaggucuuuggcaagaaucccaggcuugaccaacugguaccaggucaaagauuuuuguauucuu

SEQ ID NO: 502157 - RNA, 64 nt, Homo Sapiens
gggucccgggcggccuuguggcucugguaauguuugguaccaaacuugggggccaaaaagggca

SEQ ID NO: 502158 - RNA, 64 nt, Homo Sapiens
aucuaaacaugacaauaauagacauaucuuuguaugguaccaguuaguuuugccguggaucaga

SEQ ID NO: 502159 - RNA, 64 nt, Homo Sapiens
gacagaaacuuuucuggucaaaaaugaaagguccugguaccaucuuccccagaaacgaucaaga

SEQ ID NO: 502160 - RNA, 64 nt, Homo Sapiens
ccugcuuccuuugccuuacaauugaagcagcccgugguaccaucacaguaugcagagacuuccu

SEQ ID NO: 502161 - RNA, 64 nt, Homo Sapiens
ggcugguuuccccaccccagaaacauguaacgguugguaccaugcuaagcccuugccaugcuaa

SEQ ID NO: 502162 - RNA, 64 nt, Homo Sapiens
aucaauuaugugaagggacaauuauuauagaaggugguaccauuagauguuuuuauuuuauauu

SEQ ID NO: 502163 - RNA, 64 nt, Homo Sapiens
uaguugggauuaccgaagagcguuugcuuggcucugguaccaaagacccagcucccuuuaguca

SEQ ID NO: 502164 - RNA, 64 nt, Homo Sapiens
gugcucagaaacucaagauaguacagacauuccaugguaccagauggcuuuggcgaaggucagu

SEQ ID NO: 502165 - RNA, 64 nt, Homo Sapiens
caggagaaguuuauucuuccgaaaucucauaagcugguaccacuuuaccucuguaucaacucag

SEQ ID NO: 502166 - RNA, 64 nt, Homo Sapiens
ccugggcucugcuggcgagaucucacaguguacuugguaccauccugccaacuccaguaucagc

SEQ ID NO: 502167 - RNA, 64 nt, Homo Sapiens
uauucuuucugcaucuuguaaguuucagcaggauugguaccaguccuccuugauuuuuuggcau

SEQ ID NO: 502168 - RNA, 64 nt, Homo Sapiens
gaagccucacauagugguacuucuggucucacuuugguaccaagccccaaaucccuagagugcu

SEQ ID NO: 502169 - RNA, 64 nt, Homo Sapiens
aggaguacccagggccugguucaggaggccagccugguaccaaaccgagccaacgccucaggaa

SEQ ID NO: 502170 - RNA, 64 nt, Homo Sapiens
uacugauguaaaaaucaugcaaauauuaauguuaugguaccauaauuuccacuaaauggaaccc

SEQ ID NO: 502171 - RNA, 64 nt, Homo Sapiens
aaaagcauuaacaguuauguuccuguuucguuauugguaccaaaacucuugccagauaaccagu

SEQ ID NO: 502172 - RNA, 64 nt, Homo Sapiens
aauauaaauuucucuauccugcucugaggcuaauugguaccauauuuucccuuugugucuugug

SEQ ID NO: 502173 - RNA, 64 nt, Homo Sapiens
acguugaucccaguaaggacaucaccucuacccuugguaccacaacucuguaugggguugccca

SEQ ID NO: 502174 - RNA, 64 nt, Homo Sapiens
gggcaguaccugagggucuguagguugcacacuuugguaccagauaacuuuuuuuuuucuuuau

SEQ ID NO: 502175 - RNA, 64 nt, Homo Sapiens
gcaguacugugaauuuugaaguuaaacuaaauuuugguaccauaccaacuggaauuuaggcuuu

SEQ ID NO: 502176 - RNA, 64 nt, Homo Sapiens
cucuguucuguuccauugaucuauaucuuuguuuugguaccaguaccaugcuguuuugguuacu

SEQ ID NO: 502177 - RNA, 64 nt, Homo Sapiens
cccuugugaggagggggcacuccucuccagccccugguaccacaguccucacgauggugcagug

SEQ ID NO: 502178 - RNA, 64 nt, Homo Sapiens
uucagcccgggagagggggugggcguguucuuugugguaccaaagugggacuaggacaaaaauu

SEQ ID NO: 502179 - RNA, 64 nt, Homo Sapiens
uuacuguauuaguccguuuuaggucccaaucuacugguaccaauauuuuggguauuucuucagc

SEQ ID NO: 502180 - RNA, 64 nt, Homo Sapiens
ccaacuggaauuuaggcuuuguuaaacuaaauuuugguaccauagcaguacugugaauuuugaa

SEQ ID NO: 502181 - RNA, 64 nt, Homo Sapiens
uuuucaguguuggacuugacuacuggccaggaaaugguaccaauuagccccucuguucugugcu

SEQ ID NO: 502182 - RNA, 64 nt, Homo Sapiens
ccucccgagugcaaugcuaaagauaguaaggaugugguaccaauacauccaggaaucugaaguc

SEQ ID NO: 502183 - RNA, 64 nt, Homo Sapiens
gaagagggagaauuaauuuaggugguaaggacucugguaccagguuugugauucaaaguucagg

SEQ ID NO: 502184 - RNA, 64 nt, Homo Sapiens
gcucuuuccuagcuaacccugugggcucccaggaugguaccauugagucuaaucuuucaaggag

SEQ ID NO: 502185 - RNA, 64 nt, Homo Sapiens
ggaaucgaucuguacuguaauugagaugugaugcugguaccacucaguccagaauaagugcugu

SEQ ID NO: 502186 - RNA, 64 nt, Homo Sapiens
gggcgcccaacagcuuuuaucuucuaugaaauggugguaccaagugcuuguuuacaacuaugau

SEQ ID NO: 502187 - RNA, 64 nt, Homo Sapiens
uaaaccucagcagccaucaguuuggccaagugguugguaccaguggaaugaagucuuugauggg

SEQ ID NO: 502188 - RNA, 64 nt, Homo Sapiens
ggaaugugggucugcaccuuguccccucauaggaugguaccaagcauuuagugcacaguggccc

SEQ ID NO: 502189 - RNA, 64 nt, Homo Sapiens
gccucaaaccucuuacggagcuucuccucagaagugguaccaucgccuuccaaagucagcacuc

SEQ ID NO: 502190 - RNA, 64 nt, Homo Sapiens
cccaggacacucaguucuuucaaagaccaggaugugguaccaacuuuggaaacgaaaggucucu

SEQ ID NO: 502191 - RNA, 64 nt, Homo Sapiens
auuagcaaaugaccuucauaccauuuuagcuaugugguaccaaggauguuuaucaauacaacug

SEQ ID NO: 502192 - RNA, 64 nt, Homo Sapiens
agaugucaaaaccugggggccauguaacccacagugguaccauguccucugcuuaauguuaaua

SEQ ID NO: 502193 - RNA, 64 nt, Homo Sapiens
uagaucaaaagcuuuguaacaucagaaccucacuugguaccauaugcucuccuuagucuugguc

SEQ ID NO: 502194 - RNA, 64 nt, Homo Sapiens
guuacaguauaugaucacuaauauaguaugcucuugguaccaggagcucugauauauaucuggu

SEQ ID NO: 502195 - RNA, 64 nt, Homo Sapiens
caaaaguccccagauggcaauacaaaguauccccugguaccacauauauucauuugugaguuug

SEQ ID NO: 502196 - RNA, 64 nt, Homo Sapiens
ucacuacguagagcauucgaaggaaguagaucuuugguaccacuauuuuuauuuggugcuuuuu

SEQ ID NO: 502197 - RNA, 64 nt, Homo Sapiens
gugugaaaugcugggaacaaauguguuuuuuguuugguaccauaccuuuuuuucaaaaaagaaa

SEQ ID NO: 502198 - RNA, 64 nt, Homo Sapiens
auccucaacuuagagaggaaagaaugcaagcuucugguaccaugguaagcacugucaugaucac

SEQ ID NO: 502199 - RNA, 64 nt, Homo Sapiens
ccuagugauugcuggugaaguaauauuggaauuuugguaccaugagaagacuuauaaaggauuu

SEQ ID NO: 502200 - RNA, 64 nt, Homo Sapiens
uccucccuuacugaaccacucucccaccuccuggugguaccauuauuauagaagcccucuacag

SEQ ID NO: 502201 - RNA, 64 nt, Homo Sapiens
uuggucuucuccugaaauucccaaauucacugaaugguaccaugccgaucucugagaaguuaug

SEQ ID NO: 502202 - RNA, 64 nt, Homo Sapiens
ucagcccuaauaaauaauaucuuuuacuauaaugugguaccaccugagggucacuuuucuaaua

SEQ ID NO: 502203 - RNA, 64 nt, Homo Sapiens
uuguuuagauaauuuuaaaauggcaaguuuucuuugguaccaauacauauauacuguuuaagua

SEQ ID NO: 502204 - RNA, 64 nt, Homo Sapiens
gauuacacuuguguuucuacgaaaaaaaaaucuuugguaccaaagagaugguaaaauaggccgg

SEQ ID NO: 502205 - RNA, 64 nt, Homo Sapiens
guuuugucuuuagcuuuucucuaagggcuauguuugguaccaguuuugagagccuagcccaggc

SEQ ID NO: 502206 - RNA, 64 nt, Homo Sapiens
ucugaaaaugcucaguguguacucuaauuauuuaugguaccauuugaauuguaacuugcauuuu

SEQ ID NO: 502207 - RNA, 64 nt, Homo Sapiens
ugcguuacuuuaaguacuaaguaugcagguuuccugguaccauugaguugcugcuauuaaagcu

SEQ ID NO: 502208 - RNA, 64 nt, Homo Sapiens
ucauucaauuauucauaugacaguuguuugaguuugguaccaucuuauuuuccccuuauacaga

SEQ ID NO: 502209 - RNA, 64 nt, Homo Sapiens
cgugaagggcaccgagaacucgaagcccuuccagugguaccagcucacucccugggaaaggggu

SEQ ID NO: 502210 - RNA, 64 nt, Homo Sapiens
ccuguuuuuccuugcaaacucaaaucugugagcuugguaccaaguccagguauaacauuccuau

SEQ ID NO: 502211 - RNA, 64 nt, Homo Sapiens
uggugcuaaagaaaggacuagcauaugagacuucugguaccaauggggcuggugggcaugcugu

SEQ ID NO: 502212 - RNA, 64 nt, Homo Sapiens
uaaaaaugaaauacuuuaugcaaacaggcaaaauugguaccaaagggaaacauuaaccaugagg

SEQ ID NO: 502213 - RNA, 64 nt, Homo Sapiens
cuccugagacacugccuccccagacugcugcugcugguaccaguucugagggccucauuaggcc

SEQ ID NO: 502214 - RNA, 64 nt, Homo Sapiens
uaaaagugguuguaucugaaauuuaauagauguaugguaccauuguuugccuauuuuucaaauu

SEQ ID NO: 502215 - RNA, 64 nt, Homo Sapiens
uucuuagcauuuuuaccugcagaaaaacuuuguaugguaccacuguguugguuauauggugaau

SEQ ID NO: 502216 - RNA, 64 nt, Homo Sapiens
uugggaaacgcuuuggugcuuuucuccaguuuucugguaccaguuacuuguuuauaaacugaac

SEQ ID NO: 502217 - RNA, 64 nt, Homo Sapiens
ccuacccggccucaaauggugcugcugcccaugaugguaccacaccagggccucagccuggccc

SEQ ID NO: 502218 - RNA, 64 nt, Homo Sapiens
gaaugcuacaaaguguauguucaagaaaauuaaaugguaccacucuuccacaguuuggaauaau

SEQ ID NO: 502219 - RNA, 64 nt, Homo Sapiens
ccucucccgacccaggcuuuguggggcaggcaccugguaccaaggguaacccggcuccugguau

SEQ ID NO: 502220 - RNA, 64 nt, Homo Sapiens
agggaggauggacagaccucuugcccucacacucugguaccaggacuguucgcuuuuaugauug

SEQ ID NO: 502221 - RNA, 64 nt, Homo Sapiens
cagcacagccucuuagaugcaguucugaagaagaugguaccaccagucugacuguuuccaucaa

SEQ ID NO: 502222 - RNA, 64 nt, Homo Sapiens
cugaaaauaggagcuauuuaggggcaguuuaaugugguaccaaauuggggucacagaacauuuu

SEQ ID NO: 502223 - RNA, 64 nt, Homo Sapiens
acuacuagggaaaugccuuuaaucauauuguuacugguaccaagccacauuggagauguuuagu

SEQ ID NO: 502224 - RNA, 64 nt, Homo Sapiens
ggcuagaguggacaaaugaguggcaauagaguuuugguaccagauggucagaaaaagcuguaaa

SEQ ID NO: 502225 - RNA, 64 nt, Homo Sapiens
cugucacaacugagcaguucggaggcaacauuaaugguaccagcaaaugcuagauauuggucug

SEQ ID NO: 502226 - RNA, 64 nt, Homo Sapiens
agugagcucauaucuccauuugucagugcuggacugguaccagaucguaaccuucccguugguc

SEQ ID NO: 502227 - RNA, 64 nt, Homo Sapiens
aacuuacauaaugcucugcuuuuuuuuuuucucuugguaccauugguauuauaauaaagagcaa

SEQ ID NO: 502228 - RNA, 64 nt, Homo Sapiens
ugaaggguaauaaaauguacuggauuuuuuaaggugguaccaaaaaugaaugucugucauauau

SEQ ID NO: 502229 - RNA, 64 nt, Homo Sapiens
uuuccauuucuaaagauggacaggcccuuuggcgugguaccaaccagauaaugacugcaucagg

SEQ ID NO: 502230 - RNA, 64 nt, Homo Sapiens
gcccgacaugguggugccaccuccgcgggagcacugguaccaccccauccuccggcugcaggag

SEQ ID NO: 502231 - RNA, 64 nt, Homo Sapiens
cccgcacugggggcaauugaugugccccuuuucaugguaccaggggcuggcaucucccccaccc

SEQ ID NO: 502232 - RNA, 64 nt, Homo Sapiens
cucagucuuaaagcucaggcgccaugacuacccgugguaccaaucccuacgcugccagcaggug

SEQ ID NO: 502233 - RNA, 64 nt, Homo Sapiens
ggauggugaggcgaaggccagcugaccaaaugccugguaccagauuccgauacuaguuugcuuu

SEQ ID NO: 502234 - RNA, 64 nt, Homo Sapiens
ucaccucuauuuugucaguuaagaauuggcccacugguaccaaccauuuuuaaauguccguguu

SEQ ID NO: 502235 - RNA, 64 nt, Homo Sapiens
gguuuuuuguuuuguuuuguucugaagagaagagugguaccauauguugcaggaagucaaacug

SEQ ID NO: 502236 - RNA, 64 nt, Homo Sapiens
cuacugguuuugcauagaucauucaucuuaauuuugguaccaguuaaaaauacaaauguacuau

SEQ ID NO: 502237 - RNA, 64 nt, Homo Sapiens
caugaaucuuuguuucaggucaagagugcacccaugguaccaauuguucucggaguguguaugc

SEQ ID NO: 502238 - RNA, 64 nt, Homo Sapiens
auggaaaugcuauacguuuuugacauuuauuaaaugguaccaauaaaguauuuuauuaccaaaa

SEQ ID NO: 502239 - RNA, 64 nt, Homo Sapiens
cugggccaagaccucccacuccgcccucugaggaugguaccaagaaugggccuuugggacuucu

SEQ ID NO: 502240 - RNA, 64 nt, Homo Sapiens
agaaaaaaaaaugcacucuucccuugccggcuccugguaccauuggucugaacagcuguaguug

SEQ ID NO: 502241 - RNA, 64 nt, Homo Sapiens
acucaggcacuuggauuuuauuuucagggcuuuuugguaccagaccaaaugaaaaauaacaguu

SEQ ID NO: 502242 - RNA, 64 nt, Homo Sapiens
uuuuggaugugugauguuuauccauuuacggcagugguaccauguuuuccuguuuuuuguuuuu

SEQ ID NO: 502243 - RNA, 64 nt, Homo Sapiens
guccucuuaaaagaugccuucuucccaagauaaaugguaccagccaacgcaacgucuaacugga

SEQ ID NO: 502244 - RNA, 64 nt, Homo Sapiens
ugcagcucaagagaucccaacccagcugugcuuaugguaccagaaaagcagucccccaacuacc

SEQ ID NO: 502245 - RNA, 64 nt, Homo Sapiens
acauuucaccuuuagagauggaggauggaaggauugguaccagaagagggcuaagauacguuuu

SEQ ID NO: 502246 - RNA, 64 nt, Homo Sapiens
accagggcuacccagaaaaagugacuugauaacaugguaccaauaaguaagggaugcucucucg

SEQ ID NO: 502247 - RNA, 64 nt, Homo Sapiens
ggccaaaguguacauugagacuggcagccaucuaugguaccacugaaacccugacccagaaaag

SEQ ID NO: 502248 - RNA, 64 nt, Homo Sapiens
cugcugggcuggggccugauggggagggucucggugguaccaggucuccuccaccgccauggcu

SEQ ID NO: 502249 - RNA, 64 nt, Homo Sapiens
aucaugguucuggaggcugggagguccaagagcaugguaccagcaucugcuuggcaucugguga

SEQ ID NO: 502250 - RNA, 64 nt, Homo Sapiens
ugaaccuacugcaaaccaagaauaacucaugaggugguaccaaagaugaaagcccagacuucag

SEQ ID NO: 502251 - RNA, 64 nt, Homo Sapiens
ccagccuguuuucucuuuucuaaaagacaaauuaugguaccauaagcugccaaagauccccucc

SEQ ID NO: 502252 - RNA, 64 nt, Homo Sapiens
uucuccucaugaaaugcaguccccacccauauuuugguaccaguccuucucacaccccccgacu

SEQ ID NO: 502253 - RNA, 64 nt, Homo Sapiens
guaauaauaauaauauaaaucagaugaagaaauuugguaccaaauuugauuugugccauuccuu

SEQ ID NO: 502254 - RNA, 64 nt, Homo Sapiens
augauuucuuugguaauugucaauuuagcaaaauugguaccaaagaaguuucuauuaguauauc

SEQ ID NO: 502255 - RNA, 64 nt, Homo Sapiens
ccuggggcugggccccccaguagugagcugggcaugguaccagcucacucugccagggcagugc

SEQ ID NO: 502256 - RNA, 64 nt, Homo Sapiens
aaaaauuuccaaaacuauuguaagaaggagauauugguaccaaguucugugguugugguggugg

SEQ ID NO: 502257 - RNA, 64 nt, Homo Sapiens
aaggcagacacucuccacuguccagguuauaaccugguaccagcagacuuugcagggaagaaag

SEQ ID NO: 502258 - RNA, 64 nt, Homo Sapiens
auugucuccucucccucugcaugugucuaaaaggugguaccaggcaucccuuuccuggcuuaug

SEQ ID NO: 502259 - RNA, 64 nt, Homo Sapiens
ggcacauccuaugcaauauaucuaaauugaauaaugguaccagauaaaauuauagaugggaaug

SEQ ID NO: 502260 - RNA, 64 nt, Homo Sapiens
caauaccucauauaauacuugcucaacaguauagugguaccaauggcauuaagaugguguuuuu

SEQ ID NO: 502261 - RNA, 64 nt, Homo Sapiens
ccucagacguguucugcacaucccuucuuccuggugguaccaucccuauuuccuggagcaccag

SEQ ID NO: 502262 - RNA, 64 nt, Homo Sapiens
aucuuacuguaacauuuuucuauuaccauguacaugguaccaccauguuguaauuaaugcaaga

SEQ ID NO: 502263 - RNA, 64 nt, Homo Sapiens
ucuauucccauccagagacauccaguggccuagcugguaccacauggcagcugaacucggguag

SEQ ID NO: 502264 - RNA, 64 nt, Homo Sapiens
gaggacaucaucacaggugguaugaggggaaggaugguaccaucccaaggaacaccggccuguu

SEQ ID NO: 502265 - RNA, 64 nt, Homo Sapiens
gugaggugaauaaaacgggacucaguauaguuacugguaccacauuaacuguaaaguaaccuga

SEQ ID NO: 502266 - RNA, 64 nt, Homo Sapiens
gcucucuuuggcuauagacauaauucgaauuuauugguaccaaaaucuaaaaaaaccgauuccc

SEQ ID NO: 502267 - RNA, 64 nt, Homo Sapiens
ugaaauuuuugguuauaaaugugaauauucaaucugguaccaguuaucaacuguguguucgaca

SEQ ID NO: 502268 - RNA, 64 nt, Homo Sapiens
cagcaguuuuuuuuuauugucacagggaaauaaaugguaccagaagucccuuuccuguucuguc

SEQ ID NO: 502269 - RNA, 64 nt, Homo Sapiens
guuaccagcucaacuaaaacgggaaaaaagaaagugguaccaguacuguugaaauccauuggaa

SEQ ID NO: 502270 - RNA, 64 nt, Homo Sapiens
cuuuacuaaugggaaugauuucuguauguucccuugguaccaagagguacuaugcaaaguaacc

SEQ ID NO: 502271 - RNA, 64 nt, Homo Sapiens
guggggcggacggaaaaggggugggcaucccuccugguaccaagcugcugggugcgaaggcaga

SEQ ID NO: 502272 - RNA, 64 nt, Homo Sapiens
acucucugccacugaacauucugcucugauuuugugguaccaguuuauauccccuuugcuucua

SEQ ID NO: 502273 - RNA, 64 nt, Homo Sapiens
cuuuaccucauuucaagaaaauaagcauugcacuugguaccaugguucuguucauguagcacag

SEQ ID NO: 502274 - RNA, 64 nt, Homo Sapiens
cccaaacuccaagacagccauacuuccagcgaaaugguaccaaggagaggucuugcucacaggg

SEQ ID NO: 502275 - RNA, 64 nt, Homo Sapiens
cuaccuuaauuuaaccuguggccaaacucagagaugguaccagccaggggcaagcaugaccaga

SEQ ID NO: 502276 - RNA, 64 nt, Homo Sapiens
gaucccuacucaugacacggaggugacucgugagugguaccaacaaacucaugagcagcagcaa

SEQ ID NO: 502277 - RNA, 64 nt, Homo Sapiens
gaagaguacagugagagguuaauuucugcucaagugguaccacuuaaaggcauguauucuuuua

SEQ ID NO: 502278 - RNA, 64 nt, Homo Sapiens
cugacuugaaauucauaaacaugccuauaaagucugguaccagauuuggggguacuuagcuucc

SEQ ID NO: 502279 - RNA, 64 nt, Homo Sapiens
gaauaucacuguauuuggaggaagucuuaacccuugguaccacacucccuaaaauuucuauguu

SEQ ID NO: 502280 - RNA, 64 nt, Homo Sapiens
ggcuuccaggggccccaggagaagcugggcugugugguaccaacagccccgagggguggccuug

SEQ ID NO: 502281 - RNA, 64 nt, Homo Sapiens
gguuuauuggguugcagauauugggggagcugcaugguaccaggcagcuuugguugcacugaau

SEQ ID NO: 502282 - RNA, 64 nt, Homo Sapiens
aaagaggauauucuaggcuuccagcggcgcagggugguaccaggucucaucucacacugugagu

SEQ ID NO: 502283 - RNA, 64 nt, Homo Sapiens
ucugagucaaggguugugucucugcagcagccucugguaccaccagcugaugcaacaggauuug

SEQ ID NO: 502284 - RNA, 64 nt, Homo Sapiens
uuucuucgggaaaguuuugauccgagugcuuuuuugguaccacgagacccggcccucugccagc

SEQ ID NO: 502285 - RNA, 64 nt, Homo Sapiens
caugggcccacaggguaccaggauaaagccgaacugguaccaucuacucuuuugaaguguuuua

SEQ ID NO: 502286 - RNA, 64 nt, Homo Sapiens
cagcgagucaguagaagcccuggcuggccccacuugguaccaauccaccaggcagcucagggcu

SEQ ID NO: 502287 - RNA, 64 nt, Homo Sapiens
uccgucaggaauuuuguagaagggcuucaugugcugguaccaauaggacaggaagauuuuaauc

SEQ ID NO: 502288 - RNA, 64 nt, Homo Sapiens
aaagacuuuugaauaaauaaacugaacucacaccugguaccacucagaaccuccaacugacuga

SEQ ID NO: 502289 - RNA, 64 nt, Homo Sapiens
auuuuaaaaaaucucuuacagguuuucuugcagcugguaccauccaugucucacagcccuggcc

SEQ ID NO: 502290 - RNA, 64 nt, Homo Sapiens
augugguaaagccuucaguaguuccaguuccuuuugguaccaugaaaggacucacacuggagag

SEQ ID NO: 502291 - RNA, 64 nt, Homo Sapiens
gcuacaaggcuacauaaccaaaauagcaugguacugguaccaaaacagagauauagaucaauag

SEQ ID NO: 502292 - RNA, 64 nt, Homo Sapiens
accuucucaagaccucagugggagcaccagccaaugguaccaucggcugggcugccagguaccc

SEQ ID NO: 502293 - RNA, 64 nt, Homo Sapiens
gcuggaggccccggcggcuaggaggaggccucggugguaccagaagaggaggggcugaugugaa

SEQ ID NO: 502294 - RNA, 64 nt, Homo Sapiens
augcauccccaugacccacaauuggaacaaagggugguaccaaaaggguggaggggcuguguuu

SEQ ID NO: 502295 - RNA, 64 nt, Homo Sapiens
uagaauucuuccagcagccuaaucacuugaugggugguaccaccuuguuucuugaguguuuccu

SEQ ID NO: 502296 - RNA, 64 nt, Homo Sapiens
acuccgcggcggggccgccggcccccucaacaucugguaccagcguuccguaaguggaagccca

SEQ ID NO: 502297 - RNA, 64 nt, Homo Sapiens
guagaaacaaggugcauccuagagaugguucagcugguaccagacauggagggggcugagugac

SEQ ID NO: 502298 - RNA, 64 nt, Homo Sapiens
ucccgccccucgccccccaccccugcauccaggaugguaccagcgccugccaaucgaagcccgu

SEQ ID NO: 502299 - RNA, 64 nt, Homo Sapiens
aauuuucuuuaaaccaucugguuuuuaagaaauuugguaccaaaaauugaugaguagaggcaaa

SEQ ID NO: 502300 - RNA, 64 nt, Homo Sapiens
aauguccaccuucuuuccugugugugauuuauuaugguaccaaaaagcaauauggaugugugag

SEQ ID NO: 502301 - RNA, 64 nt, Homo Sapiens
agggacccauggcugacugagggucacaagucucugguaccaaagcagaagagguucgagucca

SEQ ID NO: 502302 - RNA, 64 nt, Homo Sapiens
accuuuuguucacagcgugcgccugagaccagccugguaccagguacugguauuuuuuucacgu

SEQ ID NO: 502303 - RNA, 64 nt, Homo Sapiens
gcacuccagccugggugacagcagugagcucugaugguaccacugacuccaggaggcgcaggcu

SEQ ID NO: 502304 - RNA, 64 nt, Homo Sapiens
caaggcagacuugcaagaacgugaugcucugugcugguaccaaaccccggcacacuuagugaca

SEQ ID NO: 502305 - RNA, 64 nt, Homo Sapiens
uaggugucugugucucaaaauuuauuguaaucauugguaccauugguggccucaacagaggcca

SEQ ID NO: 502306 - RNA, 64 nt, Homo Sapiens
gaugccccugacccuugacaaaucuaucggugcuugguaccagcaugagcuaacuuuauggcuc

SEQ ID NO: 502307 - RNA, 64 nt, Homo Sapiens
aaaggggagcgaugagcuguggaggaagcccuggugguaccagaggccagaauggugggaaaga

SEQ ID NO: 502308 - RNA, 64 nt, Homo Sapiens
gguugugcccucagcagugaagccucacagggucugguaccaggggugcccuuacugaggugac

SEQ ID NO: 502309 - RNA, 64 nt, Homo Sapiens
agagcugcucacuuagggccggagggguuccccuugguaccaggaaccuggccugggugugcag

SEQ ID NO: 502310 - RNA, 64 nt, Homo Sapiens
auuguacugugauuuucauaacccguugccuuuuugguaccagagcuacgugguuugaauucug

SEQ ID NO: 502311 - RNA, 64 nt, Homo Sapiens
aaaaugucaccuuuuuauuauugacauuaaguaaugguaccauauauuuuuuaaaauacauauu

SEQ ID NO: 502312 - RNA, 64 nt, Homo Sapiens
caaggcauccucacaacaaagaagagaugugauuugguaccauuucacaccagcaggugucugg

SEQ ID NO: 502313 - RNA, 64 nt, Homo Sapiens
ggugggggcaaagagacccagucaauuacauguuugguaccaagaaaggaaccugucagggcag

SEQ ID NO: 502314 - RNA, 64 nt, Homo Sapiens
gaaguuucuagaggugaaaaggcagaaucuuaaaugguaccauuggugucacugggaggagaaa

SEQ ID NO: 502315 - RNA, 64 nt, Homo Sapiens
ugugacuuuucuauuucuccuugggcgugcucugugguaccagcaagaggagacagcugugaag

SEQ ID NO: 502316 - RNA, 64 nt, Homo Sapiens
guguaagcugauagcacaagcucagugagauauuugguaccaugcaacagcccugugaagugac

SEQ ID NO: 502317 - RNA, 64 nt, Homo Sapiens
ucuguaccauaugagaaagucccaucccccaggcugguaccagugacugacccaugggacuccu

SEQ ID NO: 502318 - RNA, 64 nt, Homo Sapiens
gccuauggaaaggguguggcggugggucuuggauugguaccagagaauggugggcuccagagua

SEQ ID NO: 502319 - RNA, 64 nt, Homo Sapiens
uugauaugacuugucaauauucauuaaauuuagcugguaccagggaauucaguggaacuuaucu

SEQ ID NO: 502320 - RNA, 64 nt, Homo Sapiens
agauuauucagccaugcuucuugcuucugugcuaugguaccagcccaaacaagaauugauuaua

SEQ ID NO: 502321 - RNA, 64 nt, Homo Sapiens
ccgugaacaccugcuuccucuccugguggacaugugguaccagaucagcaugacuucaccucca

SEQ ID NO: 502322 - RNA, 64 nt, Homo Sapiens
aucucauuggauuuuggauuuuagguaauuuccuugguaccagcucaucugaugaaauuuuguu

SEQ ID NO: 502323 - RNA, 64 nt, Homo Sapiens
ucuuugcaaaguaaggaggacuaagggaaaaugaugguaccauguaacagaaugagagcuaauu

SEQ ID NO: 502324 - RNA, 64 nt, Homo Sapiens
gcccucccuuggccgcccuacuccccaguuuccuggcgaugagccauuuauugugucucacacc

SEQ ID NO: 502325 - RNA, 64 nt, Homo Sapiens
gaacugcugauggacaaaugguaccaggagagcuggcgaugacuuguuucugaaguguucgagg

SEQ ID NO: 502326 - RNA, 64 nt, Homo Sapiens
ggaacaaguguaauuuccuucccuccuuuaaccuggcgaugagcguccuuuaaaccacugugcc

SEQ ID NO: 502327 - RNA, 64 nt, Homo Sapiens
auuuaauguuugauuuaguaauaguccaauauuuggcgaugagguaauucucccuaaggaaucu

SEQ ID NO: 502328 - RNA, 64 nt, Homo Sapiens
ucugggagguguacccaacagcucauugagagcgggcgaugaugacaguggcggcuuuguggag

SEQ ID NO: 502329 - RNA, 64 nt, Homo Sapiens
acuuugccagagccugagagagcgauguccucgaggcgaugauauucucaccauccugacugaa

SEQ ID NO: 502330 - RNA, 64 nt, Homo Sapiens
uccccccacacugcucaggggaggggagggaucaggcgaugagacugugaggccaaaagaaggg

SEQ ID NO: 502331 - RNA, 64 nt, Homo Sapiens
agaaaaggcaauaaacggcccaacuagugcuucuggcgaugacauuucuaagcuacagcguacu

SEQ ID NO: 502332 - RNA, 64 nt, Homo Sapiens
auuuacuuaauggguacaaugaggguuggcagggggcgaugauacuggagacuuggaagaguug

SEQ ID NO: 502333 - RNA, 64 nt, Homo Sapiens
uaagaguaguggggugggugccuuuuguggagagggcgaugaaucuaccuuuuuugccuuuugu

SEQ ID NO: 502334 - RNA, 64 nt, Homo Sapiens
cacacuccccgccguacaguucuccagaaucccaggcgaugacaagucugaacccacgaaaaua

SEQ ID NO: 502335 - RNA, 64 nt, Homo Sapiens
agccucucccaggcgggagucuaccauccgagacggcgaugacaaagagcuucauuccacauuc

SEQ ID NO: 502336 - RNA, 64 nt, Homo Sapiens
uuuaaacuuuuaaaggaucaugagcuguuucuugggcgaugaauguucucaaucagaaaacuga

SEQ ID NO: 502337 - RNA, 64 nt, Homo Sapiens
gcuuuuugcacgacacaggguuccccaggggcagggcgaugaaugccaggagcccgguggcccc

SEQ ID NO: 502338 - RNA, 64 nt, Homo Sapiens
cagagauguguuaguguugugcuuugccuucuuuggcgaugaaugucagaaauugaaugccaca

SEQ ID NO: 502339 - RNA, 64 nt, Homo Sapiens
guugcugcaggcggaacugagaccagccucucugggcgaugaaggacaauggugguagggccac

SEQ ID NO: 502340 - RNA, 64 nt, Homo Sapiens
acccgaaggugggagggaggcaauugcugaagguggcgaugaacugggaacugagaggugccag

SEQ ID NO: 502341 - RNA, 64 nt, Homo Sapiens
acuaaaugcuuuuuugacuaccccucagagggacggcgaugagccaguugccuuucugacggcc

SEQ ID NO: 502342 - RNA, 64 nt, Homo Sapiens
ccucuccucaaaugcugugugcugcaauuguccaggcgaugacaauggugauggcuccagagaa

SEQ ID NO: 502343 - RNA, 64 nt, Homo Sapiens
cccaguauuagcacaaguuagggaggaagaggcaggcgaugagucuaguagcacccaggacggc

SEQ ID NO: 502344 - RNA, 64 nt, Homo Sapiens
gcgagggcgcggggaggggugugacuccggcagcggcgaugaggccuggacguggauggcgcca

SEQ ID NO: 502345 - RNA, 64 nt, Homo Sapiens
cagaguccccuggucaagucguugccuuugugggggcgaugaaggaaccucaggccuagacuag

SEQ ID NO: 502346 - RNA, 64 nt, Homo Sapiens
uuugcagcauuaaaaaauggacugucccuagaggggcgaugagcgacccagacauauccuuugc

SEQ ID NO: 502347 - RNA, 64 nt, Homo Sapiens
guggcucccgcucucugaccugcuggggagaucuggcgaugacuugcccugaugggccaugaga

SEQ ID NO: 502348 - RNA, 64 nt, Homo Sapiens
uugagcaguaggauauaaauuccaaucacaccuuggcgaugaccguugcaauuuuuugaauuuu

SEQ ID NO: 502349 - RNA, 64 nt, Homo Sapiens
uuauuugcggagcauuucugcuguucgcaucaguggcgaugacuagagguaccugguggcugcc

SEQ ID NO: 502350 - RNA, 64 nt, Homo Sapiens
caaagaagacagagaggucaggacagugugagaaggcgaugaucuuuuucagaaucaagaggga

SEQ ID NO: 502351 - RNA, 64 nt, Homo Sapiens
uguuuugugcgucucuucuccccccugcuugugcggcgaugaucgcugagcccgcccgcccucg

SEQ ID NO: 502352 - RNA, 64 nt, Homo Sapiens
guuguuucuaugccuucugaagaaagggaggaugggcgaugacaccuugucccgccucauccac

SEQ ID NO: 502353 - RNA, 64 nt, Homo Sapiens
uuucugaccugaaugaaauauucagggacuuaggggcgaugauuguagaacagguacgugagcu

SEQ ID NO: 502354 - RNA, 64 nt, Homo Sapiens
gccccacauggucagugaguuucuccccauguguggcgaugagagaguguagaaauaaagacac

SEQ ID NO: 502355 - RNA, 64 nt, Homo Sapiens
uacgguggggaaggugccuagccugccugcccugggcgaugagguacgagaucuagccugcccu

SEQ ID NO: 502356 - RNA, 64 nt, Homo Sapiens
auuauuacaagaagaaaccaauaagcuaauuaagggcgaugauuucggcaacaucuggagaagc

SEQ ID NO: 502357 - RNA, 64 nt, Homo Sapiens
acaauaaaaucaaguuuaagucaucaccacugauggcgaugauugagaaaccaaauuggacaaa

SEQ ID NO: 502358 - RNA, 64 nt, Homo Sapiens
acaauaaaaucaaguuugaguccucacuaccaauggcgaugauugagaaaccaaauuggacaaa

SEQ ID NO: 502359 - RNA, 64 nt, Homo Sapiens
uggcacagccccagucggaaacagcagaggcaccggcgaugaagcucagaagaggagagccggc

SEQ ID NO: 502360 - RNA, 63 nt, Homo Sapiens
gauggaaggaggguagggaacccccuucuccugaaucagcagguuuuguuuucuuuguuuuuu

SEQ ID NO: 502361 - RNA, 63 nt, Homo Sapiens
caccauggauuauauucuuuuuucuccccuuugaaucagcagagauacuaaaugacagccuug

SEQ ID NO: 502362 - RNA, 63 nt, Homo Sapiens
auauuguaauaaagaaaucuauuuuuauaauuaaaucagcaaagaaaugaccauuucccuugu

SEQ ID NO: 502363 - RNA, 63 nt, Homo Sapiens
gaaauuuucauaguuaaauugaggugacauucgaaucagcaauaaauuucaacaaagguucca

SEQ ID NO: 502364 - RNA, 63 nt, Homo Sapiens
auccauaccaaaacaacgacccccuccuauuuuaaucagcaaagggguuaucuuuuuuuuuuu

SEQ ID NO: 502365 - RNA, 63 nt, Homo Sapiens
auauuaugccuaaaguaaauaucaaugggcuuaaaucagcaaaugcucagauuuguguguuca

SEQ ID NO: 502366 - RNA, 63 nt, Homo Sapiens
cauggugggagaguuuacaucacaaccacuacaaaucagcacuugcuuucuucuucuuaaaga

SEQ ID NO: 502367 - RNA, 63 nt, Homo Sapiens
acuaauuucugcugcagcaucacgaucagggcaaaucagcacagccccccagccaucaguggu

SEQ ID NO: 502368 - RNA, 63 nt, Homo Sapiens
ucuguaccuggagagagaguuuaggcaaauaacaaucagcaaggaaaccuucaccagugagaa

SEQ ID NO: 502369 - RNA, 63 nt, Homo Sapiens
acaaaaaaccauacacacacacacacacacacaaaucagcaucauaagggaauguagccuucc

SEQ ID NO: 502370 - RNA, 63 nt, Homo Sapiens
gaaaaugggggcaggugagaaguccauuuugagaaucagcauaguaaauuacauuucuaaucc

SEQ ID NO: 502371 - RNA, 63 nt, Homo Sapiens
uuaauauuuucuuuugucaccccagaggugaaaaaucagcaguugaagccugacaggccucag

SEQ ID NO: 502372 - RNA, 63 nt, Homo Sapiens
aaaugcacccaucagcacucuguaaaacgcaccaaucagcacucuguaaaaugcaccaaucag

SEQ ID NO: 502373 - RNA, 63 nt, Homo Sapiens
aaacgcaccaaucagcacucuguaaaaugcaccaaucagcaggauucuaaaaguagacaauca

SEQ ID NO: 502374 - RNA, 63 nt, Homo Sapiens
cucuguaucuagcucaagguuuguaaacacaccaaucagcacccugugucuagcucaguguuu

SEQ ID NO: 502375 - RNA, 63 nt, Homo Sapiens
cuuugugucuagcucagggaucguaaacgcaccaaucagcacccugucaaaacagaccacuug

SEQ ID NO: 502376 - RNA, 63 nt, Homo Sapiens
aaacagaccacuugacucucuguaaaauggaccaaucagcaggauguggguggggcgagacaa

SEQ ID NO: 502377 - RNA, 63 nt, Homo Sapiens
ccucagauaacugcuuuaugagacgggagucaaaaucagcauccuauaauaaagauuucccug

SEQ ID NO: 502378 - RNA, 63 nt, Homo Sapiens
uuugacuucuuaguagccacgugaaaagcccaaaaucagcaaaugacuuuggagaguuucaaa

SEQ ID NO: 502379 - RNA, 63 nt, Homo Sapiens
ugauuuuuguacgaaaaaaagcuuuguuauagaaaucagcauacuauuuuuuuaaaucuggag

SEQ ID NO: 502380 - RNA, 63 nt, Homo Sapiens
uacgguaaaugaggacucagcacagccaaccauaaucagcaugucugggauagacuggucuag

SEQ ID NO: 502381 - RNA, 63 nt, Homo Sapiens
acaugggcggggacaauaaguguaaaauggaccaaucagcaggagauggaccaaucagcgcuc

SEQ ID NO: 502382 - RNA, 63 nt, Homo Sapiens
cuguaagauggaccaaucaguguaaaauggaccaaucagcacuuuucugucuuacaagaggau

SEQ ID NO: 502383 - RNA, 64 nt, Homo Sapiens; identical to SEQ ID NO: 154250

SEQ ID NO: 502384 - RNA, 64 nt, Homo Sapiens; identical to SEQ ID NO: 154251

SEQ ID NO: 502385 - RNA, 64 nt, Homo Sapiens; identical to SEQ ID NO: 154252

SEQ ID NO: 502386 - RNA, 64 nt, Homo Sapiens; identical to SEQ ID NO: 154253

SEQ ID NO: 502387 - RNA, 64 nt, Homo Sapiens; identical to SEQ ID NO: 154254

SEQ ID NO: 502388 - RNA, 64 nt, Homo Sapiens; identical to SEQ ID NO: 154255

SEQ ID NO: 502389 - RNA, 64 nt, Homo Sapiens; identical to SEQ ID NO: 154256

SEQ ID NO: 502390 - RNA, 64 nt, Homo Sapiens; identical to SEQ ID NO: 154257

SEQ ID NO: 502391 - RNA, 64 nt, Homo Sapiens; identical to SEQ ID NO: 154258

SEQ ID NO: 502392 - RNA, 64 nt, Homo Sapiens; identical to SEQ ID NO: 154259

SEQ ID NO: 502393 - RNA, 64 nt, Homo Sapiens; identical to SEQ ID NO: 154260

SEQ ID NO: 502394 - RNA, 64 nt, Homo Sapiens; identical to SEQ ID NO: 154261

SEQ ID NO: 502395 - RNA, 64 nt, Homo Sapiens; identical to SEQ ID NO: 154262

SEQ ID NO: 502396 - RNA, 64 nt, Homo Sapiens; identical to SEQ ID NO: 154263

SEQ ID NO: 502397 - RNA, 64 nt, Homo Sapiens; identical to SEQ ID NO: 154264

SEQ ID NO: 502398 - RNA, 64 nt, Homo Sapiens; identical to SEQ ID NO: 154265

SEQ ID NO: 502399 - RNA, 64 nt, Homo Sapiens; identical to SEQ ID NO: 154266

SEQ ID NO: 502400 - RNA, 64 nt, Homo Sapiens; identical to SEQ ID NO: 154267

SEQ ID NO: 502401 - RNA, 64 nt, Homo Sapiens; identical to SEQ ID NO: 154268

SEQ ID NO: 502402 - RNA, 64 nt, Homo Sapiens; identical to SEQ ID NO: 154269

SEQ ID NO: 502403 - RNA, 64 nt, Homo Sapiens; identical to SEQ ID NO: 154270

SEQ ID NO: 502404 - RNA, 64 nt, Homo Sapiens; identical to SEQ ID NO: 154271

SEQ ID NO: 502405 - RNA, 64 nt, Homo Sapiens; identical to SEQ ID NO: 154272

SEQ ID NO: 502406 - RNA, 64 nt, Homo Sapiens; identical to SEQ ID NO: 154273

SEQ ID NO: 502407 - RNA, 64 nt, Homo Sapiens; identical to SEQ ID NO: 154274

SEQ ID NO: 502408 - RNA, 64 nt, Homo Sapiens; identical to SEQ ID NO: 154275

SEQ ID NO: 502409 - RNA, 64 nt, Homo Sapiens; identical to SEQ ID NO: 154276

SEQ ID NO: 502410 - RNA, 64 nt, Homo Sapiens; identical to SEQ ID NO: 154277

SEQ ID NO: 502411 - RNA, 64 nt, Homo Sapiens; identical to SEQ ID NO: 154278

SEQ ID NO: 502412 - RNA, 64 nt, Homo Sapiens; identical to SEQ ID NO: 376100

SEQ ID NO: 502413 - RNA, 64 nt, Homo Sapiens; identical to SEQ ID NO: 376101

SEQ ID NO: 502414 - RNA, 64 nt, Homo Sapiens; identical to SEQ ID NO: 376102

SEQ ID NO: 502415 - RNA, 64 nt, Homo Sapiens; identical to SEQ ID NO: 376103

SEQ ID NO: 502416 - RNA, 64 nt, Homo Sapiens; identical to SEQ ID NO: 376104

SEQ ID NO: 502417 - RNA, 64 nt, Homo Sapiens; identical to SEQ ID NO: 376105

SEQ ID NO: 502418 - RNA, 64 nt, Homo Sapiens; identical to SEQ ID NO: 376106

SEQ ID NO: 502419 - RNA, 64 nt, Homo Sapiens; identical to SEQ ID NO: 376107

SEQ ID NO: 502420 - RNA, 64 nt, Homo Sapiens; identical to SEQ ID NO: 376108

SEQ ID NO: 502421 - RNA, 64 nt, Homo Sapiens; identical to SEQ ID NO: 376109

SEQ ID NO: 502422 - RNA, 64 nt, Homo Sapiens; identical to SEQ ID NO: 376110

SEQ ID NO: 502423 - RNA, 64 nt, Homo Sapiens; identical to SEQ ID NO: 376111

SEQ ID NO: 502424 - RNA, 64 nt, Homo Sapiens; identical to SEQ ID NO: 376112

SEQ ID NO: 502425 - RNA, 64 nt, Homo Sapiens; identical to SEQ ID NO: 376113

SEQ ID NO: 502426 - RNA, 64 nt, Homo Sapiens; identical to SEQ ID NO: 376114

SEQ ID NO: 502427 - RNA, 57 nt, Homo Sapiens; identical to SEQ ID NO: 376115

SEQ ID NO: 502428 - RNA, 64 nt, Homo Sapiens; identical to SEQ ID NO: 376116

SEQ ID NO: 502429 - RNA, 64 nt, Homo Sapiens; identical to SEQ ID NO: 376117

SEQ ID NO: 502430 - RNA, 64 nt, Homo Sapiens; identical to SEQ ID NO: 376118

SEQ ID NO: 502431 - RNA, 64 nt, Homo Sapiens; identical to SEQ ID NO: 376119

SEQ ID NO: 502432 - RNA, 64 nt, Homo Sapiens; identical to SEQ ID NO: 376120

SEQ ID NO: 502433 - RNA, 64 nt, Homo Sapiens; identical to SEQ ID NO: 376121

SEQ ID NO: 502434 - RNA, 64 nt, Homo Sapiens; identical to SEQ ID NO: 376122

SEQ ID NO: 502435 - RNA, 64 nt, Homo Sapiens; identical to SEQ ID NO: 376123

SEQ ID NO: 502436 - RNA, 64 nt, Homo Sapiens; identical to SEQ ID NO: 376124

SEQ ID NO: 502437 - RNA, 64 nt, Homo Sapiens; identical to SEQ ID NO: 376125

SEQ ID NO: 502438 - RNA, 64 nt, Homo Sapiens; identical to SEQ ID NO: 376126

SEQ ID NO: 502439 - RNA, 64 nt, Homo Sapiens; identical to SEQ ID NO: 376127

SEQ ID NO: 502440 - RNA, 64 nt, Homo Sapiens; identical to SEQ ID NO: 376128

SEQ ID NO: 502441 - RNA, 64 nt, Homo Sapiens; identical to SEQ ID NO: 376129

SEQ ID NO: 502442 - RNA, 64 nt, Homo Sapiens; identical to SEQ ID NO: 376130

SEQ ID NO: 502443 - RNA, 64 nt, Homo Sapiens; identical to SEQ ID NO: 376131

SEQ ID NO: 502444 - RNA, 64 nt, Homo Sapiens; identical to SEQ ID NO: 376132

SEQ ID NO: 502445 - RNA, 64 nt, Homo Sapiens; identical to SEQ ID NO: 376133

SEQ ID NO: 502446 - RNA, 64 nt, Homo Sapiens; identical to SEQ ID NO: 376134

SEQ ID NO: 502447 - RNA, 64 nt, Homo Sapiens; identical to SEQ ID NO: 376135

SEQ ID NO: 502448 - RNA, 64 nt, Homo Sapiens; identical to SEQ ID NO: 376136

SEQ ID NO: 502449 - RNA, 64 nt, Homo Sapiens; identical to SEQ ID NO: 376137

SEQ ID NO: 502450 - RNA, 64 nt, Homo Sapiens; identical to SEQ ID NO: 376138

SEQ ID NO: 502451 - RNA, 64 nt, Homo Sapiens; identical to SEQ ID NO: 376139

SEQ ID NO: 502452 - RNA, 64 nt, Homo Sapiens; identical to SEQ ID NO: 376140

SEQ ID NO: 502453 - RNA, 64 nt, Homo Sapiens; identical to SEQ ID NO: 376141

SEQ ID NO: 502454 - RNA, 64 nt, Homo Sapiens; identical to SEQ ID NO: 376142

SEQ ID NO: 502455 - RNA, 64 nt, Homo Sapiens; identical to SEQ ID NO: 376143

SEQ ID NO: 502456 - RNA, 64 nt, Homo Sapiens; identical to SEQ ID NO: 376144

SEQ ID NO: 502457 - RNA, 64 nt, Homo Sapiens; identical to SEQ ID NO: 376145

SEQ ID NO: 502458 - RNA, 64 nt, Homo Sapiens; identical to SEQ ID NO: 376146

SEQ ID NO: 502459 - RNA, 64 nt, Homo Sapiens; identical to SEQ ID NO: 376147

SEQ ID NO: 502460 - RNA, 64 nt, Homo Sapiens; identical to SEQ ID NO: 376148

SEQ ID NO: 502461 - RNA, 64 nt, Homo Sapiens; identical to SEQ ID NO: 376149

SEQ ID NO: 502462 - RNA, 64 nt, Homo Sapiens; identical to SEQ ID NO: 376150

SEQ ID NO: 502463 - RNA, 64 nt, Homo Sapiens
ucuugccucagccucccaaguagcugggaugacaggcgcacaccaccacgcccagcaaauuuuu

SEQ ID NO: 502464 - RNA, 64 nt, Homo Sapiens
uugugccucggccucccuaguagcugggauuacaggcgcacaccaccacacacagcuaauuuuu

SEQ ID NO: 502465 - RNA, 64 nt, Homo Sapiens
ccuccugccguugucaucugcagcucacccacgcggcgcacacccacccccaccccgcggauca

SEQ ID NO: 502466 - RNA, 64 nt, Homo Sapiens
aggcccaguucucagggguuagagcagcaggagaggcgcacagacuccccaaaagagagucagg

SEQ ID NO: 502467 - RNA, 64 nt, Homo Sapiens
ggugcccgccaggaucugugccgagcuugagcugggcgcacagacgcugccagggagccgccau

SEQ ID NO: 502468 - RNA, 64 nt, Homo Sapiens
uccugcaguugggccagcugucgcaucucagcggggcgcacauguuauccacaagcaauggacc

SEQ ID NO: 502469 - RNA, 64 nt, Homo Sapiens
uguaaucccagcuacuuggguagacgggcaugguggcgcacaccucuacugaaaacacaaaaau

SEQ ID NO: 502470 - RNA, 64 nt, Homo Sapiens
gauguuuuguuuagcuugcgcuacaaaaugaucuggcgcacaggacugacucccacaggagagg

SEQ ID NO: 502471 - RNA, 61 nt, Homo Sapiens
ccaaaauacaaauuggacaggcauuauucuuggcgcacaguggaucuuuaaaaaggauuga

SEQ ID NO: 502472 - RNA, 64 nt, Homo Sapiens
uacuaaaaauacgaaaaaauuagcugggcaugguggcgcacaccuguagucccagcuacuccgg

SEQ ID NO: 502473 - RNA, 64 nt, Homo Sapiens
cucuacuaaaaauacaaaauuagccagaugugguggcgcacaccuguaaucccagcuacucagg

SEQ ID NO: 502474 - RNA, 64 nt, Homo Sapiens
caugcauuaaaaaauuuuucaagcugggccuaguggcgcacaccugcaaucccaacacuuuggg

SEQ ID NO: 502475 - RNA, 64 nt, Homo Sapiens
uguauucccaucuagucagguagcugggcauuguggcgcacaccucuacaaaaaacacaaaaau

SEQ ID NO: 502476 - RNA, 64 nt, Homo Sapiens
gaccgaggcgcauagagaccugaggcgggaccgaggcgcacagacggagacgccacccggugcu

SEQ ID NO: 502477 - RNA, 64 nt, Homo Sapiens
accaugccccauauaacgcuugggugcgugggagggcgcacaucagggcagaggccaaguucca

SEQ ID NO: 502478 - RNA, 64 nt, Homo Sapiens
ccucucaagacugaauggugaggccagguacaguggcgcacaccuguaaucccagcuacucuga

SEQ ID NO: 502479 - RNA, 64 nt, Homo Sapiens
ccaggcucaagccucccgaauagcugggacuacaggcgcacaccaccauccccggcuaauuuuu

SEQ ID NO: 502480 - RNA, 64 nt, Homo Sapiens
caugcagccccugauguucuuagagggaaacugaggcgcacaccaguaggcaguuugggggcgg

SEQ ID NO: 502481 - RNA, 64 nt, Homo Sapiens
cacagugcacguccacagugagggugcacgcuauggcgcacacaccuagcuggggagcagaguu

SEQ ID NO: 502482 - RNA, 64 nt, Homo Sapiens
ggaacucauuuggaacuccccgugaggaggucgaggcgcacagggcaagcaggaagaggcgagg

SEQ ID NO: 502483 - RNA, 64 nt, Homo Sapiens
cggucucagucuuuaauccuggcagggauucacgggcgcacacacacacacucaggauucagau

SEQ ID NO: 502484 - RNA, 64 nt, Homo Sapiens
uauaaucucagcuacucaggcagccaggcaugguggcgcacacccucuacuaaaaauauaaaau

SEQ ID NO: 502485 - RNA, 64 nt, Homo Sapiens
ccgacguguccugaagguguaggcucuccacuuaggcgcacaagcugacggcugcagccagcag

SEQ ID NO: 502486 - RNA, 64 nt, Homo Sapiens
cagcaccaagcaccacgcucucauccugcaagucggcgcacacaguggaugaaggcaggagacc

SEQ ID NO: 502487 - RNA, 64 nt, Homo Sapiens
uccggcugcaggaccagguggugaucaucgacgaggcgcacaaccugaucgacaccaucacggg

SEQ ID NO: 502488 - RNA, 64 nt, Homo Sapiens
uuguguuuuggauuuuaggagaauacuuaucucuggcgcacaucacuauauuuggcugccucug

SEQ ID NO: 502489 - RNA, 64 nt, Homo Sapiens
uccagacuguucccuucgcaaacgugcacacauaggcgcacacaaagaaccauguuuuaggaag

SEQ ID NO: 502490 - RNA, 64 nt, Homo Sapiens
cuucagugcagugugguguagguguuacgcgaagggcgcacagugucuagaaauacuugaucgu

SEQ ID NO: 502491 - RNA, 64 nt, Homo Sapiens
ugggccucgguggcgagguggucguucuggcaaaggcgcacacugacuuugacguccaggccuu

SEQ ID NO: 502492 - RNA, 64 nt, Homo Sapiens
gagacccaggagugccugauugucccacagggguggcgcacagcucugggaccacucagaagau

SEQ ID NO: 502493 - RNA, 64 nt, Homo Sapiens
ucuacuaaaauacaaaaaauuagcugggcaugguggcgcacaccuguagucccagcuacucugg

SEQ ID NO: 502494 - RNA, 64 nt, Homo Sapiens
uuuaacugcuuuguuauguaagcuuacccagcccggcgcacagugacucacgccuguaauccca

SEQ ID NO: 502495 - RNA, 64 nt, Homo Sapiens
gaaguccccuuccaucccagagggugggcuucagggcgcacagcaugagaggcucugugccccc

SEQ ID NO: 502496 - RNA, 64 nt, Homo Sapiens
gcagggcugugggcugcauacuggccgagcugcuggcgcacaggccucuucuccccggcacuuc

SEQ ID NO: 502497 - RNA, 64 nt, Homo Sapiens
gugagcccgcccccacgucgaagagugugggggaggcgcacaguugagcaccacacccaguggg

SEQ ID NO: 502498 - RNA, 64 nt, Homo Sapiens
uguaauccuagcuacucggguagccgggcaugguggcgcacaccucuacuaaaaaugcaaaaac

SEQ ID NO: 502499 - RNA, 64 nt, Homo Sapiens
gugauugagguuaugcuggcaccacucgcacacaggcgcacaaugguguuagcugggcagaaag

SEQ ID NO: 502500 - RNA, 64 nt, Homo Sapiens
cucggccccgccccggcuuugcggagcggggcggggcgcacaaguagccccgcgcgccaggcag

SEQ ID NO: 502501 - RNA, 64 nt, Homo Sapiens
auccuccucucagccugagugccuugaccucccaggcgcacaaaugccaucaugacucacugca

SEQ ID NO: 502502 - RNA, 64 nt, Homo Sapiens
gaggggccgaugcugccaccgcaccuggaauuggggcgcacaggagaccucucgccucuacgug

SEQ ID NO: 502503 - RNA, 64 nt, Homo Sapiens
cgcagaagagcaacaugaagcugcacaugaagcgggcgcacagcuaugcuggugagaaugcugc

SEQ ID NO: 502504 - RNA, 64 nt, Homo Sapiens
uucaucccucucaaguaauggcucagcuaauaaaggcgcacaugacuccaguccuuugcgcagc

SEQ ID NO: 502505 - RNA, 64 nt, Homo Sapiens
aggaagggggcagagagaguuaugaccccgagagggcgcacagaccaagcgugagcuccacgcg

SEQ ID NO: 502506 - RNA, 64 nt, Homo Sapiens
caggggcgcgcuccacuucguugcacgcggguccggcgcacaguucccgggcgagugggcugug

SEQ ID NO: 502507 - RNA, 64 nt, Homo Sapiens
uccugccucagccucuugaguagcugggacuacaggcgcacaccaccacgccaggcuaauuuuu

SEQ ID NO: 502508 - RNA, 64 nt, Homo Sapiens
uuagcagcaaagaauucucacaaaugugaauaugggcgcacauuugccucauaaagcacagcau

SEQ ID NO: 502509 - RNA, 64 nt, Homo Sapiens
ccgcuggggcccggggguguggggcgguguggcgggcgcacacuguauguaccuauaauaaacc

SEQ ID NO: 502510 - RNA, 64 nt, Homo Sapiens
agggccuggaguggugggauuggucccagugccuggcgcacauuggccugcagaguagauuaac

SEQ ID NO: 502511 - RNA, 64 nt, Homo Sapiens
ucccgccucagccuccugagcagcugggauuacaggcgcacaucaccaugcccaaccuccaagu

SEQ ID NO: 502512 - RNA, 64 nt, Homo Sapiens
ggccucaugaagucucagguccguguucccgcagggcgcacaugcuuggagaguccucagcagg

SEQ ID NO: 502513 - RNA, 64 nt, Homo Sapiens
gugggcggcuuccucaagcccggaggagcucccaggcgcacaggggccgccgguaacaggggcc

SEQ ID NO: 502514 - RNA, 64 nt, Homo Sapiens
ccaaguagggagcuagucagccugaaguguggguggcgcacacaagcauccugagauuuuaaau

SEQ ID NO: 502515 - RNA, 64 nt, Homo Sapiens
accacgcccaacugauuuuuuagcugagauuacaggcgcacaccuucugccucagcuucccaag

SEQ ID NO: 502516 - RNA, 64 nt, Homo Sapiens
gaaaugagagcccggcgcauucauugggagcuuaggcgcacaugucucgcuggcaucuguagua

SEQ ID NO: 502517 - RNA, 64 nt, Homo Sapiens
caagugcccuguuguguggaacacuucacauauuggcgcacaguacguaaggaggucucaugug

SEQ ID NO: 502518 - RNA, 64 nt, Homo Sapiens
ugcacacguccagcugcgccugggcuuggguagugagugacauggcugagugacaucccaagcu

SEQ ID NO: 502519 - RNA, 64 nt, Homo Sapiens
ccaagcuugggcuuggguaggggccuggggagcugagugacaucgucccgggccgagugagguc

SEQ ID NO: 502520 - RNA, 64 nt, Homo Sapiens
cugucucaaaaaauaaaauacagccugggcaacagagugacacucagaucgcgacacugcacuc

SEQ ID NO: 502521 - RNA, 64 nt, Homo Sapiens
auggaggguacaauugccagacucauggccaggagagugacaccccaccaagaggccaccuguc

SEQ ID NO: 502522 - RNA, 64 nt, Homo Sapiens
acaaauaaucauuacuuucaaagacuuaaaacuggagugacaggagacauaagaaaggaaagaa

SEQ ID NO: 502523 - RNA, 64 nt, Homo Sapiens
uccuaaccucuccuuguuuucgucaugaaagcacgagugacagcaaaugcuuuggauuuagaag

SEQ ID NO: 502524 - RNA, 64 nt, Homo Sapiens
gcgagacuccaucucuuuaacugcacuccagccugagugacagacaaugagccaugauuuccca

SEQ ID NO: 502525 - RNA, 64 nt, Homo Sapiens
uuuccucaaaaagcagaaggcaggcggagcugcugagugacagccccaguccaugcuccagggu

SEQ ID NO: 502526 - RNA, 64 nt, Homo Sapiens
auuucaaaaccaaggaagcagccucagaguggucgagugacacaccucacgcaggcugagucca

SEQ ID NO: 502527 - RNA, 64 nt, Homo Sapiens
uugcuuguaaucaagccuuuauggcugcugggcugagugacacaagcacuuuaauggccuggag

SEQ ID NO: 502528 - RNA, 64 nt, Homo Sapiens
cccagcagaggccuuagucccauuuggggcuugggagugacauuugcuugaggcuuauacacug

SEQ ID NO: 502529 - RNA, 64 nt, Homo Sapiens
agugaacagagacagugccacugcacaucagccugagugacagagagacuuugucucaaaaaaa

SEQ ID NO: 502530 - RNA, 64 nt, Homo Sapiens
ggccucuggagaaugcaaguaugcagacagcugugagugacaugcucacucuuccuucucugaa

SEQ ID NO: 502531 - RNA, 64 nt, Homo Sapiens
uuaugacauuuccaugucaaguguucugaccagggagugacaggcuuuucagugaucuggauaa

SEQ ID NO: 502532 - RNA, 64 nt, Homo Sapiens
uggcuguucagguggaccaaccuuucucuuggcugagugacaggugauuguacaacuuaaagcu

SEQ ID NO: 502533 - RNA, 64 nt, Homo Sapiens
gcuagaagaccccagagagauccugggcugggcagagugacagugcuucgugggcacagacacc

SEQ ID NO: 502534 - RNA, 64 nt, Homo Sapiens
ccugggcccugccccucuccccacauguaucccucggucugaauuagacauuccugggcacagg

SEQ ID NO: 502535 - RNA, 64 nt, Homo Sapiens
agaauuuucccuuuuuuuuuuuuuuuuugagacacggucugacucugucacccaggcuagagua

SEQ ID NO: 502536 - RNA, 64 nt, Homo Sapiens
auagcauugucauuucuucuuuccugagcuuuuccggucugaggccuccugccggagagucugc

SEQ ID NO: 502537 - RNA, 59 nt, Homo Sapiens
ccaaccucacguuuucuuaggucugaggccggucugaggccggucagaggccaggauug

SEQ ID NO: 502538 - RNA, 64 nt, Homo Sapiens
gacucgaguauccaacaggcagucagagcucucccggucugaaaguugcauugccacugcuaac

SEQ ID NO: 502539 - RNA, 64 nt, Homo Sapiens
aaauccaaguuuuauucucuaaaugggaagcauacggucugaauugucccccacucugcacccc

SEQ ID NO: 502540 - RNA, 64 nt, Homo Sapiens
uuagcauggggcuagauuaacuggacccauccuucggucugaccacagggcugacugcacaaag

SEQ ID NO: 502541 - RNA, 64 nt, Homo Sapiens
ccucgggcugcaacccugucugugccagauugcccggucugacccugcaggaagcaaagaggug

SEQ ID NO: 502542 - RNA, 64 nt, Homo Sapiens
uuuagacgaucacagaaacgagucacucauucuucggucugaauagauuuuucauguaucuuau

SEQ ID NO: 502543 - RNA, 64 nt, Homo Sapiens
ugagcuggacgucgcgguguguccucugugcccacggucugagcuagcuagcgcaccgccgagu

SEQ ID NO: 502544 - RNA, 64 nt, Homo Sapiens
gcaugcauucaugaguccauuugguagcaauaugcggucugaauagcauauucccacauuccau

SEQ ID NO: 502545 - RNA, 64 nt, Homo Sapiens
cgccuuccuccgugacgccuugccguccccugugcggucugaugccaaacaauaucaaugguga

SEQ ID NO: 502546 - RNA, 64 nt, Homo Sapiens
cuauggcccagaaacaacaggggaaacuagaguucggucugacaguccuugggguuaagucucc

SEQ ID NO: 502547 - RNA, 64 nt, Homo Sapiens
uucauccuggcaaaaacaaauguauuguacaucucggucugaacgucugcaccgucaucuagau

SEQ ID NO: 502548 - RNA, 64 nt, Homo Sapiens
aagggaacagaaggucaugaaggcaucucgccugcggucugaggacaggcauccggccuugccc

SEQ ID NO: 502549 - RNA, 64 nt, Homo Sapiens
aauauacauauguuaauucuaguccuggaugacucggucugagaagauucaauuuaaaaucaga

SEQ ID NO: 502550 - RNA, 64 nt, Homo Sapiens
ugaaugcaccuggaaugacauuuguaacagaagacggucugacuugcuuucaguauucacaagu

SEQ ID NO: 502551 - RNA, 64 nt, Homo Sapiens
aaauaauuuguaguaaccuuacucugagguuuuacggucugauaaugaagcacuugcaugagua

SEQ ID NO: 502552 - RNA, 64 nt, Homo Sapiens
auuaccugagacgaccagcacugggaguuagguacggucugaaguuaugucuagauaagacuuc

SEQ ID NO: 502553 - RNA, 64 nt, Homo Sapiens
ccauggaggugguugcugcagcagaaaacuccggcggucugaggugacaacuguggaaaggcga

SEQ ID NO: 502554 - RNA, 64 nt, Homo Sapiens
gucccagccacccaccccccacucccaggacuugcggucugagccuuuuuggauaauuaauaaa

SEQ ID NO: 502555 - RNA, 64 nt, Homo Sapiens
uuuccuacagggagaugccugucaaucucugccccggucugaugcugcuguuguggguugcuuu

SEQ ID NO: 502556 - RNA, 64 nt, Homo Sapiens
ccaccuguucccacccucuuguggcuuugcugcacggucugaaagccuuaaaacuuaccuggca

SEQ ID NO: 502557 - RNA, 64 nt, Homo Sapiens
ugcccccaccucugucucccugucuucuuuagaucggucugauugauuuuaaaaguggacccaa

SEQ ID NO: 502558 - RNA, 64 nt, Homo Sapiens
gaaaagcagcccacucuuguaacacagucuuccucggucugagagaggacguccuuuucuaagc

SEQ ID NO: 502559 - RNA, 64 nt, Homo Sapiens
auauuaaauggaaaauucuuucugcggucaaccacggucugacaacuuuccauggguucaguua

SEQ ID NO: 502560 - RNA, 64 nt, Homo Sapiens
gguguggccuuuauauuugaucuuugaguagguucggucugaaaaauuauugcaaaguaaagga

SEQ ID NO: 502561 - RNA, 64 nt, Homo Sapiens
ugcuuuccaugcugccaucuccccacggaggccgcggucugaacgcgggcacuggacccccggg

SEQ ID NO: 502562 - RNA, 64 nt, Homo Sapiens
ucuugagcccauacucaauaaauucaaacauguacggucugacuucaguaaacaguggagcugg

SEQ ID NO: 502563 - RNA, 64 nt, Homo Sapiens
agugagcaaagucuugaauuccuucuaaaaauuacggucugacucuagucaggaugcuccuauu

SEQ ID NO: 502564 - RNA, 64 nt, Homo Sapiens
agaagaagcaacaauggccaacgaagcacugaugcggucugaggagacagcugaccuguuggcu

SEQ ID NO: 502565 - RNA, 64 nt, Homo Sapiens
aacaccucauuacaccgaaggacaccgagguucacggucugaguguucccguugcgcaguugag

SEQ ID NO: 502566 - RNA, 64 nt, Homo Sapiens
ucgcccucccacuccgccaccuccguccacaccucggucugaugggcgaggucagccugcugcu

SEQ ID NO: 502567 - RNA, 64 nt, Homo Sapiens
gagcgagagcagaagaaauugagcgagagagagagcgagagagacaaaaaaaaaaaaaaaaagc

SEQ ID NO: 502568 - RNA, 64 nt, Homo Sapiens
gagcgagagagagagcgagaaaaaaaaaaagcgagcgagagagaaaguugaaaagacaaaaaaa

SEQ ID NO: 502569 - RNA, 59 nt, Homo Sapiens
augcuguaugaauggaaaucauuuugcaauugagugacacuucauuguaauucacagug

SEQ ID NO: 502570 - RNA, 59 nt, Homo Sapiens
uuucuccagacaggaaagcuuuagaaaacuugagugaaauggagcaagcuugaaggagu

SEQ ID NO: 502571 - RNA, 59 nt, Homo Sapiens
aaggccucgggcuuggcaaauggaagaacuugagugagaguucagucugcaguccucug

SEQ ID NO: 502572 - RNA, 59 nt, Homo Sapiens
auucuuucauugacagcugacauaauucauugagugaaauauuuuaagccaaaaaaaaa

SEQ ID NO: 502573 - RNA, 59 nt, Homo Sapiens
cagauggagauaaggauuccagauggcacuugagugaagaugagaauagauccuaugug

SEQ ID NO: 502574 - RNA, 59 nt, Homo Sapiens
cacugacccccguugaccaggcugccuucuugagugaggugcugcggcggaccugccac

SEQ ID NO: 502575 - RNA, 59 nt, Homo Sapiens
aggcucuccccaucuccccugcuuugguguugagugaugagcugagucagggauaggga

SEQ ID NO: 502576 - RNA, 59 nt, Homo Sapiens
uuaaugaaucuugcuuucuaauaaauaaauugagugauucugguugcauuccuauuucc

SEQ ID NO: 502577 - RNA, 59 nt, Homo Sapiens
acuuacucauagugguuguuucucuggucuugagugacuguguccacaguucauuuuuu

SEQ ID NO: 502578 - RNA, 59 nt, Homo Sapiens
guuuuuaauggcucaacugucugauguaauugagugaagguuugcacugagaaauuagc

SEQ ID NO: 502579 - RNA, 59 nt, Homo Sapiens
auuuugagcuuaucugucuuauuuaugcuuugagugaaucaucuguugaggucuaaugc

SEQ ID NO: 502580 - RNA, 59 nt, Homo Sapiens
gcacuggaaacaguuucauggaguuuaaguugagugaacaucggccaugaaaauccauc

SEQ ID NO: 502581 - RNA, 59 nt, Homo Sapiens
cuuuugagaugacauuauugucuccauaauugagugauagcuuuaaaaaaaagauuagu

SEQ ID NO: 502582 - RNA, 59 nt, Homo Sapiens
acuaaacguuucgguagaaugcuucauacuugagugaugcuggauaagguauuguauuu

SEQ ID NO: 502583 - RNA, 59 nt, Homo Sapiens
ugaaaucauuccaguauauuugggaagaauugagugaaugagaaugcucuuccuuauuc

SEQ ID NO: 502584 - RNA, 59 nt, Homo Sapiens
agccaugguugcaccacugcucuccaggcuugagugacagagcaagacuguaucucaaa

SEQ ID NO: 502585 - RNA, 59 nt, Homo Sapiens
uuggguauaggguugaggggaaauaaguuuugagugagaaauaaacguuuuagcugaaa

SEQ ID NO: 502586 - RNA, 59 nt, Homo Sapiens
ugcacaauuuuuaugucuaguauguaugcuugagugaaugugcgaguaugaaugauuag

SEQ ID NO: 502587 - RNA, 59 nt, Homo Sapiens
cugucuucugggcaauauuucuaaaauauuugagugacauugauguuuaagugaccucc

SEQ ID NO: 502588 - RNA, 59 nt, Homo Sapiens
acaucucaaguacguaaauuaaguugucauugagugaaagguucacuuggaccuagugc

SEQ ID NO: 502589 - RNA, 59 nt, Homo Sapiens
auagguuauauuucccaaaucuuuaauuauugagugaaagagcuauagaugaauugaua

SEQ ID NO: 502590 - RNA, 59 nt, Homo Sapiens
cauuugacugagaccacauggugugccccuugagugaggcuaaucuuuagguuuuuccu

SEQ ID NO: 502591 - RNA, 59 nt, Homo Sapiens
cugaacuuguugcgacagagguuaccugcuugagugaucaucauugugcguugugugcg

SEQ ID NO: 502592 - RNA, 59 nt, Homo Sapiens
cccaaaaacuugcuuucucugccuaggucuugagugaacaggcacuugaccuggcugua

SEQ ID NO: 502593 - RNA, 59 nt, Homo Sapiens
cuaucagcacagccuuccuuaaagcuggguugagugaggugccuccugcagaacuuuga

SEQ ID NO: 502594 - RNA, 59 nt, Homo Sapiens
cugaaggcuggguuugaaaagccauucaguugagugagggggcccaggacccagucuug

SEQ ID NO: 502595 - RNA, 59 nt, Homo Sapiens
gcacugggagaucagggcagaagaugacuuugagugaugcauuuccuugcacaaacagu

SEQ ID NO: 502596 - RNA, 59 nt, Homo Sapiens
ucccaaucauguccuguuuugacacauucuugagugaaacuuacaaauucuucaauaaa

SEQ ID NO: 502597 - RNA, 59 nt, Homo Sapiens
cagaaagcucuuuugaaaagaggagaucauugagugacccaaagaaguggauaagaggg

SEQ ID NO: 502598 - RNA, 59 nt, Homo Sapiens
ggcaggaaagggccaucuccguucuagauuugagugaauuugugagccacauauuggga

SEQ ID NO: 502599 - RNA, 59 nt, Homo Sapiens
guaagggaaagaauaucuuauuggaaugguugagugagguuugcaguauucuccccuga

SEQ ID NO: 502600 - RNA, 59 nt, Homo Sapiens
caaauuucaucuauuuuauuaucaccaaauugagugauagaacuauaguuuuuacuagu

SEQ ID NO: 502601 - RNA, 59 nt, Homo Sapiens
aacaauugggcuaaugaagagaguaggaauugagugauaguggaagaaaccaugggcag

SEQ ID NO: 502602 - RNA, 59 nt, Homo Sapiens
gccuguuuaugaugacugagguuuaccccuugagugaauguauguuuggcucauuacug

SEQ ID NO: 502603 - RNA, 59 nt, Homo Sapiens
ggagggugaggcugccgaugguuuuaagcuugagugaaaauaucugugcagaacacggu

SEQ ID NO: 502604 - RNA, 59 nt, Homo Sapiens
ucuuaucugaaauuuugcuaugcaugucuuugagugacucauuugccuucgguccucaa

SEQ ID NO: 502605 - RNA, 59 nt, Homo Sapiens
uggucagcuaacaagucuucgucuguguguugagugagccagccagaccugcguugugu

SEQ ID NO: 502606 - RNA, 59 nt, Homo Sapiens
uguauauauuuauauauaaauauaucuauuugagugaaaccuugugaacucuuuaauua

SEQ ID NO: 502607 - RNA, 59 nt, Homo Sapiens
uauucauucuuuaugcaaugaggguauuuuugagugaauuuuaacugcucugaacuaag

SEQ ID NO: 502608 - RNA, 59 nt, Homo Sapiens
aacaguuugguuuuuaauggcugugguauuugagugaggcaacucuggggcauuuguua

SEQ ID NO: 502609 - RNA, 59 nt, Homo Sapiens
uugucacuuagaauaauauguacuacuacuugagugagcgcuuuuggaaguuauaucaa

SEQ ID NO: 502610 - RNA, 59 nt, Homo Sapiens
uggaccaggaaggcauauguauuuugaacuugagugaaaagguugaaguuacagacuuu

SEQ ID NO: 502611 - RNA, 59 nt, Homo Sapiens
augaaggaaauuuuuuucugaauguagguuugagugaggggcaccucugcuuucccuua

SEQ ID NO: 502612 - RNA, 59 nt, Homo Sapiens
ccaaggagacccugccacaugcuggcccuuugagugagaaugcugcaucuuucuacaua

SEQ ID NO: 502613 - RNA, 59 nt, Homo Sapiens
uaugccaguaauauaguguuguaugccuauugagugauuguggcaagaaaagcuacagc

SEQ ID NO: 502614 - RNA, 59 nt, Homo Sapiens
aaaaaauaaauuaggcccaauccaagaaauugagugagaaggaaacacuuguuuuauuc

SEQ ID NO: 502615 - RNA, 59 nt, Homo Sapiens
caaccugcaaaccuuuaagaacuguccuuuugagugacucaguccaauugccagagaag

SEQ ID NO: 502616 - RNA, 59 nt, Homo Sapiens
aucugacagaucauucuagaccaguguuguugagugaaaauguauagaagagaucugau

SEQ ID NO: 502617 - RNA, 59 nt, Homo Sapiens
uuaaauagagagguuuucggaauucauaauugagugauaauuccucugaaagcaaaaca

SEQ ID NO: 502618 - RNA, 59 nt, Homo Sapiens
ucuggaguuagacauagauuuuccaaacuuugagugauuaacauuguucgguucacacg

SEQ ID NO: 502619 - RNA, 59 nt, Homo Sapiens
cccgucaugugcacuugggucugguggaguugagugaugacgaggaguugggagccugc

SEQ ID NO: 502620 - RNA, 59 nt, Homo Sapiens
gagcuaacccuuaucuguaauuuaaagaguugagugauacuggauauucauauaaacuu

SEQ ID NO: 502621 - RNA, 59 nt, Homo Sapiens
agggaaaaaaaucuacaguaagauauaacuugagugaguauagauauaaagcuuuacuu

SEQ ID NO: 502622 - RNA, 59 nt, Homo Sapiens
auuacuacuagguaauaauaaugggagacuugagugauaauaggggauuuuaaaacucu

SEQ ID NO: 502623 - RNA, 59 nt, Homo Sapiens
uauuccuugauuuaaauuggcuuuugugauugagugaaacuuuauaaagcauaugguca

SEQ ID NO: 502624 - RNA, 59 nt, Homo Sapiens
agggcgguauggaaggcaggcuguacugguugagugaauggaaaguuggggaguagaac

SEQ ID NO: 502625 - RNA, 59 nt, Homo Sapiens
ggaguaggugugaguugauaauguugaaguugagugaucaguacguggguuuauuacac

SEQ ID NO: 502626 - RNA, 59 nt, Homo Sapiens
gaauuuauugcugaaucaugcuccaguauuugagugauguuuuaaauauccuaugucug

SEQ ID NO: 502627 - RNA, 59 nt, Homo Sapiens
uuaaccucagugcucaacuauuugaacuguugagugauaaaggaaacaaauauaacugu

SEQ ID NO: 502628 - RNA, 59 nt, Homo Sapiens
gugggauaggucccaugucaaaggaacuuuugagugaugacucugagaaguugaauugc

SEQ ID NO: 502629 - RNA, 59 nt, Homo Sapiens
cuaaucauguaaaguaagaggugugaaccuugagugauauuuuuagcuauuuuuuccau

SEQ ID NO: 502630 - RNA, 59 nt, Homo Sapiens
gacuuacaaagggaguguuuagguguuccuugagugacagagacugauguauaauggac

SEQ ID NO: 502631 - RNA, 59 nt, Homo Sapiens
gggagauauaagccaaggauauguagucauugagugagguaauaaaauuaguuugcauc

SEQ ID NO: 502632 - RNA, 59 nt, Homo Sapiens
cuggggcagagaggccugggcugagcagauugagugauguccccugcagcagucgagga

SEQ ID NO: 502633 - RNA, 59 nt, Homo Sapiens
caggugaaauuuagagucaugcaaucaauuugagugacuagaggcaauauuuucuacuu

SEQ ID NO: 502634 - RNA, 59 nt, Homo Sapiens
cuguuuacauuuagaauaauaaaaaagaguugagugaaucucugaaguuuucuacaaca

SEQ ID NO: 502635 - RNA, 59 nt, Homo Sapiens
acuucuccgugaaccugcugggucguccuuugagugacacaggcgcacguugguuucuu

SEQ ID NO: 502636 - RNA, 59 nt, Homo Sapiens
cuccaacuucauuugaugcuucgcuuacuuugagugauccugcugaagguuguaagugg

SEQ ID NO: 502637 - RNA, 59 nt, Homo Sapiens
cucaagacuggaaaacaauagcauuugucuugagugaggaagugaagcccgcuguguuc

SEQ ID NO: 502638 - RNA, 59 nt, Homo Sapiens
gcacacaacacacacugaguaaauauuuguugagugaaauaaaaucaagaaacaaguaa

SEQ ID NO: 502639 - RNA, 59 nt, Homo Sapiens
gagaaaaagagguugauugaauugugccuuugagugaacccaguuuuuaaauaccgcug

SEQ ID NO: 502640 - RNA, 59 nt, Homo Sapiens
auuuuguuaauuacaguguuuuugguucauugagugaagauucugccgggugggaucuu

SEQ ID NO: 502641 - RNA, 59 nt, Homo Sapiens
cguauuugaaguaacugagauuuccauuguugagugaaguagcccucacuuucaugcca

SEQ ID NO: 502642 - RNA, 59 nt, Homo Sapiens
guuguuuaccaggcacugugcucaggcacuugagugacaucacucauuucuauucauuc

SEQ ID NO: 502643 - RNA, 59 nt, Homo Sapiens
auacagaagggguguuugagcaaugaugguugagugaaauccuuauguaucaucuaaua

SEQ ID NO: 502644 - RNA, 59 nt, Homo Sapiens
gggcagcagcgguggagucuuuaaucaccuugagugacuguuagcucucaccuguaggu

SEQ ID NO: 502645 - RNA, 59 nt, Homo Sapiens
auuuguaaaauuaugaauauaaucuaauauugagugauuaauauguuacuguauuaauu

SEQ ID NO: 502646 - RNA, 59 nt, Homo Sapiens
aacauaaaauggcuugguaauucuuugcauugagugagguucuucagauuauguuuuau

SEQ ID NO: 502647 - RNA, 59 nt, Homo Sapiens
gaugaauaccugugaggauaacucuuccauugagugaauauuuuuguguguaguugauu

SEQ ID NO: 502648 - RNA, 59 nt, Homo Sapiens
cuuuuggugagcucagcugaccugucugauugagugagcaauagucaaaaauguguuua

SEQ ID NO: 502649 - RNA, 59 nt, Homo Sapiens
caaucuuuguacaaugacuaaaaaauuuauugagugaaaaguguaacugcauuucuaau

SEQ ID NO: 502650 - RNA, 59 nt, Homo Sapiens
cuuuuuuuuaaugugcauuauuaaaaauauugagugaagcuaauugucaacuuuauuaa

SEQ ID NO: 502651 - RNA, 59 nt, Homo Sapiens
uuucucuccccuauggauuuugcuaaugguugagugauaccuaaaggccuuguugcauu

SEQ ID NO: 502652 - RNA, 59 nt, Homo Sapiens
guuuccucuagaacugaauuccucuggaauugagugauggacuucacaacaacuagcca

SEQ ID NO: 502653 - RNA, 59 nt, Homo Sapiens
uuuaagcuguaaaaagagagaaaacuuauuugagugauuauuuguuauuuguacaguuc

SEQ ID NO: 502654 - RNA, 59 nt, Homo Sapiens
cuucaaaggacccugacauuucuuaacacuugagugaaugacgcugcauuccagaaacg

SEQ ID NO: 502655 - RNA, 58 nt, Homo Sapiens
gugaaagaggaaugugggagccuguuuguugagugauuuggaccuaggggauguguga

SEQ ID NO: 502656 - RNA, 59 nt, Homo Sapiens
ggugguuaggagaaagacuuguuguuguuuugagugaauaacaggugcuagagaccacu

SEQ ID NO: 502657 - RNA, 59 nt, Homo Sapiens
ucauugggauaaaugguccaagauaaaguuugagugaguagccugucaugauauguuuu

SEQ ID NO: 502658 - RNA, 59 nt, Homo Sapiens
guuauuauuuguauuugauguuuuaaaaauugagugaggacauuaucaauauaccaaug

SEQ ID NO: 502659 - RNA, 59 nt, Homo Sapiens
augcaaaaguuuaauuuuuaaauaguagcuugagugaauuauaagacaguauguauagu

SEQ ID NO: 502660 - RNA, 59 nt, Homo Sapiens
cuagugaaaccaaauagaaaucaaguucuuugagugauauguuaaagcauuagccugug

SEQ ID NO: 502661 - RNA, 59 nt, Homo Sapiens
guauguauaaccugguggguuuuacaugauugagugagaacaaauaaagaauucaauuc

SEQ ID NO: 502662 - RNA, 59 nt, Homo Sapiens
ugcuaacagcaauuucauagugaguggcuuugagugacaggacuugauacccucugaga

SEQ ID NO: 502663 - RNA, 59 nt, Homo Sapiens
agcccgggacaacagccagugucccgucuuugagugacaagaacuggaaggagacaucu

SEQ ID NO: 502664 - RNA, 59 nt, Homo Sapiens
ugugcaucuggagguguugcggcagagguuugagugaacccucuuucaaagacaauaaa

SEQ ID NO: 502665 - RNA, 59 nt, Homo Sapiens
auuuuauaaaugaggaaacggaggcuuaguugagugagcugaccaauaucacccagcca

SEQ ID NO: 502666 - RNA, 59 nt, Homo Sapiens
aguuaucaugauggugcugauugcccaccuugagugagggguggauaaacuaccccugc

SEQ ID NO: 502667 - RNA, 59 nt, Homo Sapiens
uugcugcgggaguuuggcuggccaggaacuugagugacauugaccucauggcaccucag

SEQ ID NO: 502668 - RNA, 59 nt, Homo Sapiens
aaggcccuucuaacuuccagauuguaugcuugagugauggguccccagcccaagcccac

SEQ ID NO: 502669 - RNA, 59 nt, Homo Sapiens
gaggaagaguuucuauuaaaaucugucacuugagugaugucauucaaguccuauuuuag

SEQ ID NO: 502670 - RNA, 59 nt, Homo Sapiens
gcaaaaccaaauaaaguggagaugagugauugagugagguagauugcugucccguuaac

SEQ ID NO: 502671 - RNA, 59 nt, Homo Sapiens
uuggugaaagaaagcacaucgcuccugaguugagugauuaaauugcuggacuauuugug

SEQ ID NO: 502672 - RNA, 59 nt, Homo Sapiens
cuccugcgucagccucccgacucccggguuugagugauucggcucacugcaaccucugc

SEQ ID NO: 502673 - RNA, 59 nt, Homo Sapiens
uucugaucuagauuugaaaggcaguaggcuugagugaacaaaaccagugucaggccuuu

SEQ ID NO: 502674 - RNA, 59 nt, Homo Sapiens
agcagacauguuuaagggucccaaauggauugagugauggguguggacggaaagggugg

SEQ ID NO: 502675 - RNA, 59 nt, Homo Sapiens
acaucaggcacagaccuucaauucauauuuugagugaauucaacuauuuaaucaucaug

SEQ ID NO: 502676 - RNA, 59 nt, Homo Sapiens
uacaaaaaagaaugauguuuaaaauugcuuugagugauucauacagagauguauauaug

SEQ ID NO: 502677 - RNA, 59 nt, Homo Sapiens
aagaggcuguuuguguuuaacuuauaauauugagugauccaugaaguagguuuucagag

SEQ ID NO: 502678 - RNA, 59 nt, Homo Sapiens
agagaggcucuugugguuaacugauaauauugagugaugcaugagguagguguucagag

SEQ ID NO: 502679 - RNA, 59 nt, Homo Sapiens
ccgacuucccccuugcuguucucgugauauugagugagcgcuugugggaucugguuguu

SEQ ID NO: 502680 - RNA, 59 nt, Homo Sapiens
aguauacuagggcaugauaugguauccuuuugagugagguauauacucaucucacaagu

SEQ ID NO: 502681 - RNA, 59 nt, Homo Sapiens
uggagagaauccccuccagauaagagauuuugagugaaaaacauaaugauccugccauu

SEQ ID NO: 502682 - RNA, 59 nt, Homo Sapiens
acuuugauagaacuaaggaaauagugguuuugagugaagggaaaggaaacccagaaaca

SEQ ID NO: 502683 - RNA, 59 nt, Homo Sapiens
uagaugggucuggcugagcugaacccauuuugagugacucgaggguuggguucaucuga

SEQ ID NO: 502684 - RNA, 59 nt, Homo Sapiens
ucuucaaugcuuccuccuugcugcugcuguugagugagaaaggugcugacaaagaugac

SEQ ID NO: 502685 - RNA, 59 nt, Homo Sapiens
aggagaaaacaauauauaacugauuauauuugagugaaucuccuguauauuggauuuug

SEQ ID NO: 502686 - RNA, 59 nt, Homo Sapiens
acucucuugauuuauguauuuuguugcauuugagugaaucaguucuuccaucgguguag

SEQ ID NO: 502687 - RNA, 59 nt, Homo Sapiens
uguuagaugugcacugaacuugccuagucuugagugaauaguaaacacuuauugucagg

SEQ ID NO: 502688 - RNA, 59 nt, Homo Sapiens
uguuugcuuccuucuugcccuuguuaggcuugagugagguugggggaaaacaggaaauc

SEQ ID NO: 502689 - RNA, 59 nt, Homo Sapiens
cuguugaauguuucuaaaaaauccagcauuugagugacaaauuguaaaaauuuuuguug

SEQ ID NO: 502690 - RNA, 59 nt, Homo Sapiens
aaguugggaaacagaaugggccagggagguugagugacugaagaccaaggguuggugca

SEQ ID NO: 502691 - RNA, 59 nt, Homo Sapiens
ucuuagucccucugcccucuguaaauguguugagugauauagcuaucagauguauugaa

SEQ ID NO: 502692 - RNA, 59 nt, Homo Sapiens
cucauagugugguuuuuaaauauaugcaguugagugaugauuggauacuauucaucaua

SEQ ID NO: 502693 - RNA, 59 nt, Homo Sapiens
gcugggaagugugaaaauauuuaauauauuugagugauuuuuuaaagaaggauacauuu

SEQ ID NO: 502694 - RNA, 59 nt, Homo Sapiens
uaauaacuguauuauagaaaaacuguguguugagugaacagaagcacgaggcccuugag

SEQ ID NO: 502695 - RNA, 59 nt, Homo Sapiens
agacaguuuauuuaaaacuuaucaguacuuugagugagauuacauaccuucucuguugu

SEQ ID NO: 502696 - RNA, 59 nt, Homo Sapiens
ugguaguggacuugggaaauuaaaccaaguugagugaauacaaucagguauuauguuuu

SEQ ID NO: 502697 - RNA, 59 nt, Homo Sapiens
gcacuuuuuuuguacauauguuugcucauuugagugaggcacuaauauuuugcauguaa

SEQ ID NO: 502698 - RNA, 59 nt, Homo Sapiens
caauaguuacgaugaccagucuuuagcauuugagugauucugcgccaauugugagggcg

SEQ ID NO: 502699 - RNA, 59 nt, Homo Sapiens
uuugaggcgucuuuuuuuuuucucaaaaguugagugaaugcugccuauugccauugcug

SEQ ID NO: 502700 - RNA, 59 nt, Homo Sapiens
cucccgccccagccuccugacucccuggcuugagugauccagcucacugcagccucgac

SEQ ID NO: 502701 - RNA, 59 nt, Homo Sapiens
ggagaacggcugugauaaguagguuuugauugagugaaagcaugagcuuguucagagug

SEQ ID NO: 502702 - RNA, 59 nt, Homo Sapiens
uuuaaucacaaaucauuuuuuaugaaugauugagugaaaauaguguuuauaaagguuaa

SEQ ID NO: 502703 - RNA, 59 nt, Homo Sapiens
gucugaguuaauauucaagugaucagacuuugagugacaucaagaaaagaugauaucag

SEQ ID NO: 502704 - RNA, 59 nt, Homo Sapiens
caaaaucacagauauucaugaguuucuacuugagugagaaaacugggugaaggaauaga

SEQ ID NO: 502705 - RNA, 59 nt, Homo Sapiens
cggcuuccaggucccaacccaggguuggguugagugagucccacaaagggcaagugggg

SEQ ID NO: 502706 - RNA, 59 nt, Homo Sapiens
cucaacucacugcaaccuccgcucccgguuugagugauucucaugccucagccucccga

SEQ ID NO: 502707 - RNA, 59 nt, Homo Sapiens
cucuuuaauguuuagcaugcuugucaaccuugagugagugucauuuuuaagaacaguug

SEQ ID NO: 502708 - RNA, 59 nt, Homo Sapiens
uuccuagccuucaaauuauuaaacacuccuugagugaaauaauuuugcauugcaaagug

SEQ ID NO: 502709 - RNA, 59 nt, Homo Sapiens
auaagcacacacauuuucaauucucauguuugagugauuuuaaaauguuuuggugaaug

SEQ ID NO: 502710 - RNA, 59 nt, Homo Sapiens
auccccuccuagcacaaggagugcccgccuugagugacaugcggcugcccacgcuccug

SEQ ID NO: 502711 - RNA, 59 nt, Homo Sapiens
aauuuucuaaaaacacacacagaaaucgcuugagugaggaaaaguccacauggcagaga

SEQ ID NO: 502712 - RNA, 59 nt, Homo Sapiens
caucuauacuucaucuuacaucgucaugauugagugaucuuuacauuugauuccagagg

SEQ ID NO: 502713 - RNA, 59 nt, Homo Sapiens
ugcauaggauugccaaaacugaggcagauuugagugagguuccaggguucuuccugaga

SEQ ID NO: 502714 - RNA, 59 nt, Homo Sapiens
aaacauuuacuaccuuguccaauggauuuuugagugauagcaauuuauuugaaacuucu

SEQ ID NO: 502715 - RNA, 59 nt, Homo Sapiens
ggagucggaaugugcuaccccagcccuuguugagugacgucagcuccacccauggccaa

SEQ ID NO: 502716 - RNA, 59 nt, Homo Sapiens
aaccuuuaacuuuggccugccuucaaucauugagugaaaggaaauauugcuuaauuuuu

SEQ ID NO: 502717 - RNA, 59 nt, Homo Sapiens
ccacagcugucagccuucaauuccugguuuugagugacauaugaggaagaagugauucc

SEQ ID NO: 502718 - RNA, 59 nt, Homo Sapiens
cuuauaggcccaaagaauugucaauaaaauugagugagacuuuuaaagucuuaaacuuu

SEQ ID NO: 502719 - RNA, 59 nt, Homo Sapiens
ugccucucagucuuaggggacuugguuuauugagugaaaagauaacaucugucaucuuc

SEQ ID NO: 502720 - RNA, 59 nt, Homo Sapiens
cucucuuuaugcgcaggaacaaacagcuguugagugagcugcuaugacuuugguagaga

SEQ ID NO: 502721 - RNA, 59 nt, Homo Sapiens
gaggucaccccgacuuuucuaaaucuuguuugagugaagucauuuuuucauguguucau

SEQ ID NO: 502722 - RNA, 59 nt, Homo Sapiens
acuuauuuauggaagauuacugcucuaauuugagugaaauaaaaguuauuagugcgagg

SEQ ID NO: 502723 - RNA, 59 nt, Homo Sapiens
ucaucuuucaaaagagaaaaauuggacacuugagugacuuuguuuuuaguuuuguuuuu

SEQ ID NO: 502724 - RNA, 59 nt, Homo Sapiens
uucuguacuucucaguuaagacuuguucuuugagugauguauuaaaugcugcuagaaaa

SEQ ID NO: 502725 - RNA, 59 nt, Homo Sapiens
uuugugcaccaggcccggcugcguagcaguugagugaugcugguuagcuauuaaggugg

SEQ ID NO: 502726 - RNA, 59 nt, Homo Sapiens
aggaugauggaauuagaugcagucugucuuugagugagacuggucaccaucagaggagu

SEQ ID NO: 502727 - RNA, 59 nt, Homo Sapiens
accagcaauuucuuuuuccuagauaaaucuugagugaaaaguagucaguacacuuuucu

SEQ ID NO: 502728 - RNA, 59 nt, Homo Sapiens
uaaugaauuaagaguggcugauauauuuguugagugaauggugcuccauauauauucau

SEQ ID NO: 502729 - RNA, 59 nt, Homo Sapiens
cagcacgcgacccagguguggagaagaucuugagugaagcuuuucuauauuuauaagaa

SEQ ID NO: 502730 - RNA, 59 nt, Homo Sapiens
guuaggccuugggggcugaggccaguggcuugagugaauucaaauuaaccagguuguga

SEQ ID NO: 502731 - RNA, 59 nt, Homo Sapiens
agaggacaaaccuugggucacaccucuuuuugagugaacggaggaauccguuuuugcuc

SEQ ID NO: 502732 - RNA, 59 nt, Homo Sapiens
uuccuaaggucacccagcugcaggagcgguugagugauucagaugaggaaauccguagg

SEQ ID NO: 502733 - RNA, 59 nt, Homo Sapiens
ucucauuuaugacuaaauuaauaaaacaguugagugaucuguauuaccaagcuuaagaa

SEQ ID NO: 502734 - RNA, 59 nt, Homo Sapiens
cucaucccaagcaaggagccuccuccacguugagugaaggggaccaguccaccaccauc

SEQ ID NO: 502735 - RNA, 59 nt, Homo Sapiens
ccuguuaguuuuguaaaaacugaagaauuuugagugaauuagaccuuuauuuuucuauc

SEQ ID NO: 502736 - RNA, 59 nt, Homo Sapiens
uucucugucgcugcuaaauuauucuucacuugagugaagcaaauauuuagcuuccaaau

SEQ ID NO: 502737 - RNA, 59 nt, Homo Sapiens
auaguuuaccucauagaguuuggggagaauugagugaauuaaugugugugaggacacua

SEQ ID NO: 502738 - RNA, 59 nt, Homo Sapiens
agaaugcugacacuuuuucagggcugugauugagugagggcauggguaaaaauauuucu

SEQ ID NO: 502739 - RNA, 59 nt, Homo Sapiens
ggaguugcacagaaucauggaauuuuguguugagugacauaauagguauggaaauauga

SEQ ID NO: 502740 - RNA, 59 nt, Homo Sapiens
cauauucuuuuuaaacuauaaauaccauuuugagugagaaaguacuuuuaaacaagaaa

SEQ ID NO: 502741 - RNA, 59 nt, Homo Sapiens
aaugccagucagugaugaucgcaucacaguugagugaaauggccuuccuguucagcugu

SEQ ID NO: 502742 - RNA, 59 nt, Homo Sapiens
uuuuucaaacuguccaugggaaggcugaauugagugacuccccagaaugaagaugagaa

SEQ ID NO: 502743 - RNA, 59 nt, Homo Sapiens
cugggagaaccaaaaagaggauauccucuuugagugaagugguguggaagagcuccuug

SEQ ID NO: 502744 - RNA, 59 nt, Homo Sapiens
gacaauuuuguaauuuaggauggaagaaauugagugaauuuuauucucugccuaaaaag

SEQ ID NO: 502745 - RNA, 59 nt, Homo Sapiens
guucccaaguaggcauucuauuguaucauuugagugaauaagaauauagcagacguaua

SEQ ID NO: 502746 - RNA, 59 nt, Homo Sapiens
uuuaguccauuuaugguugaauucaaacuuugagugacaguugauaccaagugcauaag

SEQ ID NO: 502747 - RNA, 59 nt, Homo Sapiens
ugcuugggugacuuggggguguugccagcuugagugaugggaugggagggaagguuaaa

SEQ ID NO: 502748 - RNA, 59 nt, Homo Sapiens
uugccuucaguuaacaugggcuagagagguugagugaauguaggcccaugggucccuua

SEQ ID NO: 502749 - RNA, 59 nt, Homo Sapiens
uauaacuaucauuaauucucuuuggcauuuugagugaaauacuuuguugaauuuuuuuu

SEQ ID NO: 502750 - RNA, 59 nt, Homo Sapiens
cuucuccauccuggauccugcugcccguguugagugagacgaggccugagccgcaaugc

SEQ ID NO: 502751 - RNA, 59 nt, Homo Sapiens
gaaaaacuugauggaaguggaugaugccauugagugagucuuaagcaacuggauggaua

SEQ ID NO: 502752 - RNA, 59 nt, Homo Sapiens
ucuuacaacauccacauaagccacagacauugagugacuugugaagugacuuauuaaau

SEQ ID NO: 502753 - RNA, 59 nt, Homo Sapiens
uaggaagcuucaugguguuguguggccuuuugagugaaaccccauuuuuauauacugaa

SEQ ID NO: 502754 - RNA, 59 nt, Homo Sapiens
cuguggugugagguguucugggacuugaguugagugacggagcccucugaugugaggag

SEQ ID NO: 502755 - RNA, 59 nt, Homo Sapiens
uuaccauucaccucccaaagccaaggaacuugagugagcuuccuuggcaagccucccau

SEQ ID NO: 502756 - RNA, 59 nt, Homo Sapiens
uuuuaucaauaaauauuuuuauacuuacauugagugauguguuuaacaacaaauuguga

SEQ ID NO: 502757 - RNA, 59 nt, Homo Sapiens
uguguaccugaaguacaguacaggcuggcuugagugaauaucugcauccaaggccuucu

SEQ ID NO: 502758 - RNA, 59 nt, Homo Sapiens
uaugcugaauaaacaguggacuguagaauuugagugaucauggggaucccagcacauca

SEQ ID NO: 502759 - RNA, 59 nt, Homo Sapiens
uaucauaagaugagaauggaacuaaauuuuugagugaaaaauguguuuuggggugggua

SEQ ID NO: 502760 - RNA, 59 nt, Homo Sapiens
aacugaauugaaaccuauuauuauaauacuugagugacuucuguaaauccaguugcauu

SEQ ID NO: 502761 - RNA, 59 nt, Homo Sapiens
ucccuuagugaauuuugucucauuuccauuugagugaguugcucucugguccaugaacu

SEQ ID NO: 502762 - RNA, 59 nt, Homo Sapiens
ccuuaaaaagcacacaccacgauguuuuauugagugaagcucaucagcagagagcaaca

SEQ ID NO: 502763 - RNA, 59 nt, Homo Sapiens
uauccucaccagacauuccuugagcacaguugagugauuguguugugacuuauucgucc

SEQ ID NO: 502764 - RNA, 59 nt, Homo Sapiens
aaccuguguugcgcaaaugccgcauaaauuugagugauuguuaauguugucuuaaaauu

SEQ ID NO: 502765 - RNA, 59 nt, Homo Sapiens
uuccucuagcuuuucuauuuuugauuguguugagugaaguuuggagauuuuucauacuu

SEQ ID NO: 502766 - RNA, 59 nt, Homo Sapiens
cacaauacuuaauguauuguaucacaaaauugagugaaaaguuuuuucaaaaauggagu

SEQ ID NO: 502767 - RNA, 59 nt, Homo Sapiens
caguauugagccaugaauaagucaaagacuugagugaccaucauugaaauucauuuggg

SEQ ID NO: 502768 - RNA, 59 nt, Homo Sapiens
agcucuguggcccugugucguaccagauguugagugaccggauuucaccucacccuuug

SEQ ID NO: 502769 - RNA, 59 nt, Homo Sapiens
cuaaaauccuuaaaaauacucuaauagccuugagugaccaacuuuuuuuuuaaagcaca

SEQ ID NO: 502770 - RNA, 59 nt, Homo Sapiens
gaauuuugguaccuacaacaugcuugauuuugagugauuaaaaaaaaauaauuuggcug

SEQ ID NO: 502771 - RNA, 59 nt, Homo Sapiens
caccggcccccuccccccagacucuuuuuuugagugacagcuuucugggaugucacagu

SEQ ID NO: 502772 - RNA, 59 nt, Homo Sapiens
auuugacauuguccaaaccuuuuucauuuuugagugauuaaaaaugaaauguccuuugu

SEQ ID NO: 502773 - RNA, 59 nt, Homo Sapiens
ccaggcuguaguaugaucauauuuuuuguuugagugauucuuuaaagagaacuagaaga

SEQ ID NO: 502774 - RNA, 59 nt, Homo Sapiens
uauacauaacauuguuuuuguaauaaaauuugagugauggcgggcuauugugcugccuu

SEQ ID NO: 502775 - RNA, 59 nt, Homo Sapiens
uauuugauauauuacuuuguaguaggaguuugagugaauuggugaugacacguuucuua

SEQ ID NO: 502776 - RNA, 59 nt, Homo Sapiens
uuaaccugcuauuaaauagugggauuagauugagugaaauucaaaugaauauuauuugg

SEQ ID NO: 502777 - RNA, 59 nt, Homo Sapiens
uugauggauaaugagcuaauaggugacacuugagugaguuuacauuucccaagagaguc

SEQ ID NO: 502778 - RNA, 59 nt, Homo Sapiens
gaaauggggagucuagagccggcucuuccuugagugaaagugaggacaagaaugcaaau

SEQ ID NO: 502779 - RNA, 59 nt, Homo Sapiens
uggccuuugaacugaacuuaaaaggcuucuugagugaggggcugucuggagguguuugg

SEQ ID NO: 502780 - RNA, 59 nt, Homo Sapiens
gucugugcaggcccuguagucaucuuucuuugagugacccaaggaguagggcacaggga

SEQ ID NO: 502781 - RNA, 59 nt, Homo Sapiens
uacacagcuagaaggugccaggaguggcuuugagugaguuucugggaguccauccagcu

SEQ ID NO: 502782 - RNA, 59 nt, Homo Sapiens
accuccccagauggagcaugcaauaaacauugagugagcucuuuucuguauucgcuguu

SEQ ID NO: 502783 - RNA, 59 nt, Homo Sapiens
aaauuuucuuaaaauauccacaauauuccuugagugagucagaaucuauagccgguuag

SEQ ID NO: 502784 - RNA, 59 nt, Homo Sapiens
cagacagacaccucccucuggagaugcaguugagugacaaccuuguuacauuguagccu

SEQ ID NO: 502785 - RNA, 59 nt, Homo Sapiens
uuuccucaaccgagagugaauuuauguaauugagugaaagucuacgaaucauaauugua

SEQ ID NO: 502786 - RNA, 59 nt, Homo Sapiens
gggcccccuguucuuucuuucccauuaacuugagugaccugugugagagacagacagau

SEQ ID NO: 502787 - RNA, 59 nt, Homo Sapiens
uguggcaggaggcaaagaguaggguguaauugagugaaggaauccuggguagagaccau

SEQ ID NO: 502788 - RNA, 59 nt, Homo Sapiens
auucuggacuccugagaggcaguggccucuugagugaacaggggaggccaguagaugcc

SEQ ID NO: 502789 - RNA, 59 nt, Homo Sapiens
auaucauugaugugcugucacacuauauauugagugacuuucugaacaaauuuauccag

SEQ ID NO: 502790 - RNA, 59 nt, Homo Sapiens
cuuuugcacugaagauagagaccaccuuuuugagugacuugagcccaaaggcaagcgua

SEQ ID NO: 502791 - RNA, 59 nt, Homo Sapiens
caagacccggacagagcuucagaggaguguugagugacaccugaggaugcggcugcaca

SEQ ID NO: 502792 - RNA, 59 nt, Homo Sapiens
gagguggugugagggccagguagggacgcuugagugaggaguccugggguccgagaugc

SEQ ID NO: 502793 - RNA, 59 nt, Homo Sapiens
gguagauuuauuuccauuuguauuugggcuugagugaaagucuguauuuuauauuugau

SEQ ID NO: 502794 - RNA, 59 nt, Homo Sapiens
augcuggagaaugagagaccaugaacauguugagugagcuguuggaaccuuacccagcc

SEQ ID NO: 502795 - RNA, 59 nt, Homo Sapiens
ugcaaacccagauauuguacaaaacccaauugagugauugacuauuagggcuuggucuu

SEQ ID NO: 502796 - RNA, 59 nt, Homo Sapiens
cucuuggggccagcgugcguccagccguguugagugaagugcccacguccgcccaggac

SEQ ID NO: 502797 - RNA, 59 nt, Homo Sapiens
guaaguucuagccccacccucccgccuucuugagugauaccuauuacggaugaguucug

SEQ ID NO: 502798 - RNA, 59 nt, Homo Sapiens
ccucugcuuucucccugccuugauugagcuugagugauguggaauaaauuguccgucuc

SEQ ID NO: 502799 - RNA, 59 nt, Homo Sapiens
guacuaugucugaacauagaaacucgggcuugagugagaagagcuugcacagccaacga

SEQ ID NO: 502800 - RNA, 59 nt, Homo Sapiens
uuaucuguauuuagcagaguauuuucaacuugagugaucugagcugaauuugaagacua

SEQ ID NO: 502801 - RNA, 59 nt, Homo Sapiens
cauguccuuagcacaggggggccgccgguuugagugaggguuucugagcugcucugaau

SEQ ID NO: 502802 - RNA, 59 nt, Homo Sapiens
agaucuucuuagcccagagagcaguggaguugagugaggaggcagauguccugucugug

SEQ ID NO: 502803 - RNA, 59 nt, Homo Sapiens
acuccaagaugaagauguggucccugcccuugagugacagcccagggacuuaauguggc

SEQ ID NO: 502804 - RNA, 59 nt, Homo Sapiens
uuuauuuagcagcuaguaacagacugcuuuugagugacacuguguaagaaaaagccaag

SEQ ID NO: 502805 - RNA, 59 nt, Homo Sapiens
guaguauggauggguuuucuuguccaguuuugagugacuuuuggcucuaccccuagaaa

SEQ ID NO: 502806 - RNA, 59 nt, Homo Sapiens
gcuucagggguuggaaguuccauuuuagcuugagugaugcccugaggaccagaacugcu

SEQ ID NO: 502807 - RNA, 59 nt, Homo Sapiens
caucgccaagauuugcuguaugaaagcuguugagugacuugcggccuuugguuuguggc

SEQ ID NO: 502808 - RNA, 59 nt, Homo Sapiens
cgggaccgugccauuguacuaaguggagguugagugagcgagaaucgcuugaaccuggg

SEQ ID NO: 502809 - RNA, 59 nt, Homo Sapiens
agagauaauaaauguuuuaauuuggcaguuugagugauugggaaaaggaaucuuaaacu

SEQ ID NO: 502810 - RNA, 59 nt, Homo Sapiens
ugggcugcgaggagaagcuguacuuuggcuugagugaguacagcaagucucugcagugg

SEQ ID NO: 502811 - RNA, 59 nt, Homo Sapiens
ccaccguguugugcucaaagagacacuacuugagugaagauuucuucuuucccuguacc

SEQ ID NO: 502812 - RNA, 59 nt, Homo Sapiens
auuuacauuuuucugguuuuuuuuuuuuuuugagugagguacgaguauuaccaaaugau

SEQ ID NO: 502813 - RNA, 59 nt, Homo Sapiens
agguuugguuucugacgaaaguaaaugauuugagugaguuuucugcacuaguuuuccuu

SEQ ID NO: 502814 - RNA, 59 nt, Homo Sapiens
uaaaaugcaugacagacaaguaaugauauuugagugaaugauaaucuuuacugcaagug

SEQ ID NO: 502815 - RNA, 59 nt, Homo Sapiens
gucccaccgugaagugaauucaguagacuuugagugacccuuuuuggggaugagguuca

SEQ ID NO: 502816 - RNA, 59 nt, Homo Sapiens
agaauugcaaauagucucuacaggaucuauugagugaacacaugucuagcuuucaccuc

SEQ ID NO: 502817 - RNA, 59 nt, Homo Sapiens
cuggcuccaggggcggcuuuuguuggaaguugagugaagcccucccccuguccucagcg

SEQ ID NO: 502818 - RNA, 59 nt, Homo Sapiens
gagaggcucuuugugguuaacuuauaauauugagugaugcaugagguagguguucagaa

SEQ ID NO: 502819 - RNA, 59 nt, Homo Sapiens
uggacaagcaguaaugauauuuaaauauuuugagugagggggagugggucaaagaggaa

SEQ ID NO: 502820 - RNA, 59 nt, Homo Sapiens
uggaaacccucuccucccuccuccacaccuugagugaugaccacaccaaucacuguauu

SEQ ID NO: 502821 - RNA, 59 nt, Homo Sapiens
uuuuuuuaaauagagggauugacucggauuugagugaucauuagggcugaggucuguuu

SEQ ID NO: 502822 - RNA, 59 nt, Homo Sapiens
gcccccacccaagccugcgucagcggaacuugagugaggggcguugugcaauuuguggc

SEQ ID NO: 502823 - RNA, 59 nt, Homo Sapiens
uuggaaggacucauauaugcauacauuccuugagugacuaugaaugacugccgggcagu

SEQ ID NO: 502824 - RNA, 59 nt, Homo Sapiens
gugcuuuuuuguuuguguguguguguaauuugagugauuguaaauggcauugauguuug

SEQ ID NO: 502825 - RNA, 59 nt, Homo Sapiens
gaaucaggacugaaugugaaagggaaguauugagugaggacauucccaaaaccaaagga

SEQ ID NO: 502826 - RNA, 59 nt, Homo Sapiens
uuuuggauccaccagaccagaccagacauuugagugaaauucuugacauccaccaagau

SEQ ID NO: 502827 - RNA, 59 nt, Homo Sapiens
guugggaagggggcucagaauaggcaggauugagugacgcccuccccuucugguaguca

SEQ ID NO: 502828 - RNA, 59 nt, Homo Sapiens
cugcuguaaacuauuuguggcugugcugcuugagugacgucucugucgugugggugcca

SEQ ID NO: 502829 - RNA, 59 nt, Homo Sapiens
caaauaauccagaaauauaccuaauaagauugagugaaaaauuugagucaaauaucuag

SEQ ID NO: 502830 - RNA, 59 nt, Homo Sapiens
uuuuaaaccccaggaacagagacuccuaguugagugauagcugggaaaguuuuacauug

SEQ ID NO: 502831 - RNA, 59 nt, Homo Sapiens
cuuucagucaaucucuuccacucuaaggauugagugagcgcgagcuggggacucucuca

SEQ ID NO: 502832 - RNA, 59 nt, Homo Sapiens
acagaagugaagaguuucagagcaucagauugagugaaaaguugucagauucuguauuu

SEQ ID NO: 502833 - RNA, 59 nt, Homo Sapiens
ggaguccccuaaugacuaauugcacagccuugagugauucugcugaaucugguacuuuc

SEQ ID NO: 502834 - RNA, 59 nt, Homo Sapiens
gaauuuucauguggcugggugcugggugguugagugagugguguuuccaguuugauguu

SEQ ID NO: 502835 - RNA, 59 nt, Homo Sapiens
ggcuacaagggccugagaggucgcucucuuugagugacucgguuggccgguguuagaac

SEQ ID NO: 502836 - RNA, 59 nt, Homo Sapiens
uuaagguuuuccaaaucuucccaacucaguugagugauugugaauuugcugauguucuu

SEQ ID NO: 502837 - RNA, 59 nt, Homo Sapiens
ggagagcacgguccuaagucaggguggguuugagugaagagugaguugggggagggcac

SEQ ID NO: 502838 - RNA, 59 nt, Homo Sapiens
ugggacgguucguuugaauggaggagguguugagugagcaacacgcagaagcucgccua

SEQ ID NO: 502839 - RNA, 59 nt, Homo Sapiens
gcugggcuguuuucugucuuauuucucaguugagugagcaaggauacgaaaacagugug

SEQ ID NO: 502840 - RNA, 59 nt, Homo Sapiens
acaugugaugauuuucagaacguaaguguuugagugaugggaaagcacuugauuguacc

SEQ ID NO: 502841 - RNA, 59 nt, Homo Sapiens
cuacucugaaaugcaaaacuucuauucuguugagugaaagaauaaaauguagacaaaau

SEQ ID NO: 502842 - RNA, 59 nt, Homo Sapiens
uauuuuuauuuccugggccuucauuggcuuugagugacaucuaguucugauucugucac

SEQ ID NO: 502843 - RNA, 59 nt, Homo Sapiens
cuucauuccucucccaugugcccuucccuuugagugagugaaaacuuaucuuaaacuga

SEQ ID NO: 502844 - RNA, 59 nt, Homo Sapiens
gguugguauuaucaacacugaguuguauguugagugauuguaaaaauaugaaguguuuu

SEQ ID NO: 502845 - RNA, 59 nt, Homo Sapiens
auuuugagguuuuuaauuuacaucccauuuugagugaagaacuuaaaugaacaagcuua

SEQ ID NO: 502846 - RNA, 59 nt, Homo Sapiens
uucagggacaguagaaaguguuuuguuuuuugagugaaacaacuuauuaauaaaaaucc

SEQ ID NO: 502847 - RNA, 59 nt, Homo Sapiens
cacuuuaauuuagaagauaggugagcaacuugagugaucccaaaccaaacuaacagugc

SEQ ID NO: 502848 - RNA, 59 nt, Homo Sapiens
aaagucugucuguacugcagugggaauucuugagugaggucuuaccucuucuuuaaacc

SEQ ID NO: 502849 - RNA, 59 nt, Homo Sapiens
gugagaacuuaguaaacaagaaaauacucuugagugaaaugcaauguauuucuuuugua

SEQ ID NO: 502850 - RNA, 59 nt, Homo Sapiens
uuucagggucuuucaugaaguuccaauaguugagugaguuaaaagguuuguuucccaga

SEQ ID NO: 502851 - RNA, 59 nt, Homo Sapiens
guaaaccauuaaugaaaacuuuuucacaguugagugaaauuaaaaucacuauaucucaa

SEQ ID NO: 502852 - RNA, 59 nt, Homo Sapiens
ugaaaaaauucucuuaaaccacagcacuauugagugaaacauugaacucauaucuguaa

SEQ ID NO: 502853 - RNA, 59 nt, Homo Sapiens
ccuugaaaaaugaacugcccguuauuugcuugagugagcaaugacuacauuggcuguug

SEQ ID NO: 502854 - RNA, 59 nt, Homo Sapiens
ugaaggcaaacagagccaaggacugaggcuugagugaacagggggaaauggguaugaga

SEQ ID NO: 502855 - RNA, 59 nt, Homo Sapiens
cauacauucuguuucuuuaaauucucucuuugagugauuaaucguuaaucuuuaguugc

SEQ ID NO: 502856 - RNA, 59 nt, Homo Sapiens
cuccaauucugaccuuacaaaagugucccuugagugaggcagugaccacgcauugucac

SEQ ID NO: 502857 - RNA, 59 nt, Homo Sapiens
agauaacacaggucuauugagguugagcuuugagugaaagcugacucagucuguucacu

SEQ ID NO: 502858 - RNA, 64 nt, Homo Sapiens; identical to SEQ ID NO: 179520

SEQ ID NO: 502859 - RNA, 64 nt, Homo Sapiens; identical to SEQ ID NO: 179521

SEQ ID NO: 502860 - RNA, 64 nt, Homo Sapiens; identical to SEQ ID NO: 179522

SEQ ID NO: 502861 - RNA, 64 nt, Homo Sapiens; identical to SEQ ID NO: 179523

SEQ ID NO: 502862 - RNA, 64 nt, Homo Sapiens; identical to SEQ ID NO: 179524

SEQ ID NO: 502863 - RNA, 64 nt, Homo Sapiens; identical to SEQ ID NO: 179525

SEQ ID NO: 502864 - RNA, 64 nt, Homo Sapiens; identical to SEQ ID NO: 179526

SEQ ID NO: 502865 - RNA, 64 nt, Homo Sapiens; identical to SEQ ID NO: 179527

SEQ ID NO: 502866 - RNA, 64 nt, Homo Sapiens; identical to SEQ ID NO: 179528

SEQ ID NO: 502867 - RNA, 64 nt, Homo Sapiens; identical to SEQ ID NO: 179529

SEQ ID NO: 502868 - RNA, 64 nt, Homo Sapiens; identical to SEQ ID NO: 179530

SEQ ID NO: 502869 - RNA, 64 nt, Homo Sapiens; identical to SEQ ID NO: 179531

SEQ ID NO: 502870 - RNA, 64 nt, Homo Sapiens; identical to SEQ ID NO: 179532

SEQ ID NO: 502871 - RNA, 64 nt, Homo Sapiens; identical to SEQ ID NO: 179533

SEQ ID NO: 502872 - RNA, 64 nt, Homo Sapiens; identical to SEQ ID NO: 179534

SEQ ID NO: 502873 - RNA, 64 nt, Homo Sapiens; identical to SEQ ID NO: 179535

SEQ ID NO: 502874 - RNA, 64 nt, Homo Sapiens; identical to SEQ ID NO: 179536

SEQ ID NO: 502875 - RNA, 64 nt, Homo Sapiens; identical to SEQ ID NO: 179537

SEQ ID NO: 502876 - RNA, 64 nt, Homo Sapiens; identical to SEQ ID NO: 179538

SEQ ID NO: 502877 - RNA, 64 nt, Homo Sapiens; identical to SEQ ID NO: 179539

SEQ ID NO: 502878 - RNA, 64 nt, Homo Sapiens; identical to SEQ ID NO: 179540

SEQ ID NO: 502879 - RNA, 64 nt, Homo Sapiens; identical to SEQ ID NO: 179541

SEQ ID NO: 502880 - RNA, 64 nt, Homo Sapiens; identical to SEQ ID NO: 179542

SEQ ID NO: 502881 - RNA, 64 nt, Homo Sapiens; identical to SEQ ID NO: 179543

SEQ ID NO: 502882 - RNA, 64 nt, Homo Sapiens; identical to SEQ ID NO: 179544

SEQ ID NO: 502883 - RNA, 64 nt, Homo Sapiens; identical to SEQ ID NO: 179545

SEQ ID NO: 502884 - RNA, 64 nt, Homo Sapiens; identical to SEQ ID NO: 179546

SEQ ID NO: 502885 - RNA, 64 nt, Homo Sapiens; identical to SEQ ID NO: 179547

SEQ ID NO: 502886 - RNA, 64 nt, Homo Sapiens; identical to SEQ ID NO: 179548

SEQ ID NO: 502887 - RNA, 64 nt, Homo Sapiens; identical to SEQ ID NO: 179549

SEQ ID NO: 502888 - RNA, 64 nt, Homo Sapiens; identical to SEQ ID NO: 179550

SEQ ID NO: 502889 - RNA, 64 nt, Homo Sapiens; identical to SEQ ID NO: 179551

SEQ ID NO: 502890 - RNA, 64 nt, Homo Sapiens; identical to SEQ ID NO: 179552

SEQ ID NO: 502891 - RNA, 64 nt, Homo Sapiens; identical to SEQ ID NO: 179553

SEQ ID NO: 502892 - RNA, 64 nt, Homo Sapiens; identical to SEQ ID NO: 179554

SEQ ID NO: 502893 - RNA, 64 nt, Homo Sapiens; identical to SEQ ID NO: 179555

SEQ ID NO: 502894 - RNA, 64 nt, Homo Sapiens; identical to SEQ ID NO: 179556

SEQ ID NO: 502895 - RNA, 64 nt, Homo Sapiens; identical to SEQ ID NO: 179557

SEQ ID NO: 502896 - RNA, 64 nt, Homo Sapiens; identical to SEQ ID NO: 179558

SEQ ID NO: 502897 - RNA, 64 nt, Homo Sapiens; identical to SEQ ID NO: 179559

SEQ ID NO: 502898 - RNA, 64 nt, Homo Sapiens; identical to SEQ ID NO: 179560

SEQ ID NO: 502899 - RNA, 64 nt, Homo Sapiens; identical to SEQ ID NO: 179561

SEQ ID NO: 502900 - RNA, 64 nt, Homo Sapiens; identical to SEQ ID NO: 179562

SEQ ID NO: 502901 - RNA, 64 nt, Homo Sapiens; identical to SEQ ID NO: 179563

SEQ ID NO: 502902 - RNA, 64 nt, Homo Sapiens; identical to SEQ ID NO: 179564

SEQ ID NO: 502903 - RNA, 64 nt, Homo Sapiens; identical to SEQ ID NO: 179565

SEQ ID NO: 502904 - RNA, 64 nt, Homo Sapiens; identical to SEQ ID NO: 179566

SEQ ID NO: 502905 - RNA, 64 nt, Homo Sapiens; identical to SEQ ID NO: 179567

SEQ ID NO: 502906 - RNA, 64 nt, Homo Sapiens; identical to SEQ ID NO: 179568

SEQ ID NO: 502907 - RNA, 64 nt, Homo Sapiens; identical to SEQ ID NO: 179569

SEQ ID NO: 502908 - RNA, 64 nt, Homo Sapiens; identical to SEQ ID NO: 179570

SEQ ID NO: 502909 - RNA, 64 nt, Homo Sapiens; identical to SEQ ID NO: 179571

SEQ ID NO: 502910 - RNA, 64 nt, Homo Sapiens; identical to SEQ ID NO: 179572

SEQ ID NO: 502911 - RNA, 64 nt, Homo Sapiens; identical to SEQ ID NO: 179573

SEQ ID NO: 502912 - RNA, 64 nt, Homo Sapiens; identical to SEQ ID NO: 179574

SEQ ID NO: 502913 - RNA, 64 nt, Homo Sapiens; identical to SEQ ID NO: 179575

SEQ ID NO: 502914 - RNA, 64 nt, Homo Sapiens; identical to SEQ ID NO: 179576

SEQ ID NO: 502915 - RNA, 64 nt, Homo Sapiens; identical to SEQ ID NO: 179577

SEQ ID NO: 502916 - RNA, 64 nt, Homo Sapiens; identical to SEQ ID NO: 179578

SEQ ID NO: 502917 - RNA, 64 nt, Homo Sapiens; identical to SEQ ID NO: 179579

SEQ ID NO: 502918 - RNA, 64 nt, Homo Sapiens; identical to SEQ ID NO: 179580

SEQ ID NO: 502919 - RNA, 64 nt, Homo Sapiens
auuauuaauauuauuaugaacagcccgacaaugucgaguauauucggacucccgggccacgccc

SEQ ID NO: 502920 - RNA, 64 nt, Homo Sapiens
aaggaaaccacaaauucagcuaauaauagcauuucgaguauauuucguaaacuaaggaaauaca

SEQ ID NO: 502921 - RNA, 64 nt, Homo Sapiens
uuuauauaugaugugauguaucuuugauccauuucgaguauauuacuuuuaguucucacaaugg

SEQ ID NO: 502922 - RNA, 64 nt, Homo Sapiens
aaaauaagucacuguugacagggucaugaguuuccgaguauaguuuucuuuuuaucuuauuuuu

SEQ ID NO: 502923 - RNA, 64 nt, Homo Sapiens
guugcuauuuagcaaugugccaauuauuguuuaccgaguauaauuauuaaacuuauuuuguugc

SEQ ID NO: 502924 - RNA, 64 nt, Homo Sapiens
uacuugcuguguauuuaguggcauaaucuuuaaccgaguauaaguuugguugcuaaagaaaaaa

SEQ ID NO: 502925 - RNA, 64 nt, Homo Sapiens
gacuuuuguuuucugaguugauuagaaugcuguucgaguauaccuacccuaguuucagaagcau

SEQ ID NO: 502926 - RNA, 64 nt, Homo Sapiens
uguuuuuuaacaaguugaaauuuaacagucuuugcgaguauacauuuuguagaaaauguuauaa

SEQ ID NO: 502927 - RNA, 64 nt, Homo Sapiens
accucagucuccuguaagaccuccuaccacauggcgaguauacaccaaucaggagaggguagcu

SEQ ID NO: 502928 - RNA, 64 nt, Homo Sapiens
aaucauugucaugaaguuagcacagagggaguuucgaguauaaggcaucacagugagcagugag

SEQ ID NO: 502929 - RNA, 64 nt, Homo Sapiens
uucccagggagaaaaccugucagaacuuuccauacgaguauaucagaacacacccuuccaaggu

SEQ ID NO: 502930 - RNA, 64 nt, Homo Sapiens
cccuugugguuucagaacaagcuuuauuuuauuacgaguauauuaaugacaacuaauuccuguu

SEQ ID NO: 502931 - RNA, 64 nt, Homo Sapiens
agcucuaacaucucccacaagcuagaggaacuugcgaguauauuaacaaggacacaucugacau

SEQ ID NO: 502932 - RNA, 64 nt, Homo Sapiens
cccauuguacuuuguggaggcuuaacugccgaugcgaguauacauucgaaugacugacuauugg

SEQ ID NO: 502933 - RNA, 64 nt, Homo Sapiens
guuuuccucuuuuuuaacugcugugggggaggggcgaguauaaaacaacagguuuggaaaaccu

SEQ ID NO: 502934 - RNA, 64 nt, Homo Sapiens
cacucaagggggagcaaauuaauaauuccuuucccgaguauaacuuugaauacuugcacauuuc

SEQ ID NO: 502935 - RNA, 64 nt, Homo Sapiens
uggagcauuacuggcuacugcaucuuaugauacucgaguauauaucugggauccacauaaugga

SEQ ID NO: 502936 - RNA, 64 nt, Homo Sapiens
ucaagacaaacgagaaaauccuggcuacccaagucgaguauauacaggaauacaaaucgguaac

SEQ ID NO: 502937 - RNA, 64 nt, Homo Sapiens
ugaagcacuuauuugcuaaguucaggagcccuugcgaguauaucgaugaugcagaaaacuccaa

SEQ ID NO: 502938 - RNA, 64 nt, Homo Sapiens
guguuauuuuuaucgucauaauaaaaauuauauacgaguauaaaugaaauucauuucuaaauuc

SEQ ID NO: 502939 - RNA, 64 nt, Homo Sapiens
uugcccauaucccucccauaucucugcguacguucgaguauacguagagcuaaccguacucucu

SEQ ID NO: 502940 - RNA, 64 nt, Homo Sapiens
aauaaugauauaugguauuuccaucgucaguuaccgaguauagccacuggguaucacuacuuug

SEQ ID NO: 502941 - RNA, 64 nt, Homo Sapiens
gaaauguuucuuuauggccaaucuuacuuuuaaucgaguauaagauaacaauaguacaucuucc

SEQ ID NO: 502942 - RNA, 64 nt, Homo Sapiens
cuggugccuaauuuauuaaagagaauuagcuuagcgaguauaugcugauauucuucgacacacg

SEQ ID NO: 502943 - RNA, 64 nt, Homo Sapiens
cagugcuggcaaagcugcaguauugagaugcuaaggagcugaugccaccucuuugucuuccccu

SEQ ID NO: 502944 - RNA, 64 nt, Homo Sapiens
acuggggccauuggaggcccacuguaggugggagggagcugauuuugggguggggggugggacu

SEQ ID NO: 502945 - RNA, 64 nt, Homo Sapiens
gaggugguggccguggguuccugaugucggugcaggagcugaaggugaguggagugcugccaag

SEQ ID NO: 502946 - RNA, 64 nt, Homo Sapiens
ugcucacccccaggauguguacccgguuguaguaggagcugaaauccaugcugagcuguaccag

SEQ ID NO: 502947 - RNA, 64 nt, Homo Sapiens
ggggucugggcucugccccugcaggggugagaguggagcugaguucucagcagcuuugcuugug

SEQ ID NO: 502948 - RNA, 64 nt, Homo Sapiens
ggcuagcaccugcauugagggaggaaggcugccaggagcugaggcugagccugguucugcaggg

SEQ ID NO: 502949 - RNA, 64 nt, Homo Sapiens
auguggacuuguaugcugcccacauacgugagggggagcugaaagggagccccuccucugagca

SEQ ID NO: 502950 - RNA, 64 nt, Homo Sapiens
gagcccucggagccaaugaacagcuccuccucuuggagcugagaugagccccacguggagcucg

SEQ ID NO: 502951 - RNA, 64 nt, Homo Sapiens
ugugaaaucccuacuucuuauaaugcagaguuaaggagcugagcccccaugauuuuguagcugu

SEQ ID NO: 502952 - RNA, 64 nt, Homo Sapiens
uggaauggauagguaacuugggugggcaacuuggggagcugaccauucucuuuugguaaauguu

SEQ ID NO: 502953 - RNA, 64 nt, Homo Sapiens
gagcacugccaggacccaccacuggaagcaggauggagcugacuacggaacugcacacucagug

SEQ ID NO: 502954 - RNA, 64 nt, Homo Sapiens
uuuguuuuuuuaaauauuaugcugcuuuaacaguggagcugaauuuucuggaaaaugcuucuug

SEQ ID NO: 502955 - RNA, 64 nt, Homo Sapiens
ccacgcaguguaaacccaguggcuucucugaccuggagcugaugggccgugaagggggccuauu

SEQ ID NO: 502956 - RNA, 64 nt, Homo Sapiens
uuguguucguaaucgggcuugagccagaggcuggggagcugagucccagccaaaccucacuggc

SEQ ID NO: 502957 - RNA, 64 nt, Homo Sapiens
ggcuggggaggggguaccucaugaggaccaggguggagcugagaagaggaggaggugggggcug

SEQ ID NO: 502958 - RNA, 64 nt, Homo Sapiens
ccccgacccccgcagaggcagaaugaacccauagggagcugaucguaauguuuaucauguuacu

SEQ ID NO: 502959 - RNA, 64 nt, Homo Sapiens
ucucagcccuggggaucagaaaggugggcuugcuggagcugagcuguuucacugccucucgcag

SEQ ID NO: 502960 - RNA, 64 nt, Homo Sapiens
ccugaaguccugggcaugcaucugggacccccguggagcugacaaguuuuccuugcuuuccuga

SEQ ID NO: 502961 - RNA, 64 nt, Homo Sapiens
uguguggacaugcagagaagcagagaagaagaaaggagcugaggaggagaagccaaagaggagg

SEQ ID NO: 502962 - RNA, 64 nt, Homo Sapiens
aucccaauacacagagucugucacagacagggacggagcugaagaccaucaacgacuuucucuu

SEQ ID NO: 502963 - RNA, 64 nt, Homo Sapiens
gaacaggaugggcagagaaaggguagugugugagggagcugaguaggccagguaggcgauugga

SEQ ID NO: 502964 - RNA, 64 nt, Homo Sapiens
gccucaggaguccuuggggagaugaaggggguggggagcugagcaggcugggcaauuugcccuc

SEQ ID NO: 502965 - RNA, 64 nt, Homo Sapiens
aguucccacccaagcccuccuuuggagcaaagaaggagcugagaacaagccgaaugaggaguuu

SEQ ID NO: 502966 - RNA, 64 nt, Homo Sapiens
uucaguuucaggagugcaagcagcacucaaaccuggagcugaggaaucuaauucagacagagac

SEQ ID NO: 502967 - RNA, 64 nt, Homo Sapiens
acgagcagcgggccgagccacgcagcggcuucgaggagcugaacaacgagaacaagagcacacu

SEQ ID NO: 502968 - RNA, 64 nt, Homo Sapiens
acaagagcacacugcaguuggagcagcaaguaaaggagcugaagaagucgggugagcugaaaga

SEQ ID NO: 502969 - RNA, 64 nt, Homo Sapiens
ggagcagcaaguaaaggagcugaagaagucggguggagcugaagagccaagaggcuccgagucu

SEQ ID NO: 502970 - RNA, 64 nt, Homo Sapiens
cugguguucccagccccaccagagccccgugccgggagcugacagcuuucacgcuuaaggcacg

SEQ ID NO: 502971 - RNA, 64 nt, Homo Sapiens
ccugcccacaucugcugguuuggggcuucaguggggagcugacagcugugagcacaccacuguc

SEQ ID NO: 502972 - RNA, 64 nt, Homo Sapiens
gaggcugucuggcuugggggggggccccagccaaggagcugagccuugcaggccuguucccuaa

SEQ ID NO: 502973 - RNA, 64 nt, Homo Sapiens
ucgcucauugccuaccuuaccugcaguuugacaaggagcugagguucuccugcagcuggguggu

SEQ ID NO: 502974 - RNA, 64 nt, Homo Sapiens
ccuguuguggcccauuaaagcaaaaguucugagaggagcugagcggucuuaacucugauuguag

SEQ ID NO: 502975 - RNA, 64 nt, Homo Sapiens
acggaagcugcagaaagauaccucccccaugugaggagcugagaguugaccucggagugcgcua

SEQ ID NO: 502976 - RNA, 64 nt, Homo Sapiens
cccagccacuguuagugucgccaccgcccauaaaggagcugagcccagcaggggcacugccugg

SEQ ID NO: 502977 - RNA, 64 nt, Homo Sapiens
cugccuggggcccuguagccaaaaggcuacagcaggagcugaugacccucaugaugccugguga

SEQ ID NO: 502978 - RNA, 64 nt, Homo Sapiens
ugcuacccggagccccauucgaggggagcugagaggagcugagggucuggaaggagaacaggcu

SEQ ID NO: 502979 - RNA, 64 nt, Homo Sapiens
ggagcugaggugcuacccggagaacaggcugaggggagcugagaagcucucugggucuggaagg

SEQ ID NO: 502980 - RNA, 64 nt, Homo Sapiens; identical to SEQ ID NO: 315746

SEQ ID NO: 502981 - RNA, 64 nt, Homo Sapiens; identical to SEQ ID NO: 315747

SEQ ID NO: 502982 - RNA, 64 nt, Homo Sapiens; identical to SEQ ID NO: 315748

SEQ ID NO: 502983 - RNA, 64 nt, Homo Sapiens; identical to SEQ ID NO: 315749

SEQ ID NO: 502984 - RNA, 64 nt, Homo Sapiens
acuuggacacaucgccuuuggcagcacguaucaccucauucauccuuucucguuuguggacaaa

SEQ ID NO: 502985 - RNA, 64 nt, Homo Sapiens
cucuugggcuccuuuucaaggagccucagacaaccucauucagcagccccacucuccacuuucu

SEQ ID NO: 502986 - RNA, 64 nt, Homo Sapiens
uuaaaaguuuuugagaaaaaaaggaagaaaccaacucauucagaaggcucggauuccucuucca

SEQ ID NO: 502987 - RNA, 64 nt, Homo Sapiens
ucacauucaaggucuaggucuccaucaucuagaucucauucacgaaauaaauacagugaucauu

SEQ ID NO: 502988 - RNA, 64 nt, Homo Sapiens
ggugaagaaaaauccaagucugaacgggaaugcccucauucaaaaaaaagaacuuugaaagaga

SEQ ID NO: 502989 - RNA, 64 nt, Homo Sapiens
uuuuauccauuugauaauuuuacaguaaguaggucucauucauuuugacaguuaucaaagaugu

SEQ ID NO: 502990 - RNA, 64 nt, Homo Sapiens
gcuuuuacuguuuccacaguauuucaggucuuugcucauucacucaguaauacugagcacuuac

SEQ ID NO: 502991 - RNA, 64 nt, Homo Sapiens
cuuaugguuuaggccuugccuuagaaccugaggucucauucaucuaaaucccagacugacagac

SEQ ID NO: 502992 - RNA, 64 nt, Homo Sapiens
aaguucugugguuccaguaaaaagaggaauggcccucauucaguuucagaugaaaagaaaacuu

SEQ ID NO: 502993 - RNA, 64 nt, Homo Sapiens
cccuacuaugugcuggcagcuuuaaggagacacacucauucaucguuacuaaugucccagccuu

SEQ ID NO: 502994 - RNA, 64 nt, Homo Sapiens
cagugcuuguugcauuuauguuuccagugaaugacucauucagcccacuggcuuucugaagugu

SEQ ID NO: 502995 - RNA, 64 nt, Homo Sapiens
acaagagugaaggucaagggcccuccccaggcaucucauucauuacucagcuuccuuccugacc

SEQ ID NO: 502996 - RNA, 64 nt, Homo Sapiens
uccucugcucaagguuccccucugcucaucccuccucauucagacauccuccaccauaccagug

SEQ ID NO: 502997 - RNA, 64 nt, Homo Sapiens
uucugugaucauugguacugaagccagaaaagcucucauucaggaacucugaagagcaaaaagg

SEQ ID NO: 502998 - RNA, 64 nt, Homo Sapiens
uccagggaucccugucccccgacauugaagagaucucauucaggccagagacacagagaccaca

SEQ ID NO: 502999 - RNA, 64 nt, Homo Sapiens
agaggucuuagaagaaaauaucagaaacaaaagucucauucauaccaucaugggaagucaaguu

SEQ ID NO: 503000 - RNA, 64 nt, Homo Sapiens
cuugggauuggcccuuucuuucuuucccccaagccucauucauuccuucuugcuucucucuccu

SEQ ID NO: 503001 - RNA, 64 nt, Homo Sapiens
ugauugugugaaauccuuuagccagcguuucaaccucauucaacaccagaaaguucacagugga

SEQ ID NO: 503002 - RNA, 64 nt, Homo Sapiens
uaacagauggaaauccguuagccacaccuccagucucauucaacacuggacaguuuacaaugug

SEQ ID NO: 503003 - RNA, 64 nt, Homo Sapiens
ggaaaaggccgccaaacaaaaaaauaaccacugucucauucaugauuuccuuucugcuuuagca

SEQ ID NO: 503004 - RNA, 64 nt, Homo Sapiens
cuucuccugacauuaggagguggguauacauuuucucauucaaucccagaagggcaagcucucc

SEQ ID NO: 503005 - RNA, 64 nt, Homo Sapiens
uaccaaccacuccuugauccuuguuaaagauagucucauucagcucuccuuuugagaaguuaga

SEQ ID NO: 503006 - RNA, 64 nt, Homo Sapiens
uacaccaucacacuuuaauugagcucagccuuuacucauucacagcagcaaagccgggugcgau

SEQ ID NO: 503007 - RNA, 64 nt, Homo Sapiens; identical to SEQ ID NO: 305640

SEQ ID NO: 503008 - RNA, 64 nt, Homo Sapiens; identical to SEQ ID NO: 305641

SEQ ID NO: 503009 - RNA, 64 nt, Homo Sapiens; identical to SEQ ID NO: 125569

SEQ ID NO: 503010 - RNA, 64 nt, Homo Sapiens; identical to SEQ ID NO: 125570

SEQ ID NO: 503011 - RNA, 64 nt, Homo Sapiens; identical to SEQ ID NO: 125571

SEQ ID NO: 503012 - RNA, 64 nt, Homo Sapiens; identical to SEQ ID NO: 125572

SEQ ID NO: 503013 - RNA, 64 nt, Homo Sapiens; identical to SEQ ID NO: 125573

SEQ ID NO: 503014 - RNA, 64 nt, Homo Sapiens; identical to SEQ ID NO: 125574

SEQ ID NO: 503015 - RNA, 64 nt, Homo Sapiens; identical to SEQ ID NO: 125575

SEQ ID NO: 503016 - RNA, 64 nt, Homo Sapiens; identical to SEQ ID NO: 125576

SEQ ID NO: 503017 - RNA, 64 nt, Homo Sapiens; identical to SEQ ID NO: 125577

SEQ ID NO: 503018 - RNA, 64 nt, Homo Sapiens; identical to SEQ ID NO: 125578

SEQ ID NO: 503019 - RNA, 64 nt, Homo Sapiens; identical to SEQ ID NO: 125579

SEQ ID NO: 503020 - RNA, 64 nt, Homo Sapiens; identical to SEQ ID NO: 125580

SEQ ID NO: 503021 - RNA, 64 nt, Homo Sapiens; identical to SEQ ID NO: 125581

SEQ ID NO: 503022 - RNA, 64 nt, Homo Sapiens; identical to SEQ ID NO: 125582

SEQ ID NO: 503023 - RNA, 64 nt, Homo Sapiens; identical to SEQ ID NO: 125583

SEQ ID NO: 503024 - RNA, 64 nt, Homo Sapiens; identical to SEQ ID NO: 125584

SEQ ID NO: 503025 - RNA, 64 nt, Homo Sapiens; identical to SEQ ID NO: 125585

SEQ ID NO: 503026 - RNA, 64 nt, Homo Sapiens; identical to SEQ ID NO: 125586

SEQ ID NO: 503027 - RNA, 64 nt, Homo Sapiens; identical to SEQ ID NO: 125587

SEQ ID NO: 503028 - RNA, 64 nt, Homo Sapiens; identical to SEQ ID NO: 125588

SEQ ID NO: 503029 - RNA, 64 nt, Homo Sapiens; identical to SEQ ID NO: 125589

SEQ ID NO: 503030 - RNA, 64 nt, Homo Sapiens; identical to SEQ ID NO: 125590

SEQ ID NO: 503031 - RNA, 64 nt, Homo Sapiens; identical to SEQ ID NO: 125591

SEQ ID NO: 503032 - RNA, 64 nt, Homo Sapiens; identical to SEQ ID NO: 125592

SEQ ID NO: 503033 - RNA, 64 nt, Homo Sapiens; identical to SEQ ID NO: 125593

SEQ ID NO: 503034 - RNA, 64 nt, Homo Sapiens; identical to SEQ ID NO: 125594

SEQ ID NO: 503035 - RNA, 64 nt, Homo Sapiens; identical to SEQ ID NO: 125595

SEQ ID NO: 503036 - RNA, 64 nt, Homo Sapiens; identical to SEQ ID NO: 125596

SEQ ID NO: 503037 - RNA, 64 nt, Homo Sapiens; identical to SEQ ID NO: 125597

SEQ ID NO: 503038 - RNA, 64 nt, Homo Sapiens; identical to SEQ ID NO: 125598

SEQ ID NO: 503039 - RNA, 64 nt, Homo Sapiens; identical to SEQ ID NO: 125599

SEQ ID NO: 503040 - RNA, 64 nt, Homo Sapiens; identical to SEQ ID NO: 125600

SEQ ID NO: 503041 - RNA, 64 nt, Homo Sapiens; identical to SEQ ID NO: 125601

SEQ ID NO: 503042 - RNA, 64 nt, Homo Sapiens; identical to SEQ ID NO: 125602

SEQ ID NO: 503043 - RNA, 64 nt, Homo Sapiens; identical to SEQ ID NO: 125603

SEQ ID NO: 503044 - RNA, 64 nt, Homo Sapiens; identical to SEQ ID NO: 125604

SEQ ID NO: 503045 - RNA, 64 nt, Homo Sapiens; identical to SEQ ID NO: 125605

SEQ ID NO: 503046 - RNA, 64 nt, Homo Sapiens; identical to SEQ ID NO: 125606

SEQ ID NO: 503047 - RNA, 64 nt, Homo Sapiens; identical to SEQ ID NO: 125607

SEQ ID NO: 503048 - RNA, 64 nt, Homo Sapiens; identical to SEQ ID NO: 125608

SEQ ID NO: 503049 - RNA, 64 nt, Homo Sapiens; identical to SEQ ID NO: 125609

SEQ ID NO: 503050 - RNA, 64 nt, Homo Sapiens; identical to SEQ ID NO: 125610

SEQ ID NO: 503051 - RNA, 64 nt, Homo Sapiens; identical to SEQ ID NO: 125611

SEQ ID NO: 503052 - RNA, 64 nt, Homo Sapiens; identical to SEQ ID NO: 125612

SEQ ID NO: 503053 - RNA, 64 nt, Homo Sapiens; identical to SEQ ID NO: 125613

SEQ ID NO: 503054 - RNA, 64 nt, Homo Sapiens; identical to SEQ ID NO: 125614

SEQ ID NO: 503055 - RNA, 64 nt, Homo Sapiens; identical to SEQ ID NO: 125615

SEQ ID NO: 503056 - RNA, 64 nt, Homo Sapiens; identical to SEQ ID NO: 125616

SEQ ID NO: 503057 - RNA, 64 nt, Homo Sapiens; identical to SEQ ID NO: 125617

SEQ ID NO: 503058 - RNA, 64 nt, Homo Sapiens; identical to SEQ ID NO: 125618

SEQ ID NO: 503059 - RNA, 64 nt, Homo Sapiens; identical to SEQ ID NO: 125619

SEQ ID NO: 503060 - RNA, 64 nt, Homo Sapiens; identical to SEQ ID NO: 125620

SEQ ID NO: 503061 - RNA, 64 nt, Homo Sapiens; identical to SEQ ID NO: 125621

SEQ ID NO: 503062 - RNA, 64 nt, Homo Sapiens; identical to SEQ ID NO: 125622

SEQ ID NO: 503063 - RNA, 64 nt, Homo Sapiens; identical to SEQ ID NO: 125623

SEQ ID NO: 503064 - RNA, 64 nt, Homo Sapiens; identical to SEQ ID NO: 125624

SEQ ID NO: 503065 - RNA, 64 nt, Homo Sapiens; identical to SEQ ID NO: 125625

SEQ ID NO: 503066 - RNA, 64 nt, Homo Sapiens; identical to SEQ ID NO: 125626

SEQ ID NO: 503067 - RNA, 64 nt, Homo Sapiens; identical to SEQ ID NO: 125627

SEQ ID NO: 503068 - RNA, 64 nt, Homo Sapiens; identical to SEQ ID NO: 125628

SEQ ID NO: 503069 - RNA, 64 nt, Homo Sapiens; identical to SEQ ID NO: 125629

SEQ ID NO: 503070 - RNA, 64 nt, Homo Sapiens; identical to SEQ ID NO: 125630

SEQ ID NO: 503071 - RNA, 64 nt, Homo Sapiens; identical to SEQ ID NO: 125631

SEQ ID NO: 503072 - RNA, 64 nt, Homo Sapiens; identical to SEQ ID NO: 125632

SEQ ID NO: 503073 - RNA, 64 nt, Homo Sapiens; identical to SEQ ID NO: 125633

SEQ ID NO: 503074 - RNA, 64 nt, Homo Sapiens; identical to SEQ ID NO: 125634

SEQ ID NO: 503075 - RNA, 64 nt, Homo Sapiens; identical to SEQ ID NO: 125635

SEQ ID NO: 503076 - RNA, 64 nt, Homo Sapiens; identical to SEQ ID NO: 125636

SEQ ID NO: 503077 - RNA, 64 nt, Homo Sapiens; identical to SEQ ID NO: 125637

SEQ ID NO: 503078 - RNA, 64 nt, Homo Sapiens; identical to SEQ ID NO: 125638

SEQ ID NO: 503079 - RNA, 64 nt, Homo Sapiens; identical to SEQ ID NO: 125639

SEQ ID NO: 503080 - RNA, 64 nt, Homo Sapiens; identical to SEQ ID NO: 125640

SEQ ID NO: 503081 - RNA, 64 nt, Homo Sapiens; identical to SEQ ID NO: 125641

SEQ ID NO: 503082 - RNA, 64 nt, Homo Sapiens; identical to SEQ ID NO: 125642

SEQ ID NO: 503083 - RNA, 64 nt, Homo Sapiens
ugugcuaggucagucuggcacguaagaugaacaucccuaccaauacagagcucaccaucucuua

SEQ ID NO: 503084 - RNA, 64 nt, Homo Sapiens
uauguucccugacacauaucuugaauggagaccucccuaccaagugaugaaaguguugaaaaac

SEQ ID NO: 503085 - RNA, 64 nt, Homo Sapiens
acuccuguucccuuauucuucauucccaguaauucccuaccaaaugguggggacccugagccca

SEQ ID NO: 503086 - RNA, 64 nt, Homo Sapiens
cccaacacgucacccgaguagaagcugggcaaggcccuaccauccuggccgucuguucacaagc

SEQ ID NO: 503087 - RNA, 64 nt, Homo Sapiens
acugagcaccuuuuaaaccccucccucuucugcccccuaccacuuuucugcuguugccucucuu

SEQ ID NO: 503088 - RNA, 64 nt, Homo Sapiens
agcaguauagacaauuaugaguuugcccucuuuccccuaccaaguucaaaauauaucuaagaaa

SEQ ID NO: 503089 - RNA, 64 nt, Homo Sapiens
ccucccgccaaacaaaaccccaagagagcaaugccccuaccacccaagggugccauggucccgg

SEQ ID NO: 503090 - RNA, 64 nt, Homo Sapiens
aagagggaaugcggugaggcacucuggaauaugacccuaccagagguuggagaacaaacuuggg

SEQ ID NO: 503091 - RNA, 64 nt, Homo Sapiens
gacgucuguggccaagcgaguagugcccagggaguccagcgaauaaggaugcuagacacucauu

SEQ ID NO: 503092 - RNA, 64 nt, Homo Sapiens
ugacuuuuuucagaauauuugggaaacuguuuauuccagcgaugguuuucaaagcaguuaucuu

SEQ ID NO: 503093 - RNA, 64 nt, Homo Sapiens
cgacaaagauucuguuucaaauauagccacagaaauaaaggagggaccaauaucugggacaggu

SEQ ID NO: 503094 - RNA, 64 nt, Homo Sapiens
caagacagauucugcuuugaauauagcuacagaaauaaaggauggacuacagugugggacaggu

SEQ ID NO: 503095 - RNA, 64 nt, Homo Sapiens
cgaggaagacucuguuucgaauauagccacagaaauaaaggauggagaaaaaucugggacaggu

SEQ ID NO: 503096 - RNA, 64 nt, Homo Sapiens
ugagaaagauucuguuucgaacauagccacagaaauaaaggauggagaaaaaucugggacaggu

SEQ ID NO: 503097 - RNA, 64 nt, Homo Sapiens
caaagagguuuuuguacuugaucuccagacguuaauaaaggacuguuaauuguauguaccacac

SEQ ID NO: 503098 - RNA, 64 nt, Homo Sapiens
uguuccuuaguucccgugugaguggaacauugaaauaaaggaagaggguuuugguuuuuuccaa

SEQ ID NO: 503099 - RNA, 64 nt, Homo Sapiens
gagaaauuuuaguaugguuugaggaaaucaagugauaaaggaguaugcugaauaugcaaucauu

SEQ ID NO: 503100 - RNA, 64 nt, Homo Sapiens
guuggaaaaugaaguuggauuuuuguauucauguauaaaggaaagucucccagugcugucaaag

SEQ ID NO: 503101 - RNA, 64 nt, Homo Sapiens
augacaaaaucaaauuauaaaccaauagcggagcauaaaggaucagaaaaagaguugagauuua

SEQ ID NO: 503102 - RNA, 64 nt, Homo Sapiens
uucaugagaaaucgacuaccgaacugaaaggugaauaaaggacgggguuucagcauccaccaau

SEQ ID NO: 503103 - RNA, 64 nt, Homo Sapiens
gcuguucacucacaucccuaccuugcaugguaauauaaaggacuaggaagcagucauacuucca

SEQ ID NO: 503104 - RNA, 64 nt, Homo Sapiens
cagaccuaguuuaaaaggaauaaucaacaauuuuauaaaggagauggcuuauucaaccauagcc

SEQ ID NO: 503105 - RNA, 64 nt, Homo Sapiens
guucccauacuuuguuauuuuuuaaagcuauuguauaaaggaugcauguuuuuuuaauuauuau

SEQ ID NO: 503106 - RNA, 54 nt, Homo Sapiens; identical to SEQ ID NO: 375573

SEQ ID NO: 503107 - RNA, 64 nt, Homo Sapiens
uucuggagaaaaugaagguaacagugggcaauagauaaaggaaacuuuaaaaauuauucauaaa

SEQ ID NO: 503108 - RNA, 64 nt, Homo Sapiens
ugggccauacaaauguuuucucuagagcaagauaauaaaggagagaggaacaggaacauuguuu

SEQ ID NO: 503109 - RNA, 64 nt, Homo Sapiens
ugaaagaaagagugcacugauugcaaccaauuuaauaaaggaguuauaagaauguauaucuuuu

SEQ ID NO: 503110 - RNA, 64 nt, Homo Sapiens
cuaagugagguauaugaugaaggaauuaugcaucauaaaggaacguuucacaaaugaaugauua

SEQ ID NO: 503111 - RNA, 64 nt, Homo Sapiens
agugaaaaagcauaagaaauaguguuaggguuagauaaaggaaauaaauaaacaggaaauuaga

SEQ ID NO: 503112 - RNA, 64 nt, Homo Sapiens
uuccauuagagggacacagggcugugguggccacauaaaggaucgauuuggucuccucuggcag

SEQ ID NO: 503113 - RNA, 64 nt, Homo Sapiens
cuaaguauauugcugcacuugcaccauuucguagauaaaggaaaaccaguuuugaauuggaauu

SEQ ID NO: 503114 - RNA, 64 nt, Homo Sapiens
aacagcaaaacaaaaagcaaaagagucccugaguauaaaggaaacuucuguuuaaguugaaagc

SEQ ID NO: 503115 - RNA, 64 nt, Homo Sapiens
aagaaguuaccuacuccauaaagaaaaaaugaaaauaaaggaauagaauuaaaaaaauacaaaa

SEQ ID NO: 503116 - RNA, 64 nt, Homo Sapiens
aucacagcucuuuuagaauuaguuuauucagaaaauaaaggaguaacagaguaaaguggaagga

SEQ ID NO: 503117 - RNA, 64 nt, Homo Sapiens
ucagagaaacuuuaugcauaaugauguuuuuaucauaaaggaugacacaaaauuguuaguguuu

SEQ ID NO: 503118 - RNA, 64 nt, Homo Sapiens
ucacaaaaacgguaauguaagcaaagcuuugaaaauaaaggacugucuguuaaagccauuguca

SEQ ID NO: 503119 - RNA, 64 nt, Homo Sapiens
uuuuuuauuuugggaggggauuucguuuuugacuauaaaggagcuguauauuuugauuacuugu

SEQ ID NO: 503120 - RNA, 64 nt, Homo Sapiens
uuuaaauuugauacauaugcagaugaucauucugauaaaggaaagaguucucaaaggugaaacc

SEQ ID NO: 503121 - RNA, 64 nt, Homo Sapiens
gagagggaaaauguuuuguaagaaaccaaucaagauaaaggacagugaaguaauccguaccuug

SEQ ID NO: 503122 - RNA, 64 nt, Homo Sapiens
ucauuucugauauagaauugcaauuuuaacacacauaaaggauaaacuuuuagaaacuuaucuu

SEQ ID NO: 503123 - RNA, 64 nt, Homo Sapiens
aguuguauggaaaaauaguagaauuacacagcaugaaaagcagcccaugguuuaaauuauugga

SEQ ID NO: 503124 - RNA, 64 nt, Homo Sapiens
ugguuguuaucuuacuucuacaguggaagagauugaaaagcauuugucagguuaaugcuaaauc

SEQ ID NO: 503125 - RNA, 64 nt, Homo Sapiens
ucggguuguccaauucuguacuuccucugguuuugaaaagcagugaguaacggcuaagaaccuc

SEQ ID NO: 503126 - RNA, 64 nt, Homo Sapiens
caggccucccggucagggagaugggaaacaaccugaaaagcagguucugcaguccacgcugaac

SEQ ID NO: 503127 - RNA, 64 nt, Homo Sapiens
cuagucuaaccauggugcuaaaaaugauggcuuggaaaagcagguuguuugcuuaauaaauuau

SEQ ID NO: 503128 - RNA, 64 nt, Homo Sapiens
uggcaagaggauuauggcuauagcaaccuagccagaaaagcaagaacuuccuagaguugcaccc

SEQ ID NO: 503129 - RNA, 64 nt, Homo Sapiens
aaacaaaaauagguaguucuuuaacauuaugagagaaaagcauaucguauauaugagcuauacu

SEQ ID NO: 503130 - RNA, 64 nt, Homo Sapiens
cuauaaagcaaauaucuauuauauuuuaugccaagaaaagcauagguaacuuuaugucuagcaa

SEQ ID NO: 503131 - RNA, 64 nt, Homo Sapiens
ccugaauaaucaaaaauugguaaucuauggguuagaaaagcaucaggaaauacagaagccugaa

SEQ ID NO: 503132 - RNA, 64 nt, Homo Sapiens
guccacuggaccccuucuggcauucucugugggggaaaagcaguaacaaacucuagaauauuga

SEQ ID NO: 503133 - RNA, 64 nt, Homo Sapiens
acauagaauuugugaauuacuuucugacuacaaagaaaagcagaugccaaaauacucuucugaa

SEQ ID NO: 503134 - RNA, 64 nt, Homo Sapiens
uggaauauuacacgaugagauucugauucaugaagaaaagcagauagaagugguugaaaaaaug

SEQ ID NO: 503135 - RNA, 64 nt, Homo Sapiens
ugcacuugcagcuuuugagguuuaaagaagaaaggaaaagcaaauuaugcuauauaauacuuca

SEQ ID NO: 503136 - RNA, 64 nt, Homo Sapiens
uaacuggggggaaauggacaguuugaguuuguuggaaaagcaguucuuagcaccuuuucaaggg

SEQ ID NO: 503137 - RNA, 64 nt, Homo Sapiens
aaaggguugauauuuuuuaacuccaaauuuuuaagaaaagcaucuaugaggaauguuuuaauac

SEQ ID NO: 503138 - RNA, 64 nt, Homo Sapiens
caacuucuucauggaacucaaaaauuuuacauccgaaaagcaaccugaaauuuuacauccgaac

SEQ ID NO: 503139 - RNA, 64 nt, Homo Sapiens
ugaguacaauuguuaugaucuuucuuuucucuaugaaaagcaacagugaauuaucccugcuggc

SEQ ID NO: 503140 - RNA, 64 nt, Homo Sapiens
aucaacuuuucugagcugguaguguggaauuggagaaaagcacacuacuaaccugacaucacca

SEQ ID NO: 503141 - RNA, 64 nt, Homo Sapiens
ucucacaagcaucuuugucuugcaaauccuaagggaaaagcaagucccugcagugagcacuagg

SEQ ID NO: 503142 - RNA, 64 nt, Homo Sapiens
gacuuccgaauagaauguuuucuuuaagaggcaugaaaagcaacuauuguuguguuacaguguu

SEQ ID NO: 503143 - RNA, 64 nt, Homo Sapiens
ccucaguaagcagcuugccaaucacuccaggucugaaaagcaagucccccagccccaccccagg

SEQ ID NO: 503144 - RNA, 64 nt, Homo Sapiens
aaaaagugauuuaaaaaugaucuuaccuguaccagaaaagcaaaguuaaaggaaacaaaauuug

SEQ ID NO: 503145 - RNA, 64 nt, Homo Sapiens
uguuuaagcccuuggacugagcgcuuccaguuccgaaaagcagaugaaaagcaagguuugugcu

SEQ ID NO: 503146 - RNA, 64 nt, Homo Sapiens
guuugugcugcgcuuccaguaccccagcgccuuugaaaagcaagcgagauggggccgccgagag

SEQ ID NO: 503147 - RNA, 64 nt, Homo Sapiens
guccagugccuucugagaaagggagccauugagagaaaagcaugacuucgucagaaccuucugu

SEQ ID NO: 503148 - RNA, 64 nt, Homo Sapiens
ucgucagaaccuucuguggggaagaauuuggaaugaaaagcacuuuuauagaaacacaggagag

SEQ ID NO: 503149 - RNA, 64 nt, Homo Sapiens
acccaguauuuaaagucuaugcuuaaaagauggagaaaagcaaaaaaagggaguuacagaggcu

SEQ ID NO: 503150 - RNA, 64 nt, Homo Sapiens
gaccugagccgaggagaggaugcauauauuaaaagaaaagcaaacaaaugccuacuauuuuaua

SEQ ID NO: 503151 - RNA, 64 nt, Homo Sapiens
uguucaaagaguuuucuaaagugauaaaaccaaagaaaagcauguggaaaagcagaagcuuaga

SEQ ID NO: 503152 - RNA, 64 nt, Homo Sapiens
uuucuaaagugauaaaaccaaagaaaagcauguggaaaagcagaagcuuagaaaguugugguca

SEQ ID NO: 503153 - RNA, 64 nt, Homo Sapiens
uuaaaaagauaccaacauucuaccaaaagauggagaaaagcacaaaaaggagaauugcaaauuu

SEQ ID NO: 503154 - RNA, 64 nt, Homo Sapiens
gaauaagcaugccuguuuucggaauucauacugcgaaaagcaauugcccucucaaauguugcua

SEQ ID NO: 503155 - RNA, 64 nt, Homo Sapiens
ccgcgcccccaccccagaccccgagccaccccaggaaaagcacaaggacugccgccuucucgcu

SEQ ID NO: 503156 - RNA, 64 nt, Homo Sapiens
caaaugucugggaagcccuccaagaaaaaaaauagaaaagcacuugaagaauauucccaauauu

SEQ ID NO: 503157 - RNA, 64 nt, Homo Sapiens
aaauguuguucaacaccagaaaauuuauauuggagaaaagcacuguaaauguaaugcauuugug

SEQ ID NO: 503158 - RNA, 64 nt, Homo Sapiens
ucaaauuauauuuuuucuugaaaaauuaguuuuugaaaagcaaaugauguaauucaacucaaau

SEQ ID NO: 503159 - RNA, 64 nt, Homo Sapiens
caaggaagaccagaugggcuaccaccagagcauagaaaagcaugucacuuaaaggauuugacuu

SEQ ID NO: 503160 - RNA, 64 nt, Homo Sapiens
uucuuuugaagucuuagucuugccgaguuggcgggaaaagcaaauugaaaggcaggcuucacag

SEQ ID NO: 503161 - RNA, 64 nt, Homo Sapiens
uucagaugaacucugcuguuuagaaguaaccacagaaaagcaaagucaguguacacucugagug

SEQ ID NO: 503162 - RNA, 64 nt, Homo Sapiens
uuuaacucauuuccuugagcuuauacaaaacauagaaaagcaaacuguuaaaguagucaauaau

SEQ ID NO: 503163 - RNA, 64 nt, Homo Sapiens
guuuuuaauauaacccauaaucaagaacaugagcgaaaagcagacauaaaucgauauggauggu

SEQ ID NO: 503164 - RNA, 64 nt, Homo Sapiens
cuccauguauugguuagcacaguuuauaguaagugaaaagcaagggacccaccuacauuaccuu

SEQ ID NO: 503165 - RNA, 64 nt, Homo Sapiens
cagccugaaaugugaacugaacaggagaaaaaaagaaaagcaaaaaacuccuguaacccuugag

SEQ ID NO: 503166 - RNA, 64 nt, Homo Sapiens
gagaacuacauuuguuuuuaacauauguguuugagaaaagcauauggaguguuucaccgcaggc

SEQ ID NO: 503167 - RNA, 64 nt, Homo Sapiens
cgcgcauaccugcuuccaagaauaaaacaguucugaaaagcaaccgcaaagccgggcgcggugg

SEQ ID NO: 503168 - RNA, 64 nt, Homo Sapiens
aaaaaaaaaagaaagaaagaaagagaaaagaaaagaaaagcaaccacagccagccuuagggaaa

SEQ ID NO: 503169 - RNA, 64 nt, Homo Sapiens
gaggcccagacaggcucacucaagcucuuuaacugaaaagcaacaagccacuccaggacaaggu

SEQ ID NO: 503170 - RNA, 64 nt, Homo Sapiens
aggaguaggagagaggaaacauuugacuuaucuggaaaagcaaaauguacuuaagaauaagaau

SEQ ID NO: 503171 - RNA, 64 nt, Homo Sapiens
gcagcaaguaacuauguguaaguccucaucaaaugaaaagcagaaagacaagaacaauuaguca

SEQ ID NO: 503172 - RNA, 64 nt, Homo Sapiens
aguuucuuaugugcccuuaaagacuguuagacaagaaaagcauucacuggcuaauaauccauag

SEQ ID NO: 503173 - RNA, 64 nt, Homo Sapiens
ugcuuuuuaaaaaucagaacaagaugaaaaaaaggaaaagcaggaaagcugaaaauuuagaagc

SEQ ID NO: 503174 - RNA, 64 nt, Homo Sapiens
acgcucucacugagaucagguauagaccccauuggaaaagcaaacaaugaaagaaaacuguuua

SEQ ID NO: 503175 - RNA, 64 nt, Homo Sapiens
ucuguauaaaugugaaauuuguaaauacauuauugaaaagcaaaaauguucacugaauaaauaa

SEQ ID NO: 503176 - RNA, 64 nt, Homo Sapiens
ccuuaauuugaaauaacagcaucagaaaaaguccgaaaagcaaagagauccaacuauuucuuuc

SEQ ID NO: 503177 - RNA, 64 nt, Homo Sapiens
agaauccuaaaggacauaaccaucaugagcaacagaaaagcagucucuuucaaaaagcacagug

SEQ ID NO: 503178 - RNA, 64 nt, Homo Sapiens
aaugaauaaaaggacuuuccgcgccucuugaggagaaaagcaauaaagcagagauggaaauaau

SEQ ID NO: 503179 - RNA, 64 nt, Homo Sapiens
uagaaguggcugaaaaugaauucugauucaugaagaaaagcagauggaauauuacaagaugaga

SEQ ID NO: 503180 - RNA, 64 nt, Homo Sapiens
acaccugaaagccagcaauuuuaauuccaccaaggaaaagcagacugacaauggugaugaugga

SEQ ID NO: 503181 - RNA, 64 nt, Homo Sapiens
auacuugagaugaaaguuggugucuguggggaaagaaaagcagauguaaagaacaacacuuguu

SEQ ID NO: 503182 - RNA, 64 nt, Homo Sapiens
ugcauuaguauguuugccuuguaugauuucugaagaaaagcaaaauuuuauguaaucuuuauaa

SEQ ID NO: 503183 - RNA, 64 nt, Homo Sapiens
ccauaccuccuugaacuacuucauaacuugucaagaaaagcaguuugcagcaagggcauguggu

SEQ ID NO: 503184 - RNA, 64 nt, Homo Sapiens
agacugcuuaucucagagugaagauacugcggcugaaaagcacuaguuugauauaaaauuaaaa

SEQ ID NO: 503185 - RNA, 64 nt, Homo Sapiens
uuuuuugcagcuugcugauauuuuauauaaaaaagaaaagcaaagcaaaagagaagcugauagu

SEQ ID NO: 503186 - RNA, 64 nt, Homo Sapiens
uuuccccauccuuggugagauaacaagcuaucgcgaaaagcacuugggagauuuggaugauuug

SEQ ID NO: 503187 - RNA, 64 nt, Homo Sapiens
acuggagagaaacccugugaauguaagaaauguagaaaagcauuccauaauuucucuucuuugc

SEQ ID NO: 503188 - RNA, 64 nt, Homo Sapiens
aauggagagaaacccuaugaauguaaagaaugcagaaaagcauucagcuugccuacuuccuuuc

SEQ ID NO: 503189 - RNA, 64 nt, Homo Sapiens
uagauacuacuacucagcucguguaaaaaauguggaaaagcauuacuggagauaaacccuuuga

SEQ ID NO: 503190 - RNA, 64 nt, Homo Sapiens
ccgauaccaccaaucugcucguguaaagaauguggaaaagcauuacuggagauaaacccuuuaa

SEQ ID NO: 503191 - RNA, 64 nt, Homo Sapiens
aaagauagucuucccuguaccuuggggagaggcugaaaagcacauggcaggggguggggauuau

SEQ ID NO: 503192 - RNA, 64 nt, Homo Sapiens
uuagcugcaucugucuccccuuuuuccaacuugugaaaagcagucaguuuauaggguuggguuu

SEQ ID NO: 503193 - RNA, 64 nt, Homo Sapiens
uuccuacccccuaccuccagaguuguugaaagcugaaaagcauacaagauucuuccuuuuaacu

SEQ ID NO: 503194 - RNA, 64 nt, Homo Sapiens
uaggcaucauuucacaaggucaguaaugcugcaggaaaagcaaaauugcaaucuacguaucuau

SEQ ID NO: 503195 - RNA, 64 nt, Homo Sapiens
caagauuugcaggccuugcucugggaugagagcagaaaagcauugggacucagguaagcccagc

SEQ ID NO: 503196 - RNA, 64 nt, Homo Sapiens
uuauauguucacaaaauggaccaauuuuauuggagaaaagcaaguucuuugccuagccaagcag

SEQ ID NO: 503197 - RNA, 64 nt, Homo Sapiens; identical to SEQ ID NO: 199847

SEQ ID NO: 503198 - RNA, 64 nt, Homo Sapiens; identical to SEQ ID NO: 199848

SEQ ID NO: 503199 - RNA, 64 nt, Homo Sapiens; identical to SEQ ID NO: 199849

SEQ ID NO: 503200 - RNA, 64 nt, Homo Sapiens; identical to SEQ ID NO: 199850

SEQ ID NO: 503201 - RNA, 64 nt, Homo Sapiens; identical to SEQ ID NO: 199851

SEQ ID NO: 503202 - RNA, 64 nt, Homo Sapiens; identical to SEQ ID NO: 199852

SEQ ID NO: 503203 - RNA, 64 nt, Homo Sapiens; identical to SEQ ID NO: 199853

SEQ ID NO: 503204 - RNA, 64 nt, Homo Sapiens; identical to SEQ ID NO: 199854

SEQ ID NO: 503205 - RNA, 55 nt, Homo Sapiens; identical to SEQ ID NO: 199855

SEQ ID NO: 503206 - RNA, 64 nt, Homo Sapiens; identical to SEQ ID NO: 199856

SEQ ID NO: 503207 - RNA, 64 nt, Homo Sapiens; identical to SEQ ID NO: 199857

SEQ ID NO: 503208 - RNA, 64 nt, Homo Sapiens; identical to SEQ ID NO: 199858

SEQ ID NO: 503209 - RNA, 64 nt, Homo Sapiens; identical to SEQ ID NO: 199859

SEQ ID NO: 503210 - RNA, 64 nt, Homo Sapiens; identical to SEQ ID NO: 199860

SEQ ID NO: 503211 - RNA, 64 nt, Homo Sapiens; identical to SEQ ID NO: 199861

SEQ ID NO: 503212 - RNA, 64 nt, Homo Sapiens; identical to SEQ ID NO: 199862

SEQ ID NO: 503213 - RNA, 64 nt, Homo Sapiens; identical to SEQ ID NO: 199863

SEQ ID NO: 503214 - RNA, 64 nt, Homo Sapiens; identical to SEQ ID NO: 199864

SEQ ID NO: 503215 - RNA, 64 nt, Homo Sapiens; identical to SEQ ID NO: 199865

SEQ ID NO: 503216 - RNA, 64 nt, Homo Sapiens; identical to SEQ ID NO: 199866

SEQ ID NO: 503217 - RNA, 64 nt, Homo Sapiens
uggaaagugaggagcgucucugcccggccgccaucccaucuaggaagugaggagcgccucuucc

SEQ ID NO: 503218 - RNA, 64 nt, Homo Sapiens
uaggaagugaggagcgccucuucccacccgccaucccaucuaggaagugaggagcuucucugcc

SEQ ID NO: 503219 - RNA, 64 nt, Homo Sapiens
uggaaagugaggagcgccucugcccggccgccaucccaucuaggaagugaggagcgccucuucc

SEQ ID NO: 503220 - RNA, 64 nt, Homo Sapiens
uaggaagugaggagcgccucuucccagccgccaucccaucuaggaagugaggagcgucucugcc

SEQ ID NO: 503221 - RNA, 64 nt, Homo Sapiens; identical to SEQ ID NO: 415214

SEQ ID NO: 503222 - RNA, 64 nt, Homo Sapiens; identical to SEQ ID NO: 415215

SEQ ID NO: 503223 - RNA, 64 nt, Homo Sapiens; identical to SEQ ID NO: 415216

SEQ ID NO: 503224 - RNA, 64 nt, Homo Sapiens; identical to SEQ ID NO: 415217

SEQ ID NO: 503225 - RNA, 64 nt, Homo Sapiens; identical to SEQ ID NO: 415218

SEQ ID NO: 503226 - RNA, 64 nt, Homo Sapiens; identical to SEQ ID NO: 415219

SEQ ID NO: 503227 - RNA, 64 nt, Homo Sapiens; identical to SEQ ID NO: 415220

SEQ ID NO: 503228 - RNA, 64 nt, Homo Sapiens; identical to SEQ ID NO: 415221

SEQ ID NO: 503229 - RNA, 55 nt, Homo Sapiens; identical to SEQ ID NO: 415222

SEQ ID NO: 503230 - RNA, 64 nt, Homo Sapiens; identical to SEQ ID NO: 415223

SEQ ID NO: 503231 - RNA, 64 nt, Homo Sapiens; identical to SEQ ID NO: 415224

SEQ ID NO: 503232 - RNA, 64 nt, Homo Sapiens; identical to SEQ ID NO: 415225

SEQ ID NO: 503233 - RNA, 64 nt, Homo Sapiens; identical to SEQ ID NO: 415226

SEQ ID NO: 503234 - RNA, 64 nt, Homo Sapiens; identical to SEQ ID NO: 415227

SEQ ID NO: 503235 - RNA, 64 nt, Homo Sapiens; identical to SEQ ID NO: 415228

SEQ ID NO: 503236 - RNA, 50 nt, Homo Sapiens; identical to SEQ ID NO: 415229

SEQ ID NO: 503237 - RNA, 64 nt, Homo Sapiens; identical to SEQ ID NO: 415230

SEQ ID NO: 503238 - RNA, 64 nt, Homo Sapiens; identical to SEQ ID NO: 415231

SEQ ID NO: 503239 - RNA, 64 nt, Homo Sapiens; identical to SEQ ID NO: 415232

SEQ ID NO: 503240 - RNA, 64 nt, Homo Sapiens; identical to SEQ ID NO: 415233

SEQ ID NO: 503241 - RNA, 64 nt, Homo Sapiens; identical to SEQ ID NO: 415234

SEQ ID NO: 503242 - RNA, 64 nt, Homo Sapiens; identical to SEQ ID NO: 415235

SEQ ID NO: 503243 - RNA, 64 nt, Homo Sapiens; identical to SEQ ID NO: 415236

SEQ ID NO: 503244 - RNA, 64 nt, Homo Sapiens; identical to SEQ ID NO: 415237

SEQ ID NO: 503245 - RNA, 64 nt, Homo Sapiens; identical to SEQ ID NO: 415238

SEQ ID NO: 503246 - RNA, 64 nt, Homo Sapiens; identical to SEQ ID NO: 415239

SEQ ID NO: 503247 - RNA, 64 nt, Homo Sapiens; identical to SEQ ID NO: 415240

SEQ ID NO: 503248 - RNA, 64 nt, Homo Sapiens; identical to SEQ ID NO: 415241

SEQ ID NO: 503249 - RNA, 64 nt, Homo Sapiens; identical to SEQ ID NO: 415242

SEQ ID NO: 503250 - RNA, 64 nt, Homo Sapiens; identical to SEQ ID NO: 415243

SEQ ID NO: 503251 - RNA, 64 nt, Homo Sapiens; identical to SEQ ID NO: 415244

SEQ ID NO: 503252 - RNA, 64 nt, Homo Sapiens; identical to SEQ ID NO: 415245

SEQ ID NO: 503253 - RNA, 64 nt, Homo Sapiens; identical to SEQ ID NO: 415246

SEQ ID NO: 503254 - RNA, 64 nt, Homo Sapiens; identical to SEQ ID NO: 415247

SEQ ID NO: 503255 - RNA, 64 nt, Homo Sapiens; identical to SEQ ID NO: 415248

SEQ ID NO: 503256 - RNA, 64 nt, Homo Sapiens; identical to SEQ ID NO: 415249

SEQ ID NO: 503257 - RNA, 64 nt, Homo Sapiens; identical to SEQ ID NO: 415250

SEQ ID NO: 503258 - RNA, 64 nt, Homo Sapiens; identical to SEQ ID NO: 415251

SEQ ID NO: 503259 - RNA, 64 nt, Homo Sapiens; identical to SEQ ID NO: 415252

SEQ ID NO: 503260 - RNA, 64 nt, Homo Sapiens; identical to SEQ ID NO: 415253

SEQ ID NO: 503261 - RNA, 64 nt, Homo Sapiens; identical to SEQ ID NO: 415254

SEQ ID NO: 503262 - RNA, 64 nt, Homo Sapiens; identical to SEQ ID NO: 415255

SEQ ID NO: 503263 - RNA, 64 nt, Homo Sapiens; identical to SEQ ID NO: 415256

SEQ ID NO: 503264 - RNA, 64 nt, Homo Sapiens; identical to SEQ ID NO: 216073

SEQ ID NO: 503265 - RNA, 64 nt, Homo Sapiens; identical to SEQ ID NO: 216074

SEQ ID NO: 503266 - RNA, 64 nt, Homo Sapiens; identical to SEQ ID NO: 216075

SEQ ID NO: 503267 - RNA, 64 nt, Homo Sapiens; identical to SEQ ID NO: 216076

SEQ ID NO: 503268 - RNA, 64 nt, Homo Sapiens; identical to SEQ ID NO: 216077

SEQ ID NO: 503269 - RNA, 64 nt, Homo Sapiens; identical to SEQ ID NO: 216078

SEQ ID NO: 503270 - RNA, 64 nt, Homo Sapiens; identical to SEQ ID NO: 216079

SEQ ID NO: 503271 - RNA, 64 nt, Homo Sapiens; identical to SEQ ID NO: 216080

SEQ ID NO: 503272 - RNA, 64 nt, Homo Sapiens; identical to SEQ ID NO: 216081

SEQ ID NO: 503273 - RNA, 64 nt, Homo Sapiens; identical to SEQ ID NO: 216082

SEQ ID NO: 503274 - RNA, 64 nt, Homo Sapiens; identical to SEQ ID NO: 216083

SEQ ID NO: 503275 - RNA, 64 nt, Homo Sapiens; identical to SEQ ID NO: 216084

SEQ ID NO: 503276 - RNA, 64 nt, Homo Sapiens; identical to SEQ ID NO: 216085

SEQ ID NO: 503277 - RNA, 64 nt, Homo Sapiens; identical to SEQ ID NO: 216086

SEQ ID NO: 503278 - RNA, 64 nt, Homo Sapiens; identical to SEQ ID NO: 216087

SEQ ID NO: 503279 - RNA, 64 nt, Homo Sapiens; identical to SEQ ID NO: 216088

SEQ ID NO: 503280 - RNA, 64 nt, Homo Sapiens; identical to SEQ ID NO: 216089

SEQ ID NO: 503281 - RNA, 64 nt, Homo Sapiens; identical to SEQ ID NO: 216090

SEQ ID NO: 503282 - RNA, 64 nt, Homo Sapiens; identical to SEQ ID NO: 216091

SEQ ID NO: 503283 - RNA, 64 nt, Homo Sapiens; identical to SEQ ID NO: 216092

SEQ ID NO: 503284 - RNA, 64 nt, Homo Sapiens; identical to SEQ ID NO: 216093

SEQ ID NO: 503285 - RNA, 64 nt, Homo Sapiens; identical to SEQ ID NO: 216094

SEQ ID NO: 503286 - RNA, 64 nt, Homo Sapiens; identical to SEQ ID NO: 216095

SEQ ID NO: 503287 - RNA, 64 nt, Homo Sapiens; identical to SEQ ID NO: 216096

SEQ ID NO: 503288 - RNA, 64 nt, Homo Sapiens; identical to SEQ ID NO: 216097

SEQ ID NO: 503289 - RNA, 64 nt, Homo Sapiens; identical to SEQ ID NO: 216098

SEQ ID NO: 503290 - RNA, 64 nt, Homo Sapiens; identical to SEQ ID NO: 216099

SEQ ID NO: 503291 - RNA, 64 nt, Homo Sapiens; identical to SEQ ID NO: 216100

SEQ ID NO: 503292 - RNA, 64 nt, Homo Sapiens; identical to SEQ ID NO: 216101

SEQ ID NO: 503293 - RNA, 64 nt, Homo Sapiens; identical to SEQ ID NO: 216102

SEQ ID NO: 503294 - RNA, 64 nt, Homo Sapiens; identical to SEQ ID NO: 216103

SEQ ID NO: 503295 - RNA, 64 nt, Homo Sapiens; identical to SEQ ID NO: 216104

SEQ ID NO: 503296 - RNA, 64 nt, Homo Sapiens; identical to SEQ ID NO: 216105

SEQ ID NO: 503297 - RNA, 64 nt, Homo Sapiens; identical to SEQ ID NO: 216106

SEQ ID NO: 503298 - RNA, 64 nt, Homo Sapiens; identical to SEQ ID NO: 216107

SEQ ID NO: 503299 - RNA, 64 nt, Homo Sapiens; identical to SEQ ID NO: 216108

SEQ ID NO: 503300 - RNA, 64 nt, Homo Sapiens; identical to SEQ ID NO: 216109

SEQ ID NO: 503301 - RNA, 64 nt, Homo Sapiens; identical to SEQ ID NO: 216110

SEQ ID NO: 503302 - RNA, 64 nt, Homo Sapiens; identical to SEQ ID NO: 216111

SEQ ID NO: 503303 - RNA, 64 nt, Homo Sapiens; identical to SEQ ID NO: 216112

SEQ ID NO: 503304 - RNA, 64 nt, Homo Sapiens; identical to SEQ ID NO: 216113

SEQ ID NO: 503305 - RNA, 64 nt, Homo Sapiens; identical to SEQ ID NO: 216114

SEQ ID NO: 503306 - RNA, 64 nt, Homo Sapiens; identical to SEQ ID NO: 216115

SEQ ID NO: 503307 - RNA, 64 nt, Homo Sapiens; identical to SEQ ID NO: 216116

SEQ ID NO: 503308 - RNA, 64 nt, Homo Sapiens; identical to SEQ ID NO: 216117

SEQ ID NO: 503309 - RNA, 64 nt, Homo Sapiens; identical to SEQ ID NO: 216118

SEQ ID NO: 503310 - RNA, 64 nt, Homo Sapiens; identical to SEQ ID NO: 216119

SEQ ID NO: 503311 - RNA, 64 nt, Homo Sapiens; identical to SEQ ID NO: 216120

SEQ ID NO: 503312 - RNA, 64 nt, Homo Sapiens; identical to SEQ ID NO: 216121

SEQ ID NO: 503313 - RNA, 64 nt, Homo Sapiens; identical to SEQ ID NO: 216121

SEQ ID NO: 503314 - RNA, 64 nt, Homo Sapiens; identical to SEQ ID NO: 216123

SEQ ID NO: 503315 - RNA, 64 nt, Homo Sapiens; identical to SEQ ID NO: 216124

SEQ ID NO: 503316 - RNA, 64 nt, Homo Sapiens; identical to SEQ ID NO: 216125

SEQ ID NO: 503317 - RNA, 64 nt, Homo Sapiens; identical to SEQ ID NO: 216126

SEQ ID NO: 503318 - RNA, 64 nt, Homo Sapiens; identical to SEQ ID NO: 216127

SEQ ID NO: 503319 - RNA, 64 nt, Homo Sapiens; identical to SEQ ID NO: 216128

SEQ ID NO: 503320 - RNA, 64 nt, Homo Sapiens; identical to SEQ ID NO: 216129

SEQ ID NO: 503321 - RNA, 64 nt, Homo Sapiens; identical to SEQ ID NO: 216130

SEQ ID NO: 503322 - RNA, 64 nt, Homo Sapiens; identical to SEQ ID NO: 216131

SEQ ID NO: 503323 - RNA, 64 nt, Homo Sapiens; identical to SEQ ID NO: 216132

SEQ ID NO: 503324 - RNA, 64 nt, Homo Sapiens; identical to SEQ ID NO: 216133

SEQ ID NO: 503325 - RNA, 64 nt, Homo Sapiens; identical to SEQ ID NO: 216134

SEQ ID NO: 503326 - RNA, 64 nt, Homo Sapiens; identical to SEQ ID NO: 216135

SEQ ID NO: 503327 - RNA, 64 nt, Homo Sapiens; identical to SEQ ID NO: 216136

SEQ ID NO: 503328 - RNA, 64 nt, Homo Sapiens; identical to SEQ ID NO: 216137

SEQ ID NO: 503329 - RNA, 64 nt, Homo Sapiens; identical to SEQ ID NO: 216138

SEQ ID NO: 503330 - RNA, 64 nt, Homo Sapiens; identical to SEQ ID NO: 216139

SEQ ID NO: 503331 - RNA, 64 nt, Homo Sapiens; identical to SEQ ID NO: 216140

SEQ ID NO: 503332 - RNA, 64 nt, Homo Sapiens; identical to SEQ ID NO: 216141

SEQ ID NO: 503333 - RNA, 64 nt, Homo Sapiens; identical to SEQ ID NO: 216142

SEQ ID NO: 503334 - RNA, 64 nt, Homo Sapiens; identical to SEQ ID NO: 216143

SEQ ID NO: 503335 - RNA, 64 nt, Homo Sapiens
aagccaauccuuuuucuuuuuuuuggaggucccaccgagauagauaggaacuuggauugcugaa

SEQ ID NO: 503336 - RNA, 64 nt, Homo Sapiens
gacuuuucaugaaacugaauaaaagaaauccuuuccgagauagaggagauuuguaggugaaugc

SEQ ID NO: 503337 - RNA, 64 nt, Homo Sapiens
gucacugcacuccagccugggagcuugcagggagccgagauaguuggcgugaauccgggaggcg

SEQ ID NO: 503338 - RNA, 64 nt, Homo Sapiens
caaggccaaaggaagcacauucuaaagcugccagccgagauagcccucagaucuucuguggguu

SEQ ID NO: 503339 - RNA, 64 nt, Homo Sapiens
aggggagccuuguguuucuucaaaaagagaugccccgagauagauuuugugguaugagaacagg

SEQ ID NO: 503340 - RNA, 64 nt, Homo Sapiens
guguggagaaugcauugacagguucuuugcggagccgagauaccaugcagacauuuugcuuguu

SEQ ID NO: 503341 - RNA, 64 nt, Homo Sapiens
ccaccagacagagagagagagcacuugauucuucccgagauagccaccuggaaacacuaggugc

SEQ ID NO: 503342 - RNA, 64 nt, Homo Sapiens
ucgcuugaaccuggcaggcggagguugcagugagccgagauagugccacagcucuccagccugg

SEQ ID NO: 503343 - RNA, 64 nt, Homo Sapiens
ugcuugaacccaggaggcagaggguugcagugagccgagauagcaccauugcacuccagccugg

SEQ ID NO: 503344 - RNA, 64 nt, Homo Sapiens
auuaugccuaguuugucauaucuacucaacaauuccgagauagggaguauuaguacauaaauuu

SEQ ID NO: 503345 - RNA, 64 nt, Homo Sapiens
ugagggaaguucuuugccuggagguaugaggccuccgagauagcgguugacucuucacaugaug

SEQ ID NO: 503346 - RNA, 64 nt, Homo Sapiens
cggauugcuugagcccaggaagcacuuugagaggccgagauagguggcucaugccuguaauccu

SEQ ID NO: 503347 - RNA, 64 nt, Homo Sapiens
guggcacaucuguccugacacacccucccggaauccgagauaggaguugagggaaacccccagc

SEQ ID NO: 503348 - RNA, 64 nt, Homo Sapiens
uggcaugaacccgggaggaggagcuugcagugagccgagauagcgccacugcaguccggccugg

SEQ ID NO: 503349 - RNA, 64 nt, Homo Sapiens
cuuccaaugcuuuaacucacuuaauccucacaacccgagauagguacuguuaccauccucucug

SEQ ID NO: 503350 - RNA, 64 nt, Homo Sapiens
cuaauuuaacuuacaaaugagucuuccuucaccaccgagauaugauuauuuugcuuuauuaaaa

SEQ ID NO: 503351 - RNA, 64 nt, Homo Sapiens
uagccaugucugccuugggcuuggugagacagugccgagauagauucugaaugaucaauauagc

SEQ ID NO: 503352 - RNA, 64 nt, Homo Sapiens
gagccacugugcccagcccagguuuugaaguuguccgagauagcagucugcucucuacugccuu

SEQ ID NO: 503353 - RNA, 64 nt, Homo Sapiens
ugggagggaaguggagguugcuguacaggaaaaaccgagauaggggaggggggagggggaagca

SEQ ID NO: 503354 - RNA, 64 nt, Homo Sapiens
cucggcgucccccagucuccaggagccucucccuccgagauacccacccagcuuugucaaucac

SEQ ID NO: 503355 - RNA, 64 nt, Homo Sapiens
ggguuccaggaaaggggagguccccccccccaccccgagauacgcucccuaaaugaucucuccu

SEQ ID NO: 503356 - RNA, 64 nt, Homo Sapiens
gccauuguacuccagcuugggaguuugcagugagccgagauaguucgcuugaacccuagaggcg

SEQ ID NO: 503357 - RNA, 64 nt, Homo Sapiens
caccacuguauccuccagcugccucccugggcucccgagauaggccugccacuccugugucccu

SEQ ID NO: 503358 - RNA, 64 nt, Homo Sapiens
ugguucacaccuguaaucccggcauuuugggaggccgagauagguggaucaccugaagucaggu

SEQ ID NO: 503359 - RNA, 64 nt, Homo Sapiens
ggaaggaacuggauaucucuccugcagcccagcaccgagauacccaggacgggccuggggggcg

SEQ ID NO: 503360 - RNA, 64 nt, Homo Sapiens
ucacuugaaccugggagacagagguugcaaugaaccgagauagugccauugcacuccggccugg

SEQ ID NO: 503361 - RNA, 64 nt, Homo Sapiens
uggcguguagguugcuguagaggagccugcuccuccgagauacggucacagagcccgcgugugc

SEQ ID NO: 503362 - RNA, 64 nt, Homo Sapiens
uggagggggcgaguagggaacuggcgauaaaggaccgagauagaugacagccucccagccaggg

SEQ ID NO: 503363 - RNA, 64 nt, Homo Sapiens
gccauugcacuccagccugguuccagccugggcgccgagauagcgcugagaucgcgcuacugca

SEQ ID NO: 503364 - RNA, 64 nt, Homo Sapiens
ucaucagcccagggcuucaggccuugcagcgugaccgagauaggaccaacccuccugcauccuu

SEQ ID NO: 503365 - RNA, 64 nt, Homo Sapiens
agcauggaacauauguucuaggggcuaccagaagccgagauagacuucaagccaaggaacacac

SEQ ID NO: 503366 - RNA, 64 nt, Homo Sapiens
caguggaugcccaggaucuugugccccugccacuccgagauaacagaaccugcggagggacuga

SEQ ID NO: 503367 - RNA, 64 nt, Homo Sapiens
guuuuaacaaauggauccaggauggauaaauccaccgagauaaggguuuuggucacugucucca

SEQ ID NO: 503368 - RNA, 64 nt, Homo Sapiens
ggucucgcagggaaaagggcuggcuucuagguccccgagauaagugugcagggggaugggccag

SEQ ID NO: 503369 - RNA, 64 nt, Homo Sapiens
uuuuagacaauguuuauaguugagggacuaucagccgagauacuuguaauuagaaccaucccca

SEQ ID NO: 503370 - RNA, 64 nt, Homo Sapiens
gaacccgggaggaggaggaggagguugcagugagccgagauagcggcacugcacuccagccugg

SEQ ID NO: 503371 - RNA, 64 nt, Homo Sapiens
uggcgugaaccugggagguggagcuugcagugagccgagauaucgccacugcacuccagccugg

SEQ ID NO: 503372 - RNA, 64 nt, Homo Sapiens
cuguuuucucaugaugccuuuuuauauuuaaaccccgagauagugcuggaacacugcugagguu

SEQ ID NO: 503373 - RNA, 64 nt, Homo Sapiens
gagggagaccccauuccaagcaucaugguggggaccgagauagaccugucggaccuucacuuca

SEQ ID NO: 503374 - RNA, 64 nt, Homo Sapiens
cgaagacaaccaaaagaaugcaaacuggauuuauccgagauauuugacuuuuaaaaaucucaau

SEQ ID NO: 503375 - RNA, 64 nt, Homo Sapiens
uguauaccacacccugggccccuaaucccaggccccgagauaggaaagccagcuagucucuucu

SEQ ID NO: 503376 - RNA, 64 nt, Homo Sapiens; identical to SEQ ID NO: 355656

SEQ ID NO: 503377 - RNA, 64 nt, Homo Sapiens; identical to SEQ ID NO: 355657

SEQ ID NO: 503378 - RNA, 64 nt, Homo Sapiens; identical to SEQ ID NO: 355658

SEQ ID NO: 503379 - RNA, 64 nt, Homo Sapiens; identical to SEQ ID NO: 355659

SEQ ID NO: 503380 - RNA, 64 nt, Homo Sapiens; identical to SEQ ID NO: 355660

SEQ ID NO: 503381 - RNA, 64 nt, Homo Sapiens; identical to SEQ ID NO: 355661

SEQ ID NO: 503382 - RNA, 64 nt, Homo Sapiens; identical to SEQ ID NO: 355662

SEQ ID NO: 503383 - RNA, 64 nt, Homo Sapiens; identical to SEQ ID NO: 355663

SEQ ID NO: 503384 - RNA, 64 nt, Homo Sapiens; identical to SEQ ID NO: 355664

SEQ ID NO: 503385 - RNA, 64 nt, Homo Sapiens; identical to SEQ ID NO: 355665

SEQ ID NO: 503386 - RNA, 64 nt, Homo Sapiens; identical to SEQ ID NO: 355666

SEQ ID NO: 503387 - RNA, 64 nt, Homo Sapiens; identical to SEQ ID NO: 355667

SEQ ID NO: 503388 - RNA, 64 nt, Homo Sapiens; identical to SEQ ID NO: 355668

SEQ ID NO: 503389 - RNA, 64 nt, Homo Sapiens; identical to SEQ ID NO: 355669

SEQ ID NO: 503390 - RNA, 64 nt, Homo Sapiens; identical to SEQ ID NO: 324319

SEQ ID NO: 503391 - RNA, 64 nt, Homo Sapiens; identical to SEQ ID NO: 324320

SEQ ID NO: 503392 - RNA, 64 nt, Homo Sapiens
cuauuucccgccuccauuugucagccccucagcucggccccagcacccacggucacugcugugu

SEQ ID NO: 503393 - RNA, 64 nt, Homo Sapiens
ggaggcggcgcugcucucccgaacagcagccccacggccccaugugcuucagccagugcaguga

SEQ ID NO: 503394 - RNA, 64 nt, Homo Sapiens
cccaccauccugugaaccccuaugagcccacgcccggccccacuuggccccacucacaccaucc

SEQ ID NO: 503395 - RNA, 64 nt, Homo Sapiens
cacucuauccugugagaccaugugagaccacgcccggccccacucggccccauucacuccaucc

SEQ ID NO: 503396 - RNA, 64 nt, Homo Sapiens
cacuccauccugugagaccauguaagacugugcccggccccauucggccccacucacaacaucu

SEQ ID NO: 503397 - RNA, 64 nt, Homo Sapiens
cacaacaucuuguaagacuggugagccccacucccggccccacuagccccacucacaccaaccu

SEQ ID NO: 503398 - RNA, 64 nt, Homo Sapiens
cacuccauccugugagccccgugagccccacucccggccccacuagccccacucccaccauccu

SEQ ID NO: 503399 - RNA, 64 nt, Homo Sapiens
cacuccaucuuguaagacuagugagccccacucccggccccacuggccccacucacaccaaccu

SEQ ID NO: 503400 - RNA, 64 nt, Homo Sapiens
cacaccaaccugugagccccugugagcccaugcccggccccacucagccccacucccaccaucc

SEQ ID NO: 503401 - RNA, 64 nt, Homo Sapiens
cccaccaucuuguaagacugugugagaccacgcccggccccacucggccccucucacaccaucc

SEQ ID NO: 503402 - RNA, 64 nt, Homo Sapiens
gguguguccucacaaugugaagcugugccaagcccggccccacugcagagggaggagggggcac

SEQ ID NO: 503403 - RNA, 64 nt, Homo Sapiens
ggagacaggcgucuaagaacuaguccugucccuccggccccaguguaguagaauaaaacuagcc

SEQ ID NO: 503404 - RNA, 64 nt, Homo Sapiens
accuccugcaguacccacacuuucuagugugccacggccccacccuacucagcgugacccaacu

SEQ ID NO: 503405 - RNA, 64 nt, Homo Sapiens
gcuaaaagcaccagagaaaagagaggccuuugaccggccccagacccuggacagccaugccaga

SEQ ID NO: 503406 - RNA, 64 nt, Homo Sapiens
cgccugccguccuggggcgccuccgcccuccaggcggccccacccgggggcggcgacugccgag

SEQ ID NO: 503407 - RNA, 64 nt, Homo Sapiens
cguguuugcuuaaagucugcccgccaggcgggagcggccccacagaccgacgcggacaacugac

SEQ ID NO: 503408 - RNA, 64 nt, Homo Sapiens; identical to SEQ ID NO: 443317

SEQ ID NO: 503409 - RNA, 64 nt, Homo Sapiens; identical to SEQ ID NO: 443318

SEQ ID NO: 503410 - RNA, 64 nt, Homo Sapiens; identical to SEQ ID NO: 443319

SEQ ID NO: 503411 - RNA, 64 nt, Homo Sapiens; identical to SEQ ID NO: 443320

SEQ ID NO: 503412 - RNA, 64 nt, Homo Sapiens; identical to SEQ ID NO: 443321

SEQ ID NO: 503413 - RNA, 64 nt, Homo Sapiens; identical to SEQ ID NO: 443322

SEQ ID NO: 503414 - RNA, 64 nt, Homo Sapiens; identical to SEQ ID NO: 443323

SEQ ID NO: 503415 - RNA, 64 nt, Homo Sapiens; identical to SEQ ID NO: 443324

SEQ ID NO: 503416 - RNA, 64 nt, Homo Sapiens; identical to SEQ ID NO: 443325

SEQ ID NO: 503417 - RNA, 64 nt, Homo Sapiens; identical to SEQ ID NO: 443326

SEQ ID NO: 503418 - RNA, 64 nt, Homo Sapiens; identical to SEQ ID NO: 443327

SEQ ID NO: 503419 - RNA, 64 nt, Homo Sapiens; identical to SEQ ID NO: 443328

SEQ ID NO: 503420 - RNA, 64 nt, Homo Sapiens; identical to SEQ ID NO: 443329

SEQ ID NO: 503421 - RNA, 64 nt, Homo Sapiens; identical to SEQ ID NO: 443330

SEQ ID NO: 503422 - RNA, 64 nt, Homo Sapiens; identical to SEQ ID NO: 443331

SEQ ID NO: 503423 - RNA, 64 nt, Homo Sapiens; identical to SEQ ID NO: 443332

SEQ ID NO: 503424 - RNA, 64 nt, Homo Sapiens; identical to SEQ ID NO: 443333

SEQ ID NO: 503425 - RNA, 64 nt, Homo Sapiens; identical to SEQ ID NO: 443334

SEQ ID NO: 503426 - RNA, 64 nt, Homo Sapiens; identical to SEQ ID NO: 443335

SEQ ID NO: 503427 - RNA, 64 nt, Homo Sapiens; identical to SEQ ID NO: 443336

SEQ ID NO: 503428 - RNA, 64 nt, Homo Sapiens; identical to SEQ ID NO: 443337

SEQ ID NO: 503429 - RNA, 64 nt, Homo Sapiens; identical to SEQ ID NO: 443338

SEQ ID NO: 503430 - RNA, 64 nt, Homo Sapiens; identical to SEQ ID NO: 443339

SEQ ID NO: 503431 - RNA, 64 nt, Homo Sapiens; identical to SEQ ID NO: 443340

SEQ ID NO: 503432 - RNA, 64 nt, Homo Sapiens; identical to SEQ ID NO: 443341

SEQ ID NO: 503433 - RNA, 64 nt, Homo Sapiens; identical to SEQ ID NO: 443342

SEQ ID NO: 503434 - RNA, 64 nt, Homo Sapiens; identical to SEQ ID NO: 443343

SEQ ID NO: 503435 - RNA, 64 nt, Homo Sapiens; identical to SEQ ID NO: 443344

SEQ ID NO: 503436 - RNA, 64 nt, Homo Sapiens; identical to SEQ ID NO: 85116

SEQ ID NO: 503437 - RNA, 64 nt, Homo Sapiens; identical to SEQ ID NO: 85117

SEQ ID NO: 503438 - RNA, 64 nt, Homo Sapiens; identical to SEQ ID NO: 85118

SEQ ID NO: 503439 - RNA, 64 nt, Homo Sapiens; identical to SEQ ID NO: 85119

SEQ ID NO: 503440 - RNA, 64 nt, Homo Sapiens; identical to SEQ ID NO: 85120

SEQ ID NO: 503441 - RNA, 64 nt, Homo Sapiens; identical to SEQ ID NO: 85121

SEQ ID NO: 503442 - RNA, 64 nt, Homo Sapiens
aggaauuagcuauagaacugguuaccuuuccuuuccccuuuaaaauaaauguuuuccugcuuug

SEQ ID NO: 503443 - RNA, 64 nt, Homo Sapiens
ucacacugcugcgaucuguucugcccugccaccuccccuuuauuucagcaagaaaacacacgcc

SEQ ID NO: 503444 - RNA, 64 nt, Homo Sapiens
aacuuuugauauauaugccuuacugaguacaugcccccuuuaauguuaacaugacuuggaguaa

SEQ ID NO: 503445 - RNA, 64 nt, Homo Sapiens
uaaucugaagguguuugagucagaggcuacuuuuccccuuuauauuuuauauagaagccuauuu

SEQ ID NO: 503446 - RNA, 64 nt, Homo Sapiens
uucgugccucacuccaccaggaaggucuucccauccccuuuagacucccaugcucacacccaca

SEQ ID NO: 503447 - RNA, 64 nt, Homo Sapiens
ugguuuucuuuuugaggcaaaaaaagacacccccccccuuuaaacaacagagaugcaaaaagcu

SEQ ID NO: 503448 - RNA, 64 nt, Homo Sapiens
auaacucggacaauuucuggguggugacugaguaccccuuuagugaguaccccuuuagugcuau

SEQ ID NO: 503449 - RNA, 64 nt, Homo Sapiens
ucuggguggugacugaguaccccuuuagugaguaccccuuuagugcuauauuugugccauucau

SEQ ID NO: 503450 - RNA, 64 nt, Homo Sapiens
ccucuggagggcucugugggcagcuucucugugaccccuuuacuugcggucagcagucucaggc

SEQ ID NO: 503451 - RNA, 64 nt, Homo Sapiens
gucuaggccgccugccauggcagcccaggcccugccccuuuacaaaacuucauccuaaggugug

SEQ ID NO: 503452 - RNA, 64 nt, Homo Sapiens
caccacccaacuggggcuagaguggggaagauuuccccuuuagaucaaacugccccuuccaugg

SEQ ID NO: 503453 - RNA, 64 nt, Homo Sapiens
aggguagggauaguggcccuggccgucuauccuaccccuuuagugaccgcccccaucccggcuu

SEQ ID NO: 503454 - RNA, 64 nt, Homo Sapiens
gcauguuggucucaaggggacuuuaaacccaaacccccuuuaagaaaaaaaaagauacauuggu

SEQ ID NO: 503455 - RNA, 64 nt, Homo Sapiens
acauauuggggcugggcgcacuuuaaucccaaacccccuuuaaguuccucagcggaaaacugua

SEQ ID NO: 503456 - RNA, 64 nt, Homo Sapiens
accuuagguuuccucagcggacuugaucccaaaaccccuuuaagcuaguuuuccucaacaggac

SEQ ID NO: 503457 - RNA, 64 nt, Homo Sapiens
aagaguccagccaacccucuucgagguccccaguagcucugaacggacaagccucccuggauga

SEQ ID NO: 503458 - RNA, 64 nt, Homo Sapiens
uugauagggauacagcuuugcaucgauguucuguagcucugacccuuccuaaacucucuuccag

SEQ ID NO: 503459 - RNA, 64 nt, Homo Sapiens
ggagagcugggcccccugagccagcccugaggacagcucugaugccucagccccagccccagcu

SEQ ID NO: 503460 - RNA, 64 nt, Homo Sapiens
cuugggaauguuguuacccuucuugccgccuuccagcucugaguucugucucuccuggcuccac

SEQ ID NO: 503461 - RNA, 64 nt, Homo Sapiens
uggcagcugaacgaggugcuguugugggugucucagcucugagggucuuugugagcucccacug

SEQ ID NO: 503462 - RNA, 64 nt, Homo Sapiens
ggucuuugugagcucccacuguugugggugucucagcucugagggucuuugugagcucccacug

SEQ ID NO: 503463 - RNA, 64 nt, Homo Sapiens
ggucuuugugagcucccacuguugugggugucucagcucugagggucuuugugaguucccacca

SEQ ID NO: 503464 - RNA, 64 nt, Homo Sapiens
cagaagaguaucaagauuaauauauuaauaguauagcucugacugguaaauuucuuuuuuuuaa

SEQ ID NO: 503465 - RNA, 64 nt, Homo Sapiens
aggugcuccucacuucccagagggugcaggagccagcucugacuaguaaauuucuaaggauacc

SEQ ID NO: 503466 - RNA, 64 nt, Homo Sapiens
gagaaacccaacaacuucauaugccuuuagggguagcucugaaacuucagagaauauaaaguga

SEQ ID NO: 503467 - RNA, 64 nt, Homo Sapiens
uuaaaaagcacugaaauaguaaagccaggcucagagcucugaaagaaaaaucaacaaacaaauc

SEQ ID NO: 503468 - RNA, 64 nt, Homo Sapiens
cacuugcagaucuuaaggucccuuuuucugccccagcucugagauucucccuauaaaaguaaag

SEQ ID NO: 503469 - RNA, 64 nt, Homo Sapiens
ugacagcgccacagccauagaucaggagguagauagcucugaaacuccagccuuucucccucac

SEQ ID NO: 503470 - RNA, 64 nt, Homo Sapiens
aggugagggggucugcggugccucacagaaagagagcucugagcggucacugcccuuaccugac

SEQ ID NO: 503471 - RNA, 64 nt, Homo Sapiens
caguugcuuaauuauacccauagguaauacaaaaagcucugaagacccaaagaugacauuacua

SEQ ID NO: 503472 - RNA, 64 nt, Homo Sapiens
aucuucuguguaggugaccggagcacugagaggcagcucugaugcacuauugugugucagcagc

SEQ ID NO: 503473 - RNA, 64 nt, Homo Sapiens
uucaggacacauacauuuauauaauucauuauuaagcucugaaauccaaucauuaucaaguucc

SEQ ID NO: 503474 - RNA, 64 nt, Homo Sapiens
caccugaaccccuacccaucgugcagggcuguggagcucugagacugaucugugguuuaacacu

SEQ ID NO: 503475 - RNA, 64 nt, Homo Sapiens
ccuagacccuggaauagccuuguugagauggggcagcucugaauagccugggggagcuuuuagg

SEQ ID NO: 503476 - RNA, 64 nt, Homo Sapiens
agcagcaggcaacuucgagaggacucaacagcagagcucugagccaggagccggcugccggggg

SEQ ID NO: 503477 - RNA, 64 nt, Homo Sapiens
ugucuugauggaagguauuauucuaaacgucuagagcucugaaaaaagagauucuugaccuuau

SEQ ID NO: 503478 - RNA, 64 nt, Homo Sapiens
uugaaugagauaucauguuuuugucaguuguaguagcucugaugugauguauaccaugaaguca

SEQ ID NO: 503479 - RNA, 64 nt, Homo Sapiens
uggaaccauggcucuaacugggucaaguccuccuagcucugaagcuaaggcugcagagcugucc

SEQ ID NO: 503480 - RNA, 64 nt, Homo Sapiens
uccauuccgcaaacucuugugaucuuccaaaauuagcucugauuagcuuucacuuccuguagaa

SEQ ID NO: 503481 - RNA, 64 nt, Homo Sapiens
gacugaaagaauuccagucagccagagccuuggcagcucugaagcuaaccuuagcaucuaagug

SEQ ID NO: 503482 - RNA, 64 nt, Homo Sapiens
cugcugcagagcugggcugagaguucugcagucuagcucugacuuaggucaggggccuguuggu

SEQ ID NO: 503483 - RNA, 64 nt, Homo Sapiens
uaacaguccuaagaacuccuuaacaguaauaaauagcucugaaaaaauaacaagagcucuguaa

SEQ ID NO: 503484 - RNA, 64 nt, Homo Sapiens
uaacaagagcucuguaauaaccaagggcuacaguagcucugaaaccucuuucuguugguugugc

SEQ ID NO: 503485 - RNA, 64 nt, Homo Sapiens
ucauccucucucuaaggcuccaugguuccuacgaagcucugaaaggugggaacaccacagaggc

SEQ ID NO: 503486 - RNA, 64 nt, Homo Sapiens
uaagcaaaagcaguccccacagccacagccuggcagcucugaucaggaaagugaggaacagcaa

SEQ ID NO: 503487 - RNA, 64 nt, Homo Sapiens
ugggcuagcagaggccggcccuggccaucgggagagcucugaccugcacaccgcgggaggccag

SEQ ID NO: 503488 - RNA, 64 nt, Homo Sapiens
uacagggaggggcccugggucuaugcacagcuggagcucugagccuuccacagcccgugugacu

SEQ ID NO: 503489 - RNA, 64 nt, Homo Sapiens
agccaggaggcuggcaagauggccgaauaggaacagcucugaucugcaguucccagugagauca

SEQ ID NO: 503490 - RNA, 64 nt, Homo Sapiens
acagcuucagcagacuuaaacauuccugccugccagcucugaagagagcagcaguucuuccagc

SEQ ID NO: 503491 - RNA, 64 nt, Homo Sapiens
gccccucccuggaggaccugugucccugcugagaagcucugaggugucucagcucugaaccugc

SEQ ID NO: 503492 - RNA, 64 nt, Homo Sapiens
cugcugucccugcugagaaggugcccggugucucagcucugaacugcagaucugugcuggccac

SEQ ID NO: 503493 - RNA, 64 nt, Homo Sapiens
ccucccucuccuaggagcacccacacucuccuccagcucugagcugccuucuccaucccagugu

SEQ ID NO: 503494 - RNA, 64 nt, Homo Sapiens
caaugaaacccugcaagguguuguugacauugacagcucugagaagaguuauccgcaccaguga

SEQ ID NO: 503495 - RNA, 64 nt, Homo Sapiens; identical to SEQ ID NO: 305658

SEQ ID NO: 503496 - RNA, 64 nt, Homo Sapiens; identical to SEQ ID NO: 305659

SEQ ID NO: 503497 - RNA, 64 nt, Homo Sapiens; identical to SEQ ID NO: 305660

SEQ ID NO: 503498 - RNA, 64 nt, Homo Sapiens; identical to SEQ ID NO: 305661

SEQ ID NO: 503499 - RNA, 64 nt, Homo Sapiens; identical to SEQ ID NO: 305662

SEQ ID NO: 503500 - RNA, 64 nt, Homo Sapiens; identical to SEQ ID NO: 305663

SEQ ID NO: 503501 - RNA, 64 nt, Homo Sapiens; identical to SEQ ID NO: 305664

SEQ ID NO: 503502 - RNA, 64 nt, Homo Sapiens; identical to SEQ ID NO: 305665

SEQ ID NO: 503503 - RNA, 64 nt, Homo Sapiens; identical to SEQ ID NO: 305666

SEQ ID NO: 503504 - RNA, 64 nt, Homo Sapiens; identical to SEQ ID NO: 305667

SEQ ID NO: 503505 - RNA, 64 nt, Homo Sapiens; identical to SEQ ID NO: 305668

SEQ ID NO: 503506 - RNA, 64 nt, Homo Sapiens; identical to SEQ ID NO: 305669

SEQ ID NO: 503507 - RNA, 64 nt, Homo Sapiens; identical to SEQ ID NO: 305670

SEQ ID NO: 503508 - RNA, 64 nt, Homo Sapiens; identical to SEQ ID NO: 305671

SEQ ID NO: 503509 - RNA, 64 nt, Homo Sapiens; identical to SEQ ID NO: 305672

SEQ ID NO: 503510 - RNA, 64 nt, Homo Sapiens; identical to SEQ ID NO: 305673

SEQ ID NO: 503511 - RNA, 64 nt, Homo Sapiens; identical to SEQ ID NO: 305674

SEQ ID NO: 503512 - RNA, 64 nt, Homo Sapiens; identical to SEQ ID NO: 305675

SEQ ID NO: 503513 - RNA, 64 nt, Homo Sapiens; identical to SEQ ID NO: 305676

SEQ ID NO: 503514 - RNA, 64 nt, Homo Sapiens; identical to SEQ ID NO: 305677

SEQ ID NO: 503515 - RNA, 64 nt, Homo Sapiens; identical to SEQ ID NO: 305678

SEQ ID NO: 503516 - RNA, 64 nt, Homo Sapiens; identical to SEQ ID NO: 305679

SEQ ID NO: 503517 - RNA, 64 nt, Homo Sapiens; identical to SEQ ID NO: 305680

SEQ ID NO: 503518 - RNA, 64 nt, Homo Sapiens; identical to SEQ ID NO: 305681

SEQ ID NO: 503519 - RNA, 64 nt, Homo Sapiens; identical to SEQ ID NO: 305682

SEQ ID NO: 503520 - RNA, 64 nt, Homo Sapiens; identical to SEQ ID NO: 305683

SEQ ID NO: 503521 - RNA, 64 nt, Homo Sapiens; identical to SEQ ID NO: 305684

SEQ ID NO: 503522 - RNA, 64 nt, Homo Sapiens; identical to SEQ ID NO: 305685

SEQ ID NO: 503523 - RNA, 64 nt, Homo Sapiens; identical to SEQ ID NO: 305686

SEQ ID NO: 503524 - RNA, 64 nt, Homo Sapiens; identical to SEQ ID NO: 305687

SEQ ID NO: 503525 - RNA, 64 nt, Homo Sapiens; identical to SEQ ID NO: 305688

SEQ ID NO: 503526 - RNA, 64 nt, Homo Sapiens; identical to SEQ ID NO: 305689

SEQ ID NO: 503527 - RNA, 64 nt, Homo Sapiens; identical to SEQ ID NO: 305690

SEQ ID NO: 503528 - RNA, 64 nt, Homo Sapiens; identical to SEQ ID NO: 305691

SEQ ID NO: 503529 - RNA, 64 nt, Homo Sapiens; identical to SEQ ID NO: 305692

SEQ ID NO: 503530 - RNA, 64 nt, Homo Sapiens; identical to SEQ ID NO: 305693

SEQ ID NO: 503531 - RNA, 64 nt, Homo Sapiens; identical to SEQ ID NO: 305694

SEQ ID NO: 503532 - RNA, 64 nt, Homo Sapiens; identical to SEQ ID NO: 156567

SEQ ID NO: 503533 - RNA, 64 nt, Homo Sapiens; identical to SEQ ID NO: 156568

SEQ ID NO: 503534 - RNA, 64 nt, Homo Sapiens; identical to SEQ ID NO: 156569

SEQ ID NO: 503535 - RNA, 64 nt, Homo Sapiens; identical to SEQ ID NO: 156570

SEQ ID NO: 503536 - RNA, 64 nt, Homo Sapiens; identical to SEQ ID NO: 156571

SEQ ID NO: 503537 - RNA, 64 nt, Homo Sapiens; identical to SEQ ID NO: 156572

SEQ ID NO: 503538 - RNA, 64 nt, Homo Sapiens; identical to SEQ ID NO: 156573

SEQ ID NO: 503539 - RNA, 64 nt, Homo Sapiens; identical to SEQ ID NO: 156574

SEQ ID NO: 503540 - RNA, 64 nt, Homo Sapiens; identical to SEQ ID NO: 156575

SEQ ID NO: 503541 - RNA, 64 nt, Homo Sapiens; identical to SEQ ID NO: 156576

SEQ ID NO: 503542 - RNA, 64 nt, Homo Sapiens; identical to SEQ ID NO: 156577

SEQ ID NO: 503543 - RNA, 64 nt, Homo Sapiens; identical to SEQ ID NO: 156578

SEQ ID NO: 503544 - RNA, 64 nt, Homo Sapiens; identical to SEQ ID NO: 156579

SEQ ID NO: 503545 - RNA, 64 nt, Homo Sapiens; identical to SEQ ID NO: 156580

SEQ ID NO: 503546 - RNA, 64 nt, Homo Sapiens; identical to SEQ ID NO: 156581

SEQ ID NO: 503547 - RNA, 64 nt, Homo Sapiens; identical to SEQ ID NO: 156582

SEQ ID NO: 503548 - RNA, 64 nt, Homo Sapiens; identical to SEQ ID NO: 156583

SEQ ID NO: 503549 - RNA, 64 nt, Homo Sapiens; identical to SEQ ID NO: 156584

SEQ ID NO: 503550 - RNA, 64 nt, Homo Sapiens; identical to SEQ ID NO: 156585

SEQ ID NO: 503551 - RNA, 64 nt, Homo Sapiens; identical to SEQ ID NO: 156586

SEQ ID NO: 503552 - RNA, 64 nt, Homo Sapiens; identical to SEQ ID NO: 156587

SEQ ID NO: 503553 - RNA, 64 nt, Homo Sapiens; identical to SEQ ID NO: 156588

SEQ ID NO: 503554 - RNA, 64 nt, Homo Sapiens; identical to SEQ ID NO: 156589

SEQ ID NO: 503555 - RNA, 64 nt, Homo Sapiens; identical to SEQ ID NO: 156590

SEQ ID NO: 503556 - RNA, 64 nt, Homo Sapiens; identical to SEQ ID NO: 156591

SEQ ID NO: 503557 - RNA, 64 nt, Homo Sapiens; identical to SEQ ID NO: 156592

SEQ ID NO: 503558 - RNA, 64 nt, Homo Sapiens; identical to SEQ ID NO: 156593

SEQ ID NO: 503559 - RNA, 64 nt, Homo Sapiens; identical to SEQ ID NO: 156594

SEQ ID NO: 503560 - RNA, 64 nt, Homo Sapiens; identical to SEQ ID NO: 156595

SEQ ID NO: 503561 - RNA, 64 nt, Homo Sapiens; identical to SEQ ID NO: 156596

SEQ ID NO: 503562 - RNA, 64 nt, Homo Sapiens; identical to SEQ ID NO: 156597

SEQ ID NO: 503563 - RNA, 64 nt, Homo Sapiens; identical to SEQ ID NO: 156598

SEQ ID NO: 503564 - RNA, 64 nt, Homo Sapiens; identical to SEQ ID NO: 156599

SEQ ID NO: 503565 - RNA, 64 nt, Homo Sapiens; identical to SEQ ID NO: 156600

SEQ ID NO: 503566 - RNA, 64 nt, Homo Sapiens; identical to SEQ ID NO: 156601

SEQ ID NO: 503567 - RNA, 64 nt, Homo Sapiens; identical to SEQ ID NO: 156602

SEQ ID NO: 503568 - RNA, 64 nt, Homo Sapiens; identical to SEQ ID NO: 156603

SEQ ID NO: 503569 - RNA, 64 nt, Homo Sapiens; identical to SEQ ID NO: 156604

SEQ ID NO: 503570 - RNA, 64 nt, Homo Sapiens; identical to SEQ ID NO: 156605

SEQ ID NO: 503571 - RNA, 64 nt, Homo Sapiens; identical to SEQ ID NO: 156606

SEQ ID NO: 503572 - RNA, 64 nt, Homo Sapiens; identical to SEQ ID NO: 156607

SEQ ID NO: 503573 - RNA, 64 nt, Homo Sapiens
uguccuuggucuucugaagauucagguccuccucuccggguagcuuagaaguaaggagguuggu

SEQ ID NO: 503574 - RNA, 64 nt, Homo Sapiens
uguauagauguucuucauuaauaaaaggaaaaacuccggguauauuugguuuacugcuuuguaa

SEQ ID NO: 503575 - RNA, 64 nt, Homo Sapiens
uguuguauagcaaucgcuuuuuaccuuucaaaguuccggguaaaaauguguuauaucuguaguu

SEQ ID NO: 503576 - RNA, 64 nt, Homo Sapiens
caauuuacaaauuuucaacuuuaugauagguuuauccggguacuaaaugcauuucaacuugaua

SEQ ID NO: 503577 - RNA, 64 nt, Homo Sapiens
aggacuuccuccaaccuggcacaaagcaaacugcuccggguaccagaucacugacacugcaaaa

SEQ ID NO: 503578 - RNA, 64 nt, Homo Sapiens
cccaguucaucucuauguccuguucacugaauauuccggguaauugaaagaaaauauaauggau

SEQ ID NO: 503579 - RNA, 64 nt, Homo Sapiens
acagccgcugcaauacacagucuugacggugccauccggguacucccuccucuugaaccgggcu

SEQ ID NO: 503580 - RNA, 64 nt, Homo Sapiens
uuuuccccacucugucugccugcaucuccucuguuccggguaggccuugauaucaccucuggga

SEQ ID NO: 503581 - RNA, 64 nt, Homo Sapiens
gugcaugugcagucccagcuacacuuaaaaauuauccggguacccaucucuacaaaaaauaaaa

SEQ ID NO: 503582 - RNA, 64 nt, Homo Sapiens
ugggacuacaggugugcaccuugugucucagucuuccggguagccucccgggcuugagcgauuc

SEQ ID NO: 503583 - RNA, 64 nt, Homo Sapiens
gccaccccccggcugagacuuugcccugaacuuguccggguagggagggccggaggcauguggc

SEQ ID NO: 503584 - RNA, 64 nt, Homo Sapiens
ggcaagccccaaacuccuuaauauuagccaugcuuccggguaaagccuugcaacacauuuugau

SEQ ID NO: 503585 - RNA, 64 nt, Homo Sapiens
ggcagugggacgagcuagccuccucuuuaagggcuccggguacugccucucaaccaaaaggugu

SEQ ID NO: 503586 - RNA, 64 nt, Homo Sapiens
ccgaggcaggugcaggauucgccauggugcagccuccggguacaaacaucugaggcacuggcga

SEQ ID NO: 503587 - RNA, 64 nt, Homo Sapiens
uaguacuguggugaggagcagcuggcugcgcuucuccggguauuccaucagugucauuaccaaa

SEQ ID NO: 503588 - RNA, 64 nt, Homo Sapiens
uaguacugugcugaggagcagcuggcugcgcuucuccggguauuccaucagugucaucaccaaa

SEQ ID NO: 503589 - RNA, 63 nt, Homo Sapiens
gggaugccccuucuggcauauaaauccauuuuccuccggguaaacuucuuuuuuauaaagcaa

SEQ ID NO: 503590 - RNA, 64 nt, Homo Sapiens
caguuuugguccugccagcuggagccagggacuguccggguagcucagcuucccuuccccaccu

SEQ ID NO: 503591 - RNA, 64 nt, Homo Sapiens
gggagucaauugauuacccaacacccuauugacuuccggguaagugauuaaaguauaaauuaag

SEQ ID NO: 503592 - RNA, 64 nt, Homo Sapiens
cuggggcccagcaccccuccucgccccauccccguccggguacgggggcgcggcaggggucccc

SEQ ID NO: 503593 - RNA, 64 nt, Homo Sapiens
cuuuuccuccaugucuguuacucacuuucagcaguccggguaaaaucuguggaucaggguuaaa

SEQ ID NO: 503594 - RNA, 64 nt, Homo Sapiens
cuugacaagcaccgcucuguaugaauuuuacuaguccggguaccucauauaagaaaacuuaagu

SEQ ID NO: 503595 - RNA, 64 nt, Homo Sapiens
acauuuccaucccuucccuaccucuacaaagacauccggguacuuccucuacuuccuucugagu

SEQ ID NO: 503596 - RNA, 64 nt, Homo Sapiens
gcuccucuuccuccuuucuuggcgggugggagacuccggguagccgcacugcagaagcaacagc

SEQ ID NO: 503597 - RNA, 64 nt, Homo Sapiens
auaaugagaccuguccucuagaauuucacgacaguccggguaacaggcaggaggguugaaguca

SEQ ID NO: 503598 - RNA, 64 nt, Homo Sapiens
ggauuacuuugaaaaggguuuacuagugugguccuccggguagaauuuagcuguaagcauguug

SEQ ID NO: 503599 - RNA, 64 nt, Homo Sapiens
aaacuaaauugugauuuaugaaugugaguauauacacuaagaacguauauguucuuuauauuuu

SEQ ID NO: 503600 - RNA, 64 nt, Homo Sapiens
uuauguagauaauguacuuuuugcugaagacauacacuaagaauuuuuucugugaaacuucaua

SEQ ID NO: 503601 - RNA, 64 nt, Homo Sapiens
ucugggggcaggcucagcaucugcccacuggucucacuaagagcuuucagauuucccuccauag

SEQ ID NO: 503602 - RNA, 64 nt, Homo Sapiens
aagaaaaaaaucaaaaugcagaaaauguguggugcacuaagaugaucacacagcauuaaaacua

SEQ ID NO: 503603 - RNA, 64 nt, Homo Sapiens
guuuguuuaggaggcccugagaaacccucaccagauaaacuacaaucuaaaaaacccucgaccc

SEQ ID NO: 503604 - RNA, 64 nt, Homo Sapiens
auugugaucuauuuuuuccaccuuuuuuucuuccauaaacuacuaauaaauaauuuuagaacag

SEQ ID NO: 503605 - RNA, 64 nt, Homo Sapiens
augcagcaucuacacuuugauuugagcuuuguuaauaaacuauuuuaauguuauuucuguaaac

SEQ ID NO: 503606 - RNA, 64 nt, Homo Sapiens
caaaacaaauaacuguuagaugauuucaauguuaauaaacuagguauaguaucagaacuugggu

SEQ ID NO: 503607 - RNA, 64 nt, Homo Sapiens
gcuuauuuuuauuguugcuauuuucaguguauacauaaacuaaaaauuaggguugauuuuuuug

SEQ ID NO: 503608 - RNA, 64 nt, Homo Sapiens
auuuuuaaauauuuguaauauuguugacugacuaauaaacuauuaaguuauuggcauaguugug

SEQ ID NO: 503609 - RNA, 64 nt, Homo Sapiens
cgagcaucacaagcuuuugagcgcauggaacuccauaaacuaacaaauuacauaaacuaaaggg

SEQ ID NO: 503610 - RNA, 64 nt, Homo Sapiens
ugagcgcauggaacuccauaaacuaacaaauuacauaaacuaaagggggauuuucuuucuucuu

SEQ ID NO: 503611 - RNA, 64 nt, Homo Sapiens
uaaaauggcaugcuauuuggaaauuuaguuugagauaaacuaaaguguguugaugccagaaugu

SEQ ID NO: 503612 - RNA, 64 nt, Homo Sapiens
caaaaucuuuguuaaaccaaacauucaacacaaaauaaacuagaaggccagaggauaauggaau

SEQ ID NO: 503613 - RNA, 64 nt, Homo Sapiens
cuacucucauacaggggaccuuuaaaaguaugcuauaaacuaugcaaaauuaccgaaugccauu

SEQ ID NO: 503614 - RNA, 64 nt, Homo Sapiens
uuuuaacugaaugucuaaagauuuugagauuuagauaaacuacagauacuuguuuuuauuaaac

SEQ ID NO: 503615 - RNA, 64 nt, Homo Sapiens
auauuuggauuuuuuuccccuaugauacagguucauaaacuacaacuaaauuuuucuaguuucu

SEQ ID NO: 503616 - RNA, 64 nt, Homo Sapiens
ucauuugagcaccauucuuucagcauauggcacuauaaacuauuaaccagcuuccaaaagaaac

SEQ ID NO: 503617 - RNA, 64 nt, Homo Sapiens
aucagaauuguuaaaacuuuugccaguggaauggauaaacuauugaugaauuguuuccuggguc

SEQ ID NO: 503618 - RNA, 64 nt, Homo Sapiens
ugaagugaaguuauaaaagggcaaauccagauucauaaacuaucaccucggauuucuuguaauc

SEQ ID NO: 503619 - RNA, 64 nt, Homo Sapiens
gagcagaauucucacagauuuuaccauuccuguuauaaacuaguauuuguuguuuagccaaaac

SEQ ID NO: 503620 - RNA, 64 nt, Homo Sapiens
uugcccaaauaacagaaauuuuguucgggaagggauaaacuagauauagcauacagagccuguu

SEQ ID NO: 503621 - RNA, 64 nt, Homo Sapiens
ugaugccaggagcuuagggcaucucuuaauauuuauaaacuaccgugaucaaguuuaaucacaa

SEQ ID NO: 503622 - RNA, 64 nt, Homo Sapiens
ucauuauuuccaucuuuggaggucauuaauuuagauaaacuagcuuugauacaucugugauuua

SEQ ID NO: 503623 - RNA, 64 nt, Homo Sapiens
acauuugugauucucauuuucucaccauuaaauuaccuuggaggguagggcugugguuuacucc

SEQ ID NO: 503624 - RNA, 64 nt, Homo Sapiens
uguuuaauggauuccaccccugccuuccuaggugaccuuggacaaauucucgaacccauucacc

SEQ ID NO: 503625 - RNA, 64 nt, Homo Sapiens
ugcaaauauaaaucuauggauaaaguacagccauaccuuggacauaaaacauuugaaugaacug

SEQ ID NO: 503626 - RNA, 64 nt, Homo Sapiens
auauuuuucuuacuuuaccaaacugaauuuuuugaccuuggaaaauuaaaacugaaaaaauuua

SEQ ID NO: 503627 - RNA, 64 nt, Homo Sapiens
ggagcagaugugugguggggggguggauuucagcaccuuggacagauuaggaggagccuaugug

SEQ ID NO: 503628 - RNA, 64 nt, Homo Sapiens
guaccaagguugcagaagagguaugagaggcacaaccuuggaggcuguggucagaucaagaaag

SEQ ID NO: 503629 - RNA, 64 nt, Homo Sapiens
aagccugggaacuugggcaucguugggccagcaggaugagcagcaaagggucugaggacagggu

SEQ ID NO: 503630 - RNA, 64 nt, Homo Sapiens
gaaguuuaaaaaugggccuuuucugagccccccugaugagcagucagugcuucugggcccagcu

SEQ ID NO: 503631 - RNA, 64 nt, Homo Sapiens
auuuccuagcuguucuaauuaagaaaacuauuaagaugagcaaccacauuuagaaauguuuauu

SEQ ID NO: 503632 - RNA, 64 nt, Homo Sapiens
uuguuuguuuuauuuggggcugggggagguauaugaugagcagacuucucggaauucauaauaa

SEQ ID NO: 503633 - RNA, 64 nt, Homo Sapiens
aaggcauuuuccuugggagauggaaagcacaagugaugagcaaggguaccccccgccgcccccc

SEQ ID NO: 503634 - RNA, 64 nt, Homo Sapiens
aguaaaacuaaggcuucagccuaugaauauuccugaugagcacaaacuuucccucugugggaga

SEQ ID NO: 503635 - RNA, 64 nt, Homo Sapiens
gggccuccucacaacauggugucuggauucccaggaugagcaucccaggaucgcaagagccaug

SEQ ID NO: 503636 - RNA, 64 nt, Homo Sapiens
uggguuuucaucaagacuggaagguggggacagggaugagcauggagcuggccgugggccuggg

SEQ ID NO: 503637 - RNA, 64 nt, Homo Sapiens; identical to SEQ ID NO: 127462

SEQ ID NO: 503638 - RNA, 64 nt, Homo Sapiens; identical to SEQ ID NO: 127463

SEQ ID NO: 503639 - RNA, 64 nt, Homo Sapiens; identical to SEQ ID NO: 127464

SEQ ID NO: 503640 - RNA, 64 nt, Homo Sapiens; identical to SEQ ID NO: 127465

SEQ ID NO: 503641 - RNA, 64 nt, Homo Sapiens; identical to SEQ ID NO: 127466

SEQ ID NO: 503642 - RNA, 64 nt, Homo Sapiens; identical to SEQ ID NO: 127467

SEQ ID NO: 503643 - RNA, 64 nt, Homo Sapiens; identical to SEQ ID NO: 127468

SEQ ID NO: 503644 - RNA, 64 nt, Homo Sapiens; identical to SEQ ID NO: 127469

SEQ ID NO: 503645 - RNA, 64 nt, Homo Sapiens; identical to SEQ ID NO: 127470

SEQ ID NO: 503646 - RNA, 64 nt, Homo Sapiens; identical to SEQ ID NO: 127471

SEQ ID NO: 503647 - RNA, 64 nt, Homo Sapiens; identical to SEQ ID NO: 127472

SEQ ID NO: 503648 - RNA, 64 nt, Homo Sapiens; identical to SEQ ID NO: 127473

SEQ ID NO: 503649 - RNA, 64 nt, Homo Sapiens; identical to SEQ ID NO: 127474

SEQ ID NO: 503650 - RNA, 64 nt, Homo Sapiens; identical to SEQ ID NO: 127475

SEQ ID NO: 503651 - RNA, 64 nt, Homo Sapiens; identical to SEQ ID NO: 127476

SEQ ID NO: 503652 - RNA, 64 nt, Homo Sapiens; identical to SEQ ID NO: 127477

SEQ ID NO: 503653 - RNA, 64 nt, Homo Sapiens; identical to SEQ ID NO: 127476

SEQ ID NO: 503654 - RNA, 64 nt, Homo Sapiens; identical to SEQ ID NO: 127477

SEQ ID NO: 503655 - RNA, 64 nt, Homo Sapiens; identical to SEQ ID NO: 127480

SEQ ID NO: 503656 - RNA, 64 nt, Homo Sapiens; identical to SEQ ID NO: 127477

SEQ ID NO: 503657 - RNA, 64 nt, Homo Sapiens; identical to SEQ ID NO: 127482

SEQ ID NO: 503658 - RNA, 64 nt, Homo Sapiens; identical to SEQ ID NO: 127483

SEQ ID NO: 503659 - RNA, 64 nt, Homo Sapiens; identical to SEQ ID NO: 127484

SEQ ID NO: 503660 - RNA, 64 nt, Homo Sapiens; identical to SEQ ID NO: 127485

SEQ ID NO: 503661 - RNA, 64 nt, Homo Sapiens; identical to SEQ ID NO: 127486

SEQ ID NO: 503662 - RNA, 64 nt, Homo Sapiens; identical to SEQ ID NO: 127487

SEQ ID NO: 503663 - RNA, 64 nt, Homo Sapiens; identical to SEQ ID NO: 127488

SEQ ID NO: 503664 - RNA, 64 nt, Homo Sapiens; identical to SEQ ID NO: 127489

SEQ ID NO: 503665 - RNA, 64 nt, Homo Sapiens; identical to SEQ ID NO: 127490

SEQ ID NO: 503666 - RNA, 64 nt, Homo Sapiens; identical to SEQ ID NO: 127491

SEQ ID NO: 503667 - RNA, 64 nt, Homo Sapiens; identical to SEQ ID NO: 127492

SEQ ID NO: 503668 - RNA, 64 nt, Homo Sapiens; identical to SEQ ID NO: 127493

SEQ ID NO: 503669 - RNA, 64 nt, Homo Sapiens; identical to SEQ ID NO: 127494

SEQ ID NO: 503670 - RNA, 64 nt, Homo Sapiens; identical to SEQ ID NO: 127495

SEQ ID NO: 503671 - RNA, 64 nt, Homo Sapiens
gaaacaugccuacccaugaauacccaccaucaucuucacuaagagaagcauccugcauugucuu

SEQ ID NO: 503672 - RNA, 64 nt, Homo Sapiens
gagguuccuucccugcaaaucuggugaaaagcuuuucacuaaguuuagcugggaccuaaaucuu

SEQ ID NO: 503673 - RNA, 64 nt, Homo Sapiens
guggcucucccccaacccuccccaccguccccccuucacuaaacaucuuucuugccuuaugugc

SEQ ID NO: 503674 - RNA, 64 nt, Homo Sapiens
guucacugcaagccccagaagcauauggcauguguucacuaagaggccuuuaauccuggggagu

SEQ ID NO: 503675 - RNA, 64 nt, Homo Sapiens
auuaguuaagacugugcuagugugguuguauuauuucacuaauccucaagcuccuauuacuauu

SEQ ID NO: 503676 - RNA, 64 nt, Homo Sapiens
uugcuaaacuuuguaaugcaaacuugcuucccuuuucacuaauuaaaaguguaacacuaaggug

SEQ ID NO: 503677 - RNA, 64 nt, Homo Sapiens
ucagugacucacuuccaaagcucccuugugagucuucacuaaaaaggagguagaacucaguccu

SEQ ID NO: 503678 - RNA, 64 nt, Homo Sapiens
cccuggauugaaagugaaaacucauaugacuaaguucacuaaaaaaaauuuugaaaguuguauu

SEQ ID NO: 503679 - RNA, 64 nt, Homo Sapiens
ucaauucaugugaauuuuagcucaauuuucaaaguucacuaauauucucaauauuuaaugcuaa

SEQ ID NO: 503680 - RNA, 64 nt, Homo Sapiens
uaguaugcaaauuauaaauauacagucuucccacuucacuaaccaaauuccuacuuuccagugu

SEQ ID NO: 503681 - RNA, 64 nt, Homo Sapiens
auugaaauaaaguuguaaauucuguuugcagugcuucacuaaaccuaaaaugcauuccugcaau

SEQ ID NO: 503682 - RNA, 64 nt, Homo Sapiens
acuauaauuauuuuuggcuuauuacaaauaucacuucacuaaccuucuguguauuaaacuacga

SEQ ID NO: 503683 - RNA, 64 nt, Homo Sapiens
cuuacuguuaacugucuugauguaaaaauacuguuucacuaauauuuucuagucaguaaacauu

SEQ ID NO: 503684 - RNA, 64 nt, Homo Sapiens
caugccaugcccaggagacuaaugcacauccucauucacuaagcauugaucaaaaucaaaaggu

SEQ ID NO: 503685 - RNA, 64 nt, Homo Sapiens
aaaacucucaguuucuugguaaguaguggaagguuucacuaagucaugauauuugacuuuucau

SEQ ID NO: 503686 - RNA, 64 nt, Homo Sapiens
aaagaucugaguuucuugguaaguaguggaagguuucacuaaguaaugguauuugacuuuucau

SEQ ID NO: 503687 - RNA, 64 nt, Homo Sapiens
ugcauguucuaaaacaagagaguccaagguucaguucacuaaagacauacuccuuguaaccauc

SEQ ID NO: 503688 - RNA, 64 nt, Homo Sapiens
auaggccaagaacaaaggcacugcuaucuugggauucacuaauauacaacaaucuucaggaagc

SEQ ID NO: 503689 - RNA, 64 nt, Homo Sapiens
guucauacgugcuuuaucuucucucuuacccagauucacuaauuuucaaaaauaguacaaagag

SEQ ID NO: 503690 - RNA, 64 nt, Homo Sapiens
cuaaauaaaauuuggggaacauucucauaauacuuucacuaauaguugaauagauuauauauuu

SEQ ID NO: 503691 - RNA, 64 nt, Homo Sapiens
uuucucaaucuucaaggcucuaagugcuuaagaauucacuaacagacagaccaucuggaggagc

SEQ ID NO: 503692 - RNA, 64 nt, Homo Sapiens
gacuuuuuagcauuuugaccuagggccuuuggcuuucacuaaaaguggggaccucaguauccca

SEQ ID NO: 503693 - RNA, 64 nt, Homo Sapiens
augaacauaaugaaacaccucauuuauuugauaauucacuaauguuuuauauucauauauuagg

SEQ ID NO: 503694 - RNA, 64 nt, Homo Sapiens
accaacuuucaaaugagcuaacuugggugagacguucacuaaaguaccaagcacaauacaaaug

SEQ ID NO: 503695 - RNA, 64 nt, Homo Sapiens
auacaaaacuuagcugguuaggugaaaccccaucuucacuaaaagaagucagccuggccaacgu

SEQ ID NO: 503696 - RNA, 64 nt, Homo Sapiens
uugacagcacccccaguaggcaacuguaucugauuucacuaauuaccccacccucccugcccau

SEQ ID NO: 503697 - RNA, 64 nt, Homo Sapiens
uuuauuuaaacugaauuuccaguauauuuuuguuuucacuaacaacagauaagguagagcagug

SEQ ID NO: 503698 - RNA, 64 nt, Homo Sapiens
uuauacauauacaggucauauaaaauuaccuggauucacuaaauuuguuuguuguuguuguugu

SEQ ID NO: 503699 - RNA, 64 nt, Homo Sapiens
cauucgguucuacauuauuaacuuuuuuuuucuauauccugaugaccaguaaauuagagccaca

SEQ ID NO: 503700 - RNA, 64 nt, Homo Sapiens
uuaguuuaacaugcaaacaaccauuguugcuaccuauccugaaucaagccuugagccuaaauca

SEQ ID NO: 503701 - RNA, 64 nt, Homo Sapiens
uaguugacuaaauguauuugaaaaccuuguguguuauccugauaugagaagccuaaaacaaaca

SEQ ID NO: 503702 - RNA, 64 nt, Homo Sapiens
cacaacaccuauuccuguucugaauugccuuuuguauccugauucauuagcuauugacuuagag

SEQ ID NO: 503703 - RNA, 64 nt, Homo Sapiens
uguacauuucaacccauauuauucugcaaaucuguauccugaagguauugcacuauuuuauuuu

SEQ ID NO: 503704 - RNA, 64 nt, Homo Sapiens
uugguauugcacuauuuuauaacagaagaguguuuauccugagacaugcuuauuccuuaaaaac

SEQ ID NO: 503705 - RNA, 64 nt, Homo Sapiens
aaagggguuuuucuuaaucaaaguuuuacauuugguagcauaaguaguucuuuaugcuucacag

SEQ ID NO: 503706 - RNA, 64 nt, Homo Sapiens
caagauaagauuuucuguuuuuugaaauaagucuguagcauaaagguuaaacuauuuuaagaca

SEQ ID NO: 503707 - RNA, 64 nt, Homo Sapiens; identical to SEQ ID NO: 144070

SEQ ID NO: 503708 - RNA, 64 nt, Homo Sapiens; identical to SEQ ID NO: 144071

SEQ ID NO: 503709 - RNA, 64 nt, Homo Sapiens; identical to SEQ ID NO: 144072

SEQ ID NO: 503710 - RNA, 64 nt, Homo Sapiens; identical to SEQ ID NO: 144073

SEQ ID NO: 503711 - RNA, 64 nt, Homo Sapiens; identical to SEQ ID NO: 144074

SEQ ID NO: 503712 - RNA, 64 nt, Homo Sapiens; identical to SEQ ID NO: 144075

SEQ ID NO: 503713 - RNA, 64 nt, Homo Sapiens; identical to SEQ ID NO: 144076

SEQ ID NO: 503714 - RNA, 64 nt, Homo Sapiens; identical to SEQ ID NO: 144077

SEQ ID NO: 503715 - RNA, 64 nt, Homo Sapiens; identical to SEQ ID NO: 144078

SEQ ID NO: 503716 - RNA, 64 nt, Homo Sapiens; identical to SEQ ID NO: 144079

SEQ ID NO: 503717 - RNA, 64 nt, Homo Sapiens; identical to SEQ ID NO: 144080

SEQ ID NO: 503718 - RNA, 64 nt, Homo Sapiens; identical to SEQ ID NO: 144081

SEQ ID NO: 503719 - RNA, 64 nt, Homo Sapiens; identical to SEQ ID NO: 144082

SEQ ID NO: 503720 - RNA, 64 nt, Homo Sapiens; identical to SEQ ID NO: 144083

SEQ ID NO: 503721 - RNA, 64 nt, Homo Sapiens; identical to SEQ ID NO: 144084

SEQ ID NO: 503722 - RNA, 64 nt, Homo Sapiens; identical to SEQ ID NO: 144085

SEQ ID NO: 503723 - RNA, 64 nt, Homo Sapiens; identical to SEQ ID NO: 144086

SEQ ID NO: 503724 - RNA, 64 nt, Homo Sapiens; identical to SEQ ID NO: 144087

SEQ ID NO: 503725 - RNA, 64 nt, Homo Sapiens; identical to SEQ ID NO: 144088

SEQ ID NO: 503726 - RNA, 64 nt, Homo Sapiens; identical to SEQ ID NO: 144089

SEQ ID NO: 503727 - RNA, 64 nt, Homo Sapiens; identical to SEQ ID NO: 144090

SEQ ID NO: 503728 - RNA, 64 nt, Homo Sapiens; identical to SEQ ID NO: 144091

SEQ ID NO: 503729 - RNA, 64 nt, Homo Sapiens; identical to SEQ ID NO: 144092

SEQ ID NO: 503730 - RNA, 64 nt, Homo Sapiens; identical to SEQ ID NO: 144093

SEQ ID NO: 503731 - RNA, 64 nt, Homo Sapiens; identical to SEQ ID NO: 144094

SEQ ID NO: 503732 - RNA, 64 nt, Homo Sapiens; identical to SEQ ID NO: 144095

SEQ ID NO: 503733 - RNA, 64 nt, Homo Sapiens; identical to SEQ ID NO: 144096

SEQ ID NO: 503734 - RNA, 64 nt, Homo Sapiens; identical to SEQ ID NO: 144097

SEQ ID NO: 503735 - RNA, 64 nt, Homo Sapiens; identical to SEQ ID NO: 144098

SEQ ID NO: 503736 - RNA, 64 nt, Homo Sapiens; identical to SEQ ID NO: 144099

SEQ ID NO: 503737 - RNA, 64 nt, Homo Sapiens; identical to SEQ ID NO: 144100

SEQ ID NO: 503738 - RNA, 64 nt, Homo Sapiens; identical to SEQ ID NO: 144101

SEQ ID NO: 503739 - RNA, 64 nt, Homo Sapiens; identical to SEQ ID NO: 144102

SEQ ID NO: 503740 - RNA, 64 nt, Homo Sapiens; identical to SEQ ID NO: 144103

SEQ ID NO: 503741 - RNA, 64 nt, Homo Sapiens; identical to SEQ ID NO: 144104

SEQ ID NO: 503742 - RNA, 64 nt, Homo Sapiens; identical to SEQ ID NO: 144105

SEQ ID NO: 503743 - RNA, 64 nt, Homo Sapiens; identical to SEQ ID NO: 144106

SEQ ID NO: 503744 - RNA, 64 nt, Homo Sapiens; identical to SEQ ID NO: 144107

SEQ ID NO: 503745 - RNA, 64 nt, Homo Sapiens; identical to SEQ ID NO: 144108

SEQ ID NO: 503746 - RNA, 64 nt, Homo Sapiens; identical to SEQ ID NO: 144109

SEQ ID NO: 503747 - RNA, 64 nt, Homo Sapiens; identical to SEQ ID NO: 144110

SEQ ID NO: 503748 - RNA, 64 nt, Homo Sapiens; identical to SEQ ID NO: 144111

SEQ ID NO: 503749 - RNA, 64 nt, Homo Sapiens; identical to SEQ ID NO: 144112

SEQ ID NO: 503750 - RNA, 64 nt, Homo Sapiens; identical to SEQ ID NO: 144113

SEQ ID NO: 503751 - RNA, 64 nt, Homo Sapiens; identical to SEQ ID NO: 144114

SEQ ID NO: 503752 - RNA, 64 nt, Homo Sapiens; identical to SEQ ID NO: 144115

SEQ ID NO: 503753 - RNA, 64 nt, Homo Sapiens; identical to SEQ ID NO: 144116

SEQ ID NO: 503754 - RNA, 64 nt, Homo Sapiens; identical to SEQ ID NO: 144117

SEQ ID NO: 503755 - RNA, 64 nt, Homo Sapiens; identical to SEQ ID NO: 144118

SEQ ID NO: 503756 - RNA, 64 nt, Homo Sapiens; identical to SEQ ID NO: 144119

SEQ ID NO: 503757 - RNA, 64 nt, Homo Sapiens; identical to SEQ ID NO: 144120

SEQ ID NO: 503758 - RNA, 64 nt, Homo Sapiens; identical to SEQ ID NO: 144121

SEQ ID NO: 503759 - RNA, 64 nt, Homo Sapiens; identical to SEQ ID NO: 144122

SEQ ID NO: 503760 - RNA, 64 nt, Homo Sapiens; identical to SEQ ID NO: 144123

SEQ ID NO: 503761 - RNA, 64 nt, Homo Sapiens; identical to SEQ ID NO: 144124

SEQ ID NO: 503762 - RNA, 64 nt, Homo Sapiens; identical to SEQ ID NO: 144125

SEQ ID NO: 503763 - RNA, 64 nt, Homo Sapiens; identical to SEQ ID NO: 144126

SEQ ID NO: 503764 - RNA, 64 nt, Homo Sapiens; identical to SEQ ID NO: 144127

SEQ ID NO: 503765 - RNA, 64 nt, Homo Sapiens; identical to SEQ ID NO: 144128

SEQ ID NO: 503766 - RNA, 64 nt, Homo Sapiens; identical to SEQ ID NO: 144129

SEQ ID NO: 503767 - RNA, 64 nt, Homo Sapiens; identical to SEQ ID NO: 144130

SEQ ID NO: 503768 - RNA, 64 nt, Homo Sapiens; identical to SEQ ID NO: 144131

SEQ ID NO: 503769 - RNA, 64 nt, Homo Sapiens; identical to SEQ ID NO: 144132

SEQ ID NO: 503770 - RNA, 64 nt, Homo Sapiens; identical to SEQ ID NO: 144133

SEQ ID NO: 503771 - RNA, 64 nt, Homo Sapiens; identical to SEQ ID NO: 144134

SEQ ID NO: 503772 - RNA, 64 nt, Homo Sapiens; identical to SEQ ID NO: 144135

SEQ ID NO: 503773 - RNA, 64 nt, Homo Sapiens; identical to SEQ ID NO: 144136

SEQ ID NO: 503774 - RNA, 64 nt, Homo Sapiens; identical to SEQ ID NO: 144137

SEQ ID NO: 503775 - RNA, 64 nt, Homo Sapiens; identical to SEQ ID NO: 144138

SEQ ID NO: 503776 - RNA, 64 nt, Homo Sapiens; identical to SEQ ID NO: 144139

SEQ ID NO: 503777 - RNA, 64 nt, Homo Sapiens; identical to SEQ ID NO: 144140

SEQ ID NO: 503778 - RNA, 64 nt, Homo Sapiens; identical to SEQ ID NO: 144141

SEQ ID NO: 503779 - RNA, 64 nt, Homo Sapiens; identical to SEQ ID NO: 144142

SEQ ID NO: 503780 - RNA, 64 nt, Homo Sapiens; identical to SEQ ID NO: 144143

SEQ ID NO: 503781 - RNA, 64 nt, Homo Sapiens; identical to SEQ ID NO: 144144

SEQ ID NO: 503782 - RNA, 64 nt, Homo Sapiens; identical to SEQ ID NO: 144145

SEQ ID NO: 503783 - RNA, 64 nt, Homo Sapiens; identical to SEQ ID NO: 144146

SEQ ID NO: 503784 - RNA, 64 nt, Homo Sapiens; identical to SEQ ID NO: 144147

SEQ ID NO: 503785 - RNA, 64 nt, Homo Sapiens; identical to SEQ ID NO: 144148

SEQ ID NO: 503786 - RNA, 64 nt, Homo Sapiens; identical to SEQ ID NO: 144149

SEQ ID NO: 503787 - RNA, 64 nt, Homo Sapiens; identical to SEQ ID NO: 144150

SEQ ID NO: 503788 - RNA, 64 nt, Homo Sapiens; identical to SEQ ID NO: 144151

SEQ ID NO: 503789 - RNA, 64 nt, Homo Sapiens; identical to SEQ ID NO: 144152

SEQ ID NO: 503790 - RNA, 64 nt, Homo Sapiens; identical to SEQ ID NO: 144153

SEQ ID NO: 503791 - RNA, 64 nt, Homo Sapiens; identical to SEQ ID NO: 144154

SEQ ID NO: 503792 - RNA, 64 nt, Homo Sapiens; identical to SEQ ID NO: 144155

SEQ ID NO: 503793 - RNA, 64 nt, Homo Sapiens
auagcaauuguuaauaaaaucagaguaaucuuucaggaacuaaauucaguguaauccuuuauau

SEQ ID NO: 503794 - RNA, 64 nt, Homo Sapiens
aacauugcacugaaaacuugaguaucuuaaaagaaggaacuauacuucgaggcuguagauucca

SEQ ID NO: 503795 - RNA, 64 nt, Homo Sapiens
uuaaaaaucuauggcagaaaaauggucaaggaauaggaacuacaacuucauaaaugaggaacca

SEQ ID NO: 503796 - RNA, 64 nt, Homo Sapiens
uaguauugccuaugauaaucguuagucaucauuaaggaacuaaguauuauguacuccuugccuu

SEQ ID NO: 503797 - RNA, 64 nt, Homo Sapiens
cuggaaacugauaguucacugcguacuuuguuccaggaacuauguucgcuacuaguuauucaga

SEQ ID NO: 503798 - RNA, 64 nt, Homo Sapiens
cuagaaacugucucucuagggccuacuguguuccaggaacuauguuacuacauaguuauucaga

SEQ ID NO: 503799 - RNA, 64 nt, Homo Sapiens
gcagcagccuguguagucugcccccgggaaacugaggaacuaaagaaagcugaaggugcccacc

SEQ ID NO: 503800 - RNA, 64 nt, Homo Sapiens
cccugccagccccuaacuacccuccccagccuccaggaacuauccauccacucuuaucuccaug

SEQ ID NO: 503801 - RNA, 64 nt, Homo Sapiens
cugugucugcauguaagagugagggagggaaggaaggaacuacaagagagucggagaugaugca

SEQ ID NO: 503802 - RNA, 64 nt, Homo Sapiens
caagcagcuagacuggugaauugggggaaauagaaggaacuaguaacugagacuccuccagccu

SEQ ID NO: 503803 - RNA, 64 nt, Homo Sapiens
cuuggcagauucuacaagucuauuaugacaaaccaggaacuaauucuauaauggaaaacuaucc

SEQ ID NO: 503804 - RNA, 64 nt, Homo Sapiens
cuccuaugcuaaauuaccuguaaauauucuggauaggaacuacuugaaauaguaauuuguuaaa

SEQ ID NO: 503805 - RNA, 64 nt, Homo Sapiens
uugacucccuuauacuguggcuagggcuuguuggaggaacuagugcuggauccgaguagauucc

SEQ ID NO: 503806 - RNA, 64 nt, Homo Sapiens
cucauuagcuauaaggaucagugagguucauuuuaggaacuaaccacaucccagccuaacaccu

SEQ ID NO: 503807 - RNA, 64 nt, Homo Sapiens; identical to SEQ ID NO: 74555

SEQ ID NO: 503808 - RNA, 64 nt, Homo Sapiens; identical to SEQ ID NO: 74556

SEQ ID NO: 503809 - RNA, 64 nt, Homo Sapiens; identical to SEQ ID NO: 74557

SEQ ID NO: 503810 - RNA, 64 nt, Homo Sapiens; identical to SEQ ID NO: 74558

SEQ ID NO: 503811 - RNA, 64 nt, Homo Sapiens; identical to SEQ ID NO: 74559

SEQ ID NO: 503812 - RNA, 64 nt, Homo Sapiens; identical to SEQ ID NO: 74560

SEQ ID NO: 503813 - RNA, 64 nt, Homo Sapiens; identical to SEQ ID NO: 56439

SEQ ID NO: 503814 - RNA, 64 nt, Homo Sapiens; identical to SEQ ID NO: 56440

SEQ ID NO: 503815 - RNA, 64 nt, Homo Sapiens; identical to SEQ ID NO: 56441

SEQ ID NO: 503816 - RNA, 64 nt, Homo Sapiens; identical to SEQ ID NO: 56442

SEQ ID NO: 503817 - RNA, 64 nt, Homo Sapiens; identical to SEQ ID NO: 56443

SEQ ID NO: 503818 - RNA, 64 nt, Homo Sapiens; identical to SEQ ID NO: 56444

SEQ ID NO: 503819 - RNA, 64 nt, Homo Sapiens; identical to SEQ ID NO: 56445

SEQ ID NO: 503820 - RNA, 64 nt, Homo Sapiens; identical to SEQ ID NO: 56446

SEQ ID NO: 503821 - RNA, 64 nt, Homo Sapiens; identical to SEQ ID NO: 56447

SEQ ID NO: 503822 - RNA, 64 nt, Homo Sapiens; identical to SEQ ID NO: 56448

SEQ ID NO: 503823 - RNA, 64 nt, Homo Sapiens; identical to SEQ ID NO: 56449

SEQ ID NO: 503824 - RNA, 64 nt, Homo Sapiens; identical to SEQ ID NO: 56450

SEQ ID NO: 503825 - RNA, 64 nt, Homo Sapiens; identical to SEQ ID NO: 56451

SEQ ID NO: 503826 - RNA, 64 nt, Homo Sapiens; identical to SEQ ID NO: 56452

SEQ ID NO: 503827 - RNA, 64 nt, Homo Sapiens; identical to SEQ ID NO: 56453

SEQ ID NO: 503828 - RNA, 64 nt, Homo Sapiens; identical to SEQ ID NO: 56454

SEQ ID NO: 503829 - RNA, 64 nt, Homo Sapiens; identical to SEQ ID NO: 56455

SEQ ID NO: 503830 - RNA, 64 nt, Homo Sapiens; identical to SEQ ID NO: 56456

SEQ ID NO: 503831 - RNA, 64 nt, Homo Sapiens; identical to SEQ ID NO: 56457

SEQ ID NO: 503832 - RNA, 64 nt, Homo Sapiens; identical to SEQ ID NO: 56458

SEQ ID NO: 503833 - RNA, 64 nt, Homo Sapiens; identical to SEQ ID NO: 56459

SEQ ID NO: 503834 - RNA, 64 nt, Homo Sapiens; identical to SEQ ID NO: 56460

SEQ ID NO: 503835 - RNA, 64 nt, Homo Sapiens; identical to SEQ ID NO: 56461

SEQ ID NO: 503836 - RNA, 64 nt, Homo Sapiens; identical to SEQ ID NO: 56462

SEQ ID NO: 503837 - RNA, 64 nt, Homo Sapiens; identical to SEQ ID NO: 56463

SEQ ID NO: 503838 - RNA, 64 nt, Homo Sapiens; identical to SEQ ID NO: 56464

SEQ ID NO: 503839 - RNA, 64 nt, Homo Sapiens; identical to SEQ ID NO: 56465

SEQ ID NO: 503840 - RNA, 64 nt, Homo Sapiens; identical to SEQ ID NO: 56466

SEQ ID NO: 503841 - RNA, 64 nt, Homo Sapiens; identical to SEQ ID NO: 56467

SEQ ID NO: 503842 - RNA, 50 nt, Homo Sapiens; identical to SEQ ID NO: 56468

SEQ ID NO: 503843 - RNA, 64 nt, Homo Sapiens; identical to SEQ ID NO: 56469

SEQ ID NO: 503844 - RNA, 64 nt, Homo Sapiens; identical to SEQ ID NO: 56470

SEQ ID NO: 503845 - RNA, 64 nt, Homo Sapiens; identical to SEQ ID NO: 56471

SEQ ID NO: 503846 - RNA, 64 nt, Homo Sapiens; identical to SEQ ID NO: 56472

SEQ ID NO: 503847 - RNA, 64 nt, Homo Sapiens; identical to SEQ ID NO: 56473

SEQ ID NO: 503848 - RNA, 64 nt, Homo Sapiens; identical to SEQ ID NO: 56474

SEQ ID NO: 503849 - RNA, 64 nt, Homo Sapiens; identical to SEQ ID NO: 56475

SEQ ID NO: 503850 - RNA, 64 nt, Homo Sapiens; identical to SEQ ID NO: 56476

SEQ ID NO: 503851 - RNA, 64 nt, Homo Sapiens; identical to SEQ ID NO: 56477

SEQ ID NO: 503852 - RNA, 64 nt, Homo Sapiens; identical to SEQ ID NO: 56478

SEQ ID NO: 503853 - RNA, 64 nt, Homo Sapiens; identical to SEQ ID NO: 56479

SEQ ID NO: 503854 - RNA, 64 nt, Homo Sapiens; identical to SEQ ID NO: 56480

SEQ ID NO: 503855 - RNA, 64 nt, Homo Sapiens; identical to SEQ ID NO: 56481

SEQ ID NO: 503856 - RNA, 64 nt, Homo Sapiens; identical to SEQ ID NO: 56482

SEQ ID NO: 503857 - RNA, 64 nt, Homo Sapiens; identical to SEQ ID NO: 56483

SEQ ID NO: 503858 - RNA, 64 nt, Homo Sapiens; identical to SEQ ID NO: 56484

SEQ ID NO: 503859 - RNA, 64 nt, Homo Sapiens; identical to SEQ ID NO: 56485

SEQ ID NO: 503860 - RNA, 64 nt, Homo Sapiens; identical to SEQ ID NO: 56486

SEQ ID NO: 503861 - RNA, 64 nt, Homo Sapiens; identical to SEQ ID NO: 56487

SEQ ID NO: 503862 - RNA, 64 nt, Homo Sapiens; identical to SEQ ID NO: 56488

SEQ ID NO: 503863 - RNA, 64 nt, Homo Sapiens; identical to SEQ ID NO: 56489

SEQ ID NO: 503864 - RNA, 64 nt, Homo Sapiens; identical to SEQ ID NO: 56490

SEQ ID NO: 503865 - RNA, 64 nt, Homo Sapiens; identical to SEQ ID NO: 56491

SEQ ID NO: 503866 - RNA, 64 nt, Homo Sapiens; identical to SEQ ID NO: 56492

SEQ ID NO: 503867 - RNA, 64 nt, Homo Sapiens; identical to SEQ ID NO: 56493

SEQ ID NO: 503868 - RNA, 64 nt, Homo Sapiens; identical to SEQ ID NO: 56494

SEQ ID NO: 503869 - RNA, 64 nt, Homo Sapiens; identical to SEQ ID NO: 56495

SEQ ID NO: 503870 - RNA, 64 nt, Homo Sapiens; identical to SEQ ID NO: 56496

SEQ ID NO: 503871 - RNA, 64 nt, Homo Sapiens; identical to SEQ ID NO: 56497

SEQ ID NO: 503872 - RNA, 64 nt, Homo Sapiens; identical to SEQ ID NO: 56498

SEQ ID NO: 503873 - RNA, 64 nt, Homo Sapiens; identical to SEQ ID NO: 56499

SEQ ID NO: 503874 - RNA, 64 nt, Homo Sapiens; identical to SEQ ID NO: 56500

SEQ ID NO: 503875 - RNA, 64 nt, Homo Sapiens; identical to SEQ ID NO: 56501

SEQ ID NO: 503876 - RNA, 64 nt, Homo Sapiens; identical to SEQ ID NO: 56502

SEQ ID NO: 503877 - RNA, 64 nt, Homo Sapiens; identical to SEQ ID NO: 56503

SEQ ID NO: 503878 - RNA, 64 nt, Homo Sapiens; identical to SEQ ID NO: 56504

SEQ ID NO: 503879 - RNA, 64 nt, Homo Sapiens; identical to SEQ ID NO: 56505

SEQ ID NO: 503880 - RNA, 64 nt, Homo Sapiens; identical to SEQ ID NO: 56506

SEQ ID NO: 503881 - RNA, 64 nt, Homo Sapiens; identical to SEQ ID NO: 56507

SEQ ID NO: 503882 - RNA, 64 nt, Homo Sapiens; identical to SEQ ID NO: 56508

SEQ ID NO: 503883 - RNA, 64 nt, Homo Sapiens; identical to SEQ ID NO: 56509

SEQ ID NO: 503884 - RNA, 64 nt, Homo Sapiens; identical to SEQ ID NO: 56510

SEQ ID NO: 503885 - RNA, 64 nt, Homo Sapiens; identical to SEQ ID NO: 56511

SEQ ID NO: 503886 - RNA, 64 nt, Homo Sapiens; identical to SEQ ID NO: 56512

SEQ ID NO: 503887 - RNA, 64 nt, Homo Sapiens; identical to SEQ ID NO: 56513

SEQ ID NO: 503888 - RNA, 64 nt, Homo Sapiens; identical to SEQ ID NO: 56514

SEQ ID NO: 503889 - RNA, 64 nt, Homo Sapiens; identical to SEQ ID NO: 56515

SEQ ID NO: 503890 - RNA, 64 nt, Homo Sapiens; identical to SEQ ID NO: 56516

SEQ ID NO: 503891 - RNA, 64 nt, Homo Sapiens; identical to SEQ ID NO: 56517

SEQ ID NO: 503892 - RNA, 64 nt, Homo Sapiens; identical to SEQ ID NO: 56518

SEQ ID NO: 503893 - RNA, 64 nt, Homo Sapiens; identical to SEQ ID NO: 56519

SEQ ID NO: 503894 - RNA, 64 nt, Homo Sapiens; identical to SEQ ID NO: 56520

SEQ ID NO: 503895 - RNA, 64 nt, Homo Sapiens; identical to SEQ ID NO: 56521

SEQ ID NO: 503896 - RNA, 64 nt, Homo Sapiens; identical to SEQ ID NO: 56522

SEQ ID NO: 503897 - RNA, 64 nt, Homo Sapiens; identical to SEQ ID NO: 56523

SEQ ID NO: 503898 - RNA, 64 nt, Homo Sapiens; identical to SEQ ID NO: 56524

SEQ ID NO: 503899 - RNA, 64 nt, Homo Sapiens; identical to SEQ ID NO: 56525

SEQ ID NO: 503900 - RNA, 64 nt, Homo Sapiens; identical to SEQ ID NO: 56526

SEQ ID NO: 503901 - RNA, 64 nt, Homo Sapiens; identical to SEQ ID NO: 56527

SEQ ID NO: 503902 - RNA, 64 nt, Homo Sapiens; identical to SEQ ID NO: 56528

SEQ ID NO: 503903 - RNA, 64 nt, Homo Sapiens; identical to SEQ ID NO: 56529

SEQ ID NO: 503904 - RNA, 64 nt, Homo Sapiens; identical to SEQ ID NO: 56530

SEQ ID NO: 503905 - RNA, 64 nt, Homo Sapiens; identical to SEQ ID NO: 56531

SEQ ID NO: 503906 - RNA, 64 nt, Homo Sapiens; identical to SEQ ID NO: 56532

SEQ ID NO: 503907 - RNA, 64 nt, Homo Sapiens; identical to SEQ ID NO: 56533

SEQ ID NO: 503908 - RNA, 64 nt, Homo Sapiens; identical to SEQ ID NO: 56534

SEQ ID NO: 503909 - RNA, 59 nt, Homo Sapiens; identical to SEQ ID NO: 56535

SEQ ID NO: 503910 - RNA, 64 nt, Homo Sapiens; identical to SEQ ID NO: 56536

SEQ ID NO: 503911 - RNA, 64 nt, Homo Sapiens; identical to SEQ ID NO: 56537

SEQ ID NO: 503912 - RNA, 64 nt, Homo Sapiens; identical to SEQ ID NO: 56538

SEQ ID NO: 503913 - RNA, 64 nt, Homo Sapiens; identical to SEQ ID NO: 56539

SEQ ID NO: 503914 - RNA, 64 nt, Homo Sapiens; identical to SEQ ID NO: 56540

SEQ ID NO: 503915 - RNA, 64 nt, Homo Sapiens; identical to SEQ ID NO: 56541

SEQ ID NO: 503916 - RNA, 64 nt, Homo Sapiens; identical to SEQ ID NO: 56542

SEQ ID NO: 503917 - RNA, 64 nt, Homo Sapiens; identical to SEQ ID NO: 56543

SEQ ID NO: 503918 - RNA, 64 nt, Homo Sapiens; identical to SEQ ID NO: 56544

SEQ ID NO: 503919 - RNA, 64 nt, Homo Sapiens; identical to SEQ ID NO: 56545

SEQ ID NO: 503920 - RNA, 64 nt, Homo Sapiens; identical to SEQ ID NO: 56546

SEQ ID NO: 503921 - RNA, 64 nt, Homo Sapiens; identical to SEQ ID NO: 56547

SEQ ID NO: 503922 - RNA, 64 nt, Homo Sapiens; identical to SEQ ID NO: 56548

SEQ ID NO: 503923 - RNA, 64 nt, Homo Sapiens; identical to SEQ ID NO: 56549

SEQ ID NO: 503924 - RNA, 64 nt, Homo Sapiens; identical to SEQ ID NO: 56550

SEQ ID NO: 503925 - RNA, 64 nt, Homo Sapiens; identical to SEQ ID NO: 56551

SEQ ID NO: 503926 - RNA, 64 nt, Homo Sapiens; identical to SEQ ID NO: 56552

SEQ ID NO: 503927 - RNA, 64 nt, Homo Sapiens; identical to SEQ ID NO: 56553

SEQ ID NO: 503928 - RNA, 64 nt, Homo Sapiens; identical to SEQ ID NO: 56554

SEQ ID NO: 503929 - RNA, 64 nt, Homo Sapiens; identical to SEQ ID NO: 56555

SEQ ID NO: 503930 - RNA, 64 nt, Homo Sapiens; identical to SEQ ID NO: 56556

SEQ ID NO: 503931 - RNA, 62 nt, Homo Sapiens; identical to SEQ ID NO: 56557

SEQ ID NO: 503932 - RNA, 58 nt, Homo Sapiens; identical to SEQ ID NO: 56558

SEQ ID NO: 503933 - RNA, 64 nt, Homo Sapiens; identical to SEQ ID NO: 56559

SEQ ID NO: 503934 - RNA, 64 nt, Homo Sapiens; identical to SEQ ID NO: 56560

SEQ ID NO: 503935 - RNA, 64 nt, Homo Sapiens; identical to SEQ ID NO: 56561

SEQ ID NO: 503936 - RNA, 64 nt, Homo Sapiens; identical to SEQ ID NO: 56562

SEQ ID NO: 503937 - RNA, 64 nt, Homo Sapiens; identical to SEQ ID NO: 56563

SEQ ID NO: 503938 - RNA, 64 nt, Homo Sapiens; identical to SEQ ID NO: 56564

SEQ ID NO: 503939 - RNA, 64 nt, Homo Sapiens; identical to SEQ ID NO: 56565

SEQ ID NO: 503940 - RNA, 64 nt, Homo Sapiens; identical to SEQ ID NO: 56566

SEQ ID NO: 503941 - RNA, 64 nt, Homo Sapiens; identical to SEQ ID NO: 56567

SEQ ID NO: 503942 - RNA, 64 nt, Homo Sapiens; identical to SEQ ID NO: 56568

SEQ ID NO: 503943 - RNA, 64 nt, Homo Sapiens; identical to SEQ ID NO: 56569

SEQ ID NO: 503944 - RNA, 64 nt, Homo Sapiens; identical to SEQ ID NO: 56570

SEQ ID NO: 503945 - RNA, 64 nt, Homo Sapiens; identical to SEQ ID NO: 56571

SEQ ID NO: 503946 - RNA, 64 nt, Homo Sapiens; identical to SEQ ID NO: 56572

SEQ ID NO: 503947 - RNA, 64 nt, Homo Sapiens; identical to SEQ ID NO: 56573

SEQ ID NO: 503948 - RNA, 64 nt, Homo Sapiens; identical to SEQ ID NO: 56574

SEQ ID NO: 503949 - RNA, 64 nt, Homo Sapiens; identical to SEQ ID NO: 56575

SEQ ID NO: 503950 - RNA, 64 nt, Homo Sapiens; identical to SEQ ID NO: 56576

SEQ ID NO: 503951 - RNA, 64 nt, Homo Sapiens; identical to SEQ ID NO: 56577

SEQ ID NO: 503952 - RNA, 64 nt, Homo Sapiens; identical to SEQ ID NO: 56578

SEQ ID NO: 503953 - RNA, 64 nt, Homo Sapiens; identical to SEQ ID NO: 56579

SEQ ID NO: 503954 - RNA, 64 nt, Homo Sapiens; identical to SEQ ID NO: 56580

SEQ ID NO: 503955 - RNA, 64 nt, Homo Sapiens; identical to SEQ ID NO: 56581

SEQ ID NO: 503956 - RNA, 64 nt, Homo Sapiens; identical to SEQ ID NO: 56582

SEQ ID NO: 503957 - RNA, 64 nt, Homo Sapiens
cugggcugugugcucuuaugggaaugaggguuggguguccaagaugcccugggcuguguccuuc

SEQ ID NO: 503958 - RNA, 64 nt, Homo Sapiens
cugggcuguguacuccccuaggaaugagggcuggguguccaagauacccugggcuguguccucc

SEQ ID NO: 503959 - RNA, 64 nt, Homo Sapiens
cuguccuuuguaagaagucaggaaaucugaugcuguguccaaaauuaugcacuguuuguugaag

SEQ ID NO: 503960 - RNA, 64 nt, Homo Sapiens
ccugcuucuggcauaacugcuuugccucugucuaguguccaagcaucuuagcuguucaagagga

SEQ ID NO: 503961 - RNA, 64 nt, Homo Sapiens; identical to SEQ ID NO: 494526

SEQ ID NO: 503962 - RNA, 64 nt, Homo Sapiens; identical to SEQ ID NO: 494527

SEQ ID NO: 503963 - RNA, 64 nt, Homo Sapiens; identical to SEQ ID NO: 494528

SEQ ID NO: 503964 - RNA, 64 nt, Homo Sapiens; identical to SEQ ID NO: 494529

SEQ ID NO: 503965 - RNA, 64 nt, Homo Sapiens; identical to SEQ ID NO: 494530

SEQ ID NO: 503966 - RNA, 64 nt, Homo Sapiens; identical to SEQ ID NO: 494531

SEQ ID NO: 503967 - RNA, 64 nt, Homo Sapiens; identical to SEQ ID NO: 494532

SEQ ID NO: 503968 - RNA, 64 nt, Homo Sapiens; identical to SEQ ID NO: 494533

SEQ ID NO: 503969 - RNA, 64 nt, Homo Sapiens; identical to SEQ ID NO: 494534

SEQ ID NO: 503970 - RNA, 64 nt, Homo Sapiens; identical to SEQ ID NO: 494535

SEQ ID NO: 503971 - RNA, 64 nt, Homo Sapiens; identical to SEQ ID NO: 494536

SEQ ID NO: 503972 - RNA, 64 nt, Homo Sapiens; identical to SEQ ID NO: 494537

SEQ ID NO: 503973 - RNA, 64 nt, Homo Sapiens; identical to SEQ ID NO: 494538

SEQ ID NO: 503974 - RNA, 64 nt, Homo Sapiens; identical to SEQ ID NO: 494539

SEQ ID NO: 503975 - RNA, 64 nt, Homo Sapiens; identical to SEQ ID NO: 494540

SEQ ID NO: 503976 - RNA, 64 nt, Homo Sapiens; identical to SEQ ID NO: 494541

SEQ ID NO: 503977 - RNA, 64 nt, Homo Sapiens; identical to SEQ ID NO: 209384

SEQ ID NO: 503978 - RNA, 64 nt, Homo Sapiens; identical to SEQ ID NO: 209385

SEQ ID NO: 503979 - RNA, 64 nt, Homo Sapiens; identical to SEQ ID NO: 209386

SEQ ID NO: 503980 - RNA, 64 nt, Homo Sapiens; identical to SEQ ID NO: 209387

SEQ ID NO: 503981 - RNA, 64 nt, Homo Sapiens; identical to SEQ ID NO: 209388

SEQ ID NO: 503982 - RNA, 64 nt, Homo Sapiens; identical to SEQ ID NO: 209389

SEQ ID NO: 503983 - RNA, 64 nt, Homo Sapiens; identical to SEQ ID NO: 209390

SEQ ID NO: 503984 - RNA, 64 nt, Homo Sapiens; identical to SEQ ID NO: 209391

SEQ ID NO: 503985 - RNA, 64 nt, Homo Sapiens; identical to SEQ ID NO: 209392

SEQ ID NO: 503986 - RNA, 64 nt, Homo Sapiens; identical to SEQ ID NO: 209393

SEQ ID NO: 503987 - RNA, 64 nt, Homo Sapiens; identical to SEQ ID NO: 209394

SEQ ID NO: 503988 - RNA, 64 nt, Homo Sapiens; identical to SEQ ID NO: 209395

SEQ ID NO: 503989 - RNA, 61 nt, Homo Sapiens; identical to SEQ ID NO: 209396

SEQ ID NO: 503990 - RNA, 64 nt, Homo Sapiens; identical to SEQ ID NO: 209397

SEQ ID NO: 503991 - RNA, 64 nt, Homo Sapiens; identical to SEQ ID NO: 209398

SEQ ID NO: 503992 - RNA, 64 nt, Homo Sapiens; identical to SEQ ID NO: 209399

SEQ ID NO: 503993 - RNA, 64 nt, Homo Sapiens; identical to SEQ ID NO: 209400

SEQ ID NO: 503994 - RNA, 64 nt, Homo Sapiens; identical to SEQ ID NO: 209401

SEQ ID NO: 503995 - RNA, 64 nt, Homo Sapiens; identical to SEQ ID NO: 209402

SEQ ID NO: 503996 - RNA, 64 nt, Homo Sapiens; identical to SEQ ID NO: 209403

SEQ ID NO: 503997 - RNA, 64 nt, Homo Sapiens; identical to SEQ ID NO: 209404

SEQ ID NO: 503998 - RNA, 64 nt, Homo Sapiens; identical to SEQ ID NO: 209405

SEQ ID NO: 503999 - RNA, 64 nt, Homo Sapiens; identical to SEQ ID NO: 209406

SEQ ID NO: 504000 - RNA, 64 nt, Homo Sapiens; identical to SEQ ID NO: 209407

SEQ ID NO: 504001 - RNA, 64 nt, Homo Sapiens; identical to SEQ ID NO: 86201

SEQ ID NO: 504002 - RNA, 64 nt, Homo Sapiens; identical to SEQ ID NO: 86202

SEQ ID NO: 504003 - RNA, 64 nt, Homo Sapiens; identical to SEQ ID NO: 86203

SEQ ID NO: 504004 - RNA, 64 nt, Homo Sapiens; identical to SEQ ID NO: 86204

SEQ ID NO: 504005 - RNA, 64 nt, Homo Sapiens; identical to SEQ ID NO: 86205

SEQ ID NO: 504006 - RNA, 64 nt, Homo Sapiens; identical to SEQ ID NO: 86206

SEQ ID NO: 504007 - RNA, 64 nt, Homo Sapiens; identical to SEQ ID NO: 86207

SEQ ID NO: 504008 - RNA, 64 nt, Homo Sapiens; identical to SEQ ID NO: 86208

SEQ ID NO: 504009 - RNA, 64 nt, Homo Sapiens; identical to SEQ ID NO: 86209

SEQ ID NO: 504010 - RNA, 64 nt, Homo Sapiens; identical to SEQ ID NO: 86210

SEQ ID NO: 504011 - RNA, 64 nt, Homo Sapiens; identical to SEQ ID NO: 86211

SEQ ID NO: 504012 - RNA, 64 nt, Homo Sapiens; identical to SEQ ID NO: 86212

SEQ ID NO: 504013 - RNA, 64 nt, Homo Sapiens; identical to SEQ ID NO: 86213

SEQ ID NO: 504014 - RNA, 64 nt, Homo Sapiens; identical to SEQ ID NO: 86214

SEQ ID NO: 504015 - RNA, 64 nt, Homo Sapiens; identical to SEQ ID NO: 86215

SEQ ID NO: 504016 - RNA, 64 nt, Homo Sapiens; identical to SEQ ID NO: 86216

SEQ ID NO: 504017 - RNA, 64 nt, Homo Sapiens; identical to SEQ ID NO: 86217

SEQ ID NO: 504018 - RNA, 64 nt, Homo Sapiens; identical to SEQ ID NO: 86218

SEQ ID NO: 504019 - RNA, 64 nt, Homo Sapiens; identical to SEQ ID NO: 86219

SEQ ID NO: 504020 - RNA, 64 nt, Homo Sapiens; identical to SEQ ID NO: 86220

SEQ ID NO: 504021 - RNA, 64 nt, Homo Sapiens; identical to SEQ ID NO: 86221

SEQ ID NO: 504022 - RNA, 64 nt, Homo Sapiens; identical to SEQ ID NO: 86222

SEQ ID NO: 504023 - RNA, 64 nt, Homo Sapiens; identical to SEQ ID NO: 86223

SEQ ID NO: 504024 - RNA, 64 nt, Homo Sapiens; identical to SEQ ID NO: 86224

SEQ ID NO: 504025 - RNA, 64 nt, Homo Sapiens; identical to SEQ ID NO: 86225

SEQ ID NO: 504026 - RNA, 64 nt, Homo Sapiens; identical to SEQ ID NO: 86226

SEQ ID NO: 504027 - RNA, 64 nt, Homo Sapiens; identical to SEQ ID NO: 86227

SEQ ID NO: 504028 - RNA, 64 nt, Homo Sapiens; identical to SEQ ID NO: 86228

SEQ ID NO: 504029 - RNA, 64 nt, Homo Sapiens; identical to SEQ ID NO: 86229

SEQ ID NO: 504030 - RNA, 64 nt, Homo Sapiens; identical to SEQ ID NO: 86230

SEQ ID NO: 504031 - RNA, 64 nt, Homo Sapiens; identical to SEQ ID NO: 86231

SEQ ID NO: 504032 - RNA, 64 nt, Homo Sapiens; identical to SEQ ID NO: 86232

SEQ ID NO: 504033 - RNA, 64 nt, Homo Sapiens; identical to SEQ ID NO: 86233

SEQ ID NO: 504034 - RNA, 64 nt, Homo Sapiens; identical to SEQ ID NO: 86234

SEQ ID NO: 504035 - RNA, 64 nt, Homo Sapiens; identical to SEQ ID NO: 86235

SEQ ID NO: 504036 - RNA, 64 nt, Homo Sapiens; identical to SEQ ID NO: 86236

SEQ ID NO: 504037 - RNA, 64 nt, Homo Sapiens; identical to SEQ ID NO: 86237

SEQ ID NO: 504038 - RNA, 64 nt, Homo Sapiens; identical to SEQ ID NO: 86238

SEQ ID NO: 504039 - RNA, 64 nt, Homo Sapiens; identical to SEQ ID NO: 86239

SEQ ID NO: 504040 - RNA, 64 nt, Homo Sapiens; identical to SEQ ID NO: 86240

SEQ ID NO: 504041 - RNA, 64 nt, Homo Sapiens; identical to SEQ ID NO: 86241

SEQ ID NO: 504042 - RNA, 64 nt, Homo Sapiens; identical to SEQ ID NO: 86242

SEQ ID NO: 504043 - RNA, 64 nt, Homo Sapiens; identical to SEQ ID NO: 86243

SEQ ID NO: 504044 - RNA, 64 nt, Homo Sapiens; identical to SEQ ID NO: 86244

SEQ ID NO: 504045 - RNA, 64 nt, Homo Sapiens; identical to SEQ ID NO: 86245

SEQ ID NO: 504046 - RNA, 64 nt, Homo Sapiens; identical to SEQ ID NO: 86246

SEQ ID NO: 504047 - RNA, 64 nt, Homo Sapiens; identical to SEQ ID NO: 86247

SEQ ID NO: 504048 - RNA, 64 nt, Homo Sapiens; identical to SEQ ID NO: 86248

SEQ ID NO: 504049 - RNA, 64 nt, Homo Sapiens; identical to SEQ ID NO: 86249

SEQ ID NO: 504050 - RNA, 64 nt, Homo Sapiens; identical to SEQ ID NO: 86250

SEQ ID NO: 504051 - RNA, 64 nt, Homo Sapiens; identical to SEQ ID NO: 86251

SEQ ID NO: 504052 - RNA, 64 nt, Homo Sapiens; identical to SEQ ID NO: 86252

SEQ ID NO: 504053 - RNA, 64 nt, Homo Sapiens; identical to SEQ ID NO: 86253

SEQ ID NO: 504054 - RNA, 64 nt, Homo Sapiens; identical to SEQ ID NO: 86254

SEQ ID NO: 504055 - RNA, 64 nt, Homo Sapiens; identical to SEQ ID NO: 86255

SEQ ID NO: 504056 - RNA, 64 nt, Homo Sapiens; identical to SEQ ID NO: 86256

SEQ ID NO: 504057 - RNA, 55 nt, Homo Sapiens; identical to SEQ ID NO: 86257

SEQ ID NO: 504058 - RNA, 64 nt, Homo Sapiens; identical to SEQ ID NO: 86258

SEQ ID NO: 504059 - RNA, 64 nt, Homo Sapiens; identical to SEQ ID NO: 86259

SEQ ID NO: 504060 - RNA, 64 nt, Homo Sapiens; identical to SEQ ID NO: 86260

SEQ ID NO: 504061 - RNA, 64 nt, Homo Sapiens; identical to SEQ ID NO: 86261

SEQ ID NO: 504062 - RNA, 64 nt, Homo Sapiens; identical to SEQ ID NO: 86262

SEQ ID NO: 504063 - RNA, 64 nt, Homo Sapiens; identical to SEQ ID NO: 86263

SEQ ID NO: 504064 - RNA, 64 nt, Homo Sapiens; identical to SEQ ID NO: 86264

SEQ ID NO: 504065 - RNA, 64 nt, Homo Sapiens; identical to SEQ ID NO: 86265

SEQ ID NO: 504066 - RNA, 64 nt, Homo Sapiens; identical to SEQ ID NO: 86266

SEQ ID NO: 504067 - RNA, 64 nt, Homo Sapiens; identical to SEQ ID NO: 86267

SEQ ID NO: 504068 - RNA, 64 nt, Homo Sapiens; identical to SEQ ID NO: 86268

SEQ ID NO: 504069 - RNA, 64 nt, Homo Sapiens; identical to SEQ ID NO: 86269

SEQ ID NO: 504070 - RNA, 64 nt, Homo Sapiens; identical to SEQ ID NO: 86270

SEQ ID NO: 504071 - RNA, 64 nt, Homo Sapiens; identical to SEQ ID NO: 86271

SEQ ID NO: 504072 - RNA, 64 nt, Homo Sapiens; identical to SEQ ID NO: 86272

SEQ ID NO: 504073 - RNA, 64 nt, Homo Sapiens; identical to SEQ ID NO: 86273

SEQ ID NO: 504074 - RNA, 64 nt, Homo Sapiens; identical to SEQ ID NO: 86274

SEQ ID NO: 504075 - RNA, 64 nt, Homo Sapiens; identical to SEQ ID NO: 86275

SEQ ID NO: 504076 - RNA, 64 nt, Homo Sapiens; identical to SEQ ID NO: 86276

SEQ ID NO: 504077 - RNA, 64 nt, Homo Sapiens; identical to SEQ ID NO: 86277

SEQ ID NO: 504078 - RNA, 64 nt, Homo Sapiens; identical to SEQ ID NO: 86278

SEQ ID NO: 504079 - RNA, 64 nt, Homo Sapiens; identical to SEQ ID NO: 21144

SEQ ID NO: 504080 - RNA, 64 nt, Homo Sapiens; identical to SEQ ID NO: 21145

SEQ ID NO: 504081 - RNA, 64 nt, Homo Sapiens; identical to SEQ ID NO: 21146

SEQ ID NO: 504082 - RNA, 64 nt, Homo Sapiens; identical to SEQ ID NO: 21147

SEQ ID NO: 504083 - RNA, 64 nt, Homo Sapiens; identical to SEQ ID NO: 21148

SEQ ID NO: 504084 - RNA, 64 nt, Homo Sapiens; identical to SEQ ID NO: 21149

SEQ ID NO: 504085 - RNA, 58 nt, Homo Sapiens
ggcccacuugcggaaccugacucaggcugcuggcaagcguagcuauguguuggcccug

SEQ ID NO: 504086 - RNA, 58 nt, Homo Sapiens
ucuacagccucauuccuuaguucccggagcuggcaagggcuggagccccgccuggguc

SEQ ID NO: 504087 - RNA, 58 nt, Homo Sapiens
acuagaaaaccugacuaauggugucacugcuggcaauggugauaauggauuaauuccu

SEQ ID NO: 504088 - RNA, 58 nt, Homo Sapiens
cccagaaaaccugacuaauggugccacugcuggcaauggugaugauggauuaauuccu

SEQ ID NO: 504089 - RNA, 58 nt, Homo Sapiens
uguggggcugggucagaaagacagacuggcuggcaaguagucuguuuacagcuggcaa

SEQ ID NO: 504090 - RNA, 58 nt, Homo Sapiens
agacuggcuggcaaguuguguguuuacagcuggcaaacgagaggcagccugggcaguc

SEQ ID NO: 504091 - RNA, 58 nt, Homo Sapiens
uucuagggaaacuuggccaguuaauuuggcuggcaaaaaaauaguuaacaucaggaag

SEQ ID NO: 504092 - RNA, 58 nt, Homo Sapiens
gaaggucaugagaugaguucguggcacugcuggcaaauuguggugcuguagguaacgu

SEQ ID NO: 504093 - RNA, 58 nt, Homo Sapiens
uuucuaaaacuuucacuggagacgucuagcuggcaaugucaaucaacucuaacucgga

SEQ ID NO: 504094 - RNA, 58 nt, Homo Sapiens
gacuuagcuauuaguauauugggaccuggcuggcaaaucuuguucucuacuguucacc

SEQ ID NO: 504095 - RNA, 58 nt, Homo Sapiens
gcccuuaggaugccgcauggggauaagagcuggcaaguaacaacagugcugacugucc

SEQ ID NO: 504096 - RNA, 58 nt, Homo Sapiens
guaagucccccaguugcucuugugcugugcuggcaaguucugcccaagaccagaggag

SEQ ID NO: 504097 - RNA, 58 nt, Homo Sapiens
aaugggaacaguggcugucuguccugcugcuggcaaggggugggguagagcacucucc

SEQ ID NO: 504098 - RNA, 58 nt, Homo Sapiens; identical to SEQ ID NO: 234416

SEQ ID NO: 504099 - RNA, 58 nt, Homo Sapiens
aauuuagccuuacucccaaguuauaaaugcuggcaacaaaucacaguaguaaaagcag

SEQ ID NO: 504100 - RNA, 64 nt, Homo Sapiens
agguuuggguuuuugagauuugcuggugaagucagugacgaaaaauaaaccuucccuuaucuuc

SEQ ID NO: 504101 - RNA, 64 nt, Homo Sapiens
agcccuucugagcaucaguggugugggggaguaggugacgaaacacuagaccucuccugagaga

SEQ ID NO: 504102 - RNA, 64 nt, Homo Sapiens
uuuuuuacaacgugacaggaagaggagggagagggugacgaacaccaggcauuuccaggggcua

SEQ ID NO: 504103 - RNA, 64 nt, Homo Sapiens
caauuuccugacacugagaaugaagaguaucacagugacgaacaaaaugauacucagaagcaau

SEQ ID NO: 504104 - RNA, 64 nt, Homo Sapiens
guggcuuggguucacagugcauauacacaauaaugugacgaaaguggaaauggagaugguccug

SEQ ID NO: 504105 - RNA, 64 nt, Homo Sapiens
aaacaaaagugucucccuguggaaaggcauaacugugacgaaagcaacuuuuauaggcaaagca

SEQ ID NO: 504106 - RNA, 64 nt, Homo Sapiens
aaggcaggaaugaagaagcacuuaaaagagagaggugacgaaggauuuuaagcuuauucuuuuu

SEQ ID NO: 504107 - RNA, 64 nt, Homo Sapiens
gacugaugguuugaacuuaaaagacauacagcuagugacgaauggagguaaaauaauuugcccg

SEQ ID NO: 504108 - RNA, 64 nt, Homo Sapiens
uaaagagauccuuaaauuaucauugauaaccuuugugacgaacauaugcagaugcucuuaaaag

SEQ ID NO: 504109 - RNA, 64 nt, Homo Sapiens
gaggaauguauauguuggcuaucaaaugccaguugugacgaaaugaggagccuauggaaugugg

SEQ ID NO: 504110 - RNA, 64 nt, Homo Sapiens
auuugacaugaggguaccuucgcccucaggagaugugacgaaggaacaaggucuaauuugugcg

SEQ ID NO: 504111 - RNA, 64 nt, Homo Sapiens
uccccccucccugguggucuuaggucuauaaucagugacgaacagagggugcccuuggccaaug

SEQ ID NO: 504112 - RNA, 64 nt, Homo Sapiens
uacaaagcaaggaaaaaaugaugaggucaaaggagugacgaaaaucaguuuuuagccuuuacac

SEQ ID NO: 504113 - RNA, 64 nt, Homo Sapiens
aguaguccucagugugugugcugcuucggaaagcgugacgaagcacuuacauagccccacucag

SEQ ID NO: 504114 - RNA, 64 nt, Homo Sapiens
uuuuaaacgcgugaugaagacagaaggcuccggggugacgaauuuggccgauggcagauguuuu

SEQ ID NO: 504115 - RNA, 64 nt, Homo Sapiens
ugcguuguagggguauugaugagacagaaauucagugacgaagguucucauuucgugccgaaau

SEQ ID NO: 504116 - RNA, 64 nt, Homo Sapiens
cauuguccccaaugaauauaauuucuuaacccaagugacgaaaaacuuugacacuuuucauauc

SEQ ID NO: 504117 - RNA, 64 nt, Homo Sapiens
cagauaauucacaccagagagaaacccucugaaugugacgaaugaagaaaagguauuaguguua

SEQ ID NO: 504118 - RNA, 64 nt, Homo Sapiens
agccuuguugauugaagauuggauaauagaauuugugacgaaagcugauaugcaauggucuugg

SEQ ID NO: 504119 - RNA, 64 nt, Homo Sapiens
gucaauucauuuuuucccaugagaugaagcacaugugacgaauacggacuagauaaccucuaag

SEQ ID NO: 504120 - RNA, 64 nt, Homo Sapiens
ugauuggaacauuuggggaguguuguuuuccguugugacgaaugugucugcacaguaucuuaug

SEQ ID NO: 504121 - RNA, 64 nt, Homo Sapiens
guuggccaagugaaugaugcacuggcaugucuuggugacgaagaaacuccaugugguugauuuu

SEQ ID NO: 504122 - RNA, 64 nt, Homo Sapiens
uguguagaaacuaaaucaucagucuucauguacagugacgaaacuucuuauuugcaguuuuacc

SEQ ID NO: 504123 - RNA, 64 nt, Homo Sapiens
gagggacagaggagggauggguggggacaggccagugacgaagaagaaaagaacaucagggugg

SEQ ID NO: 504124 - RNA, 64 nt, Homo Sapiens
gugggaauugugaauucugaagauacagaugacagugacgaaugccuucugucucaugauugac

SEQ ID NO: 504125 - RNA, 64 nt, Homo Sapiens
aggagguggaggaggaggaagaggagaaggaaaagugacgaagagagaggaggaggggggcccc

SEQ ID NO: 504126 - RNA, 64 nt, Homo Sapiens
cagagauggcucaaaaaugggguuucagaucuuugugacgaaauagaauacuguuucauauuug

SEQ ID NO: 504127 - RNA, 64 nt, Homo Sapiens
ucuggcagugaggacacauuggacucagaugauagugacgaaugccuuuggcuuugcugagaga

SEQ ID NO: 504128 - RNA, 64 nt, Homo Sapiens
gucgggagaagggagggagagaauuuuauuaaaugugacgaacugccccccccccccccccagc

SEQ ID NO: 504129 - RNA, 64 nt, Homo Sapiens
uccuacugaauguaccaaguuggccacagccugagugacgaauucuuugcacuuuucuuggucu

SEQ ID NO: 504130 - RNA, 64 nt, Homo Sapiens
cugacuuugucucaaaaaaugcacucuagcucgggugacgaagcugagcugagaucacaccacu

SEQ ID NO: 504131 - RNA, 64 nt, Homo Sapiens
cccuaucugcgcacccggagguggggugaggacggugacgaagguacccaggucuggggcugca

SEQ ID NO: 504132 - RNA, 64 nt, Homo Sapiens
uacccaggucuggggcugcaguggggugaggacggugacgaaggcccuaugugcacacccggag

SEQ ID NO: 504133 - RNA, 64 nt, Homo Sapiens; identical to SEQ ID NO: 45025

SEQ ID NO: 504134 - RNA, 64 nt, Homo Sapiens; identical to SEQ ID NO: 45026

SEQ ID NO: 504135 - RNA, 64 nt, Homo Sapiens; identical to SEQ ID NO: 45027

SEQ ID NO: 504136 - RNA, 64 nt, Homo Sapiens; identical to SEQ ID NO: 45028

SEQ ID NO: 504137 - RNA, 64 nt, Homo Sapiens; identical to SEQ ID NO: 45029

SEQ ID NO: 504138 - RNA, 64 nt, Homo Sapiens; identical to SEQ ID NO: 45030

SEQ ID NO: 504139 - RNA, 64 nt, Homo Sapiens; identical to SEQ ID NO: 45031

SEQ ID NO: 504140 - RNA, 64 nt, Homo Sapiens; identical to SEQ ID NO: 45032

SEQ ID NO: 504141 - RNA, 64 nt, Homo Sapiens; identical to SEQ ID NO: 45033

SEQ ID NO: 504142 - RNA, 64 nt, Homo Sapiens; identical to SEQ ID NO: 45034

SEQ ID NO: 504143 - RNA, 64 nt, Homo Sapiens; identical to SEQ ID NO: 45035

SEQ ID NO: 504144 - RNA, 64 nt, Homo Sapiens; identical to SEQ ID NO: 45036

SEQ ID NO: 504145 - RNA, 64 nt, Homo Sapiens; identical to SEQ ID NO: 45037

SEQ ID NO: 504146 - RNA, 64 nt, Homo Sapiens; identical to SEQ ID NO: 45038

SEQ ID NO: 504147 - RNA, 64 nt, Homo Sapiens; identical to SEQ ID NO: 45039

SEQ ID NO: 504148 - RNA, 64 nt, Homo Sapiens; identical to SEQ ID NO: 45040

SEQ ID NO: 504149 - RNA, 64 nt, Homo Sapiens; identical to SEQ ID NO: 45041

SEQ ID NO: 504150 - RNA, 64 nt, Homo Sapiens; identical to SEQ ID NO: 45042

SEQ ID NO: 504151 - RNA, 64 nt, Homo Sapiens; identical to SEQ ID NO: 45043

SEQ ID NO: 504152 - RNA, 64 nt, Homo Sapiens; identical to SEQ ID NO: 45044

SEQ ID NO: 504153 - RNA, 64 nt, Homo Sapiens; identical to SEQ ID NO: 45045

SEQ ID NO: 504154 - RNA, 64 nt, Homo Sapiens; identical to SEQ ID NO: 45046

SEQ ID NO: 504155 - RNA, 64 nt, Homo Sapiens; identical to SEQ ID NO: 45047

SEQ ID NO: 504156 - RNA, 64 nt, Homo Sapiens; identical to SEQ ID NO: 45048

SEQ ID NO: 504157 - RNA, 64 nt, Homo Sapiens; identical to SEQ ID NO: 45049

SEQ ID NO: 504158 - RNA, 64 nt, Homo Sapiens; identical to SEQ ID NO: 45050

SEQ ID NO: 504159 - RNA, 64 nt, Homo Sapiens; identical to SEQ ID NO: 45051

SEQ ID NO: 504160 - RNA, 64 nt, Homo Sapiens; identical to SEQ ID NO: 45052

SEQ ID NO: 504161 - RNA, 64 nt, Homo Sapiens; identical to SEQ ID NO: 45053

SEQ ID NO: 504162 - RNA, 64 nt, Homo Sapiens; identical to SEQ ID NO: 45054

SEQ ID NO: 504163 - RNA, 64 nt, Homo Sapiens; identical to SEQ ID NO: 45055

SEQ ID NO: 504164 - RNA, 64 nt, Homo Sapiens; identical to SEQ ID NO: 45056

SEQ ID NO: 504165 - RNA, 64 nt, Homo Sapiens; identical to SEQ ID NO: 45057

SEQ ID NO: 504166 - RNA, 64 nt, Homo Sapiens; identical to SEQ ID NO: 45058

SEQ ID NO: 504167 - RNA, 64 nt, Homo Sapiens; identical to SEQ ID NO: 45059

SEQ ID NO: 504168 - RNA, 64 nt, Homo Sapiens; identical to SEQ ID NO: 45060

SEQ ID NO: 504169 - RNA, 64 nt, Homo Sapiens; identical to SEQ ID NO: 45061

SEQ ID NO: 504170 - RNA, 64 nt, Homo Sapiens; identical to SEQ ID NO: 45062

SEQ ID NO: 504171 - RNA, 64 nt, Homo Sapiens; identical to SEQ ID NO: 45063

SEQ ID NO: 504172 - RNA, 64 nt, Homo Sapiens; identical to SEQ ID NO: 45064

SEQ ID NO: 504173 - RNA, 64 nt, Homo Sapiens; identical to SEQ ID NO: 45065

SEQ ID NO: 504174 - RNA, 64 nt, Homo Sapiens; identical to SEQ ID NO: 45066

SEQ ID NO: 504175 - RNA, 64 nt, Homo Sapiens; identical to SEQ ID NO: 366326

SEQ ID NO: 504176 - RNA, 64 nt, Homo Sapiens; identical to SEQ ID NO: 366327

SEQ ID NO: 504177 - RNA, 64 nt, Homo Sapiens; identical to SEQ ID NO: 366328

SEQ ID NO: 504178 - RNA, 64 nt, Homo Sapiens; identical to SEQ ID NO: 366329

SEQ ID NO: 504179 - RNA, 64 nt, Homo Sapiens; identical to SEQ ID NO: 366330

SEQ ID NO: 504180 - RNA, 64 nt, Homo Sapiens; identical to SEQ ID NO: 366331

SEQ ID NO: 504181 - RNA, 64 nt, Homo Sapiens; identical to SEQ ID NO: 366332

SEQ ID NO: 504182 - RNA, 64 nt, Homo Sapiens; identical to SEQ ID NO: 366333

SEQ ID NO: 504183 - RNA, 64 nt, Homo Sapiens; identical to SEQ ID NO: 366334

SEQ ID NO: 504184 - RNA, 64 nt, Homo Sapiens; identical to SEQ ID NO: 366335

SEQ ID NO: 504185 - RNA, 64 nt, Homo Sapiens; identical to SEQ ID NO: 366336

SEQ ID NO: 504186 - RNA, 64 nt, Homo Sapiens; identical to SEQ ID NO: 366337

SEQ ID NO: 504187 - RNA, 64 nt, Homo Sapiens; identical to SEQ ID NO: 366338

SEQ ID NO: 504188 - RNA, 64 nt, Homo Sapiens; identical to SEQ ID NO: 366339

SEQ ID NO: 504189 - RNA, 64 nt, Homo Sapiens; identical to SEQ ID NO: 366340

SEQ ID NO: 504190 - RNA, 64 nt, Homo Sapiens; identical to SEQ ID NO: 366341

SEQ ID NO: 504191 - RNA, 64 nt, Homo Sapiens; identical to SEQ ID NO: 366342

SEQ ID NO: 504192 - RNA, 64 nt, Homo Sapiens; identical to SEQ ID NO: 366343

SEQ ID NO: 504193 - RNA, 64 nt, Homo Sapiens; identical to SEQ ID NO: 366344

SEQ ID NO: 504194 - RNA, 64 nt, Homo Sapiens; identical to SEQ ID NO: 366345

SEQ ID NO: 504195 - RNA, 64 nt, Homo Sapiens; identical to SEQ ID NO: 366346

SEQ ID NO: 504196 - RNA, 64 nt, Homo Sapiens; identical to SEQ ID NO: 366347

SEQ ID NO: 504197 - RNA, 64 nt, Homo Sapiens; identical to SEQ ID NO: 366348

SEQ ID NO: 504198 - RNA, 64 nt, Homo Sapiens; identical to SEQ ID NO: 366349

SEQ ID NO: 504199 - RNA, 64 nt, Homo Sapiens; identical to SEQ ID NO: 366350

SEQ ID NO: 504200 - RNA, 64 nt, Homo Sapiens; identical to SEQ ID NO: 366351

SEQ ID NO: 504201 - RNA, 64 nt, Homo Sapiens; identical to SEQ ID NO: 366352

SEQ ID NO: 504202 - RNA, 64 nt, Homo Sapiens; identical to SEQ ID NO: 366353

SEQ ID NO: 504203 - RNA, 64 nt, Homo Sapiens; identical to SEQ ID NO: 366354

SEQ ID NO: 504204 - RNA, 64 nt, Homo Sapiens; identical to SEQ ID NO: 366355

SEQ ID NO: 504205 - RNA, 64 nt, Homo Sapiens; identical to SEQ ID NO: 366356

SEQ ID NO: 504206 - RNA, 64 nt, Homo Sapiens; identical to SEQ ID NO: 366357

SEQ ID NO: 504207 - RNA, 64 nt, Homo Sapiens; identical to SEQ ID NO: 366358

SEQ ID NO: 504208 - RNA, 64 nt, Homo Sapiens; identical to SEQ ID NO: 366359

SEQ ID NO: 504209 - RNA, 64 nt, Homo Sapiens; identical to SEQ ID NO: 366360

SEQ ID NO: 504210 - RNA, 64 nt, Homo Sapiens; identical to SEQ ID NO: 366361

SEQ ID NO: 504211 - RNA, 64 nt, Homo Sapiens; identical to SEQ ID NO: 366362

SEQ ID NO: 504212 - RNA, 64 nt, Homo Sapiens; identical to SEQ ID NO: 366363

SEQ ID NO: 504213 - RNA, 64 nt, Homo Sapiens; identical to SEQ ID NO: 366364

SEQ ID NO: 504214 - RNA, 64 nt, Homo Sapiens; identical to SEQ ID NO: 366365

SEQ ID NO: 504215 - RNA, 64 nt, Homo Sapiens; identical to SEQ ID NO: 366366

SEQ ID NO: 504216 - RNA, 64 nt, Homo Sapiens; identical to SEQ ID NO: 366367

SEQ ID NO: 504217 - RNA, 64 nt, Homo Sapiens; identical to SEQ ID NO: 366368

SEQ ID NO: 504218 - RNA, 64 nt, Homo Sapiens; identical to SEQ ID NO: 366369

SEQ ID NO: 504219 - RNA, 64 nt, Homo Sapiens; identical to SEQ ID NO: 366370

SEQ ID NO: 504220 - RNA, 64 nt, Homo Sapiens; identical to SEQ ID NO: 366371

SEQ ID NO: 504221 - RNA, 64 nt, Homo Sapiens; identical to SEQ ID NO: 366372

SEQ ID NO: 504222 - RNA, 64 nt, Homo Sapiens; identical to SEQ ID NO: 366373

SEQ ID NO: 504223 - RNA, 64 nt, Homo Sapiens; identical to SEQ ID NO: 366374

SEQ ID NO: 504224 - RNA, 64 nt, Homo Sapiens; identical to SEQ ID NO: 366375

SEQ ID NO: 504225 - RNA, 64 nt, Homo Sapiens; identical to SEQ ID NO: 366376

SEQ ID NO: 504226 - RNA, 64 nt, Homo Sapiens; identical to SEQ ID NO: 366377

SEQ ID NO: 504227 - RNA, 64 nt, Homo Sapiens; identical to SEQ ID NO: 366378

SEQ ID NO: 504228 - RNA, 64 nt, Homo Sapiens; identical to SEQ ID NO: 366379

SEQ ID NO: 504229 - RNA, 64 nt, Homo Sapiens; identical to SEQ ID NO: 366380

SEQ ID NO: 504230 - RNA, 64 nt, Homo Sapiens; identical to SEQ ID NO: 366381

SEQ ID NO: 504231 - RNA, 64 nt, Homo Sapiens; identical to SEQ ID NO: 366382

SEQ ID NO: 504232 - RNA, 64 nt, Homo Sapiens; identical to SEQ ID NO: 366383

SEQ ID NO: 504233 - RNA, 64 nt, Homo Sapiens; identical to SEQ ID NO: 366384

SEQ ID NO: 504234 - RNA, 64 nt, Homo Sapiens; identical to SEQ ID NO: 366385

SEQ ID NO: 504235 - RNA, 64 nt, Homo Sapiens; identical to SEQ ID NO: 366386

SEQ ID NO: 504236 - RNA, 64 nt, Homo Sapiens; identical to SEQ ID NO: 366387

SEQ ID NO: 504237 - RNA, 64 nt, Homo Sapiens; identical to SEQ ID NO: 366388

SEQ ID NO: 504238 - RNA, 64 nt, Homo Sapiens; identical to SEQ ID NO: 366389

SEQ ID NO: 504239 - RNA, 64 nt, Homo Sapiens; identical to SEQ ID NO: 366390

SEQ ID NO: 504240 - RNA, 64 nt, Homo Sapiens; identical to SEQ ID NO: 366391

SEQ ID NO: 504241 - RNA, 64 nt, Homo Sapiens; identical to SEQ ID NO: 366392

SEQ ID NO: 504242 - RNA, 64 nt, Homo Sapiens; identical to SEQ ID NO: 366393

SEQ ID NO: 504243 - RNA, 64 nt, Homo Sapiens; identical to SEQ ID NO: 366394

SEQ ID NO: 504244 - RNA, 64 nt, Homo Sapiens; identical to SEQ ID NO: 366395

SEQ ID NO: 504245 - RNA, 64 nt, Homo Sapiens; identical to SEQ ID NO: 366396

SEQ ID NO: 504246 - RNA, 64 nt, Homo Sapiens; identical to SEQ ID NO: 366397

SEQ ID NO: 504247 - RNA, 64 nt, Homo Sapiens; identical to SEQ ID NO: 366398

SEQ ID NO: 504248 - RNA, 64 nt, Homo Sapiens; identical to SEQ ID NO: 366399

SEQ ID NO: 504249 - RNA, 64 nt, Homo Sapiens; identical to SEQ ID NO: 366400

SEQ ID NO: 504250 - RNA, 64 nt, Homo Sapiens; identical to SEQ ID NO: 366401

SEQ ID NO: 504251 - RNA, 64 nt, Homo Sapiens; identical to SEQ ID NO: 366402

SEQ ID NO: 504252 - RNA, 64 nt, Homo Sapiens; identical to SEQ ID NO: 366403

SEQ ID NO: 504253 - RNA, 64 nt, Homo Sapiens; identical to SEQ ID NO: 366404

SEQ ID NO: 504254 - RNA, 64 nt, Homo Sapiens; identical to SEQ ID NO: 366405

SEQ ID NO: 504255 - RNA, 64 nt, Homo Sapiens; identical to SEQ ID NO: 366406

SEQ ID NO: 504256 - RNA, 64 nt, Homo Sapiens; identical to SEQ ID NO: 366407

SEQ ID NO: 504257 - RNA, 64 nt, Homo Sapiens; identical to SEQ ID NO: 366408

SEQ ID NO: 504258 - RNA, 64 nt, Homo Sapiens; identical to SEQ ID NO: 366409

SEQ ID NO: 504259 - RNA, 64 nt, Homo Sapiens; identical to SEQ ID NO: 366410

SEQ ID NO: 504260 - RNA, 64 nt, Homo Sapiens; identical to SEQ ID NO: 366411

SEQ ID NO: 504261 - RNA, 64 nt, Homo Sapiens; identical to SEQ ID NO: 366412

SEQ ID NO: 504262 - RNA, 64 nt, Homo Sapiens; identical to SEQ ID NO: 366413

SEQ ID NO: 504263 - RNA, 64 nt, Homo Sapiens; identical to SEQ ID NO: 366414

SEQ ID NO: 504264 - RNA, 64 nt, Homo Sapiens; identical to SEQ ID NO: 366415

SEQ ID NO: 504265 - RNA, 64 nt, Homo Sapiens; identical to SEQ ID NO: 366416

SEQ ID NO: 504266 - RNA, 64 nt, Homo Sapiens; identical to SEQ ID NO: 366417

SEQ ID NO: 504267 - RNA, 64 nt, Homo Sapiens; identical to SEQ ID NO: 366418

SEQ ID NO: 504268 - RNA, 64 nt, Homo Sapiens; identical to SEQ ID NO: 366419

SEQ ID NO: 504269 - RNA, 64 nt, Homo Sapiens; identical to SEQ ID NO: 366420

SEQ ID NO: 504270 - RNA, 64 nt, Homo Sapiens; identical to SEQ ID NO: 366421

SEQ ID NO: 504271 - RNA, 64 nt, Homo Sapiens; identical to SEQ ID NO: 366422

SEQ ID NO: 504272 - RNA, 64 nt, Homo Sapiens; identical to SEQ ID NO: 366423

SEQ ID NO: 504273 - RNA, 64 nt, Homo Sapiens; identical to SEQ ID NO: 366424

SEQ ID NO: 504274 - RNA, 64 nt, Homo Sapiens; identical to SEQ ID NO: 366425

SEQ ID NO: 504275 - RNA, 64 nt, Homo Sapiens; identical to SEQ ID NO: 366426

SEQ ID NO: 504276 - RNA, 64 nt, Homo Sapiens; identical to SEQ ID NO: 366427

SEQ ID NO: 504277 - RNA, 64 nt, Homo Sapiens; identical to SEQ ID NO: 366428

SEQ ID NO: 504278 - RNA, 64 nt, Homo Sapiens; identical to SEQ ID NO: 366429

SEQ ID NO: 504279 - RNA, 64 nt, Homo Sapiens; identical to SEQ ID NO: 366430

SEQ ID NO: 504280 - RNA, 64 nt, Homo Sapiens; identical to SEQ ID NO: 366431

SEQ ID NO: 504281 - RNA, 64 nt, Homo Sapiens; identical to SEQ ID NO: 366432

SEQ ID NO: 504282 - RNA, 64 nt, Homo Sapiens; identical to SEQ ID NO: 366433

SEQ ID NO: 504283 - RNA, 64 nt, Homo Sapiens; identical to SEQ ID NO: 366434

SEQ ID NO: 504284 - RNA, 64 nt, Homo Sapiens; identical to SEQ ID NO: 366435

SEQ ID NO: 504285 - RNA, 64 nt, Homo Sapiens; identical to SEQ ID NO: 366436

SEQ ID NO: 504286 - RNA, 64 nt, Homo Sapiens; identical to SEQ ID NO: 366437

SEQ ID NO: 504287 - RNA, 64 nt, Homo Sapiens; identical to SEQ ID NO: 366438

SEQ ID NO: 504288 - RNA, 64 nt, Homo Sapiens; identical to SEQ ID NO: 366439

SEQ ID NO: 504289 - RNA, 64 nt, Homo Sapiens; identical to SEQ ID NO: 366440

SEQ ID NO: 504290 - RNA, 64 nt, Homo Sapiens; identical to SEQ ID NO: 366441

SEQ ID NO: 504291 - RNA, 64 nt, Homo Sapiens; identical to SEQ ID NO: 366442

SEQ ID NO: 504292 - RNA, 64 nt, Homo Sapiens; identical to SEQ ID NO: 366443

SEQ ID NO: 504293 - RNA, 64 nt, Homo Sapiens; identical to SEQ ID NO: 366444

SEQ ID NO: 504294 - RNA, 64 nt, Homo Sapiens; identical to SEQ ID NO: 366445

SEQ ID NO: 504295 - RNA, 64 nt, Homo Sapiens; identical to SEQ ID NO: 366446

SEQ ID NO: 504296 - RNA, 64 nt, Homo Sapiens; identical to SEQ ID NO: 366447

SEQ ID NO: 504297 - RNA, 64 nt, Homo Sapiens; identical to SEQ ID NO: 366448

SEQ ID NO: 504298 - RNA, 64 nt, Homo Sapiens; identical to SEQ ID NO: 366449

SEQ ID NO: 504299 - RNA, 64 nt, Homo Sapiens; identical to SEQ ID NO: 366450

SEQ ID NO: 504300 - RNA, 64 nt, Homo Sapiens; identical to SEQ ID NO: 366451

SEQ ID NO: 504301 - RNA, 64 nt, Homo Sapiens; identical to SEQ ID NO: 366452

SEQ ID NO: 504302 - RNA, 64 nt, Homo Sapiens; identical to SEQ ID NO: 366453

SEQ ID NO: 504303 - RNA, 64 nt, Homo Sapiens; identical to SEQ ID NO: 366454

SEQ ID NO: 504304 - RNA, 64 nt, Homo Sapiens; identical to SEQ ID NO: 366455

SEQ ID NO: 504305 - RNA, 64 nt, Homo Sapiens; identical to SEQ ID NO: 366456

SEQ ID NO: 504306 - RNA, 64 nt, Homo Sapiens; identical to SEQ ID NO: 366457

SEQ ID NO: 504307 - RNA, 64 nt, Homo Sapiens; identical to SEQ ID NO: 366458

SEQ ID NO: 504308 - RNA, 64 nt, Homo Sapiens; identical to SEQ ID NO: 366459

SEQ ID NO: 504309 - RNA, 64 nt, Homo Sapiens; identical to SEQ ID NO: 366460

SEQ ID NO: 504310 - RNA, 64 nt, Homo Sapiens; identical to SEQ ID NO: 366461

SEQ ID NO: 504311 - RNA, 64 nt, Homo Sapiens; identical to SEQ ID NO: 366462

SEQ ID NO: 504312 - RNA, 64 nt, Homo Sapiens; identical to SEQ ID NO: 366463

SEQ ID NO: 504313 - RNA, 64 nt, Homo Sapiens; identical to SEQ ID NO: 366464

SEQ ID NO: 504314 - RNA, 64 nt, Homo Sapiens; identical to SEQ ID NO: 366465

SEQ ID NO: 504315 - RNA, 64 nt, Homo Sapiens; identical to SEQ ID NO: 366466

SEQ ID NO: 504316 - RNA, 64 nt, Homo Sapiens; identical to SEQ ID NO: 366467

SEQ ID NO: 504317 - RNA, 64 nt, Homo Sapiens; identical to SEQ ID NO: 366468

SEQ ID NO: 504318 - RNA, 64 nt, Homo Sapiens; identical to SEQ ID NO: 366469

SEQ ID NO: 504319 - RNA, 64 nt, Homo Sapiens; identical to SEQ ID NO: 366470

SEQ ID NO: 504320 - RNA, 64 nt, Homo Sapiens; identical to SEQ ID NO: 366471

SEQ ID NO: 504321 - RNA, 64 nt, Homo Sapiens; identical to SEQ ID NO: 366472

SEQ ID NO: 504322 - RNA, 64 nt, Homo Sapiens; identical to SEQ ID NO: 366473

SEQ ID NO: 504323 - RNA, 64 nt, Homo Sapiens; identical to SEQ ID NO: 366474

SEQ ID NO: 504324 - RNA, 64 nt, Homo Sapiens; identical to SEQ ID NO: 366475

SEQ ID NO: 504325 - RNA, 64 nt, Homo Sapiens; identical to SEQ ID NO: 366476

SEQ ID NO: 504326 - RNA, 64 nt, Homo Sapiens; identical to SEQ ID NO: 366477

SEQ ID NO: 504327 - RNA, 64 nt, Homo Sapiens; identical to SEQ ID NO: 366478

SEQ ID NO: 504328 - RNA, 64 nt, Homo Sapiens; identical to SEQ ID NO: 366479

SEQ ID NO: 504329 - RNA, 64 nt, Homo Sapiens; identical to SEQ ID NO: 366480

SEQ ID NO: 504330 - RNA, 64 nt, Homo Sapiens; identical to SEQ ID NO: 366481

SEQ ID NO: 504331 - RNA, 64 nt, Homo Sapiens; identical to SEQ ID NO: 366482

SEQ ID NO: 504332 - RNA, 64 nt, Homo Sapiens; identical to SEQ ID NO: 366483

SEQ ID NO: 504333 - RNA, 64 nt, Homo Sapiens; identical to SEQ ID NO: 366484

SEQ ID NO: 504334 - RNA, 64 nt, Homo Sapiens; identical to SEQ ID NO: 366485

SEQ ID NO: 504335 - RNA, 64 nt, Homo Sapiens; identical to SEQ ID NO: 366486

SEQ ID NO: 504336 - RNA, 64 nt, Homo Sapiens; identical to SEQ ID NO: 366487

SEQ ID NO: 504337 - RNA, 64 nt, Homo Sapiens; identical to SEQ ID NO: 366488

SEQ ID NO: 504338 - RNA, 64 nt, Homo Sapiens; identical to SEQ ID NO: 366489

SEQ ID NO: 504339 - RNA, 64 nt, Homo Sapiens; identical to SEQ ID NO: 366490

SEQ ID NO: 504340 - RNA, 64 nt, Homo Sapiens
ugaacaucucuugaaaccuguuaaaacaaccaguuaaagccacagauggcuuucagggcaguag

SEQ ID NO: 504341 - RNA, 64 nt, Homo Sapiens
caaagucacauccacaacuaaugagggaaaucuguaaagccaguuagauagaagaauuuuauuu

SEQ ID NO: 504342 - RNA, 64 nt, Homo Sapiens
cccuauugguauccuuuuugagauauuccuugauuaaagccagagguugguaaugugacuuugu

SEQ ID NO: 504343 - RNA, 64 nt, Homo Sapiens
acuuggucuuuuccagugcuuauauuuacccuaauaaagccaccauucacuguagcaacuguga

SEQ ID NO: 504344 - RNA, 64 nt, Homo Sapiens
auuacggcuagcaccuagcaugggguuuugguuuuaaagccagaauuuuuauuuauuaaauauu

SEQ ID NO: 504345 - RNA, 64 nt, Homo Sapiens
gaacuaccccgcucccugcgcccagauuaaugcauaaagccaagaaccauuacuccagcugccu

SEQ ID NO: 504346 - RNA, 64 nt, Homo Sapiens
uuuuuguuuguuuguuuuuuguuuuuuuucuugguaaagccaugcaccacagacuucugggcag

SEQ ID NO: 504347 - RNA, 64 nt, Homo Sapiens
uguuauuguccuuuugaacuguuuuuuuuuuuauuaaagccaaauuuguguuguauauauucgu

SEQ ID NO: 504348 - RNA, 64 nt, Homo Sapiens
uggaaacgaaucggagccaucugccaaacaauaauaaagccaacucuucuccccuaaacaacuu

SEQ ID NO: 504349 - RNA, 64 nt, Homo Sapiens
uauuuugaugcaaaagaaauuacuuuuuuuuucuuaaagccaauuagcagacugcauguguuga

SEQ ID NO: 504350 - RNA, 64 nt, Homo Sapiens
aacagagugaccaagggacaagaagggacuugccuaaagccacccagcaacucagcagcagaac

SEQ ID NO: 504351 - RNA, 64 nt, Homo Sapiens
uggcauaacugagauaaggugaauaagugacaaauaaagccaguuuuuuacaagguacuugauc

SEQ ID NO: 504352 - RNA, 64 nt, Homo Sapiens
cauuauauguauacaucaguauaguguuuuauuauaaagccaauuaucugauuaagcauucuuu

SEQ ID NO: 504353 - RNA, 64 nt, Homo Sapiens
auuaugcaagucaggaaucauuaauuucaaaauuuaaagccaugcuaaaauuaaaaagaaaaua

SEQ ID NO: 504354 - RNA, 64 nt, Homo Sapiens
aucccuucuuuuucuuuuuuucuuugguuuaauuuaaagccacaaccacauacaacacaaagag

SEQ ID NO: 504355 - RNA, 64 nt, Homo Sapiens
ucaguuuuucccacccaguguagcauccuaaagauaaagccagaagcuaagcugcagugaggcu

SEQ ID NO: 504356 - RNA, 64 nt, Homo Sapiens
aagucaaucaagcaggaaucauuuaaaaaccagauaaagccauguuuuucuucugugacaauuu

SEQ ID NO: 504357 - RNA, 64 nt, Homo Sapiens
cuucacacuauagacacagaauauagcuuuuucuuaaagccaaauuugggugauaggacacuuu

SEQ ID NO: 504358 - RNA, 64 nt, Homo Sapiens
cauauauauacuauuaaaaacuugguaauuguacuaaagccaaaaauuacuguaacugauuaca

SEQ ID NO: 504359 - RNA, 64 nt, Homo Sapiens
cuggaaaauaauacugcugaaguucuuuaaaauguaaagccauguguuuauucuauaguuauua

SEQ ID NO: 504360 - RNA, 64 nt, Homo Sapiens
ggcucuccuugaauaagaaagccagcagaacucuuaaagccaguuguaguacggaguugucagc

SEQ ID NO: 504361 - RNA, 64 nt, Homo Sapiens
caguauuuucccucuuccccuuuauaaauuaugcuaaagccacaaagcacauuuuuggggauca

SEQ ID NO: 504362 - RNA, 64 nt, Homo Sapiens
ucuauguuucuguucagauaaaaaacagauuaucuaaagccaucggaacauugguuugugaagg

SEQ ID NO: 504363 - RNA, 64 nt, Homo Sapiens
uaauuaaagcaguugaacuauucuaagaaacggauaaagccacauuucauuuggggagcugguc

SEQ ID NO: 504364 - RNA, 64 nt, Homo Sapiens
auggguggaugugcuuggaggggacgugacugaauaaagccaccuggagggagccgugggcgug

SEQ ID NO: 504365 - RNA, 64 nt, Homo Sapiens
ccucccuguccuuuccagagucccguggagucgcuaaagccagcgaagagcccaagcguccccg

SEQ ID NO: 504366 - RNA, 64 nt, Homo Sapiens
auuacacuuaaaugaaguauucacgguacguccauaaagccagugcuuuaauuucacuuucuga

SEQ ID NO: 504367 - RNA, 64 nt, Homo Sapiens
uuucagcaagagaaagcgcuagccuccaaggcuuuaaagccacacuuucgaggccagugagcuc

SEQ ID NO: 504368 - RNA, 64 nt, Homo Sapiens
agcccagcuuugccagcccuaauaagaagcaugcuaaagccacagcagcuacugugguucuuca

SEQ ID NO: 504369 - RNA, 64 nt, Homo Sapiens
gugugaugaucagcacuaaguccugcauuccuguuaaagccacuugggucauaagaagggagua

SEQ ID NO: 504370 - RNA, 64 nt, Homo Sapiens; identical to SEQ ID NO: 68831

SEQ ID NO: 504371 - RNA, 64 nt, Homo Sapiens; identical to SEQ ID NO: 68832

SEQ ID NO: 504372 - RNA, 64 nt, Homo Sapiens; identical to SEQ ID NO: 68833

SEQ ID NO: 504373 - RNA, 64 nt, Homo Sapiens; identical to SEQ ID NO: 68834

SEQ ID NO: 504374 - RNA, 64 nt, Homo Sapiens; identical to SEQ ID NO: 68835

SEQ ID NO: 504375 - RNA, 64 nt, Homo Sapiens; identical to SEQ ID NO: 68836

SEQ ID NO: 504376 - RNA, 64 nt, Homo Sapiens; identical to SEQ ID NO: 68837

SEQ ID NO: 504377 - RNA, 64 nt, Homo Sapiens; identical to SEQ ID NO: 68838

SEQ ID NO: 504378 - RNA, 64 nt, Homo Sapiens; identical to SEQ ID NO: 68839

SEQ ID NO: 504379 - RNA, 64 nt, Homo Sapiens; identical to SEQ ID NO: 68840

SEQ ID NO: 504380 - RNA, 64 nt, Homo Sapiens; identical to SEQ ID NO: 68841

SEQ ID NO: 504381 - RNA, 64 nt, Homo Sapiens; identical to SEQ ID NO: 68842

SEQ ID NO: 504382 - RNA, 64 nt, Homo Sapiens; identical to SEQ ID NO: 68843

SEQ ID NO: 504383 - RNA, 64 nt, Homo Sapiens; identical to SEQ ID NO: 68844

SEQ ID NO: 504384 - RNA, 64 nt, Homo Sapiens; identical to SEQ ID NO: 68845

SEQ ID NO: 504385 - RNA, 64 nt, Homo Sapiens; identical to SEQ ID NO: 68846

SEQ ID NO: 504386 - RNA, 64 nt, Homo Sapiens; identical to SEQ ID NO: 68847

SEQ ID NO: 504387 - RNA, 64 nt, Homo Sapiens; identical to SEQ ID NO: 68848

SEQ ID NO: 504388 - RNA, 64 nt, Homo Sapiens; identical to SEQ ID NO: 68849

SEQ ID NO: 504389 - RNA, 64 nt, Homo Sapiens; identical to SEQ ID NO: 68850

SEQ ID NO: 504390 - RNA, 64 nt, Homo Sapiens; identical to SEQ ID NO: 68851

SEQ ID NO: 504391 - RNA, 64 nt, Homo Sapiens; identical to SEQ ID NO: 68852

SEQ ID NO: 504392 - RNA, 64 nt, Homo Sapiens; identical to SEQ ID NO: 68853

SEQ ID NO: 504393 - RNA, 64 nt, Homo Sapiens; identical to SEQ ID NO: 68854

SEQ ID NO: 504394 - RNA, 64 nt, Homo Sapiens; identical to SEQ ID NO: 68855

SEQ ID NO: 504395 - RNA, 64 nt, Homo Sapiens; identical to SEQ ID NO: 68856

SEQ ID NO: 504396 - RNA, 64 nt, Homo Sapiens; identical to SEQ ID NO: 68857

SEQ ID NO: 504397 - RNA, 64 nt, Homo Sapiens; identical to SEQ ID NO: 68858

SEQ ID NO: 504398 - RNA, 64 nt, Homo Sapiens; identical to SEQ ID NO: 68859

SEQ ID NO: 504399 - RNA, 64 nt, Homo Sapiens; identical to SEQ ID NO: 68860

SEQ ID NO: 504400 - RNA, 64 nt, Homo Sapiens; identical to SEQ ID NO: 68861

SEQ ID NO: 504401 - RNA, 64 nt, Homo Sapiens; identical to SEQ ID NO: 68862

SEQ ID NO: 504402 - RNA, 64 nt, Homo Sapiens; identical to SEQ ID NO: 68863

SEQ ID NO: 504403 - RNA, 64 nt, Homo Sapiens; identical to SEQ ID NO: 68864

SEQ ID NO: 504404 - RNA, 64 nt, Homo Sapiens; identical to SEQ ID NO: 68865

SEQ ID NO: 504405 - RNA, 64 nt, Homo Sapiens; identical to SEQ ID NO: 68866

SEQ ID NO: 504406 - RNA, 64 nt, Homo Sapiens; identical to SEQ ID NO: 68867

SEQ ID NO: 504407 - RNA, 64 nt, Homo Sapiens; identical to SEQ ID NO: 68868

SEQ ID NO: 504408 - RNA, 64 nt, Homo Sapiens; identical to SEQ ID NO: 68869

SEQ ID NO: 504409 - RNA, 64 nt, Homo Sapiens; identical to SEQ ID NO: 68870

SEQ ID NO: 504410 - RNA, 64 nt, Homo Sapiens; identical to SEQ ID NO: 68871

SEQ ID NO: 504411 - RNA, 64 nt, Homo Sapiens; identical to SEQ ID NO: 68872

SEQ ID NO: 504412 - RNA, 64 nt, Homo Sapiens; identical to SEQ ID NO: 68873

SEQ ID NO: 504413 - RNA, 64 nt, Homo Sapiens; identical to SEQ ID NO: 68874

SEQ ID NO: 504414 - RNA, 64 nt, Homo Sapiens; identical to SEQ ID NO: 68875

SEQ ID NO: 504415 - RNA, 64 nt, Homo Sapiens; identical to SEQ ID NO: 68876

SEQ ID NO: 504416 - RNA, 64 nt, Homo Sapiens; identical to SEQ ID NO: 68877

SEQ ID NO: 504417 - RNA, 64 nt, Homo Sapiens; identical to SEQ ID NO: 68877

SEQ ID NO: 504418 - RNA, 64 nt, Homo Sapiens; identical to SEQ ID NO: 68879

SEQ ID NO: 504419 - RNA, 64 nt, Homo Sapiens; identical to SEQ ID NO: 68880

SEQ ID NO: 504420 - RNA, 64 nt, Homo Sapiens; identical to SEQ ID NO: 68881

SEQ ID NO: 504421 - RNA, 64 nt, Homo Sapiens; identical to SEQ ID NO: 68882

SEQ ID NO: 504422 - RNA, 64 nt, Homo Sapiens; identical to SEQ ID NO: 68883

SEQ ID NO: 504423 - RNA, 64 nt, Homo Sapiens; identical to SEQ ID NO: 68884

SEQ ID NO: 504424 - RNA, 64 nt, Homo Sapiens; identical to SEQ ID NO: 68885

SEQ ID NO: 504425 - RNA, 64 nt, Homo Sapiens; identical to SEQ ID NO: 68886

SEQ ID NO: 504426 - RNA, 64 nt, Homo Sapiens; identical to SEQ ID NO: 68887

SEQ ID NO: 504427 - RNA, 64 nt, Homo Sapiens; identical to SEQ ID NO: 68888

SEQ ID NO: 504428 - RNA, 64 nt, Homo Sapiens; identical to SEQ ID NO: 68889

SEQ ID NO: 504429 - RNA, 64 nt, Homo Sapiens; identical to SEQ ID NO: 68890

SEQ ID NO: 504430 - RNA, 64 nt, Homo Sapiens; identical to SEQ ID NO: 68891

SEQ ID NO: 504431 - RNA, 64 nt, Homo Sapiens; identical to SEQ ID NO: 68892

SEQ ID NO: 504432 - RNA, 64 nt, Homo Sapiens; identical to SEQ ID NO: 68893

SEQ ID NO: 504433 - RNA, 64 nt, Homo Sapiens; identical to SEQ ID NO: 68894

SEQ ID NO: 504434 - RNA, 64 nt, Homo Sapiens; identical to SEQ ID NO: 68895

SEQ ID NO: 504435 - RNA, 64 nt, Homo Sapiens; identical to SEQ ID NO: 68896

SEQ ID NO: 504436 - RNA, 64 nt, Homo Sapiens; identical to SEQ ID NO: 68897

SEQ ID NO: 504437 - RNA, 64 nt, Homo Sapiens; identical to SEQ ID NO: 68898

SEQ ID NO: 504438 - RNA, 64 nt, Homo Sapiens; identical to SEQ ID NO: 68899

SEQ ID NO: 504439 - RNA, 64 nt, Homo Sapiens; identical to SEQ ID NO: 68900

SEQ ID NO: 504440 - RNA, 64 nt, Homo Sapiens; identical to SEQ ID NO: 68901

SEQ ID NO: 504441 - RNA, 64 nt, Homo Sapiens; identical to SEQ ID NO: 68902

SEQ ID NO: 504442 - RNA, 64 nt, Homo Sapiens; identical to SEQ ID NO: 68903

SEQ ID NO: 504443 - RNA, 64 nt, Homo Sapiens; identical to SEQ ID NO: 68904

SEQ ID NO: 504444 - RNA, 64 nt, Homo Sapiens; identical to SEQ ID NO: 68905

SEQ ID NO: 504445 - RNA, 64 nt, Homo Sapiens; identical to SEQ ID NO: 68906

SEQ ID NO: 504446 - RNA, 64 nt, Homo Sapiens; identical to SEQ ID NO: 68907

SEQ ID NO: 504447 - RNA, 64 nt, Homo Sapiens; identical to SEQ ID NO: 68908

SEQ ID NO: 504448 - RNA, 64 nt, Homo Sapiens; identical to SEQ ID NO: 68909

SEQ ID NO: 504449 - RNA, 64 nt, Homo Sapiens; identical to SEQ ID NO: 68910

SEQ ID NO: 504450 - RNA, 64 nt, Homo Sapiens; identical to SEQ ID NO: 68911

SEQ ID NO: 504451 - RNA, 64 nt, Homo Sapiens; identical to SEQ ID NO: 68912

SEQ ID NO: 504452 - RNA, 64 nt, Homo Sapiens; identical to SEQ ID NO: 68913

SEQ ID NO: 504453 - RNA, 64 nt, Homo Sapiens; identical to SEQ ID NO: 68914

SEQ ID NO: 504454 - RNA, 64 nt, Homo Sapiens; identical to SEQ ID NO: 68915

SEQ ID NO: 504455 - RNA, 64 nt, Homo Sapiens; identical to SEQ ID NO: 68916

SEQ ID NO: 504456 - RNA, 64 nt, Homo Sapiens; identical to SEQ ID NO: 68917

SEQ ID NO: 504457 - RNA, 64 nt, Homo Sapiens; identical to SEQ ID NO: 68918

SEQ ID NO: 504458 - RNA, 64 nt, Homo Sapiens; identical to SEQ ID NO: 68919

SEQ ID NO: 504459 - RNA, 64 nt, Homo Sapiens; identical to SEQ ID NO: 68920

SEQ ID NO: 504460 - RNA, 64 nt, Homo Sapiens; identical to SEQ ID NO: 68921

SEQ ID NO: 504461 - RNA, 64 nt, Homo Sapiens; identical to SEQ ID NO: 68922

SEQ ID NO: 504462 - RNA, 64 nt, Homo Sapiens; identical to SEQ ID NO: 68923

SEQ ID NO: 504463 - RNA, 64 nt, Homo Sapiens; identical to SEQ ID NO: 68924

SEQ ID NO: 504464 - RNA, 64 nt, Homo Sapiens; identical to SEQ ID NO: 68925

SEQ ID NO: 504465 - RNA, 64 nt, Homo Sapiens; identical to SEQ ID NO: 68926

SEQ ID NO: 504466 - RNA, 64 nt, Homo Sapiens; identical to SEQ ID NO: 68927

SEQ ID NO: 504467 - RNA, 64 nt, Homo Sapiens; identical to SEQ ID NO: 68928

SEQ ID NO: 504468 - RNA, 64 nt, Homo Sapiens; identical to SEQ ID NO: 68929

SEQ ID NO: 504469 - RNA, 64 nt, Homo Sapiens; identical to SEQ ID NO: 68930

SEQ ID NO: 504470 - RNA, 64 nt, Homo Sapiens; identical to SEQ ID NO: 68931

SEQ ID NO: 504471 - RNA, 64 nt, Homo Sapiens; identical to SEQ ID NO: 68932

SEQ ID NO: 504472 - RNA, 64 nt, Homo Sapiens; identical to SEQ ID NO: 68933

SEQ ID NO: 504473 - RNA, 64 nt, Homo Sapiens; identical to SEQ ID NO: 68934

SEQ ID NO: 504474 - RNA, 64 nt, Homo Sapiens; identical to SEQ ID NO: 68935

SEQ ID NO: 504475 - RNA, 64 nt, Homo Sapiens
cgaguagcugggauuacaggugcaugccaccauggcuggcuaauuuuuguauuuuuaguagaga

SEQ ID NO: 504476 - RNA, 64 nt, Homo Sapiens
caucacugcaguggcccugggaggugaggaagaagcuggcuagaggagggggcucccaccuacc

SEQ ID NO: 504477 - RNA, 64 nt, Homo Sapiens
gacuguugaguaacuccuccuuuacuuuuuuccugcuggcuacagcauggggugcccuauaggc

SEQ ID NO: 504478 - RNA, 64 nt, Homo Sapiens
ugcaaggaccaccuugugggaucaccuuuucccagcuggcuagggcugaggcuggggucucugc

SEQ ID NO: 504479 - RNA, 64 nt, Homo Sapiens
cagccugacuugacuuuugaguccuagggaugcugcuggcuagagaugaggcuuuaccucagac

SEQ ID NO: 504480 - RNA, 64 nt, Homo Sapiens
gggaaccaucucuccugcucuccuugggaugauggcuggcuagucagccuugcauguauuccuu

SEQ ID NO: 504481 - RNA, 64 nt, Homo Sapiens
ccacccaccccuagcccaggucagcuuuccuggagcuggcuaaugaaagccuccucaccucuuc

SEQ ID NO: 504482 - RNA, 64 nt, Homo Sapiens
gcugugagaagucacucacacuggccacaaggacgcuggcuacugucuauuaaaauucugaugu

SEQ ID NO: 504483 - RNA, 64 nt, Homo Sapiens
aggccuggagcugcugaagacugcgauugggaaagcuggcuacacugauaaggugaucgucagc

SEQ ID NO: 504484 - RNA, 64 nt, Homo Sapiens
accagggagcuaaaaacuugggggaucgucgccugcuggcuaagacaggaaaaggcaaacuuga

SEQ ID NO: 504485 - RNA, 64 nt, Homo Sapiens
ccuucccuccauccuguaggcuguguacccccaggcuggcuagcggacccugcggggcugggua

SEQ ID NO: 504486 - RNA, 64 nt, Homo Sapiens
ucuguugguuugaagacugagguuuccaccccgggcuggcuagcugggucucccuccccauccu

SEQ ID NO: 504487 - RNA, 64 nt, Homo Sapiens
agcccuggguggugaggcucgacugacugugagugcuggcuaaacugugccaacugaaguagga

SEQ ID NO: 504488 - RNA, 64 nt, Homo Sapiens
aucugcucuugguuucugcuugucgcaggaauccgcuggcuaacguaugugaaggaagcaggga

SEQ ID NO: 504489 - RNA, 64 nt, Homo Sapiens
uuguacugauuaauagauuuuuagaguugauucugcuggcuagauuucgauguguuguaguugc

SEQ ID NO: 504490 - RNA, 64 nt, Homo Sapiens
gcaagagggaaccaauuccuuguucuugggcagggcuggcuacguccggccuuugggagaggca

SEQ ID NO: 504491 - RNA, 64 nt, Homo Sapiens
aaccccaaagagggggauggcccuuccccuggaggcuggcuagacacugcccucagaggcugcu

SEQ ID NO: 504492 - RNA, 64 nt, Homo Sapiens
gugcagcccagcccacgguggcuguuccaugaaugcuggcuaccuaugugugugguaccuguug

SEQ ID NO: 504493 - RNA, 64 nt, Homo Sapiens
aucucaaaacucauuauguugucagagcccuagagcuggcuaguguaacacugacuaugaguag

SEQ ID NO: 504494 - RNA, 64 nt, Homo Sapiens
agaagagaugggacuauuucuauauuuaaaugcugcuggcuauuccuuuguauauaaaugaaaa

SEQ ID NO: 504495 - RNA, 64 nt, Homo Sapiens
caguuuggcacuggaaccaagagcacaugucguggcuggcuacaagguuguaaagcagaaaauc

SEQ ID NO: 504496 - RNA, 64 nt, Homo Sapiens
caagcaacaacuccgcaggcaguuaccaaguacggcuggcuacaacugcuccauccgugccucu

SEQ ID NO: 504497 - RNA, 64 nt, Homo Sapiens
uacuccucuuauuauuuuuccauuaaaaauaauagcuggcuauuauagaaaauuuagaccauac

SEQ ID NO: 504498 - RNA, 64 nt, Homo Sapiens
cuagauguguuuuuauuccuuuugcuuuaaauuugcuggcuaccugugacuacaaaauauuuua

SEQ ID NO: 504499 - RNA, 64 nt, Homo Sapiens
auuacccuucuugcuauugggcauuauucugagagcuggcuaccuccaagcuagauuuccgaca

SEQ ID NO: 504500 - RNA, 64 nt, Homo Sapiens
guaacacugacuaugaguaggucagagcccuagagcuggcuaguaccucaaaacucauuauguu

SEQ ID NO: 504501 - RNA, 64 nt, Homo Sapiens
ggcagggacuucauauaaagcaucaauuaggauggcuggcuagugccugugaacagauaacuuu

SEQ ID NO: 504502 - RNA, 64 nt, Homo Sapiens
ggggcaggcaugcacccgguacgaaucaccuccugcuggcuacccacgcccccacugcccccgc

SEQ ID NO: 504503 - RNA, 64 nt, Homo Sapiens
ugguuuuguuucucgaucuuuuguuuggagaacagcuggcuaaggaugacucuaaguguacugu

SEQ ID NO: 504504 - RNA, 64 nt, Homo Sapiens
uggccugucucccuagggaauuccugcuaugacagcuggcuagcauuccucaggaaggacaugg

SEQ ID NO: 504505 - RNA, 64 nt, Homo Sapiens
gauaaagaaaaagguuuguuuggcucacaauuuugcuggcuagaagguugggcauccggugaaa

SEQ ID NO: 504506 - RNA, 64 nt, Homo Sapiens
acaaacagcaggauaccucacaggaccuggaguugcuggcuaccuuaccgcagguacaucuaca

SEQ ID NO: 504507 - RNA, 64 nt, Homo Sapiens
uugagaauaguauauguaacauuaaaaaaaaguugcuggcuauaggaaauguuauuuuguuuuc

SEQ ID NO: 504508 - RNA, 64 nt, Homo Sapiens
ugucaccaucaccgacaucauuggccuuccuuaggcuggcuacugcauuccacccaagguggga

SEQ ID NO: 504509 - RNA, 64 nt, Homo Sapiens
ccucuucugucccuguuagagcccagggcaucuugcuggcuacgcccacacucccaagguugga

SEQ ID NO: 504510 - RNA, 64 nt, Homo Sapiens
gauaggaguggggacuggguuggauggacaguuugcuggcuauucauuuguucccgccuucaga

SEQ ID NO: 504511 - RNA, 64 nt, Homo Sapiens
cagggucacccagcaguccuaccaugcugauacagcuggcuauuuuuaugauguacggaaaaaa

SEQ ID NO: 504512 - RNA, 64 nt, Homo Sapiens
aguauuggaauacauugggaucucuuuuaguucagcuggcuaauaguugccuaccagcacccau

SEQ ID NO: 504513 - RNA, 64 nt, Homo Sapiens
aagggaagggccacagccuuaggauaugaagguggcuggcuaggguuuauuuguuuugcaauaa

SEQ ID NO: 504514 - RNA, 64 nt, Homo Sapiens
ggguuagccuggcuggggcccaccccagaagcuagcuggcuagaagggucccugccuggugauu

SEQ ID NO: 504515 - RNA, 64 nt, Homo Sapiens
guuuuguuugaaagaucgguuccgggccccggcggcuggcuaaugucccgucgcuucgggcacc

SEQ ID NO: 504516 - RNA, 64 nt, Homo Sapiens
agacacugaaucacccggagucugaaauuggauggcuggcuaauaaugcauuuuaaacaguguu

SEQ ID NO: 504517 - RNA, 64 nt, Homo Sapiens
gauuuauuuguuguaaaugcauauuuuacccccagcuggcuagacauagucuauacauagaugc

SEQ ID NO: 504518 - RNA, 64 nt, Homo Sapiens
uuuggagucagguuuguguucagaauccagcccugcuggcuacuaacuaacugggagaccuuag

SEQ ID NO: 504519 - RNA, 64 nt, Homo Sapiens
uaucguugcugcugaaaccaccuauaaaagacuugcuggcuaaugugcauugucauauaaugua

SEQ ID NO: 504520 - RNA, 64 nt, Homo Sapiens
ucuuagagcaucuuccacaucaacuccccuggcugcuggcuaccgauuaaauucauuaguguga

SEQ ID NO: 504521 - RNA, 64 nt, Homo Sapiens
agugugugagaaaagaauagccuuuuuuggggaggcuggcuaguuucuuacuuuuuucccuuuu

SEQ ID NO: 504522 - RNA, 64 nt, Homo Sapiens
uugccuacuuuagucacccagcagagccacuggagcuggcuaguccagcccagccauggugcau

SEQ ID NO: 504523 - RNA, 64 nt, Homo Sapiens
uaggcauuugauuuccuguuuuagcuuuaguaaggcuggcuaacuucccccucuucaagcuagg

SEQ ID NO: 504524 - RNA, 64 nt, Homo Sapiens
ucaucaaccacauuucaagugcucaaagccacgugcuggcuaggggccacagcguuagacagug

SEQ ID NO: 504525 - RNA, 64 nt, Homo Sapiens
uaauguaaauaaguguguggccuucuuuaaaauagcuggcuaacauaggaggcacuucuuuuca

SEQ ID NO: 504526 - RNA, 64 nt, Homo Sapiens
aaaggacuccucaauucgucgccgucucucggucgcuggcuaaucgagagaauuuugagcacua

SEQ ID NO: 504527 - RNA, 64 nt, Homo Sapiens
uuuugcuaaacugcccucucgagugaguuauggugcuggcuauaugcucugaauaaguucuagu

SEQ ID NO: 504528 - RNA, 64 nt, Homo Sapiens
gcugggaggguuuugcucuccagaugcagccagcgcuggcuagguggacaaggaagaauagugg

SEQ ID NO: 504529 - RNA, 64 nt, Homo Sapiens
accuggggcuguggccucucuucuguacuggggggcuggcuaggugcugucccugaguccucca

SEQ ID NO: 504530 - RNA, 64 nt, Homo Sapiens
ugaucucagcaguugauauggugguugugccucugcuggcuacugggugugcuguccccauguu

SEQ ID NO: 504531 - RNA, 64 nt, Homo Sapiens
gucuuuugggugaguagcuauagguuugagagaggcuggcuacuccuaguuccugugcuucuuc

SEQ ID NO: 504532 - RNA, 64 nt, Homo Sapiens
cauccuacccggccugggcugacccauggggaaggcuggcuaauuucagugcuucugcuugguu

SEQ ID NO: 504533 - RNA, 64 nt, Homo Sapiens
aggguuggauggugaccuugggcaagucccuggggcuggcuaggccuccacuuguccaucugug

SEQ ID NO: 504534 - RNA, 64 nt, Homo Sapiens
uuccaaaauguaaauccagucgcggugugaccgagcuggcuaacaggcuugucugccugguuuu

SEQ ID NO: 504535 - RNA, 64 nt, Homo Sapiens
cccccacaggugacuuggaugcgauuauuuuaaugcuggcuacaagaugccugcauggguccug

SEQ ID NO: 504536 - RNA, 64 nt, Homo Sapiens
gacuugggugucuggcaaacuggaggaguaccgagcuggcuaugggggagacagagagagugaa

SEQ ID NO: 504537 - RNA, 64 nt, Homo Sapiens
uuccaguuacaagauauuuguuuuauuaauauuugcuggcuaaaaacaaaugugguuuuuauau

SEQ ID NO: 504538 - RNA, 64 nt, Homo Sapiens
auucuugcauucuggguuuguuuccacgugcucugcuggcuacguaccugcaacuuggacguug

SEQ ID NO: 504539 - RNA, 64 nt, Homo Sapiens
gccucgauuuauauuucuguggacaugaccagcagcuggcuacauuugcacaaaagacugccaa

SEQ ID NO: 504540 - RNA, 64 nt, Homo Sapiens
aaauggucuuacucuugaaugcucuuuacaauaugcuggcuacaauucuguuggcuaaaauaau

SEQ ID NO: 504541 - RNA, 64 nt, Homo Sapiens
cagaaccccacuacuuaccaaguuaguguaauaagcuggcuacacuaugacuggagucaggaga

SEQ ID NO: 504542 - RNA, 64 nt, Homo Sapiens
uuaaacaaaauuuuuaucuuuuuucaagaauauagcuggcuaucuuuaagaaagaugauauauc

SEQ ID NO: 504543 - RNA, 64 nt, Homo Sapiens
gaagcuccugaaugcuggacuagacaaacuacaugcuggcuaaacauucuccacugaagauaca

SEQ ID NO: 504544 - RNA, 64 nt, Homo Sapiens
ccagccuauucagcgcuuugacagccagguuccugcuggcuagaugaaagccccuccucuuaug

SEQ ID NO: 504545 - RNA, 64 nt, Homo Sapiens
acauugguugaucuaagucaagagaagaagaggagcuggcuagucaggaacuuauucauuaacc

SEQ ID NO: 504546 - RNA, 64 nt, Homo Sapiens
ucuauucauuuauguuagcaggaaaagauaguuugcuggcuagcauccagcuguuagauaugca

SEQ ID NO: 504547 - RNA, 64 nt, Homo Sapiens
aaauaacugauuaauauaauguuuggaccauuuugcuggcuauaaucuuuuguuuucuuaaugc

SEQ ID NO: 504548 - RNA, 64 nt, Homo Sapiens
gagaacuggaaagaguaaaacuugcucuuugagggcuggcuauuuuccuguuguccuaccaccc

SEQ ID NO: 504549 - RNA, 64 nt, Homo Sapiens
ccuggugccaaagggggccagccagaacugaggugcuggcuagcucaugugugaauucacauaa

SEQ ID NO: 504550 - RNA, 64 nt, Homo Sapiens
caccucaccuccagcucaggggccgcaccccgccgcuggcuaagccuugugacccaucaggcca

SEQ ID NO: 504551 - RNA, 64 nt, Homo Sapiens
cugggagaccccuucugugugggagggagcgggggcuggcuagcgggccccccagccagggauc

SEQ ID NO: 504552 - RNA, 64 nt, Homo Sapiens
gugagacagagagaaugugauauagagaaaucuggcuggcuacaguguagaucaguauuaggaa

SEQ ID NO: 504553 - RNA, 64 nt, Homo Sapiens
acucauacguccugugguggcacuggggcacucugcuggcuacagggggacugucaccuggcac

SEQ ID NO: 504554 - RNA, 64 nt, Homo Sapiens
ccgcuuuaaaguuuuauuugauuccuaagcugaugcuggcuaaacuuagaacauugaagaaaau

SEQ ID NO: 504555 - RNA, 64 nt, Homo Sapiens
uaguuucuacagaacauaauguaacaucuugguggcuggcuagcguacaaggaauccuuuauug

SEQ ID NO: 504556 - RNA, 64 nt, Homo Sapiens
guauuuuguaucaaggacacggaggggguguggugcuggcuagaggucccugccccugucugga

SEQ ID NO: 504557 - RNA, 64 nt, Homo Sapiens
caaauuaugcauggguccuaaucacacauauaaggcuggcuaccagcuuugacacagcacuguu

SEQ ID NO: 504558 - RNA, 64 nt, Homo Sapiens
ccauggguccugggcacccaggccugcccugccugcuggcuacuuccuggcuuaccuucuaccc

SEQ ID NO: 504559 - RNA, 64 nt, Homo Sapiens
gauaaccccuagaaagaagaggacaugaaaggaugcuggcuauauauguuaaugagcaaaagga

SEQ ID NO: 504560 - RNA, 64 nt, Homo Sapiens
ugggccccccauggcagugcugccucuuguaggugcuggcuaagggccaggccaggaugaguuu

SEQ ID NO: 504561 - RNA, 64 nt, Homo Sapiens
ccuuucugugaagcuaauacccuuagacgaagaagcuggcuaguacaaaugaucaccauguuag

SEQ ID NO: 504562 - RNA, 64 nt, Homo Sapiens
uaaaaagcucuuucaucuuuugguagagagaguugcuggcuauucuagcucuuaccaaaacaga

SEQ ID NO: 504563 - RNA, 64 nt, Homo Sapiens
aggucucagccucgggcacuggagagacagaagugcuggcuagggugauagcccaagcugguca

SEQ ID NO: 504564 - RNA, 64 nt, Homo Sapiens
ccaugggauuuagcuuauaagcaaagagagacgggcuggcuaacccuccuaauuaagggccacu

SEQ ID NO: 504565 - RNA, 64 nt, Homo Sapiens
uggacagcaagagucguuuuaguuuggcuucacggcuggcuaugaggggagggcagaggccugc

SEQ ID NO: 504566 - RNA, 64 nt, Homo Sapiens
aaggaaucuucuugaccguucuugggcacuggaggcuggcuaggaguucaguaauaaacguggc

SEQ ID NO: 504567 - RNA, 64 nt, Homo Sapiens
uaaaccagggccugcggcacuugcgggccucccugcuggcuacugaugccaguaccagaggagc

SEQ ID NO: 504568 - RNA, 64 nt, Homo Sapiens
aaugaucauccugcgcaaauucagauuacuguuugcuggcuaauugacaguauuucucagcauc

SEQ ID NO: 504569 - RNA, 64 nt, Homo Sapiens
uccuguuccccgacaccaagacccuggcgcagcggcuggcuauccucacaggcaccguagaggu

SEQ ID NO: 504570 - RNA, 64 nt, Homo Sapiens
cucagcucccagacacaggguaggaggggggacugcuggcuacugcagagacccuuggcuauuu

SEQ ID NO: 504571 - RNA, 64 nt, Homo Sapiens
uccuuuaauagcccacaaucaguguucuguucuagcuggcuacugcuucacuggauugagaauc

SEQ ID NO: 504572 - RNA, 64 nt, Homo Sapiens
cuuguuuucccucaugauaagcauuuuuaagauggcuggcuacuuuugagaagcagugguuggg

SEQ ID NO: 504573 - RNA, 64 nt, Homo Sapiens
uggaagcauguaggagaaucaggaaaauccucuggcuggcuaacuccacaagauucccagagac

SEQ ID NO: 504574 - RNA, 64 nt, Homo Sapiens
gauugaaguccuggacagugacuguaaguuccuagcuggcuagggagaagcuccuggaaccaua

SEQ ID NO: 504575 - RNA, 64 nt, Homo Sapiens
cauuuaucaaagcauaagcuuguucauugaugcugcuggcuaagcucuuuuugggcuuucauag

SEQ ID NO: 504576 - RNA, 64 nt, Homo Sapiens
ucguaggaagagagcacugucuguacuuggauaggcuggcuaacauuaaguacuguauaucgcc

SEQ ID NO: 504577 - RNA, 64 nt, Homo Sapiens
cugcucaggcuucaggcccacugcuccccacacagcuggcuacaagaagcaauggagugaaccu

SEQ ID NO: 504578 - RNA, 64 nt, Homo Sapiens
aaaaagaauaaugccuacagauuauccuucagaugcuggcuagaauccccuuugacuucuagcc

SEQ ID NO: 504579 - RNA, 64 nt, Homo Sapiens
gaugucuuuucccauuuaucaagacuaugaaaaugcuggcuauauguugacauuagucucagug

SEQ ID NO: 504580 - RNA, 64 nt, Homo Sapiens
aagaggaggucaacgugugugaguggaaaugauggcuggcuaugacacccgcagcagaauguug

SEQ ID NO: 504581 - RNA, 64 nt, Homo Sapiens
gcucagggacgaagcuuguggcaaggaaacuccagcuggcuaugccggccugugccagugagug

SEQ ID NO: 504582 - RNA, 64 nt, Homo Sapiens
ggguguuaguuugcaguccucccagagggcccuugcuggcuacuccaggauucaguauuccugg

SEQ ID NO: 504583 - RNA, 64 nt, Homo Sapiens
ucuggaucaucuggcugagcgacaaaaauaaaaugcuggcuaccaugcagucuuaaauucaaug

SEQ ID NO: 504584 - RNA, 64 nt, Homo Sapiens
uuuauuuuucacugaguuacgauugucugagguugcuggcuaaccuuaaggauauacagccgaa

SEQ ID NO: 504585 - RNA, 64 nt, Homo Sapiens
augccagguaaaggguugguugcaagcgggucuugcuggcuaaaagcaccgugaacgacugcaa

SEQ ID NO: 504586 - RNA, 64 nt, Homo Sapiens
auugcauggucggauagagauguggguaauuggugcuggcuaacaucucuuaugggcaaagcau

SEQ ID NO: 504587 - RNA, 64 nt, Homo Sapiens
ugaucaaggugugaauaacugaagaaaauaacuugcuggcuauauaggaaaaugcuguggaaau

SEQ ID NO: 504588 - RNA, 64 nt, Homo Sapiens
cucauucuggccaguucuuuccaguagccauggggcuggcuacaagaagcaaaacugcccaugc

SEQ ID NO: 504589 - RNA, 64 nt, Homo Sapiens
cgaguagcugggauuacaggugcaugccaucacagcuggcuaauuuuuguauuuuuaguagaga

SEQ ID NO: 504590 - RNA, 64 nt, Homo Sapiens
cugacagcucccacacagaacagucugaggugaugcuggcuacagcccuggcagcccauggcaa

SEQ ID NO: 504591 - RNA, 64 nt, Homo Sapiens
uggacgcuggggcagagccaaggcugggcuguccgcuggcuaugacugggaaaagugcuucgga

SEQ ID NO: 504592 - RNA, 64 nt, Homo Sapiens
uuagaauuauuguuucuuguaaguaguuugauuggcuggcuaacuguaguaugaucauuuacug

SEQ ID NO: 504593 - RNA, 64 nt, Homo Sapiens
caaguagcugggacuacaggugugcaccaccacagcuggcuaauucuauuuuuuuauagaggcg

SEQ ID NO: 504594 - RNA, 64 nt, Homo Sapiens
caaguagcugggauuacaggugugugccacuacggcuggcuaauuuuuguauuuuuaguagaga

SEQ ID NO: 504595 - RNA, 64 nt, Homo Sapiens
cugagggggccaccacuuuuccaugcugguuggugcuggcuaggcugccaggcugagucuccac

SEQ ID NO: 504596 - RNA, 64 nt, Homo Sapiens
agcucgauggugggcccagccucugcuguccaaggcuggcuagcugcggugcuccuugcugguu

SEQ ID NO: 504597 - RNA, 64 nt, Homo Sapiens
agcagcagaggugagaacucagaagagaaauacagcuggcuaucuacuaccagaagggcuucaa

SEQ ID NO: 504598 - RNA, 64 nt, Homo Sapiens
guccuauuugcuaguaacaugagcacugugauuggcuggcuauaaccaccccaguuaaaccauu

SEQ ID NO: 504599 - RNA, 64 nt, Homo Sapiens
guggaggaggcccagguaaaggcugggggcuguugcuggcuauccucuuugcuucuggaaguuu

SEQ ID NO: 504600 - RNA, 64 nt, Homo Sapiens
gagggggaggacaaggggcagagaguagggucuagcuggcuaucucuggccuuacuaacacccc

SEQ ID NO: 504601 - RNA, 64 nt, Homo Sapiens
gcaacagcagcugggcaagcuuagcagggagguggcuggcuacacccuccugggcugccaggau

SEQ ID NO: 504602 - RNA, 64 nt, Homo Sapiens
guggaggacugagcaccugagagggggaaugugugcuggcuaggucuccuccugcuccugcgug

SEQ ID NO: 504603 - RNA, 64 nt, Homo Sapiens
gcgagggauacccaaagagaguggacccacaggggcuggcuaaggaagccgauucugaauuccu

SEQ ID NO: 504604 - RNA, 64 nt, Homo Sapiens
ucgccucuccugugcguauggccugcccgccuuggcuggcuagcaacagcuagagggccucccc

SEQ ID NO: 504605 - RNA, 64 nt, Homo Sapiens
uaggaccucucgaaagucucagcagguugguguggcuggcuaacacagcuacuuacgcgaacac

SEQ ID NO: 504606 - RNA, 64 nt, Homo Sapiens
acucuuccccagagcagcagugugccccuuugcugcuggcuaccugguucucaguccccagaca

SEQ ID NO: 504607 - RNA, 64 nt, Homo Sapiens
accgggcccagcccagcccuggcgccugcccucugcuggcuagggcagccuccccaggaccuag

SEQ ID NO: 504608 - RNA, 64 nt, Homo Sapiens
ccggcugacauuuggaccccaucccagaggagaugcuggcuaccagcuggggcgaccccaaggg

SEQ ID NO: 504609 - RNA, 64 nt, Homo Sapiens
gggccagcucaguugccgaaacucuggaguggcggcuggcuagaaauuggucuguagaaaugac

SEQ ID NO: 504610 - RNA, 64 nt, Homo Sapiens
cccccagagccccucuucagggggauggagaggggcuggcuauccccugcagggcccuggcugg

SEQ ID NO: 504611 - RNA, 50 nt, Homo Sapiens
ggauagugagcuugugccccgcuggcuaacauuucuccaaacacaauuag

SEQ ID NO: 504612 - RNA, 64 nt, Homo Sapiens
aagggcaccacaaggaagaaugcacauauggagggcuggcuauauauuugagauugguugaauc

SEQ ID NO: 504613 - RNA, 64 nt, Homo Sapiens
guggguaggccuuggcccaccugcuggaggggacgcuggcuaaaguggguuggcuugcugaugg

SEQ ID NO: 504614 - RNA, 64 nt, Homo Sapiens
ucacagaugauuuuggacaagauuuuccaaccuugcuggcuacuuuaguuugggaccuguuuuu

SEQ ID NO: 504615 - RNA, 64 nt, Homo Sapiens
uuccaagaaaagcauuuuaaauuucuuccauguggcuggcuauaaauauacucguauuuuuuau

SEQ ID NO: 504616 - RNA, 64 nt, Homo Sapiens
gguucaccggugaaggcagguuggugguuguucagcuggcuaaaacuugucucugcagggcgcu

SEQ ID NO: 504617 - RNA, 64 nt, Homo Sapiens
gaugacgucuguguuccuguccaucacugaugcugcuggcuacugcaugugccacaccugucug

SEQ ID NO: 504618 - RNA, 64 nt, Homo Sapiens
auccaugcacacgcugucuugugaccgccugacugcuggcuacucuucauagcugacccuucuu

SEQ ID NO: 504619 - RNA, 64 nt, Homo Sapiens
cacaggcaucaucauagcccagugggguacaguagcuggcuauuuuuaacacuuguccagcuac

SEQ ID NO: 504620 - RNA, 64 nt, Homo Sapiens
caggaacugaaugaauggccgaggggaggagggugcuggcuaaagugagggcagagggacagau

SEQ ID NO: 504621 - RNA, 64 nt, Homo Sapiens
aaagaaccagaggggcaggggaggacuggggagggcuggcuagccagaggaguuggcuguauca

SEQ ID NO: 504622 - RNA, 64 nt, Homo Sapiens
caagaggacgcggccccgggucugagcgcucccugcuggcuaugacaacaacuccccagugcug

SEQ ID NO: 504623 - RNA, 64 nt, Homo Sapiens
ugcuucgcaggaagugggaagaggaggcucauuagcuggcuacagagcuaccacuggcuacuca

SEQ ID NO: 504624 - RNA, 64 nt, Homo Sapiens
caaccagcauggaaaacagauuaaccuguuucuggcuggcuagcacuccagaucagaugugaac

SEQ ID NO: 504625 - RNA, 64 nt, Homo Sapiens
caugaggccacuuguuuuagggaagcuacuuuuagcuggcuacacgguuuuguagccuguugga

SEQ ID NO: 504626 - RNA, 64 nt, Homo Sapiens
gugaugcagacuuguucuucgcaaaucucauuaugcuggcuagauguacaaacauguauuuucu

SEQ ID NO: 504627 - RNA, 64 nt, Homo Sapiens
aguacagcaagacacucuggccaccauaaaaaacgcagaaaagaaaaaaagguuaagcauaaaa

SEQ ID NO: 504628 - RNA, 64 nt, Homo Sapiens
acaaaaugaaaauguaguaguacaaccaguuguagcagaaaauauuccuguaauaccacugagu

SEQ ID NO: 504629 - RNA, 64 nt, Homo Sapiens
uagaaucugaagguaaggagccagcccgcucaaugcagaaaaacauccucaacagggucaccaa

SEQ ID NO: 504630 - RNA, 64 nt, Homo Sapiens
ggcaaugcugugagagccaugcaagaaggaaauggcagaaaacgaccggaugaagaaguacaug

SEQ ID NO: 504631 - RNA, 64 nt, Homo Sapiens
uauugccucaugauguuuuaaaaauuauaauggagcagaaaaucauauacaauaguggucccau

SEQ ID NO: 504632 - RNA, 64 nt, Homo Sapiens
agggagagaaccucaugggcaaaggacucugaaggcagaaaagaaggcaguaauuuccuuuugg

SEQ ID NO: 504633 - RNA, 64 nt, Homo Sapiens
uucagaaagacaucagguuucguggaagcgcacagcagaaaaucuuuaauacaggccaaaguaa

SEQ ID NO: 504634 - RNA, 64 nt, Homo Sapiens
ggaccaauuucauauaguacuuucguuggguauugcagaaaagaaauaauaaagagaaaaggug

SEQ ID NO: 504635 - RNA, 64 nt, Homo Sapiens
uuaucuugaaaacgguacauauuuuaguauuugugcagaaaaacaaguccuaaaguauuuguuu

SEQ ID NO: 504636 - RNA, 64 nt, Homo Sapiens
cugaugguaugugccauuuguaaaauaaaauagagcagaaaaacacaaaaagagaacacugguu

SEQ ID NO: 504637 - RNA, 64 nt, Homo Sapiens
gguugaccuucuccccuucucuagaauucacagggcagaaaaggugacuuccaaccgacaguug

SEQ ID NO: 504638 - RNA, 64 nt, Homo Sapiens
cccucgugcacaggcagcucccagauuggcuccagcagaaaaguucguuuuuauuccuccucuc

SEQ ID NO: 504639 - RNA, 64 nt, Homo Sapiens
uugauuaaaucuuaaugggaugaggguuuggggugcagaaaacucaucauagaggucuguuuug

SEQ ID NO: 504640 - RNA, 64 nt, Homo Sapiens
ccaaaagauugcuguagcucggggaaaauuugcugcagaaaauuccuuuguagggacagcaaaa

SEQ ID NO: 504641 - RNA, 64 nt, Homo Sapiens
uugcauggauggcagcauuguucugaagggguuugcagaaaaaaaagauuuucuuuacauaaag

SEQ ID NO: 504642 - RNA, 64 nt, Homo Sapiens
gguggugauuucucuuugaccaaugcauaguuuggcagaaaaaucagccguucauuuagaagaa

SEQ ID NO: 504643 - RNA, 64 nt, Homo Sapiens
uauugucucugcuaucugacugccaguaauuagugcagaaaacuaagacaggaugauacagguu

SEQ ID NO: 504644 - RNA, 64 nt, Homo Sapiens
augcaugucaaauauuucucccaugcuucucuuagcagaaaaguuuuuaccuauaagacagggc

SEQ ID NO: 504645 - RNA, 64 nt, Homo Sapiens
aaauaaggucuaaaggaaaguauuguauugcuuggcagaaaagauuggcauaauggccagaaaa

SEQ ID NO: 504646 - RNA, 64 nt, Homo Sapiens
acugagcuguuguuacccucuuuuccaugaaucugcagaaaauugggauaucuuuuuuauauuu

SEQ ID NO: 504647 - RNA, 64 nt, Homo Sapiens
cuauugauuucaucucaccccuguuacaaugguagcagaaaauccuuuguaacuacauauagaa

SEQ ID NO: 504648 - RNA, 64 nt, Homo Sapiens
aaaaacuaaauuuaugguauagcaaauauuaauggcagaaaaccuuuuuuagcuugaauuuguu

SEQ ID NO: 504649 - RNA, 64 nt, Homo Sapiens
cacaguccaaaagacaagcauguuuaucaccuuagcagaaaaacagaauuagagacaucugauu

SEQ ID NO: 504650 - RNA, 64 nt, Homo Sapiens
caguaaaaacacaggagaagaaaagucuaagauagcagaaaauaauacuacaaauaauuuucuu

SEQ ID NO: 504651 - RNA, 64 nt, Homo Sapiens
auuuaaauuauuacuacacuuuauuacuacacuugcagaaaagaaacauguuaaaaucauggca

SEQ ID NO: 504652 - RNA, 64 nt, Homo Sapiens
uagaugcagacuggcagcauccuccuugauaaaagcagaaaagcaaagagguaauuggaguuga

SEQ ID NO: 504653 - RNA, 64 nt, Homo Sapiens
ucccuacguucaguuguuaggggaccacugauuggcagaaaacuuauuuaccugaugagcagag

SEQ ID NO: 504654 - RNA, 64 nt, Homo Sapiens
gaacuuagccaaaccuaagucuuuacuugccuuugcagaaaacaacugaacacuuggaagucac

SEQ ID NO: 504655 - RNA, 64 nt, Homo Sapiens
uauauguuuuaaucucccuugucccucagaauaagcagaaaauauaacugcagcuguaugucgu

SEQ ID NO: 504656 - RNA, 64 nt, Homo Sapiens
augacuuaccauuccagcugcaugggaaagcaaagcagaaaacagugccccaaauggaaaaaag

SEQ ID NO: 504657 - RNA, 64 nt, Homo Sapiens
gcccccagaauugucuggcccaaauugaauagaagcagaaaaacauuuagggauaacaucaggc

SEQ ID NO: 504658 - RNA, 64 nt, Homo Sapiens
guugggagcuauccuuguuuaugccucacuauuggcagaaaagaccccauuuaaaacccagaga

SEQ ID NO: 504659 - RNA, 64 nt, Homo Sapiens
cagaaaauucacacaagagaaaggccuuaugaaugcagaaaauaugucaucuuguucauccuca

SEQ ID NO: 504660 - RNA, 64 nt, Homo Sapiens
caccuuuaugugccucagaggggaccaaaggauggcagaaaacuguucucagucuaguuugacc

SEQ ID NO: 504661 - RNA, 64 nt, Homo Sapiens
uuuucccacugguguguagcaaaugcaaacaugagcagaaaauagagagcacaaaaaugggaga

SEQ ID NO: 504662 - RNA, 64 nt, Homo Sapiens
uaacaaaagcuucucagcugucucauaacuaaaagcagaaaagccuccguuugaaguaucaccu

SEQ ID NO: 504663 - RNA, 64 nt, Homo Sapiens
gaggaaaggacucauucaugucacgcuuccuugagcagaaaagagcacugagagcacuugggac

SEQ ID NO: 504664 - RNA, 64 nt, Homo Sapiens
caaccgacagcaaacagcuuucuccggccucagggcagaaaaagggaauggcagggaguaagag

SEQ ID NO: 504665 - RNA, 64 nt, Homo Sapiens
ggaccuguuuuuuuucucauuugauuuugcuugugcagaaaauaguuuccagcacauggauuga

SEQ ID NO: 504666 - RNA, 64 nt, Homo Sapiens
ccaacuuccuuagauuuuuuuuuuuaagcuguuugcagaaaacugggugguagcgugucugaac

SEQ ID NO: 504667 - RNA, 64 nt, Homo Sapiens
aauaauauaaaugcccuuguaauauuucaaauaugcagaaaaauuaaaauucuuuuuaauuaaa

SEQ ID NO: 504668 - RNA, 64 nt, Homo Sapiens
aaauggaauaauggagcauuggcccaaaccccaagcagaaaagaauugguacaucuuggcuucu

SEQ ID NO: 504669 - RNA, 64 nt, Homo Sapiens
gccccaacgcgugcuagagaggcccaauccaggggcagaaaacagggggccuaaagaauguccc

SEQ ID NO: 504670 - RNA, 64 nt, Homo Sapiens
uuuuuuuuuuuuuggccaaaucucgugguguuucgcagaaaaaaauccagaaaauuucaaaugc

SEQ ID NO: 504671 - RNA, 64 nt, Homo Sapiens
auucaagauuugcaggccuuagccugggaugagagcagaaaagcaaagggacucagguaagccc

SEQ ID NO: 504672 - RNA, 64 nt, Homo Sapiens
gacucagguaagcccagccugcagaauguauucggcagaaaaggagcaaaggcuucaagagagg

SEQ ID NO: 504673 - RNA, 64 nt, Homo Sapiens
acaaguguucuauuuauuucuuguauuguuuggaagaaaaaaugaugauagagucccaaaaaga

SEQ ID NO: 504674 - RNA, 64 nt, Homo Sapiens
gaagaaaaaaugaugauagagucccaaaaagaagagaaaaaaaaugcccaaguugcccuuuaaa

SEQ ID NO: 504675 - RNA, 64 nt, Homo Sapiens
cagccugggcgacagagcgagagucugucucaaaagaaaaaaaaaagcaccgccuccaaaugcc

SEQ ID NO: 504676 - RNA, 64 nt, Homo Sapiens
agccugagcaacagagugagacccugucucuuaaagaaaaaaaaagucagacugcugggacugg

SEQ ID NO: 504677 - RNA, 64 nt, Homo Sapiens
caucugucacggacccacgcccagaggaacgugcagaaaaaagcagagcuacauggcugugggc

SEQ ID NO: 504678 - RNA, 64 nt, Homo Sapiens
augggacaaaaaagaacgauccuccacuugaccaagaaaaaagugauucucccagaagcacaaa

SEQ ID NO: 504679 - RNA, 64 nt, Homo Sapiens
uguuagcauaguagauaaauuguuaugaaauaccagaaaaaaaaaucuguaucuuuuacugaga

SEQ ID NO: 504680 - RNA, 64 nt, Homo Sapiens
aaaauuguguaaaauuacauuuuuuuuccaggggagaaaaaaacaucaaacaaaaacaucuaaa

SEQ ID NO: 504681 - RNA, 64 nt, Homo Sapiens
uaagcugccucaaggaauuuuuuuaacuuaagggagaaaaaaagggaucuggggaugggguggg

SEQ ID NO: 504682 - RNA, 64 nt, Homo Sapiens
cuguucagcuacucccacucccggccugucauucagaaaaaaauaaauguucuaauaagcucca

SEQ ID NO: 504683 - RNA, 64 nt, Homo Sapiens
aagacaguucagugcauauauaguagaagccuuaagaaaaaagaaaaugagcaagcaaauauuu

SEQ ID NO: 504684 - RNA, 64 nt, Homo Sapiens
uuugaagaaauguauaaaaccauagauuucuuucagaaaaaaaaaacaggcauaggaacaguuu

SEQ ID NO: 504685 - RNA, 64 nt, Homo Sapiens
uacaaaagccagcaauaauucuucaagauccaaaagaaaaaaauauacuaccucagauuuucaa

SEQ ID NO: 504686 - RNA, 64 nt, Homo Sapiens
ugguagauacaguuuaaaagugcuuacccaggcaagaaaaaacacagcuaggcuaagucaacaa

SEQ ID NO: 504687 - RNA, 64 nt, Homo Sapiens
uguuuuuguccuaauguugcuacucccauggcaaagaaaaaaaaaagaaugaaaaaaagaaaaa

SEQ ID NO: 504688 - RNA, 64 nt, Homo Sapiens
ucccauggcaaagaaaaaaaaaagaaugaaaaaaagaaaaaaauuuggaaaaaaaaaucaggcu

SEQ ID NO: 504689 - RNA, 64 nt, Homo Sapiens
agaaaauucccccuacuucuaauuugcugaaugaagaaaaaaaaaaaucuuuuauuugugauau

SEQ ID NO: 504690 - RNA, 63 nt, Homo Sapiens
cuaguaugguguauuuaaauaauaaaaacuuaaaagaaaaaauauuuaaugguguuuggguuu

SEQ ID NO: 504691 - RNA, 64 nt, Homo Sapiens
agcccaaaaccaagucaagugaaaaaggaggaagagaaaaaauauuuuccugccaggcauggug

SEQ ID NO: 504692 - RNA, 64 nt, Homo Sapiens
agugagacccugucucaaaaaaagaaaaagaaaaagaaaaaauauuuucccuauuagagaagag

SEQ ID NO: 504693 - RNA, 64 nt, Homo Sapiens
gggcuuuauuaucuugucagucacuaccuccuaaagaaaaaaaaaaaggcuagaagaaaaaaca

SEQ ID NO: 504694 - RNA, 64 nt, Homo Sapiens
ucacuaccuccuaaagaaaaaaaaaaaggcuagaagaaaaaacauuacauucauguucuaauua

SEQ ID NO: 504695 - RNA, 64 nt, Homo Sapiens
aaguugaaacaaacuaacaugacaagaaagcuauagaaaaaauaaacauugaacucaguucuuc

SEQ ID NO: 504696 - RNA, 64 nt, Homo Sapiens
gagcuccuaaaaaugagaaauauuuauugaaauaagaaaaaagcccucagacauguugaauauu

SEQ ID NO: 504697 - RNA, 64 nt, Homo Sapiens
uaaaauuguauguuacuuauuuccagaaucucgaagaaaaaagaaaaaagagugguauuauuau

SEQ ID NO: 504698 - RNA, 64 nt, Homo Sapiens
guauguuacuuauuuccagaaucucgaagaaaaaagaaaaaagagugguauuauuaugggcaaa

SEQ ID NO: 504699 - RNA, 64 nt, Homo Sapiens
gaguucuaauaauccauguucaguuuguagggaaagaaaaaauaauuuuuccuucuacccacuu

SEQ ID NO: 504700 - RNA, 64 nt, Homo Sapiens
agaagcugcaaaagggaucuucgaaacugggcagagaaaaaauaaaguggaauauuaaguaaaa

SEQ ID NO: 504701 - RNA, 64 nt, Homo Sapiens
agcuugguuuuauuugucauguuaauguuuaaaaagaaaaaaauaauguucuuuauacagccua

SEQ ID NO: 504702 - RNA, 64 nt, Homo Sapiens
auccaacucugcuuuuggucgauuauuuagcaugagaaaaaaaaaacauugaaagguaaaaucu

SEQ ID NO: 504703 - RNA, 64 nt, Homo Sapiens
gaaaagguuuuuagcucauugcuuuaaaaaaaaaagaaaaaaagugguuuaacaaaaaaaaaaa

SEQ ID NO: 504704 - RNA, 64 nt, Homo Sapiens
aguguccgagaacuaaagccaaguugcgacggagagaaaaaagagacagacuugagaacuugac

SEQ ID NO: 504705 - RNA, 64 nt, Homo Sapiens
uaacacagagagacagacuucugaggggcaacgaagaaaaaaaaugaagagagaccgucggggg

SEQ ID NO: 504706 - RNA, 64 nt, Homo Sapiens
aaaaaaaccaaaaagccaagcaacacuuugucucagaaaaaaaacuccagccuggguggcagag

SEQ ID NO: 504707 - RNA, 64 nt, Homo Sapiens
uuguuuuaauaucuacuuggugaaguuuugugacagaaaaaagggccaaaauuaguuguuuaag

SEQ ID NO: 504708 - RNA, 64 nt, Homo Sapiens
cauaggcugcucugccuguguuaaagacguaaaaagaaaaaaacacgggguaggagaaguuucu

SEQ ID NO: 504709 - RNA, 64 nt, Homo Sapiens
agauugcacaguuggagagaugagaguggguacuagaaaaaacgguagguucaugcccaagccc

SEQ ID NO: 504710 - RNA, 64 nt, Homo Sapiens
ucgacacuguggauugacuuagucugcaacuucaagaaaaaaaauuugaggguuugccuucuaa

SEQ ID NO: 504711 - RNA, 64 nt, Homo Sapiens
uuucccuugaaaaaaacuggcugaccuuucacagagaaaaaauauuaaacuagcucuuuuacua

SEQ ID NO: 504712 - RNA, 64 nt, Homo Sapiens
caaaggaacauuuuaacuguaaaggcuggagacaagaaaaaauaaguagaucguuuuaauaaca

SEQ ID NO: 504713 - RNA, 64 nt, Homo Sapiens
augccgaagaguugaugucaaucuuuuuuuccuaagaaaaaaaguccgcgaguauuaaauauuu

SEQ ID NO: 504714 - RNA, 64 nt, Homo Sapiens
caucugaacagaagugcacaggcuacuuguacagagaaaaaauuaauacucaaaggaaaucuuc

SEQ ID NO: 504715 - RNA, 64 nt, Homo Sapiens
aguuuccugacucagugcuuuugcauaaggaacuagaaaaaaaaaguaaggaaaauuggagaug

SEQ ID NO: 504716 - RNA, 64 nt, Homo Sapiens
gugaagcaacuucaguucuuuuacugcaaagaacagaaaaaagaaagaaagcaaacaagaagac

SEQ ID NO: 504717 - RNA, 64 nt, Homo Sapiens
ccccacccccuuucucuuucucucucucucucaaagaaaaaaaaaaugggagugcaaaaaaaac

SEQ ID NO: 504718 - RNA, 64 nt, Homo Sapiens
guguugcuagagaaaauuagggaaaaggugaaaaagaaaaaaugguaguaauugagcagaaaaa

SEQ ID NO: 504719 - RNA, 64 nt, Homo Sapiens
aaaggugaaaaagaaaaaaugguaguaauugagcagaaaaaaauuaauuuauauauguauugau

SEQ ID NO: 504720 - RNA, 64 nt, Homo Sapiens
ccugcaccguuacgcugugauggcaacuggggauagaaaaaaaauggggaaagacaggaauccu

SEQ ID NO: 504721 - RNA, 64 nt, Homo Sapiens
gcccaggcaacaagagugaaacccugucucaaaaagaaaaaaaaaguugaccuugagaauuuau

SEQ ID NO: 504722 - RNA, 64 nt, Homo Sapiens
gccugggcaacauggcuaaacucugucucuauuaagaaaaaaaauguuaacauuaugauuuaaa

SEQ ID NO: 504723 - RNA, 64 nt, Homo Sapiens
ccagaacugugaaaaauaaauuuguuauuuaaaaagaaaaaaaaaaaaacaaaaaccugaguuu

SEQ ID NO: 504724 - RNA, 64 nt, Homo Sapiens
gugcccagcacacauuaauguuagcuucuuucugagaaaaaaauaccucuuccaggcccugaaa

SEQ ID NO: 504725 - RNA, 64 nt, Homo Sapiens
acauuugcugugaagauugaaaaugaacaaaguuagaaaaaaaaacagcaaaaucagugauuua

SEQ ID NO: 504726 - RNA, 64 nt, Homo Sapiens
agccuauuccaucaacugugaaagcuggggaauuagaaaaaauaauaagucgcugucaggugug

SEQ ID NO: 504727 - RNA, 64 nt, Homo Sapiens
cccaggcacuguacuaaccuacagagaugcuaagagaaaaaaaagacuuguuucugaucuaaua

SEQ ID NO: 504728 - RNA, 64 nt, Homo Sapiens
acaugaauucuuuuucuggagcuuagcaaugagaagaaaaaaaaugcccaacuuuucuaaguga

SEQ ID NO: 504729 - RNA, 64 nt, Homo Sapiens
cuagagacccuuuuugcaaauuaaugugccaaaaagaaaaaaagucagaaguauuuuaaagggc

SEQ ID NO: 504730 - RNA, 64 nt, Homo Sapiens
aaaaaaggagcugugccccaguuuuuuaaaaaaaagaaaaaaaaccacugcaagcucugaauca

SEQ ID NO: 504731 - RNA, 64 nt, Homo Sapiens
aaaagguacuuagaggucgcaucuugucucuuaaagaaaaaaaacaccugggcaacauaguaag

SEQ ID NO: 504732 - RNA, 57 nt, Homo Sapiens
cacaugugggacucaaaugcaaaguacagaaaaaagcuccugaaaaacaucaaguag

SEQ ID NO: 504733 - RNA, 64 nt, Homo Sapiens
aggaaaaaaaaaaaaaaaccaguaaaagaaagaaagaaaaaaaaagcaucuuaccuucauaugc

SEQ ID NO: 504734 - RNA, 64 nt, Homo Sapiens
ccuugaauugacaaauuaacucaauuggaaaggaagaaaaaaggucucuaaaggguuaaaugua

SEQ ID NO: 504735 - RNA, 64 nt, Homo Sapiens
ggcagucccugaugcucagaccucugcugcacucagaaaaaauagcagguuaaaugagaccugu

SEQ ID NO: 504736 - RNA, 64 nt, Homo Sapiens
ucuuuucacaugacaaaugaucgaauauuuauauagaaaaaaagagcagugguauugagguuuu

SEQ ID NO: 504737 - RNA, 64 nt, Homo Sapiens
uacagagagcacccaggagggacuuguauagaggagaaaaaaugacagcagaagccauggcaca

SEQ ID NO: 504738 - RNA, 64 nt, Homo Sapiens
auacaaaggaagaaaagaaagagaguaacaauaaagaaaaaaaacagaaagcaguagugagagu

SEQ ID NO: 504739 - RNA, 64 nt, Homo Sapiens
aaaaguuucagaagagcagaaaaagaaaaaagauagaaaaaagaagaucgacuggagaagaaaa

SEQ ID NO: 504740 - RNA, 64 nt, Homo Sapiens
uagaaaaaagaaaaaguuucggagaagaaaaaaaagaaaaaagauacaggaaauuagaucgacu

SEQ ID NO: 504741 - RNA, 64 nt, Homo Sapiens
gaaaaaagauagaaaaaagaagaucgacuggagaagaaaaaaaauuucccaauuacaggaaauu

SEQ ID NO: 504742 - RNA, 64 nt, Homo Sapiens
uuaagaggacucaccaaaagagauugguaaugccagaaaaaauuauugauaaaaagugacucuc

SEQ ID NO: 504743 - RNA, 64 nt, Homo Sapiens
ugccuuucuuuuuuuaugacuguauaagccacauagaaaaaaguuuagcuguaacauccgauuc

SEQ ID NO: 504744 - RNA, 64 nt, Homo Sapiens
uaugugcuugaaaguaaaauaagaaugaaaacagagaaaaaaugaggaaacaaagaaugccgaa

SEQ ID NO: 504745 - RNA, 64 nt, Homo Sapiens
agaggauaauuaagauacuaucuuugacuuagucagaaaaaaacgcaguugaaaaaugcuaauc

SEQ ID NO: 504746 - RNA, 64 nt, Homo Sapiens
uuuaucuagcacuugugacacauuugucauauuaagaaaaaaagaauaaaaaggacuacuuaaa

SEQ ID NO: 504747 - RNA, 64 nt, Homo Sapiens
aacagcaggaaucggugggaggaacaaugccuuaagaaaaaacacuggguuuucugaagucuga

SEQ ID NO: 504748 - RNA, 64 nt, Homo Sapiens
gacaauuuauuuuugccaucauuuuuuuaauuaaagaaaaaauuuccagaagaggaaaaaaaaa

SEQ ID NO: 504749 - RNA, 64 nt, Homo Sapiens
cacagaaguuuaagacuaugaguuuuuagggugaagaaaaaacuguacaguuuaaaugaaaaug

SEQ ID NO: 504750 - RNA, 64 nt, Homo Sapiens
uacuggguuugcuuuucuuaaaacauaccaaaaaagaaaaaaauagaaaaaaaaaaaaaaaaag

SEQ ID NO: 504751 - RNA, 64 nt, Homo Sapiens
gcuuuucuuaaaacauaccaaaaaagaaaaaaauagaaaaaaaaaaaaaaaaagcuugaucucu

SEQ ID NO: 504752 - RNA, 64 nt, Homo Sapiens
guacuugccacaaaaucaauaaaagauguuuuugagaaaaaaaggaagaaaccaacucauucag

SEQ ID NO: 504753 - RNA, 64 nt, Homo Sapiens
caagacacucuggccaccauaaaaaacgcagaaaagaaaaaaagguuaagcauaaaaagaaagg

SEQ ID NO: 504754 - RNA, 64 nt, Homo Sapiens
aagagacugguagcucaucauccuaccauaaaagagaaaaaaauucggaaagugaucagagcac

SEQ ID NO: 504755 - RNA, 64 nt, Homo Sapiens
agcagggccaaauggaaagaacacauaauaaacaagaaaaaaacagaggugaagaaaaauccaa

SEQ ID NO: 504756 - RNA, 64 nt, Homo Sapiens
auugaugacaagcaaguuacucaggaaucaaaagagaaaaaaguuucugaaaacaaugaaacca

SEQ ID NO: 504757 - RNA, 64 nt, Homo Sapiens
gauuuaaauguguucuauuauuagaguagaucgaagaaaaaauuagucucagaaagagcuuuua

SEQ ID NO: 504758 - RNA, 64 nt, Homo Sapiens
aucauucuuuacaguuuugcauugcugaggagagagaaaaaacaauuuuuuugcaagagauguu

SEQ ID NO: 504759 - RNA, 64 nt, Homo Sapiens
aaaguuuaauugaaagaauguaaagcaaccaaaaagaaaaaaaaaaagaaagaaagaggaaaag

SEQ ID NO: 504760 - RNA, 64 nt, Homo Sapiens
ugcaaacuauuuaaagaaauauguauucuguaaaagaaaaaaaaaaugcggccuuuucaugagg

SEQ ID NO: 504761 - RNA, 64 nt, Homo Sapiens
acaauucaagaaacugaguauuuaugggcauugaagaaaaaauguugagauaaaauugcugugc

SEQ ID NO: 504762 - RNA, 64 nt, Homo Sapiens
uugaagaaaaaauguugagauaaaauugcugugcagaaaaaaguguuaaugaagccgaccugac

SEQ ID NO: 504763 - RNA, 64 nt, Homo Sapiens
cacacaauauaugaaauaguacccucuaaaaaagagaaaaaaaaaaucaggcggucaaacuuag

SEQ ID NO: 504764 - RNA, 64 nt, Homo Sapiens
aacauugucuuauuaaagcauaguuuauuucacuagaaaaaauuuaauaucaaggacuauuaca

SEQ ID NO: 504765 - RNA, 64 nt, Homo Sapiens
acauggagaagcccugucucuacaaaauacagagagaaaaaaucagccagucaugguggccuac

SEQ ID NO: 504766 - RNA, 64 nt, Homo Sapiens
guuuggguaaaggaugagcagacaagucaacuaaagaaaaaagaaaagcaaggaggaggguuga

SEQ ID NO: 504767 - RNA, 64 nt, Homo Sapiens
uucuuuuguauuuuguuauaaucuuaagcaacaaagaaaaaacccuaauauuugaaucuauuua

SEQ ID NO: 504768 - RNA, 64 nt, Homo Sapiens
uucugagguacauuuugaaugacagcauauuguaagaaaaaaaaaggugaauaaaauuugacau

SEQ ID NO: 504769 - RNA, 64 nt, Homo Sapiens
uuugauuuauauacucuguuuuacagauuuagcuagaaaaaaaaugucaguguuuuggugcacc

SEQ ID NO: 504770 - RNA, 64 nt, Homo Sapiens
aaaagguuaaacuggauuuuuuuuuuuaaaaaaaagaaaaaaaaagaagaaaaguauaccagau

SEQ ID NO: 504771 - RNA, 64 nt, Homo Sapiens
gguauaguggugaauacucgcugauaugaaucccagaaaaaaauuuccuguuuuuaauguucuu

SEQ ID NO: 504772 - RNA, 64 nt, Homo Sapiens
uuauugcuguuuugucuuucuuuuuucuaaaaaaagaaaaaaaagaaaaaaaggaaaagaagaa

SEQ ID NO: 504773 - RNA, 64 nt, Homo Sapiens
uuuugucuuucuuuuuucuaaaaaaagaaaaaaaagaaaaaaaggaaaagaagaacaaagaaac

SEQ ID NO: 504774 - RNA, 64 nt, Homo Sapiens
uaauuuuagaucugaucagguaguagcuaaaauuagaaaaaaacaaaauagaugcuuaaagaau

SEQ ID NO: 504775 - RNA, 64 nt, Homo Sapiens
gguaaaaucaguuuuuugauaguguguguauauaagaaaaaauagauacacacauucuuuuuuc

SEQ ID NO: 504776 - RNA, 64 nt, Homo Sapiens
agguuuggcaggccaucuuuuuuuuccuggaagaagaaaaaaaaauaccauucucuguggccug

SEQ ID NO: 504777 - RNA, 64 nt, Homo Sapiens
gcugguuucuauuaauuauagcauguuuuaauggagaaaaaauacauagugcuuuaaacgugau

SEQ ID NO: 504778 - RNA, 64 nt, Homo Sapiens
guauuuuacuguuuucuguaaaaaaaaaagaaaaagaaaaaaguucuuguuuguaaaaaaaaaa

SEQ ID NO: 504779 - RNA, 64 nt, Homo Sapiens
uuacaugucgauuagguacuuacauauuuaaggcagaaaaaaaguuaagggcucuguccuguua

SEQ ID NO: 504780 - RNA, 64 nt, Homo Sapiens
auguuguuuaaaaaauguuuucauacauuugaaaagaaaaaaaaccuggcuaucuuaaacaagu

SEQ ID NO: 504781 - RNA, 64 nt, Homo Sapiens
aagagagacaaacucuaggaagagaaugaaugacagaaaaaaaagacgugacguccugccagaa

SEQ ID NO: 504782 - RNA, 64 nt, Homo Sapiens
guacauuuauucauagauaguuggugcuauuugaagaaaaaaaugaauaucauugauuuuauaa

SEQ ID NO: 504783 - RNA, 64 nt, Homo Sapiens
agguuuaaguuuguuguggcuuuccuggacuuaaagaaaaaaagugaaccaaaugguucuuacu

SEQ ID NO: 504784 - RNA, 64 nt, Homo Sapiens
guuuugaugaauacaauguacuaaugagaaacucagaaaaaaaucaaaacacagcuuaucuaau

SEQ ID NO: 504785 - RNA, 64 nt, Homo Sapiens
aaauucaugcauagcuucuggggaacuguaaaagagaaaaaaaguuuuuuuuuuuaaguaagaa

SEQ ID NO: 504786 - RNA, 64 nt, Homo Sapiens
caacuuaauauauuuuggauaaaaauauugugaaagaaaaaaaaaaaaagaggaaaaaaaggca

SEQ ID NO: 504787 - RNA, 64 nt, Homo Sapiens
ggaaaaaaaggcaaaaaauauuuacaaagcaaaaagaaaaaagacauuugguucaugugcauug

SEQ ID NO: 504788 - RNA, 64 nt, Homo Sapiens
uaaagucaccucuacugaacucaguuguaguugcagaaaaaaauaagucuuaaacaucuaagac

SEQ ID NO: 504789 - RNA, 64 nt, Homo Sapiens
uuuauuauccuuacuuuuuucugucucaaaaaaaagaaaaaagucuggagagcagagcaagacu

SEQ ID NO: 504790 - RNA, 64 nt, Homo Sapiens
cauaaaggaguaguuaagcuagucuacaucuucuagaaaaaauauuucugaaaugauggauaag

SEQ ID NO: 504791 - RNA, 64 nt, Homo Sapiens
aacgcccaacucuugaagucagauaugugcugaaagaaaaaaaacuuuugugccccuuaaaugu

SEQ ID NO: 504792 - RNA, 64 nt, Homo Sapiens
auuggaacaaaugcucucuuaucaaauuuaaccaagaaaaaaagcuuccguagauaauguggaa

SEQ ID NO: 504793 - RNA, 64 nt, Homo Sapiens
gaaauauauccagcuaacaaaaaaagaaaaaaaaagaaaaaacagugacaaaaaaaaaaaaaaa

SEQ ID NO: 504794 - RNA, 64 nt, Homo Sapiens
agaaaaaacagaaauauaucaaaaaaaaaaaaaaagaaaaaaaaacaguguucugugacaaaaa

SEQ ID NO: 504795 - RNA, 64 nt, Homo Sapiens
ccacaaugaaagaauguauuaaucaaccaaacaaagaaaaaauuaggaacccaccaaaccaacc

SEQ ID NO: 504796 - RNA, 64 nt, Homo Sapiens
uacacauucagaaucuggccgugcauuuugaaaaagaaaaaaagugaacuuugguucuucauga

SEQ ID NO: 504797 - RNA, 64 nt, Homo Sapiens
ucacuuuuccuuuauaguguuacguuaaagaaaaagaaaaaaccagaagcucaaagaaaagaag

SEQ ID NO: 504798 - RNA, 64 nt, Homo Sapiens
ugacuugaguguggcaaaaaguuaacaaaaaaggagaaaaaaugaacaaucguuugugguuucu

SEQ ID NO: 504799 - RNA, 64 nt, Homo Sapiens
gccacaguaaaaaaaaaaaaaaaaaaaaaaaaaaagaaaaaaaaaucaaaauguauaaauauug

SEQ ID NO: 504800 - RNA, 64 nt, Homo Sapiens
ccuagacaacauagugagacuuggucucuaaaaaagaaaaaaaaaaauaaaacugauguaauga

SEQ ID NO: 504801 - RNA, 64 nt, Homo Sapiens
guaugauaccacuuuuaaaaaaagauaaauuuauagaaaaaaguuuauaugacugacaacaaug

SEQ ID NO: 504802 - RNA, 64 nt, Homo Sapiens
guuauguuuuuggcaugaacaaaagaaacaagagagaaaaaaaucaaaauaauuaaaauaaauu

SEQ ID NO: 504803 - RNA, 64 nt, Homo Sapiens
cucuuugaauguaugucaaacucaguuacuccagagaaaaaacugccuuucccuucaaagugcu

SEQ ID NO: 504804 - RNA, 54 nt, Homo Sapiens
caucuucugaggucaauuaaaaggagaaaaaauacaauuucucacuuugcauuu

SEQ ID NO: 504805 - RNA, 64 nt, Homo Sapiens
aaaaauacaauuucucacuuugcauuuagucaaaagaaaaaaugcuuuauagcaaaaugaaaga

SEQ ID NO: 504806 - RNA, 64 nt, Homo Sapiens
aagguaauucagggucccaaagacaaacuuacuaagaaaaaaucauuaauaguuuucucccaau

SEQ ID NO: 504807 - RNA, 64 nt, Homo Sapiens
uaaagaaucgauaaauucaccuguauuuguuguuagaaaaaaacugggugucuguacauuuugu

SEQ ID NO: 504808 - RNA, 64 nt, Homo Sapiens
uagcuuugauuuucucacugacguucuauguaaaagaaaaaaaaauagcuuuuccuucugaacc

SEQ ID NO: 504809 - RNA, 64 nt, Homo Sapiens
cuguuaauuuguuuuuucuugcaacuuuugugccagaaaaaagauaauuacuaauauuuaugua

SEQ ID NO: 504810 - RNA, 64 nt, Homo Sapiens
gguagauaugaaaagaaaaaaccaagucuuacauagaaaaaaaacugaaauguauaagagaaga

SEQ ID NO: 504811 - RNA, 64 nt, Homo Sapiens
agcugccaguucuuggaauguucagaaaugacucagaaaaaagaacugaaacauaaucaaugga

SEQ ID NO: 504812 - RNA, 64 nt, Homo Sapiens
aaguuuuaagaggggucagguaucaaaccaaaaaagaaaaaaaaaagccagugccuauugagua

SEQ ID NO: 504813 - RNA, 64 nt, Homo Sapiens
uucugucuuuuugaaugccaauauuuacggaaguagaaaaaauggugauuuuucaauuucuuuu

SEQ ID NO: 504814 - RNA, 64 nt, Homo Sapiens
aauggcuguaucggccuguaaugcauguuuuuuaagaaaaaaaaaaaaaaaaaaaaaucugccu

SEQ ID NO: 504815 - RNA, 64 nt, Homo Sapiens
gaacguugcaaauuuguuaaaaaaaaacagaaaaagaaaaaaaauuaggcagucuuaaaaaaaa

SEQ ID NO: 504816 - RNA, 64 nt, Homo Sapiens
uuuuaaaaagaaagcuaaugaaaaaugcuuauagagaaaaaaaacucuuuuggguaugccuuuu

SEQ ID NO: 504817 - RNA, 64 nt, Homo Sapiens
aaauuauuuuuuuuuauuuugcuaaaugaaagaaagaaaaaagcuggccaaacuuauuuaugcu

SEQ ID NO: 504818 - RNA, 64 nt, Homo Sapiens
cccuuguucucaguggugcaaaaagaaaagaaaaagaaaaaaaucuucccccugcaaaaagaaa

SEQ ID NO: 504819 - RNA, 64 nt, Homo Sapiens
aaaagaaaaagaaaaaaaucuucccccugcaaaaagaaaaaaagagacgauauacucccugccc

SEQ ID NO: 504820 - RNA, 64 nt, Homo Sapiens
aguuugcacuaauugagguacccaaaaaauagaaagaaaaaaaaagaccccauccuccaccccc

SEQ ID NO: 504821 - RNA, 64 nt, Homo Sapiens
accaucagcaaagugggccuauauugcuugucucagaaaaaaacuccugcuugcauaacugauc

SEQ ID NO: 504822 - RNA, 64 nt, Homo Sapiens
gaaucaguaugaagacacugucaaugagguuaugagaaaaaaacagcaggggcauuaguuucag

SEQ ID NO: 504823 - RNA, 64 nt, Homo Sapiens
gggaagcauuacuuuguagauguauuuucaauaaagaaaaaaauaguuuuacauuaacaucuuu

SEQ ID NO: 504824 - RNA, 64 nt, Homo Sapiens
aaauuuuaagugccacagguuuuaaggauucugcagaaaaaaaagaaaaaaguccuucaguuua

SEQ ID NO: 504825 - RNA, 64 nt, Homo Sapiens
gugccacagguuuuaaggauucugcagaaaaaaaagaaaaaaguccuucaguuuagaaccuaca

SEQ ID NO: 504826 - RNA, 64 nt, Homo Sapiens
aacccacagauuaaaccaaccacagaucaaaaauagaaaaaaaaaaaaaaagaaaaaaagaaug

SEQ ID NO: 504827 - RNA, 64 nt, Homo Sapiens
caaccacagaucaaaaauagaaaaaaaaaaaaaaagaaaaaaagaauguaaaauuuuaaaaaua

SEQ ID NO: 504828 - RNA, 64 nt, Homo Sapiens
ugaauuguucuuaaggcaucauaucuagaagcaaagaaaaaagaaaaauaacaauuuaaguugu

SEQ ID NO: 504829 - RNA, 64 nt, Homo Sapiens
uaaaccaacccaguuacuuauauuaauaauauucagaaaaaaaaaaaaagaaaaggaaaaagaa

SEQ ID NO: 504830 - RNA, 64 nt, Homo Sapiens
ucuagggaaaagggaagacugguuaaugaugaguagaaaaaacuuguaagcuaaucauucacug

SEQ ID NO: 504831 - RNA, 64 nt, Homo Sapiens
ugaaauguaauauucaucagaacaaggaucacugagaaaaaauauucagaaacaacuuuaauaa

SEQ ID NO: 504832 - RNA, 64 nt, Homo Sapiens
auaaauagguaagcacaaagagcucuucaaaaucagaaaaaacaauaggaguccuuccuugucu

SEQ ID NO: 504833 - RNA, 64 nt, Homo Sapiens
aguuuauaguuuuauauuuggaccuugaaagguaagaaaaaaccagguucuccaaaguuaggaa

SEQ ID NO: 504834 - RNA, 64 nt, Homo Sapiens
cuagcagggaaguuuccuugagccuaaaauaaaaagaaaaaauuaaaaagaaucaguuuuuuua

SEQ ID NO: 504835 - RNA, 64 nt, Homo Sapiens
agggggaagaugguucaaagauacaagaaaaaguagaaaaaaaaauaacacuuaacuaaaaccc

SEQ ID NO: 504836 - RNA, 64 nt, Homo Sapiens
guguuucaaaggguaaauuauaaauguuucaugaagaaaaaauuuuaaaaaucuacgucuuuau

SEQ ID NO: 504837 - RNA, 64 nt, Homo Sapiens
ugaaugaaauggauuuuacauuacagacaaggaaagaaaaaacuaauaauguagauagaacaaa

SEQ ID NO: 504838 - RNA, 64 nt, Homo Sapiens
aaagacguauguuugaccaauaaucuuucaaauaagaaaaaaauccucuguaaagaucagaugg

SEQ ID NO: 504839 - RNA, 64 nt, Homo Sapiens
ccagaacucuuuggugacucguugaugaaaaaccagaaaaaaguaaaaaaacuuagguauaacu

SEQ ID NO: 504840 - RNA, 64 nt, Homo Sapiens
uaaaggagaaaaucaauuauuuauagaauguauaagaaaaaauaguuaaauaauggguaguaaa

SEQ ID NO: 504841 - RNA, 64 nt, Homo Sapiens
ucaacccauccauagaaauacuuaauuuagaggaagaaaaaaaaaauauauuagucuagggcca

SEQ ID NO: 504842 - RNA, 64 nt, Homo Sapiens
aaaaggaaaguuuaggcuuuuccuauuggagcccagaaaaaagggacacguuguaaaugcugcu

SEQ ID NO: 504843 - RNA, 64 nt, Homo Sapiens
cccacaauuagaaaaauuuacucaagcaauaacaagaaaaaaggcauugucuagguaugaaauc

SEQ ID NO: 504844 - RNA, 64 nt, Homo Sapiens
ggaaaaaagaaaagcaaggaaaagaaaaaagaaaagaaaaaaagacuuaauguauguuguaaga

SEQ ID NO: 504845 - RNA, 64 nt, Homo Sapiens
aaagaaaaaaagggaaaaaauauguuguaagaaaagaaaaaagaaucugauucacgacuuaaug

SEQ ID NO: 504846 - RNA, 64 nt, Homo Sapiens
uccgucugccuaaaucacuuaaagccucugauugagaaaaaaccgugcaucagcagaguuacug

SEQ ID NO: 504847 - RNA, 64 nt, Homo Sapiens
aaaaaauacaccacacuguaagauguugugaaaaagaaaaaaacgugcuucucuuguguccugu

SEQ ID NO: 504848 - RNA, 64 nt, Homo Sapiens
aaguuaaaaacugaauguacucuucuguuugugaagaaaaaaacaagucuacuauuguaagagu

SEQ ID NO: 504849 - RNA, 64 nt, Homo Sapiens
acacauucagccaaccacuuucagaaggagugguagaaaaaaacuauggauguucuugaacauu

SEQ ID NO: 504850 - RNA, 64 nt, Homo Sapiens
uucuguuuguuuuuagcaguugguuuccuuuaaaagaaaaaaacuuuuuuucaggacugcucua

SEQ ID NO: 504851 - RNA, 64 nt, Homo Sapiens
aagcauacauaugugauuauuauauuuuuguccaagaaaaaaaaaucaguuuuuuauaaaaaua

SEQ ID NO: 504852 - RNA, 64 nt, Homo Sapiens
gcacuagagagggagggggaagagcagaaguuagagaaaaaaagccaccggaggaaaggaaaaa

SEQ ID NO: 504853 - RNA, 64 nt, Homo Sapiens
uccuuccuccaaagaauuaauaggcaacagugggagaaaaaaaaggcauaauggcaaauccuuc

SEQ ID NO: 504854 - RNA, 64 nt, Homo Sapiens
aggcagggagaagggccgggggggguaggagaggagaaaaaaaaagugaaaaaaagaaacgaaa

SEQ ID NO: 504855 - RNA, 64 nt, Homo Sapiens
ucaguggagggcgagugguuucggaaaaaaaaaaagaaaaaaagaaaaaaaaagaaaaaaaaaa

SEQ ID NO: 504856 - RNA, 64 nt, Homo Sapiens
gggcgagugguuucggaaaaaaaaaaagaaaaaaagaaaaaaaaagaaaaaaaaaagauuuuuu

SEQ ID NO: 504857 - RNA, 64 nt, Homo Sapiens
uuucggaaaaaaaaaaagaaaaaaagaaaaaaaaagaaaaaaaaaagauuuuuuucuucucuua

SEQ ID NO: 504858 - RNA, 64 nt, Homo Sapiens
caaggccacaaaaacaauguuugggggaaaaaaaagaaaaaaucaugccagcuaaucaugucaa

SEQ ID NO: 504859 - RNA, 64 nt, Homo Sapiens
agacaguuguggaguaucccauucugaugaguacagaaaaaaaaagaaaaagaaaagaagagaa

SEQ ID NO: 504860 - RNA, 64 nt, Homo Sapiens
augaguacagaaaaaaaaagaaaaagaaaagaagagaaaaaauuaagaaaaaaaucaaaaaagg

SEQ ID NO: 504861 - RNA, 64 nt, Homo Sapiens
aaaaaaaagaaaaagaaaagaagagaaaaaauuaagaaaaaaaucaaaaaaggaagaaaacuaa

SEQ ID NO: 504862 - RNA, 64 nt, Homo Sapiens
gugucagauucaucaaacaaaaaauaaaucucgaagaaaaaaaaugcacuuacaugugcuuauu

SEQ ID NO: 504863 - RNA, 63 nt, Homo Sapiens
agcaacaacagcagaguugauuaagaaaaaugaagaaaaaacgcaaaaagagaacacauguag

SEQ ID NO: 504864 - RNA, 64 nt, Homo Sapiens
ucugccacucuugcugugaaauugaagugcauguagaaaaaaccuuuuacuauaugaaacuuua

SEQ ID NO: 504865 - RNA, 64 nt, Homo Sapiens
uugggaaggaggguaauaaugaacaaaaaguuugagaaaaaaaugcuuuaauggguuuuacagg

SEQ ID NO: 504866 - RNA, 64 nt, Homo Sapiens
ugcagaauuuggcauaucgaugcaugcaauggaaagaaaaaaaauuuguuaaaauuuguaaaug

SEQ ID NO: 504867 - RNA, 64 nt, Homo Sapiens
uugaaagcaucaagauuccacucaauuguggagaagaaaaaaggugcuguagaaagugcaccag

SEQ ID NO: 504868 - RNA, 64 nt, Homo Sapiens
guaaacaggcuuuagucauuaaugugagagacuuagaaaaaaugcuuagaguggacuauuaaau

SEQ ID NO: 504869 - RNA, 64 nt, Homo Sapiens
gucacugcugccauguguguacuguauuauuuucagaaaaaaauauaauagucugaguccaagu

SEQ ID NO: 504870 - RNA, 64 nt, Homo Sapiens
aaaacuugucuauaauuaugucaucuauguaccuagaaaaaaguaaauaaauuucuucaguuga

SEQ ID NO: 504871 - RNA, 64 nt, Homo Sapiens
uauugcauuuuugggggaagcaaauugacuuuaaagaaaaaaguuguggcaaaagaugcuaaga

SEQ ID NO: 504872 - RNA, 64 nt, Homo Sapiens
uuuuuucauuagggccauaucuccaaaaaaagaaagaaaaaauacaaaaaacaaaaacaaaaaa

SEQ ID NO: 504873 - RNA, 64 nt, Homo Sapiens
uauuucaagauaauguaguuuaaaaaaaaaaaaaagaaaaaaacuugauguaaauuccuccuuu

SEQ ID NO: 504874 - RNA, 64 nt, Homo Sapiens
aaguacugucugucuuaaauaaaaaaaaaaaaaaagaaaaaagaagccagaccuugucucaaaa

SEQ ID NO: 504875 - RNA, 64 nt, Homo Sapiens
cuccguuucagaauuguucauuguauuagccuuuagaaaaaacagaaauucuauuuugguaugu

SEQ ID NO: 504876 - RNA, 64 nt, Homo Sapiens
gugaaaaacaguaaaguugguaggcaaacaaaauagaaaaaaguuacauaggggaacugugggc

SEQ ID NO: 504877 - RNA, 64 nt, Homo Sapiens
aagaaaagaugauuuaccucauaugcaaagaccaagaaaaaauagaccaucgaggaagccgaaa

SEQ ID NO: 504878 - RNA, 64 nt, Homo Sapiens
gaauagagacauauuaaaauaauguuuacaucuuagaaaaaacauagauagugcuaguaauauu

SEQ ID NO: 504879 - RNA, 64 nt, Homo Sapiens
aaagucuuuacaaugcuuguuucaaagaaccaacagaaaaaaaagcuaagaaaacugagaacua

SEQ ID NO: 504880 - RNA, 64 nt, Homo Sapiens
uauggaaauguugucuuuuauacuuaguuauauaagaaaaaagggaguuaugcaauuaauaucu

SEQ ID NO: 504881 - RNA, 64 nt, Homo Sapiens
uagcauugcaugugaauaagaaaauaauguuuaaagaaaaaaaaaaaaaagcaaaccuccaaaa

SEQ ID NO: 504882 - RNA, 64 nt, Homo Sapiens
uuuucucucacuauaguauaagaaucuauuuuggagaaaaaaagaaaauaugagggucucgaag

SEQ ID NO: 504883 - RNA, 64 nt, Homo Sapiens
acaaaagcaaaaaaaaaaagcaaaaaaagaaaagagaaaaaaagaaaaaaugcaaauggaauaa

SEQ ID NO: 504884 - RNA, 64 nt, Homo Sapiens
aaaaaaaaaaagcaaaaaaagaaaagagaaaaaaagaaaaaaugcaaauggaauaauuuucuau

SEQ ID NO: 504885 - RNA, 64 nt, Homo Sapiens
cagccugggugauagagcaagacugucucaaaaaagaaaaaaaagaaaaaauuuuaauuuaauc

SEQ ID NO: 504886 - RNA, 64 nt, Homo Sapiens
ugauagagcaagacugucucaaaaaagaaaaaaaagaaaaaauuuuaauuuaauccuucuguag

SEQ ID NO: 504887 - RNA, 64 nt, Homo Sapiens
aaauuguaaaaccugucaaugauacagucccuaaagaaaaaaaaucauugcuuugaagcaguug

SEQ ID NO: 504888 - RNA, 64 nt, Homo Sapiens
augauguguugugauagcuaacauuuuaaauaaaagaaaaaauaucuugaagauuuuugucaca

SEQ ID NO: 504889 - RNA, 64 nt, Homo Sapiens
ggcaacagagcaagagucugucucaaaaaaaaaaagaaaaaaagaaaaaaagaaaaaagaaaaa

SEQ ID NO: 504890 - RNA, 64 nt, Homo Sapiens
agcaagagucugucucaaaaaaaaaaagaaaaaaagaaaaaaagaaaaaagaaaaaucucauua

SEQ ID NO: 504891 - RNA, 64 nt, Homo Sapiens
ucugucucaaaaaaaaaaagaaaaaaagaaaaaaagaaaaaagaaaaaucucauuauuucaaaa

SEQ ID NO: 504892 - RNA, 64 nt, Homo Sapiens
aaguagcuugucaucaauccccuugucgaaaacuagaaaaaaaggaguugacccauauaaauua

SEQ ID NO: 504893 - RNA, 64 nt, Homo Sapiens
cccaaaauuauuaauuuuauuaggcuuuuggaaaagaaaaaaaacuuuuugauguuuuagguga

SEQ ID NO: 504894 - RNA, 64 nt, Homo Sapiens
aaaaaaaaaaacagaaucucugagacuccaucucagaaaaaaaacuccagccugggcgacagag

SEQ ID NO: 504895 - RNA, 64 nt, Homo Sapiens
augaaguugcaaauggcaguuacagccgcaagaaagaaaaaaugcacauuuaauuccuauuaag

SEQ ID NO: 504896 - RNA, 64 nt, Homo Sapiens
uauaaauacaaaucuguauaguagaugcagaaaaagaaaaaaacugcauaaaagggucaaaccu

SEQ ID NO: 504897 - RNA, 64 nt, Homo Sapiens
agaauuaccaagagaaggggucccagcuuuaaaaagaaaaaaaauuuccuuccucuguaagaua

SEQ ID NO: 504898 - RNA, 64 nt, Homo Sapiens
auugggaggcuuuucaaaggguguuuugguaguaagaaaaaaaagauaugcuccaugaugcugu

SEQ ID NO: 504899 - RNA, 64 nt, Homo Sapiens
uaugaaucagauggaacaauaucuuuugaauuuuagaaaaaacaaaacuacuuacugauuuaag

SEQ ID NO: 504900 - RNA, 64 nt, Homo Sapiens
gguuuuaaaaauuguauccuacauuuucagugguagaaaaaaaaugaucaaaucauauuucugu

SEQ ID NO: 504901 - RNA, 64 nt, Homo Sapiens
auauuccuccccacugcaugguagcuuuaguuuaagaaaaaaaaucacagagagacagugcagu

SEQ ID NO: 504902 - RNA, 64 nt, Homo Sapiens
aggagauguuucuccugaagcuaucuugaacaagagaaaaaacucagcuuaaugugauauauga

SEQ ID NO: 504903 - RNA, 64 nt, Homo Sapiens
cuaguauauuuuaagagaugacacagcaaaaaggagaaaaaauuuaaaagaugaaguuuuauac

SEQ ID NO: 504904 - RNA, 64 nt, Homo Sapiens
aauguuaguaucucaauuacaucucuaaaacacuagaaaaaagauaacucaaauacugugaacu

SEQ ID NO: 504905 - RNA, 64 nt, Homo Sapiens
gaggauuuuucugcauuguauuaaacuggcauauagaaaaaaaguuacccgugucaauuaacau

SEQ ID NO: 504906 - RNA, 64 nt, Homo Sapiens
ggagaauaaaauuccuaucuaucuguacagaucaagaaaaaaagggauggaauaucagaaguau

SEQ ID NO: 504907 - RNA, 64 nt, Homo Sapiens
gugucucaaaggagcuuucugcaguuggccaagcagaaaaaaaaugacguuucuucuuucuaga

SEQ ID NO: 504908 - RNA, 64 nt, Homo Sapiens
ggaagacuaaacagaaaccauaaguaaagaaaaaagaaaaaaaaucuaaaaggaaaaauaauuu

SEQ ID NO: 504909 - RNA, 64 nt, Homo Sapiens
aaaaaaaggaagacuaaacaauaauuuuaaguaaagaaaaaagaugaacuuucuaaaaggaaaa

SEQ ID NO: 504910 - RNA, 64 nt, Homo Sapiens
auucacagauuuaauaccuauugaaauguuuuaaagaaaaaaguggcuuuagauuuaaaguaaa

SEQ ID NO: 504911 - RNA, 64 nt, Homo Sapiens
aucaaagggcagucucaauagccuuuuuaaggagagaaaaaaaauguugaauguuucuaaaaau

SEQ ID NO: 504912 - RNA, 64 nt, Homo Sapiens
uugcauguucuguaguuuugauacuuaacaucucagaaaaaauuuuuuguucuccacugaagua

SEQ ID NO: 504913 - RNA, 64 nt, Homo Sapiens
aauuguuuuggaggaggggccaaauccgacuaccagaaaaaaaaggggagagagaaauucauaa

SEQ ID NO: 504914 - RNA, 64 nt, Homo Sapiens
gaauaauauugugaaaaugaaucuguuaugauaaagaaaaaauaaaguggaaacuuuuagagua

SEQ ID NO: 504915 - RNA, 64 nt, Homo Sapiens
acuaguagggccaaaaaaaaaaagaaaaagaaaaagaaaaaagaaaaaaaaagaaaaaacuggg

SEQ ID NO: 504916 - RNA, 64 nt, Homo Sapiens
gggccaaaaaaaaaaagaaaaagaaaaagaaaaaagaaaaaaaaagaaaaaacugggaccuaag

SEQ ID NO: 504917 - RNA, 64 nt, Homo Sapiens
aaaaaagaaaaagaaaaagaaaaaagaaaaaaaaagaaaaaacugggaccuaaguauaaauauc

SEQ ID NO: 504918 - RNA, 64 nt, Homo Sapiens
gacaaagaucacuacagaccaaaacagaagaagaagaaaaaaaagaaaaagaaaucuaagcaac

SEQ ID NO: 504919 - RNA, 64 nt, Homo Sapiens
cgaaaagaccaagaucaaauaauagcugggguggagaaaaaaauagcucaagacacaguuaauc

SEQ ID NO: 504920 - RNA, 64 nt, Homo Sapiens
aguuugauccugaguaugcuugguguuugccuucagaaaaaaaaaaauacauuguaaauaaccu

SEQ ID NO: 504921 - RNA, 64 nt, Homo Sapiens
aaaaaaaagaauaugcacaggaaacuccauuucaagaaaaaaaaccagccugugcaacaagagu

SEQ ID NO: 504922 - RNA, 64 nt, Homo Sapiens
gucaaccugauuugagaaauacucauacaauuugagaaaaaacagaccacaaaauuucaaaggg

SEQ ID NO: 504923 - RNA, 64 nt, Homo Sapiens
caaaccagauguaauauauuaaaguugaguacuuagaaaaaagauuuuugaaagacuuuuguau

SEQ ID NO: 504924 - RNA, 64 nt, Homo Sapiens
cagguuuuaaacaggaaaacuuaugugaacugagagaaaaaaauaaaagaaaaugcacucuaac

SEQ ID NO: 504925 - RNA, 64 nt, Homo Sapiens
aagaaagaaagagggaaaaaaaaaauagaaaaaaagaaaaaaaaccaucucuguaggaucguaa

SEQ ID NO: 504926 - RNA, 64 nt, Homo Sapiens
aaaaaaaaaagaaagaaagagaucguaaaaaaauagaaaaaaagcagcuggaccaucucuguag

SEQ ID NO: 504927 - RNA, 64 nt, Homo Sapiens
ugaacaaaacaggguaccagaauuuaguuuaugcagaaaaaaauuaugaagccuuucagauacc

SEQ ID NO: 504928 - RNA, 64 nt, Homo Sapiens
ggcaaacaauuaaugcuuaauuguaaaauauuuaagaaaaaauuugaaaaccaccuuccuaugu

SEQ ID NO: 504929 - RNA, 64 nt, Homo Sapiens
aagccccuucacucuacaggaaaaaaaacuaaaaagaaaaaaaguuuuuuuaagacucugucuu

SEQ ID NO: 504930 - RNA, 56 nt, Homo Sapiens
caccgagacguuucugugacaucagcagaaaaaaaaaaaaagcaggaaagauguaa

SEQ ID NO: 504931 - RNA, 64 nt, Homo Sapiens
cauugcauaucugaucaauaauuaucaucacagcagaaaaaaguuacuuaagaaaaaagauuug

SEQ ID NO: 504932 - RNA, 64 nt, Homo Sapiens
uuugauuaucaucacagcagcaagucaguacuuaagaaaaaagaaguuaucaaagauaaauugg

SEQ ID NO: 504933 - RNA, 64 nt, Homo Sapiens
acuucagugaagguaagauaucucauguccagccagaaaaaagaauugaucacuuaauccuguu

SEQ ID NO: 504934 - RNA, 64 nt, Homo Sapiens
aaugguaguaaagaaacugacguuaucuccggcuagaaaaaaauggccuuacuuugugauuaua

SEQ ID NO: 504935 - RNA, 64 nt, Homo Sapiens
uauuuaauuuggaucuggaugaauaguuugaaauagaaaaaaagauuaucaccuuagcaacuua

SEQ ID NO: 504936 - RNA, 64 nt, Homo Sapiens
augaauuuagaaauauucaagugaggauggauuuagaaaaaaacugaaagaaguauuaaaaaga

SEQ ID NO: 504937 - RNA, 64 nt, Homo Sapiens
ugaggaaauuauuucaucccuccuacacugauaaagaaaaaaaaggcuauggaaagacagcuuu

SEQ ID NO: 504938 - RNA, 64 nt, Homo Sapiens
guauauuagcuauuuugauuuucucaaaagugccagaaaaaaauuuuuauguucaaugccuaau

SEQ ID NO: 504939 - RNA, 64 nt, Homo Sapiens
uaagaguguguuuacaacuguaucuugcagauaaagaaaaaaauguguaaucuuuuaaaaauau

SEQ ID NO: 504940 - RNA, 64 nt, Homo Sapiens
uuguacaguguauauuccuugacaucagaaugaaagaaaaaaaaaaacugauaauaucuguaau

SEQ ID NO: 504941 - RNA, 64 nt, Homo Sapiens
ucaucccuuccuauaaccucuagguaaaaagaaaagaaaaaaagaaauuucgagauauuuucaa

SEQ ID NO: 504942 - RNA, 64 nt, Homo Sapiens
aacauuguuagaguuugggcuaaaaugagcaaggagaaaaaaaccaccaagaacauuuccuggg

SEQ ID NO: 504943 - RNA, 64 nt, Homo Sapiens
acuuucaaguaaauauagcauuccuuuggcaaaaagaaaaaaaaaguaaaagaaaagaaaaaaa

SEQ ID NO: 504944 - RNA, 64 nt, Homo Sapiens
uccuuuggcaaaaagaaaaaaaaaguaaaagaaaagaaaaaaaauguauuaccacccgaugagc

SEQ ID NO: 504945 - RNA, 64 nt, Homo Sapiens
aaaaaaacaguuugaacacaaaaaaaggaaaaaaagaaaaaagguaaaaaaagaaaaaaugaaa

SEQ ID NO: 504946 - RNA, 64 nt, Homo Sapiens
aaaaaaaaaggaaaaaaagagaaaucuuaaaaaaagaaaaaauguccaguguguaacccaguuu

SEQ ID NO: 504947 - RNA, 64 nt, Homo Sapiens
auggucuuguuuuuacuaccacauuuuuaaaaaaagaaaaaaacauuuauguuagcauuaaugc

SEQ ID NO: 504948 - RNA, 64 nt, Homo Sapiens
aacaaaaaggaacuucuuauaaaagggaaaaaaaagaaaaaagaugacuguugccugcaaaaau

SEQ ID NO: 504949 - RNA, 64 nt, Homo Sapiens
uuuauauauacauuguguguaauugucuaccugaagaaaaaaaaaagagguacuuuccuggaau

SEQ ID NO: 504950 - RNA, 64 nt, Homo Sapiens
auucugaacaaagcuauaggaaugaaaaaagcaaagaaaaaaaucuuuuuggucaguaaaacuu

SEQ ID NO: 504951 - RNA, 64 nt, Homo Sapiens
uuuucucucauguuaguacauucacucuauguagagaaaaaauaaacaaguccccaagaaaaaa

SEQ ID NO: 504952 - RNA, 64 nt, Homo Sapiens
cacucuauguagagaaaaaaaaaacaaguccccaagaaaaaauuuuuuuagccuucccuggaga

SEQ ID NO: 504953 - RNA, 64 nt, Homo Sapiens
uuuuguaugucaauaacuuuauuaaaaggaaaaaagaaaaaaaauucuaaguuaaaucauuuuc

SEQ ID NO: 504954 - RNA, 64 nt, Homo Sapiens
gauuguuuuagaaguuaaagcccacugcugaaaaagaaaaaaauauuuacagaauauuauauaa

SEQ ID NO: 504955 - RNA, 64 nt, Homo Sapiens
uaaucucaaggguuuuuuguuaaggucuucuuuuagaaaaaaauuuuuuaaaaguuauuuuugg

SEQ ID NO: 504956 - RNA, 64 nt, Homo Sapiens
uuuacagucuuaaggaaaauuuauaauuguuuucagaaaaaaagccuacuuauaaacuacuuuu

SEQ ID NO: 504957 - RNA, 64 nt, Homo Sapiens
cuggguuuacuauugcacauuacuguauagaaaaagaaaaaagguacaggcugcauucuugccu

SEQ ID NO: 504958 - RNA, 64 nt, Homo Sapiens
cuguuguaaaaacaguuuaauuaauuaaaaaaaaagaaaaaacuuucuguacaucuuacugggu

SEQ ID NO: 504959 - RNA, 64 nt, Homo Sapiens
caaacccaaagguaggaaggacguggucaugaauagaaaaaaaaauuaugggauuggaagaaac

SEQ ID NO: 504960 - RNA, 64 nt, Homo Sapiens
uuuuagaaacggacagcuuaggcccaagugcaaaagaaaaaacacugaauuggaaaggaaaaga

SEQ ID NO: 504961 - RNA, 64 nt, Homo Sapiens
caguuguuugaugcauuaaaagaaaauaaaaaaaagaaaaaagagaaaagaaaaaaaaagaaaa

SEQ ID NO: 504962 - RNA, 64 nt, Homo Sapiens
auuaaaagaaaauaaaaaaaagaaaaaagagaaaagaaaaaaaaagaaaaaaguuguaggcgaa

SEQ ID NO: 504963 - RNA, 64 nt, Homo Sapiens
aauaaaaaaaagaaaaaagagaaaagaaaaaaaaagaaaaaaguuguaggcgaaucauuuguuc

SEQ ID NO: 504964 - RNA, 64 nt, Homo Sapiens
aagacugaaauuuauuauuagacaaauucauuauagaaaaaaccuguggcaaaaacguuucuuu

SEQ ID NO: 504965 - RNA, 64 nt, Homo Sapiens
ugguuucuaacagacuacuuccaaaaacaguuugagaaaaaaacugucugauuuuaagucucua

SEQ ID NO: 504966 - RNA, 64 nt, Homo Sapiens
guguucagcaaaaugugauguuuuuuucuuuuaaagaaaaaaagugaaaauauauagugccaaa

SEQ ID NO: 504967 - RNA, 64 nt, Homo Sapiens
caaaucuacuguacugucagcuucacuccaccugagaaaaaagaaaaaaaaauugauagcucaa

SEQ ID NO: 504968 - RNA, 64 nt, Homo Sapiens
acuguacugucagcuucacuccaccugagaaaaaagaaaaaaaaauugauagcucaaaugcaug

SEQ ID NO: 504969 - RNA, 64 nt, Homo Sapiens
gaaauaauaccaggcuuuuauaaacuuuucuagaagaaaaaagauggaacuuuuccaauucagu

SEQ ID NO: 504970 - RNA, 64 nt, Homo Sapiens
uggaagacagagugagaccccaucucaggaaaaaagaaaaaaaaaaagaugucauucagcaggu

SEQ ID NO: 504971 - RNA, 64 nt, Homo Sapiens
auagggcuuuuugacagcuuuuugagaccucuuaagaaaaaauaaaaaguaaaaaaugaaagga

SEQ ID NO: 504972 - RNA, 64 nt, Homo Sapiens
ccaaugacuacucaguuuuaggacuuucuguggaagaaaaaagggagaagaaaucaauuccacu

SEQ ID NO: 504973 - RNA, 64 nt, Homo Sapiens
aucuacgauucaacuaaucgaaggauuaaacuaaagaaaaaacuaagaagaacaaugaaccuuu

SEQ ID NO: 504974 - RNA, 64 nt, Homo Sapiens
uccacauuaaugaaggauccauguuuguagugagagaaaaaaaccccaagguaacccgauauga

SEQ ID NO: 504975 - RNA, 64 nt, Homo Sapiens
gccuguuuccucuuagcuuucuagacuucuuaacagaaaaaacaguuuggguucaauagcauuu

SEQ ID NO: 504976 - RNA, 64 nt, Homo Sapiens
auuguucaacaauaagggcaagauuccguucccaagaaaaaaaaccagccugggcgacagagca

SEQ ID NO: 504977 - RNA, 64 nt, Homo Sapiens
ucaacuguguauuuugucacugugaaagagagagagaaaaaaccaggggcugguagacaagaac

SEQ ID NO: 504978 - RNA, 64 nt, Homo Sapiens
acaauagcagcaaggcccugucugaauuuuaauuagaaaaaaauuacucaacuguguuuaauac

SEQ ID NO: 504979 - RNA, 64 nt, Homo Sapiens
guucaaaugagagagcuuuccagcaggauauaaaagaaaaaaauuccccccaggcaucuucacu

SEQ ID NO: 504980 - RNA, 64 nt, Homo Sapiens
uucagcuuucauguuucugauucuuuuuauacaaagaaaaaaaaacuuuagucuguuauuuugu

SEQ ID NO: 504981 - RNA, 58 nt, Homo Sapiens
caaaaaacagaaaccaaucgagaggaagagaaaaaaaacaucuccagcaguggccuga

SEQ ID NO: 504982 - RNA, 64 nt, Homo Sapiens
auuguuuaaaaaaaaaaggaaagaaaaaaaaaaaagaaaaaaagccgagguguuuuuuacauuu

SEQ ID NO: 504983 - RNA, 64 nt, Homo Sapiens
aaaagaaaaaaagauuguuuguuuuuuacauuuaagaaaaaaaaugucucugcuguaccgaggu

SEQ ID NO: 504984 - RNA, 64 nt, Homo Sapiens
uaaacauauuuacauauuuuaagauuuuuugcuaagaaaaaaauuuuucauuguuauuuuuaga

SEQ ID NO: 504985 - RNA, 64 nt, Homo Sapiens
cauaaaucuuuauugcagauaaaaaaaaaagaaaagaaaaaaggacuguuuguauaaaaaauag

SEQ ID NO: 504986 - RNA, 64 nt, Homo Sapiens
aagaaaagaaaaaaggcauauuuguauaaaaaauagaaaaaaaagugcaauacuguuuguacug

SEQ ID NO: 504987 - RNA, 64 nt, Homo Sapiens
uuaguuaauaugaacacagcacagauuuguuagaagaaaaaaaauuugcuguaauaccaaaacu

SEQ ID NO: 504988 - RNA, 64 nt, Homo Sapiens
gcuguaauaccaaaacuaaccucaucaaagauacagaaaaaaagaaauauagugagcccuaaag

SEQ ID NO: 504989 - RNA, 64 nt, Homo Sapiens
gaucaucgccguugaaaugaaaagagagacagagagaaaaaaaaaaagagaacccacaugaagc

SEQ ID NO: 504990 - RNA, 64 nt, Homo Sapiens
gacucauuuguguggaugcgugaccaugggaaaaagaaaaaaaaaaagauccauuuuuuagguu

SEQ ID NO: 504991 - RNA, 64 nt, Homo Sapiens
uuauuacaacuuuguacugguuguaacuugcauuagaaaaaaaagagauauauacaccacaaag

SEQ ID NO: 504992 - RNA, 64 nt, Homo Sapiens
uuguuuaaaaaaaugcaaaucauucuuuaccuuaagaaaaaaaaaauacccuuugcuuugugcc

SEQ ID NO: 504993 - RNA, 64 nt, Homo Sapiens
gcaugaauauaaaucuauauuauuugcuaaaaaaagaaaaaacauuuguguuuuaguuucuuuu

SEQ ID NO: 504994 - RNA, 64 nt, Homo Sapiens
ugauacuuuugaaacagaugugaaaaacagaaaaagaaaaaauugucugaaauguuuauuuugc

SEQ ID NO: 504995 - RNA, 64 nt, Homo Sapiens
cuauuaauuugcucagugcacuuuuuucaaauacagaaaaaagauucuccauuauaguuacaaa

SEQ ID NO: 504996 - RNA, 64 nt, Homo Sapiens
uguuacagcaauccuaggaagcuaauacucugacagaaaaaaaucuuggauaauaugcaugaga

SEQ ID NO: 504997 - RNA, 64 nt, Homo Sapiens
agauuuaacuguuugauuauaacugugcaaauacagaaaaaaagaaggcuggcugaaaguugag

SEQ ID NO: 504998 - RNA, 64 nt, Homo Sapiens
uuaugaauagaagguagugaagaaaagcaagcuaagaaaaaauucuguuuauaaaagaaggaaa

SEQ ID NO: 504999 - RNA, 64 nt, Homo Sapiens
gauuacccaaaaacugucuuuaaaagagagagagagaaaaaaaaaauaguauuugcauaacccu

SEQ ID NO: 505000 - RNA, 64 nt, Homo Sapiens
aguuuauuuuuaaagauagauccuuuuauaggugagaaaaaaacaaucuggaagaaaaaaacca

SEQ ID NO: 505001 - RNA, 64 nt, Homo Sapiens
gauccuuuuauaggugagaaaaaaacaaucuggaagaaaaaaaccacacaaagacauugauuca

SEQ ID NO: 505002 - RNA, 64 nt, Homo Sapiens
ucucggccuaagcacuucuuucuaaauguaucggagaaaaaaucaaauggacuacaagcacgug

SEQ ID NO: 505003 - RNA, 64 nt, Homo Sapiens
augguauuaaacuaucauagaaguagacagaaaaagaaaaaaggacucauggcauuauuaauau

SEQ ID NO: 505004 - RNA, 64 nt, Homo Sapiens
uauagaaaauauuugagaauuucuuauacuaucaagaaaaaauucugugaauuaagauguaauu

SEQ ID NO: 505005 - RNA, 64 nt, Homo Sapiens
caaccugagugacagagcaacacucugucuuaaaagaaaaaaaaaaaagagagagauaguaauc

SEQ ID NO: 505006 - RNA, 64 nt, Homo Sapiens
auggcggaaucuuaaagugauacaugcuaacuguagaaaaaaauagaaaaugcacauaagcaaa

SEQ ID NO: 505007 - RNA, 64 nt, Homo Sapiens
aaauuguauaaaauuagguacuucgauuaguaaaagaaaaaaauuugaauguuuuuuuuuuuua

SEQ ID NO: 505008 - RNA, 64 nt, Homo Sapiens
gguuaagucuuuuaaauuuuguggcucauuuaaaagaaaaaaaacauuauaaaagagcacuucu

SEQ ID NO: 505009 - RNA, 64 nt, Homo Sapiens
uuuuauucaaacauuagauucauuuuuauaucgaagaaaaaauagauuuuuaucuaaaaaaauu

SEQ ID NO: 505010 - RNA, 64 nt, Homo Sapiens
gagaggaagacuauaaaaaugcauacacugagagagaaaaaaguugaaaagauuaggaaucuac

SEQ ID NO: 505011 - RNA, 64 nt, Homo Sapiens
gauauuuagaaaguuaauuugaggauuuuuuuggagaaaaaaauauauccagguuagcugguaa

SEQ ID NO: 505012 - RNA, 64 nt, Homo Sapiens
cacacacacacacaacaaaacucuuucagaaaacagaaaaaaaaugaauugauaauaaacuguc

SEQ ID NO: 505013 - RNA, 64 nt, Homo Sapiens
aauuuuaugaacugcauguaaaauuauucaguuaagaaaaaaauguauauauacauaacagggu

SEQ ID NO: 505014 - RNA, 64 nt, Homo Sapiens
acuuuugugauuuaauaauaugcuagaaaguuaaagaaaaaaaacagccuuugugccacuucag

SEQ ID NO: 505015 - RNA, 64 nt, Homo Sapiens
guggcuggucuacuaggcagagcacaauauuuuaagaaaaaaaaaguuguacagauaguuuaua

SEQ ID NO: 505016 - RNA, 64 nt, Homo Sapiens
cugaacugagaaaggagcucaaaccuuuuauuacagaaaaaaauuuagaauugugucauuuauc

SEQ ID NO: 505017 - RNA, 64 nt, Homo Sapiens
guguuccugcauuuaccauaggucuggugugaacagaaaaaacaauuucucagugccuucucag

SEQ ID NO: 505018 - RNA, 64 nt, Homo Sapiens
aaagacagguaaauguuauauauagcaugguaaaagaaaaaaaauucuguaucucguaauugug

SEQ ID NO: 505019 - RNA, 54 nt, Homo Sapiens
auagugaaacacauuguuaaggggagaaaaaaagccacuucugcuucuguguuu

SEQ ID NO: 505020 - RNA, 64 nt, Homo Sapiens
agccuaugaacuuauaauaaaacaaacuguagguagaaaaaaugagaguacucauuguuacauu

SEQ ID NO: 505021 - RNA, 64 nt, Homo Sapiens
auuaaagugagagacaugguuacuguguaauaaaagaaaaaauacuuguucagguaauucuaau

SEQ ID NO: 505022 - RNA, 64 nt, Homo Sapiens
aaauuuaaaugggaagggaagaaaacaccaaauaagaaaaaaauuugccuuuaagaguuacuuu

SEQ ID NO: 505023 - RNA, 64 nt, Homo Sapiens
gacagugcaagacucugucuccaaaaaaaaaaaaagaaaaaagaaaaucccccuucauccccca

SEQ ID NO: 505024 - RNA, 64 nt, Homo Sapiens
guacuagauguacuuuuucuaaaaaggaaaggacagaaaaaaaugaagaaaggaaaggaagaca

SEQ ID NO: 505025 - RNA, 64 nt, Homo Sapiens
gaaaaagagaaaaauuuuaaaauccugcuauaggagaaaaaaagagaaaaaaauaaaaaucaaa

SEQ ID NO: 505026 - RNA, 64 nt, Homo Sapiens
aaaauuuuaaaauccugcuauaggagaaaaaaagagaaaaaaauaaaaaucaaaaaaaaaaaaa

SEQ ID NO: 505027 - RNA, 64 nt, Homo Sapiens
gucuugaauucucuguuuaugcaaugugcucgaaagaaaaaaauguuaaaaauauaucuauaau

SEQ ID NO: 505028 - RNA, 63 nt, Homo Sapiens
auuuaguucuuuuggacuaauacaauucaggaaagaaaaaacccaaaaaccaaccucauucac

SEQ ID NO: 505029 - RNA, 64 nt, Homo Sapiens
aacaauuagguguacuucuauuuuaaaacauuucagaaaaaaauauauguuauagcaauacucu

SEQ ID NO: 505030 - RNA, 64 nt, Homo Sapiens
uugucaguggcguugggagggggagaaaaggaaaagaaaaaaaaaagaagaagaagaagaaaag

SEQ ID NO: 505031 - RNA, 64 nt, Homo Sapiens
aaaaaaaaaagaagaagaagaagaaaagagaagaagaaaaaaacgaaaacagucaaccaacccc

SEQ ID NO: 505032 - RNA, 64 nt, Homo Sapiens
agccgacggaggaggaggagccuuccaaacagagagaaaaaaaugaggccgaaaauuuagagga

SEQ ID NO: 505033 - RNA, 64 nt, Homo Sapiens
cgcuacacuguccuggcagaaaacaaaagugacgagaaaaaaaaaucaggagucagcucugaca

SEQ ID NO: 505034 - RNA, 64 nt, Homo Sapiens
aaaaaaaagagagagagagacaagacucugucucagaaaaaaaauccagccugggcgacaagag

SEQ ID NO: 505035 - RNA, 64 nt, Homo Sapiens
uuuauauacgacucuuuaaauucuuagaguuuacagaaaaaauauuuauucuucaacucucacu

SEQ ID NO: 505036 - RNA, 64 nt, Homo Sapiens
gaaaaaugaauuucucuuuaguaaugcaccugacagaaaaaaaauccuuucauuuuuuuucuuu

SEQ ID NO: 505037 - RNA, 64 nt, Homo Sapiens
uuuguuuuguuuuuugggguuacaauuuuuaaaaagaaaaaaguuguguuuuguuguuuugugc

SEQ ID NO: 505038 - RNA, 64 nt, Homo Sapiens
aauacaacaagcaaacaacacaaaaggcuuggaaagaaaaaacaugacuaauagaccucagccu

SEQ ID NO: 505039 - RNA, 64 nt, Homo Sapiens
auggcuaaaauguauaaaauuggcauuuguugaaagaaaaaagccaauauaaaaauuguuuuaa

SEQ ID NO: 505040 - RNA, 64 nt, Homo Sapiens
gcagcaagacauguuuuauauaagcuaagcacagagaaaaaaaguuauacugcaugaaguaugu

SEQ ID NO: 505041 - RNA, 64 nt, Homo Sapiens
aaacuguagacccuaacaguaugauaacauuugaagaaaaaauaaaaauaucacauaagacauc

SEQ ID NO: 505042 - RNA, 64 nt, Homo Sapiens
gaaaaggaaacaacuagcaagauaaaguagaaaaagaaaaaaguagucaaagaaagagaaaaaa

SEQ ID NO: 505043 - RNA, 64 nt, Homo Sapiens
uaaaguagaaaaagaaaaaaacagucaaagaaagagaaaaaagacagcaguuugugccuccuac

SEQ ID NO: 505044 - RNA, 64 nt, Homo Sapiens
uauuaaaaagauauuugaaauuauugucaucccaagaaaaaauaauacuaucauaguaauauua

SEQ ID NO: 505045 - RNA, 64 nt, Homo Sapiens
uauuuuaaaaauuuauuugauuauugucaucccaagaaaaaagaauacuaucauguuaauacua

SEQ ID NO: 505046 - RNA, 64 nt, Homo Sapiens
agucuagcgaaaaaacuccuuaauaagguuaaaaagaaaaaaaauuuaggaccaaucucauuuu

SEQ ID NO: 505047 - RNA, 64 nt, Homo Sapiens
aauuuuucuuuucuguuuuaagccaaaaaaagaaagaaaaaaauugagguccuucuggacuaaa

SEQ ID NO: 505048 - RNA, 64 nt, Homo Sapiens
cauggaauuucaaauauacuuacaugcauauaauagaaaaaaaauguauuauauacaaguguaa

SEQ ID NO: 505049 - RNA, 64 nt, Homo Sapiens
guucauuuuccucagucucauucaaucuguugauagaaaaaauuuuugaaugcuuauauauuug

SEQ ID NO: 505050 - RNA, 64 nt, Homo Sapiens
cagaagcccuggauucaaaugaaaaaagaaagaaagaaaaaaggcugucucaaaaaaaaaaaaa

SEQ ID NO: 505051 - RNA, 64 nt, Homo Sapiens
aagaaagaaaaaaggcagaaucaaaaaaaaaaaaagaaaaaagaugacagagcgaaccucuguc

SEQ ID NO: 505052 - RNA, 64 nt, Homo Sapiens
aauagcaacucuggugagcagcacuaaacagaaaagaaaaaaaauauaagaauuaagggguaaa

SEQ ID NO: 505053 - RNA, 64 nt, Homo Sapiens
uuuaccauuaggacucaauuuaccuuuuuuuaucagaaaaaaaucuccuaacagcacuacaaag

SEQ ID NO: 505054 - RNA, 64 nt, Homo Sapiens
uggcuucauuucugugaaaugugauuuguuuauaagaaaaaaaccaguuuugaaccaagaauug

SEQ ID NO: 505055 - RNA, 64 nt, Homo Sapiens
gcaagcaagcuguuaaagauagcauuauguagguagaaaaaaauuuucuaccagaaauuuccag

SEQ ID NO: 505056 - RNA, 64 nt, Homo Sapiens
aacauuuuaauguauauuguaccaauaucauuauagaaaaaaauaaucaaauuauauaaacagu

SEQ ID NO: 505057 - RNA, 64 nt, Homo Sapiens
aauacaaaaaaaaaaaagaaaaauuucuuuuucuagaaaaaauauuaauaaaauucuauugcaa

SEQ ID NO: 505058 - RNA, 64 nt, Homo Sapiens
gaaagcauagacauauuuuuaaaaaaagaaaaaaagaaaaaaaauaagaaaguacuugacuaaa

SEQ ID NO: 505059 - RNA, 64 nt, Homo Sapiens
aaaaaaaagaaagcauagacugacuaaaaaaaaaagaaaaaaaguguuucuuuaagaaaguacu

SEQ ID NO: 505060 - RNA, 64 nt, Homo Sapiens
aauauauauauauauauaucauguucuauagaaaagaaaaaaaacuguugaucuuuuaucaaua

SEQ ID NO: 505061 - RNA, 64 nt, Homo Sapiens
agagaaacuugacugcacauguaucauuccuagaagaaaaaaaguguagggauuuacuggcaug

SEQ ID NO: 505062 - RNA, 64 nt, Homo Sapiens
ucaccuuacagugcuaagaaguucuagggagaugagaaaaaaauggaaaaaccaacaaacaaua

SEQ ID NO: 505063 - RNA, 64 nt, Homo Sapiens
caaugaggaacaauuggagaauguguguuuuaaaagaaaaaaccaagcaaccccaaaagaguug

SEQ ID NO: 505064 - RNA, 64 nt, Homo Sapiens
gcacgugaccuuaugaggcuaaaaaagaaaaaaaagaaaaaaaacaaaagcgaaacucugucuc

SEQ ID NO: 505065 - RNA, 64 nt, Homo Sapiens
gaaaaaaaagcacgugaccucucugucucaaaaaagaaaaaaaaccugggcaacaaaagcgaaa

SEQ ID NO: 505066 - RNA, 64 nt, Homo Sapiens
aaguccccuuuuaaaacaagauuuuuuuccauuaagaaaaaaaaagcuuuuggcucucuguuuc

SEQ ID NO: 505067 - RNA, 64 nt, Homo Sapiens
aacaguuaaaagcuuuuggcuuucauugaagaaaagaaaaaaacgucuuuucaaaaugagaggc

SEQ ID NO: 505068 - RNA, 64 nt, Homo Sapiens
auaauacauacacaugaacauuuaaaacaccuugagaaaaaaaggcacugauaaacagaauacu

SEQ ID NO: 505069 - RNA, 64 nt, Homo Sapiens
acuuagagaagaggaagagaagugauauacagagagaaaaaaagguaagaauaaaaacuaccaa

SEQ ID NO: 505070 - RNA, 64 nt, Homo Sapiens
aaugaacuugaagaguaagagauacagaaaaagaagaaaaaaucaaucccgaguggagagauua

SEQ ID NO: 505071 - RNA, 64 nt, Homo Sapiens
uuaugcaauuuuaaguauacacucagcaauaauuagaaaaaaaggagagagaaaagugauuuaa

SEQ ID NO: 505072 - RNA, 64 nt, Homo Sapiens
aaaccaaagaaacaaugaucuacucaaacauuggagaaaaaaacugccagaggaggaguugcca

SEQ ID NO: 505073 - RNA, 64 nt, Homo Sapiens
caauaauaauaauaauaauaaugaugauacucuaagaaaaaaaucucaacauacuucauuuaau

SEQ ID NO: 505074 - RNA, 64 nt, Homo Sapiens
gccugggugaaaaagacaggcugugucuccaaaaagaaaaaaaaaagucaaauucaaauaucau

SEQ ID NO: 505075 - RNA, 64 nt, Homo Sapiens
ggaaacgacccuguggcugugagaaagugaaaaaagaaaaaaaaaaaggcauuggcauuuucuu

SEQ ID NO: 505076 - RNA, 64 nt, Homo Sapiens
uauuaggacagaauuaaugaugcuuaaagagaaaagaaaaaaagagagaagaaaaaggagagau

SEQ ID NO: 505077 - RNA, 64 nt, Homo Sapiens
uacuuucaaugugaggaaugaaugauaaauuaagagaaaaaaauaucaggaaggucaauauaug

SEQ ID NO: 505078 - RNA, 64 nt, Homo Sapiens
auaucagugucaaaagcccaagaaaagacaaaaaagaaaaaaacaauccccagggguucuauga

SEQ ID NO: 505079 - RNA, 64 nt, Homo Sapiens
uuuagauguauagaaaaguaagaaaaucuuacuuagaaaaaagccccuugaaacuugcaggauu

SEQ ID NO: 505080 - RNA, 64 nt, Homo Sapiens
aaauagcauucuuauucacuuuaugccgguauuuagaaaaaauaaauuauagcaaguaugauuu

SEQ ID NO: 505081 - RNA, 64 nt, Homo Sapiens
cuguacugcuuguucaagagcuuuugucuuuuggagaaaaaaaaaucacugaggaugaaacuga

SEQ ID NO: 505082 - RNA, 64 nt, Homo Sapiens
cuuaagucuguagucuuuauuauuauauggaaaaagaaaaaaagggauauuuagaaauuuugug

SEQ ID NO: 505083 - RNA, 64 nt, Homo Sapiens
augcaucaagcuuguuugucaagggaaaaaaaggagaaaaaacgcaucuuuuuaaaacaaggaa

SEQ ID NO: 505084 - RNA, 64 nt, Homo Sapiens
aaaagcaaaugaguguuuucgcaacugguguuggagaaaaaaagauagagauugauaagauuua

SEQ ID NO: 505085 - RNA, 64 nt, Homo Sapiens
ccauauguguauuagggugaaggaaaaaaaaaaaagaaaaaaaaaaaaaaaaaaaaaaaaaaaa

SEQ ID NO: 505086 - RNA, 64 nt, Homo Sapiens
gcaggcugggcgcgguggcuguuuucuucuaugaagaaaaaaauauuugggaaguuuuacuuuu

SEQ ID NO: 505087 - RNA, 64 nt, Homo Sapiens
uaucagcuguauguuaagaguuagcaaggauuaaagaaaaaagcauuugaaauaaaaggaaauu

SEQ ID NO: 505088 - RNA, 64 nt, Homo Sapiens
aacauuauagauacucuggcuaauuacuugauuaagaaaaaauuauauaguucugauuggguau

SEQ ID NO: 505089 - RNA, 64 nt, Homo Sapiens
aaaguccuuuuaagggaacuucaugggaaaguucagaaaaaaauacuuugcagucagacauucg

SEQ ID NO: 505090 - RNA, 64 nt, Homo Sapiens
uucauuuuccuacagaggaaauuuaauauuuguaagaaaaaacuuuugcguaaguacuuugauu

SEQ ID NO: 505091 - RNA, 64 nt, Homo Sapiens
ugaaagaacacuucuaagccguuucuuuuuuaaaagaaaaaacuacaaaaaucuucaaagacug

SEQ ID NO: 505092 - RNA, 64 nt, Homo Sapiens
ccugccgauuaacaagacuggaacaaaugagaaaagaaaaaaaauaacuaaaacauugaaaaca

SEQ ID NO: 505093 - RNA, 64 nt, Homo Sapiens
gcaccaccauuauuaccaccuucccccauagaagagaaaaaagaccauaaucugcaacuucauu

SEQ ID NO: 505094 - RNA, 64 nt, Homo Sapiens
aaccuucaauuauuagcuuuauaaaacacauuuuagaaaaaaggcaauucauuugcaaauugca

SEQ ID NO: 505095 - RNA, 64 nt, Homo Sapiens
cacagaauuguuucaacagauuuagcaaaacugaagaaaaaaagugguaauuauauauuuauua

SEQ ID NO: 505096 - RNA, 64 nt, Homo Sapiens
aggagugauagagaacaaaauuuuaaaauaguauagaaaaaaguuuuaauuuacuauuucagau

SEQ ID NO: 505097 - RNA, 64 nt, Homo Sapiens
agggugauaggauauucauuaauccauuucuuuuagaaaaaauuuuauauuugucacuuuaaaa

SEQ ID NO: 505098 - RNA, 64 nt, Homo Sapiens
ucaauacaauuguaauguagaaauauaagaauuuagaaaaaaguaaacuugccauuugguuaag

SEQ ID NO: 505099 - RNA, 64 nt, Homo Sapiens
uccaugcaacuaugagucucuaaaucucucuguaagaaaaaaauuucaaaguaaagauuuuacu

SEQ ID NO: 505100 - RNA, 61 nt, Homo Sapiens
ccaaagucggaaucuacugaacaaucagaaaagaaaaaaauguaaugcaaauuuuaagaaa

SEQ ID NO: 505101 - RNA, 64 nt, Homo Sapiens
auuccacguuuggauaugcucauuuaauuucuacagaaaaaauuuuaaauuauuucacauuagc

SEQ ID NO: 505102 - RNA, 64 nt, Homo Sapiens
guauagcuuacucuaccugcagacagaaaaugaaagaaaaaaauggacuugccuagaauaauau

SEQ ID NO: 505103 - RNA, 64 nt, Homo Sapiens
ucuugcauccagaaaggccagauuuuaccuaccaagaaaaaaagauauuuuuccagagaguuag

SEQ ID NO: 505104 - RNA, 64 nt, Homo Sapiens
guguuaaaacaugaaaaugcuggugagcugagguagaaaaaaaacaagaaaaaaauuuuaaaaa

SEQ ID NO: 505105 - RNA, 64 nt, Homo Sapiens
gaaaaugcuggugagcugagguagaaaaaaaacaagaaaaaaauuuuaaaaauagcguuaaaau

SEQ ID NO: 505106 - RNA, 64 nt, Homo Sapiens
uaaauggagauaaaacuuguauuuaguauguaauagaaaaaauucuguuauucgcagauuguua

SEQ ID NO: 505107 - RNA, 64 nt, Homo Sapiens
aaugugucucugguacagaauaguugauauuaacagaaaaaaaaaaaucuguagcuucaugaau

SEQ ID NO: 505108 - RNA, 64 nt, Homo Sapiens
aacuauauuucaaaugaauuuaaauaucuuuuaaagaaaaaaacaccuaaaaauaaaucuuaac

SEQ ID NO: 505109 - RNA, 64 nt, Homo Sapiens
aacuggacaccuuuuauuugaagaaacaaacugaagaaaaaaugcuuccuuaagugcugacagc

SEQ ID NO: 505110 - RNA, 64 nt, Homo Sapiens
cucaugggaaaguguucacaccauauuauuaaagagaaaaaacagauuauaaagcaauaugcau

SEQ ID NO: 505111 - RNA, 64 nt, Homo Sapiens
uaaagcaauaugcauacaauguaguaguucuguaagaaaaaaguauuaugugcauuuuaacugg

SEQ ID NO: 505112 - RNA, 64 nt, Homo Sapiens
auuauguaaaaaacaaaacuacaacaacaaaaaaagaaaaaaguuaaaaaagaaaaaaacacca

SEQ ID NO: 505113 - RNA, 64 nt, Homo Sapiens
aacuacaacaacaaaaaaagaaaaaaguuaaaaaagaaaaaaacaccaaaaaacaaaaacaaac

SEQ ID NO: 505114 - RNA, 64 nt, Homo Sapiens
uaaucuuggcauccuaucacaaaugaacucuuaaagaaaaaaacacagugggguuuaguacucc

SEQ ID NO: 505115 - RNA, 64 nt, Homo Sapiens
acuccaguauuuguggccugauuuugugggacaaagaaaaaaggaaguuaacuguaauuacugu

SEQ ID NO: 505116 - RNA, 64 nt, Homo Sapiens
uaaaggguguacuuauauccaaaaagaaaaaagaagaaaaaauuaaaaaguuuuauuuuucuaa

SEQ ID NO: 505117 - RNA, 64 nt, Homo Sapiens
agaaaaaauuuaaaggguguauuuuucuaaaaaaagaaaaaagauuguacaaaaaaaaaguuuu

SEQ ID NO: 505118 - RNA, 64 nt, Homo Sapiens
acaaaaaaaacaaaaucuaggaccaaauuguuuaagaaaaaaaauuauaucaaaggugcaucgu

SEQ ID NO: 505119 - RNA, 64 nt, Homo Sapiens
acugucauuuccuuauaaguuuuauaguaaaggaagaaaaaaagcugcuaagcuguuaaaugua

SEQ ID NO: 505120 - RNA, 64 nt, Homo Sapiens
uaaaguugaaaauacauucuuaaauaaaauggauagaaaaaaacauuaauaacugaauaaaaaa

SEQ ID NO: 505121 - RNA, 64 nt, Homo Sapiens
auacuuaaauauuuguaauuaaggggugauugaaagaaaaaaaaauaugcuccuagagaggaga

SEQ ID NO: 505122 - RNA, 64 nt, Homo Sapiens
cacaaaaacaaacuuuuuuuaaaaaaagaaaaagagaaaaaaauugcauggauuccuuugaaga

SEQ ID NO: 505123 - RNA, 64 nt, Homo Sapiens
gaaaaagagaaaaaaaucacauggauuccuuugaagaaaaaaaaaaauuucugauccacaaugc

SEQ ID NO: 505124 - RNA, 64 nt, Homo Sapiens
aaaaagcauauauauauauaguaagguugcucucagaaaaaaaaaagauaaaugugaagucuga

SEQ ID NO: 505125 - RNA, 64 nt, Homo Sapiens
aaaaaaauuguuuucaguuagcuuucucaccaacagaaaaaagggguguuguguaaugcauaau

SEQ ID NO: 505126 - RNA, 64 nt, Homo Sapiens
aacaaaaacaaacaggcugcauuuggaaauaaaaagaaaaaaaaauguaccuuuuuguuaguga

SEQ ID NO: 505127 - RNA, 64 nt, Homo Sapiens
aaaaucacauuucugaccuguguuauugcuuugcagaaaaaaaaagaaaaaaagugcuuaauau

SEQ ID NO: 505128 - RNA, 64 nt, Homo Sapiens
ugcuuaauauuguuauugcuuagaaaaaguauguagaaaaaaagaaggggauugcuacaccaug

SEQ ID NO: 505129 - RNA, 64 nt, Homo Sapiens
uacccuuuucuuuuccuugacauuuuacaaaacaagaaaaaaaaaauaaucgagaaugccuggg

SEQ ID NO: 505130 - RNA, 64 nt, Homo Sapiens
uguauccagaaaagcuuuaagcaguuaaagaaacagaaaaaaaccgacacuuugucgacacuga

SEQ ID NO: 505131 - RNA, 64 nt, Homo Sapiens
uguuauuagaagaaaaguacuguacugaaaauucagaaaaaaaaucucaaccuuaugccaaaau

SEQ ID NO: 505132 - RNA, 64 nt, Homo Sapiens
aguugugaaaaaggaagagaaucauuaaagaaaaagaaaaaagauuuuaagaccguugaaauca

SEQ ID NO: 505133 - RNA, 64 nt, Homo Sapiens
aauacaaaagcccacugauacuaauuauauaaugagaaaaaaauguauccaacuaggacacaua

SEQ ID NO: 505134 - RNA, 64 nt, Homo Sapiens
auuaucugaagacacaaaccugacaggagggagaagaaaaaacaaaacacuugaaccaagaaac

SEQ ID NO: 505135 - RNA, 64 nt, Homo Sapiens
aguaugcccagaagcuuuccuucauaaaauagaaagaaaaaaacauuuggcuuauuuuucacug

SEQ ID NO: 505136 - RNA, 64 nt, Homo Sapiens
auuaauaauccaacuuuaauaguauacauuuaaaagaaaaaaaacaaaagcccuggaaguugag

SEQ ID NO: 505137 - RNA, 64 nt, Homo Sapiens
cagggcuugucuggaucagcaccaacgauuuuaaagaaaaaaggaagaguuucuuagaugagua

SEQ ID NO: 505138 - RNA, 64 nt, Homo Sapiens
gggcuuaggggauuggaacugggguuuggcugaaagaaaaaaaaaaaaauguaacugaugaauc

SEQ ID NO: 505139 - RNA, 64 nt, Homo Sapiens
aggcccaggacacuugucagaaggaugcaaaaaaagaaaaaaguacauccacccucuuaauccc

SEQ ID NO: 505140 - RNA, 64 nt, Homo Sapiens
guuuuguuucuguuguuguucaaaugcaaaaaaaagaaaaaaaaagaaaaaaaaaggugacuca

SEQ ID NO: 505141 - RNA, 64 nt, Homo Sapiens
uguuguuguucaaaugcaaaaaaaagaaaaaaaaagaaaaaaaaaggugacucacauuguuaca

SEQ ID NO: 505142 - RNA, 64 nt, Homo Sapiens
acaaaaauaggugcaaaugauggggggcaauagaagaaaaaauuugcauuuuggaaaauugggu

SEQ ID NO: 505143 - RNA, 64 nt, Homo Sapiens
gccaacaugaugaaaccccgucucuaccaaaaauagaaaaaaauauagccgggccugguggcgc

SEQ ID NO: 505144 - RNA, 54 nt, Homo Sapiens
ggaugaaauugucaguguaaaaccagaaaaaaugcagcucuucuagaauuguuu

SEQ ID NO: 505145 - RNA, 64 nt, Homo Sapiens
ucaguaagauuccuguaagaaauacugcuuuuuaagaaaaaaaauaacaugcugaggggugacc

SEQ ID NO: 505146 - RNA, 64 nt, Homo Sapiens
aauccaaaagagagaagaguaaaaaaaagaaaaaagaaaaaaaaaaaaaaaaaaaaaaaaaaaa

SEQ ID NO: 505147 - RNA, 64 nt, Homo Sapiens
aaaaaaaaauccaaaagagaaaaaaaaaaaaaaaagaaaaaagaaaaagccaaaaaaaaaaaaa

SEQ ID NO: 505148 - RNA, 64 nt, Homo Sapiens
cuuauuuuguauugaaacuuuuaaacaauacugaagaaaaaaaaacuuuuccgacaucuguucu

SEQ ID NO: 505149 - RNA, 64 nt, Homo Sapiens
guuauacaaaaaucuagaaauaauagauuuguacagaaaaaaaugauaauaaaugagaacacaa

SEQ ID NO: 505150 - RNA, 64 nt, Homo Sapiens
uuucuuacgaauauaccaacauccugaaaguuaaagaaaaaaaucuaauguaugaaugugacuc

SEQ ID NO: 505151 - RNA, 64 nt, Homo Sapiens
accuaaaaauaauucucuuguauuuuggagaugaagaaaaaagucauucaccugggagggauuu

SEQ ID NO: 505152 - RNA, 64 nt, Homo Sapiens
uauuuacacuaauuuuuuuaucuuuauugcuaccagaaaaaaaugcgaacgaaugcauugcuuu

SEQ ID NO: 505153 - RNA, 64 nt, Homo Sapiens
ugauagucuugaauauuuuauuuuuuuaaugaaaagaaaaaacaagaaaguuauguuucauaau

SEQ ID NO: 505154 - RNA, 64 nt, Homo Sapiens
augcuuugauaucugguucagacuaucaucaggaagaaaaaaaaaucccacaguaccugaaaug

SEQ ID NO: 505155 - RNA, 64 nt, Homo Sapiens
caguaacccagcugcaauaccugucuguaauaugagaaaaaaaaaaugaaucuauuuaaucauu

SEQ ID NO: 505156 - RNA, 64 nt, Homo Sapiens
cuuccuuauauuuuuuuccucaacaguuuuaaaaagaaaaaaaggucuauuuuuuuuucuccua

SEQ ID NO: 505157 - RNA, 64 nt, Homo Sapiens
aauuauauucuuggccaauuuuguccaacggacaagaaaaaagcaaagucaacgacaccauuau

SEQ ID NO: 505158 - RNA, 64 nt, Homo Sapiens
cuuuguuuauugaaaaaaaaagaaaaagaaagcaagaaaaaaagauacuauggggucaagugua

SEQ ID NO: 505159 - RNA, 64 nt, Homo Sapiens
uugucaguuuugagggggacauguguuaaaucacagaaaaaaauggugccuucuucugcguuug

SEQ ID NO: 505160 - RNA, 64 nt, Homo Sapiens
caaggaaggacagaggguuuugauuuuaaaaagaagaaaaaaaaaccuuauuuuuucuuucuug

SEQ ID NO: 505161 - RNA, 64 nt, Homo Sapiens
uggacuuuguaauuauuuuuuuagcaguaauuaaagaaaaaaguccucugugaggaauauucuc

SEQ ID NO: 505162 - RNA, 64 nt, Homo Sapiens
guauuuuuguacagauuugcuuucucuuacaaaaagaaaaaaaaaauccuguuguauuaacauu

SEQ ID NO: 505163 - RNA, 64 nt, Homo Sapiens
guacaaccaaaugccagucacagugaagagauaaagaaaaaaaacaaauugauaguuguucuag

SEQ ID NO: 505164 - RNA, 64 nt, Homo Sapiens
guagaucugaaugcugaucccggacucccagcacagaaaaaaagaggaaacauguaaugauagg

SEQ ID NO: 505165 - RNA, 64 nt, Homo Sapiens
aacucuuucaauugagauuaugagcucugugguaagaaaaaaugucgagcacuuuucuaacuaa

SEQ ID NO: 505166 - RNA, 64 nt, Homo Sapiens
uuuuauaaucaucaaaaugucuauguuguaaaauagaaaaaaauuuuuuucaguguagcugaac

SEQ ID NO: 505167 - RNA, 64 nt, Homo Sapiens
uuuaaagcauuguuugacaguuuuuuuuuuuccuagaaaaaauacuucucauauauuguguuuu

SEQ ID NO: 505168 - RNA, 64 nt, Homo Sapiens
uaacugcacugacuuuauaucauugcacagggaaagaaaaaaaaggaguggggugagagcuaaa

SEQ ID NO: 505169 - RNA, 64 nt, Homo Sapiens
auguuagaagguuauuuaaaauuucagagaaaauagaaaaaacauugcaaguuuaauuugauuu

SEQ ID NO: 505170 - RNA, 64 nt, Homo Sapiens
uaaaauuggaagucauuaaaggucuuagugcuuuagaaaaaagugauacauaaucuacaauaag

SEQ ID NO: 505171 - RNA, 64 nt, Homo Sapiens
ucccuuucuuguaaacuuacaaaaagaaaaaaaaagaaaaaaaagaaacuuugcuaguuaaaaa

SEQ ID NO: 505172 - RNA, 64 nt, Homo Sapiens
agaaaaaaaaucccuuucuuuaguuaaaaaaaaaagaaaaaaaaaaguauaauagaaacuuugc

SEQ ID NO: 505173 - RNA, 64 nt, Homo Sapiens
caagcaagaagaccauuugauaaaacugucuuuuagaaaaaaaaaaagagcugcagaguauuua

SEQ ID NO: 505174 - RNA, 64 nt, Homo Sapiens
gcugcagaguauuuauaaaauguuuaaaaguuaaagaaaaaagaaaguuauuaaauuaauuaua

SEQ ID NO: 505175 - RNA, 64 nt, Homo Sapiens
uuagagggaacuaacauuuuaggaaugcuuauucagaaaaaaauccuagaguugauucauuguu

SEQ ID NO: 505176 - RNA, 64 nt, Homo Sapiens
uauguauguugcauuuuauccauaagaaauaaagagaaaaaaacuaaaaacauuguaugagaau

SEQ ID NO: 505177 - RNA, 64 nt, Homo Sapiens
uaugagagaaaaggaaaaaggaaucaaagguggaagaaaaaaaaagccaaauucuguuuacggu

SEQ ID NO: 505178 - RNA, 64 nt, Homo Sapiens
cgccuaaugaacaagcacaguuuuucaauggugaagaaaaaagcaccagacuuuuuuucuuuuu

SEQ ID NO: 505179 - RNA, 64 nt, Homo Sapiens
guuccauuuugaggaauggggaaggcuauucuaaagaaaaaaaugggauuuguuuucucggcag

SEQ ID NO: 505180 - RNA, 64 nt, Homo Sapiens
gcuaagaauaucaaguauuucucuggcucuugacagaaaaaaaucaguugacuuaacccuuugc

SEQ ID NO: 505181 - RNA, 64 nt, Homo Sapiens
cuugguucagaagccuaacagauugcuagacaagagaaaaaacuugaagaaaaaagaagcuuaa

SEQ ID NO: 505182 - RNA, 64 nt, Homo Sapiens
ccuaacagauugcuagacaagagaaaaaacuugaagaaaaaagaagcuuaauuucaugcuucau

SEQ ID NO: 505183 - RNA, 64 nt, Homo Sapiens
uaaaaaugggauguccuaaauuucaacuggaaaaagaaaaaacuucuaaaaacaucugcauagu

SEQ ID NO: 505184 - RNA, 64 nt, Homo Sapiens
agcuaaaaaagaguggaccaaucauuuuaaaggaagaaaaaagccuggggccuccuuccauugc

SEQ ID NO: 505185 - RNA, 64 nt, Homo Sapiens
auuuauuuauuuaagacaguuuuuuacauuauuaagaaaaaaagcaaagggaaauaucauuuau

SEQ ID NO: 505186 - RNA, 64 nt, Homo Sapiens
acacacauauaaacaucacacugcaggcuguuuaagaaaaaauaugauguaccaugaaacaaag

SEQ ID NO: 505187 - RNA, 64 nt, Homo Sapiens
ccagaaaggagccacagcugacgccaaaaagaaaagaaaaaagauauauauauauauauauaua

SEQ ID NO: 505188 - RNA, 64 nt, Homo Sapiens
guguuccuucagggaaacuggucuugaaaaagcaagaaaaaaaagcaaaaaaaaaaaaaaaaaa

SEQ ID NO: 505189 - RNA, 64 nt, Homo Sapiens
gguuuuguuuuguuuucauuuuuccaaaaaaaaaagaaaaaaaaauagaaaaaaaaggaguaaa

SEQ ID NO: 505190 - RNA, 64 nt, Homo Sapiens
uuuucauuuuuccaaaaaaaaaagaaaaaaaaauagaaaaaaaaggaguaaaaggggcggguuu

SEQ ID NO: 505191 - RNA, 64 nt, Homo Sapiens
cuuucuauaaauacauauuguuuaaaaaaaagcaagaaaaaaaggaaaacaaaggaaaauaucc

SEQ ID NO: 505192 - RNA, 64 nt, Homo Sapiens
gaaucugcuucuuaggaguggguugagcugauagagaaaaaacggccuucagcccaggcuggga

SEQ ID NO: 505193 - RNA, 64 nt, Homo Sapiens
uuuuuguggguguugcaugcaaaucaaguggacaagaaaaaauaacaaaacaaaaaacaagaaa

SEQ ID NO: 505194 - RNA, 64 nt, Homo Sapiens
aaguggacaagaaaaaauaacaaaacaaaaaacaagaaaaaaaaaacacaaaaccccguaaaau

SEQ ID NO: 505195 - RNA, 64 nt, Homo Sapiens
ugccucaaagacucuuguccucuugucccuccugagaaaaaagaaaacgaaaagugggguuuuu

SEQ ID NO: 505196 - RNA, 64 nt, Homo Sapiens
uuaauuguaacauuuuuagaaaaagaacaaaaaaagaaaaaaaaaagaaagaaacacagcaacu

SEQ ID NO: 505197 - RNA, 64 nt, Homo Sapiens
aagggaccuugcagggaccucucccuccaaaaaaagaaaaaaagaaaaagaaagaaaaaauaaa

SEQ ID NO: 505198 - RNA, 64 nt, Homo Sapiens
cucucccuccaaaaaaagaaaaaaagaaaaagaaagaaaaaauaaaugaggaaacguguugcag

SEQ ID NO: 505199 - RNA, 64 nt, Homo Sapiens
gagggcaacaggagauguggggacguguuaggagagaaaaaaaaaaaaacaaaaauauauaugg

SEQ ID NO: 505200 - RNA, 64 nt, Homo Sapiens
gagaguuuuccuaucuuuguauguuaagagauuaagaaaaaaaaauucuauuuuuguuguaaug

SEQ ID NO: 505201 - RNA, 64 nt, Homo Sapiens
aagguuuuacaaaaugaaagcaauaaaacaaacuagaaaaaaaaaaauuccaaugucacaaaag

SEQ ID NO: 505202 - RNA, 64 nt, Homo Sapiens
ucacccaccacccccccaaaagagacagagagagagaaaaaaaaaacagaaacccgagaaagag

SEQ ID NO: 505203 - RNA, 64 nt, Homo Sapiens
aucagggauauaguucauauaaaaaaaaaaaaaaagaaaaaaaacaagagugagacuuagucuc

SEQ ID NO: 505204 - RNA, 64 nt, Homo Sapiens
ucuuucaggaaaguucucccagagagagauguccagaaaaaauagccucacccuaucagucagu

SEQ ID NO: 505205 - RNA, 64 nt, Homo Sapiens
aaaaaguuuuaaaaaaauugaacaagaacguuucagaaaaaaaccaaaacaaaaggcucauaac

SEQ ID NO: 505206 - RNA, 64 nt, Homo Sapiens
ucucaucacuugaagccaccaaaaaaaaaagaaaagaaaaaaaaagaaaaaaaaaagacaaaaa

SEQ ID NO: 505207 - RNA, 64 nt, Homo Sapiens
aagacaaaaaaaaaaaaaaacaacgaaauggaaaagaaaaaaaaccccauugcuguaaauauuu

SEQ ID NO: 505208 - RNA, 64 nt, Homo Sapiens
auuuucuggggcuccucacauagcuacccaaaagagaaaaaaaauuaagacaagccuggcaaca

SEQ ID NO: 505209 - RNA, 64 nt, Homo Sapiens
uugcaaaggucuuuuuaaaccaguuuagauuucaagaaaaaauaaauggaaaucaucgaaaauu

SEQ ID NO: 505210 - RNA, 64 nt, Homo Sapiens
cagacaaauugaagaacuggugggauuuuuuucaagaaaaaaaauuauauaauaacuauaaucc

SEQ ID NO: 505211 - RNA, 64 nt, Homo Sapiens
cagcagcaagacacgcacagucaaccauuuuccgagaaaaaaagaaaauuccccacuuggaaag

SEQ ID NO: 505212 - RNA, 64 nt, Homo Sapiens
ugggguuuuguaauuuagcagaacucuuacugguagaaaaaauagaccugaauuauguguaacu

SEQ ID NO: 505213 - RNA, 64 nt, Homo Sapiens
guggaaucuacuuucauuguuaacacugagcuaaagaaaaaaagccguguguuuuaugaaugac

SEQ ID NO: 505214 - RNA, 64 nt, Homo Sapiens
auuuaugcacugauuuaaaacaaaccaaaaaaaaagaaaaaaacaaaaaaaaaaaucccuccuu

SEQ ID NO: 505215 - RNA, 64 nt, Homo Sapiens
augaacagacucagcuuuggaguaagaaaaaaauagaaaaaaaucagggagaagagaaggcauu

SEQ ID NO: 505216 - RNA, 64 nt, Homo Sapiens
agaaaaaaauaugaacagacagaaggcauuaguaagaaaaaaaugccacaggggcagggagaag

SEQ ID NO: 505217 - RNA, 64 nt, Homo Sapiens
uacaaagcagggguuuagagguauuaccuuguaaagaaaaaaauagugccaagucagaaagugu

SEQ ID NO: 505218 - RNA, 64 nt, Homo Sapiens
uuucuacaguagucuuucuugucuugaaggcaaaagaaaaaaaaacguuucuuuguugagcugu

SEQ ID NO: 505219 - RNA, 64 nt, Homo Sapiens
aaaccacguuucuuuguugaaaaaaaaagaaaaaagaaaaaaaaaagcuaagagagcuugcaaa

SEQ ID NO: 505220 - RNA, 64 nt, Homo Sapiens
aaaaaaaaaaccacguuucuuugcaaaaaaaaaaagaaaaaagaaaugcacaagcuaagagagc

SEQ ID NO: 505221 - RNA, 64 nt, Homo Sapiens
cauugucucugguuugaaauaauuugaauaaaugagaaaaaaugaguguuuacuuccugcagug

SEQ ID NO: 505222 - RNA, 64 nt, Homo Sapiens
uguugguauucucccuugggcuuagagguaugucagaaaaaauacguuguggaagguuuggagc

SEQ ID NO: 505223 - RNA, 64 nt, Homo Sapiens
aagguguuuauuuuuaacuccacuuuugcuaaaaagaaaaaaaaaaauauaugcuuacauuuuu

SEQ ID NO: 505224 - RNA, 64 nt, Homo Sapiens
uuuuuuuuucaaucuaaaaaucuucuggaucuacagaaaaaauuuuaaaguuucaaugaaaguu

SEQ ID NO: 505225 - RNA, 64 nt, Homo Sapiens
aauuuauugcugaucacaagacucagucucaaaaagaaaaaagaagccugggcaacagagcgag

SEQ ID NO: 505226 - RNA, 64 nt, Homo Sapiens
agcagauaucauguaggaaagagaggauaaacaaagaaaaaagaaaaaaaaauaagcucauacc

SEQ ID NO: 505227 - RNA, 64 nt, Homo Sapiens
aucauguaggaaagagaggauaaacaaagaaaaaagaaaaaaaaauaagcucauacccaaauuc

SEQ ID NO: 505228 - RNA, 64 nt, Homo Sapiens
acauuuugaaugaguauggaaccuccaugggcucagaaaaaagaugcuaauauauuuaucucau

SEQ ID NO: 505229 - RNA, 64 nt, Homo Sapiens
uguaagaaggcagggcaggggggcuuuuuacaggagaaaaaaaaaugacuuauaagagaaagag

SEQ ID NO: 505230 - RNA, 64 nt, Homo Sapiens
uguuuuuuaaccuuuuguuccgccauuuaaaaaaagaaaaaaaaaaagcuuauguuucuuguca

SEQ ID NO: 505231 - RNA, 64 nt, Homo Sapiens
ccccgccaccuguacucacccucacgcucuuugaagaaaaaaaaaaaaaucaccuuguguguug

SEQ ID NO: 505232 - RNA, 64 nt, Homo Sapiens
agacaguuuccuucuggaguuccaaaugcaauauagaaaaaaaaacccugugacucuggauuuu

SEQ ID NO: 505233 - RNA, 64 nt, Homo Sapiens
caagacuccuaccuugagaucuuagucuagguaaagaaaaaaaaaaaaaggucaugaaacacaa

SEQ ID NO: 505234 - RNA, 64 nt, Homo Sapiens
cagccugggugacagagugagauccugucucugaagaaaaaaaaaaccugccuggcaagguccu

SEQ ID NO: 505235 - RNA, 64 nt, Homo Sapiens
uaacaccuccaccagggggaaggcuggcacaaggagaaaaaaaaagcaagcaucagcgaauagu

SEQ ID NO: 505236 - RNA, 64 nt, Homo Sapiens
auuaugcuagagcaauuagacacccauggcgaggagaaaaaagaaccucuacuuaaaccucaca

SEQ ID NO: 505237 - RNA, 64 nt, Homo Sapiens
agcgaggcuaugacuuacuuaucucaauggcuaaagaaaaaauagugaaaauaccaaauacuga

SEQ ID NO: 505238 - RNA, 64 nt, Homo Sapiens
aaauccuguccuaggcuuuuaugagaaaaaaguaagaaaaaaaaaaagagaaaaaagaaaaaaa

SEQ ID NO: 505239 - RNA, 64 nt, Homo Sapiens
aagaaaaaaaaaaauccuguaaagaaaaaaaaugagaaaaaagucuaucuauaaaaaagagaaa

SEQ ID NO: 505240 - RNA, 64 nt, Homo Sapiens
ugagaaaaaaguaagaaaaaaaaaaagagaaaaaagaaaaaaaaaaaauauacuugcuaucuau

SEQ ID NO: 505241 - RNA, 64 nt, Homo Sapiens
aaaaaaaugagaaaaaaguauaucuauaaaaaagagaaaaaagaaugagaaaaaauauacuugc

SEQ ID NO: 505242 - RNA, 64 nt, Homo Sapiens
uacuugcuaucuauaaaaaacauagaguucuaugagaaaaaauagaaagaaguuauagaaucuu

SEQ ID NO: 505243 - RNA, 64 nt, Homo Sapiens
aaaguguuuuuagaaaugcgugagagugaccucuagaaaaaagauauagugauauaucaguguu

SEQ ID NO: 505244 - RNA, 64 nt, Homo Sapiens
cuuuuauugguguuuucacucaaacagacaaacaagaaaaaaaggugaguuuaaacaaaaacca

SEQ ID NO: 505245 - RNA, 64 nt, Homo Sapiens
uuauuaaauguuucucacaucauuuucuuaaaaaagaaaaaaaauuccucaaguuacuuuccuu

SEQ ID NO: 505246 - RNA, 64 nt, Homo Sapiens
ccaugauguacccuccgagauaagcaucgaaaaaagaaaaaaagaaggucaguucaggaaagcu

SEQ ID NO: 505247 - RNA, 64 nt, Homo Sapiens
auucuggcuuuauauuaaauuagaaaaaaggaguagaaaaaacaaaucuuuggucuuaguuuuc

SEQ ID NO: 505248 - RNA, 64 nt, Homo Sapiens
aguagaaaaaacaauucuggggucuuaguuuucuagaaaaaaggacacaauuucuucaaucuuu

SEQ ID NO: 505249 - RNA, 64 nt, Homo Sapiens
auuuuugaaaaagagauuuuaaaauacaccguuuagaaaaaacacauuuuagacauucagacua

SEQ ID NO: 505250 - RNA, 64 nt, Homo Sapiens
aaguacaaguuccaacaugcaucucuguuacaaaagaaaaaagcguaacacuaaucaauacgug

SEQ ID NO: 505251 - RNA, 64 nt, Homo Sapiens
ugauuuagauacuucucccugagguggggauaaaagaaaaaaaaaaacaacuucuuuuuuucuu

SEQ ID NO: 505252 - RNA, 64 nt, Homo Sapiens
aucccucuguuauugucggcaggcggugagggguagaaaaaaaacaaacaaacaaacagaaaaa

SEQ ID NO: 505253 - RNA, 64 nt, Homo Sapiens
cggugagggguagaaaaaaaacaaacaaacaaacagaaaaaaaaaccaaaaaaaaccacccuga

SEQ ID NO: 505254 - RNA, 64 nt, Homo Sapiens
guguggaauguguuguauuuaacaaaaagcaaacagaaaaaaaaguacaaaaaugcagacacuu

SEQ ID NO: 505255 - RNA, 64 nt, Homo Sapiens
agacacaagagagguggcuuagacucucucaaaaagaaaaaagacagccugggcgacaagagcg

SEQ ID NO: 505256 - RNA, 64 nt, Homo Sapiens
cuuuuagggagagaacaauaccuaagauugucugagcuuccaucuuucucauauuuccuaagca

SEQ ID NO: 505257 - RNA, 64 nt, Homo Sapiens
ugagugaguuaguacauauuaauccugguuguugagcuuccagacuaccccguccaaaguuuga

SEQ ID NO: 505258 - RNA, 64 nt, Homo Sapiens
caagaccuguggcuacugguagagaauuggaauaagcuuccaacaauggacuguagagauuaau

SEQ ID NO: 505259 - RNA, 64 nt, Homo Sapiens
augguguaaagccaacucgaggggaaucugaauaagcuuccaaaauuuuuuuuuuuaagaaaua

SEQ ID NO: 505260 - RNA, 64 nt, Homo Sapiens
cacacccagaagaggccuuucccaucuggagagaagcuuccagaccagcccuucacacaccaca

SEQ ID NO: 505261 - RNA, 64 nt, Homo Sapiens
cacagccaggagaggccuuuaccaccuggagagaagcuuccagaccagccccucacaccacagc

SEQ ID NO: 505262 - RNA, 64 nt, Homo Sapiens
cacagccaggagaggccguuccugccuggagagaagcuuccagaccagcccuucacaccacagc

SEQ ID NO: 505263 - RNA, 64 nt, Homo Sapiens
ucuguaguugguuuccuuccugugucccuuugcaagcuuccaggcgaucuaaggugucauuucu

SEQ ID NO: 505264 - RNA, 64 nt, Homo Sapiens
uuuacacuagcuuguguuuugugcuacguauaccagcuuccaaaauuagcaucucauugagcca

SEQ ID NO: 505265 - RNA, 64 nt, Homo Sapiens
auguggugguucugggcaacugaucaaggaaaauagcuuccagacauuuuuuuuuucuuaaaua

SEQ ID NO: 505266 - RNA, 64 nt, Homo Sapiens
ccuuuggaucuuccauguucaagacaccuuccucagcuuccauggucccuguuucccuuguauc

SEQ ID NO: 505267 - RNA, 64 nt, Homo Sapiens
ccuucuccagcccuuggggcugaggggcagggccagcuuccaucccuccagggaauggccucca

SEQ ID NO: 505268 - RNA, 64 nt, Homo Sapiens
uuucuguucagauuggcagugugcacuauuaaaaagcuuccaucucccggcugggcacgguggc

SEQ ID NO: 505269 - RNA, 64 nt, Homo Sapiens
aaacucugucucaaaaauaauaauaauaaaaaaaagcuuccaucucccagcccuucuugcaagc

SEQ ID NO: 505270 - RNA, 64 nt, Homo Sapiens
uaaaaucuuagcgguggaccugggagauuugagaagcuuccagaaacaguuuaaacaagccagc

SEQ ID NO: 505271 - RNA, 64 nt, Homo Sapiens
gugccgcggccggaggaguuuuguuguugguuuuagcuuccaguggcuucuuucugcggggcau

SEQ ID NO: 505272 - RNA, 64 nt, Homo Sapiens
ccccgaggcgugcuuccuuccugauugucucuagagcuuccaaguccugggaaugugcggggcc

SEQ ID NO: 505273 - RNA, 64 nt, Homo Sapiens
cucuggucaggaacccucagggacccaggaacucagcuuccaaacaucugcaccuugaccggac

SEQ ID NO: 505274 - RNA, 64 nt, Homo Sapiens
guuggccccaggaccugaucugaguucugcuggcagcuuccagaggauugccuuuuuugaggac

SEQ ID NO: 505275 - RNA, 64 nt, Homo Sapiens
gaucucaggcgaugcuugugaugaagcauuuuuuagcuuccaccacuuaccaggaacugccugu

SEQ ID NO: 505276 - RNA, 64 nt, Homo Sapiens
agucccagagaugaagcuccccucccagaagugcagcuuccaaaauggccgugcccgaugugca

SEQ ID NO: 505277 - RNA, 64 nt, Homo Sapiens
ggugccugagaugaaacuucagucccugagaugaagcuuccaaaccgaaagugccagagaugaa

SEQ ID NO: 505278 - RNA, 64 nt, Homo Sapiens
agugcccgaggcagcccuucggcuccugaggucaagcuuccaaaccugaagugaagcuccccaa

SEQ ID NO: 505279 - RNA, 64 nt, Homo Sapiens
ggcuagaaauaaaauagccauuuuucuugaaacaagcuuccaaggauguuuaugauaugguguc

SEQ ID NO: 505280 - RNA, 64 nt, Homo Sapiens
uuggcauuuuuucuagaaccgaauuggugccacaagcuuccaagcugcuguuccaucccagcuu

SEQ ID NO: 505281 - RNA, 64 nt, Homo Sapiens
ugggcuacacggagaccggguccugggcacagacagcuuccacccauccucucccugcaguuug

SEQ ID NO: 505282 - RNA, 64 nt, Homo Sapiens
caucucugcccaagcuuccuacccuaugcucuacagcuuccagaccgccuucuauccagccggc

SEQ ID NO: 505283 - RNA, 64 nt, Homo Sapiens
cagaaugcaccagucaucagcuauucaguugguaagcuuccaggaaaaaggacaggcagaaaga

SEQ ID NO: 505284 - RNA, 64 nt, Homo Sapiens
cuugauacuuguuuucaaaccaguauacaagauaagcuuccaggcugcauagaaggaggagagg

SEQ ID NO: 505285 - RNA, 64 nt, Homo Sapiens; identical to SEQ ID NO: 87537

SEQ ID NO: 505286 - RNA, 64 nt, Homo Sapiens; identical to SEQ ID NO: 87538

SEQ ID NO: 505287 - RNA, 64 nt, Homo Sapiens; identical to SEQ ID NO: 87539

SEQ ID NO: 505288 - RNA, 64 nt, Homo Sapiens; identical to SEQ ID NO: 87540

SEQ ID NO: 505289 - RNA, 64 nt, Homo Sapiens; identical to SEQ ID NO: 87541

SEQ ID NO: 505290 - RNA, 64 nt, Homo Sapiens; identical to SEQ ID NO: 87542

SEQ ID NO: 505291 - RNA, 64 nt, Homo Sapiens; identical to SEQ ID NO: 87543

SEQ ID NO: 505292 - RNA, 64 nt, Homo Sapiens; identical to SEQ ID NO: 87544

SEQ ID NO: 505293 - RNA, 64 nt, Homo Sapiens; identical to SEQ ID NO: 87545

SEQ ID NO: 505294 - RNA, 64 nt, Homo Sapiens; identical to SEQ ID NO: 87546

SEQ ID NO: 505295 - RNA, 64 nt, Homo Sapiens; identical to SEQ ID NO: 87547

SEQ ID NO: 505296 - RNA, 64 nt, Homo Sapiens; identical to SEQ ID NO: 87548

SEQ ID NO: 505297 - RNA, 64 nt, Homo Sapiens; identical to SEQ ID NO: 87549

SEQ ID NO: 505298 - RNA, 64 nt, Homo Sapiens; identical to SEQ ID NO: 87550

SEQ ID NO: 505299 - RNA, 64 nt, Homo Sapiens; identical to SEQ ID NO: 87551

SEQ ID NO: 505300 - RNA, 64 nt, Homo Sapiens; identical to SEQ ID NO: 87552

SEQ ID NO: 505301 - RNA, 64 nt, Homo Sapiens; identical to SEQ ID NO: 87553

SEQ ID NO: 505302 - RNA, 64 nt, Homo Sapiens; identical to SEQ ID NO: 87554

SEQ ID NO: 505303 - RNA, 64 nt, Homo Sapiens; identical to SEQ ID NO: 87555

SEQ ID NO: 505304 - RNA, 64 nt, Homo Sapiens; identical to SEQ ID NO: 87556

SEQ ID NO: 505305 - RNA, 64 nt, Homo Sapiens; identical to SEQ ID NO: 87557

SEQ ID NO: 505306 - RNA, 64 nt, Homo Sapiens; identical to SEQ ID NO: 87558

SEQ ID NO: 505307 - RNA, 64 nt, Homo Sapiens; identical to SEQ ID NO: 87559

SEQ ID NO: 505308 - RNA, 64 nt, Homo Sapiens; identical to SEQ ID NO: 87560

SEQ ID NO: 505309 - RNA, 64 nt, Homo Sapiens; identical to SEQ ID NO: 87561

SEQ ID NO: 505310 - RNA, 64 nt, Homo Sapiens; identical to SEQ ID NO: 87562

SEQ ID NO: 505311 - RNA, 64 nt, Homo Sapiens; identical to SEQ ID NO: 87563

SEQ ID NO: 505312 - RNA, 64 nt, Homo Sapiens; identical to SEQ ID NO: 87564

SEQ ID NO: 505313 - RNA, 64 nt, Homo Sapiens; identical to SEQ ID NO: 87565

SEQ ID NO: 505314 - RNA, 64 nt, Homo Sapiens; identical to SEQ ID NO: 87566

SEQ ID NO: 505315 - RNA, 64 nt, Homo Sapiens; identical to SEQ ID NO: 87567

SEQ ID NO: 505316 - RNA, 64 nt, Homo Sapiens; identical to SEQ ID NO: 87568

SEQ ID NO: 505317 - RNA, 64 nt, Homo Sapiens; identical to SEQ ID NO: 87569

SEQ ID NO: 505318 - RNA, 64 nt, Homo Sapiens; identical to SEQ ID NO: 87570

SEQ ID NO: 505319 - RNA, 64 nt, Homo Sapiens; identical to SEQ ID NO: 87571

SEQ ID NO: 505320 - RNA, 64 nt, Homo Sapiens; identical to SEQ ID NO: 87572

SEQ ID NO: 505321 - RNA, 64 nt, Homo Sapiens; identical to SEQ ID NO: 87573

SEQ ID NO: 505322 - RNA, 64 nt, Homo Sapiens; identical to SEQ ID NO: 87574

SEQ ID NO: 505323 - RNA, 64 nt, Homo Sapiens; identical to SEQ ID NO: 87575

SEQ ID NO: 505324 - RNA, 64 nt, Homo Sapiens; identical to SEQ ID NO: 87576

SEQ ID NO: 505325 - RNA, 64 nt, Homo Sapiens; identical to SEQ ID NO: 87577

SEQ ID NO: 505326 - RNA, 64 nt, Homo Sapiens; identical to SEQ ID NO: 87578

SEQ ID NO: 505327 - RNA, 64 nt, Homo Sapiens; identical to SEQ ID NO: 87579

SEQ ID NO: 505328 - RNA, 64 nt, Homo Sapiens; identical to SEQ ID NO: 87580

SEQ ID NO: 505329 - RNA, 62 nt, Homo Sapiens; identical to SEQ ID NO: 87581

SEQ ID NO: 505330 - RNA, 64 nt, Homo Sapiens; identical to SEQ ID NO: 87582

SEQ ID NO: 505331 - RNA, 64 nt, Homo Sapiens; identical to SEQ ID NO: 87583

SEQ ID NO: 505332 - RNA, 64 nt, Homo Sapiens; identical to SEQ ID NO: 87584

SEQ ID NO: 505333 - RNA, 64 nt, Homo Sapiens; identical to SEQ ID NO: 87585

SEQ ID NO: 505334 - RNA, 64 nt, Homo Sapiens; identical to SEQ ID NO: 87586

SEQ ID NO: 505335 - RNA, 64 nt, Homo Sapiens; identical to SEQ ID NO: 87587

SEQ ID NO: 505336 - RNA, 64 nt, Homo Sapiens; identical to SEQ ID NO: 87588

SEQ ID NO: 505337 - RNA, 64 nt, Homo Sapiens; identical to SEQ ID NO: 87589

SEQ ID NO: 505338 - RNA, 64 nt, Homo Sapiens; identical to SEQ ID NO: 87590

SEQ ID NO: 505339 - RNA, 64 nt, Homo Sapiens; identical to SEQ ID NO: 87591

SEQ ID NO: 505340 - RNA, 64 nt, Homo Sapiens; identical to SEQ ID NO: 87592

SEQ ID NO: 505341 - RNA, 64 nt, Homo Sapiens; identical to SEQ ID NO: 87593

SEQ ID NO: 505342 - RNA, 64 nt, Homo Sapiens; identical to SEQ ID NO: 87594

SEQ ID NO: 505343 - RNA, 64 nt, Homo Sapiens; identical to SEQ ID NO: 87595

SEQ ID NO: 505344 - RNA, 64 nt, Homo Sapiens; identical to SEQ ID NO: 87596

SEQ ID NO: 505345 - RNA, 64 nt, Homo Sapiens; identical to SEQ ID NO: 87597

SEQ ID NO: 505346 - RNA, 64 nt, Homo Sapiens; identical to SEQ ID NO: 87598

SEQ ID NO: 505347 - RNA, 50 nt, Homo Sapiens; identical to SEQ ID NO: 87599

SEQ ID NO: 505348 - RNA, 64 nt, Homo Sapiens; identical to SEQ ID NO: 87600

SEQ ID NO: 505349 - RNA, 64 nt, Homo Sapiens; identical to SEQ ID NO: 87601

SEQ ID NO: 505350 - RNA, 64 nt, Homo Sapiens; identical to SEQ ID NO: 87602

SEQ ID NO: 505351 - RNA, 64 nt, Homo Sapiens; identical to SEQ ID NO: 87603

SEQ ID NO: 505352 - RNA, 64 nt, Homo Sapiens; identical to SEQ ID NO: 87604

SEQ ID NO: 505353 - RNA, 64 nt, Homo Sapiens; identical to SEQ ID NO: 87605

SEQ ID NO: 505354 - RNA, 56 nt, Homo Sapiens; identical to SEQ ID NO: 87606

SEQ ID NO: 505355 - RNA, 64 nt, Homo Sapiens; identical to SEQ ID NO: 87607

SEQ ID NO: 505356 - RNA, 64 nt, Homo Sapiens; identical to SEQ ID NO: 87608

SEQ ID NO: 505357 - RNA, 64 nt, Homo Sapiens; identical to SEQ ID NO: 87609

SEQ ID NO: 505358 - RNA, 64 nt, Homo Sapiens; identical to SEQ ID NO: 87610

SEQ ID NO: 505359 - RNA, 64 nt, Homo Sapiens; identical to SEQ ID NO: 87611

SEQ ID NO: 505360 - RNA, 64 nt, Homo Sapiens; identical to SEQ ID NO: 87612

SEQ ID NO: 505361 - RNA, 55 nt, Homo Sapiens; identical to SEQ ID NO: 87613

SEQ ID NO: 505362 - RNA, 64 nt, Homo Sapiens; identical to SEQ ID NO: 87614

SEQ ID NO: 505363 - RNA, 64 nt, Homo Sapiens; identical to SEQ ID NO: 87615

SEQ ID NO: 505364 - RNA, 64 nt, Homo Sapiens; identical to SEQ ID NO: 87616

SEQ ID NO: 505365 - RNA, 64 nt, Homo Sapiens; identical to SEQ ID NO: 87617

SEQ ID NO: 505366 - RNA, 64 nt, Homo Sapiens; identical to SEQ ID NO: 87618

SEQ ID NO: 505367 - RNA, 64 nt, Homo Sapiens; identical to SEQ ID NO: 87619

SEQ ID NO: 505368 - RNA, 64 nt, Homo Sapiens; identical to SEQ ID NO: 87620

SEQ ID NO: 505369 - RNA, 64 nt, Homo Sapiens; identical to SEQ ID NO: 87621

SEQ ID NO: 505370 - RNA, 64 nt, Homo Sapiens; identical to SEQ ID NO: 87622

SEQ ID NO: 505371 - RNA, 64 nt, Homo Sapiens; identical to SEQ ID NO: 87623

SEQ ID NO: 505372 - RNA, 64 nt, Homo Sapiens; identical to SEQ ID NO: 87624

SEQ ID NO: 505373 - RNA, 64 nt, Homo Sapiens; identical to SEQ ID NO: 87625

SEQ ID NO: 505374 - RNA, 64 nt, Homo Sapiens; identical to SEQ ID NO: 87626

SEQ ID NO: 505375 - RNA, 64 nt, Homo Sapiens; identical to SEQ ID NO: 87627

SEQ ID NO: 505376 - RNA, 64 nt, Homo Sapiens; identical to SEQ ID NO: 87628

SEQ ID NO: 505377 - RNA, 64 nt, Homo Sapiens; identical to SEQ ID NO: 87629

SEQ ID NO: 505378 - RNA, 64 nt, Homo Sapiens; identical to SEQ ID NO: 87630

SEQ ID NO: 505379 - RNA, 64 nt, Homo Sapiens; identical to SEQ ID NO: 87631

SEQ ID NO: 505380 - RNA, 64 nt, Homo Sapiens; identical to SEQ ID NO: 87632

SEQ ID NO: 505381 - RNA, 64 nt, Homo Sapiens; identical to SEQ ID NO: 87633

SEQ ID NO: 505382 - RNA, 64 nt, Homo Sapiens; identical to SEQ ID NO: 87634

SEQ ID NO: 505383 - RNA, 64 nt, Homo Sapiens; identical to SEQ ID NO: 87635

SEQ ID NO: 505384 - RNA, 64 nt, Homo Sapiens; identical to SEQ ID NO: 87636

SEQ ID NO: 505385 - RNA, 64 nt, Homo Sapiens; identical to SEQ ID NO: 87637

SEQ ID NO: 505386 - RNA, 64 nt, Homo Sapiens; identical to SEQ ID NO: 87638

SEQ ID NO: 505387 - RNA, 64 nt, Homo Sapiens; identical to SEQ ID NO: 87639

SEQ ID NO: 505388 - RNA, 64 nt, Homo Sapiens; identical to SEQ ID NO: 87640

SEQ ID NO: 505389 - RNA, 64 nt, Homo Sapiens; identical to SEQ ID NO: 87641

SEQ ID NO: 505390 - RNA, 64 nt, Homo Sapiens; identical to SEQ ID NO: 87642

SEQ ID NO: 505391 - RNA, 64 nt, Homo Sapiens; identical to SEQ ID NO: 87643

SEQ ID NO: 505392 - RNA, 64 nt, Homo Sapiens; identical to SEQ ID NO: 87644

SEQ ID NO: 505393 - RNA, 64 nt, Homo Sapiens; identical to SEQ ID NO: 87645

SEQ ID NO: 505394 - RNA, 64 nt, Homo Sapiens; identical to SEQ ID NO: 87646

SEQ ID NO: 505395 - RNA, 64 nt, Homo Sapiens; identical to SEQ ID NO: 87647

SEQ ID NO: 505396 - RNA, 64 nt, Homo Sapiens; identical to SEQ ID NO: 87648

SEQ ID NO: 505397 - RNA, 64 nt, Homo Sapiens; identical to SEQ ID NO: 87649

SEQ ID NO: 505398 - RNA, 64 nt, Homo Sapiens; identical to SEQ ID NO: 87650

SEQ ID NO: 505399 - RNA, 64 nt, Homo Sapiens; identical to SEQ ID NO: 87651

SEQ ID NO: 505400 - RNA, 64 nt, Homo Sapiens; identical to SEQ ID NO: 87652

SEQ ID NO: 505401 - RNA, 64 nt, Homo Sapiens; identical to SEQ ID NO: 87653

SEQ ID NO: 505402 - RNA, 64 nt, Homo Sapiens; identical to SEQ ID NO: 87654

SEQ ID NO: 505403 - RNA, 64 nt, Homo Sapiens; identical to SEQ ID NO: 87655

SEQ ID NO: 505404 - RNA, 64 nt, Homo Sapiens; identical to SEQ ID NO: 87656

SEQ ID NO: 505405 - RNA, 64 nt, Homo Sapiens; identical to SEQ ID NO: 87657

SEQ ID NO: 505406 - RNA, 64 nt, Homo Sapiens; identical to SEQ ID NO: 87658

SEQ ID NO: 505407 - RNA, 64 nt, Homo Sapiens; identical to SEQ ID NO: 87659

SEQ ID NO: 505408 - RNA, 64 nt, Homo Sapiens; identical to SEQ ID NO: 87659

SEQ ID NO: 505409 - RNA, 64 nt, Homo Sapiens; identical to SEQ ID NO: 87661

SEQ ID NO: 505410 - RNA, 64 nt, Homo Sapiens; identical to SEQ ID NO: 87662

SEQ ID NO: 505411 - RNA, 64 nt, Homo Sapiens; identical to SEQ ID NO: 87661

SEQ ID NO: 505412 - RNA, 64 nt, Homo Sapiens; identical to SEQ ID NO: 87659

SEQ ID NO: 505413 - RNA, 64 nt, Homo Sapiens; identical to SEQ ID NO: 87665

SEQ ID NO: 505414 - RNA, 64 nt, Homo Sapiens; identical to SEQ ID NO: 87666

SEQ ID NO: 505415 - RNA, 64 nt, Homo Sapiens; identical to SEQ ID NO: 87667

SEQ ID NO: 505416 - RNA, 64 nt, Homo Sapiens; identical to SEQ ID NO: 87668

SEQ ID NO: 505417 - RNA, 64 nt, Homo Sapiens; identical to SEQ ID NO: 87669

SEQ ID NO: 505418 - RNA, 63 nt, Homo Sapiens; identical to SEQ ID NO: 87670

SEQ ID NO: 505419 - RNA, 64 nt, Homo Sapiens; identical to SEQ ID NO: 87671

SEQ ID NO: 505420 - RNA, 64 nt, Homo Sapiens; identical to SEQ ID NO: 87672

SEQ ID NO: 505421 - RNA, 64 nt, Homo Sapiens; identical to SEQ ID NO: 87673

SEQ ID NO: 505422 - RNA, 64 nt, Homo Sapiens; identical to SEQ ID NO: 87674

SEQ ID NO: 505423 - RNA, 64 nt, Homo Sapiens; identical to SEQ ID NO: 87675

SEQ ID NO: 505424 - RNA, 64 nt, Homo Sapiens; identical to SEQ ID NO: 87676

SEQ ID NO: 505425 - RNA, 64 nt, Homo Sapiens; identical to SEQ ID NO: 87677

SEQ ID NO: 505426 - RNA, 64 nt, Homo Sapiens; identical to SEQ ID NO: 87678

SEQ ID NO: 505427 - RNA, 64 nt, Homo Sapiens; identical to SEQ ID NO: 87679

SEQ ID NO: 505428 - RNA, 64 nt, Homo Sapiens; identical to SEQ ID NO: 87680

SEQ ID NO: 505429 - RNA, 64 nt, Homo Sapiens; identical to SEQ ID NO: 172974

SEQ ID NO: 505430 - RNA, 64 nt, Homo Sapiens; identical to SEQ ID NO: 172975

SEQ ID NO: 505431 - RNA, 64 nt, Homo Sapiens; identical to SEQ ID NO: 172976

SEQ ID NO: 505432 - RNA, 64 nt, Homo Sapiens; identical to SEQ ID NO: 172977

SEQ ID NO: 505433 - RNA, 64 nt, Homo Sapiens; identical to SEQ ID NO: 172978

SEQ ID NO: 505434 - RNA, 64 nt, Homo Sapiens; identical to SEQ ID NO: 172979

SEQ ID NO: 505435 - RNA, 64 nt, Homo Sapiens; identical to SEQ ID NO: 172980

SEQ ID NO: 505436 - RNA, 64 nt, Homo Sapiens; identical to SEQ ID NO: 172981

SEQ ID NO: 505437 - RNA, 64 nt, Homo Sapiens; identical to SEQ ID NO: 172982

SEQ ID NO: 505438 - RNA, 64 nt, Homo Sapiens; identical to SEQ ID NO: 172983

SEQ ID NO: 505439 - RNA, 64 nt, Homo Sapiens; identical to SEQ ID NO: 172984

SEQ ID NO: 505440 - RNA, 64 nt, Homo Sapiens; identical to SEQ ID NO: 172985

SEQ ID NO: 505441 - RNA, 64 nt, Homo Sapiens; identical to SEQ ID NO: 172986

SEQ ID NO: 505442 - RNA, 64 nt, Homo Sapiens; identical to SEQ ID NO: 172987

SEQ ID NO: 505443 - RNA, 64 nt, Homo Sapiens; identical to SEQ ID NO: 172988

SEQ ID NO: 505444 - RNA, 54 nt, Homo Sapiens; identical to SEQ ID NO: 172989

SEQ ID NO: 505445 - RNA, 64 nt, Homo Sapiens; identical to SEQ ID NO: 172990

SEQ ID NO: 505446 - RNA, 64 nt, Homo Sapiens; identical to SEQ ID NO: 172991

SEQ ID NO: 505447 - RNA, 64 nt, Homo Sapiens; identical to SEQ ID NO: 172992

SEQ ID NO: 505448 - RNA, 64 nt, Homo Sapiens; identical to SEQ ID NO: 172993

SEQ ID NO: 505449 - RNA, 64 nt, Homo Sapiens; identical to SEQ ID NO: 172994

SEQ ID NO: 505450 - RNA, 64 nt, Homo Sapiens; identical to SEQ ID NO: 172995

SEQ ID NO: 505451 - RNA, 64 nt, Homo Sapiens; identical to SEQ ID NO: 172996

SEQ ID NO: 505452 - RNA, 64 nt, Homo Sapiens; identical to SEQ ID NO: 172997

SEQ ID NO: 505453 - RNA, 64 nt, Homo Sapiens; identical to SEQ ID NO: 172998

SEQ ID NO: 505454 - RNA, 64 nt, Homo Sapiens; identical to SEQ ID NO: 172999

SEQ ID NO: 505455 - RNA, 64 nt, Homo Sapiens; identical to SEQ ID NO: 173000

SEQ ID NO: 505456 - RNA, 64 nt, Homo Sapiens; identical to SEQ ID NO: 173001

SEQ ID NO: 505457 - RNA, 64 nt, Homo Sapiens; identical to SEQ ID NO: 173002

SEQ ID NO: 505458 - RNA, 64 nt, Homo Sapiens; identical to SEQ ID NO: 173003

SEQ ID NO: 505459 - RNA, 64 nt, Homo Sapiens; identical to SEQ ID NO: 173004

SEQ ID NO: 505460 - RNA, 61 nt, Homo Sapiens; identical to SEQ ID NO: 173005

SEQ ID NO: 505461 - RNA, 64 nt, Homo Sapiens; identical to SEQ ID NO: 173006

SEQ ID NO: 505462 - RNA, 64 nt, Homo Sapiens; identical to SEQ ID NO: 173007

SEQ ID NO: 505463 - RNA, 64 nt, Homo Sapiens; identical to SEQ ID NO: 173008

SEQ ID NO: 505464 - RNA, 64 nt, Homo Sapiens; identical to SEQ ID NO: 173009

SEQ ID NO: 505465 - RNA, 64 nt, Homo Sapiens; identical to SEQ ID NO: 104217

SEQ ID NO: 505466 - RNA, 64 nt, Homo Sapiens; identical to SEQ ID NO: 104218

SEQ ID NO: 505467 - RNA, 64 nt, Homo Sapiens; identical to SEQ ID NO: 104219

SEQ ID NO: 505468 - RNA, 64 nt, Homo Sapiens; identical to SEQ ID NO: 104220

SEQ ID NO: 505469 - RNA, 64 nt, Homo Sapiens; identical to SEQ ID NO: 104221

SEQ ID NO: 505470 - RNA, 64 nt, Homo Sapiens; identical to SEQ ID NO: 104222

SEQ ID NO: 505471 - RNA, 64 nt, Homo Sapiens; identical to SEQ ID NO: 104223

SEQ ID NO: 505472 - RNA, 64 nt, Homo Sapiens; identical to SEQ ID NO: 104224

SEQ ID NO: 505473 - RNA, 64 nt, Homo Sapiens; identical to SEQ ID NO: 104225

SEQ ID NO: 505474 - RNA, 64 nt, Homo Sapiens; identical to SEQ ID NO: 104226

SEQ ID NO: 505475 - RNA, 64 nt, Homo Sapiens; identical to SEQ ID NO: 104227

SEQ ID NO: 505476 - RNA, 64 nt, Homo Sapiens; identical to SEQ ID NO: 104228

SEQ ID NO: 505477 - RNA, 64 nt, Homo Sapiens; identical to SEQ ID NO: 104229

SEQ ID NO: 505478 - RNA, 64 nt, Homo Sapiens; identical to SEQ ID NO: 104230

SEQ ID NO: 505479 - RNA, 64 nt, Homo Sapiens; identical to SEQ ID NO: 104231

SEQ ID NO: 505480 - RNA, 64 nt, Homo Sapiens; identical to SEQ ID NO: 104232

SEQ ID NO: 505481 - RNA, 64 nt, Homo Sapiens; identical to SEQ ID NO: 296587

SEQ ID NO: 505482 - RNA, 64 nt, Homo Sapiens; identical to SEQ ID NO: 296588

SEQ ID NO: 505483 - RNA, 64 nt, Homo Sapiens; identical to SEQ ID NO: 96836

SEQ ID NO: 505484 - RNA, 64 nt, Homo Sapiens; identical to SEQ ID NO: 96837

SEQ ID NO: 505485 - RNA, 64 nt, Homo Sapiens; identical to SEQ ID NO: 96838

SEQ ID NO: 505486 - RNA, 64 nt, Homo Sapiens; identical to SEQ ID NO: 96839

SEQ ID NO: 505487 - RNA, 64 nt, Homo Sapiens; identical to SEQ ID NO: 96840

SEQ ID NO: 505488 - RNA, 64 nt, Homo Sapiens; identical to SEQ ID NO: 96841

SEQ ID NO: 505489 - RNA, 64 nt, Homo Sapiens; identical to SEQ ID NO: 96842

SEQ ID NO: 505490 - RNA, 64 nt, Homo Sapiens; identical to SEQ ID NO: 96843

SEQ ID NO: 505491 - RNA, 64 nt, Homo Sapiens; identical to SEQ ID NO: 96844

SEQ ID NO: 505492 - RNA, 64 nt, Homo Sapiens; identical to SEQ ID NO: 96845

SEQ ID NO: 505493 - RNA, 64 nt, Homo Sapiens; identical to SEQ ID NO: 96846

SEQ ID NO: 505494 - RNA, 64 nt, Homo Sapiens; identical to SEQ ID NO: 96847

SEQ ID NO: 505495 - RNA, 64 nt, Homo Sapiens; identical to SEQ ID NO: 96848

SEQ ID NO: 505496 - RNA, 64 nt, Homo Sapiens; identical to SEQ ID NO: 96849

SEQ ID NO: 505497 - RNA, 64 nt, Homo Sapiens; identical to SEQ ID NO: 96850

SEQ ID NO: 505498 - RNA, 64 nt, Homo Sapiens; identical to SEQ ID NO: 96851

SEQ ID NO: 505499 - RNA, 64 nt, Homo Sapiens; identical to SEQ ID NO: 96852

SEQ ID NO: 505500 - RNA, 64 nt, Homo Sapiens; identical to SEQ ID NO: 96853

SEQ ID NO: 505501 - RNA, 64 nt, Homo Sapiens; identical to SEQ ID NO: 96854

SEQ ID NO: 505502 - RNA, 64 nt, Homo Sapiens; identical to SEQ ID NO: 96855

SEQ ID NO: 505503 - RNA, 64 nt, Homo Sapiens; identical to SEQ ID NO: 96856

SEQ ID NO: 505504 - RNA, 64 nt, Homo Sapiens; identical to SEQ ID NO: 96857

SEQ ID NO: 505505 - RNA, 64 nt, Homo Sapiens; identical to SEQ ID NO: 96858

SEQ ID NO: 505506 - RNA, 64 nt, Homo Sapiens; identical to SEQ ID NO: 96859

SEQ ID NO: 505507 - RNA, 64 nt, Homo Sapiens; identical to SEQ ID NO: 96860

SEQ ID NO: 505508 - RNA, 64 nt, Homo Sapiens; identical to SEQ ID NO: 96861

SEQ ID NO: 505509 - RNA, 64 nt, Homo Sapiens; identical to SEQ ID NO: 96862

SEQ ID NO: 505510 - RNA, 64 nt, Homo Sapiens; identical to SEQ ID NO: 96863

SEQ ID NO: 505511 - RNA, 64 nt, Homo Sapiens; identical to SEQ ID NO: 96864

SEQ ID NO: 505512 - RNA, 64 nt, Homo Sapiens; identical to SEQ ID NO: 96865

SEQ ID NO: 505513 - RNA, 64 nt, Homo Sapiens; identical to SEQ ID NO: 96866

SEQ ID NO: 505514 - RNA, 64 nt, Homo Sapiens; identical to SEQ ID NO: 96867

SEQ ID NO: 505515 - RNA, 64 nt, Homo Sapiens; identical to SEQ ID NO: 96868

SEQ ID NO: 505516 - RNA, 64 nt, Homo Sapiens; identical to SEQ ID NO: 96869

SEQ ID NO: 505517 - RNA, 64 nt, Homo Sapiens; identical to SEQ ID NO: 96870

SEQ ID NO: 505518 - RNA, 64 nt, Homo Sapiens; identical to SEQ ID NO: 96871

SEQ ID NO: 505519 - RNA, 64 nt, Homo Sapiens; identical to SEQ ID NO: 96872

SEQ ID NO: 505520 - RNA, 64 nt, Homo Sapiens; identical to SEQ ID NO: 96873

SEQ ID NO: 505521 - RNA, 64 nt, Homo Sapiens; identical to SEQ ID NO: 96874

SEQ ID NO: 505522 - RNA, 64 nt, Homo Sapiens; identical to SEQ ID NO: 96875

SEQ ID NO: 505523 - RNA, 64 nt, Homo Sapiens; identical to SEQ ID NO: 91745

SEQ ID NO: 505524 - RNA, 64 nt, Homo Sapiens; identical to SEQ ID NO: 91746

SEQ ID NO: 505525 - RNA, 64 nt, Homo Sapiens; identical to SEQ ID NO: 91747

SEQ ID NO: 505526 - RNA, 64 nt, Homo Sapiens; identical to SEQ ID NO: 91748

SEQ ID NO: 505527 - RNA, 64 nt, Homo Sapiens; identical to SEQ ID NO: 91749

SEQ ID NO: 505528 - RNA, 64 nt, Homo Sapiens; identical to SEQ ID NO: 91750

SEQ ID NO: 505529 - RNA, 64 nt, Homo Sapiens; identical to SEQ ID NO: 91751

SEQ ID NO: 505530 - RNA, 64 nt, Homo Sapiens; identical to SEQ ID NO: 91752

SEQ ID NO: 505531 - RNA, 64 nt, Homo Sapiens; identical to SEQ ID NO: 91753

SEQ ID NO: 505532 - RNA, 64 nt, Homo Sapiens; identical to SEQ ID NO: 91754

SEQ ID NO: 505533 - RNA, 64 nt, Homo Sapiens; identical to SEQ ID NO: 91755

SEQ ID NO: 505534 - RNA, 64 nt, Homo Sapiens; identical to SEQ ID NO: 91756

SEQ ID NO: 505535 - RNA, 64 nt, Homo Sapiens; identical to SEQ ID NO: 91757

SEQ ID NO: 505536 - RNA, 64 nt, Homo Sapiens; identical to SEQ ID NO: 91758

SEQ ID NO: 505537 - RNA, 64 nt, Homo Sapiens; identical to SEQ ID NO: 91759

SEQ ID NO: 505538 - RNA, 64 nt, Homo Sapiens; identical to SEQ ID NO: 91760

SEQ ID NO: 505539 - RNA, 64 nt, Homo Sapiens; identical to SEQ ID NO: 91761

SEQ ID NO: 505540 - RNA, 64 nt, Homo Sapiens; identical to SEQ ID NO: 91762

SEQ ID NO: 505541 - RNA, 64 nt, Homo Sapiens; identical to SEQ ID NO: 91763

SEQ ID NO: 505542 - RNA, 64 nt, Homo Sapiens; identical to SEQ ID NO: 91764

SEQ ID NO: 505543 - RNA, 64 nt, Homo Sapiens; identical to SEQ ID NO: 91765

SEQ ID NO: 505544 - RNA, 64 nt, Homo Sapiens; identical to SEQ ID NO: 91766

SEQ ID NO: 505545 - RNA, 64 nt, Homo Sapiens; identical to SEQ ID NO: 91767

SEQ ID NO: 505546 - RNA, 64 nt, Homo Sapiens; identical to SEQ ID NO: 91768

SEQ ID NO: 505547 - RNA, 64 nt, Homo Sapiens; identical to SEQ ID NO: 91769

SEQ ID NO: 505548 - RNA, 64 nt, Homo Sapiens; identical to SEQ ID NO: 91770

SEQ ID NO: 505549 - RNA, 64 nt, Homo Sapiens; identical to SEQ ID NO: 91771

SEQ ID NO: 505550 - RNA, 64 nt, Homo Sapiens; identical to SEQ ID NO: 91772

SEQ ID NO: 505551 - RNA, 64 nt, Homo Sapiens; identical to SEQ ID NO: 91773

SEQ ID NO: 505552 - RNA, 64 nt, Homo Sapiens; identical to SEQ ID NO: 91774

SEQ ID NO: 505553 - RNA, 64 nt, Homo Sapiens; identical to SEQ ID NO: 91775

SEQ ID NO: 505554 - RNA, 64 nt, Homo Sapiens; identical to SEQ ID NO: 91776

SEQ ID NO: 505555 - RNA, 64 nt, Homo Sapiens; identical to SEQ ID NO: 91777

SEQ ID NO: 505556 - RNA, 64 nt, Homo Sapiens; identical to SEQ ID NO: 91778

SEQ ID NO: 505557 - RNA, 64 nt, Homo Sapiens; identical to SEQ ID NO: 91779

SEQ ID NO: 505558 - RNA, 64 nt, Homo Sapiens; identical to SEQ ID NO: 91780

SEQ ID NO: 505559 - RNA, 64 nt, Homo Sapiens; identical to SEQ ID NO: 91781

SEQ ID NO: 505560 - RNA, 64 nt, Homo Sapiens; identical to SEQ ID NO: 91782

SEQ ID NO: 505561 - RNA, 64 nt, Homo Sapiens; identical to SEQ ID NO: 91783

SEQ ID NO: 505562 - RNA, 64 nt, Homo Sapiens; identical to SEQ ID NO: 91784

SEQ ID NO: 505563 - RNA, 64 nt, Homo Sapiens; identical to SEQ ID NO: 91785

SEQ ID NO: 505564 - RNA, 64 nt, Homo Sapiens; identical to SEQ ID NO: 91786

SEQ ID NO: 505565 - RNA, 64 nt, Homo Sapiens; identical to SEQ ID NO: 91787

SEQ ID NO: 505566 - RNA, 64 nt, Homo Sapiens; identical to SEQ ID NO: 91788

SEQ ID NO: 505567 - RNA, 64 nt, Homo Sapiens; identical to SEQ ID NO: 91789

SEQ ID NO: 505568 - RNA, 64 nt, Homo Sapiens; identical to SEQ ID NO: 91790

SEQ ID NO: 505569 - RNA, 64 nt, Homo Sapiens; identical to SEQ ID NO: 91791

SEQ ID NO: 505570 - RNA, 64 nt, Homo Sapiens; identical to SEQ ID NO: 91792

SEQ ID NO: 505571 - RNA, 64 nt, Homo Sapiens; identical to SEQ ID NO: 91793

SEQ ID NO: 505572 - RNA, 64 nt, Homo Sapiens; identical to SEQ ID NO: 91794

SEQ ID NO: 505573 - RNA, 64 nt, Homo Sapiens; identical to SEQ ID NO: 91795

SEQ ID NO: 505574 - RNA, 64 nt, Homo Sapiens; identical to SEQ ID NO: 91796

SEQ ID NO: 505575 - RNA, 64 nt, Homo Sapiens; identical to SEQ ID NO: 91797

SEQ ID NO: 505576 - RNA, 64 nt, Homo Sapiens; identical to SEQ ID NO: 91798

SEQ ID NO: 505577 - RNA, 64 nt, Homo Sapiens; identical to SEQ ID NO: 91799

SEQ ID NO: 505578 - RNA, 64 nt, Homo Sapiens; identical to SEQ ID NO: 91800

SEQ ID NO: 505579 - RNA, 54 nt, Homo Sapiens; identical to SEQ ID NO: 91801

SEQ ID NO: 505580 - RNA, 64 nt, Homo Sapiens
ccagcuaacucuugggcucaggcacccuugcacaggguugcauuucuuuagucuucuguggguc

SEQ ID NO: 505581 - RNA, 64 nt, Homo Sapiens
ugcugccgucaccgccuccugggucguccgccacggguugcacugccguggcagacagcuggac

SEQ ID NO: 505582 - RNA, 64 nt, Homo Sapiens
aguguucuacucagaaaugucucacagcccagcuggguugcaauuccagaaugcugggaguuuu

SEQ ID NO: 505583 - RNA, 64 nt, Homo Sapiens
caaacuaauuuuucacuguugacaagcgaggcaaggguugcacuggaccaaaggcugaggcuug

SEQ ID NO: 505584 - RNA, 64 nt, Homo Sapiens
auuugcugaauacagaggcaacugcauuggcuuuggguugcaggaccucaggugagaagcagag

SEQ ID NO: 505585 - RNA, 64 nt, Homo Sapiens
uguagauauugugaaguacauauuaggaaaauauggguugcauuuggucaagauuuugaaugcu

SEQ ID NO: 505586 - RNA, 64 nt, Homo Sapiens
auccacuggauuaauggguuauuuucagugggcaggguugcacaguguaauccuacaccuuuug

SEQ ID NO: 505587 - RNA, 64 nt, Homo Sapiens
aaaaguuauuuuccagagaauguagcuguuuccaggguugcaacuugaauuaagaccaaacaga

SEQ ID NO: 505588 - RNA, 64 nt, Homo Sapiens
cugcggugccucaggccccugacugcagcccuggggguugcagguauucuguaaaaaguuagug

SEQ ID NO: 505589 - RNA, 64 nt, Homo Sapiens
cacugcaacggcuuagacuugacagaaguaagugggguugcaacggagguuuggaugggaguga

SEQ ID NO: 505590 - RNA, 64 nt, Homo Sapiens
ggagagggacagcccacugaggcuggaggaagggggguugcagugauagugcgauguuucagga

SEQ ID NO: 505591 - RNA, 64 nt, Homo Sapiens
acaaacugcucuugacaaugaaaacuuacuuuguggguugcaauuacuauaaaaaguuaaaaaa

SEQ ID NO: 505592 - RNA, 64 nt, Homo Sapiens
ugaccagcaucuucaaucuacagguggaggaaagggguugcagguagccaugcugacucaugaa

SEQ ID NO: 505593 - RNA, 64 nt, Homo Sapiens
caagcuguuaccaaaaaauuagggguacacuuagggguugcauggaaaaaagccaaaggguuau

SEQ ID NO: 505594 - RNA, 64 nt, Homo Sapiens
gcugcaaagugacaacugcagaagaagugccucgggguugcaggacaaaguguucuuccucaug

SEQ ID NO: 505595 - RNA, 64 nt, Homo Sapiens
gcccgcuguggagguaagauugccacaugucugaggguugcagauugaggcucagggagagauc

SEQ ID NO: 505596 - RNA, 64 nt, Homo Sapiens
uuuggacuuaccuaacaagaguauaaauugacuuggguugcaagcacugagcacuguuacuucu

SEQ ID NO: 505597 - RNA, 64 nt, Homo Sapiens
gcagcacuucgaucacugugagagaacucaaaguggguugcaaucauuccuaacacaggcugaa

SEQ ID NO: 505598 - RNA, 64 nt, Homo Sapiens
accagguaggagcuuuccuguuucauauguuucaggguugcacaguuggucucuuuaaugucgg

SEQ ID NO: 505599 - RNA, 64 nt, Homo Sapiens
gaggcagcagaauugcuugaacccaggaggcagaggguugcagugagccgagauagcaccauug

SEQ ID NO: 505600 - RNA, 64 nt, Homo Sapiens
acggaaacucccgaacuacagaccccucccugguggguugcaugaaugugucucauuacugcug

SEQ ID NO: 505601 - RNA, 64 nt, Homo Sapiens
uucuucauggguuuauguuuauuugaagagugguggguugcauugggauuuuuaaaugucauaa

SEQ ID NO: 505602 - RNA, 64 nt, Homo Sapiens
aacagcacccaggacucugacacccaucacugguggguugcaggcuggcuagucaggguggcuu

SEQ ID NO: 505603 - RNA, 64 nt, Homo Sapiens
auagaaaugagcuuaauccagaaaaugggggaauggguugcaaaggauuugagaggaaagagag

SEQ ID NO: 505604 - RNA, 64 nt, Homo Sapiens
uaaaaugugauuggcuuagguugcccuuaaaauaggguugcaauuaaccauuuacugucuggcu

SEQ ID NO: 505605 - RNA, 64 nt, Homo Sapiens
uguuuaguuuuaaaaauucagaggacgugguacaggguugcagaugcucccugccgagaaagug

SEQ ID NO: 505606 - RNA, 64 nt, Homo Sapiens
auauauacauauaugcauauuugcacuuccagauggguugcauaagaaucagguccuuaaauac

SEQ ID NO: 505607 - RNA, 64 nt, Homo Sapiens
cugaugagaauuuauaaauuauuaugacaccuuuggguugcaaucuggggauacuggcaaagca

SEQ ID NO: 505608 - RNA, 64 nt, Homo Sapiens
aaagugaaggaauaaacauaacuuaccugagcuaggguugcagcagaaauugaguugcagcuug

SEQ ID NO: 505609 - RNA, 64 nt, Homo Sapiens
uucuaagugaaacuguauuuuaacauuacuuggaggguugcagucauuaauaccuaaguaaaca

SEQ ID NO: 505610 - RNA, 64 nt, Homo Sapiens
cuggauguuuuaugauagcccagacacuuccccuggguugcaucauaaaaacagcucggcccaa

SEQ ID NO: 505611 - RNA, 64 nt, Homo Sapiens
aagcccuggauucagaguguagucaccuagcauaggguugcagcaaugagaggagagaggccug

SEQ ID NO: 505612 - RNA, 64 nt, Homo Sapiens
ggcuccugcccugcuguaucaagaccuguaccugggguugcaggaagccgguguccagggacuc

SEQ ID NO: 505613 - RNA, 64 nt, Homo Sapiens
aucauuuuuucccuuaauacuaagucccaacuugggguugcaaaaccauaaggauuucuuaugu

SEQ ID NO: 505614 - RNA, 64 nt, Homo Sapiens
ccgggcaauccaugagccugugcugagccccaguggguugcaccuccaccggcagucagcgagc

SEQ ID NO: 505615 - RNA, 64 nt, Homo Sapiens
ugaagauaauauuaauaaugauggaaggaagacuggguugcagggacuguggucucuccugggg

SEQ ID NO: 505616 - RNA, 64 nt, Homo Sapiens
acaucacacacaagguuuccacuucacacuuggaggguugcauggcggcugggcaaaggugcuc

SEQ ID NO: 505617 - RNA, 64 nt, Homo Sapiens
auuuucucuuaaucguuuauuauacugggcauugggguugcaagauaaugcacaguccgagcuc

SEQ ID NO: 505618 - RNA, 64 nt, Homo Sapiens
gacaaggggggcaaaugaaaaguauucuagagacggguugcaauaugcuaguuucaauuaccac

SEQ ID NO: 505619 - RNA, 64 nt, Homo Sapiens
gcuaucccgccccccacccuauucucuuaaauuuggguugcaaagcugcuuuguuuuccuccug

SEQ ID NO: 505620 - RNA, 64 nt, Homo Sapiens
aacgcccuuccuccagacccugacaccugagcugggguugcaaagucacuggccacauccagcc

SEQ ID NO: 505621 - RNA, 64 nt, Homo Sapiens
caaacaauaugaacuccuuuuucguauugccaucggguugcauggaaguuuuauucucuuguuu

SEQ ID NO: 505622 - RNA, 64 nt, Homo Sapiens
uagauaagaaaacguagcuucagugggggcuccaggguugcagaguaugagugacacagaccgg

SEQ ID NO: 505623 - RNA, 64 nt, Homo Sapiens
cacauuccuggguacccagucugugaacaugccaggguugcauuaugcaagggcauaauguuag

SEQ ID NO: 505624 - RNA, 64 nt, Homo Sapiens
gacuuuuuuacuagagaauuuuauuuuguagcauggguugcaucuuuauauggcuuucucacuu

SEQ ID NO: 505625 - RNA, 64 nt, Homo Sapiens
gacucccaagggccaaaagacggcauuuguauugggguugcaaugccacuggaaaucccugggc

SEQ ID NO: 505626 - RNA, 64 nt, Homo Sapiens
uaguaagaaauugugauuuauugcuugaaccaaaggguugcaugguucaagugagggaugaugg

SEQ ID NO: 505627 - RNA, 64 nt, Homo Sapiens
uuccugcugcucgcuuuguuuuuaaaaguaacuuggguugcauucuucccucuggacuagagua

SEQ ID NO: 505628 - RNA, 64 nt, Homo Sapiens
uuaucagggcugccuaacagaccaggagaucuggggguugcaccagggaaucgccauauuugac

SEQ ID NO: 505629 - RNA, 64 nt, Homo Sapiens
uaaguuaacguuaggauaggaauugguguugaggggguugcaagaauauuuuauuuuaauuuuu

SEQ ID NO: 505630 - RNA, 64 nt, Homo Sapiens
cuauuuugaaaaaagaguuuuuuuucuuucuaugggguugcagggaugguguacaacagguccu

SEQ ID NO: 505631 - RNA, 64 nt, Homo Sapiens
caaauguuuaaaaauaccucaggcuauacugaaaggguugcaguuugguuaggaguggaaauau

SEQ ID NO: 505632 - RNA, 64 nt, Homo Sapiens
ccucauggucaggugcuggugaggacccugaucuggguugcagacugcugacuucuuauugugu

SEQ ID NO: 505633 - RNA, 64 nt, Homo Sapiens
caugugggggugcacaggcgccugcaggggugcaggguugcacgaaaagucccgugggaagggu

SEQ ID NO: 505634 - RNA, 64 nt, Homo Sapiens
gguuaugauuauuucaacaccuucugaguaaacaggguugcaaauaggguggaaugaggaacau

SEQ ID NO: 505635 - RNA, 64 nt, Homo Sapiens
aucuuagagauagaaaguacagagugucuuucaaggguugcagguauucaugaaacugucaaau

SEQ ID NO: 505636 - RNA, 64 nt, Homo Sapiens
ucagaacuaaaauucuaagcccuaccaaaccuguggguugcaaaccaauucuugcaaccacugc

SEQ ID NO: 505637 - RNA, 64 nt, Homo Sapiens
gcccucuuuauuguucguguauuucucaucgacaggguugcacagcuuuuuuuccagauauaug

SEQ ID NO: 505638 - RNA, 64 nt, Homo Sapiens
ucagcuucaucuccuuggcaguugagugcaacugggguugcacucguucaguaaagaacccaag

SEQ ID NO: 505639 - RNA, 64 nt, Homo Sapiens
ugugugaaggggccggcuucucuuggugccugcuggguugcaggggcaggaagcguguggacug

SEQ ID NO: 505640 - RNA, 64 nt, Homo Sapiens
cugccaaugcaacagcccuggaagaaacccuagaggguugcauagucuagaaaggagugugacc

SEQ ID NO: 505641 - RNA, 64 nt, Homo Sapiens
ccuccuucugggcuaacuccugaaggcuaauuaaggguugcaguaacuugaagcccugccuccc

SEQ ID NO: 505642 - RNA, 64 nt, Homo Sapiens
ugcuuucuuuguaauaaguacuuaccccucucuaggguugcaguugacuauugcccagagaagg

SEQ ID NO: 505643 - RNA, 64 nt, Homo Sapiens
ccaacaaauauuaaauggcuuucccucagacauuggguugcaccggugacgacuuaaaucuggg

SEQ ID NO: 505644 - RNA, 64 nt, Homo Sapiens
gacuuccuuccucaagaauacagucuauucugggggguugcaggacagcugaaaaagaaaacgu

SEQ ID NO: 505645 - RNA, 64 nt, Homo Sapiens
uaauguacauuguaaucuuuuaaaagaaaaaucaggguugcacuugcaacuuuuaaaaaaccga

SEQ ID NO: 505646 - RNA, 64 nt, Homo Sapiens
gaugggggagacucaagucuauguaccugcagugggguugcagaugucacaaacugccacuacu

SEQ ID NO: 505647 - RNA, 64 nt, Homo Sapiens
aauaauucaucaaguaaucaguguauucucauugggguugcaacuuuuuuuuuuuuuuguuccu

SEQ ID NO: 505648 - RNA, 64 nt, Homo Sapiens
acaggaagaaaggaaaaggacgcccaggacaaguggguugcaaguguacuggguacacaguagg

SEQ ID NO: 505649 - RNA, 64 nt, Homo Sapiens
augacaagauuauaaugcuuuuggcuuaggugcaggguugcaaagggaucagaaaaaaaaaauc

SEQ ID NO: 505650 - RNA, 64 nt, Homo Sapiens
gguccccuugagggccaucacacccagacccaacggguugcagccuccugagcaggccuaggca

SEQ ID NO: 505651 - RNA, 64 nt, Homo Sapiens
cugaggcacgagaaucacuugaacccaggaagcgggguugcagugagccaaagguacaccacua

SEQ ID NO: 505652 - RNA, 64 nt, Homo Sapiens
auuccuuugaguguuugauuucccagucauaagaggguugcaugguaaguggcacaugacggua

SEQ ID NO: 505653 - RNA, 64 nt, Homo Sapiens
agcuccacccauggccaacaaacauggugauggaggguugcaucaguggccuuugcucucaggg

SEQ ID NO: 505654 - RNA, 64 nt, Homo Sapiens
caggaaucuuaagguguagcuuuggugagaaccuggguugcagacuggcuucuggccaggaagc

SEQ ID NO: 505655 - RNA, 64 nt, Homo Sapiens
aucaggacuggugcugcuuccagagacuuccuugggguugcaaccuggggaagccacaucccac

SEQ ID NO: 505656 - RNA, 64 nt, Homo Sapiens
uuaugaguugguuuuugcaauugaguuucccucuggguugcauugagggcuucuccuagcaccc

SEQ ID NO: 505657 - RNA, 64 nt, Homo Sapiens
cuuuauacguuacguacccaaggacauugccucaggguugcaaacucuuuaaaggaaaauuuau

SEQ ID NO: 505658 - RNA, 64 nt, Homo Sapiens
uuauaagaaauuaaccuucuuuucuuuuugccaaggguugcaugugaauuauaccuuucuuaau

SEQ ID NO: 505659 - RNA, 64 nt, Homo Sapiens
gccgacuuccuggcugcuucaccuuugcauagcuggguugcagcugcgaaccucauucugacug

SEQ ID NO: 505660 - RNA, 64 nt, Homo Sapiens
uagaaauuaugccuucauucucuuacauuuguguggguugcaagagggggagauuauucuggaa

SEQ ID NO: 505661 - RNA, 64 nt, Homo Sapiens
uggagcuucgggggccacagggcacguggccccuggguugcacccuacacggaggaacugcugc

SEQ ID NO: 505662 - RNA, 64 nt, Homo Sapiens
cuaccuauggggccuggguuuguucuucugccuuggguugcacccugcuggccacagaggcucc

SEQ ID NO: 505663 - RNA, 64 nt, Homo Sapiens
cggaggucaggucuuccucuguggguggggugauggguugcagagggggcuuuuguuaguaagg

SEQ ID NO: 505664 - RNA, 64 nt, Homo Sapiens
cugcccccuuccugccagacacaccugcccuuggggguugcaggcuggagcaucuggcagcccc

SEQ ID NO: 505665 - RNA, 64 nt, Homo Sapiens
ucacacccuuaaccuuuaagccaguuagaucaggggguugcaacaauuggguuaaacuuugggu

SEQ ID NO: 505666 - RNA, 64 nt, Homo Sapiens
gagagagccagagggccuccuuggugguaaaagaggguugcauuucuugcagccagaaggcaga

SEQ ID NO: 505667 - RNA, 64 nt, Homo Sapiens
acuugaagguggcuacaaagaugacuguggacguggguugcacuggccacccaaggaugucugc

SEQ ID NO: 505668 - RNA, 64 nt, Homo Sapiens
gagcggagaucgcaucauugaacccgggacgcagggguugcaguugaggcgggagaaucaugug

SEQ ID NO: 505669 - RNA, 64 nt, Homo Sapiens
accgagacccacauccucuccugggaggcauuugggguugcaggccacccagacccgcguccac

SEQ ID NO: 505670 - RNA, 64 nt, Homo Sapiens
gaaaagacaaauccucaaagugucggcggcgcugggguugcaggaguccugggccuguaaugaa

SEQ ID NO: 505671 - RNA, 64 nt, Homo Sapiens
cuugucucuugcaguuuaagaaauguuaaccuucggguugcaacguagccagucauaaauacau

SEQ ID NO: 505672 - RNA, 64 nt, Homo Sapiens
ugaggcacgagaaucacuugaagccgggagguggggguugcagugagccgagaucacaccacug

SEQ ID NO: 505673 - RNA, 64 nt, Homo Sapiens
gggaagcaaugcugggcagcguuuuugccauugaggguugcagaauuugcucuuuuugggaugg

SEQ ID NO: 505674 - RNA, 64 nt, Homo Sapiens
gaccacagguuggcacuguguggucuuucacaucggguugcacuguccaugaaauagaaacacu

SEQ ID NO: 505675 - RNA, 64 nt, Homo Sapiens
gugcccugccugccagcaccuaggacuucgaguuggguugcagcuuaugacaugcaugauaggu

SEQ ID NO: 505676 - RNA, 64 nt, Homo Sapiens
uggcccugggggaguuacuaugccucagacuuggggguugcaugacuggcagaaguaauaguug

SEQ ID NO: 505677 - RNA, 64 nt, Homo Sapiens
caaagauaacauauauauccggcggacuugggggggguugcauauuggaucauuuuuuacuggg

SEQ ID NO: 505678 - RNA, 64 nt, Homo Sapiens
ggccuugagugccacccccagggaagaacauaaaggguugcacaaugccacccauccacuccuu

SEQ ID NO: 505679 - RNA, 64 nt, Homo Sapiens
ucaagggugucaguaggaaucaaaaguuggggguggguugcaaaauguucuuucaguuuuuaga

SEQ ID NO: 505680 - RNA, 64 nt, Homo Sapiens
ucgacugcugcggguccaguguccgccaucuucaggguugcacagaauccuccaagauacuuug

SEQ ID NO: 505681 - RNA, 64 nt, Homo Sapiens
uuccagcaugguauuauuaagggauuuaaaguuuggguugcaugccuguaaucccagcauuuug

SEQ ID NO: 505682 - RNA, 64 nt, Homo Sapiens
guuucgaggggcgugugcuggaccccaccacuguggguugcaggcccaaugcagaagaguauua

SEQ ID NO: 505683 - RNA, 64 nt, Homo Sapiens
ucccaccucaguuuaguuuuugggagguggaggaggguugcagcaaguguggugacacagugaa

SEQ ID NO: 505684 - RNA, 64 nt, Homo Sapiens
acuguaauaaauggaucucuggggugggcagucgggguugcaggacagaggcaagaauccccaa

SEQ ID NO: 505685 - RNA, 64 nt, Homo Sapiens
cccgacacggcuuuaggaagcuggaucgaagggcggguugcaguuaaguggggcccggccccag

SEQ ID NO: 505686 - RNA, 64 nt, Homo Sapiens
gcagcuuaaauuuuuuuuaucuuuuagcaaaggaggguugcagagagugguguaauguaucuaa

SEQ ID NO: 505687 - RNA, 64 nt, Homo Sapiens
acagcauguaacauaacacuaaggggaaaagggaggguugcauaaaagauauccaaaacaaauu

SEQ ID NO: 505688 - RNA, 64 nt, Homo Sapiens
auuagugucccccuuugacaaaugacagaacugaggguugcaauggggaaaugacuuauaaagu

SEQ ID NO: 505689 - RNA, 64 nt, Homo Sapiens
acugaagacaaaaacugcccuagccagguacugaggguugcaugaaucugcaggagacagagau

SEQ ID NO: 505690 - RNA, 64 nt, Homo Sapiens
cggcuugcggggggguuuguacuucucugcgaauggguugcagugcucagcauugcgggucucu

SEQ ID NO: 505691 - RNA, 64 nt, Homo Sapiens
uugcauacaggagccuuuacaagaugauuauacaggguugcagauugggugacugaccagacuu

SEQ ID NO: 505692 - RNA, 64 nt, Homo Sapiens
ugcuuucuucucucucuccugucucggcuguuguggguugcagguugggugcugcuguuguggu

SEQ ID NO: 505693 - RNA, 64 nt, Homo Sapiens
uguccauguauaaacuugaagugguuguguuguaggguugcagguuuuuuguuacgcugcuguc

SEQ ID NO: 505694 - RNA, 64 nt, Homo Sapiens
agcugacuccugauuuaaccgcuggcguaaccgcggguugcacgcaugcgugcugaaaagccuu

SEQ ID NO: 505695 - RNA, 50 nt, Homo Sapiens
cacauauauuuuugaggcugggguugcagaagaaacggcagagagacuga

SEQ ID NO: 505696 - RNA, 64 nt, Homo Sapiens
uauauaaaugcccuaaacuuaccagggguuuauuggguugcagaauuugggggagcugcauggu

SEQ ID NO: 505697 - RNA, 64 nt, Homo Sapiens
gccccggguuugagcagaacgggcccagugcccuggguugcagacucaguagcguuuuagucgu

SEQ ID NO: 505698 - RNA, 64 nt, Homo Sapiens
uuuguuggggauuaguuucaugcugcacauaaugggguugcacuggucugacccaggacuuugg

SEQ ID NO: 505699 - RNA, 64 nt, Homo Sapiens
cagaguuaaagcagugacuggaggguggacugggggguugcagcaucuuuagaccuagaucugu

SEQ ID NO: 505700 - RNA, 64 nt, Homo Sapiens
auggggugagcuuugaagugcuggugguccagagggguugcagauacgugacuuggagcacccg

SEQ ID NO: 505701 - RNA, 64 nt, Homo Sapiens
ccugugugcgggcagcagcugugugcgggccuggggguugcaugugucaccuggagcugggcac

SEQ ID NO: 505702 - RNA, 64 nt, Homo Sapiens
cuguugauauggaagggagucucccacaccagcuggguugcacaucaaugaguaguuucauccu

SEQ ID NO: 505703 - RNA, 64 nt, Homo Sapiens
gcaacaguacagucgcgcuuuccagggggagcugggguugcaggguuauucuuguccuuagucc

SEQ ID NO: 505704 - RNA, 64 nt, Homo Sapiens
aggaggagcugggcagggccgcuuacugagcaguggguugcaggagacuggguaagggagcagg

SEQ ID NO: 505705 - RNA, 64 nt, Homo Sapiens
aucuugcucgggcccuagcuguugggguucucauggguugcacugaccauacugcuuacgucuu

SEQ ID NO: 505706 - RNA, 64 nt, Homo Sapiens
gaaauggaacccccguuguacagggguuggguggggguugcaggacuccacucacaagccuccu

SEQ ID NO: 505707 - RNA, 64 nt, Homo Sapiens
ucugccuuaauaauucccacggccacaggcaaggggguugcaguggccgccugcaccuuggaug

SEQ ID NO: 505708 - RNA, 64 nt, Homo Sapiens
gaagcaaauggaaaacaaacaaaaaaagaggcagggguugcaauccuagucucugauaaaacag

SEQ ID NO: 505709 - RNA, 64 nt, Homo Sapiens
ucccugcccagcgagucuuccagaaggggugaaaggguugcaggucccgaccacugacccuucc

SEQ ID NO: 505710 - RNA, 64 nt, Homo Sapiens
accuccgauaagcaaaaaaguccucacauucaauggguugcauacccaugaauucuaaaacuuc

SEQ ID NO: 505711 - RNA, 64 nt, Homo Sapiens
ccagcaccugguaggcuccacacaccgggcagcgggguugcaaccuaaaucuagacuugggguc

SEQ ID NO: 505712 - RNA, 64 nt, Homo Sapiens
gagccaagaugcacugcaccagcccaagggguggggguugcaguugaggugggaagaucucuug

SEQ ID NO: 505713 - RNA, 64 nt, Homo Sapiens
ggaggggaggaagaaaguuguccccgcucagccuggguugcacuauuggccuguggagucucca

SEQ ID NO: 505714 - RNA, 64 nt, Homo Sapiens
ccaccacaauaaagcaaauaagauauuguggauuggguugcagcaaaguacagccauaccucaa

SEQ ID NO: 505715 - RNA, 64 nt, Homo Sapiens
ugaaagcagagagaccagugcagggcuguuaacaggguugcaggcgagagacuggggugcuggg

SEQ ID NO: 505716 - RNA, 64 nt, Homo Sapiens
uuuaccucuuucccucagauggggagccaugacuggguugcaccucaggauacuguaauuugac

SEQ ID NO: 505717 - RNA, 64 nt, Homo Sapiens
cggccugcugcuuaagguggcacccucggaugauggguugcagccuccugcagcaaagggcaac

SEQ ID NO: 505718 - RNA, 64 nt, Homo Sapiens
cacauugcaggucagcuucuacugaaggaucacuggguugcagagauccagagauccccaucga

SEQ ID NO: 505719 - RNA, 64 nt, Homo Sapiens
ggaagaaugucacagggaacuuuuucugugagcuggguugcacaacagagacaaagaggagcuc

SEQ ID NO: 505720 - RNA, 64 nt, Homo Sapiens
gcuauggcuuuggacaacguggcuucggccccugggguugcagagcuugcauuggguuuaccuc

SEQ ID NO: 505721 - RNA, 64 nt, Homo Sapiens
cucaccucuaggaacugagcccaaggaaauagcgggguugcaggcagacauugagcugcgagac

SEQ ID NO: 505722 - RNA, 64 nt, Homo Sapiens
gagucugcagaggccgcgacuuuguaaggcccagggguugcacugugcaccucugagugucccu

SEQ ID NO: 505723 - RNA, 50 nt, Homo Sapiens
ccagcgcucccaccuagaugggguugcaccgcgccugcagccuccucuag

SEQ ID NO: 505724 - RNA, 64 nt, Homo Sapiens
ccacgccgcuuacucucagccuguacgcaucugcggguugcagccauauuuggcauuuucaguu

SEQ ID NO: 505725 - RNA, 64 nt, Homo Sapiens
gaaaagaauucuaaugaccagccgugaauguguaggguugcagcucuauucuccaaaacuguag

SEQ ID NO: 505726 - RNA, 64 nt, Homo Sapiens
auaugggugaugaagaaaacugcacaaaauuaagggguugcagaaucacgggagcauaauaauu

SEQ ID NO: 505727 - RNA, 64 nt, Homo Sapiens
aggaguccccuuucccugucccagccccaucuguggguugcacuuacaaacccccacccaccuu

SEQ ID NO: 505728 - RNA, 64 nt, Homo Sapiens
gagaguggcuuaaguggaaugcuucaggggugguggguugcaaguggggggagcuuugccaaca

SEQ ID NO: 505729 - RNA, 64 nt, Homo Sapiens
ggacuauggauugggccucugccucugugccuauggguugcacuucuuccucuguucccacacu

SEQ ID NO: 505730 - RNA, 64 nt, Homo Sapiens
uuucauguauuccaguuuguuuauuacuuauuugggguugcaucagaaaugucuggagaauaau

SEQ ID NO: 505731 - RNA, 64 nt, Homo Sapiens
uuuguugcaauguuuauuccuaaugauuuugauuggguugcauugagggaguaauaguuauuac

SEQ ID NO: 505732 - RNA, 64 nt, Homo Sapiens
gaggcagggauaucauggguagcccucacccugaggguugcagguuuuccaggcucuggagaga

SEQ ID NO: 505733 - RNA, 64 nt, Homo Sapiens
uguccuugaagagagugaggguucccauccacauggguugcagacuuuucccugcauucaccug

SEQ ID NO: 505734 - RNA, 64 nt, Homo Sapiens
acugagccuugguaaaccuggaacuuuacaaccuggguugcagaugcacagaugcugcuuugga

SEQ ID NO: 505735 - RNA, 64 nt, Homo Sapiens
gaaaagaauucuaaugaccugccuugaaugcaugggguugcagcucuguucaaacacaauucua

SEQ ID NO: 505736 - RNA, 64 nt, Homo Sapiens; identical to SEQ ID NO: 262404

SEQ ID NO: 505737 - RNA, 64 nt, Homo Sapiens; identical to SEQ ID NO: 262405

SEQ ID NO: 505738 - RNA, 64 nt, Homo Sapiens; identical to SEQ ID NO: 262406

SEQ ID NO: 505739 - RNA, 64 nt, Homo Sapiens; identical to SEQ ID NO: 262407

SEQ ID NO: 505740 - RNA, 64 nt, Homo Sapiens; identical to SEQ ID NO: 262408

SEQ ID NO: 505741 - RNA, 64 nt, Homo Sapiens; identical to SEQ ID NO: 262409

SEQ ID NO: 505742 - RNA, 64 nt, Homo Sapiens; identical to SEQ ID NO: 262410

SEQ ID NO: 505743 - RNA, 64 nt, Homo Sapiens; identical to SEQ ID NO: 262411

SEQ ID NO: 505744 - RNA, 64 nt, Homo Sapiens; identical to SEQ ID NO: 262412

SEQ ID NO: 505745 - RNA, 64 nt, Homo Sapiens; identical to SEQ ID NO: 262413

SEQ ID NO: 505746 - RNA, 64 nt, Homo Sapiens; identical to SEQ ID NO: 262414

SEQ ID NO: 505747 - RNA, 64 nt, Homo Sapiens; identical to SEQ ID NO: 262415

SEQ ID NO: 505748 - RNA, 64 nt, Homo Sapiens; identical to SEQ ID NO: 262416

SEQ ID NO: 505749 - RNA, 64 nt, Homo Sapiens; identical to SEQ ID NO: 262417

SEQ ID NO: 505750 - RNA, 64 nt, Homo Sapiens; identical to SEQ ID NO: 262418

SEQ ID NO: 505751 - RNA, 64 nt, Homo Sapiens; identical to SEQ ID NO: 262419

SEQ ID NO: 505752 - RNA, 64 nt, Homo Sapiens; identical to SEQ ID NO: 262420

SEQ ID NO: 505753 - RNA, 64 nt, Homo Sapiens; identical to SEQ ID NO: 262421

SEQ ID NO: 505754 - RNA, 64 nt, Homo Sapiens; identical to SEQ ID NO: 262422

SEQ ID NO: 505755 - RNA, 64 nt, Homo Sapiens; identical to SEQ ID NO: 262423

SEQ ID NO: 505756 - RNA, 64 nt, Homo Sapiens
aaauaccgucaccuguuacagguguacuuucuuaaugacugaaagauaaguggguagcaccguc

SEQ ID NO: 505757 - RNA, 64 nt, Homo Sapiens
ucagccccugggugggguggggugguucaaauggaugacugaucuccugaguacacugaagcca

SEQ ID NO: 505758 - RNA, 64 nt, Homo Sapiens
cacaaauuuuaaugauuaaacugugcuugauuucaugacugaugcacagaucaugacuuuuuga

SEQ ID NO: 505759 - RNA, 64 nt, Homo Sapiens
gaauauuuuguugggcagucaauucagaucaugaaugacugacauaauagaucucauacaccag

SEQ ID NO: 505760 - RNA, 64 nt, Homo Sapiens
uucauuccauuuaauuggggaauugaauugcuaaaugacugacacggaauuuugaaucagcauu

SEQ ID NO: 505761 - RNA, 64 nt, Homo Sapiens
ugugauuaggaaguugugauuacuuuucauucucaugacugaacaauuagugcaauuuccugcu

SEQ ID NO: 505762 - RNA, 64 nt, Homo Sapiens
gauuuuaugaagggaguuuauguuacuucagcauaugacugacucaagaguaucaucuugauag

SEQ ID NO: 505763 - RNA, 64 nt, Homo Sapiens
cuauuuuaagaucuaaauuaaucuaaaauugaagaugacugaaugaaauucccucucuccaauc

SEQ ID NO: 505764 - RNA, 64 nt, Homo Sapiens; identical to SEQ ID NO: 165047

SEQ ID NO: 505765 - RNA, 64 nt, Homo Sapiens; identical to SEQ ID NO: 165048

SEQ ID NO: 505766 - RNA, 64 nt, Homo Sapiens; identical to SEQ ID NO: 165049

SEQ ID NO: 505767 - RNA, 64 nt, Homo Sapiens; identical to SEQ ID NO: 165050

SEQ ID NO: 505768 - RNA, 64 nt, Homo Sapiens; identical to SEQ ID NO: 165051

SEQ ID NO: 505769 - RNA, 64 nt, Homo Sapiens; identical to SEQ ID NO: 165052

SEQ ID NO: 505770 - RNA, 64 nt, Homo Sapiens; identical to SEQ ID NO: 165053

SEQ ID NO: 505771 - RNA, 64 nt, Homo Sapiens; identical to SEQ ID NO: 165054

SEQ ID NO: 505772 - RNA, 64 nt, Homo Sapiens; identical to SEQ ID NO: 165055

SEQ ID NO: 505773 - RNA, 64 nt, Homo Sapiens; identical to SEQ ID NO: 165056

SEQ ID NO: 505774 - RNA, 64 nt, Homo Sapiens; identical to SEQ ID NO: 165057

SEQ ID NO: 505775 - RNA, 64 nt, Homo Sapiens; identical to SEQ ID NO: 165058

SEQ ID NO: 505776 - RNA, 64 nt, Homo Sapiens; identical to SEQ ID NO: 165059

SEQ ID NO: 505777 - RNA, 64 nt, Homo Sapiens; identical to SEQ ID NO: 165060

SEQ ID NO: 505778 - RNA, 64 nt, Homo Sapiens; identical to SEQ ID NO: 165061

SEQ ID NO: 505779 - RNA, 64 nt, Homo Sapiens; identical to SEQ ID NO: 165062

SEQ ID NO: 505780 - RNA, 61 nt, Homo Sapiens
gcauugugaagaggaggaaaagugaaucacggagagagaaaggaaaggauagaaucacagg

SEQ ID NO: 505781 - RNA, 61 nt, Homo Sapiens
caugucugugacacaggacggugggaagccugagagagagugaaauuaugugauacacuga

SEQ ID NO: 505782 - RNA, 61 nt, Homo Sapiens
gcccacagugguggccucugccucuuuccuggagagagaaggacagugcacggagagguuu

SEQ ID NO: 505783 - RNA, 61 nt, Homo Sapiens
gcccuaccugucuuuccugaguguuugaggggagagagagacccacaucuccccaaagaga

SEQ ID NO: 505784 - RNA, 61 nt, Homo Sapiens
ccuaccugucuuuccugaguguuugaggggagagagagacccacaucuccccaaagagaug

SEQ ID NO: 505785 - RNA, 61 nt, Homo Sapiens
caggcucacugccaggccagccuccgagagggagagagagagagagaggacagcuugagcc

SEQ ID NO: 505786 - RNA, 61 nt, Homo Sapiens
ggcucacugccaggccagccuccgagagggagagagagagagagaggacagcuugagccgg

SEQ ID NO: 505787 - RNA, 61 nt, Homo Sapiens
cucacugccaggccagccuccgagagggagagagagagagagaggacagcuugagccgggc

SEQ ID NO: 505788 - RNA, 61 nt, Homo Sapiens
cacugccaggccagccuccgagagggagagagagagagagaggacagcuugagccgggccc

SEQ ID NO: 505789 - RNA, 61 nt, Homo Sapiens
cugccaggccagccuccgagagggagagagagagagagaggacagcuugagccgggccccu

SEQ ID NO: 505790 - RNA, 61 nt, Homo Sapiens
agaucuuacagguaucaggcacaggcaggaagagagagagagagguucuggggaggaaggg

SEQ ID NO: 505791 - RNA, 61 nt, Homo Sapiens
aucuuacagguaucaggcacaggcaggaagagagagagagagguucuggggaggaagggcc

SEQ ID NO: 505792 - RNA, 61 nt, Homo Sapiens
cuuacagguaucaggcacaggcaggaagagagagagagagguucuggggaggaagggccag

SEQ ID NO: 505793 - RNA, 61 nt, Homo Sapiens
agagagagagguucuggggaggaagggccaggagagagaucuagaaaguggguucacuaga

SEQ ID NO: 505794 - RNA, 61 nt, Homo Sapiens
cccuuucccugucuggcuucucccuuaagaagagagagauacuuguagaauuggguggggg

SEQ ID NO: 505795 - RNA, 61 nt, Homo Sapiens
uccuuccauuugggauauguuacauuagagugagagagagaauaaggagccuuucuuaugg

SEQ ID NO: 505796 - RNA, 61 nt, Homo Sapiens
cuuccauuugggauauguuacauuagagugagagagagaauaaggagccuuucuuauggaa

SEQ ID NO: 505797 - RNA, 61 nt, Homo Sapiens
augggaccucgaggcucgagcugaagcaggcgagagagaaacagcuacugcgugcgugcgc

SEQ ID NO: 505798 - RNA, 61 nt, Homo Sapiens
cucugucgaagaaagaagcucugucaaguuagagagagacaauguguaggaaauguucuuu

SEQ ID NO: 505799 - RNA, 61 nt, Homo Sapiens
aacucuccguccccccggggcccuccggagggagagagagaggaacugcuguuuaucucac

SEQ ID NO: 505800 - RNA, 61 nt, Homo Sapiens
cucuccguccccccggggcccuccggagggagagagagaggaacugcuguuuaucucacuc

SEQ ID NO: 505801 - RNA, 61 nt, Homo Sapiens
aaagagcauguacaugggagugagagaaaaagagagagagagacagaguggcgggggcggg

SEQ ID NO: 505802 - RNA, 61 nt, Homo Sapiens
agagcauguacaugggagugagagaaaaagagagagagagacagaguggcgggggcgggga

SEQ ID NO: 505803 - RNA, 61 nt, Homo Sapiens
agcauguacaugggagugagagaaaaagagagagagagacagaguggcgggggcggggagg

SEQ ID NO: 505804 - RNA, 61 nt, Homo Sapiens
caguuccuaaaugauucucacaagcaacccugagagagacagucuugugagggagaucugg

SEQ ID NO: 505805 - RNA, 61 nt, Homo Sapiens
caaacaaaaaacaauggaaaagaugaagcuggagagagaggaaccaguugccaagguagag

SEQ ID NO: 505806 - RNA, 61 nt, Homo Sapiens
agcagcagccucagcagcugucuugguaaaggagagagagagacauggggccaguaauucc

SEQ ID NO: 505807 - RNA, 61 nt, Homo Sapiens
cagcagccucagcagcugucuugguaaaggagagagagagacauggggccaguaauuccgg

SEQ ID NO: 505808 - RNA, 61 nt, Homo Sapiens
gcagccucagcagcugucuugguaaaggagagagagagacauggggccaguaauuccgggg

SEQ ID NO: 505809 - RNA, 61 nt, Homo Sapiens
ugaaacugaggagucugcaauuuggaauauggagagagagacugauuugcugaauuuccuu

SEQ ID NO: 505810 - RNA, 61 nt, Homo Sapiens
aaacugaggagucugcaauuuggaauauggagagagagacugauuugcugaauuuccuucu

SEQ ID NO: 505811 - RNA, 61 nt, Homo Sapiens
agaaccacaaugcacauuagcauauuagucugagagagaacuuauaguaaggaaacucacu

SEQ ID NO: 505812 - RNA, 61 nt, Homo Sapiens
uccuggaaacuuugacaagcuuuauuaaguugagagagagagaggggaaaaaaaaaagccu

SEQ ID NO: 505813 - RNA, 61 nt, Homo Sapiens
cuggaaacuuugacaagcuuuauuaaguugagagagagagaggggaaaaaaaaaagccuuu

SEQ ID NO: 505814 - RNA, 61 nt, Homo Sapiens
ggaaacuuugacaagcuuuauuaaguugagagagagagaggggaaaaaaaaaagccuuucg

SEQ ID NO: 505815 - RNA, 61 nt, Homo Sapiens
cagucauggcccccuuccucugcaggagggagagagagacacggcggccgcggcugggccc

SEQ ID NO: 505816 - RNA, 61 nt, Homo Sapiens
cacagucauggcccccuuccccugcaggagggagagagagauucggcggccgcggcugggc

SEQ ID NO: 505817 - RNA, 61 nt, Homo Sapiens
guagaugaguacuugccuagaaucuguuugagagagagaaaugaaauguccagaauaggca

SEQ ID NO: 505818 - RNA, 61 nt, Homo Sapiens
aaguagaugaguacuugccucaaaucuguuugagagagagauaugaaauguccagaauagg

SEQ ID NO: 505819 - RNA, 61 nt, Homo Sapiens
cugggcccagccgggccgugcugcagguggagagagagaaggguucuccccccuacacccu

SEQ ID NO: 505820 - RNA, 61 nt, Homo Sapiens
agcugggcccagccgggccgcucugcagguggagagagagaaggguucuccccccuacacc

SEQ ID NO: 505821 - RNA, 61 nt, Homo Sapiens
gaauggcgugggaugggggagccuugcugcagagagagaaggucucuagagguagaaauuu

SEQ ID NO: 505822 - RNA, 61 nt, Homo Sapiens
ugccgcaaagcacaaggcugcugcaccagcugagagagacugagacacaggucucccgucc

SEQ ID NO: 505823 - RNA, 61 nt, Homo Sapiens
aaaagaaaaaugaagaaaagaggaagaaagggagagagaaggaaauaaaaagaagagaggg

SEQ ID NO: 505824 - RNA, 61 nt, Homo Sapiens
gacuguuaugaaaaacagaaagggggauaaagagagagaagccuagggucugcuuuagaga

SEQ ID NO: 505825 - RNA, 61 nt, Homo Sapiens
ggauccucauaggucagggaagagagacagagagagagaauugggacuccaggucuugagg

SEQ ID NO: 505826 - RNA, 61 nt, Homo Sapiens
auggauccucauaggucaggggagagagacagagagagagaucugggacuccaggucuuga

SEQ ID NO: 505827 - RNA, 61 nt, Homo Sapiens
gagagagagaauggauccuccaggucuugaggagagagacaggagcacuguucugggacuc

SEQ ID NO: 505828 - RNA, 61 nt, Homo Sapiens
caucugacacuucuuuuggagggacaagggagagagagacugagagccccacaaaacuuug

SEQ ID NO: 505829 - RNA, 61 nt, Homo Sapiens
cucaucugacacuucuuuuguggggacaagggagagagagagggagagccccacaaaacuu

SEQ ID NO: 505830 - RNA, 61 nt, Homo Sapiens
cucagaguggaaggagggggagagagagagagagagagaucagagacagaaagagagagag

SEQ ID NO: 505831 - RNA, 61 nt, Homo Sapiens
uccucagaguggaaggagggagagagagagagagagagagaagagagacagaaagagagag

SEQ ID NO: 505832 - RNA, 61 nt, Homo Sapiens
gauccucagaguggaaggagagagagagagagagagagagaagagagagacagaaagagag

SEQ ID NO: 505833 - RNA, 61 nt, Homo Sapiens
gagauccucagaguggaaggagagagagagagagagagagaagagagagagacagaaagag

SEQ ID NO: 505834 - RNA, 61 nt, Homo Sapiens
gagagauccucagaguggaaagagagagagagagagagagaagagagagagagacagaaag

SEQ ID NO: 505835 - RNA, 61 nt, Homo Sapiens
gagagagauccucagaguggagagagagagagagagagagagcagagagagagagacagaa

SEQ ID NO: 505836 - RNA, 61 nt, Homo Sapiens
gagagagagauccucagaguaaagagagagagagagagagauagcagagagagagagacag

SEQ ID NO: 505837 - RNA, 61 nt, Homo Sapiens
gagagagagagauccucagaagaaagagagagagagagagagguagcagagagagagagac

SEQ ID NO: 505838 - RNA, 61 nt, Homo Sapiens
gagagagagagagauccucaacagaaagagagagagagagaaggguagcagagagagagag

SEQ ID NO: 505839 - RNA, 61 nt, Homo Sapiens
gagagagagagagagauccuagacagaaagagagagagagagaaggguagcagagagagag

SEQ ID NO: 505840 - RNA, 61 nt, Homo Sapiens
gagagagagagagagagaucagagacagaaagagagagagagggaaggguagcagagagag

SEQ ID NO: 505841 - RNA, 61 nt, Homo Sapiens
gaaagagagagagagagagagguagcagagagagagagacaucugagggcagguugggaag

SEQ ID NO: 505842 - RNA, 61 nt, Homo Sapiens
cagaaagagagagagagagaaggguagcagagagagagagaugucugagggcagguuggga

SEQ ID NO: 505843 - RNA, 61 nt, Homo Sapiens
gacagaaagagagagagagagaaggguagcagagagagagaagugucugagggcagguugg

SEQ ID NO: 505844 - RNA, 61 nt, Homo Sapiens
acuugauucauuaaaaagucugugugugugagagagagaguaaauguguguguguguucug

SEQ ID NO: 505845 - RNA, 61 nt, Homo Sapiens
guacuugauucauuaaaaagugugugugugugagagagagaaaaaauguguguguguguuc

SEQ ID NO: 505846 - RNA, 61 nt, Homo Sapiens
auuggagaaggacugggucagagaucuguuggagagagagaauaaagagauuauuuuucau

SEQ ID NO: 505847 - RNA, 61 nt, Homo Sapiens
uggagaaggacugggucagagaucuguuggagagagagaauaaagagauuauuuuucauua

SEQ ID NO: 505848 - RNA, 61 nt, Homo Sapiens
gcacacauaaaagcacaaagacagagacgcagagagagagagagagccacggagaggaaaa

SEQ ID NO: 505849 - RNA, 61 nt, Homo Sapiens
acacauaaaagcacaaagacagagacgcagagagagagagagagccacggagaggaaaagc

SEQ ID NO: 505850 - RNA, 61 nt, Homo Sapiens
acauaaaagcacaaagacagagacgcagagagagagagagagccacggagaggaaaagcag

SEQ ID NO: 505851 - RNA, 61 nt, Homo Sapiens
auaaaagcacaaagacagagacgcagagagagagagagagccacggagaggaaaagcagau

SEQ ID NO: 505852 - RNA, 61 nt, Homo Sapiens
cgcccagcaccccugcugauaccaccagacagagagagagagcacuugauucuucccgaga

SEQ ID NO: 505853 - RNA, 61 nt, Homo Sapiens
cccagcaccccugcugauaccaccagacagagagagagagcacuugauucuucccgagaua

SEQ ID NO: 505854 - RNA, 61 nt, Homo Sapiens
guccacagguggacaaagggauccccagccagagagagagagaccagccaacagcuugaua

SEQ ID NO: 505855 - RNA, 61 nt, Homo Sapiens
ccacagguggacaaagggauccccagccagagagagagagaccagccaacagcuugauaga

SEQ ID NO: 505856 - RNA, 61 nt, Homo Sapiens
acagguggacaaagggauccccagccagagagagagagaccagccaacagcuugauagacc

SEQ ID NO: 505857 - RNA, 61 nt, Homo Sapiens
uguguguguguguguguguguguguguggcagagagagagaaagagagagagagagagaaa

SEQ ID NO: 505858 - RNA, 61 nt, Homo Sapiens
uguguguguguguguguguguguguggcagagagagagaaagagagagagagagagaaauu

SEQ ID NO: 505859 - RNA, 61 nt, Homo Sapiens
uguguguguguguguggcagagagagagaaagagagagagagagagaaauucuguuaaaau

SEQ ID NO: 505860 - RNA, 61 nt, Homo Sapiens
uguguguguguguggcagagagagagaaagagagagagagagagaaauucuguuaaaaucu

SEQ ID NO: 505861 - RNA, 61 nt, Homo Sapiens
uguguguguguggcagagagagagaaagagagagagagagagaaauucuguuaaaaucuau

SEQ ID NO: 505862 - RNA, 61 nt, Homo Sapiens
uguguguguggcagagagagagaaagagagagagagagagaaauucuguuaaaaucuauuc

SEQ ID NO: 505863 - RNA, 61 nt, Homo Sapiens
uguguguggcagagagagagaaagagagagagagagagaaauucuguuaaaaucuauucug

SEQ ID NO: 505864 - RNA, 61 nt, Homo Sapiens
ggauagcagugaggucagaagucuuucccgggagagagauggccuggguuaucauugcuga

SEQ ID NO: 505865 - RNA, 61 nt, Homo Sapiens
acauaggacugagccaaggaagagucugccugagagagacgcuuggccugugcuuugcugc

SEQ ID NO: 505866 - RNA, 61 nt, Homo Sapiens
aagaccaugcugcauacauuaaaaagagagagagagagaaauuccaguuccguucugagag

SEQ ID NO: 505867 - RNA, 61 nt, Homo Sapiens
aaaagaccaugcugcauacaagaaaaagagagagagagagaguuuccaguuccguucugag

SEQ ID NO: 505868 - RNA, 61 nt, Homo Sapiens
gaaaaagaccaugcugcauaagagaaaaagagagagagagacuguuuccaguuccguucug

SEQ ID NO: 505869 - RNA, 61 nt, Homo Sapiens
gagaaaaagaccaugcugcaugagagaaaaagagagagagaugcuguuuccaguuccguuc

SEQ ID NO: 505870 - RNA, 61 nt, Homo Sapiens
acugaaaaagcaacuccucuucacacagagagagagagaguuuucugaaagaucuaguggu

SEQ ID NO: 505871 - RNA, 61 nt, Homo Sapiens
guacugaaaaagcaacuccuguucacacagagagagagagagcuuucugaaagaucuagug

SEQ ID NO: 505872 - RNA, 61 nt, Homo Sapiens
gaguacugaaaaagcaacucugguucacacagagagagagaaggcuuucugaaagaucuag

SEQ ID NO: 505873 - RNA, 61 nt, Homo Sapiens
augugugugugugugugcguugcauaagagagagagagaauuugggauguggauggaugug

SEQ ID NO: 505874 - RNA, 61 nt, Homo Sapiens
auaugugugugugugugugcugugcauaagagagagagagauguugggauguggauggaug

SEQ ID NO: 505875 - RNA, 61 nt, Homo Sapiens
gaauauguguguguguguguugugugcauaagagagagagaauuguugggauguggaugga

SEQ ID NO: 505876 - RNA, 61 nt, Homo Sapiens
gauggaggagaagaacuuggagagagagagagagagagaaagggaaaagagagagagagag

SEQ ID NO: 505877 - RNA, 61 nt, Homo Sapiens
aagauggaggagaagaacuuagagagagagagagagagagagggggaaaagagagagagag

SEQ ID NO: 505878 - RNA, 61 nt, Homo Sapiens
gaaagauggaggagaagaacagagagagagagagagagagagagggggaaaagagagagag

SEQ ID NO: 505879 - RNA, 61 nt, Homo Sapiens
gagaaagauggaggagaagaagagagagagagagagagagagggagggggaaaagagagag

SEQ ID NO: 505880 - RNA, 61 nt, Homo Sapiens
gagagaaagauggaggagaaagagagagagagagagagagaaggggagggggaaaagagag

SEQ ID NO: 505881 - RNA, 61 nt, Homo Sapiens
gagagagaaagauggaggagagagagagagagagagagagaagaggggagggggaaaagag

SEQ ID NO: 505882 - RNA, 61 nt, Homo Sapiens
gagagagagaaagauggaggagagagagagagagagagagagcagaggggagggggaaaag

SEQ ID NO: 505883 - RNA, 61 nt, Homo Sapiens
gagagagagagaaagauggaagagagagagagagagagagauugcagaggggagggggaaa

SEQ ID NO: 505884 - RNA, 61 nt, Homo Sapiens
gagagagagagagaaagaugaaagagagagagagagagagaaauugcagaggggaggggga

SEQ ID NO: 505885 - RNA, 61 nt, Homo Sapiens
gagagagagagagagaaagagaaaagagagagagagagagaugaauugcagaggggagggg

SEQ ID NO: 505886 - RNA, 61 nt, Homo Sapiens
gagagagagagagagagaaagggaaaagagagagagagagaagugaauugcagaggggagg

SEQ ID NO: 505887 - RNA, 61 nt, Homo Sapiens
gagagagagagagagagagagggggaaaagagagagagagagaagugaauugcagagggga

SEQ ID NO: 505888 - RNA, 61 nt, Homo Sapiens
gagagagagagagagagagagagggggaaaagagagagagagggaagugaauugcagaggg

SEQ ID NO: 505889 - RNA, 61 nt, Homo Sapiens
gagauggaaugugucugguauccuugauggagagagagaagaacucaucugaaucaucagu

SEQ ID NO: 505890 - RNA, 61 nt, Homo Sapiens
aggagauggaaugugucuggguuccuugauggagagagagaugaacucaucugaaucauca

SEQ ID NO: 505891 - RNA, 61 nt, Homo Sapiens
agagguaaaggagggagccaaaagaaagagagagagagaaaguucgacugggagguucugg

SEQ ID NO: 505892 - RNA, 61 nt, Homo Sapiens
aaagagguaaaggagggagcggaaagaaagagagagagagacuguucgacugggagguucu

SEQ ID NO: 505893 - RNA, 61 nt, Homo Sapiens
gaaaagagguaaaggagggacuggaaagaaagagagagagauccuguucgacugggagguu

SEQ ID NO: 505894 - RNA, 61 nt, Homo Sapiens
auggacgugggagaaagcaaugugagucagagagagagaggaggcuagaaaccuggcuggc

SEQ ID NO: 505895 - RNA, 61 nt, Homo Sapiens
ggauggacgugggagaaagcgcugugagucagagagagagacaaggcuagaaaccuggcug

SEQ ID NO: 505896 - RNA, 61 nt, Homo Sapiens
gggauuugcccuauccacagacauuucccuugagagagagugaucuagggguuucuuggcc

SEQ ID NO: 505897 - RNA, 61 nt, Homo Sapiens
guucaaaaagaaaaaaauaauaaaaauaaaagagagagagaaucagaccuggguggaacuc

SEQ ID NO: 505898 - RNA, 61 nt, Homo Sapiens
ucaaaaagaaaaaaauaauaaaaauaaaagagagagagaaucagaccuggguggaacucuc

SEQ ID NO: 505899 - RNA, 61 nt, Homo Sapiens
ccugggguggacauucagcagagugcgaguggagagagagagaugguguuuacucagaacc

SEQ ID NO: 505900 - RNA, 61 nt, Homo Sapiens
ugggguggacauucagcagagugcgaguggagagagagagaugguguuuacucagaaccug

SEQ ID NO: 505901 - RNA, 61 nt, Homo Sapiens
ggguggacauucagcagagugcgaguggagagagagagaugguguuuacucagaaccugcu

SEQ ID NO: 505902 - RNA, 61 nt, Homo Sapiens
ucaaggaaucauuguuuggcauugaaaauaggagagagaucaugagaaauuaccaaaaugu

SEQ ID NO: 505903 - RNA, 61 nt, Homo Sapiens
ugaagucuuguucaggguauggggcuaggaugagagagaaugccacagaguaugaaggaag

SEQ ID NO: 505904 - RNA, 61 nt, Homo Sapiens
caagucaacaaagaacuuaccuuggaggauagagagagagaagggaccaauuaugaggacu

SEQ ID NO: 505905 - RNA, 61 nt, Homo Sapiens
agucaacaaagaacuuaccuuggaggauagagagagagaagggaccaauuaugaggacuga

SEQ ID NO: 505906 - RNA, 61 nt, Homo Sapiens
ccuuaguguuuggguauauucauuucaaagggagagagagagguuuuuuucuguucugucu

SEQ ID NO: 505907 - RNA, 61 nt, Homo Sapiens
uuaguguuuggguauauucauuucaaagggagagagagagguuuuuuucuguucugucuca

SEQ ID NO: 505908 - RNA, 61 nt, Homo Sapiens
gguuuugaugcuagagaggaaaaaggacuuggagagagagaaggaauggcugguccagagg

SEQ ID NO: 505909 - RNA, 61 nt, Homo Sapiens
uuuugaugcuagagaggaaaaaggacuuggagagagagaaggaauggcugguccagaggcu

SEQ ID NO: 505910 - RNA, 50 nt, Homo Sapiens; identical to SEQ ID NO: 157121

SEQ ID NO: 505911 - RNA, 52 nt, Homo Sapiens; identical to SEQ ID NO: 157122

SEQ ID NO: 505912 - RNA, 54 nt, Homo Sapiens; identical to SEQ ID NO: 157123

SEQ ID NO: 505913 - RNA, 56 nt, Homo Sapiens; identical to SEQ ID NO: 157124

SEQ ID NO: 505914 - RNA, 58 nt, Homo Sapiens; identical to SEQ ID NO: 157125

SEQ ID NO: 505915 - RNA, 60 nt, Homo Sapiens; identical to SEQ ID NO: 157126

SEQ ID NO: 505916 - RNA, 61 nt, Homo Sapiens
guucacugagauggagugagagagagagagagagagagaugacaaggagcacaagaagugg

SEQ ID NO: 505917 - RNA, 61 nt, Homo Sapiens
aagggaauaagcaaagggggaagaauugaaagagagagagaagaaagaauacagagagcuu

SEQ ID NO: 505918 - RNA, 61 nt, Homo Sapiens
gggaauaagcaaagggggaagaauugaaagagagagagaagaaagaauacagagagcuuac

SEQ ID NO: 505919 - RNA, 61 nt, Homo Sapiens
ucuuuauguguguguaugugugucagagaaagagagagagagagagagaagggaggaugag

SEQ ID NO: 505920 - RNA, 61 nt, Homo Sapiens
uuuauguguguguaugugugucagagaaagagagagagagagagagaagggaggaugagaa

SEQ ID NO: 505921 - RNA, 61 nt, Homo Sapiens
uauguguguguaugugugucagagaaagagagagagagagagagaagggaggaugagaacg

SEQ ID NO: 505922 - RNA, 61 nt, Homo Sapiens
uguguguguaugugugucagagaaagagagagagagagagagaagggaggaugagaacgaa

SEQ ID NO: 505923 - RNA, 61 nt, Homo Sapiens
uguguguaugugugucagagaaagagagagagagagagagaagggaggaugagaacgaaug

SEQ ID NO: 505924 - RNA, 61 nt, Homo Sapiens
uguguaugugugucagagaaagagagagagagagagagaagggaggaugagaacgaauggg

SEQ ID NO: 505925 - RNA, 61 nt, Homo Sapiens
aaagaaccaaaagagaucacaauacucaaaagagagagagagagaaaaaagagagaucuug

SEQ ID NO: 505926 - RNA, 61 nt, Homo Sapiens
agaaccaaaagagaucacaauacucaaaagagagagagagagaaaaaagagagaucuugau

SEQ ID NO: 505927 - RNA, 61 nt, Homo Sapiens
aaccaaaagagaucacaauacucaaaagagagagagagagaaaaaagagagaucuugaucc

SEQ ID NO: 505928 - RNA, 61 nt, Homo Sapiens
ccaaaagagaucacaauacucaaaagagagagagagagaaaaaagagagaucuugauccac

SEQ ID NO: 505929 - RNA, 61 nt, Homo Sapiens
gugugcagaaaucaaaugacagagaggaagugagagagagaggugucggggaggugccagg

SEQ ID NO: 505930 - RNA, 61 nt, Homo Sapiens
gugcagaaaucaaaugacagagaggaagugagagagagaggugucggggaggugccaggcu

SEQ ID NO: 505931 - RNA, 61 nt, Homo Sapiens
uggugcuacacagcuagaauagauauauuuagagagagagauauuuuuaagacaaagccca

SEQ ID NO: 505932 - RNA, 61 nt, Homo Sapiens
gugcuacacagcuagaauagauauauuuagagagagagauauuuuuaagacaaagcccaca

SEQ ID NO: 505933 - RNA, 61 nt, Homo Sapiens
ggcauuggaagcuuauucuuuuuguucacuggagagagagagaacuguuuacaguuaaucu

SEQ ID NO: 505934 - RNA, 61 nt, Homo Sapiens
cauuggaagcuuauucuuuuuguucacuggagagagagagaacuguuuacaguuaaucugu

SEQ ID NO: 505935 - RNA, 61 nt, Homo Sapiens
uuggaagcuuauucuuuuuguucacuggagagagagagaacuguuuacaguuaaucugugu

SEQ ID NO: 505936 - RNA, 61 nt, Homo Sapiens
acaggaccaucacagcuucugaacugagccggagagagagaauggaauugcugaccccugg

SEQ ID NO: 505937 - RNA, 61 nt, Homo Sapiens
aggaccaucacagcuucugaacugagccggagagagagaauggaauugcugaccccuggaa

SEQ ID NO: 505938 - RNA, 61 nt, Homo Sapiens
uaaaaacauagacuggaggagguaauccauggagagagaaaaagaagagggcucaggacaa

SEQ ID NO: 505939 - RNA, 61 nt, Homo Sapiens
auauugauggcaacagucaagauggugugaugagagagaugggaggggcacaaagaggagg

SEQ ID NO: 505940 - RNA, 61 nt, Homo Sapiens
uuauauacuaugaaaagugcaaaugaugagagagagagaaaaccuuguauuagcauccaag

SEQ ID NO: 505941 - RNA, 61 nt, Homo Sapiens
aauuauauacuaugaaaaguagaaaugaugagagagagagaagaccuuguauuagcaucca

SEQ ID NO: 505942 - RNA, 61 nt, Homo Sapiens
gaaauuauauacuaugaaaacaagaaaugaugagagagagaugagaccuuguauuagcauc

SEQ ID NO: 505943 - RNA, 61 nt, Homo Sapiens
aaaagaguaggaaaaugagaaaaaaaaaagagagagagaugagagugagacuccaucucaa

SEQ ID NO: 505944 - RNA, 61 nt, Homo Sapiens
ugaaaagaguaggaaaaugaaaaaaaaaaaagagagagagaacagagugagacuccaucuc

SEQ ID NO: 505945 - RNA, 61 nt, Homo Sapiens
cagacaagcaaacucaaaauauaggucaagagagagagaccaccugccccgaagacuccua

SEQ ID NO: 505946 - RNA, 61 nt, Homo Sapiens
cccagacaagcaaacucaaauaauaggucaagagagagagaacaccugccccgaagacucc

SEQ ID NO: 505947 - RNA, 61 nt, Homo Sapiens
augagcaaauguauugcuucugauaccuggagagagagauuuucauuaauaauaugagaaa

SEQ ID NO: 505948 - RNA, 61 nt, Homo Sapiens
uuaugagcaaauguauugcuaaugauaccuggagagagagauuuucauuaauaauaugaga

SEQ ID NO: 505949 - RNA, 61 nt, Homo Sapiens
aauaauauuaacacaaaaaaauuaaaacgaggagagagaaaagagcaagaaaagagaaaau

SEQ ID NO: 505950 - RNA, 61 nt, Homo Sapiens
ggacaggggagugcuggaacgggggagucuggagagagacugguuuuguaggagcggguuu

SEQ ID NO: 505951 - RNA, 61 nt, Homo Sapiens
auuggagauguccugaauuuagaaaaacagagagagagaauaaaaaaaaaaaagaugacaa

SEQ ID NO: 505952 - RNA, 61 nt, Homo Sapiens
auauuggagauguccugaauaaagaaaaacagagagagagauuaaaaaaaaaaaagaugac

SEQ ID NO: 505953 - RNA, 61 nt, Homo Sapiens
gcucuuaaaaaaaaaaaaaaaaaaaaaaaaagagagagagagaauaaauagaaaagaaugu

SEQ ID NO: 505954 - RNA, 61 nt, Homo Sapiens
ucuuaaaaaaaaaaaaaaaaaaaaaaaaagagagagagagaauaaauagaaaagaaugugg

SEQ ID NO: 505955 - RNA, 61 nt, Homo Sapiens
uuaaaaaaaaaaaaaaaaaaaaaaaaagagagagagagaauaaauagaaaagaauguggcu

SEQ ID NO: 505956 - RNA, 61 nt, Homo Sapiens
caauaauguucaacugaaucucacagaugaggagagagaagaaacggaagaggaaguuuau

SEQ ID NO: 505957 - RNA, 61 nt, Homo Sapiens
uggaauggaggaguuguuuggggagggaaaggagagagaaggaaaggagugagguauuucc

SEQ ID NO: 505958 - RNA, 61 nt, Homo Sapiens
ugcuguucguucaaaaguggagagagaucuugagagagaaacugacaaauucaaaagagag

SEQ ID NO: 505959 - RNA, 61 nt, Homo Sapiens
uugagagagaaaugcuguucuucaaaagagagagagagaucgcguaacuccaucugacaaa

SEQ ID NO: 505960 - RNA, 61 nt, Homo Sapiens
ucuugagagagaaaugcuguaauucaaaagagagagagagacugcguaacuccaucugaca

SEQ ID NO: 505961 - RNA, 61 nt, Homo Sapiens
gaucuugagagagaaaugcucaaauucaaaagagagagagaaccugcguaacuccaucuga

SEQ ID NO: 505962 - RNA, 61 nt, Homo Sapiens
gacuguguugugauucauaguacauuaaaaagagagagagagagaaagaaucccacagggc

SEQ ID NO: 505963 - RNA, 61 nt, Homo Sapiens
cuguguugugauucauaguacauuaaaaagagagagagagagaaagaaucccacagggcac

SEQ ID NO: 505964 - RNA, 61 nt, Homo Sapiens
guguugugauucauaguacauuaaaaagagagagagagagaaagaaucccacagggcacua

SEQ ID NO: 505965 - RNA, 61 nt, Homo Sapiens
guugugauucauaguacauuaaaaagagagagagagagaaagaaucccacagggcacuauu

SEQ ID NO: 505966 - RNA, 61 nt, Homo Sapiens
ugacuucugcuagguagaggcauuugucuuagagagagagagagcgcgggagagagugaga

SEQ ID NO: 505967 - RNA, 61 nt, Homo Sapiens
acuucugcuagguagaggcauuugucuuagagagagagagagcgcgggagagagugagaga

SEQ ID NO: 505968 - RNA, 61 nt, Homo Sapiens
uucugcuagguagaggcauuugucuuagagagagagagagcgcgggagagagugagagaga

SEQ ID NO: 505969 - RNA, 61 nt, Homo Sapiens
ucuuagagagagagagagcgcgggagagagugagagagagugagagcacaaagauaacgca

SEQ ID NO: 505970 - RNA, 61 nt, Homo Sapiens
gagagagagugagagcacaaagauaacgcaggagagagagagagaaagaaugagaaagaaa

SEQ ID NO: 505971 - RNA, 61 nt, Homo Sapiens
gagagagugagagcacaaagauaacgcaggagagagagagagaaagaaugagaaagaaaag

SEQ ID NO: 505972 - RNA, 61 nt, Homo Sapiens
gagagugagagcacaaagauaacgcaggagagagagagagaaagaaugagaaagaaaagga

SEQ ID NO: 505973 - RNA, 61 nt, Homo Sapiens
gagugagagcacaaagauaacgcaggagagagagagagaaagaaugagaaagaaaaggaau

SEQ ID NO: 505974 - RNA, 61 nt, Homo Sapiens
aacaauagauuauuucuguuuuacuccaaaagagagagagagagugagugugagugugugu

SEQ ID NO: 505975 - RNA, 61 nt, Homo Sapiens
caauagauuauuucuguuuuacuccaaaagagagagagagagugagugugagugugugugu

SEQ ID NO: 505976 - RNA, 61 nt, Homo Sapiens
auagauuauuucuguuuuacuccaaaagagagagagagagugagugugagugugugugugu

SEQ ID NO: 505977 - RNA, 61 nt, Homo Sapiens
gauccaaacuuccugcaacauuuucuuagaggagagagagaaauauuaaaagagaaaugaa

SEQ ID NO: 505978 - RNA, 61 nt, Homo Sapiens
uccaaacuuccugcaacauuuucuuagaggagagagagaaauauuaaaagagaaaugaaac

SEQ ID NO: 505979 - RNA, 61 nt, Homo Sapiens
gaagucgagacaccaucccagguguguguaagagagagagagagaacagggaggauacaga

SEQ ID NO: 505980 - RNA, 61 nt, Homo Sapiens
agucgagacaccaucccagguguguguaagagagagagagagaacagggaggauacagaag

SEQ ID NO: 505981 - RNA, 61 nt, Homo Sapiens
ucgagacaccaucccagguguguguaagagagagagagagaacagggaggauacagaagua

SEQ ID NO: 505982 - RNA, 61 nt, Homo Sapiens
gagacaccaucccagguguguguaagagagagagagagaacagggaggauacagaaguauu

SEQ ID NO: 505983 - RNA, 61 nt, Homo Sapiens
ugugagggacaaaaugcaaaaaaaagagagagagagagaggcuaagaugcauuuaauaaaa

SEQ ID NO: 505984 - RNA, 61 nt, Homo Sapiens
ggugugagggacaaaaugcaaaaaaaagagagagagagagaugcuaagaugcauuuaauaa

SEQ ID NO: 505985 - RNA, 61 nt, Homo Sapiens
gaggugugagggacaaaaugaaaaaaaaagagagagagagauuugcuaagaugcauuuaau

SEQ ID NO: 505986 - RNA, 61 nt, Homo Sapiens
gagaggugugagggacaaaaauaaaaaaaaagagagagagacuuuugcuaagaugcauuua

SEQ ID NO: 505987 - RNA, 61 nt, Homo Sapiens
uggaaggggcucuggcucccgaagaugaagagagagagauuuuccuccccuugcuuccagg

SEQ ID NO: 505988 - RNA, 61 nt, Homo Sapiens
uuuggaaggggcucuggcucgggaagaugaagagagagagaucuuccuccccuugcuucca

SEQ ID NO: 505989 - RNA, 61 nt, Homo Sapiens
uuuccucagugcccuuuggcuguugaggagugagagagagagagagagagagagagagaga

SEQ ID NO: 505990 - RNA, 61 nt, Homo Sapiens
uccucagugcccuuuggcuguugaggagugagagagagagagagagagagagagagagaga

SEQ ID NO: 505991 - RNA, 61 nt, Homo Sapiens
cucagugcccuuuggcuguugaggagugagagagagagagagagagagagagagagagaga

SEQ ID NO: 505992 - RNA, 61 nt, Homo Sapiens
cagugcccuuuggcuguugaggagugagagagagagagagagagagagagagagagagaga

SEQ ID NO: 505993 - RNA, 61 nt, Homo Sapiens
gugcccuuuggcuguugaggagugagagagagagagagagagagagagagagagagagaga

SEQ ID NO: 505994 - RNA, 61 nt, Homo Sapiens
gcccuuuggcuguugaggagugagagagagagagagagagagagagagagagagagagaga

SEQ ID NO: 505995 - RNA, 61 nt, Homo Sapiens
ccuuuggcuguugaggagugagagagagagagagagagagagagagagagagagagagaga

SEQ ID NO: 505996 - RNA, 61 nt, Homo Sapiens
uuuggcuguugaggagugagagagagagagagagagagagagagagagagagagagagaca

SEQ ID NO: 505997 - RNA, 61 nt, Homo Sapiens
uggcuguugaggagugagagagagagagagagagagagagagagagagagagagagacaag

SEQ ID NO: 505998 - RNA, 61 nt, Homo Sapiens
gcuguugaggagugagagagagagagagagagagagagagagagagagagagagacaagca

SEQ ID NO: 505999 - RNA, 61 nt, Homo Sapiens
uguugaggagugagagagagagagagagagagagagagagagagagagagagacaagcagg

SEQ ID NO: 506000 - RNA, 61 nt, Homo Sapiens
uugaggagugagagagagagagagagagagagagagagagagagagagagacaagcaggag

SEQ ID NO: 506001 - RNA, 61 nt, Homo Sapiens
gaggagugagagagagagagagagagagagagagagagagagagagagacaagcaggagcg

SEQ ID NO: 506002 - RNA, 61 nt, Homo Sapiens
ggagugagagagagagagagagagagagagagagagagagagagagacaagcaggagcgug

SEQ ID NO: 506003 - RNA, 61 nt, Homo Sapiens
agugagagagagagagagagagagagagagagagagagagagagacaagcaggagcguggc

SEQ ID NO: 506004 - RNA, 61 nt, Homo Sapiens
ugagagagagagagagagagagagagagagagagagagagagacaagcaggagcguggcug

SEQ ID NO: 506005 - RNA, 61 nt, Homo Sapiens
agagagagagagagagagagagagagagagagagagagagacaagcaggagcguggcugcu

SEQ ID NO: 506006 - RNA, 61 nt, Homo Sapiens
agagagagagagagagagagagagagagagagagagagacaagcaggagcguggcugcucg

SEQ ID NO: 506007 - RNA, 61 nt, Homo Sapiens
agucacauucgaauucggguggcauccuccggagagagagagaggaaggagauuccacaca

SEQ ID NO: 506008 - RNA, 61 nt, Homo Sapiens
ucacauucgaauucggguggcauccuccggagagagagagaggaaggagauuccacacagg

SEQ ID NO: 506009 - RNA, 61 nt, Homo Sapiens
acauucgaauucggguggcauccuccggagagagagagaggaaggagauuccacacagggg

SEQ ID NO: 506010 - RNA, 61 nt, Homo Sapiens
aaccuagaaacguuuucauucgucauuccaagagagagagaggaaagaaaaauacaacuuu

SEQ ID NO: 506011 - RNA, 61 nt, Homo Sapiens
ccuagaaacguuuucauucgucauuccaagagagagagaggaaagaaaaauacaacuuuca

SEQ ID NO: 506012 - RNA, 61 nt, Homo Sapiens
cagccuagugggagagagugggggagaggaagagagagagagagcauguauacccguaugu

SEQ ID NO: 506013 - RNA, 61 nt, Homo Sapiens
gccuagugggagagagugggggagaggaagagagagagagagcauguauacccguauguua

SEQ ID NO: 506014 - RNA, 61 nt, Homo Sapiens
cuagugggagagagugggggagaggaagagagagagagagcauguauacccguauguuauc

SEQ ID NO: 506015 - RNA, 61 nt, Homo Sapiens
gagagugaggagagugugugauagcuagaaagagagagagacagagagauggcaagcacug

SEQ ID NO: 506016 - RNA, 61 nt, Homo Sapiens
gagugaggagagugugugauagcuagaaagagagagagacagagagauggcaagcacugag

SEQ ID NO: 506017 - RNA, 61 nt, Homo Sapiens
uaauuuaaaaaguuuauuauaaaaaaaaagagagagagaugauaaaagagccuugauuuua

SEQ ID NO: 506018 - RNA, 61 nt, Homo Sapiens
uguaauuuaaaaaguuuauuuaaaaaaaaaagagagagagaacauaaaagagccuugauuu

SEQ ID NO: 506019 - RNA, 61 nt, Homo Sapiens
gcauaaauguaauaacugagaauccacaugagagagagacuggccuuauuugacuucaaag

SEQ ID NO: 506020 - RNA, 61 nt, Homo Sapiens
cugcauaaauguaauaacugagaauccacaugagagagagaauggccuuauuugacuucaa

SEQ ID NO: 506021 - RNA, 60 nt, Homo Sapiens
aucuggguguuggugguugcgaaaauaaagagagagagaguggauaacagcaaaaaaacu

SEQ ID NO: 506022 - RNA, 61 nt, Homo Sapiens
gaucuggguguuggugguugcugaaaauaaagagagagagaucuggauaacagcaaaaaaa

SEQ ID NO: 506023 - RNA, 61 nt, Homo Sapiens
agagcagauuuuaaaaaaaacuggggaaagagagagagaaaagcuccauaucugcauucca

SEQ ID NO: 506024 - RNA, 61 nt, Homo Sapiens
aaagagcagauuuuaaaaaacacuggggaaagagagagagaucagcuccauaucugcauuc

SEQ ID NO: 506025 - RNA, 61 nt, Homo Sapiens
aagacccaaguuuugaaucuagagagagcgcgagagagaucgacaauggagagagaaagag

SEQ ID NO: 506026 - RNA, 61 nt, Homo Sapiens
gcgagagagaucaagacccaagagagaaagagagagagagcaguuuuucuagagacaaugg

SEQ ID NO: 506027 - RNA, 61 nt, Homo Sapiens
gcgcgagagagaucaagaccggagagagaaagagagagagaacaguuuuucuagagacaau

SEQ ID NO: 506028 - RNA, 61 nt, Homo Sapiens
gagagagagagcgcgagagauagagacaauggagagagaaauguccuugccacaguuuuuc

SEQ ID NO: 506029 - RNA, 61 nt, Homo Sapiens
uugacauggugggcacacuggcgcccaguaagagagagagagagccaaagcuguccguuuu

SEQ ID NO: 506030 - RNA, 61 nt, Homo Sapiens
gacauggugggcacacuggcgcccaguaagagagagagagagccaaagcuguccguuuugc

SEQ ID NO: 506031 - RNA, 61 nt, Homo Sapiens
cauggugggcacacuggcgcccaguaagagagagagagagccaaagcuguccguuuugcag

SEQ ID NO: 506032 - RNA, 61 nt, Homo Sapiens
gccaggacacagcucagcuugcucacgcccagagagagaaaaaguuaagcugcugacccug

SEQ ID NO: 506033 - RNA, 61 nt, Homo Sapiens
ugucccaaagugaguaaaauccccuagagcagagagagagagagagagagagagugucuuc

SEQ ID NO: 506034 - RNA, 61 nt, Homo Sapiens
ucccaaagugaguaaaauccccuagagcagagagagagagagagagagagagugucuucau

SEQ ID NO: 506035 - RNA, 61 nt, Homo Sapiens
ccaaagugaguaaaauccccuagagcagagagagagagagagagagagagugucuucaugc

SEQ ID NO: 506036 - RNA, 61 nt, Homo Sapiens
aaagugaguaaaauccccuagagcagagagagagagagagagagagagugucuucaugcca

SEQ ID NO: 506037 - RNA, 61 nt, Homo Sapiens
agugaguaaaauccccuagagcagagagagagagagagagagagagugucuucaugccaac

SEQ ID NO: 506038 - RNA, 61 nt, Homo Sapiens
ugaguaaaauccccuagagcagagagagagagagagagagagagugucuucaugccaacca

SEQ ID NO: 506039 - RNA, 61 nt, Homo Sapiens
aguaaaauccccuagagcagagagagagagagagagagagagugucuucaugccaaccaca

SEQ ID NO: 506040 - RNA, 61 nt, Homo Sapiens
uaaaauccccuagagcagagagagagagagagagagagagugucuucaugccaaccacagc

SEQ ID NO: 506041 - RNA, 61 nt, Homo Sapiens
gccuuugggucgacauaguauggaaguauuugagagagagaaccuuuccacucccacugcc

SEQ ID NO: 506042 - RNA, 61 nt, Homo Sapiens
cuuugggucgacauaguauggaaguauuugagagagagaaccuuuccacucccacugccag

SEQ ID NO: 506043 - RNA, 61 nt, Homo Sapiens
gcacggcugaggcugagucaauucagagugagagagagaaagcaaauguacuuaagucauc

SEQ ID NO: 506044 - RNA, 61 nt, Homo Sapiens
aagcacggcugaggcugaguucauucagagugagagagagaaagcaaauguacuuaaguca

SEQ ID NO: 506045 - RNA, 61 nt, Homo Sapiens
gaggacccuccucacuaccccugauaauggagagagagacaugcaaaugcuuuagaaaucu

SEQ ID NO: 506046 - RNA, 61 nt, Homo Sapiens
cagaggacccuccucacuaccucugauaauggagagagagaauugcaaaugcuuuagaaau

SEQ ID NO: 506047 - RNA, 61 nt, Homo Sapiens
gugauuuuuggccuuguggcgagaggagagagagagagaaucugaggagaaugguagagag

SEQ ID NO: 506048 - RNA, 61 nt, Homo Sapiens
augugauuuuuggccuugugaggagaggagagagagagagacacugaggagaaugguagag

SEQ ID NO: 506049 - RNA, 61 nt, Homo Sapiens
gaaugugauuuuuggccuugagaggagaggagagagagagaggcacugaggagaaugguag

SEQ ID NO: 506050 - RNA, 61 nt, Homo Sapiens
gagaaugugauuuuuggccuagagaggagaggagagagagacuggcacugaggagaauggu

SEQ ID NO: 506051 - RNA, 61 nt, Homo Sapiens
gaaauagaagagaagagccaaaaaagagagagagagagaaagagacuccaucucaaaaaaa

SEQ ID NO: 506052 - RNA, 61 nt, Homo Sapiens
aagaaauagaagagaagagcaaaaaaagagagagagagagagugagacuccaucucaaaaa

SEQ ID NO: 506053 - RNA, 61 nt, Homo Sapiens
gaaagaaauagaagagaagaaaaaaaaaagagagagagagagagugagacuccaucucaaa

SEQ ID NO: 506054 - RNA, 61 nt, Homo Sapiens
gagaaagaaauagaagagaaaaaaaaaaaaagagagagagacagagugagacuccaucuca

SEQ ID NO: 506055 - RNA, 61 nt, Homo Sapiens
gcaguuuccaaggauauguuaaagacgaagggagagagaaaaagaagagggagggagagag

SEQ ID NO: 506056 - RNA, 61 nt, Homo Sapiens
gacgaagggagagagaaagcgaagagggagggagagagaaauacugaagagaaaugggaaa

SEQ ID NO: 506057 - RNA, 61 nt, Homo Sapiens
ugccaaaguaacagcaaaaauggggauuggagagagagaaugugcacugaacucgggaugu

SEQ ID NO: 506058 - RNA, 61 nt, Homo Sapiens
auugccaaaguaacagcaaaguuggggauuggagagagagaaugugcacugaacucgggau

SEQ ID NO: 506059 - RNA, 61 nt, Homo Sapiens
gcugugaucaugccacugcauuccagccugggagagagagaggaccugucuguugaaaaaa

SEQ ID NO: 506060 - RNA, 61 nt, Homo Sapiens
ugugaucaugccacugcauuccagccugggagagagagaggaccugucuguugaaaaaaac

SEQ ID NO: 506061 - RNA, 61 nt, Homo Sapiens
gugggcucagagcucaggagucgccuuaccugagagagauguucuagcugagagggccugg

SEQ ID NO: 506062 - RNA, 61 nt, Homo Sapiens
ugucccuguccccagagggaggagcaggcaggagagagaggggaaggagguaugaauccca

SEQ ID NO: 506063 - RNA, 61 nt, Homo Sapiens
guugacuuaagugagggggaaauaaaacccagagagagagagagagcgagagagagagaca

SEQ ID NO: 506064 - RNA, 61 nt, Homo Sapiens
ugacuuaagugagggggaaauaaaacccagagagagagagagagcgagagagagagacaug

SEQ ID NO: 506065 - RNA, 61 nt, Homo Sapiens
acuuaagugagggggaaauaaaacccagagagagagagagagcgagagagagagacauguu

SEQ ID NO: 506066 - RNA, 61 nt, Homo Sapiens
uuaagugagggggaaauaaaacccagagagagagagagagcgagagagagagacauguuac

SEQ ID NO: 506067 - RNA, 61 nt, Homo Sapiens
gggaaauaaaacccagagagagagagagagcgagagagagagacauguuacuaugaaagac

SEQ ID NO: 506068 - RNA, 61 nt, Homo Sapiens
gaaauaaaacccagagagagagagagagcgagagagagagacauguuacuaugaaagacuu

SEQ ID NO: 506069 - RNA, 61 nt, Homo Sapiens
aauaaaacccagagagagagagagagcgagagagagagacauguuacuaugaaagacuugu

SEQ ID NO: 506070 - RNA, 61 nt, Homo Sapiens
ccagcaguggagugccgggacccucagaguggagagagagacccgggaugugugugcugua

SEQ ID NO: 506071 - RNA, 61 nt, Homo Sapiens
agcaguggagugccgggacccucagaguggagagagagacccgggaugugugugcuguacc

SEQ ID NO: 506072 - RNA, 61 nt, Homo Sapiens
gggcuggcuccucucgcccccagggccaggagagagagacagcccucgcggcgggcgcccc

SEQ ID NO: 506073 - RNA, 61 nt, Homo Sapiens
cagggcuggcuccucucgcccccagggccaggagagagagaccgcccucgcggcgggcgcc

SEQ ID NO: 506074 - RNA, 61 nt, Homo Sapiens
gauagaaaacaagcgcaggacaagaagcggggagagagagggaaccaggacacaaaagcag

SEQ ID NO: 506075 - RNA, 61 nt, Homo Sapiens
ucacucauccugagacuuucuuuuugcaguggagagagagaauaaucuaguuggggcaaac

SEQ ID NO: 506076 - RNA, 61 nt, Homo Sapiens
acucauccugagacuuucuuuuugcaguggagagagagaauaaucuaguuggggcaaacac

SEQ ID NO: 506077 - RNA, 61 nt, Homo Sapiens
uugucugcguguguguguguugugugugugagagagagaucuugggagcugugugugucug

SEQ ID NO: 506078 - RNA, 61 nt, Homo Sapiens
ucuugucugcguguguguguugugugugugugagagagagaguuugggagcuguguguguc

SEQ ID NO: 506079 - RNA, 61 nt, Homo Sapiens
aucaaguuuuaauuuggguauucuauucugagagagagaugucccgacauuuuuuuucugu

SEQ ID NO: 506080 - RNA, 61 nt, Homo Sapiens
ugaucaaguuuuaauuugggguuucuauucugagagagagaugucccgacauuuuuuuucu

SEQ ID NO: 506081 - RNA, 61 nt, Homo Sapiens
acuauuucuugucccuuuuuaccgcaugagagagagagauucagugagccaagaucgcacc

SEQ ID NO: 506082 - RNA, 61 nt, Homo Sapiens
uuacuauuucuugucccuuuccaccgcaugagagagagagaugcagugagccaagaucgca

SEQ ID NO: 506083 - RNA, 61 nt, Homo Sapiens
gauuacuauuucuugucccucaccaccgcaugagagagagaguugcagugagccaagaucg

SEQ ID NO: 506084 - RNA, 61 nt, Homo Sapiens
uugacgguuguagauauuuuuguaugagagagagagagacuugugugugugugugugugug

SEQ ID NO: 506085 - RNA, 61 nt, Homo Sapiens
cuuugacgguuguagauauuuguguaugagagagagagagaugugugugugugugugugug

SEQ ID NO: 506086 - RNA, 61 nt, Homo Sapiens
gacuuugacgguuguagauauguguguaugagagagagagaugugugugugugugugugug

SEQ ID NO: 506087 - RNA, 61 nt, Homo Sapiens
gagacuuugacgguuguagauguguguguaugagagagagaugugugugugugugugugug

SEQ ID NO: 506088 - RNA, 61 nt, Homo Sapiens
aguaaaugggggccguugggucuggugacaagagagagacagcagcgccuuugucugucua

SEQ ID NO: 506089 - RNA, 61 nt, Homo Sapiens
gacuccaucucaaaaaauaaauaaauagaaagagagagagaggaaaaaaaaagaaaagaac

SEQ ID NO: 506090 - RNA, 61 nt, Homo Sapiens
cuccaucucaaaaaauaaauaaauagaaagagagagagaggaaaaaaaaagaaaagaacac

SEQ ID NO: 506091 - RNA, 61 nt, Homo Sapiens
ccuaucuccugcaaccucagugccucagccugagagagagaugagaugcucuuggacuccc

SEQ ID NO: 506092 - RNA, 61 nt, Homo Sapiens
uaucuccugcaaccucagugccucagccugagagagagaugagaugcucuuggacucccca

SEQ ID NO: 506093 - RNA, 61 nt, Homo Sapiens
agagacacagagagaaggagaaagagggagggagagagagaaagagagagaaagagagaga

SEQ ID NO: 506094 - RNA, 61 nt, Homo Sapiens
agacacagagagaaggagaaagagggagggagagagagaaagagagagaaagagagagaga

SEQ ID NO: 506095 - RNA, 61 nt, Homo Sapiens
agaaggagaaagagggagggagagagagaaagagagagaaagagagagagagagagagaga

SEQ ID NO: 506096 - RNA, 61 nt, Homo Sapiens
agagggagggagagagagaaagagagagaaagagagagagagagagagagagagaaagcug

SEQ ID NO: 506097 - RNA, 61 nt, Homo Sapiens
agggagggagagagagaaagagagagaaagagagagagagagagagagagagaaagcugaa

SEQ ID NO: 506098 - RNA, 61 nt, Homo Sapiens
ggagggagagagagaaagagagagaaagagagagagagagagagagagagaaagcugaacg

SEQ ID NO: 506099 - RNA, 61 nt, Homo Sapiens
agggagagagagaaagagagagaaagagagagagagagagagagagagaaagcugaacgug

SEQ ID NO: 506100 - RNA, 61 nt, Homo Sapiens
ggagagagagaaagagagagaaagagagagagagagagagagagagaaagcugaacgugca

SEQ ID NO: 506101 - RNA, 61 nt, Homo Sapiens
agagagagaaagagagagaaagagagagagagagagagagagagaaagcugaacgugcacu

SEQ ID NO: 506102 - RNA, 61 nt, Homo Sapiens
agagagaaagagagagaaagagagagagagagagagagagagaaagcugaacgugcacucu

SEQ ID NO: 506103 - RNA, 61 nt, Homo Sapiens
agagaaagagagagaaagagagagagagagagagagagagaaagcugaacgugcacucuga

SEQ ID NO: 506104 - RNA, 61 nt, Homo Sapiens
agaaagagagagaaagagagagagagagagagagagagaaagcugaacgugcacucugaca

SEQ ID NO: 506105 - RNA, 61 nt, Homo Sapiens
aaaccucaacuguguauuuuacugugaaagagagagagaaaccaggggcugguagacaaga

SEQ ID NO: 506106 - RNA, 61 nt, Homo Sapiens
aaaaaccucaacuguguauugaacugugaaagagagagagaugccaggggcugguagacaa

SEQ ID NO: 506107 - RNA, 61 nt, Homo Sapiens
cugauaccucuguggggacuccagcuggagagagagagaucagcagccaggcgcucuggag

SEQ ID NO: 506108 - RNA, 61 nt, Homo Sapiens
uccugauaccucuguggggaagccagcuggagagagagagaggagcagccaggcgcucugg

SEQ ID NO: 506109 - RNA, 61 nt, Homo Sapiens
gauccugauaccucugugggggagccagcuggagagagagacuggagcagccaggcgcucu

SEQ ID NO: 506110 - RNA, 61 nt, Homo Sapiens
uauuaaacaaauaccccccucaaaaaugggagagagagagggaaaugcaacuuguauaaaa

SEQ ID NO: 506111 - RNA, 61 nt, Homo Sapiens
gguauuaaacaaauacccccaacaaaaaugggagagagagauagaaaugcaacuuguauaa

SEQ ID NO: 506112 - RNA, 61 nt, Homo Sapiens
agcaucuucaagagaaguauagagagagagagagagagaccugugugugugugugagagag

SEQ ID NO: 506113 - RNA, 61 nt, Homo Sapiens
ccagcaucuucaagagaaguagagagagagagagagagagaugugugugugugugugagag

SEQ ID NO: 506114 - RNA, 61 nt, Homo Sapiens
gaccagcaucuucaagagaaagagagagagagagagagagaugugugugugugugugugag

SEQ ID NO: 506115 - RNA, 61 nt, Homo Sapiens
gagaccagcaucuucaagagagagagagagagagagagagaugugugugugugugugugug

SEQ ID NO: 506116 - RNA, 61 nt, Homo Sapiens
gagagaccagcaucuucaagugagagagagagagagagagauuugugugugugugugugug

SEQ ID NO: 506117 - RNA, 61 nt, Homo Sapiens
gagagagaccagcaucuucaugugagagagagagagagagauguuugugugugugugugug

SEQ ID NO: 506118 - RNA, 61 nt, Homo Sapiens
gagagagagaccagcaucuuugugugagagagagagagagauguguuugugugugugugug

SEQ ID NO: 506119 - RNA, 61 nt, Homo Sapiens
gagagagagagaccagcaucugugugugagagagagagagauguguguuugugugugugug

SEQ ID NO: 506120 - RNA, 61 nt, Homo Sapiens
gagagagagagagaccagcaugugugugugagagagagagauguguguguuugugugugug

SEQ ID NO: 506121 - RNA, 61 nt, Homo Sapiens
gagagagagagagagaccagugugugugugugagagagagauguguguguguuugugugug

SEQ ID NO: 506122 - RNA, 61 nt, Homo Sapiens
ccuccgcuccuuaaugugaacuaugagacgagagagagaagaguauuuucaggauuuguuu

SEQ ID NO: 506123 - RNA, 61 nt, Homo Sapiens
agccuccgcuccuuaauguguucuaugagacgagagagagaugaguauuuucaggauuugu

SEQ ID NO: 506124 - RNA, 61 nt, Homo Sapiens
cugagaucauucaggaguuuguucagaaaaggagagagaggcuuuuucaacaaaggagugu

SEQ ID NO: 506125 - RNA, 61 nt, Homo Sapiens
gagaaggaggggagccugucccugggaaucagagagagaaggagagaacucagcaagccaa

SEQ ID NO: 506126 - RNA, 61 nt, Homo Sapiens
uucauauuucuaaaaggggccaaugcaaaaggagagagaaggacuggauuuaagccaguuu

SEQ ID NO: 506127 - RNA, 61 nt, Homo Sapiens
cgaacuaauuuuuuuaaggauacugaaaaaugagagagaguggucgaaugccugaaauuuu

SEQ ID NO: 506128 - RNA, 61 nt, Homo Sapiens
gagucuuuguugcuauauuuuguggggcugggagagagagauuagauuauuuugacauggg

SEQ ID NO: 506129 - RNA, 61 nt, Homo Sapiens
gucuuuguugcuauauuuuguggggcugggagagagagauuagauuauuuugacaugggau

SEQ ID NO: 506130 - RNA, 61 nt, Homo Sapiens
gaaaaagauuacccaaaaacugucuuuaaaagagagagagagaaaaaaaaaauaguauuug

SEQ ID NO: 506131 - RNA, 61 nt, Homo Sapiens
aaaagauuacccaaaaacugucuuuaaaagagagagagagaaaaaaaaaauaguauuugca

SEQ ID NO: 506132 - RNA, 61 nt, Homo Sapiens
aagauuacccaaaaacugucuuuaaaagagagagagagaaaaaaaaaauaguauuugcaua

SEQ ID NO: 506133 - RNA, 61 nt, Homo Sapiens
aucgccuuuuccuuccaucaguugaguggcugagagagaagugccucaucccugagccaca

SEQ ID NO: 506134 - RNA, 61 nt, Homo Sapiens
gggacaaaaccgguugaccagaaaaugggcagagagagaugaccucggaagcauuuccaca

SEQ ID NO: 506135 - RNA, 61 nt, Homo Sapiens
aucucauggaugguucucaaagguaaaaaaagagagagaaagagagagagcuagcuguggg

SEQ ID NO: 506136 - RNA, 61 nt, Homo Sapiens
ugguucucaaagguaaaaaaagagagagaaagagagagagcuagcugugggauucugugua

SEQ ID NO: 506137 - RNA, 61 nt, Homo Sapiens
cccuguuuccugggcuagucuuggaccccacgagagagaaucguuccucagccucauggug

SEQ ID NO: 506138 - RNA, 61 nt, Homo Sapiens
caucuccguaaaugugcucugcuccucagcugagagagaaaaaaauaaacuguauuuggcu

SEQ ID NO: 506139 - RNA, 61 nt, Homo Sapiens
gugugcguguguguguauauguaaagauggagagagagaguaacuggaaaagauguuaaca

SEQ ID NO: 506140 - RNA, 61 nt, Homo Sapiens
gugugugcguguguguguaucaguaaagauggagagagagauuaacuggaaaagauguuaa

SEQ ID NO: 506141 - RNA, 61 nt, Homo Sapiens
augcuugugccagguggcacuugguuccagagagagagaagugcagaauucuuuugguucu

SEQ ID NO: 506142 - RNA, 61 nt, Homo Sapiens
agaugcuugugccagguggccuuugguuccagagagagagaagugcagaauucuuuugguu

SEQ ID NO: 506143 - RNA, 61 nt, Homo Sapiens
aagaaaugcuguguuuaaucaaaaagagagagagagagaaacuuaucucaaaaaaaaaaaa

SEQ ID NO: 506144 - RNA, 61 nt, Homo Sapiens
aaaagaaaugcuguguuuaaaaaaaaagagagagagagagaaccuuaucucaaaaaaaaaa

SEQ ID NO: 506145 - RNA, 61 nt, Homo Sapiens
gaaaaagaaaugcuguguuuaaaaaaaaagagagagagagaagaccuuaucucaaaaaaaa

SEQ ID NO: 506146 - RNA, 61 nt, Homo Sapiens
gagaaaaagaaaugcuguguaaaaaaaaaaagagagagagaugagaccuuaucucaaaaaa

SEQ ID NO: 506147 - RNA, 61 nt, Homo Sapiens
ugcuaaccuuguagcauguguguguguaugagagagagaaaguguguguguguguacucug

SEQ ID NO: 506148 - RNA, 61 nt, Homo Sapiens
aaugcuaaccuuguagcauguguguguguaugagagagagaguguguguguguguguacuc

SEQ ID NO: 506149 - RNA, 61 nt, Homo Sapiens
guguguguguguguguguguagagagaaugagagagagacuuguauggcugagcaagagag

SEQ ID NO: 506150 - RNA, 61 nt, Homo Sapiens
cuguguguguguguguguguagagagagaaugagagagagaguuguauggcugagcaagag

SEQ ID NO: 506151 - RNA, 61 nt, Homo Sapiens
gagagagagacuguguguguugagcaagagagagagagaaucuggagggguguuguauggc

SEQ ID NO: 506152 - RNA, 61 nt, Homo Sapiens
augagagagagacugugugugcugagcaagagagagagagauccuggagggguguuguaug

SEQ ID NO: 506153 - RNA, 61 nt, Homo Sapiens
gaaugagagagagacuguguuggcugagcaagagagagagacauccuggagggguguugua

SEQ ID NO: 506154 - RNA, 61 nt, Homo Sapiens
guauugaaauuuuguucugcauugagagagagagagagaaacaagaaaaauuuccaaaacu

SEQ ID NO: 506155 - RNA, 61 nt, Homo Sapiens
aaguauugaaauuuuguucucuauugagagagagagagagaaccaagaaaaauuuccaaaa

SEQ ID NO: 506156 - RNA, 61 nt, Homo Sapiens
gaaaguauugaaauuuuguuaacuauugagagagagagagaguaccaagaaaaauuuccaa

SEQ ID NO: 506157 - RNA, 61 nt, Homo Sapiens
gagaaaguauugaaauuuugaaaacuauugagagagagagaugguaccaagaaaaauuucc

SEQ ID NO: 506158 - RNA, 61 nt, Homo Sapiens
gagagaaaguauugaaauuuccaaaacuauugagagagagaauugguaccaagaaaaauuu

SEQ ID NO: 506159 - RNA, 61 nt, Homo Sapiens
uuuugaaucuaucuuaaaauacugagguguggagagagagacaggaucaggagcgauagag

SEQ ID NO: 506160 - RNA, 61 nt, Homo Sapiens
uugaaucuaucuuaaaauacugagguguggagagagagacaggaucaggagcgauagagag

SEQ ID NO: 506161 - RNA, 61 nt, Homo Sapiens
aguguguguguguguguguguguguguguaugagagagagagagagagacaacagagacag

SEQ ID NO: 506162 - RNA, 61 nt, Homo Sapiens
uguguguguguguguguguguguguguaugagagagagagagagagacaacagagacagag

SEQ ID NO: 506163 - RNA, 61 nt, Homo Sapiens
uguguguguguguguguguguguguaugagagagagagagagagacaacagagacagagag

SEQ ID NO: 506164 - RNA, 61 nt, Homo Sapiens
uguguguguguguguguguguguaugagagagagagagagagacaacagagacagagagag

SEQ ID NO: 506165 - RNA, 61 nt, Homo Sapiens
uguguguguguguguguguguaugagagagagagagagagacaacagagacagagagaggc

SEQ ID NO: 506166 - RNA, 61 nt, Homo Sapiens
uguguguguguguguguguaugagagagagagagagagacaacagagacagagagaggcag

SEQ ID NO: 506167 - RNA, 61 nt, Homo Sapiens
acagagagaggcagagaggcauagagagacagagagagagacaagaaacagagauagacag

SEQ ID NO: 506168 - RNA, 61 nt, Homo Sapiens
agagagaggcagagaggcauagagagacagagagagagacaagaaacagagauagacagaa

SEQ ID NO: 506169 - RNA, 61 nt, Homo Sapiens
gagaacaauauuugggagagaaaaagagagagagagagaaacugucucagaaaaaaaaaaa

SEQ ID NO: 506170 - RNA, 61 nt, Homo Sapiens
aagagaacaauauuugggagaaaaaaagagagagagagagacucugucucagaaaaaaaaa

SEQ ID NO: 506171 - RNA, 61 nt, Homo Sapiens
gaaagagaacaauauuugggaaaaaaaaagagagagagagagacucugucucagaaaaaaa

SEQ ID NO: 506172 - RNA, 61 nt, Homo Sapiens
gagaaagagaacaauauuugaaaaaaaaaaagagagagagaaagacucugucucagaaaaa

SEQ ID NO: 506173 - RNA, 61 nt, Homo Sapiens
uaagaaauuuagagaaaaauagagagagagagagagagacaggugcuguucucaggugaaa

SEQ ID NO: 506174 - RNA, 61 nt, Homo Sapiens
cauaagaaauuuagagaaaaaaagagagagagagagagagauaggugcuguucucagguga

SEQ ID NO: 506175 - RNA, 61 nt, Homo Sapiens
gacauaagaaauuuagagaagaaaagagagagagagagagauguaggugcuguucucaggu

SEQ ID NO: 506176 - RNA, 61 nt, Homo Sapiens
gagacauaagaaauuuagaggugaaaagagagagagagagaacuguaggugcuguucucag

SEQ ID NO: 506177 - RNA, 61 nt, Homo Sapiens
gagagacauaagaaauuuagaggugaaaagagagagagagaaaacuguaggugcuguucuc

SEQ ID NO: 506178 - RNA, 61 nt, Homo Sapiens
gagagagacauaagaaauuuucaggugaaaagagagagagaggaaacuguaggugcuguuc

SEQ ID NO: 506179 - RNA, 61 nt, Homo Sapiens
gaacccuuucuggguguuucuaacagaaggagagagagaauguugaccaugauaaugcaaa

SEQ ID NO: 506180 - RNA, 61 nt, Homo Sapiens
augaacccuuucuggguguuaauaacagaaggagagagagauuguugaccaugauaaugca

SEQ ID NO: 506181 - RNA, 61 nt, Homo Sapiens
uugggagugguccccaaagaagccauuaggagagagagaaaagaggaggcugaauuucuca

SEQ ID NO: 506182 - RNA, 61 nt, Homo Sapiens
aauugggagugguccccaaacaagccauuaggagagagagacgagaggaggcugaauuucu

SEQ ID NO: 506183 - RNA, 61 nt, Homo Sapiens
guagccaagagaaccccacgagagagagaaggagagagacaaagagagagagagaggagaa

SEQ ID NO: 506184 - RNA, 61 nt, Homo Sapiens
gagagagacaguagccaagagagaggagaaagagagagaaguuccuagagaaagagagaga

SEQ ID NO: 506185 - RNA, 61 nt, Homo Sapiens
agaaagagagagaaggagagagagaaagagagagagagaggcuucacaacagacauuuccu

SEQ ID NO: 506186 - RNA, 61 nt, Homo Sapiens
ggagaaagagagagaaggagcuagagaaagagagagagagaugcuucacaacagacauuuc

SEQ ID NO: 506187 - RNA, 61 nt, Homo Sapiens
gaggagaaagagagagaagguccuagagaaagagagagagaccugcuucacaacagacauu

SEQ ID NO: 506188 - RNA, 61 nt, Homo Sapiens
gccacuugcuugauuuaucaugagagaagaggagagagagagagacugagcgcuaggagug

SEQ ID NO: 506189 - RNA, 61 nt, Homo Sapiens
cacuugcuugauuuaucaugagagaagaggagagagagagagacugagcgcuaggagugug

SEQ ID NO: 506190 - RNA, 61 nt, Homo Sapiens
cuugcuugauuuaucaugagagaagaggagagagagagagacugagcgcuaggagugugug

SEQ ID NO: 506191 - RNA, 61 nt, Homo Sapiens
ugcuugauuuaucaugagagaagaggagagagagagagacugagcgcuaggagugugugua

SEQ ID NO: 506192 - RNA, 61 nt, Homo Sapiens
agagguggggagggagacagagacagaaacagagagagacagagacagagagagacugagg

SEQ ID NO: 506193 - RNA, 61 nt, Homo Sapiens
acagagacagaaacagagagagacagagacagagagagacugagggagagacucugaggac

SEQ ID NO: 506194 - RNA, 61 nt, Homo Sapiens
gagagacugagggagagacucugaggacauggagagagacucaaagagacuccaagauuca

SEQ ID NO: 506195 - RNA, 61 nt, Homo Sapiens
caagagagcgggagggagggaaggagggagggagagagauagagagagagagagagagaga

SEQ ID NO: 506196 - RNA, 61 nt, Homo Sapiens
ggagggagggaaggagggagggagagagauagagagagagagagagagagaggaugugugg

SEQ ID NO: 506197 - RNA, 61 nt, Homo Sapiens
agggagggaaggagggagggagagagauagagagagagagagagagagaggaugugugggc

SEQ ID NO: 506198 - RNA, 61 nt, Homo Sapiens
ggagggaaggagggagggagagagauagagagagagagagagagagaggaugugugggccc

SEQ ID NO: 506199 - RNA, 61 nt, Homo Sapiens
agggaaggagggagggagagagauagagagagagagagagagagaggaugugugggcccua

SEQ ID NO: 506200 - RNA, 61 nt, Homo Sapiens
ggaaggagggagggagagagauagagagagagagagagagagaggaugugugggcccuaag

SEQ ID NO: 506201 - RNA, 61 nt, Homo Sapiens
ggagggagagagauagagagagagagagagagagagagagaggaugugugggcccuaaggc

SEQ ID NO: 506202 - RNA, 61 nt, Homo Sapiens
agggagagagauagagagagagagagagagagagagagaggaugugugggcccuaaggcug

SEQ ID NO: 506203 - RNA, 61 nt, Homo Sapiens
cagaccuugucucaaaaaaugcagccugagagagagagagcaagaucgcaccacuugcacu

SEQ ID NO: 506204 - RNA, 61 nt, Homo Sapiens
gccagaccuugucucaaaaacugcagccugagagagagagaucaagaucgcaccacuugca

SEQ ID NO: 506205 - RNA, 61 nt, Homo Sapiens
gagccagaccuugucucaaacacugcagccugagagagagaggucaagaucgcaccacuug

SEQ ID NO: 506206 - RNA, 61 nt, Homo Sapiens
ggugguggugagaaguguugagagagagagagagagagaugugugugugugugugugugug

SEQ ID NO: 506207 - RNA, 61 nt, Homo Sapiens
ugggugguggugagaaguguugagagagagagagagagagaugugugugugugugugugug

SEQ ID NO: 506208 - RNA, 61 nt, Homo Sapiens
gaugggugguggugagaaguugugagagagagagagagagaugugugugugugugugugug

SEQ ID NO: 506209 - RNA, 61 nt, Homo Sapiens
gagaugggugguggugagaaugugugagagagagagagagaugugugugugugugugugug

SEQ ID NO: 506210 - RNA, 61 nt, Homo Sapiens
gagagaugggugguggugagugugugugagagagagagagaugugugugugugugugugug

SEQ ID NO: 506211 - RNA, 61 nt, Homo Sapiens
gagagagaugggugguggugugugugugugagagagagagaagugugugugugugugugug

SEQ ID NO: 506212 - RNA, 61 nt, Homo Sapiens
gagagagagaugggugguggugugugugugugagagagagagaagugugugugugugugug

SEQ ID NO: 506213 - RNA, 61 nt, Homo Sapiens
acugauggggaaaacaagcucacgaaggagagagagagaaacacacacacacacacacaca

SEQ ID NO: 506214 - RNA, 61 nt, Homo Sapiens
aaacugauggggaaaacaagcacacgaaggagagagagagacacacacacacacacacaca

SEQ ID NO: 506215 - RNA, 61 nt, Homo Sapiens
gaaaacugauggggaaaacacacacacgaaggagagagagacacacacacacacacacaca

SEQ ID NO: 506216 - RNA, 61 nt, Homo Sapiens
cccuggccuuuccuuuuguaauaagaaagaagagagagaacuugaugcaaaguccacgaaa

SEQ ID NO: 506217 - RNA, 61 nt, Homo Sapiens
ucucugaccucccugcuugcauugggucugggagagagaguggaauauuugguagggaccu

SEQ ID NO: 506218 - RNA, 61 nt, Homo Sapiens
ugucauuccccacacacguccuguucaccucgagagagagagagagagagcaccuuucuuc

SEQ ID NO: 506219 - RNA, 61 nt, Homo Sapiens
ucauuccccacacacguccuguucaccucgagagagagagagagagagcaccuuucuuccg

SEQ ID NO: 506220 - RNA, 61 nt, Homo Sapiens
auuccccacacacguccuguucaccucgagagagagagagagagagcaccuuucuuccguc

SEQ ID NO: 506221 - RNA, 61 nt, Homo Sapiens
uccccacacacguccuguucaccucgagagagagagagagagagcaccuuucuuccgucug

SEQ ID NO: 506222 - RNA, 61 nt, Homo Sapiens
cccacacacguccuguucaccucgagagagagagagagagagcaccuuucuuccgucuguu

SEQ ID NO: 506223 - RNA, 61 nt, Homo Sapiens
cacacacguccuguucaccucgagagagagagagagagagcaccuuucuuccgucuguuca

SEQ ID NO: 506224 - RNA, 61 nt, Homo Sapiens
gauuuuaaguguugaggagcagaggugagaagagagagagagagagaaagucaaauaaagu

SEQ ID NO: 506225 - RNA, 61 nt, Homo Sapiens
uuuuaaguguugaggagcagaggugagaagagagagagagagagaaagucaaauaaaguca

SEQ ID NO: 506226 - RNA, 61 nt, Homo Sapiens
uuaaguguugaggagcagaggugagaagagagagagagagagaaagucaaauaaagucaaa

SEQ ID NO: 506227 - RNA, 61 nt, Homo Sapiens
aaguguugaggagcagaggugagaagagagagagagagagaaagucaaauaaagucaaaga

SEQ ID NO: 506228 - RNA, 61 nt, Homo Sapiens
guguugaggagcagaggugagaagagagagagagagagaaagucaaauaaagucaaagacc

SEQ ID NO: 506229 - RNA, 61 nt, Homo Sapiens
aguuaaugaacaugagguagguaaauagagagagagagaagccacccaagacauuuuaaua

SEQ ID NO: 506230 - RNA, 61 nt, Homo Sapiens
agaguuaaugaacaugagguuaguaaauagagagagagagaccccacccaagacauuuuaa

SEQ ID NO: 506231 - RNA, 61 nt, Homo Sapiens
gaagaguuaaugaacaugagaauaguaaauagagagagagaacccccacccaagacauuuu

SEQ ID NO: 506232 - RNA, 61 nt, Homo Sapiens
ggaacgcgaacgcuuggaaaaaaacuagagagagagagaaucgccuagaaauugaaaggca

SEQ ID NO: 506233 - RNA, 61 nt, Homo Sapiens
auggaacgcgaacgcuuggacaaaaacuagagagagagagaagcgccuagaaauugaaagg

SEQ ID NO: 506234 - RNA, 61 nt, Homo Sapiens
gaauggaacgcgaacgcuugggcaaaaacuagagagagagaagagcgccuagaaauugaaa

SEQ ID NO: 506235 - RNA, 61 nt, Homo Sapiens
gccuagaaauugaaaggcaagcuuacagagagagagagagcugaacgggaagaacgggaac

SEQ ID NO: 506236 - RNA, 61 nt, Homo Sapiens
gcgccuagaaauugaaaggcacgcuuacagagagagagagacgugaacgggaagaacggga

SEQ ID NO: 506237 - RNA, 61 nt, Homo Sapiens
gagcgccuagaaauugaaaggaacgcuuacagagagagagauucgugaacgggaagaacgg

SEQ ID NO: 506238 - RNA, 61 nt, Homo Sapiens
gucgagagcgagaacgcauugagagauugcagagagagagcacugauuuuugguagacgaa

SEQ ID NO: 506239 - RNA, 61 nt, Homo Sapiens
agaagacagagagauuaaagggagagagagagagagagaggacagauggagauccuuucag

SEQ ID NO: 506240 - RNA, 61 nt, Homo Sapiens
ggagaagacagagagauuaaagggagagagagagagagagacaacagauggagauccuuuc

SEQ ID NO: 506241 - RNA, 61 nt, Homo Sapiens
gaggagaagacagagagauuucagggagagagagagagagaugcaacagauggagauccuu

SEQ ID NO: 506242 - RNA, 61 nt, Homo Sapiens
gagaggagaagacagagagauuucagggagagagagagagaggugcaacagauggagaucc

SEQ ID NO: 506243 - RNA, 61 nt, Homo Sapiens
gagagaggagaagacagagaccuuucagggagagagagagacuggugcaacagauggagau

SEQ ID NO: 506244 - RNA, 61 nt, Homo Sapiens
gagagagaggagaagacagaauccuuucagggagagagagauccuggugcaacagauggag

SEQ ID NO: 506245 - RNA, 61 nt, Homo Sapiens
ugcauuuccugcugggguccugguuccucaggagagagagaccacagggugagagugagcc

SEQ ID NO: 506246 - RNA, 61 nt, Homo Sapiens
cauuuccugcugggguccugguuccucaggagagagagaccacagggugagagugagccag

SEQ ID NO: 506247 - RNA, 61 nt, Homo Sapiens
acauggccuuggcaguuauuuuuccaucaccgagagagagagacagagagagaaaauaaac

SEQ ID NO: 506248 - RNA, 61 nt, Homo Sapiens
auggccuuggcaguuauuuuuccaucaccgagagagagagacagagagagaaaauaaacua

SEQ ID NO: 506249 - RNA, 61 nt, Homo Sapiens
ggccuuggcaguuauuuuuccaucaccgagagagagagacagagagagaaaauaaacuacc

SEQ ID NO: 506250 - RNA, 61 nt, Homo Sapiens
guuauuuuuccaucaccgagagagagagacagagagagaaaauaaacuaccccuccuauuc

SEQ ID NO: 506251 - RNA, 61 nt, Homo Sapiens
cuguugaaucagaaacagauagagaaagagagagagagaugagaaagagagugagagagag

SEQ ID NO: 506252 - RNA, 61 nt, Homo Sapiens
ugcuguugaaucagaaacagagagagaaagagagagagagaagagaaagagagugagagag

SEQ ID NO: 506253 - RNA, 61 nt, Homo Sapiens
gaugcuguugaaucagaaacagagagagaaagagagagagaagagagaaagagagugagag

SEQ ID NO: 506254 - RNA, 61 nt, Homo Sapiens
gagagagagagaugcuguugagagugagagagagagagaaaagagagugagagagagaaag

SEQ ID NO: 506255 - RNA, 61 nt, Homo Sapiens
aagagagagagagaugcuguagagagugagagagagagagaccagagagugagagagagaa

SEQ ID NO: 506256 - RNA, 61 nt, Homo Sapiens
gaaagagagagagagaugcuaaagagagugagagagagagaagccagagagugagagagag

SEQ ID NO: 506257 - RNA, 61 nt, Homo Sapiens
gagaaagagagagagagaugagaaagagagugagagagagaagagccagagagugagagag

SEQ ID NO: 506258 - RNA, 61 nt, Homo Sapiens
gagagugagagagagagagaccagagagugagagagagaaaaguaaccaguuuccagagag

SEQ ID NO: 506259 - RNA, 61 nt, Homo Sapiens
aagagagugagagagagagaagccagagagugagagagagaagaguaaccaguuuccagag

SEQ ID NO: 506260 - RNA, 61 nt, Homo Sapiens
gagacagagaaauaagcauuuuguuaaaagagagagagacacugaggccgcugguagacuu

SEQ ID NO: 506261 - RNA, 61 nt, Homo Sapiens
cagagacagagaaauaagcauuuuguuaaaagagagagagagccugaggccgcugguagac

SEQ ID NO: 506262 - RNA, 61 nt, Homo Sapiens
ccuuguuguuggauaggaaaauaaauggagagagagagaagacuuuacaaaggaaauuuga

SEQ ID NO: 506263 - RNA, 61 nt, Homo Sapiens
agccuuguuguuggauaggagaauaaauggagagagagagaccacuuuacaaaggaaauuu

SEQ ID NO: 506264 - RNA, 61 nt, Homo Sapiens
gaagccuuguuguuggauaguugaauaaauggagagagagaggccacuuuacaaaggaaau

SEQ ID NO: 506265 - RNA, 61 nt, Homo Sapiens
agaagugcuggggcagggaggcccaggagaugagagagaagguccgaguaggugauagaag

SEQ ID NO: 506266 - RNA, 61 nt, Homo Sapiens
cacggaguugccaggagcaaaccaaagugaagagagagauaggaagcugccucggggccac

SEQ ID NO: 506267 - RNA, 61 nt, Homo Sapiens
gaaaggucuaaaugcccacuugaaugaagcugagagagagaucuagcaaaagcuaaaacuc

SEQ ID NO: 506268 - RNA, 61 nt, Homo Sapiens
aaggucuaaaugcccacuugaaugaagcugagagagagaucuagcaaaagcuaaaacucau

SEQ ID NO: 506269 - RNA, 61 nt, Homo Sapiens
cacuccggagugagaagcuuugcccuccuaagagagagagacagagagacagagagagaga

SEQ ID NO: 506270 - RNA, 61 nt, Homo Sapiens
cuccggagugagaagcuuugcccuccuaagagagagagacagagagacagagagagagaaa

SEQ ID NO: 506271 - RNA, 61 nt, Homo Sapiens
ugcccuccuaagagagagagacagagagacagagagagagaaagagagagugugugggucu

SEQ ID NO: 506272 - RNA, 61 nt, Homo Sapiens
cccuccuaagagagagagacagagagacagagagagagaaagagagagugugugggucuau

SEQ ID NO: 506273 - RNA, 61 nt, Homo Sapiens
aauuuaucucugugaccugccagggagaggggagagagagagagaugcuguugagcacaug

SEQ ID NO: 506274 - RNA, 61 nt, Homo Sapiens
uuuaucucugugaccugccagggagaggggagagagagagagaugcuguugagcacaugac

SEQ ID NO: 506275 - RNA, 61 nt, Homo Sapiens
uaucucugugaccugccagggagaggggagagagagagagaugcuguugagcacaugacaa

SEQ ID NO: 506276 - RNA, 61 nt, Homo Sapiens
ucucugugaccugccagggagaggggagagagagagagaugcuguugagcacaugacaaaa

SEQ ID NO: 506277 - RNA, 61 nt, Homo Sapiens
augagagcacaguagcccaguccaugugggagagagagagccugggagcuauuuacaaaug

SEQ ID NO: 506278 - RNA, 61 nt, Homo Sapiens
gcaugagagcacaguagcccuguccaugugggagagagagaaccugggagcuauuuacaaa

SEQ ID NO: 506279 - RNA, 61 nt, Homo Sapiens
gagcaggaggucggggcacuagagagggacagagagagauaaggcagagagacagagaggg

SEQ ID NO: 506280 - RNA, 61 nt, Homo Sapiens
gaggggaagagaggcagagaagacagagggagagagagacaggagacagagagggagagag

SEQ ID NO: 506281 - RNA, 61 nt, Homo Sapiens
cagaggggaagagaggcagaagagacagagggagagagagagaggagacagagagggagag

SEQ ID NO: 506282 - RNA, 61 nt, Homo Sapiens
gagggagagagagacagaggacagagagggagagagagacagagggagagaaacagaggag

SEQ ID NO: 506283 - RNA, 61 nt, Homo Sapiens
cagagggagagagagacagaagacagagagggagagagagagagagggagagaaacagagg

SEQ ID NO: 506284 - RNA, 61 nt, Homo Sapiens
gaggaggcagagagggagagagauaugaggagagagagacagagguggggagaggggagag

SEQ ID NO: 506285 - RNA, 61 nt, Homo Sapiens
cagaggaggcagagagggagagagauaugaggagagagagagagagguggggagaggggag

SEQ ID NO: 506286 - RNA, 61 nt, Homo Sapiens
ugaggagagagagacagagguggggagaggggagagagauaaggggagagagaaagagagg

SEQ ID NO: 506287 - RNA, 61 nt, Homo Sapiens
gagagguggggagaggggagggagaggaggggagagagaaaaaaggaggagggagagagau

SEQ ID NO: 506288 - RNA, 61 nt, Homo Sapiens
gagaggaggggagagagaaaaaaggaggagggagagagauguaaaugggggucagggaggg

SEQ ID NO: 506289 - RNA, 61 nt, Homo Sapiens
aagaagaagaagagacacaaaaaaagagagagagagagaagugccugauuggaaaaaaaaa

SEQ ID NO: 506290 - RNA, 61 nt, Homo Sapiens
agaagaagaagaagagacacaaaaaaagagagagagagagaagugccugauuggaaaaaaa

SEQ ID NO: 506291 - RNA, 61 nt, Homo Sapiens
gaagaagaagaagaagagacaaaaaaaaagagagagagagaagagugccugauuggaaaaa

SEQ ID NO: 506292 - RNA, 61 nt, Homo Sapiens
gagaagaagaagaagaagagaaaaaaaaaaagagagagagaagagagugccugauuggaaa

SEQ ID NO: 506293 - RNA, 61 nt, Homo Sapiens
acagaagaaaagcaauugccgcaacaucagagagagagaacaucagcaucuggcauccaaa

SEQ ID NO: 506294 - RNA, 61 nt, Homo Sapiens
acacagaagaaaagcaauugaagcaacaucagagagagagauuaucagcaucuggcaucca

SEQ ID NO: 506295 - RNA, 61 nt, Homo Sapiens
gaaagaaagaaaggcugccuagaaagagagagagagagaaaaguuauuuggaaagaaagaa

SEQ ID NO: 506296 - RNA, 61 nt, Homo Sapiens
aagaaagaaagaaaggcugcaaagaaagagagagagagagaaaaguuauuuggaaagaaag

SEQ ID NO: 506297 - RNA, 61 nt, Homo Sapiens
gaaagaaagaaagaaaggcuagaaagaaagagagagagagaaaaaaguuauuuggaaagaa

SEQ ID NO: 506298 - RNA, 61 nt, Homo Sapiens
gagaaagaaagaaagaaaggaaagaaagaaagagagagagaggaaaaaguuauuuggaaag

SEQ ID NO: 506299 - RNA, 61 nt, Homo Sapiens
gaaugcaguugcauugauucagagagagaaagagagagaauaaugggcagaggugagagag

SEQ ID NO: 506300 - RNA, 61 nt, Homo Sapiens
gagagagaaugaaugcaguuggugagagagagagagagaaagugccuuuugaaugggcaga

SEQ ID NO: 506301 - RNA, 61 nt, Homo Sapiens
aagagagagaaugaaugcaggaggugagagagagagagagacagugccuuuugaaugggca

SEQ ID NO: 506302 - RNA, 61 nt, Homo Sapiens
gaaagagagagaaugaaugccagaggugagagagagagagauccagugccuuuugaauggg

SEQ ID NO: 506303 - RNA, 61 nt, Homo Sapiens
gagaaagagagagaaugaauggcagaggugagagagagagaacuccagugccuuuugaaug

SEQ ID NO: 506304 - RNA, 61 nt, Homo Sapiens
gagagaaagagagagaaugaugggcagaggugagagagagaggacuccagugccuuuugaa

SEQ ID NO: 506305 - RNA, 61 nt, Homo Sapiens
gagcggaggcuaaggacugggggcaucuggagagagagaggcuauggacacggaguggggc

SEQ ID NO: 506306 - RNA, 61 nt, Homo Sapiens
gggagcggaggcuaaggacugcgggcaucuggagagagagaugcuauggacacggaguggg

SEQ ID NO: 506307 - RNA, 61 nt, Homo Sapiens
guguguuuguguguuucaaguguguguaugagagagagaguggaauuucagugggucucug

SEQ ID NO: 506308 - RNA, 61 nt, Homo Sapiens
guguguguuuguguguuucauguguguguaugagagagagagaggaauuucagugggucuc

SEQ ID NO: 506309 - RNA, 61 nt, Homo Sapiens
uggugauacuccaacaccgucuuucccaugagagagagaacuacaaaguguugauccccuu

SEQ ID NO: 506310 - RNA, 61 nt, Homo Sapiens
acuggugauacuccaacaccuucuuucccaugagagagagaucuacaaaguguugaucccc

SEQ ID NO: 506311 - RNA, 61 nt, Homo Sapiens
uagcaucuguaacagcauuaacugucuuaaagagagagagagagaauuccgaauuggggaa

SEQ ID NO: 506312 - RNA, 61 nt, Homo Sapiens
gcaucuguaacagcauuaacugucuuaaagagagagagagagaauuccgaauuggggaaca

SEQ ID NO: 506313 - RNA, 61 nt, Homo Sapiens
aucuguaacagcauuaacugucuuaaagagagagagagagaauuccgaauuggggaacaca

SEQ ID NO: 506314 - RNA, 61 nt, Homo Sapiens
cuguaacagcauuaacugucuuaaagagagagagagagaauuccgaauuggggaacacacg

SEQ ID NO: 506315 - RNA, 61 nt, Homo Sapiens
ugaacgggcccacccacacguuguauauucagagagagagagggagucaaggugugaccgu

SEQ ID NO: 506316 - RNA, 61 nt, Homo Sapiens
aacgggcccacccacacguuguauauucagagagagagagggagucaaggugugaccgucg

SEQ ID NO: 506317 - RNA, 61 nt, Homo Sapiens
ucugaaagaaagagagaaagaaagaaagaaagagagagaaagaaagaaagaaagaaaggga

SEQ ID NO: 506318 - RNA, 61 nt, Homo Sapiens
auggaaggaaggaaggaaaaagaaagagaaagagagagagagagaaagaaaaagaaagaaa

SEQ ID NO: 506319 - RNA, 61 nt, Homo Sapiens
ggaaggaaggaaggaaaaagaaagagaaagagagagagagagaaagaaaaagaaagaaaag

SEQ ID NO: 506320 - RNA, 61 nt, Homo Sapiens
aaggaaggaaggaaaaagaaagagaaagagagagagagagaaagaaaaagaaagaaaagua

SEQ ID NO: 506321 - RNA, 61 nt, Homo Sapiens
ggaaggaaggaaaaagaaagagaaagagagagagagagaaagaaaaagaaagaaaaguaag

SEQ ID NO: 506322 - RNA, 61 nt, Homo Sapiens
acucgagcucaagaauucaagaccugggcaagagagagagacuuugucucuauuaaaaaua

SEQ ID NO: 506323 - RNA, 61 nt, Homo Sapiens
ucgagcucaagaauucaagaccugggcaagagagagagacuuugucucuauuaaaaauaaa

SEQ ID NO: 506324 - RNA, 61 nt, Homo Sapiens
uuagacacacaaaacaaacaaacacaugggggagagagacuuggaagaggaggaggaggag

SEQ ID NO: 506325 - RNA, 61 nt, Homo Sapiens
cuuggaagaggaggaggaggaggagaaggaggagagagaggggaagagacaaagugggugu

SEQ ID NO: 506326 - RNA, 61 nt, Homo Sapiens
acaccauuucccuccucuagaccucaucuuggagagagagauguuggauggggccaucuau

SEQ ID NO: 506327 - RNA, 61 nt, Homo Sapiens
accauuucccuccucuagaccucaucuuggagagagagauguuggauggggccaucuauuc

SEQ ID NO: 506328 - RNA, 61 nt, Homo Sapiens
ucuccucugcauuuuggguucgggagagagagagagagaagcguggaaccccgaagccugg

SEQ ID NO: 506329 - RNA, 61 nt, Homo Sapiens
agucuccucugcauuuugggggcgggagagagagagagagacccguggaaccccgaagccu

SEQ ID NO: 506330 - RNA, 61 nt, Homo Sapiens
gaagucuccucugcauuuugcuggcgggagagagagagagagccccguggaaccccgaagc

SEQ ID NO: 506331 - RNA, 61 nt, Homo Sapiens
gagaagucuccucugcauuugccuggcgggagagagagagagggccccguggaaccccgaa

SEQ ID NO: 506332 - RNA, 61 nt, Homo Sapiens
gagagaagucuccucugcauaagccuggcgggagagagagaaugggccccguggaaccccg

SEQ ID NO: 506333 - RNA, 61 nt, Homo Sapiens
gcacacaugugucucuguagagugagagagagagagagauugugcgcacgcccuuuugugc

SEQ ID NO: 506334 - RNA, 61 nt, Homo Sapiens
uugcacacaugugucucugugcagugagagagagagagagagugugcgcacgcccuuuugu

SEQ ID NO: 506335 - RNA, 61 nt, Homo Sapiens
gauugcacacaugugucucugugcagugagagagagagagagugugugcgcacgcccuuuu

SEQ ID NO: 506336 - RNA, 61 nt, Homo Sapiens
gagauugcacacaugugucuuugugcagugagagagagagagugugugugcgcacgcccuu

SEQ ID NO: 506337 - RNA, 61 nt, Homo Sapiens
gagagauugcacacauguguuuuugugcagugagagagagagugugugugugcgcacgccc

SEQ ID NO: 506338 - RNA, 61 nt, Homo Sapiens
gagagcagaagaaauuccuaagagagagcgagagagagagcaaaaaaaaaaagcgagcgag

SEQ ID NO: 506339 - RNA, 61 nt, Homo Sapiens
gcgagagcagaagaaauuccagagagagagcgagagagagaaaaaaaaaaaaaagcgagcg

SEQ ID NO: 506340 - RNA, 61 nt, Homo Sapiens
gagagagagagcgagagcagaaagcgagcgagagagagagcaaagacaaaaaaaaaaaaaa

SEQ ID NO: 506341 - RNA, 61 nt, Homo Sapiens
gcgagagagagagcgagagcaaaaagcgagcgagagagagagaaaagacaaaaaaaaaaaa

SEQ ID NO: 506342 - RNA, 61 nt, Homo Sapiens
auccacaaauuccaaugucaggauggggggagagagagaaaccagggucuggugauggcag

SEQ ID NO: 506343 - RNA, 61 nt, Homo Sapiens
aaauccacaaauuccaauguagggauggggggagagagagaccccagggucuggugauggc

SEQ ID NO: 506344 - RNA, 61 nt, Homo Sapiens
aaaaaucacccaccacccccagagagacagagagagagaaaaaaacagaaacccgagaaag

SEQ ID NO: 506345 - RNA, 61 nt, Homo Sapiens
aaaaaaaucacccaccacccagagagagacagagagagagaagaaaacagaaacccgagaa

SEQ ID NO: 506346 - RNA, 61 nt, Homo Sapiens
gagagagagaaaaaaaaucaaacccgagaaagagagagacaaaccaaaaagagaaaacaga

SEQ ID NO: 506347 - RNA, 61 nt, Homo Sapiens
gggcccaagagagacagcacagagagagagagagagagaaggcagagagagagagagagaa

SEQ ID NO: 506348 - RNA, 61 nt, Homo Sapiens
aggggcccaagagagacagcaaagagagagagagagagagacagcagagagagagagagag

SEQ ID NO: 506349 - RNA, 61 nt, Homo Sapiens
gaaggggcccaagagagacaagaaagagagagagagagagaggcagcagagagagagagag

SEQ ID NO: 506350 - RNA, 61 nt, Homo Sapiens
gagaaggggcccaagagagaagagaaagagagagagagagacgggcagcagagagagagag

SEQ ID NO: 506351 - RNA, 61 nt, Homo Sapiens
gagagaaggggcccaagagaagagagaaagagagagagagacccgggcagcagagagagag

SEQ ID NO: 506352 - RNA, 61 nt, Homo Sapiens
gagagagaaggggcccaagaagagagagaaagagagagagauccccgggcagcagagagag

SEQ ID NO: 506353 - RNA, 61 nt, Homo Sapiens
gagagagagagagagagaaggcagagagagagagagagaaaucccacccccuccccgggca

SEQ ID NO: 506354 - RNA, 61 nt, Homo Sapiens
aagagagagagagagagagacagcagagagagagagagagaccucccacccccuccccggg

SEQ ID NO: 506355 - RNA, 61 nt, Homo Sapiens
gaaagagagagagagagagaggcagcagagagagagagagagcccucccacccccuccccg

SEQ ID NO: 506356 - RNA, 61 nt, Homo Sapiens
gagaaagagagagagagagacgggcagcagagagagagagacugcccucccacccccuccc

SEQ ID NO: 506357 - RNA, 61 nt, Homo Sapiens
gagagaaagagagagagagacccgggcagcagagagagagagccugcccucccacccccuc

SEQ ID NO: 506358 - RNA, 61 nt, Homo Sapiens
guaaaggcaguaaugccuucaggaaacaagagagagagaaauuccauuaaguacaugugcc

SEQ ID NO: 506359 - RNA, 61 nt, Homo Sapiens
aaguaaaggcaguaaugccuccaggaaacaagagagagagauuuuccauuaaguacaugug

SEQ ID NO: 506360 - RNA, 61 nt, Homo Sapiens
gaggacaccgaacugggcuggggaggagagcgagagagaguuuauauauuauauagagaga

SEQ ID NO: 506361 - RNA, 61 nt, Homo Sapiens
cauauauuauauauuauauagagagaauggagagagagaaaaagauacagagagucaaaua

SEQ ID NO: 506362 - RNA, 61 nt, Homo Sapiens
aacauauauuauauauuauauagagagaauggagagagagauaaagauacagagagucaaa

SEQ ID NO: 506363 - RNA, 61 nt, Homo Sapiens
gcugugacucaaggccacggcucuacuaaaagagagagaggaagcgagagagagagagaaa

SEQ ID NO: 506364 - RNA, 61 nt, Homo Sapiens
ccacggcucuacuaaaagagagagaggaagcgagagagagagagaaaaaacaaaaaacaga

SEQ ID NO: 506365 - RNA, 61 nt, Homo Sapiens
acggcucuacuaaaagagagagaggaagcgagagagagagagaaaaaacaaaaaacagaaa

SEQ ID NO: 506366 - RNA, 61 nt, Homo Sapiens
ggcucuacuaaaagagagagaggaagcgagagagagagagaaaaaacaaaaaacagaaaac

SEQ ID NO: 506367 - RNA, 61 nt, Homo Sapiens
cucuacuaaaagagagagaggaagcgagagagagagagaaaaaacaaaaaacagaaaacac

SEQ ID NO: 506368 - RNA, 61 nt, Homo Sapiens
cgagaggucccaguacaaggguuggugcugagagagagaacucgcuuuaguuuucaaccuu

SEQ ID NO: 506369 - RNA, 61 nt, Homo Sapiens
accgagaggucccaguacaauuguuggugcugagagagagaucucgcuuuaguuuucaacc

SEQ ID NO: 506370 - RNA, 61 nt, Homo Sapiens
agagggugggaggucccggagcagagccggagagagagacggcgccgccuccuagacucga

SEQ ID NO: 506371 - RNA, 61 nt, Homo Sapiens
cgagagggugggaggucccggagcagagccggagagagagacagcgccgccuccuagacuc

SEQ ID NO: 506372 - RNA, 61 nt, Homo Sapiens
uccgaagcaauaacaacacccuuuauaaagagagagagagcuccccuggugucugcacagc

SEQ ID NO: 506373 - RNA, 61 nt, Homo Sapiens
gcuccgaagcaauaacaacagccuuuauaaagagagagagacuuccccuggugucugcaca

SEQ ID NO: 506374 - RNA, 61 nt, Homo Sapiens
ccuuguuacauuuccugcuaaacaugcaagagagagagaaguuagcacuguucacuacauu

SEQ ID NO: 506375 - RNA, 61 nt, Homo Sapiens
agccuuguuacauuuccugcuuaacaugcaagagagagagauauuagcacuguucacuaca

SEQ ID NO: 506376 - RNA, 61 nt, Homo Sapiens
cagagugcacgugacccgcagcagguuugcagagagagaccuauucccagacugaggcagg

SEQ ID NO: 506377 - RNA, 61 nt, Homo Sapiens
uccacuccacucuuccuuaacagauuuacaggagagagaaacuccuuaccacccaccaggc

SEQ ID NO: 506378 - RNA, 61 nt, Homo Sapiens
agaaaacgacauuaggaauuucuuuuuuagagagagagauuauuauaggauuuuuuuuucu

SEQ ID NO: 506379 - RNA, 61 nt, Homo Sapiens
uuagaaaacgacauuaggaacuucuuuuuuagagagagagaaaauuauaggauuuuuuuuu

SEQ ID NO: 506380 - RNA, 61 nt, Homo Sapiens
gaagacagugguucugauggguucagcccuagagagagagagagaagcggggagaauaaga

SEQ ID NO: 506381 - RNA, 61 nt, Homo Sapiens
agacagugguucugauggguucagcccuagagagagagagagaagcggggagaauaagagu

SEQ ID NO: 506382 - RNA, 61 nt, Homo Sapiens
acagugguucugauggguucagcccuagagagagagagagaagcggggagaauaagagugc

SEQ ID NO: 506383 - RNA, 61 nt, Homo Sapiens
agugguucugauggguucagcccuagagagagagagagaagcggggagaauaagagugcac

SEQ ID NO: 506384 - RNA, 61 nt, Homo Sapiens
gagccagaaaguaacacagagcucaugcuuggagagagagagucuuggccauggcuuuccu

SEQ ID NO: 506385 - RNA, 61 nt, Homo Sapiens
gccagaaaguaacacagagcucaugcuuggagagagagagucuuggccauggcuuuccugc

SEQ ID NO: 506386 - RNA, 61 nt, Homo Sapiens
cucuccggaucugucgauuuggagaccuuccgagagagaaccaagggugcagucagcuuaa

SEQ ID NO: 506387 - RNA, 61 nt, Homo Sapiens
cauauuuagaaguaaaacacaaaacaaaaaagagagagaaaagaaaagaaaucacaaugua

SEQ ID NO: 506388 - RNA, 61 nt, Homo Sapiens
cucugggccuccagcgcuggguuugucgagugagagagagagaggagcuuggguugcuucc

SEQ ID NO: 506389 - RNA, 61 nt, Homo Sapiens
cugggccuccagcgcuggguuugucgagugagagagagagaggagcuuggguugcuucccu

SEQ ID NO: 506390 - RNA, 61 nt, Homo Sapiens
gggccuccagcgcuggguuugucgagugagagagagagaggagcuuggguugcuucccugu

SEQ ID NO: 506391 - RNA, 61 nt, Homo Sapiens
gaaagucuccagaccaggaaagaaggaaagagagagagaaauagaagagggaaggaaagag

SEQ ID NO: 506392 - RNA, 61 nt, Homo Sapiens
aagaaagucuccagaccaggagagaaggaaagagagagagacauagaagagggaaggaaag

SEQ ID NO: 506393 - RNA, 61 nt, Homo Sapiens
gucaaaauguuacaaccgcuguaaaaugacggagagagagagaaagaaucccagacauuaa

SEQ ID NO: 506394 - RNA, 61 nt, Homo Sapiens
caaaauguuacaaccgcuguaaaaugacggagagagagagaaagaaucccagacauuaacg

SEQ ID NO: 506395 - RNA, 61 nt, Homo Sapiens
aaauguuacaaccgcuguaaaaugacggagagagagagaaagaaucccagacauuaacggu

SEQ ID NO: 506396 - RNA, 64 nt, Homo Sapiens; identical to SEQ ID NO: 90267

SEQ ID NO: 506397 - RNA, 64 nt, Homo Sapiens; identical to SEQ ID NO: 90268

SEQ ID NO: 506398 - RNA, 64 nt, Homo Sapiens; identical to SEQ ID NO: 90269

SEQ ID NO: 506399 - RNA, 64 nt, Homo Sapiens; identical to SEQ ID NO: 90270

SEQ ID NO: 506400 - RNA, 64 nt, Homo Sapiens; identical to SEQ ID NO: 90271

SEQ ID NO: 506401 - RNA, 64 nt, Homo Sapiens; identical to SEQ ID NO: 90272

SEQ ID NO: 506402 - RNA, 64 nt, Homo Sapiens; identical to SEQ ID NO: 90273

SEQ ID NO: 506403 - RNA, 64 nt, Homo Sapiens; identical to SEQ ID NO: 90274

SEQ ID NO: 506404 - RNA, 64 nt, Homo Sapiens; identical to SEQ ID NO: 90275

SEQ ID NO: 506405 - RNA, 64 nt, Homo Sapiens; identical to SEQ ID NO: 90276

SEQ ID NO: 506406 - RNA, 64 nt, Homo Sapiens; identical to SEQ ID NO: 90277

SEQ ID NO: 506407 - RNA, 64 nt, Homo Sapiens; identical to SEQ ID NO: 90278

SEQ ID NO: 506408 - RNA, 64 nt, Homo Sapiens; identical to SEQ ID NO: 90279

SEQ ID NO: 506409 - RNA, 64 nt, Homo Sapiens; identical to SEQ ID NO: 90280

SEQ ID NO: 506410 - RNA, 64 nt, Homo Sapiens; identical to SEQ ID NO: 90281

SEQ ID NO: 506411 - RNA, 64 nt, Homo Sapiens; identical to SEQ ID NO: 90282

SEQ ID NO: 506412 - RNA, 64 nt, Homo Sapiens; identical to SEQ ID NO: 90283

SEQ ID NO: 506413 - RNA, 64 nt, Homo Sapiens; identical to SEQ ID NO: 90284

SEQ ID NO: 506414 - RNA, 64 nt, Homo Sapiens; identical to SEQ ID NO: 90285

SEQ ID NO: 506415 - RNA, 64 nt, Homo Sapiens; identical to SEQ ID NO: 90286

SEQ ID NO: 506416 - RNA, 64 nt, Homo Sapiens; identical to SEQ ID NO: 90287

SEQ ID NO: 506417 - RNA, 64 nt, Homo Sapiens; identical to SEQ ID NO: 175595

SEQ ID NO: 506418 - RNA, 64 nt, Homo Sapiens; identical to SEQ ID NO: 175596

SEQ ID NO: 506419 - RNA, 64 nt, Homo Sapiens; identical to SEQ ID NO: 175597

SEQ ID NO: 506420 - RNA, 64 nt, Homo Sapiens; identical to SEQ ID NO: 175598

SEQ ID NO: 506421 - RNA, 64 nt, Homo Sapiens; identical to SEQ ID NO: 175599

SEQ ID NO: 506422 - RNA, 64 nt, Homo Sapiens; identical to SEQ ID NO: 175600

SEQ ID NO: 506423 - RNA, 64 nt, Homo Sapiens; identical to SEQ ID NO: 175601

SEQ ID NO: 506424 - RNA, 64 nt, Homo Sapiens; identical to SEQ ID NO: 175602

SEQ ID NO: 506425 - RNA, 64 nt, Homo Sapiens; identical to SEQ ID NO: 175603

SEQ ID NO: 506426 - RNA, 64 nt, Homo Sapiens; identical to SEQ ID NO: 175604

SEQ ID NO: 506427 - RNA, 64 nt, Homo Sapiens; identical to SEQ ID NO: 175605

SEQ ID NO: 506428 - RNA, 64 nt, Homo Sapiens; identical to SEQ ID NO: 175606

SEQ ID NO: 506429 - RNA, 64 nt, Homo Sapiens; identical to SEQ ID NO: 175607

SEQ ID NO: 506430 - RNA, 64 nt, Homo Sapiens; identical to SEQ ID NO: 175608

SEQ ID NO: 506431 - RNA, 64 nt, Homo Sapiens; identical to SEQ ID NO: 175609

SEQ ID NO: 506432 - RNA, 64 nt, Homo Sapiens; identical to SEQ ID NO: 175610

SEQ ID NO: 506433 - RNA, 64 nt, Homo Sapiens; identical to SEQ ID NO: 175611

SEQ ID NO: 506434 - RNA, 64 nt, Homo Sapiens; identical to SEQ ID NO: 175612

SEQ ID NO: 506435 - RNA, 64 nt, Homo Sapiens; identical to SEQ ID NO: 175613

SEQ ID NO: 506436 - RNA, 64 nt, Homo Sapiens; identical to SEQ ID NO: 175614

SEQ ID NO: 506437 - RNA, 64 nt, Homo Sapiens; identical to SEQ ID NO: 175615

SEQ ID NO: 506438 - RNA, 64 nt, Homo Sapiens; identical to SEQ ID NO: 175616

SEQ ID NO: 506439 - RNA, 64 nt, Homo Sapiens; identical to SEQ ID NO: 175617

SEQ ID NO: 506440 - RNA, 64 nt, Homo Sapiens; identical to SEQ ID NO: 175618

SEQ ID NO: 506441 - RNA, 64 nt, Homo Sapiens; identical to SEQ ID NO: 283135

SEQ ID NO: 506442 - RNA, 64 nt, Homo Sapiens; identical to SEQ ID NO: 283136

SEQ ID NO: 506443 - RNA, 64 nt, Homo Sapiens; identical to SEQ ID NO: 283137

SEQ ID NO: 506444 - RNA, 64 nt, Homo Sapiens; identical to SEQ ID NO: 283138

SEQ ID NO: 506445 - RNA, 64 nt, Homo Sapiens; identical to SEQ ID NO: 283139

SEQ ID NO: 506446 - RNA, 64 nt, Homo Sapiens; identical to SEQ ID NO: 283140

SEQ ID NO: 506447 - RNA, 64 nt, Homo Sapiens; identical to SEQ ID NO: 283141

SEQ ID NO: 506448 - RNA, 64 nt, Homo Sapiens; identical to SEQ ID NO: 283142

SEQ ID NO: 506449 - RNA, 64 nt, Homo Sapiens; identical to SEQ ID NO: 283143

SEQ ID NO: 506450 - RNA, 64 nt, Homo Sapiens; identical to SEQ ID NO: 283144

SEQ ID NO: 506451 - RNA, 64 nt, Homo Sapiens; identical to SEQ ID NO: 283145

SEQ ID NO: 506452 - RNA, 64 nt, Homo Sapiens; identical to SEQ ID NO: 283146

SEQ ID NO: 506453 - RNA, 64 nt, Homo Sapiens; identical to SEQ ID NO: 283147

SEQ ID NO: 506454 - RNA, 64 nt, Homo Sapiens; identical to SEQ ID NO: 283148

SEQ ID NO: 506455 - RNA, 64 nt, Homo Sapiens; identical to SEQ ID NO: 283149

SEQ ID NO: 506456 - RNA, 64 nt, Homo Sapiens; identical to SEQ ID NO: 283150

SEQ ID NO: 506457 - RNA, 64 nt, Homo Sapiens; identical to SEQ ID NO: 283151

SEQ ID NO: 506458 - RNA, 64 nt, Homo Sapiens; identical to SEQ ID NO: 283152

SEQ ID NO: 506459 - RNA, 64 nt, Homo Sapiens; identical to SEQ ID NO: 283153

SEQ ID NO: 506460 - RNA, 64 nt, Homo Sapiens; identical to SEQ ID NO: 283154

SEQ ID NO: 506461 - RNA, 64 nt, Homo Sapiens; identical to SEQ ID NO: 283155

SEQ ID NO: 506462 - RNA, 64 nt, Homo Sapiens; identical to SEQ ID NO: 283156

SEQ ID NO: 506463 - RNA, 64 nt, Homo Sapiens; identical to SEQ ID NO: 283157

SEQ ID NO: 506464 - RNA, 64 nt, Homo Sapiens; identical to SEQ ID NO: 283158

SEQ ID NO: 506465 - RNA, 64 nt, Homo Sapiens; identical to SEQ ID NO: 283159

SEQ ID NO: 506466 - RNA, 64 nt, Homo Sapiens; identical to SEQ ID NO: 283160

SEQ ID NO: 506467 - RNA, 64 nt, Homo Sapiens; identical to SEQ ID NO: 283161

SEQ ID NO: 506468 - RNA, 64 nt, Homo Sapiens; identical to SEQ ID NO: 283162

SEQ ID NO: 506469 - RNA, 64 nt, Homo Sapiens; identical to SEQ ID NO: 283163

SEQ ID NO: 506470 - RNA, 64 nt, Homo Sapiens; identical to SEQ ID NO: 283164

SEQ ID NO: 506471 - RNA, 64 nt, Homo Sapiens; identical to SEQ ID NO: 283165

SEQ ID NO: 506472 - RNA, 64 nt, Homo Sapiens; identical to SEQ ID NO: 283166

SEQ ID NO: 506473 - RNA, 64 nt, Homo Sapiens; identical to SEQ ID NO: 283167

SEQ ID NO: 506474 - RNA, 64 nt, Homo Sapiens; identical to SEQ ID NO: 237135

SEQ ID NO: 506475 - RNA, 64 nt, Homo Sapiens; identical to SEQ ID NO: 237136

SEQ ID NO: 506476 - RNA, 64 nt, Homo Sapiens; identical to SEQ ID NO: 237137

SEQ ID NO: 506477 - RNA, 64 nt, Homo Sapiens; identical to SEQ ID NO: 237138

SEQ ID NO: 506478 - RNA, 64 nt, Homo Sapiens; identical to SEQ ID NO: 237139

SEQ ID NO: 506479 - RNA, 64 nt, Homo Sapiens; identical to SEQ ID NO: 237140

SEQ ID NO: 506480 - RNA, 64 nt, Homo Sapiens; identical to SEQ ID NO: 237141

SEQ ID NO: 506481 - RNA, 64 nt, Homo Sapiens; identical to SEQ ID NO: 237142

SEQ ID NO: 506482 - RNA, 64 nt, Homo Sapiens; identical to SEQ ID NO: 237143

SEQ ID NO: 506483 - RNA, 64 nt, Homo Sapiens; identical to SEQ ID NO: 237144

SEQ ID NO: 506484 - RNA, 64 nt, Homo Sapiens; identical to SEQ ID NO: 237145

SEQ ID NO: 506485 - RNA, 64 nt, Homo Sapiens; identical to SEQ ID NO: 237146

SEQ ID NO: 506486 - RNA, 64 nt, Homo Sapiens; identical to SEQ ID NO: 237147

SEQ ID NO: 506487 - RNA, 64 nt, Homo Sapiens; identical to SEQ ID NO: 237148

SEQ ID NO: 506488 - RNA, 64 nt, Homo Sapiens; identical to SEQ ID NO: 237149

SEQ ID NO: 506489 - RNA, 64 nt, Homo Sapiens; identical to SEQ ID NO: 237150

SEQ ID NO: 506490 - RNA, 64 nt, Homo Sapiens; identical to SEQ ID NO: 120942

SEQ ID NO: 506491 - RNA, 64 nt, Homo Sapiens; identical to SEQ ID NO: 120943

SEQ ID NO: 506492 - RNA, 64 nt, Homo Sapiens; identical to SEQ ID NO: 120944

SEQ ID NO: 506493 - RNA, 64 nt, Homo Sapiens; identical to SEQ ID NO: 120945

SEQ ID NO: 506494 - RNA, 64 nt, Homo Sapiens; identical to SEQ ID NO: 120946

SEQ ID NO: 506495 - RNA, 64 nt, Homo Sapiens; identical to SEQ ID NO: 120947

SEQ ID NO: 506496 - RNA, 64 nt, Homo Sapiens; identical to SEQ ID NO: 120948

SEQ ID NO: 506497 - RNA, 64 nt, Homo Sapiens; identical to SEQ ID NO: 120949

SEQ ID NO: 506498 - RNA, 64 nt, Homo Sapiens; identical to SEQ ID NO: 120950

SEQ ID NO: 506499 - RNA, 64 nt, Homo Sapiens; identical to SEQ ID NO: 120951

SEQ ID NO: 506500 - RNA, 64 nt, Homo Sapiens; identical to SEQ ID NO: 120952

SEQ ID NO: 506501 - RNA, 64 nt, Homo Sapiens; identical to SEQ ID NO: 120953

SEQ ID NO: 506502 - RNA, 64 nt, Homo Sapiens; identical to SEQ ID NO: 120954

SEQ ID NO: 506503 - RNA, 64 nt, Homo Sapiens; identical to SEQ ID NO: 120955

SEQ ID NO: 506504 - RNA, 64 nt, Homo Sapiens; identical to SEQ ID NO: 120956

SEQ ID NO: 506505 - RNA, 64 nt, Homo Sapiens; identical to SEQ ID NO: 120957

SEQ ID NO: 506506 - RNA, 64 nt, Homo Sapiens; identical to SEQ ID NO: 120958

SEQ ID NO: 506507 - RNA, 64 nt, Homo Sapiens; identical to SEQ ID NO: 120959

SEQ ID NO: 506508 - RNA, 64 nt, Homo Sapiens; identical to SEQ ID NO: 120960

SEQ ID NO: 506509 - RNA, 64 nt, Homo Sapiens; identical to SEQ ID NO: 120961

SEQ ID NO: 506510 - RNA, 64 nt, Homo Sapiens; identical to SEQ ID NO: 120962

SEQ ID NO: 506511 - RNA, 64 nt, Homo Sapiens; identical to SEQ ID NO: 120963

SEQ ID NO: 506512 - RNA, 64 nt, Homo Sapiens; identical to SEQ ID NO: 120964

SEQ ID NO: 506513 - RNA, 62 nt, Homo Sapiens; identical to SEQ ID NO: 120965

SEQ ID NO: 506514 - RNA, 64 nt, Homo Sapiens; identical to SEQ ID NO: 120966

SEQ ID NO: 506515 - RNA, 64 nt, Homo Sapiens; identical to SEQ ID NO: 120967

SEQ ID NO: 506516 - RNA, 64 nt, Homo Sapiens; identical to SEQ ID NO: 120968

SEQ ID NO: 506517 - RNA, 64 nt, Homo Sapiens; identical to SEQ ID NO: 120969

SEQ ID NO: 506518 - RNA, 64 nt, Homo Sapiens; identical to SEQ ID NO: 120970

SEQ ID NO: 506519 - RNA, 64 nt, Homo Sapiens; identical to SEQ ID NO: 120971

SEQ ID NO: 506520 - RNA, 64 nt, Homo Sapiens; identical to SEQ ID NO: 210217

SEQ ID NO: 506521 - RNA, 64 nt, Homo Sapiens; identical to SEQ ID NO: 210218

SEQ ID NO: 506522 - RNA, 64 nt, Homo Sapiens; identical to SEQ ID NO: 210219

SEQ ID NO: 506523 - RNA, 64 nt, Homo Sapiens; identical to SEQ ID NO: 210220

SEQ ID NO: 506524 - RNA, 64 nt, Homo Sapiens; identical to SEQ ID NO: 210221

SEQ ID NO: 506525 - RNA, 64 nt, Homo Sapiens; identical to SEQ ID NO: 210222

SEQ ID NO: 506526 - RNA, 64 nt, Homo Sapiens; identical to SEQ ID NO: 210223

SEQ ID NO: 506527 - RNA, 64 nt, Homo Sapiens; identical to SEQ ID NO: 210224

SEQ ID NO: 506528 - RNA, 64 nt, Homo Sapiens; identical to SEQ ID NO: 210225

SEQ ID NO: 506529 - RNA, 64 nt, Homo Sapiens; identical to SEQ ID NO: 210226

SEQ ID NO: 506530 - RNA, 64 nt, Homo Sapiens; identical to SEQ ID NO: 210227

SEQ ID NO: 506531 - RNA, 64 nt, Homo Sapiens; identical to SEQ ID NO: 210228

SEQ ID NO: 506532 - RNA, 64 nt, Homo Sapiens; identical to SEQ ID NO: 210229

SEQ ID NO: 506533 - RNA, 64 nt, Homo Sapiens; identical to SEQ ID NO: 210230

SEQ ID NO: 506534 - RNA, 64 nt, Homo Sapiens; identical to SEQ ID NO: 210231

SEQ ID NO: 506535 - RNA, 64 nt, Homo Sapiens; identical to SEQ ID NO: 210232

SEQ ID NO: 506536 - RNA, 64 nt, Homo Sapiens
gucccucccccaaugcaggccacuucuccucccuccucucuaaauguaguccccucuccuccau

SEQ ID NO: 506537 - RNA, 64 nt, Homo Sapiens
ugaugcuucucaguagccuuaucauucacaggugccucucuagccugcacaaaugauugacaag

SEQ ID NO: 506538 - RNA, 64 nt, Homo Sapiens
aguucuucuuagccucugcuccuucccugggaacccucucuauauccucuucacaagucauggg

SEQ ID NO: 506539 - RNA, 64 nt, Homo Sapiens
uccuucugcccugccugccucccugcaccugcggccucucuaggaagcuguuccuuucuaugcc

SEQ ID NO: 506540 - RNA, 64 nt, Homo Sapiens
auccuccuuccucuuccccuuucuaguuccccuaccucucuaucuuucuauucucaccaauaau

SEQ ID NO: 506541 - RNA, 64 nt, Homo Sapiens
cucaggacugagucaacccccuucaaccuccucaccucucuaaacaccauccauaguaacaugu

SEQ ID NO: 506542 - RNA, 64 nt, Homo Sapiens
uuuuaaaacaaaguguguuacacuaaaaaccaguccucucuaaucucaggugggacuuggcgcu

SEQ ID NO: 506543 - RNA, 52 nt, Homo Sapiens
acuuggaagcugguagcuagugccucucuaucaaaucaggguuugcaccuug

SEQ ID NO: 506544 - RNA, 64 nt, Homo Sapiens
guugcauccugucaggaggcagauaaugcuggugccucucuauugguaauguuaagacugcugg

SEQ ID NO: 506545 - RNA, 64 nt, Homo Sapiens
ccuagguccucugaggcacucaucuacugaaugaccucucuacuuccccuucuugccauuauua

SEQ ID NO: 506546 - RNA, 64 nt, Homo Sapiens
uucugucagugccuuaucuuaugaagaaacagaaccucucuagcuaaugugugguuucuccuuc

SEQ ID NO: 506547 - RNA, 64 nt, Homo Sapiens
cuuggccuccuuuccgcuucuccucucugcuguuccucucuacaagaaccugggaggccaacgc

SEQ ID NO: 506548 - RNA, 64 nt, Homo Sapiens
aucagugucccacccagagggaggggcaggugggccucucuaggccuggguggggcuuguccaa

SEQ ID NO: 506549 - RNA, 64 nt, Homo Sapiens
gcuaugcaacccuccccacguuccccucauucuaccucucuaagcucugggcacugaggaguau

SEQ ID NO: 506550 - RNA, 64 nt, Homo Sapiens
ucucuucccuccaucuccuuaacaaacaucuggcccucucuacagguucugaugaugauuaucc

SEQ ID NO: 506551 - RNA, 64 nt, Homo Sapiens
aaaacauuuuuaaaaaauuaacacagggagacccccucucuacaguuugggaccaggcugggca

SEQ ID NO: 506552 - RNA, 64 nt, Homo Sapiens
agaagguaauuuccuccccaacuccacuauuccaccucucuaaaaacugcucagcaguugggcc

SEQ ID NO: 506553 - RNA, 64 nt, Homo Sapiens
acacaacuguuucugcuuugaggguuuaacagacccucucuaggauagagauacacauggaaag

SEQ ID NO: 506554 - RNA, 64 nt, Homo Sapiens
gucagcgagcugugcaacguccuagguuucagccccucucuacuguggcgugugagucaggaga

SEQ ID NO: 506555 - RNA, 64 nt, Homo Sapiens
uuaaauaaauuauagaauguuuuuccauuugauaccucucuaaauuauuuuggauuaaaagaag

SEQ ID NO: 506556 - RNA, 64 nt, Homo Sapiens
acaaaacuuauuggguaaguucccauaccugaccccucucuaaccuuuaauagccuccuucaga

SEQ ID NO: 506557 - RNA, 64 nt, Homo Sapiens
guaacauuuauagaagaaauccccugcucuguugccucucuaagcccuuucccuucuggcuguu

SEQ ID NO: 506558 - RNA, 64 nt, Homo Sapiens
gucucgucucuuuuacccugcuggucucucuaugccucucuacaccucucccacccucuuccua

SEQ ID NO: 506559 - RNA, 64 nt, Homo Sapiens
agcagcaggaaacauagaacccaucauccucaggccucucuacaauuucucuggauuugcaacc

SEQ ID NO: 506560 - RNA, 64 nt, Homo Sapiens
auauugggacccucaagaggucaaucucccagccccucucuaccacuuucuugcucucuuuuuc

SEQ ID NO: 506561 - RNA, 64 nt, Homo Sapiens
ugagguaacucagacagugccugaugauuuucacccucucuagcauuuguugcccugaugauaa

SEQ ID NO: 506562 - RNA, 64 nt, Homo Sapiens
gacagguuggggaggguugguccucggccagagcccucucuaagcuggggaggggcccaguggg

SEQ ID NO: 506563 - RNA, 64 nt, Homo Sapiens
ugggagguacaauugccauauugucaggagugcaccucucuacuugagauauagauccguagaa

SEQ ID NO: 506564 - RNA, 64 nt, Homo Sapiens
cacauacggaagugauggccgcacaauggugggcccucucuagacacgucaauggcugugcuga

SEQ ID NO: 506565 - RNA, 64 nt, Homo Sapiens
uccaguuuuuuuuucuuuaaaaaagcgguuucuaccucucuaugugccugagugaugauacaau

SEQ ID NO: 506566 - RNA, 64 nt, Homo Sapiens
gaacuccugaccucaggugauccacccaccuuggccucucuaaauacugggauuacaggcguga

SEQ ID NO: 506567 - RNA, 59 nt, Homo Sapiens
uugaaguugcugucccuuaacuggcgccuccucucuacuuucauggacuuguuccuuug

SEQ ID NO: 506568 - RNA, 64 nt, Homo Sapiens
aaccacguucuuagccuagauugagcuuagauugccucucuagacaacuaccccuuaguuauaa

SEQ ID NO: 506569 - RNA, 64 nt, Homo Sapiens
gguggggaggggacaccaagggcccauuuccuccccucucuaccugcagugaguuccagaccug

SEQ ID NO: 506570 - RNA, 64 nt, Homo Sapiens
uuaucccagacauguucuuucaagcccuuggagcccucucuaaauucacugucaucauuuagua

SEQ ID NO: 506571 - RNA, 64 nt, Homo Sapiens
aaaguuaugggcugcuuuacacaagaggcuaggcccucucuagcucaguuugaugaaccaauuc

SEQ ID NO: 506572 - RNA, 64 nt, Homo Sapiens
cguccagccugcccagaccccauccccccggccaccucucuaccaauaaagaacugaaugaauu

SEQ ID NO: 506573 - RNA, 64 nt, Homo Sapiens
uuuggaaaaaugaacaugugggcuagaaacugagccucucuacuuacuuccuuaugguuugaga

SEQ ID NO: 506574 - RNA, 64 nt, Homo Sapiens
aaucauauaauguaaaggauuaugauaaaagcaaccucucuauaagcaucaguuuuuacuauau

SEQ ID NO: 506575 - RNA, 64 nt, Homo Sapiens
ccuuugacugucuccucagccccucaaagccaggccucucuauuuugugcugguggugaagagg

SEQ ID NO: 506576 - RNA, 64 nt, Homo Sapiens
accacauuuucucuuauuaauuuaagaaaaugccccucucuauuaaugacagcuuuagcacaau

SEQ ID NO: 506577 - RNA, 64 nt, Homo Sapiens
ugacucaggggcucacaagguuuucuauuuaaauccucucuacucuuuuaauggcuguuuuccu

SEQ ID NO: 506578 - RNA, 64 nt, Homo Sapiens
caaguuuauuaaagauuauuauguaaaccggaauccucucuauaguuauuuaaagcagacuuac

SEQ ID NO: 506579 - RNA, 64 nt, Homo Sapiens
uccuguauggaaaacgggagacuuuguacaguggccucucuaaaaguacaaaacauucauaaga

SEQ ID NO: 506580 - RNA, 64 nt, Homo Sapiens
acuaucacaaaaagucuccauuuucauuuuacauccucucuauuggaggcagcacuuuucccuc

SEQ ID NO: 506581 - RNA, 64 nt, Homo Sapiens
uccuuccucuuuaucccuccuguuuuacuuuauaccucucuauuccuugcucaaauuauugcaa

SEQ ID NO: 506582 - RNA, 64 nt, Homo Sapiens
gugucacaaaagcaguuauuuuaaaaucugauccccucucuacccuaccacuuugguuugaauu

SEQ ID NO: 506583 - RNA, 64 nt, Homo Sapiens
aggucagauggcagagcaagguugguccucagggccucucuaagccuuagggccccuccucucc

SEQ ID NO: 506584 - RNA, 64 nt, Homo Sapiens
aucugaggcaauaucacuaggacuuuagcugugaccucucuaacacagagaagcacuaacuuag

SEQ ID NO: 506585 - RNA, 64 nt, Homo Sapiens
uauuuuagccagugggucccuuccuuucuccuuuccucucuacugcucaagaacagauuugagg

SEQ ID NO: 506586 - RNA, 64 nt, Homo Sapiens
cccuuuuugugccuucaugcccuacuucuuaaugccucucuaaagccaaaaaaaaaaaaaaaga

SEQ ID NO: 506587 - RNA, 64 nt, Homo Sapiens
ugcaagcugagugacuguaggcagggaaccuuaaccucucuaagccacagcuucuucaucuuua

SEQ ID NO: 506588 - RNA, 64 nt, Homo Sapiens
caacacucugucuugaauuuggcccucccucuccccucucuacuuuaauucauuggagcauggg

SEQ ID NO: 506589 - RNA, 64 nt, Homo Sapiens
uuugauagccaucuauucaucuggaucaugggacccucucuaauccuuccaccaaucaaauaag

SEQ ID NO: 506590 - RNA, 64 nt, Homo Sapiens
aaaaauugccccaacuacaggguccaggaccagaccucucuacacucuaaggucucugacggug

SEQ ID NO: 506591 - RNA, 64 nt, Homo Sapiens
gagugcuccagagucuuagcggucaucccacacaccucucuacuaaaaccuagugauucugucu

SEQ ID NO: 506592 - RNA, 64 nt, Homo Sapiens
gugcuucccugggccaagcugugcucaggugagcccucucuauaacaugggaucauggguuggg

SEQ ID NO: 506593 - RNA, 64 nt, Homo Sapiens
ugaauuuacuguggaccaugcugcaacuauugcaccucucuauuauuuuuuuguguguuuacca

SEQ ID NO: 506594 - RNA, 64 nt, Homo Sapiens
uguuuuuuuaaggaaaagucgacauuuacagccuccucucuauuccugcacaagggcagugaga

SEQ ID NO: 506595 - RNA, 64 nt, Homo Sapiens
cuggaugagcucaugaacauccuuccccaagaguccucucuauccagcauggggaaggaggucc

SEQ ID NO: 506596 - RNA, 64 nt, Homo Sapiens
augcaaaugaauuuaguuuugagauuuuauuaucccucucuauuccucuggugccugaagaaau

SEQ ID NO: 506597 - RNA, 64 nt, Homo Sapiens
cacacuguuugugauuuaucuagacuauuuguacccucucuaccaaaagccuggcugaaaucuu

SEQ ID NO: 506598 - RNA, 64 nt, Homo Sapiens
gcaaugccgugaucuccgcucacugccaccuccgccucucuaguucaagcgauuuuccugccuc

SEQ ID NO: 506599 - RNA, 64 nt, Homo Sapiens
ugcccuccggcuggaaacugcagcucuguaaaugccucucuagguagcugcuggcggugguggg

SEQ ID NO: 506600 - RNA, 64 nt, Homo Sapiens
cugaucaugaaucaaguaucugugguuucaugccccucucuauaccuuucaaagaacuccugaa

SEQ ID NO: 506601 - RNA, 64 nt, Homo Sapiens
acuguugcccagucacuucugcuccaauucucuuccucucuaaauaguaguuuauuacugccac

SEQ ID NO: 506602 - RNA, 64 nt, Homo Sapiens
aaugggaaaaaucuuuuuguagacucuauaguacccucucuauucacuagcuucugaaaaggga

SEQ ID NO: 506603 - RNA, 64 nt, Homo Sapiens
aacagaugucaggacugucaacuccuuccacuccccucucuaccagggaagcaacuccaggaac

SEQ ID NO: 506604 - RNA, 64 nt, Homo Sapiens
gagagcuaccagguugucacggcaggcucuguuaccucucuaaggugauggggagagccugaaa

SEQ ID NO: 506605 - RNA, 64 nt, Homo Sapiens
acugauuccucauuuauaacaacaagucucuuaaccucucuaagcugagugucuugugguuuua

SEQ ID NO: 506606 - RNA, 64 nt, Homo Sapiens
augagggaagaagacacagcacguaggaccaaacccucucuaccuccugagguggccuuuacau

SEQ ID NO: 506607 - RNA, 64 nt, Homo Sapiens
auccaucaucagaaucacagugcucuccagaccuccucucuaaacugcuucauugaccuaaguc

SEQ ID NO: 506608 - RNA, 64 nt, Homo Sapiens
ccuaaguuagaacacagccuuggcuggugggugcccucucuagacugguaucagcagccugugu

SEQ ID NO: 506609 - RNA, 64 nt, Homo Sapiens
guguagcauacuggcuucaccaucaauccugauuccucucuaagugggcauugccauguggaag

SEQ ID NO: 506610 - RNA, 64 nt, Homo Sapiens
uaggucagauggagguucucagagccaaguccucccucucuacuggaguggaaggucuauuggc

SEQ ID NO: 506611 - RNA, 64 nt, Homo Sapiens
gauggcacauucaguguggcuaugaagagcgaauccucucuauuguuuaaauagauuacuguag

SEQ ID NO: 506612 - RNA, 64 nt, Homo Sapiens
auaagaaauaaggacaagccuaacuucauagaaaccucucuauuuuuaaucaguuguuuaauaa

SEQ ID NO: 506613 - RNA, 64 nt, Homo Sapiens
gguccguuuccuuacacauuacuuggauaucaacccucucuacaauuuucacacauucacgcau

SEQ ID NO: 506614 - RNA, 64 nt, Homo Sapiens
ccaaaguauaaaacaaaaucuaggcucccccuccccucucuaaauucuguaagacugcuacagc

SEQ ID NO: 506615 - RNA, 64 nt, Homo Sapiens
ucccuuuuuuuaauuuaaaaaaucccauaaagaaccucucuaugauuuaauagccauuucaaga

SEQ ID NO: 506616 - RNA, 64 nt, Homo Sapiens
cuauuguguucagauacuuauccuuuucugguugccucucuauggcaugggcauauguaaaaug

SEQ ID NO: 506617 - RNA, 64 nt, Homo Sapiens
agacacaggaggaugacacaaguccucacccccaccucucuaaaucagcuuuagcuuccauggc

SEQ ID NO: 506618 - RNA, 64 nt, Homo Sapiens
cugcuccugaauccuguucuuucuccuuuucuuuccucucuaggcauuggcccucuggacuccu

SEQ ID NO: 506619 - RNA, 64 nt, Homo Sapiens
aaaaaggaucuccuuuuuucccagcccaaauucuccucucuaaaaguguccacaagaaggggug

SEQ ID NO: 506620 - RNA, 64 nt, Homo Sapiens
ucauaaauucuuucccuauaacauuccuucucugccucucuauggcccacuuugaccacuaaca

SEQ ID NO: 506621 - RNA, 64 nt, Homo Sapiens
ucuccggcagcccagauguucaguucucuuggccccucucuaccccuuacugggauccgguuuu

SEQ ID NO: 506622 - RNA, 64 nt, Homo Sapiens
uuucuaguuuccuuuccuugucucucucugccugccucucuacuguucccccuuuucuaacaca

SEQ ID NO: 506623 - RNA, 64 nt, Homo Sapiens
gcccagcccccaccacuccucagcugccccccaaccucucuauggcagagaggcagggaguggc

SEQ ID NO: 506624 - RNA, 64 nt, Homo Sapiens
ccuccccaggaagggacugcagaggcgggcaagcccucucuauguguuuuuauccccaccuucc

SEQ ID NO: 506625 - RNA, 64 nt, Homo Sapiens
gacccugggcugcuuccugggggcucuccagaccccucucuaggaccaagucacccgucgugcu

SEQ ID NO: 506626 - RNA, 64 nt, Homo Sapiens
ugcucccuacuggcugucuugggggaaggcagcgccucucuagcuacucaagggagggggaugu

SEQ ID NO: 506627 - RNA, 64 nt, Homo Sapiens
gaaggcaguaaacuaagggugucaagccccauucccucucuacucuugacagcaggauuggaug

SEQ ID NO: 506628 - RNA, 64 nt, Homo Sapiens
auacuacuuuugugucacaauuuauuuuuaucacccucucuaggguaacguguauauuuuggug

SEQ ID NO: 506629 - RNA, 64 nt, Homo Sapiens
uucgguccuuggcccuuucccggcccucuuguucccucucuaacuucugauuguucuuuuauuu

SEQ ID NO: 506630 - RNA, 64 nt, Homo Sapiens
ucuuuaaacacuuuuuaaauuucuaaccacaagaccucucuauaaugguaaauguaagacauca

SEQ ID NO: 506631 - RNA, 64 nt, Homo Sapiens
uuugucauggaagagaagcauggguucagcagugccucucuagcagcugugcggaauaaugugc

SEQ ID NO: 506632 - RNA, 64 nt, Homo Sapiens
aguuugagaccagccuggccaacauggcgaaaccccucucuacuaaaaauacaaaaauuugcca

SEQ ID NO: 506633 - RNA, 64 nt, Homo Sapiens
uccccuuggccugcauguacauaugucuugucagccucucuagucuacgguacucuccccagag

SEQ ID NO: 506634 - RNA, 64 nt, Homo Sapiens
uuugaaaacucuccugggguaaagaccaaaggguccucucuaccaaaguaugaugguggugaau

SEQ ID NO: 506635 - RNA, 64 nt, Homo Sapiens
cuuacugguauuuuuuguuuaaacauuaaccaccccucucuaguaauuccacagcugccuccag

SEQ ID NO: 506636 - RNA, 64 nt, Homo Sapiens
auaagguugcagaaaugggauggaggccuucaucccucucuacggauuuguuuccuaacgccau

SEQ ID NO: 506637 - RNA, 64 nt, Homo Sapiens
gugagaaauguuuuagaggcucaugacaauugagccucucuacuuguuaguauuauucacacau

SEQ ID NO: 506638 - RNA, 64 nt, Homo Sapiens
guaccacccaguaagucuggaaccuggaguuuugccucucuagaggauuauuuguaggacaacc

SEQ ID NO: 506639 - RNA, 64 nt, Homo Sapiens
augagagccaucucaccucacccaggagucacuuccucucuacaccccaacaccugguucauuu

SEQ ID NO: 506640 - RNA, 64 nt, Homo Sapiens
acagugcauuaucuguucuuguauuucuauagcaccucucuauuggguuuaucaucaucaacaa

SEQ ID NO: 506641 - RNA, 64 nt, Homo Sapiens
uauuccuccaggaaggagcaaaacgccucuuuucccucucuaggccuguugccucgggccuggg

SEQ ID NO: 506642 - RNA, 64 nt, Homo Sapiens
auuuuaacuaaaaguugauuuguacuuauuugucccucucuaacagcaccgcacaucgacacac

SEQ ID NO: 506643 - RNA, 64 nt, Homo Sapiens
auccaauuagggauguuuguggccuucccugcuuccucucuagaaggcaugagccaccgcaccu

SEQ ID NO: 506644 - RNA, 64 nt, Homo Sapiens
uauaaggucccugcuccacccaccccuuucccuuccucucuauuccccaaaaucggcccucccu

SEQ ID NO: 506645 - RNA, 64 nt, Homo Sapiens
cuacacuaaucugccuaaaguuaggguuucuuugccucucuacauacuaaaugguguguuaaaa

SEQ ID NO: 506646 - RNA, 64 nt, Homo Sapiens
ggaagcccacuggguuuaaaugcaagaaucuaaaccucucuaggaagaacgauucaccuggguu

SEQ ID NO: 506647 - RNA, 64 nt, Homo Sapiens
cucacuaauuaucaacuuaugugcuaucagauauccucucuacccucacguuauuuugaagaaa

SEQ ID NO: 506648 - RNA, 64 nt, Homo Sapiens
ccaguucccuuugcuugucuucuugacugucuucccucucuaucggggucacuugcaauuguua

SEQ ID NO: 506649 - RNA, 64 nt, Homo Sapiens
ucccagucucagauugagugggugcucucauuggccucucuagcuaggccgucucccuggucag

SEQ ID NO: 506650 - RNA, 64 nt, Homo Sapiens
guugcaguugcuuucuuuguagagaaggcuuaccccucucuaggaauguccaugacuauugccc

SEQ ID NO: 506651 - RNA, 64 nt, Homo Sapiens
accuucccuccccuucccacgagacgggcucuuaccucucuacaugccuugacccagaagggau

SEQ ID NO: 506652 - RNA, 64 nt, Homo Sapiens
auugauaaccaggacaaccagguagucacccaguccucucuaagcagggagcacuuguccuucu

SEQ ID NO: 506653 - RNA, 64 nt, Homo Sapiens
gaggcuggcugcaccugcucucugaagacgccuuccucucuagguucauuguucaguguugcug

SEQ ID NO: 506654 - RNA, 64 nt, Homo Sapiens
uuuuuuuuaggcaaaaccuugucccagcacauuuccucucuaucacagaggaugcugaaguaca

SEQ ID NO: 506655 - RNA, 64 nt, Homo Sapiens
uuuaaguaaauugacauauagucucugggguuucccucucuaauggaugggcagugccacucag

SEQ ID NO: 506656 - RNA, 64 nt, Homo Sapiens
cacauuuacagaauuucacacagauggccacaggccucucuauacacagacaaggccuccagca

SEQ ID NO: 506657 - RNA, 64 nt, Homo Sapiens
auacaguauuucaucccuccucaggaagaaagcgccucucuaccugaacaguuucucuuggccu

SEQ ID NO: 506658 - RNA, 64 nt, Homo Sapiens
ugugagcguucaggggguccugcuaggccugaccccucucuaccugcaggagcuguuuuuccau

SEQ ID NO: 506659 - RNA, 64 nt, Homo Sapiens
uuauuuuuuauuuaacaugacuguuuuaaaaguuccucucuauuuaccagggauaucuguucua

SEQ ID NO: 506660 - RNA, 64 nt, Homo Sapiens
uguguccccacucacuccaguguggcugagggggccucucuacccuccuaaauguagagaugcc

SEQ ID NO: 506661 - RNA, 64 nt, Homo Sapiens
uguguccacagaguuuuucaugggcagacagugaccucucuaggaccagcauuacuaaggcagg

SEQ ID NO: 506662 - RNA, 64 nt, Homo Sapiens
ucccugccaggucccucuccaaacagggauuuccccucucuagaccugaaaugggcagggaaga

SEQ ID NO: 506663 - RNA, 64 nt, Homo Sapiens
ugggaaguaccaggggacuggcagaagcccaggcccucucuacuuuuaccagcaacugaucaug

SEQ ID NO: 506664 - RNA, 64 nt, Homo Sapiens
aaucugaugaggccucugcucucugggauguggcccucucuaugcagguuacuccaaugauuag

SEQ ID NO: 506665 - RNA, 64 nt, Homo Sapiens
ccuuguauccuggaauagcuccauuuccccuccuccucucuaccagacaaaggagugccugugu

SEQ ID NO: 506666 - RNA, 64 nt, Homo Sapiens
uucauacugagacccagaugggggaaaacagcuuccucucuaaaaggaaaaacuugauauuuau

SEQ ID NO: 506667 - RNA, 64 nt, Homo Sapiens
aauacauuuaaucauagggauauagauauaagcaccucucuaaagaaucuuuaguuuccgacgu

SEQ ID NO: 506668 - RNA, 64 nt, Homo Sapiens
auaaccccuccccccaacacgugaugcaagucauccucucuaucacucacaacaccuguauaau

SEQ ID NO: 506669 - RNA, 64 nt, Homo Sapiens
cuucacuacaaucuucacuacaaccuuuggccuuccucucuacauuuaagaguagcaauagaac

SEQ ID NO: 506670 - RNA, 64 nt, Homo Sapiens
ggcuuugcugcuuuuaacucuucuuccuucugugccucucuaagugggucaguauccuaaggaa

SEQ ID NO: 506671 - RNA, 64 nt, Homo Sapiens
cccugauugccacagacccagcacccagcaaaucccucucuaccucccaaggugauaugggcag

SEQ ID NO: 506672 - RNA, 64 nt, Homo Sapiens
gaaaauuagacaguguuuaauuuucgaaaacuucccucucuagacaguagauaccaccuacuga

SEQ ID NO: 506673 - RNA, 64 nt, Homo Sapiens
ccagcggaauuggccacauuuccaguguaugugcccucucuaaggaaagaugacaaagaaauca

SEQ ID NO: 506674 - RNA, 64 nt, Homo Sapiens
guuauguguucuaacuauuaucaaaugaauaaauccucucuaucacaucccccaaaaauguucu

SEQ ID NO: 506675 - RNA, 64 nt, Homo Sapiens
cuauagucuaugcuuagagaccuucccauucagaccucucuagauaauagaagcuccaggggcu

SEQ ID NO: 506676 - RNA, 64 nt, Homo Sapiens
ggagcccucugcacucguguuccucuagcccggcccucucuaagcuuauucugaaacuucagcu

SEQ ID NO: 506677 - RNA, 64 nt, Homo Sapiens
ccugccugauuguguuuacaguuaccgcucauugccucucuaaucaagcuccuuugcuuuuagu

SEQ ID NO: 506678 - RNA, 64 nt, Homo Sapiens
ucaagcgauucuccugucuccacugcaauguccaccucucuaguggcacgaucucagcucacug

SEQ ID NO: 506679 - RNA, 64 nt, Homo Sapiens
aauauuaaaacucugggccuucugccuuuggaccccucucuauugcauuuccagaaccauggau

SEQ ID NO: 506680 - RNA, 64 nt, Homo Sapiens
agucaacuccauuuguaauaagauuggagaagggccucucuagcgggaagaagguacagaagaa

SEQ ID NO: 506681 - RNA, 52 nt, Homo Sapiens
cugaggcacucuguugggguacccucucuacuuuguggucuuccuugcuuga

SEQ ID NO: 506682 - RNA, 64 nt, Homo Sapiens
acaauuugcacuaaaucagauucucuugagcuggccucucuagcccaccaaagcugcccacugu

SEQ ID NO: 506683 - RNA, 64 nt, Homo Sapiens
acugaccagaaaaaucucucuguggccagcucugccucucuaaaauguagauuaucucaggcau

SEQ ID NO: 506684 - RNA, 64 nt, Homo Sapiens
cugccagucucagccuucaaccucccauccaccuccucucuacucucuccccucucccguucuu

SEQ ID NO: 506685 - RNA, 64 nt, Homo Sapiens
ggccccuccauuuauuugaccauugccuuccuacccucucuaauuacauaauucagagugguuu

SEQ ID NO: 506686 - RNA, 64 nt, Homo Sapiens
cgguauguccugacauaacagcccuuacccccauccucucuagaugccuuaguccugaauccua

SEQ ID NO: 506687 - RNA, 64 nt, Homo Sapiens
uuaccucuuuccgugcaucccaauuccuauggagccucucuauuugccccucccccacuccucc

SEQ ID NO: 506688 - RNA, 64 nt, Homo Sapiens
aaucuauuuacuguuuaucauacccaccugucuuccucucuagcuaucucaccauccaauuauc

SEQ ID NO: 506689 - RNA, 64 nt, Homo Sapiens
acagacauuccugcuagaaacugucagacaaauaccucucuaguucggaugcugcucacuuucc

SEQ ID NO: 506690 - RNA, 64 nt, Homo Sapiens
ucccuucucccaaagggauuuuaaucauucuuggccucucuacucacucuuaaucaaagugugg

SEQ ID NO: 506691 - RNA, 64 nt, Homo Sapiens
cucauuccuacaucucaagcuagccaggcagucuccucucuaucagaagaaagcacugguaauu

SEQ ID NO: 506692 - RNA, 64 nt, Homo Sapiens
gguuccugucccugcgccuuuccuuuucgccuuuccucucuauauuucgggucgggggcaggug

SEQ ID NO: 506693 - RNA, 64 nt, Homo Sapiens
ucauucauucuguucuguuucucuacuggguguuccucucuaaagaaacucuugcaagugaaac

SEQ ID NO: 506694 - RNA, 64 nt, Homo Sapiens
ugaccaacaugccaggugacauuggccccuagacccucucuauagccaugagacuccuuguggc

SEQ ID NO: 506695 - RNA, 64 nt, Homo Sapiens
cgucuucaugccaggggcacucauuucuuagcagccucucuacauacaucucucagguggugcc

SEQ ID NO: 506696 - RNA, 64 nt, Homo Sapiens
ggacgugcaaagcccuuggaauuuucuggcacuuccucucuauugcccccaccaccaccacccc

SEQ ID NO: 506697 - RNA, 64 nt, Homo Sapiens
uaguuugauuuaagcauuagaaaaauuacuuuucccucucuauauuuuaacuagaugauguuuu

SEQ ID NO: 506698 - RNA, 64 nt, Homo Sapiens
gcuguuuccucagagggaaaguugaacugggcuaccucucuacaaaguucacugucucagcaaa

SEQ ID NO: 506699 - RNA, 64 nt, Homo Sapiens
cccuccugccuucuguucucugcccuuucccagaccucucuaguuuuuuugcaaggcauuuuaa

SEQ ID NO: 506700 - RNA, 64 nt, Homo Sapiens
ccucaggcuccucaucuguagacaaauuaauaaaccucucuaugaaacuuggaacuuuuugauu

SEQ ID NO: 506701 - RNA, 64 nt, Homo Sapiens
ccugugacuguaguuaguuauuguuccauagaccccucucuagcucuuguggcacaggccauaa

SEQ ID NO: 506702 - RNA, 64 nt, Homo Sapiens
cucuucuauuuuugguauauggauguggugcagcccucucuacggugggugugcuugcguggua

SEQ ID NO: 506703 - RNA, 64 nt, Homo Sapiens
gauaacaaguaaauauuuagagcauuugauguucccucucuaauuugguuaguaaugauguccc

SEQ ID NO: 506704 - RNA, 64 nt, Homo Sapiens
ggcagagcagcucacacuccguaggccuccagagccucucuaguuguuuugauuaugcaacuaa

SEQ ID NO: 506705 - RNA, 64 nt, Homo Sapiens
accccucgggggugaggggcgugaugugcccaccccucucuaagucauauguaaauacugugag

SEQ ID NO: 506706 - RNA, 64 nt, Homo Sapiens
uuccuggcuuuucugauggaccuauuuaggacaaccucucuauccccagggagaccucccaaau

SEQ ID NO: 506707 - RNA, 64 nt, Homo Sapiens
uugggaaacuugccucaccuucaggcuuguggggccucucuaugcccaaugaguccaggcaguc

SEQ ID NO: 506708 - RNA, 64 nt, Homo Sapiens
uccaccagaggagcggacagugaaauguaauaucccucucuagagcagguauguauaugguaua

SEQ ID NO: 506709 - RNA, 64 nt, Homo Sapiens
aacugcauguguaaacagcaucacauuauuaccaccucucuaugguauuauaguggcaguaugc

SEQ ID NO: 506710 - RNA, 64 nt, Homo Sapiens
aucuccaucucccaauuaauuuuauugucucuuuccucucuauucgcuuucuccuguuuuuuuu

SEQ ID NO: 506711 - RNA, 64 nt, Homo Sapiens
guaaccuauuacaccaaguuacuugcuuugcuuuccucucuaugaugugauaauacaguaaaag

SEQ ID NO: 506712 - RNA, 64 nt, Homo Sapiens
cacagauggcccugggaauccccaaccccuuuguccucucuaccugaccgaaaguuacaaggac

SEQ ID NO: 506713 - RNA, 64 nt, Homo Sapiens
aauuugaaauguauaaaccagaacuacuguagggccucucuaagauacuguaaacugucuuccu

SEQ ID NO: 506714 - RNA, 64 nt, Homo Sapiens
ucuguuuccuagcuuuuucuuguuuuuuuccauuccucucuacugcagagguauuggguuuuuu

SEQ ID NO: 506715 - RNA, 64 nt, Homo Sapiens
caugggugaagaggaggggaagaggccuguuuggccucucuauccucucuuccucuucccccaa

SEQ ID NO: 506716 - RNA, 64 nt, Homo Sapiens
uuaucacucuuuuucuacuacuuuuucucaaauaccucucuaauccaagaggcacuuccaagaa

SEQ ID NO: 506717 - RNA, 64 nt, Homo Sapiens
cuguccugcccgugagggugggggggaccgggccccucucuagggaccccucgccccagccuca

SEQ ID NO: 506718 - RNA, 64 nt, Homo Sapiens
cccgugugaggggucugauacucccuuugucuucccucucuacuccucgcuacaccugagccag

SEQ ID NO: 506719 - RNA, 64 nt, Homo Sapiens
gggacuuaccaggguuagcucugcccucuccucuccucucuacguggccgccgcucugucucuc

SEQ ID NO: 506720 - RNA, 64 nt, Homo Sapiens
ccguuuccccuccacauccaaacagcacccugguccucucuauccccccucuccuggggucccu

SEQ ID NO: 506721 - RNA, 64 nt, Homo Sapiens
gaaacaguaauaauaacuucuuuuagccugguagccucucuaaggacaaaccaaacuaagugaa

SEQ ID NO: 506722 - RNA, 64 nt, Homo Sapiens
ggcuguauggaaaugcacccucccuccugccgcuccucucuagaaccuucuagaaccugggcug

SEQ ID NO: 506723 - RNA, 64 nt, Homo Sapiens
agcgggauuggaccggcucggcugaugucugcucccucucuaggagcugucugcuggcuccggg

SEQ ID NO: 506724 - RNA, 64 nt, Homo Sapiens
aaagccagaugcuagagccucugccugacagcauccucucuaugggccauauuccgcacugggc

SEQ ID NO: 506725 - RNA, 64 nt, Homo Sapiens
uuuccccucacccuccaaguccuaaccccuccauccucucuaacuuuucaagccaaucccuuaa

SEQ ID NO: 506726 - RNA, 64 nt, Homo Sapiens
gagggcuauggccucccuaugcuuucacuucccaccucucuaccuaaguuccuucccagcacau

SEQ ID NO: 506727 - RNA, 64 nt, Homo Sapiens
gauguguguggccauuggacuaacuggcacggggccucucuagggaagucugguuguagagccu

SEQ ID NO: 506728 - RNA, 64 nt, Homo Sapiens
uaagcacacaugcgcacacaccucuacgacccgaccucucuaugucugucuaugucacaguguu

SEQ ID NO: 506729 - RNA, 64 nt, Homo Sapiens
ugccugagguguccgcugacuguggaauggccuuccucucuaggggguuucuuguggcgucugg

SEQ ID NO: 506730 - RNA, 64 nt, Homo Sapiens
gccaacugucugcugucucggacaauaaaacugcccucucuaagccucagcccugccccucuga

SEQ ID NO: 506731 - RNA, 64 nt, Homo Sapiens
aaaaaugcaaaaauuaguccacauagugaaacccccucucuacuguucgaaaccagccuggcca

SEQ ID NO: 506732 - RNA, 64 nt, Homo Sapiens
cccuuuguccuccagcaucccuucacuuccucauccucucuaaccuccuuuuucuuuuuuuaau

SEQ ID NO: 506733 - RNA, 64 nt, Homo Sapiens
gaagcuucucgacugcccagauagggaggugaguccucucuaucuccucuggcucuggaagcac

SEQ ID NO: 506734 - RNA, 64 nt, Homo Sapiens
uuccuuggccuaggucuccccuccaggcugagggccucucuacuuccccagaugccugggugca

SEQ ID NO: 506735 - RNA, 64 nt, Homo Sapiens
ugggcugggucuacccccagccaccagcccucauccucucuacccagugcucugguuuaugcuu

SEQ ID NO: 506736 - RNA, 64 nt, Homo Sapiens
accauccaguacuuguggacacuacacguuucaaccucucuacuagcaccaucacccuugaaaa

SEQ ID NO: 506737 - RNA, 64 nt, Homo Sapiens
caaugcuaucaagugugcugggaagggaggaaggccucucuacauauggaaaagcccaugcgug

SEQ ID NO: 506738 - RNA, 64 nt, Homo Sapiens
cauaucccagucccagcccuucuuugcagcugggccucucuauaccccuggaugaacagcuugc

SEQ ID NO: 506739 - RNA, 64 nt, Homo Sapiens
ucaucuugaccaaagcugcuguguggcagcucggccucucuacgaccccaucuugguggcugca

SEQ ID NO: 506740 - RNA, 64 nt, Homo Sapiens
ucucuguaccgagccucuggucucagcccgccucccucucuacgugcaucagggcaggacgggg

SEQ ID NO: 506741 - RNA, 64 nt, Homo Sapiens
acccauggcaggaaccuagucacucugaacuuucccucucuacuuuccucgucauagggguucu

SEQ ID NO: 506742 - RNA, 64 nt, Homo Sapiens
caaagugguauuacagacaucuucauaucauguaccucucuaguuguauucaguuuugacugug

SEQ ID NO: 506743 - RNA, 64 nt, Homo Sapiens
ccccuuuuuuaaauguccauuagggccagauuccccucucuaguuguguaaccacuugucgccu

SEQ ID NO: 506744 - RNA, 64 nt, Homo Sapiens
aaaugaacauaaguuguaauccccccacauuuuaccucucuacccuggccuccaaauauaugcu

SEQ ID NO: 506745 - RNA, 64 nt, Homo Sapiens
ccugugcuguagcaccuucaagaucugagcccguccucucuacuuggggccacacagccggggu

SEQ ID NO: 506746 - RNA, 64 nt, Homo Sapiens
accuccuucuguuggaggccugcaggcuuuuccuccucucuagaccccaguacggcccccucuu

SEQ ID NO: 506747 - RNA, 64 nt, Homo Sapiens
ccccaccuuggucccucucaccuguugaagacuuccucucuaccgccuggaccgagaugugagu

SEQ ID NO: 506748 - RNA, 64 nt, Homo Sapiens
gccucuggggucuuugccuguggggcaaggagauccucucuaagaaugaggugguggcacaggg

SEQ ID NO: 506749 - RNA, 64 nt, Homo Sapiens
ccagaucuagccccacccucagagcuuggagucgccucucuagacacagcugggagccagcaag

SEQ ID NO: 506750 - RNA, 64 nt, Homo Sapiens
gcacggccuguggccuguucauugugaccacuggccucucuacaccuccuccugucgugggcuc

SEQ ID NO: 506751 - RNA, 64 nt, Homo Sapiens
uggccuggcucuggaagggccucugcagggcugcccucucuaacuucugcguuuggacauagga

SEQ ID NO: 506752 - RNA, 64 nt, Homo Sapiens
cucuuuuccacugcccauccucugugaacccauaccucucuagauggagcagguggccacuggu

SEQ ID NO: 506753 - RNA, 64 nt, Homo Sapiens
auuuggagucaucuuacuaacaaaagcuacucauccucucuauaauuuugccugcaggaaaauu

SEQ ID NO: 506754 - RNA, 64 nt, Homo Sapiens
guauaacuuuaaauauuugcaggccuuugaucuuccucucuagucuaaaggaugaauuuccuuu

SEQ ID NO: 506755 - RNA, 64 nt, Homo Sapiens
aaguguugauccccuucuuucugaagacgugcuaccucucuacacuguguguagcagcuguuac

SEQ ID NO: 506756 - RNA, 64 nt, Homo Sapiens
gcuccagaacccagcccagaucggaggacaaguuccucucuagaacccaauccaauuuggagcc

SEQ ID NO: 506757 - RNA, 64 nt, Homo Sapiens
guucgagaucagccuggccaacauggugaaauccccucucuacuaaaaauauaaaaauuagcca

SEQ ID NO: 506758 - RNA, 64 nt, Homo Sapiens
aucucauucuaacagcaaugagaacuuaggcuccccucucuacuaaaauacaaaaguuagcugg

SEQ ID NO: 506759 - RNA, 64 nt, Homo Sapiens
ucccugccagcacccccacgcccucauuacggcuccucucuaaccuccuuuacccucaucuguc

SEQ ID NO: 506760 - RNA, 64 nt, Homo Sapiens
acucagcggggaggcaggggaggcagaggggcagccucucuaaugcuuccuacucauuuuguuu

SEQ ID NO: 506761 - RNA, 64 nt, Homo Sapiens
uguuggacaccuuuagguucuuugcugcauucugccucucuaggaccaugguuaagaguccaag

SEQ ID NO: 506762 - RNA, 64 nt, Homo Sapiens
cucuggagcccacaauugucuuacccacuaugccccucucuagucaugguccccaagaggggcu

SEQ ID NO: 506763 - RNA, 64 nt, Homo Sapiens
aaucaacccuucuuccccaccaaaccacccaacuccucucuacucuuauccuuuuauccucugu

SEQ ID NO: 506764 - RNA, 64 nt, Homo Sapiens
gauccaugaaggaccauuaaccugugauaccuuuccucucuauuaauguugacuucccuugguu

SEQ ID NO: 506765 - RNA, 64 nt, Homo Sapiens
agcugugcugugugagccugugcaagugacaugaccucucuaaaccuugguuuucugcucucug

SEQ ID NO: 506766 - RNA, 64 nt, Homo Sapiens
uccacagcucagcaaagccucuguagccagacugccucucuagauuccuccucucugggcagcg

SEQ ID NO: 506767 - RNA, 64 nt, Homo Sapiens
guuagagaucagccugggcaacauagccagaccuccucucuacaaaaagaaaaaagaaugacau

SEQ ID NO: 506768 - RNA, 64 nt, Homo Sapiens
ucuauauuauaguacccauguuuuauuuaguugaccucucuaucaguuaaaauguagguccaca

SEQ ID NO: 506769 - RNA, 64 nt, Homo Sapiens
acccucacuccaugaccugucugaaauuucugccccucucuaccuuucccagccaccccucccc

SEQ ID NO: 506770 - RNA, 64 nt, Homo Sapiens
cccgugcacuuuuucugacaauuuuaacaauaugccucucuaccgggaaacaaccaaaaucgca

SEQ ID NO: 506771 - RNA, 64 nt, Homo Sapiens
augggcuccagacggaucucgccucuuucuucaaccucucuaauccuggcuggaccacauacug

SEQ ID NO: 506772 - RNA, 64 nt, Homo Sapiens
aguaauguggaucuuucccuuaaaacuccaaguuccucucuauuuuugcuaucuauaaaaugac

SEQ ID NO: 506773 - RNA, 64 nt, Homo Sapiens
caugcaaguguguuugccagcucaggagcugucuccucucuaccuggcuaguaagaggugggac

SEQ ID NO: 506774 - RNA, 64 nt, Homo Sapiens
aagaggggcaugagcugauucacauucugaaggaccucucuagcuggccagugcugaggagguu

SEQ ID NO: 506775 - RNA, 62 nt, Homo Sapiens
caguccaggaaugggugugagcagcccagagcccucucuauccacuuggucuggccagccag

SEQ ID NO: 506776 - RNA, 64 nt, Homo Sapiens
gucaccagcauaagaacaucaacaggaaugccgcccucucuacugucugaaccccuugucccug

SEQ ID NO: 506777 - RNA, 64 nt, Homo Sapiens
aacauuugggaaaugacaaacucaggcuggcucuccucucuaaccucacugggcuauaaauguu

SEQ ID NO: 506778 - RNA, 64 nt, Homo Sapiens
agcucucaccccucugagucuccagcugcccucaccucucuagccacccacucccagccccagc

SEQ ID NO: 506779 - RNA, 64 nt, Homo Sapiens
uggugcuccucccuaaugcugggacgguacuuucccucucuacccacaaaaaguccagacccca

SEQ ID NO: 506780 - RNA, 64 nt, Homo Sapiens
cagcgggugggcacagccccaaagcaccggugcuccucucuagguauuuauacugcucuuuaca

SEQ ID NO: 506781 - RNA, 64 nt, Homo Sapiens
ggcgcugggacagucagggugaccccaccgccuaccucucuacaucuaaagagcccucugggcc

SEQ ID NO: 506782 - RNA, 64 nt, Homo Sapiens
uguuuugacuuguuguaaccuguauacuggaaucccucucuagcuguauuaaaaauucccacag

SEQ ID NO: 506783 - RNA, 64 nt, Homo Sapiens
gacuguuccauuuuaacauguaaaaagacuagacccucucuaaaccccaaauccuuacuuauuu

SEQ ID NO: 506784 - RNA, 64 nt, Homo Sapiens
acgcagcagccucuccccagugacugcauucagcccucucuagggagacuugagcccagccuuc

SEQ ID NO: 506785 - RNA, 64 nt, Homo Sapiens
gcagaagacuagaggccaggugaucccagucacuccucucuaggccccuuauuaaggccccaga

SEQ ID NO: 506786 - RNA, 64 nt, Homo Sapiens
agguagguaaauagguaggccucuaauugaaccaccucucuaaguuauguacguauauauaagc

SEQ ID NO: 506787 - RNA, 64 nt, Homo Sapiens
guuccagaccagccugaccaaaauggugaaaccuccucucuacuaaaacuacaaaaauuaacug

SEQ ID NO: 506788 - RNA, 64 nt, Homo Sapiens
cauuugccauuauucaccuugucccuugccugccccucucuauuaguaccucauccuccacuca

SEQ ID NO: 506789 - RNA, 64 nt, Homo Sapiens
uguauauuucuaauggaucuucucuuuuucccccccucucuaugagacagacaucuaauuauuc

SEQ ID NO: 506790 - RNA, 64 nt, Homo Sapiens
uaccagagggaagaugcccagggcuucugguacuccucucuaaaccuucuaguaucucugccgg

SEQ ID NO: 506791 - RNA, 64 nt, Homo Sapiens
aaccccacccuacuagcuagccuccugucccacuccucucuaccgucacauugagaucauaauc

SEQ ID NO: 506792 - RNA, 64 nt, Homo Sapiens
uuuuuaugccugcuuuuagcaacuccacagauuuccucucuaaaaguccuuccauaauaguaac

SEQ ID NO: 506793 - RNA, 64 nt, Homo Sapiens
uuuaaggugcguucauuuugucugugggccuauuccucucuaccagauaguguaacccaaugua

SEQ ID NO: 506794 - RNA, 64 nt, Homo Sapiens
ucugggaaugcaccucuucuaauacaaaaaggccccucucuacagagccuuugugcucccacuc

SEQ ID NO: 506795 - RNA, 64 nt, Homo Sapiens; identical to SEQ ID NO: 46290

SEQ ID NO: 506796 - RNA, 64 nt, Homo Sapiens; identical to SEQ ID NO: 46291

SEQ ID NO: 506797 - RNA, 64 nt, Homo Sapiens; identical to SEQ ID NO: 46292

SEQ ID NO: 506798 - RNA, 64 nt, Homo Sapiens; identical to SEQ ID NO: 46293

SEQ ID NO: 506799 - RNA, 64 nt, Homo Sapiens; identical to SEQ ID NO: 46294

SEQ ID NO: 506800 - RNA, 64 nt, Homo Sapiens; identical to SEQ ID NO: 46295

SEQ ID NO: 506801 - RNA, 55 nt, Homo Sapiens; identical to SEQ ID NO: 46296

SEQ ID NO: 506802 - RNA, 64 nt, Homo Sapiens; identical to SEQ ID NO: 46297

SEQ ID NO: 506803 - RNA, 63 nt, Homo Sapiens; identical to SEQ ID NO: 46298

SEQ ID NO: 506804 - RNA, 64 nt, Homo Sapiens; identical to SEQ ID NO: 46299

SEQ ID NO: 506805 - RNA, 64 nt, Homo Sapiens; identical to SEQ ID NO: 46300

SEQ ID NO: 506806 - RNA, 64 nt, Homo Sapiens; identical to SEQ ID NO: 46301

SEQ ID NO: 506807 - RNA, 64 nt, Homo Sapiens; identical to SEQ ID NO: 46302

SEQ ID NO: 506808 - RNA, 64 nt, Homo Sapiens; identical to SEQ ID NO: 46303

SEQ ID NO: 506809 - RNA, 64 nt, Homo Sapiens; identical to SEQ ID NO: 46304

SEQ ID NO: 506810 - RNA, 64 nt, Homo Sapiens; identical to SEQ ID NO: 46305

SEQ ID NO: 506811 - RNA, 64 nt, Homo Sapiens; identical to SEQ ID NO: 46306

SEQ ID NO: 506812 - RNA, 64 nt, Homo Sapiens; identical to SEQ ID NO: 46307

SEQ ID NO: 506813 - RNA, 64 nt, Homo Sapiens; identical to SEQ ID NO: 46308

SEQ ID NO: 506814 - RNA, 64 nt, Homo Sapiens; identical to SEQ ID NO: 46309

SEQ ID NO: 506815 - RNA, 64 nt, Homo Sapiens; identical to SEQ ID NO: 46310

SEQ ID NO: 506816 - RNA, 64 nt, Homo Sapiens; identical to SEQ ID NO: 46311

SEQ ID NO: 506817 - RNA, 64 nt, Homo Sapiens; identical to SEQ ID NO: 46312

SEQ ID NO: 506818 - RNA, 64 nt, Homo Sapiens; identical to SEQ ID NO: 46313

SEQ ID NO: 506819 - RNA, 64 nt, Homo Sapiens; identical to SEQ ID NO: 46314

SEQ ID NO: 506820 - RNA, 64 nt, Homo Sapiens; identical to SEQ ID NO: 46315

SEQ ID NO: 506821 - RNA, 64 nt, Homo Sapiens; identical to SEQ ID NO: 46316

SEQ ID NO: 506822 - RNA, 64 nt, Homo Sapiens; identical to SEQ ID NO: 46317

SEQ ID NO: 506823 - RNA, 64 nt, Homo Sapiens; identical to SEQ ID NO: 46318

SEQ ID NO: 506824 - RNA, 64 nt, Homo Sapiens; identical to SEQ ID NO: 46319

SEQ ID NO: 506825 - RNA, 64 nt, Homo Sapiens; identical to SEQ ID NO: 46320

SEQ ID NO: 506826 - RNA, 64 nt, Homo Sapiens; identical to SEQ ID NO: 46321

SEQ ID NO: 506827 - RNA, 64 nt, Homo Sapiens; identical to SEQ ID NO: 46322

SEQ ID NO: 506828 - RNA, 64 nt, Homo Sapiens; identical to SEQ ID NO: 46323

SEQ ID NO: 506829 - RNA, 64 nt, Homo Sapiens; identical to SEQ ID NO: 46324

SEQ ID NO: 506830 - RNA, 64 nt, Homo Sapiens; identical to SEQ ID NO: 46325

SEQ ID NO: 506831 - RNA, 64 nt, Homo Sapiens; identical to SEQ ID NO: 46326

SEQ ID NO: 506832 - RNA, 64 nt, Homo Sapiens; identical to SEQ ID NO: 46327

SEQ ID NO: 506833 - RNA, 64 nt, Homo Sapiens; identical to SEQ ID NO: 46328

SEQ ID NO: 506834 - RNA, 64 nt, Homo Sapiens; identical to SEQ ID NO: 46329

SEQ ID NO: 506835 - RNA, 64 nt, Homo Sapiens; identical to SEQ ID NO: 46330

SEQ ID NO: 506836 - RNA, 64 nt, Homo Sapiens; identical to SEQ ID NO: 46331

SEQ ID NO: 506837 - RNA, 64 nt, Homo Sapiens; identical to SEQ ID NO: 46332

SEQ ID NO: 506838 - RNA, 64 nt, Homo Sapiens; identical to SEQ ID NO: 46333

SEQ ID NO: 506839 - RNA, 64 nt, Homo Sapiens; identical to SEQ ID NO: 46334

SEQ ID NO: 506840 - RNA, 64 nt, Homo Sapiens; identical to SEQ ID NO: 46335

SEQ ID NO: 506841 - RNA, 64 nt, Homo Sapiens; identical to SEQ ID NO: 46336

SEQ ID NO: 506842 - RNA, 64 nt, Homo Sapiens; identical to SEQ ID NO: 46337

SEQ ID NO: 506843 - RNA, 64 nt, Homo Sapiens; identical to SEQ ID NO: 46338

SEQ ID NO: 506844 - RNA, 64 nt, Homo Sapiens; identical to SEQ ID NO: 46339

SEQ ID NO: 506845 - RNA, 64 nt, Homo Sapiens; identical to SEQ ID NO: 46340

SEQ ID NO: 506846 - RNA, 64 nt, Homo Sapiens; identical to SEQ ID NO: 46341

SEQ ID NO: 506847 - RNA, 64 nt, Homo Sapiens; identical to SEQ ID NO: 46342

SEQ ID NO: 506848 - RNA, 64 nt, Homo Sapiens; identical to SEQ ID NO: 46343

SEQ ID NO: 506849 - RNA, 64 nt, Homo Sapiens; identical to SEQ ID NO: 46344

SEQ ID NO: 506850 - RNA, 64 nt, Homo Sapiens; identical to SEQ ID NO: 46345

SEQ ID NO: 506851 - RNA, 64 nt, Homo Sapiens; identical to SEQ ID NO: 46346

SEQ ID NO: 506852 - RNA, 64 nt, Homo Sapiens; identical to SEQ ID NO: 46347

SEQ ID NO: 506853 - RNA, 64 nt, Homo Sapiens; identical to SEQ ID NO: 46348

SEQ ID NO: 506854 - RNA, 64 nt, Homo Sapiens; identical to SEQ ID NO: 46349

SEQ ID NO: 506855 - RNA, 64 nt, Homo Sapiens; identical to SEQ ID NO: 46350

SEQ ID NO: 506856 - RNA, 64 nt, Homo Sapiens; identical to SEQ ID NO: 46351

SEQ ID NO: 506857 - RNA, 64 nt, Homo Sapiens; identical to SEQ ID NO: 46352

SEQ ID NO: 506858 - RNA, 64 nt, Homo Sapiens; identical to SEQ ID NO: 46353

SEQ ID NO: 506859 - RNA, 64 nt, Homo Sapiens; identical to SEQ ID NO: 46354

SEQ ID NO: 506860 - RNA, 64 nt, Homo Sapiens; identical to SEQ ID NO: 46355

SEQ ID NO: 506861 - RNA, 64 nt, Homo Sapiens; identical to SEQ ID NO: 46356

SEQ ID NO: 506862 - RNA, 64 nt, Homo Sapiens; identical to SEQ ID NO: 46357

SEQ ID NO: 506863 - RNA, 64 nt, Homo Sapiens; identical to SEQ ID NO: 46358

SEQ ID NO: 506864 - RNA, 64 nt, Homo Sapiens; identical to SEQ ID NO: 46359

SEQ ID NO: 506865 - RNA, 64 nt, Homo Sapiens; identical to SEQ ID NO: 46360

SEQ ID NO: 506866 - RNA, 64 nt, Homo Sapiens; identical to SEQ ID NO: 46361

SEQ ID NO: 506867 - RNA, 64 nt, Homo Sapiens; identical to SEQ ID NO: 114692

SEQ ID NO: 506868 - RNA, 64 nt, Homo Sapiens; identical to SEQ ID NO: 114693

SEQ ID NO: 506869 - RNA, 64 nt, Homo Sapiens; identical to SEQ ID NO: 114694

SEQ ID NO: 506870 - RNA, 64 nt, Homo Sapiens; identical to SEQ ID NO: 114695

SEQ ID NO: 506871 - RNA, 64 nt, Homo Sapiens; identical to SEQ ID NO: 114696

SEQ ID NO: 506872 - RNA, 64 nt, Homo Sapiens; identical to SEQ ID NO: 114697

SEQ ID NO: 506873 - RNA, 64 nt, Homo Sapiens; identical to SEQ ID NO: 114698

SEQ ID NO: 506874 - RNA, 64 nt, Homo Sapiens; identical to SEQ ID NO: 114699

SEQ ID NO: 506875 - RNA, 64 nt, Homo Sapiens; identical to SEQ ID NO: 290844

SEQ ID NO: 506876 - RNA, 64 nt, Homo Sapiens; identical to SEQ ID NO: 290845

SEQ ID NO: 506877 - RNA, 64 nt, Homo Sapiens; identical to SEQ ID NO: 290846

SEQ ID NO: 506878 - RNA, 64 nt, Homo Sapiens; identical to SEQ ID NO: 290847

SEQ ID NO: 506879 - RNA, 64 nt, Homo Sapiens; identical to SEQ ID NO: 290848

SEQ ID NO: 506880 - RNA, 64 nt, Homo Sapiens; identical to SEQ ID NO: 290849

SEQ ID NO: 506881 - RNA, 64 nt, Homo Sapiens; identical to SEQ ID NO: 290850

SEQ ID NO: 506882 - RNA, 64 nt, Homo Sapiens; identical to SEQ ID NO: 290851

SEQ ID NO: 506883 - RNA, 64 nt, Homo Sapiens; identical to SEQ ID NO: 290852

SEQ ID NO: 506884 - RNA, 64 nt, Homo Sapiens; identical to SEQ ID NO: 290853

SEQ ID NO: 506885 - RNA, 64 nt, Homo Sapiens; identical to SEQ ID NO: 290854

SEQ ID NO: 506886 - RNA, 64 nt, Homo Sapiens; identical to SEQ ID NO: 290855

SEQ ID NO: 506887 - RNA, 64 nt, Homo Sapiens; identical to SEQ ID NO: 290856

SEQ ID NO: 506888 - RNA, 64 nt, Homo Sapiens; identical to SEQ ID NO: 290857

SEQ ID NO: 506889 - RNA, 64 nt, Homo Sapiens; identical to SEQ ID NO: 290858

SEQ ID NO: 506890 - RNA, 64 nt, Homo Sapiens; identical to SEQ ID NO: 290859

SEQ ID NO: 506891 - RNA, 64 nt, Homo Sapiens; identical to SEQ ID NO: 290860

SEQ ID NO: 506892 - RNA, 64 nt, Homo Sapiens; identical to SEQ ID NO: 290861

SEQ ID NO: 506893 - RNA, 64 nt, Homo Sapiens; identical to SEQ ID NO: 290862

SEQ ID NO: 506894 - RNA, 64 nt, Homo Sapiens; identical to SEQ ID NO: 290863

SEQ ID NO: 506895 - RNA, 64 nt, Homo Sapiens; identical to SEQ ID NO: 290864

SEQ ID NO: 506896 - RNA, 64 nt, Homo Sapiens; identical to SEQ ID NO: 290865

SEQ ID NO: 506897 - RNA, 63 nt, Homo Sapiens; identical to SEQ ID NO: 290866

SEQ ID NO: 506898 - RNA, 64 nt, Homo Sapiens
cggggcuggguuucucuuuccucuuuuuggagaaaaggaacagggcaguggaaugaaaauuuuu

SEQ ID NO: 506899 - RNA, 64 nt, Homo Sapiens
aaggacuucaaacuucugcugagaccuuggggucaaggaacauuucauugguuuuuuuugucca

SEQ ID NO: 506900 - RNA, 64 nt, Homo Sapiens
auggaagagguucugauaauuuuuuuaacuuuuuaaggaacagauguggaauacacuggcccau

SEQ ID NO: 506901 - RNA, 64 nt, Homo Sapiens
uuuaguccuauaauuuucagcuuaauuauaaacaaaggaacaaauaaguggaagggcagcuauu

SEQ ID NO: 506902 - RNA, 64 nt, Homo Sapiens
uuguugcauuuccuugauaauauugacguguuuaaaggaacaucucaucuccauuagauuugcc

SEQ ID NO: 506903 - RNA, 64 nt, Homo Sapiens
aagggauuaugacagguauuaccaaaaacaccaaaaggaacaaaggggccugcguuaaaaccua

SEQ ID NO: 506904 - RNA, 64 nt, Homo Sapiens
aauauuauuaaacaaucaucaggcuuuuagcgacaaggaacacacacauuuuucuuaaaggccc

SEQ ID NO: 506905 - RNA, 64 nt, Homo Sapiens
aaaaaugguauacaugaagucacauacuuuuuuaaaggaacacucagaacauucugucauucca

SEQ ID NO: 506906 - RNA, 64 nt, Homo Sapiens
gcuauuugaaaacagaaggcugucaugccuggagaaggaacaaggcgagggacggugugugaca

SEQ ID NO: 506907 - RNA, 64 nt, Homo Sapiens
uucaauuuggcuuuuuguggugagaccuuuuucaaaggaacauaacaaauuuguuacaugucag

SEQ ID NO: 506908 - RNA, 64 nt, Homo Sapiens
gcuucugucauaugaaugagauauacauuuauucaaggaacagcaaugucaacaggauggaaac

SEQ ID NO: 506909 - RNA, 64 nt, Homo Sapiens
ccauuuuaugggcaugaaauaugugguuuagaauaaggaacaagcauuauuccuuugccaacag

SEQ ID NO: 506910 - RNA, 64 nt, Homo Sapiens
uaaaagagcuccugaaggaagcacuaaacauggaaaggaacaacugauaccagccgcugcaaaa

SEQ ID NO: 506911 - RNA, 64 nt, Homo Sapiens
auaguuggaaguaaagcacuccucagcaaauguaaaggaacaaaaauuauaacaaacugucucu

SEQ ID NO: 506912 - RNA, 64 nt, Homo Sapiens
caucgauuuuugggcccuagaaaugcucaaagggugcuccuaggauuaucagagccuaucuuuc

SEQ ID NO: 506913 - RNA, 64 nt, Homo Sapiens
ggcagcucccuagaucuuuagcuucuacucccacugcuccuaccacuccagcaacgccagauaa

SEQ ID NO: 506914 - RNA, 64 nt, Homo Sapiens
ugugcccagaucguucugccacuugcacugugcuugcuccuaagcaaaagggaaaaggagcgcg

SEQ ID NO: 506915 - RNA, 64 nt, Homo Sapiens
auccaggauguuauucuuccuucccaacucacugugcuccuaaaggcagcaaccauucaucuuu

SEQ ID NO: 506916 - RNA, 64 nt, Homo Sapiens
uuuugauuaggagaauauuuuaaauuuuucaaacugcuccuagcuuaauaaggaaguacauuuu

SEQ ID NO: 506917 - RNA, 64 nt, Homo Sapiens
uuuuuuuaauccuuggagcacugauauuuuaucaugcuccuauacucugaaggagcuuuggcuc

SEQ ID NO: 506918 - RNA, 64 nt, Homo Sapiens
guugaauuuugaugaacaaagcuaguuuuugacuugcuccuaauauguguauuacaaauauuuu

SEQ ID NO: 506919 - RNA, 64 nt, Homo Sapiens
ggcaauguguggcaguccuaauuguaugaauuuaugcuccuaccauuaccaguuuuccuaagug

SEQ ID NO: 506920 - RNA, 64 nt, Homo Sapiens
ugcccccuggguucuggacgugagugguggguccugcuccuaucucuccaaaccccauacccuu

SEQ ID NO: 506921 - RNA, 64 nt, Homo Sapiens
ugauccugacuuucuagccauuaauaaagagaacugcuccuagcaccucagccucuaaccauca

SEQ ID NO: 506922 - RNA, 64 nt, Homo Sapiens; identical to SEQ ID NO: 309371

SEQ ID NO: 506923 - RNA, 64 nt, Homo Sapiens; identical to SEQ ID NO: 309372

SEQ ID NO: 506924 - RNA, 64 nt, Homo Sapiens; identical to SEQ ID NO: 309373

SEQ ID NO: 506925 - RNA, 64 nt, Homo Sapiens; identical to SEQ ID NO: 309374

SEQ ID NO: 506926 - RNA, 64 nt, Homo Sapiens; identical to SEQ ID NO: 309375

SEQ ID NO: 506927 - RNA, 64 nt, Homo Sapiens; identical to SEQ ID NO: 309376

SEQ ID NO: 506928 - RNA, 64 nt, Homo Sapiens; identical to SEQ ID NO: 309377

SEQ ID NO: 506929 - RNA, 64 nt, Homo Sapiens; identical to SEQ ID NO: 309378

SEQ ID NO: 506930 - RNA, 64 nt, Homo Sapiens; identical to SEQ ID NO: 309379

SEQ ID NO: 506931 - RNA, 64 nt, Homo Sapiens; identical to SEQ ID NO: 309380

SEQ ID NO: 506932 - RNA, 50 nt, Homo Sapiens; identical to SEQ ID NO: 56892

SEQ ID NO: 506933 - RNA, 64 nt, Homo Sapiens; identical to SEQ ID NO: 309382

SEQ ID NO: 506934 - RNA, 64 nt, Homo Sapiens; identical to SEQ ID NO: 309383

SEQ ID NO: 506935 - RNA, 64 nt, Homo Sapiens; identical to SEQ ID NO: 309384

SEQ ID NO: 506936 - RNA, 64 nt, Homo Sapiens; identical to SEQ ID NO: 309385

SEQ ID NO: 506937 - RNA, 64 nt, Homo Sapiens; identical to SEQ ID NO: 309386

SEQ ID NO: 506938 - RNA, 64 nt, Homo Sapiens; identical to SEQ ID NO: 309387

SEQ ID NO: 506939 - RNA, 64 nt, Homo Sapiens; identical to SEQ ID NO: 309388

SEQ ID NO: 506940 - RNA, 64 nt, Homo Sapiens; identical to SEQ ID NO: 309389

SEQ ID NO: 506941 - RNA, 64 nt, Homo Sapiens; identical to SEQ ID NO: 309390

SEQ ID NO: 506942 - RNA, 64 nt, Homo Sapiens; identical to SEQ ID NO: 309391

SEQ ID NO: 506943 - RNA, 64 nt, Homo Sapiens; identical to SEQ ID NO: 309392

SEQ ID NO: 506944 - RNA, 64 nt, Homo Sapiens; identical to SEQ ID NO: 309393

SEQ ID NO: 506945 - RNA, 64 nt, Homo Sapiens; identical to SEQ ID NO: 309394

SEQ ID NO: 506946 - RNA, 64 nt, Homo Sapiens; identical to SEQ ID NO: 309395

SEQ ID NO: 506947 - RNA, 64 nt, Homo Sapiens; identical to SEQ ID NO: 309396

SEQ ID NO: 506948 - RNA, 64 nt, Homo Sapiens; identical to SEQ ID NO: 309397

SEQ ID NO: 506949 - RNA, 64 nt, Homo Sapiens; identical to SEQ ID NO: 309398

SEQ ID NO: 506950 - RNA, 64 nt, Homo Sapiens; identical to SEQ ID NO: 309399

SEQ ID NO: 506951 - RNA, 64 nt, Homo Sapiens; identical to SEQ ID NO: 309400

SEQ ID NO: 506952 - RNA, 64 nt, Homo Sapiens; identical to SEQ ID NO: 309401

SEQ ID NO: 506953 - RNA, 64 nt, Homo Sapiens; identical to SEQ ID NO: 309402

SEQ ID NO: 506954 - RNA, 64 nt, Homo Sapiens; identical to SEQ ID NO: 309403

SEQ ID NO: 506955 - RNA, 64 nt, Homo Sapiens; identical to SEQ ID NO: 309404

SEQ ID NO: 506956 - RNA, 64 nt, Homo Sapiens; identical to SEQ ID NO: 309405

SEQ ID NO: 506957 - RNA, 64 nt, Homo Sapiens; identical to SEQ ID NO: 309406

SEQ ID NO: 506958 - RNA, 64 nt, Homo Sapiens; identical to SEQ ID NO: 309407

SEQ ID NO: 506959 - RNA, 64 nt, Homo Sapiens; identical to SEQ ID NO: 309408

SEQ ID NO: 506960 - RNA, 64 nt, Homo Sapiens; identical to SEQ ID NO: 309409

SEQ ID NO: 506961 - RNA, 64 nt, Homo Sapiens; identical to SEQ ID NO: 309410

SEQ ID NO: 506962 - RNA, 64 nt, Homo Sapiens; identical to SEQ ID NO: 309411

SEQ ID NO: 506963 - RNA, 64 nt, Homo Sapiens; identical to SEQ ID NO: 309412

SEQ ID NO: 506964 - RNA, 64 nt, Homo Sapiens; identical to SEQ ID NO: 309413

SEQ ID NO: 506965 - RNA, 64 nt, Homo Sapiens; identical to SEQ ID NO: 309414

SEQ ID NO: 506966 - RNA, 64 nt, Homo Sapiens; identical to SEQ ID NO: 309415

SEQ ID NO: 506967 - RNA, 64 nt, Homo Sapiens; identical to SEQ ID NO: 309416

SEQ ID NO: 506968 - RNA, 64 nt, Homo Sapiens; identical to SEQ ID NO: 309417

SEQ ID NO: 506969 - RNA, 64 nt, Homo Sapiens; identical to SEQ ID NO: 309418

SEQ ID NO: 506970 - RNA, 64 nt, Homo Sapiens; identical to SEQ ID NO: 309419

SEQ ID NO: 506971 - RNA, 64 nt, Homo Sapiens; identical to SEQ ID NO: 309420

SEQ ID NO: 506972 - RNA, 64 nt, Homo Sapiens; identical to SEQ ID NO: 309421

SEQ ID NO: 506973 - RNA, 54 nt, Homo Sapiens; identical to SEQ ID NO: 56933

SEQ ID NO: 506974 - RNA, 64 nt, Homo Sapiens; identical to SEQ ID NO: 309423

SEQ ID NO: 506975 - RNA, 64 nt, Homo Sapiens; identical to SEQ ID NO: 309424

SEQ ID NO: 506976 - RNA, 64 nt, Homo Sapiens; identical to SEQ ID NO: 309425

SEQ ID NO: 506977 - RNA, 64 nt, Homo Sapiens; identical to SEQ ID NO: 309426

SEQ ID NO: 506978 - RNA, 64 nt, Homo Sapiens; identical to SEQ ID NO: 309427

SEQ ID NO: 506979 - RNA, 64 nt, Homo Sapiens; identical to SEQ ID NO: 309428

SEQ ID NO: 506980 - RNA, 64 nt, Homo Sapiens; identical to SEQ ID NO: 309429

SEQ ID NO: 506981 - RNA, 64 nt, Homo Sapiens; identical to SEQ ID NO: 309430

SEQ ID NO: 506982 - RNA, 64 nt, Homo Sapiens
cuuuagcucucuuuuucuuugcccaccucuaagccaauuggauuaauuaaccauaugcuagaau

SEQ ID NO: 506983 - RNA, 64 nt, Homo Sapiens
acauuucaagaugguaacagguucucuuugaccacaauuggaaucauauacagugcaucagucu

SEQ ID NO: 506984 - RNA, 64 nt, Homo Sapiens
ugccaaaaacucacuaauagguuaaauuugacuacaauuggaaaaauugacuacaaaauuugua

SEQ ID NO: 506985 - RNA, 64 nt, Homo Sapiens
ucuuggcugcuguacaugauugguacuaguuaaacaauuggauaucagcaaccagaaaauaagc

SEQ ID NO: 506986 - RNA, 64 nt, Homo Sapiens
ugccaaaaacucgagucuuucagugcccugacuacaauuggaaauuuguaguuaaauuugaccu

SEQ ID NO: 506987 - RNA, 64 nt, Homo Sapiens
auaucuuggcugcugcacauugguacuaguuaaacaauuggauaucagcaaccagaaaauaagc

SEQ ID NO: 506988 - RNA, 64 nt, Homo Sapiens; identical to SEQ ID NO: 344304

SEQ ID NO: 506989 - RNA, 64 nt, Homo Sapiens; identical to SEQ ID NO: 344305

SEQ ID NO: 506990 - RNA, 64 nt, Homo Sapiens; identical to SEQ ID NO: 344306

SEQ ID NO: 506991 - RNA, 64 nt, Homo Sapiens; identical to SEQ ID NO: 344307

SEQ ID NO: 506992 - RNA, 64 nt, Homo Sapiens; identical to SEQ ID NO: 344308

SEQ ID NO: 506993 - RNA, 64 nt, Homo Sapiens; identical to SEQ ID NO: 344309

SEQ ID NO: 506994 - RNA, 64 nt, Homo Sapiens; identical to SEQ ID NO: 344310

SEQ ID NO: 506995 - RNA, 64 nt, Homo Sapiens; identical to SEQ ID NO: 344311

SEQ ID NO: 506996 - RNA, 64 nt, Homo Sapiens; identical to SEQ ID NO: 299712

SEQ ID NO: 506997 - RNA, 64 nt, Homo Sapiens; identical to SEQ ID NO: 299713

SEQ ID NO: 506998 - RNA, 64 nt, Homo Sapiens; identical to SEQ ID NO: 299714

SEQ ID NO: 506999 - RNA, 64 nt, Homo Sapiens; identical to SEQ ID NO: 299715

SEQ ID NO: 507000 - RNA, 64 nt, Homo Sapiens; identical to SEQ ID NO: 299716

SEQ ID NO: 507001 - RNA, 64 nt, Homo Sapiens; identical to SEQ ID NO: 299717

SEQ ID NO: 507002 - RNA, 64 nt, Homo Sapiens; identical to SEQ ID NO: 299718

SEQ ID NO: 507003 - RNA, 64 nt, Homo Sapiens; identical to SEQ ID NO: 299719

SEQ ID NO: 507004 - RNA, 64 nt, Homo Sapiens; identical to SEQ ID NO: 299720

SEQ ID NO: 507005 - RNA, 64 nt, Homo Sapiens; identical to SEQ ID NO: 299721

SEQ ID NO: 507006 - RNA, 64 nt, Homo Sapiens
ucagcugcugggccccaccuccccacugcacccagggggcaacuccaccuggacugaugggcac

SEQ ID NO: 507007 - RNA, 64 nt, Homo Sapiens
cugaugggcacaggaggcaccaauagcgauuauugggggcaaugcgaggucuccuccuaugccc

SEQ ID NO: 507008 - RNA, 64 nt, Homo Sapiens
auuaccaauuaugguauacacuuaaaaguauugagggggcaaaacugaaaauuuuaacagucuu

SEQ ID NO: 507009 - RNA, 64 nt, Homo Sapiens
gaaaucaaugcaagauuucuguugcaaugacaaggggggcaaauccacaguauucuagagacgg

SEQ ID NO: 507010 - RNA, 64 nt, Homo Sapiens
cuaugauuaacuugcuucaaauaccaggguacuggggggcaauggugaugcuccuuguagcagg

SEQ ID NO: 507011 - RNA, 64 nt, Homo Sapiens
ccccucugcccgaagcaauacugcuuggccuccugggggcaaaguggugccagcuucugagggc

SEQ ID NO: 507012 - RNA, 64 nt, Homo Sapiens
aggggcaggcacacaccauggugucggggugugggggggcaaggaggucaguccucaccugcag

SEQ ID NO: 507013 - RNA, 64 nt, Homo Sapiens
agcugggugggcagaaugcaaggggcccuggaaugggggcaagcccugggguggccuguccugc

SEQ ID NO: 507014 - RNA, 64 nt, Homo Sapiens
gggaaaugcccccccaucucgaggggagagaggugggggcaaggcaaaggaccagguaauuggg

SEQ ID NO: 507015 - RNA, 64 nt, Homo Sapiens
gcagcgaggggcaggacccccacugcccagugaagggggcaagguaccccuuccaugcucaucu

SEQ ID NO: 507016 - RNA, 64 nt, Homo Sapiens
ggcgugggaagagcagggcucaaaaacccagugugggggcaaaguugguuggaccugcccacuc

SEQ ID NO: 507017 - RNA, 64 nt, Homo Sapiens
ggccaggugccccccaccagagccccaggccgcagggggcaagguucuagguuugugaauguga

SEQ ID NO: 507018 - RNA, 64 nt, Homo Sapiens
uggagagagcuggcaacuacaagacugaguuuuggggggcaaggacucucuuccucccaccccc

SEQ ID NO: 507019 - RNA, 64 nt, Homo Sapiens
cuagguggugggggagucauagggcagggugagugggggcaaucuaaaaggagggaauaggagg

SEQ ID NO: 507020 - RNA, 64 nt, Homo Sapiens; identical to SEQ ID NO: 182371

SEQ ID NO: 507021 - RNA, 64 nt, Homo Sapiens; identical to SEQ ID NO: 182372

SEQ ID NO: 507022 - RNA, 64 nt, Homo Sapiens; identical to SEQ ID NO: 182373

SEQ ID NO: 507023 - RNA, 64 nt, Homo Sapiens; identical to SEQ ID NO: 182374

SEQ ID NO: 507024 - RNA, 64 nt, Homo Sapiens; identical to SEQ ID NO: 182375

SEQ ID NO: 507025 - RNA, 64 nt, Homo Sapiens; identical to SEQ ID NO: 182376

SEQ ID NO: 507026 - RNA, 64 nt, Homo Sapiens; identical to SEQ ID NO: 182377

SEQ ID NO: 507027 - RNA, 64 nt, Homo Sapiens; identical to SEQ ID NO: 182378

SEQ ID NO: 507028 - RNA, 64 nt, Homo Sapiens; identical to SEQ ID NO: 182379

SEQ ID NO: 507029 - RNA, 64 nt, Homo Sapiens; identical to SEQ ID NO: 182380

SEQ ID NO: 507030 - RNA, 64 nt, Homo Sapiens; identical to SEQ ID NO: 182381

SEQ ID NO: 507031 - RNA, 64 nt, Homo Sapiens; identical to SEQ ID NO: 182382

SEQ ID NO: 507032 - RNA, 64 nt, Homo Sapiens; identical to SEQ ID NO: 182383

SEQ ID NO: 507033 - RNA, 64 nt, Homo Sapiens; identical to SEQ ID NO: 182384

SEQ ID NO: 507034 - RNA, 64 nt, Homo Sapiens; identical to SEQ ID NO: 182385

SEQ ID NO: 507035 - RNA, 64 nt, Homo Sapiens; identical to SEQ ID NO: 182386

SEQ ID NO: 507036 - RNA, 64 nt, Homo Sapiens; identical to SEQ ID NO: 182387

SEQ ID NO: 507037 - RNA, 64 nt, Homo Sapiens; identical to SEQ ID NO: 182388

SEQ ID NO: 507038 - RNA, 64 nt, Homo Sapiens; identical to SEQ ID NO: 182389

SEQ ID NO: 507039 - RNA, 64 nt, Homo Sapiens; identical to SEQ ID NO: 182390

SEQ ID NO: 507040 - RNA, 64 nt, Homo Sapiens; identical to SEQ ID NO: 182391

SEQ ID NO: 507041 - RNA, 64 nt, Homo Sapiens; identical to SEQ ID NO: 182392

SEQ ID NO: 507042 - RNA, 64 nt, Homo Sapiens; identical to SEQ ID NO: 182393

SEQ ID NO: 507043 - RNA, 64 nt, Homo Sapiens; identical to SEQ ID NO: 182394

SEQ ID NO: 507044 - RNA, 64 nt, Homo Sapiens; identical to SEQ ID NO: 182395

SEQ ID NO: 507045 - RNA, 64 nt, Homo Sapiens; identical to SEQ ID NO: 182396

SEQ ID NO: 507046 - RNA, 64 nt, Homo Sapiens; identical to SEQ ID NO: 182397

SEQ ID NO: 507047 - RNA, 64 nt, Homo Sapiens; identical to SEQ ID NO: 182398

SEQ ID NO: 507048 - RNA, 64 nt, Homo Sapiens; identical to SEQ ID NO: 182399

SEQ ID NO: 507049 - RNA, 64 nt, Homo Sapiens; identical to SEQ ID NO: 182400

SEQ ID NO: 507050 - RNA, 64 nt, Homo Sapiens; identical to SEQ ID NO: 182401

SEQ ID NO: 507051 - RNA, 64 nt, Homo Sapiens; identical to SEQ ID NO: 182402

SEQ ID NO: 507052 - RNA, 64 nt, Homo Sapiens; identical to SEQ ID NO: 182403

SEQ ID NO: 507053 - RNA, 64 nt, Homo Sapiens; identical to SEQ ID NO: 182404

SEQ ID NO: 507054 - RNA, 64 nt, Homo Sapiens; identical to SEQ ID NO: 182405

SEQ ID NO: 507055 - RNA, 64 nt, Homo Sapiens; identical to SEQ ID NO: 182406

SEQ ID NO: 507056 - RNA, 64 nt, Homo Sapiens; identical to SEQ ID NO: 182407

SEQ ID NO: 507057 - RNA, 64 nt, Homo Sapiens; identical to SEQ ID NO: 182408

SEQ ID NO: 507058 - RNA, 64 nt, Homo Sapiens; identical to SEQ ID NO: 182409

SEQ ID NO: 507059 - RNA, 64 nt, Homo Sapiens; identical to SEQ ID NO: 182410

SEQ ID NO: 507060 - RNA, 64 nt, Homo Sapiens; identical to SEQ ID NO: 182411

SEQ ID NO: 507061 - RNA, 64 nt, Homo Sapiens; identical to SEQ ID NO: 182412

SEQ ID NO: 507062 - RNA, 64 nt, Homo Sapiens; identical to SEQ ID NO: 182413

SEQ ID NO: 507063 - RNA, 64 nt, Homo Sapiens; identical to SEQ ID NO: 182414

SEQ ID NO: 507064 - RNA, 64 nt, Homo Sapiens; identical to SEQ ID NO: 182415

SEQ ID NO: 507065 - RNA, 64 nt, Homo Sapiens; identical to SEQ ID NO: 182416

SEQ ID NO: 507066 - RNA, 64 nt, Homo Sapiens; identical to SEQ ID NO: 182417

SEQ ID NO: 507067 - RNA, 64 nt, Homo Sapiens; identical to SEQ ID NO: 182418

SEQ ID NO: 507068 - RNA, 64 nt, Homo Sapiens; identical to SEQ ID NO: 182419

SEQ ID NO: 507069 - RNA, 64 nt, Homo Sapiens; identical to SEQ ID NO: 182420

SEQ ID NO: 507070 - RNA, 64 nt, Homo Sapiens; identical to SEQ ID NO: 182421

SEQ ID NO: 507071 - RNA, 64 nt, Homo Sapiens; identical to SEQ ID NO: 182422

SEQ ID NO: 507072 - RNA, 64 nt, Homo Sapiens; identical to SEQ ID NO: 182423

SEQ ID NO: 507073 - RNA, 64 nt, Homo Sapiens; identical to SEQ ID NO: 182424

SEQ ID NO: 507074 - RNA, 64 nt, Homo Sapiens; identical to SEQ ID NO: 182425

SEQ ID NO: 507075 - RNA, 64 nt, Homo Sapiens; identical to SEQ ID NO: 182426

SEQ ID NO: 507076 - RNA, 64 nt, Homo Sapiens; identical to SEQ ID NO: 182427

SEQ ID NO: 507077 - RNA, 64 nt, Homo Sapiens; identical to SEQ ID NO: 182428

SEQ ID NO: 507078 - RNA, 64 nt, Homo Sapiens; identical to SEQ ID NO: 182429

SEQ ID NO: 507079 - RNA, 64 nt, Homo Sapiens; identical to SEQ ID NO: 206766

SEQ ID NO: 507080 - RNA, 64 nt, Homo Sapiens; identical to SEQ ID NO: 206767

SEQ ID NO: 507081 - RNA, 64 nt, Homo Sapiens; identical to SEQ ID NO: 225502

SEQ ID NO: 507082 - RNA, 64 nt, Homo Sapiens; identical to SEQ ID NO: 225503

SEQ ID NO: 507083 - RNA, 64 nt, Homo Sapiens; identical to SEQ ID NO: 225504

SEQ ID NO: 507084 - RNA, 64 nt, Homo Sapiens; identical to SEQ ID NO: 225505

SEQ ID NO: 507085 - RNA, 64 nt, Homo Sapiens; identical to SEQ ID NO: 225506

SEQ ID NO: 507086 - RNA, 64 nt, Homo Sapiens; identical to SEQ ID NO: 225507

SEQ ID NO: 507087 - RNA, 64 nt, Homo Sapiens; identical to SEQ ID NO: 225508

SEQ ID NO: 507088 - RNA, 64 nt, Homo Sapiens; identical to SEQ ID NO: 225509

SEQ ID NO: 507089 - RNA, 64 nt, Homo Sapiens; identical to SEQ ID NO: 225510

SEQ ID NO: 507090 - RNA, 64 nt, Homo Sapiens; identical to SEQ ID NO: 225511

SEQ ID NO: 507091 - RNA, 64 nt, Homo Sapiens; identical to SEQ ID NO: 225512

SEQ ID NO: 507092 - RNA, 64 nt, Homo Sapiens
cagccaaaggccacgucugacuugggaggcagagggcagcuacugcagguuuccgagcagaggg

SEQ ID NO: 507093 - RNA, 64 nt, Homo Sapiens
ccauggguccagaggauacuacugggaaggggauggcagcuacugccaccuuccagaugguucc

SEQ ID NO: 507094 - RNA, 64 nt, Homo Sapiens
augagcagcucccaagaaucgcagagcugggacaggcagcuaaacauuaccucagcgggaggga

SEQ ID NO: 507095 - RNA, 64 nt, Homo Sapiens
cagaagucccugacggucacgcugacuuuggagaggcagcuaagccacgguucuguugacggau

SEQ ID NO: 507096 - RNA, 64 nt, Homo Sapiens; identical to SEQ ID NO: 256768

SEQ ID NO: 507097 - RNA, 64 nt, Homo Sapiens; identical to SEQ ID NO: 256769

SEQ ID NO: 507098 - RNA, 64 nt, Homo Sapiens; identical to SEQ ID NO: 256770

SEQ ID NO: 507099 - RNA, 64 nt, Homo Sapiens; identical to SEQ ID NO: 256771

SEQ ID NO: 507100 - RNA, 64 nt, Homo Sapiens; identical to SEQ ID NO: 256772

SEQ ID NO: 507101 - RNA, 64 nt, Homo Sapiens; identical to SEQ ID NO: 256773

SEQ ID NO: 507102 - RNA, 64 nt, Homo Sapiens; identical to SEQ ID NO: 256774

SEQ ID NO: 507103 - RNA, 64 nt, Homo Sapiens; identical to SEQ ID NO: 256775

SEQ ID NO: 507104 - RNA, 64 nt, Homo Sapiens; identical to SEQ ID NO: 256776

SEQ ID NO: 507105 - RNA, 64 nt, Homo Sapiens; identical to SEQ ID NO: 256777

SEQ ID NO: 507106 - RNA, 64 nt, Homo Sapiens; identical to SEQ ID NO: 256778

SEQ ID NO: 507107 - RNA, 64 nt, Homo Sapiens; identical to SEQ ID NO: 256779

SEQ ID NO: 507108 - RNA, 64 nt, Homo Sapiens; identical to SEQ ID NO: 256780

SEQ ID NO: 507109 - RNA, 64 nt, Homo Sapiens; identical to SEQ ID NO: 256781

SEQ ID NO: 507110 - RNA, 64 nt, Homo Sapiens
uuuugcagagggcaguaucaaaagaaagugguuuucuucaaauguauacuauuuuacuuccuga

SEQ ID NO: 507111 - RNA, 64 nt, Homo Sapiens
ucacagucaaaaaaugaaaagguuuuugugcguuucuucaaaauucugcuuucuucaacaucaa

SEQ ID NO: 507112 - RNA, 64 nt, Homo Sapiens
aaaaguaucucacgguacaaauuaagaaugacuuucuucaaaauaucugaauaggugcaguuuu

SEQ ID NO: 507113 - RNA, 64 nt, Homo Sapiens
uagaacaaauaugggaggacaaagaaucgcaaauucuucaaaugacuauuaucaguauuauuaa

SEQ ID NO: 507114 - RNA, 64 nt, Homo Sapiens
gaagaaaccaaauauauguguuuacuguagcaugucuucaaauuaguggaacuuaguucaggga

SEQ ID NO: 507115 - RNA, 64 nt, Homo Sapiens
aaagcuuaugcagaacaucugcaauggaacucuuucuucaaacauacuccaaccccguuuuuaa

SEQ ID NO: 507116 - RNA, 64 nt, Homo Sapiens
aaggcagaaauaauuuuaugauaaaucauucaaaucuucaaaccucucuaaaauucuaaaaagc

SEQ ID NO: 507117 - RNA, 64 nt, Homo Sapiens
cuucaccuuaaugggucuugucuaucuucauuagucuucaaagaaaaaccauuugcuaccaaag

SEQ ID NO: 507118 - RNA, 64 nt, Homo Sapiens
uuuuagauacugaaauugaaggaaagaaaaugcaucuucaaacauuuuuuggaaucucaccaca

SEQ ID NO: 507119 - RNA, 50 nt, Homo Sapiens
agaagugccggguuuggugaucuucaaaagaagcauugcagcccuuggcu

SEQ ID NO: 507120 - RNA, 64 nt, Homo Sapiens
uuaccaucuuacuugagccuuuaauggacuuauuucuucaaauccuuccaaaaauuauuauaag

SEQ ID NO: 507121 - RNA, 64 nt, Homo Sapiens
gacuacagcuagcugcacauauaaaaagucauuuucuucaaagaaaacauaaauguguguaaug

SEQ ID NO: 507122 - RNA, 64 nt, Homo Sapiens
gcauaauggaacaaauggcaaaggaaaacauguuucuucaaauuauaucuguucauaaaaauaa

SEQ ID NO: 507123 - RNA, 64 nt, Homo Sapiens
ucagaaugcuuucaaggguaaccagauuuaagaaucuucaaacaauacacuguuaccuuuugac

SEQ ID NO: 507124 - RNA, 64 nt, Homo Sapiens
gcuucagaauuggaauguuuauauuauguagaaaucuucaaagguagcauuauuaaauagcaaa

SEQ ID NO: 507125 - RNA, 64 nt, Homo Sapiens
cagauuauuagauuccagcagugugugucagucaucuucaaaggggguguguguguguguguuu

SEQ ID NO: 507126 - RNA, 64 nt, Homo Sapiens
cuuggucaucuguuuggauggagaaauaagguagucuucaaaaucuugaaaguuuuaacuaagu

SEQ ID NO: 507127 - RNA, 64 nt, Homo Sapiens
cgcaguuaggcaaaaugacaggcucucuggcuaaucuucaaagcaaaggaaaguuucuucaaag

SEQ ID NO: 507128 - RNA, 64 nt, Homo Sapiens
gcucucuggcuaaucuucaaacuaaaggaaaguuucuucaaagguuucaaguauuauucacaac

SEQ ID NO: 507129 - RNA, 64 nt, Homo Sapiens
auugaaguguguucauagucauuuggcuuggaguucuucaaagcuaauauugauuggucuuuuu

SEQ ID NO: 507130 - RNA, 64 nt, Homo Sapiens
gaguccuaaagaacauacugaggcuccuggugcaucuucaaaauggcagugcuugaaugagaaa

SEQ ID NO: 507131 - RNA, 64 nt, Homo Sapiens
guaaauggggaaauuaacaggacuuucuucuucaucuucaaacucuucagaagcagcaacaggg

SEQ ID NO: 507132 - RNA, 64 nt, Homo Sapiens
uucuuccuuguaauuauacuuaagaucuucaauuucuucaaaaaaugaaggaucaaaauuuucc

SEQ ID NO: 507133 - RNA, 64 nt, Homo Sapiens
aaugccaagauuuuuuuguaagcaacuucuuuucucuucaaaugaauguuaaauauuuggauau

SEQ ID NO: 507134 - RNA, 64 nt, Homo Sapiens
ccaaaaaaugagguuuugcugucauacuccauggucuucaaagaguuaauguuugcucuuagaa

SEQ ID NO: 507135 - RNA, 64 nt, Homo Sapiens
guccauaaacaauaucugccaacucaaccuguugucuucaaaugcuaaaaaaggagaauggagg

SEQ ID NO: 507136 - RNA, 64 nt, Homo Sapiens
ucaguuuuuccugaagaauuuucuuuaccauuagucuucaaauuggauacuguugugcaguggu

SEQ ID NO: 507137 - RNA, 64 nt, Homo Sapiens
gaaagcucuguguucuuuugccuucaaucuguugucuucaaaacaaacaaacaaaaaaagcuuc

SEQ ID NO: 507138 - RNA, 64 nt, Homo Sapiens
uccuggugcaacuuaauuuuuuuuuuuaaugcuaucuucaaaacguuagagaaaguucuucaaa

SEQ ID NO: 507139 - RNA, 64 nt, Homo Sapiens
uuuuuaaugcuaucuucaaaacguuagagaaaguucuucaaaagugcagcccagagcugcuggg

SEQ ID NO: 507140 - RNA, 64 nt, Homo Sapiens
agcuuaccagguucaaggguacaaacuucucaaaucuucaaaacauuuuagucaaaguguaaua

SEQ ID NO: 507141 - RNA, 64 nt, Homo Sapiens
auuuugguuuuuuuucuuaagugaauaauaccagucuucaaagaaaacaaggugaagaccuauu

SEQ ID NO: 507142 - RNA, 64 nt, Homo Sapiens
aagaaauuuugcaaauguaaagaauaugacaaggucuucaaacacaaguuuuucuaauaacuca

SEQ ID NO: 507143 - RNA, 64 nt, Homo Sapiens
gagacuucacaauuauaauaaauguguggaaaagucuucaaaaaaauuucacaccuugcaaaag

SEQ ID NO: 507144 - RNA, 53 nt, Homo Sapiens
aagauguccugaagucauagaugucuucaaaucccuguuccuauccuucuucu

SEQ ID NO: 507145 - RNA, 64 nt, Homo Sapiens
aagucugagagucugugucuuuauuugaaaagauucuucaaauugcguacuuacuccuccauau

SEQ ID NO: 507146 - RNA, 64 nt, Homo Sapiens
uacuaauguaacuaucuuaaguaauaguaauuccucuucaaaaauugagcgcuauguugcaaga

SEQ ID NO: 507147 - RNA, 64 nt, Homo Sapiens
uuuugcaaaauuuggggaacuuucaacuauuauuucuucaaauauuuuuucaccccccagucuu

SEQ ID NO: 507148 - RNA, 64 nt, Homo Sapiens
ggaggaggacgaaggccuagacucagcugaaggaucuucaaagcaggaugaagaccuagacuua

SEQ ID NO: 507149 - RNA, 64 nt, Homo Sapiens
agacuuaccugaaggccuagacucagcugaaggaucuucaaagcaggaugaagaccuagacuua

SEQ ID NO: 507150 - RNA, 64 nt, Homo Sapiens
aaagcaggaugaagaccuagacuuaccugaaggaucuucaaagcagaaugaagaccuaggcuua

SEQ ID NO: 507151 - RNA, 64 nt, Homo Sapiens
aaagcagaaugaagaccuaggcuuaccugaaggaucuucaaagcaggaugaagaccuagacuua

SEQ ID NO: 507152 - RNA, 64 nt, Homo Sapiens
ccgugugcacgcugaacgacuaguuuaugagaauucuucaaaucgaaagauauaaaggaucuug

SEQ ID NO: 507153 - RNA, 64 nt, Homo Sapiens
acacagcccacuuauccaucgaggcuuugaaaauucuucaaaaaguaaacaugcagcugccgac

SEQ ID NO: 507154 - RNA, 64 nt, Homo Sapiens; identical to SEQ ID NO: 212887

SEQ ID NO: 507155 - RNA, 64 nt, Homo Sapiens; identical to SEQ ID NO: 212888

SEQ ID NO: 507156 - RNA, 64 nt, Homo Sapiens; identical to SEQ ID NO: 212889

SEQ ID NO: 507157 - RNA, 64 nt, Homo Sapiens; identical to SEQ ID NO: 212890

SEQ ID NO: 507158 - RNA, 64 nt, Homo Sapiens; identical to SEQ ID NO: 212891

SEQ ID NO: 507159 - RNA, 64 nt, Homo Sapiens; identical to SEQ ID NO: 212892

SEQ ID NO: 507160 - RNA, 64 nt, Homo Sapiens; identical to SEQ ID NO: 212893

SEQ ID NO: 507161 - RNA, 64 nt, Homo Sapiens; identical to SEQ ID NO: 212894

SEQ ID NO: 507162 - RNA, 64 nt, Homo Sapiens; identical to SEQ ID NO: 212895

SEQ ID NO: 507163 - RNA, 64 nt, Homo Sapiens; identical to SEQ ID NO: 212896

SEQ ID NO: 507164 - RNA, 64 nt, Homo Sapiens; identical to SEQ ID NO: 212897

SEQ ID NO: 507165 - RNA, 64 nt, Homo Sapiens; identical to SEQ ID NO: 212898

SEQ ID NO: 507166 - RNA, 64 nt, Homo Sapiens; identical to SEQ ID NO: 212899

SEQ ID NO: 507167 - RNA, 64 nt, Homo Sapiens; identical to SEQ ID NO: 212900

SEQ ID NO: 507168 - RNA, 64 nt, Homo Sapiens; identical to SEQ ID NO: 212901

SEQ ID NO: 507169 - RNA, 64 nt, Homo Sapiens; identical to SEQ ID NO: 212902

SEQ ID NO: 507170 - RNA, 64 nt, Homo Sapiens; identical to SEQ ID NO: 212903

SEQ ID NO: 507171 - RNA, 64 nt, Homo Sapiens; identical to SEQ ID NO: 212904

SEQ ID NO: 507172 - RNA, 64 nt, Homo Sapiens; identical to SEQ ID NO: 212905

SEQ ID NO: 507173 - RNA, 64 nt, Homo Sapiens; identical to SEQ ID NO: 212906

SEQ ID NO: 507174 - RNA, 64 nt, Homo Sapiens; identical to SEQ ID NO: 212907

SEQ ID NO: 507175 - RNA, 64 nt, Homo Sapiens; identical to SEQ ID NO: 212908

SEQ ID NO: 507176 - RNA, 64 nt, Homo Sapiens; identical to SEQ ID NO: 212909

SEQ ID NO: 507177 - RNA, 64 nt, Homo Sapiens; identical to SEQ ID NO: 212910

SEQ ID NO: 507178 - RNA, 64 nt, Homo Sapiens; identical to SEQ ID NO: 212911

SEQ ID NO: 507179 - RNA, 64 nt, Homo Sapiens; identical to SEQ ID NO: 209092

SEQ ID NO: 507180 - RNA, 64 nt, Homo Sapiens; identical to SEQ ID NO: 209093

SEQ ID NO: 507181 - RNA, 64 nt, Homo Sapiens; identical to SEQ ID NO: 209094

SEQ ID NO: 507182 - RNA, 64 nt, Homo Sapiens; identical to SEQ ID NO: 209095

SEQ ID NO: 507183 - RNA, 64 nt, Homo Sapiens; identical to SEQ ID NO: 209096

SEQ ID NO: 507184 - RNA, 64 nt, Homo Sapiens; identical to SEQ ID NO: 209097

SEQ ID NO: 507185 - RNA, 64 nt, Homo Sapiens; identical to SEQ ID NO: 209098

SEQ ID NO: 507186 - RNA, 64 nt, Homo Sapiens; identical to SEQ ID NO: 209099

SEQ ID NO: 507187 - RNA, 64 nt, Homo Sapiens; identical to SEQ ID NO: 209100

SEQ ID NO: 507188 - RNA, 64 nt, Homo Sapiens; identical to SEQ ID NO: 209101

SEQ ID NO: 507189 - RNA, 64 nt, Homo Sapiens; identical to SEQ ID NO: 209102

SEQ ID NO: 507190 - RNA, 64 nt, Homo Sapiens; identical to SEQ ID NO: 209103

SEQ ID NO: 507191 - RNA, 64 nt, Homo Sapiens; identical to SEQ ID NO: 209104

SEQ ID NO: 507192 - RNA, 64 nt, Homo Sapiens; identical to SEQ ID NO: 209105

SEQ ID NO: 507193 - RNA, 64 nt, Homo Sapiens; identical to SEQ ID NO: 209106

SEQ ID NO: 507194 - RNA, 64 nt, Homo Sapiens; identical to SEQ ID NO: 209107

SEQ ID NO: 507195 - RNA, 64 nt, Homo Sapiens; identical to SEQ ID NO: 209108

SEQ ID NO: 507196 - RNA, 64 nt, Homo Sapiens; identical to SEQ ID NO: 209109

SEQ ID NO: 507197 - RNA, 64 nt, Homo Sapiens; identical to SEQ ID NO: 209110

SEQ ID NO: 507198 - RNA, 64 nt, Homo Sapiens; identical to SEQ ID NO: 209111

SEQ ID NO: 507199 - RNA, 64 nt, Homo Sapiens; identical to SEQ ID NO: 209112

SEQ ID NO: 507200 - RNA, 64 nt, Homo Sapiens; identical to SEQ ID NO: 209113

SEQ ID NO: 507201 - RNA, 59 nt, Homo Sapiens; identical to SEQ ID NO: 209114

SEQ ID NO: 507202 - RNA, 64 nt, Homo Sapiens; identical to SEQ ID NO: 209115

SEQ ID NO: 507203 - RNA, 64 nt, Homo Sapiens; identical to SEQ ID NO: 209116

SEQ ID NO: 507204 - RNA, 64 nt, Homo Sapiens; identical to SEQ ID NO: 209117

SEQ ID NO: 507205 - RNA, 64 nt, Homo Sapiens; identical to SEQ ID NO: 209118

SEQ ID NO: 507206 - RNA, 64 nt, Homo Sapiens; identical to SEQ ID NO: 209119

SEQ ID NO: 507207 - RNA, 64 nt, Homo Sapiens; identical to SEQ ID NO: 209120

SEQ ID NO: 507208 - RNA, 64 nt, Homo Sapiens; identical to SEQ ID NO: 209121

SEQ ID NO: 507209 - RNA, 64 nt, Homo Sapiens; identical to SEQ ID NO: 209122

SEQ ID NO: 507210 - RNA, 64 nt, Homo Sapiens; identical to SEQ ID NO: 209123

SEQ ID NO: 507211 - RNA, 64 nt, Homo Sapiens; identical to SEQ ID NO: 209124

SEQ ID NO: 507212 - RNA, 64 nt, Homo Sapiens; identical to SEQ ID NO: 209125

SEQ ID NO: 507213 - RNA, 64 nt, Homo Sapiens; identical to SEQ ID NO: 209126

SEQ ID NO: 507214 - RNA, 64 nt, Homo Sapiens; identical to SEQ ID NO: 209127

SEQ ID NO: 507215 - RNA, 64 nt, Homo Sapiens; identical to SEQ ID NO: 209128

SEQ ID NO: 507216 - RNA, 64 nt, Homo Sapiens; identical to SEQ ID NO: 209129

SEQ ID NO: 507217 - RNA, 64 nt, Homo Sapiens; identical to SEQ ID NO: 209130

SEQ ID NO: 507218 - RNA, 64 nt, Homo Sapiens; identical to SEQ ID NO: 209131

SEQ ID NO: 507219 - RNA, 64 nt, Homo Sapiens; identical to SEQ ID NO: 209132

SEQ ID NO: 507220 - RNA, 64 nt, Homo Sapiens; identical to SEQ ID NO: 209133

SEQ ID NO: 507221 - RNA, 64 nt, Homo Sapiens; identical to SEQ ID NO: 209134

SEQ ID NO: 507222 - RNA, 64 nt, Homo Sapiens; identical to SEQ ID NO: 209135

SEQ ID NO: 507223 - RNA, 64 nt, Homo Sapiens; identical to SEQ ID NO: 209136

SEQ ID NO: 507224 - RNA, 64 nt, Homo Sapiens; identical to SEQ ID NO: 209137

SEQ ID NO: 507225 - RNA, 64 nt, Homo Sapiens; identical to SEQ ID NO: 209138

SEQ ID NO: 507226 - RNA, 64 nt, Homo Sapiens; identical to SEQ ID NO: 209139

SEQ ID NO: 507227 - RNA, 64 nt, Homo Sapiens; identical to SEQ ID NO: 209140

SEQ ID NO: 507228 - RNA, 64 nt, Homo Sapiens; identical to SEQ ID NO: 209141

SEQ ID NO: 507229 - RNA, 64 nt, Homo Sapiens; identical to SEQ ID NO: 209142

SEQ ID NO: 507230 - RNA, 64 nt, Homo Sapiens; identical to SEQ ID NO: 209143

SEQ ID NO: 507231 - RNA, 64 nt, Homo Sapiens; identical to SEQ ID NO: 209144

SEQ ID NO: 507232 - RNA, 64 nt, Homo Sapiens; identical to SEQ ID NO: 209145

SEQ ID NO: 507233 - RNA, 64 nt, Homo Sapiens
uuguuuaauaaguauaucuuuugguuauuucuaaaccacaaaagaagagucaaaguaguuaguu

SEQ ID NO: 507234 - RNA, 64 nt, Homo Sapiens
caaaauuuuuaaaacugcauuucuccagaaauuuaccacaaaaguugagcuuugcauuuaugau

SEQ ID NO: 507235 - RNA, 64 nt, Homo Sapiens
aaaaggcugguguucaccaaccaaacaaaacugaaccacaaaaagaccccaguggaaaacaaag

SEQ ID NO: 507236 - RNA, 64 nt, Homo Sapiens
auucgaaugggguagaaacaauagcaaaugcagaaccacaaacaugcuggaagaaacuaaaaau

SEQ ID NO: 507237 - RNA, 64 nt, Homo Sapiens
uuccgcucaggguuuuuucuuaaaggaagcaguaaccacaaagcaguuuguuuugcuuuuaauu

SEQ ID NO: 507238 - RNA, 64 nt, Homo Sapiens
aacuagccaugaugggagacauaccaaaacaaggaccacaaaacacagcaacaacacgaagaug

SEQ ID NO: 507239 - RNA, 64 nt, Homo Sapiens
uacauccccagucuuuuguuagaaucuaaaacauaccacaaaaaaugcuguucuguccuucuug

SEQ ID NO: 507240 - RNA, 64 nt, Homo Sapiens
cagaucacaggggccuuacauuuggagaaauagaaccacaaacauucaguaaaagccugcucaa

SEQ ID NO: 507241 - RNA, 64 nt, Homo Sapiens
aguuggcuguuacuguauuuucacuggaagucugaccacaaacagaaguuucugaagguugacg

SEQ ID NO: 507242 - RNA, 64 nt, Homo Sapiens
aucccucuaaauuaguucccaaagcaacccccuaaccacaaaauuugaacaacuuugcaggaau

SEQ ID NO: 507243 - RNA, 64 nt, Homo Sapiens
gcacacaggaucacucacauauguacauguacccaccacaaacgugcaagcuccugcacacaug

SEQ ID NO: 507244 - RNA, 64 nt, Homo Sapiens
gcagccuccugcacacgugcacauucauguguacaccacaaaugaguucccagacguguaaaca

SEQ ID NO: 507245 - RNA, 64 nt, Homo Sapiens
gcacaggcuccuacacacaugcacacacguguacaccacaaacgagcucccagacauguaaaca

SEQ ID NO: 507246 - RNA, 64 nt, Homo Sapiens
gugagcucccacacguacacaugcacauguacgcaccacaaacacaugcgcaggcuccugcagg

SEQ ID NO: 507247 - RNA, 64 nt, Homo Sapiens
ggcucucugugaaacuacaaaccccaccugagcaaccacaaauaauuucugcaagcaauguaug

SEQ ID NO: 507248 - RNA, 64 nt, Homo Sapiens
gacaaacaagaaaaaaagcugaguuuaaacaaaaaccacaaacaagaaaaauguauauagcugu

SEQ ID NO: 507249 - RNA, 64 nt, Homo Sapiens; identical to SEQ ID NO: 116369

SEQ ID NO: 507250 - RNA, 64 nt, Homo Sapiens; identical to SEQ ID NO: 116370

SEQ ID NO: 507251 - RNA, 64 nt, Homo Sapiens; identical to SEQ ID NO: 116371

SEQ ID NO: 507252 - RNA, 64 nt, Homo Sapiens; identical to SEQ ID NO: 116372

SEQ ID NO: 507253 - RNA, 64 nt, Homo Sapiens; identical to SEQ ID NO: 116373

SEQ ID NO: 507254 - RNA, 64 nt, Homo Sapiens; identical to SEQ ID NO: 116374

SEQ ID NO: 507255 - RNA, 64 nt, Homo Sapiens; identical to SEQ ID NO: 116375

SEQ ID NO: 507256 - RNA, 64 nt, Homo Sapiens; identical to SEQ ID NO: 116376

SEQ ID NO: 507257 - RNA, 64 nt, Homo Sapiens; identical to SEQ ID NO: 116377

SEQ ID NO: 507258 - RNA, 64 nt, Homo Sapiens; identical to SEQ ID NO: 116378

SEQ ID NO: 507259 - RNA, 64 nt, Homo Sapiens; identical to SEQ ID NO: 116379

SEQ ID NO: 507260 - RNA, 64 nt, Homo Sapiens; identical to SEQ ID NO: 116380

SEQ ID NO: 507261 - RNA, 64 nt, Homo Sapiens; identical to SEQ ID NO: 116381

SEQ ID NO: 507262 - RNA, 64 nt, Homo Sapiens; identical to SEQ ID NO: 116382

SEQ ID NO: 507263 - RNA, 64 nt, Homo Sapiens; identical to SEQ ID NO: 116383

SEQ ID NO: 507264 - RNA, 64 nt, Homo Sapiens; identical to SEQ ID NO: 116384

SEQ ID NO: 507265 - RNA, 64 nt, Homo Sapiens; identical to SEQ ID NO: 116385

SEQ ID NO: 507266 - RNA, 64 nt, Homo Sapiens; identical to SEQ ID NO: 116386

SEQ ID NO: 507267 - RNA, 64 nt, Homo Sapiens; identical to SEQ ID NO: 116387

SEQ ID NO: 507268 - RNA, 64 nt, Homo Sapiens; identical to SEQ ID NO: 116388

SEQ ID NO: 507269 - RNA, 64 nt, Homo Sapiens; identical to SEQ ID NO: 116389

SEQ ID NO: 507270 - RNA, 64 nt, Homo Sapiens; identical to SEQ ID NO: 116390

SEQ ID NO: 507271 - RNA, 64 nt, Homo Sapiens; identical to SEQ ID NO: 116391

SEQ ID NO: 507272 - RNA, 64 nt, Homo Sapiens; identical to SEQ ID NO: 116392

SEQ ID NO: 507273 - RNA, 64 nt, Homo Sapiens; identical to SEQ ID NO: 116393

SEQ ID NO: 507274 - RNA, 64 nt, Homo Sapiens; identical to SEQ ID NO: 116394

SEQ ID NO: 507275 - RNA, 54 nt, Homo Sapiens; identical to SEQ ID NO: 116395

SEQ ID NO: 507276 - RNA, 64 nt, Homo Sapiens; identical to SEQ ID NO: 116396

SEQ ID NO: 507277 - RNA, 64 nt, Homo Sapiens; identical to SEQ ID NO: 116397

SEQ ID NO: 507278 - RNA, 64 nt, Homo Sapiens; identical to SEQ ID NO: 116398

SEQ ID NO: 507279 - RNA, 64 nt, Homo Sapiens; identical to SEQ ID NO: 116399

SEQ ID NO: 507280 - RNA, 64 nt, Homo Sapiens; identical to SEQ ID NO: 116400

SEQ ID NO: 507281 - RNA, 64 nt, Homo Sapiens; identical to SEQ ID NO: 116401

SEQ ID NO: 507282 - RNA, 64 nt, Homo Sapiens; identical to SEQ ID NO: 116402

SEQ ID NO: 507283 - RNA, 64 nt, Homo Sapiens; identical to SEQ ID NO: 116403

SEQ ID NO: 507284 - RNA, 64 nt, Homo Sapiens; identical to SEQ ID NO: 116404

SEQ ID NO: 507285 - RNA, 64 nt, Homo Sapiens; identical to SEQ ID NO: 116405

SEQ ID NO: 507286 - RNA, 64 nt, Homo Sapiens; identical to SEQ ID NO: 116406

SEQ ID NO: 507287 - RNA, 64 nt, Homo Sapiens; identical to SEQ ID NO: 116407

SEQ ID NO: 507288 - RNA, 64 nt, Homo Sapiens; identical to SEQ ID NO: 116408

SEQ ID NO: 507289 - RNA, 64 nt, Homo Sapiens; identical to SEQ ID NO: 116409

SEQ ID NO: 507290 - RNA, 64 nt, Homo Sapiens; identical to SEQ ID NO: 116410

SEQ ID NO: 507291 - RNA, 64 nt, Homo Sapiens; identical to SEQ ID NO: 116411

SEQ ID NO: 507292 - RNA, 64 nt, Homo Sapiens; identical to SEQ ID NO: 280098

SEQ ID NO: 507293 - RNA, 64 nt, Homo Sapiens; identical to SEQ ID NO: 280099

SEQ ID NO: 507294 - RNA, 64 nt, Homo Sapiens; identical to SEQ ID NO: 280100

SEQ ID NO: 507295 - RNA, 64 nt, Homo Sapiens; identical to SEQ ID NO: 280101

SEQ ID NO: 507296 - RNA, 64 nt, Homo Sapiens; identical to SEQ ID NO: 280102

SEQ ID NO: 507297 - RNA, 64 nt, Homo Sapiens; identical to SEQ ID NO: 280103

SEQ ID NO: 507298 - RNA, 64 nt, Homo Sapiens; identical to SEQ ID NO: 280104

SEQ ID NO: 507299 - RNA, 64 nt, Homo Sapiens; identical to SEQ ID NO: 280105

SEQ ID NO: 507300 - RNA, 64 nt, Homo Sapiens; identical to SEQ ID NO: 280106

SEQ ID NO: 507301 - RNA, 64 nt, Homo Sapiens; identical to SEQ ID NO: 280107

SEQ ID NO: 507302 - RNA, 64 nt, Homo Sapiens; identical to SEQ ID NO: 280108

SEQ ID NO: 507303 - RNA, 64 nt, Homo Sapiens; identical to SEQ ID NO: 280109

SEQ ID NO: 507304 - RNA, 64 nt, Homo Sapiens; identical to SEQ ID NO: 280110

SEQ ID NO: 507305 - RNA, 64 nt, Homo Sapiens; identical to SEQ ID NO: 280111

SEQ ID NO: 507306 - RNA, 64 nt, Homo Sapiens; identical to SEQ ID NO: 280112

SEQ ID NO: 507307 - RNA, 64 nt, Homo Sapiens; identical to SEQ ID NO: 280113

SEQ ID NO: 507308 - RNA, 64 nt, Homo Sapiens; identical to SEQ ID NO: 280114

SEQ ID NO: 507309 - RNA, 64 nt, Homo Sapiens; identical to SEQ ID NO: 280115

SEQ ID NO: 507310 - RNA, 64 nt, Homo Sapiens; identical to SEQ ID NO: 280116

SEQ ID NO: 507311 - RNA, 64 nt, Homo Sapiens; identical to SEQ ID NO: 280117

SEQ ID NO: 507312 - RNA, 64 nt, Homo Sapiens; identical to SEQ ID NO: 280118

SEQ ID NO: 507313 - RNA, 64 nt, Homo Sapiens; identical to SEQ ID NO: 280119

SEQ ID NO: 507314 - RNA, 64 nt, Homo Sapiens; identical to SEQ ID NO: 280120

SEQ ID NO: 507315 - RNA, 64 nt, Homo Sapiens; identical to SEQ ID NO: 280121

SEQ ID NO: 507316 - RNA, 64 nt, Homo Sapiens; identical to SEQ ID NO: 280122

SEQ ID NO: 507317 - RNA, 64 nt, Homo Sapiens; identical to SEQ ID NO: 280123

SEQ ID NO: 507318 - RNA, 64 nt, Homo Sapiens; identical to SEQ ID NO: 280124

SEQ ID NO: 507319 - RNA, 64 nt, Homo Sapiens; identical to SEQ ID NO: 280125

SEQ ID NO: 507320 - RNA, 64 nt, Homo Sapiens; identical to SEQ ID NO: 280126

SEQ ID NO: 507321 - RNA, 64 nt, Homo Sapiens; identical to SEQ ID NO: 280127

SEQ ID NO: 507322 - RNA, 64 nt, Homo Sapiens; identical to SEQ ID NO: 280128

SEQ ID NO: 507323 - RNA, 64 nt, Homo Sapiens; identical to SEQ ID NO: 280129

SEQ ID NO: 507324 - RNA, 64 nt, Homo Sapiens; identical to SEQ ID NO: 280130

SEQ ID NO: 507325 - RNA, 64 nt, Homo Sapiens; identical to SEQ ID NO: 280131

SEQ ID NO: 507326 - RNA, 64 nt, Homo Sapiens; identical to SEQ ID NO: 280132

SEQ ID NO: 507327 - RNA, 64 nt, Homo Sapiens; identical to SEQ ID NO: 280133

SEQ ID NO: 507328 - RNA, 64 nt, Homo Sapiens; identical to SEQ ID NO: 280134

SEQ ID NO: 507329 - RNA, 64 nt, Homo Sapiens; identical to SEQ ID NO: 280135

SEQ ID NO: 507330 - RNA, 64 nt, Homo Sapiens; identical to SEQ ID NO: 280136

SEQ ID NO: 507331 - RNA, 64 nt, Homo Sapiens; identical to SEQ ID NO: 280137

SEQ ID NO: 507332 - RNA, 64 nt, Homo Sapiens; identical to SEQ ID NO: 280138

SEQ ID NO: 507333 - RNA, 64 nt, Homo Sapiens; identical to SEQ ID NO: 280139

SEQ ID NO: 507334 - RNA, 64 nt, Homo Sapiens; identical to SEQ ID NO: 280140

SEQ ID NO: 507335 - RNA, 64 nt, Homo Sapiens; identical to SEQ ID NO: 280141

SEQ ID NO: 507336 - RNA, 64 nt, Homo Sapiens; identical to SEQ ID NO: 280142

SEQ ID NO: 507337 - RNA, 64 nt, Homo Sapiens; identical to SEQ ID NO: 280143

SEQ ID NO: 507338 - RNA, 64 nt, Homo Sapiens; identical to SEQ ID NO: 280144

SEQ ID NO: 507339 - RNA, 64 nt, Homo Sapiens; identical to SEQ ID NO: 280145

SEQ ID NO: 507340 - RNA, 64 nt, Homo Sapiens; identical to SEQ ID NO: 280146

SEQ ID NO: 507341 - RNA, 64 nt, Homo Sapiens; identical to SEQ ID NO: 280147

SEQ ID NO: 507342 - RNA, 64 nt, Homo Sapiens; identical to SEQ ID NO: 280148

SEQ ID NO: 507343 - RNA, 64 nt, Homo Sapiens; identical to SEQ ID NO: 280149

SEQ ID NO: 507344 - RNA, 64 nt, Homo Sapiens; identical to SEQ ID NO: 280150

SEQ ID NO: 507345 - RNA, 64 nt, Homo Sapiens; identical to SEQ ID NO: 280151

SEQ ID NO: 507346 - RNA, 64 nt, Homo Sapiens; identical to SEQ ID NO: 280152

SEQ ID NO: 507347 - RNA, 64 nt, Homo Sapiens; identical to SEQ ID NO: 280153

SEQ ID NO: 507348 - RNA, 64 nt, Homo Sapiens; identical to SEQ ID NO: 280154

SEQ ID NO: 507349 - RNA, 64 nt, Homo Sapiens; identical to SEQ ID NO: 280155

SEQ ID NO: 507350 - RNA, 64 nt, Homo Sapiens; identical to SEQ ID NO: 280156

SEQ ID NO: 507351 - RNA, 64 nt, Homo Sapiens; identical to SEQ ID NO: 280157

SEQ ID NO: 507352 - RNA, 64 nt, Homo Sapiens; identical to SEQ ID NO: 280158

SEQ ID NO: 507353 - RNA, 64 nt, Homo Sapiens; identical to SEQ ID NO: 280159

SEQ ID NO: 507354 - RNA, 64 nt, Homo Sapiens; identical to SEQ ID NO: 280160

SEQ ID NO: 507355 - RNA, 64 nt, Homo Sapiens; identical to SEQ ID NO: 280161

SEQ ID NO: 507356 - RNA, 64 nt, Homo Sapiens; identical to SEQ ID NO: 280162

SEQ ID NO: 507357 - RNA, 64 nt, Homo Sapiens; identical to SEQ ID NO: 280163

SEQ ID NO: 507358 - RNA, 64 nt, Homo Sapiens; identical to SEQ ID NO: 280164

SEQ ID NO: 507359 - RNA, 64 nt, Homo Sapiens; identical to SEQ ID NO: 280165

SEQ ID NO: 507360 - RNA, 54 nt, Homo Sapiens; identical to SEQ ID NO: 280166

SEQ ID NO: 507361 - RNA, 64 nt, Homo Sapiens; identical to SEQ ID NO: 280167

SEQ ID NO: 507362 - RNA, 64 nt, Homo Sapiens; identical to SEQ ID NO: 280168

SEQ ID NO: 507363 - RNA, 64 nt, Homo Sapiens; identical to SEQ ID NO: 280169

SEQ ID NO: 507364 - RNA, 64 nt, Homo Sapiens; identical to SEQ ID NO: 280170

SEQ ID NO: 507365 - RNA, 64 nt, Homo Sapiens; identical to SEQ ID NO: 280171

SEQ ID NO: 507366 - RNA, 64 nt, Homo Sapiens; identical to SEQ ID NO: 280172

SEQ ID NO: 507367 - RNA, 64 nt, Homo Sapiens; identical to SEQ ID NO: 280173

SEQ ID NO: 507368 - RNA, 64 nt, Homo Sapiens; identical to SEQ ID NO: 280174

SEQ ID NO: 507369 - RNA, 64 nt, Homo Sapiens; identical to SEQ ID NO: 280175

SEQ ID NO: 507370 - RNA, 64 nt, Homo Sapiens; identical to SEQ ID NO: 280176

SEQ ID NO: 507371 - RNA, 64 nt, Homo Sapiens; identical to SEQ ID NO: 280177

SEQ ID NO: 507372 - RNA, 64 nt, Homo Sapiens; identical to SEQ ID NO: 280178

SEQ ID NO: 507373 - RNA, 64 nt, Homo Sapiens; identical to SEQ ID NO: 280179

SEQ ID NO: 507374 - RNA, 64 nt, Homo Sapiens; identical to SEQ ID NO: 280180

SEQ ID NO: 507375 - RNA, 64 nt, Homo Sapiens; identical to SEQ ID NO: 280181

SEQ ID NO: 507376 - RNA, 64 nt, Homo Sapiens; identical to SEQ ID NO: 280182

SEQ ID NO: 507377 - RNA, 64 nt, Homo Sapiens; identical to SEQ ID NO: 280183

SEQ ID NO: 507378 - RNA, 64 nt, Homo Sapiens; identical to SEQ ID NO: 280184

SEQ ID NO: 507379 - RNA, 64 nt, Homo Sapiens; identical to SEQ ID NO: 280185

SEQ ID NO: 507380 - RNA, 64 nt, Homo Sapiens; identical to SEQ ID NO: 280186

SEQ ID NO: 507381 - RNA, 64 nt, Homo Sapiens; identical to SEQ ID NO: 280187

SEQ ID NO: 507382 - RNA, 64 nt, Homo Sapiens; identical to SEQ ID NO: 280188

SEQ ID NO: 507383 - RNA, 64 nt, Homo Sapiens; identical to SEQ ID NO: 280189

SEQ ID NO: 507384 - RNA, 64 nt, Homo Sapiens; identical to SEQ ID NO: 280190

SEQ ID NO: 507385 - RNA, 64 nt, Homo Sapiens; identical to SEQ ID NO: 280191

SEQ ID NO: 507386 - RNA, 64 nt, Homo Sapiens; identical to SEQ ID NO: 280192

SEQ ID NO: 507387 - RNA, 64 nt, Homo Sapiens; identical to SEQ ID NO: 280193

SEQ ID NO: 507388 - RNA, 64 nt, Homo Sapiens; identical to SEQ ID NO: 280194

SEQ ID NO: 507389 - RNA, 64 nt, Homo Sapiens; identical to SEQ ID NO: 280195

SEQ ID NO: 507390 - RNA, 64 nt, Homo Sapiens; identical to SEQ ID NO: 280196

SEQ ID NO: 507391 - RNA, 64 nt, Homo Sapiens; identical to SEQ ID NO: 280197

SEQ ID NO: 507392 - RNA, 64 nt, Homo Sapiens; identical to SEQ ID NO: 280198

SEQ ID NO: 507393 - RNA, 64 nt, Homo Sapiens; identical to SEQ ID NO: 280199

SEQ ID NO: 507394 - RNA, 64 nt, Homo Sapiens; identical to SEQ ID NO: 280200

SEQ ID NO: 507395 - RNA, 64 nt, Homo Sapiens; identical to SEQ ID NO: 280201

SEQ ID NO: 507396 - RNA, 64 nt, Homo Sapiens; identical to SEQ ID NO: 280202

SEQ ID NO: 507397 - RNA, 64 nt, Homo Sapiens; identical to SEQ ID NO: 280203

SEQ ID NO: 507398 - RNA, 64 nt, Homo Sapiens; identical to SEQ ID NO: 280204

SEQ ID NO: 507399 - RNA, 64 nt, Homo Sapiens; identical to SEQ ID NO: 280205

SEQ ID NO: 507400 - RNA, 64 nt, Homo Sapiens; identical to SEQ ID NO: 280206

SEQ ID NO: 507401 - RNA, 64 nt, Homo Sapiens; identical to SEQ ID NO: 280207

SEQ ID NO: 507402 - RNA, 64 nt, Homo Sapiens; identical to SEQ ID NO: 280208

SEQ ID NO: 507403 - RNA, 64 nt, Homo Sapiens; identical to SEQ ID NO: 280209

SEQ ID NO: 507404 - RNA, 64 nt, Homo Sapiens; identical to SEQ ID NO: 280210

SEQ ID NO: 507405 - RNA, 64 nt, Homo Sapiens; identical to SEQ ID NO: 280211

SEQ ID NO: 507406 - RNA, 64 nt, Homo Sapiens; identical to SEQ ID NO: 280212

SEQ ID NO: 507407 - RNA, 64 nt, Homo Sapiens; identical to SEQ ID NO: 280213

SEQ ID NO: 507408 - RNA, 64 nt, Homo Sapiens; identical to SEQ ID NO: 280214

SEQ ID NO: 507409 - RNA, 64 nt, Homo Sapiens; identical to SEQ ID NO: 280215

SEQ ID NO: 507410 - RNA, 64 nt, Homo Sapiens; identical to SEQ ID NO: 280216

SEQ ID NO: 507411 - RNA, 64 nt, Homo Sapiens; identical to SEQ ID NO: 280217

SEQ ID NO: 507412 - RNA, 64 nt, Homo Sapiens; identical to SEQ ID NO: 280218

SEQ ID NO: 507413 - RNA, 64 nt, Homo Sapiens; identical to SEQ ID NO: 280219

SEQ ID NO: 507414 - RNA, 64 nt, Homo Sapiens; identical to SEQ ID NO: 280220

SEQ ID NO: 507415 - RNA, 64 nt, Homo Sapiens; identical to SEQ ID NO: 280221

SEQ ID NO: 507416 - RNA, 64 nt, Homo Sapiens; identical to SEQ ID NO: 280222

SEQ ID NO: 507417 - RNA, 64 nt, Homo Sapiens; identical to SEQ ID NO: 280223

SEQ ID NO: 507418 - RNA, 64 nt, Homo Sapiens; identical to SEQ ID NO: 280224

SEQ ID NO: 507419 - RNA, 64 nt, Homo Sapiens; identical to SEQ ID NO: 280225

SEQ ID NO: 507420 - RNA, 64 nt, Homo Sapiens; identical to SEQ ID NO: 280226

SEQ ID NO: 507421 - RNA, 64 nt, Homo Sapiens; identical to SEQ ID NO: 280227

SEQ ID NO: 507422 - RNA, 64 nt, Homo Sapiens; identical to SEQ ID NO: 280228

SEQ ID NO: 507423 - RNA, 64 nt, Homo Sapiens; identical to SEQ ID NO: 280229

SEQ ID NO: 507424 - RNA, 64 nt, Homo Sapiens; identical to SEQ ID NO: 280230

SEQ ID NO: 507425 - RNA, 64 nt, Homo Sapiens; identical to SEQ ID NO: 280231

SEQ ID NO: 507426 - RNA, 64 nt, Homo Sapiens; identical to SEQ ID NO: 280232

SEQ ID NO: 507427 - RNA, 64 nt, Homo Sapiens; identical to SEQ ID NO: 280233

SEQ ID NO: 507428 - RNA, 64 nt, Homo Sapiens; identical to SEQ ID NO: 280234

SEQ ID NO: 507429 - RNA, 64 nt, Homo Sapiens; identical to SEQ ID NO: 280235

SEQ ID NO: 507430 - RNA, 64 nt, Homo Sapiens; identical to SEQ ID NO: 280236

SEQ ID NO: 507431 - RNA, 64 nt, Homo Sapiens; identical to SEQ ID NO: 280237

SEQ ID NO: 507432 - RNA, 64 nt, Homo Sapiens; identical to SEQ ID NO: 280238

SEQ ID NO: 507433 - RNA, 64 nt, Homo Sapiens; identical to SEQ ID NO: 280239

SEQ ID NO: 507434 - RNA, 64 nt, Homo Sapiens; identical to SEQ ID NO: 280240

SEQ ID NO: 507435 - RNA, 64 nt, Homo Sapiens; identical to SEQ ID NO: 280241

SEQ ID NO: 507436 - RNA, 64 nt, Homo Sapiens; identical to SEQ ID NO: 280242

SEQ ID NO: 507437 - RNA, 64 nt, Homo Sapiens; identical to SEQ ID NO: 280243

SEQ ID NO: 507438 - RNA, 64 nt, Homo Sapiens; identical to SEQ ID NO: 280244

SEQ ID NO: 507439 - RNA, 64 nt, Homo Sapiens; identical to SEQ ID NO: 280245

SEQ ID NO: 507440 - RNA, 64 nt, Homo Sapiens; identical to SEQ ID NO: 280246

SEQ ID NO: 507441 - RNA, 64 nt, Homo Sapiens; identical to SEQ ID NO: 280247

SEQ ID NO: 507442 - RNA, 64 nt, Homo Sapiens; identical to SEQ ID NO: 280248

SEQ ID NO: 507443 - RNA, 64 nt, Homo Sapiens; identical to SEQ ID NO: 280249

SEQ ID NO: 507444 - RNA, 64 nt, Homo Sapiens; identical to SEQ ID NO: 280250

SEQ ID NO: 507445 - RNA, 64 nt, Homo Sapiens; identical to SEQ ID NO: 280251

SEQ ID NO: 507446 - RNA, 64 nt, Homo Sapiens; identical to SEQ ID NO: 280252

SEQ ID NO: 507447 - RNA, 64 nt, Homo Sapiens; identical to SEQ ID NO: 280253

SEQ ID NO: 507448 - RNA, 64 nt, Homo Sapiens; identical to SEQ ID NO: 280254

SEQ ID NO: 507449 - RNA, 64 nt, Homo Sapiens; identical to SEQ ID NO: 280255

SEQ ID NO: 507450 - RNA, 64 nt, Homo Sapiens; identical to SEQ ID NO: 280256

SEQ ID NO: 507451 - RNA, 64 nt, Homo Sapiens; identical to SEQ ID NO: 280257

SEQ ID NO: 507452 - RNA, 64 nt, Homo Sapiens; identical to SEQ ID NO: 280258

SEQ ID NO: 507453 - RNA, 64 nt, Homo Sapiens; identical to SEQ ID NO: 280259

SEQ ID NO: 507454 - RNA, 64 nt, Homo Sapiens; identical to SEQ ID NO: 280260

SEQ ID NO: 507455 - RNA, 64 nt, Homo Sapiens; identical to SEQ ID NO: 280261

SEQ ID NO: 507456 - RNA, 64 nt, Homo Sapiens; identical to SEQ ID NO: 280262

SEQ ID NO: 507457 - RNA, 64 nt, Homo Sapiens; identical to SEQ ID NO: 280263

SEQ ID NO: 507458 - RNA, 64 nt, Homo Sapiens; identical to SEQ ID NO: 280264

SEQ ID NO: 507459 - RNA, 64 nt, Homo Sapiens; identical to SEQ ID NO: 280265

SEQ ID NO: 507460 - RNA, 64 nt, Homo Sapiens; identical to SEQ ID NO: 280266

SEQ ID NO: 507461 - RNA, 64 nt, Homo Sapiens; identical to SEQ ID NO: 280267

SEQ ID NO: 507462 - RNA, 64 nt, Homo Sapiens; identical to SEQ ID NO: 280268

SEQ ID NO: 507463 - RNA, 64 nt, Homo Sapiens; identical to SEQ ID NO: 280269

SEQ ID NO: 507464 - RNA, 64 nt, Homo Sapiens; identical to SEQ ID NO: 280270

SEQ ID NO: 507465 - RNA, 64 nt, Homo Sapiens; identical to SEQ ID NO: 280271

SEQ ID NO: 507466 - RNA, 64 nt, Homo Sapiens; identical to SEQ ID NO: 280272

SEQ ID NO: 507467 - RNA, 64 nt, Homo Sapiens; identical to SEQ ID NO: 280273

SEQ ID NO: 507468 - RNA, 64 nt, Homo Sapiens; identical to SEQ ID NO: 280274

SEQ ID NO: 507469 - RNA, 64 nt, Homo Sapiens; identical to SEQ ID NO: 280275

SEQ ID NO: 507470 - RNA, 64 nt, Homo Sapiens; identical to SEQ ID NO: 280276

SEQ ID NO: 507471 - RNA, 64 nt, Homo Sapiens; identical to SEQ ID NO: 280277

SEQ ID NO: 507472 - RNA, 64 nt, Homo Sapiens; identical to SEQ ID NO: 280278

SEQ ID NO: 507473 - RNA, 64 nt, Homo Sapiens; identical to SEQ ID NO: 280279

SEQ ID NO: 507474 - RNA, 64 nt, Homo Sapiens; identical to SEQ ID NO: 280280

SEQ ID NO: 507475 - RNA, 57 nt, Homo Sapiens; identical to SEQ ID NO: 280281

SEQ ID NO: 507476 - RNA, 64 nt, Homo Sapiens; identical to SEQ ID NO: 280282

SEQ ID NO: 507477 - RNA, 64 nt, Homo Sapiens; identical to SEQ ID NO: 280283

SEQ ID NO: 507478 - RNA, 64 nt, Homo Sapiens; identical to SEQ ID NO: 280284

SEQ ID NO: 507479 - RNA, 64 nt, Homo Sapiens; identical to SEQ ID NO: 280285

SEQ ID NO: 507480 - RNA, 64 nt, Homo Sapiens; identical to SEQ ID NO: 280286

SEQ ID NO: 507481 - RNA, 64 nt, Homo Sapiens; identical to SEQ ID NO: 280287

SEQ ID NO: 507482 - RNA, 64 nt, Homo Sapiens; identical to SEQ ID NO: 280288

SEQ ID NO: 507483 - RNA, 64 nt, Homo Sapiens; identical to SEQ ID NO: 280289

SEQ ID NO: 507484 - RNA, 64 nt, Homo Sapiens; identical to SEQ ID NO: 280290

SEQ ID NO: 507485 - RNA, 64 nt, Homo Sapiens; identical to SEQ ID NO: 280291

SEQ ID NO: 507486 - RNA, 64 nt, Homo Sapiens; identical to SEQ ID NO: 280292

SEQ ID NO: 507487 - RNA, 64 nt, Homo Sapiens; identical to SEQ ID NO: 280293

SEQ ID NO: 507488 - RNA, 64 nt, Homo Sapiens; identical to SEQ ID NO: 280294

SEQ ID NO: 507489 - RNA, 64 nt, Homo Sapiens; identical to SEQ ID NO: 280295

SEQ ID NO: 507490 - RNA, 64 nt, Homo Sapiens; identical to SEQ ID NO: 280296

SEQ ID NO: 507491 - RNA, 64 nt, Homo Sapiens; identical to SEQ ID NO: 280297

SEQ ID NO: 507492 - RNA, 64 nt, Homo Sapiens; identical to SEQ ID NO: 280298

SEQ ID NO: 507493 - RNA, 64 nt, Homo Sapiens; identical to SEQ ID NO: 280299

SEQ ID NO: 507494 - RNA, 64 nt, Homo Sapiens; identical to SEQ ID NO: 280300

SEQ ID NO: 507495 - RNA, 64 nt, Homo Sapiens; identical to SEQ ID NO: 280301

SEQ ID NO: 507496 - RNA, 64 nt, Homo Sapiens; identical to SEQ ID NO: 280302

SEQ ID NO: 507497 - RNA, 64 nt, Homo Sapiens; identical to SEQ ID NO: 280303

SEQ ID NO: 507498 - RNA, 64 nt, Homo Sapiens; identical to SEQ ID NO: 280304

SEQ ID NO: 507499 - RNA, 64 nt, Homo Sapiens; identical to SEQ ID NO: 280305

SEQ ID NO: 507500 - RNA, 64 nt, Homo Sapiens; identical to SEQ ID NO: 280306

SEQ ID NO: 507501 - RNA, 64 nt, Homo Sapiens; identical to SEQ ID NO: 280307

SEQ ID NO: 507502 - RNA, 64 nt, Homo Sapiens; identical to SEQ ID NO: 280308

SEQ ID NO: 507503 - RNA, 64 nt, Homo Sapiens; identical to SEQ ID NO: 280309

SEQ ID NO: 507504 - RNA, 64 nt, Homo Sapiens; identical to SEQ ID NO: 280310

SEQ ID NO: 507505 - RNA, 64 nt, Homo Sapiens; identical to SEQ ID NO: 280311

SEQ ID NO: 507506 - RNA, 64 nt, Homo Sapiens; identical to SEQ ID NO: 280312

SEQ ID NO: 507507 - RNA, 64 nt, Homo Sapiens; identical to SEQ ID NO: 280313

SEQ ID NO: 507508 - RNA, 64 nt, Homo Sapiens; identical to SEQ ID NO: 280314

SEQ ID NO: 507509 - RNA, 64 nt, Homo Sapiens; identical to SEQ ID NO: 280315

SEQ ID NO: 507510 - RNA, 64 nt, Homo Sapiens; identical to SEQ ID NO: 280316

SEQ ID NO: 507511 - RNA, 64 nt, Homo Sapiens; identical to SEQ ID NO: 280317

SEQ ID NO: 507512 - RNA, 64 nt, Homo Sapiens; identical to SEQ ID NO: 280318

SEQ ID NO: 507513 - RNA, 64 nt, Homo Sapiens; identical to SEQ ID NO: 280319

SEQ ID NO: 507514 - RNA, 64 nt, Homo Sapiens; identical to SEQ ID NO: 280320

SEQ ID NO: 507515 - RNA, 64 nt, Homo Sapiens; identical to SEQ ID NO: 280321

SEQ ID NO: 507516 - RNA, 64 nt, Homo Sapiens; identical to SEQ ID NO: 280322

SEQ ID NO: 507517 - RNA, 64 nt, Homo Sapiens; identical to SEQ ID NO: 280323

SEQ ID NO: 507518 - RNA, 64 nt, Homo Sapiens; identical to SEQ ID NO: 280324

SEQ ID NO: 507519 - RNA, 64 nt, Homo Sapiens; identical to SEQ ID NO: 280325

SEQ ID NO: 507520 - RNA, 64 nt, Homo Sapiens; identical to SEQ ID NO: 280326

SEQ ID NO: 507521 - RNA, 64 nt, Homo Sapiens; identical to SEQ ID NO: 280327

SEQ ID NO: 507522 - RNA, 64 nt, Homo Sapiens; identical to SEQ ID NO: 280328

SEQ ID NO: 507523 - RNA, 64 nt, Homo Sapiens; identical to SEQ ID NO: 280329

SEQ ID NO: 507524 - RNA, 64 nt, Homo Sapiens; identical to SEQ ID NO: 280330

SEQ ID NO: 507525 - RNA, 64 nt, Homo Sapiens; identical to SEQ ID NO: 280331

SEQ ID NO: 507526 - RNA, 64 nt, Homo Sapiens; identical to SEQ ID NO: 280332

SEQ ID NO: 507527 - RNA, 64 nt, Homo Sapiens; identical to SEQ ID NO: 280333

SEQ ID NO: 507528 - RNA, 64 nt, Homo Sapiens; identical to SEQ ID NO: 280334

SEQ ID NO: 507529 - RNA, 64 nt, Homo Sapiens; identical to SEQ ID NO: 280335

SEQ ID NO: 507530 - RNA, 64 nt, Homo Sapiens; identical to SEQ ID NO: 280336

SEQ ID NO: 507531 - RNA, 64 nt, Homo Sapiens; identical to SEQ ID NO: 280337

SEQ ID NO: 507532 - RNA, 64 nt, Homo Sapiens; identical to SEQ ID NO: 280338

SEQ ID NO: 507533 - RNA, 64 nt, Homo Sapiens; identical to SEQ ID NO: 280339

SEQ ID NO: 507534 - RNA, 64 nt, Homo Sapiens; identical to SEQ ID NO: 280340

SEQ ID NO: 507535 - RNA, 64 nt, Homo Sapiens; identical to SEQ ID NO: 280341

SEQ ID NO: 507536 - RNA, 64 nt, Homo Sapiens; identical to SEQ ID NO: 280342

SEQ ID NO: 507537 - RNA, 64 nt, Homo Sapiens; identical to SEQ ID NO: 280343

SEQ ID NO: 507538 - RNA, 64 nt, Homo Sapiens; identical to SEQ ID NO: 280344

SEQ ID NO: 507539 - RNA, 64 nt, Homo Sapiens; identical to SEQ ID NO: 280345

SEQ ID NO: 507540 - RNA, 64 nt, Homo Sapiens; identical to SEQ ID NO: 280346

SEQ ID NO: 507541 - RNA, 64 nt, Homo Sapiens; identical to SEQ ID NO: 280347

SEQ ID NO: 507542 - RNA, 64 nt, Homo Sapiens; identical to SEQ ID NO: 280348

SEQ ID NO: 507543 - RNA, 64 nt, Homo Sapiens; identical to SEQ ID NO: 280349

SEQ ID NO: 507544 - RNA, 64 nt, Homo Sapiens; identical to SEQ ID NO: 280350

SEQ ID NO: 507545 - RNA, 64 nt, Homo Sapiens; identical to SEQ ID NO: 280351

SEQ ID NO: 507546 - RNA, 64 nt, Homo Sapiens; identical to SEQ ID NO: 280352

SEQ ID NO: 507547 - RNA, 64 nt, Homo Sapiens; identical to SEQ ID NO: 280353

SEQ ID NO: 507548 - RNA, 64 nt, Homo Sapiens; identical to SEQ ID NO: 280354

SEQ ID NO: 507549 - RNA, 64 nt, Homo Sapiens; identical to SEQ ID NO: 280355

SEQ ID NO: 507550 - RNA, 64 nt, Homo Sapiens; identical to SEQ ID NO: 280356

SEQ ID NO: 507551 - RNA, 64 nt, Homo Sapiens; identical to SEQ ID NO: 280357

SEQ ID NO: 507552 - RNA, 64 nt, Homo Sapiens; identical to SEQ ID NO: 280358

SEQ ID NO: 507553 - RNA, 64 nt, Homo Sapiens; identical to SEQ ID NO: 280359

SEQ ID NO: 507554 - RNA, 64 nt, Homo Sapiens; identical to SEQ ID NO: 280360

SEQ ID NO: 507555 - RNA, 64 nt, Homo Sapiens; identical to SEQ ID NO: 280361

SEQ ID NO: 507556 - RNA, 64 nt, Homo Sapiens; identical to SEQ ID NO: 280362

SEQ ID NO: 507557 - RNA, 64 nt, Homo Sapiens; identical to SEQ ID NO: 280363

SEQ ID NO: 507558 - RNA, 64 nt, Homo Sapiens; identical to SEQ ID NO: 280364

SEQ ID NO: 507559 - RNA, 64 nt, Homo Sapiens; identical to SEQ ID NO: 280365

SEQ ID NO: 507560 - RNA, 64 nt, Homo Sapiens; identical to SEQ ID NO: 280366

SEQ ID NO: 507561 - RNA, 64 nt, Homo Sapiens; identical to SEQ ID NO: 280367

SEQ ID NO: 507562 - RNA, 64 nt, Homo Sapiens; identical to SEQ ID NO: 280368

SEQ ID NO: 507563 - RNA, 64 nt, Homo Sapiens; identical to SEQ ID NO: 280369

SEQ ID NO: 507564 - RNA, 64 nt, Homo Sapiens; identical to SEQ ID NO: 280370

SEQ ID NO: 507565 - RNA, 64 nt, Homo Sapiens; identical to SEQ ID NO: 280371

SEQ ID NO: 507566 - RNA, 64 nt, Homo Sapiens; identical to SEQ ID NO: 280372

SEQ ID NO: 507567 - RNA, 64 nt, Homo Sapiens; identical to SEQ ID NO: 280373

SEQ ID NO: 507568 - RNA, 64 nt, Homo Sapiens; identical to SEQ ID NO: 280374

SEQ ID NO: 507569 - RNA, 64 nt, Homo Sapiens; identical to SEQ ID NO: 280375

SEQ ID NO: 507570 - RNA, 64 nt, Homo Sapiens; identical to SEQ ID NO: 280376

SEQ ID NO: 507571 - RNA, 64 nt, Homo Sapiens; identical to SEQ ID NO: 280377

SEQ ID NO: 507572 - RNA, 64 nt, Homo Sapiens; identical to SEQ ID NO: 280378

SEQ ID NO: 507573 - RNA, 64 nt, Homo Sapiens; identical to SEQ ID NO: 280379

SEQ ID NO: 507574 - RNA, 64 nt, Homo Sapiens; identical to SEQ ID NO: 280380

SEQ ID NO: 507575 - RNA, 64 nt, Homo Sapiens; identical to SEQ ID NO: 280381

SEQ ID NO: 507576 - RNA, 64 nt, Homo Sapiens; identical to SEQ ID NO: 280382

SEQ ID NO: 507577 - RNA, 64 nt, Homo Sapiens; identical to SEQ ID NO: 280383

SEQ ID NO: 507578 - RNA, 64 nt, Homo Sapiens; identical to SEQ ID NO: 280384

SEQ ID NO: 507579 - RNA, 64 nt, Homo Sapiens; identical to SEQ ID NO: 280385

SEQ ID NO: 507580 - RNA, 64 nt, Homo Sapiens; identical to SEQ ID NO: 280386

SEQ ID NO: 507581 - RNA, 64 nt, Homo Sapiens; identical to SEQ ID NO: 280387

SEQ ID NO: 507582 - RNA, 64 nt, Homo Sapiens; identical to SEQ ID NO: 280388

SEQ ID NO: 507583 - RNA, 64 nt, Homo Sapiens; identical to SEQ ID NO: 280389

SEQ ID NO: 507584 - RNA, 64 nt, Homo Sapiens; identical to SEQ ID NO: 280390

SEQ ID NO: 507585 - RNA, 64 nt, Homo Sapiens; identical to SEQ ID NO: 280391

SEQ ID NO: 507586 - RNA, 64 nt, Homo Sapiens; identical to SEQ ID NO: 280392

SEQ ID NO: 507587 - RNA, 64 nt, Homo Sapiens; identical to SEQ ID NO: 280393

SEQ ID NO: 507588 - RNA, 64 nt, Homo Sapiens; identical to SEQ ID NO: 280394

SEQ ID NO: 507589 - RNA, 64 nt, Homo Sapiens; identical to SEQ ID NO: 280395

SEQ ID NO: 507590 - RNA, 64 nt, Homo Sapiens; identical to SEQ ID NO: 280396

SEQ ID NO: 507591 - RNA, 64 nt, Homo Sapiens; identical to SEQ ID NO: 280397

SEQ ID NO: 507592 - RNA, 64 nt, Homo Sapiens; identical to SEQ ID NO: 280398

SEQ ID NO: 507593 - RNA, 64 nt, Homo Sapiens; identical to SEQ ID NO: 280399

SEQ ID NO: 507594 - RNA, 64 nt, Homo Sapiens; identical to SEQ ID NO: 280400

SEQ ID NO: 507595 - RNA, 64 nt, Homo Sapiens; identical to SEQ ID NO: 280401

SEQ ID NO: 507596 - RNA, 64 nt, Homo Sapiens; identical to SEQ ID NO: 280402

SEQ ID NO: 507597 - RNA, 64 nt, Homo Sapiens; identical to SEQ ID NO: 280403

SEQ ID NO: 507598 - RNA, 64 nt, Homo Sapiens; identical to SEQ ID NO: 280404

SEQ ID NO: 507599 - RNA, 64 nt, Homo Sapiens; identical to SEQ ID NO: 280405

SEQ ID NO: 507600 - RNA, 64 nt, Homo Sapiens; identical to SEQ ID NO: 280406

SEQ ID NO: 507601 - RNA, 64 nt, Homo Sapiens; identical to SEQ ID NO: 280407

SEQ ID NO: 507602 - RNA, 64 nt, Homo Sapiens; identical to SEQ ID NO: 280408

SEQ ID NO: 507603 - RNA, 64 nt, Homo Sapiens; identical to SEQ ID NO: 280409

SEQ ID NO: 507604 - RNA, 64 nt, Homo Sapiens; identical to SEQ ID NO: 280410

SEQ ID NO: 507605 - RNA, 64 nt, Homo Sapiens; identical to SEQ ID NO: 280411

SEQ ID NO: 507606 - RNA, 64 nt, Homo Sapiens; identical to SEQ ID NO: 280412

SEQ ID NO: 507607 - RNA, 64 nt, Homo Sapiens; identical to SEQ ID NO: 280413

SEQ ID NO: 507608 - RNA, 64 nt, Homo Sapiens; identical to SEQ ID NO: 280414

SEQ ID NO: 507609 - RNA, 64 nt, Homo Sapiens; identical to SEQ ID NO: 280415

SEQ ID NO: 507610 - RNA, 64 nt, Homo Sapiens; identical to SEQ ID NO: 280416

SEQ ID NO: 507611 - RNA, 64 nt, Homo Sapiens; identical to SEQ ID NO: 280417

SEQ ID NO: 507612 - RNA, 64 nt, Homo Sapiens; identical to SEQ ID NO: 280418

SEQ ID NO: 507613 - RNA, 64 nt, Homo Sapiens; identical to SEQ ID NO: 280419

SEQ ID NO: 507614 - RNA, 64 nt, Homo Sapiens; identical to SEQ ID NO: 280420

SEQ ID NO: 507615 - RNA, 64 nt, Homo Sapiens; identical to SEQ ID NO: 280421

SEQ ID NO: 507616 - RNA, 64 nt, Homo Sapiens; identical to SEQ ID NO: 280422

SEQ ID NO: 507617 - RNA, 64 nt, Homo Sapiens; identical to SEQ ID NO: 280423

SEQ ID NO: 507618 - RNA, 64 nt, Homo Sapiens; identical to SEQ ID NO: 280424

SEQ ID NO: 507619 - RNA, 64 nt, Homo Sapiens; identical to SEQ ID NO: 280425

SEQ ID NO: 507620 - RNA, 64 nt, Homo Sapiens; identical to SEQ ID NO: 280426

SEQ ID NO: 507621 - RNA, 64 nt, Homo Sapiens; identical to SEQ ID NO: 280427

SEQ ID NO: 507622 - RNA, 64 nt, Homo Sapiens; identical to SEQ ID NO: 280428

SEQ ID NO: 507623 - RNA, 64 nt, Homo Sapiens; identical to SEQ ID NO: 280429

SEQ ID NO: 507624 - RNA, 64 nt, Homo Sapiens; identical to SEQ ID NO: 280430

SEQ ID NO: 507625 - RNA, 64 nt, Homo Sapiens; identical to SEQ ID NO: 280431

SEQ ID NO: 507626 - RNA, 64 nt, Homo Sapiens; identical to SEQ ID NO: 280432

SEQ ID NO: 507627 - RNA, 64 nt, Homo Sapiens; identical to SEQ ID NO: 280433

SEQ ID NO: 507628 - RNA, 64 nt, Homo Sapiens; identical to SEQ ID NO: 280434

SEQ ID NO: 507629 - RNA, 64 nt, Homo Sapiens; identical to SEQ ID NO: 280435

SEQ ID NO: 507630 - RNA, 64 nt, Homo Sapiens; identical to SEQ ID NO: 280436

SEQ ID NO: 507631 - RNA, 64 nt, Homo Sapiens; identical to SEQ ID NO: 280437

SEQ ID NO: 507632 - RNA, 64 nt, Homo Sapiens; identical to SEQ ID NO: 280438

SEQ ID NO: 507633 - RNA, 64 nt, Homo Sapiens; identical to SEQ ID NO: 280439

SEQ ID NO: 507634 - RNA, 64 nt, Homo Sapiens; identical to SEQ ID NO: 280440

SEQ ID NO: 507635 - RNA, 64 nt, Homo Sapiens; identical to SEQ ID NO: 280441

SEQ ID NO: 507636 - RNA, 64 nt, Homo Sapiens; identical to SEQ ID NO: 280442

SEQ ID NO: 507637 - RNA, 64 nt, Homo Sapiens; identical to SEQ ID NO: 280443

SEQ ID NO: 507638 - RNA, 64 nt, Homo Sapiens; identical to SEQ ID NO: 280444

SEQ ID NO: 507639 - RNA, 64 nt, Homo Sapiens; identical to SEQ ID NO: 280445

SEQ ID NO: 507640 - RNA, 64 nt, Homo Sapiens; identical to SEQ ID NO: 280446

SEQ ID NO: 507641 - RNA, 64 nt, Homo Sapiens; identical to SEQ ID NO: 280447

SEQ ID NO: 507642 - RNA, 64 nt, Homo Sapiens; identical to SEQ ID NO: 280448

SEQ ID NO: 507643 - RNA, 64 nt, Homo Sapiens; identical to SEQ ID NO: 280449

SEQ ID NO: 507644 - RNA, 64 nt, Homo Sapiens; identical to SEQ ID NO: 280450

SEQ ID NO: 507645 - RNA, 64 nt, Homo Sapiens; identical to SEQ ID NO: 280451

SEQ ID NO: 507646 - RNA, 64 nt, Homo Sapiens; identical to SEQ ID NO: 280452

SEQ ID NO: 507647 - RNA, 64 nt, Homo Sapiens; identical to SEQ ID NO: 280453

SEQ ID NO: 507648 - RNA, 64 nt, Homo Sapiens; identical to SEQ ID NO: 280454

SEQ ID NO: 507649 - RNA, 64 nt, Homo Sapiens; identical to SEQ ID NO: 280455

SEQ ID NO: 507650 - RNA, 64 nt, Homo Sapiens; identical to SEQ ID NO: 280456

SEQ ID NO: 507651 - RNA, 64 nt, Homo Sapiens; identical to SEQ ID NO: 280457

SEQ ID NO: 507652 - RNA, 64 nt, Homo Sapiens; identical to SEQ ID NO: 280458

SEQ ID NO: 507653 - RNA, 64 nt, Homo Sapiens; identical to SEQ ID NO: 280459

SEQ ID NO: 507654 - RNA, 64 nt, Homo Sapiens; identical to SEQ ID NO: 280460

SEQ ID NO: 507655 - RNA, 64 nt, Homo Sapiens; identical to SEQ ID NO: 280461

SEQ ID NO: 507656 - RNA, 64 nt, Homo Sapiens; identical to SEQ ID NO: 280462

SEQ ID NO: 507657 - RNA, 64 nt, Homo Sapiens; identical to SEQ ID NO: 280463

SEQ ID NO: 507658 - RNA, 64 nt, Homo Sapiens; identical to SEQ ID NO: 280464

SEQ ID NO: 507659 - RNA, 64 nt, Homo Sapiens; identical to SEQ ID NO: 280465

SEQ ID NO: 507660 - RNA, 64 nt, Homo Sapiens; identical to SEQ ID NO: 280466

SEQ ID NO: 507661 - RNA, 64 nt, Homo Sapiens; identical to SEQ ID NO: 280467

SEQ ID NO: 507662 - RNA, 64 nt, Homo Sapiens; identical to SEQ ID NO: 280468

SEQ ID NO: 507663 - RNA, 64 nt, Homo Sapiens; identical to SEQ ID NO: 280469

SEQ ID NO: 507664 - RNA, 64 nt, Homo Sapiens; identical to SEQ ID NO: 280470

SEQ ID NO: 507665 - RNA, 64 nt, Homo Sapiens; identical to SEQ ID NO: 280471

SEQ ID NO: 507666 - RNA, 64 nt, Homo Sapiens; identical to SEQ ID NO: 280472

SEQ ID NO: 507667 - RNA, 64 nt, Homo Sapiens; identical to SEQ ID NO: 280473

SEQ ID NO: 507668 - RNA, 64 nt, Homo Sapiens; identical to SEQ ID NO: 280474

SEQ ID NO: 507669 - RNA, 64 nt, Homo Sapiens; identical to SEQ ID NO: 280475

SEQ ID NO: 507670 - RNA, 64 nt, Homo Sapiens; identical to SEQ ID NO: 280476

SEQ ID NO: 507671 - RNA, 64 nt, Homo Sapiens; identical to SEQ ID NO: 280477

SEQ ID NO: 507672 - RNA, 64 nt, Homo Sapiens; identical to SEQ ID NO: 280478

SEQ ID NO: 507673 - RNA, 64 nt, Homo Sapiens; identical to SEQ ID NO: 280479

SEQ ID NO: 507674 - RNA, 64 nt, Homo Sapiens; identical to SEQ ID NO: 280480

SEQ ID NO: 507675 - RNA, 64 nt, Homo Sapiens; identical to SEQ ID NO: 280481

SEQ ID NO: 507676 - RNA, 64 nt, Homo Sapiens; identical to SEQ ID NO: 280482

SEQ ID NO: 507677 - RNA, 64 nt, Homo Sapiens; identical to SEQ ID NO: 280483

SEQ ID NO: 507678 - RNA, 54 nt, Homo Sapiens; identical to SEQ ID NO: 280484

SEQ ID NO: 507679 - RNA, 64 nt, Homo Sapiens; identical to SEQ ID NO: 280485

SEQ ID NO: 507680 - RNA, 64 nt, Homo Sapiens; identical to SEQ ID NO: 280486

SEQ ID NO: 507681 - RNA, 64 nt, Homo Sapiens; identical to SEQ ID NO: 280487

SEQ ID NO: 507682 - RNA, 64 nt, Homo Sapiens; identical to SEQ ID NO: 280488

SEQ ID NO: 507683 - RNA, 64 nt, Homo Sapiens; identical to SEQ ID NO: 280489

SEQ ID NO: 507684 - RNA, 64 nt, Homo Sapiens; identical to SEQ ID NO: 280490

SEQ ID NO: 507685 - RNA, 64 nt, Homo Sapiens; identical to SEQ ID NO: 280491

SEQ ID NO: 507686 - RNA, 64 nt, Homo Sapiens; identical to SEQ ID NO: 280492

SEQ ID NO: 507687 - RNA, 64 nt, Homo Sapiens; identical to SEQ ID NO: 280493

SEQ ID NO: 507688 - RNA, 64 nt, Homo Sapiens; identical to SEQ ID NO: 280494

SEQ ID NO: 507689 - RNA, 64 nt, Homo Sapiens; identical to SEQ ID NO: 280495

SEQ ID NO: 507690 - RNA, 64 nt, Homo Sapiens; identical to SEQ ID NO: 280496

SEQ ID NO: 507691 - RNA, 64 nt, Homo Sapiens; identical to SEQ ID NO: 280497

SEQ ID NO: 507692 - RNA, 64 nt, Homo Sapiens; identical to SEQ ID NO: 280498

SEQ ID NO: 507693 - RNA, 64 nt, Homo Sapiens; identical to SEQ ID NO: 280499

SEQ ID NO: 507694 - RNA, 64 nt, Homo Sapiens; identical to SEQ ID NO: 280500

SEQ ID NO: 507695 - RNA, 64 nt, Homo Sapiens; identical to SEQ ID NO: 280501

SEQ ID NO: 507696 - RNA, 64 nt, Homo Sapiens; identical to SEQ ID NO: 280502

SEQ ID NO: 507697 - RNA, 64 nt, Homo Sapiens; identical to SEQ ID NO: 280503

SEQ ID NO: 507698 - RNA, 64 nt, Homo Sapiens; identical to SEQ ID NO: 280504

SEQ ID NO: 507699 - RNA, 64 nt, Homo Sapiens; identical to SEQ ID NO: 280505

SEQ ID NO: 507700 - RNA, 64 nt, Homo Sapiens; identical to SEQ ID NO: 280506

SEQ ID NO: 507701 - RNA, 64 nt, Homo Sapiens; identical to SEQ ID NO: 280507

SEQ ID NO: 507702 - RNA, 64 nt, Homo Sapiens; identical to SEQ ID NO: 280508

SEQ ID NO: 507703 - RNA, 64 nt, Homo Sapiens; identical to SEQ ID NO: 280509

SEQ ID NO: 507704 - RNA, 64 nt, Homo Sapiens; identical to SEQ ID NO: 280510

SEQ ID NO: 507705 - RNA, 64 nt, Homo Sapiens; identical to SEQ ID NO: 280511

SEQ ID NO: 507706 - RNA, 64 nt, Homo Sapiens; identical to SEQ ID NO: 280512

SEQ ID NO: 507707 - RNA, 64 nt, Homo Sapiens; identical to SEQ ID NO: 280513

SEQ ID NO: 507708 - RNA, 64 nt, Homo Sapiens; identical to SEQ ID NO: 280514

SEQ ID NO: 507709 - RNA, 64 nt, Homo Sapiens; identical to SEQ ID NO: 280515

SEQ ID NO: 507710 - RNA, 64 nt, Homo Sapiens; identical to SEQ ID NO: 280516

SEQ ID NO: 507711 - RNA, 64 nt, Homo Sapiens; identical to SEQ ID NO: 280517

SEQ ID NO: 507712 - RNA, 64 nt, Homo Sapiens; identical to SEQ ID NO: 280518

SEQ ID NO: 507713 - RNA, 64 nt, Homo Sapiens; identical to SEQ ID NO: 280519

SEQ ID NO: 507714 - RNA, 64 nt, Homo Sapiens; identical to SEQ ID NO: 280520

SEQ ID NO: 507715 - RNA, 64 nt, Homo Sapiens; identical to SEQ ID NO: 280521

SEQ ID NO: 507716 - RNA, 64 nt, Homo Sapiens; identical to SEQ ID NO: 280522

SEQ ID NO: 507717 - RNA, 64 nt, Homo Sapiens; identical to SEQ ID NO: 280523

SEQ ID NO: 507718 - RNA, 64 nt, Homo Sapiens; identical to SEQ ID NO: 280524

SEQ ID NO: 507719 - RNA, 64 nt, Homo Sapiens; identical to SEQ ID NO: 280525

SEQ ID NO: 507720 - RNA, 64 nt, Homo Sapiens; identical to SEQ ID NO: 280526

SEQ ID NO: 507721 - RNA, 64 nt, Homo Sapiens; identical to SEQ ID NO: 280527

SEQ ID NO: 507722 - RNA, 64 nt, Homo Sapiens; identical to SEQ ID NO: 280528

SEQ ID NO: 507723 - RNA, 64 nt, Homo Sapiens; identical to SEQ ID NO: 280529

SEQ ID NO: 507724 - RNA, 64 nt, Homo Sapiens; identical to SEQ ID NO: 280530

SEQ ID NO: 507725 - RNA, 64 nt, Homo Sapiens; identical to SEQ ID NO: 280531

SEQ ID NO: 507726 - RNA, 64 nt, Homo Sapiens; identical to SEQ ID NO: 280532

SEQ ID NO: 507727 - RNA, 64 nt, Homo Sapiens; identical to SEQ ID NO: 280533

SEQ ID NO: 507728 - RNA, 64 nt, Homo Sapiens; identical to SEQ ID NO: 280534

SEQ ID NO: 507729 - RNA, 64 nt, Homo Sapiens; identical to SEQ ID NO: 280535

SEQ ID NO: 507730 - RNA, 64 nt, Homo Sapiens; identical to SEQ ID NO: 280536

SEQ ID NO: 507731 - RNA, 64 nt, Homo Sapiens; identical to SEQ ID NO: 280537

SEQ ID NO: 507732 - RNA, 64 nt, Homo Sapiens; identical to SEQ ID NO: 280538

SEQ ID NO: 507733 - RNA, 64 nt, Homo Sapiens; identical to SEQ ID NO: 280539

SEQ ID NO: 507734 - RNA, 64 nt, Homo Sapiens; identical to SEQ ID NO: 280540

SEQ ID NO: 507735 - RNA, 64 nt, Homo Sapiens; identical to SEQ ID NO: 280541

SEQ ID NO: 507736 - RNA, 64 nt, Homo Sapiens; identical to SEQ ID NO: 280542

SEQ ID NO: 507737 - RNA, 64 nt, Homo Sapiens; identical to SEQ ID NO: 280543

SEQ ID NO: 507738 - RNA, 64 nt, Homo Sapiens; identical to SEQ ID NO: 280544

SEQ ID NO: 507739 - RNA, 64 nt, Homo Sapiens; identical to SEQ ID NO: 280545

SEQ ID NO: 507740 - RNA, 64 nt, Homo Sapiens; identical to SEQ ID NO: 280546

SEQ ID NO: 507741 - RNA, 64 nt, Homo Sapiens; identical to SEQ ID NO: 280547

SEQ ID NO: 507742 - RNA, 64 nt, Homo Sapiens; identical to SEQ ID NO: 280548

SEQ ID NO: 507743 - RNA, 64 nt, Homo Sapiens; identical to SEQ ID NO: 280549

SEQ ID NO: 507744 - RNA, 64 nt, Homo Sapiens; identical to SEQ ID NO: 280550

SEQ ID NO: 507745 - RNA, 64 nt, Homo Sapiens; identical to SEQ ID NO: 280551

SEQ ID NO: 507746 - RNA, 64 nt, Homo Sapiens; identical to SEQ ID NO: 280552

SEQ ID NO: 507747 - RNA, 64 nt, Homo Sapiens; identical to SEQ ID NO: 280553

SEQ ID NO: 507748 - RNA, 64 nt, Homo Sapiens; identical to SEQ ID NO: 280554

SEQ ID NO: 507749 - RNA, 64 nt, Homo Sapiens; identical to SEQ ID NO: 280555

SEQ ID NO: 507750 - RNA, 64 nt, Homo Sapiens; identical to SEQ ID NO: 280556

SEQ ID NO: 507751 - RNA, 64 nt, Homo Sapiens; identical to SEQ ID NO: 280557

SEQ ID NO: 507752 - RNA, 64 nt, Homo Sapiens; identical to SEQ ID NO: 280558

SEQ ID NO: 507753 - RNA, 64 nt, Homo Sapiens; identical to SEQ ID NO: 280559

SEQ ID NO: 507754 - RNA, 60 nt, Homo Sapiens; identical to SEQ ID NO: 280560

SEQ ID NO: 507755 - RNA, 64 nt, Homo Sapiens; identical to SEQ ID NO: 280561

SEQ ID NO: 507756 - RNA, 64 nt, Homo Sapiens; identical to SEQ ID NO: 280562

SEQ ID NO: 507757 - RNA, 64 nt, Homo Sapiens; identical to SEQ ID NO: 280563

SEQ ID NO: 507758 - RNA, 64 nt, Homo Sapiens; identical to SEQ ID NO: 280564

SEQ ID NO: 507759 - RNA, 64 nt, Homo Sapiens; identical to SEQ ID NO: 280565

SEQ ID NO: 507760 - RNA, 64 nt, Homo Sapiens; identical to SEQ ID NO: 280566

SEQ ID NO: 507761 - RNA, 64 nt, Homo Sapiens; identical to SEQ ID NO: 280567

SEQ ID NO: 507762 - RNA, 64 nt, Homo Sapiens; identical to SEQ ID NO: 280568

SEQ ID NO: 507763 - RNA, 64 nt, Homo Sapiens; identical to SEQ ID NO: 280569

SEQ ID NO: 507764 - RNA, 64 nt, Homo Sapiens; identical to SEQ ID NO: 280570

SEQ ID NO: 507765 - RNA, 64 nt, Homo Sapiens; identical to SEQ ID NO: 280571

SEQ ID NO: 507766 - RNA, 64 nt, Homo Sapiens; identical to SEQ ID NO: 280572

SEQ ID NO: 507767 - RNA, 64 nt, Homo Sapiens; identical to SEQ ID NO: 280573

SEQ ID NO: 507768 - RNA, 64 nt, Homo Sapiens; identical to SEQ ID NO: 280574

SEQ ID NO: 507769 - RNA, 64 nt, Homo Sapiens; identical to SEQ ID NO: 280575

SEQ ID NO: 507770 - RNA, 64 nt, Homo Sapiens; identical to SEQ ID NO: 280576

SEQ ID NO: 507771 - RNA, 64 nt, Homo Sapiens; identical to SEQ ID NO: 280577

SEQ ID NO: 507772 - RNA, 64 nt, Homo Sapiens; identical to SEQ ID NO: 280578

SEQ ID NO: 507773 - RNA, 64 nt, Homo Sapiens; identical to SEQ ID NO: 280579

SEQ ID NO: 507774 - RNA, 64 nt, Homo Sapiens; identical to SEQ ID NO: 280580

SEQ ID NO: 507775 - RNA, 64 nt, Homo Sapiens; identical to SEQ ID NO: 280581

SEQ ID NO: 507776 - RNA, 64 nt, Homo Sapiens; identical to SEQ ID NO: 280582

SEQ ID NO: 507777 - RNA, 64 nt, Homo Sapiens; identical to SEQ ID NO: 280583

SEQ ID NO: 507778 - RNA, 64 nt, Homo Sapiens; identical to SEQ ID NO: 280584

SEQ ID NO: 507779 - RNA, 64 nt, Homo Sapiens; identical to SEQ ID NO: 280585

SEQ ID NO: 507780 - RNA, 64 nt, Homo Sapiens; identical to SEQ ID NO: 280586

SEQ ID NO: 507781 - RNA, 64 nt, Homo Sapiens; identical to SEQ ID NO: 280587

SEQ ID NO: 507782 - RNA, 64 nt, Homo Sapiens; identical to SEQ ID NO: 280588

SEQ ID NO: 507783 - RNA, 64 nt, Homo Sapiens; identical to SEQ ID NO: 280589

SEQ ID NO: 507784 - RNA, 64 nt, Homo Sapiens; identical to SEQ ID NO: 280590

SEQ ID NO: 507785 - RNA, 64 nt, Homo Sapiens; identical to SEQ ID NO: 280591

SEQ ID NO: 507786 - RNA, 64 nt, Homo Sapiens; identical to SEQ ID NO: 280592

SEQ ID NO: 507787 - RNA, 64 nt, Homo Sapiens; identical to SEQ ID NO: 280593

SEQ ID NO: 507788 - RNA, 64 nt, Homo Sapiens; identical to SEQ ID NO: 280594

SEQ ID NO: 507789 - RNA, 64 nt, Homo Sapiens; identical to SEQ ID NO: 280595

SEQ ID NO: 507790 - RNA, 64 nt, Homo Sapiens; identical to SEQ ID NO: 280596

SEQ ID NO: 507791 - RNA, 64 nt, Homo Sapiens; identical to SEQ ID NO: 280597

SEQ ID NO: 507792 - RNA, 64 nt, Homo Sapiens; identical to SEQ ID NO: 280598

SEQ ID NO: 507793 - RNA, 64 nt, Homo Sapiens; identical to SEQ ID NO: 280599

SEQ ID NO: 507794 - RNA, 64 nt, Homo Sapiens; identical to SEQ ID NO: 280600

SEQ ID NO: 507795 - RNA, 64 nt, Homo Sapiens; identical to SEQ ID NO: 280601

SEQ ID NO: 507796 - RNA, 64 nt, Homo Sapiens; identical to SEQ ID NO: 280602

SEQ ID NO: 507797 - RNA, 64 nt, Homo Sapiens; identical to SEQ ID NO: 280603

SEQ ID NO: 507798 - RNA, 64 nt, Homo Sapiens; identical to SEQ ID NO: 280604

SEQ ID NO: 507799 - RNA, 64 nt, Homo Sapiens; identical to SEQ ID NO: 280605

SEQ ID NO: 507800 - RNA, 64 nt, Homo Sapiens; identical to SEQ ID NO: 280606

SEQ ID NO: 507801 - RNA, 64 nt, Homo Sapiens; identical to SEQ ID NO: 280607

SEQ ID NO: 507802 - RNA, 64 nt, Homo Sapiens; identical to SEQ ID NO: 280608

SEQ ID NO: 507803 - RNA, 64 nt, Homo Sapiens; identical to SEQ ID NO: 280609

SEQ ID NO: 507804 - RNA, 64 nt, Homo Sapiens; identical to SEQ ID NO: 280610

SEQ ID NO: 507805 - RNA, 64 nt, Homo Sapiens; identical to SEQ ID NO: 280611

SEQ ID NO: 507806 - RNA, 64 nt, Homo Sapiens; identical to SEQ ID NO: 280612

SEQ ID NO: 507807 - RNA, 64 nt, Homo Sapiens; identical to SEQ ID NO: 280613

SEQ ID NO: 507808 - RNA, 64 nt, Homo Sapiens; identical to SEQ ID NO: 280614

SEQ ID NO: 507809 - RNA, 64 nt, Homo Sapiens; identical to SEQ ID NO: 280615

SEQ ID NO: 507810 - RNA, 64 nt, Homo Sapiens; identical to SEQ ID NO: 280616

SEQ ID NO: 507811 - RNA, 64 nt, Homo Sapiens; identical to SEQ ID NO: 280617

SEQ ID NO: 507812 - RNA, 64 nt, Homo Sapiens; identical to SEQ ID NO: 280618

SEQ ID NO: 507813 - RNA, 64 nt, Homo Sapiens; identical to SEQ ID NO: 280619

SEQ ID NO: 507814 - RNA, 64 nt, Homo Sapiens; identical to SEQ ID NO: 280620

SEQ ID NO: 507815 - RNA, 64 nt, Homo Sapiens; identical to SEQ ID NO: 280621

SEQ ID NO: 507816 - RNA, 64 nt, Homo Sapiens; identical to SEQ ID NO: 280622

SEQ ID NO: 507817 - RNA, 64 nt, Homo Sapiens; identical to SEQ ID NO: 280623

SEQ ID NO: 507818 - RNA, 64 nt, Homo Sapiens; identical to SEQ ID NO: 280624

SEQ ID NO: 507819 - RNA, 64 nt, Homo Sapiens; identical to SEQ ID NO: 280625

SEQ ID NO: 507820 - RNA, 64 nt, Homo Sapiens; identical to SEQ ID NO: 280626

SEQ ID NO: 507821 - RNA, 64 nt, Homo Sapiens; identical to SEQ ID NO: 280627

SEQ ID NO: 507822 - RNA, 64 nt, Homo Sapiens; identical to SEQ ID NO: 280628

SEQ ID NO: 507823 - RNA, 64 nt, Homo Sapiens; identical to SEQ ID NO: 280629

SEQ ID NO: 507824 - RNA, 64 nt, Homo Sapiens; identical to SEQ ID NO: 280630

SEQ ID NO: 507825 - RNA, 64 nt, Homo Sapiens; identical to SEQ ID NO: 280631

SEQ ID NO: 507826 - RNA, 64 nt, Homo Sapiens; identical to SEQ ID NO: 280632

SEQ ID NO: 507827 - RNA, 64 nt, Homo Sapiens; identical to SEQ ID NO: 280633

SEQ ID NO: 507828 - RNA, 64 nt, Homo Sapiens; identical to SEQ ID NO: 280634

SEQ ID NO: 507829 - RNA, 64 nt, Homo Sapiens; identical to SEQ ID NO: 280635

SEQ ID NO: 507830 - RNA, 64 nt, Homo Sapiens; identical to SEQ ID NO: 280636

SEQ ID NO: 507831 - RNA, 64 nt, Homo Sapiens; identical to SEQ ID NO: 280637

SEQ ID NO: 507832 - RNA, 64 nt, Homo Sapiens; identical to SEQ ID NO: 280638

SEQ ID NO: 507833 - RNA, 64 nt, Homo Sapiens; identical to SEQ ID NO: 280639

SEQ ID NO: 507834 - RNA, 64 nt, Homo Sapiens; identical to SEQ ID NO: 280640

SEQ ID NO: 507835 - RNA, 64 nt, Homo Sapiens; identical to SEQ ID NO: 280641

SEQ ID NO: 507836 - RNA, 64 nt, Homo Sapiens; identical to SEQ ID NO: 280642

SEQ ID NO: 507837 - RNA, 64 nt, Homo Sapiens; identical to SEQ ID NO: 280643

SEQ ID NO: 507838 - RNA, 64 nt, Homo Sapiens; identical to SEQ ID NO: 280644

SEQ ID NO: 507839 - RNA, 64 nt, Homo Sapiens; identical to SEQ ID NO: 280645

SEQ ID NO: 507840 - RNA, 64 nt, Homo Sapiens; identical to SEQ ID NO: 280646

SEQ ID NO: 507841 - RNA, 64 nt, Homo Sapiens; identical to SEQ ID NO: 280647

SEQ ID NO: 507842 - RNA, 64 nt, Homo Sapiens; identical to SEQ ID NO: 280648

SEQ ID NO: 507843 - RNA, 64 nt, Homo Sapiens; identical to SEQ ID NO: 280649

SEQ ID NO: 507844 - RNA, 64 nt, Homo Sapiens; identical to SEQ ID NO: 280650

SEQ ID NO: 507845 - RNA, 64 nt, Homo Sapiens; identical to SEQ ID NO: 280651

SEQ ID NO: 507846 - RNA, 64 nt, Homo Sapiens; identical to SEQ ID NO: 280652

SEQ ID NO: 507847 - RNA, 64 nt, Homo Sapiens; identical to SEQ ID NO: 280653

SEQ ID NO: 507848 - RNA, 64 nt, Homo Sapiens; identical to SEQ ID NO: 280654

SEQ ID NO: 507849 - RNA, 64 nt, Homo Sapiens; identical to SEQ ID NO: 280655

SEQ ID NO: 507850 - RNA, 64 nt, Homo Sapiens; identical to SEQ ID NO: 280656

SEQ ID NO: 507851 - RNA, 64 nt, Homo Sapiens; identical to SEQ ID NO: 280657

SEQ ID NO: 507852 - RNA, 64 nt, Homo Sapiens; identical to SEQ ID NO: 280658

SEQ ID NO: 507853 - RNA, 64 nt, Homo Sapiens; identical to SEQ ID NO: 280659

SEQ ID NO: 507854 - RNA, 64 nt, Homo Sapiens; identical to SEQ ID NO: 280660

SEQ ID NO: 507855 - RNA, 64 nt, Homo Sapiens; identical to SEQ ID NO: 280661

SEQ ID NO: 507856 - RNA, 64 nt, Homo Sapiens; identical to SEQ ID NO: 280662

SEQ ID NO: 507857 - RNA, 64 nt, Homo Sapiens; identical to SEQ ID NO: 280663

SEQ ID NO: 507858 - RNA, 64 nt, Homo Sapiens; identical to SEQ ID NO: 280664

SEQ ID NO: 507859 - RNA, 64 nt, Homo Sapiens; identical to SEQ ID NO: 280665

SEQ ID NO: 507860 - RNA, 64 nt, Homo Sapiens; identical to SEQ ID NO: 280666

SEQ ID NO: 507861 - RNA, 64 nt, Homo Sapiens; identical to SEQ ID NO: 280667

SEQ ID NO: 507862 - RNA, 64 nt, Homo Sapiens; identical to SEQ ID NO: 280668

SEQ ID NO: 507863 - RNA, 64 nt, Homo Sapiens; identical to SEQ ID NO: 280669

SEQ ID NO: 507864 - RNA, 64 nt, Homo Sapiens; identical to SEQ ID NO: 280670

SEQ ID NO: 507865 - RNA, 64 nt, Homo Sapiens; identical to SEQ ID NO: 280671

SEQ ID NO: 507866 - RNA, 64 nt, Homo Sapiens; identical to SEQ ID NO: 280672

SEQ ID NO: 507867 - RNA, 64 nt, Homo Sapiens; identical to SEQ ID NO: 280673

SEQ ID NO: 507868 - RNA, 64 nt, Homo Sapiens; identical to SEQ ID NO: 280674

SEQ ID NO: 507869 - RNA, 64 nt, Homo Sapiens; identical to SEQ ID NO: 280675

SEQ ID NO: 507870 - RNA, 64 nt, Homo Sapiens; identical to SEQ ID NO: 280676

SEQ ID NO: 507871 - RNA, 64 nt, Homo Sapiens; identical to SEQ ID NO: 280677

SEQ ID NO: 507872 - RNA, 64 nt, Homo Sapiens; identical to SEQ ID NO: 280678

SEQ ID NO: 507873 - RNA, 64 nt, Homo Sapiens; identical to SEQ ID NO: 280679

SEQ ID NO: 507874 - RNA, 64 nt, Homo Sapiens; identical to SEQ ID NO: 280680

SEQ ID NO: 507875 - RNA, 64 nt, Homo Sapiens; identical to SEQ ID NO: 280681

SEQ ID NO: 507876 - RNA, 64 nt, Homo Sapiens; identical to SEQ ID NO: 280682

SEQ ID NO: 507877 - RNA, 64 nt, Homo Sapiens; identical to SEQ ID NO: 280683

SEQ ID NO: 507878 - RNA, 64 nt, Homo Sapiens; identical to SEQ ID NO: 280684

SEQ ID NO: 507879 - RNA, 64 nt, Homo Sapiens; identical to SEQ ID NO: 280685

SEQ ID NO: 507880 - RNA, 64 nt, Homo Sapiens; identical to SEQ ID NO: 280686

SEQ ID NO: 507881 - RNA, 64 nt, Homo Sapiens; identical to SEQ ID NO: 280687

SEQ ID NO: 507882 - RNA, 64 nt, Homo Sapiens; identical to SEQ ID NO: 280688

SEQ ID NO: 507883 - RNA, 64 nt, Homo Sapiens; identical to SEQ ID NO: 280689

SEQ ID NO: 507884 - RNA, 64 nt, Homo Sapiens; identical to SEQ ID NO: 280690

SEQ ID NO: 507885 - RNA, 64 nt, Homo Sapiens; identical to SEQ ID NO: 280691

SEQ ID NO: 507886 - RNA, 64 nt, Homo Sapiens; identical to SEQ ID NO: 280692

SEQ ID NO: 507887 - RNA, 64 nt, Homo Sapiens; identical to SEQ ID NO: 280693

SEQ ID NO: 507888 - RNA, 64 nt, Homo Sapiens; identical to SEQ ID NO: 280694

SEQ ID NO: 507889 - RNA, 64 nt, Homo Sapiens; identical to SEQ ID NO: 280695

SEQ ID NO: 507890 - RNA, 64 nt, Homo Sapiens; identical to SEQ ID NO: 280696

SEQ ID NO: 507891 - RNA, 64 nt, Homo Sapiens; identical to SEQ ID NO: 280697

SEQ ID NO: 507892 - RNA, 64 nt, Homo Sapiens; identical to SEQ ID NO: 280698

SEQ ID NO: 507893 - RNA, 64 nt, Homo Sapiens; identical to SEQ ID NO: 280699

SEQ ID NO: 507894 - RNA, 64 nt, Homo Sapiens; identical to SEQ ID NO: 280700

SEQ ID NO: 507895 - RNA, 64 nt, Homo Sapiens; identical to SEQ ID NO: 280701

SEQ ID NO: 507896 - RNA, 64 nt, Homo Sapiens; identical to SEQ ID NO: 280702

SEQ ID NO: 507897 - RNA, 64 nt, Homo Sapiens; identical to SEQ ID NO: 280703

SEQ ID NO: 507898 - RNA, 64 nt, Homo Sapiens; identical to SEQ ID NO: 280704

SEQ ID NO: 507899 - RNA, 64 nt, Homo Sapiens; identical to SEQ ID NO: 280705

SEQ ID NO: 507900 - RNA, 64 nt, Homo Sapiens; identical to SEQ ID NO: 280706

SEQ ID NO: 507901 - RNA, 64 nt, Homo Sapiens; identical to SEQ ID NO: 280707

SEQ ID NO: 507902 - RNA, 64 nt, Homo Sapiens; identical to SEQ ID NO: 280708

SEQ ID NO: 507903 - RNA, 64 nt, Homo Sapiens; identical to SEQ ID NO: 280709

SEQ ID NO: 507904 - RNA, 64 nt, Homo Sapiens; identical to SEQ ID NO: 280710

SEQ ID NO: 507905 - RNA, 64 nt, Homo Sapiens; identical to SEQ ID NO: 280711

SEQ ID NO: 507906 - RNA, 64 nt, Homo Sapiens; identical to SEQ ID NO: 280712

SEQ ID NO: 507907 - RNA, 64 nt, Homo Sapiens; identical to SEQ ID NO: 280713

SEQ ID NO: 507908 - RNA, 64 nt, Homo Sapiens; identical to SEQ ID NO: 280714

SEQ ID NO: 507909 - RNA, 64 nt, Homo Sapiens; identical to SEQ ID NO: 280715

SEQ ID NO: 507910 - RNA, 64 nt, Homo Sapiens; identical to SEQ ID NO: 280716

SEQ ID NO: 507911 - RNA, 64 nt, Homo Sapiens; identical to SEQ ID NO: 280717

SEQ ID NO: 507912 - RNA, 64 nt, Homo Sapiens; identical to SEQ ID NO: 280718

SEQ ID NO: 507913 - RNA, 64 nt, Homo Sapiens; identical to SEQ ID NO: 280719

SEQ ID NO: 507914 - RNA, 64 nt, Homo Sapiens; identical to SEQ ID NO: 280720

SEQ ID NO: 507915 - RNA, 64 nt, Homo Sapiens; identical to SEQ ID NO: 280721

SEQ ID NO: 507916 - RNA, 64 nt, Homo Sapiens; identical to SEQ ID NO: 280722

SEQ ID NO: 507917 - RNA, 64 nt, Homo Sapiens; identical to SEQ ID NO: 280723

SEQ ID NO: 507918 - RNA, 64 nt, Homo Sapiens; identical to SEQ ID NO: 280724

SEQ ID NO: 507919 - RNA, 64 nt, Homo Sapiens; identical to SEQ ID NO: 280725

SEQ ID NO: 507920 - RNA, 64 nt, Homo Sapiens; identical to SEQ ID NO: 280726

SEQ ID NO: 507921 - RNA, 64 nt, Homo Sapiens; identical to SEQ ID NO: 280727

SEQ ID NO: 507922 - RNA, 64 nt, Homo Sapiens; identical to SEQ ID NO: 280728

SEQ ID NO: 507923 - RNA, 64 nt, Homo Sapiens; identical to SEQ ID NO: 280729

SEQ ID NO: 507924 - RNA, 64 nt, Homo Sapiens; identical to SEQ ID NO: 280730

SEQ ID NO: 507925 - RNA, 64 nt, Homo Sapiens; identical to SEQ ID NO: 280731

SEQ ID NO: 507926 - RNA, 64 nt, Homo Sapiens; identical to SEQ ID NO: 280732

SEQ ID NO: 507927 - RNA, 64 nt, Homo Sapiens; identical to SEQ ID NO: 280733

SEQ ID NO: 507928 - RNA, 64 nt, Homo Sapiens; identical to SEQ ID NO: 280734

SEQ ID NO: 507929 - RNA, 64 nt, Homo Sapiens; identical to SEQ ID NO: 280735

SEQ ID NO: 507930 - RNA, 64 nt, Homo Sapiens; identical to SEQ ID NO: 280736

SEQ ID NO: 507931 - RNA, 64 nt, Homo Sapiens; identical to SEQ ID NO: 280737

SEQ ID NO: 507932 - RNA, 64 nt, Homo Sapiens; identical to SEQ ID NO: 280738

SEQ ID NO: 507933 - RNA, 64 nt, Homo Sapiens; identical to SEQ ID NO: 280739

SEQ ID NO: 507934 - RNA, 64 nt, Homo Sapiens; identical to SEQ ID NO: 280740

SEQ ID NO: 507935 - RNA, 64 nt, Homo Sapiens; identical to SEQ ID NO: 280741

SEQ ID NO: 507936 - RNA, 64 nt, Homo Sapiens; identical to SEQ ID NO: 280742

SEQ ID NO: 507937 - RNA, 64 nt, Homo Sapiens; identical to SEQ ID NO: 280743

SEQ ID NO: 507938 - RNA, 64 nt, Homo Sapiens; identical to SEQ ID NO: 280744

SEQ ID NO: 507939 - RNA, 64 nt, Homo Sapiens; identical to SEQ ID NO: 280745

SEQ ID NO: 507940 - RNA, 64 nt, Homo Sapiens; identical to SEQ ID NO: 280746

SEQ ID NO: 507941 - RNA, 64 nt, Homo Sapiens; identical to SEQ ID NO: 280747

SEQ ID NO: 507942 - RNA, 64 nt, Homo Sapiens; identical to SEQ ID NO: 280748

SEQ ID NO: 507943 - RNA, 64 nt, Homo Sapiens; identical to SEQ ID NO: 280749

SEQ ID NO: 507944 - RNA, 64 nt, Homo Sapiens; identical to SEQ ID NO: 280750

SEQ ID NO: 507945 - RNA, 64 nt, Homo Sapiens; identical to SEQ ID NO: 280751

SEQ ID NO: 507946 - RNA, 64 nt, Homo Sapiens; identical to SEQ ID NO: 280752

SEQ ID NO: 507947 - RNA, 64 nt, Homo Sapiens; identical to SEQ ID NO: 280753

SEQ ID NO: 507948 - RNA, 64 nt, Homo Sapiens; identical to SEQ ID NO: 280754

SEQ ID NO: 507949 - RNA, 64 nt, Homo Sapiens; identical to SEQ ID NO: 280755

SEQ ID NO: 507950 - RNA, 64 nt, Homo Sapiens; identical to SEQ ID NO: 280756

SEQ ID NO: 507951 - RNA, 64 nt, Homo Sapiens; identical to SEQ ID NO: 280757

SEQ ID NO: 507952 - RNA, 64 nt, Homo Sapiens; identical to SEQ ID NO: 280758

SEQ ID NO: 507953 - RNA, 64 nt, Homo Sapiens; identical to SEQ ID NO: 280759

SEQ ID NO: 507954 - RNA, 64 nt, Homo Sapiens; identical to SEQ ID NO: 280760

SEQ ID NO: 507955 - RNA, 64 nt, Homo Sapiens; identical to SEQ ID NO: 280761

SEQ ID NO: 507956 - RNA, 64 nt, Homo Sapiens; identical to SEQ ID NO: 280762

SEQ ID NO: 507957 - RNA, 64 nt, Homo Sapiens; identical to SEQ ID NO: 280763

SEQ ID NO: 507958 - RNA, 64 nt, Homo Sapiens; identical to SEQ ID NO: 280764

SEQ ID NO: 507959 - RNA, 64 nt, Homo Sapiens; identical to SEQ ID NO: 280765

SEQ ID NO: 507960 - RNA, 64 nt, Homo Sapiens; identical to SEQ ID NO: 280766

SEQ ID NO: 507961 - RNA, 64 nt, Homo Sapiens; identical to SEQ ID NO: 280767

SEQ ID NO: 507962 - RNA, 64 nt, Homo Sapiens; identical to SEQ ID NO: 280768

SEQ ID NO: 507963 - RNA, 64 nt, Homo Sapiens; identical to SEQ ID NO: 280769

SEQ ID NO: 507964 - RNA, 64 nt, Homo Sapiens; identical to SEQ ID NO: 280770

SEQ ID NO: 507965 - RNA, 64 nt, Homo Sapiens; identical to SEQ ID NO: 280771

SEQ ID NO: 507966 - RNA, 64 nt, Homo Sapiens; identical to SEQ ID NO: 280772

SEQ ID NO: 507967 - RNA, 64 nt, Homo Sapiens; identical to SEQ ID NO: 280773

SEQ ID NO: 507968 - RNA, 64 nt, Homo Sapiens; identical to SEQ ID NO: 280774

SEQ ID NO: 507969 - RNA, 64 nt, Homo Sapiens; identical to SEQ ID NO: 280775

SEQ ID NO: 507970 - RNA, 64 nt, Homo Sapiens; identical to SEQ ID NO: 280776

SEQ ID NO: 507971 - RNA, 64 nt, Homo Sapiens; identical to SEQ ID NO: 280777

SEQ ID NO: 507972 - RNA, 64 nt, Homo Sapiens; identical to SEQ ID NO: 280778

SEQ ID NO: 507973 - RNA, 64 nt, Homo Sapiens; identical to SEQ ID NO: 280779

SEQ ID NO: 507974 - RNA, 64 nt, Homo Sapiens; identical to SEQ ID NO: 280780

SEQ ID NO: 507975 - RNA, 64 nt, Homo Sapiens; identical to SEQ ID NO: 280781

SEQ ID NO: 507976 - RNA, 64 nt, Homo Sapiens; identical to SEQ ID NO: 280782

SEQ ID NO: 507977 - RNA, 64 nt, Homo Sapiens; identical to SEQ ID NO: 280783

SEQ ID NO: 507978 - RNA, 64 nt, Homo Sapiens; identical to SEQ ID NO: 280784

SEQ ID NO: 507979 - RNA, 64 nt, Homo Sapiens; identical to SEQ ID NO: 280785

SEQ ID NO: 507980 - RNA, 64 nt, Homo Sapiens; identical to SEQ ID NO: 280786

SEQ ID NO: 507981 - RNA, 64 nt, Homo Sapiens; identical to SEQ ID NO: 280787

SEQ ID NO: 507982 - RNA, 64 nt, Homo Sapiens; identical to SEQ ID NO: 280788

SEQ ID NO: 507983 - RNA, 64 nt, Homo Sapiens; identical to SEQ ID NO: 280789

SEQ ID NO: 507984 - RNA, 64 nt, Homo Sapiens; identical to SEQ ID NO: 280790

SEQ ID NO: 507985 - RNA, 64 nt, Homo Sapiens; identical to SEQ ID NO: 280791

SEQ ID NO: 507986 - RNA, 64 nt, Homo Sapiens; identical to SEQ ID NO: 280792

SEQ ID NO: 507987 - RNA, 64 nt, Homo Sapiens; identical to SEQ ID NO: 280793

SEQ ID NO: 507988 - RNA, 64 nt, Homo Sapiens; identical to SEQ ID NO: 280794

SEQ ID NO: 507989 - RNA, 64 nt, Homo Sapiens; identical to SEQ ID NO: 280795

SEQ ID NO: 507990 - RNA, 64 nt, Homo Sapiens; identical to SEQ ID NO: 280796

SEQ ID NO: 507991 - RNA, 64 nt, Homo Sapiens; identical to SEQ ID NO: 280797

SEQ ID NO: 507992 - RNA, 64 nt, Homo Sapiens; identical to SEQ ID NO: 280798

SEQ ID NO: 507993 - RNA, 64 nt, Homo Sapiens; identical to SEQ ID NO: 280799

SEQ ID NO: 507994 - RNA, 64 nt, Homo Sapiens; identical to SEQ ID NO: 280800

SEQ ID NO: 507995 - RNA, 64 nt, Homo Sapiens; identical to SEQ ID NO: 280801

SEQ ID NO: 507996 - RNA, 64 nt, Homo Sapiens; identical to SEQ ID NO: 280802

SEQ ID NO: 507997 - RNA, 64 nt, Homo Sapiens; identical to SEQ ID NO: 280803

SEQ ID NO: 507998 - RNA, 64 nt, Homo Sapiens; identical to SEQ ID NO: 280804

SEQ ID NO: 507999 - RNA, 64 nt, Homo Sapiens; identical to SEQ ID NO: 280805

SEQ ID NO: 508000 - RNA, 64 nt, Homo Sapiens; identical to SEQ ID NO: 280806

SEQ ID NO: 508001 - RNA, 64 nt, Homo Sapiens; identical to SEQ ID NO: 280807

SEQ ID NO: 508002 - RNA, 64 nt, Homo Sapiens; identical to SEQ ID NO: 280808

SEQ ID NO: 508003 - RNA, 64 nt, Homo Sapiens; identical to SEQ ID NO: 280809

SEQ ID NO: 508004 - RNA, 64 nt, Homo Sapiens; identical to SEQ ID NO: 280810

SEQ ID NO: 508005 - RNA, 64 nt, Homo Sapiens; identical to SEQ ID NO: 280811

SEQ ID NO: 508006 - RNA, 64 nt, Homo Sapiens; identical to SEQ ID NO: 280812

SEQ ID NO: 508007 - RNA, 64 nt, Homo Sapiens; identical to SEQ ID NO: 280813

SEQ ID NO: 508008 - RNA, 64 nt, Homo Sapiens; identical to SEQ ID NO: 280814

SEQ ID NO: 508009 - RNA, 64 nt, Homo Sapiens; identical to SEQ ID NO: 280815

SEQ ID NO: 508010 - RNA, 64 nt, Homo Sapiens; identical to SEQ ID NO: 280816

SEQ ID NO: 508011 - RNA, 64 nt, Homo Sapiens; identical to SEQ ID NO: 280817

SEQ ID NO: 508012 - RNA, 64 nt, Homo Sapiens; identical to SEQ ID NO: 280818

SEQ ID NO: 508013 - RNA, 64 nt, Homo Sapiens; identical to SEQ ID NO: 280819

SEQ ID NO: 508014 - RNA, 64 nt, Homo Sapiens; identical to SEQ ID NO: 280820

SEQ ID NO: 508015 - RNA, 64 nt, Homo Sapiens; identical to SEQ ID NO: 280821

SEQ ID NO: 508016 - RNA, 64 nt, Homo Sapiens; identical to SEQ ID NO: 280822

SEQ ID NO: 508017 - RNA, 64 nt, Homo Sapiens; identical to SEQ ID NO: 280823

SEQ ID NO: 508018 - RNA, 64 nt, Homo Sapiens; identical to SEQ ID NO: 280824

SEQ ID NO: 508019 - RNA, 64 nt, Homo Sapiens; identical to SEQ ID NO: 280825

SEQ ID NO: 508020 - RNA, 64 nt, Homo Sapiens; identical to SEQ ID NO: 280826

SEQ ID NO: 508021 - RNA, 64 nt, Homo Sapiens; identical to SEQ ID NO: 280827

SEQ ID NO: 508022 - RNA, 64 nt, Homo Sapiens; identical to SEQ ID NO: 280828

SEQ ID NO: 508023 - RNA, 64 nt, Homo Sapiens; identical to SEQ ID NO: 280829

SEQ ID NO: 508024 - RNA, 64 nt, Homo Sapiens; identical to SEQ ID NO: 280830

SEQ ID NO: 508025 - RNA, 64 nt, Homo Sapiens; identical to SEQ ID NO: 280831

SEQ ID NO: 508026 - RNA, 64 nt, Homo Sapiens; identical to SEQ ID NO: 280832

SEQ ID NO: 508027 - RNA, 64 nt, Homo Sapiens; identical to SEQ ID NO: 280833

SEQ ID NO: 508028 - RNA, 64 nt, Homo Sapiens; identical to SEQ ID NO: 280834

SEQ ID NO: 508029 - RNA, 64 nt, Homo Sapiens; identical to SEQ ID NO: 280835

SEQ ID NO: 508030 - RNA, 64 nt, Homo Sapiens; identical to SEQ ID NO: 280836

SEQ ID NO: 508031 - RNA, 64 nt, Homo Sapiens; identical to SEQ ID NO: 280837

SEQ ID NO: 508032 - RNA, 64 nt, Homo Sapiens; identical to SEQ ID NO: 280838

SEQ ID NO: 508033 - RNA, 64 nt, Homo Sapiens; identical to SEQ ID NO: 280839

SEQ ID NO: 508034 - RNA, 64 nt, Homo Sapiens; identical to SEQ ID NO: 280840

SEQ ID NO: 508035 - RNA, 64 nt, Homo Sapiens; identical to SEQ ID NO: 280841

SEQ ID NO: 508036 - RNA, 58 nt, Homo Sapiens; identical to SEQ ID NO: 280842

SEQ ID NO: 508037 - RNA, 53 nt, Homo Sapiens; identical to SEQ ID NO: 280843

SEQ ID NO: 508038 - RNA, 64 nt, Homo Sapiens; identical to SEQ ID NO: 280844

SEQ ID NO: 508039 - RNA, 64 nt, Homo Sapiens; identical to SEQ ID NO: 280845

SEQ ID NO: 508040 - RNA, 64 nt, Homo Sapiens; identical to SEQ ID NO: 280846

SEQ ID NO: 508041 - RNA, 64 nt, Homo Sapiens; identical to SEQ ID NO: 280847

SEQ ID NO: 508042 - RNA, 64 nt, Homo Sapiens; identical to SEQ ID NO: 280848

SEQ ID NO: 508043 - RNA, 64 nt, Homo Sapiens; identical to SEQ ID NO: 280849

SEQ ID NO: 508044 - RNA, 64 nt, Homo Sapiens; identical to SEQ ID NO: 280850

SEQ ID NO: 508045 - RNA, 64 nt, Homo Sapiens; identical to SEQ ID NO: 280851

SEQ ID NO: 508046 - RNA, 64 nt, Homo Sapiens; identical to SEQ ID NO: 280852

SEQ ID NO: 508047 - RNA, 64 nt, Homo Sapiens; identical to SEQ ID NO: 280853

SEQ ID NO: 508048 - RNA, 64 nt, Homo Sapiens; identical to SEQ ID NO: 280854

SEQ ID NO: 508049 - RNA, 64 nt, Homo Sapiens; identical to SEQ ID NO: 280855

SEQ ID NO: 508050 - RNA, 64 nt, Homo Sapiens; identical to SEQ ID NO: 280856

SEQ ID NO: 508051 - RNA, 64 nt, Homo Sapiens; identical to SEQ ID NO: 280857

SEQ ID NO: 508052 - RNA, 64 nt, Homo Sapiens; identical to SEQ ID NO: 280858

SEQ ID NO: 508053 - RNA, 64 nt, Homo Sapiens; identical to SEQ ID NO: 280859

SEQ ID NO: 508054 - RNA, 64 nt, Homo Sapiens; identical to SEQ ID NO: 280860

SEQ ID NO: 508055 - RNA, 64 nt, Homo Sapiens; identical to SEQ ID NO: 280861

SEQ ID NO: 508056 - RNA, 64 nt, Homo Sapiens; identical to SEQ ID NO: 280862

SEQ ID NO: 508057 - RNA, 64 nt, Homo Sapiens; identical to SEQ ID NO: 280863

SEQ ID NO: 508058 - RNA, 64 nt, Homo Sapiens; identical to SEQ ID NO: 280864

SEQ ID NO: 508059 - RNA, 64 nt, Homo Sapiens; identical to SEQ ID NO: 280865

SEQ ID NO: 508060 - RNA, 64 nt, Homo Sapiens; identical to SEQ ID NO: 280866

SEQ ID NO: 508061 - RNA, 64 nt, Homo Sapiens; identical to SEQ ID NO: 280867

SEQ ID NO: 508062 - RNA, 64 nt, Homo Sapiens; identical to SEQ ID NO: 280868

SEQ ID NO: 508063 - RNA, 64 nt, Homo Sapiens; identical to SEQ ID NO: 280869

SEQ ID NO: 508064 - RNA, 64 nt, Homo Sapiens; identical to SEQ ID NO: 280870

SEQ ID NO: 508065 - RNA, 64 nt, Homo Sapiens; identical to SEQ ID NO: 280871

SEQ ID NO: 508066 - RNA, 64 nt, Homo Sapiens; identical to SEQ ID NO: 280872

SEQ ID NO: 508067 - RNA, 64 nt, Homo Sapiens; identical to SEQ ID NO: 280873

SEQ ID NO: 508068 - RNA, 64 nt, Homo Sapiens; identical to SEQ ID NO: 280874

SEQ ID NO: 508069 - RNA, 64 nt, Homo Sapiens; identical to SEQ ID NO: 280875

SEQ ID NO: 508070 - RNA, 64 nt, Homo Sapiens; identical to SEQ ID NO: 280876

SEQ ID NO: 508071 - RNA, 64 nt, Homo Sapiens; identical to SEQ ID NO: 280877

SEQ ID NO: 508072 - RNA, 64 nt, Homo Sapiens; identical to SEQ ID NO: 280878

SEQ ID NO: 508073 - RNA, 64 nt, Homo Sapiens; identical to SEQ ID NO: 280879

SEQ ID NO: 508074 - RNA, 60 nt, Homo Sapiens; identical to SEQ ID NO: 280880

SEQ ID NO: 508075 - RNA, 64 nt, Homo Sapiens; identical to SEQ ID NO: 280881

SEQ ID NO: 508076 - RNA, 64 nt, Homo Sapiens; identical to SEQ ID NO: 280882

SEQ ID NO: 508077 - RNA, 64 nt, Homo Sapiens; identical to SEQ ID NO: 280883

SEQ ID NO: 508078 - RNA, 64 nt, Homo Sapiens; identical to SEQ ID NO: 280884

SEQ ID NO: 508079 - RNA, 64 nt, Homo Sapiens; identical to SEQ ID NO: 280885

SEQ ID NO: 508080 - RNA, 64 nt, Homo Sapiens; identical to SEQ ID NO: 280886

SEQ ID NO: 508081 - RNA, 64 nt, Homo Sapiens; identical to SEQ ID NO: 280887

SEQ ID NO: 508082 - RNA, 64 nt, Homo Sapiens; identical to SEQ ID NO: 280888

SEQ ID NO: 508083 - RNA, 64 nt, Homo Sapiens; identical to SEQ ID NO: 280889

SEQ ID NO: 508084 - RNA, 64 nt, Homo Sapiens; identical to SEQ ID NO: 280890

SEQ ID NO: 508085 - RNA, 64 nt, Homo Sapiens; identical to SEQ ID NO: 280891

SEQ ID NO: 508086 - RNA, 64 nt, Homo Sapiens; identical to SEQ ID NO: 280892

SEQ ID NO: 508087 - RNA, 64 nt, Homo Sapiens; identical to SEQ ID NO: 280893

SEQ ID NO: 508088 - RNA, 64 nt, Homo Sapiens; identical to SEQ ID NO: 280894

SEQ ID NO: 508089 - RNA, 64 nt, Homo Sapiens; identical to SEQ ID NO: 280895

SEQ ID NO: 508090 - RNA, 64 nt, Homo Sapiens; identical to SEQ ID NO: 280896

SEQ ID NO: 508091 - RNA, 64 nt, Homo Sapiens; identical to SEQ ID NO: 280897

SEQ ID NO: 508092 - RNA, 64 nt, Homo Sapiens; identical to SEQ ID NO: 280898

SEQ ID NO: 508093 - RNA, 64 nt, Homo Sapiens; identical to SEQ ID NO: 280899

SEQ ID NO: 508094 - RNA, 64 nt, Homo Sapiens; identical to SEQ ID NO: 280900

SEQ ID NO: 508095 - RNA, 64 nt, Homo Sapiens; identical to SEQ ID NO: 280901

SEQ ID NO: 508096 - RNA, 64 nt, Homo Sapiens; identical to SEQ ID NO: 280902

SEQ ID NO: 508097 - RNA, 64 nt, Homo Sapiens; identical to SEQ ID NO: 280903

SEQ ID NO: 508098 - RNA, 64 nt, Homo Sapiens; identical to SEQ ID NO: 280904

SEQ ID NO: 508099 - RNA, 64 nt, Homo Sapiens; identical to SEQ ID NO: 280905

SEQ ID NO: 508100 - RNA, 64 nt, Homo Sapiens; identical to SEQ ID NO: 280906

SEQ ID NO: 508101 - RNA, 64 nt, Homo Sapiens; identical to SEQ ID NO: 280907

SEQ ID NO: 508102 - RNA, 64 nt, Homo Sapiens; identical to SEQ ID NO: 280908

SEQ ID NO: 508103 - RNA, 64 nt, Homo Sapiens; identical to SEQ ID NO: 280909

SEQ ID NO: 508104 - RNA, 64 nt, Homo Sapiens; identical to SEQ ID NO: 280910

SEQ ID NO: 508105 - RNA, 64 nt, Homo Sapiens; identical to SEQ ID NO: 280911

SEQ ID NO: 508106 - RNA, 64 nt, Homo Sapiens; identical to SEQ ID NO: 280912

SEQ ID NO: 508107 - RNA, 64 nt, Homo Sapiens; identical to SEQ ID NO: 280913

SEQ ID NO: 508108 - RNA, 64 nt, Homo Sapiens; identical to SEQ ID NO: 280914

SEQ ID NO: 508109 - RNA, 64 nt, Homo Sapiens; identical to SEQ ID NO: 280915

SEQ ID NO: 508110 - RNA, 64 nt, Homo Sapiens; identical to SEQ ID NO: 280916

SEQ ID NO: 508111 - RNA, 64 nt, Homo Sapiens; identical to SEQ ID NO: 280917

SEQ ID NO: 508112 - RNA, 64 nt, Homo Sapiens; identical to SEQ ID NO: 280918

SEQ ID NO: 508113 - RNA, 64 nt, Homo Sapiens; identical to SEQ ID NO: 280919

SEQ ID NO: 508114 - RNA, 64 nt, Homo Sapiens; identical to SEQ ID NO: 280920

SEQ ID NO: 508115 - RNA, 64 nt, Homo Sapiens; identical to SEQ ID NO: 280921

SEQ ID NO: 508116 - RNA, 64 nt, Homo Sapiens; identical to SEQ ID NO: 280922

SEQ ID NO: 508117 - RNA, 64 nt, Homo Sapiens; identical to SEQ ID NO: 280923

SEQ ID NO: 508118 - RNA, 64 nt, Homo Sapiens; identical to SEQ ID NO: 280924

SEQ ID NO: 508119 - RNA, 64 nt, Homo Sapiens; identical to SEQ ID NO: 280925

SEQ ID NO: 508120 - RNA, 64 nt, Homo Sapiens; identical to SEQ ID NO: 280926

SEQ ID NO: 508121 - RNA, 64 nt, Homo Sapiens; identical to SEQ ID NO: 280927

SEQ ID NO: 508122 - RNA, 64 nt, Homo Sapiens; identical to SEQ ID NO: 280928

SEQ ID NO: 508123 - RNA, 64 nt, Homo Sapiens; identical to SEQ ID NO: 280929

SEQ ID NO: 508124 - RNA, 64 nt, Homo Sapiens; identical to SEQ ID NO: 280930

SEQ ID NO: 508125 - RNA, 64 nt, Homo Sapiens; identical to SEQ ID NO: 280931

SEQ ID NO: 508126 - RNA, 64 nt, Homo Sapiens; identical to SEQ ID NO: 280932

SEQ ID NO: 508127 - RNA, 64 nt, Homo Sapiens; identical to SEQ ID NO: 280933

SEQ ID NO: 508128 - RNA, 64 nt, Homo Sapiens; identical to SEQ ID NO: 280934

SEQ ID NO: 508129 - RNA, 64 nt, Homo Sapiens; identical to SEQ ID NO: 280935

SEQ ID NO: 508130 - RNA, 64 nt, Homo Sapiens; identical to SEQ ID NO: 280936

SEQ ID NO: 508131 - RNA, 64 nt, Homo Sapiens; identical to SEQ ID NO: 280937

SEQ ID NO: 508132 - RNA, 64 nt, Homo Sapiens; identical to SEQ ID NO: 280938

SEQ ID NO: 508133 - RNA, 64 nt, Homo Sapiens; identical to SEQ ID NO: 280939

SEQ ID NO: 508134 - RNA, 64 nt, Homo Sapiens; identical to SEQ ID NO: 280940

SEQ ID NO: 508135 - RNA, 64 nt, Homo Sapiens; identical to SEQ ID NO: 280941

SEQ ID NO: 508136 - RNA, 64 nt, Homo Sapiens; identical to SEQ ID NO: 280942

SEQ ID NO: 508137 - RNA, 64 nt, Homo Sapiens; identical to SEQ ID NO: 280943

SEQ ID NO: 508138 - RNA, 64 nt, Homo Sapiens; identical to SEQ ID NO: 280944

SEQ ID NO: 508139 - RNA, 64 nt, Homo Sapiens; identical to SEQ ID NO: 280945

SEQ ID NO: 508140 - RNA, 64 nt, Homo Sapiens; identical to SEQ ID NO: 280946

SEQ ID NO: 508141 - RNA, 64 nt, Homo Sapiens; identical to SEQ ID NO: 280947

SEQ ID NO: 508142 - RNA, 64 nt, Homo Sapiens; identical to SEQ ID NO: 280948

SEQ ID NO: 508143 - RNA, 64 nt, Homo Sapiens; identical to SEQ ID NO: 280949

SEQ ID NO: 508144 - RNA, 64 nt, Homo Sapiens; identical to SEQ ID NO: 280950

SEQ ID NO: 508145 - RNA, 64 nt, Homo Sapiens; identical to SEQ ID NO: 280951

SEQ ID NO: 508146 - RNA, 64 nt, Homo Sapiens; identical to SEQ ID NO: 280952

SEQ ID NO: 508147 - RNA, 64 nt, Homo Sapiens; identical to SEQ ID NO: 280953

SEQ ID NO: 508148 - RNA, 64 nt, Homo Sapiens; identical to SEQ ID NO: 280954

SEQ ID NO: 508149 - RNA, 64 nt, Homo Sapiens; identical to SEQ ID NO: 280955

SEQ ID NO: 508150 - RNA, 64 nt, Homo Sapiens; identical to SEQ ID NO: 280956

SEQ ID NO: 508151 - RNA, 64 nt, Homo Sapiens; identical to SEQ ID NO: 280957

SEQ ID NO: 508152 - RNA, 64 nt, Homo Sapiens; identical to SEQ ID NO: 280958

SEQ ID NO: 508153 - RNA, 64 nt, Homo Sapiens; identical to SEQ ID NO: 280959

SEQ ID NO: 508154 - RNA, 64 nt, Homo Sapiens; identical to SEQ ID NO: 280960

SEQ ID NO: 508155 - RNA, 64 nt, Homo Sapiens; identical to SEQ ID NO: 280961

SEQ ID NO: 508156 - RNA, 64 nt, Homo Sapiens; identical to SEQ ID NO: 280962

SEQ ID NO: 508157 - RNA, 64 nt, Homo Sapiens; identical to SEQ ID NO: 280963

SEQ ID NO: 508158 - RNA, 64 nt, Homo Sapiens; identical to SEQ ID NO: 280964

SEQ ID NO: 508159 - RNA, 64 nt, Homo Sapiens; identical to SEQ ID NO: 280965

SEQ ID NO: 508160 - RNA, 64 nt, Homo Sapiens; identical to SEQ ID NO: 280966

SEQ ID NO: 508161 - RNA, 64 nt, Homo Sapiens; identical to SEQ ID NO: 280967

SEQ ID NO: 508162 - RNA, 64 nt, Homo Sapiens; identical to SEQ ID NO: 280968

SEQ ID NO: 508163 - RNA, 64 nt, Homo Sapiens; identical to SEQ ID NO: 280969

SEQ ID NO: 508164 - RNA, 64 nt, Homo Sapiens; identical to SEQ ID NO: 280970

SEQ ID NO: 508165 - RNA, 64 nt, Homo Sapiens; identical to SEQ ID NO: 280971

SEQ ID NO: 508166 - RNA, 64 nt, Homo Sapiens; identical to SEQ ID NO: 280972

SEQ ID NO: 508167 - RNA, 64 nt, Homo Sapiens; identical to SEQ ID NO: 280973

SEQ ID NO: 508168 - RNA, 64 nt, Homo Sapiens; identical to SEQ ID NO: 280974

SEQ ID NO: 508169 - RNA, 64 nt, Homo Sapiens; identical to SEQ ID NO: 280975

SEQ ID NO: 508170 - RNA, 64 nt, Homo Sapiens; identical to SEQ ID NO: 280976

SEQ ID NO: 508171 - RNA, 64 nt, Homo Sapiens; identical to SEQ ID NO: 280977

SEQ ID NO: 508172 - RNA, 64 nt, Homo Sapiens; identical to SEQ ID NO: 280978

SEQ ID NO: 508173 - RNA, 64 nt, Homo Sapiens; identical to SEQ ID NO: 280979

SEQ ID NO: 508174 - RNA, 64 nt, Homo Sapiens; identical to SEQ ID NO: 280980

SEQ ID NO: 508175 - RNA, 64 nt, Homo Sapiens; identical to SEQ ID NO: 280981

SEQ ID NO: 508176 - RNA, 64 nt, Homo Sapiens; identical to SEQ ID NO: 280982

SEQ ID NO: 508177 - RNA, 64 nt, Homo Sapiens; identical to SEQ ID NO: 280983

SEQ ID NO: 508178 - RNA, 64 nt, Homo Sapiens; identical to SEQ ID NO: 280984

SEQ ID NO: 508179 - RNA, 64 nt, Homo Sapiens; identical to SEQ ID NO: 280985

SEQ ID NO: 508180 - RNA, 64 nt, Homo Sapiens; identical to SEQ ID NO: 280986

SEQ ID NO: 508181 - RNA, 64 nt, Homo Sapiens; identical to SEQ ID NO: 280987

SEQ ID NO: 508182 - RNA, 64 nt, Homo Sapiens; identical to SEQ ID NO: 280988

SEQ ID NO: 508183 - RNA, 64 nt, Homo Sapiens; identical to SEQ ID NO: 280989

SEQ ID NO: 508184 - RNA, 64 nt, Homo Sapiens; identical to SEQ ID NO: 280990

SEQ ID NO: 508185 - RNA, 64 nt, Homo Sapiens; identical to SEQ ID NO: 280991

SEQ ID NO: 508186 - RNA, 64 nt, Homo Sapiens; identical to SEQ ID NO: 280992

SEQ ID NO: 508187 - RNA, 64 nt, Homo Sapiens; identical to SEQ ID NO: 280993

SEQ ID NO: 508188 - RNA, 64 nt, Homo Sapiens; identical to SEQ ID NO: 280994

SEQ ID NO: 508189 - RNA, 64 nt, Homo Sapiens; identical to SEQ ID NO: 280995

SEQ ID NO: 508190 - RNA, 64 nt, Homo Sapiens; identical to SEQ ID NO: 280996

SEQ ID NO: 508191 - RNA, 64 nt, Homo Sapiens; identical to SEQ ID NO: 280997

SEQ ID NO: 508192 - RNA, 64 nt, Homo Sapiens; identical to SEQ ID NO: 280998

SEQ ID NO: 508193 - RNA, 64 nt, Homo Sapiens; identical to SEQ ID NO: 280999

SEQ ID NO: 508194 - RNA, 64 nt, Homo Sapiens; identical to SEQ ID NO: 281000

SEQ ID NO: 508195 - RNA, 64 nt, Homo Sapiens; identical to SEQ ID NO: 281001

SEQ ID NO: 508196 - RNA, 64 nt, Homo Sapiens; identical to SEQ ID NO: 281002

SEQ ID NO: 508197 - RNA, 64 nt, Homo Sapiens; identical to SEQ ID NO: 281003

SEQ ID NO: 508198 - RNA, 64 nt, Homo Sapiens; identical to SEQ ID NO: 281004

SEQ ID NO: 508199 - RNA, 64 nt, Homo Sapiens; identical to SEQ ID NO: 281005

SEQ ID NO: 508200 - RNA, 64 nt, Homo Sapiens; identical to SEQ ID NO: 281006

SEQ ID NO: 508201 - RNA, 64 nt, Homo Sapiens; identical to SEQ ID NO: 281007

SEQ ID NO: 508202 - RNA, 64 nt, Homo Sapiens; identical to SEQ ID NO: 281008

SEQ ID NO: 508203 - RNA, 64 nt, Homo Sapiens; identical to SEQ ID NO: 281009

SEQ ID NO: 508204 - RNA, 64 nt, Homo Sapiens; identical to SEQ ID NO: 281010

SEQ ID NO: 508205 - RNA, 64 nt, Homo Sapiens; identical to SEQ ID NO: 281011

SEQ ID NO: 508206 - RNA, 64 nt, Homo Sapiens; identical to SEQ ID NO: 281012

SEQ ID NO: 508207 - RNA, 64 nt, Homo Sapiens; identical to SEQ ID NO: 281013

SEQ ID NO: 508208 - RNA, 64 nt, Homo Sapiens; identical to SEQ ID NO: 281014

SEQ ID NO: 508209 - RNA, 64 nt, Homo Sapiens; identical to SEQ ID NO: 281015

SEQ ID NO: 508210 - RNA, 64 nt, Homo Sapiens; identical to SEQ ID NO: 281016

SEQ ID NO: 508211 - RNA, 64 nt, Homo Sapiens; identical to SEQ ID NO: 281017

SEQ ID NO: 508212 - RNA, 64 nt, Homo Sapiens; identical to SEQ ID NO: 281018

SEQ ID NO: 508213 - RNA, 64 nt, Homo Sapiens; identical to SEQ ID NO: 281019

SEQ ID NO: 508214 - RNA, 64 nt, Homo Sapiens; identical to SEQ ID NO: 281020

SEQ ID NO: 508215 - RNA, 64 nt, Homo Sapiens; identical to SEQ ID NO: 281021

SEQ ID NO: 508216 - RNA, 64 nt, Homo Sapiens; identical to SEQ ID NO: 281022

SEQ ID NO: 508217 - RNA, 64 nt, Homo Sapiens; identical to SEQ ID NO: 281023

SEQ ID NO: 508218 - RNA, 64 nt, Homo Sapiens; identical to SEQ ID NO: 281024

SEQ ID NO: 508219 - RNA, 64 nt, Homo Sapiens; identical to SEQ ID NO: 281025

SEQ ID NO: 508220 - RNA, 64 nt, Homo Sapiens; identical to SEQ ID NO: 281026

SEQ ID NO: 508221 - RNA, 64 nt, Homo Sapiens; identical to SEQ ID NO: 281027

SEQ ID NO: 508222 - RNA, 64 nt, Homo Sapiens; identical to SEQ ID NO: 281028

SEQ ID NO: 508223 - RNA, 64 nt, Homo Sapiens; identical to SEQ ID NO: 281029

SEQ ID NO: 508224 - RNA, 64 nt, Homo Sapiens; identical to SEQ ID NO: 281030

SEQ ID NO: 508225 - RNA, 64 nt, Homo Sapiens; identical to SEQ ID NO: 281031

SEQ ID NO: 508226 - RNA, 64 nt, Homo Sapiens; identical to SEQ ID NO: 281032

SEQ ID NO: 508227 - RNA, 64 nt, Homo Sapiens; identical to SEQ ID NO: 281033

SEQ ID NO: 508228 - RNA, 64 nt, Homo Sapiens; identical to SEQ ID NO: 281034

SEQ ID NO: 508229 - RNA, 64 nt, Homo Sapiens; identical to SEQ ID NO: 281035

SEQ ID NO: 508230 - RNA, 64 nt, Homo Sapiens; identical to SEQ ID NO: 281036

SEQ ID NO: 508231 - RNA, 64 nt, Homo Sapiens; identical to SEQ ID NO: 281037

SEQ ID NO: 508232 - RNA, 64 nt, Homo Sapiens; identical to SEQ ID NO: 281038

SEQ ID NO: 508233 - RNA, 64 nt, Homo Sapiens; identical to SEQ ID NO: 281039

SEQ ID NO: 508234 - RNA, 64 nt, Homo Sapiens; identical to SEQ ID NO: 281040

SEQ ID NO: 508235 - RNA, 64 nt, Homo Sapiens; identical to SEQ ID NO: 281041

SEQ ID NO: 508236 - RNA, 64 nt, Homo Sapiens; identical to SEQ ID NO: 281042

SEQ ID NO: 508237 - RNA, 64 nt, Homo Sapiens; identical to SEQ ID NO: 281043

SEQ ID NO: 508238 - RNA, 64 nt, Homo Sapiens; identical to SEQ ID NO: 281044

SEQ ID NO: 508239 - RNA, 64 nt, Homo Sapiens; identical to SEQ ID NO: 281045

SEQ ID NO: 508240 - RNA, 64 nt, Homo Sapiens; identical to SEQ ID NO: 281046

SEQ ID NO: 508241 - RNA, 64 nt, Homo Sapiens; identical to SEQ ID NO: 281047

SEQ ID NO: 508242 - RNA, 64 nt, Homo Sapiens; identical to SEQ ID NO: 281048

SEQ ID NO: 508243 - RNA, 64 nt, Homo Sapiens; identical to SEQ ID NO: 281049

SEQ ID NO: 508244 - RNA, 64 nt, Homo Sapiens; identical to SEQ ID NO: 281050

SEQ ID NO: 508245 - RNA, 64 nt, Homo Sapiens; identical to SEQ ID NO: 281051

SEQ ID NO: 508246 - RNA, 64 nt, Homo Sapiens; identical to SEQ ID NO: 281052

SEQ ID NO: 508247 - RNA, 64 nt, Homo Sapiens; identical to SEQ ID NO: 281053

SEQ ID NO: 508248 - RNA, 64 nt, Homo Sapiens; identical to SEQ ID NO: 281054

SEQ ID NO: 508249 - RNA, 64 nt, Homo Sapiens; identical to SEQ ID NO: 281055

SEQ ID NO: 508250 - RNA, 64 nt, Homo Sapiens; identical to SEQ ID NO: 281056

SEQ ID NO: 508251 - RNA, 64 nt, Homo Sapiens; identical to SEQ ID NO: 281057

SEQ ID NO: 508252 - RNA, 64 nt, Homo Sapiens; identical to SEQ ID NO: 281058

SEQ ID NO: 508253 - RNA, 64 nt, Homo Sapiens; identical to SEQ ID NO: 281059

SEQ ID NO: 508254 - RNA, 64 nt, Homo Sapiens; identical to SEQ ID NO: 281060

SEQ ID NO: 508255 - RNA, 64 nt, Homo Sapiens; identical to SEQ ID NO: 281061

SEQ ID NO: 508256 - RNA, 64 nt, Homo Sapiens; identical to SEQ ID NO: 281062

SEQ ID NO: 508257 - RNA, 64 nt, Homo Sapiens; identical to SEQ ID NO: 281063

SEQ ID NO: 508258 - RNA, 64 nt, Homo Sapiens; identical to SEQ ID NO: 281064

SEQ ID NO: 508259 - RNA, 64 nt, Homo Sapiens; identical to SEQ ID NO: 281065

SEQ ID NO: 508260 - RNA, 64 nt, Homo Sapiens; identical to SEQ ID NO: 281066

SEQ ID NO: 508261 - RNA, 64 nt, Homo Sapiens; identical to SEQ ID NO: 281067

SEQ ID NO: 508262 - RNA, 64 nt, Homo Sapiens; identical to SEQ ID NO: 281068

SEQ ID NO: 508263 - RNA, 64 nt, Homo Sapiens; identical to SEQ ID NO: 281069

SEQ ID NO: 508264 - RNA, 64 nt, Homo Sapiens; identical to SEQ ID NO: 281070

SEQ ID NO: 508265 - RNA, 64 nt, Homo Sapiens; identical to SEQ ID NO: 281071

SEQ ID NO: 508266 - RNA, 64 nt, Homo Sapiens; identical to SEQ ID NO: 281072

SEQ ID NO: 508267 - RNA, 64 nt, Homo Sapiens; identical to SEQ ID NO: 281073

SEQ ID NO: 508268 - RNA, 64 nt, Homo Sapiens; identical to SEQ ID NO: 281074

SEQ ID NO: 508269 - RNA, 64 nt, Homo Sapiens; identical to SEQ ID NO: 281075

SEQ ID NO: 508270 - RNA, 64 nt, Homo Sapiens; identical to SEQ ID NO: 281076

SEQ ID NO: 508271 - RNA, 64 nt, Homo Sapiens; identical to SEQ ID NO: 281077

SEQ ID NO: 508272 - RNA, 64 nt, Homo Sapiens; identical to SEQ ID NO: 281078

SEQ ID NO: 508273 - RNA, 64 nt, Homo Sapiens; identical to SEQ ID NO: 281079

SEQ ID NO: 508274 - RNA, 64 nt, Homo Sapiens; identical to SEQ ID NO: 281080

SEQ ID NO: 508275 - RNA, 64 nt, Homo Sapiens; identical to SEQ ID NO: 281081

SEQ ID NO: 508276 - RNA, 64 nt, Homo Sapiens; identical to SEQ ID NO: 281082

SEQ ID NO: 508277 - RNA, 64 nt, Homo Sapiens; identical to SEQ ID NO: 281083

SEQ ID NO: 508278 - RNA, 64 nt, Homo Sapiens; identical to SEQ ID NO: 281084

SEQ ID NO: 508279 - RNA, 64 nt, Homo Sapiens; identical to SEQ ID NO: 281085

SEQ ID NO: 508280 - RNA, 64 nt, Homo Sapiens; identical to SEQ ID NO: 281086

SEQ ID NO: 508281 - RNA, 64 nt, Homo Sapiens; identical to SEQ ID NO: 281087

SEQ ID NO: 508282 - RNA, 64 nt, Homo Sapiens; identical to SEQ ID NO: 281088

SEQ ID NO: 508283 - RNA, 64 nt, Homo Sapiens; identical to SEQ ID NO: 281089

SEQ ID NO: 508284 - RNA, 64 nt, Homo Sapiens; identical to SEQ ID NO: 281090

SEQ ID NO: 508285 - RNA, 64 nt, Homo Sapiens; identical to SEQ ID NO: 281091

SEQ ID NO: 508286 - RNA, 64 nt, Homo Sapiens; identical to SEQ ID NO: 281092

SEQ ID NO: 508287 - RNA, 64 nt, Homo Sapiens; identical to SEQ ID NO: 281093

SEQ ID NO: 508288 - RNA, 64 nt, Homo Sapiens; identical to SEQ ID NO: 281094

SEQ ID NO: 508289 - RNA, 64 nt, Homo Sapiens; identical to SEQ ID NO: 281095

SEQ ID NO: 508290 - RNA, 64 nt, Homo Sapiens; identical to SEQ ID NO: 281096

SEQ ID NO: 508291 - RNA, 64 nt, Homo Sapiens; identical to SEQ ID NO: 281097

SEQ ID NO: 508292 - RNA, 64 nt, Homo Sapiens; identical to SEQ ID NO: 281098

SEQ ID NO: 508293 - RNA, 64 nt, Homo Sapiens; identical to SEQ ID NO: 281099

SEQ ID NO: 508294 - RNA, 64 nt, Homo Sapiens; identical to SEQ ID NO: 281100

SEQ ID NO: 508295 - RNA, 64 nt, Homo Sapiens; identical to SEQ ID NO: 281101

SEQ ID NO: 508296 - RNA, 64 nt, Homo Sapiens; identical to SEQ ID NO: 281102

SEQ ID NO: 508297 - RNA, 64 nt, Homo Sapiens; identical to SEQ ID NO: 281103

SEQ ID NO: 508298 - RNA, 64 nt, Homo Sapiens; identical to SEQ ID NO: 265473

SEQ ID NO: 508299 - RNA, 64 nt, Homo Sapiens; identical to SEQ ID NO: 265474

SEQ ID NO: 508300 - RNA, 64 nt, Homo Sapiens; identical to SEQ ID NO: 265475

SEQ ID NO: 508301 - RNA, 64 nt, Homo Sapiens; identical to SEQ ID NO: 265476

SEQ ID NO: 508302 - RNA, 64 nt, Homo Sapiens; identical to SEQ ID NO: 265477

SEQ ID NO: 508303 - RNA, 64 nt, Homo Sapiens; identical to SEQ ID NO: 265478

SEQ ID NO: 508304 - RNA, 64 nt, Homo Sapiens; identical to SEQ ID NO: 265479

SEQ ID NO: 508305 - RNA, 64 nt, Homo Sapiens; identical to SEQ ID NO: 265480

SEQ ID NO: 508306 - RNA, 64 nt, Homo Sapiens; identical to SEQ ID NO: 265481

SEQ ID NO: 508307 - RNA, 60 nt, Homo Sapiens; identical to SEQ ID NO: 265482

SEQ ID NO: 508308 - RNA, 64 nt, Homo Sapiens; identical to SEQ ID NO: 265483

SEQ ID NO: 508309 - RNA, 64 nt, Homo Sapiens; identical to SEQ ID NO: 265484

SEQ ID NO: 508310 - RNA, 64 nt, Homo Sapiens; identical to SEQ ID NO: 265485

SEQ ID NO: 508311 - RNA, 64 nt, Homo Sapiens; identical to SEQ ID NO: 265486

SEQ ID NO: 508312 - RNA, 64 nt, Homo Sapiens; identical to SEQ ID NO: 265487

SEQ ID NO: 508313 - RNA, 64 nt, Homo Sapiens; identical to SEQ ID NO: 265488

SEQ ID NO: 508314 - RNA, 64 nt, Homo Sapiens; identical to SEQ ID NO: 265489

SEQ ID NO: 508315 - RNA, 64 nt, Homo Sapiens; identical to SEQ ID NO: 265490

SEQ ID NO: 508316 - RNA, 64 nt, Homo Sapiens; identical to SEQ ID NO: 265491

SEQ ID NO: 508317 - RNA, 64 nt, Homo Sapiens; identical to SEQ ID NO: 265492

SEQ ID NO: 508318 - RNA, 64 nt, Homo Sapiens; identical to SEQ ID NO: 265493

SEQ ID NO: 508319 - RNA, 64 nt, Homo Sapiens; identical to SEQ ID NO: 265494

SEQ ID NO: 508320 - RNA, 64 nt, Homo Sapiens; identical to SEQ ID NO: 265495

SEQ ID NO: 508321 - RNA, 64 nt, Homo Sapiens; identical to SEQ ID NO: 265496

SEQ ID NO: 508322 - RNA, 64 nt, Homo Sapiens; identical to SEQ ID NO: 265497

SEQ ID NO: 508323 - RNA, 64 nt, Homo Sapiens; identical to SEQ ID NO: 265498

SEQ ID NO: 508324 - RNA, 64 nt, Homo Sapiens; identical to SEQ ID NO: 265499

SEQ ID NO: 508325 - RNA, 64 nt, Homo Sapiens; identical to SEQ ID NO: 265500

SEQ ID NO: 508326 - RNA, 64 nt, Homo Sapiens; identical to SEQ ID NO: 265501

SEQ ID NO: 508327 - RNA, 64 nt, Homo Sapiens; identical to SEQ ID NO: 265502

SEQ ID NO: 508328 - RNA, 64 nt, Homo Sapiens; identical to SEQ ID NO: 265503

SEQ ID NO: 508329 - RNA, 64 nt, Homo Sapiens; identical to SEQ ID NO: 265504

SEQ ID NO: 508330 - RNA, 64 nt, Homo Sapiens; identical to SEQ ID NO: 265505

SEQ ID NO: 508331 - RNA, 64 nt, Homo Sapiens; identical to SEQ ID NO: 265506

SEQ ID NO: 508332 - RNA, 64 nt, Homo Sapiens; identical to SEQ ID NO: 265507

SEQ ID NO: 508333 - RNA, 64 nt, Homo Sapiens; identical to SEQ ID NO: 265508

SEQ ID NO: 508334 - RNA, 64 nt, Homo Sapiens; identical to SEQ ID NO: 265509

SEQ ID NO: 508335 - RNA, 64 nt, Homo Sapiens; identical to SEQ ID NO: 265510

SEQ ID NO: 508336 - RNA, 64 nt, Homo Sapiens; identical to SEQ ID NO: 265511

SEQ ID NO: 508337 - RNA, 64 nt, Homo Sapiens; identical to SEQ ID NO: 265512

SEQ ID NO: 508338 - RNA, 64 nt, Homo Sapiens; identical to SEQ ID NO: 265513

SEQ ID NO: 508339 - RNA, 64 nt, Homo Sapiens; identical to SEQ ID NO: 265514

SEQ ID NO: 508340 - RNA, 64 nt, Homo Sapiens; identical to SEQ ID NO: 265515

SEQ ID NO: 508341 - RNA, 64 nt, Homo Sapiens; identical to SEQ ID NO: 265516

SEQ ID NO: 508342 - RNA, 64 nt, Homo Sapiens; identical to SEQ ID NO: 265517

SEQ ID NO: 508343 - RNA, 64 nt, Homo Sapiens; identical to SEQ ID NO: 265518

SEQ ID NO: 508344 - RNA, 64 nt, Homo Sapiens; identical to SEQ ID NO: 265519

SEQ ID NO: 508345 - RNA, 64 nt, Homo Sapiens; identical to SEQ ID NO: 265520

SEQ ID NO: 508346 - RNA, 64 nt, Homo Sapiens; identical to SEQ ID NO: 265521

SEQ ID NO: 508347 - RNA, 64 nt, Homo Sapiens; identical to SEQ ID NO: 265522

SEQ ID NO: 508348 - RNA, 64 nt, Homo Sapiens; identical to SEQ ID NO: 265523

SEQ ID NO: 508349 - RNA, 64 nt, Homo Sapiens; identical to SEQ ID NO: 265524

SEQ ID NO: 508350 - RNA, 64 nt, Homo Sapiens; identical to SEQ ID NO: 265525

SEQ ID NO: 508351 - RNA, 64 nt, Homo Sapiens; identical to SEQ ID NO: 265526

SEQ ID NO: 508352 - RNA, 64 nt, Homo Sapiens; identical to SEQ ID NO: 265527

SEQ ID NO: 508353 - RNA, 64 nt, Homo Sapiens; identical to SEQ ID NO: 265528

SEQ ID NO: 508354 - RNA, 64 nt, Homo Sapiens; identical to SEQ ID NO: 265529

SEQ ID NO: 508355 - RNA, 64 nt, Homo Sapiens; identical to SEQ ID NO: 265530

SEQ ID NO: 508356 - RNA, 64 nt, Homo Sapiens; identical to SEQ ID NO: 265531

SEQ ID NO: 508357 - RNA, 64 nt, Homo Sapiens; identical to SEQ ID NO: 265532

SEQ ID NO: 508358 - RNA, 64 nt, Homo Sapiens; identical to SEQ ID NO: 265533

SEQ ID NO: 508359 - RNA, 64 nt, Homo Sapiens; identical to SEQ ID NO: 265534

SEQ ID NO: 508360 - RNA, 64 nt, Homo Sapiens; identical to SEQ ID NO: 265535

SEQ ID NO: 508361 - RNA, 64 nt, Homo Sapiens; identical to SEQ ID NO: 265536

SEQ ID NO: 508362 - RNA, 64 nt, Homo Sapiens; identical to SEQ ID NO: 265537

SEQ ID NO: 508363 - RNA, 64 nt, Homo Sapiens; identical to SEQ ID NO: 265538

SEQ ID NO: 508364 - RNA, 64 nt, Homo Sapiens; identical to SEQ ID NO: 265539

SEQ ID NO: 508365 - RNA, 64 nt, Homo Sapiens; identical to SEQ ID NO: 265540

SEQ ID NO: 508366 - RNA, 64 nt, Homo Sapiens; identical to SEQ ID NO: 265541

SEQ ID NO: 508367 - RNA, 64 nt, Homo Sapiens; identical to SEQ ID NO: 265542

SEQ ID NO: 508368 - RNA, 64 nt, Homo Sapiens; identical to SEQ ID NO: 265543

SEQ ID NO: 508369 - RNA, 64 nt, Homo Sapiens; identical to SEQ ID NO: 265544

SEQ ID NO: 508370 - RNA, 64 nt, Homo Sapiens; identical to SEQ ID NO: 265545

SEQ ID NO: 508371 - RNA, 64 nt, Homo Sapiens; identical to SEQ ID NO: 265546

SEQ ID NO: 508372 - RNA, 64 nt, Homo Sapiens; identical to SEQ ID NO: 265547

SEQ ID NO: 508373 - RNA, 64 nt, Homo Sapiens; identical to SEQ ID NO: 265548

SEQ ID NO: 508374 - RNA, 64 nt, Homo Sapiens; identical to SEQ ID NO: 265549

SEQ ID NO: 508375 - RNA, 64 nt, Homo Sapiens; identical to SEQ ID NO: 265550

SEQ ID NO: 508376 - RNA, 64 nt, Homo Sapiens; identical to SEQ ID NO: 265551

SEQ ID NO: 508377 - RNA, 64 nt, Homo Sapiens; identical to SEQ ID NO: 265552

SEQ ID NO: 508378 - RNA, 64 nt, Homo Sapiens; identical to SEQ ID NO: 265553

SEQ ID NO: 508379 - RNA, 64 nt, Homo Sapiens; identical to SEQ ID NO: 265554

SEQ ID NO: 508380 - RNA, 64 nt, Homo Sapiens; identical to SEQ ID NO: 265555

SEQ ID NO: 508381 - RNA, 64 nt, Homo Sapiens; identical to SEQ ID NO: 265556

SEQ ID NO: 508382 - RNA, 64 nt, Homo Sapiens; identical to SEQ ID NO: 265557

SEQ ID NO: 508383 - RNA, 64 nt, Homo Sapiens; identical to SEQ ID NO: 265558

SEQ ID NO: 508384 - RNA, 64 nt, Homo Sapiens; identical to SEQ ID NO: 265559

SEQ ID NO: 508385 - RNA, 64 nt, Homo Sapiens; identical to SEQ ID NO: 265560

SEQ ID NO: 508386 - RNA, 64 nt, Homo Sapiens; identical to SEQ ID NO: 265561

SEQ ID NO: 508387 - RNA, 64 nt, Homo Sapiens; identical to SEQ ID NO: 265562

SEQ ID NO: 508388 - RNA, 64 nt, Homo Sapiens; identical to SEQ ID NO: 265563

SEQ ID NO: 508389 - RNA, 64 nt, Homo Sapiens; identical to SEQ ID NO: 265564

SEQ ID NO: 508390 - RNA, 64 nt, Homo Sapiens; identical to SEQ ID NO: 265565

SEQ ID NO: 508391 - RNA, 64 nt, Homo Sapiens; identical to SEQ ID NO: 265566

SEQ ID NO: 508392 - RNA, 64 nt, Homo Sapiens; identical to SEQ ID NO: 265567

SEQ ID NO: 508393 - RNA, 64 nt, Homo Sapiens; identical to SEQ ID NO: 265568

SEQ ID NO: 508394 - RNA, 64 nt, Homo Sapiens; identical to SEQ ID NO: 265569

SEQ ID NO: 508395 - RNA, 64 nt, Homo Sapiens; identical to SEQ ID NO: 265570

SEQ ID NO: 508396 - RNA, 64 nt, Homo Sapiens; identical to SEQ ID NO: 265571

SEQ ID NO: 508397 - RNA, 64 nt, Homo Sapiens; identical to SEQ ID NO: 265572

SEQ ID NO: 508398 - RNA, 64 nt, Homo Sapiens; identical to SEQ ID NO: 265573

SEQ ID NO: 508399 - RNA, 64 nt, Homo Sapiens; identical to SEQ ID NO: 265574

SEQ ID NO: 508400 - RNA, 64 nt, Homo Sapiens
augaagaaggcaaaaaacuuaaaacuccacuguacacuuauagaacauaucauguagcuucuga

SEQ ID NO: 508401 - RNA, 64 nt, Homo Sapiens
agggauaauuuuucuuuuuuuuuuuuuuuucuuucacuuauauaacugaguggcuggaaugcuu

SEQ ID NO: 508402 - RNA, 64 nt, Homo Sapiens
aacuuauuuuucaccagguuauuguuuauuauaccacuuauaucgacaguaaccauuucagugu

SEQ ID NO: 508403 - RNA, 64 nt, Homo Sapiens
aaauggggacauucacuauacaccauuauaaaaacacuuauaguauguuccuuuauuuaggaaa

SEQ ID NO: 508404 - RNA, 64 nt, Homo Sapiens; identical to SEQ ID NO: 99376

SEQ ID NO: 508405 - RNA, 64 nt, Homo Sapiens; identical to SEQ ID NO: 99377

SEQ ID NO: 508406 - RNA, 64 nt, Homo Sapiens; identical to SEQ ID NO: 99378

SEQ ID NO: 508407 - RNA, 64 nt, Homo Sapiens; identical to SEQ ID NO: 99379

SEQ ID NO: 508408 - RNA, 64 nt, Homo Sapiens; identical to SEQ ID NO: 99380

SEQ ID NO: 508409 - RNA, 64 nt, Homo Sapiens; identical to SEQ ID NO: 99381

SEQ ID NO: 508410 - RNA, 64 nt, Homo Sapiens; identical to SEQ ID NO: 99382

SEQ ID NO: 508411 - RNA, 64 nt, Homo Sapiens; identical to SEQ ID NO: 99383

SEQ ID NO: 508412 - RNA, 64 nt, Homo Sapiens; identical to SEQ ID NO: 99384

SEQ ID NO: 508413 - RNA, 64 nt, Homo Sapiens; identical to SEQ ID NO: 99385

SEQ ID NO: 508414 - RNA, 64 nt, Homo Sapiens; identical to SEQ ID NO: 99386

SEQ ID NO: 508415 - RNA, 64 nt, Homo Sapiens; identical to SEQ ID NO: 99387

SEQ ID NO: 508416 - RNA, 64 nt, Homo Sapiens; identical to SEQ ID NO: 99388

SEQ ID NO: 508417 - RNA, 64 nt, Homo Sapiens; identical to SEQ ID NO: 99389

SEQ ID NO: 508418 - RNA, 64 nt, Homo Sapiens; identical to SEQ ID NO: 99390

SEQ ID NO: 508419 - RNA, 64 nt, Homo Sapiens; identical to SEQ ID NO: 99391

SEQ ID NO: 508420 - RNA, 64 nt, Homo Sapiens; identical to SEQ ID NO: 99392

SEQ ID NO: 508421 - RNA, 64 nt, Homo Sapiens; identical to SEQ ID NO: 99393

SEQ ID NO: 508422 - RNA, 64 nt, Homo Sapiens; identical to SEQ ID NO: 99394

SEQ ID NO: 508423 - RNA, 64 nt, Homo Sapiens; identical to SEQ ID NO: 99395

SEQ ID NO: 508424 - RNA, 64 nt, Homo Sapiens; identical to SEQ ID NO: 99396

SEQ ID NO: 508425 - RNA, 64 nt, Homo Sapiens; identical to SEQ ID NO: 99397

SEQ ID NO: 508426 - RNA, 64 nt, Homo Sapiens; identical to SEQ ID NO: 99398

SEQ ID NO: 508427 - RNA, 64 nt, Homo Sapiens; identical to SEQ ID NO: 99399

SEQ ID NO: 508428 - RNA, 64 nt, Homo Sapiens; identical to SEQ ID NO: 99400

SEQ ID NO: 508429 - RNA, 64 nt, Homo Sapiens; identical to SEQ ID NO: 99401

SEQ ID NO: 508430 - RNA, 64 nt, Homo Sapiens; identical to SEQ ID NO: 99402

SEQ ID NO: 508431 - RNA, 64 nt, Homo Sapiens; identical to SEQ ID NO: 99403

SEQ ID NO: 508432 - RNA, 64 nt, Homo Sapiens; identical to SEQ ID NO: 99404

SEQ ID NO: 508433 - RNA, 64 nt, Homo Sapiens; identical to SEQ ID NO: 99405

SEQ ID NO: 508434 - RNA, 64 nt, Homo Sapiens; identical to SEQ ID NO: 99406

SEQ ID NO: 508435 - RNA, 64 nt, Homo Sapiens; identical to SEQ ID NO: 99407

SEQ ID NO: 508436 - RNA, 64 nt, Homo Sapiens; identical to SEQ ID NO: 99408

SEQ ID NO: 508437 - RNA, 64 nt, Homo Sapiens; identical to SEQ ID NO: 99409

SEQ ID NO: 508438 - RNA, 64 nt, Homo Sapiens; identical to SEQ ID NO: 99410

SEQ ID NO: 508439 - RNA, 64 nt, Homo Sapiens; identical to SEQ ID NO: 99411

SEQ ID NO: 508440 - RNA, 64 nt, Homo Sapiens; identical to SEQ ID NO: 99412

SEQ ID NO: 508441 - RNA, 64 nt, Homo Sapiens; identical to SEQ ID NO: 99413

SEQ ID NO: 508442 - RNA, 64 nt, Homo Sapiens; identical to SEQ ID NO: 99414

SEQ ID NO: 508443 - RNA, 64 nt, Homo Sapiens; identical to SEQ ID NO: 99415

SEQ ID NO: 508444 - RNA, 64 nt, Homo Sapiens; identical to SEQ ID NO: 99416

SEQ ID NO: 508445 - RNA, 64 nt, Homo Sapiens; identical to SEQ ID NO: 99417

SEQ ID NO: 508446 - RNA, 64 nt, Homo Sapiens; identical to SEQ ID NO: 99418

SEQ ID NO: 508447 - RNA, 64 nt, Homo Sapiens; identical to SEQ ID NO: 99419

SEQ ID NO: 508448 - RNA, 64 nt, Homo Sapiens; identical to SEQ ID NO: 99420

SEQ ID NO: 508449 - RNA, 64 nt, Homo Sapiens; identical to SEQ ID NO: 99421

SEQ ID NO: 508450 - RNA, 64 nt, Homo Sapiens; identical to SEQ ID NO: 99422

SEQ ID NO: 508451 - RNA, 64 nt, Homo Sapiens; identical to SEQ ID NO: 99423

SEQ ID NO: 508452 - RNA, 64 nt, Homo Sapiens; identical to SEQ ID NO: 99424

SEQ ID NO: 508453 - RNA, 64 nt, Homo Sapiens; identical to SEQ ID NO: 99425

SEQ ID NO: 508454 - RNA, 64 nt, Homo Sapiens; identical to SEQ ID NO: 99426

SEQ ID NO: 508455 - RNA, 64 nt, Homo Sapiens; identical to SEQ ID NO: 99427

SEQ ID NO: 508456 - RNA, 64 nt, Homo Sapiens; identical to SEQ ID NO: 99428

SEQ ID NO: 508457 - RNA, 64 nt, Homo Sapiens; identical to SEQ ID NO: 99429

SEQ ID NO: 508458 - RNA, 64 nt, Homo Sapiens; identical to SEQ ID NO: 99430

SEQ ID NO: 508459 - RNA, 64 nt, Homo Sapiens; identical to SEQ ID NO: 99431

SEQ ID NO: 508460 - RNA, 64 nt, Homo Sapiens; identical to SEQ ID NO: 99432

SEQ ID NO: 508461 - RNA, 64 nt, Homo Sapiens; identical to SEQ ID NO: 99433

SEQ ID NO: 508462 - RNA, 64 nt, Homo Sapiens; identical to SEQ ID NO: 99434

SEQ ID NO: 508463 - RNA, 64 nt, Homo Sapiens; identical to SEQ ID NO: 99435

SEQ ID NO: 508464 - RNA, 64 nt, Homo Sapiens; identical to SEQ ID NO: 99436

SEQ ID NO: 508465 - RNA, 64 nt, Homo Sapiens; identical to SEQ ID NO: 99437

SEQ ID NO: 508466 - RNA, 64 nt, Homo Sapiens; identical to SEQ ID NO: 99438

SEQ ID NO: 508467 - RNA, 64 nt, Homo Sapiens; identical to SEQ ID NO: 99439

SEQ ID NO: 508468 - RNA, 64 nt, Homo Sapiens; identical to SEQ ID NO: 99440

SEQ ID NO: 508469 - RNA, 64 nt, Homo Sapiens; identical to SEQ ID NO: 99441

SEQ ID NO: 508470 - RNA, 64 nt, Homo Sapiens; identical to SEQ ID NO: 99442

SEQ ID NO: 508471 - RNA, 64 nt, Homo Sapiens; identical to SEQ ID NO: 99443

SEQ ID NO: 508472 - RNA, 64 nt, Homo Sapiens; identical to SEQ ID NO: 99444

SEQ ID NO: 508473 - RNA, 64 nt, Homo Sapiens; identical to SEQ ID NO: 99445

SEQ ID NO: 508474 - RNA, 64 nt, Homo Sapiens; identical to SEQ ID NO: 99446

SEQ ID NO: 508475 - RNA, 64 nt, Homo Sapiens; identical to SEQ ID NO: 99447

SEQ ID NO: 508476 - RNA, 64 nt, Homo Sapiens; identical to SEQ ID NO: 99448

SEQ ID NO: 508477 - RNA, 64 nt, Homo Sapiens; identical to SEQ ID NO: 99449

SEQ ID NO: 508478 - RNA, 64 nt, Homo Sapiens; identical to SEQ ID NO: 99450

SEQ ID NO: 508479 - RNA, 64 nt, Homo Sapiens; identical to SEQ ID NO: 99451

SEQ ID NO: 508480 - RNA, 64 nt, Homo Sapiens; identical to SEQ ID NO: 99452

SEQ ID NO: 508481 - RNA, 64 nt, Homo Sapiens; identical to SEQ ID NO: 99453

SEQ ID NO: 508482 - RNA, 64 nt, Homo Sapiens; identical to SEQ ID NO: 99454

SEQ ID NO: 508483 - RNA, 64 nt, Homo Sapiens; identical to SEQ ID NO: 99455

SEQ ID NO: 508484 - RNA, 64 nt, Homo Sapiens; identical to SEQ ID NO: 99456

SEQ ID NO: 508485 - RNA, 64 nt, Homo Sapiens; identical to SEQ ID NO: 99457

SEQ ID NO: 508486 - RNA, 64 nt, Homo Sapiens; identical to SEQ ID NO: 99458

SEQ ID NO: 508487 - RNA, 64 nt, Homo Sapiens; identical to SEQ ID NO: 99459

SEQ ID NO: 508488 - RNA, 64 nt, Homo Sapiens; identical to SEQ ID NO: 99460

SEQ ID NO: 508489 - RNA, 64 nt, Homo Sapiens; identical to SEQ ID NO: 99461

SEQ ID NO: 508490 - RNA, 64 nt, Homo Sapiens; identical to SEQ ID NO: 99462

SEQ ID NO: 508491 - RNA, 64 nt, Homo Sapiens; identical to SEQ ID NO: 99463

SEQ ID NO: 508492 - RNA, 64 nt, Homo Sapiens; identical to SEQ ID NO: 99464

SEQ ID NO: 508493 - RNA, 64 nt, Homo Sapiens; identical to SEQ ID NO: 99465

SEQ ID NO: 508494 - RNA, 64 nt, Homo Sapiens; identical to SEQ ID NO: 99466

SEQ ID NO: 508495 - RNA, 64 nt, Homo Sapiens; identical to SEQ ID NO: 99467

SEQ ID NO: 508496 - RNA, 64 nt, Homo Sapiens; identical to SEQ ID NO: 99468

SEQ ID NO: 508497 - RNA, 64 nt, Homo Sapiens; identical to SEQ ID NO: 99469

SEQ ID NO: 508498 - RNA, 64 nt, Homo Sapiens; identical to SEQ ID NO: 99470

SEQ ID NO: 508499 - RNA, 64 nt, Homo Sapiens; identical to SEQ ID NO: 99471

SEQ ID NO: 508500 - RNA, 64 nt, Homo Sapiens; identical to SEQ ID NO: 99472

SEQ ID NO: 508501 - RNA, 64 nt, Homo Sapiens; identical to SEQ ID NO: 99473

SEQ ID NO: 508502 - RNA, 64 nt, Homo Sapiens; identical to SEQ ID NO: 99474

SEQ ID NO: 508503 - RNA, 64 nt, Homo Sapiens; identical to SEQ ID NO: 99475

SEQ ID NO: 508504 - RNA, 64 nt, Homo Sapiens; identical to SEQ ID NO: 99476

SEQ ID NO: 508505 - RNA, 64 nt, Homo Sapiens; identical to SEQ ID NO: 99477

SEQ ID NO: 508506 - RNA, 64 nt, Homo Sapiens; identical to SEQ ID NO: 99478

SEQ ID NO: 508507 - RNA, 64 nt, Homo Sapiens; identical to SEQ ID NO: 99479

SEQ ID NO: 508508 - RNA, 64 nt, Homo Sapiens; identical to SEQ ID NO: 99480

SEQ ID NO: 508509 - RNA, 64 nt, Homo Sapiens; identical to SEQ ID NO: 99481

SEQ ID NO: 508510 - RNA, 64 nt, Homo Sapiens; identical to SEQ ID NO: 99482

SEQ ID NO: 508511 - RNA, 64 nt, Homo Sapiens; identical to SEQ ID NO: 99483

SEQ ID NO: 508512 - RNA, 64 nt, Homo Sapiens; identical to SEQ ID NO: 99484

SEQ ID NO: 508513 - RNA, 64 nt, Homo Sapiens; identical to SEQ ID NO: 99485

SEQ ID NO: 508514 - RNA, 64 nt, Homo Sapiens; identical to SEQ ID NO: 99486

SEQ ID NO: 508515 - RNA, 64 nt, Homo Sapiens; identical to SEQ ID NO: 99487

SEQ ID NO: 508516 - RNA, 64 nt, Homo Sapiens
agccauucuccauguccccuucucccucuucucagaucaaaaucccuagggaguucuauuuuua

SEQ ID NO: 508517 - RNA, 64 nt, Homo Sapiens
ugagagggcacagacuuguggagcugggcgucuggaucaaaacugcuuugggauggaaccucga

SEQ ID NO: 508518 - RNA, 64 nt, Homo Sapiens
aacaaacaaaaaaaacaaggacaucauuuuaaaagaucaaaacaaacacuaguccugauaauaa

SEQ ID NO: 508519 - RNA, 64 nt, Homo Sapiens
uaagaacuacccuguagccaaccagugagagggagaucaaaagcaagauggcaaaauuguuuac

SEQ ID NO: 508520 - RNA, 64 nt, Homo Sapiens
cgaguacuguguuuauucucucuccaggaaagcagaucaaaagaaaguuagcagaucgaguguc

SEQ ID NO: 508521 - RNA, 64 nt, Homo Sapiens
ucuagcccucucaguuaccagcucuuuggagaaggaucaaaauucagauggaaugugggauggg

SEQ ID NO: 508522 - RNA, 64 nt, Homo Sapiens
gcauacccuaacaucaccaugggaaagcaggaaagaucaaaaacauagcacuaaaugcccacaa

SEQ ID NO: 508523 - RNA, 64 nt, Homo Sapiens
gacuuagacucccacauaguggucuuuaaagugugaucaaaagaucuuugcgcuucuaccuuuu

SEQ ID NO: 508524 - RNA, 64 nt, Homo Sapiens
uagaacuuauaugaauuugauuuauauuuugcaagaucaaaaauuagauguuaaguaucagauu

SEQ ID NO: 508525 - RNA, 64 nt, Homo Sapiens
gaauaagagaaacaaauuauaucaagguaaaacugaucaaaagcauaauugaaaguucugaaaa

SEQ ID NO: 508526 - RNA, 64 nt, Homo Sapiens; identical to SEQ ID NO: 411751

SEQ ID NO: 508527 - RNA, 64 nt, Homo Sapiens; identical to SEQ ID NO: 411752

SEQ ID NO: 508528 - RNA, 64 nt, Homo Sapiens; identical to SEQ ID NO: 411753

SEQ ID NO: 508529 - RNA, 64 nt, Homo Sapiens; identical to SEQ ID NO: 411754

SEQ ID NO: 508530 - RNA, 64 nt, Homo Sapiens; identical to SEQ ID NO: 411755

SEQ ID NO: 508531 - RNA, 64 nt, Homo Sapiens; identical to SEQ ID NO: 411756

SEQ ID NO: 508532 - RNA, 64 nt, Homo Sapiens; identical to SEQ ID NO: 411757

SEQ ID NO: 508533 - RNA, 64 nt, Homo Sapiens; identical to SEQ ID NO: 411758

SEQ ID NO: 508534 - RNA, 64 nt, Homo Sapiens; identical to SEQ ID NO: 411759

SEQ ID NO: 508535 - RNA, 64 nt, Homo Sapiens; identical to SEQ ID NO: 411760

SEQ ID NO: 508536 - RNA, 64 nt, Homo Sapiens; identical to SEQ ID NO: 411761

SEQ ID NO: 508537 - RNA, 64 nt, Homo Sapiens; identical to SEQ ID NO: 411762

SEQ ID NO: 508538 - RNA, 64 nt, Homo Sapiens; identical to SEQ ID NO: 411763

SEQ ID NO: 508539 - RNA, 64 nt, Homo Sapiens; identical to SEQ ID NO: 411764

SEQ ID NO: 508540 - RNA, 64 nt, Homo Sapiens; identical to SEQ ID NO: 411765

SEQ ID NO: 508541 - RNA, 64 nt, Homo Sapiens; identical to SEQ ID NO: 411766

SEQ ID NO: 508542 - RNA, 64 nt, Homo Sapiens; identical to SEQ ID NO: 411767

SEQ ID NO: 508543 - RNA, 64 nt, Homo Sapiens; identical to SEQ ID NO: 411768

SEQ ID NO: 508544 - RNA, 64 nt, Homo Sapiens; identical to SEQ ID NO: 411769

SEQ ID NO: 508545 - RNA, 64 nt, Homo Sapiens; identical to SEQ ID NO: 411770

SEQ ID NO: 508546 - RNA, 64 nt, Homo Sapiens; identical to SEQ ID NO: 92076

SEQ ID NO: 508547 - RNA, 64 nt, Homo Sapiens; identical to SEQ ID NO: 92077

SEQ ID NO: 508548 - RNA, 64 nt, Homo Sapiens; identical to SEQ ID NO: 92078

SEQ ID NO: 508549 - RNA, 64 nt, Homo Sapiens; identical to SEQ ID NO: 92079

SEQ ID NO: 508550 - RNA, 64 nt, Homo Sapiens; identical to SEQ ID NO: 92080

SEQ ID NO: 508551 - RNA, 64 nt, Homo Sapiens; identical to SEQ ID NO: 92081

SEQ ID NO: 508552 - RNA, 62 nt, Homo Sapiens; identical to SEQ ID NO: 92082

SEQ ID NO: 508553 - RNA, 64 nt, Homo Sapiens; identical to SEQ ID NO: 92083

SEQ ID NO: 508554 - RNA, 64 nt, Homo Sapiens; identical to SEQ ID NO: 92084

SEQ ID NO: 508555 - RNA, 64 nt, Homo Sapiens; identical to SEQ ID NO: 92085

SEQ ID NO: 508556 - RNA, 64 nt, Homo Sapiens; identical to SEQ ID NO: 92086

SEQ ID NO: 508557 - RNA, 64 nt, Homo Sapiens; identical to SEQ ID NO: 92087

SEQ ID NO: 508558 - RNA, 64 nt, Homo Sapiens; identical to SEQ ID NO: 92088

SEQ ID NO: 508559 - RNA, 64 nt, Homo Sapiens; identical to SEQ ID NO: 92089

SEQ ID NO: 508560 - RNA, 64 nt, Homo Sapiens; identical to SEQ ID NO: 92090

SEQ ID NO: 508561 - RNA, 64 nt, Homo Sapiens; identical to SEQ ID NO: 92091

SEQ ID NO: 508562 - RNA, 64 nt, Homo Sapiens; identical to SEQ ID NO: 92092

SEQ ID NO: 508563 - RNA, 64 nt, Homo Sapiens; identical to SEQ ID NO: 92093

SEQ ID NO: 508564 - RNA, 64 nt, Homo Sapiens; identical to SEQ ID NO: 92094

SEQ ID NO: 508565 - RNA, 64 nt, Homo Sapiens; identical to SEQ ID NO: 92095

SEQ ID NO: 508566 - RNA, 64 nt, Homo Sapiens; identical to SEQ ID NO: 92096

SEQ ID NO: 508567 - RNA, 64 nt, Homo Sapiens; identical to SEQ ID NO: 92097

SEQ ID NO: 508568 - RNA, 64 nt, Homo Sapiens; identical to SEQ ID NO: 92098

SEQ ID NO: 508569 - RNA, 64 nt, Homo Sapiens; identical to SEQ ID NO: 92099

SEQ ID NO: 508570 - RNA, 64 nt, Homo Sapiens; identical to SEQ ID NO: 92100

SEQ ID NO: 508571 - RNA, 64 nt, Homo Sapiens; identical to SEQ ID NO: 92101

SEQ ID NO: 508572 - RNA, 64 nt, Homo Sapiens; identical to SEQ ID NO: 92102

SEQ ID NO: 508573 - RNA, 64 nt, Homo Sapiens; identical to SEQ ID NO: 92103

SEQ ID NO: 508574 - RNA, 64 nt, Homo Sapiens; identical to SEQ ID NO: 92104

SEQ ID NO: 508575 - RNA, 64 nt, Homo Sapiens; identical to SEQ ID NO: 92105

SEQ ID NO: 508576 - RNA, 64 nt, Homo Sapiens; identical to SEQ ID NO: 92106

SEQ ID NO: 508577 - RNA, 64 nt, Homo Sapiens; identical to SEQ ID NO: 92107

SEQ ID NO: 508578 - RNA, 64 nt, Homo Sapiens; identical to SEQ ID NO: 92108

SEQ ID NO: 508579 - RNA, 64 nt, Homo Sapiens; identical to SEQ ID NO: 92109

SEQ ID NO: 508580 - RNA, 64 nt, Homo Sapiens; identical to SEQ ID NO: 92110

SEQ ID NO: 508581 - RNA, 64 nt, Homo Sapiens; identical to SEQ ID NO: 92111

SEQ ID NO: 508582 - RNA, 64 nt, Homo Sapiens; identical to SEQ ID NO: 92112

SEQ ID NO: 508583 - RNA, 64 nt, Homo Sapiens; identical to SEQ ID NO: 92113

SEQ ID NO: 508584 - RNA, 64 nt, Homo Sapiens; identical to SEQ ID NO: 92114

SEQ ID NO: 508585 - RNA, 64 nt, Homo Sapiens; identical to SEQ ID NO: 92115

SEQ ID NO: 508586 - RNA, 64 nt, Homo Sapiens; identical to SEQ ID NO: 92116

SEQ ID NO: 508587 - RNA, 64 nt, Homo Sapiens; identical to SEQ ID NO: 92117

SEQ ID NO: 508588 - RNA, 64 nt, Homo Sapiens; identical to SEQ ID NO: 92118

SEQ ID NO: 508589 - RNA, 64 nt, Homo Sapiens; identical to SEQ ID NO: 92119

SEQ ID NO: 508590 - RNA, 64 nt, Homo Sapiens; identical to SEQ ID NO: 92120

SEQ ID NO: 508591 - RNA, 64 nt, Homo Sapiens; identical to SEQ ID NO: 92121

SEQ ID NO: 508592 - RNA, 64 nt, Homo Sapiens; identical to SEQ ID NO: 92122

SEQ ID NO: 508593 - RNA, 64 nt, Homo Sapiens; identical to SEQ ID NO: 92123

SEQ ID NO: 508594 - RNA, 64 nt, Homo Sapiens; identical to SEQ ID NO: 92124

SEQ ID NO: 508595 - RNA, 64 nt, Homo Sapiens; identical to SEQ ID NO: 92125

SEQ ID NO: 508596 - RNA, 64 nt, Homo Sapiens; identical to SEQ ID NO: 92126

SEQ ID NO: 508597 - RNA, 64 nt, Homo Sapiens; identical to SEQ ID NO: 92127

SEQ ID NO: 508598 - RNA, 64 nt, Homo Sapiens; identical to SEQ ID NO: 92128

SEQ ID NO: 508599 - RNA, 64 nt, Homo Sapiens; identical to SEQ ID NO: 92129

SEQ ID NO: 508600 - RNA, 64 nt, Homo Sapiens; identical to SEQ ID NO: 92130

SEQ ID NO: 508601 - RNA, 64 nt, Homo Sapiens; identical to SEQ ID NO: 92131

SEQ ID NO: 508602 - RNA, 64 nt, Homo Sapiens; identical to SEQ ID NO: 92132

SEQ ID NO: 508603 - RNA, 64 nt, Homo Sapiens; identical to SEQ ID NO: 92133

SEQ ID NO: 508604 - RNA, 64 nt, Homo Sapiens; identical to SEQ ID NO: 92134

SEQ ID NO: 508605 - RNA, 64 nt, Homo Sapiens; identical to SEQ ID NO: 92135

SEQ ID NO: 508606 - RNA, 64 nt, Homo Sapiens; identical to SEQ ID NO: 92136

SEQ ID NO: 508607 - RNA, 64 nt, Homo Sapiens; identical to SEQ ID NO: 301439

SEQ ID NO: 508608 - RNA, 64 nt, Homo Sapiens; identical to SEQ ID NO: 301440

SEQ ID NO: 508609 - RNA, 64 nt, Homo Sapiens; identical to SEQ ID NO: 301441

SEQ ID NO: 508610 - RNA, 64 nt, Homo Sapiens; identical to SEQ ID NO: 301442

SEQ ID NO: 508611 - RNA, 64 nt, Homo Sapiens; identical to SEQ ID NO: 301443

SEQ ID NO: 508612 - RNA, 64 nt, Homo Sapiens; identical to SEQ ID NO: 301444

SEQ ID NO: 508613 - RNA, 64 nt, Homo Sapiens; identical to SEQ ID NO: 301445

SEQ ID NO: 508614 - RNA, 64 nt, Homo Sapiens; identical to SEQ ID NO: 301446

SEQ ID NO: 508615 - RNA, 64 nt, Homo Sapiens; identical to SEQ ID NO: 301447

SEQ ID NO: 508616 - RNA, 64 nt, Homo Sapiens; identical to SEQ ID NO: 301448

SEQ ID NO: 508617 - RNA, 64 nt, Homo Sapiens
uggagguugcagugagcugagaucgugccauugugauaugaauaugccuuauaugcugauauga

SEQ ID NO: 508618 - RNA, 64 nt, Homo Sapiens
cgugccauugugauaugaauaugccuuauaugcugauaugaauaugccuuaaaauaaaguguuc

SEQ ID NO: 508619 - RNA, 64 nt, Homo Sapiens
ccauuugaaaaaucuugguacugcuaaauuauuugauaugaacucaauccagcauuuguagcag

SEQ ID NO: 508620 - RNA, 64 nt, Homo Sapiens
uuuuugucaccagcaaaacuuuucacuaauuagugauaugaaaugugauuuuuguguuguuaaa

SEQ ID NO: 508621 - RNA, 64 nt, Homo Sapiens
acuugucaugucuuuggccacucaaauuuuaagugauaugaaaugggcccccauacacuuaucc

SEQ ID NO: 508622 - RNA, 64 nt, Homo Sapiens
auuauccuuuuguucaguugcuacucuuaagugagauaugaagcugauaguugaacuguaauuu

SEQ ID NO: 508623 - RNA, 64 nt, Homo Sapiens
agagucuugcuuauugggcugcauccccagagaggauaugaauuauuuuuugaaaagacagggu

SEQ ID NO: 508624 - RNA, 64 nt, Homo Sapiens
ugggauuacaggcaugagccacugugccuggcuggauaugaaauuuuuuuuuuuuuuuuuuuug

SEQ ID NO: 508625 - RNA, 64 nt, Homo Sapiens
gggauuacaggcaaaagccaacacacccggccuggauaugaauuuauaauacccuacagugcaa

SEQ ID NO: 508626 - RNA, 64 nt, Homo Sapiens
ucuugucuugacaagaugcuugaaaaaccaagaggauaugaaaaucugucucuggagaaacaaa

SEQ ID NO: 508627 - RNA, 64 nt, Homo Sapiens
gagguuagcauuugauaaaugauuuuuuaaaguagauaugaagauuuuguuaauuuauaauuua

SEQ ID NO: 508628 - RNA, 64 nt, Homo Sapiens
uccuggaaagugaacugggugaccuaggaccucugauaugaaugugaucugagacuaaaguuug

SEQ ID NO: 508629 - RNA, 64 nt, Homo Sapiens
ugauucacugaagaugaaaagauaggacggaugugauaugaaaaaaacccaaacauuuuggcau

SEQ ID NO: 508630 - RNA, 64 nt, Homo Sapiens; identical to SEQ ID NO: 155373

SEQ ID NO: 508631 - RNA, 64 nt, Homo Sapiens; identical to SEQ ID NO: 155374

SEQ ID NO: 508632 - RNA, 64 nt, Homo Sapiens; identical to SEQ ID NO: 155375

SEQ ID NO: 508633 - RNA, 64 nt, Homo Sapiens; identical to SEQ ID NO: 155376

SEQ ID NO: 508634 - RNA, 64 nt, Homo Sapiens; identical to SEQ ID NO: 155377

SEQ ID NO: 508635 - RNA, 64 nt, Homo Sapiens; identical to SEQ ID NO: 155378

SEQ ID NO: 508636 - RNA, 64 nt, Homo Sapiens; identical to SEQ ID NO: 155379

SEQ ID NO: 508637 - RNA, 64 nt, Homo Sapiens; identical to SEQ ID NO: 155380

SEQ ID NO: 508638 - RNA, 64 nt, Homo Sapiens
caagaccuuuuuccuccguuuuuuuuuugagauggagucucacacagucacccgggauuggaau

SEQ ID NO: 508639 - RNA, 64 nt, Homo Sapiens
ugguguaugagugucaaucaucugacccuucuuggagucucauauuucguggaacuccugugca

SEQ ID NO: 508640 - RNA, 64 nt, Homo Sapiens
auucauguuuuuuauuuuuauuuuuuuugauacagagucucacucugucacucaggcuggagug

SEQ ID NO: 508641 - RNA, 64 nt, Homo Sapiens
acccagcuauuuuuuuguauuuuuaguagagacagagucucaccacauugcccaggcuggucuc

SEQ ID NO: 508642 - RNA, 64 nt, Homo Sapiens
aagacggggugggguggggagaugggcauuuggagagucucauguagcuggagacguuaagagc

SEQ ID NO: 508643 - RNA, 64 nt, Homo Sapiens
auuuauuauuuauuuauuuauuuauuuagagacagagucucacccuguuggccaggcuggagug

SEQ ID NO: 508644 - RNA, 64 nt, Homo Sapiens
guugcccaggcuggucuugauuuuugcagagauggagucucacucaacuaauuuuauuuuuuau

SEQ ID NO: 508645 - RNA, 64 nt, Homo Sapiens
uuaucacccagacuggcguguuguuuuugagacugagucucacuagcauuaguaguuuguuugu

SEQ ID NO: 508646 - RNA, 64 nt, Homo Sapiens
uuuacauuuuuguuguuguuguuguucugagauggagucucacucugucgcccaggcuagacug

SEQ ID NO: 508647 - RNA, 64 nt, Homo Sapiens
auguauaugugauuuuuuuuuuuuuuuugagaccgagucucacucugucaccaggcuggagugc

SEQ ID NO: 508648 - RNA, 64 nt, Homo Sapiens
cugucccccaggcuggaguguuuuuuuugagacagagucucacuagcgauuccuuuuuuuuuuu

SEQ ID NO: 508649 - RNA, 64 nt, Homo Sapiens
cugucacccagacuggagugauuuuuuugagacagagucucacuuuuuuuuuuuuuaaucuuuu

SEQ ID NO: 508650 - RNA, 64 nt, Homo Sapiens
agccgcccacacgcuccuaaguacuguggugugugagucucagcgcugccccugaaggaugcca

SEQ ID NO: 508651 - RNA, 64 nt, Homo Sapiens
uuggaaucagaauuggaaucuggaugaucugggagagucucacuacaaagagaaugagaagaca

SEQ ID NO: 508652 - RNA, 64 nt, Homo Sapiens
uggggccuagaguggaagugcaggacuggugguggagucucacccaccggggaacccucacuag

SEQ ID NO: 508653 - RNA, 64 nt, Homo Sapiens
aaagcucugcaccauccucguggaugggccacuggagucucaaugggggugccuggagaugaac

SEQ ID NO: 508654 - RNA, 64 nt, Homo Sapiens
cuggcgccuggucacugugcuucuuuuugagacagagucucacuaggagagcguuuuuuucuuu

SEQ ID NO: 508655 - RNA, 64 nt, Homo Sapiens
cugucucccaggcuggagugguuuguuugagauggagucucacuccugauccaaaucuuuuuuu

SEQ ID NO: 508656 - RNA, 64 nt, Homo Sapiens
cauauauauauauauguucuuguuuuuugagacagagucucacacuguugcccaggcuggagug

SEQ ID NO: 508657 - RNA, 64 nt, Homo Sapiens
ucuaguuccaaacauuuucuuuuuuucugagauggagucucacucugucacccagguucgaguu

SEQ ID NO: 508658 - RNA, 64 nt, Homo Sapiens
gcaggggaguggcuucccaacaggggagaaaccugagucucagagggggccucacucuguuuuc

SEQ ID NO: 508659 - RNA, 64 nt, Homo Sapiens
gaaagagaaccacaauagaagagacagaacaacagagucucagggcgucagacacccagaguug

SEQ ID NO: 508660 - RNA, 64 nt, Homo Sapiens
gggccaugcugaauugaguuucaugccacuguuugagucucauaguaaggccaguucaguuggg

SEQ ID NO: 508661 - RNA, 64 nt, Homo Sapiens
gaugaaagucugagaaugcccaacucuucauuuugagucucaggcccugaagguuccugaggau

SEQ ID NO: 508662 - RNA, 64 nt, Homo Sapiens
uuuuuuacucuuaucauuuuuuuuuuuugagguggagucucauucuguugcccaggcuggccug

SEQ ID NO: 508663 - RNA, 64 nt, Homo Sapiens
ugucacaggccuagagucugagggaggggagugggagucucagcaaucucuuggucuuggcuuc

SEQ ID NO: 508664 - RNA, 64 nt, Homo Sapiens
aggcagcagcuugggcugggaagaggugguggcagagucucaaagcugagaugcugagagagau

SEQ ID NO: 508665 - RNA, 64 nt, Homo Sapiens; identical to SEQ ID NO: 96836

SEQ ID NO: 508666 - RNA, 64 nt, Homo Sapiens; identical to SEQ ID NO: 96837

SEQ ID NO: 508667 - RNA, 64 nt, Homo Sapiens; identical to SEQ ID NO: 96838

SEQ ID NO: 508668 - RNA, 64 nt, Homo Sapiens; identical to SEQ ID NO: 96839

SEQ ID NO: 508669 - RNA, 64 nt, Homo Sapiens; identical to SEQ ID NO: 96840

SEQ ID NO: 508670 - RNA, 64 nt, Homo Sapiens; identical to SEQ ID NO: 96841

SEQ ID NO: 508671 - RNA, 64 nt, Homo Sapiens; identical to SEQ ID NO: 96842

SEQ ID NO: 508672 - RNA, 64 nt, Homo Sapiens; identical to SEQ ID NO: 96843

SEQ ID NO: 508673 - RNA, 64 nt, Homo Sapiens; identical to SEQ ID NO: 96844

SEQ ID NO: 508674 - RNA, 64 nt, Homo Sapiens; identical to SEQ ID NO: 96845

SEQ ID NO: 508675 - RNA, 64 nt, Homo Sapiens; identical to SEQ ID NO: 96846

SEQ ID NO: 508676 - RNA, 64 nt, Homo Sapiens; identical to SEQ ID NO: 96847

SEQ ID NO: 508677 - RNA, 64 nt, Homo Sapiens; identical to SEQ ID NO: 96848

SEQ ID NO: 508678 - RNA, 64 nt, Homo Sapiens; identical to SEQ ID NO: 96849

SEQ ID NO: 508679 - RNA, 64 nt, Homo Sapiens; identical to SEQ ID NO: 96850

SEQ ID NO: 508680 - RNA, 64 nt, Homo Sapiens; identical to SEQ ID NO: 96851

SEQ ID NO: 508681 - RNA, 64 nt, Homo Sapiens; identical to SEQ ID NO: 96852

SEQ ID NO: 508682 - RNA, 64 nt, Homo Sapiens; identical to SEQ ID NO: 96853

SEQ ID NO: 508683 - RNA, 64 nt, Homo Sapiens; identical to SEQ ID NO: 96854

SEQ ID NO: 508684 - RNA, 64 nt, Homo Sapiens; identical to SEQ ID NO: 96855

SEQ ID NO: 508685 - RNA, 64 nt, Homo Sapiens; identical to SEQ ID NO: 96856

SEQ ID NO: 508686 - RNA, 64 nt, Homo Sapiens; identical to SEQ ID NO: 96857

SEQ ID NO: 508687 - RNA, 64 nt, Homo Sapiens; identical to SEQ ID NO: 96858

SEQ ID NO: 508688 - RNA, 64 nt, Homo Sapiens; identical to SEQ ID NO: 96859

SEQ ID NO: 508689 - RNA, 64 nt, Homo Sapiens; identical to SEQ ID NO: 96860

SEQ ID NO: 508690 - RNA, 64 nt, Homo Sapiens; identical to SEQ ID NO: 96861

SEQ ID NO: 508691 - RNA, 64 nt, Homo Sapiens; identical to SEQ ID NO: 96862

SEQ ID NO: 508692 - RNA, 64 nt, Homo Sapiens; identical to SEQ ID NO: 96863

SEQ ID NO: 508693 - RNA, 64 nt, Homo Sapiens; identical to SEQ ID NO: 96864

SEQ ID NO: 508694 - RNA, 64 nt, Homo Sapiens; identical to SEQ ID NO: 96865

SEQ ID NO: 508695 - RNA, 64 nt, Homo Sapiens; identical to SEQ ID NO: 96866

SEQ ID NO: 508696 - RNA, 64 nt, Homo Sapiens; identical to SEQ ID NO: 96867

SEQ ID NO: 508697 - RNA, 64 nt, Homo Sapiens; identical to SEQ ID NO: 96868

SEQ ID NO: 508698 - RNA, 64 nt, Homo Sapiens; identical to SEQ ID NO: 96869

SEQ ID NO: 508699 - RNA, 64 nt, Homo Sapiens; identical to SEQ ID NO: 96870

SEQ ID NO: 508700 - RNA, 64 nt, Homo Sapiens; identical to SEQ ID NO: 96871

SEQ ID NO: 508701 - RNA, 64 nt, Homo Sapiens; identical to SEQ ID NO: 96872

SEQ ID NO: 508702 - RNA, 64 nt, Homo Sapiens; identical to SEQ ID NO: 96873

SEQ ID NO: 508703 - RNA, 64 nt, Homo Sapiens; identical to SEQ ID NO: 96874

SEQ ID NO: 508704 - RNA, 64 nt, Homo Sapiens; identical to SEQ ID NO: 96875

SEQ ID NO: 508705 - RNA, 64 nt, Homo Sapiens; identical to SEQ ID NO: 361974

SEQ ID NO: 508706 - RNA, 64 nt, Homo Sapiens; identical to SEQ ID NO: 361975

SEQ ID NO: 508707 - RNA, 64 nt, Homo Sapiens; identical to SEQ ID NO: 361976

SEQ ID NO: 508708 - RNA, 64 nt, Homo Sapiens; identical to SEQ ID NO: 361977

SEQ ID NO: 508709 - RNA, 64 nt, Homo Sapiens; identical to SEQ ID NO: 361978

SEQ ID NO: 508710 - RNA, 64 nt, Homo Sapiens; identical to SEQ ID NO: 361979

SEQ ID NO: 508711 - RNA, 64 nt, Homo Sapiens; identical to SEQ ID NO: 361980

SEQ ID NO: 508712 - RNA, 64 nt, Homo Sapiens; identical to SEQ ID NO: 361981

SEQ ID NO: 508713 - RNA, 64 nt, Homo Sapiens; identical to SEQ ID NO: 361982

SEQ ID NO: 508714 - RNA, 64 nt, Homo Sapiens; identical to SEQ ID NO: 361983

SEQ ID NO: 508715 - RNA, 64 nt, Homo Sapiens; identical to SEQ ID NO: 361984

SEQ ID NO: 508716 - RNA, 64 nt, Homo Sapiens; identical to SEQ ID NO: 361985

SEQ ID NO: 508717 - RNA, 64 nt, Homo Sapiens; identical to SEQ ID NO: 361986

SEQ ID NO: 508718 - RNA, 64 nt, Homo Sapiens; identical to SEQ ID NO: 361987

SEQ ID NO: 508719 - RNA, 64 nt, Homo Sapiens; identical to SEQ ID NO: 361988

SEQ ID NO: 508720 - RNA, 64 nt, Homo Sapiens; identical to SEQ ID NO: 361989

SEQ ID NO: 508721 - RNA, 64 nt, Homo Sapiens; identical to SEQ ID NO: 361990

SEQ ID NO: 508722 - RNA, 64 nt, Homo Sapiens; identical to SEQ ID NO: 361991

SEQ ID NO: 508723 - RNA, 64 nt, Homo Sapiens; identical to SEQ ID NO: 361992

SEQ ID NO: 508724 - RNA, 64 nt, Homo Sapiens; identical to SEQ ID NO: 361993

SEQ ID NO: 508725 - RNA, 64 nt, Homo Sapiens; identical to SEQ ID NO: 361994

SEQ ID NO: 508726 - RNA, 64 nt, Homo Sapiens; identical to SEQ ID NO: 361995

SEQ ID NO: 508727 - RNA, 64 nt, Homo Sapiens; identical to SEQ ID NO: 361996

SEQ ID NO: 508728 - RNA, 64 nt, Homo Sapiens; identical to SEQ ID NO: 361997

SEQ ID NO: 508729 - RNA, 64 nt, Homo Sapiens; identical to SEQ ID NO: 361998

SEQ ID NO: 508730 - RNA, 64 nt, Homo Sapiens
uacaagugauuaccuaguugaaggccacaaaaaugaacuccaucaacccugcagaugucaacug

SEQ ID NO: 508731 - RNA, 64 nt, Homo Sapiens
auaugaugaaaaccccaugaugagauggaccugggaacuccaacgccagccuugagcaugaagc

SEQ ID NO: 508732 - RNA, 64 nt, Homo Sapiens
ccucugaccucaucaugguucuaguucucauacagaacuccagaauuuuuaaagaacucuauaa

SEQ ID NO: 508733 - RNA, 64 nt, Homo Sapiens
gaccauguggcccaccagcagccuuuccaaaggggaacuccagagacauuucauaaugcaaaca

SEQ ID NO: 508734 - RNA, 64 nt, Homo Sapiens
guguggagauaaggcuggacuggucuaucagauugaacuccaagaaugaucacacaaaauguuu

SEQ ID NO: 508735 - RNA, 64 nt, Homo Sapiens
aaacccacagcuccagagaaggugaccauucucagaacuccagcuauucacucuccagggagaa

SEQ ID NO: 508736 - RNA, 64 nt, Homo Sapiens; identical to SEQ ID NO: 199877

SEQ ID NO: 508737 - RNA, 64 nt, Homo Sapiens; identical to SEQ ID NO: 199878

SEQ ID NO: 508738 - RNA, 64 nt, Homo Sapiens; identical to SEQ ID NO: 199879

SEQ ID NO: 508739 - RNA, 64 nt, Homo Sapiens; identical to SEQ ID NO: 199880

SEQ ID NO: 508740 - RNA, 64 nt, Homo Sapiens; identical to SEQ ID NO: 199881

SEQ ID NO: 508741 - RNA, 64 nt, Homo Sapiens; identical to SEQ ID NO: 199882

SEQ ID NO: 508742 - RNA, 64 nt, Homo Sapiens; identical to SEQ ID NO: 199883

SEQ ID NO: 508743 - RNA, 64 nt, Homo Sapiens; identical to SEQ ID NO: 199884

SEQ ID NO: 508744 - RNA, 64 nt, Homo Sapiens; identical to SEQ ID NO: 199885

SEQ ID NO: 508745 - RNA, 64 nt, Homo Sapiens; identical to SEQ ID NO: 199886

SEQ ID NO: 508746 - RNA, 64 nt, Homo Sapiens; identical to SEQ ID NO: 199887

SEQ ID NO: 508747 - RNA, 64 nt, Homo Sapiens; identical to SEQ ID NO: 199888

SEQ ID NO: 508748 - RNA, 64 nt, Homo Sapiens; identical to SEQ ID NO: 199889

SEQ ID NO: 508749 - RNA, 64 nt, Homo Sapiens; identical to SEQ ID NO: 199890

SEQ ID NO: 508750 - RNA, 64 nt, Homo Sapiens; identical to SEQ ID NO: 199891

SEQ ID NO: 508751 - RNA, 64 nt, Homo Sapiens; identical to SEQ ID NO: 199892

SEQ ID NO: 508752 - RNA, 64 nt, Homo Sapiens; identical to SEQ ID NO: 199893

SEQ ID NO: 508753 - RNA, 64 nt, Homo Sapiens; identical to SEQ ID NO: 199894

SEQ ID NO: 508754 - RNA, 64 nt, Homo Sapiens; identical to SEQ ID NO: 199895

SEQ ID NO: 508755 - RNA, 64 nt, Homo Sapiens; identical to SEQ ID NO: 199896

SEQ ID NO: 508756 - RNA, 64 nt, Homo Sapiens; identical to SEQ ID NO: 199897

SEQ ID NO: 508757 - RNA, 64 nt, Homo Sapiens; identical to SEQ ID NO: 140344

SEQ ID NO: 508758 - RNA, 64 nt, Homo Sapiens; identical to SEQ ID NO: 140345

SEQ ID NO: 508759 - RNA, 64 nt, Homo Sapiens; identical to SEQ ID NO: 140346

SEQ ID NO: 508760 - RNA, 64 nt, Homo Sapiens; identical to SEQ ID NO: 140347

SEQ ID NO: 508761 - RNA, 64 nt, Homo Sapiens
auaaggccugcuucccaguccaugggagauuccaaguggccacugcaggagucacucaccuccc

SEQ ID NO: 508762 - RNA, 64 nt, Homo Sapiens
ccuuggaaaccuuucccaagccuuccuggcccacaguggccagugccauaggcagugcugugga

SEQ ID NO: 508763 - RNA, 56 nt, Homo Sapiens
ucggggagggcacccccuaagaccacaguggccaagaucacaguggccacggccac

SEQ ID NO: 508764 - RNA, 64 nt, Homo Sapiens
gggcacccccuaagaccacaguggccaagaucacaguggccacggccacggccacagucauggu

SEQ ID NO: 508765 - RNA, 64 nt, Homo Sapiens
gggcagccuaugcaaguguuccggcaggaccagaaguggccacucaacacacguccucaccagu

SEQ ID NO: 508766 - RNA, 64 nt, Homo Sapiens
gggcugacaguccuaaaaucaagugcuaggacacaguggccauugagcugggagcauucuuccc

SEQ ID NO: 508767 - RNA, 64 nt, Homo Sapiens
ggggcaggugucucccuucgacauugagccuucgaguggccagcuucacucucugggggagugc

SEQ ID NO: 508768 - RNA, 64 nt, Homo Sapiens
uucuaggcauuucugggaagccccagggacugcaaguggccauuaccaucucuaaggagagcuc

SEQ ID NO: 508769 - RNA, 64 nt, Homo Sapiens
aucucuaaggagagcucugauugcagcacagagcaguggccaggccacccaaaggagcuccgcc

SEQ ID NO: 508770 - RNA, 64 nt, Homo Sapiens
cccugcccagacucuucagccccugcucccauccaguggccagucgggggaggagaaagacgcg

SEQ ID NO: 508771 - RNA, 64 nt, Homo Sapiens
ccagaguggccugcccccgggagccaaagaccccaguggccacacugggauaggguggggaggc

SEQ ID NO: 508772 - RNA, 64 nt, Homo Sapiens
uccugucaauuuauuugcuuaaaaggcacaugaaaguggccagccaccauuaucagaggguggg

SEQ ID NO: 508773 - RNA, 64 nt, Homo Sapiens
ucuccaccuuccagcaccauuguguccugcagggaguggccaacacaguccaggucucuugcug

SEQ ID NO: 508774 - RNA, 64 nt, Homo Sapiens
uggccaaagcgcccauccaccugccucccucuggaguggccacucaggucccauguugucccug

SEQ ID NO: 508775 - RNA, 64 nt, Homo Sapiens
ggcucgcgggcugggaaggaucccuccacucccgaguggccacaagcagugagggucccagugu

SEQ ID NO: 508776 - RNA, 64 nt, Homo Sapiens
ugcggccaccaggucucagcgcuuuugcuuucgaaguggccagcugcuucugugaggugguuua

SEQ ID NO: 508777 - RNA, 64 nt, Homo Sapiens
ccagccugguuggcugguuuaacccucucccuugaguggccaccaaggagcauuggaaggccca

SEQ ID NO: 508778 - RNA, 64 nt, Homo Sapiens; identical to SEQ ID NO: 196032

SEQ ID NO: 508779 - RNA, 64 nt, Homo Sapiens; identical to SEQ ID NO: 196033

SEQ ID NO: 508780 - RNA, 64 nt, Homo Sapiens; identical to SEQ ID NO: 196034

SEQ ID NO: 508781 - RNA, 64 nt, Homo Sapiens; identical to SEQ ID NO: 196035

SEQ ID NO: 508782 - RNA, 64 nt, Homo Sapiens; identical to SEQ ID NO: 196036

SEQ ID NO: 508783 - RNA, 64 nt, Homo Sapiens; identical to SEQ ID NO: 196037

SEQ ID NO: 508784 - RNA, 64 nt, Homo Sapiens; identical to SEQ ID NO: 196038

SEQ ID NO: 508785 - RNA, 64 nt, Homo Sapiens; identical to SEQ ID NO: 196039

SEQ ID NO: 508786 - RNA, 64 nt, Homo Sapiens; identical to SEQ ID NO: 196040

SEQ ID NO: 508787 - RNA, 64 nt, Homo Sapiens; identical to SEQ ID NO: 196041

SEQ ID NO: 508788 - RNA, 64 nt, Homo Sapiens; identical to SEQ ID NO: 196042

SEQ ID NO: 508789 - RNA, 64 nt, Homo Sapiens; identical to SEQ ID NO: 196043

SEQ ID NO: 508790 - RNA, 64 nt, Homo Sapiens; identical to SEQ ID NO: 196044

SEQ ID NO: 508791 - RNA, 64 nt, Homo Sapiens; identical to SEQ ID NO: 196045

SEQ ID NO: 508792 - RNA, 64 nt, Homo Sapiens; identical to SEQ ID NO: 196046

SEQ ID NO: 508793 - RNA, 64 nt, Homo Sapiens; identical to SEQ ID NO: 196047

SEQ ID NO: 508794 - RNA, 64 nt, Homo Sapiens; identical to SEQ ID NO: 196048

SEQ ID NO: 508795 - RNA, 64 nt, Homo Sapiens; identical to SEQ ID NO: 196049

SEQ ID NO: 508796 - RNA, 64 nt, Homo Sapiens; identical to SEQ ID NO: 196050

SEQ ID NO: 508797 - RNA, 64 nt, Homo Sapiens; identical to SEQ ID NO: 196051

SEQ ID NO: 508798 - RNA, 64 nt, Homo Sapiens; identical to SEQ ID NO: 196052

SEQ ID NO: 508799 - RNA, 64 nt, Homo Sapiens; identical to SEQ ID NO: 196053

SEQ ID NO: 508800 - RNA, 64 nt, Homo Sapiens; identical to SEQ ID NO: 196054

SEQ ID NO: 508801 - RNA, 64 nt, Homo Sapiens; identical to SEQ ID NO: 196055

SEQ ID NO: 508802 - RNA, 64 nt, Homo Sapiens; identical to SEQ ID NO: 153638

SEQ ID NO: 508803 - RNA, 64 nt, Homo Sapiens; identical to SEQ ID NO: 153639

SEQ ID NO: 508804 - RNA, 64 nt, Homo Sapiens; identical to SEQ ID NO: 153640

SEQ ID NO: 508805 - RNA, 64 nt, Homo Sapiens; identical to SEQ ID NO: 153641

SEQ ID NO: 508806 - RNA, 64 nt, Homo Sapiens; identical to SEQ ID NO: 153642

SEQ ID NO: 508807 - RNA, 64 nt, Homo Sapiens; identical to SEQ ID NO: 153643

SEQ ID NO: 508808 - RNA, 64 nt, Homo Sapiens; identical to SEQ ID NO: 153644

SEQ ID NO: 508809 - RNA, 64 nt, Homo Sapiens; identical to SEQ ID NO: 153645

SEQ ID NO: 508810 - RNA, 64 nt, Homo Sapiens; identical to SEQ ID NO: 153646

SEQ ID NO: 508811 - RNA, 64 nt, Homo Sapiens; identical to SEQ ID NO: 153647

SEQ ID NO: 508812 - RNA, 64 nt, Homo Sapiens; identical to SEQ ID NO: 153648

SEQ ID NO: 508813 - RNA, 64 nt, Homo Sapiens; identical to SEQ ID NO: 153649

SEQ ID NO: 508814 - RNA, 64 nt, Homo Sapiens; identical to SEQ ID NO: 153650

SEQ ID NO: 508815 - RNA, 64 nt, Homo Sapiens; identical to SEQ ID NO: 153651

SEQ ID NO: 508816 - RNA, 64 nt, Homo Sapiens; identical to SEQ ID NO: 153652

SEQ ID NO: 508817 - RNA, 64 nt, Homo Sapiens; identical to SEQ ID NO: 153653

SEQ ID NO: 508818 - RNA, 64 nt, Homo Sapiens; identical to SEQ ID NO: 153654

SEQ ID NO: 508819 - RNA, 64 nt, Homo Sapiens; identical to SEQ ID NO: 153655

SEQ ID NO: 508820 - RNA, 64 nt, Homo Sapiens; identical to SEQ ID NO: 153656

SEQ ID NO: 508821 - RNA, 64 nt, Homo Sapiens; identical to SEQ ID NO: 153657

SEQ ID NO: 508822 - RNA, 64 nt, Homo Sapiens; identical to SEQ ID NO: 153658

SEQ ID NO: 508823 - RNA, 64 nt, Homo Sapiens; identical to SEQ ID NO: 153659

SEQ ID NO: 508824 - RNA, 64 nt, Homo Sapiens; identical to SEQ ID NO: 153660

SEQ ID NO: 508825 - RNA, 64 nt, Homo Sapiens; identical to SEQ ID NO: 153661

SEQ ID NO: 508826 - RNA, 64 nt, Homo Sapiens; identical to SEQ ID NO: 153662

SEQ ID NO: 508827 - RNA, 64 nt, Homo Sapiens; identical to SEQ ID NO: 153663

SEQ ID NO: 508828 - RNA, 64 nt, Homo Sapiens; identical to SEQ ID NO: 153664

SEQ ID NO: 508829 - RNA, 64 nt, Homo Sapiens; identical to SEQ ID NO: 153665

SEQ ID NO: 508830 - RNA, 64 nt, Homo Sapiens; identical to SEQ ID NO: 153666

SEQ ID NO: 508831 - RNA, 64 nt, Homo Sapiens; identical to SEQ ID NO: 153667

SEQ ID NO: 508832 - RNA, 64 nt, Homo Sapiens; identical to SEQ ID NO: 153668

SEQ ID NO: 508833 - RNA, 64 nt, Homo Sapiens; identical to SEQ ID NO: 153669

SEQ ID NO: 508834 - RNA, 64 nt, Homo Sapiens; identical to SEQ ID NO: 153670

SEQ ID NO: 508835 - RNA, 64 nt, Homo Sapiens; identical to SEQ ID NO: 153671

SEQ ID NO: 508836 - RNA, 64 nt, Homo Sapiens; identical to SEQ ID NO: 153672

SEQ ID NO: 508837 - RNA, 64 nt, Homo Sapiens; identical to SEQ ID NO: 153673

SEQ ID NO: 508838 - RNA, 62 nt, Homo Sapiens
uuccaucccacuccacuauguugucuauuuuuucugaggaauuaaggguuaccccacccugc

SEQ ID NO: 508839 - RNA, 62 nt, Homo Sapiens
gaccuagauaggucaugcaagugagaaagacaucugaggaaaauggaagaccuaaggcagac

SEQ ID NO: 508840 - RNA, 62 nt, Homo Sapiens
aaaacggcaccucuggccuuugcagcaucagaucugaggagugcugaaaucgcagagacuuu

SEQ ID NO: 508841 - RNA, 62 nt, Homo Sapiens
gacagagaagcaagggggcuagcacccaggacucugaggaggcacugguggguugcaggaac

SEQ ID NO: 508842 - RNA, 62 nt, Homo Sapiens
cugcccacaccccugcgugcgauguaagaugcucugaggaccaacuguuacaacuuaguuug

SEQ ID NO: 508843 - RNA, 62 nt, Homo Sapiens
gacuccugggcucuugucagauaaagcaguucucugaggaauagcccaggcucgcaguauca

SEQ ID NO: 508844 - RNA, 62 nt, Homo Sapiens
gggaagaaggccugcugggggcaccugacugcucugaggagaauccucucagcuacuccagg

SEQ ID NO: 508845 - RNA, 62 nt, Homo Sapiens
ucuagguaguuuuccuuuuguccugacuuuuaucugaggaagccuguuuuaauuccuaaaga

SEQ ID NO: 508846 - RNA, 62 nt, Homo Sapiens
ugcuaacuuccacagcauuguugugaauuacuucugaggaaaagauaaggauaaaaauauau

SEQ ID NO: 508847 - RNA, 62 nt, Homo Sapiens
cacugagccacugcgcccagccaacaauccgcucugaggaaagcguaagcaggaagaccucu

SEQ ID NO: 508848 - RNA, 62 nt, Homo Sapiens
cuaguuguguuuggaaagggagagaagagaugucugaggaaggucauguucuuucagcuuau

SEQ ID NO: 508849 - RNA, 62 nt, Homo Sapiens
aucacugacaaauaguggauauagguuucauuucugaggaucaauaaacagcuuguaauguu

SEQ ID NO: 508850 - RNA, 62 nt, Homo Sapiens
uugcugaagccaaccagagaucuugaucucucucugaggaaaaaaccuagaaaugaugguua

SEQ ID NO: 508851 - RNA, 62 nt, Homo Sapiens
uggauacugguacuacgggggcauggaaucccucugaggaccuaugcuuuggggcuggggua

SEQ ID NO: 508852 - RNA, 62 nt, Homo Sapiens
ccgucgggguccagaucagggccagacucugaucugaggaccccggccagggcuggggcagu

SEQ ID NO: 508853 - RNA, 62 nt, Homo Sapiens
accugggcuuuucucuuuccccaaaccauaaaucugaggauaauugcuauucuuccuguugu

SEQ ID NO: 508854 - RNA, 62 nt, Homo Sapiens
aucuauauguuuaauacacccuauauucuucaucugaggagcguguauaaaaccagauuaga

SEQ ID NO: 508855 - RNA, 62 nt, Homo Sapiens
ugaucccagcugugcucuggacaggcauguucucugaggacacuaaccacgcuggaccuuga

SEQ ID NO: 508856 - RNA, 62 nt, Homo Sapiens
ccccagcaagugagagcugggugucaagagggucugaggaauccagacccggcugcgugguu

SEQ ID NO: 508857 - RNA, 62 nt, Homo Sapiens
guaaauuuaguuucuacuugggcagccaaaacucugaggaaggagauucugcuaguaaaaag

SEQ ID NO: 508858 - RNA, 62 nt, Homo Sapiens
ucucucauuacuccuggucuugggaguugccuucugaggauacuccacuggggguaccugag

SEQ ID NO: 508859 - RNA, 62 nt, Homo Sapiens
cuauaauggcccugucgucagcuaagaucuaaucugaggacaaagcagguuaaagccauugu

SEQ ID NO: 508860 - RNA, 62 nt, Homo Sapiens
ccagaguccucuguucauccuuuuccauuacaucugaggauuguacaauauggcucauugac

SEQ ID NO: 508861 - RNA, 62 nt, Homo Sapiens
ucaguucugaagugaucuagucaccuguuucaucugaggauuguagcaggucacagaagugu

SEQ ID NO: 508862 - RNA, 62 nt, Homo Sapiens
cuugagacaggguuauggauuauuuuccugguucugaggaggagucucuucaggaucuuuag

SEQ ID NO: 508863 - RNA, 64 nt, Homo Sapiens; identical to SEQ ID NO: 45285

SEQ ID NO: 508864 - RNA, 64 nt, Homo Sapiens; identical to SEQ ID NO: 45286

SEQ ID NO: 508865 - RNA, 64 nt, Homo Sapiens; identical to SEQ ID NO: 45287

SEQ ID NO: 508866 - RNA, 64 nt, Homo Sapiens; identical to SEQ ID NO: 45288

SEQ ID NO: 508867 - RNA, 64 nt, Homo Sapiens; identical to SEQ ID NO: 45289

SEQ ID NO: 508868 - RNA, 64 nt, Homo Sapiens; identical to SEQ ID NO: 45290

SEQ ID NO: 508869 - RNA, 64 nt, Homo Sapiens; identical to SEQ ID NO: 45291

SEQ ID NO: 508870 - RNA, 64 nt, Homo Sapiens; identical to SEQ ID NO: 45292

SEQ ID NO: 508871 - RNA, 64 nt, Homo Sapiens; identical to SEQ ID NO: 45293

SEQ ID NO: 508872 - RNA, 64 nt, Homo Sapiens; identical to SEQ ID NO: 45294

SEQ ID NO: 508873 - RNA, 64 nt, Homo Sapiens; identical to SEQ ID NO: 45295

SEQ ID NO: 508874 - RNA, 64 nt, Homo Sapiens; identical to SEQ ID NO: 45296

SEQ ID NO: 508875 - RNA, 64 nt, Homo Sapiens; identical to SEQ ID NO: 45297

SEQ ID NO: 508876 - RNA, 64 nt, Homo Sapiens; identical to SEQ ID NO: 45298

SEQ ID NO: 508877 - RNA, 64 nt, Homo Sapiens; identical to SEQ ID NO: 45299

SEQ ID NO: 508878 - RNA, 64 nt, Homo Sapiens; identical to SEQ ID NO: 45300

SEQ ID NO: 508879 - RNA, 64 nt, Homo Sapiens; identical to SEQ ID NO: 45301

SEQ ID NO: 508880 - RNA, 64 nt, Homo Sapiens; identical to SEQ ID NO: 45302

SEQ ID NO: 508881 - RNA, 64 nt, Homo Sapiens; identical to SEQ ID NO: 45303

SEQ ID NO: 508882 - RNA, 64 nt, Homo Sapiens; identical to SEQ ID NO: 45304

SEQ ID NO: 508883 - RNA, 64 nt, Homo Sapiens; identical to SEQ ID NO: 45305

SEQ ID NO: 508884 - RNA, 64 nt, Homo Sapiens; identical to SEQ ID NO: 45306

SEQ ID NO: 508885 - RNA, 64 nt, Homo Sapiens; identical to SEQ ID NO: 45307

SEQ ID NO: 508886 - RNA, 64 nt, Homo Sapiens; identical to SEQ ID NO: 45308

SEQ ID NO: 508887 - RNA, 64 nt, Homo Sapiens; identical to SEQ ID NO: 45309

SEQ ID NO: 508888 - RNA, 64 nt, Homo Sapiens; identical to SEQ ID NO: 45310

SEQ ID NO: 508889 - RNA, 64 nt, Homo Sapiens; identical to SEQ ID NO: 45311

SEQ ID NO: 508890 - RNA, 64 nt, Homo Sapiens; identical to SEQ ID NO: 45312

SEQ ID NO: 508891 - RNA, 64 nt, Homo Sapiens; identical to SEQ ID NO: 45312

SEQ ID NO: 508892 - RNA, 64 nt, Homo Sapiens; identical to SEQ ID NO: 45314

SEQ ID NO: 508893 - RNA, 64 nt, Homo Sapiens; identical to SEQ ID NO: 45315

SEQ ID NO: 508894 - RNA, 64 nt, Homo Sapiens; identical to SEQ ID NO: 45316

SEQ ID NO: 508895 - RNA, 64 nt, Homo Sapiens; identical to SEQ ID NO: 45317

SEQ ID NO: 508896 - RNA, 64 nt, Homo Sapiens; identical to SEQ ID NO: 45318

SEQ ID NO: 508897 - RNA, 64 nt, Homo Sapiens; identical to SEQ ID NO: 45319

SEQ ID NO: 508898 - RNA, 64 nt, Homo Sapiens
cucaguugaaagauuucuucuuugaaaggucaagaccgugaacugaaaaaaguguuggccuuuu

SEQ ID NO: 508899 - RNA, 64 nt, Homo Sapiens
agcugagucagggauagggaguccccuggugcuaaccgugaacguagagacuuguucugaggac

SEQ ID NO: 508900 - RNA, 64 nt, Homo Sapiens
uagucuugacugccccugguaugaugaagagagcaccgugaaucggaaaacacauuuugugcgc

SEQ ID NO: 508901 - RNA, 64 nt, Homo Sapiens
agcacuuucuaggcuaggaguugggugcauuuguaccgugaaaagcauuccucaguuguggcuu

SEQ ID NO: 508902 - RNA, 64 nt, Homo Sapiens
uggaucuguuccuaugcccaggaugauuuugugaaccgugaaguacgugagacuagaagacgcc

SEQ ID NO: 508903 - RNA, 64 nt, Homo Sapiens
uucuaacgcauaauauucugagcuagguauagugaccgugaacuguuucucugaaaaauuuuag

SEQ ID NO: 508904 - RNA, 64 nt, Homo Sapiens
gaugccuuuuggacacuuucucaguguagagaaaaccgugaagauucuguaauaggagauguaa

SEQ ID NO: 508905 - RNA, 64 nt, Homo Sapiens
caaauucuagcccaagucugguggucccauugccaccgugaagcugccacacuguagggcccag

SEQ ID NO: 508906 - RNA, 64 nt, Homo Sapiens
gacaucugccaugcccccagagaugaaaugagccaccgugaacauuggucauaaacccugagcc

SEQ ID NO: 508907 - RNA, 64 nt, Homo Sapiens
ucagccucuucccaggaaccaucgccuucuauaaaccgugaacucaagcaggcauuuuuuuuuu

SEQ ID NO: 508908 - RNA, 64 nt, Homo Sapiens
ugguuguaaaagagaaacuaagcauacugccguuaccgugaaacuacaggcacccaucagaaaa

SEQ ID NO: 508909 - RNA, 64 nt, Homo Sapiens
uacuucaaguaucuccuacacagacauacuuaucaccgugaaaaccugaaccauuuggauguua

SEQ ID NO: 508910 - RNA, 64 nt, Homo Sapiens
cuggaguagggagagcgaguuacauucugggacuaccgugaagcgucuauccugucccacuucc

SEQ ID NO: 508911 - RNA, 64 nt, Homo Sapiens
aaacuguguuuugaguuuaggcuguuugguuugaaccgugaacagcagcucuggaacgugaaga

SEQ ID NO: 508912 - RNA, 64 nt, Homo Sapiens
cuguagcauaaggucugguaacugcagaaacauaaccgugaagcucuuccuacccuccuccccc

SEQ ID NO: 508913 - RNA, 64 nt, Homo Sapiens
ccaggcccugggccugcuccuugccaccaaccgaaccgugaauguagggcccccagccucaccu

SEQ ID NO: 508914 - RNA, 64 nt, Homo Sapiens
cuaccaagaacuuuaggauccaauuuuccaagccaccgugaagccucuuauggcuacuauuaua

SEQ ID NO: 508915 - RNA, 64 nt, Homo Sapiens
ggaaaagaucauugcugaggguuggagaaggagaaccgugaacugaggaggagaagucccggcu

SEQ ID NO: 508916 - RNA, 64 nt, Homo Sapiens
ggccuuuccugaaagugacugaacaaacaacaucaccgugaauuuuccagcucugcaaaaacaa

SEQ ID NO: 508917 - RNA, 64 nt, Homo Sapiens
agaggguguggcuuuccaggggaggguugaaaccaccgugaacccugggcugggugcugggaag

SEQ ID NO: 508918 - RNA, 64 nt, Homo Sapiens
uggagccguuugaguucacacaccaagguucuugaccgugaaucaagugguaguuaugugaagu

SEQ ID NO: 508919 - RNA, 64 nt, Homo Sapiens
agaccauuucagguagaaguuguucccccucugaaccgugaaucgcacgucucaaauuuagacu

SEQ ID NO: 508920 - RNA, 64 nt, Homo Sapiens
acgaggucaggagaucgagaccguccuggcuaacaccgugaaaccccaucucuacuaaaaauac

SEQ ID NO: 508921 - RNA, 64 nt, Homo Sapiens
agaaacaauacacugccaaaauguuaaguugaccaccgugaaacuucucuauuggagugucugu

SEQ ID NO: 508922 - RNA, 64 nt, Homo Sapiens
cuuuuuauuccagucauaauaggugacaguguuaaccgugaaaacuugagaggcacucugcccu

SEQ ID NO: 508923 - RNA, 64 nt, Homo Sapiens
cccgucucuacuaaaaauaccccuccuggcuaacaccgugaaacacaaggucaggagauugaga

SEQ ID NO: 508924 - RNA, 64 nt, Homo Sapiens
uguacacuuagagguaacuaaggcuaguuugaaaaccgugaauuaagauauucuuaucaguaua

SEQ ID NO: 508925 - RNA, 64 nt, Homo Sapiens
cagugcccaccugccucacuccucccuaucauguaccgugaaaacccccucugauggccucaag

SEQ ID NO: 508926 - RNA, 64 nt, Homo Sapiens
acugcaaugcaagcgggucuuugugccagcgagcaccgugaacgauucauguaacauucuaaaa

SEQ ID NO: 508927 - RNA, 64 nt, Homo Sapiens
caucaacaccacgacgucuaugcuuuggaaaccaaccgugaacaacuauagcaauauuuaaaga

SEQ ID NO: 508928 - RNA, 64 nt, Homo Sapiens
cggcuuccucugagcauucgagguugagaugaucaccgugaaucaccccaaggaacgauuucuc

SEQ ID NO: 508929 - RNA, 64 nt, Homo Sapiens
caaaagccuuuggguuuauuauaaaucuuucuuaaccgugaaagcugacauuugaagaaaacgu

SEQ ID NO: 508930 - RNA, 64 nt, Homo Sapiens
uucauggagcaggcaaaaccagacgucugggaagaccgugaacuuaaggagucugauucuccga

SEQ ID NO: 508931 - RNA, 64 nt, Homo Sapiens
ucauuacguggcccucagccagugccuaaggcucaccgugaaaauggaguccugcaaaggcaaa

SEQ ID NO: 508932 - RNA, 64 nt, Homo Sapiens
uuugccacaacacacugcccgcagaaauggacuuaccgugaagccaauaaaguucaagcuucag

SEQ ID NO: 508933 - RNA, 64 nt, Homo Sapiens
ugaucagaggauaucuuauugcgugagcuuauguaccgugaagagagcagaaugugaggagcac

SEQ ID NO: 508934 - RNA, 64 nt, Homo Sapiens
uugguuucauuuaacaaaagauggccaaauauauaccgugaaaauuauucacuacgaagcuaaa

SEQ ID NO: 508935 - RNA, 64 nt, Homo Sapiens
uccuuccucaucgggucugugaagugugaaggugaccgugaacaaaaugcccucauaguagugg

SEQ ID NO: 508936 - RNA, 64 nt, Homo Sapiens
aguacagaggccauugaagccuuuugcuccucuuaccgugaaaaugaaauguuagccauuguau

SEQ ID NO: 508937 - RNA, 64 nt, Homo Sapiens
acaaccugaaggccaucccgucggucugcacguaaccgugaagacguguggccgcgucccaccu

SEQ ID NO: 508938 - RNA, 64 nt, Homo Sapiens
gaauucucugagcuggugguugagugaccgucccaccgugaaguaugagguucacaguagacuu

SEQ ID NO: 508939 - RNA, 64 nt, Homo Sapiens
ccuucuggagaugacaacugaguggggaaaacagaccgugaacacaaaacaucaaguuccacac

SEQ ID NO: 508940 - RNA, 64 nt, Homo Sapiens
caggaggguccuuguggacguggagaggggccgaaccgugaagggcuggaggccccggcggcua

SEQ ID NO: 508941 - RNA, 64 nt, Homo Sapiens
ggaagcggaagagccgguggcagccuccgcagccaccgugaagauccagcugcccccgggaagc

SEQ ID NO: 508942 - RNA, 64 nt, Homo Sapiens
uaauaagguucacuguugacauaaguucgaugacaccgugaaucugauugauuuuuaucuugcu

SEQ ID NO: 508943 - RNA, 64 nt, Homo Sapiens
caucuccuugaagccauaacccuuuccugcccggaccgugaauuaggcucccucaggaccccau

SEQ ID NO: 508944 - RNA, 64 nt, Homo Sapiens
aucaguaaaucagauucuguccucuucucugcauaccgugaauuuauaguuaaggaucccuuug

SEQ ID NO: 508945 - RNA, 64 nt, Homo Sapiens
uacuuuguauuguccuauuagguucaccauugagaccgugaagauaaaacagaguaaucuuguu

SEQ ID NO: 508946 - RNA, 64 nt, Homo Sapiens
cauucccaucaguccauuccaacacuguuuacacaccgugaaucgccuuagagugauugcagug

SEQ ID NO: 508947 - RNA, 64 nt, Homo Sapiens
gcucguuagagccaguuuugaaacguuuggucuuaccgugaacggaggcuggcuuggcuuagcc

SEQ ID NO: 508948 - RNA, 64 nt, Homo Sapiens
auuuugaggaaaaggaggaucagaaguucaagggaccgugaaagcccucagagucagcaccuag

SEQ ID NO: 508949 - RNA, 64 nt, Homo Sapiens
uuuugauguauuauaggcaggaaguguuuuugcuaccgugaaaccuuuaccuagaucagccauc

SEQ ID NO: 508950 - RNA, 64 nt, Homo Sapiens
aaucaagccugugaguugcgucgccguaaacuggaccgugaagaauccacgccaugaucaugua

SEQ ID NO: 508951 - RNA, 64 nt, Homo Sapiens
gcaauguugaagugaccauaaaguggucacuuccaccgugaagcgaaagagccaguagugaauc

SEQ ID NO: 508952 - RNA, 64 nt, Homo Sapiens
cagcaguggaguaaguauuuagaagugugaauucaccgugaaauaggugagauaaauuaaaaga

SEQ ID NO: 508953 - RNA, 64 nt, Homo Sapiens
ugaaaaggugaaacuggugcuucccaucaguuuuaccgugaaugcuaaacauuuagcgugcggu

SEQ ID NO: 508954 - RNA, 64 nt, Homo Sapiens
ccugcuuccucccucgggcaacaugugguaccagaccgugaacacuucaccuccauccuggugg

SEQ ID NO: 508955 - RNA, 64 nt, Homo Sapiens
aaauuaccugagacccagaggcgaagaggucuugaccgugaaggagaggaagggaaaggcuacc

SEQ ID NO: 508956 - RNA, 64 nt, Homo Sapiens; identical to SEQ ID NO: 382042

SEQ ID NO: 508957 - RNA, 64 nt, Homo Sapiens; identical to SEQ ID NO: 382043

SEQ ID NO: 508958 - RNA, 64 nt, Homo Sapiens; identical to SEQ ID NO: 382044

SEQ ID NO: 508959 - RNA, 64 nt, Homo Sapiens; identical to SEQ ID NO: 382045

SEQ ID NO: 508960 - RNA, 64 nt, Homo Sapiens; identical to SEQ ID NO: 382046

SEQ ID NO: 508961 - RNA, 64 nt, Homo Sapiens; identical to SEQ ID NO: 382047

SEQ ID NO: 508962 - RNA, 64 nt, Homo Sapiens; identical to SEQ ID NO: 382048

SEQ ID NO: 508963 - RNA, 64 nt, Homo Sapiens; identical to SEQ ID NO: 382049

SEQ ID NO: 508964 - RNA, 64 nt, Homo Sapiens; identical to SEQ ID NO: 382050

SEQ ID NO: 508965 - RNA, 64 nt, Homo Sapiens; identical to SEQ ID NO: 382051

SEQ ID NO: 508966 - RNA, 64 nt, Homo Sapiens; identical to SEQ ID NO: 382052

SEQ ID NO: 508967 - RNA, 64 nt, Homo Sapiens; identical to SEQ ID NO: 382053

SEQ ID NO: 508968 - RNA, 64 nt, Homo Sapiens; identical to SEQ ID NO: 382054

SEQ ID NO: 508969 - RNA, 64 nt, Homo Sapiens; identical to SEQ ID NO: 382055

SEQ ID NO: 508970 - RNA, 64 nt, Homo Sapiens; identical to SEQ ID NO: 382056

SEQ ID NO: 508971 - RNA, 64 nt, Homo Sapiens; identical to SEQ ID NO: 382057

SEQ ID NO: 508972 - RNA, 64 nt, Homo Sapiens; identical to SEQ ID NO: 382058

SEQ ID NO: 508973 - RNA, 64 nt, Homo Sapiens; identical to SEQ ID NO: 382059

SEQ ID NO: 508974 - RNA, 64 nt, Homo Sapiens; identical to SEQ ID NO: 382060

SEQ ID NO: 508975 - RNA, 64 nt, Homo Sapiens; identical to SEQ ID NO: 382061

SEQ ID NO: 508976 - RNA, 64 nt, Homo Sapiens
caaguccuuguauucuaaaauagccaagcaaaaugauaguaaauucuuugucuuuguucuuuca

SEQ ID NO: 508977 - RNA, 64 nt, Homo Sapiens
guggcuugccugugccucuggguggauuacauaugauaguaaagcccaccuguuuggaugggag

SEQ ID NO: 508978 - RNA, 64 nt, Homo Sapiens
ugucuugagaaauuuacuugucacucuugcuucugauaguaaaggggauggugcgauagauuca

SEQ ID NO: 508979 - RNA, 64 nt, Homo Sapiens
aacgccagaaacuuuucaguccagcuauucauuagauaguaauugaagauauguauaaauauua

SEQ ID NO: 508980 - RNA, 64 nt, Homo Sapiens
aaugacaacauugagcccacacugcaguuuugaagauaguaacugauggcuggugggaaagagu

SEQ ID NO: 508981 - RNA, 64 nt, Homo Sapiens
aaauugcucuuccuaccccaccuggagaggcagggauaguaaaugauuacuaacccuuccugau

SEQ ID NO: 508982 - RNA, 64 nt, Homo Sapiens
gagcaggggcuacaaagaggccucgcuuccuggagauaguaacuaggcuggaacauagugucug

SEQ ID NO: 508983 - RNA, 64 nt, Homo Sapiens
ccuacuugcagguuguuguccauuaguugaaagggauaguaauaccucugagcccgggucucuu

SEQ ID NO: 508984 - RNA, 64 nt, Homo Sapiens
auaauaaauguaggcucagcuauguuguuguuuugauaguaauagcauguuucuucaugaaaag

SEQ ID NO: 508985 - RNA, 64 nt, Homo Sapiens
acaacauuuuuaacucucaucauuugcaacuagggauaguaaguauggcacugucauguuuuaa

SEQ ID NO: 508986 - RNA, 64 nt, Homo Sapiens
gaggugacaacccacccagaaaccagggcucugggauaguaagaucauuaauucuagaaacuau

SEQ ID NO: 508987 - RNA, 64 nt, Homo Sapiens
aaggccacuguuagguuuccccaggggagggugugauaguaaggauaggaugguaaugccaguc

SEQ ID NO: 508988 - RNA, 64 nt, Homo Sapiens
cgugagacugaaguugcuuaaugcccacgagggugauaguaauucuuuaggguaaccaucaugu

SEQ ID NO: 508989 - RNA, 64 nt, Homo Sapiens
gacuuuauucuaacuugagacaguuuuuguuucugauaguaauggcuauaggaucuuauguaaa

SEQ ID NO: 508990 - RNA, 64 nt, Homo Sapiens
cucggaguuuuuauaauuuuuuugcaaagugcaugauaguaaugccauaagugcuugugaggua

SEQ ID NO: 508991 - RNA, 64 nt, Homo Sapiens
uguagaaaccucuucugauuugguggguaaaugugauaguaaauuauauggcagaggugauggc

SEQ ID NO: 508992 - RNA, 64 nt, Homo Sapiens
augugguaccaauccucccgggaaucugaagucagauaguaaggagcacaacuacauacaucca

SEQ ID NO: 508993 - RNA, 64 nt, Homo Sapiens
acaaaauaaagcaagcuaucuuggaccuccuugagauaguaacaucaauuguuaguuauaauug

SEQ ID NO: 508994 - RNA, 64 nt, Homo Sapiens
uguuucaucagaucuugaucaguuuacuaaagaugauaguaaacucaguauuucucccacagcu

SEQ ID NO: 508995 - RNA, 64 nt, Homo Sapiens
ucagauaggacaacacugcuggguuuuacauccagauaguaauaaacaccauuucaucauuuuc

SEQ ID NO: 508996 - RNA, 64 nt, Homo Sapiens
agacuuauucgacucauuaaugaggaaaccagcagauaguaaaccugguucaaaguacaauuca

SEQ ID NO: 508997 - RNA, 64 nt, Homo Sapiens
ucccuuugaggucucuauggcucugauuguacaugauaguaaguguaagccauguaaaaaguaa

SEQ ID NO: 508998 - RNA, 64 nt, Homo Sapiens
uaagcaggauugaauuuaccagaggcuaaguucagauaguaagaauaaugcauaugugauuguu

SEQ ID NO: 508999 - RNA, 64 nt, Homo Sapiens
ugaguguaugaguagccaggguaagggguaaaaggauaguaagcauagaaaccacuagaaagug

SEQ ID NO: 509000 - RNA, 64 nt, Homo Sapiens
acuauuacauugaauggagucccuuggauauuuugauaguaaaauuaauagccauaaaguccua

SEQ ID NO: 509001 - RNA, 64 nt, Homo Sapiens
gcggcaauguuaagacaagacuuucaaaugagaugauaguaaauacccaacccaaacacaucag

SEQ ID NO: 509002 - RNA, 64 nt, Homo Sapiens
caauaccuccaccuuaauuuauggauggaugaaggauaguaauggcuuugaagaggaagccauu

SEQ ID NO: 509003 - RNA, 64 nt, Homo Sapiens
gcaccuagugugauagauuaaaaaaaaaacucaagauaguaaaauucucuaaaacucaaaaaaa

SEQ ID NO: 509004 - RNA, 64 nt, Homo Sapiens
uucuacuguauggaauacaaaaaaucauuguauggauaguaaaaacuauuuaacuugagcuuua

SEQ ID NO: 509005 - RNA, 64 nt, Homo Sapiens
auccugggcacaaagugccugaugucaaaaugaagauaguaaaacaagggaggaagcaguggau

SEQ ID NO: 509006 - RNA, 64 nt, Homo Sapiens
ugaaaaauuccuuuguguuucuauugacuucaaugauaguaagaaaagugguuguuaguuauag

SEQ ID NO: 509007 - RNA, 64 nt, Homo Sapiens
guuuuaaagugugcuuguguugucaaaaauaucagauaguaauacacagugagcauuuuuaaac

SEQ ID NO: 509008 - RNA, 64 nt, Homo Sapiens
cuguuucuaauuugucuuaacccuaguuuucauugauaguaacguaaaguuacaggaacacgau

SEQ ID NO: 509009 - RNA, 64 nt, Homo Sapiens
caagccagagaucuucuaacaggaaacaaagucugauaguaaaaaauaaaagaaagucauaugu

SEQ ID NO: 509010 - RNA, 64 nt, Homo Sapiens
caaucccuaagccuuaagucuuaggcaaauuccagauaguaaaacaagaacuuugaaggucaaa

SEQ ID NO: 509011 - RNA, 64 nt, Homo Sapiens
cuaguuuuugacacagugcauuagaaaaagucuugauaguaaaugcuguuaaugcucugugagu

SEQ ID NO: 509012 - RNA, 64 nt, Homo Sapiens
cacaguccucagaagccuauauuguuauuuuaacgauaguaauucagugcauggaaucuccauc

SEQ ID NO: 509013 - RNA, 64 nt, Homo Sapiens
guagauggaaaaacuugugcuauauuccuuugaagauaguaacuuuuuugucaacauugugaug

SEQ ID NO: 509014 - RNA, 64 nt, Homo Sapiens
ugguacuuacuguggacuucauagcuuacugacagauaguaauuugauuuauuuauugacagac

SEQ ID NO: 509015 - RNA, 64 nt, Homo Sapiens
ugaaugugacaugcaccaauuuuguucuuauauggauaguaauagauauaguugacuaaaugua

SEQ ID NO: 509016 - RNA, 64 nt, Homo Sapiens
caauuucagcugagacauaauuuaaugcugauuugauaguaaauucagaaucuuugcugguccc

SEQ ID NO: 509017 - RNA, 64 nt, Homo Sapiens
ggucaggauauauuuuaauggcuuuuauuuccuggauaguaacuuuuauguuaacauuguguua

SEQ ID NO: 509018 - RNA, 64 nt, Homo Sapiens
ggauacaauguauaagcuaccaggcacugagaaugauaguaauacaguuaaacugauuaguauu

SEQ ID NO: 509019 - RNA, 64 nt, Homo Sapiens
aggcccuugguuauuuaaaucuuggauuauuugugauaguaaucacaaauuuuuggcuaauuuu

SEQ ID NO: 509020 - RNA, 64 nt, Homo Sapiens
ccuuuaccuuuuaauaucuaguuuuuccaaaaaugauaguaauaucuuuugaagaacuaugcuu

SEQ ID NO: 509021 - RNA, 64 nt, Homo Sapiens
uugguguuugguuggugugcauuucuuuagugucgauaguaacuggauuuuucuuuuuccuuaa

SEQ ID NO: 509022 - RNA, 64 nt, Homo Sapiens
auaguaaauauaaggucacugagauucuaaguaagauaguaaaucuaaggucacugagccaaau

SEQ ID NO: 509023 - RNA, 64 nt, Homo Sapiens
gaaugcuguguuaaauaaaccucaaaaugucuaagauaguaacaaugaagauaaaaagacauuc

SEQ ID NO: 509024 - RNA, 64 nt, Homo Sapiens
cugggggaugucuguccuaaaagcugacugcuaggauaguaaggaucaucuugccugggcuaug

SEQ ID NO: 509025 - RNA, 64 nt, Homo Sapiens
cuuuugguacuaccauuuggggaagccaagcaaggauaguaaauugaccagaacacaguugugg

SEQ ID NO: 509026 - RNA, 64 nt, Homo Sapiens
uauauggggugagaaguuugggcugaucgccagugauaguaaacaaaaucugugcagagggccu

SEQ ID NO: 509027 - RNA, 64 nt, Homo Sapiens
auuauuuuuaauuuuucuggcugaauaucaaauugauaguaacaacagaagcauaauuuuagga

SEQ ID NO: 509028 - RNA, 64 nt, Homo Sapiens
uugagggcuucuugaucacagaaaacucagaagagauaguaaugcucaggacaggagcggcagc

SEQ ID NO: 509029 - RNA, 64 nt, Homo Sapiens
caaacacaaggaaagaucagaugaaacagaagaugauaguaaaagugauccuaaguaagaacau

SEQ ID NO: 509030 - RNA, 64 nt, Homo Sapiens
gcagaaacaaaaacccaacauauaugggcuguuagauaguaauuguaauuucguauaaauagua

SEQ ID NO: 509031 - RNA, 64 nt, Homo Sapiens
aaaaucugugcagagggccuggcugaucgccagugauaguaaacuauauggggugagaaguuua

SEQ ID NO: 509032 - RNA, 64 nt, Homo Sapiens
uuaagaguacucaucgcucuuaauauaauuuccagauaguaauugguaauuggcagauucuaaa

SEQ ID NO: 509033 - RNA, 64 nt, Homo Sapiens
caauccuaagcaaaaagaacucuaaagaaauauugauaguaaggaugguaaguacuugaguaaa

SEQ ID NO: 509034 - RNA, 64 nt, Homo Sapiens
augucucuuuuguuaacagaaaccacuuuuaaaggauaguaauuauucuuguuuauaacagugc

SEQ ID NO: 509035 - RNA, 64 nt, Homo Sapiens
ugaagaaaggaggacuuuuaaaaauuuaagguaagauaguaauagcuucaaaagaacacauaca

SEQ ID NO: 509036 - RNA, 64 nt, Homo Sapiens
caauuuagaaccagauaugcuuuucuuuugggaggauaguaaaaaugcugagaguagcagaugc

SEQ ID NO: 509037 - RNA, 64 nt, Homo Sapiens
acaccugacaacuaaacauaguuucagauuaaaugauaguaaaacaaagaaagguuguggaaau

SEQ ID NO: 509038 - RNA, 64 nt, Homo Sapiens
aaguaguauuuuauguguuuuauaaaauauuuaugauaguaauaucauguuuuaaauaggaauu

SEQ ID NO: 509039 - RNA, 64 nt, Homo Sapiens
augcuuuguuuacguguaaaggaaaauaauguuugauaguaaauguccacuuaaaauacaugaa

SEQ ID NO: 509040 - RNA, 64 nt, Homo Sapiens
cuugaucaucugcuuccuuuuugaauuuuuaacagauaguaaguaaauuuggugguuuuuuccc

SEQ ID NO: 509041 - RNA, 64 nt, Homo Sapiens
uuuguuuacuuuuuuaaccaaaauccaaaugcaggauaguaauuaccauggauuuaacuuauga

SEQ ID NO: 509042 - RNA, 64 nt, Homo Sapiens
agaaaugauguugguuuaccuuuuccuaguugaagauaguaauuagguuucuaagcuguauacu

SEQ ID NO: 509043 - RNA, 64 nt, Homo Sapiens
caacaucacuagauuuaaauauuuaguauauuuugauaguaaaggguuuuguuucuugaauauc

SEQ ID NO: 509044 - RNA, 64 nt, Homo Sapiens
acauuaaagcuacgaaaacucauccuggcuguaggauaguaauaaaggaagaauuaugacuuca

SEQ ID NO: 509045 - RNA, 64 nt, Homo Sapiens
ucuauuuguuuuguacauguggguugaggugucagauaguaauaggagauuuaggguaagucau

SEQ ID NO: 509046 - RNA, 64 nt, Homo Sapiens
uauaaacacacacaaugauuacccuugggcugcagauaguaauauggacauuuuucuagcauuc

SEQ ID NO: 509047 - RNA, 64 nt, Homo Sapiens
cagcugaguuuuccucaguugaagacucuuaccagauaguaagauugagggcuugagaugaagg

SEQ ID NO: 509048 - RNA, 64 nt, Homo Sapiens
ugguuuaugaacuucccauaggaagcaccugagagauaguaaacugcagcaaguaacuaugugu

SEQ ID NO: 509049 - RNA, 64 nt, Homo Sapiens
cacucugucuuaaaagaaaaaaaaaaaagagagagauaguaaucucuugggcaaaagguaucaa

SEQ ID NO: 509050 - RNA, 64 nt, Homo Sapiens
ucauggcuuaugcuucuggucucagucuaccugagauaguaaaugaaugagaauuauccaaaug

SEQ ID NO: 509051 - RNA, 64 nt, Homo Sapiens
uagccaggcuggccagagaggggugcagggguuagauaguaagugguggucguuuguggucagu

SEQ ID NO: 509052 - RNA, 64 nt, Homo Sapiens
uaauuuuaauucuaagucaaaauacaaaugcauagauaguaaaugauaaaguagagacucauau

SEQ ID NO: 509053 - RNA, 64 nt, Homo Sapiens
cuugcagggcaggggaugcccagaagaguggugagauaguaaaacacuuauucccucauccuuu

SEQ ID NO: 509054 - RNA, 64 nt, Homo Sapiens
caguggccacguggaagcuuuguagcauugagcagauaguaaaauaucuuagaauuaaugaucu

SEQ ID NO: 509055 - RNA, 64 nt, Homo Sapiens
ugcaaagguccaaaccugggcagccgcuggaccugauaguaaggaguuacaaggcugaauggug

SEQ ID NO: 509056 - RNA, 64 nt, Homo Sapiens
acugcaacuaguagcuugauugaaguaucagauagauaguaaauucaauugccauuauuuguau

SEQ ID NO: 509057 - RNA, 64 nt, Homo Sapiens
ugaaaauugagaaauauaagcuuuuauagacagggauaguaaaaaaaacuuuuagccauagggu

SEQ ID NO: 509058 - RNA, 64 nt, Homo Sapiens
auuuaaaaauguaauagggauauacauuuuuggagauaguaaaauuaacauguuucaaauguuu

SEQ ID NO: 509059 - RNA, 64 nt, Homo Sapiens
caugaaaucgccuuuucaguaaacucacugcugagauaguaaacccuucuucauaaaucaugga

SEQ ID NO: 509060 - RNA, 64 nt, Homo Sapiens
uuccucuuccaaaguaaaauugcugugcuuuauggauaguaagaauggcccuagagugggaguc

SEQ ID NO: 509061 - RNA, 64 nt, Homo Sapiens
uuuucauaguaauucaaaugaacuuccuauuuuugauaguaaaugucauuuaauaguauacuug

SEQ ID NO: 509062 - RNA, 64 nt, Homo Sapiens
uccggcagagaugggguuuauguauguucagccagauaguaaaugggauuuuuggagaaauaag

SEQ ID NO: 509063 - RNA, 64 nt, Homo Sapiens
caaaaagcccacccaggacuuagccucaguugacgauaguaacaauggccuuaacaucuaccuu

SEQ ID NO: 509064 - RNA, 64 nt, Homo Sapiens
cccaccucucucauccuauuaaaaggaaaauguggauaguaaaaagauaauacguuacacuaag

SEQ ID NO: 509065 - RNA, 64 nt, Homo Sapiens
augugggcugccagccucucaaauguucuuucucgauaguaauauuaggagaacucggcuuuug

SEQ ID NO: 509066 - RNA, 64 nt, Homo Sapiens
gacagauuuuuaaugaacauucgcuguugcaccugauaguaaggguguaaggugauguucccgg

SEQ ID NO: 509067 - RNA, 64 nt, Homo Sapiens
augaaauagaacuuuauauuuuugcauauguauagauaguaauuauauuuaauguauaacuaua

SEQ ID NO: 509068 - RNA, 64 nt, Homo Sapiens
gguggucugguggauagcggguuagaauugacuggauaguaacaaagagguccucgaucauggu

SEQ ID NO: 509069 - RNA, 64 nt, Homo Sapiens
uuauuuaaaaaccuauuagugugugggaacacaagauaguaaacagagcaaagaaaagucuucu

SEQ ID NO: 509070 - RNA, 64 nt, Homo Sapiens
cuguuauagauuauuguuuaagugaaaauccuuagauaguaaaauauguauuuuuucuucuugg

SEQ ID NO: 509071 - RNA, 64 nt, Homo Sapiens
aaaguguguccaguuuugccugucuauaaaagaugauaguaauuuaccaagugacauuugcaga

SEQ ID NO: 509072 - RNA, 64 nt, Homo Sapiens
gcaaaaaauaaauaaaaaauaaaaauguaaauaugauaguaauaaaauagagcauaacgaaacu

SEQ ID NO: 509073 - RNA, 64 nt, Homo Sapiens
cuuugggccucacuuucccuaucugaauaauaaggauaguaaucccuugccuuuucucaaacca

SEQ ID NO: 509074 - RNA, 64 nt, Homo Sapiens
gaaggagaggaaacuugccuuuuuuauggcagaggauaguaaugaaaaugucucaguauuuuag

SEQ ID NO: 509075 - RNA, 64 nt, Homo Sapiens
ccaggccucucccucccgagugcauuuuuggggagauaguaaauguuuuauucggguguaucau

SEQ ID NO: 509076 - RNA, 64 nt, Homo Sapiens
gauaagugggugggaggcaccuguggaagacggggauaguaagaccauuucuggggccucauca

SEQ ID NO: 509077 - RNA, 64 nt, Homo Sapiens
ggggagggaggcugcugugguacccacagaaugugauaguaauagcaggcuuggaggguuaauu

SEQ ID NO: 509078 - RNA, 64 nt, Homo Sapiens
cgaccuuuaagaauuccuggccuuagucauuauggauaguaaauuuuucaggugucuacaucag

SEQ ID NO: 509079 - RNA, 64 nt, Homo Sapiens
uguauuuauuucaaagaugcgguacaaaaagguugauaguaacccuuuuucgauaauuuuagua

SEQ ID NO: 509080 - RNA, 64 nt, Homo Sapiens
auuuuugguugugccuagaaugagagguaguuuugauaguaaaaucagucagauuucugaaaag

SEQ ID NO: 509081 - RNA, 64 nt, Homo Sapiens
accaauguaacuaaguauuucuuucuuccucauagauaguaauuaauugucagauuccacuacc

SEQ ID NO: 509082 - RNA, 64 nt, Homo Sapiens
agacuggcuggcugaugagcuuaaaaaguagccagauaguaacacugccuuuuauuuuuuaacc

SEQ ID NO: 509083 - RNA, 64 nt, Homo Sapiens
acuccaaaaugaaauugguauauuaauuuucagggauaguaaauuagcauuagcacccccauua

SEQ ID NO: 509084 - RNA, 64 nt, Homo Sapiens
auuauuauuguucucauuuuugcgacaacccugagauaguaaguuguaaguucuauuuaauacu

SEQ ID NO: 509085 - RNA, 64 nt, Homo Sapiens
ggucaguauugaaaccuaaucuaauugcuuguaggauaguaaauuggcauauuaugauguaaug

SEQ ID NO: 509086 - RNA, 64 nt, Homo Sapiens
caccaccacggggacagccgagcauggacagguggauaguaaaucuguuggcugcaggacucag

SEQ ID NO: 509087 - RNA, 64 nt, Homo Sapiens
uaguagaguacucucuagcagaugaauaaaaugugauaguaacaaugcugucucuugugaaaua

SEQ ID NO: 509088 - RNA, 64 nt, Homo Sapiens
guuuaauaauuucuugugggaaguaaauccuuucgauaguaaaaucccacccucaacuccacca

SEQ ID NO: 509089 - RNA, 64 nt, Homo Sapiens
augauacacaucaauaaaggcaccacuuacccgggauaguaaacgugggccauuuuccugaacu

SEQ ID NO: 509090 - RNA, 64 nt, Homo Sapiens
ucaucuuuuaguguuuuuuuuuggacucgucagagauaguaaaaucccuuuucucuguaugcag

SEQ ID NO: 509091 - RNA, 64 nt, Homo Sapiens
gagggacuagcuuggccuuugcgcuuugauuccagauaguaagaugaguggaaguguuuaucga

SEQ ID NO: 509092 - RNA, 64 nt, Homo Sapiens
ucacauucagguuagauguuaccuccaccuauaugauaguaauuccuaauuuuauuuuuuauug

SEQ ID NO: 509093 - RNA, 64 nt, Homo Sapiens
cuccuugcaaguguucgagcgaaaacauaaaacagauaguaaaacuauauuuuuuucuuuuagg

SEQ ID NO: 509094 - RNA, 64 nt, Homo Sapiens
auuugaagcuuucuggaccuucuguggagggcccgauaguaaccguauggagagugggcagacu

SEQ ID NO: 509095 - RNA, 64 nt, Homo Sapiens
agauugauucaugauaauugacuuguguuaaguagauaguaaacaugaugcuuuucuucucaga

SEQ ID NO: 509096 - RNA, 64 nt, Homo Sapiens
ugccagucuguuuaucccuccagauacagucucugauaguaaacuuuucuuucucuuacacaaa

SEQ ID NO: 509097 - RNA, 64 nt, Homo Sapiens
cugcgggagggggagggggagugggcgggcaguggauaguaagacuuacugcagucgauuuggg

SEQ ID NO: 509098 - RNA, 64 nt, Homo Sapiens
acauggaauggagaaaaccaagauuccagauggggauaguaacuagaaggugcuucagaugcac

SEQ ID NO: 509099 - RNA, 64 nt, Homo Sapiens
gaagcucucugcagcugucucauuccuucccaacgauaguaacaggaaaugacucuuuagcauc

SEQ ID NO: 509100 - RNA, 64 nt, Homo Sapiens
acuuaggauaacuuagaaagagaagugcugguuagauaguaaaaguuuuaagggaaaaaaaauc

SEQ ID NO: 509101 - RNA, 64 nt, Homo Sapiens
uuguguccaggauguacaaagaacucucaaaccggauaguaagaaaacaaacagcccaagugaa

SEQ ID NO: 509102 - RNA, 64 nt, Homo Sapiens
uagugcuaugguuguuucuauaauucuaaccuuugauaguaaucagaauguauuacauuucauu

SEQ ID NO: 509103 - RNA, 64 nt, Homo Sapiens
agccuuucucggcaucaucuuguauuccuuaucagauaguaaguaaccuguaaguuuggaguau

SEQ ID NO: 509104 - RNA, 64 nt, Homo Sapiens
uccaauuuauuugcauuuuuaaacauuagccuaugauaguaauuuaauguagaaugaagauauu

SEQ ID NO: 509105 - RNA, 64 nt, Homo Sapiens
cucagaggaaacaguaagaagggauaaucauuaagauaguaaaacaggcaaagcagaaucacau

SEQ ID NO: 509106 - RNA, 64 nt, Homo Sapiens
uggauuuucaccagucauguguuaauuuacauuagauaguaaagaauggcuacacuaagacuga

SEQ ID NO: 509107 - RNA, 64 nt, Homo Sapiens
uaagugaaaaaaauagguaacaaaacaaccaccugauaguaaguuuucugauaagacuauagau

SEQ ID NO: 509108 - RNA, 64 nt, Homo Sapiens
uuuuacaagaaagaacagggcaggguccaagucugauaguaacccuucaaauuauugaccugga

SEQ ID NO: 509109 - RNA, 64 nt, Homo Sapiens
ggggcuggagacaaggauaaacacagaaucuccugauaguaaagcugaccccuucacuaugacu

SEQ ID NO: 509110 - RNA, 64 nt, Homo Sapiens
uagugcugacagauuccacuagcaugcugaguaggauaguaaaucaggaugcucauaacuuugu

SEQ ID NO: 509111 - RNA, 64 nt, Homo Sapiens; identical to SEQ ID NO: 156567

SEQ ID NO: 509112 - RNA, 64 nt, Homo Sapiens; identical to SEQ ID NO: 156568

SEQ ID NO: 509113 - RNA, 64 nt, Homo Sapiens; identical to SEQ ID NO: 156569

SEQ ID NO: 509114 - RNA, 64 nt, Homo Sapiens; identical to SEQ ID NO: 156570

SEQ ID NO: 509115 - RNA, 64 nt, Homo Sapiens; identical to SEQ ID NO: 156571

SEQ ID NO: 509116 - RNA, 64 nt, Homo Sapiens; identical to SEQ ID NO: 156572

SEQ ID NO: 509117 - RNA, 64 nt, Homo Sapiens; identical to SEQ ID NO: 156573

SEQ ID NO: 509118 - RNA, 64 nt, Homo Sapiens; identical to SEQ ID NO: 156574

SEQ ID NO: 509119 - RNA, 64 nt, Homo Sapiens; identical to SEQ ID NO: 156575

SEQ ID NO: 509120 - RNA, 64 nt, Homo Sapiens; identical to SEQ ID NO: 156576

SEQ ID NO: 509121 - RNA, 64 nt, Homo Sapiens; identical to SEQ ID NO: 156577

SEQ ID NO: 509122 - RNA, 64 nt, Homo Sapiens; identical to SEQ ID NO: 156578

SEQ ID NO: 509123 - RNA, 64 nt, Homo Sapiens; identical to SEQ ID NO: 156579

SEQ ID NO: 509124 - RNA, 64 nt, Homo Sapiens; identical to SEQ ID NO: 156580

SEQ ID NO: 509125 - RNA, 64 nt, Homo Sapiens; identical to SEQ ID NO: 156581

SEQ ID NO: 509126 - RNA, 64 nt, Homo Sapiens; identical to SEQ ID NO: 156582

SEQ ID NO: 509127 - RNA, 64 nt, Homo Sapiens; identical to SEQ ID NO: 156583

SEQ ID NO: 509128 - RNA, 64 nt, Homo Sapiens; identical to SEQ ID NO: 156584

SEQ ID NO: 509129 - RNA, 64 nt, Homo Sapiens; identical to SEQ ID NO: 156585

SEQ ID NO: 509130 - RNA, 64 nt, Homo Sapiens; identical to SEQ ID NO: 156586

SEQ ID NO: 509131 - RNA, 64 nt, Homo Sapiens; identical to SEQ ID NO: 156587

SEQ ID NO: 509132 - RNA, 64 nt, Homo Sapiens; identical to SEQ ID NO: 156588

SEQ ID NO: 509133 - RNA, 64 nt, Homo Sapiens; identical to SEQ ID NO: 156589

SEQ ID NO: 509134 - RNA, 64 nt, Homo Sapiens; identical to SEQ ID NO: 156590

SEQ ID NO: 509135 - RNA, 64 nt, Homo Sapiens; identical to SEQ ID NO: 156591

SEQ ID NO: 509136 - RNA, 64 nt, Homo Sapiens; identical to SEQ ID NO: 156592

SEQ ID NO: 509137 - RNA, 64 nt, Homo Sapiens; identical to SEQ ID NO: 156593

SEQ ID NO: 509138 - RNA, 64 nt, Homo Sapiens; identical to SEQ ID NO: 156594

SEQ ID NO: 509139 - RNA, 64 nt, Homo Sapiens; identical to SEQ ID NO: 156595

SEQ ID NO: 509140 - RNA, 64 nt, Homo Sapiens; identical to SEQ ID NO: 156596

SEQ ID NO: 509141 - RNA, 64 nt, Homo Sapiens; identical to SEQ ID NO: 156597

SEQ ID NO: 509142 - RNA, 64 nt, Homo Sapiens; identical to SEQ ID NO: 156598

SEQ ID NO: 509143 - RNA, 64 nt, Homo Sapiens; identical to SEQ ID NO: 156599

SEQ ID NO: 509144 - RNA, 64 nt, Homo Sapiens; identical to SEQ ID NO: 156600

SEQ ID NO: 509145 - RNA, 64 nt, Homo Sapiens; identical to SEQ ID NO: 156601

SEQ ID NO: 509146 - RNA, 64 nt, Homo Sapiens; identical to SEQ ID NO: 156602

SEQ ID NO: 509147 - RNA, 64 nt, Homo Sapiens; identical to SEQ ID NO: 156603

SEQ ID NO: 509148 - RNA, 64 nt, Homo Sapiens; identical to SEQ ID NO: 156604

SEQ ID NO: 509149 - RNA, 64 nt, Homo Sapiens; identical to SEQ ID NO: 156605

SEQ ID NO: 509150 - RNA, 64 nt, Homo Sapiens; identical to SEQ ID NO: 156606

SEQ ID NO: 509151 - RNA, 64 nt, Homo Sapiens; identical to SEQ ID NO: 156607

SEQ ID NO: 509152 - RNA, 64 nt, Homo Sapiens
cuaaguaggaagugaaaagagguaaaacuaccaccuggccuagcgucaggacuuuaucagcagg

SEQ ID NO: 509153 - RNA, 64 nt, Homo Sapiens
ugauuacuugcucugggcaaucuguaaaguuccccuggccuaaacaggcaaacauggucaguau

SEQ ID NO: 509154 - RNA, 64 nt, Homo Sapiens
gccggugauguggaugaguggugugguucagacccuggccuagguuacugcagccauucugugu

SEQ ID NO: 509155 - RNA, 64 nt, Homo Sapiens
ucauaaucucuaaguuugggaauaagugaauuuccuggccuacuuucccugccaagcaucgugc

SEQ ID NO: 509156 - RNA, 64 nt, Homo Sapiens
gauugggccacccuacccaguggaccaaacagcucuggccuaggaagcucugggagcuugacua

SEQ ID NO: 509157 - RNA, 64 nt, Homo Sapiens
ccccagccguggggcccgggcccugccugcccaucuggccuauacaggcauggcugucuccugc

SEQ ID NO: 509158 - RNA, 64 nt, Homo Sapiens
augacuuuuaaaagaucaaagugagccacccggccuggccuagaaaagcacugggauuacaggc

SEQ ID NO: 509159 - RNA, 64 nt, Homo Sapiens
cuggucucuuuaacucucucauuagccaccaugccuggccuauuaaagugcuggaauuacaggc

SEQ ID NO: 509160 - RNA, 64 nt, Homo Sapiens
acagcugccuccgggccucgccuuccacccugcccuggccuaccggcccggucccaguccggug

SEQ ID NO: 509161 - RNA, 64 nt, Homo Sapiens
acccugugccuguguuucauggcuggaugugcaucuggccuaugccagugucuggcccagccau

SEQ ID NO: 509162 - RNA, 64 nt, Homo Sapiens; identical to SEQ ID NO: 166002

SEQ ID NO: 509163 - RNA, 64 nt, Homo Sapiens; identical to SEQ ID NO: 166003

SEQ ID NO: 509164 - RNA, 64 nt, Homo Sapiens; identical to SEQ ID NO: 166004

SEQ ID NO: 509165 - RNA, 64 nt, Homo Sapiens; identical to SEQ ID NO: 166005

SEQ ID NO: 509166 - RNA, 64 nt, Homo Sapiens; identical to SEQ ID NO: 166006

SEQ ID NO: 509167 - RNA, 64 nt, Homo Sapiens; identical to SEQ ID NO: 166007

SEQ ID NO: 509168 - RNA, 64 nt, Homo Sapiens; identical to SEQ ID NO: 166008

SEQ ID NO: 509169 - RNA, 64 nt, Homo Sapiens; identical to SEQ ID NO: 166009

SEQ ID NO: 509170 - RNA, 64 nt, Homo Sapiens; identical to SEQ ID NO: 166010

SEQ ID NO: 509171 - RNA, 60 nt, Homo Sapiens; identical to SEQ ID NO: 166011

SEQ ID NO: 509172 - RNA, 64 nt, Homo Sapiens; identical to SEQ ID NO: 166012

SEQ ID NO: 509173 - RNA, 64 nt, Homo Sapiens
ccugagucugguggggacuuggagaaccuuuaugucuagcuaagggauuguaaauacaccgaug

SEQ ID NO: 509174 - RNA, 64 nt, Homo Sapiens
gggacuuggagaaccuuuguguccacacucuguaucuagcuaaucuaguggggauguggagaac

SEQ ID NO: 509175 - RNA, 64 nt, Homo Sapiens; identical to SEQ ID NO: 91216

SEQ ID NO: 509176 - RNA, 64 nt, Homo Sapiens; identical to SEQ ID NO: 91217

SEQ ID NO: 509177 - RNA, 64 nt, Homo Sapiens; identical to SEQ ID NO: 91218

SEQ ID NO: 509178 - RNA, 64 nt, Homo Sapiens; identical to SEQ ID NO: 91219

SEQ ID NO: 509179 - RNA, 64 nt, Homo Sapiens; identical to SEQ ID NO: 91220

SEQ ID NO: 509180 - RNA, 64 nt, Homo Sapiens; identical to SEQ ID NO: 91221

SEQ ID NO: 509181 - RNA, 64 nt, Homo Sapiens; identical to SEQ ID NO: 91222

SEQ ID NO: 509182 - RNA, 64 nt, Homo Sapiens; identical to SEQ ID NO: 91223

SEQ ID NO: 509183 - RNA, 64 nt, Homo Sapiens; identical to SEQ ID NO: 91224

SEQ ID NO: 509184 - RNA, 55 nt, Homo Sapiens; identical to SEQ ID NO: 91225

SEQ ID NO: 509185 - RNA, 64 nt, Homo Sapiens; identical to SEQ ID NO: 91226

SEQ ID NO: 509186 - RNA, 64 nt, Homo Sapiens; identical to SEQ ID NO: 91227

SEQ ID NO: 509187 - RNA, 64 nt, Homo Sapiens; identical to SEQ ID NO: 91228

SEQ ID NO: 509188 - RNA, 64 nt, Homo Sapiens; identical to SEQ ID NO: 91229

SEQ ID NO: 509189 - RNA, 64 nt, Homo Sapiens; identical to SEQ ID NO: 91230

SEQ ID NO: 509190 - RNA, 64 nt, Homo Sapiens; identical to SEQ ID NO: 91231

SEQ ID NO: 509191 - RNA, 64 nt, Homo Sapiens; identical to SEQ ID NO: 91232

SEQ ID NO: 509192 - RNA, 64 nt, Homo Sapiens; identical to SEQ ID NO: 91233

SEQ ID NO: 509193 - RNA, 64 nt, Homo Sapiens; identical to SEQ ID NO: 91234

SEQ ID NO: 509194 - RNA, 64 nt, Homo Sapiens; identical to SEQ ID NO: 91235

SEQ ID NO: 509195 - RNA, 64 nt, Homo Sapiens; identical to SEQ ID NO: 91236

SEQ ID NO: 509196 - RNA, 64 nt, Homo Sapiens; identical to SEQ ID NO: 91237

SEQ ID NO: 509197 - RNA, 64 nt, Homo Sapiens; identical to SEQ ID NO: 91238

SEQ ID NO: 509198 - RNA, 55 nt, Homo Sapiens; identical to SEQ ID NO: 91239

SEQ ID NO: 509199 - RNA, 64 nt, Homo Sapiens; identical to SEQ ID NO: 91240

SEQ ID NO: 509200 - RNA, 64 nt, Homo Sapiens; identical to SEQ ID NO: 91241

SEQ ID NO: 509201 - RNA, 64 nt, Homo Sapiens; identical to SEQ ID NO: 91242

SEQ ID NO: 509202 - RNA, 64 nt, Homo Sapiens; identical to SEQ ID NO: 91243

SEQ ID NO: 509203 - RNA, 64 nt, Homo Sapiens; identical to SEQ ID NO: 91244

SEQ ID NO: 509204 - RNA, 64 nt, Homo Sapiens; identical to SEQ ID NO: 91245

SEQ ID NO: 509205 - RNA, 64 nt, Homo Sapiens; identical to SEQ ID NO: 91246

SEQ ID NO: 509206 - RNA, 64 nt, Homo Sapiens; identical to SEQ ID NO: 91247

SEQ ID NO: 509207 - RNA, 64 nt, Homo Sapiens; identical to SEQ ID NO: 91248

SEQ ID NO: 509208 - RNA, 64 nt, Homo Sapiens; identical to SEQ ID NO: 91249

SEQ ID NO: 509209 - RNA, 64 nt, Homo Sapiens; identical to SEQ ID NO: 91250

SEQ ID NO: 509210 - RNA, 64 nt, Homo Sapiens; identical to SEQ ID NO: 91251

SEQ ID NO: 509211 - RNA, 64 nt, Homo Sapiens; identical to SEQ ID NO: 91252

SEQ ID NO: 509212 - RNA, 64 nt, Homo Sapiens; identical to SEQ ID NO: 91253

SEQ ID NO: 509213 - RNA, 64 nt, Homo Sapiens; identical to SEQ ID NO: 91254

SEQ ID NO: 509214 - RNA, 64 nt, Homo Sapiens; identical to SEQ ID NO: 91255

SEQ ID NO: 509215 - RNA, 64 nt, Homo Sapiens; identical to SEQ ID NO: 91256

SEQ ID NO: 509216 - RNA, 64 nt, Homo Sapiens; identical to SEQ ID NO: 91257

SEQ ID NO: 509217 - RNA, 64 nt, Homo Sapiens; identical to SEQ ID NO: 91258

SEQ ID NO: 509218 - RNA, 64 nt, Homo Sapiens; identical to SEQ ID NO: 91259

SEQ ID NO: 509219 - RNA, 64 nt, Homo Sapiens; identical to SEQ ID NO: 91260

SEQ ID NO: 509220 - RNA, 64 nt, Homo Sapiens; identical to SEQ ID NO: 91261

SEQ ID NO: 509221 - RNA, 64 nt, Homo Sapiens
augagaaugcucuuccuuauucugguagauuugacuuguuuauaauucugcacuuuagaagaaa

SEQ ID NO: 509222 - RNA, 64 nt, Homo Sapiens
gugugugugcguguguguguucaagugccuaaaucuuguuuaccuaucacuuuaaaaaaauaau

SEQ ID NO: 509223 - RNA, 64 nt, Homo Sapiens
aggaauaacauaaacuaauccauucuuaaguguacuuguuuauaugcauuucuucacaccagua

SEQ ID NO: 509224 - RNA, 64 nt, Homo Sapiens
uaggcaauacccuuguuaaugauuuuucuuuucccuuguuuaaucagagaccacagaccacagu

SEQ ID NO: 509225 - RNA, 64 nt, Homo Sapiens
aauagaguugaccuguuauuugcuuguuuacuugcuuguuuacccacaugcugguuuguuugcu

SEQ ID NO: 509226 - RNA, 64 nt, Homo Sapiens
ugcuuguuuaccaauagagugguuuguuugcuugcuuguuuacuccaguuuucugucacaugcu

SEQ ID NO: 509227 - RNA, 64 nt, Homo Sapiens
gucaucugacuucugaucaagcauuagauuuuaacuuguuuagauuuugucuuaaacaccagua

SEQ ID NO: 509228 - RNA, 64 nt, Homo Sapiens
uuuagauuuugucuuaaacaccaguaauauggcucuuguuuaucagcuaaucuugaauuuauuc

SEQ ID NO: 509229 - RNA, 64 nt, Homo Sapiens
uaaaaucacaaauguuuggaaaacacaaaaguaacuuguuuaucucagucuguacaaaaacagu

SEQ ID NO: 509230 - RNA, 64 nt, Homo Sapiens
auauucucagaauguuaucaccuguuugucaaagcuuguuuaaauuauaaaacacuuuuaauua

SEQ ID NO: 509231 - RNA, 64 nt, Homo Sapiens
aacuuuaagccuccuuuuagagauauuuuuaaaacuuguuuaaaauuuuugugcaauucauaua

SEQ ID NO: 509232 - RNA, 64 nt, Homo Sapiens
acaaaaaaagaaaguuauucuuaguaaggaacuucuuguuuaauagcauuuuuguuuauuuuaa

SEQ ID NO: 509233 - RNA, 64 nt, Homo Sapiens
agugguagaacuauaugucuggucccuugcugcucuuguuuaggccacuaucauagauauauuu

SEQ ID NO: 509234 - RNA, 64 nt, Homo Sapiens
gaggugucaaaagacccaaauuaggugcauuuuacuuguuuaugauggcauaaccauugcuuua

SEQ ID NO: 509235 - RNA, 64 nt, Homo Sapiens
caugacgugugagcagaaugccuuauuuuguaaucuuguuuaacuuguugcuacugggacuuga

SEQ ID NO: 509236 - RNA, 64 nt, Homo Sapiens
aaauuuuaauuuuuuucuauuuugaaauuugaggcuuguuuacauugcuuagauaauuuagaau

SEQ ID NO: 509237 - RNA, 64 nt, Homo Sapiens
ugaaaacauaagugucucuggccaucaaagugaucuuguuuacagcagugcuuuugugaaacaa

SEQ ID NO: 509238 - RNA, 64 nt, Homo Sapiens
aauaauagacugcuuaucauuguguuuagaaccucuuguuuaaauucugcuuagaaucuaaaga

SEQ ID NO: 509239 - RNA, 64 nt, Homo Sapiens
guaaaucuaauaguacuuguuuugauagagguaacuuguuuaauagcauaagagaaucgagaaa

SEQ ID NO: 509240 - RNA, 64 nt, Homo Sapiens
aagguuuaguuuuguaauaaaaauuaaauuuaaacuuguuuacauagugcaauuugguucuuga

SEQ ID NO: 509241 - RNA, 64 nt, Homo Sapiens
aagaugucuucauucccaagaagaaacagcaggacuuguuuacaauuuccuauguuagcuguua

SEQ ID NO: 509242 - RNA, 64 nt, Homo Sapiens
caauguuucuucugcaacugaauacauuuaagaucuuguuuaaacauucauuaauguuaaggcu

SEQ ID NO: 509243 - RNA, 64 nt, Homo Sapiens
caaaugacugcaauaacaauaucaguuauuuauucuuguuuauugcaguuuuaaauuuuaugcc

SEQ ID NO: 509244 - RNA, 64 nt, Homo Sapiens
ggugagaauaggcuguauuagaaguauguagaaccuuguuuauauaaagcacauuugacucuaa

SEQ ID NO: 509245 - RNA, 64 nt, Homo Sapiens
gcugugaaguuuuaaggaauuucacagauggaaucuuguuuaagaaaggauggcucuguacaac

SEQ ID NO: 509246 - RNA, 64 nt, Homo Sapiens
aaaaaauaaaaucaucugaauuauagcagaguuucuuguuuaaaauaauuaaccuaaauuuuug

SEQ ID NO: 509247 - RNA, 64 nt, Homo Sapiens
auuggagauaaccacacuuacuuugugaaaugaacuuguuuacuauaagucauuuaguaacagc

SEQ ID NO: 509248 - RNA, 64 nt, Homo Sapiens
uuguauuugcaauaaacaacaacacuaaaaaaaacuuguuuaaaaaauugacaaauuguguaca

SEQ ID NO: 509249 - RNA, 64 nt, Homo Sapiens
uccaacaaaugguuagcuagacaacguagaauuacuuguuuacagacugucaucucauucuugu

SEQ ID NO: 509250 - RNA, 64 nt, Homo Sapiens
uuacucaagaauuagaaaacuuugcaagauuugacuuguuuaaaaaucacauuuauaagugaac

SEQ ID NO: 509251 - RNA, 64 nt, Homo Sapiens
uaaauagaguuuuaucaaaccacagccaugcuuacuuguuuagcuauugacuauggcugcuuua

SEQ ID NO: 509252 - RNA, 64 nt, Homo Sapiens
gcuaaugggucugggcagcaucccuucaugaauuuuuuuuuaauccaauauccguugauuugau

SEQ ID NO: 509253 - RNA, 64 nt, Homo Sapiens
ucccccuuccugacccuacuugcacugcuguggauuuuuuuaagagaagcaaaaacaaaaguaa

SEQ ID NO: 509254 - RNA, 64 nt, Homo Sapiens
gggaucguauuuuuauaucauauucacauauuuguuuuuuuaauugguguuagaugacaugauu

SEQ ID NO: 509255 - RNA, 64 nt, Homo Sapiens
aguuuuuuuuuucuuuugaaaugucccuuuaagauuuuuuuauucuaaacaaaauaaagaaaau

SEQ ID NO: 509256 - RNA, 64 nt, Homo Sapiens
ugacuuauauuuuggggagaugaggguuggguuuuuuuuuuaaugcuacgugacaguuugaaac

SEQ ID NO: 509257 - RNA, 64 nt, Homo Sapiens
cuuuggcucaagauggccuucauuuacguuuaguuuuuuuuaaaaccguggagguugcccacgg

SEQ ID NO: 509258 - RNA, 64 nt, Homo Sapiens
uguuagcuaauuccacuguguauauaaauuguauuuuuuuuaauuuguaaaaugcuauuuuuau

SEQ ID NO: 509259 - RNA, 64 nt, Homo Sapiens
gguuuguuuguuggguuguuuuuuguuuuuugguuuuuuuuaaugacaaugaagugacacuuug

SEQ ID NO: 509260 - RNA, 64 nt, Homo Sapiens
accaagggcgagauuuuauaugcacauuucuggauuuuuuuauacgguuuucauugacacucuu

SEQ ID NO: 509261 - RNA, 64 nt, Homo Sapiens
gcacucugcauguuuuuguuuuguuuuucgggguuuuuuuuaauugaagcccuaaaccaggaau

SEQ ID NO: 509262 - RNA, 64 nt, Homo Sapiens
gacugugauugugacuauaauacauuuuugguaauuuuuuuauaccuaauuuguauaggaagug

SEQ ID NO: 509263 - RNA, 64 nt, Homo Sapiens
aguuguuuuuuuuuuuuuuuguaauauacagcuuuuuuuuuaaggcaucauuuucgagggucua

SEQ ID NO: 509264 - RNA, 64 nt, Homo Sapiens
gggaaaaugauuguaauuuauuguucaugacuuuuuuuuuuaaauaaagugaguuucaacaaaa

SEQ ID NO: 509265 - RNA, 64 nt, Homo Sapiens
uuucacucuauagacuguuuuaagaguuuugggguuuuuuuaauugggugguuuguaaccccuu

SEQ ID NO: 509266 - RNA, 64 nt, Homo Sapiens
auuuuggugacaaaaaugaaggagcuuuguaaauuuuuuuuaaaauuaugaaucauaucaagua

SEQ ID NO: 509267 - RNA, 64 nt, Homo Sapiens
agacaaaggaggacuaagguaaucaauuugcaccuuuuuuuauuuuuauuuuuuuucuuuuuuu

SEQ ID NO: 509268 - RNA, 64 nt, Homo Sapiens
acuucuaaaggagagaaugucaaaaaguucuguauuuuuuuauauucuauauauuagguagguc

SEQ ID NO: 509269 - RNA, 64 nt, Homo Sapiens
ucacugaaacuuaguagccugcuuuuuuuuuuuuuuuuuuuagagcuauugcguaucuucccug

SEQ ID NO: 509270 - RNA, 64 nt, Homo Sapiens
guguuuuuuuuuuuguuguugguuuuuuuuuuuuuuuuuuuaacuugggaccaccaaguuguaa

SEQ ID NO: 509271 - RNA, 64 nt, Homo Sapiens
aaaauuaaauuaauccuugauaagaguugcuuuuuuuuuuuaggaguuaguccuugaccacuag

SEQ ID NO: 509272 - RNA, 64 nt, Homo Sapiens
ccuugguccugccucuuugaguauauuaguagguuuuuuuuauuuguuugagacagggucucac

SEQ ID NO: 509273 - RNA, 64 nt, Homo Sapiens
cacacagcuaauuuuuuuuuuuuuuuuuuuuuuuuuuuuuuagacggagccuugcucuguugcc

SEQ ID NO: 509274 - RNA, 64 nt, Homo Sapiens
auccuguuucagcuaaaugcagggaaacucaauguuuuuuuaaguuuuguuuucccuuuaaagc

SEQ ID NO: 509275 - RNA, 64 nt, Homo Sapiens
auguuuuuuuaaguuuuguuuucccuuuaaagccuuuuuuuaggccacauugacaguggugggc

SEQ ID NO: 509276 - RNA, 64 nt, Homo Sapiens
aguggcuggaaaguacaugguaaaacaaaguaaauuuuuuuauguucuuuuuuuuggucacagg

SEQ ID NO: 509277 - RNA, 64 nt, Homo Sapiens
uuauggugcucaccaaacgaaggguaucagcuauuuuuuuuaaaauucaaaaagaauaucccuu

SEQ ID NO: 509278 - RNA, 64 nt, Homo Sapiens
ggaaaugagguuucauaauucugccuuuugcagauuuuuuuacuuuaaagcugucagacucuuu

SEQ ID NO: 509279 - RNA, 64 nt, Homo Sapiens
acccuuacgaauccugaaaauuaugcuagcaugauuuuuuuauauauagaaguuuaaaaauaaa

SEQ ID NO: 509280 - RNA, 64 nt, Homo Sapiens
ucauaaaggauuauaaaauuuuuuuuuuuuuuuuuuuuuuuaaauuucuacuuaagggcaagua

SEQ ID NO: 509281 - RNA, 64 nt, Homo Sapiens
cuugucugccauucugaauaugcuuauuaaaauauuuuuuuaaacauauuugccuacauaauac

SEQ ID NO: 509282 - RNA, 64 nt, Homo Sapiens
uuuuaaauugguucuuuguuucugaagaaagaauuuuuuuuaacuucaugguuuuauuuauaau

SEQ ID NO: 509283 - RNA, 64 nt, Homo Sapiens
uauuuuuauauauauuccuucaugaugguguaauuuuuuuuaauuguccuaugcuuuguucggu

SEQ ID NO: 509284 - RNA, 64 nt, Homo Sapiens
auaauauaaaaauauuaaaagaacauaggcaggcuuuuuuuaaauuuggcuuuuuucuuuccuu

SEQ ID NO: 509285 - RNA, 64 nt, Homo Sapiens
auuaaauaaauagaaccacugagacaauaauguauuuuuuuaaaguggcaaaugugguuuucuu

SEQ ID NO: 509286 - RNA, 64 nt, Homo Sapiens
gcgcuuuuucaguauuuugaccauagggagauaauuuuuuuauaauacaaaaguaaccacuugg

SEQ ID NO: 509287 - RNA, 64 nt, Homo Sapiens
augcucaauuagguaagauuguaaaagcauugauuuuuuuuaauguacagagguagauuucaau

SEQ ID NO: 509288 - RNA, 64 nt, Homo Sapiens
gguauuuuaaaauaaugcuacuuucaaaguagcauuuuuuuaguuaguuuacagguuacauacc

SEQ ID NO: 509289 - RNA, 64 nt, Homo Sapiens
guuaaaugugaccaaaaaaauuaaaaguucacaauuuuuuuaauguagccauuugggguuaucu

SEQ ID NO: 509290 - RNA, 64 nt, Homo Sapiens
ucacugcuuucauucccacaaaaccaguauuacuuuuuuuuaaaaaaagaaagaaauuggaaau

SEQ ID NO: 509291 - RNA, 64 nt, Homo Sapiens
cacgcccggcuauguuuuuuuuuuuuuuuuuuuuuuuuuuuaacaauggauauucuguaaaaua

SEQ ID NO: 509292 - RNA, 64 nt, Homo Sapiens
gguuuucagugcaauuaaaccgagagaugucuuguuuuuuuaaaaagaauaguauuuaauaggu

SEQ ID NO: 509293 - RNA, 64 nt, Homo Sapiens
uagcuuuaucaacuuuuaaacauuaauaaacugauuuuuuuaaagaucccuuugugaagagcau

SEQ ID NO: 509294 - RNA, 64 nt, Homo Sapiens
uacauuguugaggaaguccuuuuuuuuuuuuuuuuuuuuuuaauugcucaagaaaugauucucu

SEQ ID NO: 509295 - RNA, 64 nt, Homo Sapiens
aauaaugugguaacuuugucaauuucccauuuuauuuuuuuaaauaaauauaugaucuaaaagc

SEQ ID NO: 509296 - RNA, 64 nt, Homo Sapiens
acucaguggaaagauaaacuaaguuuuaauguuauuuuuuuaaauuuaagcaaaauuuauuucu

SEQ ID NO: 509297 - RNA, 64 nt, Homo Sapiens
uuuaaaagucuuucucucucugauucagcuuaaauuuuuuuaucgaaaaagccauuaagguggu

SEQ ID NO: 509298 - RNA, 64 nt, Homo Sapiens
guggcccgagccugcuuccuauuuugauuuuuuuuuuuuuuaacugauagauggugcagcaugu

SEQ ID NO: 509299 - RNA, 64 nt, Homo Sapiens
aucagaugagugaguuguucacagauauuuuauguuuuuuuaauuuucuccaagaauauuuaua

SEQ ID NO: 509300 - RNA, 64 nt, Homo Sapiens
gauggaaagacuagagcuuauaaaaguacuuccauuuuuuuauucuccugaauaccaaaggcaa

SEQ ID NO: 509301 - RNA, 64 nt, Homo Sapiens
gccugggacccacagggagacuauaaucuccuuauuuuuuuacuccuacuccccagaggggccc

SEQ ID NO: 509302 - RNA, 64 nt, Homo Sapiens
ccuugauuuguguuguguccaguuugguuuugucuuuuuuuauuuggcaaguggaggaggcuuu

SEQ ID NO: 509303 - RNA, 64 nt, Homo Sapiens
guguguguguguguguguguguauacagacauuuuuuuuuuaacuuguugauucagaugucuug

SEQ ID NO: 509304 - RNA, 64 nt, Homo Sapiens
aaaaauuacagggaauuaaaauaauugccuuuuuuuuuuuuagaggguaagagauggguagaag

SEQ ID NO: 509305 - RNA, 64 nt, Homo Sapiens
uaugaaucccaugauuuggggguuuuuuucuuuuuuuuuuuauaccaguuuuuagcugguguuu

SEQ ID NO: 509306 - RNA, 64 nt, Homo Sapiens
uucugggguuuuguuuuuuaccuuuuuccccccuuuuuuuuaaauggagugugcuggaugucuc

SEQ ID NO: 509307 - RNA, 64 nt, Homo Sapiens
cuugcuucacuccaucagagaaugacuaucaauuuuuuuuuaacuguccuaucacguccucucc

SEQ ID NO: 509308 - RNA, 64 nt, Homo Sapiens
aggaacuucuagaauaacccagaugcgcuuuaauuuuuuuuaauauguuuugaucacagaacuu

SEQ ID NO: 509309 - RNA, 64 nt, Homo Sapiens
uuaagauuacaaauuauguguuuuauuuguugcuuuuuuuuaaccuuuuaauguauauucuugu

SEQ ID NO: 509310 - RNA, 64 nt, Homo Sapiens
aaggaauauggauauauuucuuuaagucugcagauuuuuuuauuauggugcagcuuuuuuuuaa

SEQ ID NO: 509311 - RNA, 64 nt, Homo Sapiens
uuaagucugcagauuuuuuuauuauggugcagcuuuuuuuuaauuauguuuuuaaaauuauaca

SEQ ID NO: 509312 - RNA, 64 nt, Homo Sapiens
auuuuuaaaugaagagcuauuuauauauauuauuuuuuuuuaagaaaggaggaaaagaaaccaa

SEQ ID NO: 509313 - RNA, 64 nt, Homo Sapiens
uuuuuuuaagaaaggaggaaaagaaaccaaaaguuuuuuuuaagaaaaaaaauccuucaaggga

SEQ ID NO: 509314 - RNA, 64 nt, Homo Sapiens
uaagugcaaacaaguauucauuuucauacaggaauuuuuuuaauauguuauuuuuuuaaaaguu

SEQ ID NO: 509315 - RNA, 64 nt, Homo Sapiens
uucauuuucauacaggaauuuuuuuaauauguuauuuuuuuaaaaguucauuuuucauuugccu

SEQ ID NO: 509316 - RNA, 64 nt, Homo Sapiens
ggacacaaucguuggaaccugaagaaucugaaguuuuuuuuaccaccaucuuuuucuacucugu

SEQ ID NO: 509317 - RNA, 64 nt, Homo Sapiens
agaauguggcacuaaaugcaguuucagauuuuauuuuuuuuaaucauaugaacuaaaauuguca

SEQ ID NO: 509318 - RNA, 64 nt, Homo Sapiens
augauaagauucuuuauuuaaauaugagagaauuuuuuuuuauccuuuauauucucucaauauc

SEQ ID NO: 509319 - RNA, 64 nt, Homo Sapiens
gaccuaggcuagaagauaagacuguuuuugacaauuuuuuuaucaagaaagagcaaauaaaaag

SEQ ID NO: 509320 - RNA, 64 nt, Homo Sapiens
ucccccccaacaaaguuuuuuuguuuuuuguuuuuuuuuuuaaguagaaauucccuccaguuuu

SEQ ID NO: 509321 - RNA, 64 nt, Homo Sapiens
aguagcauggaaaacguuugcuguuuuucccuuuuuuuuuuaauugcuuuuguuuaaaauuuga

SEQ ID NO: 509322 - RNA, 64 nt, Homo Sapiens
gagcauuaucuuuaguuacuugaagaguuucuaguuuuuuuaaaauacaguuuauguuaaaaua

SEQ ID NO: 509323 - RNA, 64 nt, Homo Sapiens
aggagggagaacuuuguaagaagcugcccucuguuuuuuuuauccacucguaaaucuggauuua

SEQ ID NO: 509324 - RNA, 64 nt, Homo Sapiens
guuucugcuguuugcuuuaaauacccuugggguuuuuuuuuaaacccuuacaaggggagcauca

SEQ ID NO: 509325 - RNA, 64 nt, Homo Sapiens
ugcgauaacccagaaagggcuuuuaaacaaaguauuuuuuuaggcuuuaauuuucagauuuuuu

SEQ ID NO: 509326 - RNA, 64 nt, Homo Sapiens
caaaguauuuuuuuaggugcuaauuuucagauuuuuuuuuuaaacguuguguuuuuuuuuucuu

SEQ ID NO: 509327 - RNA, 64 nt, Homo Sapiens
uauauauuucuuggaguaaaaauugucuuauuauuuuuuuuauaggugccugguuuagugcugu

SEQ ID NO: 509328 - RNA, 64 nt, Homo Sapiens
uuuuuucuuucuuccucuccaucuagguuuuuuuuuuuuuuaagagaggcagaaacuuugagca

SEQ ID NO: 509329 - RNA, 64 nt, Homo Sapiens
aucucuuucucauuagagauuuuuuuucugaauuuuuuuuuaacagugggacaccauucugaau

SEQ ID NO: 509330 - RNA, 64 nt, Homo Sapiens
uauuuucugagacuuggauugggauugucuuuuuuuuuuuuaauuuguguccuguaaccucauc

SEQ ID NO: 509331 - RNA, 64 nt, Homo Sapiens
ccuaaaaaaguaauguuuugaguucucacuaguguuuuuuuaaucuaaauguuauucaagauug

SEQ ID NO: 509332 - RNA, 64 nt, Homo Sapiens
ugacuaauugcccugcuguuauaacauguacuauuuuuuuuaauuaaauuuaauuuuauuacac

SEQ ID NO: 509333 - RNA, 64 nt, Homo Sapiens
uugagacggaguuuugcucuuuuuauuuuuuauuuuuuuuuauuuaguuauuuaacacagauuu

SEQ ID NO: 509334 - RNA, 64 nt, Homo Sapiens
uuuuauuuuuuuuuauuuuguuauuuaacacagauuuuuuuauucauucaauuuucaacuuuag

SEQ ID NO: 509335 - RNA, 64 nt, Homo Sapiens
ugggagagaagagaccugcccaaaaaaacucuuguuuuuuuaaucuauaaaauugucaagcuag

SEQ ID NO: 509336 - RNA, 64 nt, Homo Sapiens
gaaggcucauuuacuugaaauauauuuguuuuuuuuuuuuuaauagguacuuuaauuuuucaua

SEQ ID NO: 509337 - RNA, 64 nt, Homo Sapiens
uggaagcuucuagcaagcccuuuuugggggaaaauuuuuuuaaauuauuuguuuucaggggggu

SEQ ID NO: 509338 - RNA, 64 nt, Homo Sapiens
uguuuucagggggguuuuuuuaccauuguugggauuuuuuuauuuuguuuuuuguuugggguuu

SEQ ID NO: 509339 - RNA, 64 nt, Homo Sapiens
aggcuuuauucuccuuacaauaugcagaagucacuuuuuuuaucauauguauacauauauauga

SEQ ID NO: 509340 - RNA, 64 nt, Homo Sapiens
agucuauuuuucuacucaguuaaugagacauucuuuuuuuuauauuuacauuuaaugcuucacu

SEQ ID NO: 509341 - RNA, 64 nt, Homo Sapiens
cuaaaaaguggagggagauuucacauggaacgguuuuuuuuauauguaaguguuuuuuuuaaaa

SEQ ID NO: 509342 - RNA, 64 nt, Homo Sapiens
aucacauggaacgguuuuuuagauguguaaguguuuuuuuuaaaggcagaguacuauucuaucu

SEQ ID NO: 509343 - RNA, 64 nt, Homo Sapiens
ccacauuaaauuaucuguuuaauuugaaauucuuuuuuuuuaaggccaguuugaauuggaugua

SEQ ID NO: 509344 - RNA, 64 nt, Homo Sapiens
auagagacaggugucucacuagcagagccaagauuuuuuuuaaugugguuacaagcuaguaagu

SEQ ID NO: 509345 - RNA, 64 nt, Homo Sapiens
acagagauucagucugucacuuuauuguuguuuuuuuuuuuaagauuuaccuuguguuuuuuuu

SEQ ID NO: 509346 - RNA, 64 nt, Homo Sapiens
guuguuuuuuuuuuuaagacuuaccuuguguuuuuuuuuuuauugaccaagacauacaucugau

SEQ ID NO: 509347 - RNA, 64 nt, Homo Sapiens
aagccaguaucuugaaacuagcuaauuuuuuuuuuuuuuuuacgcaugguaagaaagaaucuuu

SEQ ID NO: 509348 - RNA, 64 nt, Homo Sapiens
auucaccuagaaucauaggguccuuggggaaaaauuuuuuuaaacugaaaguuuuaagaauugu

SEQ ID NO: 509349 - RNA, 64 nt, Homo Sapiens
aaaaauuugagaagucuacugccacugacauuucuuuuuuuaaaaagguacuuuaaauguagca

SEQ ID NO: 509350 - RNA, 64 nt, Homo Sapiens
ugacucuuaaugaaacuuuaaguauaugcccuauuuuuuuuaacacagguagccauauacagac

SEQ ID NO: 509351 - RNA, 64 nt, Homo Sapiens
uuaaagaguauaugugucuugcauaugaugguuuuuuuuuuacagucuuugugcauuuaguucc

SEQ ID NO: 509352 - RNA, 64 nt, Homo Sapiens
caacaucaugaauuuuaucucuccaugcuauguauuuuuuuaaggcuuggcauuugaguagcuu

SEQ ID NO: 509353 - RNA, 64 nt, Homo Sapiens
cugaagccccugauuuuauuuuguuuuuuguuuuuuuuuuuaaugcaauguuuguuuuuguuuu

SEQ ID NO: 509354 - RNA, 64 nt, Homo Sapiens
uguuggggagaggaggaugaaaucuaauugcuuuuuuuuuuaauuuuuugaaguacuggaucga

SEQ ID NO: 509355 - RNA, 64 nt, Homo Sapiens
cuaauaucacuuaaaucgaggaaaacuguaaauauuuuuuuaacgagggaagguggaccagaau

SEQ ID NO: 509356 - RNA, 64 nt, Homo Sapiens
guuugcaaauuaaaaagggcuuuuuuuguuuuuuuuuuuuuaagguguguguuugguguuuuug

SEQ ID NO: 509357 - RNA, 64 nt, Homo Sapiens
cuuuauuuugcuuuugggaaaaaggcaaaaaaaauuuuuuuagcgacagauuuugaaaaugagu

SEQ ID NO: 509358 - RNA, 64 nt, Homo Sapiens
uaaaaaaugccuuuucauugaugugccugcauuuuuuuuuuaauuucauccuugaaagauuuuu

SEQ ID NO: 509359 - RNA, 64 nt, Homo Sapiens
cuaugugcacacuuacaguaaaggagacaguuuauuuuuuuauuugccagguaguggaguaaaa

SEQ ID NO: 509360 - RNA, 64 nt, Homo Sapiens
uuggcuuuggccaguagcuaagcuuuuuuuuuuuuuuuuuuaaaagguaacagucguagauacc

SEQ ID NO: 509361 - RNA, 64 nt, Homo Sapiens
auuauaccaacaguggaucaucuugauggguaauuuuuuuuaagcuucugcacacgauugacuu

SEQ ID NO: 509362 - RNA, 64 nt, Homo Sapiens
uguauguacucaugguuguaauuugcaugagggauuuuuuuaaugaaagaaaauuuuuucuaca

SEQ ID NO: 509363 - RNA, 64 nt, Homo Sapiens
uuuaaaucacuguguuugguuuugugacuuuuuuuuuuuuuaaaacuucugcuaaaaacagguu

SEQ ID NO: 509364 - RNA, 64 nt, Homo Sapiens
acacagagauaaauguuuucuaugguagacaauuuuuuuuuaagcccacauuuuuggauauaug

SEQ ID NO: 509365 - RNA, 64 nt, Homo Sapiens
aauguuuuccccacaagucaacaaaauuggaagcuuuuuuuaaaguuuugcuuuucucucuucc

SEQ ID NO: 509366 - RNA, 64 nt, Homo Sapiens
cgcuacuaauguagagaaugcuuuuuuuuuuuuuuuuuuuuaagcagaaugauauuaauuuugc

SEQ ID NO: 509367 - RNA, 64 nt, Homo Sapiens
aaagaagaaauuuaaaaucaagaaaaacgcuuuuuuuuuuuaauggagaaguuuuaaaaaaccc

SEQ ID NO: 509368 - RNA, 64 nt, Homo Sapiens
uggauuguagaucaauccauacaauuugggucuauuuuuuuauaaauauugcaaauguaaaaug

SEQ ID NO: 509369 - RNA, 64 nt, Homo Sapiens
ggaaugugguacaaauuguugauuuuauuaaaucuuuuuuuaauuagaaaagugcuguuugagg

SEQ ID NO: 509370 - RNA, 64 nt, Homo Sapiens
uuaaaucugccuuuguuucuaugugauuccugcauuuuuuuaccugggacaggaacuaggauag

SEQ ID NO: 509371 - RNA, 64 nt, Homo Sapiens
aauuucaucccuauuuauaguaaaaugaaaaaucuuuuuuuaauauucccuuuuauuuccaaaa

SEQ ID NO: 509372 - RNA, 64 nt, Homo Sapiens
aaaaaaacuugauuuguuauacacuguucacuguuuuuuuuaaaagucaauaugcuuguauaaa

SEQ ID NO: 509373 - RNA, 64 nt, Homo Sapiens
cuugugcacugcaggccugguuuugaagcaaacuuuuuuuuaucguucaaauuuagguuuaaac

SEQ ID NO: 509374 - RNA, 64 nt, Homo Sapiens
ucaaguugagguuauuuuuguuuuugccuucgaauuuuuuuaagacacuacacuaucaaaauaa

SEQ ID NO: 509375 - RNA, 64 nt, Homo Sapiens
aaaaaaaaguuguuaguuugccuagaauaauggauuuuuuuaaacaaagaagcacaguugaagu

SEQ ID NO: 509376 - RNA, 64 nt, Homo Sapiens
uugugagcauaauuuauuguagccucauucagaauuuuuuuauuugaaucuugcaacuaaguuu

SEQ ID NO: 509377 - RNA, 64 nt, Homo Sapiens
caucaguggaaauuuuuauuuauuauggaaguauuuuuuuuaauuugcaauuauuagcugcuga

SEQ ID NO: 509378 - RNA, 64 nt, Homo Sapiens
ucaaugauuuggccugucuaauguuuuucuauauuuuuuuuauuucagaaguuaaugggcuuuu

SEQ ID NO: 509379 - RNA, 64 nt, Homo Sapiens
ggaaauguaacuuggaucuauccuuugacauuuuuuuuuuuagaaaaacaaaucuuggcagcug

SEQ ID NO: 509380 - RNA, 64 nt, Homo Sapiens
uaucuccgugaguuguaaaugauaugugaguuaauuuuuuuaaacagggugacaaaugccaaua

SEQ ID NO: 509381 - RNA, 64 nt, Homo Sapiens
ucuaagcauuucauuauguguauaaaaugcaauuuuuuuuuaaauugguuuggggacugguugu

SEQ ID NO: 509382 - RNA, 64 nt, Homo Sapiens
caggucuuacucugucacccuuucuuuuuucuuuuuuuuuuagaccaaucucuuccaguugcuu

SEQ ID NO: 509383 - RNA, 64 nt, Homo Sapiens
uuuuagauggugucucacgcuugggggguuuuuauuuuuuuauuuaaauauuuaauuucucauu

SEQ ID NO: 509384 - RNA, 64 nt, Homo Sapiens
aaugaaaaauauuuucgugaaacuuuauaacaauuuuuuuuaauaacuccauaucagaagaaau

SEQ ID NO: 509385 - RNA, 64 nt, Homo Sapiens
gguauaacuaucuugauuuuuucugaauugauguuuuuuuuaauaugcuugccugacuuaguau

SEQ ID NO: 509386 - RNA, 64 nt, Homo Sapiens
uucugaauuuugcaugcuugaaccaggcccugcauuuuuuuauaccugaggaauguaugugggc

SEQ ID NO: 509387 - RNA, 64 nt, Homo Sapiens
uuugauauacauugugugaauauaaaucaguauuuuuuuuuaauacuguacuuugccauuuuuc

SEQ ID NO: 509388 - RNA, 64 nt, Homo Sapiens
cugcacaguggcacaaaaaaguugagggccacuuuuuuuuuauagcacuuugcacuuaauggcu

SEQ ID NO: 509389 - RNA, 64 nt, Homo Sapiens
aaccgaauuucaucauuuaugguugcuacucaucuuuuuuuaaauuaguccccuauuagaauag

SEQ ID NO: 509390 - RNA, 64 nt, Homo Sapiens
gagaacuuuaaauuagucccuugucuagcuuucauuuuuuuacuuuaacaaaaaauugcagcua

SEQ ID NO: 509391 - RNA, 64 nt, Homo Sapiens
ugucagcagauacaauuugguuuaaaaucuugauuuuuuuuaaauuuaaaaucuuuagacaaua

SEQ ID NO: 509392 - RNA, 64 nt, Homo Sapiens
auugguuuuguuuuuauucuaaugaaaauucuauuuuuuuuagaaauuucauauguuuucaugu

SEQ ID NO: 509393 - RNA, 64 nt, Homo Sapiens
ggaaauaagauuuggucucugcacuuuuuuucauuuuuuuuaaucuuucaaaaagaucaauuug

SEQ ID NO: 509394 - RNA, 64 nt, Homo Sapiens
ccaugcugugaccuacaagcuagaucuuuuuucuuuuuuuuaaggauuacacccuuucccuuca

SEQ ID NO: 509395 - RNA, 64 nt, Homo Sapiens
uuuuuucuuaagagaacuuaaagaacuggugauuuuuuuuuaacaaaaaaagggaccauugcaa

SEQ ID NO: 509396 - RNA, 64 nt, Homo Sapiens
ggcuucagaaugggaagagauagucaagauuuuuuuuuuuuaaagccauguggccuaacuugau

SEQ ID NO: 509397 - RNA, 64 nt, Homo Sapiens
uuuuguaguuucagaaguuuuuuuguuuugguuuuuuuuuuaaagaaaugguagaaaauuugau

SEQ ID NO: 509398 - RNA, 64 nt, Homo Sapiens
acagaauguugcacuaauuugguagccugggaauuuuuuuuauugugcaguauguauuuaaauu

SEQ ID NO: 509399 - RNA, 64 nt, Homo Sapiens
ucaaguuuauugcagccuuucuuuuccuauuucuuuuuuuuaaggguuaguauuaacaaauggc

SEQ ID NO: 509400 - RNA, 64 nt, Homo Sapiens
acuaaguauguugguuaauaggaauccuuuuuuuuuuuuuuaaagacuaaaugugaaaaaauaa

SEQ ID NO: 509401 - RNA, 64 nt, Homo Sapiens
auuguaaaaaguaccuaaacauucgugaaaugauuuuuuuuagcugaaaaaugcuggcaagaag

SEQ ID NO: 509402 - RNA, 64 nt, Homo Sapiens
aaucuaagauggaaccuuucuuucuuucuuucuuuuuuuuuaaauuuuguauuuuccauccaac

SEQ ID NO: 509403 - RNA, 64 nt, Homo Sapiens
augguuuuuaaacuugggcuucauuuuaaacuuuuuuuuuuaaacccaguuauuucacuugauu

SEQ ID NO: 509404 - RNA, 64 nt, Homo Sapiens
gcacuuaauuuugugggaaaaauauugcuacaauuuuuuuuaaucucugaauguaauuucgaua

SEQ ID NO: 509405 - RNA, 64 nt, Homo Sapiens
cuuguuuuuucuuuuucuuuucuuuuuuuuuuuuuuuuuuuaaaaaagcaccuuuuuuuguugu

SEQ ID NO: 509406 - RNA, 64 nt, Homo Sapiens
acuccaaaaauaauuguccuuuuuucuuucuuucuuuuuuuacaauaaggcucuugaaaauugu

SEQ ID NO: 509407 - RNA, 64 nt, Homo Sapiens
uuuuagaagagaaucuugguuuugguaauucauuuuuuuuuaagaucauuaugugcaaaacacc

SEQ ID NO: 509408 - RNA, 64 nt, Homo Sapiens
aagucauuucuugaugugagcacuggagcuuuuuuuuuuuuacaacgugacaggaagaggaggg

SEQ ID NO: 509409 - RNA, 64 nt, Homo Sapiens
uaguuuuuguugaagcucuagcuuaagaagaaacuuuuuuuaaaaagacuguuuggggauucuu

SEQ ID NO: 509410 - RNA, 64 nt, Homo Sapiens
gaaaauacuaacaggauauaggacaagguguaaauuuuuuuauuauuauuuuaaagauaugauu

SEQ ID NO: 509411 - RNA, 64 nt, Homo Sapiens
ugagggauaagauacucaucaaauugcaaauucuuuuuuuuacagaaguguggguaacagucac

SEQ ID NO: 509412 - RNA, 64 nt, Homo Sapiens
uuuuuacagaaguguggguaacagucacagcaguuuuuuuuaccaacagcauacuuaacagacu

SEQ ID NO: 509413 - RNA, 64 nt, Homo Sapiens
ugggcaaugcauguauuaugcauuggaaagguauuuuuuuuaaguucuguuggcuagcuauggu

SEQ ID NO: 509414 - RNA, 64 nt, Homo Sapiens
uccugacacgcaauccgguaacauaagauugaaauuuuuuuacuuugucuuaauuuguuucuaa

SEQ ID NO: 509415 - RNA, 64 nt, Homo Sapiens
aaacaauaggaugcuaaacuaauucauuguaucuuuuuuuuacaaugguggaagcaacuuucug

SEQ ID NO: 509416 - RNA, 64 nt, Homo Sapiens
acccuuaagcaugcaggaugagguauuuggguuuuuuuuuuagaucgaucacaucuacagaaaa

SEQ ID NO: 509417 - RNA, 64 nt, Homo Sapiens
auauaucuuacagguguuuuuuuguauuuuuuuuuuuuuuuaguuugaaauguguaagcuuuga

SEQ ID NO: 509418 - RNA, 64 nt, Homo Sapiens
guuuaaaauguuggccaaaaaaaucaagauuuaauuuuuuuauuuguacugaaaaacuaaucau

SEQ ID NO: 509419 - RNA, 64 nt, Homo Sapiens
uucuggaaaaaauauuuuucuucauuuuaaaacuuuuuuuuaacuaauaauagcuuugaaagaa

SEQ ID NO: 509420 - RNA, 64 nt, Homo Sapiens
uuagaauugccaauacuucuacauuugagaaggguuuuuuuagaaauacauuuaguaaaguccc

SEQ ID NO: 509421 - RNA, 64 nt, Homo Sapiens
cagcccccguguuauuguccuuuugaacuguuuuuuuuuuuauuaaagccaaauuuguguugua

SEQ ID NO: 509422 - RNA, 64 nt, Homo Sapiens
gcaaaaccuguacaaugacaacccuggaaguugcuuuuuuuaaaaaaauaauaaauuucuuaaa

SEQ ID NO: 509423 - RNA, 64 nt, Homo Sapiens
cccagaaggacaggaggauucucaacacuuugaauuuuuuuaacuucauuuuucuacacugcua

SEQ ID NO: 509424 - RNA, 64 nt, Homo Sapiens
cauagucaaagccuugaaagcaucuacaaaucucuuuuuuuagguuuuguccauagcaucaguu

SEQ ID NO: 509425 - RNA, 64 nt, Homo Sapiens
uuucugacaagauaaaggaagucaccaaaauuucuuuuuuuaaauuguaucuaauccucaacaa

SEQ ID NO: 509426 - RNA, 64 nt, Homo Sapiens
gcauuggucugcugaccuguuuuuguguuuuucuuuuuuuuauacacaacauuuauuucaaacu

SEQ ID NO: 509427 - RNA, 64 nt, Homo Sapiens
uuagguacuaucugugaaguuacacuuuuuuuuuuuuuuuuaaagguagagaugugugugugug

SEQ ID NO: 509428 - RNA, 64 nt, Homo Sapiens
uaaugccuuccacauuaauuagauuuucuugcaguuuuuuuauggcauuuuuuuaaagaugccc

SEQ ID NO: 509429 - RNA, 64 nt, Homo Sapiens
auuaauuagauuuucuugcaguuuuuuuauggcauuuuuuuaaagaugcccuaaguguugaaga

SEQ ID NO: 509430 - RNA, 64 nt, Homo Sapiens
gauaaauuauguuuguacuaguugaugaaggaguuuuuuuuaaccuguuuauauaauuuugcag

SEQ ID NO: 509431 - RNA, 64 nt, Homo Sapiens
uaaaugcaguuuugccuaguucccuuuuuuuuucuuuuuuuacuuuuuuuuaaacguuuguaaa

SEQ ID NO: 509432 - RNA, 64 nt, Homo Sapiens
uuugccuaguucccuuuuuuuuucuuuuuuuacuuuuuuuuaaacguuuguaaaaaccucuuug

SEQ ID NO: 509433 - RNA, 64 nt, Homo Sapiens
cauuuaacauucauacaguuauauauaauauccuuuuuuuuaaagaaugguauuucacaaaaau

SEQ ID NO: 509434 - RNA, 64 nt, Homo Sapiens
auugcagagauauaaugauuacauuguuauuaaauuuuuuuaacacaaguaagugucaccauuu

SEQ ID NO: 509435 - RNA, 64 nt, Homo Sapiens
cacuauaaaggcagacuuagggccaacuuuuuuuuuuuuuuacaauuauuacaacacuaaagag

SEQ ID NO: 509436 - RNA, 64 nt, Homo Sapiens
uuacuugucaggauuucuccucuucagagagauuuuuuuuuauagcacagauuccuuugccccu

SEQ ID NO: 509437 - RNA, 64 nt, Homo Sapiens
aaacuaguuuacaauuugcaggcugaucuuaagauuuuuuuauaucuaauugcugcugccuuca

SEQ ID NO: 509438 - RNA, 64 nt, Homo Sapiens
gagagagcaaaugcaguaucuucagaaugauuuauuuuuuuaauuaauuguaaagacuugugcc

SEQ ID NO: 509439 - RNA, 64 nt, Homo Sapiens
uuuauauuuuuuauggggcauaguuccuuauguguuuuuuuaauguauuuucauacuacauacu

SEQ ID NO: 509440 - RNA, 64 nt, Homo Sapiens
uaaaauuguuacaucuagacaacuguaaacauuauuuuuuuagcuagugcaaaccuaguaccug

SEQ ID NO: 509441 - RNA, 64 nt, Homo Sapiens
uacacuuuucauuuugucuucuucuuuuuuuuucuuuuuuuagauggaguuuggcucuugucac

SEQ ID NO: 509442 - RNA, 64 nt, Homo Sapiens
uuuuucaauucuguuaucggcauuucuuucuuuuuuuuuuuaauguauagguguucugucauac

SEQ ID NO: 509443 - RNA, 64 nt, Homo Sapiens
aauacuaaagacuuuauaacugcaugaacuuggauuuuuuuaaucacucauaugguagaauuuu

SEQ ID NO: 509444 - RNA, 64 nt, Homo Sapiens
ugaaagccuacuuucugaagaaaauggugggauuuuuuuuuaucaugauuaaauaucaaaaaau

SEQ ID NO: 509445 - RNA, 64 nt, Homo Sapiens
aaaagagaaaaguaaaauauuucuuaugccuauuuuuuuuuaaaucaaaagggagagaacaaaa

SEQ ID NO: 509446 - RNA, 64 nt, Homo Sapiens
gugacagaacaagaccccgucucaaaaaaaauuuuuuuuuuaauaaaacaaaauuuguuugaaa

SEQ ID NO: 509447 - RNA, 64 nt, Homo Sapiens
uauauguguguguaucaaaaguggucucaaaauauuuuuuuaagaaaaaaagcaaaaacaaugu

SEQ ID NO: 509448 - RNA, 64 nt, Homo Sapiens
acuuauaaucuccucuaaaacaaccucugcauguuuuuuuuaaauaaagcacuuucugucaaau

SEQ ID NO: 509449 - RNA, 64 nt, Homo Sapiens
auuuucuauuaauuugcaaacugaugauuucacuuuuuuuuacuuuuuuuucgauuaucagagu

SEQ ID NO: 509450 - RNA, 64 nt, Homo Sapiens
cccacuuuuauguauagaaagaggucuuuuaauuuuuuuuuaaugugagaaggaagggaggagu

SEQ ID NO: 509451 - RNA, 64 nt, Homo Sapiens
uuuuugaaauggcaguggcaaauaaauaaauacuuuuuuuuaaauggaaagacuugaucuaugg

SEQ ID NO: 509452 - RNA, 64 nt, Homo Sapiens
cucagacugcaaaaggccuauuuuaacuauugauuuuuuuuaaaaaaaauugucuuugaaugua

SEQ ID NO: 509453 - RNA, 64 nt, Homo Sapiens
gaaaaccgaacacaacucagaaacuuggaaucguuuuuuuuaaaaaugccucugagcaacccau

SEQ ID NO: 509454 - RNA, 64 nt, Homo Sapiens
acccacacaaagccgcugucuuguguuuguuucauuuuuuuaaaccagucacugcagcaacgcc

SEQ ID NO: 509455 - RNA, 64 nt, Homo Sapiens
agagaucugcagaagaaacgauauggaagagaucuuuuuuuacucaugcuauucugucagcuga

SEQ ID NO: 509456 - RNA, 64 nt, Homo Sapiens
gcaaaacuauuuauugacuuaugaaucuucaauuuuuuuuuaaauaucaaaacacaacucaacu

SEQ ID NO: 509457 - RNA, 64 nt, Homo Sapiens
cugccaaaaauaaaaaaaaguaaaaacacugauuuuuuuuuaacaauggaacuaaugcuauauu

SEQ ID NO: 509458 - RNA, 64 nt, Homo Sapiens
aauguuauuuucccugugauuuucaaaaaaaauuuuuuuuuagaaaagauuaaaucaaauuaau

SEQ ID NO: 509459 - RNA, 64 nt, Homo Sapiens
gaaaaacaagucaagcuagcuauauguuuguuuguuuuuuuaauuauauauauauaaauauaaa

SEQ ID NO: 509460 - RNA, 64 nt, Homo Sapiens
ucagcacugaugccacccuccagauuuuuuuuuuuuuuuuuaaggaaaaaugaacaugugaggu

SEQ ID NO: 509461 - RNA, 64 nt, Homo Sapiens
uguuaugcccuguuugcaaaauucuuacaaaguauuuuuuuaccguuggguuuucuaaaauaau

SEQ ID NO: 509462 - RNA, 64 nt, Homo Sapiens
aguuccaauuuuauaucacacagggaaacaucaauuuuuuuaguaaaaauagauuuaguuaacc

SEQ ID NO: 509463 - RNA, 64 nt, Homo Sapiens
uugagagcugacuguugcuuuguaugcgugugcauuuuuuuaacuuuucuuugguauuggguua

SEQ ID NO: 509464 - RNA, 64 nt, Homo Sapiens
aagaugguuuuucagcaaauguuuuucugaaacuuuuuuuuaguguuaacccaugguaaagagu

SEQ ID NO: 509465 - RNA, 64 nt, Homo Sapiens
ucgaguaacccauauuuguuauuuacaugugccauuuuuuuaauuuauuuguacuaaaaugcuc

SEQ ID NO: 509466 - RNA, 54 nt, Homo Sapiens
gagaauucuagaauucuauuuuuuuuuuuuuaaacaucaucuaauucucaguga

SEQ ID NO: 509467 - RNA, 64 nt, Homo Sapiens
uagaugaccaaaggucauuauuuguuuuuauuuuuuuuuuuauuaauuugaucuuuuauuuuuc

SEQ ID NO: 509468 - RNA, 64 nt, Homo Sapiens
uuggcaggauaauauagugcgcugccacaguauauuuuuuuaauaguggaaaaaaaaaagacag

SEQ ID NO: 509469 - RNA, 64 nt, Homo Sapiens
aaacacuucauuauguuuagauguuaagaaaaauuuuuuuuaaacaaaacuuuuuuaaauauaa

SEQ ID NO: 509470 - RNA, 64 nt, Homo Sapiens
uuuuucuuuuuuauuaagcuuguuuuuauuuuuauuuuuuuaauuaacauggaagaggauucau

SEQ ID NO: 509471 - RNA, 64 nt, Homo Sapiens
caaugauuaaauugaauguggcccaaaguuuuauuuuuuuuaaauaaaagaaaugggcuguuuu

SEQ ID NO: 509472 - RNA, 64 nt, Homo Sapiens
cuuagacagcauguaugguaauguuguguauguuuuuuuuuaaaucucuugugcaauaauuuac

SEQ ID NO: 509473 - RNA, 64 nt, Homo Sapiens
uaauuaauacuuaaaaaaaagaaagacuuaagccuuuuuuuaagccagagcucucuaaauaccu

SEQ ID NO: 509474 - RNA, 64 nt, Homo Sapiens
gaucuuucuauaaaaaauaauugaaaaauuauuauuuuuuuacacucuaugaaaguaaagcugu

SEQ ID NO: 509475 - RNA, 64 nt, Homo Sapiens
uuuuauuuuucacuaaacagcaaaaaugaauagguuuuuuuaauaauuuaagcuaaacacaagc

SEQ ID NO: 509476 - RNA, 64 nt, Homo Sapiens
cccuugacucaagacagcuagucaauacugacuuuuuuuuuauuaaggucagagauuguaaaug

SEQ ID NO: 509477 - RNA, 64 nt, Homo Sapiens
guuucuaauauguaugaccauuuaguucuuaacuuuuuuuuauguacaaguguaugauguacau

SEQ ID NO: 509478 - RNA, 64 nt, Homo Sapiens
auaagccuuuuuaccucugucccuguuguauugauuuuuuuauacuuuaccuguauacuaaaaa

SEQ ID NO: 509479 - RNA, 64 nt, Homo Sapiens
acuccuuacucugaugucugauaaaccugaugcuuuuuuuuagauuuucauuaucuuuauuaua

SEQ ID NO: 509480 - RNA, 64 nt, Homo Sapiens
cauccugacaggaaauguuucuacaggcugugacuuuuuuuaagccuggauuuuucccacugcu

SEQ ID NO: 509481 - RNA, 64 nt, Homo Sapiens
auucagacaauucuaugaccauuuucucuuuauuuuuuuuuauauggaagaacaauuucuauga

SEQ ID NO: 509482 - RNA, 64 nt, Homo Sapiens
uaaguggcagacacuuuauuuuggguuuuuuuuuuuuuuuuacgguuucuauguguacauaguu

SEQ ID NO: 509483 - RNA, 64 nt, Homo Sapiens
uguauuuuuugagacaggguuuuuucuuuuauuuuuuuuuuaaugaaguuuuccuuauuugcca

SEQ ID NO: 509484 - RNA, 64 nt, Homo Sapiens
uuaaguauguugacucuuauugauuuaauaaaacuuuuuuuaaaugacuucuuucaagucuaaa

SEQ ID NO: 509485 - RNA, 64 nt, Homo Sapiens
ucaaauuuaagcuggauuuguuuuuguggacuacuuuuuuuauaaguuuguucuucgcucaauu

SEQ ID NO: 509486 - RNA, 64 nt, Homo Sapiens
aacuugaaacuuguaaacuguuuuuuuguuguuuuuuuuuuaaggcuuucccuggaggaaaggu

SEQ ID NO: 509487 - RNA, 64 nt, Homo Sapiens
uuagcacauaauuuguauauaaaggacauuuuauuuuuuuuacuacagaaguuuggcuugaacu

SEQ ID NO: 509488 - RNA, 64 nt, Homo Sapiens
uagucuguguuugguuccacgcuuaccuuuuuuuuuuuuuuacuggacauggugucguugggaa

SEQ ID NO: 509489 - RNA, 64 nt, Homo Sapiens
uuuucuguuuuccuaaccacuugaguugucuuuuuuuuuuuaaggguccuuugccuauuuuuaa

SEQ ID NO: 509490 - RNA, 64 nt, Homo Sapiens
uuacacauuuuucagauauauacgauaaauaacuuuuuuuuaagauguaaaagacuuuuuuuua

SEQ ID NO: 509491 - RNA, 64 nt, Homo Sapiens
cgauaaauaacuuuuuuuuaagauguaaaagacuuuuuuuuauaguuuucacuccagcuaacac

SEQ ID NO: 509492 - RNA, 64 nt, Homo Sapiens
ggaagcagucauucuuucuagauuucuauauuuguuuuuuuaaaaaaaaguuacguggaagcaa

SEQ ID NO: 509493 - RNA, 64 nt, Homo Sapiens
gaggugauucaaguaccguuuuagugguguguuguuuuuuuaaacauggaugauaaguguguuu

SEQ ID NO: 509494 - RNA, 64 nt, Homo Sapiens
aguguuauuuuucacuauguaaaagguagcauucuuuuuuuagguuuaaaauaaaauguugugg

SEQ ID NO: 509495 - RNA, 64 nt, Homo Sapiens
uuguaguuuauuuuuuagugauaucuauuuuucauuuuuuuacuucuccuuucccucucaauaa

SEQ ID NO: 509496 - RNA, 64 nt, Homo Sapiens
uccugcugcacuaaagcuaugcagacuagucuuauuuuuuuaaucuuuuguaguauuuacguau

SEQ ID NO: 509497 - RNA, 64 nt, Homo Sapiens
caacuuuuguaguauuuacguauucauagauguuuuuuuuuauuguugccucaauauaaccuuu

SEQ ID NO: 509498 - RNA, 64 nt, Homo Sapiens
uauguggaaaacacaauaaaaucaaaaagccuuauuuuuuuauccuuuguaauggauucuuuuc

SEQ ID NO: 509499 - RNA, 64 nt, Homo Sapiens
uacauaaaaauagaucaauagauuuguuacuguauuuuuuuaacuuuggggggauaggaagaaa

SEQ ID NO: 509500 - RNA, 64 nt, Homo Sapiens
ucuucuugaaggcacucuaaauuggauauuguauuuuuuuuaaguuuaaaauauggcuuuucua

SEQ ID NO: 509501 - RNA, 64 nt, Homo Sapiens
caagacgugguuaagaacuguuuuuuuuuuuuuuuuuuuuuacaaguguuuguuuucuuuuucu

SEQ ID NO: 509502 - RNA, 64 nt, Homo Sapiens
aguuuaggugccuuugcggauuuuuuauuuguuauuuuuuuaaaucauccaucaccaguggagu

SEQ ID NO: 509503 - RNA, 64 nt, Homo Sapiens
uguuauuuuuuuaaaaguuucaucaccaguggaguuuuuuuauucccucagcucucuccucauc

SEQ ID NO: 509504 - RNA, 64 nt, Homo Sapiens
ucuaaguaguagauuauuugaaaagaaaucaacuuuuuuuuaugggugccuuacuuugugauuu

SEQ ID NO: 509505 - RNA, 64 nt, Homo Sapiens
acauuuucagauaaauguauagcuuacauguguguuuuuuuauauuuuucuucccugaaaucag

SEQ ID NO: 509506 - RNA, 64 nt, Homo Sapiens
cucuagcaguuugguaauuuuuuuuaaaaaaaaauuuuuuuaauaagcuuggcaaaguguuggc

SEQ ID NO: 509507 - RNA, 64 nt, Homo Sapiens
aauauuauuagauuuauuaaaagacugauuuugcuuuuuuuauacgguuuuuagucucuggaaa

SEQ ID NO: 509508 - RNA, 64 nt, Homo Sapiens
ugaaauuaaauuuggcucuagguuguaaauuuuuuuuuuuuacuuccauuuaugcgaaaucugu

SEQ ID NO: 509509 - RNA, 64 nt, Homo Sapiens
uauuugugguagccuccaucagaauagagugaaguuuuuuuauaacuagaucuauguaaguugu

SEQ ID NO: 509510 - RNA, 64 nt, Homo Sapiens
accuggauauauaagcaaauaaaaguugccuuucuuuuuuuaugucuguauaagccacauagaa

SEQ ID NO: 509511 - RNA, 64 nt, Homo Sapiens
uguauuuagccuuggcaucuuuacguaccacacuuuuuuuuauccuuuuuucaaaauggcuuuc

SEQ ID NO: 509512 - RNA, 64 nt, Homo Sapiens
guuuaaaaguuaaagugccuauguuaauauccaguuuuuuuauaccaacuuuaaccuuaccagc

SEQ ID NO: 509513 - RNA, 64 nt, Homo Sapiens
uauuuacuguacuuuauguaguauuucuacuuuuuuuuuuuagccgaugaacuauagcauauuu

SEQ ID NO: 509514 - RNA, 64 nt, Homo Sapiens
uacauugauguugauguuccaaccaggcuuagauuuuuuuuaagaagcacaucugaucaaaaag

SEQ ID NO: 509515 - RNA, 64 nt, Homo Sapiens
caaacuguaugaaauggcaaucucuaagguucuuuuuuuuuauugagucaaagcuuuuucuuuu

SEQ ID NO: 509516 - RNA, 64 nt, Homo Sapiens
uccucuuacaauccauguuuaacauacuguuugauuuuuuuauuguaucaaaagggaaacuuaa

SEQ ID NO: 509517 - RNA, 64 nt, Homo Sapiens
caagggaugucucuuguaaucaagaugguauuuuuuuuuuuaacugcaggugugugcugaauug

SEQ ID NO: 509518 - RNA, 64 nt, Homo Sapiens
uggaguuucuuuuugcccaguuuuuuuuuuuuuuuuuuuuuagagaccaggguuuucuuuuuuu

SEQ ID NO: 509519 - RNA, 64 nt, Homo Sapiens
cauaccaaauggagauagcagucaagguagaguguuuuuuuauauuuaucugaauuaucauuua

SEQ ID NO: 509520 - RNA, 64 nt, Homo Sapiens
uuuccuacaccuggagguuguauauaugaauauauuuuuuuaaguauaaauauauagauauaaa

SEQ ID NO: 509521 - RNA, 64 nt, Homo Sapiens
cagaugaugggauaacauggaucaucucacuuuuuuuuuuuaaguggcuuauggggaggaaugc

SEQ ID NO: 509522 - RNA, 64 nt, Homo Sapiens
uuucaaagguuuuuaauuaucuugcuuguacauuuuuuuuuaccaucuuuuuccuuucugaauu

SEQ ID NO: 509523 - RNA, 64 nt, Homo Sapiens
gcucugguggauuuuuguggcgaguuugugccuuuuuuuuuauuucaaaagccaucggaagaug

SEQ ID NO: 509524 - RNA, 64 nt, Homo Sapiens
gaggacguuuucuacggcugucuuguagcuuauuuuuuuuuaaauguguaaaccacucgacuca

SEQ ID NO: 509525 - RNA, 64 nt, Homo Sapiens
aacagaaguauacguuuuucaguuucaacaugaauuuuuuuauuucugucaguuaugacaucca

SEQ ID NO: 509526 - RNA, 64 nt, Homo Sapiens
ggucaaguucagcgcucgacauuuuauggaaagauuuuuuuaaccuuaccacgaaauacuuaac

SEQ ID NO: 509527 - RNA, 64 nt, Homo Sapiens
gcuauacuggaguauugcuaugucuuuaaaaaauuuuuuuuauuauauuuuauuuuuuugagac

SEQ ID NO: 509528 - RNA, 64 nt, Homo Sapiens
gagccaguuucaaagguuacuuguuuuuuuuuuuuuuuuuuaaagucagaauguuaacagcugu

SEQ ID NO: 509529 - RNA, 64 nt, Homo Sapiens
aaaaaccagcuucuguauucaaaucuuuccuucauuuuuuuaaauuuuuuuuuuggcagcgcuu

SEQ ID NO: 509530 - RNA, 64 nt, Homo Sapiens
cuucugauguucaguccccugggccgggacagauuuuuuuuaacgucuugaaacuuaaacucug

SEQ ID NO: 509531 - RNA, 64 nt, Homo Sapiens
gauacuguaaccuuuuugucuuuuuuuuuuuuuuuuuuuuuaaaccuccaccuccaguggcugu

SEQ ID NO: 509532 - RNA, 64 nt, Homo Sapiens
aauggaaugcauuuuuuuguuguuguuguuguuuuuuuuuuaguguuauaccuuacccaaugaa

SEQ ID NO: 509533 - RNA, 64 nt, Homo Sapiens
cuucauguggucugacaauuuauuuuugccaucauuuuuuuaauuaaagaaaaaauuuccagaa

SEQ ID NO: 509534 - RNA, 64 nt, Homo Sapiens
cagaauuuuucugaagguguagauacuuuuuuuuuuuuuuuaacagaaaaccugaugucaagag

SEQ ID NO: 509535 - RNA, 64 nt, Homo Sapiens
agaaauaaugcguguuuggggggcagaaugcagauuuuuuuaauuuacaaagcgugaucgcuag

SEQ ID NO: 509536 - RNA, 64 nt, Homo Sapiens
accaaaacuaaguucuuagauuuugggggauuuuuuuuuuuaaacgaugagaagggaauccggu

SEQ ID NO: 509537 - RNA, 64 nt, Homo Sapiens
uaguguacaagauacugucugcugugguucuguauuuuuuuauuuuuugaccaacuguauggaa

SEQ ID NO: 509538 - RNA, 64 nt, Homo Sapiens
auguuaagcauguuuauuuauuugccuguuuuuguuuuuuuacuugagcuguggucacagcugc

SEQ ID NO: 509539 - RNA, 64 nt, Homo Sapiens
auaaacaaagacagacuuguaguuuauuuuguauuuuuuuuaaauaaauacacuuuacauuaaa

SEQ ID NO: 509540 - RNA, 64 nt, Homo Sapiens
acaauuugguguaucacaacaugcaugucuuauuuuuuuuuaguuuuaaguccuauaggacuau

SEQ ID NO: 509541 - RNA, 64 nt, Homo Sapiens
gagucucuaaguuauuuguuucagaaaauuauucuuuuuuuaugugauaaaucauaugauuuaa

SEQ ID NO: 509542 - RNA, 64 nt, Homo Sapiens
uagaccuuucucccuccuuccuuuuacuaccauuuuuuuuuaacacugucaucuguaggucacu

SEQ ID NO: 509543 - RNA, 64 nt, Homo Sapiens
uuuucaugauacaaaagcaauucugugugauuuuuuuuuuuaagaagaaagaaaaugcaagcua

SEQ ID NO: 509544 - RNA, 64 nt, Homo Sapiens
acuaucuuuggagccgcuuuuuuuuucuuuuucauuuuuuuaaaagauugagugguacacuaau

SEQ ID NO: 509545 - RNA, 64 nt, Homo Sapiens
aaaucagaaaugguaccuuuuuaagaauugcauauuuuuuuagacacaacuauuaguacauuaa

SEQ ID NO: 509546 - RNA, 64 nt, Homo Sapiens
ccguggauacagacgcuuagcucuuaaaagauuuuuuuuuuauguaaacuguugaauauuugaa

SEQ ID NO: 509547 - RNA, 64 nt, Homo Sapiens
guguuuguuuuguauuuuuguauuguauaugaacuuuuuuuaaaugugacaguuaaacacaucu

SEQ ID NO: 509548 - RNA, 64 nt, Homo Sapiens
aauuucuaauuuauguguucuguugaaauuuuuguuuuuuuaccuuuauugaaacaacaaaaag

SEQ ID NO: 509549 - RNA, 64 nt, Homo Sapiens
uuuuuguaauaaauuugacucauuaaaaaccuuuuuuuuuuaaaaaaaaaaaaaaagaaaaucu

SEQ ID NO: 509550 - RNA, 64 nt, Homo Sapiens
ucacuggcauugacauuauugguaaucaacuggcuuuuuuuaaaaaagguagcauuuuguugac

SEQ ID NO: 509551 - RNA, 64 nt, Homo Sapiens
uguauuauuuuauuuuauuuuuuacaauuagccuuuuuuuuaguuaauuuuugucaaaugaaac

SEQ ID NO: 509552 - RNA, 64 nt, Homo Sapiens
ucuguccuugauuuuuuuucauuaaaguauuuccuuuuuuuaauucaagaaaaguuuaccuuuc

SEQ ID NO: 509553 - RNA, 64 nt, Homo Sapiens
acugcacauuauauucaaacuuaaaauugagcuuuuuuuuuaaaggcccaaaauuguacaguga

SEQ ID NO: 509554 - RNA, 64 nt, Homo Sapiens
gggguuucgccuuguugcccaggcugaauuuggguuuuuuuaaaaugagacuuucaguccuaau

SEQ ID NO: 509555 - RNA, 64 nt, Homo Sapiens
uacaggugugagcuaccucaccuggccaaaacaguuuuuuuagaaaugaaguauauuagacaac

SEQ ID NO: 509556 - RNA, 64 nt, Homo Sapiens
uguauugaaaaacaauuaggaaucauugcagauuuuuuuuuauucugcucccaccucccacccg

SEQ ID NO: 509557 - RNA, 64 nt, Homo Sapiens
cccgggacuacuugcuggugacuuuuuuuuuuuuuuuuuuuaaauaggggaugauuuuagcuug

SEQ ID NO: 509558 - RNA, 64 nt, Homo Sapiens
ccaucugucagucaucaacuuuuccccuagauuuuuuuuuuaacuaguucugaaagugucaaga

SEQ ID NO: 509559 - RNA, 64 nt, Homo Sapiens
aaaaguaaaaauucaauuuuacaauauacauuuuuuuuuuuaacuauuuggcuuuaccuuuuua

SEQ ID NO: 509560 - RNA, 64 nt, Homo Sapiens
gaggcuauagcucacauuuucaauccucuauuucuuuuuuuaaauauaacuuucuacucugaug

SEQ ID NO: 509561 - RNA, 64 nt, Homo Sapiens
ucagaaauugucccuagaugaaugagaaaauuauuuuuuuuaauuuaaguccuaaauauaguua

SEQ ID NO: 509562 - RNA, 64 nt, Homo Sapiens
cacaaaaucacccaguuaauguguguguguguuuuuuuuuuaagguaaacauuacuacuuguaa

SEQ ID NO: 509563 - RNA, 64 nt, Homo Sapiens
aggauuuuaaacauggugugguauucuaaagccuuuuuuuuaaaaaaagagaucuuuuugagag

SEQ ID NO: 509564 - RNA, 64 nt, Homo Sapiens
aaaggggagucugggggagaaugguaguauuuuuuuuuuuuaucagcugugaaaaaaauguuac

SEQ ID NO: 509565 - RNA, 64 nt, Homo Sapiens
aaugcugaagucaugucaaguacugucuggaggguuuuuuuaagaaaaggcauuuggcauuuaa

SEQ ID NO: 509566 - RNA, 64 nt, Homo Sapiens
uuucagacccauuuuuuaaagugcuagaaaaugcuuuuuuuaaaaaaaaaauacaaguuuuaaa

SEQ ID NO: 509567 - RNA, 64 nt, Homo Sapiens
cccuaaggaaaaagaaagcuuuaugacauauuuauuuuuuuaauaaaacuaagcaaaaauaaaa

SEQ ID NO: 509568 - RNA, 64 nt, Homo Sapiens
aaaaucguuuauaauuguuaauagaauggcgauuuuuuuuuaagaacuucagauuugcuaugcu

SEQ ID NO: 509569 - RNA, 64 nt, Homo Sapiens
aaaagucaucuugugucuuuuguaaauugaauuuuuuuuuuaaaucuauuaggaacuggaaaac

SEQ ID NO: 509570 - RNA, 64 nt, Homo Sapiens
accauuauucaggguggucuuuuguuuuuaaaucuuuuuuuaacuaauaagauuuacggugugu

SEQ ID NO: 509571 - RNA, 64 nt, Homo Sapiens
ucauaauguaaucuauuucuguaccuuuuuuuuuuuuuuuuacuuugaagucuuuaaauaaaau

SEQ ID NO: 509572 - RNA, 64 nt, Homo Sapiens
aaugcaaaacuaggaaaagguuaaacuggauuuuuuuuuuuaaaaaaaagaaaaaaaaagaaga

SEQ ID NO: 509573 - RNA, 64 nt, Homo Sapiens
cugcuauaaagaaauucucuaauugguugaauuuuuuuuuuaaguaaauaguacuuuaggccaa

SEQ ID NO: 509574 - RNA, 64 nt, Homo Sapiens
cuagauguaguaauacacugguuaugaaauuguauuuuuuuaaguauuaaugaaaaaagagcca

SEQ ID NO: 509575 - RNA, 64 nt, Homo Sapiens
uuuagaugaaaaaugaaacuaccuuacaauauuauuuuuuuaaccaauguauuuguuugcaaac

SEQ ID NO: 509576 - RNA, 64 nt, Homo Sapiens
guugcccuaauacuuuauauguuuuuaauggauuuuuuuuuaaguauuagaaaaugacacauaa

SEQ ID NO: 509577 - RNA, 64 nt, Homo Sapiens
uagaagaugguuauacacaguguuauuguuaaaauuuuuuuaccuuuugguugguuugcaucuu

SEQ ID NO: 509578 - RNA, 64 nt, Homo Sapiens
ucuaagaucuaccugaacuuagagacucaagauauuuuuuuaggaaaccuccuacccaugucug

SEQ ID NO: 509579 - RNA, 64 nt, Homo Sapiens
cccccaaaucuucuccuaaccaccaucuguuuuuuuuuuuuaaagcauuuuuugcuuuaaaagc

SEQ ID NO: 509580 - RNA, 64 nt, Homo Sapiens
uaaccuugccuuagaaacacauaaauuaugagauuuuuuuuaaaaguuguuaccaaauacacau

SEQ ID NO: 509581 - RNA, 64 nt, Homo Sapiens
auagacaggacucugaaaacacaacuuccagccauuuuuuuaguuaguaaaaauccuauuaaug

SEQ ID NO: 509582 - RNA, 64 nt, Homo Sapiens
ggauagugggauuuccagaaccacacuugaaaccuuuuuuuaucguuuuuguauuuucaugaaa

SEQ ID NO: 509583 - RNA, 64 nt, Homo Sapiens
gcuacaauuuuaagaggggagggaagggaaaguuuuuuuuuauuauuuuuuuaaaauuuuguau

SEQ ID NO: 509584 - RNA, 64 nt, Homo Sapiens
aagaggggagggaagggaaaguuuuuuuuuauuauuuuuuuaaaauuuuguauguuaaagagaa

SEQ ID NO: 509585 - RNA, 64 nt, Homo Sapiens
aaaaguagaaaaguaggucauucuuggaucuacuuuuuuuuagccuuauuaauauuuuucccua

SEQ ID NO: 509586 - RNA, 64 nt, Homo Sapiens
uacguaucauugcaagagaauuuguuucaagauuuuuuuuuaauguuccagaagauggccaaua

SEQ ID NO: 509587 - RNA, 64 nt, Homo Sapiens
uaauuuagagaacaagaacaaaccaugucucaaauuuuuuuaaaaaaaauuaaugguuuuaaau

SEQ ID NO: 509588 - RNA, 64 nt, Homo Sapiens
gcacagaugcgcugguagaugcauagucaggaacuuuuuuuauuucuuuuaggucuagggacag

SEQ ID NO: 509589 - RNA, 64 nt, Homo Sapiens
uuucacuugugcacugugaaugaacuuuguauuauuuuuuuaaaaccuucacauuacguguaga

SEQ ID NO: 509590 - RNA, 64 nt, Homo Sapiens
cuaaauaacucuuauuuuuauuuuugaagguuuuuuuuuuuaaaaaaaaaaacguauaaaauaa

SEQ ID NO: 509591 - RNA, 64 nt, Homo Sapiens
gguuguaauccuuguucaguucuuaaguuucgguuuuuuuuaaaaacaggaugcaacuuaaacu

SEQ ID NO: 509592 - RNA, 64 nt, Homo Sapiens
uagacaauaauguaaauaaaucuguuuuuaugaauuuuuuuaucaaauaauuuaugaccauuca

SEQ ID NO: 509593 - RNA, 64 nt, Homo Sapiens
uaguaacuuacagguuuguuauuguguugauuuuuuuuuuuauuguugaaauauuauaaauggu

SEQ ID NO: 509594 - RNA, 64 nt, Homo Sapiens
cagauuuuugcacacugauuccaguuuuguuuuguuuuuuuaauuuugacuuaauuguuaaacc

SEQ ID NO: 509595 - RNA, 64 nt, Homo Sapiens
ucuuaaaaccuucauaucuauuuuauguuuaaauuuuuuuuaaauaauaaugauaguuuuuaac

SEQ ID NO: 509596 - RNA, 64 nt, Homo Sapiens
ucucuugaugucagauuuuaucuuaugggucuuuuuuuuuuaucuuuauauuugucaauuuaaa

SEQ ID NO: 509597 - RNA, 64 nt, Homo Sapiens
acaccagccuuugguuuuucugaagccaaucuguuuuuuuuagggucuuccuuaguguuuucuu

SEQ ID NO: 509598 - RNA, 64 nt, Homo Sapiens
uaauaauugaaacuuaucucaguuaaaaaaaauuuuuuuuuaaaaccacaaaguaggccagaua

SEQ ID NO: 509599 - RNA, 64 nt, Homo Sapiens
aguaggauguacacauuucaaauuuguuacuuuguuuuuuuaauaauaaauuuuggcaccagca

SEQ ID NO: 509600 - RNA, 64 nt, Homo Sapiens
uucuauuccauuuuaauuguaggggacugaauuuuuuuuuuaacauguuugaggccuguggugu

SEQ ID NO: 509601 - RNA, 64 nt, Homo Sapiens
ccuaauauaaagugaauuuguucucaucuuuacuuuuuuuuaauggaaccaggauacuaaugau

SEQ ID NO: 509602 - RNA, 64 nt, Homo Sapiens
caccucuugcuacacccauuuacuuuuuagcaaauuuuuuuaaucuuaaagggugauuuucugu

SEQ ID NO: 509603 - RNA, 64 nt, Homo Sapiens
ugcugguuaaacaggaaugcuaugauuguauaaauuuuuuuaaaccauuaaccuuugccagugu

SEQ ID NO: 509604 - RNA, 64 nt, Homo Sapiens
uaaauauaguuguuacuggucauggcagucuuuuuuuuuuuaaaauuaaguaauucuguaacug

SEQ ID NO: 509605 - RNA, 64 nt, Homo Sapiens
guagacacaaguuuggcccuauucuuuuuuuuuuuuuuuuuacuuuaaugguugccaguuagua

SEQ ID NO: 509606 - RNA, 64 nt, Homo Sapiens
aacugggggcuauuuuaucauuuuccuuggauuuuuuuuuuaauauaagacuaauuauuggggg

SEQ ID NO: 509607 - RNA, 64 nt, Homo Sapiens
cauuucugaguucgaagguaaaauguuugagacuuuuuuuuaaagguguuuugucuaaccauca

SEQ ID NO: 509608 - RNA, 64 nt, Homo Sapiens
aggggcagccccuugauggcucacucuuuuuuuuuuuuuuuaaaagcguccuugggaucccaga

SEQ ID NO: 509609 - RNA, 64 nt, Homo Sapiens
aagucagcugcuccaaaaucugucacauaaagcauuuuuuuaaaaaacacugcucuuccucacc

SEQ ID NO: 509610 - RNA, 64 nt, Homo Sapiens
guauuuucuagucuuuucucuuuaaaauauuuauuuuuuuuaaauugucacuguaagcuauacu

SEQ ID NO: 509611 - RNA, 64 nt, Homo Sapiens
ugcuaaaucagauuguuccuaaaccaugaaguacuuuuuuuauuuuuugguuuuuauuauacaa

SEQ ID NO: 509612 - RNA, 64 nt, Homo Sapiens
aaggacaccucuuuccaaacagcuuuuuuuuuuuuuuuuuuaauauucagcccacuacauagau

SEQ ID NO: 509613 - RNA, 64 nt, Homo Sapiens
acuaagcuuuuacaaaagaagguuuuuuuuuuuuuuuuuuuacuggugacagagcagaagaacc

SEQ ID NO: 509614 - RNA, 62 nt, Homo Sapiens
agauuguuguggacuuuguucuguaguaacuuuuuuuuuaagcauauucacaagagaaauaa

SEQ ID NO: 509615 - RNA, 64 nt, Homo Sapiens
aaagcaaugcacauguuggugucauugucacugauuuuuuuaaacagguauuaauaugacauuu

SEQ ID NO: 509616 - RNA, 64 nt, Homo Sapiens
uugcaaauguaauuuuugccaagugguaguaauuuuuuuuuaaaaguagaauuuauuuucuaca

SEQ ID NO: 509617 - RNA, 64 nt, Homo Sapiens
uauuguuccuaaaaaggaaugcagagggcgguucuuuuuuuagauuugucuuuuuugggggagg

SEQ ID NO: 509618 - RNA, 64 nt, Homo Sapiens
ucgagagccuuucgaagcuuuauaggacuguaguuuuuuuuaguacuuuccugucauuuauuua

SEQ ID NO: 509619 - RNA, 64 nt, Homo Sapiens
gacugugcuaaagaaaugauuagcuugaaaaguuuuuuuuuaauuuaguuuugaauuauaugua

SEQ ID NO: 509620 - RNA, 64 nt, Homo Sapiens
auuguaaaaauuguugaguuuuugagggauguauuuuuuuuaaauuuagcauugaugggcuauu

SEQ ID NO: 509621 - RNA, 64 nt, Homo Sapiens
caaccaccuugucaggaaaguucauuuugauuuuuuuuuuuagcauauauagcuaaguuuuugu

SEQ ID NO: 509622 - RNA, 64 nt, Homo Sapiens
acauuuauaugucugauacaauuuuuuuuuuuuuuuuuuuuacuuuuuauaguagagguuuucu

SEQ ID NO: 509623 - RNA, 64 nt, Homo Sapiens
aggggcaaguguuuucugaaguuuuggguuuuuuuuuuuuuaagguuuuuguuguuguuguuua

SEQ ID NO: 509624 - RNA, 64 nt, Homo Sapiens
aauuagugauauaagcauugauucuuuucuggauuuuuuuuaauauuuccucuucuauuccuau

SEQ ID NO: 509625 - RNA, 64 nt, Homo Sapiens
uauuagugguaguaauauauagcacauggccuuuuuuuuuuaauuuuacaaagcaucguuuuaa

SEQ ID NO: 509626 - RNA, 64 nt, Homo Sapiens
uguauuaaaucaauuuaucaccguuaaagguuuuuuuuuuuauaguuguuuuacagcuguguua

SEQ ID NO: 509627 - RNA, 64 nt, Homo Sapiens
aacaguuuuacuugugucauauuugguugagggauuuuuuuauauuuauuuuuuauuguauuuu

SEQ ID NO: 509628 - RNA, 64 nt, Homo Sapiens
aauuuucaaaagcagugguacugcguuaauuuuuuuuuuuuaauaacacaaagcaggagacagc

SEQ ID NO: 509629 - RNA, 64 nt, Homo Sapiens
uuaaaaaaaacuucaguaucccuaaaauugccacuuuuuuuagguugccucagcuuuaugguua

SEQ ID NO: 509630 - RNA, 64 nt, Homo Sapiens
uauacauacucacauauuauauguucaauggguauuuuuuuacaagauuucaaaacauaauuuu

SEQ ID NO: 509631 - RNA, 64 nt, Homo Sapiens
cuaucuuuuugcuugcuuaauuguucaucauuacuuuuuuuaacguguguguguguguccguaa

SEQ ID NO: 509632 - RNA, 64 nt, Homo Sapiens
gaaaagucaacuccugaaaucuccucucuauuuguuuuuuuaagcagugagagacauuuacagc

SEQ ID NO: 509633 - RNA, 64 nt, Homo Sapiens
uaagaaauguuuauuuuuguggaaauuuguggguuuuuuuuaaaaacagauaagcuauaguugg

SEQ ID NO: 509634 - RNA, 64 nt, Homo Sapiens
agcaauguguuuuuauuaaauguuuacauauacuuuuuuuuaauacuagaggguuuuuuuuuuc

SEQ ID NO: 509635 - RNA, 64 nt, Homo Sapiens
gcgugugugaacaaauggaauguguuuuuuuuuuuuuuuuuaaauuggguauugugugagugca

SEQ ID NO: 509636 - RNA, 64 nt, Homo Sapiens
aaaagaaaacuuuaaaaaaaacuuucuuuuuuuuuuuuuuuaaagaguuugccguuuguccuua

SEQ ID NO: 509637 - RNA, 64 nt, Homo Sapiens
aauacuuauuagaagcaaacagaggaaaaaaaaauuuuuuuaaaagaaaauuuaaagaaaagcu

SEQ ID NO: 509638 - RNA, 64 nt, Homo Sapiens
guuauuuuuuaucacuacucacucaccuuuaaaguuuuuuuaguucaucaaggugauguaagug

SEQ ID NO: 509639 - RNA, 64 nt, Homo Sapiens
ucaucaaggugauguaagugccaacugcuuuuuauuuuuuuacuuggaauuagcuaucuuagug

SEQ ID NO: 509640 - RNA, 64 nt, Homo Sapiens
gugcuguucauuaugaaggcauaugcuccuaguuuuuuuuuaggugccacagucuuuauuuuga

SEQ ID NO: 509641 - RNA, 64 nt, Homo Sapiens
auuauaaaaagauuuuauuuaguaugugacagaauuuuuuuaaauaauuaaauuuagacuaugu

SEQ ID NO: 509642 - RNA, 64 nt, Homo Sapiens
guuucuuucuaugaucagguacuauugaugcaaguuuuuuuauugauugguggaggaaugaaga

SEQ ID NO: 509643 - RNA, 64 nt, Homo Sapiens
auuauuauucuaaaggucaauauuauccuuacuuuuuuuuuaaccaaaaaaaagaaaaaaguuu

SEQ ID NO: 509644 - RNA, 64 nt, Homo Sapiens
aaaaguaaaaguugcugcuucugcuacuagcuuuuuuuuuuaaaguaaugcucauuuuuacaug

SEQ ID NO: 509645 - RNA, 64 nt, Homo Sapiens
acagucaguauguagaaugguggacugcauuuuuuuuuuuuaacuuuaguuuucuaccugcaua

SEQ ID NO: 509646 - RNA, 64 nt, Homo Sapiens
caauuaaaaucccuuuuguuaugcagugccuguuuuuuuuuaacguuugcuuccaucuuuuuuu

SEQ ID NO: 509647 - RNA, 64 nt, Homo Sapiens
cagugccuguuuuuuuuuaagguuugcuuccaucuuuuuuuaugcccuucgcacauaggcauuu

SEQ ID NO: 509648 - RNA, 64 nt, Homo Sapiens
ugcuucucaagucagaaaacuuaccuaguaugccuuuuuuuaguuuuuuuaguuuuuauuuacu

SEQ ID NO: 509649 - RNA, 64 nt, Homo Sapiens
uuuuauuuacuuuaccuagugcuuuucuuuucuuuuuuuuuaguuccuuuuuuuuuucuuuuuu

SEQ ID NO: 509650 - RNA, 64 nt, Homo Sapiens
guuguaguuuugauuuaaaguuuucaguaacuauuuuuuuuauaaaauucaaugugucuuuuua

SEQ ID NO: 509651 - RNA, 64 nt, Homo Sapiens
cugaaacuugagacuuugacaaauguuaucauuauuuuuuuauacuucgcagacuuuugccagc

SEQ ID NO: 509652 - RNA, 64 nt, Homo Sapiens
uuuacaacuuuccacaacuuuguugguaacuuuuuuuuuuuaaauagucuguuggugccucaac

SEQ ID NO: 509653 - RNA, 64 nt, Homo Sapiens
uguuuucagauugugcugggagcaaccucauuucuuuuuuuaauccaaagcuauagccuucaua

SEQ ID NO: 509654 - RNA, 64 nt, Homo Sapiens
acauaacuagaaaccugaggauuucaacauaucauuuuuuuaacguucuucuaaaauugaagag

SEQ ID NO: 509655 - RNA, 64 nt, Homo Sapiens
uuagagaauauauuuuugauuuaccaaaaaaguauuuuuuuaagaucagaaaugucaucaaaua

SEQ ID NO: 509656 - RNA, 64 nt, Homo Sapiens
caugauucuaguuaaauguacauuuaauaucaguuuuuuuuaaaguaguagcucugaaguguca

SEQ ID NO: 509657 - RNA, 64 nt, Homo Sapiens
aaucacuacuauaucaugucgcugcuaauuuuuuuuuuuuuaguucaaauauagauagauuuaa

SEQ ID NO: 509658 - RNA, 64 nt, Homo Sapiens
gaaaguauaauugcacuaaccagugauucagaauuuuuuuuaauuucaagguguuuuuaaauag

SEQ ID NO: 509659 - RNA, 64 nt, Homo Sapiens
uaccauagagaagauacauugaagggcacaacuuuuuuuuuaauuuucugccaauuaaagacua

SEQ ID NO: 509660 - RNA, 64 nt, Homo Sapiens
aaaaaugaguuggaaaaaaaggagcauuuuuuuauuuuuuuaauauuuuguaaagcugauaguu

SEQ ID NO: 509661 - RNA, 64 nt, Homo Sapiens
uuuuuaauaaaaaugaguugugauaguuggagcauuuuuuuauuccuuagagauuuuguaaagc

SEQ ID NO: 509662 - RNA, 64 nt, Homo Sapiens
gagaaaaacacacagaagaaguuaaauucacagauuuuuuuaaccaagguuguuggcccagggc

SEQ ID NO: 509663 - RNA, 64 nt, Homo Sapiens
cacaaaaaaaaaccccaguuaagaagcucuuuuuuuuuuuuaaugauuuauuuuaugcagcaaa

SEQ ID NO: 509664 - RNA, 64 nt, Homo Sapiens
gcuuuaauucuacuuaauuucuaaaaaaucacaauuuuuuuacuugacccccuaauguauacag

SEQ ID NO: 509665 - RNA, 51 nt, Homo Sapiens
aaugggaaaauaugaaaucuauuuuuuuaaaaagauucacagaaauucuga

SEQ ID NO: 509666 - RNA, 64 nt, Homo Sapiens
uaaaagcagcaucugcuaauguuauacugucgguuuuuuuuaaaugccuuccauaauuaugaca

SEQ ID NO: 509667 - RNA, 64 nt, Homo Sapiens
agaauauaauuaucggaagccacuauaaaugguguuuuuuuaauuauuuaucagugacagaguu

SEQ ID NO: 509668 - RNA, 64 nt, Homo Sapiens
uaaagaagucuguaucuagugauaaauauaccaguuuuuuuaaaaagaugcuguugugccuaua

SEQ ID NO: 509669 - RNA, 64 nt, Homo Sapiens
uuuaacacuucucaguguauuuaauuucaaauuguuuuuuuaauugguuuuaugcugcuuuguu

SEQ ID NO: 509670 - RNA, 64 nt, Homo Sapiens
cuacacugaaagacucagugccaugcagaagccuuuuuuuuaagaugaaggaaauauuuuaugu

SEQ ID NO: 509671 - RNA, 64 nt, Homo Sapiens
guccuagauauuuccaugggccagugugaugacuuuuuuuuaaaugagguucaguaccauaaug

SEQ ID NO: 509672 - RNA, 64 nt, Homo Sapiens
ccucuaaagacaaacacaaacucucagacuuuuuuuuuuuuaaugggauuuuuaggucagccca

SEQ ID NO: 509673 - RNA, 64 nt, Homo Sapiens
guaagcauuggaaggucaaauuauuuugaagugauuuuuuuaaaaaaaagucuucuguuuauua

SEQ ID NO: 509674 - RNA, 64 nt, Homo Sapiens
gaauacaaaagguaaauuagcagcacauauaauuuuuuuuuaauuuaugauccauuuuguaugg

SEQ ID NO: 509675 - RNA, 64 nt, Homo Sapiens
acacuuuuggcagcuuaauaugaccuuuuuaaauuuuuuuuauuuuuuuuauuuuuauuucuuu

SEQ ID NO: 509676 - RNA, 64 nt, Homo Sapiens
gcagcuuaauaugaccuuuuuaaauuuuuuuuauuuuuuuuauuuuuauuucuuuaagauggag

SEQ ID NO: 509677 - RNA, 64 nt, Homo Sapiens
caaaacuuuuugaccaguuucuuuucuuuuguuuuuuuuuuaaaaaagacauuuaaagacaaag

SEQ ID NO: 509678 - RNA, 64 nt, Homo Sapiens
uaccauacauaaacugucucauuauacguaugcauuuuuuuaguuuguuuuuguuugguauaaa

SEQ ID NO: 509679 - RNA, 64 nt, Homo Sapiens
caagugcuggaaugucccuuuuuuccuaugcaacuuuuuuuaacccuuuaaugaacuuaucugu

SEQ ID NO: 509680 - RNA, 64 nt, Homo Sapiens
accugccacuuauuuuuugucaauuuuuaaaacuuuuuuuuaauuacuguaaagaaaaugaauu

SEQ ID NO: 509681 - RNA, 64 nt, Homo Sapiens
ucuaugcaaacuggacacaaauuacaacaguaaauuuuuuuauaagugcuucucccuucuccau

SEQ ID NO: 509682 - RNA, 64 nt, Homo Sapiens
uguguguucuuuaguuuuauuuuauuuuauuuuauuuuuuuacccuuccucaaacaccaguaac

SEQ ID NO: 509683 - RNA, 64 nt, Homo Sapiens
agcuacuggaccaacauucuuguuuuugcuuuuguuuuuuuaaauaauucuagucuggagcuaa

SEQ ID NO: 509684 - RNA, 64 nt, Homo Sapiens
guacacuuuuaaauugucucuugcaucacuaaaauuuuuuuaaaaugagcauaacaacgaaagg

SEQ ID NO: 509685 - RNA, 64 nt, Homo Sapiens
gaauaaaaagucaaaagaaacaaauagaagcuuuuuuuuuuaaaaaauguauugcuucugaacu

SEQ ID NO: 509686 - RNA, 64 nt, Homo Sapiens
uggguguaugaauggucuagaaacauuucuauuuuuuuuuuaaaccagcaggauacaaguugca

SEQ ID NO: 509687 - RNA, 64 nt, Homo Sapiens
uagccacgcuaguccauucccagaaggaaauuuuuuuuuuuaacaaugacuuuugguaaagggu

SEQ ID NO: 509688 - RNA, 64 nt, Homo Sapiens
ggcgugagccaccacaccuggccuuucugcaacauuuuuuuaaaaaaaucuaauaaaucuuaga

SEQ ID NO: 509689 - RNA, 64 nt, Homo Sapiens
uauuacaacuagagagaaauuccagaaauauuuguuuuuuuaagagaaaguaaauuuucacauu

SEQ ID NO: 509690 - RNA, 64 nt, Homo Sapiens
ugaaacuuuagagauuaacgacaagauuuucuacuuuuuuuaagugauuuuuuuguccuucagc

SEQ ID NO: 509691 - RNA, 64 nt, Homo Sapiens
gcaauuagauuaguauuuuccacgucacuguuuauuuuuuuaaaacacaaauucuaaagcuaca

SEQ ID NO: 509692 - RNA, 64 nt, Homo Sapiens
uacaggcgugcaccaccacgccugguuaauuguuuuuuuuuaauuuaucuuuuguagagauggg

SEQ ID NO: 509693 - RNA, 64 nt, Homo Sapiens
gacuaauugggaaacggggaaauucuuggaauuuuuuuuuuaagaaacuuuuuuguguuuuuuu

SEQ ID NO: 509694 - RNA, 64 nt, Homo Sapiens
cuuggaauuuuuuuuuuaagaaacuuuuuuguguuuuuuuuaauuuuaggucacuuauuaguga

SEQ ID NO: 509695 - RNA, 64 nt, Homo Sapiens
guuuuuccaggaagauuuacauuuagguuuaauauuuuuuuaguuagguagaguuuuaaaaaau

SEQ ID NO: 509696 - RNA, 64 nt, Homo Sapiens
gauaucucaauaguagacugaauacaaagcuaauuuuuuuuacaugucaauauuggcacaaacu

SEQ ID NO: 509697 - RNA, 64 nt, Homo Sapiens
acaugacuacaaguccuuuaugacuguuugccauuuuuuuuaaugguacuuaguauuuugauca

SEQ ID NO: 509698 - RNA, 64 nt, Homo Sapiens
augauuauacugcuuuaccuugugucacuuuuuuuuuuuuuaggaaaaacucauguuccaguau

SEQ ID NO: 509699 - RNA, 64 nt, Homo Sapiens
cguuaaaagauacacagugagguguuguguuuuguuuuuuuaaugaugaaaaguuacacauuuu

SEQ ID NO: 509700 - RNA, 64 nt, Homo Sapiens
auuuauuuuuaauauuacuacuauaugaauuaucuuuuuuuaaacuuguagauaaaaguguucc

SEQ ID NO: 509701 - RNA, 64 nt, Homo Sapiens
aauugacuucauuauuuggaaggaaaauuaguauuuuuuuuaauauuauauggaccaucugauu

SEQ ID NO: 509702 - RNA, 64 nt, Homo Sapiens
uucugauagaagauuuuuguccaugcuugauuuuuuuuuuuaaagaaaaacuuucauggguuag

SEQ ID NO: 509703 - RNA, 64 nt, Homo Sapiens
caaaauacuuuuaaaaaaaagaaaauguuaccaguuuuuuuaucugaaguuuaacugucccauu

SEQ ID NO: 509704 - RNA, 64 nt, Homo Sapiens
caauggauaauauaaaaagaguaccugagauguauuuuuuuaaacucuuagagauaucuguaac

SEQ ID NO: 509705 - RNA, 64 nt, Homo Sapiens
ugugcaguacacaucagccuaaaauuccugugauuuuuuuuaaagugguuuuauucauuguaug

SEQ ID NO: 509706 - RNA, 64 nt, Homo Sapiens
aaagugcagaaucaacuugagccuuuguacucuguuuuuuuaagccgcugaugucugggcauca

SEQ ID NO: 509707 - RNA, 64 nt, Homo Sapiens
auuucuuuuuuauuuuucaaguagcuaaguuuuuuuuuuuuagcguuuugauauuaaacauuau

SEQ ID NO: 509708 - RNA, 64 nt, Homo Sapiens
uaaagguguggucucuucccuagguuuuuuuuucuuuuuuuaagcuaccuggucacauuuaauc

SEQ ID NO: 509709 - RNA, 64 nt, Homo Sapiens
uuauuauuaagguuguaaugguuugauuuuuagauuuuuuuaaaccacaggguccuguuguuuu

SEQ ID NO: 509710 - RNA, 64 nt, Homo Sapiens
auuguaugcaaucuuuauguugcuccccagauuauuuuuuuaauaaguaggaaauaaaaugaau

SEQ ID NO: 509711 - RNA, 64 nt, Homo Sapiens
ccaaaagccaaaaauauuuacucacuaaucuuuuuuuuuuuagucccauuauuuauugguuuuc

SEQ ID NO: 509712 - RNA, 64 nt, Homo Sapiens
caugaagagaaaauuaguagugguuaaaagauuuuuuuuuuaauauuuccagucaccccaaaua

SEQ ID NO: 509713 - RNA, 64 nt, Homo Sapiens
uauuuuuauaauacuguuaguuaugaaucuagaauuuuuuuacagauauuagcauaucugguaa

SEQ ID NO: 509714 - RNA, 64 nt, Homo Sapiens
caucagauuuauacuagcuaaggaaacaaaacuauuuuuuuaauccaugaaccaaguguuuuua

SEQ ID NO: 509715 - RNA, 64 nt, Homo Sapiens
aacuugaagcagaaccuugucugaauuuuuaaauuuuuuuuaaaauucuugugcugcacauggg

SEQ ID NO: 509716 - RNA, 64 nt, Homo Sapiens
uuuccuuuucaaaggaaaaccuuguuuacgggaauuuuuuuaguaccaagcugauggggaggga

SEQ ID NO: 509717 - RNA, 64 nt, Homo Sapiens
aauuuaaucucaaauguuguauucaauuacaauuuuuuuuuacccacaauuuucugaagucuga

SEQ ID NO: 509718 - RNA, 64 nt, Homo Sapiens
gaagugcuugaucacuugcauaauuaucauaugcuuuuuuuaaucccuuuauccuuaauuuaau

SEQ ID NO: 509719 - RNA, 64 nt, Homo Sapiens
caagcauuggcuagccuuuuauaugugguguucuuuuuuuuacacaauugcauauaauacaaca

SEQ ID NO: 509720 - RNA, 64 nt, Homo Sapiens
ugacucuaguuagaaagucuagauuaaccuuucauuuuuuuaggugaagcgcucaugauuugau

SEQ ID NO: 509721 - RNA, 64 nt, Homo Sapiens
uugcccaaaauuauuucuucacauugaaaacaguuuuuuuuaggaagccuuaauaaaaacauca

SEQ ID NO: 509722 - RNA, 64 nt, Homo Sapiens
uguguguuauguacauauaugcuugguggugggauuuuuuuaaagauuaguuuacagagaaaag

SEQ ID NO: 509723 - RNA, 64 nt, Homo Sapiens
uccccaaagacauuaucuguuaauuauaaauauguuuuuuuaaagacaucccucacuuaccaau

SEQ ID NO: 509724 - RNA, 64 nt, Homo Sapiens
agucacaaaaacaauucacuuuaaaaacaaaugauuuuuuuaaaggacuauccucuuguuuuua

SEQ ID NO: 509725 - RNA, 64 nt, Homo Sapiens
agaaaaaauaauccgacuccgugcccagccuuuuuuuuuuuaaugauuacgggugugagccacc

SEQ ID NO: 509726 - RNA, 64 nt, Homo Sapiens
agaagcuuuguaauaaaacauaaugugcugagcauuuuuuuaaauuugucauuccaguuugagu

SEQ ID NO: 509727 - RNA, 64 nt, Homo Sapiens
caguaaaccuuaacagaugcguuuucuucuuuucuuuuuuuaaauucaguuuauuuuuucuucu

SEQ ID NO: 509728 - RNA, 64 nt, Homo Sapiens
uuacacuuuuuaguuuuaauuuuuuaaacuugaauuuuuuuaauaaggaucguuuuuuuuugcu

SEQ ID NO: 509729 - RNA, 64 nt, Homo Sapiens
cuuuuaacuuagcaugugguuagauguagaguguuuuuuuuacauguauuuaaagaaaaaaaaa

SEQ ID NO: 509730 - RNA, 64 nt, Homo Sapiens
guaaaaaaaaaauacaccuuuugguuuuuuuuuuuuuuuuuaagguuaaucuguuuugguuugu

SEQ ID NO: 509731 - RNA, 64 nt, Homo Sapiens
uuaguuaaaaaagaggacauaccaugcuucuucauuuuuuuacuuaaucagcacaagugaauua

SEQ ID NO: 509732 - RNA, 64 nt, Homo Sapiens
ugaaaaagaaauaucuaagcuguuuuugcacuauuuuuuuuaacaucaccuugacuaucagaua

SEQ ID NO: 509733 - RNA, 64 nt, Homo Sapiens
ugucuuuucuccauauuuuaacagguuaagauaauuuuuuuaccuaaaaagaaaaaagacuacu

SEQ ID NO: 509734 - RNA, 64 nt, Homo Sapiens
aaaaaacaauguauauuauguccuaaauuaaccuuuuuuuuaaagugguugaagaugaaaucau

SEQ ID NO: 509735 - RNA, 64 nt, Homo Sapiens
auauaugacuaaaauggacagagaaacuuuuuuuuuuuuuuaagacugucugauuuacuacaca

SEQ ID NO: 509736 - RNA, 64 nt, Homo Sapiens
aaaaauuuuguaauaaaauugauguugcauuucguuuuuuuaaaguaaauuuuggguuuuuuag

SEQ ID NO: 509737 - RNA, 64 nt, Homo Sapiens
uucuuguguaugguagcacauaaauauuuaaugguuuuuuuaaucuucugauguugaauguucc

SEQ ID NO: 509738 - RNA, 64 nt, Homo Sapiens
ugucaaauaucaucaugguugccaacuuuggguauuuuuuuaagaaggauaauuuuuaucaaua

SEQ ID NO: 509739 - RNA, 64 nt, Homo Sapiens
aacauauuaaaggauguggcaccuuaacuauuccuuuuuuuauacgaagacaggucucagagau

SEQ ID NO: 509740 - RNA, 64 nt, Homo Sapiens
aaugaauuuguacaugcagccaaauuuacaggaauuuuuuuaaaaggcagaaaaacuugaaaua

SEQ ID NO: 509741 - RNA, 64 nt, Homo Sapiens
ccagguaaucugguggagcgaauacugcaauaaauuuuuuuacuucucuuuguuacuugucugu

SEQ ID NO: 509742 - RNA, 64 nt, Homo Sapiens
agagucaaccaccacagauaggaauuccuuauucuuuuuuuaauuuuuuuaagacagagucuca

SEQ ID NO: 509743 - RNA, 64 nt, Homo Sapiens
caccacagauaggaauuccuuauucuuuuuuuaauuuuuuuaagacagagucucacuuuguugc

SEQ ID NO: 509744 - RNA, 64 nt, Homo Sapiens
auuuagcuuuacaaagauuuuuucuauuacuuuuuuuuuuuauugugguauauguaacacaagu

SEQ ID NO: 509745 - RNA, 64 nt, Homo Sapiens
ucuucacuauauuuuuuucucucucucucuuuuuuuuuuuuacuuuacauauuuuauacaaugu

SEQ ID NO: 509746 - RNA, 64 nt, Homo Sapiens
acauaauuaugggaacaaguguacagaagaauuuuuuuuuuaagauaugugagaacuuuucaua

SEQ ID NO: 509747 - RNA, 64 nt, Homo Sapiens
gaaauugcaaagaaaauucucaagugauagucuuuuuuuuuaaguguuucguaagacaaaaauu

SEQ ID NO: 509748 - RNA, 64 nt, Homo Sapiens
aauguaaauaauuauuuuuuagaaguuuuuuuuuuuuuuuuaaagacagggucucgcuuuaucg

SEQ ID NO: 509749 - RNA, 64 nt, Homo Sapiens
ggugugagccacuguguccagccuguaacuauuauuuuuuuauaaagagagauucuuauuuucu

SEQ ID NO: 509750 - RNA, 64 nt, Homo Sapiens
ucuguaaauucaggguuuuuuuuuguuuuuuuguuuuuuuuaagccgaaaaaaugcuuaauaug

SEQ ID NO: 509751 - RNA, 64 nt, Homo Sapiens
aacaugauugaaaucacugcuuauaaaugugugauuuuuuuaaaacgaccaaaacuguucugaa

SEQ ID NO: 509752 - RNA, 64 nt, Homo Sapiens
aaaugucccacuugaauaacguaauucuucauaguuuuuuuaaucuauggauaaauggaaaccu

SEQ ID NO: 509753 - RNA, 64 nt, Homo Sapiens
gagugaaggcuaaucauagaaaaaaaaccucuaguuuuuuuaaaaauagaauuuggaaacuuau

SEQ ID NO: 509754 - RNA, 64 nt, Homo Sapiens
agaaauguguaugguuugcagcuuuuaaaaaccauuuuuuuaaaacuaauaaauagugacugaa

SEQ ID NO: 509755 - RNA, 64 nt, Homo Sapiens
uucugcaaacuuuuccaucuaaaaaaaaaaauguuuuuuuuaagacaggaucucauucuguugc

SEQ ID NO: 509756 - RNA, 64 nt, Homo Sapiens
uuggggagaauuauagaauguuuguuuuuguauuuuuuuuuaaaguaaauucaacuuacgcuua

SEQ ID NO: 509757 - RNA, 64 nt, Homo Sapiens
uuuuuugacuuuuuuuguauguguguuuuuucuuuuuuuuuaaguucuuaugaggaggggaggg

SEQ ID NO: 509758 - RNA, 64 nt, Homo Sapiens
gaauuuuuuuguaauaagcaaucaagguuauaauuuuuuuuaaaauagaaauuuuguaagaagg

SEQ ID NO: 509759 - RNA, 64 nt, Homo Sapiens
aaaugugcacagguacacuuaccuuuuuuuuuuuuuuuuuuaaguuuuucccauucaggaaaac

SEQ ID NO: 509760 - RNA, 64 nt, Homo Sapiens
agcuaaaaauagcuuuauuuaugcugaauugugauuuuuuuaugccaaauuuuuuuuaguucua

SEQ ID NO: 509761 - RNA, 64 nt, Homo Sapiens
auuuaugcugaauugugauuuuuuuaugccaaauuuuuuuuaguucuaaucauugaugauagcu

SEQ ID NO: 509762 - RNA, 64 nt, Homo Sapiens
uaaaugaagauuuuuuaaauucuaucuugcugauuuuuuuuaaauauaagaaacugguacuugg

SEQ ID NO: 509763 - RNA, 64 nt, Homo Sapiens
ugacuuuuaaaauuugaaugauauauagacuuuguuuuuuuaaugcaauaugaauauuugcuca

SEQ ID NO: 509764 - RNA, 64 nt, Homo Sapiens
uuuaugugaacaaauagaguuguucuuuuucucuuuuuuuuaagacagaguguugcucugucgc

SEQ ID NO: 509765 - RNA, 64 nt, Homo Sapiens
aaagaaaaggaaaaagaaaaauauauauucuauauuuuuuuaacuuaugagaauguguucauuu

SEQ ID NO: 509766 - RNA, 64 nt, Homo Sapiens
uuccaauuuuccagcauuucuucauuugauucucuuuuuuuagucuuaaaauaaugacuccuau

SEQ ID NO: 509767 - RNA, 64 nt, Homo Sapiens
uuaauguauauacaccagaaacuauuuuucaaacuuuuuuuacugcaaccaauaguuaagauua

SEQ ID NO: 509768 - RNA, 64 nt, Homo Sapiens
uguuaauuuugucuuccucacuuuucaccuuaguuuuuuuuaacccuuuaguaaucuugaauuc

SEQ ID NO: 509769 - RNA, 64 nt, Homo Sapiens
uuuuuuuaacccuuuaguaaucuugaauucuacuuuuuuuuaaauuucuacuguugucuuuagu

SEQ ID NO: 509770 - RNA, 64 nt, Homo Sapiens
ucucauuucauuuauuaauaguuaaugcugaauuuuuuuuuaaguuuccucuggcucuauuuau

SEQ ID NO: 509771 - RNA, 64 nt, Homo Sapiens
caccacugcgcccgcaaaguuuuuuuguuguuuuuuuuuuuaaguugguacucacaaaucacua

SEQ ID NO: 509772 - RNA, 64 nt, Homo Sapiens
agaaaaugagcugauuguaauuacucucuguguguuuuuuuauugcuagcuaucauuaccaguu

SEQ ID NO: 509773 - RNA, 64 nt, Homo Sapiens
ccuacuacaguaggugcucagauauuuauuuuuauuuuuuuauuaugcacauuguuuuuccugc

SEQ ID NO: 509774 - RNA, 64 nt, Homo Sapiens
ucugaugguaauaaaacugacaagaugucuaauuuuuuuuuaaguaggaccaaaggaaaacaag

SEQ ID NO: 509775 - RNA, 64 nt, Homo Sapiens
ccuaaaauaaaaagaaaaaauuaaaaagaaucaguuuuuuuaauuaaaaaaauagaaagcuguu

SEQ ID NO: 509776 - RNA, 64 nt, Homo Sapiens
ucuuucauuaguuuauuuguguuggguucuuuuuuuuuuuuaaaugaaaaguauaguauguggc

SEQ ID NO: 509777 - RNA, 64 nt, Homo Sapiens
uuuuuucuaggcaaacauugaaugcaaacguguauuuuuuuaauauaaauauauaacuguccuu

SEQ ID NO: 509778 - RNA, 64 nt, Homo Sapiens
ggcauguaaugcuuaguuuucuuguauuuacuucuuuuuuuaaauguaaggaccaaacuucuaa

SEQ ID NO: 509779 - RNA, 64 nt, Homo Sapiens
cccuuuucccaugcauggauggaaauggaagauuuuuuuuuaacuuguucuagaagucuuaaua

SEQ ID NO: 509780 - RNA, 64 nt, Homo Sapiens
ucacaauucaguuucuaugaguuugaucaccugauuuuuuuaacaaaauauuucuaacgggaau

SEQ ID NO: 509781 - RNA, 64 nt, Homo Sapiens
aauucauauuauuauuauuauuauaauacaauauuuuuuuuaaaagacugcugcauccuuagga

SEQ ID NO: 509782 - RNA, 64 nt, Homo Sapiens
cuuucucucuauugcuauguugaaguaauaggguuuuuuuuaaccucuggaugucucgucugug

SEQ ID NO: 509783 - RNA, 64 nt, Homo Sapiens
ggugcuugaacaaggagcuccgcucuacaacugguuuuuuuaggacuugugaggaacacagcaa

SEQ ID NO: 509784 - RNA, 64 nt, Homo Sapiens
uugugaaauguaacaugaagcaaacuaacuuuuuuuuuuuuaacaucuuuguuuuuaaaauaga

SEQ ID NO: 509785 - RNA, 64 nt, Homo Sapiens
guuagggagaugaguugcaguuuuuauaauagauuuuuuuuaaaguuugguauuguaaaacauu

SEQ ID NO: 509786 - RNA, 64 nt, Homo Sapiens
auaaauuacacaauaaagcaguccuguucaaauuuuuuuuuaacguggcuuguagaauuuuuaa

SEQ ID NO: 509787 - RNA, 64 nt, Homo Sapiens
aacguuggcaguuugauguuuuuccaguccccucuuuuuuuauauuucugcuuuucuuaauccu

SEQ ID NO: 509788 - RNA, 64 nt, Homo Sapiens
auagaaucugaggcuguuuguuuauaggccuuuuuuuuuuuaauuuagagucaaaggauauuua

SEQ ID NO: 509789 - RNA, 64 nt, Homo Sapiens
augaagggacaaagucaacuggggguuuuuuuuguuuuuuuaaacgugguuuauugacaggguu

SEQ ID NO: 509790 - RNA, 64 nt, Homo Sapiens
ccucaacuugguaauuggguacuacuuggucgaauuuuuuuagcacuaaaggcaaugauguggg

SEQ ID NO: 509791 - RNA, 64 nt, Homo Sapiens
ucggaaacacaacuggggaaauuuccuuuuuuuuuuuuuuuaacucagcuacuugcauuugauu

SEQ ID NO: 509792 - RNA, 64 nt, Homo Sapiens
uagaaaaauuguuuccaaaguuucaugccuuuuuuuuuuuuaagacacguaacagugcaaaaac

SEQ ID NO: 509793 - RNA, 64 nt, Homo Sapiens
uaacacuaaagaagcuguaaauugauuuuuuuuuuuuuuuuaaguaccaucaaucauccaucag

SEQ ID NO: 509794 - RNA, 64 nt, Homo Sapiens
cgagacgggguuucaccaugagcuaauuuuguuuuuuuuuuaguaggcaugugccaccaugccc

SEQ ID NO: 509795 - RNA, 64 nt, Homo Sapiens
guugaaucauuuugugaaugaugggggugaaauauuuuuuuauuuaauacuagauaauaaggaa

SEQ ID NO: 509796 - RNA, 64 nt, Homo Sapiens
auuauuuugaaaguauggaacucuuaaaaauuauuuuuuuuauucaaagaguugagggcuguug

SEQ ID NO: 509797 - RNA, 64 nt, Homo Sapiens
uaauauagccuggacuuuacaacgcacugacauuuuuuuuuauuaaaaaacuuuaacaugaaaa

SEQ ID NO: 509798 - RNA, 64 nt, Homo Sapiens
gaagagugacuuauuuuguccagaugaccauaauuuuuuuuaaacugggauuauucuuugaaaa

SEQ ID NO: 509799 - RNA, 64 nt, Homo Sapiens
agguagagucuuacaaucaaaaccaagugugcucuuuuuuuaaacaaguuuaaaagccauguau

SEQ ID NO: 509800 - RNA, 64 nt, Homo Sapiens
ugcaacugcuuuucugccguucugcuguuuuuuuuuuuuuuaauauauagauauuuaaagcuuu

SEQ ID NO: 509801 - RNA, 64 nt, Homo Sapiens
uguaaagguggaaaaacuuuguggaaaggacaccuuuuuuuauuacaaugcauauucccaaacu

SEQ ID NO: 509802 - RNA, 64 nt, Homo Sapiens
gagacagcguuucggucuuguuuuuuuuuuuuuuuuuuuuuaaaauacauaggacuuugcacuu

SEQ ID NO: 509803 - RNA, 64 nt, Homo Sapiens
guuuacauuuaucucuaugucuaaaggguuccuuuuuuuuuaauucaugguaaaaguuaauaua

SEQ ID NO: 509804 - RNA, 64 nt, Homo Sapiens
gcaauauuuuuuuucugaaucuuugaauuggcuauuuuuuuaauuauuuuaaaacuaaaaaaaa

SEQ ID NO: 509805 - RNA, 64 nt, Homo Sapiens
uucuuuuuguauucuaucccauuauuugcuuuuuuuuuuuuacuguguguuguguugucuuuca

SEQ ID NO: 509806 - RNA, 64 nt, Homo Sapiens
uaauggcuucuugucugucuuuaaaaaguuuuuuuuuuuuuaaaaaauaauuuggcaaucagaa

SEQ ID NO: 509807 - RNA, 64 nt, Homo Sapiens
guuuacaauuauccaguuuucuacagucuuuuuuuuuuuuuaauguucuauuacuugaauaguu

SEQ ID NO: 509808 - RNA, 64 nt, Homo Sapiens
aacuaaaaagaaaaaaggaauugagguuuuauuguuuuuuuaauaaccaguuauacccaguauu

SEQ ID NO: 509809 - RNA, 64 nt, Homo Sapiens
auuuucauuaauacuguaguuuuuaaacccauuuuuuuuuuagaaauauauguuguuguuguug

SEQ ID NO: 509810 - RNA, 64 nt, Homo Sapiens
ggugcuuuuuaaaaauccaauaaauuugagcuauuuuuuuuagacuuguuuuucuuuagauuua

SEQ ID NO: 509811 - RNA, 64 nt, Homo Sapiens
guaaaagcaagugaaauuuuuuuaauuuuuucaguuuuuuuaauuauauuuuauauauauuaag

SEQ ID NO: 509812 - RNA, 64 nt, Homo Sapiens
gaaauucuuaucaugggugucaaguauggaauacuuuuuuuaaaaacuaaaaucucucauaacu

SEQ ID NO: 509813 - RNA, 64 nt, Homo Sapiens
guagcucuguauagcacuugcuuguacuuuuuuuuuuuuuuauucgugagccacugugcccagc

SEQ ID NO: 509814 - RNA, 64 nt, Homo Sapiens
gcugagauucccaaaaugagaguaaagccaaccuuuuuuuuaaguucacacacucuaaaauaua

SEQ ID NO: 509815 - RNA, 64 nt, Homo Sapiens
aagcagaaauagaaauacaacauauguaccuauuuuuuuuuaaaauguuauccacccaagugua

SEQ ID NO: 509816 - RNA, 64 nt, Homo Sapiens
cuuucauaaagauugcuuuucuuuuauuaaaagcuuuuuuuaagauuagggcaauguuggucgc

SEQ ID NO: 509817 - RNA, 64 nt, Homo Sapiens
uuuaaaauauaucucuagaaagggugaaucuuguuuuuuuuaucagagagagacuuuuauuuga

SEQ ID NO: 509818 - RNA, 64 nt, Homo Sapiens
gaucuuuaauacuuuccaugaugacagcauucgauuuuuuuaaauuuucaugccucacuuugac

SEQ ID NO: 509819 - RNA, 64 nt, Homo Sapiens
cacucaaucccaaauggagggcuguacagauuuuuuuuuuuaacaucaugauaagggcacaaaa

SEQ ID NO: 509820 - RNA, 64 nt, Homo Sapiens
cguuugcacuauuuagagucagguuagaauguaauuuuuuuaagguuugccuggagaagcaagg

SEQ ID NO: 509821 - RNA, 64 nt, Homo Sapiens
aauaccauauucaagggaguaugagccuuuuuuuuuuuuuuaaauuuucaguagcuccagguag

SEQ ID NO: 509822 - RNA, 64 nt, Homo Sapiens
ugaagagaacuucaugaugaaaauuagcagcuuuuuuuuuuaaauuuuaaaaaagaaaaguagu

SEQ ID NO: 509823 - RNA, 64 nt, Homo Sapiens
aaagaaaaguaguaaauuaggaguuagcuguauuuuuuuuuaaauuauaguauauucauuuaug

SEQ ID NO: 509824 - RNA, 64 nt, Homo Sapiens
guuauuuucuguguccuuuaaacaauaaaguaucuuuuuuuacuucauuggucauuuuuuuuuu

SEQ ID NO: 509825 - RNA, 64 nt, Homo Sapiens
aauaaaguaucuuuuuuuacuucauuggucauuuuuuuuuuaacgugagugacagauacauagu

SEQ ID NO: 509826 - RNA, 64 nt, Homo Sapiens
guaucacccaaagcauguaucuaauuauuguagguuuuuuuaacgaaauguuaaggcaauacua

SEQ ID NO: 509827 - RNA, 64 nt, Homo Sapiens
uuauguagccaacauugcaguccucuuaaaaagauuuuuuuauucagccucugauuauugagcu

SEQ ID NO: 509828 - RNA, 64 nt, Homo Sapiens
uucuauuuuaaaagcuaucaaggcugauuuuucuuuuuuuuaagaaaaaccagcccauccuuug

SEQ ID NO: 509829 - RNA, 64 nt, Homo Sapiens
uauccaguuauaucuacauaaaucucgauuucacuuuuuuuauuauauuuuaaccacugcuuca

SEQ ID NO: 509830 - RNA, 64 nt, Homo Sapiens
auuguugcugauuucagaggagugcaaucauuauuuuuuuuaaucuaguucugcuugaccaagu

SEQ ID NO: 509831 - RNA, 64 nt, Homo Sapiens
augaaaguugcuaguucugcuaacagauuuguacuuuuuuuaaauguauacugauugaaauuuu

SEQ ID NO: 509832 - RNA, 64 nt, Homo Sapiens
gcgccuucaguguacuguuucuuauuaacuuuacuuuuuuuaaaucaacuugcuauagacuuua

SEQ ID NO: 509833 - RNA, 64 nt, Homo Sapiens
ccagucuuaaaguagacaaaauauucagagccauuuuuuuuaagggaaaugaaaaagauacucu

SEQ ID NO: 509834 - RNA, 64 nt, Homo Sapiens
agaauguuuuuaugaucuguuuagugcuuauuauuuuuuuuaugaucuguuuagugcuuauuau

SEQ ID NO: 509835 - RNA, 64 nt, Homo Sapiens
ucagagggaacuuuagcuuuauccauaacauuaauuuuuuuaaaaaauaaggucuuaauguuuc

SEQ ID NO: 509836 - RNA, 64 nt, Homo Sapiens
cucugggacgcagacacauuccuuggauguugauuuuuuuuaugaucuaguaaaggaauaggua

SEQ ID NO: 509837 - RNA, 64 nt, Homo Sapiens
ccuuuucuguuuuuggggggggaguuuuguuguguuuuuuuaaaguaagugcuuaaguauuaac

SEQ ID NO: 509838 - RNA, 64 nt, Homo Sapiens
gcuuuacuaaucuaccagagcauuguagauauuuuuuuuuuacaucuauuguuuaaaauagaug

SEQ ID NO: 509839 - RNA, 64 nt, Homo Sapiens
uuaaauauuuuuuuguaaauauuauguguguguuuuuuuuuaaucuaugggaauauuucuuuug

SEQ ID NO: 509840 - RNA, 64 nt, Homo Sapiens
caaauuaaacuuguucugaguccauucaaauguguuuuuuuaaauguagauugaaaucuuugua

SEQ ID NO: 509841 - RNA, 64 nt, Homo Sapiens
cagaccaaaaauucugaugaccgcaucuagauuauuuuuuuauaaaaaugauuuucacuauagc

SEQ ID NO: 509842 - RNA, 64 nt, Homo Sapiens
uaugcuucgugugaacucuccuuaaaaaccgauauuuuuuuaucauggaaccagaacaucuguc

SEQ ID NO: 509843 - RNA, 64 nt, Homo Sapiens
acuuaguucuuuguggauuguucuagacuuuuaauuuuuuuagcugccauuuaagcauuccugu

SEQ ID NO: 509844 - RNA, 64 nt, Homo Sapiens
uaaauuuuguaugguaaaggaucaauaaaaugauuuuuuuuaagaguucaggcuuguggauggg

SEQ ID NO: 509845 - RNA, 64 nt, Homo Sapiens
aaggaggggagaacccagcgcaccccucccccccuuuuuuuaaacgcgugaugaagacagaagg

SEQ ID NO: 509846 - RNA, 64 nt, Homo Sapiens
uagcuuuaacuuguaaaccacaucuuuuuugcacuuuuuuuauaagcaaaaacgugccguuuaa

SEQ ID NO: 509847 - RNA, 64 nt, Homo Sapiens
acuacaggcaccugccaccacccccaguuaauauuuuuuuuaauuuuuuuuagaggcaggaucu

SEQ ID NO: 509848 - RNA, 64 nt, Homo Sapiens
ccugccaccacccccaguuaauauuuuuuuuaauuuuuuuuagaggcaggaucuugcuguccaa

SEQ ID NO: 509849 - RNA, 64 nt, Homo Sapiens
aauuuuuuuuagaggcaggaucuugcuguccaauuuuuuuuaaaaagcuaaaauugccaacuuu

SEQ ID NO: 509850 - RNA, 64 nt, Homo Sapiens
aaaccguuaggaacagccccguggauacugaaguuuuuuuuaugguaguuacaggaaacuucug

SEQ ID NO: 509851 - RNA, 64 nt, Homo Sapiens
uuugacauaaccuuauuucuuguauuugcccccuuuuuuuuauaaaaggugaauaaaaagaaau

SEQ ID NO: 509852 - RNA, 64 nt, Homo Sapiens
auaaaccucuaaaccugcccagcggaaguguguuuuuuuuuaaauuuaaauacagaaacaacug

SEQ ID NO: 509853 - RNA, 64 nt, Homo Sapiens
gaugucaccuaagugauaguuaacccauuuuuuuuuuuuuuaggcauagaagccaguucagggu

SEQ ID NO: 509854 - RNA, 64 nt, Homo Sapiens
uacuacugaauauaaauaagaaugugcacaguaguuuuuuuauugaaacuuguauuauuuuuaa

SEQ ID NO: 509855 - RNA, 64 nt, Homo Sapiens
ucagauuuuugaguaccaaugaucaugcuuccauuuuuuuuaguuuuaaaccaccaaaccaaua

SEQ ID NO: 509856 - RNA, 59 nt, Homo Sapiens
agaaacuggaugcaucuuaaagaguguuuuuuuuuuagauuguuccauauuaauuuaau

SEQ ID NO: 509857 - RNA, 64 nt, Homo Sapiens
caaacuacaguauacugucuuggguuuuuuuuuuuuuuuuuagucuguaaaauaaaaugacugc

SEQ ID NO: 509858 - RNA, 64 nt, Homo Sapiens
auuuuauuuguacuguacaaaugaugcuaguuuauuuuuuuagcagugaaaaugaauauaaaaa

SEQ ID NO: 509859 - RNA, 64 nt, Homo Sapiens
ucuguaacacuaaauauuuuagugugaaauugaauuuuuuuauuacuauagucuuuucaaucua

SEQ ID NO: 509860 - RNA, 64 nt, Homo Sapiens
auacgucagguuugcuuaaccauugauuuuuuuuuuuuuuuaccaagucuuacagugauuauuu

SEQ ID NO: 509861 - RNA, 64 nt, Homo Sapiens
acauguagaauaugcucuuuaauuuaguaaaauauuuuuuuaaaagguagagaugcuuuguuau

SEQ ID NO: 509862 - RNA, 64 nt, Homo Sapiens
auuuuuggcuaauuuuuaaccugagguuuuguuuuuuuuuuaaaggaaaugcagccuagucuug

SEQ ID NO: 509863 - RNA, 64 nt, Homo Sapiens
acuuggcuaaagaaucucaaucucuugaaauuuauuuuuuuaaugucauauucaucugguaaau

SEQ ID NO: 509864 - RNA, 64 nt, Homo Sapiens
guggacaacuaaaucagacucuugccuuugcacuuuuuuuuaacuuuuguagauaauuuuuguu

SEQ ID NO: 509865 - RNA, 64 nt, Homo Sapiens
ucacuauuuacaaaaguacaauuagaaacacuguuuuuuuuaaguaccguuuuuauuuucauaa

SEQ ID NO: 509866 - RNA, 64 nt, Homo Sapiens
gcauucuugucccuauaacagggaugcuuaauuuuuuuuuuaacuuagaguuuuaaauugccaa

SEQ ID NO: 509867 - RNA, 64 nt, Homo Sapiens
ccauuugacaaaucccagggacuauccaggaauuuuuuuuuaacuggauauuguguuugaguau

SEQ ID NO: 509868 - RNA, 64 nt, Homo Sapiens
cagcagcaguuaaacuuuguuucucuaauagcuuuuuuuuuacauaaaaaaagacccaggaacu

SEQ ID NO: 509869 - RNA, 64 nt, Homo Sapiens
aaauaguuuaaauguuucuuugucuauuuuucuuuuuuuuuaaugcuacccagggaaauauuuu

SEQ ID NO: 509870 - RNA, 64 nt, Homo Sapiens
uugucuacaaccagggauugauuuuaaagaugucuuuuuuuauuuuacuuuuuuuuaagcacca

SEQ ID NO: 509871 - RNA, 64 nt, Homo Sapiens
gauugauuuuaaagaugucuuuuuuuauuuuacuuuuuuuuaagcaccaaauuuuguuguuuuu

SEQ ID NO: 509872 - RNA, 64 nt, Homo Sapiens
cacuagaaaugguguaaaggcugucuuuuuuuuuuuuuuuuaaagaaaaguuauuaccauguau

SEQ ID NO: 509873 - RNA, 64 nt, Homo Sapiens
acccuccaggugucaauggacuugugcuacuauauuuuuuuauucuugguaucaguuuaaaauu

SEQ ID NO: 509874 - RNA, 64 nt, Homo Sapiens
gguuuuguuaauuaugauucuuuauuuucucuccuuuuuuuaggauauagcaguaaugcuauua

SEQ ID NO: 509875 - RNA, 64 nt, Homo Sapiens
gcaguuaguccugcaugggaauaaggacuaguuauuuuuuuagugcugcauuuuuuuaaaguug

SEQ ID NO: 509876 - RNA, 64 nt, Homo Sapiens
gggaauaaggacuaguuauuuuuuuagugcugcauuuuuuuaaaguuggauugcugcuauuuaa

SEQ ID NO: 509877 - RNA, 64 nt, Homo Sapiens
gugacagagugagacucugucucaauuaauuuuuuuuuuuuaaaggaggaggaucuccaugggu

SEQ ID NO: 509878 - RNA, 64 nt, Homo Sapiens
uugagugccguaaaagugcuuguaaaucuuuuuuuuuuuuuaagaagaaagaaaaaaauggugu

SEQ ID NO: 509879 - RNA, 64 nt, Homo Sapiens
uauaaguacauccuuugggguuuuuuuuuucucuuuuuuuuaaccaaaguugcugucuagugca

SEQ ID NO: 509880 - RNA, 64 nt, Homo Sapiens
uucuucacaauuccuuucaucauuuuuuaaauauuuuuuuuacugccuaugggcugugauguau

SEQ ID NO: 509881 - RNA, 64 nt, Homo Sapiens
cauacccucauuuuuuucuuuucuuuuuuuuuuuuuuuuuuaguacaaaguuuuaguuucuuuu

SEQ ID NO: 509882 - RNA, 64 nt, Homo Sapiens
aguggugugcucgaaaaagacauuacugaugccuuuuuuuuauagaguggauugaaaugccagu

SEQ ID NO: 509883 - RNA, 64 nt, Homo Sapiens
ugaggacugugaagauaacuuucauguaguuggauuuuuuuauauaaauuagagcgucaauucc

SEQ ID NO: 509884 - RNA, 64 nt, Homo Sapiens
ucuuuccuuuuucuuaaguucacucucuuuuacauuuuuuuacuaagcuucgccuuugcuuuug

SEQ ID NO: 509885 - RNA, 64 nt, Homo Sapiens
cggagucucgcucugucacguauucuuuguuuuuuuuuuuuagaaucagcuguguuaaugccuu

SEQ ID NO: 509886 - RNA, 64 nt, Homo Sapiens
aaaaauaaguuauggccaucuauuuuccuuuuccuuuuuuuaaaacuuccucaccaacacuuau

SEQ ID NO: 509887 - RNA, 64 nt, Homo Sapiens
gagguaaacuucacauaacauuuuuuuuuaagaauuuuuuuauuugguuggauaucacugaguu

SEQ ID NO: 509888 - RNA, 64 nt, Homo Sapiens
aauuuuuuuauugagguaaauaucacugaguuuuuuuuuuuaaguauauuuuuuaaugguugga

SEQ ID NO: 509889 - RNA, 64 nt, Homo Sapiens
auagauugagaacaguugaaauuugucauuuuuuuuuuuuuagcucggaaauguagaauuuauu

SEQ ID NO: 509890 - RNA, 64 nt, Homo Sapiens
ccauuaaaaucuauguguguuaacaaauuugguuuuuuuuuaaacugcauucauuuuucuaaag

SEQ ID NO: 509891 - RNA, 64 nt, Homo Sapiens
caauuacuuuauuauuguuguaugugagcaagauuuuuuuuaaauuuccauaaagacauuuaua

SEQ ID NO: 509892 - RNA, 64 nt, Homo Sapiens
gagcaacugccacaugcggggcacugauauauauuuuuuuuaaaucccccuauggggccugacu

SEQ ID NO: 509893 - RNA, 64 nt, Homo Sapiens
ggaugaguggaugagaggagaugguuuuguggguuuuuuuuaagguuuuguuuuuuuacuaaug

SEQ ID NO: 509894 - RNA, 64 nt, Homo Sapiens
aaugaugguuuuguggguuuuugaagggguuuuguuuuuuuacugaaccccuaacccccaauac

SEQ ID NO: 509895 - RNA, 64 nt, Homo Sapiens
ucuuacuuucccauauuagguucuugucuuuuuuuuuuuuuauuuuuuuuauaaauauguugau

SEQ ID NO: 509896 - RNA, 64 nt, Homo Sapiens
aauauguugauuucuugucuaaguagcuuguuuuuuuuuuuauaauuuuuaauuuaguuugggg

SEQ ID NO: 509897 - RNA, 64 nt, Homo Sapiens
gaaagaaaaagaaacccuggggguugaacuuuuuuuuuuuuaaagaauuauugacugggcuuug

SEQ ID NO: 509898 - RNA, 64 nt, Homo Sapiens
gcuugauugugggagaaaaguucugagacuguuguuuuuuuagaguuuguuccuccucauccuc

SEQ ID NO: 509899 - RNA, 64 nt, Homo Sapiens
uaagggauaacauauucuuuuuuccccacuuuuauuuuuuuaaacauguuaauuuuuuucccuc

SEQ ID NO: 509900 - RNA, 64 nt, Homo Sapiens
augagccucuccuagacuugagacuuugcaauuuuuuuuuuagguuuuuguuuuaauugagaaa

SEQ ID NO: 509901 - RNA, 64 nt, Homo Sapiens
ccaacauguucauuuggguuucuagaucuuguuuuuuuuuuaauaagcucuuccuucaagaguu

SEQ ID NO: 509902 - RNA, 64 nt, Homo Sapiens
uugagugccacuauuaauguuuuaacagaucuuauuuuuuuauuuggaacagucaguuuaacuu

SEQ ID NO: 509903 - RNA, 64 nt, Homo Sapiens
uguagaucaugcaugugauuguaauccaaacuuuuuuuuuuaacauucacaauuuaaaaacacu

SEQ ID NO: 509904 - RNA, 64 nt, Homo Sapiens
uaauucucacuguuuguucacuacacgagaauuuuuuuuuuaaugccuguucuauguuuuuaag

SEQ ID NO: 509905 - RNA, 64 nt, Homo Sapiens
uguacuuguauuagauuuuuaagcauucuaugucuuuuuuuaauaagugccuucuguauugugu

SEQ ID NO: 509906 - RNA, 64 nt, Homo Sapiens
agagucaugaugaaucaguccaaccugcucauuuuuuuuuuaucuucagaaagggccaaauucc

SEQ ID NO: 509907 - RNA, 64 nt, Homo Sapiens
ugaaaagaaguagugucuggacaacagucuucauuuuuuuuaauuuucaugccuggguggccaa

SEQ ID NO: 509908 - RNA, 64 nt, Homo Sapiens
uuuaccaugcucaaugaaaaucuccuugguuauauuuuuuuaacaaaucuagaagagucuauug

SEQ ID NO: 509909 - RNA, 64 nt, Homo Sapiens
cucaaaaucuagaagagucuaggaaaagaauuuuuuuuuuuaagugaugccucccuggcagcac

SEQ ID NO: 509910 - RNA, 64 nt, Homo Sapiens
ugccagggcuacuucugcuuuccugggagacuucuuuuuuuaaaagguccuuuauguguuguuc

SEQ ID NO: 509911 - RNA, 64 nt, Homo Sapiens
aaaagaaaguuaucguagccauacacauuugaauuuuuuuuaaaacgacuguggcuugauguug

SEQ ID NO: 509912 - RNA, 64 nt, Homo Sapiens
uggaaguauauguaagguuagaaaagccuauguguuuuuuuaauaaaaucuaggccaaaauacu

SEQ ID NO: 509913 - RNA, 64 nt, Homo Sapiens
agucaaacaauguuggaaguuauuuguaaguuaauuuuuuuacaagguuaugcuccaaaagugu

SEQ ID NO: 509914 - RNA, 64 nt, Homo Sapiens
gaguaaagauuuuuaauucuaaauggaacucauuuuuuuuuaagugauugugauacauugaaca

SEQ ID NO: 509915 - RNA, 64 nt, Homo Sapiens
gaaaggaaaaccuuauaauggcaaagaaagacuuuuuuuuuaagaccguuacauuuugaaauau

SEQ ID NO: 509916 - RNA, 64 nt, Homo Sapiens
caaacacauuucaaagaaccuuccugaagaucaguuuuuuuauuuaggaauagucuguuuuucu

SEQ ID NO: 509917 - RNA, 64 nt, Homo Sapiens
uguaguuuugcucuuguugcgauuauuauuauuuuuuuuuuagaggcuuguaauuaugucucug

SEQ ID NO: 509918 - RNA, 64 nt, Homo Sapiens
uccugaauaagucuacuggauaaagagggauuuuuuuuuuuaagguugaagaauguauuuuacu

SEQ ID NO: 509919 - RNA, 64 nt, Homo Sapiens
auguggaaaugucuucucuuugugacauaguuuuuuuuuuuaaucucugugaaauguguccaga

SEQ ID NO: 509920 - RNA, 64 nt, Homo Sapiens
gauauaaaaauaacaauuacgaaguauuagagguuuuuuuuauuguaaucaauauuuuucaaua

SEQ ID NO: 509921 - RNA, 64 nt, Homo Sapiens
uaguugugagcguuagccaagucucuccaaugcauuuuuuuacauuuucauguauuucuuuucu

SEQ ID NO: 509922 - RNA, 64 nt, Homo Sapiens
agcagcgugauuuguauaucuuaugauaagcuuuuuuuuuuauuacucugaucugauagacugu

SEQ ID NO: 509923 - RNA, 64 nt, Homo Sapiens
cauaacuugcuuuucccauuuuucaucucauucauuuuuuuaacuauccuaauggcagauccaa

SEQ ID NO: 509924 - RNA, 64 nt, Homo Sapiens
ccaggcauauggucuuuaguaucuauuggacuauuuuuuuuaauuagguugaaugagagacuuc

SEQ ID NO: 509925 - RNA, 64 nt, Homo Sapiens
auauuauugcaaagagcucuagaguuuaagccuguuuuuuuaaacaaguagaaugaauaggaga

SEQ ID NO: 509926 - RNA, 64 nt, Homo Sapiens
gacaaagaagaaaggaaaccaaaauuaaauguaauuuuuuuaguaagaacuuaucuuuauucuc

SEQ ID NO: 509927 - RNA, 64 nt, Homo Sapiens
auagcauuacagacugaggcaaauguugaaauaauuuuuuuaaaccaaggaauaguauuuaaga

SEQ ID NO: 509928 - RNA, 64 nt, Homo Sapiens
caaccacauaguucguuuaccuucaaacuuuagguuuuuuuaaugauauacugaucuucauuac

SEQ ID NO: 509929 - RNA, 64 nt, Homo Sapiens
aaaaaaaaaaaaauacaauuuuuauuucuuuuacuuuuuuuaguaaguuaauguauauaaaaau

SEQ ID NO: 509930 - RNA, 64 nt, Homo Sapiens
uguuaaagguagucugccccuuccuuccucucucuuuuuuuaguuaaguagaaauguucugguc

SEQ ID NO: 509931 - RNA, 64 nt, Homo Sapiens
ucuguuauaagucucuuccuuucucaaauaaaguuuuuuuuaaaagauccccuuucauacacuu

SEQ ID NO: 509932 - RNA, 64 nt, Homo Sapiens
uagaaaucuaauuauucaguuauucaugacaauauuuuuuuaaaaguaagaaauucugaguugu

SEQ ID NO: 509933 - RNA, 64 nt, Homo Sapiens
aaaauuauuaagucaccuaucaccuuuaaacgccuuuuuuuaaaauuauaaaauauuguaaagc

SEQ ID NO: 509934 - RNA, 64 nt, Homo Sapiens
aaagcgcagcuacugacaaguagaacacugcuacuuuuuuuaaggcaguuucuuguuuuuuuag

SEQ ID NO: 509935 - RNA, 64 nt, Homo Sapiens
agaacacugcuacuuuuuuuaaggcaguuucuuguuuuuuuagacggaauuaguccuuggcuuc

SEQ ID NO: 509936 - RNA, 64 nt, Homo Sapiens
ugugcaauucuuauauuuauuuuacugguucacuuuuuuuuacauuuauuuuagucuuuauauu

SEQ ID NO: 509937 - RNA, 64 nt, Homo Sapiens
gaaauuacaugaaacaugaaacaguuuuugcaauuuuuuuuaaacugggcaucugguuucuaaa

SEQ ID NO: 509938 - RNA, 64 nt, Homo Sapiens
gcaucugggacuugaccaaaguuguucuguuuuguuuuuuuaacugaaaguaacagaaggaccu

SEQ ID NO: 509939 - RNA, 64 nt, Homo Sapiens
agcaaaguaaacagcacuccccaccccacccuccuuuuuuuacucaucuuggaaaagguuaguc

SEQ ID NO: 509940 - RNA, 64 nt, Homo Sapiens
uucaacuuaaaaaguagaaaugcauuauuauacauuuuuuuaagaaaggacacguuauguuagc

SEQ ID NO: 509941 - RNA, 64 nt, Homo Sapiens
uuuuauuaucuuguacccucuuuuuuuuuuuuuuuuuuuuuaaagacagagucuugcucuguca

SEQ ID NO: 509942 - RNA, 64 nt, Homo Sapiens
guuuuucuacgucauuuuuuaaaauuauauuuaauuuuuuuauuuugaaaguuuuuucacagau

SEQ ID NO: 509943 - RNA, 64 nt, Homo Sapiens
aauuuuuuuauuuugaaaguuuuuucacagaucuuuuuuuuaguauuauuaccuucugauauau

SEQ ID NO: 509944 - RNA, 64 nt, Homo Sapiens
aaaugccgucaguagaaagcacacaagguuaugauuuuuuuaauuacuggcuucugauuucuuu

SEQ ID NO: 509945 - RNA, 64 nt, Homo Sapiens
uaaagguagacucagucuuuaagauauuagacaguuuuuuuaguccaugggauuguaaauauaa

SEQ ID NO: 509946 - RNA, 64 nt, Homo Sapiens
ggucaggguggcauuaaaauggacuccaaaaacauuuuuuuaaauguucuguaagauaaacugu

SEQ ID NO: 509947 - RNA, 64 nt, Homo Sapiens
cugaugcugauuugaugcuguaugaucuuuuuuuuuuuuuuaguuaaauucauuuagugaaugu

SEQ ID NO: 509948 - RNA, 64 nt, Homo Sapiens
ugccaagcauuuucugugauuucagguuuuuuccuuuuuuuacauuuacaacguaucaauaaac

SEQ ID NO: 509949 - RNA, 64 nt, Homo Sapiens
ggcaauuaaacaugcuacacagcauggcaucacuuuuuuuuauaacucauuaaacacaguaaaa

SEQ ID NO: 509950 - RNA, 64 nt, Homo Sapiens
aaugcauuuuucccucaucaagcauauaucugcuuuuuuuuauuuugcaauucucuguauucua

SEQ ID NO: 509951 - RNA, 64 nt, Homo Sapiens
auuugaucuugacauuuaaugucacaaaguuuuguuuuuuuaaaaagugauuuaaacuuaagau

SEQ ID NO: 509952 - RNA, 64 nt, Homo Sapiens
cucauugaucagcagccaauauggguuuguuugguuuuuuuaauucuuaaaaacauccucuaga

SEQ ID NO: 509953 - RNA, 64 nt, Homo Sapiens
aaguucagaaaaaugcacuaugaccgguucguaauuuuuuuaaugccacacauagguuguauug

SEQ ID NO: 509954 - RNA, 64 nt, Homo Sapiens
auaaggaagagucggaaaaaacaaugaccuuaguuuuuuuuaagccugaugauacuaugguuua

SEQ ID NO: 509955 - RNA, 64 nt, Homo Sapiens
gcagagguggcauuuucuuuauugcauuucucuauuuuuuuaauguacccuaccuucaguauuc

SEQ ID NO: 509956 - RNA, 64 nt, Homo Sapiens
aacaguauccacacuuuuuaguucuuuauuuuuuuuuuuuuauuuugagcaauucuccugccuc

SEQ ID NO: 509957 - RNA, 64 nt, Homo Sapiens
aagguuauuuagcuagcuuaguguugaacuaaauuuuuuuuaaacaaggcaaggucuaaugcug

SEQ ID NO: 509958 - RNA, 64 nt, Homo Sapiens
acguacucccacagacgucugggccuggaaauuuuuuuuuuauuuuauuuuauuguuuuuuuuu

SEQ ID NO: 509959 - RNA, 64 nt, Homo Sapiens
uggaaauuuuuuuuuuauuuuauuuuauuguuuuuuuuuuuagaaaaacaccacuuuuauuaug

SEQ ID NO: 509960 - RNA, 64 nt, Homo Sapiens
ugaugcagaaagacguucuuuugcauaaaagacuuuuuuuuaacacuuuggacuucucugaaau

SEQ ID NO: 509961 - RNA, 64 nt, Homo Sapiens
ugaaagaccuaugagcaaauggugcugaauacuuuuuuuuuaaagccacauuucauugucuuag

SEQ ID NO: 509962 - RNA, 64 nt, Homo Sapiens
aaagcaggauuauuaagugauuauuuaaaauucguuuuuuuaaauuagcaacuucaaguauaac

SEQ ID NO: 509963 - RNA, 64 nt, Homo Sapiens
ggcuacaauaccggaaaaugcuaguuuuuauuuauuuuuuuaaguagugcuuccuaaaugguuu

SEQ ID NO: 509964 - RNA, 64 nt, Homo Sapiens
acuucuugucaacaaaaaauauaaauggaaauuuuuuuuuuagcucuugcuuuaaguguuuguu

SEQ ID NO: 509965 - RNA, 64 nt, Homo Sapiens
augaaaacgguauuaauucuuggaugauuaaaaguuuuuuuauuagaauguucuuuauccuaau

SEQ ID NO: 509966 - RNA, 64 nt, Homo Sapiens
cuucgccuuaauacuuuuuuuauguaaugcaaaauuuuuuuaauagcauugcuuucguguaaau

SEQ ID NO: 509967 - RNA, 64 nt, Homo Sapiens
agucauuccaaauaugagauauugcacauuguuguuuuuuuaaucaauguggccgaggacuuug

SEQ ID NO: 509968 - RNA, 64 nt, Homo Sapiens
uuaaaaaauucuuugaaacuauaagugcaaauuuuuuuuuuauuaagugaagauuuugugagga

SEQ ID NO: 509969 - RNA, 64 nt, Homo Sapiens
caaagaaacuuaaugcuguaacuguguacaaagauuuuuuuacauugccuuaucuuuuuuuauu

SEQ ID NO: 509970 - RNA, 64 nt, Homo Sapiens
acuguguacaaagauuuuuucaucuugccuuaucuuuuuuuauucagaagguuucuguuuaaug

SEQ ID NO: 509971 - RNA, 64 nt, Homo Sapiens
gaugaaaagcuugugaacucgguaguugaaaguuuuuuuuuagagggguggaauggaacaguca

SEQ ID NO: 509972 - RNA, 64 nt, Homo Sapiens
uuuauuuuugggaaaguaaccaugaguuccuuuuuuuuuuuaacuauuagagaucugcauuuau

SEQ ID NO: 509973 - RNA, 64 nt, Homo Sapiens
ucugagauuuccccaagcugcuuuuuuuuuuuuuuuuuuuuaauuuaaggacauuuuuuuuccu

SEQ ID NO: 509974 - RNA, 64 nt, Homo Sapiens
ugaaagagaaauauaauuccggcguacuuagaauuuuuuuuauucuuuuguucaauuguguauu

SEQ ID NO: 509975 - RNA, 64 nt, Homo Sapiens
ugcacuucuuguaaagaguguuaauuuuaaauuuuuuuuuuaauaggggaagcgauuacuuuuu

SEQ ID NO: 509976 - RNA, 64 nt, Homo Sapiens
uuuaaauuuuuuuuuuaauuggggaagcgauuacuuuuuuuaauucuuacauuauggcucccga

SEQ ID NO: 509977 - RNA, 64 nt, Homo Sapiens
uucuuccugcccuuuccuuccuuuuuuuuuuuuuuuuuuuuaggccaccuuuuuucuuugguug

SEQ ID NO: 509978 - RNA, 64 nt, Homo Sapiens
cuuggcaaacaucccagcuaugauuuugagccuuuuuuuuuaaguuuucaguuguugcuaugaa

SEQ ID NO: 509979 - RNA, 64 nt, Homo Sapiens
gcuuuucuuuuaaauuuuucaauuuuuaaacagauuuuuuuaaaacucucaucauccacaguag

SEQ ID NO: 509980 - RNA, 64 nt, Homo Sapiens
cugcaugccugccccuuauucacaaucuuaguauuuuuuuuaaagaggcaaguaaccccgccuc

SEQ ID NO: 509981 - RNA, 64 nt, Homo Sapiens
aaaaugguuuugcauggaacccaaauuggauccauuuuuuuaaaagccaucuaagaauacagaa

SEQ ID NO: 509982 - RNA, 64 nt, Homo Sapiens
uuuuuggggggaaaaguauuuuagcuuuucuuuauuuuuuuaaccaagacauucugccuaccua

SEQ ID NO: 509983 - RNA, 64 nt, Homo Sapiens
ccaaaguuuagaaagagguuuguggugaacugauuuuuuuuaaaccucgauuuauauuucuguu

SEQ ID NO: 509984 - RNA, 64 nt, Homo Sapiens
gucuucaaagaggaagggccuuguuguuguuuuuuuuuuuuauuuucagugacaccugaauugu

SEQ ID NO: 509985 - RNA, 64 nt, Homo Sapiens
uugacuuuucuaguuauuaauaaauguuuaauuuuuuuuuuaaagaagaaaagcaggaagaauu

SEQ ID NO: 509986 - RNA, 64 nt, Homo Sapiens
uuaauuuuuccuuuuggggguuuuaaagguuuuuuuuuuuuaauaaaaauuaagucuucaaauu

SEQ ID NO: 509987 - RNA, 64 nt, Homo Sapiens
uauauaaagucagugacgagcgcaugugcauucuuuuuuuuauagucuaucugugaacguggcc

SEQ ID NO: 509988 - RNA, 64 nt, Homo Sapiens
aaaaaaagaugaaaaaugaauuugguuuuuuuuuuuuuuuuaagguccacagagguuuuuguuu

SEQ ID NO: 509989 - RNA, 64 nt, Homo Sapiens
uuuaaacgacugaagaaaacuuucuuuuuauuuuuuuuuuuaauacagacugggggaggggguu

SEQ ID NO: 509990 - RNA, 64 nt, Homo Sapiens
gaagauuugagcauuuuucuagaacaugaacuuuuuuuuuuaaaccuuggcucugcuugugauc

SEQ ID NO: 509991 - RNA, 64 nt, Homo Sapiens
cuuguccuuguaauuacauugacauuguuuuuuauuuuuuuaacaaggaaggaagaccuugauc

SEQ ID NO: 509992 - RNA, 64 nt, Homo Sapiens
gauaaaacuuuacaaccugcaaugauagauuuuuuuuuuuuaaaguucuuggaacagauaacug

SEQ ID NO: 509993 - RNA, 64 nt, Homo Sapiens
cugugcaauaccucauuuaauugccuuuuuugcuuuuuuuuaaucaauuugcuguauauuuuug

SEQ ID NO: 509994 - RNA, 64 nt, Homo Sapiens
uuuaaaaugcaacccugcccgguguuuuguuuuguuuuuuuaauaguauuugucuuguagauca

SEQ ID NO: 509995 - RNA, 64 nt, Homo Sapiens
caaaaaaugaaauauaacaauuuugcuugauuuuuuuuuuuaaaucuuacuggaaaugacaagu

SEQ ID NO: 509996 - RNA, 64 nt, Homo Sapiens
uagguuauuuauaauguauuugguucacaguuucuuuuuuuaacauagaauagacugaccaaga

SEQ ID NO: 509997 - RNA, 64 nt, Homo Sapiens
ccuguggcuuuuucacuuacuuccccaugaguccuuuuuuuaauguggguguguguguguauuu

SEQ ID NO: 509998 - RNA, 64 nt, Homo Sapiens
gaaaagcauuaagacauaaaauguugacuuuuuuuuuuuuuaaagcagagcauguccuaguuca

SEQ ID NO: 509999 - RNA, 64 nt, Homo Sapiens
uuuuuugggcagcaauuuaaauuuuacauuaaauuuuuuuuacaguuuuuugaaauuaugugac

SEQ ID NO: 510000 - RNA, 64 nt, Homo Sapiens
uuaagguuuaaaauuccuuugugaaaauguuuucuuuuuuuaauaaagcagauaauucuucugu

SEQ ID NO: 510001 - RNA, 64 nt, Homo Sapiens
ccuucuaauuucuuuauuucggguuugaaaaauuuuuuuuuacaucuauuuuuaucauuauuug

SEQ ID NO: 510002 - RNA, 64 nt, Homo Sapiens
uuuuuauacuuugguguuucgauuccuuuuuuuuuuuuuuuaaucaacaaacgacaguaucucg

SEQ ID NO: 510003 - RNA, 64 nt, Homo Sapiens
ccuuucuuagugguuucuuucaguuauacuuuuuuuuuuuuaaacguuuucuuuccuagcauau

SEQ ID NO: 510004 - RNA, 64 nt, Homo Sapiens
gacaguauauaaaugggucauauauuuaaagugguuuuuuuauauuucuaucuauaugugucuu

SEQ ID NO: 510005 - RNA, 64 nt, Homo Sapiens
cugguuuauauguguauguguguuuuauuguguguuuuuuuaauuuguaaguauucuaagaguu

SEQ ID NO: 510006 - RNA, 64 nt, Homo Sapiens
auaaggauccucagauuuaaauaaguacuuuuuuuuuuuuuaaucagaagaacauuguuguuug

SEQ ID NO: 510007 - RNA, 64 nt, Homo Sapiens
uuauguugaaggcagaguuuucauaggguuagauuuuuuuuauccuuuucuaguucaguuaauu

SEQ ID NO: 510008 - RNA, 64 nt, Homo Sapiens
cuccauuuuggaaagcaggaaaacaggauuuuuuuuuuuuuaucuuguucccuggaggauccag

SEQ ID NO: 510009 - RNA, 64 nt, Homo Sapiens
aaagaacgugagcaggaaaaacugcuggugauacuuuuuuuaaguuuuguuuuuaucuugccug

SEQ ID NO: 510010 - RNA, 64 nt, Homo Sapiens
uuucccuuuacaguucugcaguuccaucacaguauuuuuuuaaauaacucagguguaugagaag

SEQ ID NO: 510011 - RNA, 64 nt, Homo Sapiens
cuucuuucuuccuuccuuuuuuuuuuuuuguuuuuuuuuuuaagagccugugauaguuacugug

SEQ ID NO: 510012 - RNA, 64 nt, Homo Sapiens
aggggccggggucagggagagucuuuuuuuuuuuuuuuuuuaaauacuaaauuggaacauuuaa

SEQ ID NO: 510013 - RNA, 64 nt, Homo Sapiens
acccaggacugaacaugcagaacuguuuuuuuuuuuuuuuuaucuuaaacacauacacaccucc

SEQ ID NO: 510014 - RNA, 64 nt, Homo Sapiens
gaaacaugaaaccaaacaggcuuugauauuuuuuuuuuuuuaauuacuuuccccuuuugcuuga

SEQ ID NO: 510015 - RNA, 64 nt, Homo Sapiens
uccugggagcuuauagcccauuauuuuuacuuuuuuuuuuuaauucagaagacuagaacagaac

SEQ ID NO: 510016 - RNA, 64 nt, Homo Sapiens
aaccacuaacauauggcuauugcucuaugauuuuuuuuuuuacauuaggaggcagugauauugu

SEQ ID NO: 510017 - RNA, 64 nt, Homo Sapiens
guuggggaguacuuggcaguugggauaugauccauuuuuuuaaacaaguuuuuuguagaucccu

SEQ ID NO: 510018 - RNA, 64 nt, Homo Sapiens
uguuucaucuacucugugaaucuacauaggucuuuuuuuuuagauguuugauacauuuuaagua

SEQ ID NO: 510019 - RNA, 64 nt, Homo Sapiens
acccuguaacguaacccauuaaaaugaauuucuuuuuuuuuaagacagaguuucucucuguugc

SEQ ID NO: 510020 - RNA, 64 nt, Homo Sapiens
guguuuccugaaucuaaaauaaaaaucgaaauaauuuuuuuaaaaaagaaaaagacaauaguau

SEQ ID NO: 510021 - RNA, 64 nt, Homo Sapiens
uauuccacaucaucgauccucucugugguguuaauuuuuuuauaugaccaguagaaaaauuuua

SEQ ID NO: 510022 - RNA, 64 nt, Homo Sapiens
ugcuauaaguuuugaaguuucuuagcaauuaaaguuuuuuuauucagugugaacugucaguauc

SEQ ID NO: 510023 - RNA, 64 nt, Homo Sapiens
acuguagggucaaagccuuauagcaaaaaaaauuuuuuuuuauauuugcacaggacuauacagc

SEQ ID NO: 510024 - RNA, 64 nt, Homo Sapiens
guuuuguuucuauuuuuauuuuuauuaauuuuauuuuuuuuaauacagauuuucagugaggggc

SEQ ID NO: 510025 - RNA, 64 nt, Homo Sapiens
agugucacaaagaaaaccagaucucucucucuuuuuuuuuuauuuuuuuuagugauagagucuc

SEQ ID NO: 510026 - RNA, 64 nt, Homo Sapiens
aagaaaaccagaucucucucucuuuuuuuuuuauuuuuuuuagugauagagucucacucuguca

SEQ ID NO: 510027 - RNA, 64 nt, Homo Sapiens
ugcacaagcaugccuggcuaauuuuuaaauuuuuuuuuuuuaagaaauagggucuugcuauguu

SEQ ID NO: 510028 - RNA, 64 nt, Homo Sapiens
uugauuuguacagauccacuuagucauuuucuccuuuuuuuaagaaccauuuucaucugauuuu

SEQ ID NO: 510029 - RNA, 64 nt, Homo Sapiens
cugcauuaagauaggguggauuuuaugugcuuuuuuuuuuuaagaguugaauuucuuuuccuga

SEQ ID NO: 510030 - RNA, 64 nt, Homo Sapiens
cauaaaaggauauuuauaucucuguugcuuugacuuuuuuuauauaaaauccgugaguauuaaa

SEQ ID NO: 510031 - RNA, 64 nt, Homo Sapiens
uaaauauuagucucccuccaugacacugcaguauuuuuuuuaauuaauacaaguaaaaaguuug

SEQ ID NO: 510032 - RNA, 64 nt, Homo Sapiens
acucuucuauugaaguuaaagaaagaaaaaaagauuuuuuuauuuguauuaaugaaaagcuuua

SEQ ID NO: 510033 - RNA, 64 nt, Homo Sapiens
uugagguguuuuuguuuuuauuuguguguuuuuuuuuuuuuaagucagcuuggaacuuuuuucc

SEQ ID NO: 510034 - RNA, 64 nt, Homo Sapiens
auguaaacuuucaugguauuuagccuuucuuaaauuuuuuuaaaauuuaaacuuucuaaccuau

SEQ ID NO: 510035 - RNA, 64 nt, Homo Sapiens
caaaauaaaugcuuuaauuuucauuugcuaccucuuuuuuuauuaugccuuggaaugguucacu

SEQ ID NO: 510036 - RNA, 64 nt, Homo Sapiens
uucauuuugcuucaaucaaaagugguuucaauauuuuuuuuaguugguuagaauacuuucuuca

SEQ ID NO: 510037 - RNA, 64 nt, Homo Sapiens
accaaucuuuguacaauuuguaaauguuaagaauuuuuuuuauaucuguuaaauaaaaauuauu

SEQ ID NO: 510038 - RNA, 64 nt, Homo Sapiens
uuuuacauugugauuuuuacauuaaaauauuaacuuuuuuuaaugcuauuuuaugaaagauuau

SEQ ID NO: 510039 - RNA, 64 nt, Homo Sapiens
guauuuugguuaaucuucaugaauugaauaauuguuuuuuuaaagcaaaauaaaguuuuuuaaa

SEQ ID NO: 510040 - RNA, 64 nt, Homo Sapiens
gugacagaauaucaaaauaauuuguggcuguggauuuuuuuaacugcuaguaguggaauacugg

SEQ ID NO: 510041 - RNA, 64 nt, Homo Sapiens
uuaaaaauuaaaaauguauguauagguuuugaaauuuuuuuaaaaggggagaaagacuguuaag

SEQ ID NO: 510042 - RNA, 64 nt, Homo Sapiens
acuguugucuauaauggggaauuguaaaguuuauuuuuuuuaaucagaugagcgaaaauguauu

SEQ ID NO: 510043 - RNA, 64 nt, Homo Sapiens
caacaaaacuauggaaauaauccccuuucuuuccuuuuuuuaaguauacauauauugugugguu

SEQ ID NO: 510044 - RNA, 64 nt, Homo Sapiens
uagggcacuugcuuccuucuuuauagacuuuuuuuuuuuuuaacuuguauuuuuaaaacuagau

SEQ ID NO: 510045 - RNA, 64 nt, Homo Sapiens
acucugucuuaaaaaaaacuaagagccugggcaauuuuuuuaaguuuuuuaagacucuuaaaaa

SEQ ID NO: 510046 - RNA, 64 nt, Homo Sapiens
acucuuaaaaaaagagccugagccugggcaagaguuuuuuuaagagaucgugccacugcacucc

SEQ ID NO: 510047 - RNA, 64 nt, Homo Sapiens
uguuaugaaaauggaucuuuugaaauuaccuugauuuuuuuaauuagacgcuuuuuagaaguuu

SEQ ID NO: 510048 - RNA, 64 nt, Homo Sapiens
uuguuuugacuucguacaggugguuuugggguuuuuuuuuuaaauuguggcuggggauggguuu

SEQ ID NO: 510049 - RNA, 64 nt, Homo Sapiens
ugggcuccuauuuuuuccccaagaguggauuuuuuuuuuuuacagaucaauaacuucagauucu

SEQ ID NO: 510050 - RNA, 64 nt, Homo Sapiens
auuuauagaaauaauguaaagggauuuugggguuuuuuuuuaguguaaguugguuucaagauug

SEQ ID NO: 510051 - RNA, 64 nt, Homo Sapiens
aaaaauucuauauauacuguaacaguucagaauauuuuuuuaaacauuugauuacuuauauaaa

SEQ ID NO: 510052 - RNA, 64 nt, Homo Sapiens
uugagguaguuuguuuguauaaugauguaugcauuuuuuuuaauucuuuuguaaacaaaaaggc

SEQ ID NO: 510053 - RNA, 64 nt, Homo Sapiens
gaaaagguauagacaaccaguuuuuuauauuuauuuuuuuuaaguuaagcauuguuucaaaagu

SEQ ID NO: 510054 - RNA, 64 nt, Homo Sapiens
uuuauuuuuuuuaaggaaaacauuguuucaaaaguuuuuuuauagggauuguaaaguaguuaag

SEQ ID NO: 510055 - RNA, 64 nt, Homo Sapiens
uauguauaucuaauaguacaaaauaaguuaaauauuuuuuuaaaaauauuuaauuucuucauaa

SEQ ID NO: 510056 - RNA, 64 nt, Homo Sapiens
ugcccuuugauguuucaaaagcaaauuguuucaguuuuuuuaaauugccucaguagauacuaaa

SEQ ID NO: 510057 - RNA, 64 nt, Homo Sapiens
cagacaacucuagaaaugcguguuuuuugguuuuuuuuuuuaccggcugaauuaaaaugguuuu

SEQ ID NO: 510058 - RNA, 64 nt, Homo Sapiens
agguuuacgugucucaaagcuuuacaaugguuuauuuuuuuacaugugugucuuuucauaaggu

SEQ ID NO: 510059 - RNA, 64 nt, Homo Sapiens
aaauagagcuuggucaaccuauuauaggccaauauuuuuuuaaaaucuagugagcaauacacau

SEQ ID NO: 510060 - RNA, 64 nt, Homo Sapiens
ccuuggagcaguaguuuuuaaucaugcuccuauauuuuuuuaaugcuuuggcuccugauauuuu

SEQ ID NO: 510061 - RNA, 64 nt, Homo Sapiens
gaaccuguugcgccuauuuagucuguauuuaaucuuuuuuuauguuauuguuucuucauacugu

SEQ ID NO: 510062 - RNA, 64 nt, Homo Sapiens
ccuuuauggacauuguuuuuaugcuucuuuauuauuuuuuuaauccacucuggaagaaauaguc

SEQ ID NO: 510063 - RNA, 64 nt, Homo Sapiens
gaaacuaaggagugacauaguuuauaaagccauauuuuuuuagggugaauuauagaagcuacuu

SEQ ID NO: 510064 - RNA, 64 nt, Homo Sapiens
ugagaggggaaagcugaaauuuaucauuuauuuauuuuuuuaaaauuucagugaaaguuuuaaa

SEQ ID NO: 510065 - RNA, 64 nt, Homo Sapiens
ccuagagguaacauuauaacuuuguuuuuuuuuuuuuuuuuagcagcuagacaucucagguaaa

SEQ ID NO: 510066 - RNA, 64 nt, Homo Sapiens
cuugcagaaaaguugauugccaaccugauuuuuuuuuuuuuaauauuccuggcuuggucaagaa

SEQ ID NO: 510067 - RNA, 64 nt, Homo Sapiens
uaauguugucaagaccaaaagauaauggauuuuuuuuuuuuagaguuuucgguauaaauaugua

SEQ ID NO: 510068 - RNA, 64 nt, Homo Sapiens
aagauaaaaaaacagcuuuaauuuaugaacagacuuuuuuuaaauaaucuguacaucucuacuu

SEQ ID NO: 510069 - RNA, 64 nt, Homo Sapiens
uaaagaauucagugucacuaguguguuacaaaaauuuuuuuaaaagaagagaagaggagguacu

SEQ ID NO: 510070 - RNA, 64 nt, Homo Sapiens
cuuuuggaaaagcuccagguauuuuuuauuuuuauuuuuuuaaggaaaugucaaauauaauucc

SEQ ID NO: 510071 - RNA, 64 nt, Homo Sapiens
uuuauaaugcauuuuacuccauuuauaauuuacuuuuuuuuacugguaaaccacuauuauuuau

SEQ ID NO: 510072 - RNA, 64 nt, Homo Sapiens
aaguagaguuaggagaaagaguuuaauugguggauuuuuuuaguauuaaacucuuuugugccaa

SEQ ID NO: 510073 - RNA, 64 nt, Homo Sapiens
uuauugagauaggaaauauauuuacauaaagaaguuuuuuuaagaagaaugcacauguauaaag

SEQ ID NO: 510074 - RNA, 64 nt, Homo Sapiens
aaaguccaaaagcagcuauggcugcggauguaauuuuuuuuaaauaagcauucaauaagaacua

SEQ ID NO: 510075 - RNA, 64 nt, Homo Sapiens
aaaaaaacacuuuucuaaggccccccuuuuuuuuuuuuuuuaacaauaccuuagaauaguuauc

SEQ ID NO: 510076 - RNA, 64 nt, Homo Sapiens
uuuuggaaaaggcauuguuuuuaaaaauaggucuuuuuuuuauaagccaucuuuaaauaguucu

SEQ ID NO: 510077 - RNA, 64 nt, Homo Sapiens
uuuugaguagaaaugggguuacgccuggcuaacuuuuuuuuauagacuacaggcaccugccacc

SEQ ID NO: 510078 - RNA, 64 nt, Homo Sapiens
uauuuauuuuuugagauggaaccauuuuauuuuauuuuuuuauuaagguguugaccaaauccag

SEQ ID NO: 510079 - RNA, 64 nt, Homo Sapiens
gccuugagguacuuuuuaaaaaaauuaaaaugauuuuuuuuauuagauguuuuaauauguauca

SEQ ID NO: 510080 - RNA, 64 nt, Homo Sapiens
gucaguugcgguuuauuuauaaaacccaacauauuuuuuuuacuuuuuaaguagugugaauugc

SEQ ID NO: 510081 - RNA, 64 nt, Homo Sapiens
caacuuuuaagauagugaugugacauauugagauuuuuuuuaauuaugcccaauucucucuaca

SEQ ID NO: 510082 - RNA, 64 nt, Homo Sapiens
gaggaauuucaugaugauuuuuaugguacggaacuuuuuuuaauuugugauuuuaaacgagcua

SEQ ID NO: 510083 - RNA, 64 nt, Homo Sapiens
uuaagauuucugaauuauuuuauuauaaaauuuauuuuuuuaauuuauuccaucucucaagaua

SEQ ID NO: 510084 - RNA, 64 nt, Homo Sapiens
uuuuaagcucuuaacucacauccaaguacuuuuuuuuuuuuaauaaaggguagcacuuauucau

SEQ ID NO: 510085 - RNA, 64 nt, Homo Sapiens
aaaagguggaaaauaggaacuaagagacuaaagcuuuuuuuaaauuaacaugaugcuuggaaau

SEQ ID NO: 510086 - RNA, 64 nt, Homo Sapiens
cuuuuaguuucccaguuuugaauuuuuaguugauuuuuuuuaacguguauacuaacaagcguac

SEQ ID NO: 510087 - RNA, 64 nt, Homo Sapiens
cucuuuuugggaacaucaauaugucaguuaaagauuuuuuuacccaaauuacuuaagauguuua

SEQ ID NO: 510088 - RNA, 64 nt, Homo Sapiens
auuuaaaauugcuuuuaaauguguuaauuucuacuuuuuuuaauacaguuuuucaguacuguau

SEQ ID NO: 510089 - RNA, 64 nt, Homo Sapiens
gccuagaacuucaacauguugcaauugcuauuuauuuuuuuauuucuuauuuuacuguugaaca

SEQ ID NO: 510090 - RNA, 64 nt, Homo Sapiens
ugcuuuacucacggaguuuaaauaauaguguucauuuuuuuaaugacacugguuucauguaguu

SEQ ID NO: 510091 - RNA, 64 nt, Homo Sapiens
aaaaugaaaucuuaggugccuuagggguuuuuuuuuuuuuuaaguauuuuuuaaaaaccugcaa

SEQ ID NO: 510092 - RNA, 64 nt, Homo Sapiens
cgggugagaagaaaagagcaggcaaaauuagugauuuuuuuagaagucugcuaaauggauauau

SEQ ID NO: 510093 - RNA, 64 nt, Homo Sapiens
gccccaaauccagcaugaccaaaaguaaaugauguuuuuuuaaagugucuuucuucaaguuucu

SEQ ID NO: 510094 - RNA, 64 nt, Homo Sapiens
gcaaucuacauugggcaucuggucauucaaucuguuuuuuuaaauguuauuuuugccuuucaau

SEQ ID NO: 510095 - RNA, 64 nt, Homo Sapiens
uuuuuaauaaaguggaagcuugcuuuuuuaacucuuuuuuuauuguuauuuuauagaaaugcuu

SEQ ID NO: 510096 - RNA, 64 nt, Homo Sapiens
aacacuucucacuugugaugcuguacuaauuuuuuuuuuuuaauuuaagcuaguauacuaagug

SEQ ID NO: 510097 - RNA, 64 nt, Homo Sapiens
aucuaugauuaaauaaagugaguuuuugguuuuguuuuuuuaauuucagccauuccuagaguua

SEQ ID NO: 510098 - RNA, 64 nt, Homo Sapiens
aaagucaucaauauuuuucaacuuuuuuuuuuuuuuuuuuuacuuuggaaaggacaauaacuau

SEQ ID NO: 510099 - RNA, 64 nt, Homo Sapiens
cauuuaacauucauacaauuauauauaauauccuuuuuuuuaaagaaugguauuucacaaaaau

SEQ ID NO: 510100 - RNA, 64 nt, Homo Sapiens; identical to SEQ ID NO: 509434

SEQ ID NO: 510101 - RNA, 64 nt, Homo Sapiens
gcuaauaugucuaaauacauauguuaucccuugauuuuuuuaaauaacugagagcucuauuuau

SEQ ID NO: 510102 - RNA, 64 nt, Homo Sapiens
aacuacuauagagaaaauaaaauuuuuuccuuuuuuuuuuuaaccggaaagugcauuugcuugg

SEQ ID NO: 510103 - RNA, 64 nt, Homo Sapiens
auuaagacaaaauguuuaauaagaauagcaaaaauuuuuuuauauuaugcauccuuauaccuca

SEQ ID NO: 510104 - RNA, 64 nt, Homo Sapiens
aauuuugcuggaauuccuaacuuuucaaugacauuuuuuuuaacuacuauauugauuguccuuu

SEQ ID NO: 510105 - RNA, 64 nt, Homo Sapiens
auaaaaugucguuaaaaaguuguuuguuuuuuucuuuuuuuauaaauaaacuguugcucguugc

SEQ ID NO: 510106 - RNA, 64 nt, Homo Sapiens
gaucuguuuaugcgauaacuccuuuuuguuacaauuuuuuuaaaaaaagcuauuuuuguuaaug

SEQ ID NO: 510107 - RNA, 64 nt, Homo Sapiens
gaccuuuaaauugcugcaaaagguaaauuguauuuuuuuuuaaguauugguguucuuuacucua

SEQ ID NO: 510108 - RNA, 64 nt, Homo Sapiens
accucacugacuucauaauuggaaugucacaugguuuuuuuaaucaagaugcagugaacugaga

SEQ ID NO: 510109 - RNA, 64 nt, Homo Sapiens
ugggaauuuaaaccaacauguggcugagccuuuuuuuuuuuaaucuucguaacauguuuaaaaa

SEQ ID NO: 510110 - RNA, 64 nt, Homo Sapiens
caguauuuguggcaguuuuaguuuuuuguuuuuuuuuuuuuaaucaaaaaacaauuuuuuuaaa

SEQ ID NO: 510111 - RNA, 64 nt, Homo Sapiens
guuuuuuguuuuuuuuuuuuuaaucaaaaaacaauuuuuuuaaaaaaaaagcuuugaaaaugga

SEQ ID NO: 510112 - RNA, 64 nt, Homo Sapiens
acaguauugugcuuuuuguggggaaagugagguuuuuuuuuauauacauauauaauugauaucu

SEQ ID NO: 510113 - RNA, 64 nt, Homo Sapiens
ugugaugggaagccuugccccccucuuuuuuuuuuuuuuuuaauaucugcggaauaaacccaau

SEQ ID NO: 510114 - RNA, 64 nt, Homo Sapiens
acaaguaagugucaccauuuacauuguuauuaaauuuuuuuaacauugcagagauauaaugauu

SEQ ID NO: 510115 - RNA, 64 nt, Homo Sapiens
gaaugguauuucacaaaaauauauauaauauccuuuuuuuuaaacauuuaacauucauacaguu

SEQ ID NO: 510116 - RNA, 64 nt, Homo Sapiens
uaaagcaaaccucaaacauuuuuguuuuguuaguuuuuuuuauuauauuacacuguuuuuuuug

SEQ ID NO: 510117 - RNA, 64 nt, Homo Sapiens
aaaaagcagaaauacacaaucacaugaagauaacuuuuuuuaaacuccaaaaucaugaaugaua

SEQ ID NO: 510118 - RNA, 64 nt, Homo Sapiens
agaaggggucucucccuauuuuuucuuccuuuuuuuuuuuuaaguaauguuuugccuuguuuuc

SEQ ID NO: 510119 - RNA, 64 nt, Homo Sapiens
cacagaauauuccuguucccaacuacccuuuuuuuuuuuuuaauuucuaggguaaauucuggca

SEQ ID NO: 510120 - RNA, 64 nt, Homo Sapiens
ccccagccccucaaaaaaauugucaucuuugguguuuuuuuaacguuuguuuuuuggcaugaau

SEQ ID NO: 510121 - RNA, 64 nt, Homo Sapiens
aaguucuuugagcauaauucuagcuguaugggguuuuuuuuagucauuuaguugauguaauaca

SEQ ID NO: 510122 - RNA, 64 nt, Homo Sapiens
guuuagauuuguagucuaguaaaguaccugugauuuuuuuuaauuuccaguaaguuucuuacag

SEQ ID NO: 510123 - RNA, 64 nt, Homo Sapiens
cuguuguggaaauuuuuaaaccaugaaccugguuuuuuuuuauuaaguguaacaaauucucgcu

SEQ ID NO: 510124 - RNA, 64 nt, Homo Sapiens
acagucauuuuaaaaugguguuugguggucauuuuuuuuuuaagauaaauuuagugaaccuauu

SEQ ID NO: 510125 - RNA, 64 nt, Homo Sapiens
ugcuucuguuuaaaaagccaguccugcaucuuuuuuuuuuuaucacuagugaagaacugaagga

SEQ ID NO: 510126 - RNA, 64 nt, Homo Sapiens
uuuuacucucucgaagaagaguuuuacuuuucuuuuuuuuuaacagauuuucuuucuguacuuc

SEQ ID NO: 510127 - RNA, 64 nt, Homo Sapiens
uuuauuccuugagggaagcaucuuuuucuuuuuuuuuuuuuaaccggagcccacucaccuuuuu

SEQ ID NO: 510128 - RNA, 64 nt, Homo Sapiens
uacagaagcaguuguguuaaugucaugggucauuuuuuuuuaguuuuugcuuugauuguguuua

SEQ ID NO: 510129 - RNA, 64 nt, Homo Sapiens
auuuugcuuugauuguguuucuuccacuuaauuauuuuuuuaggcagauuggcacgaaccuuuu

SEQ ID NO: 510130 - RNA, 64 nt, Homo Sapiens
aggaaaacuaaugacaguguagcccaggaacugauuuuuuuaagaaaaagaaaacacaucuaaa

SEQ ID NO: 510131 - RNA, 64 nt, Homo Sapiens
aagaaaacacaucuaaaagcagaaggaugcuuauuuuuuuuaaaggaccaauugugugaccaug

SEQ ID NO: 510132 - RNA, 64 nt, Homo Sapiens
aaaaugugaaaugucaucuucccaugaaggauucuuuuuuuaaaauugauuauuaggauauauu

SEQ ID NO: 510133 - RNA, 64 nt, Homo Sapiens
uaauuggagucauacuguaauguguauuguauacuuuuuuuacaaacccccauguaugccuaua

SEQ ID NO: 510134 - RNA, 64 nt, Homo Sapiens
uaaaagcacaaguacuuuugaccugauuguauuuuuuuuuuaaaccaaaacauuucuggacagu

SEQ ID NO: 510135 - RNA, 64 nt, Homo Sapiens
uuucauacaacagaaaccaguuggaagccaucccuuuuuuuacaagcaaagauuaaauguguca

SEQ ID NO: 510136 - RNA, 64 nt, Homo Sapiens
gcauuuaugauucaguggcuucauuucuguugauuuuuuuuauuaacauguuuuauuaaguucu

SEQ ID NO: 510137 - RNA, 64 nt, Homo Sapiens
ccauuuuauccuuuucucuuuuaauagcuuuaucuuuuuuuauaaucuucucucucgugcuuaa

SEQ ID NO: 510138 - RNA, 64 nt, Homo Sapiens
uuuaaaaauguauauucuaguugcguuuuuuuccuuuuuuuaacguauuuauaauaauuaucau

SEQ ID NO: 510139 - RNA, 64 nt, Homo Sapiens
uuacaaaagugauagauguuaagauagcaaauacuuuuuuuaaaaugguugucucuuaaaaaga

SEQ ID NO: 510140 - RNA, 64 nt, Homo Sapiens
uuauuaaauauucuacaacuuaauauaucagaccuuuuuuuauaucuauaguauggucagcuaa

SEQ ID NO: 510141 - RNA, 64 nt, Homo Sapiens
acuuuuuuuuuuuuucauauuguuuaaccuagauuuuuuuuaaauguuuaacaagguaacuuuu

SEQ ID NO: 510142 - RNA, 64 nt, Homo Sapiens
guucagguaugacaaaguauaggaaaauggaaucuuuuuuuaaaugauaugucuaaaaauuuuc

SEQ ID NO: 510143 - RNA, 64 nt, Homo Sapiens
caggguuaauaauccuuaaaugggaauagcagaauuuuuuuauaaguaacaauucagauucacu

SEQ ID NO: 510144 - RNA, 64 nt, Homo Sapiens
uuuuuaccagcuguucuugggcacuaaaaaaauuuuuuuuuaacuagucacuuuagaacagaug

SEQ ID NO: 510145 - RNA, 64 nt, Homo Sapiens
agccaauugacagauuacaccaggauguguuuccuuuuuuuaaauuauuuacuggucugggaaa

SEQ ID NO: 510146 - RNA, 64 nt, Homo Sapiens
uuuuaaauuaucuaaauuuagccucuugccuuuuuuuuuuuaaacacuuugcugcugaaaugcu

SEQ ID NO: 510147 - RNA, 64 nt, Homo Sapiens
auuauuacuaaugaugcuuugccuuucugguggcuuuuuuuaaaccccuuaucuuucuaaaacu

SEQ ID NO: 510148 - RNA, 64 nt, Homo Sapiens
ccuccugggcccaagugaucgggauuuuuuuuuuuuuuuuuaacacuucuauuuaaugcuucca

SEQ ID NO: 510149 - RNA, 64 nt, Homo Sapiens
uaacauuuucauuguuuuugguuguucuuuuuucuuuuuuuaauggcagcuaaagauauacaga

SEQ ID NO: 510150 - RNA, 64 nt, Homo Sapiens
agauauacagauuacuguuaaauugcaguccuuuuuuuuuuaaagauauuuucuugaauuauuu

SEQ ID NO: 510151 - RNA, 64 nt, Homo Sapiens
cauuuuacauucauuuaaccugccgauuauuuaauuuuuuuauuguaaaguaguuuuuagcauu

SEQ ID NO: 510152 - RNA, 64 nt, Homo Sapiens
uuuauuguaaaguaguuuuuagcauuugcuuuuauuuuuuuacuuugaugccuuuucaaauugg

SEQ ID NO: 510153 - RNA, 64 nt, Homo Sapiens
aguuuuguguuggcuugugaagcauugaugucauuuuuuuuaauuguggacuauuuagaugugu

SEQ ID NO: 510154 - RNA, 64 nt, Homo Sapiens
uuagaagcccauagcccuuucccagccuuuuugguuuuuuuaauugaacacauuucaucuaagu

SEQ ID NO: 510155 - RNA, 64 nt, Homo Sapiens
cugugccagaagaaaacacacacagggaaaccgcuuuuuuuaaucaauuguagagaauagucau

SEQ ID NO: 510156 - RNA, 64 nt, Homo Sapiens
cugugauagaaauauguaaaaucucauauuauuuuuuuuuuaauuuuuuuauuuuuuaugacag

SEQ ID NO: 510157 - RNA, 64 nt, Homo Sapiens
aaauauguaaaaucucauauuauuuuuuuuuuaauuuuuuuauuuuuuaugacagggucucacu

SEQ ID NO: 510158 - RNA, 64 nt, Homo Sapiens
uuucauucuuuguuagcucacuuuauaauuuguauuuuuuuacuguauagacuaaauauauucu

SEQ ID NO: 510159 - RNA, 64 nt, Homo Sapiens
uuuaaugccaucacaauuugaaaaacuuuuuuuuuuuuuuuacuauagaaguuacaaaggaagu

SEQ ID NO: 510160 - RNA, 64 nt, Homo Sapiens
uuaccuuugacaaagguaaaucagacuaugaaguuuuuuuuauacaggaugaugacuauggaaa

SEQ ID NO: 510161 - RNA, 64 nt, Homo Sapiens
uuuaagacgaaacauuuguucuauagcuuuucccuuuuuuuaaguaaggaauuuuauuuuuuuc

SEQ ID NO: 510162 - RNA, 64 nt, Homo Sapiens
ugagcuaggaauuguguuuauaauuuuaaauguuuuuuuuuaaagacuuuuaugauacuugaaa

SEQ ID NO: 510163 - RNA, 64 nt, Homo Sapiens
ggaccagagagaaggagucaccugcagucuuuuguuuuuuuaaauacuuagaacuuagcacuug

SEQ ID NO: 510164 - RNA, 64 nt, Homo Sapiens
agaauacaaacaguauacucaugauugcuaaguguuuuuuuauuuuugcauauuuauugaacug

SEQ ID NO: 510165 - RNA, 53 nt, Homo Sapiens
cacaaauuacaaaagucugaauuuuuuuuuaucaagagggauaaaacaccaug

SEQ ID NO: 510166 - RNA, 64 nt, Homo Sapiens
aaauaaacuugaauaaacugaaaauggaccuuuuuuuuuuuaauggcaauaggacauuguguca

SEQ ID NO: 510167 - RNA, 64 nt, Homo Sapiens
auuggccgcugucacugcuuguuguuugcgcauuuuuuuuuaaagcauauuggugcuagaaaag

SEQ ID NO: 510168 - RNA, 64 nt, Homo Sapiens
uuuuucccuucauuuuggguucuccuguuuguuuuuuuuuuauuauuuuaaucccuuguuuauu

SEQ ID NO: 510169 - RNA, 64 nt, Homo Sapiens
auuuuagcauuucaaagugacuucuaugaagcuuuuuuuuuaaugugaaauuuucagaauguug

SEQ ID NO: 510170 - RNA, 64 nt, Homo Sapiens
acuggauucugaauauaauaaauucaaaguacccuuuuuuuagaguuucuaauaaaguaguaug

SEQ ID NO: 510171 - RNA, 64 nt, Homo Sapiens
aaagaaacugcauuuuaagucagacaguaaauguuuuuuuuaauuuacagcaaaugaagcaguu

SEQ ID NO: 510172 - RNA, 64 nt, Homo Sapiens
uuaauuuaaaaagcuagaaaauucauguaguuacuuuuuuuacauauauaaucuguuaaugaau

SEQ ID NO: 510173 - RNA, 64 nt, Homo Sapiens
aacaacucuaauccuuuuggggcaggagggaggguuuuuuuaggguugcggggagggaacugca

SEQ ID NO: 510174 - RNA, 64 nt, Homo Sapiens
uuaauuagucacugccuugcuaacuuugcuguaauuuuuuuaaacgucuuguuuuuaauauagc

SEQ ID NO: 510175 - RNA, 64 nt, Homo Sapiens
gaaggaaaguuacaguauuaauuuuugaaaagguuuuuuuuauucugcaauuuuuuauuuuugu

SEQ ID NO: 510176 - RNA, 64 nt, Homo Sapiens
auuguuaugcuauaccaaucugcaguaaaaaaaauuuuuuuagaugauucuauauaacuucguc

SEQ ID NO: 510177 - RNA, 64 nt, Homo Sapiens
cugguuuaaaaauuaguaaggugugucuuuuuguuuuuuuuaagauagcacuugaauagaaggg

SEQ ID NO: 510178 - RNA, 64 nt, Homo Sapiens
ggauuuuguuuugguuuuggcuuuguuuuugauuuuuuuuuauuaugaaucuccuggacgcaga

SEQ ID NO: 510179 - RNA, 64 nt, Homo Sapiens
gaaugaccuuuagauugugcgacuuuuguuuuuguuuuuuuaaauuuuuuuaaaccaagaauga

SEQ ID NO: 510180 - RNA, 64 nt, Homo Sapiens
uagauugugcgacuuuuguuuuuguuuuuuuaaauuuuuuuaaaccaagaaugauuucuccugc

SEQ ID NO: 510181 - RNA, 64 nt, Homo Sapiens
uguaagaguuguuagcacaaguuuuuuuuuuuuuuuuuuuuaagcacuuguuuuggguacaagg

SEQ ID NO: 510182 - RNA, 64 nt, Homo Sapiens
ugugaagcaguauugauucuuuauugggaguacauuuuuuuaggucucuuaaacuuuaauuuca

SEQ ID NO: 510183 - RNA, 64 nt, Homo Sapiens
ugagaagcaaugggucacucauuaaugaaucacauuuuuuuaugcucuugaaauauucagaaau

SEQ ID NO: 510184 - RNA, 64 nt, Homo Sapiens
ggugcugucuuuuguucucugaauuuucagagacuuuuuuuauaauguuauucauuuggugacu

SEQ ID NO: 510185 - RNA, 64 nt, Homo Sapiens
ccugaaaauaauggaaaagagguuuuugaauuuuuuuuuuuaaauaaacaccuucuuaagugca

SEQ ID NO: 510186 - RNA, 64 nt, Homo Sapiens
accuuuccugagauuuauuuuauccgugauguauuuuuuuuaauucuuuugauacagagaaggg

SEQ ID NO: 510187 - RNA, 64 nt, Homo Sapiens
uuuuuaauucuuuugauacagagaagggucuuuuuuuuuuuaaguauuucagugaaaacuuggu

SEQ ID NO: 510188 - RNA, 64 nt, Homo Sapiens
uauucuucuuuugcugcuuucugauagugaucaauuuuuuuauuuauaucucuuguauuagagu

SEQ ID NO: 510189 - RNA, 64 nt, Homo Sapiens
caaugagggcugauuuucauuuagcuaaauaacuuuuuuuuaaguauuucuuuguaucaugguu

SEQ ID NO: 510190 - RNA, 64 nt, Homo Sapiens
ucaucaguuuuggaaaauucuuagccauuuuuuuuuuuuuuacuauuuuuuccccuguucuccc

SEQ ID NO: 510191 - RNA, 64 nt, Homo Sapiens
gguaucaccuuacaugguauauccauuuggaaauuuuuuuuacuuccauguaacagaacaaaag

SEQ ID NO: 510192 - RNA, 64 nt, Homo Sapiens
guugaccuauuugugggaggguuaaacuucauccuuuuuuuacuuguacguuucuagcuagaau

SEQ ID NO: 510193 - RNA, 64 nt, Homo Sapiens
uauuuaguagaguauaaagauuuaaaagauuuuuuuuuuuuaugaugagauuauauuuucuguu

SEQ ID NO: 510194 - RNA, 64 nt, Homo Sapiens
caaaguguugucaggccaacgucugugguuuuuuuuuuuuuaacgaaaauuccaaacauuugcu

SEQ ID NO: 510195 - RNA, 64 nt, Homo Sapiens
uacaaauaagguuaaauuucagcuguuaaaaagauuuuuuuaaucucauuaacauauauucuca

SEQ ID NO: 510196 - RNA, 64 nt, Homo Sapiens
uuuaguagagacggaauuuucaugccuggcuaauuuuuuuuauuggauuacuggcgcccgccac

SEQ ID NO: 510197 - RNA, 64 nt, Homo Sapiens
uuaauuuuuugagacggagucuuuuucuuuuuuuuuuuuuuauuucucuuucucuuuuuuccuu

SEQ ID NO: 510198 - RNA, 64 nt, Homo Sapiens
acccaagaggucaggggauucuuuuaaauaauaauuuuuuuaaagcaauggaaaaacauuuauu

SEQ ID NO: 510199 - RNA, 64 nt, Homo Sapiens
uauccuauuuuuuauguagucugaaugaauuauuuuuuuuuauaaaauuucacaaugacugacu

SEQ ID NO: 510200 - RNA, 64 nt, Homo Sapiens
uuuuuucuccuuugacaccuuguuugggagcucuuuuuuuuacacagaauuuggucucucaggc

SEQ ID NO: 510201 - RNA, 64 nt, Homo Sapiens
cuaaugaaugacauuuagauuuucuauucuuuuuuuuuuuuaaacaauuuacuugguccagagu

SEQ ID NO: 510202 - RNA, 64 nt, Homo Sapiens
auucugaaauguguugugacagccaaaauguuuguuuuuuuaaguaaaagucuuuuucuuagaa

SEQ ID NO: 510203 - RNA, 64 nt, Homo Sapiens
agucuuuuucuuagaaagccaugagggaauugauuuuuuuuaaaauguacaaguccuuucagug

SEQ ID NO: 510204 - RNA, 64 nt, Homo Sapiens
ccuuuuuuaaaaugacagaucaccacuuagccuguuuuuuuaucgccuucuuaacuaaaaugcu

SEQ ID NO: 510205 - RNA, 64 nt, Homo Sapiens
ggaaaguccugcauaacaacuucgauuuuuuuuuuuuuuuuaauacguacuugaguuaaaauau

SEQ ID NO: 510206 - RNA, 64 nt, Homo Sapiens
uugaguuaugacaaauaaaaucgcaguuguuuucuuuuuuuaaaauacauagccuacuuuuuuu

SEQ ID NO: 510207 - RNA, 62 nt, Homo Sapiens
gaaaaaaaauuucuauucaugagggauuuuuuuuuuuuuaauuggcuauugugggccaguag

SEQ ID NO: 510208 - RNA, 64 nt, Homo Sapiens
aaaaaucauaauaguuaggaauuuuaaucuaaacuuuuuuuaaacgaugcauuuguggcuagaa

SEQ ID NO: 510209 - RNA, 64 nt, Homo Sapiens
gccugacaaacuucauaaauggagaccagaacuauuuuuuuaaaaagaugaauguugacuccca

SEQ ID NO: 510210 - RNA, 64 nt, Homo Sapiens
auuuucuacccuuggcaugauauauauuuuuuuuuuuuuuuagaaccauguuuauauauauaua

SEQ ID NO: 510211 - RNA, 64 nt, Homo Sapiens
caaacucuggucucacugccuauauaucucucuauuuuuuuaauugaauggucaauuuuucaca

SEQ ID NO: 510212 - RNA, 64 nt, Homo Sapiens
gaacuguauauuuauuuugaaguaccuucuuauauuuuuuuauaggacagugaccaagaauuau

SEQ ID NO: 510213 - RNA, 64 nt, Homo Sapiens
gcaacuaacuuauugcuuuaaccugagcuauauauuuuuuuaaaacacuugaaugaagagaaac

SEQ ID NO: 510214 - RNA, 64 nt, Homo Sapiens
gagaacuuuuuuaguuuauuuucuucuguuuguauuuuuuuaaaugaccaggauugugaaagag

SEQ ID NO: 510215 - RNA, 64 nt, Homo Sapiens
agcuggaagauuguacagcaaaauaacacugagauuuuuuuaaacaccccucuuucauguauua

SEQ ID NO: 510216 - RNA, 64 nt, Homo Sapiens
cuucuuccuauguuuuggaaagacuauguaaaucuuuuuuuaauaaacacacacaaugauugca

SEQ ID NO: 510217 - RNA, 64 nt, Homo Sapiens
aucccuuuugaaaaugauaaccaucaaaagguucuuuuuuuauaguuucaggguucagucugau

SEQ ID NO: 510218 - RNA, 64 nt, Homo Sapiens
cucagagcuagcugcucucuaagaaagugagggguuuuuuuaacuguaaggacuugcaaaacaa

SEQ ID NO: 510219 - RNA, 64 nt, Homo Sapiens
ggcagaccgaaguggagaucagaaagauuuuuuuuuuuuuuaaucucuuuaaagagaaaagaag

SEQ ID NO: 510220 - RNA, 64 nt, Homo Sapiens
acaucaaaaggauggugguuuuguuuaaaucuuauuuuuuuacuaagaugcuuuuugggaaacg

SEQ ID NO: 510221 - RNA, 64 nt, Homo Sapiens
aauacauuuuuguggucagugcugguuuucaauuuuuuuuuaacucagggggacccaaaucacu

SEQ ID NO: 510222 - RNA, 64 nt, Homo Sapiens
uugaggaaaagucaaauucacuuuccauccuuuuuuuuuuuauuaaaauaugcuauuguuuaga

SEQ ID NO: 510223 - RNA, 64 nt, Homo Sapiens
uucuucuauuucugaagguuugucucuuggcaucuuuuuuuaguuucuuaccauaagaguuuga

SEQ ID NO: 510224 - RNA, 64 nt, Homo Sapiens
ugugaguagacaccugccaauauuguuugaaaccuuuuuuuaauaugacauccucucuugucau

SEQ ID NO: 510225 - RNA, 64 nt, Homo Sapiens
agaagauggggcuacauuucccccauaccuacuauuuuuuuauaucccgauuugcacuuugaga

SEQ ID NO: 510226 - RNA, 64 nt, Homo Sapiens
uucuuaaauuuaaacacgggacuucccgaacuaauuuuuuuaaggauacugaaaaaugagagag

SEQ ID NO: 510227 - RNA, 64 nt, Homo Sapiens
uagccaugugaccuggaacuuuuaaaaaaaaauuuuuuuuuaagagccagagucucacuuuguc

SEQ ID NO: 510228 - RNA, 64 nt, Homo Sapiens
gggaucacaggugcacaccaccacgccuggcuaauuuuuuuauuuuuauuuuuaguaaaggcgg

SEQ ID NO: 510229 - RNA, 64 nt, Homo Sapiens
acucagugucagcuugagccugcauuccaagcuuuuuuuuuaauuugguguuuucucccauccu

SEQ ID NO: 510230 - RNA, 64 nt, Homo Sapiens
ugaagagaucuuugugccacacaggauuuuuuuuuuuuuuuaagaaaaaccuauagaugaaaaa

SEQ ID NO: 510231 - RNA, 64 nt, Homo Sapiens
cugucccugcugcuuugauuccaggugauuuuauuuuuuuuauuuuuuuauuuuuuuugagacg

SEQ ID NO: 510232 - RNA, 64 nt, Homo Sapiens
gcugcuuugauuccaggugauuuuauuuuuuuuauuuuuuuauuuuuuuugagacggagucuug

SEQ ID NO: 510233 - RNA, 64 nt, Homo Sapiens
gugagguuuucacucauaaauuuaaaccaguguauuuuuuuagaacugguuuguguauauauau

SEQ ID NO: 510234 - RNA, 64 nt, Homo Sapiens
aaaccaaaaggauauucugaaaaauggccaacaauuuuuuuagaaguagcaucccaagcagcgu

SEQ ID NO: 510235 - RNA, 64 nt, Homo Sapiens
aaaaaagcugcuguuggaucuagaaggugaagaauuuuuuuauguauauauagacauaucuaua

SEQ ID NO: 510236 - RNA, 64 nt, Homo Sapiens
auuaacaaauauauuuaaguacuaaaggugauuuuuuuuuuaaagacuuuuucaaauugucaaa

SEQ ID NO: 510237 - RNA, 64 nt, Homo Sapiens
cuucugagauucaucuuggugguggguuuuuuuguuuuuuuaauucagugccugaucuuuaaug

SEQ ID NO: 510238 - RNA, 64 nt, Homo Sapiens
aaaaaaguucacugaacaccaagaccagaauggauuuuuuuaaaaaaauagauguuccuuuugu

SEQ ID NO: 510239 - RNA, 64 nt, Homo Sapiens
uguaguuguuuugguaaaaucuucauuuccugguuuuuuuuaccaccuuauuuaaaucucgauu

SEQ ID NO: 510240 - RNA, 64 nt, Homo Sapiens
uggguauaugaauuacauagcauguuguugggauuuuuuuuaaugugcagaagaucaaagcuac

SEQ ID NO: 510241 - RNA, 64 nt, Homo Sapiens
ugcuuguuuaguaucaaauuuuauuucacgaaaguuuuuuuaaagaacagaaacuuuuccaauu

SEQ ID NO: 510242 - RNA, 64 nt, Homo Sapiens
uucuuggcaaaugaauccauauugacauauuugauuuuuuuaaaaacauggaaacguacuguuu

SEQ ID NO: 510243 - RNA, 64 nt, Homo Sapiens
ucgauuaguaaaagaaaaaaauuugaauguuuuuuuuuuuuauuuuauuaagcaugcccaguua

SEQ ID NO: 510244 - RNA, 64 nt, Homo Sapiens
uuuucuuucuucuuuucuuuuucuuuuuuuuuuuuuuuuuuacuaaauuagagaacugcucuug

SEQ ID NO: 510245 - RNA, 64 nt, Homo Sapiens
guguagacuucugaauaagaugauagacgagaauuuuuuuuaaaaaaggaauuuaaaggaaucu

SEQ ID NO: 510246 - RNA, 64 nt, Homo Sapiens
cagauuguaagccuuuucuggcaagcuuuucuucuuuuuuuaaacucuuuuccugaaacuuuuu

SEQ ID NO: 510247 - RNA, 64 nt, Homo Sapiens
gcauugaaaggacagcuuggggauggaauuuuuuuuuuuuuaucuccauuuuccaguuagguag

SEQ ID NO: 510248 - RNA, 64 nt, Homo Sapiens
ggugugagccaccacaccuggcccauaguuguauuuuuuuuaggucacuuagaaaaauauguca

SEQ ID NO: 510249 - RNA, 64 nt, Homo Sapiens
ggauagaaccuuuguauuuguucuuuaaaaacauuuuuuuuaauguugguaacuuuugcuuccu

SEQ ID NO: 510250 - RNA, 64 nt, Homo Sapiens
ugaaagacggggaauuaaauuacuaauuuuuuuuuuuuuuuaaaugaugacaguggucccagaa

SEQ ID NO: 510251 - RNA, 64 nt, Homo Sapiens
aaagcaguuuuacuaucgaaucaaucgcuguuauuuuuuuuaauguaauuuguacaucuuuuuu

SEQ ID NO: 510252 - RNA, 64 nt, Homo Sapiens
guuuauaagugacaaaauuaggccaaaggugauuuuuuuuuaaaucaggaagcugguuacuggc

SEQ ID NO: 510253 - RNA, 64 nt, Homo Sapiens
ucuugauacccuaaucuugcuucuggaucuguucuuuuuuuaaaaaaacuuccuucaccgcgcc

SEQ ID NO: 510254 - RNA, 64 nt, Homo Sapiens
guaaauauauugucauacaauguuaaauaaccuauuuuuuuaaaaaaguucaacuuaagguaga

SEQ ID NO: 510255 - RNA, 64 nt, Homo Sapiens
uggcucacaaaauagggcccccaaugcuauuuuuuuuuuuuaaguuuguuuaauuauuuguuaa

SEQ ID NO: 510256 - RNA, 64 nt, Homo Sapiens
uccagugucuuggguuuuuuauacuuugacagcuuuuuuuuaauugcauacaugagacuguguu

SEQ ID NO: 510257 - RNA, 64 nt, Homo Sapiens
uuuuuuuuaauugcauacaugagacuguguugacuuuuuuuaguuaugugaaacacuuugccgc

SEQ ID NO: 510258 - RNA, 64 nt, Homo Sapiens
agacaaaucacauuuugcaaucacaagcgcuuuauuuuuuuaauccaucucuuaguuuucuuuu

SEQ ID NO: 510259 - RNA, 64 nt, Homo Sapiens
acuucccagacgaaaacucacucacacuguggguuuuuuuuagaauuuaaggcacacacaaucc

SEQ ID NO: 510260 - RNA, 64 nt, Homo Sapiens
gugaauuuuugccuaucuuuuagaaauauaggguuuuuuuuaaucugccuacuguuacucuaaa

SEQ ID NO: 510261 - RNA, 64 nt, Homo Sapiens
ugcuuacauuuuaauagagaacacagacaugcucuuuuuuuaaguuuaaaauauaugucuauau

SEQ ID NO: 510262 - RNA, 64 nt, Homo Sapiens
uuauuuugcucaaguacuuauccuccucuuaagauuuuuuuaaguuuaaaaaauaucauugucc

SEQ ID NO: 510263 - RNA, 64 nt, Homo Sapiens
aaaaucuaccaguaauuuaauuuuucuuuuuucuuuuuuuuaauuaauuacagucuuaucuuuu

SEQ ID NO: 510264 - RNA, 64 nt, Homo Sapiens
cugugaaauuucuuuacaguuuugcuuacucuauuuuuuuuaacaaguucuccaauucuuuuuu

SEQ ID NO: 510265 - RNA, 64 nt, Homo Sapiens
aaggaaaaguuuucuucauuuuacauucuuaaucuuuuuuuagauuuaauauuaaaauguacuu

SEQ ID NO: 510266 - RNA, 64 nt, Homo Sapiens
cccuuucugaacuuucacuuuuuuuuuuuuuuuuuuuuuuuaaauggcuaugucucuggacaag

SEQ ID NO: 510267 - RNA, 64 nt, Homo Sapiens
ggaaugguaggauaucuuggcuauuuccuugccuuuuuuuuauuacaucaaugguguguuaaag

SEQ ID NO: 510268 - RNA, 64 nt, Homo Sapiens
uuugucagaaucaaggcuucagugauguuauaguuuuuuuuacuccuuugcucucaauagcaaa

SEQ ID NO: 510269 - RNA, 64 nt, Homo Sapiens
cagagucuugcucuguugcuucuuuuuuuuuuuuuuuuuuuagauguaguaguagaaaaugcau

SEQ ID NO: 510270 - RNA, 64 nt, Homo Sapiens
uuaaaaaggaaaauaaaagaggggaaaaaaaacuuuuuuuuaaagggcaaaaaucuuuguaucu

SEQ ID NO: 510271 - RNA, 64 nt, Homo Sapiens
caagggcaaaaaucuuuguaucguucgggcacuguuuuuuuaugcuuugugaguccuuguguca

SEQ ID NO: 510272 - RNA, 64 nt, Homo Sapiens
agagacgggguuucaccaugggcuaauuuuuguguuuuuuuaguaggcgcccaccaccaugccc

SEQ ID NO: 510273 - RNA, 64 nt, Homo Sapiens
cggccagauaauaaauaaugaggggcccccaauuuuuuuuuaagaggucugggaaggaauagaa

SEQ ID NO: 510274 - RNA, 64 nt, Homo Sapiens
aaacacaauuuugcugccaacauaguccagguuuuuuuuuuaauucaaagcauugaaguguguu

SEQ ID NO: 510275 - RNA, 64 nt, Homo Sapiens
aacuuucaaucuucagauguuucuuugccuuuuuuuuuuuuaacuuuucuuuggugauauuuau

SEQ ID NO: 510276 - RNA, 64 nt, Homo Sapiens
aacucagguuagaacaaaaaucuuuccagcacauuuuuuuuaaagaugacuuuuuaaggguccu

SEQ ID NO: 510277 - RNA, 64 nt, Homo Sapiens
uuuaagggaauaaaaauuuuucuauucaaaaucuuuuuuuuauugagaaaucuucauaauaucu

SEQ ID NO: 510278 - RNA, 64 nt, Homo Sapiens
gacagcauggaaaguuuaaggggaauaaggaucuuuuuuuuaaacuagugaagacagaaccaga

SEQ ID NO: 510279 - RNA, 64 nt, Homo Sapiens
uucagagaugcuuucugauugagaaggggugacauuuuuuuaaucuuacuugggccugaaacug

SEQ ID NO: 510280 - RNA, 64 nt, Homo Sapiens
uuuuaaagcauaagaauguuagugccuuuaaaaauuuuuuuauuacuugcauucucagaaugau

SEQ ID NO: 510281 - RNA, 64 nt, Homo Sapiens
aaguuaacucuuaguuuuuauucccuggagucaguuuuuuuaaaugguaauauaauaauguccu

SEQ ID NO: 510282 - RNA, 64 nt, Homo Sapiens
gaaaacuugcacuuguuuuuccaucagccuauuauuuuuuuaaaaaccccuucgauagcaaguc

SEQ ID NO: 510283 - RNA, 64 nt, Homo Sapiens
guuuuuaauucccuuuuaacaaccagugaacuuuuuuuuuuaauaaaggagugagaugaaucaa

SEQ ID NO: 510284 - RNA, 64 nt, Homo Sapiens
uggugaagagaaaaaggcuggcucagacauuuucuuuuuuuaacaacuaugaagacuuaaaaga

SEQ ID NO: 510285 - RNA, 64 nt, Homo Sapiens
aaaaaaugcaaaaaaauucuuguaagugucgauguuuuuuuaaaguagcuuagagauguagcga

SEQ ID NO: 510286 - RNA, 64 nt, Homo Sapiens
cugagaaguauagggaugaauuuuaagaauacuuuuuuuuuaagcucaguuauugaacuuuuuu

SEQ ID NO: 510287 - RNA, 64 nt, Homo Sapiens
aauacuuuuuuuuuaagcugaguuauugaacuuuuuuuuuuaagauuaucaggaauacugccuc

SEQ ID NO: 510288 - RNA, 64 nt, Homo Sapiens
agcagccuguagugggcgcugccagaugcgggcuuuuuuuuauuuguuucaauguuccuaaugg

SEQ ID NO: 510289 - RNA, 64 nt, Homo Sapiens
ugacagcauguugcaguuucuuuucgguuuugguuuuuuuuaaauguuuuauuuugcuuuccca

SEQ ID NO: 510290 - RNA, 64 nt, Homo Sapiens
uugaauucaggucaguuucaguauuuuucaaauauuuuuuuaaaacugaauugcaauugugcca

SEQ ID NO: 510291 - RNA, 64 nt, Homo Sapiens
aggguguggcauuuuguucccuuuuccguuuuuuuuuuuuuauuguuguuguuaauuuuauugc

SEQ ID NO: 510292 - RNA, 64 nt, Homo Sapiens
gguugaagacggaaaacaaucuaagggucucucauuuuuuuaauuuuguuuuguucaguuuggu

SEQ ID NO: 510293 - RNA, 64 nt, Homo Sapiens
cacauuagagucaaccccuucuuuuuuuuuuuuuuuuuuuuaaauccaguauuuaggauaauau

SEQ ID NO: 510294 - RNA, 64 nt, Homo Sapiens
gaguuguuuuuucuuaauguaagaaaaauuguauuuuuuuuacaaguaucuucaaacugaaucu

SEQ ID NO: 510295 - RNA, 64 nt, Homo Sapiens
cuuucuugcuugguaagcaagaagccauaucgauuuuuuuuaacuuacagaaauggaaauaugu

SEQ ID NO: 510296 - RNA, 64 nt, Homo Sapiens
ccaugucaugauguaauuuuucuuucuucuuucuuuuuuuuaaauuuuagcaguggcuuauuau

SEQ ID NO: 510297 - RNA, 64 nt, Homo Sapiens
uacuauuuguuuuaccacugauugcacuguuuuguuuuuuuaacaguugcaaagcuuuuuaaug

SEQ ID NO: 510298 - RNA, 64 nt, Homo Sapiens
cuauaggaauugguuggcagugccagcuggcucuuuuuuuuaauauuuuauuauuuuuguuaac

SEQ ID NO: 510299 - RNA, 64 nt, Homo Sapiens
uguaaaguugauuuucuugugacaagagaacuucuuuuuuuaacaagaggacauggcauuauuu

SEQ ID NO: 510300 - RNA, 64 nt, Homo Sapiens
cugcuuguagaauuaguguauuuuuauuaaacuauuuuuuuaaaugucaaacuucuaucaugua

SEQ ID NO: 510301 - RNA, 64 nt, Homo Sapiens
guuuaugagauuuucucaccccacaucgcuccccuuuuuuuaaaaaggacuguuuugcuagugu

SEQ ID NO: 510302 - RNA, 64 nt, Homo Sapiens
ucauauggaagaacuugagggacauuaguauacuuuuuuuuaagauggagucuugcucugucac

SEQ ID NO: 510303 - RNA, 64 nt, Homo Sapiens
auuauaggcaugagccaccacgcccagccuguuauuuuuuuauuauuauuguuuuuuuuuagug

SEQ ID NO: 510304 - RNA, 64 nt, Homo Sapiens
acgcccagccuguuauuuuuuuauuauuauuguuuuuuuuuagugacagagucucauucuguug

SEQ ID NO: 510305 - RNA, 64 nt, Homo Sapiens
uauaaccuaacugauaauagguaauaagguuaaauuuuuuuaugacguauuuuauuuacaaaua

SEQ ID NO: 510306 - RNA, 64 nt, Homo Sapiens
uugaauugguagaugaaaaaaaccugguucaaguuuuuuuuaaaauguggugucccauuccaag

SEQ ID NO: 510307 - RNA, 64 nt, Homo Sapiens
gagaaccaaagagaauuuaacccugccauuuuuuuuuuuuuaacaccaagauccuaaguaauuc

SEQ ID NO: 510308 - RNA, 64 nt, Homo Sapiens
uuaggugcagugguggucuucaaauuacauuaguuuuuuuuauauauauuuuaaacauauguaa

SEQ ID NO: 510309 - RNA, 64 nt, Homo Sapiens
uucauaugauuguuaggagacuaccuuuuuagauuuuuuuuauuauauaucaaauuauaguugu

SEQ ID NO: 510310 - RNA, 64 nt, Homo Sapiens
auaugccaggaauaguggaauuuuauuuuuuaaauuuuuuuauaggcccauaugcucuaucuca

SEQ ID NO: 510311 - RNA, 64 nt, Homo Sapiens
auuccgcaaauuuaaaagcuaauugaggacaauuuuuuuuuaauuuccuaaaugagaccaccuu

SEQ ID NO: 510312 - RNA, 64 nt, Homo Sapiens
gcaaaugauugaugcaguuaaagcucaauaugccuuuuuuuacuggauacuguacauuuggcua

SEQ ID NO: 510313 - RNA, 64 nt, Homo Sapiens
cucgucucauuacuuuauagucaugucauguauguuuuuuuaaccaugaaaugacaauaaaaug

SEQ ID NO: 510314 - RNA, 64 nt, Homo Sapiens
uuugaagaagcauuucuguaaaauuagaaauuacuuuuuuuaaucuauuuaaaguuuggcuuga

SEQ ID NO: 510315 - RNA, 64 nt, Homo Sapiens
ucuuaaguguuaaauaauguagaaguaaaaaaauuuuuuuuaaaggcuuaauuugggagggggg

SEQ ID NO: 510316 - RNA, 64 nt, Homo Sapiens
aaacuuaauuacugcacuuaaaaugaaacauuacuuuuuuuaaacaaugugucacaaauguagg

SEQ ID NO: 510317 - RNA, 64 nt, Homo Sapiens
acagaacacuguugaaauauccauaucaacuugauuuuuuuaaccuaauucagguguccuuugc

SEQ ID NO: 510318 - RNA, 64 nt, Homo Sapiens
cacaucuguaauuuaaauguuucuaguaaccacauuuuuuuaaaaguaaaaagaaacccauggu

SEQ ID NO: 510319 - RNA, 64 nt, Homo Sapiens
uucaaacuacaguacuguguaauuauguauaaaguuuuuuuauuuauuugaaguuagacuagau

SEQ ID NO: 510320 - RNA, 64 nt, Homo Sapiens
aauggcagagaagaugaaauuugauaaacugaauuuuuuuuaaaaauccauuuacccuacaggu

SEQ ID NO: 510321 - RNA, 64 nt, Homo Sapiens
ccuacagguuugcauuuguuugcugaaauuuaccuuuuuuuaguuauauauaugugugugugug

SEQ ID NO: 510322 - RNA, 64 nt, Homo Sapiens
aagccauaacuuuuaacuggagugguuugauuucuuuuuuuaauuuuauugggaggguuuggau

SEQ ID NO: 510323 - RNA, 64 nt, Homo Sapiens
uuuuuaauuuuauugggaggguuuggauuuuaacuuuuuuuaauguuguuaaauauuaaguuuu

SEQ ID NO: 510324 - RNA, 64 nt, Homo Sapiens
uaaaacucaccaucuccugaagaccuuucuuaccuuuuuuuaaaaacaaaaaaugaaauuauuu

SEQ ID NO: 510325 - RNA, 64 nt, Homo Sapiens
guuuugggggccagccuagagggaauuccuuuuuuuuuuuuaaccccccagggggguaguuggg

SEQ ID NO: 510326 - RNA, 64 nt, Homo Sapiens
gagguggccagaccaauguguuguuuuguuguuguuuuuuuaagcuucccuugagagaauaaau

SEQ ID NO: 510327 - RNA, 64 nt, Homo Sapiens
gaagaccauucugugaccaaaauaccuuggucauuuuuuuuauauugccuuauuucccuauggc

SEQ ID NO: 510328 - RNA, 64 nt, Homo Sapiens
uuguauauccuauauaggaaacuaagcauuguauuuuuuuuaacaaaucuaaaaaagcacuaug

SEQ ID NO: 510329 - RNA, 64 nt, Homo Sapiens
uaugacuuuaucuaggaguuuguuuuucauuuuguuuuuuuaaaguauuagaaaagguuuuagc

SEQ ID NO: 510330 - RNA, 64 nt, Homo Sapiens
ugucacucuuaagaugucaaagggaauuagccauuuuuuuuauuguaauaaaggcaggugcuau

SEQ ID NO: 510331 - RNA, 64 nt, Homo Sapiens
cuucgcuucuuugauacuuguagcuuauuguaauuuuuuuuaagaaauucaaggucauuauuau

SEQ ID NO: 510332 - RNA, 64 nt, Homo Sapiens
caaaauaagcgcuuugauuaacacagcuauauaguuuuuuuaauuuuuaaaaaaccuguggaga

SEQ ID NO: 510333 - RNA, 64 nt, Homo Sapiens
ccagauuuucaguguuaacgugugggaggaauuuuuuuuuuaguuuuuauuuuuugguuuuggg

SEQ ID NO: 510334 - RNA, 64 nt, Homo Sapiens
uuucuaauguugaaauuauaucaggcuuuaccgguuuuuuuaguuguuuaaauaaguaauauuu

SEQ ID NO: 510335 - RNA, 64 nt, Homo Sapiens
ggcuaguuaauucaacucccaauuguucugaaaguuuuuuuaccuucucuucuaagagaauauu

SEQ ID NO: 510336 - RNA, 64 nt, Homo Sapiens
guuuacagucuuaaaagagguaaaacagcaaauauuuuuuuaagggaacuauaaccuuaggauu

SEQ ID NO: 510337 - RNA, 64 nt, Homo Sapiens
aacaauuugcauguuuuucagaugcuuucaaaucuuuuuuuaaaaaaauaguguaaaauauuuu

SEQ ID NO: 510338 - RNA, 64 nt, Homo Sapiens
acaggcaugagccaccaugcccagccaaagaucauuuuuuuauauagacuucagcccuuuguaa

SEQ ID NO: 510339 - RNA, 64 nt, Homo Sapiens
gguuuuuaaggcagcacagacugccaaguacuguuuuuuuuaaccgacugaaaucacuuuggga

SEQ ID NO: 510340 - RNA, 64 nt, Homo Sapiens
augcagauauauauauauauauuuuucccaguccuuuuuuuaagagacggucuuuauugggucu

SEQ ID NO: 510341 - RNA, 64 nt, Homo Sapiens
aggauccuuggauaccacaucgugaaaucuuuuauuuuuuuacucugagaccagcaccagaugu

SEQ ID NO: 510342 - RNA, 64 nt, Homo Sapiens
uuacaggcaugagccaccaucuucagccagaugauuuuuuuauugagagagugaaaugcuauuu

SEQ ID NO: 510343 - RNA, 64 nt, Homo Sapiens
guaaauuugcagccauuucaagcaggugauggucuuuuuuuauaacaucguuaacggguaccau

SEQ ID NO: 510344 - RNA, 64 nt, Homo Sapiens
ugaauguaaaauauaaaagguauagguuuuuuuuuuuuuuuaaagaaaacaauaaacuuucaaa

SEQ ID NO: 510345 - RNA, 64 nt, Homo Sapiens
gaaaggacucugaacucagaggagucacuguuccuuuuuuuagguuagaaauuaacagcaggga

SEQ ID NO: 510346 - RNA, 64 nt, Homo Sapiens
uuuccaaagugagagacgaaucuuucuuucuuuuuuuuuuuaaagggcaggauggguaugcuuu

SEQ ID NO: 510347 - RNA, 64 nt, Homo Sapiens
uuggcauuuucacuguucuguacaaggcugcuuguuuuuuuauugccaaagucaaauaaacggg

SEQ ID NO: 510348 - RNA, 64 nt, Homo Sapiens
auuaaaauuguccuuguguauaacgugugaaucauuuuuuuaaacugaaauuuaaaaugcaaca

SEQ ID NO: 510349 - RNA, 64 nt, Homo Sapiens
augacauacaacaaaugguuaucccacuuguauauuuuuuuaaagacucuuauccuguuacccu

SEQ ID NO: 510350 - RNA, 64 nt, Homo Sapiens
auugcacuuauccuugagaacagucuaaugauacuuuuuuuacuuucagacuguuucuagcuaa

SEQ ID NO: 510351 - RNA, 64 nt, Homo Sapiens
ugcagccgcuuuucuuuuugaaaugacuuugggauuuuuuuaagcuuuuauuuacuuuuuuuuu

SEQ ID NO: 510352 - RNA, 64 nt, Homo Sapiens
ugacuuugggauuuuuuuaagcuuuuauuuacuuuuuuuuuaacuguuaucuuucuggaugaaa

SEQ ID NO: 510353 - RNA, 64 nt, Homo Sapiens
cguaauuuugccaaauaauagauggaaauauuuauuuuuuuaagcauagguauauauaugccau

SEQ ID NO: 510354 - RNA, 64 nt, Homo Sapiens
uuuaaguuucaggauacaugauuacauaauuuuuuuuuuuuaacuuauuuuauccucugguuua

SEQ ID NO: 510355 - RNA, 64 nt, Homo Sapiens
ggaaacuguaggugcuguucugagauuugacuuuuuuuuuuaauccugaaauaccagcagcugg

SEQ ID NO: 510356 - RNA, 64 nt, Homo Sapiens
uaaacuuuauggcuguuugucgucaacuuuuuuuuuuuuuuaaaccaagcacugaagucuuacc

SEQ ID NO: 510357 - RNA, 64 nt, Homo Sapiens
cagcaaaaacuaucugaagauuuuuuaggggauuuuuuuuuagaucuucaaacaguauauaacu

SEQ ID NO: 510358 - RNA, 64 nt, Homo Sapiens
ggauuuuuuuuuagacagcaaaacaguauauaacuuuuuuuaggcuucuaaacauuuuuucuuc

SEQ ID NO: 510359 - RNA, 64 nt, Homo Sapiens
aaaagcuaaauuacauagacaauccuuguugaaguuuuuuuaaaauuacagccuuaaagacaaa

SEQ ID NO: 510360 - RNA, 64 nt, Homo Sapiens
guagugguuaauuaccuuuagauguagaugggcauuuuuuuaaguuuaggccucuugaauuuuu

SEQ ID NO: 510361 - RNA, 64 nt, Homo Sapiens
uggcauaacugugauucuuuacuugauuauauuguuuuuuuauuucauuguuuuaaaggaauaa

SEQ ID NO: 510362 - RNA, 64 nt, Homo Sapiens
acuauguaauuuauauuccaaacucuuaguuuuuuuuuuuuacauguuaaaagaagucaucuca

SEQ ID NO: 510363 - RNA, 64 nt, Homo Sapiens
caaugaagugaaaaaguuuucaagacauuaauuuuuuuuuuaaaauuuuggggugguggugugc

SEQ ID NO: 510364 - RNA, 64 nt, Homo Sapiens
cuaggaaaaagacccaaacacauuuuauaauauuuuuuuuuaauuguuggacuaggguccaaag

SEQ ID NO: 510365 - RNA, 64 nt, Homo Sapiens
gcauaaaacauauuucuagagagugcauugcaauuuuuuuuaaauuaucagaaaaaaauuuuug

SEQ ID NO: 510366 - RNA, 64 nt, Homo Sapiens
aaaagaggcaagaaaauaaauucaaaauuggugguuuuuuuaaaaguauauauuucaagcuuau

SEQ ID NO: 510367 - RNA, 64 nt, Homo Sapiens
caguucauacuuaccuaaaauugcauaugaaauguuuuuuuaaauuuuacuauguuguaauucu

SEQ ID NO: 510368 - RNA, 64 nt, Homo Sapiens
uauuccauuguuaacugaaugaaaagaaaacuauuuuuuuuaaauuuaccacaaguuacaauuu

SEQ ID NO: 510369 - RNA, 64 nt, Homo Sapiens
gacugaauguguucaccauucagggauaugcuuuuuuuuuuaaauauguauguauaaaauuuca

SEQ ID NO: 510370 - RNA, 64 nt, Homo Sapiens
aaaggaaaaaagaaaaaaaauuacuuccuuuuuuuuuuuuuaaguuguuggcaauuuaauuuau

SEQ ID NO: 510371 - RNA, 64 nt, Homo Sapiens
aauggccugaucauggcuaugccccccccccucuuuuuuuuaaguuucacaaacuccaccuacu

SEQ ID NO: 510372 - RNA, 64 nt, Homo Sapiens
acuauccaauuaaaauuaagccaauguuugauuuuuuuuuuaaagcauuuguugugacuggcac

SEQ ID NO: 510373 - RNA, 64 nt, Homo Sapiens
cuaccaagugaccauaaaggacaugcuuuggcaauuuuuuuauaaagaccuguugguuagcugg

SEQ ID NO: 510374 - RNA, 64 nt, Homo Sapiens
gacagggucuugcuauauugcaugcccuauuuuuuuuuuuuaaaagcaccauggcaugcgccac

SEQ ID NO: 510375 - RNA, 64 nt, Homo Sapiens
cagggucucacucuguugccgcuggggauuuuuuuuuuuuuaaaaggcuggggaugguaggauu

SEQ ID NO: 510376 - RNA, 64 nt, Homo Sapiens
uaauccccagugugacaguaauccuucuuucucuuuuuuuuacuuccccuucccuccccuuccc

SEQ ID NO: 510377 - RNA, 64 nt, Homo Sapiens
agaaaaaaauuuuaccauuacacuacaaaguaccuuuuuuuaucauuauguuaccuccuaacag

SEQ ID NO: 510378 - RNA, 64 nt, Homo Sapiens
cauaguucaucgaaaugcagcacuaugugcuuuuuuuuuuuaacuuuccuuugcuuugauuaga

SEQ ID NO: 510379 - RNA, 64 nt, Homo Sapiens
ggacaggaaacugauauuuuuagacuagguaauuuuuuuuuaaaauguuuuuguauuuucuugg

SEQ ID NO: 510380 - RNA, 64 nt, Homo Sapiens
gaaaaugaaggucagagagauagauuuugaaauguuuuuuuaaugucuuagaauccugaaagca

SEQ ID NO: 510381 - RNA, 64 nt, Homo Sapiens
auccuccucucuucuuaguaguucugaaguuuaauuuuuuuauuguaucuacgaagaguaucaa

SEQ ID NO: 510382 - RNA, 64 nt, Homo Sapiens
cccuagaauuuaauauuuguaaguuuacauaaguuuuuuuuaacauggcaaauugcuuuuuuaa

SEQ ID NO: 510383 - RNA, 64 nt, Homo Sapiens
gaaaaaaaagcgcaaaaccacaguggccuuuuuuuuuuuuuaagucagaccauuuuauacauuu

SEQ ID NO: 510384 - RNA, 64 nt, Homo Sapiens
guaguauaagauguuagauuuucauuggucacuuuuuuuuuauuuuuuaauuccuauuuucugc

SEQ ID NO: 510385 - RNA, 64 nt, Homo Sapiens
gacugagaaaacuuguuuaccugcugagaagauuuuuuuuuaauauuguuucauguuaaugcag

SEQ ID NO: 510386 - RNA, 64 nt, Homo Sapiens
caagaccauuguuucauguuuguuuuuuguuuuuuuuuuuuaauuguuuuuguuguuguugguu

SEQ ID NO: 510387 - RNA, 64 nt, Homo Sapiens
uuuuacuuauuuuuaaauuugcuuuuuaaaaauauuuuuuuauuccacuucucuugcccaggcu

SEQ ID NO: 510388 - RNA, 64 nt, Homo Sapiens
aguauuuuuacugguuuuaucgggaaguaaacgcuuuuuuuaaauauuuccaaacuaaauuacu

SEQ ID NO: 510389 - RNA, 64 nt, Homo Sapiens
agacauuucagcuucuuuacaauucauggcaauguuuuuuuaaaauaugcccuuuuauuaaaua

SEQ ID NO: 510390 - RNA, 64 nt, Homo Sapiens
aaaaaaaaagcaaagcuuuccgaauguagauuuauuuuuuuaaacaacagaagacacacuugua

SEQ ID NO: 510391 - RNA, 64 nt, Homo Sapiens
uaaaaagauuaucuaccuuuccagaauggauuuuuuuuuuuagaggagccauaaaaauaguuuu

SEQ ID NO: 510392 - RNA, 64 nt, Homo Sapiens
ucuggcaaugcugaaaaagccagaguugcuguuguuuuuuuaaaguguuuuccccucuagaaaa

SEQ ID NO: 510393 - RNA, 64 nt, Homo Sapiens
ucuacugucaaaugaugugcuuguaaauuuaguguuuuuuuauucaucaaacucaaugcuuuau

SEQ ID NO: 510394 - RNA, 64 nt, Homo Sapiens
gaaaagaugaaaggcaggccuuguaaacauuuauuuuuuuuaaauaaaaucugagggaaauguu

SEQ ID NO: 510395 - RNA, 64 nt, Homo Sapiens
aacauaagagaaauauuuaguuuuuaaacucaauuuuuuuuagaagauacuguuuaaaaguucu

SEQ ID NO: 510396 - RNA, 64 nt, Homo Sapiens
acgucuggacucaaaaaauguaagcaaacacuacuuuuuuuaaaaguuaaagggcuaaauuaua

SEQ ID NO: 510397 - RNA, 64 nt, Homo Sapiens
guauaaaaacaacaauucuaaaagcauagacauauuuuuuuaaaaagaaaaaaagaaaaaaaag

SEQ ID NO: 510398 - RNA, 64 nt, Homo Sapiens
aguuuguuaaaauaugcuuguagcuguauauacauuuuuuuaaaacaaacuuuacucuuauucu

SEQ ID NO: 510399 - RNA, 64 nt, Homo Sapiens
cuggguugcuguaagggugcauaaagauucagauuuuuuuuaccgugguauaagguuuaaaaag

SEQ ID NO: 510400 - RNA, 64 nt, Homo Sapiens
ccaugacaucccagaagaggucuuuuuuuuuuuuuuuuuuuaaguggauuauuuuccuguuuug

SEQ ID NO: 510401 - RNA, 64 nt, Homo Sapiens
gaauagggaccaaugccacacccaaguacccuuuuuuuuuuaaucuaauucugauugugucgug

SEQ ID NO: 510402 - RNA, 64 nt, Homo Sapiens
uuuaauuuuggaaauucugcgaaguuauuuuauuuuuuuuuauucuggauuugcuacagaguga

SEQ ID NO: 510403 - RNA, 64 nt, Homo Sapiens
ugggcuguuuuuaaugcaggagaacuuugaauuuuuuuuuuaaacuuuuuucccggaauucauc

SEQ ID NO: 510404 - RNA, 64 nt, Homo Sapiens
ucacaaggaccagguacaguuuuuugugacuuuauuuuuuuaauuaauuuguuuugucauaugg

SEQ ID NO: 510405 - RNA, 64 nt, Homo Sapiens
auguuacaugguguuucgaauuugggauuuuuuuuuuuuuuaagaauuccguuuucugauuugc

SEQ ID NO: 510406 - RNA, 64 nt, Homo Sapiens
guuuccuaauaaaagagaaguuuuggguuuuuuuuuuuuuuaaugagaugcgcggcuguucgug

SEQ ID NO: 510407 - RNA, 64 nt, Homo Sapiens
gaaaccuuuuuuaaacuauuuuuuuuuuuuuuuuuuuuuuuaaaccuccuuuacccuuucccuu

SEQ ID NO: 510408 - RNA, 64 nt, Homo Sapiens
gaagaaaaaaaacuacauaauuuuuuuaauuuuuuuuuuuuaaaggauuuagugucuuaggaaa

SEQ ID NO: 510409 - RNA, 64 nt, Homo Sapiens
uuuuuuuuuuuaaagaagaaagugucuuaggaaauuuuuuuaauacauuccagauugaggauuu

SEQ ID NO: 510410 - RNA, 64 nt, Homo Sapiens
uccaagggacucucccggcauuuuauuguugagguuuuuuuaucuggauuuuuaaauugcuuuu

SEQ ID NO: 510411 - RNA, 64 nt, Homo Sapiens
guugagguuuuuuuaucuccauuuuuaaauugcuuuuuuuuauuccgcccccggcugcaguugg

SEQ ID NO: 510412 - RNA, 64 nt, Homo Sapiens
ugauauuguuucaccgcuuugguuuuuccuuuuguuuuuuuaaaggauguguuucugaauaagu

SEQ ID NO: 510413 - RNA, 64 nt, Homo Sapiens
gggucuagaacuccccuuugguaaugcuucuuuguuuuuuuauggcccuucuguucucaggaug

SEQ ID NO: 510414 - RNA, 64 nt, Homo Sapiens
gacuguguauucuccaagcugugauacagcaguuuuuuuuuauugucacagggaaauaaauggu

SEQ ID NO: 510415 - RNA, 64 nt, Homo Sapiens
auuuggaccuuauguuuuacucuuguuuuuuuuuuuuuuuuaaauguuacuuaaugacucucuc

SEQ ID NO: 510416 - RNA, 64 nt, Homo Sapiens
augguuuuuuaucuuauuguaauagaugagcauauuuuuuuaccagacauaaaugggguaauaa

SEQ ID NO: 510417 - RNA, 64 nt, Homo Sapiens
aacacaauuuaauuuuugucugccacauuagacauuuuuuuaccuuauaaaaugaucaauaaag

SEQ ID NO: 510418 - RNA, 64 nt, Homo Sapiens
agccaacuguuaacuggaagcuuuugauaauuuuuuuuuuuagaacaauuuggaacauuaaaau

SEQ ID NO: 510419 - RNA, 64 nt, Homo Sapiens
gaacaguuaacuauauuaaauuuuuaucauuuacuuuuuuuaagauucagaccucaguuauaua

SEQ ID NO: 510420 - RNA, 64 nt, Homo Sapiens
uucagaacuugagauguggcagcacuggacuggguuuuuuuaaauguuaggacuaggaauguuu

SEQ ID NO: 510421 - RNA, 64 nt, Homo Sapiens
uagucacucuugucacuuuauuuauuuauugguuuuuuuuuaaccaucuguguacauuccuuuc

SEQ ID NO: 510422 - RNA, 64 nt, Homo Sapiens
uguuugcucuuguuuuuauuaauuuauauguauauuuuuuuaauuuaacaugaacacccuuaga

SEQ ID NO: 510423 - RNA, 64 nt, Homo Sapiens
ucuuuugaacuggcaauugucuauuuaucuuuuauuuuuuuaagucaguauggucuaacacugg

SEQ ID NO: 510424 - RNA, 64 nt, Homo Sapiens
ugccgcucuguuuaaagcaauguguaaagaugaguuuuuuuaagcauggaauuuaggguugggg

SEQ ID NO: 510425 - RNA, 64 nt, Homo Sapiens
aaaauggugugcuuuuggggagauacacuagcaauuuuuuuaaaaacuggaacagugugauagg

SEQ ID NO: 510426 - RNA, 64 nt, Homo Sapiens
cacuuuuucuuuagcucuugugauaagauuuucuuuuuuuuacuuuuauacaaaggcagcaucu

SEQ ID NO: 510427 - RNA, 64 nt, Homo Sapiens
gccaaucaaacauuaaggacuauggaggucuuuuuuuuuuuauuuaacaugucauuguucaucu

SEQ ID NO: 510428 - RNA, 64 nt, Homo Sapiens
cauuucauguuuuuaauauaagaaugaucuaauauuuuuuuaaaguaauagcuaucaguaauag

SEQ ID NO: 510429 - RNA, 64 nt, Homo Sapiens
uguacugaugccaaucagcuagagcaauguaggcuuuuuuuaauuuaaauuauuacuacacuuu

SEQ ID NO: 510430 - RNA, 64 nt, Homo Sapiens
uuuauugggaauaaggaauggaacauguugaaacuuuuuuuacuuaugcaauuaagggcuuaca

SEQ ID NO: 510431 - RNA, 64 nt, Homo Sapiens
uuuaaaaacaucaaaaauugggcauguaguggaguuuuuuuaacacaaccuuuucuuucaauau

SEQ ID NO: 510432 - RNA, 64 nt, Homo Sapiens
aucuuauguuuacaggcuucucuuuauuuaaauuuuuuuuuaacugcacugagugcacuuuaca

SEQ ID NO: 510433 - RNA, 64 nt, Homo Sapiens
uggauccucuuggaugcguuuuuguagucugucauuuuuuuaagaacauaaggggaauuaaguc

SEQ ID NO: 510434 - RNA, 64 nt, Homo Sapiens
ggaaauuaauauuaguaaaagcccccauaauuucuuuuuuuaaaauguuuacuauaaaccuuuu

SEQ ID NO: 510435 - RNA, 64 nt, Homo Sapiens
aaaagagauuugauuauuuugauacuaagaagguuuuuuuuaaacuuuuuggacauuuaaccaa

SEQ ID NO: 510436 - RNA, 64 nt, Homo Sapiens
uaccacugucuuuagcugucuccccuaaaaugauuuuuuuuaaacccugaggauaaaaccucca

SEQ ID NO: 510437 - RNA, 64 nt, Homo Sapiens
cuuagaagcaaugaauguuugccaauuugcaauuuuuuuuuaaaagaguccucaaaggguuaag

SEQ ID NO: 510438 - RNA, 64 nt, Homo Sapiens
uuguguaaugauugauauaucaucuucuaaagauuuuuuuuauacugacucauuaggagauagg

SEQ ID NO: 510439 - RNA, 64 nt, Homo Sapiens
ugcuucucaaaauuuucagugcacuaauuguggauuuuuuuagaaaguauuguccccucuuuuu

SEQ ID NO: 510440 - RNA, 64 nt, Homo Sapiens
guucacauacacuuuuuuguuauuguaguguagauuuuuuuaaaccagagauaauaucaauuca

SEQ ID NO: 510441 - RNA, 64 nt, Homo Sapiens
aauugaaaaaauuuaccacauuagaagaaauaauuuuuuuuaauuucucaaaggccuauuccua

SEQ ID NO: 510442 - RNA, 64 nt, Homo Sapiens
uuaaauauacugucaguguauacauuguaugcuuuuuuuuuaguuuuguaaauaaauuuguuug

SEQ ID NO: 510443 - RNA, 64 nt, Homo Sapiens
ugaauaacucauucaguugugauuagcuuucugcuuuuuuuauuuuuaggaccuaaaaugucua

SEQ ID NO: 510444 - RNA, 64 nt, Homo Sapiens
cagaacuucaugaaauccacuauauuuagauuaauuuuuuuaguucagauaaaaugaguagaug

SEQ ID NO: 510445 - RNA, 64 nt, Homo Sapiens
auaggauuauaaaucagcuagcagacuauagauuuuuuuuuaaugagaaguaugucaaaagacu

SEQ ID NO: 510446 - RNA, 64 nt, Homo Sapiens
acauauccaauaaugccuucuuuucagggggucuuuuuuuuaauuguuuuauuuuauuuuauuu

SEQ ID NO: 510447 - RNA, 64 nt, Homo Sapiens
ucuuucacacuucaggaaaaaacaaugugauucuuuuuuuuaagcuuuccauugagcaccucug

SEQ ID NO: 510448 - RNA, 64 nt, Homo Sapiens
uuuuaucuuuuaacaaacuuucaagguauggaauuuuuuuuauuaaaagauauuucaaggauua

SEQ ID NO: 510449 - RNA, 64 nt, Homo Sapiens
auuuaaaauacccaacaugucacauauguauguuuuuuuuuacuauuugagccauuacugaauu

SEQ ID NO: 510450 - RNA, 64 nt, Homo Sapiens
cuuacagcauguuuugguuuauuuuuuagugaauuuuuuuuaaaaaguguauuuuuuucaacua

SEQ ID NO: 510451 - RNA, 64 nt, Homo Sapiens
guuguaaaauauuaaccucuuagagcauuuuauuuuuuuuuagugucccaacuaagaaaauaua

SEQ ID NO: 510452 - RNA, 64 nt, Homo Sapiens
auccucuuuagagguaauuuuaacgucauugcuauuuuuuuaacauauucauuaguuaagaugg

SEQ ID NO: 510453 - RNA, 64 nt, Homo Sapiens
caaggguaggugggcgugggugguaggagguuuuuuuuuuuacccagggcucuggaaggacacc

SEQ ID NO: 510454 - RNA, 64 nt, Homo Sapiens
ugggaacagggaggugggagguggauuuuguuuauuuuuuuagcucauuuccaggggugggaau

SEQ ID NO: 510455 - RNA, 64 nt, Homo Sapiens
uuauuuuuuuagcucauuuccaggggugggaauuuuuuuuuaauaugugucaugaauaaaguug

SEQ ID NO: 510456 - RNA, 64 nt, Homo Sapiens
ccaucaaaccuauuaaguauucuuauuguuuaucuuuuuuuaauugccauuugauuuuuauugu

SEQ ID NO: 510457 - RNA, 64 nt, Homo Sapiens
uuucauauaccauagcagauuauccauuucaauuuuuuuuuacuccacaggaaaauguaagcua

SEQ ID NO: 510458 - RNA, 64 nt, Homo Sapiens
caaaugcagugugugaaaaguaugaaauuauuauuuuuuuuaaugagggauguaaacaguauaa

SEQ ID NO: 510459 - RNA, 64 nt, Homo Sapiens
auaagggcugguuauuuaccuccuuuuuuuuuuuuuuuuuuaaagaaaaaaggacuuuuaaccu

SEQ ID NO: 510460 - RNA, 64 nt, Homo Sapiens
uucuauagucaugaaccccuucagugcauuuucauuuuuuuauuaacagcaacuaaaauuuuau

SEQ ID NO: 510461 - RNA, 64 nt, Homo Sapiens
ugucccuacauuugugcuugguggcccuauuuuuuuuuuuuagagaggccuugagacauacagg

SEQ ID NO: 510462 - RNA, 64 nt, Homo Sapiens
cuaguaaaaauaaauggagugguauccuaucuucuuuuuuuaaggaaucaaugaauaauaaaug

SEQ ID NO: 510463 - RNA, 64 nt, Homo Sapiens
ggaauuguuuaagggaaaagaaaagaguaauaauuuuuuuuaaaacauuaaggaauuggaauuc

SEQ ID NO: 510464 - RNA, 64 nt, Homo Sapiens
ggggagagaauauucauaacuugugggcuuuuuuuuuuuuuaacuucaguggaauuuacuuuag

SEQ ID NO: 510465 - RNA, 64 nt, Homo Sapiens
ucucuuaauuugaccauugcagauuugggugacuuuuuuuuaaccuuuguacauauacguaauu

SEQ ID NO: 510466 - RNA, 64 nt, Homo Sapiens
caauucagaaaaguaauuucuccaaggucacuucuuuuuuuaugucuugccaucacuuuaaagg

SEQ ID NO: 510467 - RNA, 64 nt, Homo Sapiens
cacaaaacuuaauuucuaauuuuccaugaauacuuuuuuuuagaaagcucauuagcagcccucu

SEQ ID NO: 510468 - RNA, 64 nt, Homo Sapiens
uuggaaaaaaacacuauauaaaugcaauccaugcuuuuuuuaaagaacaacauugccagaguau

SEQ ID NO: 510469 - RNA, 64 nt, Homo Sapiens
auuuuuggaugguuauugauaucuuuguaguagcuuuuuuuaaaagacuaccaaaauguauggu

SEQ ID NO: 510470 - RNA, 64 nt, Homo Sapiens
aaaauguaugguuguccuuuuuuuuuguuuuuuuuuuuuuuaauuauuucucuuagcagaucag

SEQ ID NO: 510471 - RNA, 64 nt, Homo Sapiens
ggcacaaaauaacuggugucuuguaaauguucuguuuuuuuaaauaaaacuucucuacuuuagu

SEQ ID NO: 510472 - RNA, 64 nt, Homo Sapiens
cuuuaucuaacaucuucucuuucaguagucuuguuuuuuuuauaucaugugauuguuugugugu

SEQ ID NO: 510473 - RNA, 64 nt, Homo Sapiens
gcaauuaaacuguaaauaacuugcccugggggccuuuuuuuaaaaaacaaaaaccacaaaaauu

SEQ ID NO: 510474 - RNA, 64 nt, Homo Sapiens
uaaggacacaucaaagcuggccaaaauaaugaauuuuuuuuaaaaagcaauaccugguuuccac

SEQ ID NO: 510475 - RNA, 64 nt, Homo Sapiens
uuuagucuauuagcuagaggguuuuggcuguugcuuuuuuuaaaguuagguccacacagugaag

SEQ ID NO: 510476 - RNA, 64 nt, Homo Sapiens
uauaugucugauaccguuguuauaacaaaacaaauuuuuuuacuauaguuuuuuguuuucuacc

SEQ ID NO: 510477 - RNA, 64 nt, Homo Sapiens
gaaagcacaauuaauuuuauagagagguuuuuuauuuuuuuaauauuucuauugcaaaagucua

SEQ ID NO: 510478 - RNA, 64 nt, Homo Sapiens
ucguagcuacaccaaguucaggcuucucuuuuuguuuuuuuaccuagaaauugggcucaguggu

SEQ ID NO: 510479 - RNA, 64 nt, Homo Sapiens
cuaaccuccauuugaaaugaaaacacaaaagugauuuuuuuacuacuuagugcagaagguggua

SEQ ID NO: 510480 - RNA, 64 nt, Homo Sapiens
cacuggggauaaaaagacauauaauaaaaacaaauuuuuuuaagacuacugacucaaaaauaaa

SEQ ID NO: 510481 - RNA, 64 nt, Homo Sapiens
auguauaagaauuuuguuuaagagcagcuuaaauuuuuuuuauauuuuagcaaaggaggguugc

SEQ ID NO: 510482 - RNA, 64 nt, Homo Sapiens
aaaaacaauguuuguaacaacaggaaacacagucuuuuuuuaaagacaaauaguccucuaguuc

SEQ ID NO: 510483 - RNA, 64 nt, Homo Sapiens
gcaaaaauauucugcacauuucugggagauuaacuuuuuuuaacggugacuaacaaagcucaca

SEQ ID NO: 510484 - RNA, 64 nt, Homo Sapiens
ucacucuuuuuauauuuuaguucccugcaguuguuuuuuuuauuauuaaugcucaauaaacaaa

SEQ ID NO: 510485 - RNA, 64 nt, Homo Sapiens
uucuguauacuguuuugaauuuaguuuuuggauuuuuuuuuaagggaccaaauuuuuagaaaaa

SEQ ID NO: 510486 - RNA, 64 nt, Homo Sapiens
cuaugggaguguauuauaaaaauauaccuaaguguuuuuuuaaaauauauauuauauauaaaau

SEQ ID NO: 510487 - RNA, 64 nt, Homo Sapiens
gcaguuguagguuaacagaauaaaaauagacuuuuuuuuuuagacaacuuuuaaaaauuguuuu

SEQ ID NO: 510488 - RNA, 64 nt, Homo Sapiens
cauaagacaucacauuauccccuguguuuuauaauuuuuuuaccuauuuggagaaaguuugugc

SEQ ID NO: 510489 - RNA, 64 nt, Homo Sapiens
aaguccuaggagcugggcuuaucuaaugucauuuuuuuuuuaauuucccgcucagccuccauaa

SEQ ID NO: 510490 - RNA, 64 nt, Homo Sapiens
guugcaucugucuaauuuguaagguuuuguuuuuuuuuuuuaauauuagacauggcaugcuaag

SEQ ID NO: 510491 - RNA, 64 nt, Homo Sapiens
uuggcaggauaaaauauugcgcugccauaauauauuuuuuuaauaaaaaaacaaaaacaaacag

SEQ ID NO: 510492 - RNA, 64 nt, Homo Sapiens
ucacccccaccacauaaaucugacggcuucucucuuuuuuuaaacuuuuaggcguuuucuggcu

SEQ ID NO: 510493 - RNA, 64 nt, Homo Sapiens
uauuuuuuaauuuuuuuuuuguggcaugcaguuuuuuuuuuaauuuuuuguccugaaauaaaaa

SEQ ID NO: 510494 - RNA, 64 nt, Homo Sapiens
ccgguaguagccugagcaauucccuucuuuguuuuuuuuuuaacgagauuuuguuggguaucca

SEQ ID NO: 510495 - RNA, 64 nt, Homo Sapiens
uaaaaauacucuaauagccuugagugaccaacuuuuuuuuuaaagcacagauguaauugucuaa

SEQ ID NO: 510496 - RNA, 64 nt, Homo Sapiens
uucccuuagagggauaaaguugagaagugugccuuuuuuuuaauggcuugaaguuucagaggug

SEQ ID NO: 510497 - RNA, 64 nt, Homo Sapiens
acaauguauauaacacuaucugucuguaaaauacuuuuuuuaagaaagcauuuauauuuauaug

SEQ ID NO: 510498 - RNA, 64 nt, Homo Sapiens
uucugggaccaguucucccccaacaggaaacuuguuuuuuuaacgucagccagauauuuagaaa

SEQ ID NO: 510499 - RNA, 64 nt, Homo Sapiens
auguagaacugggccagagccaguccauugccuguuuuuuuaaauaagguuuuacugagcacag

SEQ ID NO: 510500 - RNA, 64 nt, Homo Sapiens
uuauuggguugucuugcuuucuuacaugaacuuguuuuuuuaaucacugaaaggaauuuagugu

SEQ ID NO: 510501 - RNA, 64 nt, Homo Sapiens
cugaaguccuuugaaacaucucauuaucuugaaauuuuuuuaauguuugagaacaccauaagca

SEQ ID NO: 510502 - RNA, 64 nt, Homo Sapiens
auuuuccuggguagaagggaaaagacuggaaaaauuuuuuuagugacaugcauuuuuuuuuuag

SEQ ID NO: 510503 - RNA, 64 nt, Homo Sapiens
aagacuggaaaaauuuuuuuagugacaugcauuuuuuuuuuaguuguuaucaaauuguaaaauc

SEQ ID NO: 510504 - RNA, 64 nt, Homo Sapiens
ccauuguccuuauguugucuguguuguauuuuuuuuuuuuuauugaccauggugauuauuuuuu

SEQ ID NO: 510505 - RNA, 64 nt, Homo Sapiens
uguauuuuuuuuuuuuuauugaccauggugauuauuuuuuuaaaccaucguuaauauacugaag

SEQ ID NO: 510506 - RNA, 64 nt, Homo Sapiens
gauugagaaauucucagugauucugcaauggauuuuuuuuuaaugcagaaguaauguauacucu

SEQ ID NO: 510507 - RNA, 64 nt, Homo Sapiens
agggggaggaaauguugcauugcuguuuguaagcuuuuuuuauuauuuuuuuauuauaauuauu

SEQ ID NO: 510508 - RNA, 64 nt, Homo Sapiens
auguugcauugcuguuuguaagcuuuuuuuauuauuuuuuuauuauaauuauuaaaggccugac

SEQ ID NO: 510509 - RNA, 64 nt, Homo Sapiens
auggauguagcuaccuuuuuuuguaugucuuuuuuuuuuuuaagcaaucguguugaauuaggag

SEQ ID NO: 510510 - RNA, 64 nt, Homo Sapiens
uuugcaaauggggggaagcuacugugagcguguguuuuuuuaauuuacacuauagagugauuuu

SEQ ID NO: 510511 - RNA, 64 nt, Homo Sapiens
aauagacaauuuauuauggcugcccuaaaguguauuuuuuuacuuaauuugugauacaaugcug

SEQ ID NO: 510512 - RNA, 64 nt, Homo Sapiens
aaaaaggaugcacagaguugacaugcaaggucauuuuuuuuaaguaaagcagcguuucuaugac

SEQ ID NO: 510513 - RNA, 64 nt, Homo Sapiens
gucacugcuuaacuucacauugugauuuuuguaauuuuuuuaucgguucaaagauauuuugcuu

SEQ ID NO: 510514 - RNA, 64 nt, Homo Sapiens
ucuauugagcuuguuucuugucauacucuaaucauuuuuuuauaagaaaggaaaaaaauauuca

SEQ ID NO: 510515 - RNA, 64 nt, Homo Sapiens
auguauaauaaucucgacaccuggaaaacugaauuuuuuuuauucauuuuauauuaagccagug

SEQ ID NO: 510516 - RNA, 64 nt, Homo Sapiens
gaagaaaaaaaaacugcccucugguuugauuuuuuuuuuuuaaaaaaagccucauuuuauuuug

SEQ ID NO: 510517 - RNA, 64 nt, Homo Sapiens
ugguggaaugucucucagcacuuuuuuuuuuuuuuuuuuuuaaaaaauaaccaguccauuuuuc

SEQ ID NO: 510518 - RNA, 64 nt, Homo Sapiens
aauuaguuugacauucgcuagaaaaccuuuagacuuuuuuuagcuacuagauuuuucaaagugu

SEQ ID NO: 510519 - RNA, 64 nt, Homo Sapiens
auuagaugaauauguuagucucuauugguagguuuuuuuuuaaauaaaauaaaauauauuuugu

SEQ ID NO: 510520 - RNA, 64 nt, Homo Sapiens
gaauuuuguuaauaaauuauaagguuuguuuuuuuuuuuuuaaacucugcaguguugauuuuuc

SEQ ID NO: 510521 - RNA, 64 nt, Homo Sapiens
uacaggugugcaccaccacagcuggcuaauucuauuuuuuuauagaggcgaagucucacuaugu

SEQ ID NO: 510522 - RNA, 64 nt, Homo Sapiens
uuuguuuuaaccaauaacuagcuucuuauaaugauuuuuuuacuaaugauacuuacaaguuucu

SEQ ID NO: 510523 - RNA, 64 nt, Homo Sapiens
auauuggccaaacuggugcaugacaaguacuguauuuuuuuauaccuaaauaaagaaaaaucuu

SEQ ID NO: 510524 - RNA, 64 nt, Homo Sapiens
uuaaaugcuaguaaucagcacucuuucuuuuuuuuuuuuuuaauagagacagggucucgcagug

SEQ ID NO: 510525 - RNA, 64 nt, Homo Sapiens
gaagucacaggcuggcuucuguuuuauucagggauuuuuuuaaaaagucaaucagaaaagggau

SEQ ID NO: 510526 - RNA, 64 nt, Homo Sapiens
uuuuuuaaauaggcuuacugucaaauugcaacuuuuuuuuuagauacagaguggaaaacagugc

SEQ ID NO: 510527 - RNA, 64 nt, Homo Sapiens
cagagcuccuugguuuuuuacuucugcacuuaaauuuuuuuaaauaacaugaugaugguacauu

SEQ ID NO: 510528 - RNA, 64 nt, Homo Sapiens
gucagcugucggguuagugguaguauuauuguuauuuuuuuaaaggaaacaaacagacaacaaa

SEQ ID NO: 510529 - RNA, 64 nt, Homo Sapiens
agguagacuuuauuacccccccacuaugcccucauuuuuuuaaaaaaggaaaaaaaaaagaaac

SEQ ID NO: 510530 - RNA, 64 nt, Homo Sapiens
aaaaaacagagauggggucuugaacagaauuucuuuuuuuuaaacuuuuggucugaaauacuuu

SEQ ID NO: 510531 - RNA, 64 nt, Homo Sapiens
uacaaggagggggcuauuaauaauuucuuaauuuuuuuuuuaaaauuagcacacagauucacuu

SEQ ID NO: 510532 - RNA, 64 nt, Homo Sapiens
cagaggcuuaauuaaaugauccaauugcuaucuauuuuuuuaucuguacuccacaauggccagu

SEQ ID NO: 510533 - RNA, 64 nt, Homo Sapiens
ggagcuuuuaaacaaaguaaugcaaaugugcaauuuuuuuuaaauaguguuacaggaagugaaa

SEQ ID NO: 510534 - RNA, 64 nt, Homo Sapiens
cguuucuacuuugggguuccggcuucaucacaaauuuuuuuaaaugucuguaguugacaaaagu

SEQ ID NO: 510535 - RNA, 64 nt, Homo Sapiens
ugugguuguucugacgugugugcauuguuuuuuguuuuuuuaauguccaauguuugguguuauc

SEQ ID NO: 510536 - RNA, 64 nt, Homo Sapiens
ucauguuuuucauuugauacgagguagacugaaauuuuuuuaauaauaaagugauguucuggug

SEQ ID NO: 510537 - RNA, 64 nt, Homo Sapiens
auuuguguguaauauagcugcuguuuuuuuuuuuuuuuuuuaacugugauuuucuuguuuaugu

SEQ ID NO: 510538 - RNA, 64 nt, Homo Sapiens
gaucuuucagccuuuaugguagcccuguuaacaguuuuuuuaggguagugagcaaugauugcgc

SEQ ID NO: 510539 - RNA, 64 nt, Homo Sapiens
guauaaaaacaauaauuuauacugcacuuuugacuuuuuuuaugcaacuuccacuuuuuuuuaa

SEQ ID NO: 510540 - RNA, 64 nt, Homo Sapiens
cugcacuuuugacuuuuuuuuaacaacuuccacuuuuuuuuaaauuucuagcucuuaucaagaa

SEQ ID NO: 510541 - RNA, 64 nt, Homo Sapiens
cugccaggaacacccaaaaaaauucuccaaccaauuuuuuuaaaaugguacuaauaaaaaccua

SEQ ID NO: 510542 - RNA, 64 nt, Homo Sapiens
caaauuacuuacuguauuuuuaguguuguguuguuuuuuuuaaggaaaccagaacacuuguucc

SEQ ID NO: 510543 - RNA, 64 nt, Homo Sapiens
uuguuuugcugagagcauagauuucugugauuuuuuuuuuuaauccuugaaaugcuguuaguaa

SEQ ID NO: 510544 - RNA, 64 nt, Homo Sapiens
cuuugaaagcuuuguuuuguuuuuuuuuuuuuuuuuuuuuuacuauuggauuacuuuuuuuuuu

SEQ ID NO: 510545 - RNA, 64 nt, Homo Sapiens
uuauugucauuucaauaaaaagugaucacuguucuuuuuuuauuuguaaaguaaguuugguuaa

SEQ ID NO: 510546 - RNA, 64 nt, Homo Sapiens
uggggucaugucaaacccucaauaaacacucaaguuuuuuuaguccaaguguagcugagcaauu

SEQ ID NO: 510547 - RNA, 64 nt, Homo Sapiens
uuaauuucucauuaaacuucuaaagaaaauggacuuuuuuuauucauacuuuuuuguacaacau

SEQ ID NO: 510548 - RNA, 64 nt, Homo Sapiens
aaauuucaccaaguauggcuuguuuuucuuuuuuuuuuuuuaauuugccaagggcauaaauuau

SEQ ID NO: 510549 - RNA, 64 nt, Homo Sapiens
gaaguucaauauaagcuuuucuuucuuuuuuuucuuuuuuuagauuagauuugugugcaucagg

SEQ ID NO: 510550 - RNA, 64 nt, Homo Sapiens
ucguagaaauuggaaguuagaacaugcuucccauuuuuuuuaugccaacacuaaugguuuauau

SEQ ID NO: 510551 - RNA, 64 nt, Homo Sapiens
ugaacuggguugaaucucugcuaaccagcucagguuuuuuuauuuuucucucuuauauuuguag

SEQ ID NO: 510552 - RNA, 64 nt, Homo Sapiens
caaagaaauauuuuaaauaauuuaaauuuuuugguuuuuuuaaguaugugcugaaagccaaacu

SEQ ID NO: 510553 - RNA, 64 nt, Homo Sapiens
acaggcuuuuaguagaauuugaaaguuguuacauuuuuuuuaugacuucauagaaacuaaagca

SEQ ID NO: 510554 - RNA, 64 nt, Homo Sapiens
aacuuuaguuuugcuuuguuugcauguccacugguuuuuuuauuuugauauuugucuuuuuuua

SEQ ID NO: 510555 - RNA, 64 nt, Homo Sapiens
cauguccacugguuuuuuuauuuugauauuugucuuuuuuuaaauuuuacaguagucauugaaa

SEQ ID NO: 510556 - RNA, 64 nt, Homo Sapiens
guugugugauuuguguuauacugguuguaauuaauuuuuuuaauucaugaacuagcggaaaauu

SEQ ID NO: 510557 - RNA, 64 nt, Homo Sapiens
aacuugagggcaauacuaaacuuaaaaauaagaguuuuuuuauuacaaaauuauuuuuaugguc

SEQ ID NO: 510558 - RNA, 64 nt, Homo Sapiens
uguguguguguguguguguguguaugauguuuuguuuuuuuaaauguuuuaaaagcuuaauagg

SEQ ID NO: 510559 - RNA, 64 nt, Homo Sapiens
acugcauuggccaauggcuuugauacuucugcuauuuuuuuagacacaaacccauaaacuaacu

SEQ ID NO: 510560 - RNA, 64 nt, Homo Sapiens
acugggcaaaugguauuuguuuuuguuuuaauuuuuuuuuuaauagacggaagucuugcucugu

SEQ ID NO: 510561 - RNA, 64 nt, Homo Sapiens
ccuugcccagccuggaugccauccaaguuguauauuuuuuuaaucucucgacugaauggacuuu

SEQ ID NO: 510562 - RNA, 64 nt, Homo Sapiens
cgccaccguuaucggugucauucaccuuucguguuuuuuuuaauuuauccucuguugauuuuuu

SEQ ID NO: 510563 - RNA, 64 nt, Homo Sapiens
acaauuuguuaaccuuacguuuucugucuguauauuuuuuuaaaaaucugguaguuucuggaaa

SEQ ID NO: 510564 - RNA, 64 nt, Homo Sapiens
caauagaaguauuucugaacauaucaaauauaaauuuuuuuaaagaucuaacugugaaaacaua

SEQ ID NO: 510565 - RNA, 64 nt, Homo Sapiens
caggauauaacuagaaaaaggaugucuuuuuuuuuuuuuuuacucccccucuaaacacugcugc

SEQ ID NO: 510566 - RNA, 64 nt, Homo Sapiens
guuugaccacacaccgcccugauuugcuguuuucuuuuuuuagggagaagggcuuuucuuuagu

SEQ ID NO: 510567 - RNA, 64 nt, Homo Sapiens
ugcgugucuguuuccuucucuuucuccguauuuauuuuuuuauucuucggaggagguggacauu

SEQ ID NO: 510568 - RNA, 64 nt, Homo Sapiens
acuaucucuguaaagucucucucucucuuuuuuuuuuuuuuacuuaaucuagcuagaaucuauu

SEQ ID NO: 510569 - RNA, 64 nt, Homo Sapiens
gacaggaagauuuuaaucagcuuuacuaucuauguuuuuuuauggaaacuguguguauguauac

SEQ ID NO: 510570 - RNA, 64 nt, Homo Sapiens
cuccauuuacggccucuuucuauauuuacacuaauuuuuuuaucuuuauugcuaccagaaaaaa

SEQ ID NO: 510571 - RNA, 64 nt, Homo Sapiens
cccugauucccaucguucucaggcggauuuuauauuuuuuuaaagucuauuuuaaugauuggau

SEQ ID NO: 510572 - RNA, 64 nt, Homo Sapiens
agcaaaagagaagcugauagucuugaauauuuuauuuuuuuaaugaaaagaaaaaacaagaaag

SEQ ID NO: 510573 - RNA, 64 nt, Homo Sapiens
uguaauauagucgccauugaaaaguuaauuauccuuuuuuuagggauuuugaugucauuucuuu

SEQ ID NO: 510574 - RNA, 64 nt, Homo Sapiens
ccuuuuuuuagggauuuugaugucauuucuuuuuuuuuuuuaauaaaaagguugaacuguuuuu

SEQ ID NO: 510575 - RNA, 64 nt, Homo Sapiens
auaguggcauagaaaaaguauaaagcucaguuaguuuuuuuauuauuauuauuauuaaaaguua

SEQ ID NO: 510576 - RNA, 64 nt, Homo Sapiens
ggauuuuuuuccuguaacauaaaagauugugaacuuuuuuuaauuaaaaaauauuuccuagggc

SEQ ID NO: 510577 - RNA, 64 nt, Homo Sapiens
acaaagaaaaucaaaagcauuucuauauuuugucuuuuuuuaguucagacagcaaaggcaugua

SEQ ID NO: 510578 - RNA, 64 nt, Homo Sapiens
acagugaucaccaauacauguuuucaguuuuuuuuuuuuuuaaggucucuaucacuuuaaucug

SEQ ID NO: 510579 - RNA, 64 nt, Homo Sapiens
uauaauacacauaucuuagugguaaacagcuuuuuuuuuuuaaggucagauugccucagguuua

SEQ ID NO: 510580 - RNA, 64 nt, Homo Sapiens
caauugauguuuuacgugcaaacaaccugaaucuuuuuuuuauauaaauauauauuuuucaaau

SEQ ID NO: 510581 - RNA, 64 nt, Homo Sapiens
caaagucaauuuguaauauuuugcaacccuaggauuuuuuuaaauagaugcugcuugcuauguu

SEQ ID NO: 510582 - RNA, 64 nt, Homo Sapiens
gauuauuuucuuuaaaaucagcuauuacaggauauuuuuuuauuuuauacaugcuguuuuuuaa

SEQ ID NO: 510583 - RNA, 64 nt, Homo Sapiens
uuuaacuuuguauauuuguuaucuaucaggcuaauuuuuuuaugaaaagaauuuuacucuccug

SEQ ID NO: 510584 - RNA, 64 nt, Homo Sapiens
accauacagggaccugucccaaagaaaaaggcucuuuuuuuagccagcauauuuccccuucuac

SEQ ID NO: 510585 - RNA, 64 nt, Homo Sapiens
uaccauagaguaaugauguaacagugcaagauuuuuuuuuuaagugacauaauuguccaguuau

SEQ ID NO: 510586 - RNA, 64 nt, Homo Sapiens
uauuccaaugauacccaacaguuuauuuuuauuauuuuuuuaaacaaaauuucacaguucugua

SEQ ID NO: 510587 - RNA, 64 nt, Homo Sapiens
accagaauucccuuuggacauuuguguuuuuuuguuuuuuuauuuuguuuuguuuuuucuucuu

SEQ ID NO: 510588 - RNA, 64 nt, Homo Sapiens
cuaaaucucucugccuguuuggacuuuguaauuauuuuuuuagcaguaauuaaagaaaaaaguc

SEQ ID NO: 510589 - RNA, 64 nt, Homo Sapiens
uguuguuaaauuauguucuuaacuguaaccaguuuuuuuuuauuuaucucuuuaaucuuuuuuu

SEQ ID NO: 510590 - RNA, 64 nt, Homo Sapiens
uguaaccaguuuuuuuuuauuuaucucuuuaaucuuuuuuuauuauuaaaagcaaguuucuuug

SEQ ID NO: 510591 - RNA, 64 nt, Homo Sapiens
ugaggauugcuuuuuaaaaaagacagcaaacuuuuuuuuuuauuuaaaaaaagauauauuaaca

SEQ ID NO: 510592 - RNA, 64 nt, Homo Sapiens
auacaaggcccugauaaaauaacaucucucucucuuuuuuuaaauucagaaaaucuugagguua

SEQ ID NO: 510593 - RNA, 64 nt, Homo Sapiens
aaucgguagagaagagacagcaaaauauaauauauuuuuuuaccuuuaaaaagaaaaaaaaaau

SEQ ID NO: 510594 - RNA, 64 nt, Homo Sapiens
ucaugaacuagcggaaaauucugguuguaauuaauuuuuuuaauuuugaucuguguuuguuaua

SEQ ID NO: 510595 - RNA, 64 nt, Homo Sapiens
uugauauuagucuuuuuuaaugcauguccacuaauuuuuuuauuaacuuuaguuuugcuuuguu

SEQ ID NO: 510596 - RNA, 64 nt, Homo Sapiens
uaaaaauuuucaaaaaguuaucuguguuuuuguguuuuuuuaaacauaacugaagugaaaaaag

SEQ ID NO: 510597 - RNA, 64 nt, Homo Sapiens
cauaauauauauauauauauauguaaacaaaacuuuuuuuuauauggauugccaauuccacuug

SEQ ID NO: 510598 - RNA, 64 nt, Homo Sapiens
gaauaugauuugcaugucuuguuagcaggguguauuuuuuuagcugcuggauaaaugccuugaa

SEQ ID NO: 510599 - RNA, 64 nt, Homo Sapiens
aaagcauuaugcaaaaagucuuuugugagaguucuuuuuuuaagggcauguuugguaaaaaugu

SEQ ID NO: 510600 - RNA, 64 nt, Homo Sapiens
auuuaauuuaccugccuaaacuuuuuauaauuacuuuuuuuaucgcagaggaaagucuuucugc

SEQ ID NO: 510601 - RNA, 64 nt, Homo Sapiens
uuucauagauuauauuugaaccccaugcugccuauuuuuuuaaauuccuuccccaugcuguugu

SEQ ID NO: 510602 - RNA, 64 nt, Homo Sapiens
aacuuacuuaaauuuguguggcguaaauacuuauuuuuuuuaaauagcagagcaaaaaaauaua

SEQ ID NO: 510603 - RNA, 64 nt, Homo Sapiens
ugcuugaccaagugucuaaagaccaauuuuuguauuuuuuuaaaaggugugagccacugcagug

SEQ ID NO: 510604 - RNA, 64 nt, Homo Sapiens
ucccuuucuucuuccuuauaugucucucuuuuuuuuuuuuuacuauacauuuaaagcaccccaa

SEQ ID NO: 510605 - RNA, 64 nt, Homo Sapiens
agcauagaaauaaaaaccaaaagaagcuucauauuuuuuuuauaacaccccuucaguccacaca

SEQ ID NO: 510606 - RNA, 64 nt, Homo Sapiens
aauagacuuauuuuccuuugaagcauuuuagacuuuuuuuuauaggaagguuuaaggagaaucu

SEQ ID NO: 510607 - RNA, 64 nt, Homo Sapiens
cuccuacuucugcuaucuuuuugugguuccagauuuuuuuuaauaucaucugaaacuacuaacu

SEQ ID NO: 510608 - RNA, 64 nt, Homo Sapiens
gugccuuuuggguugguagacccucugacaauuuuuuuuuuaauugccuuccuaguacuuagcc

SEQ ID NO: 510609 - RNA, 64 nt, Homo Sapiens
guaaaaaauugcacugaacucuuaauuuauaggauuuuuuuaauuguuguguugauguuuccuu

SEQ ID NO: 510610 - RNA, 64 nt, Homo Sapiens
agauguaaacugugcuuaguuaguauuaaaaugauuuuuuuaaauuauuucauggucaagccug

SEQ ID NO: 510611 - RNA, 64 nt, Homo Sapiens
uuuaauauuaaaugugcagacuggcuuuuauuuauuuuuuuauuucuuugccugaaucagaacg

SEQ ID NO: 510612 - RNA, 64 nt, Homo Sapiens
agacaaggucuugcuauguuccccucuccaauuuuuuuuuuaagcuaaaucacuuaccucccac

SEQ ID NO: 510613 - RNA, 64 nt, Homo Sapiens
gaaauuguaaaauauccaucgcuucauguuguauuuuuuuuacuagugaucugugacagcagca

SEQ ID NO: 510614 - RNA, 64 nt, Homo Sapiens
aaaauuggcacuaauaagugggacauggcugauuuuuuuuuauacaguauuuaagauauagcaa

SEQ ID NO: 510615 - RNA, 64 nt, Homo Sapiens
cuuauaguaaggauacauucuccuugagaauuuuuuuuuuuaaggggggauuuuuuuuuucacc

SEQ ID NO: 510616 - RNA, 64 nt, Homo Sapiens
caacuuaauuggcuauuccacgcauucguguggauuuuuuuauugauuccugccccaaccaaac

SEQ ID NO: 510617 - RNA, 64 nt, Homo Sapiens
acaaaaugaaagcaaaauaugcguugcuauuucauuuuuuuaaguccucugugugacugauaga

SEQ ID NO: 510618 - RNA, 64 nt, Homo Sapiens
ucaugaacuagcagaaaauucugguuguaauuaauuuuuuuaauuuugaucuguguuuguuaua

SEQ ID NO: 510619 - RNA, 64 nt, Homo Sapiens
uuuuacaguagucaucgaaauuugauauuugucuuuuuuuuaaaauguccacuaauuuuuuuau

SEQ ID NO: 510620 - RNA, 64 nt, Homo Sapiens
uugauauuugucuuuuuuuuugcauguccacuaauuuuuuuauuaacuuuaguuuugcuuuguu

SEQ ID NO: 510621 - RNA, 64 nt, Homo Sapiens
cguuguauuuuaaaaacguuggcuucaguccacauuuuuuuauaaacuuuaaguucaaucuaaa

SEQ ID NO: 510622 - RNA, 64 nt, Homo Sapiens
ucgcaccuaaagaugauuacaggaucaguaguaauuuuuuuaguauguuuuaaggaugcuucua

SEQ ID NO: 510623 - RNA, 64 nt, Homo Sapiens
uuagaguucaauagcuguuuuuauuuccauauaauuuuuuuauuuuuuucaaaugaaauaccuu

SEQ ID NO: 510624 - RNA, 64 nt, Homo Sapiens
gcuuuaaaaaaauggcaaaacuggauaaccuaauuuuuuuuaauuuaguuccauuauaugaaca

SEQ ID NO: 510625 - RNA, 64 nt, Homo Sapiens
aaaaaucuuaaaacacuuuuaaauuuuguuuaaauuuuuuuaauaguuucuagauaagauaaac

SEQ ID NO: 510626 - RNA, 64 nt, Homo Sapiens
uacauuuauuuuuauagcaguuuaaacccgugguuuuuuuuaaaccccaaauucuguguuccug

SEQ ID NO: 510627 - RNA, 64 nt, Homo Sapiens
ugaaauguuccacuucuuguagggcagguguaauuuuuuuuacuaagugggguugcugggucau

SEQ ID NO: 510628 - RNA, 64 nt, Homo Sapiens
caaaaggccacagugaggccugagcacuugaagauuuuuuuauagugagucacucagggaacaa

SEQ ID NO: 510629 - RNA, 64 nt, Homo Sapiens
agagaacguagggcuguucaaagaucuauuuuuuuuuuuuuaagaagagaagccacauacuaua

SEQ ID NO: 510630 - RNA, 64 nt, Homo Sapiens
ugggagaagggugggcaguuucagcuuuugcuauuuuuuuuaaguggauuccuagagacuagcu

SEQ ID NO: 510631 - RNA, 64 nt, Homo Sapiens
gaauuuuuauucuuaaacauagguguguuggcucuuuuuuuaaaagaugcgcucuaccugaaaa

SEQ ID NO: 510632 - RNA, 64 nt, Homo Sapiens
ugguaaauaccaaguuugguaucucauagcuaucuuuuuuuaaagaaauuaaguucuugaaaau

SEQ ID NO: 510633 - RNA, 64 nt, Homo Sapiens
aauucaaccacagauuuauacaaggguuaaccauuuuuuuuaaguuugacuacauagucaaguc

SEQ ID NO: 510634 - RNA, 64 nt, Homo Sapiens
agcagcuuguaguaugcuuaagcuuuggggaauuuuuuuuuaaggggaucuaaaaaaauguuuu

SEQ ID NO: 510635 - RNA, 64 nt, Homo Sapiens
auuagauuauugaauuguaauguuuaucugcugcuuuuuuuaaauaaaauuugacugaaaaugu

SEQ ID NO: 510636 - RNA, 64 nt, Homo Sapiens
uauuuaggcuaaaucaguuuuauuuuucucugauuuuuuuuaauaccacagaaucaccugagug

SEQ ID NO: 510637 - RNA, 64 nt, Homo Sapiens
ucaaacucauggaaaauucccuccucuuccccccuuuuuuuaauuaaaagaagucacuuaggaa

SEQ ID NO: 510638 - RNA, 64 nt, Homo Sapiens
uuugaucuggccucuguccuucaucagcuuuuauuuuuuuuauuuuuauuuucugcuuuuguua

SEQ ID NO: 510639 - RNA, 64 nt, Homo Sapiens
gacaaacuuaaauguuggugcgugcuuuuuuuuuuuuuuuuacacugaauacuugcugugugca

SEQ ID NO: 510640 - RNA, 64 nt, Homo Sapiens
guuuacugaaucuuuaaaacuguguauuugaccuuuuuuuuacaacacuggugacagucauaug

SEQ ID NO: 510641 - RNA, 64 nt, Homo Sapiens
guuuaaugcugcuguuuuuaaaaaaaaaaaaaaguuuuuuuaaaaagccaaucuauguacuaaa

SEQ ID NO: 510642 - RNA, 64 nt, Homo Sapiens
agguucaucuguuguaguauguauugauacuuaauuuuuuuauugccgaauacuauuccauugc

SEQ ID NO: 510643 - RNA, 64 nt, Homo Sapiens
auuugcauuuccauaauaucuaauuagguugagcuuuuuuuaugugcuuauuggccauuuguuu

SEQ ID NO: 510644 - RNA, 64 nt, Homo Sapiens
uuguacugcagaauacaucuggcugugugauuuuuuuuuuuaagcaagauuuguuuuacuauaa

SEQ ID NO: 510645 - RNA, 64 nt, Homo Sapiens
caaguaccugucaguaauaagccuuuuuuuuuuuuuuuuuuaauuuaaauguuuguagcugcua

SEQ ID NO: 510646 - RNA, 64 nt, Homo Sapiens
uauuguucaaggagggugcaagaguggaaaccaauuuuuuuagucuuaaagauuguauuuucac

SEQ ID NO: 510647 - RNA, 64 nt, Homo Sapiens
uugaucugcugauaccagugagcuugguacuguauuuuuuuauaauauggaaauauaccagugu

SEQ ID NO: 510648 - RNA, 64 nt, Homo Sapiens
aaaaaaauggaaaaaaaaaacuacuaaguguguguuuuuuuaaaguggccugacacugguggca

SEQ ID NO: 510649 - RNA, 64 nt, Homo Sapiens
uuuuauuuucuuuuugguuuuuuaauuuuuuuaauuuuuuuauuuguaguuagaauacucaauu

SEQ ID NO: 510650 - RNA, 64 nt, Homo Sapiens
uuuuuuauuuuuuauuuucuuacucaauuuuuaauuuuuuuaauuuguugagcuguaguuagaa

SEQ ID NO: 510651 - RNA, 64 nt, Homo Sapiens
auuuuaagauuacaauuuuauguuuguaaaguuauuuuuuuaauaauggcuagucauaucugug

SEQ ID NO: 510652 - RNA, 64 nt, Homo Sapiens
uuccauaugggcuaaagaauuccaguuuuuuuuuuuuuuuuaauugucucuuucuguuucucuc

SEQ ID NO: 510653 - RNA, 64 nt, Homo Sapiens
guacucgaaaaaucaaaccuuauuuauauuucaguuuuuuuaugucuuagaacuauuuccaaaa

SEQ ID NO: 510654 - RNA, 64 nt, Homo Sapiens
agaaugaucuauggaagaaaagaaaucaagucaguuuuuuuaaaaaaaguaucuucauuuaaaa

SEQ ID NO: 510655 - RNA, 64 nt, Homo Sapiens
uucacggugaacagcacuuuuuuauacuguguauuuuuuuuaaaaauguuuccaagguugugug

SEQ ID NO: 510656 - RNA, 64 nt, Homo Sapiens
uauuuuucuaucucucacuugacuguugcuucucuuuuuuuagaagauuguuaaaagggugcaa

SEQ ID NO: 510657 - RNA, 64 nt, Homo Sapiens
guugcacuuguaguuucauuuauuuaucuguuuuuuuuuuuaaugaaaauaaaaccaggguuuc

SEQ ID NO: 510658 - RNA, 64 nt, Homo Sapiens
uuauuaugggacaaaggacaucuuucagggauuuuuuuuuuaaauuauuguuauucaauuugga

SEQ ID NO: 510659 - RNA, 64 nt, Homo Sapiens
cuaccaauugugccgagaaaaucauaggaaaguauuuuuuuaaggaugggaaaaaugcccuuaa

SEQ ID NO: 510660 - RNA, 64 nt, Homo Sapiens
uccuccguucccuaaaaagguuugucuuccuuuuuuuuuuuauuuuuauuuuucaaaucuauac

SEQ ID NO: 510661 - RNA, 64 nt, Homo Sapiens
aaccguuugagccuuauagaucauuuacauucaauuuuuuuaacucagcaagugagaacuuaca

SEQ ID NO: 510662 - RNA, 64 nt, Homo Sapiens
uuuuuaacucagcaagugagaacuuacaagaggguuuuuuuaaaauuuuuuuuucucuuaauga

SEQ ID NO: 510663 - RNA, 64 nt, Homo Sapiens
ccaggccucggucacaacggacgugacaugcugcuuuuuuuaauuuuauuuuuuuaugaaaaga

SEQ ID NO: 510664 - RNA, 64 nt, Homo Sapiens
caacggacgugacaugcugcuuuuuuuaauuuuauuuuuuuaugaaaagaaccagugucaaucc

SEQ ID NO: 510665 - RNA, 64 nt, Homo Sapiens
ggacuggggaagggaggggagacuaugugugagcuuuuuuuaaauagagggauugacucggauu

SEQ ID NO: 510666 - RNA, 64 nt, Homo Sapiens
uuggaaucguuucuuuuguuugucugauuuaugguuuuuuuaaguauaaacaaaaguuuuuuau

SEQ ID NO: 510667 - RNA, 64 nt, Homo Sapiens
uucacuuuaacgcuuaaugccuucaaaguuuugguuuuuuuaagaaaaaaaaauauauauauau

SEQ ID NO: 510668 - RNA, 64 nt, Homo Sapiens
uuuuuauuuggguagguuuugggguccaggccauuuuuuuuaccccuuggaggaaauaagauga

SEQ ID NO: 510669 - RNA, 64 nt, Homo Sapiens
caguuucuuugaacagcauauacucaggccaugcuuuuuuuauucauucugcauaugucucucu

SEQ ID NO: 510670 - RNA, 64 nt, Homo Sapiens
uuacuagucuuccuauagguuacuucaccuuuuuuuuuuuuaauaauuugauuugauacauaug

SEQ ID NO: 510671 - RNA, 64 nt, Homo Sapiens
gaaacauugucucuugaccuuuuuuuuuuuuuuuuuuuuuuaaagagacagagucucacucugu

SEQ ID NO: 510672 - RNA, 64 nt, Homo Sapiens
uuuacuuuuuaccucuuguguuuuaauuuuuuuuuuuuuuuacuuguugucauuuuuaaaauuu

SEQ ID NO: 510673 - RNA, 64 nt, Homo Sapiens
uuuuuuuuuuuuuuacuuuuugucauuuuuaaaauuuuuuuaaucuuuuuacugcgguuucugu

SEQ ID NO: 510674 - RNA, 64 nt, Homo Sapiens
uuucuuauuuuuagacacccagguccgcuugcacuuuuuuuaguuacaauaaaccggagagaaa

SEQ ID NO: 510675 - RNA, 64 nt, Homo Sapiens
gaaaauaauuguauacgugugguuuucaaaaaaauuuuuuuaaaugaucugagugccucaagau

SEQ ID NO: 510676 - RNA, 64 nt, Homo Sapiens
cuuuuuuugcauauguuuugccuuuggucucugguuuuuuuaaggaaaauuagcaaggaugcug

SEQ ID NO: 510677 - RNA, 64 nt, Homo Sapiens
gaaaauaaaaacauuaguuaccuaagcgaaauauuuuuuuuaagaaagccaccagcaaauugug

SEQ ID NO: 510678 - RNA, 64 nt, Homo Sapiens
uuggucaguacacaggucaguuaauggauauuuauuuuuuuacagauacacagaaguuauuuuu

SEQ ID NO: 510679 - RNA, 64 nt, Homo Sapiens
ggauauuuauuuuuuuacauauacacagaaguuauuuuuuuaauguuuacacccucccucauag

SEQ ID NO: 510680 - RNA, 64 nt, Homo Sapiens
gcuuucuacaaaaccaaauuucaguggugguggguuuuuuuaagcgcggaaacugcguaggaau

SEQ ID NO: 510681 - RNA, 64 nt, Homo Sapiens
uuugacaacugacuucuguugagacugucuccuuuuuuuuuaacugaccucccgugaagauaca

SEQ ID NO: 510682 - RNA, 64 nt, Homo Sapiens
ccauuuucucucuuucgguaguuuuguuuuguguuuuuuuuaaaucgcuuuuggguuuucugau

SEQ ID NO: 510683 - RNA, 64 nt, Homo Sapiens
uuuaauagagaugagguuuccacacccggcuaauuuuuuuuauuggauuacaggugugcaccac

SEQ ID NO: 510684 - RNA, 64 nt, Homo Sapiens
uuuauuuuuauuuuugagaccucucucuuuuuauuuuuuuuauucccugaguuuccuuuucugu

SEQ ID NO: 510685 - RNA, 64 nt, Homo Sapiens
cagaguuuugcucuuguugcggauuuuuuuucuuuuuuuuuagaaucacgagccacugguuauu

SEQ ID NO: 510686 - RNA, 64 nt, Homo Sapiens
cuauuaucauuauuuuucuucauggcuucaauuguuuuuuuaauaauuuacaacuauauauuaa

SEQ ID NO: 510687 - RNA, 64 nt, Homo Sapiens
aauauuuuuaguagagacagacgcccggcuaauuuuuuuuuaaagacuacaggugcaugccaac

SEQ ID NO: 510688 - RNA, 64 nt, Homo Sapiens
guguauuuugaacccauucucugguugagucaguuuuuuuuaugaaguuccuaguagacaccau

SEQ ID NO: 510689 - RNA, 64 nt, Homo Sapiens
gcucauaaacugccaagagcgauccagggacacuuuuuuuuaaacuggagcagaacuuuccagg

SEQ ID NO: 510690 - RNA, 64 nt, Homo Sapiens
uuuuguagagacgaggucuucuggcccggauaauuuuuuuuaauaccggcgugagccaccaugc

SEQ ID NO: 510691 - RNA, 64 nt, Homo Sapiens
uauuuauuuauuuauuuauucagcccggauauuuuuuuuuuaaucuggcaugagccacugugcc

SEQ ID NO: 510692 - RNA, 64 nt, Homo Sapiens
uaauggacguagacuugcugcuaugaaaacauauuuuuuuuauuuaugaagacuaaauuuauau

SEQ ID NO: 510693 - RNA, 64 nt, Homo Sapiens
uuaaaguuauuuauuaaguucuucauuggaaguuuuuuuuuauaucugguucacuaccaccauu

SEQ ID NO: 510694 - RNA, 64 nt, Homo Sapiens
cuuccuuuuacauccuggaacaacaauaaaaacauuuuuuuaaacuugucuacuguaagauacu

SEQ ID NO: 510695 - RNA, 64 nt, Homo Sapiens
aaauggggaggcuaggcucuccccagcccuaugguuuuuuuauuucauguaccccaggaaauac

SEQ ID NO: 510696 - RNA, 64 nt, Homo Sapiens
auaaauccuguuaauuuuuuuuuuuuuuuuuuuuuuuuuuuacugcauguuacauugaaauaaa

SEQ ID NO: 510697 - RNA, 64 nt, Homo Sapiens
ggaagugaagaaggugguauaaaugcugucaauuuuuuuuuaacccaaguauuuugguggggaa

SEQ ID NO: 510698 - RNA, 64 nt, Homo Sapiens
cuuuucccuguuguauaucuuaagcauuuggaauuuuuuuuaucuucugaaaucauauaaaaag

SEQ ID NO: 510699 - RNA, 64 nt, Homo Sapiens
uaaacauguuugguuuucuuacgauacagggccauuuuuuuaaaacucucaggacugaacagaa

SEQ ID NO: 510700 - RNA, 64 nt, Homo Sapiens
gagauugaguucugggaucaguuauaauauauauuuuuuuuagaaagagaaaaugagcugagag

SEQ ID NO: 510701 - RNA, 64 nt, Homo Sapiens
cagaagcuguucaguauuauauguguauaugcuauuuuuuuagcagccaugucugagcagaaug

SEQ ID NO: 510702 - RNA, 64 nt, Homo Sapiens
cugaaggaaagugacccuuuaagagaggaucaucuuuuuuuauauuuauuuucaccaaauaggg

SEQ ID NO: 510703 - RNA, 64 nt, Homo Sapiens
uuuuguagagacaaggucuuccaugcccagcuaauuuuuuuauuggaacuauaggcaugugcca

SEQ ID NO: 510704 - RNA, 64 nt, Homo Sapiens
ugagacaggguuggucucugugcuuuuuuuuuuuuuuuuuuaaugaucuggguuugggguuagu

SEQ ID NO: 510705 - RNA, 64 nt, Homo Sapiens
cugcagagcaaguuuucaaaacagcaaccaggaauuuuuuuaucuuuuacuugcuuucuuacug

SEQ ID NO: 510706 - RNA, 64 nt, Homo Sapiens
ugcuuucuuacugacagcaauucaucuguaauauuuuuuuuacuuaaaaucaaagaucagugag

SEQ ID NO: 510707 - RNA, 64 nt, Homo Sapiens
cuacugcauuuagggaguauguagauuugauuuuuuuuuuuaauuacauaauacugaaccacuu

SEQ ID NO: 510708 - RNA, 64 nt, Homo Sapiens
uguauuuuuguuguugggggacuuuauuauuuauuuuuuuuaaucacagcaacgaucacaaaug

SEQ ID NO: 510709 - RNA, 64 nt, Homo Sapiens
aagcauauaauaaaauaaucucuuuggguguuuguuuuuuuauaugagggcgguguguuguaug

SEQ ID NO: 510710 - RNA, 64 nt, Homo Sapiens
cgagauauaaauauuugaggcucuuugcaccuccuuuuuuuaguaucucauuuaucuuuauaua

SEQ ID NO: 510711 - RNA, 64 nt, Homo Sapiens
uugaaaucaucaauauucccugaccuuauuuaaauuuuuuuaugccuaauuacuauguaaagau

SEQ ID NO: 510712 - RNA, 64 nt, Homo Sapiens
ucauaugacaguauaagccaaacucaggagauuuuuuuuuuaaauagaaauugagguugagagg

SEQ ID NO: 510713 - RNA, 64 nt, Homo Sapiens
agaucccaaaauauaaugaagccgaaacauaguuuuuuuuuagcccucuuauaaaauagcuuuu

SEQ ID NO: 510714 - RNA, 64 nt, Homo Sapiens
cuuuaaaccccgcuccucaucccuuccccaguuuuuuuuuuauauuuguucucuuucauuaaac

SEQ ID NO: 510715 - RNA, 64 nt, Homo Sapiens
auuuauagcuuuagauaggguuuuuuuuuuuuuuuuuuuuuacugagaugauuuuuauuaauuu

SEQ ID NO: 510716 - RNA, 64 nt, Homo Sapiens
uguucauuccuuugugcagauuaguguuuguucguuuuuuuaacgaauauuuguaaaucuauuu

SEQ ID NO: 510717 - RNA, 64 nt, Homo Sapiens
ugccuuguuugccuucaacugaguacuucguauuuuuuuuuaaugaugaggaguacuuucugaa

SEQ ID NO: 510718 - RNA, 64 nt, Homo Sapiens
aaauuaccuucuuuggguggucucuuugguuucauuuuuuuaaauucuucuagaucucuggugu

SEQ ID NO: 510719 - RNA, 64 nt, Homo Sapiens
uuaugcaacguaagauguccuagaaaaaauuuuuuuuuuuuaaaccauagagcaaggguaaucc

SEQ ID NO: 510720 - RNA, 64 nt, Homo Sapiens
cugucaaugauuuuguauuaaauguauguuuuuuuuuuuuuaaauauugugcucuuucauuuaa

SEQ ID NO: 510721 - RNA, 64 nt, Homo Sapiens
aagaggaaaaauguguagaucaaacuaauaaauauuuuuuuauguuuuuuuuuaaaucgauguu

SEQ ID NO: 510722 - RNA, 64 nt, Homo Sapiens
ucgauguucaaacuaauaaauuaugugacugauuuuuuuuuaaacaugucaugaaggguuuuuu

SEQ ID NO: 510723 - RNA, 64 nt, Homo Sapiens
ugacugauuuuuuuuuaaauaugucaugaaggguuuuuuuuauggaggcguggagggaaaagac

SEQ ID NO: 510724 - RNA, 64 nt, Homo Sapiens
caggguuugcuuguugcugcuauaguuuuuaacuuuuuuuuauuuuaauaacugcaaaagacaa

SEQ ID NO: 510725 - RNA, 64 nt, Homo Sapiens
uucagucagguuuuuacucaaguaagugguugauuuuuuuuaagucaaacuacacugaaacuuu

SEQ ID NO: 510726 - RNA, 64 nt, Homo Sapiens
cuuuuauuucuaggcuguacagucugaugcaugauuuuuuuauaaauauuucauacucuuguga

SEQ ID NO: 510727 - RNA, 64 nt, Homo Sapiens
auuuuuuucucaucuaugcaauucccauaugguuuuuuuuuaaaucauauuuuauucauuuucu

SEQ ID NO: 510728 - RNA, 64 nt, Homo Sapiens
aauguggauacagucuugguucuccaucuguaauuuuuuuuaacaguuugcuauagcuuacugc

SEQ ID NO: 510729 - RNA, 64 nt, Homo Sapiens
cauacugauuauaaaagaagcagaaaaacauugauuuuuuuauaucuuucauaauauaauuuuc

SEQ ID NO: 510730 - RNA, 64 nt, Homo Sapiens
ccggccaaaaaaaaauguauuuauuaaaaaaaaauuuuuuuaacccgccgaauaauucccauaa

SEQ ID NO: 510731 - RNA, 64 nt, Homo Sapiens
uuuaauagaugaacacuacuuuuuuaauuuuuuauuuuuuuaacccuacccuuaacccaugaac

SEQ ID NO: 510732 - RNA, 64 nt, Homo Sapiens
agggucuuccucucucgcccuuuuauauuuuuaauuuuuuuaacuuuguuuucuauuuuuuuua

SEQ ID NO: 510733 - RNA, 64 nt, Homo Sapiens
uuauauuuuuaauuuuuuuauauuuguuuucuauuuuuuuuauuaucacagugguacugauuuu

SEQ ID NO: 510734 - RNA, 64 nt, Homo Sapiens
gaaccagacauuuuuauaaaaaagauauucucauuuuuuuuauucauuccauaccagugguagg

SEQ ID NO: 510735 - RNA, 64 nt, Homo Sapiens
agccaacuacugucauuaagguauucuuucaaauuuuuuuuaaaacucuaguuuguguuacgag

SEQ ID NO: 510736 - RNA, 64 nt, Homo Sapiens
auaacugaauuauuuuaucuauguacauaguuuuuuuuuuuacccacuacgugaucugauugag

SEQ ID NO: 510737 - RNA, 64 nt, Homo Sapiens
agugugugauguguguuuuggcguguuuuacuuguuuuuuuaagucuuuuggaggacguuaaag

SEQ ID NO: 510738 - RNA, 64 nt, Homo Sapiens
gcaaauccuguauauguaucuuaaguuuuuguuuuuuuuuuaaaagagguuuaggucaguguuu

SEQ ID NO: 510739 - RNA, 64 nt, Homo Sapiens
uguauuccucuucuucgugauaauauaaucucuauuuuuuuaggaaaacaaaaaugaaaaacua

SEQ ID NO: 510740 - RNA, 64 nt, Homo Sapiens
cauuugcauauacccacauggggacauaagcuaauuuuuuuacaggacacagaauucuguucaa

SEQ ID NO: 510741 - RNA, 64 nt, Homo Sapiens
aguguuugaacugcugauaauuuggauuuuuuuuuuuuuuuaacuuuggcacauugaucuaucu

SEQ ID NO: 510742 - RNA, 64 nt, Homo Sapiens
gugccccugaccauuaacgacuguuuuuuuuuuuuuuuuuuaaagaauggaguuguuggggcag

SEQ ID NO: 510743 - RNA, 64 nt, Homo Sapiens
acugacccccuuguuugaucaaauuuguguaaaauuuuuuuagaagagauggcuuauuaacagg

SEQ ID NO: 510744 - RNA, 64 nt, Homo Sapiens
uauuccaguuguaagaauagccuuaguguuuagauuuuuuuaugauagggaagaugcggccauc

SEQ ID NO: 510745 - RNA, 64 nt, Homo Sapiens
uuagagacagggucucacugauuuuaauuuuuuuuuuuuuuacugguauuaauuuauuuuuuua

SEQ ID NO: 510746 - RNA, 64 nt, Homo Sapiens
uuuaauuuuuuuuuuuuuuaaagguauuaauuuauuuuuuuaaugugugugugugugagagaga

SEQ ID NO: 510747 - RNA, 64 nt, Homo Sapiens
uuaauuuuauuuuuuauuuagaaacggcugccacuuuuuuuaaucaucaugagagugcugguca

SEQ ID NO: 510748 - RNA, 64 nt, Homo Sapiens
cccauaagcaguagacucccgucuguuauaaauuuuuuuuuaguuuuucucuucuuuuaaguca

SEQ ID NO: 510749 - RNA, 64 nt, Homo Sapiens
aaaaaaaagagaaaugaauacaaaugaauacuuuuuuuuuuaagaaaauauuuauuuuuuauac

SEQ ID NO: 510750 - RNA, 64 nt, Homo Sapiens
aagcacugcuaguuuacuuguuauuauuuaaacauuuuuuuaaaagaugucuccgggcccuuau

SEQ ID NO: 510751 - RNA, 64 nt, Homo Sapiens
gagaugagauuuuacuauguccucauuuuuuuucuuuuuuuauagauguuugccaccaugcccg

SEQ ID NO: 510752 - RNA, 64 nt, Homo Sapiens
auuaaacuaauugugagaugacuuuauaauccauuuuuuuuaagaagaguugcuguagcuuuua

SEQ ID NO: 510753 - RNA, 64 nt, Homo Sapiens
uuuccacuuucuucuuaacuaacuuugacaucuuuuuuuuuaaucugaaauauaugcauguaaa

SEQ ID NO: 510754 - RNA, 64 nt, Homo Sapiens
uuuuccccccaaccaucgugcuuuuuucuuuuuuuuuuuuuaauucgccuuuucuuuuuuuuuc

SEQ ID NO: 510755 - RNA, 64 nt, Homo Sapiens
uuuguauuaaaagcaugauaucuauuguuccagauuuuuuuaaguugaucaaaucuguacaguu

SEQ ID NO: 510756 - RNA, 64 nt, Homo Sapiens
uuuuacauuuuuugguguccuucguaggaaaacuuuuuuuuauuucugcacuaauuuaccuggu

SEQ ID NO: 510757 - RNA, 64 nt, Homo Sapiens
aauacaaaaacagaaaucugugcuucaauuuuauuuuuuuuaaggucucaaaucuaggcauuuu

SEQ ID NO: 510758 - RNA, 64 nt, Homo Sapiens
uuuaagaagaugaaauuacucuggauguuugguauuuuuuuacauuaaaacaaacuaaagcaaa

SEQ ID NO: 510759 - RNA, 64 nt, Homo Sapiens
aauuuggacagaaugaaaagcaugcuuuugauuuuuuuuuuaaucagugagagaagucaucauu

SEQ ID NO: 510760 - RNA, 64 nt, Homo Sapiens
uuguugcuacuuccuuuuguauuuucaucagguauuuuuuuaacuguaggguuuuuacuuuuuu

SEQ ID NO: 510761 - RNA, 64 nt, Homo Sapiens
guuuaaauaaguuaauacuuuaaaaauuuucagguuuuuuuaguauggugaauauugauagaua

SEQ ID NO: 510762 - RNA, 64 nt, Homo Sapiens
ggccuuuuuuuguuuguuucauucauuguuuuuuuuuuuuuaauuauuuuaaaugagauuuuug

SEQ ID NO: 510763 - RNA, 64 nt, Homo Sapiens
uuuuuuuuuuaauuauuuuaaaugagauuuuuguuuuuuuuaaaugcaauaucucuguauacag

SEQ ID NO: 510764 - RNA, 64 nt, Homo Sapiens
agguagcugaagaccuuuuagacaguuccaucuuuuuuuuuaaauuuuuucugccuauuuaaag

SEQ ID NO: 510765 - RNA, 64 nt, Homo Sapiens
agaguuggcuuuaaaauguuugcaaaugucuuuuuuuuuuuaauacuggaagaaaaaauauucu

SEQ ID NO: 510766 - RNA, 64 nt, Homo Sapiens
auuagagauugcugaacugcugcuaaagugauuuuuuuuuuauuugaccaaaaaaaaaaaggcc

SEQ ID NO: 510767 - RNA, 64 nt, Homo Sapiens
acugaaauaucaauggguuugcauaucuaggcccuuuuuuuagaccaaugccuaugccauccuc

SEQ ID NO: 510768 - RNA, 64 nt, Homo Sapiens
uaacagugaaucuccuaauuuuagcaucuuuuuuuuuuuuuacaaucauucagauugugaauuc

SEQ ID NO: 510769 - RNA, 64 nt, Homo Sapiens
cacuuauauaguuauuuucucuuuaaaaaaaaauuuuuuuuaauguauuagagaugaggucuca

SEQ ID NO: 510770 - RNA, 64 nt, Homo Sapiens
cuugauuuuucaggguauuagcuguauuauccauuuuuuuuacuguuauuuaauugaaaccaua

SEQ ID NO: 510771 - RNA, 64 nt, Homo Sapiens
uuuuaaaguuauaaacacguacuugugcgaauuauuuuuuuaaagugauuugccauuuuugaaa

SEQ ID NO: 510772 - RNA, 64 nt, Homo Sapiens
aauuacaggcaggugccaccaugcccgacuaauuuuuuuuuauuuuuaguagagacgggguuuc

SEQ ID NO: 510773 - RNA, 64 nt, Homo Sapiens
auauacauguugaaguaaugguaugcaguaagauuuuuuuuaauccuauuauguuuaguuaaga

SEQ ID NO: 510774 - RNA, 64 nt, Homo Sapiens
uugauuguguuccccucaagcaucauauuuuacauuuuuuuaucaucuuuuaaacagguucaug

SEQ ID NO: 510775 - RNA, 64 nt, Homo Sapiens
agguggaaaauuacacugugcuuaaugacugauuuuuuuuuaaacugcgagucccuuaagauca

SEQ ID NO: 510776 - RNA, 64 nt, Homo Sapiens
cuccuucauuuuuggacaacuacuguaaucauuuuuuuuuuaggaaaaauggaaggugccgggg

SEQ ID NO: 510777 - RNA, 64 nt, Homo Sapiens
uuuuguuugagcuuauaagaacauagacagcuuuuuuuuuuacuaguuuuaaaacccaucuucc

SEQ ID NO: 510778 - RNA, 64 nt, Homo Sapiens
uuagauuugauuucuucugucugcacaacucuucuuuuuuuaauuacaaugaaaaauuuugugu

SEQ ID NO: 510779 - RNA, 64 nt, Homo Sapiens
uuacuugcucuucuuaucccacucucuucugauuuuuuuuuacuuucugcuccuuacuucucug

SEQ ID NO: 510780 - RNA, 64 nt, Homo Sapiens
auuuauuuauuuaucuaucuauugaucuaucgauuuuuuuuaauuugauguuuaccuaagccuu

SEQ ID NO: 510781 - RNA, 64 nt, Homo Sapiens
uuggccugaugaccaauuuuaacuuagagcuuuuuuuuuuuaauuuugucugccccaaguuuug

SEQ ID NO: 510782 - RNA, 64 nt, Homo Sapiens
aguguugggguuugguuuuguuuuuugagucuuuuuuuuuuaagugaaauuuauugaggaaaaa

SEQ ID NO: 510783 - RNA, 64 nt, Homo Sapiens
cgugcauauuugcucaugucaaguuuuguauuauuuuuuuuauucucuuccacagcaguuacau

SEQ ID NO: 510784 - RNA, 64 nt, Homo Sapiens
uugccacugaggcaacccuaguccuuaaauuucuuuuuuuuaaagcaaguuuuacucugcaaug

SEQ ID NO: 510785 - RNA, 64 nt, Homo Sapiens
aaauggaaguaaauuuguuuauuauuauuuuucuuuuuuuuaacguaaaacaugugauuugcaa

SEQ ID NO: 510786 - RNA, 64 nt, Homo Sapiens
uugucauuuaauucuuaaacauauuuuugcuuaauuuuuuuaaacaugccaccauuuuuuccuu

SEQ ID NO: 510787 - RNA, 64 nt, Homo Sapiens
guuaauuuaguaaguuaugcuugggggguuuuuguuuuuuuagauauggaaaauaaccuugcuu

SEQ ID NO: 510788 - RNA, 64 nt, Homo Sapiens
ggacuacagauuauuuuuaaauaccuuuuuuuuuuuuuuuuaaaagacuuguauuggaaauuac

SEQ ID NO: 510789 - RNA, 64 nt, Homo Sapiens
agggaacuuuaguuaauuaaaugccuacacaauuuuuuuuuaaauuugcuaagccgcuucauuc

SEQ ID NO: 510790 - RNA, 64 nt, Homo Sapiens
cuucaguuuuacugcauuuuacauuuacgaauuauuuuuuuaaaguuuuaacaccaacacugua

SEQ ID NO: 510791 - RNA, 64 nt, Homo Sapiens
gggaacaugugaaugaauacaguaaaguauuggauuuuuuuaaauccacugacaacgaaaguaa

SEQ ID NO: 510792 - RNA, 64 nt, Homo Sapiens
ucaucugggggaaaaccugugguauccugguuauuuuuuuuaagcuacuuaaacaugaauucau

SEQ ID NO: 510793 - RNA, 64 nt, Homo Sapiens
aaaggaauagcgauagauuuuuuaaaugucuucauuuuuuuaagcugcuauuuuuugcaaguau

SEQ ID NO: 510794 - RNA, 64 nt, Homo Sapiens
uucaaauuuuuggauuuacaauuaguaaaucaauuuuuuuuaaucuuguuuacuuuuucugagg

SEQ ID NO: 510795 - RNA, 64 nt, Homo Sapiens
uuucuaucaacuaauaguauguggaaaguaauaauuuuuuuaauucaguuguacuuaauauuua

SEQ ID NO: 510796 - RNA, 64 nt, Homo Sapiens
cuuucuuccccucaguuguacuaacauuuuuaaguuuuuuuaaagagaaaaugaugagaauuag

SEQ ID NO: 510797 - RNA, 64 nt, Homo Sapiens
uccucccuuuccuauagagaaauguaauuuauauuuuuuuuagauuuucuuauguuguguuacu

SEQ ID NO: 510798 - RNA, 64 nt, Homo Sapiens
guuucagguucuaagugaaggucuuuguuuuuguuuuuuuuaaugcuuuuccaaagaggcugau

SEQ ID NO: 510799 - RNA, 64 nt, Homo Sapiens
uuagauugugaggcaauuauuucagaguuuguuuuuuuuuuagucuuacauuuuuuuaaauugu

SEQ ID NO: 510800 - RNA, 64 nt, Homo Sapiens
uuguuucagaguuuguuuuuccaguuuccuuacauuuuuuuaaacaucaucauguucuuuuacc

SEQ ID NO: 510801 - RNA, 64 nt, Homo Sapiens
uagggcauaccauuucuuccaguuuuacuuuuuuuuuuuuuaaaaaaugccaaucuuccauauu

SEQ ID NO: 510802 - RNA, 64 nt, Homo Sapiens
aaucaaugacuuaacagaacagaaagaucuuuuauuuuuuuagguaauggauuguuaaaaucau

SEQ ID NO: 510803 - RNA, 64 nt, Homo Sapiens
aauuuagagcaauucuauauuggauaaagguaauuuuuuuuagcauagcauauuaguaaacauc

SEQ ID NO: 510804 - RNA, 64 nt, Homo Sapiens
ucauagcauauuaguaaacacacauuagguuuaauuuuuuuacauguaguuucaauuuaauaau

SEQ ID NO: 510805 - RNA, 64 nt, Homo Sapiens
aaaauuuguauuguuaaagucaguuuugauguuauuuuuuuaauuugaauacagauuugcugaa

SEQ ID NO: 510806 - RNA, 64 nt, Homo Sapiens
uucuuguuuguuuauuuuggauauagauguauauuuuuuuuaaucuuguuucuugcucauauau

SEQ ID NO: 510807 - RNA, 64 nt, Homo Sapiens
uuuauuuugguagcuagguuacauuuuuaaacuuuuuuuuuaauacugcacccgaccgauacuc

SEQ ID NO: 510808 - RNA, 64 nt, Homo Sapiens
acagagucuugcucugucaccuuuauuuuuuuucuuuuuuuaaguucagcaauacugauauuca

SEQ ID NO: 510809 - RNA, 64 nt, Homo Sapiens
auguuucuuuccuguagauuucuagagauuuugauuuuuuuauaauucaucaugauuuaaauuu

SEQ ID NO: 510810 - RNA, 64 nt, Homo Sapiens
ucguguugcauuugauuccuaaacuuugauuuccuuuuuuuaaauuacugaguagaaauugacu

SEQ ID NO: 510811 - RNA, 64 nt, Homo Sapiens
accaggcagguuagcuagccgguuuagggguguuuuuuuuuaaauuaucacauguucacacuug

SEQ ID NO: 510812 - RNA, 64 nt, Homo Sapiens
uuauuauuaagacagaauguggaggugauuuucuuuuuuuuaaaugccuuaucuggagagacgu

SEQ ID NO: 510813 - RNA, 64 nt, Homo Sapiens
uuuuuauuuauuauuaagaccagucacugagacuuuuuuuuaaguagcuaugucuauuuuauau

SEQ ID NO: 510814 - RNA, 64 nt, Homo Sapiens
aaaccuaauagaaguagggugaaucauagggguuuuuuuuuaaagguugugguccagacaccaa

SEQ ID NO: 510815 - RNA, 64 nt, Homo Sapiens
gcuagaugacuuugaaaugcaaauaagugacuuauuuuuuuaaagauaaccucuuuuagagaac

SEQ ID NO: 510816 - RNA, 64 nt, Homo Sapiens
uauuaauagcccauauacaaugguuccaaaauaauuuuuuuaaaggccaugaugauuacauuug

SEQ ID NO: 510817 - RNA, 64 nt, Homo Sapiens; identical to SEQ ID NO: 243333

SEQ ID NO: 510818 - RNA, 64 nt, Homo Sapiens; identical to SEQ ID NO: 243334

SEQ ID NO: 510819 - RNA, 64 nt, Homo Sapiens; identical to SEQ ID NO: 243335

SEQ ID NO: 510820 - RNA, 64 nt, Homo Sapiens; identical to SEQ ID NO: 243336

SEQ ID NO: 510821 - RNA, 64 nt, Homo Sapiens; identical to SEQ ID NO: 243337

SEQ ID NO: 510822 - RNA, 64 nt, Homo Sapiens; identical to SEQ ID NO: 243338

SEQ ID NO: 510823 - RNA, 64 nt, Homo Sapiens; identical to SEQ ID NO: 243339

SEQ ID NO: 510824 - RNA, 64 nt, Homo Sapiens; identical to SEQ ID NO: 243340

SEQ ID NO: 510825 - RNA, 64 nt, Homo Sapiens; identical to SEQ ID NO: 243341

SEQ ID NO: 510826 - RNA, 64 nt, Homo Sapiens; identical to SEQ ID NO: 243342

SEQ ID NO: 510827 - RNA, 64 nt, Homo Sapiens; identical to SEQ ID NO: 243343

SEQ ID NO: 510828 - RNA, 64 nt, Homo Sapiens; identical to SEQ ID NO: 243344

SEQ ID NO: 510829 - RNA, 64 nt, Homo Sapiens; identical to SEQ ID NO: 175633

SEQ ID NO: 510830 - RNA, 64 nt, Homo Sapiens; identical to SEQ ID NO: 175634

SEQ ID NO: 510831 - RNA, 64 nt, Homo Sapiens; identical to SEQ ID NO: 175635

SEQ ID NO: 510832 - RNA, 64 nt, Homo Sapiens; identical to SEQ ID NO: 175636

SEQ ID NO: 510833 - RNA, 64 nt, Homo Sapiens; identical to SEQ ID NO: 175637

SEQ ID NO: 510834 - RNA, 64 nt, Homo Sapiens; identical to SEQ ID NO: 175638

SEQ ID NO: 510835 - RNA, 64 nt, Homo Sapiens; identical to SEQ ID NO: 175639

SEQ ID NO: 510836 - RNA, 64 nt, Homo Sapiens; identical to SEQ ID NO: 175640

SEQ ID NO: 510837 - RNA, 64 nt, Homo Sapiens; identical to SEQ ID NO: 175641

SEQ ID NO: 510838 - RNA, 64 nt, Homo Sapiens; identical to SEQ ID NO: 175642

SEQ ID NO: 510839 - RNA, 64 nt, Homo Sapiens; identical to SEQ ID NO: 175643

SEQ ID NO: 510840 - RNA, 64 nt, Homo Sapiens; identical to SEQ ID NO: 175644

SEQ ID NO: 510841 - RNA, 64 nt, Homo Sapiens; identical to SEQ ID NO: 175645

SEQ ID NO: 510842 - RNA, 64 nt, Homo Sapiens; identical to SEQ ID NO: 175646

SEQ ID NO: 510843 - RNA, 64 nt, Homo Sapiens; identical to SEQ ID NO: 175647

SEQ ID NO: 510844 - RNA, 64 nt, Homo Sapiens; identical to SEQ ID NO: 175648

SEQ ID NO: 510845 - RNA, 64 nt, Homo Sapiens; identical to SEQ ID NO: 175649

SEQ ID NO: 510846 - RNA, 64 nt, Homo Sapiens; identical to SEQ ID NO: 175650

SEQ ID NO: 510847 - RNA, 64 nt, Homo Sapiens; identical to SEQ ID NO: 175651

SEQ ID NO: 510848 - RNA, 64 nt, Homo Sapiens; identical to SEQ ID NO: 175652

SEQ ID NO: 510849 - RNA, 64 nt, Homo Sapiens; identical to SEQ ID NO: 175653

SEQ ID NO: 510850 - RNA, 64 nt, Homo Sapiens; identical to SEQ ID NO: 175654

SEQ ID NO: 510851 - RNA, 64 nt, Homo Sapiens; identical to SEQ ID NO: 175655

SEQ ID NO: 510852 - RNA, 64 nt, Homo Sapiens; identical to SEQ ID NO: 175656

SEQ ID NO: 510853 - RNA, 64 nt, Homo Sapiens; identical to SEQ ID NO: 175657

SEQ ID NO: 510854 - RNA, 64 nt, Homo Sapiens; identical to SEQ ID NO: 175658

SEQ ID NO: 510855 - RNA, 64 nt, Homo Sapiens; identical to SEQ ID NO: 175659

SEQ ID NO: 510856 - RNA, 64 nt, Homo Sapiens; identical to SEQ ID NO: 175660

SEQ ID NO: 510857 - RNA, 64 nt, Homo Sapiens; identical to SEQ ID NO: 175661

SEQ ID NO: 510858 - RNA, 64 nt, Homo Sapiens; identical to SEQ ID NO: 175662

SEQ ID NO: 510859 - RNA, 64 nt, Homo Sapiens; identical to SEQ ID NO: 175663

SEQ ID NO: 510860 - RNA, 64 nt, Homo Sapiens; identical to SEQ ID NO: 175664

SEQ ID NO: 510861 - RNA, 64 nt, Homo Sapiens; identical to SEQ ID NO: 175665

SEQ ID NO: 510862 - RNA, 64 nt, Homo Sapiens; identical to SEQ ID NO: 175666

SEQ ID NO: 510863 - RNA, 64 nt, Homo Sapiens; identical to SEQ ID NO: 175667

SEQ ID NO: 510864 - RNA, 64 nt, Homo Sapiens; identical to SEQ ID NO: 175668

SEQ ID NO: 510865 - RNA, 64 nt, Homo Sapiens; identical to SEQ ID NO: 175669

SEQ ID NO: 510866 - RNA, 64 nt, Homo Sapiens; identical to SEQ ID NO: 175670

SEQ ID NO: 510867 - RNA, 64 nt, Homo Sapiens; identical to SEQ ID NO: 175671

SEQ ID NO: 510868 - RNA, 64 nt, Homo Sapiens; identical to SEQ ID NO: 175672

SEQ ID NO: 510869 - RNA, 64 nt, Homo Sapiens; identical to SEQ ID NO: 175673

SEQ ID NO: 510870 - RNA, 64 nt, Homo Sapiens; identical to SEQ ID NO: 175674

SEQ ID NO: 510871 - RNA, 64 nt, Homo Sapiens; identical to SEQ ID NO: 175675

SEQ ID NO: 510872 - RNA, 64 nt, Homo Sapiens; identical to SEQ ID NO: 175676

SEQ ID NO: 510873 - RNA, 64 nt, Homo Sapiens; identical to SEQ ID NO: 175677

SEQ ID NO: 510874 - RNA, 64 nt, Homo Sapiens; identical to SEQ ID NO: 175678

SEQ ID NO: 510875 - RNA, 64 nt, Homo Sapiens; identical to SEQ ID NO: 175679

SEQ ID NO: 510876 - RNA, 64 nt, Homo Sapiens; identical to SEQ ID NO: 175680

SEQ ID NO: 510877 - RNA, 64 nt, Homo Sapiens; identical to SEQ ID NO: 175681

SEQ ID NO: 510878 - RNA, 64 nt, Homo Sapiens; identical to SEQ ID NO: 175682

SEQ ID NO: 510879 - RNA, 64 nt, Homo Sapiens; identical to SEQ ID NO: 175683

SEQ ID NO: 510880 - RNA, 64 nt, Homo Sapiens; identical to SEQ ID NO: 175684

SEQ ID NO: 510881 - RNA, 64 nt, Homo Sapiens; identical to SEQ ID NO: 175685

SEQ ID NO: 510882 - RNA, 64 nt, Homo Sapiens; identical to SEQ ID NO: 175686

SEQ ID NO: 510883 - RNA, 64 nt, Homo Sapiens; identical to SEQ ID NO: 175687

SEQ ID NO: 510884 - RNA, 64 nt, Homo Sapiens; identical to SEQ ID NO: 175688

SEQ ID NO: 510885 - RNA, 64 nt, Homo Sapiens; identical to SEQ ID NO: 175689

SEQ ID NO: 510886 - RNA, 64 nt, Homo Sapiens; identical to SEQ ID NO: 175690

SEQ ID NO: 510887 - RNA, 64 nt, Homo Sapiens; identical to SEQ ID NO: 175691

SEQ ID NO: 510888 - RNA, 64 nt, Homo Sapiens; identical to SEQ ID NO: 175692

SEQ ID NO: 510889 - RNA, 64 nt, Homo Sapiens; identical to SEQ ID NO: 175693

SEQ ID NO: 510890 - RNA, 64 nt, Homo Sapiens; identical to SEQ ID NO: 175694

SEQ ID NO: 510891 - RNA, 64 nt, Homo Sapiens; identical to SEQ ID NO: 175695

SEQ ID NO: 510892 - RNA, 64 nt, Homo Sapiens; identical to SEQ ID NO: 175696

SEQ ID NO: 510893 - RNA, 64 nt, Homo Sapiens; identical to SEQ ID NO: 175697

SEQ ID NO: 510894 - RNA, 64 nt, Homo Sapiens; identical to SEQ ID NO: 175698

SEQ ID NO: 510895 - RNA, 64 nt, Homo Sapiens; identical to SEQ ID NO: 175699

SEQ ID NO: 510896 - RNA, 64 nt, Homo Sapiens; identical to SEQ ID NO: 175700

SEQ ID NO: 510897 - RNA, 64 nt, Homo Sapiens; identical to SEQ ID NO: 175701

SEQ ID NO: 510898 - RNA, 64 nt, Homo Sapiens; identical to SEQ ID NO: 175702

SEQ ID NO: 510899 - RNA, 64 nt, Homo Sapiens; identical to SEQ ID NO: 175703

SEQ ID NO: 510900 - RNA, 64 nt, Homo Sapiens; identical to SEQ ID NO: 175704

SEQ ID NO: 510901 - RNA, 64 nt, Homo Sapiens; identical to SEQ ID NO: 175705

SEQ ID NO: 510902 - RNA, 64 nt, Homo Sapiens; identical to SEQ ID NO: 175706

SEQ ID NO: 510903 - RNA, 64 nt, Homo Sapiens; identical to SEQ ID NO: 175707

SEQ ID NO: 510904 - RNA, 64 nt, Homo Sapiens; identical to SEQ ID NO: 175708

SEQ ID NO: 510905 - RNA, 64 nt, Homo Sapiens; identical to SEQ ID NO: 175709

SEQ ID NO: 510906 - RNA, 64 nt, Homo Sapiens; identical to SEQ ID NO: 175710

SEQ ID NO: 510907 - RNA, 64 nt, Homo Sapiens; identical to SEQ ID NO: 175711

SEQ ID NO: 510908 - RNA, 64 nt, Homo Sapiens; identical to SEQ ID NO: 175712

SEQ ID NO: 510909 - RNA, 64 nt, Homo Sapiens; identical to SEQ ID NO: 175713

SEQ ID NO: 510910 - RNA, 64 nt, Homo Sapiens; identical to SEQ ID NO: 175714

SEQ ID NO: 510911 - RNA, 64 nt, Homo Sapiens; identical to SEQ ID NO: 175715

SEQ ID NO: 510912 - RNA, 64 nt, Homo Sapiens; identical to SEQ ID NO: 175716

SEQ ID NO: 510913 - RNA, 64 nt, Homo Sapiens; identical to SEQ ID NO: 175717

SEQ ID NO: 510914 - RNA, 64 nt, Homo Sapiens; identical to SEQ ID NO: 175718

SEQ ID NO: 510915 - RNA, 64 nt, Homo Sapiens; identical to SEQ ID NO: 175719

SEQ ID NO: 510916 - RNA, 64 nt, Homo Sapiens; identical to SEQ ID NO: 175720

SEQ ID NO: 510917 - RNA, 64 nt, Homo Sapiens; identical to SEQ ID NO: 175721

SEQ ID NO: 510918 - RNA, 64 nt, Homo Sapiens; identical to SEQ ID NO: 175722

SEQ ID NO: 510919 - RNA, 64 nt, Homo Sapiens; identical to SEQ ID NO: 175723

SEQ ID NO: 510920 - RNA, 64 nt, Homo Sapiens; identical to SEQ ID NO: 175724

SEQ ID NO: 510921 - RNA, 64 nt, Homo Sapiens; identical to SEQ ID NO: 175725

SEQ ID NO: 510922 - RNA, 64 nt, Homo Sapiens; identical to SEQ ID NO: 175726

SEQ ID NO: 510923 - RNA, 64 nt, Homo Sapiens; identical to SEQ ID NO: 175727

SEQ ID NO: 510924 - RNA, 64 nt, Homo Sapiens
gauggggagggagugggccuggaucugggaccucccuccagaauuuccuccagaugggggcagu

SEQ ID NO: 510925 - RNA, 64 nt, Homo Sapiens
gugggccuggaucugggaccucccuccagaauuuccuccagaugggggcagugcccagggaggg

SEQ ID NO: 510926 - RNA, 57 nt, Homo Sapiens
agagugaguccaaggugugaccagcuuccuccagaccccuguggcagaccgggggcc

SEQ ID NO: 510927 - RNA, 64 nt, Homo Sapiens
caccccugugcaaauuuuaaaaaggaacccuuuuccuccagacagauacagccccaaaccaggg

SEQ ID NO: 510928 - RNA, 64 nt, Homo Sapiens
ccugaguuucuuggcugcaugaguaaggcucuccccuccagagcagugcauguggaaaguauca

SEQ ID NO: 510929 - RNA, 64 nt, Homo Sapiens
ucccacccugacagcccaacuucaaagagaaaccccuccagaacugcuuuccuagauccacacu

SEQ ID NO: 510930 - RNA, 64 nt, Homo Sapiens
aagcagauuaaccccaggcagaccgauaaaaagaccuccagauaggcagacagacagauggacc

SEQ ID NO: 510931 - RNA, 64 nt, Homo Sapiens
cuugauggauggaccccagcuagucagacaugauccuccagauugacagacaagucccccaaau

SEQ ID NO: 510932 - RNA, 64 nt, Homo Sapiens
aagcucugcuucacccuggaugaccacucuccugccuccagagacugccuguauuggucccuuc

SEQ ID NO: 510933 - RNA, 64 nt, Homo Sapiens
uugaaugguuccuuguucuuucccuuccucuuggccuccagauugaaagccaguggcuccuuuc

SEQ ID NO: 510934 - RNA, 64 nt, Homo Sapiens
cauacuggaagccaccucuguucuuggaagacccccuccagaagaugacccuuaagugccaccc

SEQ ID NO: 510935 - RNA, 64 nt, Homo Sapiens
ggugggugccuggguugagagccucuucucacugccuccagagaauaccauucccauuuucuca

SEQ ID NO: 510936 - RNA, 64 nt, Homo Sapiens
ucuuugugcauaggcacaaggcuccugugaguggccuccagaugugcccacagaccugucgggu

SEQ ID NO: 510937 - RNA, 64 nt, Homo Sapiens
ggaagcauggguuugcccacucccggcccauaccccuccagacagccuggugccaacaggggca

SEQ ID NO: 510938 - RNA, 64 nt, Homo Sapiens
uguccuuucaaggggaaaaugugaagcugaacccccuccagacacccagaauguagcaucugag

SEQ ID NO: 510939 - RNA, 64 nt, Homo Sapiens
ccacagcugcuggccaggguagacuuggagcuguccuccagaggggucacguguaggagugaga

SEQ ID NO: 510940 - RNA, 64 nt, Homo Sapiens
gaggcguccugucuucacgggggggucccgguggccuccagacguagccauuuccugacaucaa

SEQ ID NO: 510941 - RNA, 64 nt, Homo Sapiens
aaguaaacuggaaaugagacauugacgugcugcuccuccagaggucugcacacuccacuucaca

SEQ ID NO: 510942 - RNA, 64 nt, Homo Sapiens
cagccagccccgucaggggcuaggcugguccucaccuccagagcguucauauaccugccugaga

SEQ ID NO: 510943 - RNA, 64 nt, Homo Sapiens
gguaaugguggcagaacccacugcgcagcaggcaccuccagaaauagagcgagagcagagcaaa

SEQ ID NO: 510944 - RNA, 64 nt, Homo Sapiens
agagugaccguggcacuuggguguacagguaauuccuccagagcuguuugcuggcuucaggagu

SEQ ID NO: 510945 - RNA, 64 nt, Homo Sapiens
auugcauucugccguguuuauagguguucacuuuccuccagagcugauuaacuacugacaugac

SEQ ID NO: 510946 - RNA, 64 nt, Homo Sapiens
acuacugcuucugucccugcuggcagccucugucccuccagaacggcuaaccagagcacacugu

SEQ ID NO: 510947 - RNA, 64 nt, Homo Sapiens
uggccugcccguacuccuccacccagaugagggcccuccagagccugcaggcaucuguggggaa

SEQ ID NO: 510948 - RNA, 64 nt, Homo Sapiens
aacugcagugaccaguggguguggcuggguccagccuccagaucuggcccgcacgaugccuugc

SEQ ID NO: 510949 - RNA, 64 nt, Homo Sapiens
agucacucugaaagggaguuguggagaggagacgccuccagacucucagaaguuuugaggacug

SEQ ID NO: 510950 - RNA, 64 nt, Homo Sapiens
ugugagaaauaaauguguuucuuggaccucccagccuccagaacaugucugcuggcaccuugau

SEQ ID NO: 510951 - RNA, 64 nt, Homo Sapiens
cauuuuguuugcuuugacccagggcuacacugaaccuccagaauucauacaacauacuuaaugc

SEQ ID NO: 510952 - RNA, 64 nt, Homo Sapiens
cggccuuucugguuaaccccuaggugugcccagcccuccagaccagucaccaggagaugagggu

SEQ ID NO: 510953 - RNA, 64 nt, Homo Sapiens
agcaggcacaggugggcauugugccuccaaguuaccuccagaucuggagguuuuuaagcaguac

SEQ ID NO: 510954 - RNA, 64 nt, Homo Sapiens
uagcugaggccaacgcaggcccucccccacagagccuccagagcgacugcaaggcccaccugcc

SEQ ID NO: 510955 - RNA, 64 nt, Homo Sapiens
cccgccaggugggcaugguccagacaggcagaccccuccagagggagcucgagagccagacggc

SEQ ID NO: 510956 - RNA, 64 nt, Homo Sapiens
uugaguacuuauggcccugaaagcggccacggugccuccagauggcagguuugcaauccaagca

SEQ ID NO: 510957 - RNA, 64 nt, Homo Sapiens
agauauaccugauauauuccaccaggauauccucccuccagauauacuugguucucuccaccag

SEQ ID NO: 510958 - RNA, 64 nt, Homo Sapiens
acaaggcgucgaggaauuggaaagauuugcacacccuccagaaaggagagacgcaaucuccccu

SEQ ID NO: 510959 - RNA, 64 nt, Homo Sapiens
gcgguuccucuccacgcaucucgaggcggcguuaccuccagauuccguagaguuagagucacau

SEQ ID NO: 510960 - RNA, 64 nt, Homo Sapiens
cagcgcucugcucauguccguccaucgcagugauccuccagagaugugugcuggucuaaauuaa

SEQ ID NO: 510961 - RNA, 64 nt, Homo Sapiens
augcgccccuccugguuccccccugccccaccguccuccagagaaaccgagaaugaggagcccu

SEQ ID NO: 510962 - RNA, 64 nt, Homo Sapiens
ucacacugccgaggaggccugguccaggcagaccccuccagaccggggagcauccuaaaaaugg

SEQ ID NO: 510963 - RNA, 64 nt, Homo Sapiens
aucaaagaagggaagaaacuggccagcugcagguccuccagaaaaauggagccugucucaggaa

SEQ ID NO: 510964 - RNA, 64 nt, Homo Sapiens
agaggaacgguguuauggacugaauguucauguuccuccagaauucauaugcugaagccucugu

SEQ ID NO: 510965 - RNA, 64 nt, Homo Sapiens
gcgucugcuggcaccuugaucuugaacuucccagccuccagaacugugagaaagaaaucucuau

SEQ ID NO: 510966 - RNA, 64 nt, Homo Sapiens
aacccagggaggaagacuguguaaucauccccauccuccagagauacuaaggugcuaggaauuc

SEQ ID NO: 510967 - RNA, 64 nt, Homo Sapiens
ggaacucaagcugguuuuaaaauggcgccugcucccuccagaaucuugaccucaucucccgagc

SEQ ID NO: 510968 - RNA, 64 nt, Homo Sapiens
cuuuggccaccaguucuucggccagcaccucugcccuccagaaccugcagccuggaggggugag

SEQ ID NO: 510969 - RNA, 64 nt, Homo Sapiens
cucuucucccgucugcccugcggguugcccgccuccuccagagacuugcccaagggcccaucac

SEQ ID NO: 510970 - RNA, 64 nt, Homo Sapiens
cucucaaugaagagucaccucuaaaagcucccagccuccagagguuacauugcaaagccuuacu

SEQ ID NO: 510971 - RNA, 64 nt, Homo Sapiens
auuggaaucacuguuugccacagaggccuagggaccuccagaccaaagccccagguugagagaa

SEQ ID NO: 510972 - RNA, 64 nt, Homo Sapiens
agcuggaaaaguuuauggagucggagacuuccugccuccagacggggccggggcaagcacuuca

SEQ ID NO: 510973 - RNA, 64 nt, Homo Sapiens
aaccgugagaaccaggcauuguggaaaccauugcccuccagaacuagcggacgggggucccgag

SEQ ID NO: 510974 - RNA, 64 nt, Homo Sapiens
agcugggauuacaggcguacuucuccugccucagccuccagaaucaucuccuggauucaaacaa

SEQ ID NO: 510975 - RNA, 64 nt, Homo Sapiens
aaagagaaagacuucggacacaggcucuaugugaccuccagagcgcagcagaucuuggaugguc

SEQ ID NO: 510976 - RNA, 64 nt, Homo Sapiens
ccugcaugcacuggcugaaguccugcuggcaucaccuccagagccccagugccucaccuccaga

SEQ ID NO: 510977 - RNA, 64 nt, Homo Sapiens
cugcuggcaucaccuccagacacccagugccucaccuccagaucucuccgggugucugagaaac

SEQ ID NO: 510978 - RNA, 64 nt, Homo Sapiens
ugcuauccugggagaucuaccugaaggagaacuaccuccagaaccgacaguuccagcaaaagca

SEQ ID NO: 510979 - RNA, 64 nt, Homo Sapiens
ggcgcaucccacucuaugcgaaccacaagacccuccuccagaaggcagccgcugaguucggggc

SEQ ID NO: 510980 - RNA, 64 nt, Homo Sapiens
auguggaaacaaagcaggaccagcaggcacagcaccuccagaacagugccccggaugaccagag

SEQ ID NO: 510981 - RNA, 64 nt, Homo Sapiens
uugcccagaggcaacccuugccagucuguuuaucccuccagauacagucucugauaguaaacuu

SEQ ID NO: 510982 - RNA, 64 nt, Homo Sapiens
auucugucuggggacgaaggguuggacgggaugaccuccagaagucccuucaauuucuaguacc

SEQ ID NO: 510983 - RNA, 64 nt, Homo Sapiens
agaugaccugccccaaguggugagcaagcaccaaccuccagacucagcagagugaggggguaaa

SEQ ID NO: 510984 - RNA, 64 nt, Homo Sapiens
ccgucacuagcccaaguguuuuguauuacucagacaccaucaugaaauaauucugugaggucau

SEQ ID NO: 510985 - RNA, 64 nt, Homo Sapiens
aggcucagacaggcaucaacaaaccuauucaccccaccaucauccugaucuaaccauuccccag

SEQ ID NO: 510986 - RNA, 64 nt, Homo Sapiens
aguaggagaccucaguguuuggccugggaucugacaccaucaccccccacuaaagggcucccca

SEQ ID NO: 510987 - RNA, 53 nt, Homo Sapiens
caccacacccugcccacuccggccaccaucaccccuugguccacucugaguga

SEQ ID NO: 510988 - RNA, 64 nt, Homo Sapiens
gcccagaauuucugaaaacgccugauggacgcagcaccaucaaaugagaauuucuggacugugu

SEQ ID NO: 510989 - RNA, 64 nt, Homo Sapiens
gacucaacccuaaggcccuuuaaggagccauagucaccaucaaauguacauccacacagcaccc

SEQ ID NO: 510990 - RNA, 64 nt, Homo Sapiens
ccccuguuccccugaucuagugcucaggacccuucaccaucaggaauuccuuccugucaucuaa

SEQ ID NO: 510991 - RNA, 64 nt, Homo Sapiens
cuuagugugccccagcagucuggcugcguccagccaccaucacccggaaggaugcccacaaggc

SEQ ID NO: 510992 - RNA, 64 nt, Homo Sapiens
aaaaaaaaaauuuugcagcgauaaaacaaaaacccaccaucacagugcaaguguuuuauaaaaa

SEQ ID NO: 510993 - RNA, 64 nt, Homo Sapiens
ugaccugggggucaaggcagggagguugugaggccaccaucaccuacuucaccuaccucauagg

SEQ ID NO: 510994 - RNA, 64 nt, Homo Sapiens
uggugaucaucgacgaggcgcacaaccugaucgacaccaucacgggcaugcacagcguggaggu

SEQ ID NO: 510995 - RNA, 64 nt, Homo Sapiens
gagaaaggggcuguggucagcugggaucuucugccaccaucagggacaaacgggggcaggagga

SEQ ID NO: 510996 - RNA, 64 nt, Homo Sapiens
agagacagaacaguucugucuagauucaugugaccaccaucacaaugcaauauuaucacaugug

SEQ ID NO: 510997 - RNA, 64 nt, Homo Sapiens
gcacguuggagcuuucuugccauccuaccaacagcaccaucaaggggacgugccuggccuaagg

SEQ ID NO: 510998 - RNA, 64 nt, Homo Sapiens
gagcgagaggucagggcacgucuggacaaacagacaccaucaguaaugucgcugcauucagcug

SEQ ID NO: 510999 - RNA, 64 nt, Homo Sapiens
cgcgcgcucucccagaaacacggaacgaccguaccaccaucaggaggcgcucaggcauaccgug

SEQ ID NO: 511000 - RNA, 64 nt, Homo Sapiens
ccaucuuugagguggacccccgagggugccccuucaccaucaagcucagcgcccggaaguaagu

SEQ ID NO: 511001 - RNA, 64 nt, Homo Sapiens
ccaggugcaaacucuacagcggcucugcagacugcaccaucauugugaguggggccuacaggcg

SEQ ID NO: 511002 - RNA, 64 nt, Homo Sapiens
aggcaugucugcagagccuggguggaggcaccaucaccaucaccagccccuccaucugcccugg

SEQ ID NO: 511003 - RNA, 64 nt, Homo Sapiens
aucaccaggcaugucugcagcccugggguggaggcaccaucaccaguagaagccccuccaucug

SEQ ID NO: 511004 - RNA, 64 nt, Homo Sapiens
agguuaacuucccgccgucgccaugccucaugcucaccaucaugaaaguggagcaguggcauuu

SEQ ID NO: 511005 - RNA, 64 nt, Homo Sapiens
ccuggcuaauuuuguauuuuggauugcaggcaugcaccaucacacucagccucccgaguagcug

SEQ ID NO: 511006 - RNA, 64 nt, Homo Sapiens
ugcauugcaucaucaccaugguaacaguucccaucaccaucaccaccaccaccaccaucaccac

SEQ ID NO: 511007 - RNA, 64 nt, Homo Sapiens
ugguaacaguucccaucaccaucaccaccaccaccaccaucaccaccaccauggacaacaagcc

SEQ ID NO: 511008 - RNA, 64 nt, Homo Sapiens; identical to SEQ ID NO: 277176

SEQ ID NO: 511009 - RNA, 64 nt, Homo Sapiens; identical to SEQ ID NO: 277177

SEQ ID NO: 511010 - RNA, 64 nt, Homo Sapiens; identical to SEQ ID NO: 277178

SEQ ID NO: 511011 - RNA, 64 nt, Homo Sapiens; identical to SEQ ID NO: 277179

SEQ ID NO: 511012 - RNA, 64 nt, Homo Sapiens; identical to SEQ ID NO: 277180

SEQ ID NO: 511013 - RNA, 64 nt, Homo Sapiens; identical to SEQ ID NO: 277181

SEQ ID NO: 511014 - RNA, 64 nt, Homo Sapiens; identical to SEQ ID NO: 277182

SEQ ID NO: 511015 - RNA, 64 nt, Homo Sapiens; identical to SEQ ID NO: 277183

SEQ ID NO: 511016 - RNA, 64 nt, Homo Sapiens; identical to SEQ ID NO: 277184

SEQ ID NO: 511017 - RNA, 64 nt, Homo Sapiens; identical to SEQ ID NO: 277185

SEQ ID NO: 511018 - RNA, 52 nt, Homo Sapiens; identical to SEQ ID NO: 277186

SEQ ID NO: 511019 - RNA, 64 nt, Homo Sapiens; identical to SEQ ID NO: 277187

SEQ ID NO: 511020 - RNA, 64 nt, Homo Sapiens; identical to SEQ ID NO: 277188

SEQ ID NO: 511021 - RNA, 64 nt, Homo Sapiens; identical to SEQ ID NO: 277189

SEQ ID NO: 511022 - RNA, 64 nt, Homo Sapiens; identical to SEQ ID NO: 277190

SEQ ID NO: 511023 - RNA, 64 nt, Homo Sapiens; identical to SEQ ID NO: 277191

SEQ ID NO: 511024 - RNA, 64 nt, Homo Sapiens; identical to SEQ ID NO: 277192

SEQ ID NO: 511025 - RNA, 64 nt, Homo Sapiens; identical to SEQ ID NO: 277193

SEQ ID NO: 511026 - RNA, 64 nt, Homo Sapiens; identical to SEQ ID NO: 277194

SEQ ID NO: 511027 - RNA, 64 nt, Homo Sapiens; identical to SEQ ID NO: 277195

SEQ ID NO: 511028 - RNA, 64 nt, Homo Sapiens; identical to SEQ ID NO: 277196

SEQ ID NO: 511029 - RNA, 64 nt, Homo Sapiens; identical to SEQ ID NO: 277197

SEQ ID NO: 511030 - RNA, 64 nt, Homo Sapiens; identical to SEQ ID NO: 277198

SEQ ID NO: 511031 - RNA, 64 nt, Homo Sapiens; identical to SEQ ID NO: 277199

SEQ ID NO: 511032 - RNA, 64 nt, Homo Sapiens; identical to SEQ ID NO: 53544

SEQ ID NO: 511033 - RNA, 64 nt, Homo Sapiens; identical to SEQ ID NO: 53545

SEQ ID NO: 511034 - RNA, 64 nt, Homo Sapiens; identical to SEQ ID NO: 53546

SEQ ID NO: 511035 - RNA, 64 nt, Homo Sapiens; identical to SEQ ID NO: 53547

SEQ ID NO: 511036 - RNA, 64 nt, Homo Sapiens; identical to SEQ ID NO: 53548

SEQ ID NO: 511037 - RNA, 64 nt, Homo Sapiens; identical to SEQ ID NO: 53549

SEQ ID NO: 511038 - RNA, 64 nt, Homo Sapiens; identical to SEQ ID NO: 53550

SEQ ID NO: 511039 - RNA, 64 nt, Homo Sapiens; identical to SEQ ID NO: 53551

SEQ ID NO: 511040 - RNA, 64 nt, Homo Sapiens; identical to SEQ ID NO: 53552

SEQ ID NO: 511041 - RNA, 64 nt, Homo Sapiens; identical to SEQ ID NO: 53553

SEQ ID NO: 511042 - RNA, 64 nt, Homo Sapiens; identical to SEQ ID NO: 53554

SEQ ID NO: 511043 - RNA, 64 nt, Homo Sapiens; identical to SEQ ID NO: 53555

SEQ ID NO: 511044 - RNA, 64 nt, Homo Sapiens; identical to SEQ ID NO: 53556

SEQ ID NO: 511045 - RNA, 64 nt, Homo Sapiens; identical to SEQ ID NO: 53557

SEQ ID NO: 511046 - RNA, 64 nt, Homo Sapiens; identical to SEQ ID NO: 53558

SEQ ID NO: 511047 - RNA, 64 nt, Homo Sapiens; identical to SEQ ID NO: 53559

SEQ ID NO: 511048 - RNA, 64 nt, Homo Sapiens; identical to SEQ ID NO: 53560

SEQ ID NO: 511049 - RNA, 64 nt, Homo Sapiens; identical to SEQ ID NO: 53561

SEQ ID NO: 511050 - RNA, 64 nt, Homo Sapiens; identical to SEQ ID NO: 53562

SEQ ID NO: 511051 - RNA, 64 nt, Homo Sapiens; identical to SEQ ID NO: 53563

SEQ ID NO: 511052 - RNA, 64 nt, Homo Sapiens; identical to SEQ ID NO: 53564

SEQ ID NO: 511053 - RNA, 64 nt, Homo Sapiens; identical to SEQ ID NO: 53565

SEQ ID NO: 511054 - RNA, 64 nt, Homo Sapiens; identical to SEQ ID NO: 53566

SEQ ID NO: 511055 - RNA, 64 nt, Homo Sapiens; identical to SEQ ID NO: 53567

SEQ ID NO: 511056 - RNA, 64 nt, Homo Sapiens; identical to SEQ ID NO: 53568

SEQ ID NO: 511057 - RNA, 64 nt, Homo Sapiens; identical to SEQ ID NO: 53569

SEQ ID NO: 511058 - RNA, 64 nt, Homo Sapiens; identical to SEQ ID NO: 53570

SEQ ID NO: 511059 - RNA, 64 nt, Homo Sapiens; identical to SEQ ID NO: 53571

SEQ ID NO: 511060 - RNA, 64 nt, Homo Sapiens; identical to SEQ ID NO: 53572

SEQ ID NO: 511061 - RNA, 64 nt, Homo Sapiens; identical to SEQ ID NO: 53573

SEQ ID NO: 511062 - RNA, 64 nt, Homo Sapiens; identical to SEQ ID NO: 53574

SEQ ID NO: 511063 - RNA, 64 nt, Homo Sapiens; identical to SEQ ID NO: 53575

SEQ ID NO: 511064 - RNA, 64 nt, Homo Sapiens; identical to SEQ ID NO: 53576

SEQ ID NO: 511065 - RNA, 64 nt, Homo Sapiens; identical to SEQ ID NO: 53577

SEQ ID NO: 511066 - RNA, 64 nt, Homo Sapiens; identical to SEQ ID NO: 53578

SEQ ID NO: 511067 - RNA, 64 nt, Homo Sapiens; identical to SEQ ID NO: 53579

SEQ ID NO: 511068 - RNA, 64 nt, Homo Sapiens; identical to SEQ ID NO: 53580

SEQ ID NO: 511069 - RNA, 64 nt, Homo Sapiens; identical to SEQ ID NO: 53580

SEQ ID NO: 511070 - RNA, 64 nt, Homo Sapiens; identical to SEQ ID NO: 53582

SEQ ID NO: 511071 - RNA, 64 nt, Homo Sapiens; identical to SEQ ID NO: 53583

SEQ ID NO: 511072 - RNA, 64 nt, Homo Sapiens; identical to SEQ ID NO: 53584

SEQ ID NO: 511073 - RNA, 64 nt, Homo Sapiens; identical to SEQ ID NO: 53585

SEQ ID NO: 511074 - RNA, 64 nt, Homo Sapiens; identical to SEQ ID NO: 53586

SEQ ID NO: 511075 - RNA, 64 nt, Homo Sapiens
aacauaauuguuguagcauaauauuaauagugcaaaaguacauauaagucauuuugaugaaaaa

SEQ ID NO: 511076 - RNA, 64 nt, Homo Sapiens
uuuguaucucauuaauuuuaucaaaaugaaacuaaaaguacauauguauuauacacuugaacau

SEQ ID NO: 511077 - RNA, 64 nt, Homo Sapiens
gguauuugaauuuuaaauuaaagcaaaguaaauaaaaguacaaagcauauuuuaguuaguacua

SEQ ID NO: 511078 - RNA, 64 nt, Homo Sapiens
aauuuuuuaaaugaaagaaguuguaaggauauaaaaaguacaguguuagaugugcacaaggaaa

SEQ ID NO: 511079 - RNA, 64 nt, Homo Sapiens
uuauaaaccauuuacuauggaguaacauaaaauaaaaguacauuuaugcccuauguaacagcag

SEQ ID NO: 511080 - RNA, 64 nt, Homo Sapiens
aguccaagucuaaaacuuuaaggggaaauaaauuaaaguacacacauuucuuaauacacuagaa

SEQ ID NO: 511081 - RNA, 64 nt, Homo Sapiens
uguuaaugcaacauaguacaaauuuggaauggguaaaguacaaaauauugauuucaagucuccu

SEQ ID NO: 511082 - RNA, 64 nt, Homo Sapiens
uuuuuuacauuuuagaggaauuaaucaggaauacaaaguacagaucuucagagacaaauguuac

SEQ ID NO: 511083 - RNA, 64 nt, Homo Sapiens
cuggggaaacaacauuuauagcauaguuguagacaaaguacauugugugcauaauagcuacagu

SEQ ID NO: 511084 - RNA, 64 nt, Homo Sapiens
uaacgcaaccaagugugcuaauauugaaaauugaaaaguacaacaauaauauaugccuuguaua

SEQ ID NO: 511085 - RNA, 64 nt, Homo Sapiens
auuugaauuaucagcaaagacucuuuugcuugccaaaguacagaacuccaaggugauguuguac

SEQ ID NO: 511086 - RNA, 64 nt, Homo Sapiens
gugaguucuguuuauuuuuucagcauaucaggaaaaaguacacaaaauaacuagcaauuaauca

SEQ ID NO: 511087 - RNA, 64 nt, Homo Sapiens
cauuuaagcccuaaguuauaaaauauauuuccugaaaguacauuuuaaauaauauaauaaaagu

SEQ ID NO: 511088 - RNA, 64 nt, Homo Sapiens
uuauuuaaaauauuuaaaaagaccuauauaaaucaaaguacacauauauacuucacaaagagau

SEQ ID NO: 511089 - RNA, 64 nt, Homo Sapiens
gguaauuugggcacauucaggcacuugcaaagcaaaaguacauuauauuucaaauggauuguau

SEQ ID NO: 511090 - RNA, 64 nt, Homo Sapiens
uuaauuuuauauuuaugagggggcccuucacuaaaaaguacauguaaaaguacauuugaugaca

SEQ ID NO: 511091 - RNA, 64 nt, Homo Sapiens
uuaugagggggcccuucacuaaaaaguacauguaaaaguacauuugaugacaauagcugcuuag

SEQ ID NO: 511092 - RNA, 64 nt, Homo Sapiens
uuucuuuuaagcagacccauaccuuuccagggucaaaguacagaauagaauacauugauacaaa

SEQ ID NO: 511093 - RNA, 64 nt, Homo Sapiens
cagggucaaaguacagaauagaauacauugauacaaaguacagaaaaauacuuugauuuuuauc

SEQ ID NO: 511094 - RNA, 64 nt, Homo Sapiens
uaaaguucaaggacuaaccuuuucuucuuauuauaaaguacauugauacugauagaaaaaguga

SEQ ID NO: 511095 - RNA, 64 nt, Homo Sapiens
guguuuauuuuacaaaagagaguguucuuucaguaaaguacaaaaacggaaaggaaagaacacu

SEQ ID NO: 511096 - RNA, 64 nt, Homo Sapiens
gggcaacagaacaagacuccaucucaaaaaaaaaaaaguacaucauaaaaguacaucauaugug

SEQ ID NO: 511097 - RNA, 64 nt, Homo Sapiens
agacuccaucucaaaaaaaaaaaaguacaucauaaaaguacaucauaugugaacaugcaaaagc

SEQ ID NO: 511098 - RNA, 64 nt, Homo Sapiens
uuggcccagucaggugcugccagguuuagauaggaaaguacaugucccauuuucaugggugccc

SEQ ID NO: 511099 - RNA, 64 nt, Homo Sapiens
cgucaucacaugagacacugacucugugacgacaaaaguacaaacagucugaggcuaagaaagg

SEQ ID NO: 511100 - RNA, 64 nt, Homo Sapiens
cauuauuuccaccauaaaguggacuguguaaguaaaaguacaaauguuuuagaaacaugagucc

SEQ ID NO: 511101 - RNA, 64 nt, Homo Sapiens
uacacuaauagucugucucaacaacauauaaaugaaaguacaccuacuuuuaaccucuauuggu

SEQ ID NO: 511102 - RNA, 64 nt, Homo Sapiens
aacauaacaaaacaguuauauagacugcuuuagcaaaguacacaauaauggcuuauaaauggug

SEQ ID NO: 511103 - RNA, 64 nt, Homo Sapiens
caucugucaguuauagacaaagauaauaauucacaaaguacaugcuaucagaaugaacuuuggu

SEQ ID NO: 511104 - RNA, 64 nt, Homo Sapiens
ggagaauacccauuuucauuaaacgauggacuccaaaguacaaggugagagcauugggaguagg

SEQ ID NO: 511105 - RNA, 64 nt, Homo Sapiens
aauacaguaaacugaaagaguaaaguuuuagagaaaaguacagugauuuuagauaacagauuuu

SEQ ID NO: 511106 - RNA, 64 nt, Homo Sapiens
uuuuaaauuguuuucagcucuguuaaaugugauaaaaguacauauccauuuucucucuuguaag

SEQ ID NO: 511107 - RNA, 64 nt, Homo Sapiens
agugaaauauuugaguuguuuaauucauuagcauaaaguacaauauuuucuuaguauuacaaaa

SEQ ID NO: 511108 - RNA, 64 nt, Homo Sapiens
ugugaugugcagaacauauuuauuuaaaaaaaaaaaaguacagaagacuccgucucaaaaaaua

SEQ ID NO: 511109 - RNA, 64 nt, Homo Sapiens
uguggccgggcacaguggcuaagcuguacccuuaaaaguacagaucaaauuccuauguacugua

SEQ ID NO: 511110 - RNA, 64 nt, Homo Sapiens
aaaggauucacucuggagagucaaaaaaaaaaaaaaaguacaugcgacagagccagacccuguc

SEQ ID NO: 511111 - RNA, 64 nt, Homo Sapiens
aggcugggcacaguggcucaauuuugguaacuuaaaaguacaugauguagggaagccuucaguc

SEQ ID NO: 511112 - RNA, 64 nt, Homo Sapiens
uugauacugucuuagaagaauaaaguagugaugaaaaguacaugcuccauuggaucuuuuacuu

SEQ ID NO: 511113 - RNA, 64 nt, Homo Sapiens
gggcacauauacgugacagagauugacuaaauaaaaaguacaaacaagaagggcacuaaacuca

SEQ ID NO: 511114 - RNA, 64 nt, Homo Sapiens
aguaauaugugaauaucauauuuuugaaagguaaaaaguacauuuguauauuacauauauggac

SEQ ID NO: 511115 - RNA, 64 nt, Homo Sapiens
uacauauauggacauaacuugugaaggaugaaagaaaguacagccucucgguggugggauuaug

SEQ ID NO: 511116 - RNA, 59 nt, Homo Sapiens; identical to SEQ ID NO: 109599

SEQ ID NO: 511117 - RNA, 59 nt, Homo Sapiens; identical to SEQ ID NO: 109600

SEQ ID NO: 511118 - RNA, 59 nt, Homo Sapiens; identical to SEQ ID NO: 109601

SEQ ID NO: 511119 - RNA, 59 nt, Homo Sapiens; identical to SEQ ID NO: 109602

SEQ ID NO: 511120 - RNA, 59 nt, Homo Sapiens; identical to SEQ ID NO: 109603

SEQ ID NO: 511121 - RNA, 59 nt, Homo Sapiens; identical to SEQ ID NO: 109604

SEQ ID NO: 511122 - RNA, 59 nt, Homo Sapiens; identical to SEQ ID NO: 109605

SEQ ID NO: 511123 - RNA, 59 nt, Homo Sapiens; identical to SEQ ID NO: 109606

SEQ ID NO: 511124 - RNA, 59 nt, Homo Sapiens; identical to SEQ ID NO: 109607

SEQ ID NO: 511125 - RNA, 59 nt, Homo Sapiens; identical to SEQ ID NO: 109608

SEQ ID NO: 511126 - RNA, 59 nt, Homo Sapiens; identical to SEQ ID NO: 109609

SEQ ID NO: 511127 - RNA, 59 nt, Homo Sapiens; identical to SEQ ID NO: 109610

SEQ ID NO: 511128 - RNA, 59 nt, Homo Sapiens; identical to SEQ ID NO: 109611

SEQ ID NO: 511129 - RNA, 59 nt, Homo Sapiens; identical to SEQ ID NO: 109612

SEQ ID NO: 511130 - RNA, 59 nt, Homo Sapiens; identical to SEQ ID NO: 109613

SEQ ID NO: 511131 - RNA, 59 nt, Homo Sapiens; identical to SEQ ID NO: 109614

SEQ ID NO: 511132 - RNA, 59 nt, Homo Sapiens; identical to SEQ ID NO: 109615

SEQ ID NO: 511133 - RNA, 59 nt, Homo Sapiens; identical to SEQ ID NO: 109616

SEQ ID NO: 511134 - RNA, 59 nt, Homo Sapiens; identical to SEQ ID NO: 109617

SEQ ID NO: 511135 - RNA, 59 nt, Homo Sapiens; identical to SEQ ID NO: 109618

SEQ ID NO: 511136 - RNA, 59 nt, Homo Sapiens; identical to SEQ ID NO: 109619

SEQ ID NO: 511137 - RNA, 59 nt, Homo Sapiens; identical to SEQ ID NO: 109620

SEQ ID NO: 511138 - RNA, 59 nt, Homo Sapiens; identical to SEQ ID NO: 109621

SEQ ID NO: 511139 - RNA, 59 nt, Homo Sapiens; identical to SEQ ID NO: 109622

SEQ ID NO: 511140 - RNA, 59 nt, Homo Sapiens; identical to SEQ ID NO: 109623

SEQ ID NO: 511141 - RNA, 64 nt, Homo Sapiens; identical to SEQ ID NO: 418667

SEQ ID NO: 511142 - RNA, 64 nt, Homo Sapiens; identical to SEQ ID NO: 418668

SEQ ID NO: 511143 - RNA, 64 nt, Homo Sapiens; identical to SEQ ID NO: 418669

SEQ ID NO: 511144 - RNA, 64 nt, Homo Sapiens; identical to SEQ ID NO: 418670

SEQ ID NO: 511145 - RNA, 64 nt, Homo Sapiens; identical to SEQ ID NO: 418671

SEQ ID NO: 511146 - RNA, 64 nt, Homo Sapiens; identical to SEQ ID NO: 418672

SEQ ID NO: 511147 - RNA, 64 nt, Homo Sapiens; identical to SEQ ID NO: 418673

SEQ ID NO: 511148 - RNA, 64 nt, Homo Sapiens; identical to SEQ ID NO: 418674

SEQ ID NO: 511149 - RNA, 64 nt, Homo Sapiens; identical to SEQ ID NO: 418675

SEQ ID NO: 511150 - RNA, 64 nt, Homo Sapiens; identical to SEQ ID NO: 418676

SEQ ID NO: 511151 - RNA, 64 nt, Homo Sapiens; identical to SEQ ID NO: 418677

SEQ ID NO: 511152 - RNA, 64 nt, Homo Sapiens; identical to SEQ ID NO: 418678

SEQ ID NO: 511153 - RNA, 64 nt, Homo Sapiens; identical to SEQ ID NO: 418679

SEQ ID NO: 511154 - RNA, 64 nt, Homo Sapiens; identical to SEQ ID NO: 418680

SEQ ID NO: 511155 - RNA, 64 nt, Homo Sapiens; identical to SEQ ID NO: 418681

SEQ ID NO: 511156 - RNA, 64 nt, Homo Sapiens; identical to SEQ ID NO: 418682

SEQ ID NO: 511157 - RNA, 64 nt, Homo Sapiens; identical to SEQ ID NO: 418683

SEQ ID NO: 511158 - RNA, 64 nt, Homo Sapiens; identical to SEQ ID NO: 418684

SEQ ID NO: 511159 - RNA, 64 nt, Homo Sapiens; identical to SEQ ID NO: 418685

SEQ ID NO: 511160 - RNA, 64 nt, Homo Sapiens; identical to SEQ ID NO: 418686

SEQ ID NO: 511161 - RNA, 64 nt, Homo Sapiens; identical to SEQ ID NO: 418687

SEQ ID NO: 511162 - RNA, 64 nt, Homo Sapiens; identical to SEQ ID NO: 418688

SEQ ID NO: 511163 - RNA, 64 nt, Homo Sapiens; identical to SEQ ID NO: 418689

SEQ ID NO: 511164 - RNA, 64 nt, Homo Sapiens; identical to SEQ ID NO: 418690

SEQ ID NO: 511165 - RNA, 64 nt, Homo Sapiens; identical to SEQ ID NO: 115828

SEQ ID NO: 511166 - RNA, 64 nt, Homo Sapiens; identical to SEQ ID NO: 115829

SEQ ID NO: 511167 - RNA, 64 nt, Homo Sapiens; identical to SEQ ID NO: 115830

SEQ ID NO: 511168 - RNA, 64 nt, Homo Sapiens; identical to SEQ ID NO: 115831

SEQ ID NO: 511169 - RNA, 64 nt, Homo Sapiens; identical to SEQ ID NO: 115832

SEQ ID NO: 511170 - RNA, 64 nt, Homo Sapiens; identical to SEQ ID NO: 115833

SEQ ID NO: 511171 - RNA, 64 nt, Homo Sapiens; identical to SEQ ID NO: 115834

SEQ ID NO: 511172 - RNA, 64 nt, Homo Sapiens; identical to SEQ ID NO: 115835

SEQ ID NO: 511173 - RNA, 64 nt, Homo Sapiens; identical to SEQ ID NO: 115836

SEQ ID NO: 511174 - RNA, 64 nt, Homo Sapiens; identical to SEQ ID NO: 115837

SEQ ID NO: 511175 - RNA, 64 nt, Homo Sapiens; identical to SEQ ID NO: 115838

SEQ ID NO: 511176 - RNA, 64 nt, Homo Sapiens; identical to SEQ ID NO: 115839

SEQ ID NO: 511177 - RNA, 64 nt, Homo Sapiens; identical to SEQ ID NO: 115840

SEQ ID NO: 511178 - RNA, 64 nt, Homo Sapiens; identical to SEQ ID NO: 115841

SEQ ID NO: 511179 - RNA, 64 nt, Homo Sapiens; identical to SEQ ID NO: 115842

SEQ ID NO: 511180 - RNA, 64 nt, Homo Sapiens; identical to SEQ ID NO: 115843

SEQ ID NO: 511181 - RNA, 64 nt, Homo Sapiens; identical to SEQ ID NO: 115844

SEQ ID NO: 511182 - RNA, 64 nt, Homo Sapiens; identical to SEQ ID NO: 115845

SEQ ID NO: 511183 - RNA, 64 nt, Homo Sapiens; identical to SEQ ID NO: 115846

SEQ ID NO: 511184 - RNA, 64 nt, Homo Sapiens; identical to SEQ ID NO: 115847

SEQ ID NO: 511185 - RNA, 64 nt, Homo Sapiens; identical to SEQ ID NO: 115848

SEQ ID NO: 511186 - RNA, 64 nt, Homo Sapiens; identical to SEQ ID NO: 115849

SEQ ID NO: 511187 - RNA, 64 nt, Homo Sapiens; identical to SEQ ID NO: 115850

SEQ ID NO: 511188 - RNA, 64 nt, Homo Sapiens; identical to SEQ ID NO: 115851

SEQ ID NO: 511189 - RNA, 64 nt, Homo Sapiens; identical to SEQ ID NO: 115852

SEQ ID NO: 511190 - RNA, 64 nt, Homo Sapiens
agucacuaccccagggggagcuauagcuucaugaccguaacaugugaccugugugcuggcagga

SEQ ID NO: 511191 - RNA, 64 nt, Homo Sapiens
gucugcugcaauuuaaauaauucuuguuuuuuuuccguaacauuuuuuguuaugggauauugau

SEQ ID NO: 511192 - RNA, 64 nt, Homo Sapiens
ugaauacaacauaacauaguugugcuuuuaaacuccguaacagccaaaagccugauguucacau

SEQ ID NO: 511193 - RNA, 64 nt, Homo Sapiens
aaauuuggcuuacaauugggugagacggugaucgccguaacaguucuuuaaagggcagaaaauu

SEQ ID NO: 511194 - RNA, 64 nt, Homo Sapiens
cugugcuucccaauuguagcauacucggggcuguccguaacacccgcgcuauaucggccauuaa

SEQ ID NO: 511195 - RNA, 64 nt, Homo Sapiens
cauucagaggaggaggggauuucucucuucaaggccguaacaguggaagaacagucauaugcca

SEQ ID NO: 511196 - RNA, 64 nt, Homo Sapiens
uuuuguuggcauagcucugguucagggcuuuacuccguaacagaguacucuggugagucaccac

SEQ ID NO: 511197 - RNA, 64 nt, Homo Sapiens
caaucaauauaagcauuauugagaaaaaugugacccguaacacuguguucuggauaaaaaugug

SEQ ID NO: 511198 - RNA, 64 nt, Homo Sapiens
cuuuccaacugaaggcaguaaccauuacuucuaaccguaacacaaacacagcaaguuuuaaccu

SEQ ID NO: 511199 - RNA, 64 nt, Homo Sapiens
uuguucacacaaccuauuuuuuggcccugccuacccguaacaaacaacccaccaaguacccaug

SEQ ID NO: 511200 - RNA, 64 nt, Homo Sapiens
cuuaaguauaauuccauaaugacaugggcauauaccguaacauucuggcaaauaacaauuagaa

SEQ ID NO: 511201 - RNA, 64 nt, Homo Sapiens
auggagauguauacccucuauuacacacauaaaaccguaacaaaauucauugugguguauuaua

SEQ ID NO: 511202 - RNA, 64 nt, Homo Sapiens
aucuggagcaggggggugagcuccucagcagccuccguaacagcugcccugccuacaccugcag

SEQ ID NO: 511203 - RNA, 64 nt, Homo Sapiens
uccaccuuucagugacauuuaagacaucauauucccguaacauuaugucucagucugaucgucu

SEQ ID NO: 511204 - RNA, 64 nt, Homo Sapiens
gccucuguccccgcauccuuguucuccccuggguccguaacauuuuuuccgaggaugaacaggg

SEQ ID NO: 511205 - RNA, 64 nt, Homo Sapiens
ugauuaacugaggcauccacugcuuuccagaaucccguaacaccccuagaggccccaccuuugg

SEQ ID NO: 511206 - RNA, 64 nt, Homo Sapiens
auuuaucacaagacacgccuucacacacacaugcccguaacaggggggggccacauagaagccc

SEQ ID NO: 511207 - RNA, 64 nt, Homo Sapiens
aaauugcugucaaaagcuuagccagcaggauauaccguaacacgcuccgugugaccaccaagau

SEQ ID NO: 511208 - RNA, 64 nt, Homo Sapiens
ccugauauauacacauuagaaauauuccaguucuccguaacaguguaaaguuaaucagaaagaa

SEQ ID NO: 511209 - RNA, 64 nt, Homo Sapiens
ccguaaacagcccagcuguaccuugaaaaguacaccguaacacuuccacacgauuuccuaucuc

SEQ ID NO: 511210 - RNA, 64 nt, Homo Sapiens
auccuugauacuguugccugccuuuuuagucaccccguaacaagggcacacauccaggacugug

SEQ ID NO: 511211 - RNA, 64 nt, Homo Sapiens
augagaaugcggauuaaaaugccuggcgugcucaccguaacaccacggggaaggcugugugccu

SEQ ID NO: 511212 - RNA, 64 nt, Homo Sapiens
ucccacccccuuuuuaaagcuucccaagcucuaaccguaacacgaugugcgcaaauucugguuc

SEQ ID NO: 511213 - RNA, 64 nt, Homo Sapiens
auuaaguuggggagggcaauaauaaaaugagggcccguaacagaaccaguguguguauaacgaa

SEQ ID NO: 511214 - RNA, 64 nt, Homo Sapiens
gauaaaaucuguuaugggcugaauguuuguguucccguaacaauuccuauguugaaacacgaau

SEQ ID NO: 511215 - RNA, 64 nt, Homo Sapiens
auccucccugcuguguggccuccccuggucucauccguaacacagcccagcuuagugggccucu

SEQ ID NO: 511216 - RNA, 64 nt, Homo Sapiens
cucugugcccuguuugguugaaacagcacagacaccguaacacauguauaaaauauuggcaugu

SEQ ID NO: 511217 - RNA, 64 nt, Homo Sapiens
guuugucauuuugaaauacuuuggccuuacaauaccguaacaauugguaaauagguauuauauu

SEQ ID NO: 511218 - RNA, 64 nt, Homo Sapiens
agaggagacagaggcgaugggcgugcuucguccuccguaacacuggcuuuauuuaccguggugg

SEQ ID NO: 511219 - RNA, 64 nt, Homo Sapiens
acauuaaaccuuugauuuuacccucggaauguuuccguaacaggugccugcugugaacugcuuu

SEQ ID NO: 511220 - RNA, 64 nt, Homo Sapiens
aguggcaucugagugggcccagcacauggccauagaggcccaggcaccaccaggagcagcagcc

SEQ ID NO: 511221 - RNA, 64 nt, Homo Sapiens
agaugucaaguuggguucacuugccaugcaggaagaggcccacuagagggcccaucaggcagug

SEQ ID NO: 511222 - RNA, 64 nt, Homo Sapiens
uggguucugccuuuagccuggaccaaagggaagugaggcccaaggagcuuacccaagcuguggc

SEQ ID NO: 511223 - RNA, 64 nt, Homo Sapiens
gagguggaguggagagugggaucccaggacacuugaggcccaagcugcagcccucacuccuguc

SEQ ID NO: 511224 - RNA, 64 nt, Homo Sapiens
ucagcugggccagagcccagaucacauggaggacgaggcccagcaagggaaaccuaguaaugcc

SEQ ID NO: 511225 - RNA, 64 nt, Homo Sapiens
gccauccaugccaucccugccugugccuagaucagaggcccagagggcccccucaguugccuga

SEQ ID NO: 511226 - RNA, 64 nt, Homo Sapiens
ggcuguuugacuuucugugagcccccagcgaggggaggcccagccuccgaggagaccaggaacc

SEQ ID NO: 511227 - RNA, 64 nt, Homo Sapiens
gaacugggguuuguuagguucuuucucuaauguagaggcccagaucccaucacaaaguuuuuca

SEQ ID NO: 511228 - RNA, 64 nt, Homo Sapiens
uuuugccauguccuauugaucagugacacugccagaggcccauaccggcaagaggaagaggacg

SEQ ID NO: 511229 - RNA, 64 nt, Homo Sapiens
ggccgggggaggacgaccucgguaggcgagcgccgaggcccagcccgcggagggcacgcggcgc

SEQ ID NO: 511230 - RNA, 64 nt, Homo Sapiens
ccgcggagggcacgcggcgcucccacgggccccggaggcccacuggcgcggguggugugugugu

SEQ ID NO: 511231 - RNA, 64 nt, Homo Sapiens
guggugggaagccaguuggcggcaugggcagugcgaggcccauagagccaggccccucaggccc

SEQ ID NO: 511232 - RNA, 64 nt, Homo Sapiens
guggagcacucacuccgugcaaccuggaggaagggaggcccauggacagcauaguccuggaugc

SEQ ID NO: 511233 - RNA, 62 nt, Homo Sapiens
caugcugugccaucaugugaugcagccugccagaggcccaaugcuggaauggcaccaucauu

SEQ ID NO: 511234 - RNA, 64 nt, Homo Sapiens
gguuuggucuaagcugugcccugccaccuggcaggaggcccacucacugcccaagucauggcaa

SEQ ID NO: 511235 - RNA, 64 nt, Homo Sapiens
uacugccauagauacccuaagcccagggccccuugaggcccagacucagccugcccacuggugc

SEQ ID NO: 511236 - RNA, 64 nt, Homo Sapiens
ucacccauccuccccuggggguggcagguagcaggaggcccagagcuggagauaggaggcccag

SEQ ID NO: 511237 - RNA, 64 nt, Homo Sapiens
uggcagguagcaggaggcccccagcuggagauaggaggcccaggcguggguaggucccuggcuc

SEQ ID NO: 511238 - RNA, 64 nt, Homo Sapiens
gcauggauugaagcugcccucaaguccaggccuugaggcccaccugaggggagauacugcccuu

SEQ ID NO: 511239 - RNA, 64 nt, Homo Sapiens
gcucaggacacuuggcuuuggggggaaggaaacugaggcccagagaggggcaaccacuggccaa

SEQ ID NO: 511240 - RNA, 64 nt, Homo Sapiens
acagugcagacggugggcggggagagcucgaggggaggcccagcccugcaggugggacuggcuc

SEQ ID NO: 511241 - RNA, 64 nt, Homo Sapiens
gcgcagcccccaggccucaggaccccaccccucugaggcccaggggagcccuguucacgcuggu

SEQ ID NO: 511242 - RNA, 64 nt, Homo Sapiens
uuggggaaggccaggaccauccuugugggaaacugaggcccagcaaaagaccuagcccaacuuc

SEQ ID NO: 511243 - RNA, 64 nt, Homo Sapiens
aauauuuggaccaagugggagggggugggcaccugaggcccaauccacuuccaagcaagcagau

SEQ ID NO: 511244 - RNA, 64 nt, Homo Sapiens
cccaaagccccagggcuggcgaccucuccucacggaggcccagcccccgggccgcugaccgacu

SEQ ID NO: 511245 - RNA, 64 nt, Homo Sapiens
uugggagucagucgaggauugugaagaagcccuggaggcccaggccuuuagagaaaaaauauua

SEQ ID NO: 511246 - RNA, 64 nt, Homo Sapiens
ugggcacuaaugucugccacgggucacuugucuggaggcccagcugguuuccuggccaacccca

SEQ ID NO: 511247 - RNA, 64 nt, Homo Sapiens
accccaaaucucugccaucaaccugagguggagagaggcccagcacauugagaacaaaggaggg

SEQ ID NO: 511248 - RNA, 64 nt, Homo Sapiens
gggcugaguggggucgggugggggugugagaggagaggcccauaccaggcaggguuggaggccg

SEQ ID NO: 511249 - RNA, 64 nt, Homo Sapiens
cccagggcaguuucaggugccggccuggccaggagaggcccaucgaggcugaggcguuuggccc

SEQ ID NO: 511250 - RNA, 62 nt, Homo Sapiens
gggccgagggcccaggucccguggggccaagggaggcccaggggcaccagcugaaggccuga

SEQ ID NO: 511251 - RNA, 64 nt, Homo Sapiens
ggguuggggcagcuuacuccagcccuggcccaaggaggcccagaaguuggaaagagauggaaug

SEQ ID NO: 511252 - RNA, 64 nt, Homo Sapiens
cuuggggguccagauuccuuaggagcuuugggaugaggcccaggaggcugcauuuuuccagguc

SEQ ID NO: 511253 - RNA, 64 nt, Homo Sapiens
agaacacacaaccaugaaaggcuuuuugaggugagaggcccaggugguccuggcaacccugagu

SEQ ID NO: 511254 - RNA, 64 nt, Homo Sapiens
agugcugccaggggccgcccuccaagguuaaugagaggcccacauccaggcaagaacuaauuca

SEQ ID NO: 511255 - RNA, 64 nt, Homo Sapiens
cacucaacugcccacuucauucugugaccugucugaggcccacccugcagcugcccugaggagg

SEQ ID NO: 511256 - RNA, 64 nt, Homo Sapiens
accugucugaggcccacccugcagcugcccugaggaggcccacagguccccuucuagaauucug

SEQ ID NO: 511257 - RNA, 64 nt, Homo Sapiens
aaauguugaagcucaaguuuaaagaagcguugcagaggcccacggucuccugggucccggccac

SEQ ID NO: 511258 - RNA, 64 nt, Homo Sapiens
guuagcucuauauaaguaggggcagcuuagcccugaggcccagagaccugcuguccuuuuucuc

SEQ ID NO: 511259 - RNA, 64 nt, Homo Sapiens
cacacgccacacacugggcguucccggcacgggagaggcccagaguuuccuucacccugggaac

SEQ ID NO: 511260 - RNA, 64 nt, Homo Sapiens
auccgaauauguccauuucgcagaggaggaaagugaggcccagggagugcagauagcuacagag

SEQ ID NO: 511261 - RNA, 64 nt, Homo Sapiens; identical to SEQ ID NO: 114926

SEQ ID NO: 511262 - RNA, 64 nt, Homo Sapiens; identical to SEQ ID NO: 114927

SEQ ID NO: 511263 - RNA, 64 nt, Homo Sapiens
gcaucuggcacuugcaauuuuggauuuugugggucaguuuuacguacauagggcauuuugcaag

SEQ ID NO: 511264 - RNA, 64 nt, Homo Sapiens
uuccucaccugggugggucccacacuugugaccucaguuuuaggaccaagaucuguguugguuu

SEQ ID NO: 511265 - RNA, 64 nt, Homo Sapiens
cugagauucagagagguccagcuagaaaaaguggcaguuuuaaccaccaacguagaagcuuuuu

SEQ ID NO: 511266 - RNA, 64 nt, Homo Sapiens
agugacucaguggaauuuuuuguuugcuuuuguacaguuuuaaaauaaaaguuugguauuugug

SEQ ID NO: 511267 - RNA, 64 nt, Homo Sapiens
acuauguuuauggagauuuccauacuuuuaaagacaguuuuaauguugaauuugguauuuugaa

SEQ ID NO: 511268 - RNA, 64 nt, Homo Sapiens
uuguuguugccuguaaucacacaugguuugacaucaguuuuaaaucaauggagagaaaaaacug

SEQ ID NO: 511269 - RNA, 64 nt, Homo Sapiens
cauuugagaaguaggggaaagggaaucauguugacaguuuuaguucugugaacacuaauuugug

SEQ ID NO: 511270 - RNA, 64 nt, Homo Sapiens
uagucgcauguguggacaucaguaggcaaguaaccaguuuuacuaaugcauucaucgcucaucu

SEQ ID NO: 511271 - RNA, 64 nt, Homo Sapiens
uuuggcauagcuaacuacacuuugauacuaacuccaguuuuacuauuauuauuuugguuggaaa

SEQ ID NO: 511272 - RNA, 64 nt, Homo Sapiens
acagauauaauaauagcauuuaaccuuuaauucccaguuuuaaaaccacucugcaaaguauuuc

SEQ ID NO: 511273 - RNA, 64 nt, Homo Sapiens
caguaagcucuccuuaccauauauauuaucaauacaguuuuauggaguauuuucugacauaaga

SEQ ID NO: 511274 - RNA, 64 nt, Homo Sapiens
guuucccuauggugguaaagaaugaugccauagucaguuuuauugacauuguuagaugaaagaa

SEQ ID NO: 511275 - RNA, 64 nt, Homo Sapiens
auuugaagcacucugacauguacauuuaaagugacaguuuuaaaaguaaaaugguguuaaaucu

SEQ ID NO: 511276 - RNA, 64 nt, Homo Sapiens
ucaguaaguuagucuauaacaaauuuuacccuaacaguuuuaccaccuaguaacagucauuucu

SEQ ID NO: 511277 - RNA, 64 nt, Homo Sapiens
ccauuuugaaauguaaaauuuuuaugaucugauucaguuuuaagaaaacaugaaugaacuagaa

SEQ ID NO: 511278 - RNA, 64 nt, Homo Sapiens
guuuguacaucguuuuuuucacaauuguaagauacaguuuuacuucucauaauugguauuuagc

SEQ ID NO: 511279 - RNA, 64 nt, Homo Sapiens
gauugcacaucauucuuuaaaagagaaaaugcuacaguuuuauagggucauuguguugcuaccc

SEQ ID NO: 511280 - RNA, 64 nt, Homo Sapiens
uuugauggucuccauucaggguguugaaaauucacaguuuuaaggaaaagguuggguaagaaua

SEQ ID NO: 511281 - RNA, 64 nt, Homo Sapiens
aacaaaagaguuauugaaauuccuacaagacauccaguuuuaacgcagacacagguggaguggu

SEQ ID NO: 511282 - RNA, 64 nt, Homo Sapiens
gucuaaguugaccucgagugaguaauuugaugcucaguuuuaggauuuguaagcgugucauuua

SEQ ID NO: 511283 - RNA, 64 nt, Homo Sapiens
aaauguuuuccuuugugugcuaaauucaaaucuacaguuuuacaccacagauaggcauguaccu

SEQ ID NO: 511284 - RNA, 64 nt, Homo Sapiens
guuuacaguuuaagauacuccuuaauuuggaaagcaguuuuaauuucuaaauauuauuuaauuc

SEQ ID NO: 511285 - RNA, 64 nt, Homo Sapiens
auuaugccuacaucucuagaaaaaggccuagaaccaguuuuaagccggauauguuggguagcag

SEQ ID NO: 511286 - RNA, 64 nt, Homo Sapiens
ggagaauaucuggucauagaucuuuuuuuaaaugcaguuuuauaaaacccuaacagcggugaua

SEQ ID NO: 511287 - RNA, 64 nt, Homo Sapiens
ccuaacagcggugauaucauuagacuguaugaaucaguuuuauuaccuaguguacaagugucag

SEQ ID NO: 511288 - RNA, 64 nt, Homo Sapiens
cagaauuaacuccauuccagucucugcauguaaucaguuuuauccacagaaacauuuucauuuu

SEQ ID NO: 511289 - RNA, 64 nt, Homo Sapiens
aauauauaaauuuaaaaaacuaucuuuuugcuuacaguuuuaaauucugaacaauucucucuua

SEQ ID NO: 511290 - RNA, 64 nt, Homo Sapiens
uuaacuuuagacggucuuguuguaacaagucacucaguuuuauuucaguuuuucugucucacug

SEQ ID NO: 511291 - RNA, 64 nt, Homo Sapiens
uuuuuguuucguuucguuuuuuacuauuguuucccaguuuuaguucaaacacauccuuuggaac

SEQ ID NO: 511292 - RNA, 64 nt, Homo Sapiens
ugugucauauuuuaaaauuagauuuuuuuauaaacaguuuuacuuguauuuuauuugguugagg

SEQ ID NO: 511293 - RNA, 64 nt, Homo Sapiens
uauuguguguucucacaguguugacucuuccauucaguuuuauuccugaucccaguuucugcug

SEQ ID NO: 511294 - RNA, 64 nt, Homo Sapiens
uuaguuuuuagaauaaauauuaauuuuuccacuucaguuuuauucuagaaaauacccuuuuuag

SEQ ID NO: 511295 - RNA, 64 nt, Homo Sapiens
aguuuuauucuagaaaauacccuuuuuagaaauccaguuuuaguuuugucauuuucgauaaauc

SEQ ID NO: 511296 - RNA, 64 nt, Homo Sapiens
uaaaugugugaucagaaagaagugguauuuugaucaguuuuauuagcacuuuguuuucaaagca

SEQ ID NO: 511297 - RNA, 64 nt, Homo Sapiens
ccugcguuacauauugccucuaauaugcagaaaacaguuuuagguagcauuguuuuuagacuag

SEQ ID NO: 511298 - RNA, 64 nt, Homo Sapiens
cuuuaggaaaaugugaacuggaaaacgcuucggucaguuuuagugacauagccugugaugaugg

SEQ ID NO: 511299 - RNA, 64 nt, Homo Sapiens
gggucuggugacuauuauugcggaccgugguacccaguuuuaggaauguggagaaaggaauucu

SEQ ID NO: 511300 - RNA, 64 nt, Homo Sapiens
acacaaauagugauuuacuuuuggagauccuugucaguuuuauuuucuauuugaugaaguaaga

SEQ ID NO: 511301 - RNA, 64 nt, Homo Sapiens
uuuaacucaguucaauuuuuguagugagacugagcaguuuuaaauccuuugcgugcaugcauac

SEQ ID NO: 511302 - RNA, 64 nt, Homo Sapiens
cuaaauguacuuuuaauacuagcaucuugaaauucaguuuuacuccuugauuauuaugaaauag

SEQ ID NO: 511303 - RNA, 64 nt, Homo Sapiens
ucacaaaaccauuuuucuaacuuuucuuccuucacaguuuuaucaacuuuuucucucuugguuu

SEQ ID NO: 511304 - RNA, 64 nt, Homo Sapiens
aaauucuaguuaacaauuuuauuuuguauucuugcaguuuuaaguggaugcuaauuuuaggggc

SEQ ID NO: 511305 - RNA, 64 nt, Homo Sapiens
aacuuuuauguaacaaacagccccuccccaccuccaguuuuacaacaaucagaaagggcacuga

SEQ ID NO: 511306 - RNA, 63 nt, Homo Sapiens
cagaaaauaaaacacaaccuuucucuugaugcaacaguuuuauaaaaaaaaaaauggucaacg

SEQ ID NO: 511307 - RNA, 64 nt, Homo Sapiens
uugugaaagcuuauauuaugaauuuaaauuauuucaguuuuaacugcacauucaguguauuggu

SEQ ID NO: 511308 - RNA, 64 nt, Homo Sapiens
gauuugggcaacauucugcaaagaauggaaucagcaguuuuaagcauauuuugagaagaaauuc

SEQ ID NO: 511309 - RNA, 64 nt, Homo Sapiens
ucauuuggagcuagaaaucaauagucuauaaaaacaguuuuacuugcaauccauuaaaacaaca

SEQ ID NO: 511310 - RNA, 64 nt, Homo Sapiens
aggcguuagccacugcgcccggcccgagaaaauacaguuuuaaaaagagaaagcuuuauaaccu

SEQ ID NO: 511311 - RNA, 64 nt, Homo Sapiens
uccacagcaggcacauaucucuccaagggaugaccaguuuuaugcuuacugugugcuucucauc

SEQ ID NO: 511312 - RNA, 64 nt, Homo Sapiens
ugcaaacuuaaaaaccugcaucuucuugaagcaucaguuuuacuuaccaaaugguuuagaguca

SEQ ID NO: 511313 - RNA, 64 nt, Homo Sapiens
uugucuaguuuauagcaccuuaacuuuaacuguucaguuuuaucuggcagaggaaaacauucuu

SEQ ID NO: 511314 - RNA, 64 nt, Homo Sapiens
ucugaaaucuuauaagcuacuuaagcuacguugucaguuuuaucgcaaagauguuuuguauuuu

SEQ ID NO: 511315 - RNA, 64 nt, Homo Sapiens
aaacuuagaauuauuuuacacacuaaaaugguugcaguuuuauggcauaugucuccgauuuaga

SEQ ID NO: 511316 - RNA, 64 nt, Homo Sapiens
uauugacagacaugguguacugaucagaaauguucaguuuuaacuaaaacuaaauuuauguuau

SEQ ID NO: 511317 - RNA, 64 nt, Homo Sapiens
uuucaguuuauccaauauugaguaaguucugaaacaguuuuagaaaaaauuuucuuuuuguuaa

SEQ ID NO: 511318 - RNA, 64 nt, Homo Sapiens
caugugguaggcggugauggaacaacugucaaaucaguuuuagcaugaccuuuccuuguggauu

SEQ ID NO: 511319 - RNA, 64 nt, Homo Sapiens
aaaggagagagcaauugaggcaguugaccauauucaguuuuauuuauuuauuuuuaauuuguuu

SEQ ID NO: 511320 - RNA, 64 nt, Homo Sapiens
agcacuuuugauagauuacguuacuugccaggggcaguuuuagcgugauuuuuuucauugucca

SEQ ID NO: 511321 - RNA, 64 nt, Homo Sapiens
cucugaaguugguugugauucagcagaacggguucaguuuuagaccuggcaguggcucucagag

SEQ ID NO: 511322 - RNA, 64 nt, Homo Sapiens
auuugggugcguuuuuguguaacugaaagaagagcaguuuuauguacacuuacaaauaaaacau

SEQ ID NO: 511323 - RNA, 64 nt, Homo Sapiens
uuuuuuuuagagagagguuuuuaacuugcccuuucaguuuuauccuuuucccacucauagaacu

SEQ ID NO: 511324 - RNA, 64 nt, Homo Sapiens
uagaggaaacacuaugauagucuuguuuuuuucccaguuuuauaauucaccaaaaggacuuaau

SEQ ID NO: 511325 - RNA, 64 nt, Homo Sapiens
uagaggaaacacugucuauguucuuguuuuuucccaguuuuauauauucaccaaaaggacuuac

SEQ ID NO: 511326 - RNA, 64 nt, Homo Sapiens
guucccagugguccguuuggaaagcagaagacggcaguuuuaaaugaacaauuuaccugucaau

SEQ ID NO: 511327 - RNA, 64 nt, Homo Sapiens
ccgcauuguucguggcaguaauuauaauauugaucaguuuuauggaugaagaagacaaaucuuu

SEQ ID NO: 511328 - RNA, 64 nt, Homo Sapiens
gcaacuaaaucauuuauuaguuguuuuuugaaagcaguuuuauguauaaauaacaaauguuuau

SEQ ID NO: 511329 - RNA, 64 nt, Homo Sapiens
augaacuaaauccaaaacaugacacuguaggcagcaguuuuaagucuuauuuuuacuguuuaua

SEQ ID NO: 511330 - RNA, 64 nt, Homo Sapiens
ugacuuccucuucucucaaguugcagguuuucaacaguuuuauaagguauuugcauuuuagaag

SEQ ID NO: 511331 - RNA, 64 nt, Homo Sapiens
uuuaagauuugaggaaaaggguaaggguuaguuucaguuuuaggauuagagcuagaauuggguu

SEQ ID NO: 511332 - RNA, 64 nt, Homo Sapiens
uuguaguucaaacuaccuaaccuguuauauaauucaguuuuaaaauuuauaacacuagauggca

SEQ ID NO: 511333 - RNA, 64 nt, Homo Sapiens
uuauaacacuagauggcaccguuauaauucugugcaguuuuaaucuuuuaauaacuacacauua

SEQ ID NO: 511334 - RNA, 64 nt, Homo Sapiens
uaaaauacacugacuccugaguaaauugauuuuccaguuuuauggaauugggagucugacaagu

SEQ ID NO: 511335 - RNA, 64 nt, Homo Sapiens
uuauaaugcuuaauauaaucuuaauuaaauuuagcaguuuuaguauaagaugugccauuuuguc

SEQ ID NO: 511336 - RNA, 64 nt, Homo Sapiens
gucuaaucucuuuacagcaaauugguaagauuuucaguuuuacuucuuucuacuguuucugcug

SEQ ID NO: 511337 - RNA, 64 nt, Homo Sapiens
cugcugucuaccuuccuuauauuuuuuuccucaacaguuuuaaaaagaaaaaaaggucuauuuu

SEQ ID NO: 511338 - RNA, 64 nt, Homo Sapiens
uuucuuacaugagcuuuugaaauaccuggaaaugcaguuuuaauaugaacuuuuaagacagaug

SEQ ID NO: 511339 - RNA, 64 nt, Homo Sapiens
gggauauauggucagcagcuguuuugaaaugucccaguuuuacgacuguuacuugugaaucagu

SEQ ID NO: 511340 - RNA, 64 nt, Homo Sapiens
uagaaguugauugccuuuucuucaucacugguuacaguuuuaaauuuauguuuucgaaauauau

SEQ ID NO: 511341 - RNA, 64 nt, Homo Sapiens
aacuuuaaaaguacuucagauauggucaaaagagcaguuuuaauaaucacaauucuaugugacu

SEQ ID NO: 511342 - RNA, 64 nt, Homo Sapiens
uauuguggauauuuguccugccgcauggugcuugcaguuuuaaauaauaacaagauuguaugaa

SEQ ID NO: 511343 - RNA, 64 nt, Homo Sapiens
gccugcucgauuauauagaacgcccaaaucucaucaguuuuauugccucaguuaggacgcucgg

SEQ ID NO: 511344 - RNA, 64 nt, Homo Sapiens
gacuuuuuggaguuugcacagcaaacauuuuacacaguuuuauuucuaauauguuuuauaugua

SEQ ID NO: 511345 - RNA, 64 nt, Homo Sapiens
cuaagauuucguuuuaaaugaucagauucgguuccaguuuuauucuuguugaguuuuucccuau

SEQ ID NO: 511346 - RNA, 64 nt, Homo Sapiens
uaacugcacaaggugucaauucugcucuacagugcaguuuuagucaguuuuaguugcauagguu

SEQ ID NO: 511347 - RNA, 64 nt, Homo Sapiens
aggugucaauucugcucuacagugcaguuuuagucaguuuuaguugcauagguuuccauuguau

SEQ ID NO: 511348 - RNA, 64 nt, Homo Sapiens
auuguuagcaaaaaaguuauucaguuuuaucuuucaguuuuaccgcccuuucagaacguucucu

SEQ ID NO: 511349 - RNA, 64 nt, Homo Sapiens
uuucaguuuuaccauuguuacagaacguucucuucaguuuuaucgggcgugcauguugcccuuu

SEQ ID NO: 511350 - RNA, 64 nt, Homo Sapiens
guuuuucaguauuagggaaacaaaugucucguaucaguuuuaguguaacagagaagaaaugucu

SEQ ID NO: 511351 - RNA, 64 nt, Homo Sapiens
auuguauuccaaguugauaagggucaguuauauucaguuuuaguugcuuuugacagguaguuuu

SEQ ID NO: 511352 - RNA, 64 nt, Homo Sapiens; identical to SEQ ID NO: 167846

SEQ ID NO: 511353 - RNA, 64 nt, Homo Sapiens; identical to SEQ ID NO: 167847

SEQ ID NO: 511354 - RNA, 64 nt, Homo Sapiens; identical to SEQ ID NO: 167848

SEQ ID NO: 511355 - RNA, 64 nt, Homo Sapiens; identical to SEQ ID NO: 167849

SEQ ID NO: 511356 - RNA, 64 nt, Homo Sapiens; identical to SEQ ID NO: 167850

SEQ ID NO: 511357 - RNA, 64 nt, Homo Sapiens; identical to SEQ ID NO: 167851

SEQ ID NO: 511358 - RNA, 64 nt, Homo Sapiens; identical to SEQ ID NO: 511263

SEQ ID NO: 511359 - RNA, 64 nt, Homo Sapiens; identical to SEQ ID NO: 511264

SEQ ID NO: 511360 - RNA, 64 nt, Homo Sapiens; identical to SEQ ID NO: 511265

SEQ ID NO: 511361 - RNA, 64 nt, Homo Sapiens; identical to SEQ ID NO: 511266

SEQ ID NO: 511362 - RNA, 64 nt, Homo Sapiens; identical to SEQ ID NO: 511267

SEQ ID NO: 511363 - RNA, 64 nt, Homo Sapiens; identical to SEQ ID NO: 511268

SEQ ID NO: 511364 - RNA, 64 nt, Homo Sapiens; identical to SEQ ID NO: 511269

SEQ ID NO: 511365 - RNA, 64 nt, Homo Sapiens; identical to SEQ ID NO: 511270

SEQ ID NO: 511366 - RNA, 64 nt, Homo Sapiens; identical to SEQ ID NO: 511271

SEQ ID NO: 511367 - RNA, 64 nt, Homo Sapiens; identical to SEQ ID NO: 511272

SEQ ID NO: 511368 - RNA, 64 nt, Homo Sapiens; identical to SEQ ID NO: 511273

SEQ ID NO: 511369 - RNA, 64 nt, Homo Sapiens; identical to SEQ ID NO: 511274

SEQ ID NO: 511370 - RNA, 64 nt, Homo Sapiens; identical to SEQ ID NO: 511275

SEQ ID NO: 511371 - RNA, 64 nt, Homo Sapiens; identical to SEQ ID NO: 511276

SEQ ID NO: 511372 - RNA, 64 nt, Homo Sapiens; identical to SEQ ID NO: 511277

SEQ ID NO: 511373 - RNA, 64 nt, Homo Sapiens; identical to SEQ ID NO: 511278

SEQ ID NO: 511374 - RNA, 64 nt, Homo Sapiens; identical to SEQ ID NO: 511279

SEQ ID NO: 511375 - RNA, 64 nt, Homo Sapiens; identical to SEQ ID NO: 511280

SEQ ID NO: 511376 - RNA, 64 nt, Homo Sapiens; identical to SEQ ID NO: 511281

SEQ ID NO: 511377 - RNA, 64 nt, Homo Sapiens; identical to SEQ ID NO: 511282

SEQ ID NO: 511378 - RNA, 64 nt, Homo Sapiens; identical to SEQ ID NO: 511283

SEQ ID NO: 511379 - RNA, 64 nt, Homo Sapiens; identical to SEQ ID NO: 511284

SEQ ID NO: 511380 - RNA, 64 nt, Homo Sapiens; identical to SEQ ID NO: 511285

SEQ ID NO: 511381 - RNA, 64 nt, Homo Sapiens; identical to SEQ ID NO: 511286

SEQ ID NO: 511382 - RNA, 64 nt, Homo Sapiens; identical to SEQ ID NO: 511287

SEQ ID NO: 511383 - RNA, 64 nt, Homo Sapiens; identical to SEQ ID NO: 511288

SEQ ID NO: 511384 - RNA, 64 nt, Homo Sapiens; identical to SEQ ID NO: 511289

SEQ ID NO: 511385 - RNA, 64 nt, Homo Sapiens; identical to SEQ ID NO: 511290

SEQ ID NO: 511386 - RNA, 64 nt, Homo Sapiens; identical to SEQ ID NO: 511291

SEQ ID NO: 511387 - RNA, 64 nt, Homo Sapiens; identical to SEQ ID NO: 511292

SEQ ID NO: 511388 - RNA, 64 nt, Homo Sapiens; identical to SEQ ID NO: 511293

SEQ ID NO: 511389 - RNA, 64 nt, Homo Sapiens; identical to SEQ ID NO: 511294

SEQ ID NO: 511390 - RNA, 64 nt, Homo Sapiens; identical to SEQ ID NO: 511295

SEQ ID NO: 511391 - RNA, 64 nt, Homo Sapiens; identical to SEQ ID NO: 511296

SEQ ID NO: 511392 - RNA, 64 nt, Homo Sapiens; identical to SEQ ID NO: 511297

SEQ ID NO: 511393 - RNA, 64 nt, Homo Sapiens; identical to SEQ ID NO: 511298

SEQ ID NO: 511394 - RNA, 64 nt, Homo Sapiens; identical to SEQ ID NO: 511299

SEQ ID NO: 511395 - RNA, 64 nt, Homo Sapiens; identical to SEQ ID NO: 511300

SEQ ID NO: 511396 - RNA, 64 nt, Homo Sapiens; identical to SEQ ID NO: 511301

SEQ ID NO: 511397 - RNA, 64 nt, Homo Sapiens; identical to SEQ ID NO: 511302

SEQ ID NO: 511398 - RNA, 64 nt, Homo Sapiens; identical to SEQ ID NO: 511303

SEQ ID NO: 511399 - RNA, 64 nt, Homo Sapiens; identical to SEQ ID NO: 511304

SEQ ID NO: 511400 - RNA, 64 nt, Homo Sapiens; identical to SEQ ID NO: 511305

SEQ ID NO: 511401 - RNA, 63 nt, Homo Sapiens; identical to SEQ ID NO: 511306

SEQ ID NO: 511402 - RNA, 64 nt, Homo Sapiens; identical to SEQ ID NO: 511307

SEQ ID NO: 511403 - RNA, 64 nt, Homo Sapiens; identical to SEQ ID NO: 511308

SEQ ID NO: 511404 - RNA, 64 nt, Homo Sapiens; identical to SEQ ID NO: 511309

SEQ ID NO: 511405 - RNA, 64 nt, Homo Sapiens; identical to SEQ ID NO: 511310

SEQ ID NO: 511406 - RNA, 64 nt, Homo Sapiens; identical to SEQ ID NO: 511311

SEQ ID NO: 511407 - RNA, 64 nt, Homo Sapiens; identical to SEQ ID NO: 511312

SEQ ID NO: 511408 - RNA, 64 nt, Homo Sapiens; identical to SEQ ID NO: 511313

SEQ ID NO: 511409 - RNA, 64 nt, Homo Sapiens; identical to SEQ ID NO: 511314

SEQ ID NO: 511410 - RNA, 64 nt, Homo Sapiens; identical to SEQ ID NO: 511315

SEQ ID NO: 511411 - RNA, 64 nt, Homo Sapiens; identical to SEQ ID NO: 511316

SEQ ID NO: 511412 - RNA, 64 nt, Homo Sapiens; identical to SEQ ID NO: 511317

SEQ ID NO: 511413 - RNA, 64 nt, Homo Sapiens; identical to SEQ ID NO: 511318

SEQ ID NO: 511414 - RNA, 64 nt, Homo Sapiens; identical to SEQ ID NO: 511319

SEQ ID NO: 511415 - RNA, 64 nt, Homo Sapiens; identical to SEQ ID NO: 511320

SEQ ID NO: 511416 - RNA, 64 nt, Homo Sapiens; identical to SEQ ID NO: 511321

SEQ ID NO: 511417 - RNA, 64 nt, Homo Sapiens; identical to SEQ ID NO: 511322

SEQ ID NO: 511418 - RNA, 64 nt, Homo Sapiens; identical to SEQ ID NO: 511323

SEQ ID NO: 511419 - RNA, 64 nt, Homo Sapiens; identical to SEQ ID NO: 511324

SEQ ID NO: 511420 - RNA, 64 nt, Homo Sapiens; identical to SEQ ID NO: 511325

SEQ ID NO: 511421 - RNA, 64 nt, Homo Sapiens; identical to SEQ ID NO: 511326

SEQ ID NO: 511422 - RNA, 64 nt, Homo Sapiens; identical to SEQ ID NO: 511327

SEQ ID NO: 511423 - RNA, 64 nt, Homo Sapiens; identical to SEQ ID NO: 511328

SEQ ID NO: 511424 - RNA, 64 nt, Homo Sapiens; identical to SEQ ID NO: 511329

SEQ ID NO: 511425 - RNA, 64 nt, Homo Sapiens; identical to SEQ ID NO: 511330

SEQ ID NO: 511426 - RNA, 64 nt, Homo Sapiens; identical to SEQ ID NO: 511331

SEQ ID NO: 511427 - RNA, 64 nt, Homo Sapiens; identical to SEQ ID NO: 511332

SEQ ID NO: 511428 - RNA, 64 nt, Homo Sapiens; identical to SEQ ID NO: 511333

SEQ ID NO: 511429 - RNA, 64 nt, Homo Sapiens; identical to SEQ ID NO: 511334

SEQ ID NO: 511430 - RNA, 64 nt, Homo Sapiens; identical to SEQ ID NO: 511335

SEQ ID NO: 511431 - RNA, 64 nt, Homo Sapiens; identical to SEQ ID NO: 511336

SEQ ID NO: 511432 - RNA, 64 nt, Homo Sapiens; identical to SEQ ID NO: 511337

SEQ ID NO: 511433 - RNA, 64 nt, Homo Sapiens; identical to SEQ ID NO: 511338

SEQ ID NO: 511434 - RNA, 64 nt, Homo Sapiens; identical to SEQ ID NO: 511339

SEQ ID NO: 511435 - RNA, 64 nt, Homo Sapiens; identical to SEQ ID NO: 511340

SEQ ID NO: 511436 - RNA, 64 nt, Homo Sapiens; identical to SEQ ID NO: 511341

SEQ ID NO: 511437 - RNA, 64 nt, Homo Sapiens; identical to SEQ ID NO: 511342

SEQ ID NO: 511438 - RNA, 64 nt, Homo Sapiens; identical to SEQ ID NO: 511343

SEQ ID NO: 511439 - RNA, 64 nt, Homo Sapiens; identical to SEQ ID NO: 511344

SEQ ID NO: 511440 - RNA, 64 nt, Homo Sapiens; identical to SEQ ID NO: 511345

SEQ ID NO: 511441 - RNA, 64 nt, Homo Sapiens; identical to SEQ ID NO: 511346

SEQ ID NO: 511442 - RNA, 64 nt, Homo Sapiens; identical to SEQ ID NO: 511347

SEQ ID NO: 511443 - RNA, 64 nt, Homo Sapiens; identical to SEQ ID NO: 511348

SEQ ID NO: 511444 - RNA, 64 nt, Homo Sapiens; identical to SEQ ID NO: 511349

SEQ ID NO: 511445 - RNA, 64 nt, Homo Sapiens; identical to SEQ ID NO: 511350

SEQ ID NO: 511446 - RNA, 64 nt, Homo Sapiens; identical to SEQ ID NO: 511351

SEQ ID NO: 511447 - RNA, 64 nt, Homo Sapiens; identical to SEQ ID NO: 167846

SEQ ID NO: 511448 - RNA, 64 nt, Homo Sapiens; identical to SEQ ID NO: 167847

SEQ ID NO: 511449 - RNA, 64 nt, Homo Sapiens; identical to SEQ ID NO: 167848

SEQ ID NO: 511450 - RNA, 64 nt, Homo Sapiens; identical to SEQ ID NO: 167849

SEQ ID NO: 511451 - RNA, 64 nt, Homo Sapiens; identical to SEQ ID NO: 167850

SEQ ID NO: 511452 - RNA, 64 nt, Homo Sapiens; identical to SEQ ID NO: 167851

SEQ ID NO: 511453 - RNA, 64 nt, Homo Sapiens
uauuauuugcaaauaccauggaugauaugcugcuucuguuuaacagugaugcaacauuaugugg

SEQ ID NO: 511454 - RNA, 64 nt, Homo Sapiens
cgcauuuugcauuccauaugaaaaaaaugccacgucuguuuaaauuauuugauguagguuuggg

SEQ ID NO: 511455 - RNA, 64 nt, Homo Sapiens
uauauuucaucuguucuauagggaagccauuuugucuguuuaaaauuucaguuuaauuuugcuu

SEQ ID NO: 511456 - RNA, 64 nt, Homo Sapiens
auuugaacaguucuugucaauccgaauuguugauucuguuuaaaugaccaauacuuuuugaaau

SEQ ID NO: 511457 - RNA, 64 nt, Homo Sapiens
uagaccuaagccauacauauuucuuuucccacauucuguuuaggaugacaguaauucuguuguc

SEQ ID NO: 511458 - RNA, 64 nt, Homo Sapiens
uagccguguuuuauaacauagacgagcaguagggucuguuuauuagcaaauuuccuauuuguuc

SEQ ID NO: 511459 - RNA, 64 nt, Homo Sapiens
gaguagaauguccgugaugcauuuacugucuucaucuguuuaauuaucagugaacuacucugag

SEQ ID NO: 511460 - RNA, 64 nt, Homo Sapiens
agucugauuaggaaugauggaccuuaaaagacauucuguuuauuacacagccaucuaacucauu

SEQ ID NO: 511461 - RNA, 64 nt, Homo Sapiens
ccccacaagacuugcauagaaccagaaucaaggcucuguuuauuauuauguuuuuugcaguguu

SEQ ID NO: 511462 - RNA, 64 nt, Homo Sapiens
aauacuaaagcaggaaaauggccacauuaaauuaucuguuuauauugaaauucuuuuuuuuuaa

SEQ ID NO: 511463 - RNA, 64 nt, Homo Sapiens
uuuaguaugaaaaucugguagauccuauuacacuucuguuuauauuaaauccacaauauuuuau

SEQ ID NO: 511464 - RNA, 64 nt, Homo Sapiens
ucuagcaauagcaugauguuacaggaauauuaccucuguuuaagcaagguaauguguaaaauca

SEQ ID NO: 511465 - RNA, 64 nt, Homo Sapiens
uggcacucaugguuuuuaaauaagauuaguauuaucuguuuauaaugccuguuaauaaaagaau

SEQ ID NO: 511466 - RNA, 64 nt, Homo Sapiens
acuuuccccaauugagauaaaaguguuuuaaaauucuguuuauaguuuuugauaugcauauaua

SEQ ID NO: 511467 - RNA, 64 nt, Homo Sapiens
gggaagauucagcuguacaguaauauuuucucuuucuguuuacuggaagauuaauacuguguua

SEQ ID NO: 511468 - RNA, 64 nt, Homo Sapiens
cuuuccguucucucaaccugacuuuccuguacccucuguuuaaaccuuuacuuuuuuuguucug

SEQ ID NO: 511469 - RNA, 64 nt, Homo Sapiens
uuuguuuugucauauuugcuuucacugucuauuaucuguuuaagucucauaacucuauuuuuag

SEQ ID NO: 511470 - RNA, 64 nt, Homo Sapiens
aauauuagccaaauuucucucuguuuuauauaugucuguuuauuucaguuugugguuucugcaa

SEQ ID NO: 511471 - RNA, 64 nt, Homo Sapiens
uagaaugauuuuguuaagaguuuuuaaggagcuaucuguuuauggauuuaaugagagaguacua

SEQ ID NO: 511472 - RNA, 64 nt, Homo Sapiens
auaucaaguauuuucuuaaaaucaugucuuuuacucuguuuauauuuuuaguaaucacuacuau

SEQ ID NO: 511473 - RNA, 64 nt, Homo Sapiens
cuauaauucuacuuguaagaaggcaauuuaguagucuguuuaucauagauauaauuuuucuuga

SEQ ID NO: 511474 - RNA, 64 nt, Homo Sapiens
ccacuugaaaaaaaaacacuaagguacucacagaucuguuuaacuauucuacaugacaacucuc

SEQ ID NO: 511475 - RNA, 64 nt, Homo Sapiens
aacaaaaauuguuuauaucuuggaaaaaaaacuuucuguuuaaaaaaaauaaacaagugaaugu

SEQ ID NO: 511476 - RNA, 64 nt, Homo Sapiens
ugucuguuuccauuugaauuucuuauuguaaaaaucuguuuaaauccauuuauauuauuuuaca

SEQ ID NO: 511477 - RNA, 64 nt, Homo Sapiens
cuuucuccauauuagauuuacccacagcuauauuucuguuuaaguacuagggugaggguuuucu

SEQ ID NO: 511478 - RNA, 64 nt, Homo Sapiens
uuuaaagcuacaaucuguucaauguuuuuaaaaaucuguuuauaugacauuguuaaaauaaagu

SEQ ID NO: 511479 - RNA, 64 nt, Homo Sapiens
cuguguccugcccauguccuccuugguggacguuucuguuuacucagagcugcuagagaccauc

SEQ ID NO: 511480 - RNA, 64 nt, Homo Sapiens
ucuucucagauuucucccuuccuagaacauucucucuguuuagcacuaauguucaccucguauu

SEQ ID NO: 511481 - RNA, 64 nt, Homo Sapiens
guauuuuuuggaagugcaaaaaucucaauuugugucuguuuacagcucucucuccucacugcuc

SEQ ID NO: 511482 - RNA, 64 nt, Homo Sapiens
gccugaugggcaaugaacaaacgggugauaugucucuguuuaagggaaaaauggcuuaaaagcu

SEQ ID NO: 511483 - RNA, 64 nt, Homo Sapiens
augguccuccagagaauaguuuugacuuaacaugucuguuuagcccacaucacgucaguuauca

SEQ ID NO: 511484 - RNA, 64 nt, Homo Sapiens
uggaauuccuuugcauaggagaauguuuuuaugaucuguuuagugcuuauuauuuuuuuuauga

SEQ ID NO: 511485 - RNA, 64 nt, Homo Sapiens
augaucuguuuagugcuuauuauuuuuuuuaugaucuguuuagugcuuauuauuuuccaguaaa

SEQ ID NO: 511486 - RNA, 64 nt, Homo Sapiens
uauuaucugaaaaauggauuucuugagcaaaagaucuguuuauuguauguaaggaaaaauuuua

SEQ ID NO: 511487 - RNA, 64 nt, Homo Sapiens
uuugaaaaauauuccacaugguaaucuuauaaauucuguuuaauuacaucuguaaauauuaugu

SEQ ID NO: 511488 - RNA, 64 nt, Homo Sapiens
uuuaccuuaucaaaccuagaaaggagucauggcaucuguuuacauuguggguuuucuguuugaa

SEQ ID NO: 511489 - RNA, 64 nt, Homo Sapiens
aaaaaucaaagaccaugauuuaauuuguaauagcucuguuuagagguauguuucaaguuuguau

SEQ ID NO: 511490 - RNA, 64 nt, Homo Sapiens
ccuugggauuauggguguaacaaaaaucccuacaucuguuuaugaaggccauauucaguacauu

SEQ ID NO: 511491 - RNA, 64 nt, Homo Sapiens
aggccauauucaguacauuuuaaaugguaaauaaucuguuuaugugaagaaaaagaauuaaguc

SEQ ID NO: 511492 - RNA, 64 nt, Homo Sapiens
guucauucuccuuccaagaacucugauuuuaaguucuguuuaauaguuauuuaauauaaauagu

SEQ ID NO: 511493 - RNA, 64 nt, Homo Sapiens
agaaaaagcaaagacugaggugcgaaagggugagucuguuuagacuuuguuaaagcaaaaacua

SEQ ID NO: 511494 - RNA, 64 nt, Homo Sapiens
cuauaguuauuaaguucuuuucguauagcaugcaucuguuuauucagcucuaauacauuccaac

SEQ ID NO: 511495 - RNA, 64 nt, Homo Sapiens
gcaagguucaacuuauuaacucuagucaaucaagucuguuuacugaugugaaccauuaaccaga

SEQ ID NO: 511496 - RNA, 64 nt, Homo Sapiens
uauuuuuuuguagaugaaaaagcauguacaguguucuguuuaauacucauccuuguauaaaaaa

SEQ ID NO: 511497 - RNA, 64 nt, Homo Sapiens
gcuuggcuucuucuuuaggauugugaugguucguucuguuuacaucaguuuuaacgagagguau

SEQ ID NO: 511498 - RNA, 64 nt, Homo Sapiens
uuuuuggaauauuuguauuagacgccauuaagugucuguuuauauucaaaaacuugaaaugcag

SEQ ID NO: 511499 - RNA, 64 nt, Homo Sapiens
uuccucuugcuucccaaagauuaacaugggaccuucuguuuagcuugagugaauuugccuucag

SEQ ID NO: 511500 - RNA, 64 nt, Homo Sapiens
agagauacuaaauauuaguuuauuguggguauuaucuguuuacccuuacaggauugcuugaaau

SEQ ID NO: 511501 - RNA, 64 nt, Homo Sapiens
uaacacaacaauugaaugcccuaaauaacuacugucuguuuauuuuauugcggaaucauugcug

SEQ ID NO: 511502 - RNA, 64 nt, Homo Sapiens
gugaggagagagacucaguucagcaacuguuuauucuguuuauugagcacuuacuuggaccaag

SEQ ID NO: 511503 - RNA, 64 nt, Homo Sapiens
uuauaaaguaacauaucuggaauuugaaaucagaucuguuuagggcuaaugcugcauuuuucua

SEQ ID NO: 511504 - RNA, 64 nt, Homo Sapiens
guguuuguaacugugauuaugauagaggccuaucucuguuuacaugcauagcuuugaguuaggc

SEQ ID NO: 511505 - RNA, 64 nt, Homo Sapiens
auauuauucuauuuagcuuguaaaacacauggaaucuguuuaagauagcccuuguaaaauugaa

SEQ ID NO: 511506 - RNA, 64 nt, Homo Sapiens
acuucuguauuuauuguaagcacugugauaauggucuguuuagccugugccucagcccacaggc

SEQ ID NO: 511507 - RNA, 64 nt, Homo Sapiens
aagccauaauguaaggacagaauuggaaucacauucuguuuaucgagucucacuuuggaaucag

SEQ ID NO: 511508 - RNA, 64 nt, Homo Sapiens
uauuuugcacacuuuaaaauucuuugaugaaaugucuguuuauauaguugccaucuauauagca

SEQ ID NO: 511509 - RNA, 64 nt, Homo Sapiens
augucuuuggacucccagggaugugaagagaggcucuguuuaaauuccucccaggaauuaauaa

SEQ ID NO: 511510 - RNA, 64 nt, Homo Sapiens
ccggucaaguugguuucaaaguccgacaggcuugucuguuuacuagcugcguggccuuggacgg

SEQ ID NO: 511511 - RNA, 64 nt, Homo Sapiens
uuuucucaagagggauguauuuaucacuuggacaucuguuuauaauauaaacagacaugugacu

SEQ ID NO: 511512 - RNA, 64 nt, Homo Sapiens
ccaaauuugaugaaacugacaaauacuguauuuuucuguuuauuuuaguuuuacuaaaaucugu

SEQ ID NO: 511513 - RNA, 64 nt, Homo Sapiens
uuuacuaaaaucuguaaauacuucuuguaccauuucuguuuaguuucugugaaaaauaaauuuc

SEQ ID NO: 511514 - RNA, 64 nt, Homo Sapiens
uugugucuuacauugguagccagccagccaaggcucuguuuaugcuuuuggggggcauauauug

SEQ ID NO: 511515 - RNA, 64 nt, Homo Sapiens
uaacauuuuugguagucuucaaccagggauuguuucuguuuaacuucuuauaggaaagcuugag

SEQ ID NO: 511516 - RNA, 64 nt, Homo Sapiens
ucuggugaaacaaaaccaguaauacccuaaguacucuguuuacucuguuacuauuuaaaaaaaa

SEQ ID NO: 511517 - RNA, 64 nt, Homo Sapiens
uacguuacauuccuggauacacaaagggauucaaucuguuuauaccugacucccaaucaguuuc

SEQ ID NO: 511518 - RNA, 64 nt, Homo Sapiens
cuaugaccaaagcuucuauuuugccaaaaaguuaaauaccgauaaaauggccuuaaguguauuc

SEQ ID NO: 511519 - RNA, 64 nt, Homo Sapiens
ccuuugugggggcagaaucagguaccauuuaggaaauaccgaugaaaacaacgcugcauauaca

SEQ ID NO: 511520 - RNA, 64 nt, Homo Sapiens
acugaaugccauaaucucgaucaaaccgauccagaauaccgaagguauggacaggacagaaaag

SEQ ID NO: 511521 - RNA, 64 nt, Homo Sapiens
augcaagcaguuuauaugggagaugauuccaggaaauaccgauaugagaauggggaaaugaaac

SEQ ID NO: 511522 - RNA, 64 nt, Homo Sapiens
ugccuuuucuacgagcauuuggaaggagugaucaaauaccgaaauugaacuuucuaaaaccuac

SEQ ID NO: 511523 - RNA, 64 nt, Homo Sapiens
uaauagugucuucuauggcauguaauggauaccuaauaccgaugaguuaaaucuugcaaguuaa

SEQ ID NO: 511524 - RNA, 64 nt, Homo Sapiens
uagggauuucaccccuggcuuuuaaaaaaaacgaaauaccgacaagccacaaggaccaauguag

SEQ ID NO: 511525 - RNA, 64 nt, Homo Sapiens
uauugaugcagaucagagaguucuuagaauacagaauaccgaugacaaugauaaguaugacaug

SEQ ID NO: 511526 - RNA, 64 nt, Homo Sapiens
ggcugagcaccugcugugugugauucacccaacaaauaccgacuugaaugugauuuucauuccu

SEQ ID NO: 511527 - RNA, 64 nt, Homo Sapiens
aaaaucaaaucauuugcauucccacagcauccugaauaccgacuaccucuucacuugcuaaagc

SEQ ID NO: 511528 - RNA, 64 nt, Homo Sapiens
acugccuaccgagcucccucaugccugcaauuuaaauaccgagguguguucugagagccccagg

SEQ ID NO: 511529 - RNA, 64 nt, Homo Sapiens
aaacugcugccaaaaagauaccaauaacacuaacaauaccgaucuugaaaaaucaucagcagug

SEQ ID NO: 511530 - RNA, 64 nt, Homo Sapiens
guuccuggcugugaggaaacuggaguuuucuucuaauaccgagguagaugaugguguggggggu

SEQ ID NO: 511531 - RNA, 64 nt, Homo Sapiens
uugguuuuaaaccuuuaaugagaaaaaaauauauaauaccgagcucaaaaacacuguguuuggu

SEQ ID NO: 511532 - RNA, 64 nt, Homo Sapiens
agucaacccuguggaccacgcugcuggcguuucgaauaccgaaaucuccgcugggcucccagag

SEQ ID NO: 511533 - RNA, 64 nt, Homo Sapiens
ccaggucuagcccaacagucuaaacuauccagucaauaccgagugaaguggcagccagcacugu

SEQ ID NO: 511534 - RNA, 64 nt, Homo Sapiens
gcgccaccugaagguggagucauugaggagagcaaauaccgacagugcguuccuuaaagacaga

SEQ ID NO: 511535 - RNA, 64 nt, Homo Sapiens
auucugucauaggcauagagaguugcacauaaaaaauaccgaagaaaacccaaaauucaaucaa

SEQ ID NO: 511536 - RNA, 64 nt, Homo Sapiens
aaagggugguugugacaauauuugcuggucuuccaauaccgaagcugucaggugugacugucag

SEQ ID NO: 511537 - RNA, 64 nt, Homo Sapiens
agcagggagggauugggggugggggaggccucaaaauaccgacugcguccauucucugccucca

SEQ ID NO: 511538 - RNA, 64 nt, Homo Sapiens
uaagaggaagaagaagaaaggggcacacacacacaauaccgacgucuauccuuuccugcuaggc

SEQ ID NO: 511539 - RNA, 64 nt, Homo Sapiens
gggcucucuccugggaugggggcagguguuccugaauaccgacaggccugcuggguaaaugacu

SEQ ID NO: 511540 - RNA, 64 nt, Homo Sapiens
cugggcuggagagcagguucgggcagccgucgggaauaccgaccauccucuucucccuucuaac

SEQ ID NO: 511541 - RNA, 64 nt, Homo Sapiens
cccgcuuugccuuccaccauuucucaccaugugaaauaccgacauucccugucgcuugcccuca

SEQ ID NO: 511542 - RNA, 64 nt, Homo Sapiens
uucaugaugacaacuugguugcuuuaugcuguagaauaccgacucaaauucgcacagagguuuu

SEQ ID NO: 511543 - RNA, 64 nt, Homo Sapiens
acugaauggaaaucaacuguucucaggugagcaaaauaccgaauacacucuggggaguaucuau

SEQ ID NO: 511544 - RNA, 64 nt, Homo Sapiens
ggucuuaugagaagcaguggcuggcaaagaggaaaauaccgacucuacaugaggauaagcauuu

SEQ ID NO: 511545 - RNA, 64 nt, Homo Sapiens
uggaaaaacagauuucuaauuggaaaugcaaaugaauaccgaauaaucuguaccaaccaacggc

SEQ ID NO: 511546 - RNA, 64 nt, Homo Sapiens
agcaaaaggggagaagauccauuuuauuuaaaaaaauaccgagcggguugggggcgggguaauu

SEQ ID NO: 511547 - RNA, 64 nt, Homo Sapiens
gaagcgcaaauuuucuugaaucuguaucaugucuccccaucauuuuucccaggacauuuuuuuu

SEQ ID NO: 511548 - RNA, 64 nt, Homo Sapiens
aauaacuuuuuaucuugcucaugugaccuaccuaccccaucagagguguugagccgcucauagc

SEQ ID NO: 511549 - RNA, 64 nt, Homo Sapiens
gcgagcucuguccuuacaugggaccgacgagacuccccaucacagaacucuaagaaugccaaag

SEQ ID NO: 511550 - RNA, 64 nt, Homo Sapiens
ugcccggacccuuuggccugacaggcaacgauucccccaucagcucaccuuuucugcuugcuac

SEQ ID NO: 511551 - RNA, 64 nt, Homo Sapiens
ccugcacccaccccagccagucuuuccugccccuccccaucauaggggaugcuucccucugccc

SEQ ID NO: 511552 - RNA, 64 nt, Homo Sapiens
gggucagcuggagagacccaucaagcaauucuguccccaucaagugcauuguggggggacaggc

SEQ ID NO: 511553 - RNA, 64 nt, Homo Sapiens
cccauuuccuuccccaaccacgcacacacuucuuccccaucaagacaugcuccgcaaaguucuc

SEQ ID NO: 511554 - RNA, 64 nt, Homo Sapiens
acuacuccuccccagagacacacaccgcaucaguccccaucaucaaaucucacugucucguuuu

SEQ ID NO: 511555 - RNA, 64 nt, Homo Sapiens
uacugcccaagguaauuuauagauucaaugccauccccaucaagcuaccaaugacuuucuucac

SEQ ID NO: 511556 - RNA, 64 nt, Homo Sapiens
caaugaacucaaacaaauuuacaggaacaaacaaccccaucaaaaagucggcaaaggacaugaa

SEQ ID NO: 511557 - RNA, 64 nt, Homo Sapiens
gguucagcccagaagcccuuccaggcaugaucuuccccaucaggcugggcucuggcagggaccu

SEQ ID NO: 511558 - RNA, 64 nt, Homo Sapiens
ccugcagcuggacccugcaggguggcucccuccuccccaucaagcacaagagagggcccaggaa

SEQ ID NO: 511559 - RNA, 64 nt, Homo Sapiens
uugcuucauacauacuugaccucucuuuucuauuccccaucacuuuugugcugaagcuaaucau

SEQ ID NO: 511560 - RNA, 64 nt, Homo Sapiens
ggcuaauggaaaauacccaagggagggcaaagccccccaucagaugcaugaauguuugcgaaug

SEQ ID NO: 511561 - RNA, 64 nt, Homo Sapiens
ugagcuguuuucuguuggcccuugcugcuccuccccccaucaccggucucgguugucguuuuuu

SEQ ID NO: 511562 - RNA, 64 nt, Homo Sapiens
ccccucaaccuaucccguucgagguggcgagagcccccaucauguguuccagaggugcagacaa

SEQ ID NO: 511563 - RNA, 64 nt, Homo Sapiens
ugggaaagcccaggccgcagaugggugucccccaccccaucagcugggggcugggacuaaagaa

SEQ ID NO: 511564 - RNA, 64 nt, Homo Sapiens
ucaaacauuaaggguacccgaggacaacugacucccccaucagcgccccuuucccugacuguca

SEQ ID NO: 511565 - RNA, 64 nt, Homo Sapiens
ccccccaccucgggucccugaccccagcucgaugccccaucaccgccucucccuggcucccaag

SEQ ID NO: 511566 - RNA, 64 nt, Homo Sapiens
gcucccaagggugcaggugggcgcaaggcccggcccccaucacauguucccuuggccucagagc

SEQ ID NO: 511567 - RNA, 64 nt, Homo Sapiens; identical to SEQ ID NO: 257286

SEQ ID NO: 511568 - RNA, 64 nt, Homo Sapiens; identical to SEQ ID NO: 257287

SEQ ID NO: 511569 - RNA, 64 nt, Homo Sapiens; identical to SEQ ID NO: 257288

SEQ ID NO: 511570 - RNA, 64 nt, Homo Sapiens; identical to SEQ ID NO: 257289

SEQ ID NO: 511571 - RNA, 64 nt, Homo Sapiens; identical to SEQ ID NO: 257290

SEQ ID NO: 511572 - RNA, 64 nt, Homo Sapiens; identical to SEQ ID NO: 257291

SEQ ID NO: 511573 - RNA, 64 nt, Homo Sapiens; identical to SEQ ID NO: 257292

SEQ ID NO: 511574 - RNA, 64 nt, Homo Sapiens; identical to SEQ ID NO: 257293

SEQ ID NO: 511575 - RNA, 64 nt, Homo Sapiens; identical to SEQ ID NO: 257294

SEQ ID NO: 511576 - RNA, 64 nt, Homo Sapiens; identical to SEQ ID NO: 257295

SEQ ID NO: 511577 - RNA, 64 nt, Homo Sapiens; identical to SEQ ID NO: 257296

SEQ ID NO: 511578 - RNA, 64 nt, Homo Sapiens; identical to SEQ ID NO: 257297

SEQ ID NO: 511579 - RNA, 64 nt, Homo Sapiens; identical to SEQ ID NO: 257298

SEQ ID NO: 511580 - RNA, 64 nt, Homo Sapiens; identical to SEQ ID NO: 257299

SEQ ID NO: 511581 - RNA, 64 nt, Homo Sapiens; identical to SEQ ID NO: 257300

SEQ ID NO: 511582 - RNA, 64 nt, Homo Sapiens; identical to SEQ ID NO: 257301

SEQ ID NO: 511583 - RNA, 64 nt, Homo Sapiens; identical to SEQ ID NO: 257302

SEQ ID NO: 511584 - RNA, 64 nt, Homo Sapiens; identical to SEQ ID NO: 257303

SEQ ID NO: 511585 - RNA, 64 nt, Homo Sapiens; identical to SEQ ID NO: 257304

SEQ ID NO: 511586 - RNA, 64 nt, Homo Sapiens; identical to SEQ ID NO: 257305

SEQ ID NO: 511587 - RNA, 64 nt, Homo Sapiens; identical to SEQ ID NO: 257306

SEQ ID NO: 511588 - RNA, 64 nt, Homo Sapiens; identical to SEQ ID NO: 257307

SEQ ID NO: 511589 - RNA, 64 nt, Homo Sapiens; identical to SEQ ID NO: 257308

SEQ ID NO: 511590 - RNA, 64 nt, Homo Sapiens; identical to SEQ ID NO: 257309

SEQ ID NO: 511591 - RNA, 54 nt, Homo Sapiens; identical to SEQ ID NO: 257310

SEQ ID NO: 511592 - RNA, 64 nt, Homo Sapiens; identical to SEQ ID NO: 257311

SEQ ID NO: 511593 - RNA, 64 nt, Homo Sapiens; identical to SEQ ID NO: 257312

SEQ ID NO: 511594 - RNA, 64 nt, Homo Sapiens; identical to SEQ ID NO: 257313

SEQ ID NO: 511595 - RNA, 64 nt, Homo Sapiens; identical to SEQ ID NO: 257314

SEQ ID NO: 511596 - RNA, 64 nt, Homo Sapiens; identical to SEQ ID NO: 257315

SEQ ID NO: 511597 - RNA, 64 nt, Homo Sapiens; identical to SEQ ID NO: 257316

SEQ ID NO: 511598 - RNA, 64 nt, Homo Sapiens; identical to SEQ ID NO: 257317

SEQ ID NO: 511599 - RNA, 64 nt, Homo Sapiens; identical to SEQ ID NO: 257318

SEQ ID NO: 511600 - RNA, 64 nt, Homo Sapiens; identical to SEQ ID NO: 257319

SEQ ID NO: 511601 - RNA, 64 nt, Homo Sapiens
uaaauuuuuuucuuuugaagguaaauuguaauuucaaccagaagagcauauaguguuguauauu

SEQ ID NO: 511602 - RNA, 64 nt, Homo Sapiens
uguucuaguguagagucugagcaaauccaaccagcaaccagaaacugaccucacuggcccacug

SEQ ID NO: 511603 - RNA, 64 nt, Homo Sapiens
gcugacagaccuucuggccagacagacuccuaaccaaccagauggacugccagacaggcagaca

SEQ ID NO: 511604 - RNA, 64 nt, Homo Sapiens
cagaccccagccagacccccgccagacagacucccaaccagacugaccccuuacuauucacaca

SEQ ID NO: 511605 - RNA, 64 nt, Homo Sapiens
auugucucagagcaggugcuuaugggcaggauggcaaccagaccaauuuuuuaauugauguugu

SEQ ID NO: 511606 - RNA, 64 nt, Homo Sapiens
gucagcuccuugagggcaaguuauccuaucucuccaaccagauuguuaacuaauucuugggugu

SEQ ID NO: 511607 - RNA, 64 nt, Homo Sapiens
guaucgauuaucauaaauucacaaaauauuuuugcaaccagaacacaaaagcaggcuagucagc

SEQ ID NO: 511608 - RNA, 64 nt, Homo Sapiens
uggaucuuguccaaauuuagugaaauguggaagucaaccagaccaaugauggaauuaaauguaa

SEQ ID NO: 511609 - RNA, 64 nt, Homo Sapiens
cgccuugagccgagggcauaugcgggggggcagccaaccagagcuggucacuccucaggaccau

SEQ ID NO: 511610 - RNA, 64 nt, Homo Sapiens
gaaagggaggcucucuuaagagcuaugugccuuccaaccagagggagacccaguagaaagaaaa

SEQ ID NO: 511611 - RNA, 64 nt, Homo Sapiens
gaugauccuaaaaauaaccgaagaaagagaggaccaaccagaauucccuuuggacauuuguguu

SEQ ID NO: 511612 - RNA, 64 nt, Homo Sapiens
cucuuaguugaacagugugcccuagcuuuucuugcaaccagaguauuuuuguacagauuugcuu

SEQ ID NO: 511613 - RNA, 64 nt, Homo Sapiens
uccucggcaacccaccucccgacccccaagucuucaaccagauaccccuaagucccuuugucuu

SEQ ID NO: 511614 - RNA, 64 nt, Homo Sapiens
gucuacaacugcccccuccacgauccuuccccugcaaccagacacaggccugguucccaagacc

SEQ ID NO: 511615 - RNA, 64 nt, Homo Sapiens
augcuaaccuauauccucuacgagaugaucaucacaaccagaugccaccagguggcccauuacu

SEQ ID NO: 511616 - RNA, 64 nt, Homo Sapiens
cagagggguaguuuucuuuuauacauacuucugucaaccagaacgccucacagggaaucugaua

SEQ ID NO: 511617 - RNA, 64 nt, Homo Sapiens; identical to SEQ ID NO: 380623

SEQ ID NO: 511618 - RNA, 64 nt, Homo Sapiens; identical to SEQ ID NO: 380624

SEQ ID NO: 511619 - RNA, 64 nt, Homo Sapiens; identical to SEQ ID NO: 380625

SEQ ID NO: 511620 - RNA, 64 nt, Homo Sapiens; identical to SEQ ID NO: 380626

SEQ ID NO: 511621 - RNA, 64 nt, Homo Sapiens; identical to SEQ ID NO: 380627

SEQ ID NO: 511622 - RNA, 64 nt, Homo Sapiens; identical to SEQ ID NO: 380628

SEQ ID NO: 511623 - RNA, 64 nt, Homo Sapiens; identical to SEQ ID NO: 380629

SEQ ID NO: 511624 - RNA, 64 nt, Homo Sapiens; identical to SEQ ID NO: 380630

SEQ ID NO: 511625 - RNA, 64 nt, Homo Sapiens; identical to SEQ ID NO: 380631

SEQ ID NO: 511626 - RNA, 64 nt, Homo Sapiens; identical to SEQ ID NO: 380632

SEQ ID NO: 511627 - RNA, 64 nt, Homo Sapiens; identical to SEQ ID NO: 380633

SEQ ID NO: 511628 - RNA, 64 nt, Homo Sapiens; identical to SEQ ID NO: 380634

SEQ ID NO: 511629 - RNA, 64 nt, Homo Sapiens; identical to SEQ ID NO: 380635

SEQ ID NO: 511630 - RNA, 64 nt, Homo Sapiens; identical to SEQ ID NO: 380636

SEQ ID NO: 511631 - RNA, 64 nt, Homo Sapiens; identical to SEQ ID NO: 380637

SEQ ID NO: 511632 - RNA, 64 nt, Homo Sapiens; identical to SEQ ID NO: 380638

SEQ ID NO: 511633 - RNA, 64 nt, Homo Sapiens; identical to SEQ ID NO: 380639

SEQ ID NO: 511634 - RNA, 64 nt, Homo Sapiens; identical to SEQ ID NO: 380640

SEQ ID NO: 511635 - RNA, 64 nt, Homo Sapiens; identical to SEQ ID NO: 380641

SEQ ID NO: 511636 - RNA, 64 nt, Homo Sapiens; identical to SEQ ID NO: 380642

SEQ ID NO: 511637 - RNA, 64 nt, Homo Sapiens; identical to SEQ ID NO: 380643

SEQ ID NO: 511638 - RNA, 64 nt, Homo Sapiens; identical to SEQ ID NO: 380644

SEQ ID NO: 511639 - RNA, 64 nt, Homo Sapiens; identical to SEQ ID NO: 380645

SEQ ID NO: 511640 - RNA, 64 nt, Homo Sapiens; identical to SEQ ID NO: 380646

SEQ ID NO: 511641 - RNA, 64 nt, Homo Sapiens; identical to SEQ ID NO: 380647

SEQ ID NO: 511642 - RNA, 64 nt, Homo Sapiens; identical to SEQ ID NO: 380648

SEQ ID NO: 511643 - RNA, 64 nt, Homo Sapiens; identical to SEQ ID NO: 380649

SEQ ID NO: 511644 - RNA, 64 nt, Homo Sapiens; identical to SEQ ID NO: 380650

SEQ ID NO: 511645 - RNA, 64 nt, Homo Sapiens; identical to SEQ ID NO: 380651

SEQ ID NO: 511646 - RNA, 64 nt, Homo Sapiens; identical to SEQ ID NO: 380652

SEQ ID NO: 511647 - RNA, 64 nt, Homo Sapiens; identical to SEQ ID NO: 368368

SEQ ID NO: 511648 - RNA, 64 nt, Homo Sapiens; identical to SEQ ID NO: 368369

SEQ ID NO: 511649 - RNA, 64 nt, Homo Sapiens; identical to SEQ ID NO: 368370

SEQ ID NO: 511650 - RNA, 64 nt, Homo Sapiens; identical to SEQ ID NO: 368371

SEQ ID NO: 511651 - RNA, 64 nt, Homo Sapiens; identical to SEQ ID NO: 368372

SEQ ID NO: 511652 - RNA, 64 nt, Homo Sapiens; identical to SEQ ID NO: 368373

SEQ ID NO: 511653 - RNA, 64 nt, Homo Sapiens; identical to SEQ ID NO: 368374

SEQ ID NO: 511654 - RNA, 64 nt, Homo Sapiens; identical to SEQ ID NO: 368375

SEQ ID NO: 511655 - RNA, 64 nt, Homo Sapiens; identical to SEQ ID NO: 368376

SEQ ID NO: 511656 - RNA, 64 nt, Homo Sapiens; identical to SEQ ID NO: 368377

SEQ ID NO: 511657 - RNA, 64 nt, Homo Sapiens; identical to SEQ ID NO: 368378

SEQ ID NO: 511658 - RNA, 64 nt, Homo Sapiens; identical to SEQ ID NO: 368379

SEQ ID NO: 511659 - RNA, 64 nt, Homo Sapiens; identical to SEQ ID NO: 368380

SEQ ID NO: 511660 - RNA, 64 nt, Homo Sapiens; identical to SEQ ID NO: 368381

SEQ ID NO: 511661 - RNA, 64 nt, Homo Sapiens; identical to SEQ ID NO: 368382

SEQ ID NO: 511662 - RNA, 64 nt, Homo Sapiens; identical to SEQ ID NO: 368383

SEQ ID NO: 511663 - RNA, 64 nt, Homo Sapiens
uucagcuggaccacucaggccuggacagccucaucuccaugaggcuggugcuucggguaaaucu

SEQ ID NO: 511664 - RNA, 64 nt, Homo Sapiens
aauuauauacauacaauucuuguguggaauuuaacuccaugacugaauagcauaaggaagaggu

SEQ ID NO: 511665 - RNA, 64 nt, Homo Sapiens
gugggggugauacuacuagagcuugugguggcugcuccaugagggacaccccccaccauggugg

SEQ ID NO: 511666 - RNA, 64 nt, Homo Sapiens
caagccagcuuccugugcagcaggaguccacugccuccaugauggccugcgcaggcgggacuau

SEQ ID NO: 511667 - RNA, 64 nt, Homo Sapiens
ucccuucuauccccaugagcgcaugagcauggggcuccaugacucuuugaagauggcgcucugg

SEQ ID NO: 511668 - RNA, 64 nt, Homo Sapiens
uccuagaacaaaaccgcccuugagaacugcuugacuccaugaucuagagcgugggaggugccuu

SEQ ID NO: 511669 - RNA, 64 nt, Homo Sapiens
ggcaagcacaaugguuucaaagaaagacuguaagcuccaugauuagcauaaagcacuaaccaug

SEQ ID NO: 511670 - RNA, 64 nt, Homo Sapiens
augguagccucuggguuguuguuuuuuucuuuuccuccaugauguuaauggguuaucucaaauu

SEQ ID NO: 511671 - RNA, 64 nt, Homo Sapiens
augaguugccuccaaccuguuggaccuggcugggcuccaugagaagaggcacaugguucuagcc

SEQ ID NO: 511672 - RNA, 64 nt, Homo Sapiens
gcucccucugcugccccugauggacacccauggucuccaugagucucaggcaccuuuccucccc

SEQ ID NO: 511673 - RNA, 64 nt, Homo Sapiens; identical to SEQ ID NO: 119362

SEQ ID NO: 511674 - RNA, 64 nt, Homo Sapiens; identical to SEQ ID NO: 119363

SEQ ID NO: 511675 - RNA, 64 nt, Homo Sapiens; identical to SEQ ID NO: 119364

SEQ ID NO: 511676 - RNA, 64 nt, Homo Sapiens; identical to SEQ ID NO: 119365

SEQ ID NO: 511677 - RNA, 64 nt, Homo Sapiens; identical to SEQ ID NO: 119366

SEQ ID NO: 511678 - RNA, 64 nt, Homo Sapiens; identical to SEQ ID NO: 119367

SEQ ID NO: 511679 - RNA, 64 nt, Homo Sapiens; identical to SEQ ID NO: 119368

SEQ ID NO: 511680 - RNA, 64 nt, Homo Sapiens; identical to SEQ ID NO: 119369

SEQ ID NO: 511681 - RNA, 64 nt, Homo Sapiens; identical to SEQ ID NO: 119370

SEQ ID NO: 511682 - RNA, 64 nt, Homo Sapiens; identical to SEQ ID NO: 119371

SEQ ID NO: 511683 - RNA, 64 nt, Homo Sapiens; identical to SEQ ID NO: 119372

SEQ ID NO: 511684 - RNA, 64 nt, Homo Sapiens; identical to SEQ ID NO: 119373

SEQ ID NO: 511685 - RNA, 64 nt, Homo Sapiens; identical to SEQ ID NO: 119374

SEQ ID NO: 511686 - RNA, 64 nt, Homo Sapiens; identical to SEQ ID NO: 119375

SEQ ID NO: 511687 - RNA, 64 nt, Homo Sapiens; identical to SEQ ID NO: 119376

SEQ ID NO: 511688 - RNA, 64 nt, Homo Sapiens; identical to SEQ ID NO: 119377

SEQ ID NO: 511689 - RNA, 64 nt, Homo Sapiens; identical to SEQ ID NO: 296587

SEQ ID NO: 511690 - RNA, 64 nt, Homo Sapiens; identical to SEQ ID NO: 296588

SEQ ID NO: 511691 - RNA, 64 nt, Homo Sapiens; identical to SEQ ID NO: 270835

SEQ ID NO: 511692 - RNA, 64 nt, Homo Sapiens; identical to SEQ ID NO: 270836

SEQ ID NO: 511693 - RNA, 64 nt, Homo Sapiens; identical to SEQ ID NO: 270837

SEQ ID NO: 511694 - RNA, 64 nt, Homo Sapiens; identical to SEQ ID NO: 270838

SEQ ID NO: 511695 - RNA, 64 nt, Homo Sapiens
aguuguguuacaguucauuuacugauauaaguaaggagaugaguggggaggguggaagggaggg

SEQ ID NO: 511696 - RNA, 64 nt, Homo Sapiens
ggaggccauggccuauguacagaacugagaggugggagaugauucaaugcgaaguauuugggug

SEQ ID NO: 511697 - RNA, 64 nt, Homo Sapiens
ucaguuguguuuuuuaagauuuggaaaagacaguggagaugaggaagauagucuuggaagcugu

SEQ ID NO: 511698 - RNA, 64 nt, Homo Sapiens
aguaaaauucaguuuuuuucauauucacaucuucggagaugaggggcaagcugaaauuuuagaa

SEQ ID NO: 511699 - RNA, 64 nt, Homo Sapiens
ucaggacaggaguugaacaauuagguuagcagauggagaugagaggacuggguagaguaccaug

SEQ ID NO: 511700 - RNA, 64 nt, Homo Sapiens
ugagcagaaaauucauaaaaauguaucaucagcaggagaugagacuaugaauuggcauccagaa

SEQ ID NO: 511701 - RNA, 64 nt, Homo Sapiens
ggaugcacacuuguuaaauaguguuaagagauguggagaugagauauaccccuuugauguagaa

SEQ ID NO: 511702 - RNA, 64 nt, Homo Sapiens
gaggaugaauaaaaacagcaaaaccaaauaaaguggagaugagugauugagugagguagauugc

SEQ ID NO: 511703 - RNA, 64 nt, Homo Sapiens
acgaauauggacguaauugcagaaggaacuucaaggagaugaaugaaugcuaaaaggguucuug

SEQ ID NO: 511704 - RNA, 64 nt, Homo Sapiens
gcuaucacacugagaauagugaaaggacaaguauggagaugaaaaacagccuucugauggccau

SEQ ID NO: 511705 - RNA, 64 nt, Homo Sapiens
ggacauucugccaugacauauaacacagaucaaaggagaugaagagcauguauuuuuaucaauu

SEQ ID NO: 511706 - RNA, 64 nt, Homo Sapiens
uuuguuauuuugggguuuucgaggugggaggaagggagaugaguagcugcaggguucuuuuugg

SEQ ID NO: 511707 - RNA, 64 nt, Homo Sapiens
agugucaguaaauacugugcagguggaggaaggaggagaugagcgggaagcugaauguugaggg

SEQ ID NO: 511708 - RNA, 64 nt, Homo Sapiens
uuuaaaaaaaaaaaaaaaacuuuuuuggggcaggggagaugaacgauauggcacaugcuaucag

SEQ ID NO: 511709 - RNA, 64 nt, Homo Sapiens
gagacaaaagucaagcccucgaggaagggcggcuggagaugauaagcugcccgccguggaaauu

SEQ ID NO: 511710 - RNA, 64 nt, Homo Sapiens
cucccaaaggugccagagaucugcugaaagugucggagaugaaaugcggcuuccagagguacag

SEQ ID NO: 511711 - RNA, 64 nt, Homo Sapiens
auuagguacuuuuguuucaaaucuuucgauggauggagaugaucgagugucuuaucccugagca

SEQ ID NO: 511712 - RNA, 64 nt, Homo Sapiens
cacuguguuuugaaaguuguaggaugugugaacgggagaugauguccaucaggcuguuuccuaa

SEQ ID NO: 511713 - RNA, 64 nt, Homo Sapiens
cuuucaagggacacaggcagaauggccccaagaaggagaugauugucauuaguggucauaugaa

SEQ ID NO: 511714 - RNA, 64 nt, Homo Sapiens
ucuuccgcacaggaacacgcggguagaggaggugggagaugagaugggguggggcggugugaca

SEQ ID NO: 511715 - RNA, 64 nt, Homo Sapiens
gacgucugucccaaacucccccagcccugagcugggagaugacagggggaaagaggcccucuca

SEQ ID NO: 511716 - RNA, 64 nt, Homo Sapiens
cagcuccuccccggagucccccagcacagucccaggagaugacaggaaggaagcaccagggcaa

SEQ ID NO: 511717 - RNA, 64 nt, Homo Sapiens; identical to SEQ ID NO: 50929

SEQ ID NO: 511718 - RNA, 64 nt, Homo Sapiens; identical to SEQ ID NO: 50930

SEQ ID NO: 511719 - RNA, 64 nt, Homo Sapiens; identical to SEQ ID NO: 50931

SEQ ID NO: 511720 - RNA, 64 nt, Homo Sapiens; identical to SEQ ID NO: 50932

SEQ ID NO: 511721 - RNA, 64 nt, Homo Sapiens; identical to SEQ ID NO: 50933

SEQ ID NO: 511722 - RNA, 64 nt, Homo Sapiens; identical to SEQ ID NO: 50934

SEQ ID NO: 511723 - RNA, 64 nt, Homo Sapiens; identical to SEQ ID NO: 50935

SEQ ID NO: 511724 - RNA, 64 nt, Homo Sapiens; identical to SEQ ID NO: 50936

SEQ ID NO: 511725 - RNA, 64 nt, Homo Sapiens; identical to SEQ ID NO: 50937

SEQ ID NO: 511726 - RNA, 64 nt, Homo Sapiens; identical to SEQ ID NO: 50938

SEQ ID NO: 511727 - RNA, 64 nt, Homo Sapiens; identical to SEQ ID NO: 50939

SEQ ID NO: 511728 - RNA, 64 nt, Homo Sapiens; identical to SEQ ID NO: 50940

SEQ ID NO: 511729 - RNA, 64 nt, Homo Sapiens; identical to SEQ ID NO: 50941

SEQ ID NO: 511730 - RNA, 64 nt, Homo Sapiens; identical to SEQ ID NO: 50942

SEQ ID NO: 511731 - RNA, 64 nt, Homo Sapiens; identical to SEQ ID NO: 50943

SEQ ID NO: 511732 - RNA, 64 nt, Homo Sapiens; identical to SEQ ID NO: 50944

SEQ ID NO: 511733 - RNA, 64 nt, Homo Sapiens; identical to SEQ ID NO: 50945

SEQ ID NO: 511734 - RNA, 64 nt, Homo Sapiens; identical to SEQ ID NO: 50946

SEQ ID NO: 511735 - RNA, 64 nt, Homo Sapiens; identical to SEQ ID NO: 50947

SEQ ID NO: 511736 - RNA, 64 nt, Homo Sapiens; identical to SEQ ID NO: 50948

SEQ ID NO: 511737 - RNA, 64 nt, Homo Sapiens; identical to SEQ ID NO: 50949

SEQ ID NO: 511738 - RNA, 64 nt, Homo Sapiens; identical to SEQ ID NO: 50950

SEQ ID NO: 511739 - RNA, 64 nt, Homo Sapiens; identical to SEQ ID NO: 50951

SEQ ID NO: 511740 - RNA, 64 nt, Homo Sapiens; identical to SEQ ID NO: 50952

SEQ ID NO: 511741 - RNA, 64 nt, Homo Sapiens; identical to SEQ ID NO: 50953

SEQ ID NO: 511742 - RNA, 64 nt, Homo Sapiens; identical to SEQ ID NO: 50954

SEQ ID NO: 511743 - RNA, 64 nt, Homo Sapiens; identical to SEQ ID NO: 50955

SEQ ID NO: 511744 - RNA, 64 nt, Homo Sapiens; identical to SEQ ID NO: 50956

SEQ ID NO: 511745 - RNA, 64 nt, Homo Sapiens; identical to SEQ ID NO: 50957

SEQ ID NO: 511746 - RNA, 64 nt, Homo Sapiens; identical to SEQ ID NO: 50958

SEQ ID NO: 511747 - RNA, 64 nt, Homo Sapiens; identical to SEQ ID NO: 50959

SEQ ID NO: 511748 - RNA, 64 nt, Homo Sapiens; identical to SEQ ID NO: 50960

SEQ ID NO: 511749 - RNA, 64 nt, Homo Sapiens; identical to SEQ ID NO: 50961

SEQ ID NO: 511750 - RNA, 64 nt, Homo Sapiens; identical to SEQ ID NO: 50962

SEQ ID NO: 511751 - RNA, 64 nt, Homo Sapiens; identical to SEQ ID NO: 50963

SEQ ID NO: 511752 - RNA, 64 nt, Homo Sapiens; identical to SEQ ID NO: 50964

SEQ ID NO: 511753 - RNA, 64 nt, Homo Sapiens; identical to SEQ ID NO: 50965

SEQ ID NO: 511754 - RNA, 64 nt, Homo Sapiens; identical to SEQ ID NO: 50966

SEQ ID NO: 511755 - RNA, 64 nt, Homo Sapiens; identical to SEQ ID NO: 50967

SEQ ID NO: 511756 - RNA, 64 nt, Homo Sapiens; identical to SEQ ID NO: 50968

SEQ ID NO: 511757 - RNA, 64 nt, Homo Sapiens; identical to SEQ ID NO: 50969

SEQ ID NO: 511758 - RNA, 64 nt, Homo Sapiens; identical to SEQ ID NO: 50970

SEQ ID NO: 511759 - RNA, 64 nt, Homo Sapiens; identical to SEQ ID NO: 50971

SEQ ID NO: 511760 - RNA, 64 nt, Homo Sapiens; identical to SEQ ID NO: 50972

SEQ ID NO: 511761 - RNA, 64 nt, Homo Sapiens; identical to SEQ ID NO: 50973

SEQ ID NO: 511762 - RNA, 64 nt, Homo Sapiens; identical to SEQ ID NO: 50974

SEQ ID NO: 511763 - RNA, 64 nt, Homo Sapiens; identical to SEQ ID NO: 50975

SEQ ID NO: 511764 - RNA, 64 nt, Homo Sapiens; identical to SEQ ID NO: 50976

SEQ ID NO: 511765 - RNA, 64 nt, Homo Sapiens; identical to SEQ ID NO: 50977

SEQ ID NO: 511766 - RNA, 64 nt, Homo Sapiens; identical to SEQ ID NO: 50978

SEQ ID NO: 511767 - RNA, 64 nt, Homo Sapiens; identical to SEQ ID NO: 50979

SEQ ID NO: 511768 - RNA, 64 nt, Homo Sapiens; identical to SEQ ID NO: 50980

SEQ ID NO: 511769 - RNA, 64 nt, Homo Sapiens; identical to SEQ ID NO: 50981

SEQ ID NO: 511770 - RNA, 64 nt, Homo Sapiens; identical to SEQ ID NO: 50982

SEQ ID NO: 511771 - RNA, 64 nt, Homo Sapiens; identical to SEQ ID NO: 50983

SEQ ID NO: 511772 - RNA, 64 nt, Homo Sapiens; identical to SEQ ID NO: 50984

SEQ ID NO: 511773 - RNA, 64 nt, Homo Sapiens; identical to SEQ ID NO: 50985

SEQ ID NO: 511774 - RNA, 64 nt, Homo Sapiens; identical to SEQ ID NO: 50986

SEQ ID NO: 511775 - RNA, 64 nt, Homo Sapiens; identical to SEQ ID NO: 50987

SEQ ID NO: 511776 - RNA, 64 nt, Homo Sapiens; identical to SEQ ID NO: 50988

SEQ ID NO: 511777 - RNA, 64 nt, Homo Sapiens; identical to SEQ ID NO: 50989

SEQ ID NO: 511778 - RNA, 64 nt, Homo Sapiens; identical to SEQ ID NO: 50990

SEQ ID NO: 511779 - RNA, 64 nt, Homo Sapiens; identical to SEQ ID NO: 50991

SEQ ID NO: 511780 - RNA, 64 nt, Homo Sapiens; identical to SEQ ID NO: 50992

SEQ ID NO: 511781 - RNA, 64 nt, Homo Sapiens; identical to SEQ ID NO: 50993

SEQ ID NO: 511782 - RNA, 64 nt, Homo Sapiens; identical to SEQ ID NO: 50994

SEQ ID NO: 511783 - RNA, 64 nt, Homo Sapiens
guauguguguacucugcacguauaucucuucugucuugaagacccuguuaacuuugugaaauaa

SEQ ID NO: 511784 - RNA, 64 nt, Homo Sapiens
acgugagucaccaugcccagccccaaagccauuucuugaagaauuucucgcaaacucacaaccc

SEQ ID NO: 511785 - RNA, 64 nt, Homo Sapiens
guuuguuaaaccauauggauucucaagcuccucucuugaagauucugauucaguaggucuggga

SEQ ID NO: 511786 - RNA, 64 nt, Homo Sapiens
uuaggggugaaauuuagaagucuuaguaauguaacuugaagauguuaaacaaaaaucucaagua

SEQ ID NO: 511787 - RNA, 64 nt, Homo Sapiens
cgucuuaggaauaaaugccauucuuaugcuagaccuugaagaguagaaaauuaagagauggugg

SEQ ID NO: 511788 - RNA, 64 nt, Homo Sapiens
gucaggaaccagacuacaguggacccuggagaaccuugaagaacauuuuuccuuuucaggaaaa

SEQ ID NO: 511789 - RNA, 64 nt, Homo Sapiens
uucauguuuuugggcuguauauaaaggggacucccuugaagaauaaauucuuccaacucauggg

SEQ ID NO: 511790 - RNA, 64 nt, Homo Sapiens
agugacauucaucacuucaggagagugcuuccuucuugaagacgagguucuucuucacaaggcu

SEQ ID NO: 511791 - RNA, 64 nt, Homo Sapiens
caauccaagugugugccccuggaaaaaauauauacuugaagaaccuucacugaagcuaauguuu

SEQ ID NO: 511792 - RNA, 64 nt, Homo Sapiens
uguagaauguagcaaauuaugaaauauuaauuuacuugaagagaucacuuuaccuagcguuuua

SEQ ID NO: 511793 - RNA, 64 nt, Homo Sapiens
ucgauauacauuuauuuacaaggaaugauauauucuugaagacaugaauggguucuagugaaaa

SEQ ID NO: 511794 - RNA, 64 nt, Homo Sapiens
uuggauucagccgcgaagagacacugaggagauacuugaagaauggauccuuucauaggagaac

SEQ ID NO: 511795 - RNA, 64 nt, Homo Sapiens
acguccucucccaggaacauucuuagcucggacucuugaagaaucucuuuagauuuuguuggca

SEQ ID NO: 511796 - RNA, 64 nt, Homo Sapiens
cccuauaaggcuguggaaccugaggaaguagauacuugaagagauucuguuuaggaagaaacuc

SEQ ID NO: 511797 - RNA, 64 nt, Homo Sapiens
gaaagaaccgaagagcaaacaguagagcauaccacuugaagaagaaugugaauuucuaccaaau

SEQ ID NO: 511798 - RNA, 64 nt, Homo Sapiens
ggagaggcgagaggugagcuaucuucuuacuaagcuugaagagucuuugggacuaagcugcgga

SEQ ID NO: 511799 - RNA, 64 nt, Homo Sapiens
aauggucuuagaauucauuguuucguuuugcuggcuugaagacacaaaucccuucaccacaggg

SEQ ID NO: 511800 - RNA, 64 nt, Homo Sapiens
ugagcuuggccucucuggucgcucacccaccggccuugaagaggccauccuggcaugagcagug

SEQ ID NO: 511801 - RNA, 64 nt, Homo Sapiens
uccucuucuauuacuuaaaaaccaccguacacugcuugaagaguauucauccuuuaagaaaaac

SEQ ID NO: 511802 - RNA, 64 nt, Homo Sapiens
cgccuggcuagaggugagggggaaacacuagaaucuugaagaaagagaauguucuguaaggacu

SEQ ID NO: 511803 - RNA, 64 nt, Homo Sapiens
uaaaugaaguguauagcacuauuucuaaauaugccuugaagaacuuaaagauccacaaagcagu

SEQ ID NO: 511804 - RNA, 64 nt, Homo Sapiens
aucauauaaaaagcauuugagagucuucccagaucuugaagaaaacuacuaaaauguggccacu

SEQ ID NO: 511805 - RNA, 64 nt, Homo Sapiens
acacugugggacgcacgugccgugcccuuuggggcuugaagagcaagggacgcaguccuagagg

SEQ ID NO: 511806 - RNA, 64 nt, Homo Sapiens
caccauuguuuaaauaaaauauguagacuggcaccuugaagauuagccuggaggacuguugggc

SEQ ID NO: 511807 - RNA, 64 nt, Homo Sapiens
uuuuacaaaauaccaacuguaagucucucauuugcuugaagauauggcauaagacuaacagaug

SEQ ID NO: 511808 - RNA, 64 nt, Homo Sapiens
uaacaauucucuucauuggucauaagaaaccagccuugaagaauaagggcugguuuuuaauccu

SEQ ID NO: 511809 - RNA, 64 nt, Homo Sapiens
acauaaaagugcagaaagcccuuuccaagaugaacuugaagauuuucaaagaggacauaugauu

SEQ ID NO: 511810 - RNA, 64 nt, Homo Sapiens
acaucaaaguacagaaagcccuuuccaagaugaacuugaagauuuucaaagaagacauaugacu

SEQ ID NO: 511811 - RNA, 64 nt, Homo Sapiens; identical to SEQ ID NO: 474199

SEQ ID NO: 511812 - RNA, 64 nt, Homo Sapiens; identical to SEQ ID NO: 474200

SEQ ID NO: 511813 - RNA, 64 nt, Homo Sapiens; identical to SEQ ID NO: 474201

SEQ ID NO: 511814 - RNA, 64 nt, Homo Sapiens; identical to SEQ ID NO: 474202

SEQ ID NO: 511815 - RNA, 64 nt, Homo Sapiens; identical to SEQ ID NO: 474203

SEQ ID NO: 511816 - RNA, 64 nt, Homo Sapiens; identical to SEQ ID NO: 474204

SEQ ID NO: 511817 - RNA, 64 nt, Homo Sapiens; identical to SEQ ID NO: 474205

SEQ ID NO: 511818 - RNA, 64 nt, Homo Sapiens; identical to SEQ ID NO: 474206

SEQ ID NO: 511819 - RNA, 64 nt, Homo Sapiens; identical to SEQ ID NO: 474207

SEQ ID NO: 511820 - RNA, 64 nt, Homo Sapiens; identical to SEQ ID NO: 474208

SEQ ID NO: 511821 - RNA, 64 nt, Homo Sapiens; identical to SEQ ID NO: 106125

SEQ ID NO: 511822 - RNA, 64 nt, Homo Sapiens; identical to SEQ ID NO: 106126

SEQ ID NO: 511823 - RNA, 64 nt, Homo Sapiens; identical to SEQ ID NO: 106127

SEQ ID NO: 511824 - RNA, 64 nt, Homo Sapiens; identical to SEQ ID NO: 106128

SEQ ID NO: 511825 - RNA, 64 nt, Homo Sapiens; identical to SEQ ID NO: 106129

SEQ ID NO: 511826 - RNA, 64 nt, Homo Sapiens; identical to SEQ ID NO: 106130

SEQ ID NO: 511827 - RNA, 64 nt, Homo Sapiens; identical to SEQ ID NO: 364288

SEQ ID NO: 511828 - RNA, 64 nt, Homo Sapiens; identical to SEQ ID NO: 364289

SEQ ID NO: 511829 - RNA, 64 nt, Homo Sapiens; identical to SEQ ID NO: 364290

SEQ ID NO: 511830 - RNA, 64 nt, Homo Sapiens; identical to SEQ ID NO: 364291

SEQ ID NO: 511831 - RNA, 64 nt, Homo Sapiens; identical to SEQ ID NO: 364292

SEQ ID NO: 511832 - RNA, 64 nt, Homo Sapiens; identical to SEQ ID NO: 364293

SEQ ID NO: 511833 - RNA, 64 nt, Homo Sapiens
ucauuugcuuuucuggaggcagcuuuuaauuuacacuuaccaccuuccccucuuaaaggagagg

SEQ ID NO: 511834 - RNA, 64 nt, Homo Sapiens
uagauacgggcucaaaagucggucacugcgaggcacuuaccaugaugguaacgcuacggcccca

SEQ ID NO: 511835 - RNA, 64 nt, Homo Sapiens
acacucaagacuauguucuccaucccaacacaucacuuaccacuugcacuauucuuaauaggcc

SEQ ID NO: 511836 - RNA, 64 nt, Homo Sapiens
cauuagugcuaugguuaugaguguaugugccaguacuuaccagucaaugcauuguggauaugag

SEQ ID NO: 511837 - RNA, 64 nt, Homo Sapiens
uugaguaugugaagggguacgauuucugcaaacccaucuugaccgaggccagauggucagauau

SEQ ID NO: 511838 - RNA, 64 nt, Homo Sapiens
uauacacugaaaaaaaugggucuugaggucuugacaucuugacacuuauuuugaugaucagagg

SEQ ID NO: 511839 - RNA, 64 nt, Homo Sapiens
gucacauguuauuauacacuaaaaaauaggaagucaucuugaaaggcaguuaauguacugcaaa

SEQ ID NO: 511840 - RNA, 64 nt, Homo Sapiens
acacugaucuuauuagaggucagugcuaaguacccaucuugauugaaguuagcucagaugugga

SEQ ID NO: 511841 - RNA, 64 nt, Homo Sapiens
uaccauggaaugucagaaaugacuuuaucaucgucaucuugaagaaaaauaugaacacugauga

SEQ ID NO: 511842 - RNA, 64 nt, Homo Sapiens
caaggcuaaaaccugagauuaucgaucuaugagacaucuugauauguaaagcacuuaauauuaa

SEQ ID NO: 511843 - RNA, 64 nt, Homo Sapiens
ccuagggcaugaaguugcccauguagccgcuggccaucuugaauuccuggcaggcagacccggc

SEQ ID NO: 511844 - RNA, 64 nt, Homo Sapiens
aguagcccuuugcaauuuauggauagauauuugucaucuugacauguucauaguugaaacagua

SEQ ID NO: 511845 - RNA, 64 nt, Homo Sapiens
gucuuacaccaacccccacuuggcuguuggcugucaucuugaacucuauuugaaugugacuuaa

SEQ ID NO: 511846 - RNA, 64 nt, Homo Sapiens
uaucacaggaguuuagaaagacucugccucccagcaucuugaauaucuccagccuguucacugu

SEQ ID NO: 511847 - RNA, 64 nt, Homo Sapiens
uuaaaacauauuugaaagguaaguaaaaaacuaccaucuugaaggugaagggaguuaagaaaag

SEQ ID NO: 511848 - RNA, 64 nt, Homo Sapiens
uuaauaccauauuuuauacaucuccagagccuuucaucuugaggaucucaaagaccguagaaga

SEQ ID NO: 511849 - RNA, 64 nt, Homo Sapiens
uugaaaauaaagguagggcuucuaaaaacuucaucaucuugauaaguuaaaaaaugaaaguuau

SEQ ID NO: 511850 - RNA, 64 nt, Homo Sapiens
gggaacuucuuuaaaggaaaauuguaguagaggucaucuugauggaauuguguuuuaaaguuuu

SEQ ID NO: 511851 - RNA, 64 nt, Homo Sapiens
ugcaaaaucacaaaacuaagggggaugacccaggcaucuugauucuuucagaaucagcaaaagu

SEQ ID NO: 511852 - RNA, 64 nt, Homo Sapiens
aucccacaagccaauuaugugauagucaauaaaacaucuugaaauuguaaguagauucaaauua

SEQ ID NO: 511853 - RNA, 64 nt, Homo Sapiens
cccacacuuccaaaauuaaacaguguuuucuuagcaucuugaauaucuccugcgguguauauua

SEQ ID NO: 511854 - RNA, 64 nt, Homo Sapiens
uagcaucuugaauaucuccugcgguguauauuaacaucuugaugagacagauuuccaggcaaca

SEQ ID NO: 511855 - RNA, 63 nt, Homo Sapiens
uuuugcuuuucagugucuucucagaaacaaccagcugagaaggcuacaagugacgacaaagau

SEQ ID NO: 511856 - RNA, 63 nt, Homo Sapiens
uuuugcuuuucagugucuucucagaaacaaccagcugagaaggcuacaagugacgagaaagau

SEQ ID NO: 511857 - RNA, 63 nt, Homo Sapiens
ccaagcugauaucagcaaugggcaaacucaaaugcugagaaccuuagaugccacaggagaaga

SEQ ID NO: 511858 - RNA, 63 nt, Homo Sapiens
cuagaaggagauacagcucuccacgggagugcugcugagaaggcaccagacuguuauacugca

SEQ ID NO: 511859 - RNA, 63 nt, Homo Sapiens
guagacagcuacccaugaucgcagaggauggaggcugagaaaggcagggugucaugcaugggu

SEQ ID NO: 511860 - RNA, 63 nt, Homo Sapiens
caccuugucuggugauuuucgagcugaaaagaagcugagaaauacuugagauguauaaaacua

SEQ ID NO: 511861 - RNA, 63 nt, Homo Sapiens
augucacaaacacaaucuauucuacaugaggaggcugagaaaggggaagagaaaaacaaacca

SEQ ID NO: 511862 - RNA, 63 nt, Homo Sapiens
gaggauuucuagccagaggucccagaugccugggcugagaacccagcgauaagggggcguucc

SEQ ID NO: 511863 - RNA, 63 nt, Homo Sapiens
gagcagacucacaggugcuguacuugggagccagcugagaagaaagaggcaaagcuacagguu

SEQ ID NO: 511864 - RNA, 63 nt, Homo Sapiens
gguggccucaggacugagagugcuguggaggcagcugagaaguagaacgcagagcucccagcc

SEQ ID NO: 511865 - RNA, 63 nt, Homo Sapiens
gucugauauucgugcuaccuuuuauugcuggaugcugagaauggaguguuuauaauuauguua

SEQ ID NO: 511866 - RNA, 63 nt, Homo Sapiens
agagaaaagagaccauguuuggugauggggcaugcugagaaauguggguggaccaguacucca

SEQ ID NO: 511867 - RNA, 63 nt, Homo Sapiens
uauccucauaccaccacugcugcuucccacccagcugagaaugcccccuccucccugacuccu

SEQ ID NO: 511868 - RNA, 63 nt, Homo Sapiens
aucuucugaaggguuuuaaagaauggccaauuagcugagaagaauuaucuaaucaauuaguga

SEQ ID NO: 511869 - RNA, 63 nt, Homo Sapiens
auuucuuaugcuuuuuacuauuuuacauaauaugcugagaauuaagguuuucacugcuuuuuc

SEQ ID NO: 511870 - RNA, 63 nt, Homo Sapiens
agugauuauauauuuuucugggauugauaaaaugcugagaacucuagaagaagagaaacaaag

SEQ ID NO: 511871 - RNA, 63 nt, Homo Sapiens
agaauucagugauauuucucaaggauguuccuugcugagaaaaaggugugcauucucuuucuc

SEQ ID NO: 511872 - RNA, 63 nt, Homo Sapiens
uuccaaaucuccaaguucuggcaguauggauaggcugagaauuguacaaguuuucuaauuuuu

SEQ ID NO: 511873 - RNA, 63 nt, Homo Sapiens
ccagguucucauaucccagggguucagacuuuggcugagaacagccccuggagaacauggggu

SEQ ID NO: 511874 - RNA, 63 nt, Homo Sapiens
cacaaagguuuuccauauaauauuauuuaaaaugcugagaaaaugaaaaaaucuaaaugguga

SEQ ID NO: 511875 - RNA, 63 nt, Homo Sapiens
uccuccccccaaccuccugacccauucauaaaugcugagaaugucucucaugggaacacuguu

SEQ ID NO: 511876 - RNA, 63 nt, Homo Sapiens
auaaagguauugagagggaacaaaaaacauaaagcugagaaucuugagagagcucaucuaccc

SEQ ID NO: 511877 - RNA, 63 nt, Homo Sapiens
ucucugccaugauacuuccuugggacugacuuggcugagaacguguucugucagaggauuugu

SEQ ID NO: 511878 - RNA, 64 nt, Homo Sapiens; identical to SEQ ID NO: 44407

SEQ ID NO: 511879 - RNA, 64 nt, Homo Sapiens; identical to SEQ ID NO: 44408

SEQ ID NO: 511880 - RNA, 64 nt, Homo Sapiens; identical to SEQ ID NO: 44409

SEQ ID NO: 511881 - RNA, 64 nt, Homo Sapiens; identical to SEQ ID NO: 44410

SEQ ID NO: 511882 - RNA, 64 nt, Homo Sapiens; identical to SEQ ID NO: 44411

SEQ ID NO: 511883 - RNA, 64 nt, Homo Sapiens; identical to SEQ ID NO: 44412

SEQ ID NO: 511884 - RNA, 64 nt, Homo Sapiens; identical to SEQ ID NO: 44413

SEQ ID NO: 511885 - RNA, 64 nt, Homo Sapiens; identical to SEQ ID NO: 44414

SEQ ID NO: 511886 - RNA, 64 nt, Homo Sapiens; identical to SEQ ID NO: 44415

SEQ ID NO: 511887 - RNA, 64 nt, Homo Sapiens; identical to SEQ ID NO: 44416

SEQ ID NO: 511888 - RNA, 64 nt, Homo Sapiens
gcccaaaaggaagaauuaugcugguaguaaaugggacucugagucaaauucagaacgagauguc

SEQ ID NO: 511889 - RNA, 64 nt, Homo Sapiens
uuggaaaucaagcaaacagcgcacaucaacuucugacucugagggguccuguuccaauucggaa

SEQ ID NO: 511890 - RNA, 64 nt, Homo Sapiens
ccacggugcucucgcccugcccauggccaccccagacucugaucuccaggaaccccauagcccc

SEQ ID NO: 511891 - RNA, 64 nt, Homo Sapiens
uaagucccucucuuuaaagaacuucugcgggucagacucugaagccgaguugcugugggcgugc

SEQ ID NO: 511892 - RNA, 64 nt, Homo Sapiens
gaaugugccaccuguccggccugagaaaaugcgagacucugauguaggacuugguaagaugacu

SEQ ID NO: 511893 - RNA, 64 nt, Homo Sapiens
aaaugcgagacucugauggaggacuugguaagaugacucugagaagggccacccugcugcacua

SEQ ID NO: 511894 - RNA, 64 nt, Homo Sapiens
caagggagggaagggccaccgaagggggugcaaagacucugagccacccccaggccuccuaggg

SEQ ID NO: 511895 - RNA, 64 nt, Homo Sapiens
ucuaaggagccaauaaacacguacaguuguuacugacucugauucacggaagaugggggccucu

SEQ ID NO: 511896 - RNA, 64 nt, Homo Sapiens
ggcgacugccuccaccucaugccgcgggcccauggacucugaguacuacuacaagcacagucgg

SEQ ID NO: 511897 - RNA, 64 nt, Homo Sapiens
aaauugcuucuuuaccaaggauauuuacagaaaagacucugaccagagaucgagaccauccuag

SEQ ID NO: 511898 - RNA, 64 nt, Homo Sapiens
agcaagacuccaucucaaaaagaaaagaaaagaagacucugaccuguacucuugaauacaaguu

SEQ ID NO: 511899 - RNA, 64 nt, Homo Sapiens
uccaaggggggguuccggguccauccuucuccaugacucugaaauguagaagggacaauuaacu

SEQ ID NO: 511900 - RNA, 64 nt, Homo Sapiens
aguucugucucuacuaccuguuauugggauuugggacucugaacuuuguaagaauaaaacaggu

SEQ ID NO: 511901 - RNA, 64 nt, Homo Sapiens
gccgcuaacugaccgcguugccauuggcgaccuggacucugaacucagguuuauucuaaaccca

SEQ ID NO: 511902 - RNA, 64 nt, Homo Sapiens
uuuuucauuuggggauauuaggaucuuccuuggagacucugaaaauggcacacaaagaauggca

SEQ ID NO: 511903 - RNA, 64 nt, Homo Sapiens; identical to SEQ ID NO: 301526

SEQ ID NO: 511904 - RNA, 64 nt, Homo Sapiens; identical to SEQ ID NO: 301526

SEQ ID NO: 511905 - RNA, 64 nt, Homo Sapiens; identical to SEQ ID NO: 301528

SEQ ID NO: 511906 - RNA, 64 nt, Homo Sapiens; identical to SEQ ID NO: 301529

SEQ ID NO: 511907 - RNA, 64 nt, Homo Sapiens; identical to SEQ ID NO: 301530

SEQ ID NO: 511908 - RNA, 64 nt, Homo Sapiens; identical to SEQ ID NO: 210768

SEQ ID NO: 511909 - RNA, 64 nt, Homo Sapiens; identical to SEQ ID NO: 210769

SEQ ID NO: 511910 - RNA, 64 nt, Homo Sapiens; identical to SEQ ID NO: 210770

SEQ ID NO: 511911 - RNA, 64 nt, Homo Sapiens; identical to SEQ ID NO: 210771

SEQ ID NO: 511912 - RNA, 64 nt, Homo Sapiens; identical to SEQ ID NO: 210772

SEQ ID NO: 511913 - RNA, 64 nt, Homo Sapiens; identical to SEQ ID NO: 210773

SEQ ID NO: 511914 - RNA, 64 nt, Homo Sapiens; identical to SEQ ID NO: 210774

SEQ ID NO: 511915 - RNA, 64 nt, Homo Sapiens; identical to SEQ ID NO: 210775

SEQ ID NO: 511916 - RNA, 64 nt, Homo Sapiens; identical to SEQ ID NO: 210776

SEQ ID NO: 511917 - RNA, 64 nt, Homo Sapiens; identical to SEQ ID NO: 210777

SEQ ID NO: 511918 - RNA, 64 nt, Homo Sapiens; identical to SEQ ID NO: 210778

SEQ ID NO: 511919 - RNA, 64 nt, Homo Sapiens; identical to SEQ ID NO: 210779

SEQ ID NO: 511920 - RNA, 64 nt, Homo Sapiens; identical to SEQ ID NO: 210780

SEQ ID NO: 511921 - RNA, 64 nt, Homo Sapiens; identical to SEQ ID NO: 210781

SEQ ID NO: 511922 - RNA, 64 nt, Homo Sapiens; identical to SEQ ID NO: 210782

SEQ ID NO: 511923 - RNA, 64 nt, Homo Sapiens; identical to SEQ ID NO: 210783

SEQ ID NO: 511924 - RNA, 64 nt, Homo Sapiens; identical to SEQ ID NO: 210784

SEQ ID NO: 511925 - RNA, 64 nt, Homo Sapiens; identical to SEQ ID NO: 210785

SEQ ID NO: 511926 - RNA, 64 nt, Homo Sapiens; identical to SEQ ID NO: 210786

SEQ ID NO: 511927 - RNA, 64 nt, Homo Sapiens; identical to SEQ ID NO: 210787

SEQ ID NO: 511928 - RNA, 64 nt, Homo Sapiens; identical to SEQ ID NO: 210788

SEQ ID NO: 511929 - RNA, 64 nt, Homo Sapiens; identical to SEQ ID NO: 210789

SEQ ID NO: 511930 - RNA, 64 nt, Homo Sapiens; identical to SEQ ID NO: 210790

SEQ ID NO: 511931 - RNA, 64 nt, Homo Sapiens; identical to SEQ ID NO: 210791

SEQ ID NO: 511932 - RNA, 64 nt, Homo Sapiens; identical to SEQ ID NO: 210792

SEQ ID NO: 511933 - RNA, 64 nt, Homo Sapiens; identical to SEQ ID NO: 210793

SEQ ID NO: 511934 - RNA, 64 nt, Homo Sapiens; identical to SEQ ID NO: 210794

SEQ ID NO: 511935 - RNA, 64 nt, Homo Sapiens; identical to SEQ ID NO: 210795

SEQ ID NO: 511936 - RNA, 64 nt, Homo Sapiens; identical to SEQ ID NO: 210796

SEQ ID NO: 511937 - RNA, 64 nt, Homo Sapiens; identical to SEQ ID NO: 210797

SEQ ID NO: 511938 - RNA, 64 nt, Homo Sapiens; identical to SEQ ID NO: 210798

SEQ ID NO: 511939 - RNA, 64 nt, Homo Sapiens; identical to SEQ ID NO: 210799

SEQ ID NO: 511940 - RNA, 64 nt, Homo Sapiens; identical to SEQ ID NO: 210800

SEQ ID NO: 511941 - RNA, 64 nt, Homo Sapiens; identical to SEQ ID NO: 210801

SEQ ID NO: 511942 - RNA, 64 nt, Homo Sapiens; identical to SEQ ID NO: 210802

SEQ ID NO: 511943 - RNA, 64 nt, Homo Sapiens; identical to SEQ ID NO: 210803

SEQ ID NO: 511944 - RNA, 64 nt, Homo Sapiens; identical to SEQ ID NO: 210804

SEQ ID NO: 511945 - RNA, 64 nt, Homo Sapiens; identical to SEQ ID NO: 210805

SEQ ID NO: 511946 - RNA, 64 nt, Homo Sapiens; identical to SEQ ID NO: 210806

SEQ ID NO: 511947 - RNA, 64 nt, Homo Sapiens; identical to SEQ ID NO: 210807

SEQ ID NO: 511948 - RNA, 64 nt, Homo Sapiens; identical to SEQ ID NO: 210808

SEQ ID NO: 511949 - RNA, 64 nt, Homo Sapiens; identical to SEQ ID NO: 210809

SEQ ID NO: 511950 - RNA, 62 nt, Homo Sapiens
agcagauucccuaggcaagagcagcagcacaacuaggaaaccccaaagcccaugcuccgaca

SEQ ID NO: 511951 - RNA, 62 nt, Homo Sapiens
cacagcuuaguggccaguaaacacccuggggacuaggaaaaggaaccaacuguaggcaccuc

SEQ ID NO: 511952 - RNA, 62 nt, Homo Sapiens
uauaaccagaggaaaaaaggauggagaaauaucuaggaaagugucuucucagaaaccaccaa

SEQ ID NO: 511953 - RNA, 62 nt, Homo Sapiens
uauaaccagagaaaaaaaggauggagaaauaucuaggaaagugucuucucagaaaccaccag

SEQ ID NO: 511954 - RNA, 62 nt, Homo Sapiens
aggaaagguaucagggauuuaacagacuauaacuaggaaaggcuacccuuaacuuagggaug

SEQ ID NO: 511955 - RNA, 62 nt, Homo Sapiens
gaaagugaaggaauggucuauuuccuaggaagcuaggaaaagaagcugucucccuucugaca

SEQ ID NO: 511956 - RNA, 62 nt, Homo Sapiens
aauaccccuggggcaaaaauggacuugcucuucuaggaaaagcauuuaaauuuucuaaaaau

SEQ ID NO: 511957 - RNA, 62 nt, Homo Sapiens
agucaacgcaaauugcauuuaggaaauaaguccuaggaaauuaagaacagggguuuuacaua

SEQ ID NO: 511958 - RNA, 62 nt, Homo Sapiens
gaguuacuauguauauuaugacuauuuuuauacuaggaaaaggaacaaauauaguuucuggc

SEQ ID NO: 511959 - RNA, 62 nt, Homo Sapiens
aaaauuuguuucaaauaugcuaagcaacuggucuaggaaagguggagaaguagauaaugaau

SEQ ID NO: 511960 - RNA, 62 nt, Homo Sapiens
guaccacaucccucucaaguguuccacaacaucuaggaaagugagcucuuaaagacagacua

SEQ ID NO: 511961 - RNA, 62 nt, Homo Sapiens
uugauucuuccauugagaaaagcauaugaauccuaggaaagggcucagccugugauaggcau

SEQ ID NO: 511962 - RNA, 62 nt, Homo Sapiens
cuugaaaauauaaguggugcuuccucgaaguucuaggaaauuugcauuuacaagguuaaaga

SEQ ID NO: 511963 - RNA, 62 nt, Homo Sapiens
aggaauaaaguuuuuuuccuccugacaaguuccuaggaaaaagggaauggucacuaaaguau

SEQ ID NO: 511964 - RNA, 62 nt, Homo Sapiens
cccguccaguguggugcuuauggugcaggggacuaggaaaaaucauuauagcaaaggguuac

SEQ ID NO: 511965 - RNA, 62 nt, Homo Sapiens
uggggacuguauuuaauuuuauuaaagaugcucuaggaaauugcucaguaaauauggacgca

SEQ ID NO: 511966 - RNA, 62 nt, Homo Sapiens
guugauuuacauuuuuuacuuccuugccuucccuaggaaaccucaugccccuuuacauuccc

SEQ ID NO: 511967 - RNA, 62 nt, Homo Sapiens
uuguaggaauuuauggguaucaccaaggccuccuaggaaaaauuugaccucauuugcauugc

SEQ ID NO: 511968 - RNA, 64 nt, Homo Sapiens; identical to SEQ ID NO: 237576

SEQ ID NO: 511969 - RNA, 64 nt, Homo Sapiens; identical to SEQ ID NO: 237577

SEQ ID NO: 511970 - RNA, 64 nt, Homo Sapiens; identical to SEQ ID NO: 237578

SEQ ID NO: 511971 - RNA, 64 nt, Homo Sapiens; identical to SEQ ID NO: 237579

SEQ ID NO: 511972 - RNA, 64 nt, Homo Sapiens; identical to SEQ ID NO: 237580

SEQ ID NO: 511973 - RNA, 64 nt, Homo Sapiens; identical to SEQ ID NO: 237581

SEQ ID NO: 511974 - RNA, 64 nt, Homo Sapiens; identical to SEQ ID NO: 237582

SEQ ID NO: 511975 - RNA, 64 nt, Homo Sapiens; identical to SEQ ID NO: 237583

SEQ ID NO: 511976 - RNA, 64 nt, Homo Sapiens; identical to SEQ ID NO: 237584

SEQ ID NO: 511977 - RNA, 64 nt, Homo Sapiens; identical to SEQ ID NO: 237585

SEQ ID NO: 511978 - RNA, 64 nt, Homo Sapiens; identical to SEQ ID NO: 237586

SEQ ID NO: 511979 - RNA, 64 nt, Homo Sapiens; identical to SEQ ID NO: 237587

SEQ ID NO: 511980 - RNA, 64 nt, Homo Sapiens; identical to SEQ ID NO: 237588

SEQ ID NO: 511981 - RNA, 64 nt, Homo Sapiens; identical to SEQ ID NO: 237589

SEQ ID NO: 511982 - RNA, 64 nt, Homo Sapiens; identical to SEQ ID NO: 237590

SEQ ID NO: 511983 - RNA, 64 nt, Homo Sapiens; identical to SEQ ID NO: 237591

SEQ ID NO: 511984 - RNA, 64 nt, Homo Sapiens; identical to SEQ ID NO: 237592

SEQ ID NO: 511985 - RNA, 64 nt, Homo Sapiens; identical to SEQ ID NO: 237593

SEQ ID NO: 511986 - RNA, 64 nt, Homo Sapiens; identical to SEQ ID NO: 237594

SEQ ID NO: 511987 - RNA, 64 nt, Homo Sapiens; identical to SEQ ID NO: 237595

SEQ ID NO: 511988 - RNA, 64 nt, Homo Sapiens; identical to SEQ ID NO: 237596

SEQ ID NO: 511989 - RNA, 64 nt, Homo Sapiens; identical to SEQ ID NO: 237597

SEQ ID NO: 511990 - RNA, 64 nt, Homo Sapiens; identical to SEQ ID NO: 237598

SEQ ID NO: 511991 - RNA, 64 nt, Homo Sapiens; identical to SEQ ID NO: 237599

SEQ ID NO: 511992 - RNA, 64 nt, Homo Sapiens; identical to SEQ ID NO: 237600

SEQ ID NO: 511993 - RNA, 64 nt, Homo Sapiens; identical to SEQ ID NO: 237601

SEQ ID NO: 511994 - RNA, 64 nt, Homo Sapiens; identical to SEQ ID NO: 237602

SEQ ID NO: 511995 - RNA, 64 nt, Homo Sapiens; identical to SEQ ID NO: 237603

SEQ ID NO: 511996 - RNA, 64 nt, Homo Sapiens; identical to SEQ ID NO: 237604

SEQ ID NO: 511997 - RNA, 64 nt, Homo Sapiens; identical to SEQ ID NO: 237605

SEQ ID NO: 511998 - RNA, 64 nt, Homo Sapiens; identical to SEQ ID NO: 237606

SEQ ID NO: 511999 - RNA, 64 nt, Homo Sapiens; identical to SEQ ID NO: 237607

SEQ ID NO: 512000 - RNA, 64 nt, Homo Sapiens; identical to SEQ ID NO: 237608

SEQ ID NO: 512001 - RNA, 64 nt, Homo Sapiens; identical to SEQ ID NO: 237609

SEQ ID NO: 512002 - RNA, 64 nt, Homo Sapiens; identical to SEQ ID NO: 237610

SEQ ID NO: 512003 - RNA, 64 nt, Homo Sapiens; identical to SEQ ID NO: 237611

SEQ ID NO: 512004 - RNA, 64 nt, Homo Sapiens; identical to SEQ ID NO: 237612

SEQ ID NO: 512005 - RNA, 64 nt, Homo Sapiens; identical to SEQ ID NO: 237613

SEQ ID NO: 512006 - RNA, 64 nt, Homo Sapiens; identical to SEQ ID NO: 237614

SEQ ID NO: 512007 - RNA, 64 nt, Homo Sapiens; identical to SEQ ID NO: 237615

SEQ ID NO: 512008 - RNA, 64 nt, Homo Sapiens; identical to SEQ ID NO: 237616

SEQ ID NO: 512009 - RNA, 64 nt, Homo Sapiens; identical to SEQ ID NO: 237617

SEQ ID NO: 512010 - RNA, 64 nt, Homo Sapiens; identical to SEQ ID NO: 237618

SEQ ID NO: 512011 - RNA, 64 nt, Homo Sapiens; identical to SEQ ID NO: 237619

SEQ ID NO: 512012 - RNA, 64 nt, Homo Sapiens; identical to SEQ ID NO: 237620

SEQ ID NO: 512013 - RNA, 64 nt, Homo Sapiens; identical to SEQ ID NO: 237621

SEQ ID NO: 512014 - RNA, 64 nt, Homo Sapiens; identical to SEQ ID NO: 237622

SEQ ID NO: 512015 - RNA, 64 nt, Homo Sapiens; identical to SEQ ID NO: 237623

SEQ ID NO: 512016 - RNA, 64 nt, Homo Sapiens; identical to SEQ ID NO: 237624

SEQ ID NO: 512017 - RNA, 64 nt, Homo Sapiens; identical to SEQ ID NO: 237625

SEQ ID NO: 512018 - RNA, 64 nt, Homo Sapiens; identical to SEQ ID NO: 237626

SEQ ID NO: 512019 - RNA, 64 nt, Homo Sapiens; identical to SEQ ID NO: 237627

SEQ ID NO: 512020 - RNA, 64 nt, Homo Sapiens; identical to SEQ ID NO: 237628

SEQ ID NO: 512021 - RNA, 64 nt, Homo Sapiens; identical to SEQ ID NO: 237629

SEQ ID NO: 512022 - RNA, 64 nt, Homo Sapiens; identical to SEQ ID NO: 237630

SEQ ID NO: 512023 - RNA, 64 nt, Homo Sapiens; identical to SEQ ID NO: 237631

SEQ ID NO: 512024 - RNA, 64 nt, Homo Sapiens; identical to SEQ ID NO: 237632

SEQ ID NO: 512025 - RNA, 64 nt, Homo Sapiens; identical to SEQ ID NO: 237633

SEQ ID NO: 512026 - RNA, 64 nt, Homo Sapiens; identical to SEQ ID NO: 237634

SEQ ID NO: 512027 - RNA, 64 nt, Homo Sapiens; identical to SEQ ID NO: 237635

SEQ ID NO: 512028 - RNA, 64 nt, Homo Sapiens; identical to SEQ ID NO: 237636

SEQ ID NO: 512029 - RNA, 64 nt, Homo Sapiens; identical to SEQ ID NO: 237637

SEQ ID NO: 512030 - RNA, 64 nt, Homo Sapiens; identical to SEQ ID NO: 237638

SEQ ID NO: 512031 - RNA, 64 nt, Homo Sapiens; identical to SEQ ID NO: 237639

SEQ ID NO: 512032 - RNA, 64 nt, Homo Sapiens; identical to SEQ ID NO: 237640

SEQ ID NO: 512033 - RNA, 64 nt, Homo Sapiens; identical to SEQ ID NO: 237641

SEQ ID NO: 512034 - RNA, 64 nt, Homo Sapiens; identical to SEQ ID NO: 237642

SEQ ID NO: 512035 - RNA, 64 nt, Homo Sapiens; identical to SEQ ID NO: 237643

SEQ ID NO: 512036 - RNA, 64 nt, Homo Sapiens; identical to SEQ ID NO: 237644

SEQ ID NO: 512037 - RNA, 64 nt, Homo Sapiens; identical to SEQ ID NO: 237645

SEQ ID NO: 512038 - RNA, 64 nt, Homo Sapiens; identical to SEQ ID NO: 237646

SEQ ID NO: 512039 - RNA, 64 nt, Homo Sapiens; identical to SEQ ID NO: 237647

SEQ ID NO: 512040 - RNA, 64 nt, Homo Sapiens; identical to SEQ ID NO: 237648

SEQ ID NO: 512041 - RNA, 64 nt, Homo Sapiens; identical to SEQ ID NO: 237649

SEQ ID NO: 512042 - RNA, 64 nt, Homo Sapiens; identical to SEQ ID NO: 237650

SEQ ID NO: 512043 - RNA, 64 nt, Homo Sapiens; identical to SEQ ID NO: 237651

SEQ ID NO: 512044 - RNA, 64 nt, Homo Sapiens; identical to SEQ ID NO: 237652

SEQ ID NO: 512045 - RNA, 64 nt, Homo Sapiens; identical to SEQ ID NO: 237653

SEQ ID NO: 512046 - RNA, 64 nt, Homo Sapiens; identical to SEQ ID NO: 237654

SEQ ID NO: 512047 - RNA, 64 nt, Homo Sapiens; identical to SEQ ID NO: 237655

SEQ ID NO: 512048 - RNA, 64 nt, Homo Sapiens; identical to SEQ ID NO: 237656

SEQ ID NO: 512049 - RNA, 64 nt, Homo Sapiens; identical to SEQ ID NO: 237657

SEQ ID NO: 512050 - RNA, 64 nt, Homo Sapiens; identical to SEQ ID NO: 237658

SEQ ID NO: 512051 - RNA, 64 nt, Homo Sapiens; identical to SEQ ID NO: 237659

SEQ ID NO: 512052 - RNA, 64 nt, Homo Sapiens; identical to SEQ ID NO: 237660

SEQ ID NO: 512053 - RNA, 64 nt, Homo Sapiens; identical to SEQ ID NO: 237661

SEQ ID NO: 512054 - RNA, 64 nt, Homo Sapiens; identical to SEQ ID NO: 237662

SEQ ID NO: 512055 - RNA, 64 nt, Homo Sapiens; identical to SEQ ID NO: 237663

SEQ ID NO: 512056 - RNA, 64 nt, Homo Sapiens; identical to SEQ ID NO: 237664

SEQ ID NO: 512057 - RNA, 64 nt, Homo Sapiens; identical to SEQ ID NO: 237665

SEQ ID NO: 512058 - RNA, 64 nt, Homo Sapiens; identical to SEQ ID NO: 237666

SEQ ID NO: 512059 - RNA, 64 nt, Homo Sapiens; identical to SEQ ID NO: 237667

SEQ ID NO: 512060 - RNA, 64 nt, Homo Sapiens; identical to SEQ ID NO: 237668

SEQ ID NO: 512061 - RNA, 64 nt, Homo Sapiens; identical to SEQ ID NO: 237669

SEQ ID NO: 512062 - RNA, 64 nt, Homo Sapiens; identical to SEQ ID NO: 237670

SEQ ID NO: 512063 - RNA, 64 nt, Homo Sapiens; identical to SEQ ID NO: 237671

SEQ ID NO: 512064 - RNA, 64 nt, Homo Sapiens; identical to SEQ ID NO: 237672

SEQ ID NO: 512065 - RNA, 64 nt, Homo Sapiens; identical to SEQ ID NO: 237673

SEQ ID NO: 512066 - RNA, 64 nt, Homo Sapiens; identical to SEQ ID NO: 237674

SEQ ID NO: 512067 - RNA, 64 nt, Homo Sapiens; identical to SEQ ID NO: 237675

SEQ ID NO: 512068 - RNA, 64 nt, Homo Sapiens; identical to SEQ ID NO: 237676

SEQ ID NO: 512069 - RNA, 64 nt, Homo Sapiens; identical to SEQ ID NO: 237677

SEQ ID NO: 512070 - RNA, 64 nt, Homo Sapiens; identical to SEQ ID NO: 237678

SEQ ID NO: 512071 - RNA, 64 nt, Homo Sapiens; identical to SEQ ID NO: 237679

SEQ ID NO: 512072 - RNA, 64 nt, Homo Sapiens; identical to SEQ ID NO: 237680

SEQ ID NO: 512073 - RNA, 64 nt, Homo Sapiens; identical to SEQ ID NO: 237681

SEQ ID NO: 512074 - RNA, 64 nt, Homo Sapiens; identical to SEQ ID NO: 237682

SEQ ID NO: 512075 - RNA, 64 nt, Homo Sapiens; identical to SEQ ID NO: 237683

SEQ ID NO: 512076 - RNA, 64 nt, Homo Sapiens; identical to SEQ ID NO: 237684

SEQ ID NO: 512077 - RNA, 64 nt, Homo Sapiens; identical to SEQ ID NO: 237685

SEQ ID NO: 512078 - RNA, 64 nt, Homo Sapiens; identical to SEQ ID NO: 237686

SEQ ID NO: 512079 - RNA, 64 nt, Homo Sapiens; identical to SEQ ID NO: 237687

SEQ ID NO: 512080 - RNA, 64 nt, Homo Sapiens; identical to SEQ ID NO: 237688

SEQ ID NO: 512081 - RNA, 64 nt, Homo Sapiens; identical to SEQ ID NO: 237689

SEQ ID NO: 512082 - RNA, 64 nt, Homo Sapiens; identical to SEQ ID NO: 237690

SEQ ID NO: 512083 - RNA, 64 nt, Homo Sapiens; identical to SEQ ID NO: 237691

SEQ ID NO: 512084 - RNA, 64 nt, Homo Sapiens; identical to SEQ ID NO: 237692

SEQ ID NO: 512085 - RNA, 64 nt, Homo Sapiens; identical to SEQ ID NO: 237693

SEQ ID NO: 512086 - RNA, 64 nt, Homo Sapiens; identical to SEQ ID NO: 237694

SEQ ID NO: 512087 - RNA, 64 nt, Homo Sapiens; identical to SEQ ID NO: 237695

SEQ ID NO: 512088 - RNA, 64 nt, Homo Sapiens; identical to SEQ ID NO: 237696

SEQ ID NO: 512089 - RNA, 64 nt, Homo Sapiens; identical to SEQ ID NO: 237697

SEQ ID NO: 512090 - RNA, 64 nt, Homo Sapiens; identical to SEQ ID NO: 237698

SEQ ID NO: 512091 - RNA, 64 nt, Homo Sapiens; identical to SEQ ID NO: 237699

SEQ ID NO: 512092 - RNA, 64 nt, Homo Sapiens; identical to SEQ ID NO: 237700

SEQ ID NO: 512093 - RNA, 64 nt, Homo Sapiens; identical to SEQ ID NO: 237701

SEQ ID NO: 512094 - RNA, 64 nt, Homo Sapiens; identical to SEQ ID NO: 237702

SEQ ID NO: 512095 - RNA, 64 nt, Homo Sapiens; identical to SEQ ID NO: 237703

SEQ ID NO: 512096 - RNA, 64 nt, Homo Sapiens; identical to SEQ ID NO: 237704

SEQ ID NO: 512097 - RNA, 64 nt, Homo Sapiens; identical to SEQ ID NO: 237705

SEQ ID NO: 512098 - RNA, 64 nt, Homo Sapiens; identical to SEQ ID NO: 237706

SEQ ID NO: 512099 - RNA, 64 nt, Homo Sapiens; identical to SEQ ID NO: 237707

SEQ ID NO: 512100 - RNA, 64 nt, Homo Sapiens; identical to SEQ ID NO: 237708

SEQ ID NO: 512101 - RNA, 64 nt, Homo Sapiens; identical to SEQ ID NO: 237709

SEQ ID NO: 512102 - RNA, 64 nt, Homo Sapiens; identical to SEQ ID NO: 237710

SEQ ID NO: 512103 - RNA, 64 nt, Homo Sapiens; identical to SEQ ID NO: 237711

SEQ ID NO: 512104 - RNA, 64 nt, Homo Sapiens; identical to SEQ ID NO: 237712

SEQ ID NO: 512105 - RNA, 64 nt, Homo Sapiens; identical to SEQ ID NO: 237713

SEQ ID NO: 512106 - RNA, 64 nt, Homo Sapiens; identical to SEQ ID NO: 237714

SEQ ID NO: 512107 - RNA, 64 nt, Homo Sapiens; identical to SEQ ID NO: 237715

SEQ ID NO: 512108 - RNA, 64 nt, Homo Sapiens; identical to SEQ ID NO: 237716

SEQ ID NO: 512109 - RNA, 64 nt, Homo Sapiens; identical to SEQ ID NO: 237717

SEQ ID NO: 512110 - RNA, 64 nt, Homo Sapiens; identical to SEQ ID NO: 237718

SEQ ID NO: 512111 - RNA, 64 nt, Homo Sapiens; identical to SEQ ID NO: 237719

SEQ ID NO: 512112 - RNA, 64 nt, Homo Sapiens; identical to SEQ ID NO: 237720

SEQ ID NO: 512113 - RNA, 64 nt, Homo Sapiens; identical to SEQ ID NO: 237721

SEQ ID NO: 512114 - RNA, 64 nt, Homo Sapiens; identical to SEQ ID NO: 237722

SEQ ID NO: 512115 - RNA, 64 nt, Homo Sapiens; identical to SEQ ID NO: 237723

SEQ ID NO: 512116 - RNA, 64 nt, Homo Sapiens; identical to SEQ ID NO: 237724

SEQ ID NO: 512117 - RNA, 64 nt, Homo Sapiens; identical to SEQ ID NO: 237725

SEQ ID NO: 512118 - RNA, 64 nt, Homo Sapiens; identical to SEQ ID NO: 237726

SEQ ID NO: 512119 - RNA, 64 nt, Homo Sapiens; identical to SEQ ID NO: 237727

SEQ ID NO: 512120 - RNA, 64 nt, Homo Sapiens; identical to SEQ ID NO: 237728

SEQ ID NO: 512121 - RNA, 64 nt, Homo Sapiens; identical to SEQ ID NO: 237729

SEQ ID NO: 512122 - RNA, 64 nt, Homo Sapiens; identical to SEQ ID NO: 237730

SEQ ID NO: 512123 - RNA, 64 nt, Homo Sapiens; identical to SEQ ID NO: 237731

SEQ ID NO: 512124 - RNA, 64 nt, Homo Sapiens; identical to SEQ ID NO: 237732

SEQ ID NO: 512125 - RNA, 64 nt, Homo Sapiens; identical to SEQ ID NO: 237733

SEQ ID NO: 512126 - RNA, 64 nt, Homo Sapiens
augggagggcaugagggaacacuucuuaugagaaaacauuuauaaacaaaagaaacauuuauaa

SEQ ID NO: 512127 - RNA, 64 nt, Homo Sapiens
cacuucuuaugagaaaacauuuauaaacaaaagaaacauuuauaaacuaaagaaaaacuaaaag

SEQ ID NO: 512128 - RNA, 64 nt, Homo Sapiens
cauuaauaaaacuuagaaacaguauaauuaguauaacauuuacucugaauuugaagauuuccug

SEQ ID NO: 512129 - RNA, 64 nt, Homo Sapiens
cauguuuugacauuguaauaucuuuuacuacuugaacauuuaaauuucuaaaugagaaagguau

SEQ ID NO: 512130 - RNA, 64 nt, Homo Sapiens
uuugagucaaaacugauuuaguguucuuccaaacaacauuuauguguuggccuacagaguuuau

SEQ ID NO: 512131 - RNA, 64 nt, Homo Sapiens
uucauugaaaucuguucaaaaacagauuaagacaaacauuuaugauggucuguaucaaucagca

SEQ ID NO: 512132 - RNA, 64 nt, Homo Sapiens
acauucauguacccacuaucagguuaagaaauagaacauuuauuaauauguaggaauguuaaga

SEQ ID NO: 512133 - RNA, 64 nt, Homo Sapiens
acauuuauuaauauguaggaauguuaagaaauaaaacauuuaauaagaucucagaagacuccag

SEQ ID NO: 512134 - RNA, 64 nt, Homo Sapiens
ugaaauacuucagaucacaugaaaaugcugauuuaacauuuaaguaucacagcauuaaaagaaa

SEQ ID NO: 512135 - RNA, 64 nt, Homo Sapiens
ucguggguuuuguuuuuaagcaaaacaaugugaaaacauuuaaguuugaaauguugcauuugaa

SEQ ID NO: 512136 - RNA, 64 nt, Homo Sapiens
aaacaccccaggguaggucucugcaauacuuuaaaacauuuagaguguggagauauucauaauu

SEQ ID NO: 512137 - RNA, 64 nt, Homo Sapiens
ggcagaaaguuaauaaacugcaaugguuugacauaacauuuauauggcauuuucacaauaacug

SEQ ID NO: 512138 - RNA, 64 nt, Homo Sapiens
ugaugcuuuaggcuaguuagugcauuuuuuagcaaacauuuaucuuaaacaucacagauccacu

SEQ ID NO: 512139 - RNA, 64 nt, Homo Sapiens
agguggauauauaauuuaaaagcuugauuuaauaaacauuuaacccccuaaacuugcaccgugg

SEQ ID NO: 512140 - RNA, 64 nt, Homo Sapiens
uuugccauuuuugcauuguuucguuuuuaacuggaacauuuagaaagaaggaaaugaaugugca

SEQ ID NO: 512141 - RNA, 64 nt, Homo Sapiens
ccugccaauugaaugauuucguagcugaaguagaaacauuuagguuucuguagcauuaaauugu

SEQ ID NO: 512142 - RNA, 64 nt, Homo Sapiens
cagugagcucagaggcccuucucacugagacagcaacauuuaaaccaaaccagaggaaguauuu

SEQ ID NO: 512143 - RNA, 64 nt, Homo Sapiens
ucagcuggguuuuuaauuagcgcauucucuauccaacauuuaauuguuugaaagccuccauaua

SEQ ID NO: 512144 - RNA, 64 nt, Homo Sapiens
accgguuugugguacacaaaagaucugccuuauaaacauuuaaaggcuggaaccagcaguucag

SEQ ID NO: 512145 - RNA, 64 nt, Homo Sapiens
guagaugaaaauguggugaucccacucccuccagaacauuuaguuucccuucccucccccuuca

SEQ ID NO: 512146 - RNA, 64 nt, Homo Sapiens
auucauuugugaaacuguaugacaaaaacaguaaaacauuuaauuagaaaugucugaaacuuua

SEQ ID NO: 512147 - RNA, 64 nt, Homo Sapiens
agcagauuuuuucaaaaucguguuauuccuuaaaaacauuuaaaaaagauuguuauuguaauuu

SEQ ID NO: 512148 - RNA, 64 nt, Homo Sapiens
auuacuguguaauuauaaacucagguugguacuaaacauuuauacaacaaaauaguguuuguca

SEQ ID NO: 512149 - RNA, 64 nt, Homo Sapiens
auuccaacauuguggauuucucugggccgcucuaaacauuuauagguuugggcuugucuucuag

SEQ ID NO: 512150 - RNA, 64 nt, Homo Sapiens
gaugaacaaagacaucuaaauaucuguagauagaaacauuuaucuaucuaaauauauugauaga

SEQ ID NO: 512151 - RNA, 64 nt, Homo Sapiens
ugugaaauguauucaacaauggaauauuuucuaaaacauuuaguauacauuugaauguauuuua

SEQ ID NO: 512152 - RNA, 64 nt, Homo Sapiens
uuuuuccggugaacagaagauuuguuuggauuuaaacauuuacuaagacaguaccuauuaggaa

SEQ ID NO: 512153 - RNA, 64 nt, Homo Sapiens
ucaaccauuuuaacuuucaucucuagggauguuuaacauuuauaauugcaaaauaaaccaacua

SEQ ID NO: 512154 - RNA, 64 nt, Homo Sapiens
uauaaacaguaauagcuacguuugggaaggaggaaacauuuaaauuauaaaggacugaauaauc

SEQ ID NO: 512155 - RNA, 64 nt, Homo Sapiens
cauuagagcaaugacuguauuuuguuguccuuauaacauuuauauuauuucaguuuuaagucaa

SEQ ID NO: 512156 - RNA, 64 nt, Homo Sapiens
aucuucaaaguacaaaucuucacaucauagauuuaacauuuaccuugcagcuagagguuacugu

SEQ ID NO: 512157 - RNA, 64 nt, Homo Sapiens
cagggaaauggaucauugauacuucuggccauauaacauuuacacacaaagugcauguguacuc

SEQ ID NO: 512158 - RNA, 64 nt, Homo Sapiens
aauuaguuuauuaucagauauuuaaaaauuauuaaacauuuaaauuaucuggcauuuuuaaaca

SEQ ID NO: 512159 - RNA, 64 nt, Homo Sapiens
aauuauuaaacauuuaaaaaaucuggcauuuuuaaacauuuaaauucuguuagaaauuaguuuu

SEQ ID NO: 512160 - RNA, 64 nt, Homo Sapiens
auaguuaauauuuucuuagauauuuucuucccauaacauuuagucccuuaacucacauucaaug

SEQ ID NO: 512161 - RNA, 64 nt, Homo Sapiens
aguauugugauugaaaaauucuuuaugccugaauaacauuuagcagggaacaguggguaagaaa

SEQ ID NO: 512162 - RNA, 64 nt, Homo Sapiens
uaaacguauuaaguuuaacauauuaaauuaauuuaacauuuagacuaacauuaacauuuaaauu

SEQ ID NO: 512163 - RNA, 64 nt, Homo Sapiens
cauauuaaauuaauuuaacauuuagacuaacauuaacauuuaaauuaauauguuaagugaauau

SEQ ID NO: 512164 - RNA, 64 nt, Homo Sapiens
aaauguauguguggggcugauuugagaagaaaagaacauuuaaucacuagaguuaccauucaua

SEQ ID NO: 512165 - RNA, 64 nt, Homo Sapiens
augucaauuagugaaaguauaaagaaaaaucuugaacauuuaugcaugccuucucucucccugc

SEQ ID NO: 512166 - RNA, 64 nt, Homo Sapiens
uuuacuuaauuguagaaaauauguguuaaaauuuaacauuuagauuguguacauaauuggauau

SEQ ID NO: 512167 - RNA, 64 nt, Homo Sapiens
guauaaaaauuuaaacuaauuauuuugagcuuagaacauuuaugauuuuaauuuucauugucaa

SEQ ID NO: 512168 - RNA, 64 nt, Homo Sapiens
gaaacuaagaaauguuuuaauuuauuaccuuuacaacauuuauuuacauuacauacauacauuu

SEQ ID NO: 512169 - RNA, 64 nt, Homo Sapiens
acaacauuuauuuacauuacauacauacauuuacaacauuuauuaauuuauauuaaaauagcau

SEQ ID NO: 512170 - RNA, 64 nt, Homo Sapiens
aaacaaaaacaaaaaaaaugauuuucucuuguaaaacauuuagauuacugauuaugcuuuugaa

SEQ ID NO: 512171 - RNA, 64 nt, Homo Sapiens
cuuacuaagcagaucaucaaucaaacugaggagcaacauuuauuucaaagacagcaaaaaccuc

SEQ ID NO: 512172 - RNA, 64 nt, Homo Sapiens
ugcacaaaagcccuguucacaggggaaugguguaaacauuuauacuguuuuguucacuguauuu

SEQ ID NO: 512173 - RNA, 64 nt, Homo Sapiens
ccuugaggauagugcuuagauaacagacucauuaaacauuuacugagugucugucagggaucau

SEQ ID NO: 512174 - RNA, 64 nt, Homo Sapiens
uguauaaaacauauuuuuggaucuuuaauugagaaacauuuaucauaccuauagcuuugguccc

SEQ ID NO: 512175 - RNA, 64 nt, Homo Sapiens
gcacuaacuuuaaagaaauuaauuauauuuggaaaacauuuaaucuauaaaaagacugacaggu

SEQ ID NO: 512176 - RNA, 64 nt, Homo Sapiens
auaauauaauuucagucauuacuguuaugcaguaaacauuuauauuugggaacaucaauuuugu

SEQ ID NO: 512177 - RNA, 64 nt, Homo Sapiens
aauuaagacaguaacaguauaaauaugcugucacaacauuuaggacuaauguaccucaguaauu

SEQ ID NO: 512178 - RNA, 64 nt, Homo Sapiens
ucuuuaggaauuucuuucuauagaguucuucauuaacauuuauacgaguuuuuugcugagucag

SEQ ID NO: 512179 - RNA, 64 nt, Homo Sapiens
uguuuuuaaaguuuccuuuacccugcccuuguugaacauuuauauaaucuaaccuggacaucaa

SEQ ID NO: 512180 - RNA, 64 nt, Homo Sapiens
uugagauucuuuguggcuauacacuauuucugggaacauuuauagaagauguaaacaaacaaau

SEQ ID NO: 512181 - RNA, 64 nt, Homo Sapiens
gguccguugccucugaagauguuuuuaaacccaaaacauuuaguauuugauaauuuuaaacauu

SEQ ID NO: 512182 - RNA, 64 nt, Homo Sapiens
agaaaaaaauagaaaaugcacauaagcaaaaggaaacauuuaaaugcuaucuuucaaagauaac

SEQ ID NO: 512183 - RNA, 64 nt, Homo Sapiens
aacuuugucuugucauuauaauaauaaaaaaaugaacauuuauuauggaauuucuaugagccug

SEQ ID NO: 512184 - RNA, 64 nt, Homo Sapiens
uuaaaaauaaacauuuuuuaaaucgucagaaggcaacauuuaccauguuccuuucagucuaucc

SEQ ID NO: 512185 - RNA, 64 nt, Homo Sapiens
aacugccugcugaauggaaggaaagcaacuuuaaaacauuuagaguuuugcugaguauagccaa

SEQ ID NO: 512186 - RNA, 64 nt, Homo Sapiens
gcauacaaaaacauauaaagcguuuuuauugugcaacauuuaaguccucuucuauuacuuaaaa

SEQ ID NO: 512187 - RNA, 64 nt, Homo Sapiens
uuucuaaaacaaacuuuucacauguaucuauaacaacauuuauaaaauccauuuuacauguuca

SEQ ID NO: 512188 - RNA, 64 nt, Homo Sapiens
auugacuugucaaagacucucuucaagccagcacaacauuuagacacaacacuguagaaauuug

SEQ ID NO: 512189 - RNA, 64 nt, Homo Sapiens
cugaaggccacgauugcuggcuccacaauuuaguaacauuuauauuaagauauauauauagugg

SEQ ID NO: 512190 - RNA, 64 nt, Homo Sapiens
aaggaagagaaacuucagccauagacaaagugaaaacauuuaaauccuaaaaugauaguggaua

SEQ ID NO: 512191 - RNA, 64 nt, Homo Sapiens
uaccucauucuuuaguguugaagucugugauuaaaacauuuauacaauuaauugcauacaguaa

SEQ ID NO: 512192 - RNA, 64 nt, Homo Sapiens
gagguuaucccucggaguagcguaaucacacaauaacauuuagaacuuaaauuggcuacaggac

SEQ ID NO: 512193 - RNA, 64 nt, Homo Sapiens
augaucuuauuuauucccauuuuugcccuuaguuaacauuuacuggugcucaccuaggauuggc

SEQ ID NO: 512194 - RNA, 64 nt, Homo Sapiens
gaauacaguaaaggagaaaaaacauuuaaugugaaacauuuaguucugauuucaaagguaauac

SEQ ID NO: 512195 - RNA, 64 nt, Homo Sapiens
gugaaacauuuagugaauacuucaaagguaauacaacauuuaauuagacaauguaucuucugau

SEQ ID NO: 512196 - RNA, 64 nt, Homo Sapiens
gugaggauugacagaaauuaucuaaagaugucuuaacauuuauaaaauguagccaugauguugu

SEQ ID NO: 512197 - RNA, 64 nt, Homo Sapiens
uggauaaagaugcaguauucuucauuagaaugauaacauuuauaauucugcacuuuggaaucag

SEQ ID NO: 512198 - RNA, 64 nt, Homo Sapiens
caaaugauuaaaugucaguuccccuaaaccaauaaacauuuauacuagauuuuuuauuuccacu

SEQ ID NO: 512199 - RNA, 64 nt, Homo Sapiens
ugucuucaucaucauacauguagaaaagaaucugaacauuuaagugcgaaguuuucucuagaaa

SEQ ID NO: 512200 - RNA, 64 nt, Homo Sapiens
ucaaaucacugaauucauggauguuuaacauaacaacauuuauuaaccuuuagauuugcucaua

SEQ ID NO: 512201 - RNA, 64 nt, Homo Sapiens
ccuaaugcacgccuagaauggggcaucacaaauuaacauuuacuacagguugaaagucuuuuaa

SEQ ID NO: 512202 - RNA, 64 nt, Homo Sapiens
gccuuuauuuuauguuuaggcuuauuuuuaaauuaacauuuaacagaaacauuugaaauagaau

SEQ ID NO: 512203 - RNA, 64 nt, Homo Sapiens
uuuugggccacuccacggcaggucccuagccugcaacauuuaugucgcaugucaauccgaagag

SEQ ID NO: 512204 - RNA, 64 nt, Homo Sapiens
uauaaugacauucugauuauaaauggcacagcauaacauuuaaugaaggucugauaaacugaug

SEQ ID NO: 512205 - RNA, 64 nt, Homo Sapiens
aaacauucaauaaugauuacaguuaacaaaagaaaacauuuaauagaauguuuccuuuuacuuc

SEQ ID NO: 512206 - RNA, 64 nt, Homo Sapiens
uuaccuagaaugccucauuuaaaagugccuugaaaacauuuagcuccccuucuucaugagcauc

SEQ ID NO: 512207 - RNA, 64 nt, Homo Sapiens
uguuagcagguuuuucuguuaguuuuucccccauaacauuuaauuauuacuaaaauuguauuua

SEQ ID NO: 512208 - RNA, 64 nt, Homo Sapiens
ugccaaguaucugggggauuucugauuuagaaauaacauuuaaacacauaguugcuuccuggua

SEQ ID NO: 512209 - RNA, 64 nt, Homo Sapiens
aaaaaauaauguaaugcaugaaagaauuuuauugaacauuuauuauugaguaauuuuccacuau

SEQ ID NO: 512210 - RNA, 64 nt, Homo Sapiens
agcagacaaaaacuuccucugucaagguguuauaaacauuuaaaaucacauuuuccauuuccau

SEQ ID NO: 512211 - RNA, 64 nt, Homo Sapiens
aaaacugggaaugugaauguaauauauguagaaaaacauuuagccacagcccaaaucuuccagg

SEQ ID NO: 512212 - RNA, 64 nt, Homo Sapiens
uuuuguuaaaauuaaaaaauugcauuauaguaagaacauuuaaguguuuagaguaauauucuuu

SEQ ID NO: 512213 - RNA, 64 nt, Homo Sapiens
ccaaaauaagucuauguaaacaguauauauuuaaaacauuuaaugagauauauuuuugcagaug

SEQ ID NO: 512214 - RNA, 64 nt, Homo Sapiens
uccucuuacaguucgaugcccauuaguuuuauauaacauuuauuugacacguacugacuucuau

SEQ ID NO: 512215 - RNA, 64 nt, Homo Sapiens
ccaguuuauggcuauuacaaauaaagcuucuaugaacauuuauguacaaaucuuuguauggaug

SEQ ID NO: 512216 - RNA, 64 nt, Homo Sapiens
cuuucguuucccuuuccccaaaaguagcguaaccaacauuuaagcuugcuuaaaaacgaaaacc

SEQ ID NO: 512217 - RNA, 64 nt, Homo Sapiens
uguuuccugacgguguacagaaucaacaaaauaaaacauuuaaagucugauuuuuuacauuuuu

SEQ ID NO: 512218 - RNA, 64 nt, Homo Sapiens
uuaaacccaagaagggcacuccaacaaagcuuacaacauuuaguccauuguccuaagaacaaug

SEQ ID NO: 512219 - RNA, 64 nt, Homo Sapiens
uuuaggugguuuccugaaaagaauuagaaaaguuaacauuuaucuuaauacuccuccuuuuaca

SEQ ID NO: 512220 - RNA, 64 nt, Homo Sapiens
gcguaccuccuauauucugccuucaccaucaauaaacauuuauucagaaauaggguuuucucau

SEQ ID NO: 512221 - RNA, 64 nt, Homo Sapiens
uuuuuauaugaauuguuucacugugagugaccuuaacauuuauauucuaaugugccauauuuug

SEQ ID NO: 512222 - RNA, 64 nt, Homo Sapiens
auauuuaccaggagaauuuuuuucuuaacaagccaacauuuaaaauuuauguuuuaugucaaua

SEQ ID NO: 512223 - RNA, 64 nt, Homo Sapiens
cuaauuauuuuuuucaaugagugcugaaugggaaaacauuuauaucuuacuauaaaagguucug

SEQ ID NO: 512224 - RNA, 64 nt, Homo Sapiens
ugguaucuacauccuuaccuaugaacacaacuguaacauuuaccauccauaguuuauuguuagu

SEQ ID NO: 512225 - RNA, 64 nt, Homo Sapiens
uucuuuuugugaccucagaaacuccuuguuagcuaacauuuaaaaaguccuguuuuugaugagc

SEQ ID NO: 512226 - RNA, 64 nt, Homo Sapiens
agguucacucaguagguguuaaaucaugucuuugaacauuuauuuauacauuuauuaggaaucu

SEQ ID NO: 512227 - RNA, 64 nt, Homo Sapiens
ccacucagguaugcaauuuuaaaauuuaggagagaacauuuaaggaaacuucuugcacuuauuu

SEQ ID NO: 512228 - RNA, 64 nt, Homo Sapiens
auuugaauaguaaguuucauuauuaaagcuugaaaacauuuagccuuggaauugauauauaccu

SEQ ID NO: 512229 - RNA, 64 nt, Homo Sapiens
accuugguugucuuucaauacuugacuagugguuaacauuuagcuuuucuucagacauuccuaa

SEQ ID NO: 512230 - RNA, 64 nt, Homo Sapiens
auaaauggaaucacauaauaauuugccuauucugaacauuuauuucugccuucuaucucuaugg

SEQ ID NO: 512231 - RNA, 64 nt, Homo Sapiens
uauaaauuuugugauuauagaguuucuaacaugaaacauuuaucauauugauuauuagccauaa

SEQ ID NO: 512232 - RNA, 64 nt, Homo Sapiens; identical to SEQ ID NO: 209315

SEQ ID NO: 512233 - RNA, 64 nt, Homo Sapiens; identical to SEQ ID NO: 209316

SEQ ID NO: 512234 - RNA, 64 nt, Homo Sapiens; identical to SEQ ID NO: 209317

SEQ ID NO: 512235 - RNA, 64 nt, Homo Sapiens; identical to SEQ ID NO: 209318

SEQ ID NO: 512236 - RNA, 64 nt, Homo Sapiens; identical to SEQ ID NO: 209319

SEQ ID NO: 512237 - RNA, 64 nt, Homo Sapiens; identical to SEQ ID NO: 209320

SEQ ID NO: 512238 - RNA, 64 nt, Homo Sapiens; identical to SEQ ID NO: 209321

SEQ ID NO: 512239 - RNA, 64 nt, Homo Sapiens; identical to SEQ ID NO: 209322

SEQ ID NO: 512240 - RNA, 64 nt, Homo Sapiens; identical to SEQ ID NO: 209323

SEQ ID NO: 512241 - RNA, 64 nt, Homo Sapiens; identical to SEQ ID NO: 209324

SEQ ID NO: 512242 - RNA, 64 nt, Homo Sapiens; identical to SEQ ID NO: 209325

SEQ ID NO: 512243 - RNA, 64 nt, Homo Sapiens; identical to SEQ ID NO: 209326

SEQ ID NO: 512244 - RNA, 64 nt, Homo Sapiens; identical to SEQ ID NO: 209327

SEQ ID NO: 512245 - RNA, 64 nt, Homo Sapiens; identical to SEQ ID NO: 209328

SEQ ID NO: 512246 - RNA, 64 nt, Homo Sapiens; identical to SEQ ID NO: 209329

SEQ ID NO: 512247 - RNA, 64 nt, Homo Sapiens; identical to SEQ ID NO: 209330

SEQ ID NO: 512248 - RNA, 64 nt, Homo Sapiens; identical to SEQ ID NO: 209331

SEQ ID NO: 512249 - RNA, 64 nt, Homo Sapiens; identical to SEQ ID NO: 209332

SEQ ID NO: 512250 - RNA, 64 nt, Homo Sapiens; identical to SEQ ID NO: 209333

SEQ ID NO: 512251 - RNA, 64 nt, Homo Sapiens; identical to SEQ ID NO: 209334

SEQ ID NO: 512252 - RNA, 64 nt, Homo Sapiens; identical to SEQ ID NO: 209335

SEQ ID NO: 512253 - RNA, 64 nt, Homo Sapiens; identical to SEQ ID NO: 209336

SEQ ID NO: 512254 - RNA, 64 nt, Homo Sapiens; identical to SEQ ID NO: 209337

SEQ ID NO: 512255 - RNA, 64 nt, Homo Sapiens; identical to SEQ ID NO: 209338

SEQ ID NO: 512256 - RNA, 64 nt, Homo Sapiens; identical to SEQ ID NO: 209339

SEQ ID NO: 512257 - RNA, 64 nt, Homo Sapiens; identical to SEQ ID NO: 209340

SEQ ID NO: 512258 - RNA, 64 nt, Homo Sapiens; identical to SEQ ID NO: 209341

SEQ ID NO: 512259 - RNA, 64 nt, Homo Sapiens; identical to SEQ ID NO: 209342

SEQ ID NO: 512260 - RNA, 64 nt, Homo Sapiens; identical to SEQ ID NO: 209343

SEQ ID NO: 512261 - RNA, 64 nt, Homo Sapiens; identical to SEQ ID NO: 209344

SEQ ID NO: 512262 - RNA, 64 nt, Homo Sapiens; identical to SEQ ID NO: 209345

SEQ ID NO: 512263 - RNA, 64 nt, Homo Sapiens; identical to SEQ ID NO: 209346

SEQ ID NO: 512264 - RNA, 64 nt, Homo Sapiens; identical to SEQ ID NO: 209347

SEQ ID NO: 512265 - RNA, 64 nt, Homo Sapiens; identical to SEQ ID NO: 209348

SEQ ID NO: 512266 - RNA, 64 nt, Homo Sapiens; identical to SEQ ID NO: 209349

SEQ ID NO: 512267 - RNA, 64 nt, Homo Sapiens; identical to SEQ ID NO: 209350

SEQ ID NO: 512268 - RNA, 64 nt, Homo Sapiens; identical to SEQ ID NO: 209351

SEQ ID NO: 512269 - RNA, 64 nt, Homo Sapiens; identical to SEQ ID NO: 209352

SEQ ID NO: 512270 - RNA, 64 nt, Homo Sapiens; identical to SEQ ID NO: 37560

SEQ ID NO: 512271 - RNA, 64 nt, Homo Sapiens; identical to SEQ ID NO: 37561

SEQ ID NO: 512272 - RNA, 64 nt, Homo Sapiens; identical to SEQ ID NO: 37562

SEQ ID NO: 512273 - RNA, 64 nt, Homo Sapiens; identical to SEQ ID NO: 37563

SEQ ID NO: 512274 - RNA, 64 nt, Homo Sapiens; identical to SEQ ID NO: 37564

SEQ ID NO: 512275 - RNA, 64 nt, Homo Sapiens; identical to SEQ ID NO: 37565

SEQ ID NO: 512276 - RNA, 64 nt, Homo Sapiens; identical to SEQ ID NO: 37566

SEQ ID NO: 512277 - RNA, 64 nt, Homo Sapiens; identical to SEQ ID NO: 37567

SEQ ID NO: 512278 - RNA, 64 nt, Homo Sapiens; identical to SEQ ID NO: 37568

SEQ ID NO: 512279 - RNA, 64 nt, Homo Sapiens; identical to SEQ ID NO: 37569

SEQ ID NO: 512280 - RNA, 64 nt, Homo Sapiens; identical to SEQ ID NO: 37570

SEQ ID NO: 512281 - RNA, 64 nt, Homo Sapiens; identical to SEQ ID NO: 37571

SEQ ID NO: 512282 - RNA, 64 nt, Homo Sapiens; identical to SEQ ID NO: 37572

SEQ ID NO: 512283 - RNA, 64 nt, Homo Sapiens; identical to SEQ ID NO: 37573

SEQ ID NO: 512284 - RNA, 64 nt, Homo Sapiens; identical to SEQ ID NO: 37574

SEQ ID NO: 512285 - RNA, 64 nt, Homo Sapiens; identical to SEQ ID NO: 37575

SEQ ID NO: 512286 - RNA, 64 nt, Homo Sapiens; identical to SEQ ID NO: 37576

SEQ ID NO: 512287 - RNA, 64 nt, Homo Sapiens; identical to SEQ ID NO: 37577

SEQ ID NO: 512288 - RNA, 64 nt, Homo Sapiens; identical to SEQ ID NO: 37578

SEQ ID NO: 512289 - RNA, 64 nt, Homo Sapiens; identical to SEQ ID NO: 37579

SEQ ID NO: 512290 - RNA, 64 nt, Homo Sapiens; identical to SEQ ID NO: 37580

SEQ ID NO: 512291 - RNA, 64 nt, Homo Sapiens; identical to SEQ ID NO: 37581

SEQ ID NO: 512292 - RNA, 64 nt, Homo Sapiens; identical to SEQ ID NO: 155294

SEQ ID NO: 512293 - RNA, 64 nt, Homo Sapiens; identical to SEQ ID NO: 155295

SEQ ID NO: 512294 - RNA, 64 nt, Homo Sapiens; identical to SEQ ID NO: 155296

SEQ ID NO: 512295 - RNA, 64 nt, Homo Sapiens; identical to SEQ ID NO: 155297

SEQ ID NO: 512296 - RNA, 64 nt, Homo Sapiens; identical to SEQ ID NO: 155298

SEQ ID NO: 512297 - RNA, 64 nt, Homo Sapiens; identical to SEQ ID NO: 155299

SEQ ID NO: 512298 - RNA, 64 nt, Homo Sapiens; identical to SEQ ID NO: 155300

SEQ ID NO: 512299 - RNA, 64 nt, Homo Sapiens; identical to SEQ ID NO: 155301

SEQ ID NO: 512300 - RNA, 64 nt, Homo Sapiens; identical to SEQ ID NO: 155302

SEQ ID NO: 512301 - RNA, 64 nt, Homo Sapiens; identical to SEQ ID NO: 155303

SEQ ID NO: 512302 - RNA, 64 nt, Homo Sapiens; identical to SEQ ID NO: 155304

SEQ ID NO: 512303 - RNA, 64 nt, Homo Sapiens; identical to SEQ ID NO: 155305

SEQ ID NO: 512304 - RNA, 64 nt, Homo Sapiens; identical to SEQ ID NO: 155306

SEQ ID NO: 512305 - RNA, 64 nt, Homo Sapiens; identical to SEQ ID NO: 155307

SEQ ID NO: 512306 - RNA, 64 nt, Homo Sapiens; identical to SEQ ID NO: 155308

SEQ ID NO: 512307 - RNA, 64 nt, Homo Sapiens; identical to SEQ ID NO: 155309

SEQ ID NO: 512308 - RNA, 64 nt, Homo Sapiens; identical to SEQ ID NO: 155310

SEQ ID NO: 512309 - RNA, 64 nt, Homo Sapiens; identical to SEQ ID NO: 155311

SEQ ID NO: 512310 - RNA, 64 nt, Homo Sapiens; identical to SEQ ID NO: 155312

SEQ ID NO: 512311 - RNA, 64 nt, Homo Sapiens; identical to SEQ ID NO: 155313

SEQ ID NO: 512312 - RNA, 64 nt, Homo Sapiens; identical to SEQ ID NO: 155314

SEQ ID NO: 512313 - RNA, 64 nt, Homo Sapiens; identical to SEQ ID NO: 155315

SEQ ID NO: 512314 - RNA, 64 nt, Homo Sapiens; identical to SEQ ID NO: 155316

SEQ ID NO: 512315 - RNA, 64 nt, Homo Sapiens; identical to SEQ ID NO: 155317

SEQ ID NO: 512316 - RNA, 64 nt, Homo Sapiens; identical to SEQ ID NO: 155318

SEQ ID NO: 512317 - RNA, 64 nt, Homo Sapiens; identical to SEQ ID NO: 155319

SEQ ID NO: 512318 - RNA, 64 nt, Homo Sapiens; identical to SEQ ID NO: 155320

SEQ ID NO: 512319 - RNA, 64 nt, Homo Sapiens; identical to SEQ ID NO: 155321

SEQ ID NO: 512320 - RNA, 64 nt, Homo Sapiens; identical to SEQ ID NO: 155322

SEQ ID NO: 512321 - RNA, 64 nt, Homo Sapiens; identical to SEQ ID NO: 155323

SEQ ID NO: 512322 - RNA, 64 nt, Homo Sapiens; identical to SEQ ID NO: 155324

SEQ ID NO: 512323 - RNA, 64 nt, Homo Sapiens; identical to SEQ ID NO: 155325

SEQ ID NO: 512324 - RNA, 64 nt, Homo Sapiens; identical to SEQ ID NO: 155326

SEQ ID NO: 512325 - RNA, 64 nt, Homo Sapiens; identical to SEQ ID NO: 155327

SEQ ID NO: 512326 - RNA, 64 nt, Homo Sapiens; identical to SEQ ID NO: 155328

SEQ ID NO: 512327 - RNA, 64 nt, Homo Sapiens; identical to SEQ ID NO: 155329

SEQ ID NO: 512328 - RNA, 64 nt, Homo Sapiens; identical to SEQ ID NO: 155330

SEQ ID NO: 512329 - RNA, 64 nt, Homo Sapiens; identical to SEQ ID NO: 155331

SEQ ID NO: 512330 - RNA, 64 nt, Homo Sapiens; identical to SEQ ID NO: 155332

SEQ ID NO: 512331 - RNA, 64 nt, Homo Sapiens; identical to SEQ ID NO: 155333

SEQ ID NO: 512332 - RNA, 64 nt, Homo Sapiens; identical to SEQ ID NO: 155334

SEQ ID NO: 512333 - RNA, 64 nt, Homo Sapiens; identical to SEQ ID NO: 155335

SEQ ID NO: 512334 - RNA, 64 nt, Homo Sapiens; identical to SEQ ID NO: 155336

SEQ ID NO: 512335 - RNA, 64 nt, Homo Sapiens; identical to SEQ ID NO: 155337

SEQ ID NO: 512336 - RNA, 64 nt, Homo Sapiens; identical to SEQ ID NO: 155338

SEQ ID NO: 512337 - RNA, 64 nt, Homo Sapiens
ccucagauucagugcaggacaggggcuagaccucccaggcuaaguuucacaccuugccuggcca

SEQ ID NO: 512338 - RNA, 64 nt, Homo Sapiens
uccuugguuuccccacuguguccaagggaggggcccaggcuacauuccagggcaggucuggguu

SEQ ID NO: 512339 - RNA, 64 nt, Homo Sapiens
uucccaauauuugagaauaaucccgcuauguuguccaggcuacuuuuuuuuuuuagagaggagg

SEQ ID NO: 512340 - RNA, 64 nt, Homo Sapiens
uuaaaaaacuuuuuuuuuuacgugcagcaccaccccaggcuaaucgacuagcuggcauuacagg

SEQ ID NO: 512341 - RNA, 64 nt, Homo Sapiens
ggaugagaguccugggugugaggaacaccucccaccaggcuagaggcaacugcccaggaaggac

SEQ ID NO: 512342 - RNA, 64 nt, Homo Sapiens
guuguuguuuuuaagauggaguuucccucuguugccaggcuagagugcaguggcaugaucucgg

SEQ ID NO: 512343 - RNA, 64 nt, Homo Sapiens
cgaguagcugggaccacaggugccuaccaccaugccaggcuaauuuuuguauuuuuaguaaaga

SEQ ID NO: 512344 - RNA, 64 nt, Homo Sapiens
guuguuguuguugagacagagucucgcucugucgccaggcuagagugcgguggcgcgaucuuga

SEQ ID NO: 512345 - RNA, 64 nt, Homo Sapiens
ugaguagcugggacuacaggcacgcaccaccaugccaggcuaauuuuuuuguauuuuagcagag

SEQ ID NO: 512346 - RNA, 64 nt, Homo Sapiens
ucccuucucagccucauguccaccugccugccagccaggcuacaggugugacuuccuucucuaa

SEQ ID NO: 512347 - RNA, 64 nt, Homo Sapiens
auuuuuagcagagauggggguuucaccauguuggccaggcuagucucgaacuccugaccucagg

SEQ ID NO: 512348 - RNA, 64 nt, Homo Sapiens
gugcaguggugcaaucucagucucacucugucucccaggcuagaauuauuuuuuugagacagau

SEQ ID NO: 512349 - RNA, 64 nt, Homo Sapiens
cuugaacuccugaccucaaauuugacuauguuggccaggcuaguuauuuuuaguacagacaggg

SEQ ID NO: 512350 - RNA, 64 nt, Homo Sapiens
guggagaagggaccagggauugcaggccccaucuccaggcuaaggggaggagagcaucaucacu

SEQ ID NO: 512351 - RNA, 64 nt, Homo Sapiens
uuuguaaaggcaauucuuuugagagcaggauucuccaggcuaaaucaaaggcagcuaauccugu

SEQ ID NO: 512352 - RNA, 64 nt, Homo Sapiens
ugacccccagaguguggaaagaaagaccaucuccccaggcuaugccaucaccauacacaguggc

SEQ ID NO: 512353 - RNA, 64 nt, Homo Sapiens
cagcugccaucgaccuggagacugacaaccucauccaggcuaccauccgcacccaguuugauac

SEQ ID NO: 512354 - RNA, 64 nt, Homo Sapiens
gugcaguggcuauucacaggucuugcuauguugcccaggcuagauuuuuuuuuaagagacaagg

SEQ ID NO: 512355 - RNA, 64 nt, Homo Sapiens
ucacuuaccucccacccccuagagaacugaguucccaggcuaaaauuuuguauuucuuuaucug

SEQ ID NO: 512356 - RNA, 64 nt, Homo Sapiens
uguauugagcaucuguaaugugccagcauugugcccaggcuagggggcuauagaaacaucuaga

SEQ ID NO: 512357 - RNA, 64 nt, Homo Sapiens
cuuucuuuuuuuugagauggucuuguucugucaaccaggcuagaaugcagcggugcaaucauga

SEQ ID NO: 512358 - RNA, 64 nt, Homo Sapiens; identical to SEQ ID NO: 86796

SEQ ID NO: 512359 - RNA, 64 nt, Homo Sapiens; identical to SEQ ID NO: 86797

SEQ ID NO: 512360 - RNA, 64 nt, Homo Sapiens; identical to SEQ ID NO: 86798

SEQ ID NO: 512361 - RNA, 64 nt, Homo Sapiens; identical to SEQ ID NO: 86799

SEQ ID NO: 512362 - RNA, 64 nt, Homo Sapiens; identical to SEQ ID NO: 86800

SEQ ID NO: 512363 - RNA, 64 nt, Homo Sapiens; identical to SEQ ID NO: 86801

SEQ ID NO: 512364 - RNA, 64 nt, Homo Sapiens
uacguccugcuucuugguugagacuacugggauccuucagaaaagaaacacugggucccauagc

SEQ ID NO: 512365 - RNA, 64 nt, Homo Sapiens
gggucccauagcuaaauucucaaccgccaggcaccuucagaagaauccagccuaauacuggaau

SEQ ID NO: 512366 - RNA, 64 nt, Homo Sapiens
cuuuguacauaagagaugcucccagcuuugcuggcuucagaagcacugugcaggagaugacuuu

SEQ ID NO: 512367 - RNA, 64 nt, Homo Sapiens
uuugcccccuccuuuuacucgcagcucucugggccuucagaacccccaggggcuugugaggugg

SEQ ID NO: 512368 - RNA, 64 nt, Homo Sapiens
aaugaacaggagacacagauugggacaggauuaacuucagaauaacugaugguuauaaugacug

SEQ ID NO: 512369 - RNA, 50 nt, Homo Sapiens
auuuuuacuugcaagacgaucuucagaagcuuuauucucuguagcuauag

SEQ ID NO: 512370 - RNA, 64 nt, Homo Sapiens
caucugcaugugaacaccauccugccccagggcucuucagaaagugugaggggcaaggcugccc

SEQ ID NO: 512371 - RNA, 64 nt, Homo Sapiens
ggaaaggccagacuuugcuugaagguggauaagacuucagaagauggcagcuggguagcucuuu

SEQ ID NO: 512372 - RNA, 64 nt, Homo Sapiens
gcuguucugaaauuccuaagcccaggagaagauacuucagaaggcaaaaggaaaaaugaagugc

SEQ ID NO: 512373 - RNA, 64 nt, Homo Sapiens
uuucugcagagcccugcccuauucuuauuuaauacuucagaaaaaaauuugaaagauaagauuu

SEQ ID NO: 512374 - RNA, 64 nt, Homo Sapiens
ugcauuauacuaagaauuacaugccauaagaugacuucagaaauccuacuucagaaguguaaua

SEQ ID NO: 512375 - RNA, 64 nt, Homo Sapiens
aauuacaugccauaagaugacuucagaaauccuacuucagaaguguaauaaauggauggggaaa

SEQ ID NO: 512376 - RNA, 64 nt, Homo Sapiens
gaaggcucggauuccucuuccaauuccuccucuucuucagaaucaucuucagaaagugaacuug

SEQ ID NO: 512377 - RNA, 64 nt, Homo Sapiens
uccucuuccaauuccuccucuucuucagaaucaucuucagaaagugaacuugaacaugagagaa

SEQ ID NO: 512378 - RNA, 64 nt, Homo Sapiens
ggcagaauaaaucuaaagugauuaaaugagguggcuucagaaaucauuuauauccuauguauaa

SEQ ID NO: 512379 - RNA, 64 nt, Homo Sapiens
guuauuucaugaaucauucaugauucugggguugcuucagaagucuuuaacccuuacauuuaua

SEQ ID NO: 512380 - RNA, 64 nt, Homo Sapiens
uucuaauguuaucaggaguauauaugauuaaacacuucagaacuaugugauaaugguggcauua

SEQ ID NO: 512381 - RNA, 64 nt, Homo Sapiens
ugccauuuacggcaucccuuauuuaguaucaaggcuucagaaaaguguauuuuuuaaaaaaaua

SEQ ID NO: 512382 - RNA, 64 nt, Homo Sapiens
uuuaccugaauaaaugguaguaaucacaguuggccuucagaaccauccauaguaguaugaugau

SEQ ID NO: 512383 - RNA, 64 nt, Homo Sapiens
uuauucuguagauucuguggaacaagccuaucagcuucagaauggcauuguacucaauggauuu

SEQ ID NO: 512384 - RNA, 64 nt, Homo Sapiens
cuuuagaaaguauaaaauaucuuccuuauugccucuucagaaccggggcagaaaaauccccacu

SEQ ID NO: 512385 - RNA, 64 nt, Homo Sapiens
cacacucucugccuugaaaagaaaaugaagcucacuucagaacauucacaaaugucccugaaca

SEQ ID NO: 512386 - RNA, 64 nt, Homo Sapiens
ccaccaacaccccuagaacuuucagccauggugucuucagaauuguagcgcauuucugaaucua

SEQ ID NO: 512387 - RNA, 64 nt, Homo Sapiens
ccaaagaaaugugaaaggaccuuuugucacagcacuucagaaaauacacaacagccccuucugc

SEQ ID NO: 512388 - RNA, 64 nt, Homo Sapiens
uuucauuaaguuguuauuucaguuuuaaauguaccuucagaauaagcuuccccaccccaguuuu

SEQ ID NO: 512389 - RNA, 64 nt, Homo Sapiens
aaauguacaggaugccaguaaaaaaaaaaaauggcuucagaauuaaaacuaugaaauauuuuac

SEQ ID NO: 512390 - RNA, 64 nt, Homo Sapiens
cacucauuuuguuucaacgguccaaacgcccaaccuucagaaagaggaagucagauagaaauag

SEQ ID NO: 512391 - RNA, 64 nt, Homo Sapiens
ccccuccuuccuauuagcuacaaaacuggauaaacuucagaauaugagccaaugaguaggaagg

SEQ ID NO: 512392 - RNA, 64 nt, Homo Sapiens
cuaagucuagugaagguaccuuggccaguuugggcuucagaaguuaauguaaagcuggugaagu

SEQ ID NO: 512393 - RNA, 64 nt, Homo Sapiens
uucacuuauaaagaaacccuccuucaggucucagcuucagaacauauuuuaacuccuaauuuac

SEQ ID NO: 512394 - RNA, 64 nt, Homo Sapiens
auauuuuucaguagcuccaguuuuguuucucacccuucagaaaccaugccuguagcucucuucc

SEQ ID NO: 512395 - RNA, 64 nt, Homo Sapiens
ggcuaaaauauccagcuuuggaauuuuuagaagccuucagaagaggagaacaacaagguaccca

SEQ ID NO: 512396 - RNA, 64 nt, Homo Sapiens
agcacugaccaaggagacuuuuaagccagugguucuucagaaucaccuagaugccuccacccuc

SEQ ID NO: 512397 - RNA, 64 nt, Homo Sapiens
aaaugccauucagucuggacuucaaaucacuugucuucagaaaauaaaagauuuguuccacccg

SEQ ID NO: 512398 - RNA, 64 nt, Homo Sapiens
uacuucgcuuuuuucuuuuuuuuauagggcccaacuucagaaaauaaaauuguuuuucuaauac

SEQ ID NO: 512399 - RNA, 64 nt, Homo Sapiens
uauauaugcaagcacaacuuagcuggcagcaaagcuucagaaaaguggucuuuuccuguuaaca

SEQ ID NO: 512400 - RNA, 64 nt, Homo Sapiens
aguuugagcugcucaauaaauucugaacaguugccuucagaacucaaaagcuguugggaacgcc

SEQ ID NO: 512401 - RNA, 64 nt, Homo Sapiens
cuauuaucuuuaaagcccuaccacugaaaggccucuucagaaaagggcccuuuuuguccaagcc

SEQ ID NO: 512402 - RNA, 64 nt, Homo Sapiens
gauuccaguuccuguugugcuacauuauauugcccuucagaauaaaaucuagaauucuuggaag

SEQ ID NO: 512403 - RNA, 64 nt, Homo Sapiens
aaggaaauaggggaaaaaaaucagggauauauaccuucagaaauuuuuaaaaaggacauuucua

SEQ ID NO: 512404 - RNA, 64 nt, Homo Sapiens
gguuuuuaguauuuaauucuaaauuaaccaagugcuucagaacauuauuagacucugggagaga

SEQ ID NO: 512405 - RNA, 64 nt, Homo Sapiens
ucacugcuuuggcccccuuaucaucuucaaccuucuucagaagcguuccugcuaaucucccaug

SEQ ID NO: 512406 - RNA, 64 nt, Homo Sapiens
cuauggaagagaauauuccuugguugugcacaugcuucagaaucuugaagugacuguuguacca

SEQ ID NO: 512407 - RNA, 64 nt, Homo Sapiens
ucuuaagagugcuaaauuuugaaauuucauuuuccuucagaauagaucaucaagaaauacuuuc

SEQ ID NO: 512408 - RNA, 64 nt, Homo Sapiens
ugcagccaggacccgguaggccugagccucaacucuucagaaaauaguguuuuuaauauuccuc

SEQ ID NO: 512409 - RNA, 64 nt, Homo Sapiens
caacucuucagaaaauaguguuuuuaauauuccucuucagaaaauaguguuuuuaauauuccga

SEQ ID NO: 512410 - RNA, 64 nt, Homo Sapiens
cgauggcaggcauuccucugccccugcccuuucccuucagaaaauuuuccccuccacucagaaa

SEQ ID NO: 512411 - RNA, 64 nt, Homo Sapiens
uguggagcaagaaaggauuugcccuagggagguccuucagaauccugggacagaggcuacaucu

SEQ ID NO: 512412 - RNA, 64 nt, Homo Sapiens
uagaugugaaaaucuacacacgcuuagaucaugucuucagaacucaacuucagaagcucuucca

SEQ ID NO: 512413 - RNA, 64 nt, Homo Sapiens
ucuuccacgcuuagaucaugagaucaguggucaacuucagaagcagaugugacuugcacucaga

SEQ ID NO: 512414 - RNA, 64 nt, Homo Sapiens
ggcuuggggaggagucccucuagguagaacacagcuucagaaacuagcuuuaagaaauaauucu

SEQ ID NO: 512415 - RNA, 64 nt, Homo Sapiens
gcuuauuagaggacaagaucaggacugcuuucagcuucagaacacuuuugguucagaacagcga

SEQ ID NO: 512416 - RNA, 64 nt, Homo Sapiens
uggugguacagaagguaucagucaagcgcaggcucuucagaaaccuagaaacuaaaaagagaug

SEQ ID NO: 512417 - RNA, 64 nt, Homo Sapiens
aaucacugaaaauagaacacuucuuggaggcuuucuucagaacugaacuagaaacaagguuucc

SEQ ID NO: 512418 - RNA, 64 nt, Homo Sapiens
gacguccuucugccagagacauuguucacuaggucuucagaaugccuuccugaaaugagcagaa

SEQ ID NO: 512419 - RNA, 64 nt, Homo Sapiens
uuccugaaaugagcagaaaugacggaguucacuucuucagaaccucuggacacuuguuuauucu

SEQ ID NO: 512420 - RNA, 64 nt, Homo Sapiens
uacuccaggacucucacaaagcugaugagcuguacuucagaaaaaaauaauaauuuccauguuu

SEQ ID NO: 512421 - RNA, 64 nt, Homo Sapiens
ggcugaugaauuuguuuucaucugucuuuucccccuucagaauuuuccuuggaaaaaaaauacu

SEQ ID NO: 512422 - RNA, 64 nt, Homo Sapiens
cagaucuuggggagaguccccucuaguuuguggccuucagaaauuuauuugacugugagacguc

SEQ ID NO: 512423 - RNA, 64 nt, Homo Sapiens
uuacauuccagauaauaugauauacuugacuugccuucagaauaugccuuuuguuuuucucugc

SEQ ID NO: 512424 - RNA, 64 nt, Homo Sapiens; identical to SEQ ID NO: 51839

SEQ ID NO: 512425 - RNA, 64 nt, Homo Sapiens; identical to SEQ ID NO: 51840

SEQ ID NO: 512426 - RNA, 64 nt, Homo Sapiens; identical to SEQ ID NO: 51841

SEQ ID NO: 512427 - RNA, 64 nt, Homo Sapiens; identical to SEQ ID NO: 51842

SEQ ID NO: 512428 - RNA, 64 nt, Homo Sapiens; identical to SEQ ID NO: 51843

SEQ ID NO: 512429 - RNA, 64 nt, Homo Sapiens; identical to SEQ ID NO: 51844

SEQ ID NO: 512430 - RNA, 64 nt, Homo Sapiens; identical to SEQ ID NO: 51845

SEQ ID NO: 512431 - RNA, 64 nt, Homo Sapiens; identical to SEQ ID NO: 51846

SEQ ID NO: 512432 - RNA, 64 nt, Homo Sapiens; identical to SEQ ID NO: 51847

SEQ ID NO: 512433 - RNA, 64 nt, Homo Sapiens; identical to SEQ ID NO: 51848

SEQ ID NO: 512434 - RNA, 64 nt, Homo Sapiens; identical to SEQ ID NO: 51849

SEQ ID NO: 512435 - RNA, 64 nt, Homo Sapiens; identical to SEQ ID NO: 51850

SEQ ID NO: 512436 - RNA, 64 nt, Homo Sapiens; identical to SEQ ID NO: 51851

SEQ ID NO: 512437 - RNA, 64 nt, Homo Sapiens; identical to SEQ ID NO: 51852

SEQ ID NO: 512438 - RNA, 64 nt, Homo Sapiens; identical to SEQ ID NO: 51853

SEQ ID NO: 512439 - RNA, 64 nt, Homo Sapiens; identical to SEQ ID NO: 51854

SEQ ID NO: 512440 - RNA, 64 nt, Homo Sapiens; identical to SEQ ID NO: 51855

SEQ ID NO: 512441 - RNA, 64 nt, Homo Sapiens; identical to SEQ ID NO: 51856

SEQ ID NO: 512442 - RNA, 64 nt, Homo Sapiens; identical to SEQ ID NO: 51857

SEQ ID NO: 512443 - RNA, 64 nt, Homo Sapiens; identical to SEQ ID NO: 51858

SEQ ID NO: 512444 - RNA, 64 nt, Homo Sapiens; identical to SEQ ID NO: 51859

SEQ ID NO: 512445 - RNA, 64 nt, Homo Sapiens; identical to SEQ ID NO: 51860

SEQ ID NO: 512446 - RNA, 64 nt, Homo Sapiens; identical to SEQ ID NO: 51861

SEQ ID NO: 512447 - RNA, 64 nt, Homo Sapiens; identical to SEQ ID NO: 51862

SEQ ID NO: 512448 - RNA, 64 nt, Homo Sapiens; identical to SEQ ID NO: 51863

SEQ ID NO: 512449 - RNA, 64 nt, Homo Sapiens; identical to SEQ ID NO: 51864

SEQ ID NO: 512450 - RNA, 64 nt, Homo Sapiens; identical to SEQ ID NO: 51865

SEQ ID NO: 512451 - RNA, 64 nt, Homo Sapiens; identical to SEQ ID NO: 51866

SEQ ID NO: 512452 - RNA, 64 nt, Homo Sapiens; identical to SEQ ID NO: 51867

SEQ ID NO: 512453 - RNA, 64 nt, Homo Sapiens; identical to SEQ ID NO: 51868

SEQ ID NO: 512454 - RNA, 64 nt, Homo Sapiens; identical to SEQ ID NO: 51869

SEQ ID NO: 512455 - RNA, 64 nt, Homo Sapiens; identical to SEQ ID NO: 51870

SEQ ID NO: 512456 - RNA, 64 nt, Homo Sapiens; identical to SEQ ID NO: 51871

SEQ ID NO: 512457 - RNA, 64 nt, Homo Sapiens; identical to SEQ ID NO: 51872

SEQ ID NO: 512458 - RNA, 64 nt, Homo Sapiens; identical to SEQ ID NO: 51873

SEQ ID NO: 512459 - RNA, 64 nt, Homo Sapiens; identical to SEQ ID NO: 51874

SEQ ID NO: 512460 - RNA, 64 nt, Homo Sapiens; identical to SEQ ID NO: 51875

SEQ ID NO: 512461 - RNA, 64 nt, Homo Sapiens; identical to SEQ ID NO: 51876

SEQ ID NO: 512462 - RNA, 64 nt, Homo Sapiens; identical to SEQ ID NO: 51877

SEQ ID NO: 512463 - RNA, 64 nt, Homo Sapiens; identical to SEQ ID NO: 51878

SEQ ID NO: 512464 - RNA, 64 nt, Homo Sapiens; identical to SEQ ID NO: 51879

SEQ ID NO: 512465 - RNA, 64 nt, Homo Sapiens; identical to SEQ ID NO: 51880

SEQ ID NO: 512466 - RNA, 64 nt, Homo Sapiens; identical to SEQ ID NO: 51881

SEQ ID NO: 512467 - RNA, 64 nt, Homo Sapiens; identical to SEQ ID NO: 51882

SEQ ID NO: 512468 - RNA, 64 nt, Homo Sapiens; identical to SEQ ID NO: 51883

SEQ ID NO: 512469 - RNA, 64 nt, Homo Sapiens; identical to SEQ ID NO: 51884

SEQ ID NO: 512470 - RNA, 64 nt, Homo Sapiens; identical to SEQ ID NO: 51885

SEQ ID NO: 512471 - RNA, 64 nt, Homo Sapiens; identical to SEQ ID NO: 51886

SEQ ID NO: 512472 - RNA, 64 nt, Homo Sapiens; identical to SEQ ID NO: 51887

SEQ ID NO: 512473 - RNA, 64 nt, Homo Sapiens; identical to SEQ ID NO: 51888

SEQ ID NO: 512474 - RNA, 64 nt, Homo Sapiens; identical to SEQ ID NO: 51889

SEQ ID NO: 512475 - RNA, 64 nt, Homo Sapiens; identical to SEQ ID NO: 51890

SEQ ID NO: 512476 - RNA, 63 nt, Homo Sapiens; identical to SEQ ID NO: 51891

SEQ ID NO: 512477 - RNA, 64 nt, Homo Sapiens; identical to SEQ ID NO: 51892

SEQ ID NO: 512478 - RNA, 64 nt, Homo Sapiens; identical to SEQ ID NO: 51893

SEQ ID NO: 512479 - RNA, 64 nt, Homo Sapiens; identical to SEQ ID NO: 51894

SEQ ID NO: 512480 - RNA, 64 nt, Homo Sapiens; identical to SEQ ID NO: 51895

SEQ ID NO: 512481 - RNA, 64 nt, Homo Sapiens; identical to SEQ ID NO: 51896

SEQ ID NO: 512482 - RNA, 64 nt, Homo Sapiens; identical to SEQ ID NO: 51897

SEQ ID NO: 512483 - RNA, 64 nt, Homo Sapiens; identical to SEQ ID NO: 51898

SEQ ID NO: 512484 - RNA, 64 nt, Homo Sapiens; identical to SEQ ID NO: 51899

SEQ ID NO: 512485 - RNA, 64 nt, Homo Sapiens; identical to SEQ ID NO: 51900

SEQ ID NO: 512486 - RNA, 64 nt, Homo Sapiens; identical to SEQ ID NO: 51901

SEQ ID NO: 512487 - RNA, 64 nt, Homo Sapiens; identical to SEQ ID NO: 51902

SEQ ID NO: 512488 - RNA, 64 nt, Homo Sapiens; identical to SEQ ID NO: 51903

SEQ ID NO: 512489 - RNA, 64 nt, Homo Sapiens; identical to SEQ ID NO: 51904

SEQ ID NO: 512490 - RNA, 64 nt, Homo Sapiens; identical to SEQ ID NO: 51905

SEQ ID NO: 512491 - RNA, 64 nt, Homo Sapiens; identical to SEQ ID NO: 51906

SEQ ID NO: 512492 - RNA, 64 nt, Homo Sapiens; identical to SEQ ID NO: 51907

SEQ ID NO: 512493 - RNA, 64 nt, Homo Sapiens; identical to SEQ ID NO: 51908

SEQ ID NO: 512494 - RNA, 64 nt, Homo Sapiens; identical to SEQ ID NO: 51909

SEQ ID NO: 512495 - RNA, 64 nt, Homo Sapiens; identical to SEQ ID NO: 51910

SEQ ID NO: 512496 - RNA, 64 nt, Homo Sapiens; identical to SEQ ID NO: 51911

SEQ ID NO: 512497 - RNA, 64 nt, Homo Sapiens; identical to SEQ ID NO: 51912

SEQ ID NO: 512498 - RNA, 64 nt, Homo Sapiens; identical to SEQ ID NO: 51913

SEQ ID NO: 512499 - RNA, 64 nt, Homo Sapiens; identical to SEQ ID NO: 51914

SEQ ID NO: 512500 - RNA, 64 nt, Homo Sapiens; identical to SEQ ID NO: 51915

SEQ ID NO: 512501 - RNA, 64 nt, Homo Sapiens; identical to SEQ ID NO: 51916

SEQ ID NO: 512502 - RNA, 64 nt, Homo Sapiens; identical to SEQ ID NO: 51917

SEQ ID NO: 512503 - RNA, 64 nt, Homo Sapiens
uuagaaaguuucuuuugguuacguagguagagaauacaacaaagaguucuaagacuuagaaaag

SEQ ID NO: 512504 - RNA, 64 nt, Homo Sapiens
uucacaaagcuguaaagaccauugucuuaaauacuacaacaacuuaacacccuuuugugaagau

SEQ ID NO: 512505 - RNA, 64 nt, Homo Sapiens
uucuuuuuuguuacagcuauuuauguauauacuauacaacaauguuaaauggaguauuuuuauu

SEQ ID NO: 512506 - RNA, 64 nt, Homo Sapiens
acaacaacaacaauaacaaccaaaacaacaacaauacaacaagacucucuguacaaaaacaaaa

SEQ ID NO: 512507 - RNA, 64 nt, Homo Sapiens
aggaauacagcuaaccagggagaugaaagaucucuacaacaaaaauuacaaaacacugcugaaa

SEQ ID NO: 512508 - RNA, 64 nt, Homo Sapiens
acuaugcuuuuuaucuggaugaugaaauaaucuguacaacaaacccuggugacaugcaauuuac

SEQ ID NO: 512509 - RNA, 64 nt, Homo Sapiens
ucacuaacaacagauaagguagagcagugagguuuacaacaagcccuacaauuagagauugcug

SEQ ID NO: 512510 - RNA, 64 nt, Homo Sapiens
guauugaaauaaucaaagagauaauuucagcucuuacaacaagaacagaaaacaugcuaauuag

SEQ ID NO: 512511 - RNA, 64 nt, Homo Sapiens; identical to SEQ ID NO: 509252

SEQ ID NO: 512512 - RNA, 64 nt, Homo Sapiens; identical to SEQ ID NO: 509253

SEQ ID NO: 512513 - RNA, 64 nt, Homo Sapiens; identical to SEQ ID NO: 509254

SEQ ID NO: 512514 - RNA, 64 nt, Homo Sapiens; identical to SEQ ID NO: 509255

SEQ ID NO: 512515 - RNA, 64 nt, Homo Sapiens; identical to SEQ ID NO: 509256

SEQ ID NO: 512516 - RNA, 64 nt, Homo Sapiens; identical to SEQ ID NO: 509257

SEQ ID NO: 512517 - RNA, 64 nt, Homo Sapiens; identical to SEQ ID NO: 509258

SEQ ID NO: 512518 - RNA, 64 nt, Homo Sapiens; identical to SEQ ID NO: 509259

SEQ ID NO: 512519 - RNA, 64 nt, Homo Sapiens; identical to SEQ ID NO: 509260

SEQ ID NO: 512520 - RNA, 64 nt, Homo Sapiens; identical to SEQ ID NO: 509261

SEQ ID NO: 512521 - RNA, 64 nt, Homo Sapiens; identical to SEQ ID NO: 509262

SEQ ID NO: 512522 - RNA, 64 nt, Homo Sapiens; identical to SEQ ID NO: 509263

SEQ ID NO: 512523 - RNA, 64 nt, Homo Sapiens; identical to SEQ ID NO: 509264

SEQ ID NO: 512524 - RNA, 64 nt, Homo Sapiens; identical to SEQ ID NO: 509265

SEQ ID NO: 512525 - RNA, 64 nt, Homo Sapiens; identical to SEQ ID NO: 509266

SEQ ID NO: 512526 - RNA, 64 nt, Homo Sapiens; identical to SEQ ID NO: 509267

SEQ ID NO: 512527 - RNA, 64 nt, Homo Sapiens; identical to SEQ ID NO: 509268

SEQ ID NO: 512528 - RNA, 64 nt, Homo Sapiens; identical to SEQ ID NO: 509269

SEQ ID NO: 512529 - RNA, 64 nt, Homo Sapiens; identical to SEQ ID NO: 509270

SEQ ID NO: 512530 - RNA, 64 nt, Homo Sapiens; identical to SEQ ID NO: 509271

SEQ ID NO: 512531 - RNA, 64 nt, Homo Sapiens; identical to SEQ ID NO: 509272

SEQ ID NO: 512532 - RNA, 64 nt, Homo Sapiens; identical to SEQ ID NO: 509273

SEQ ID NO: 512533 - RNA, 64 nt, Homo Sapiens; identical to SEQ ID NO: 509274

SEQ ID NO: 512534 - RNA, 64 nt, Homo Sapiens; identical to SEQ ID NO: 509275

SEQ ID NO: 512535 - RNA, 64 nt, Homo Sapiens; identical to SEQ ID NO: 509276

SEQ ID NO: 512536 - RNA, 64 nt, Homo Sapiens; identical to SEQ ID NO: 509277

SEQ ID NO: 512537 - RNA, 64 nt, Homo Sapiens; identical to SEQ ID NO: 509278

SEQ ID NO: 512538 - RNA, 64 nt, Homo Sapiens; identical to SEQ ID NO: 509279

SEQ ID NO: 512539 - RNA, 64 nt, Homo Sapiens; identical to SEQ ID NO: 509280

SEQ ID NO: 512540 - RNA, 64 nt, Homo Sapiens; identical to SEQ ID NO: 509281

SEQ ID NO: 512541 - RNA, 64 nt, Homo Sapiens; identical to SEQ ID NO: 509282

SEQ ID NO: 512542 - RNA, 64 nt, Homo Sapiens; identical to SEQ ID NO: 509283

SEQ ID NO: 512543 - RNA, 64 nt, Homo Sapiens; identical to SEQ ID NO: 509284

SEQ ID NO: 512544 - RNA, 64 nt, Homo Sapiens; identical to SEQ ID NO: 509285

SEQ ID NO: 512545 - RNA, 64 nt, Homo Sapiens; identical to SEQ ID NO: 509286

SEQ ID NO: 512546 - RNA, 64 nt, Homo Sapiens; identical to SEQ ID NO: 509287

SEQ ID NO: 512547 - RNA, 64 nt, Homo Sapiens; identical to SEQ ID NO: 509288

SEQ ID NO: 512548 - RNA, 64 nt, Homo Sapiens; identical to SEQ ID NO: 509289

SEQ ID NO: 512549 - RNA, 64 nt, Homo Sapiens; identical to SEQ ID NO: 509290

SEQ ID NO: 512550 - RNA, 64 nt, Homo Sapiens; identical to SEQ ID NO: 509291

SEQ ID NO: 512551 - RNA, 64 nt, Homo Sapiens; identical to SEQ ID NO: 509292

SEQ ID NO: 512552 - RNA, 64 nt, Homo Sapiens; identical to SEQ ID NO: 509293

SEQ ID NO: 512553 - RNA, 64 nt, Homo Sapiens; identical to SEQ ID NO: 509294

SEQ ID NO: 512554 - RNA, 64 nt, Homo Sapiens; identical to SEQ ID NO: 509295

SEQ ID NO: 512555 - RNA, 64 nt, Homo Sapiens; identical to SEQ ID NO: 509296

SEQ ID NO: 512556 - RNA, 64 nt, Homo Sapiens; identical to SEQ ID NO: 509297

SEQ ID NO: 512557 - RNA, 64 nt, Homo Sapiens; identical to SEQ ID NO: 509298

SEQ ID NO: 512558 - RNA, 64 nt, Homo Sapiens; identical to SEQ ID NO: 509299

SEQ ID NO: 512559 - RNA, 64 nt, Homo Sapiens; identical to SEQ ID NO: 509300

SEQ ID NO: 512560 - RNA, 64 nt, Homo Sapiens; identical to SEQ ID NO: 509301

SEQ ID NO: 512561 - RNA, 64 nt, Homo Sapiens; identical to SEQ ID NO: 509302

SEQ ID NO: 512562 - RNA, 64 nt, Homo Sapiens; identical to SEQ ID NO: 509303

SEQ ID NO: 512563 - RNA, 64 nt, Homo Sapiens; identical to SEQ ID NO: 509304

SEQ ID NO: 512564 - RNA, 64 nt, Homo Sapiens; identical to SEQ ID NO: 509305

SEQ ID NO: 512565 - RNA, 64 nt, Homo Sapiens; identical to SEQ ID NO: 509306

SEQ ID NO: 512566 - RNA, 64 nt, Homo Sapiens; identical to SEQ ID NO: 509307

SEQ ID NO: 512567 - RNA, 64 nt, Homo Sapiens; identical to SEQ ID NO: 509308

SEQ ID NO: 512568 - RNA, 64 nt, Homo Sapiens; identical to SEQ ID NO: 509309

SEQ ID NO: 512569 - RNA, 64 nt, Homo Sapiens; identical to SEQ ID NO: 509310

SEQ ID NO: 512570 - RNA, 64 nt, Homo Sapiens; identical to SEQ ID NO: 509311

SEQ ID NO: 512571 - RNA, 64 nt, Homo Sapiens; identical to SEQ ID NO: 509312

SEQ ID NO: 512572 - RNA, 64 nt, Homo Sapiens; identical to SEQ ID NO: 509313

SEQ ID NO: 512573 - RNA, 64 nt, Homo Sapiens; identical to SEQ ID NO: 509314

SEQ ID NO: 512574 - RNA, 64 nt, Homo Sapiens; identical to SEQ ID NO: 509315

SEQ ID NO: 512575 - RNA, 64 nt, Homo Sapiens; identical to SEQ ID NO: 509316

SEQ ID NO: 512576 - RNA, 64 nt, Homo Sapiens; identical to SEQ ID NO: 509317

SEQ ID NO: 512577 - RNA, 64 nt, Homo Sapiens; identical to SEQ ID NO: 509318

SEQ ID NO: 512578 - RNA, 64 nt, Homo Sapiens; identical to SEQ ID NO: 509319

SEQ ID NO: 512579 - RNA, 64 nt, Homo Sapiens; identical to SEQ ID NO: 509320

SEQ ID NO: 512580 - RNA, 64 nt, Homo Sapiens; identical to SEQ ID NO: 509321

SEQ ID NO: 512581 - RNA, 64 nt, Homo Sapiens; identical to SEQ ID NO: 509322

SEQ ID NO: 512582 - RNA, 64 nt, Homo Sapiens; identical to SEQ ID NO: 509323

SEQ ID NO: 512583 - RNA, 64 nt, Homo Sapiens; identical to SEQ ID NO: 509324

SEQ ID NO: 512584 - RNA, 64 nt, Homo Sapiens; identical to SEQ ID NO: 509325

SEQ ID NO: 512585 - RNA, 64 nt, Homo Sapiens; identical to SEQ ID NO: 509326

SEQ ID NO: 512586 - RNA, 64 nt, Homo Sapiens; identical to SEQ ID NO: 509327

SEQ ID NO: 512587 - RNA, 64 nt, Homo Sapiens; identical to SEQ ID NO: 509328

SEQ ID NO: 512588 - RNA, 64 nt, Homo Sapiens; identical to SEQ ID NO: 509329

SEQ ID NO: 512589 - RNA, 64 nt, Homo Sapiens; identical to SEQ ID NO: 509330

SEQ ID NO: 512590 - RNA, 64 nt, Homo Sapiens; identical to SEQ ID NO: 509331

SEQ ID NO: 512591 - RNA, 64 nt, Homo Sapiens; identical to SEQ ID NO: 509332

SEQ ID NO: 512592 - RNA, 64 nt, Homo Sapiens; identical to SEQ ID NO: 509333

SEQ ID NO: 512593 - RNA, 64 nt, Homo Sapiens; identical to SEQ ID NO: 509334

SEQ ID NO: 512594 - RNA, 64 nt, Homo Sapiens; identical to SEQ ID NO: 509335

SEQ ID NO: 512595 - RNA, 64 nt, Homo Sapiens; identical to SEQ ID NO: 509336

SEQ ID NO: 512596 - RNA, 64 nt, Homo Sapiens; identical to SEQ ID NO: 509337

SEQ ID NO: 512597 - RNA, 64 nt, Homo Sapiens; identical to SEQ ID NO: 509338

SEQ ID NO: 512598 - RNA, 64 nt, Homo Sapiens; identical to SEQ ID NO: 509339

SEQ ID NO: 512599 - RNA, 64 nt, Homo Sapiens; identical to SEQ ID NO: 509340

SEQ ID NO: 512600 - RNA, 64 nt, Homo Sapiens; identical to SEQ ID NO: 509341

SEQ ID NO: 512601 - RNA, 64 nt, Homo Sapiens; identical to SEQ ID NO: 509342

SEQ ID NO: 512602 - RNA, 64 nt, Homo Sapiens; identical to SEQ ID NO: 509343

SEQ ID NO: 512603 - RNA, 64 nt, Homo Sapiens; identical to SEQ ID NO: 509344

SEQ ID NO: 512604 - RNA, 64 nt, Homo Sapiens; identical to SEQ ID NO: 509345

SEQ ID NO: 512605 - RNA, 64 nt, Homo Sapiens; identical to SEQ ID NO: 509346

SEQ ID NO: 512606 - RNA, 64 nt, Homo Sapiens; identical to SEQ ID NO: 509347

SEQ ID NO: 512607 - RNA, 64 nt, Homo Sapiens; identical to SEQ ID NO: 509348

SEQ ID NO: 512608 - RNA, 64 nt, Homo Sapiens; identical to SEQ ID NO: 509349

SEQ ID NO: 512609 - RNA, 64 nt, Homo Sapiens; identical to SEQ ID NO: 509350

SEQ ID NO: 512610 - RNA, 64 nt, Homo Sapiens; identical to SEQ ID NO: 509351

SEQ ID NO: 512611 - RNA, 64 nt, Homo Sapiens; identical to SEQ ID NO: 509352

SEQ ID NO: 512612 - RNA, 64 nt, Homo Sapiens; identical to SEQ ID NO: 509353

SEQ ID NO: 512613 - RNA, 64 nt, Homo Sapiens; identical to SEQ ID NO: 509354

SEQ ID NO: 512614 - RNA, 64 nt, Homo Sapiens; identical to SEQ ID NO: 509355

SEQ ID NO: 512615 - RNA, 64 nt, Homo Sapiens; identical to SEQ ID NO: 509356

SEQ ID NO: 512616 - RNA, 64 nt, Homo Sapiens; identical to SEQ ID NO: 509357

SEQ ID NO: 512617 - RNA, 64 nt, Homo Sapiens; identical to SEQ ID NO: 509358

SEQ ID NO: 512618 - RNA, 64 nt, Homo Sapiens; identical to SEQ ID NO: 509359

SEQ ID NO: 512619 - RNA, 64 nt, Homo Sapiens; identical to SEQ ID NO: 509360

SEQ ID NO: 512620 - RNA, 64 nt, Homo Sapiens; identical to SEQ ID NO: 509361

SEQ ID NO: 512621 - RNA, 64 nt, Homo Sapiens; identical to SEQ ID NO: 509362

SEQ ID NO: 512622 - RNA, 64 nt, Homo Sapiens; identical to SEQ ID NO: 509363

SEQ ID NO: 512623 - RNA, 64 nt, Homo Sapiens; identical to SEQ ID NO: 509364

SEQ ID NO: 512624 - RNA, 64 nt, Homo Sapiens; identical to SEQ ID NO: 509365

SEQ ID NO: 512625 - RNA, 64 nt, Homo Sapiens; identical to SEQ ID NO: 509366

SEQ ID NO: 512626 - RNA, 64 nt, Homo Sapiens; identical to SEQ ID NO: 509367

SEQ ID NO: 512627 - RNA, 64 nt, Homo Sapiens; identical to SEQ ID NO: 509368

SEQ ID NO: 512628 - RNA, 64 nt, Homo Sapiens; identical to SEQ ID NO: 509369

SEQ ID NO: 512629 - RNA, 64 nt, Homo Sapiens; identical to SEQ ID NO: 509370

SEQ ID NO: 512630 - RNA, 64 nt, Homo Sapiens; identical to SEQ ID NO: 509371

SEQ ID NO: 512631 - RNA, 64 nt, Homo Sapiens; identical to SEQ ID NO: 509372

SEQ ID NO: 512632 - RNA, 64 nt, Homo Sapiens; identical to SEQ ID NO: 509373

SEQ ID NO: 512633 - RNA, 64 nt, Homo Sapiens; identical to SEQ ID NO: 509374

SEQ ID NO: 512634 - RNA, 64 nt, Homo Sapiens; identical to SEQ ID NO: 509375

SEQ ID NO: 512635 - RNA, 64 nt, Homo Sapiens; identical to SEQ ID NO: 509376

SEQ ID NO: 512636 - RNA, 64 nt, Homo Sapiens; identical to SEQ ID NO: 509377

SEQ ID NO: 512637 - RNA, 64 nt, Homo Sapiens; identical to SEQ ID NO: 509378

SEQ ID NO: 512638 - RNA, 64 nt, Homo Sapiens; identical to SEQ ID NO: 509379

SEQ ID NO: 512639 - RNA, 64 nt, Homo Sapiens; identical to SEQ ID NO: 509380

SEQ ID NO: 512640 - RNA, 64 nt, Homo Sapiens; identical to SEQ ID NO: 509381

SEQ ID NO: 512641 - RNA, 64 nt, Homo Sapiens; identical to SEQ ID NO: 509382

SEQ ID NO: 512642 - RNA, 64 nt, Homo Sapiens; identical to SEQ ID NO: 509383

SEQ ID NO: 512643 - RNA, 64 nt, Homo Sapiens; identical to SEQ ID NO: 509384

SEQ ID NO: 512644 - RNA, 64 nt, Homo Sapiens; identical to SEQ ID NO: 509385

SEQ ID NO: 512645 - RNA, 64 nt, Homo Sapiens; identical to SEQ ID NO: 509386

SEQ ID NO: 512646 - RNA, 64 nt, Homo Sapiens; identical to SEQ ID NO: 509387

SEQ ID NO: 512647 - RNA, 64 nt, Homo Sapiens; identical to SEQ ID NO: 509388

SEQ ID NO: 512648 - RNA, 64 nt, Homo Sapiens; identical to SEQ ID NO: 509389

SEQ ID NO: 512649 - RNA, 64 nt, Homo Sapiens; identical to SEQ ID NO: 509390

SEQ ID NO: 512650 - RNA, 64 nt, Homo Sapiens; identical to SEQ ID NO: 509391

SEQ ID NO: 512651 - RNA, 64 nt, Homo Sapiens; identical to SEQ ID NO: 509392

SEQ ID NO: 512652 - RNA, 64 nt, Homo Sapiens; identical to SEQ ID NO: 509393

SEQ ID NO: 512653 - RNA, 64 nt, Homo Sapiens; identical to SEQ ID NO: 509394

SEQ ID NO: 512654 - RNA, 64 nt, Homo Sapiens; identical to SEQ ID NO: 509395

SEQ ID NO: 512655 - RNA, 64 nt, Homo Sapiens; identical to SEQ ID NO: 509396

SEQ ID NO: 512656 - RNA, 64 nt, Homo Sapiens; identical to SEQ ID NO: 509397

SEQ ID NO: 512657 - RNA, 64 nt, Homo Sapiens; identical to SEQ ID NO: 509398

SEQ ID NO: 512658 - RNA, 64 nt, Homo Sapiens; identical to SEQ ID NO: 509399

SEQ ID NO: 512659 - RNA, 64 nt, Homo Sapiens; identical to SEQ ID NO: 509400

SEQ ID NO: 512660 - RNA, 64 nt, Homo Sapiens; identical to SEQ ID NO: 509401

SEQ ID NO: 512661 - RNA, 64 nt, Homo Sapiens; identical to SEQ ID NO: 509402

SEQ ID NO: 512662 - RNA, 64 nt, Homo Sapiens; identical to SEQ ID NO: 509403

SEQ ID NO: 512663 - RNA, 64 nt, Homo Sapiens; identical to SEQ ID NO: 509404

SEQ ID NO: 512664 - RNA, 64 nt, Homo Sapiens; identical to SEQ ID NO: 509405

SEQ ID NO: 512665 - RNA, 64 nt, Homo Sapiens; identical to SEQ ID NO: 509406

SEQ ID NO: 512666 - RNA, 64 nt, Homo Sapiens; identical to SEQ ID NO: 509407

SEQ ID NO: 512667 - RNA, 64 nt, Homo Sapiens; identical to SEQ ID NO: 509408

SEQ ID NO: 512668 - RNA, 64 nt, Homo Sapiens; identical to SEQ ID NO: 509409

SEQ ID NO: 512669 - RNA, 64 nt, Homo Sapiens; identical to SEQ ID NO: 509410

SEQ ID NO: 512670 - RNA, 64 nt, Homo Sapiens; identical to SEQ ID NO: 509411

SEQ ID NO: 512671 - RNA, 64 nt, Homo Sapiens; identical to SEQ ID NO: 509412

SEQ ID NO: 512672 - RNA, 64 nt, Homo Sapiens; identical to SEQ ID NO: 509413

SEQ ID NO: 512673 - RNA, 64 nt, Homo Sapiens; identical to SEQ ID NO: 509414

SEQ ID NO: 512674 - RNA, 64 nt, Homo Sapiens; identical to SEQ ID NO: 509415

SEQ ID NO: 512675 - RNA, 64 nt, Homo Sapiens; identical to SEQ ID NO: 509416

SEQ ID NO: 512676 - RNA, 64 nt, Homo Sapiens; identical to SEQ ID NO: 509417

SEQ ID NO: 512677 - RNA, 64 nt, Homo Sapiens; identical to SEQ ID NO: 509418

SEQ ID NO: 512678 - RNA, 64 nt, Homo Sapiens; identical to SEQ ID NO: 509419

SEQ ID NO: 512679 - RNA, 64 nt, Homo Sapiens; identical to SEQ ID NO: 509420

SEQ ID NO: 512680 - RNA, 64 nt, Homo Sapiens; identical to SEQ ID NO: 509421

SEQ ID NO: 512681 - RNA, 64 nt, Homo Sapiens; identical to SEQ ID NO: 509422

SEQ ID NO: 512682 - RNA, 64 nt, Homo Sapiens; identical to SEQ ID NO: 509423

SEQ ID NO: 512683 - RNA, 64 nt, Homo Sapiens; identical to SEQ ID NO: 509424

SEQ ID NO: 512684 - RNA, 64 nt, Homo Sapiens; identical to SEQ ID NO: 509425

SEQ ID NO: 512685 - RNA, 64 nt, Homo Sapiens; identical to SEQ ID NO: 509426

SEQ ID NO: 512686 - RNA, 64 nt, Homo Sapiens; identical to SEQ ID NO: 509427

SEQ ID NO: 512687 - RNA, 64 nt, Homo Sapiens; identical to SEQ ID NO: 509428

SEQ ID NO: 512688 - RNA, 64 nt, Homo Sapiens; identical to SEQ ID NO: 509429

SEQ ID NO: 512689 - RNA, 64 nt, Homo Sapiens; identical to SEQ ID NO: 509430

SEQ ID NO: 512690 - RNA, 64 nt, Homo Sapiens; identical to SEQ ID NO: 509431

SEQ ID NO: 512691 - RNA, 64 nt, Homo Sapiens; identical to SEQ ID NO: 509432

SEQ ID NO: 512692 - RNA, 64 nt, Homo Sapiens; identical to SEQ ID NO: 509433

SEQ ID NO: 512693 - RNA, 64 nt, Homo Sapiens; identical to SEQ ID NO: 509434

SEQ ID NO: 512694 - RNA, 64 nt, Homo Sapiens; identical to SEQ ID NO: 509435

SEQ ID NO: 512695 - RNA, 64 nt, Homo Sapiens; identical to SEQ ID NO: 509436

SEQ ID NO: 512696 - RNA, 64 nt, Homo Sapiens; identical to SEQ ID NO: 509437

SEQ ID NO: 512697 - RNA, 64 nt, Homo Sapiens; identical to SEQ ID NO: 509438

SEQ ID NO: 512698 - RNA, 64 nt, Homo Sapiens; identical to SEQ ID NO: 509439

SEQ ID NO: 512699 - RNA, 64 nt, Homo Sapiens; identical to SEQ ID NO: 509440

SEQ ID NO: 512700 - RNA, 64 nt, Homo Sapiens; identical to SEQ ID NO: 509441

SEQ ID NO: 512701 - RNA, 64 nt, Homo Sapiens; identical to SEQ ID NO: 509442

SEQ ID NO: 512702 - RNA, 64 nt, Homo Sapiens; identical to SEQ ID NO: 509443

SEQ ID NO: 512703 - RNA, 64 nt, Homo Sapiens; identical to SEQ ID NO: 509444

SEQ ID NO: 512704 - RNA, 64 nt, Homo Sapiens; identical to SEQ ID NO: 509445

SEQ ID NO: 512705 - RNA, 64 nt, Homo Sapiens; identical to SEQ ID NO: 509446

SEQ ID NO: 512706 - RNA, 64 nt, Homo Sapiens; identical to SEQ ID NO: 509447

SEQ ID NO: 512707 - RNA, 64 nt, Homo Sapiens; identical to SEQ ID NO: 509448

SEQ ID NO: 512708 - RNA, 64 nt, Homo Sapiens; identical to SEQ ID NO: 509449

SEQ ID NO: 512709 - RNA, 64 nt, Homo Sapiens; identical to SEQ ID NO: 509450

SEQ ID NO: 512710 - RNA, 64 nt, Homo Sapiens; identical to SEQ ID NO: 509451

SEQ ID NO: 512711 - RNA, 64 nt, Homo Sapiens; identical to SEQ ID NO: 509452

SEQ ID NO: 512712 - RNA, 64 nt, Homo Sapiens; identical to SEQ ID NO: 509453

SEQ ID NO: 512713 - RNA, 64 nt, Homo Sapiens; identical to SEQ ID NO: 509454

SEQ ID NO: 512714 - RNA, 64 nt, Homo Sapiens; identical to SEQ ID NO: 509455

SEQ ID NO: 512715 - RNA, 64 nt, Homo Sapiens; identical to SEQ ID NO: 509456

SEQ ID NO: 512716 - RNA, 64 nt, Homo Sapiens; identical to SEQ ID NO: 509457

SEQ ID NO: 512717 - RNA, 64 nt, Homo Sapiens; identical to SEQ ID NO: 509458

SEQ ID NO: 512718 - RNA, 64 nt, Homo Sapiens; identical to SEQ ID NO: 509459

SEQ ID NO: 512719 - RNA, 64 nt, Homo Sapiens; identical to SEQ ID NO: 509460

SEQ ID NO: 512720 - RNA, 64 nt, Homo Sapiens; identical to SEQ ID NO: 509461

SEQ ID NO: 512721 - RNA, 64 nt, Homo Sapiens; identical to SEQ ID NO: 509462

SEQ ID NO: 512722 - RNA, 64 nt, Homo Sapiens; identical to SEQ ID NO: 509463

SEQ ID NO: 512723 - RNA, 64 nt, Homo Sapiens; identical to SEQ ID NO: 509464

SEQ ID NO: 512724 - RNA, 64 nt, Homo Sapiens; identical to SEQ ID NO: 509465

SEQ ID NO: 512725 - RNA, 54 nt, Homo Sapiens; identical to SEQ ID NO: 509466

SEQ ID NO: 512726 - RNA, 64 nt, Homo Sapiens; identical to SEQ ID NO: 509467

SEQ ID NO: 512727 - RNA, 64 nt, Homo Sapiens; identical to SEQ ID NO: 509468

SEQ ID NO: 512728 - RNA, 64 nt, Homo Sapiens; identical to SEQ ID NO: 509469

SEQ ID NO: 512729 - RNA, 64 nt, Homo Sapiens; identical to SEQ ID NO: 509470

SEQ ID NO: 512730 - RNA, 64 nt, Homo Sapiens; identical to SEQ ID NO: 509471

SEQ ID NO: 512731 - RNA, 64 nt, Homo Sapiens; identical to SEQ ID NO: 509472

SEQ ID NO: 512732 - RNA, 64 nt, Homo Sapiens; identical to SEQ ID NO: 509473

SEQ ID NO: 512733 - RNA, 64 nt, Homo Sapiens; identical to SEQ ID NO: 509474

SEQ ID NO: 512734 - RNA, 64 nt, Homo Sapiens; identical to SEQ ID NO: 509475

SEQ ID NO: 512735 - RNA, 64 nt, Homo Sapiens; identical to SEQ ID NO: 509476

SEQ ID NO: 512736 - RNA, 64 nt, Homo Sapiens; identical to SEQ ID NO: 509477

SEQ ID NO: 512737 - RNA, 64 nt, Homo Sapiens; identical to SEQ ID NO: 509478

SEQ ID NO: 512738 - RNA, 64 nt, Homo Sapiens; identical to SEQ ID NO: 509479

SEQ ID NO: 512739 - RNA, 64 nt, Homo Sapiens; identical to SEQ ID NO: 509480

SEQ ID NO: 512740 - RNA, 64 nt, Homo Sapiens; identical to SEQ ID NO: 509481

SEQ ID NO: 512741 - RNA, 64 nt, Homo Sapiens; identical to SEQ ID NO: 509482

SEQ ID NO: 512742 - RNA, 64 nt, Homo Sapiens; identical to SEQ ID NO: 509483

SEQ ID NO: 512743 - RNA, 64 nt, Homo Sapiens; identical to SEQ ID NO: 509484

SEQ ID NO: 512744 - RNA, 64 nt, Homo Sapiens; identical to SEQ ID NO: 509485

SEQ ID NO: 512745 - RNA, 64 nt, Homo Sapiens; identical to SEQ ID NO: 509486

SEQ ID NO: 512746 - RNA, 64 nt, Homo Sapiens; identical to SEQ ID NO: 509487

SEQ ID NO: 512747 - RNA, 64 nt, Homo Sapiens; identical to SEQ ID NO: 509488

SEQ ID NO: 512748 - RNA, 64 nt, Homo Sapiens; identical to SEQ ID NO: 509489

SEQ ID NO: 512749 - RNA, 64 nt, Homo Sapiens; identical to SEQ ID NO: 509490

SEQ ID NO: 512750 - RNA, 64 nt, Homo Sapiens; identical to SEQ ID NO: 509491

SEQ ID NO: 512751 - RNA, 64 nt, Homo Sapiens; identical to SEQ ID NO: 509492

SEQ ID NO: 512752 - RNA, 64 nt, Homo Sapiens; identical to SEQ ID NO: 509493

SEQ ID NO: 512753 - RNA, 64 nt, Homo Sapiens; identical to SEQ ID NO: 509494

SEQ ID NO: 512754 - RNA, 64 nt, Homo Sapiens; identical to SEQ ID NO: 509495

SEQ ID NO: 512755 - RNA, 64 nt, Homo Sapiens; identical to SEQ ID NO: 509496

SEQ ID NO: 512756 - RNA, 64 nt, Homo Sapiens; identical to SEQ ID NO: 509497

SEQ ID NO: 512757 - RNA, 64 nt, Homo Sapiens; identical to SEQ ID NO: 509498

SEQ ID NO: 512758 - RNA, 64 nt, Homo Sapiens; identical to SEQ ID NO: 509499

SEQ ID NO: 512759 - RNA, 64 nt, Homo Sapiens; identical to SEQ ID NO: 509500

SEQ ID NO: 512760 - RNA, 64 nt, Homo Sapiens; identical to SEQ ID NO: 509501

SEQ ID NO: 512761 - RNA, 64 nt, Homo Sapiens; identical to SEQ ID NO: 509502

SEQ ID NO: 512762 - RNA, 64 nt, Homo Sapiens; identical to SEQ ID NO: 509503

SEQ ID NO: 512763 - RNA, 64 nt, Homo Sapiens; identical to SEQ ID NO: 509504

SEQ ID NO: 512764 - RNA, 64 nt, Homo Sapiens; identical to SEQ ID NO: 509505

SEQ ID NO: 512765 - RNA, 64 nt, Homo Sapiens; identical to SEQ ID NO: 509506

SEQ ID NO: 512766 - RNA, 64 nt, Homo Sapiens; identical to SEQ ID NO: 509507

SEQ ID NO: 512767 - RNA, 64 nt, Homo Sapiens; identical to SEQ ID NO: 509508

SEQ ID NO: 512768 - RNA, 64 nt, Homo Sapiens; identical to SEQ ID NO: 509509

SEQ ID NO: 512769 - RNA, 64 nt, Homo Sapiens; identical to SEQ ID NO: 509510

SEQ ID NO: 512770 - RNA, 64 nt, Homo Sapiens; identical to SEQ ID NO: 509511

SEQ ID NO: 512771 - RNA, 64 nt, Homo Sapiens; identical to SEQ ID NO: 509512

SEQ ID NO: 512772 - RNA, 64 nt, Homo Sapiens; identical to SEQ ID NO: 509513

SEQ ID NO: 512773 - RNA, 64 nt, Homo Sapiens; identical to SEQ ID NO: 509514

SEQ ID NO: 512774 - RNA, 64 nt, Homo Sapiens; identical to SEQ ID NO: 509515

SEQ ID NO: 512775 - RNA, 64 nt, Homo Sapiens; identical to SEQ ID NO: 509516

SEQ ID NO: 512776 - RNA, 64 nt, Homo Sapiens; identical to SEQ ID NO: 509517

SEQ ID NO: 512777 - RNA, 64 nt, Homo Sapiens; identical to SEQ ID NO: 509518

SEQ ID NO: 512778 - RNA, 64 nt, Homo Sapiens; identical to SEQ ID NO: 509519

SEQ ID NO: 512779 - RNA, 64 nt, Homo Sapiens; identical to SEQ ID NO: 509520

SEQ ID NO: 512780 - RNA, 64 nt, Homo Sapiens; identical to SEQ ID NO: 509521

SEQ ID NO: 512781 - RNA, 64 nt, Homo Sapiens; identical to SEQ ID NO: 509522

SEQ ID NO: 512782 - RNA, 64 nt, Homo Sapiens; identical to SEQ ID NO: 509523

SEQ ID NO: 512783 - RNA, 64 nt, Homo Sapiens; identical to SEQ ID NO: 509524

SEQ ID NO: 512784 - RNA, 64 nt, Homo Sapiens; identical to SEQ ID NO: 509525

SEQ ID NO: 512785 - RNA, 64 nt, Homo Sapiens; identical to SEQ ID NO: 509526

SEQ ID NO: 512786 - RNA, 64 nt, Homo Sapiens; identical to SEQ ID NO: 509527

SEQ ID NO: 512787 - RNA, 64 nt, Homo Sapiens; identical to SEQ ID NO: 509528

SEQ ID NO: 512788 - RNA, 64 nt, Homo Sapiens; identical to SEQ ID NO: 509529

SEQ ID NO: 512789 - RNA, 64 nt, Homo Sapiens; identical to SEQ ID NO: 509530

SEQ ID NO: 512790 - RNA, 64 nt, Homo Sapiens; identical to SEQ ID NO: 509531

SEQ ID NO: 512791 - RNA, 64 nt, Homo Sapiens; identical to SEQ ID NO: 509532

SEQ ID NO: 512792 - RNA, 64 nt, Homo Sapiens; identical to SEQ ID NO: 509533

SEQ ID NO: 512793 - RNA, 64 nt, Homo Sapiens; identical to SEQ ID NO: 509534

SEQ ID NO: 512794 - RNA, 64 nt, Homo Sapiens; identical to SEQ ID NO: 509535

SEQ ID NO: 512795 - RNA, 64 nt, Homo Sapiens; identical to SEQ ID NO: 509536

SEQ ID NO: 512796 - RNA, 64 nt, Homo Sapiens; identical to SEQ ID NO: 509537

SEQ ID NO: 512797 - RNA, 64 nt, Homo Sapiens; identical to SEQ ID NO: 509538

SEQ ID NO: 512798 - RNA, 64 nt, Homo Sapiens; identical to SEQ ID NO: 509539

SEQ ID NO: 512799 - RNA, 64 nt, Homo Sapiens; identical to SEQ ID NO: 509540

SEQ ID NO: 512800 - RNA, 64 nt, Homo Sapiens; identical to SEQ ID NO: 509541

SEQ ID NO: 512801 - RNA, 64 nt, Homo Sapiens; identical to SEQ ID NO: 509542

SEQ ID NO: 512802 - RNA, 64 nt, Homo Sapiens; identical to SEQ ID NO: 509543

SEQ ID NO: 512803 - RNA, 64 nt, Homo Sapiens; identical to SEQ ID NO: 509544

SEQ ID NO: 512804 - RNA, 64 nt, Homo Sapiens; identical to SEQ ID NO: 509545

SEQ ID NO: 512805 - RNA, 64 nt, Homo Sapiens; identical to SEQ ID NO: 509546

SEQ ID NO: 512806 - RNA, 64 nt, Homo Sapiens; identical to SEQ ID NO: 509547

SEQ ID NO: 512807 - RNA, 64 nt, Homo Sapiens; identical to SEQ ID NO: 509548

SEQ ID NO: 512808 - RNA, 64 nt, Homo Sapiens; identical to SEQ ID NO: 509549

SEQ ID NO: 512809 - RNA, 64 nt, Homo Sapiens; identical to SEQ ID NO: 509550

SEQ ID NO: 512810 - RNA, 64 nt, Homo Sapiens; identical to SEQ ID NO: 509551

SEQ ID NO: 512811 - RNA, 64 nt, Homo Sapiens; identical to SEQ ID NO: 509552

SEQ ID NO: 512812 - RNA, 64 nt, Homo Sapiens; identical to SEQ ID NO: 509553

SEQ ID NO: 512813 - RNA, 64 nt, Homo Sapiens; identical to SEQ ID NO: 509554

SEQ ID NO: 512814 - RNA, 64 nt, Homo Sapiens; identical to SEQ ID NO: 509555

SEQ ID NO: 512815 - RNA, 64 nt, Homo Sapiens; identical to SEQ ID NO: 509556

SEQ ID NO: 512816 - RNA, 64 nt, Homo Sapiens; identical to SEQ ID NO: 509557

SEQ ID NO: 512817 - RNA, 64 nt, Homo Sapiens; identical to SEQ ID NO: 509558

SEQ ID NO: 512818 - RNA, 64 nt, Homo Sapiens; identical to SEQ ID NO: 509559

SEQ ID NO: 512819 - RNA, 64 nt, Homo Sapiens; identical to SEQ ID NO: 509560

SEQ ID NO: 512820 - RNA, 64 nt, Homo Sapiens; identical to SEQ ID NO: 509561

SEQ ID NO: 512821 - RNA, 64 nt, Homo Sapiens; identical to SEQ ID NO: 509562

SEQ ID NO: 512822 - RNA, 64 nt, Homo Sapiens; identical to SEQ ID NO: 509563

SEQ ID NO: 512823 - RNA, 64 nt, Homo Sapiens; identical to SEQ ID NO: 509564

SEQ ID NO: 512824 - RNA, 64 nt, Homo Sapiens; identical to SEQ ID NO: 509565

SEQ ID NO: 512825 - RNA, 64 nt, Homo Sapiens; identical to SEQ ID NO: 509566

SEQ ID NO: 512826 - RNA, 64 nt, Homo Sapiens; identical to SEQ ID NO: 509567

SEQ ID NO: 512827 - RNA, 64 nt, Homo Sapiens; identical to SEQ ID NO: 509568

SEQ ID NO: 512828 - RNA, 64 nt, Homo Sapiens; identical to SEQ ID NO: 509569

SEQ ID NO: 512829 - RNA, 64 nt, Homo Sapiens; identical to SEQ ID NO: 509570

SEQ ID NO: 512830 - RNA, 64 nt, Homo Sapiens; identical to SEQ ID NO: 509571

SEQ ID NO: 512831 - RNA, 64 nt, Homo Sapiens; identical to SEQ ID NO: 509572

SEQ ID NO: 512832 - RNA, 64 nt, Homo Sapiens; identical to SEQ ID NO: 509573

SEQ ID NO: 512833 - RNA, 64 nt, Homo Sapiens; identical to SEQ ID NO: 509574

SEQ ID NO: 512834 - RNA, 64 nt, Homo Sapiens; identical to SEQ ID NO: 509575

SEQ ID NO: 512835 - RNA, 64 nt, Homo Sapiens; identical to SEQ ID NO: 509576

SEQ ID NO: 512836 - RNA, 64 nt, Homo Sapiens; identical to SEQ ID NO: 509577

SEQ ID NO: 512837 - RNA, 64 nt, Homo Sapiens; identical to SEQ ID NO: 509578

SEQ ID NO: 512838 - RNA, 64 nt, Homo Sapiens; identical to SEQ ID NO: 509579

SEQ ID NO: 512839 - RNA, 64 nt, Homo Sapiens; identical to SEQ ID NO: 509580

SEQ ID NO: 512840 - RNA, 64 nt, Homo Sapiens; identical to SEQ ID NO: 509581

SEQ ID NO: 512841 - RNA, 64 nt, Homo Sapiens; identical to SEQ ID NO: 509582

SEQ ID NO: 512842 - RNA, 64 nt, Homo Sapiens; identical to SEQ ID NO: 509583

SEQ ID NO: 512843 - RNA, 64 nt, Homo Sapiens; identical to SEQ ID NO: 509584

SEQ ID NO: 512844 - RNA, 64 nt, Homo Sapiens; identical to SEQ ID NO: 509585

SEQ ID NO: 512845 - RNA, 64 nt, Homo Sapiens; identical to SEQ ID NO: 509586

SEQ ID NO: 512846 - RNA, 64 nt, Homo Sapiens; identical to SEQ ID NO: 509587

SEQ ID NO: 512847 - RNA, 64 nt, Homo Sapiens; identical to SEQ ID NO: 509588

SEQ ID NO: 512848 - RNA, 64 nt, Homo Sapiens; identical to SEQ ID NO: 509589

SEQ ID NO: 512849 - RNA, 64 nt, Homo Sapiens; identical to SEQ ID NO: 509590

SEQ ID NO: 512850 - RNA, 64 nt, Homo Sapiens; identical to SEQ ID NO: 509591

SEQ ID NO: 512851 - RNA, 64 nt, Homo Sapiens; identical to SEQ ID NO: 509592

SEQ ID NO: 512852 - RNA, 64 nt, Homo Sapiens; identical to SEQ ID NO: 509593

SEQ ID NO: 512853 - RNA, 64 nt, Homo Sapiens; identical to SEQ ID NO: 509594

SEQ ID NO: 512854 - RNA, 64 nt, Homo Sapiens; identical to SEQ ID NO: 509595

SEQ ID NO: 512855 - RNA, 64 nt, Homo Sapiens; identical to SEQ ID NO: 509596

SEQ ID NO: 512856 - RNA, 64 nt, Homo Sapiens; identical to SEQ ID NO: 509597

SEQ ID NO: 512857 - RNA, 64 nt, Homo Sapiens; identical to SEQ ID NO: 509598

SEQ ID NO: 512858 - RNA, 64 nt, Homo Sapiens; identical to SEQ ID NO: 509599

SEQ ID NO: 512859 - RNA, 64 nt, Homo Sapiens; identical to SEQ ID NO: 509600

SEQ ID NO: 512860 - RNA, 64 nt, Homo Sapiens; identical to SEQ ID NO: 509601

SEQ ID NO: 512861 - RNA, 64 nt, Homo Sapiens; identical to SEQ ID NO: 509602

SEQ ID NO: 512862 - RNA, 64 nt, Homo Sapiens; identical to SEQ ID NO: 509603

SEQ ID NO: 512863 - RNA, 64 nt, Homo Sapiens; identical to SEQ ID NO: 509604

SEQ ID NO: 512864 - RNA, 64 nt, Homo Sapiens; identical to SEQ ID NO: 509605

SEQ ID NO: 512865 - RNA, 64 nt, Homo Sapiens; identical to SEQ ID NO: 509606

SEQ ID NO: 512866 - RNA, 64 nt, Homo Sapiens; identical to SEQ ID NO: 509607

SEQ ID NO: 512867 - RNA, 64 nt, Homo Sapiens; identical to SEQ ID NO: 509608

SEQ ID NO: 512868 - RNA, 64 nt, Homo Sapiens; identical to SEQ ID NO: 509609

SEQ ID NO: 512869 - RNA, 64 nt, Homo Sapiens; identical to SEQ ID NO: 509610

SEQ ID NO: 512870 - RNA, 64 nt, Homo Sapiens; identical to SEQ ID NO: 509611

SEQ ID NO: 512871 - RNA, 64 nt, Homo Sapiens; identical to SEQ ID NO: 509612

SEQ ID NO: 512872 - RNA, 64 nt, Homo Sapiens; identical to SEQ ID NO: 509613

SEQ ID NO: 512873 - RNA, 62 nt, Homo Sapiens; identical to SEQ ID NO: 509614

SEQ ID NO: 512874 - RNA, 64 nt, Homo Sapiens; identical to SEQ ID NO: 509615

SEQ ID NO: 512875 - RNA, 64 nt, Homo Sapiens; identical to SEQ ID NO: 509616

SEQ ID NO: 512876 - RNA, 64 nt, Homo Sapiens; identical to SEQ ID NO: 509617

SEQ ID NO: 512877 - RNA, 64 nt, Homo Sapiens; identical to SEQ ID NO: 509618

SEQ ID NO: 512878 - RNA, 64 nt, Homo Sapiens; identical to SEQ ID NO: 509619

SEQ ID NO: 512879 - RNA, 64 nt, Homo Sapiens; identical to SEQ ID NO: 509620

SEQ ID NO: 512880 - RNA, 64 nt, Homo Sapiens; identical to SEQ ID NO: 509621

SEQ ID NO: 512881 - RNA, 64 nt, Homo Sapiens; identical to SEQ ID NO: 509622

SEQ ID NO: 512882 - RNA, 64 nt, Homo Sapiens; identical to SEQ ID NO: 509623

SEQ ID NO: 512883 - RNA, 64 nt, Homo Sapiens; identical to SEQ ID NO: 509624

SEQ ID NO: 512884 - RNA, 64 nt, Homo Sapiens; identical to SEQ ID NO: 509625

SEQ ID NO: 512885 - RNA, 64 nt, Homo Sapiens; identical to SEQ ID NO: 509626

SEQ ID NO: 512886 - RNA, 64 nt, Homo Sapiens; identical to SEQ ID NO: 509627

SEQ ID NO: 512887 - RNA, 64 nt, Homo Sapiens; identical to SEQ ID NO: 509628

SEQ ID NO: 512888 - RNA, 64 nt, Homo Sapiens; identical to SEQ ID NO: 509629

SEQ ID NO: 512889 - RNA, 64 nt, Homo Sapiens; identical to SEQ ID NO: 509630

SEQ ID NO: 512890 - RNA, 64 nt, Homo Sapiens; identical to SEQ ID NO: 509631

SEQ ID NO: 512891 - RNA, 64 nt, Homo Sapiens; identical to SEQ ID NO: 509632

SEQ ID NO: 512892 - RNA, 64 nt, Homo Sapiens; identical to SEQ ID NO: 509633

SEQ ID NO: 512893 - RNA, 64 nt, Homo Sapiens; identical to SEQ ID NO: 509634

SEQ ID NO: 512894 - RNA, 64 nt, Homo Sapiens; identical to SEQ ID NO: 509635

SEQ ID NO: 512895 - RNA, 64 nt, Homo Sapiens; identical to SEQ ID NO: 509636

SEQ ID NO: 512896 - RNA, 64 nt, Homo Sapiens; identical to SEQ ID NO: 509637

SEQ ID NO: 512897 - RNA, 64 nt, Homo Sapiens; identical to SEQ ID NO: 509638

SEQ ID NO: 512898 - RNA, 64 nt, Homo Sapiens; identical to SEQ ID NO: 509639

SEQ ID NO: 512899 - RNA, 64 nt, Homo Sapiens; identical to SEQ ID NO: 509640

SEQ ID NO: 512900 - RNA, 64 nt, Homo Sapiens; identical to SEQ ID NO: 509641

SEQ ID NO: 512901 - RNA, 64 nt, Homo Sapiens; identical to SEQ ID NO: 509642

SEQ ID NO: 512902 - RNA, 64 nt, Homo Sapiens; identical to SEQ ID NO: 509643

SEQ ID NO: 512903 - RNA, 64 nt, Homo Sapiens; identical to SEQ ID NO: 509644

SEQ ID NO: 512904 - RNA, 64 nt, Homo Sapiens; identical to SEQ ID NO: 509645

SEQ ID NO: 512905 - RNA, 64 nt, Homo Sapiens; identical to SEQ ID NO: 509646

SEQ ID NO: 512906 - RNA, 64 nt, Homo Sapiens; identical to SEQ ID NO: 509647

SEQ ID NO: 512907 - RNA, 64 nt, Homo Sapiens; identical to SEQ ID NO: 509648

SEQ ID NO: 512908 - RNA, 64 nt, Homo Sapiens; identical to SEQ ID NO: 509649

SEQ ID NO: 512909 - RNA, 64 nt, Homo Sapiens; identical to SEQ ID NO: 509650

SEQ ID NO: 512910 - RNA, 64 nt, Homo Sapiens; identical to SEQ ID NO: 509651

SEQ ID NO: 512911 - RNA, 64 nt, Homo Sapiens; identical to SEQ ID NO: 509652

SEQ ID NO: 512912 - RNA, 64 nt, Homo Sapiens; identical to SEQ ID NO: 509653

SEQ ID NO: 512913 - RNA, 64 nt, Homo Sapiens; identical to SEQ ID NO: 509654

SEQ ID NO: 512914 - RNA, 64 nt, Homo Sapiens; identical to SEQ ID NO: 509655

SEQ ID NO: 512915 - RNA, 64 nt, Homo Sapiens; identical to SEQ ID NO: 509656

SEQ ID NO: 512916 - RNA, 64 nt, Homo Sapiens; identical to SEQ ID NO: 509657

SEQ ID NO: 512917 - RNA, 64 nt, Homo Sapiens; identical to SEQ ID NO: 509658

SEQ ID NO: 512918 - RNA, 64 nt, Homo Sapiens; identical to SEQ ID NO: 509659

SEQ ID NO: 512919 - RNA, 64 nt, Homo Sapiens; identical to SEQ ID NO: 509660

SEQ ID NO: 512920 - RNA, 64 nt, Homo Sapiens; identical to SEQ ID NO: 509661

SEQ ID NO: 512921 - RNA, 64 nt, Homo Sapiens; identical to SEQ ID NO: 509662

SEQ ID NO: 512922 - RNA, 64 nt, Homo Sapiens; identical to SEQ ID NO: 509663

SEQ ID NO: 512923 - RNA, 64 nt, Homo Sapiens; identical to SEQ ID NO: 509664

SEQ ID NO: 512924 - RNA, 51 nt, Homo Sapiens; identical to SEQ ID NO: 509665

SEQ ID NO: 512925 - RNA, 64 nt, Homo Sapiens; identical to SEQ ID NO: 509666

SEQ ID NO: 512926 - RNA, 64 nt, Homo Sapiens; identical to SEQ ID NO: 509667

SEQ ID NO: 512927 - RNA, 64 nt, Homo Sapiens; identical to SEQ ID NO: 509668

SEQ ID NO: 512928 - RNA, 64 nt, Homo Sapiens; identical to SEQ ID NO: 509669

SEQ ID NO: 512929 - RNA, 64 nt, Homo Sapiens; identical to SEQ ID NO: 509670

SEQ ID NO: 512930 - RNA, 64 nt, Homo Sapiens; identical to SEQ ID NO: 509671

SEQ ID NO: 512931 - RNA, 64 nt, Homo Sapiens; identical to SEQ ID NO: 509672

SEQ ID NO: 512932 - RNA, 64 nt, Homo Sapiens; identical to SEQ ID NO: 509673

SEQ ID NO: 512933 - RNA, 64 nt, Homo Sapiens; identical to SEQ ID NO: 509674

SEQ ID NO: 512934 - RNA, 64 nt, Homo Sapiens; identical to SEQ ID NO: 509675

SEQ ID NO: 512935 - RNA, 64 nt, Homo Sapiens; identical to SEQ ID NO: 509676

SEQ ID NO: 512936 - RNA, 64 nt, Homo Sapiens; identical to SEQ ID NO: 509677

SEQ ID NO: 512937 - RNA, 64 nt, Homo Sapiens; identical to SEQ ID NO: 509678

SEQ ID NO: 512938 - RNA, 64 nt, Homo Sapiens; identical to SEQ ID NO: 509679

SEQ ID NO: 512939 - RNA, 64 nt, Homo Sapiens; identical to SEQ ID NO: 509680

SEQ ID NO: 512940 - RNA, 64 nt, Homo Sapiens; identical to SEQ ID NO: 509681

SEQ ID NO: 512941 - RNA, 64 nt, Homo Sapiens; identical to SEQ ID NO: 509682

SEQ ID NO: 512942 - RNA, 64 nt, Homo Sapiens; identical to SEQ ID NO: 509683

SEQ ID NO: 512943 - RNA, 64 nt, Homo Sapiens; identical to SEQ ID NO: 509684

SEQ ID NO: 512944 - RNA, 64 nt, Homo Sapiens; identical to SEQ ID NO: 509685

SEQ ID NO: 512945 - RNA, 64 nt, Homo Sapiens; identical to SEQ ID NO: 509686

SEQ ID NO: 512946 - RNA, 64 nt, Homo Sapiens; identical to SEQ ID NO: 509687

SEQ ID NO: 512947 - RNA, 64 nt, Homo Sapiens; identical to SEQ ID NO: 509688

SEQ ID NO: 512948 - RNA, 64 nt, Homo Sapiens; identical to SEQ ID NO: 509689

SEQ ID NO: 512949 - RNA, 64 nt, Homo Sapiens; identical to SEQ ID NO: 509690

SEQ ID NO: 512950 - RNA, 64 nt, Homo Sapiens; identical to SEQ ID NO: 509691

SEQ ID NO: 512951 - RNA, 64 nt, Homo Sapiens; identical to SEQ ID NO: 509692

SEQ ID NO: 512952 - RNA, 64 nt, Homo Sapiens; identical to SEQ ID NO: 509693

SEQ ID NO: 512953 - RNA, 64 nt, Homo Sapiens; identical to SEQ ID NO: 509694

SEQ ID NO: 512954 - RNA, 64 nt, Homo Sapiens; identical to SEQ ID NO: 509695

SEQ ID NO: 512955 - RNA, 64 nt, Homo Sapiens; identical to SEQ ID NO: 509696

SEQ ID NO: 512956 - RNA, 64 nt, Homo Sapiens; identical to SEQ ID NO: 509697

SEQ ID NO: 512957 - RNA, 64 nt, Homo Sapiens; identical to SEQ ID NO: 509698

SEQ ID NO: 512958 - RNA, 64 nt, Homo Sapiens; identical to SEQ ID NO: 509699

SEQ ID NO: 512959 - RNA, 64 nt, Homo Sapiens; identical to SEQ ID NO: 509700

SEQ ID NO: 512960 - RNA, 64 nt, Homo Sapiens; identical to SEQ ID NO: 509701

SEQ ID NO: 512961 - RNA, 64 nt, Homo Sapiens; identical to SEQ ID NO: 509702

SEQ ID NO: 512962 - RNA, 64 nt, Homo Sapiens; identical to SEQ ID NO: 509703

SEQ ID NO: 512963 - RNA, 64 nt, Homo Sapiens; identical to SEQ ID NO: 509704

SEQ ID NO: 512964 - RNA, 64 nt, Homo Sapiens; identical to SEQ ID NO: 509705

SEQ ID NO: 512965 - RNA, 64 nt, Homo Sapiens; identical to SEQ ID NO: 509706

SEQ ID NO: 512966 - RNA, 64 nt, Homo Sapiens; identical to SEQ ID NO: 509707

SEQ ID NO: 512967 - RNA, 64 nt, Homo Sapiens; identical to SEQ ID NO: 509708

SEQ ID NO: 512968 - RNA, 64 nt, Homo Sapiens; identical to SEQ ID NO: 509709

SEQ ID NO: 512969 - RNA, 64 nt, Homo Sapiens; identical to SEQ ID NO: 509710

SEQ ID NO: 512970 - RNA, 64 nt, Homo Sapiens; identical to SEQ ID NO: 509711

SEQ ID NO: 512971 - RNA, 64 nt, Homo Sapiens; identical to SEQ ID NO: 509712

SEQ ID NO: 512972 - RNA, 64 nt, Homo Sapiens; identical to SEQ ID NO: 509713

SEQ ID NO: 512973 - RNA, 64 nt, Homo Sapiens; identical to SEQ ID NO: 509714

SEQ ID NO: 512974 - RNA, 64 nt, Homo Sapiens; identical to SEQ ID NO: 509715

SEQ ID NO: 512975 - RNA, 64 nt, Homo Sapiens; identical to SEQ ID NO: 509716

SEQ ID NO: 512976 - RNA, 64 nt, Homo Sapiens; identical to SEQ ID NO: 509717

SEQ ID NO: 512977 - RNA, 64 nt, Homo Sapiens; identical to SEQ ID NO: 509718

SEQ ID NO: 512978 - RNA, 64 nt, Homo Sapiens; identical to SEQ ID NO: 509719

SEQ ID NO: 512979 - RNA, 64 nt, Homo Sapiens; identical to SEQ ID NO: 509720

SEQ ID NO: 512980 - RNA, 64 nt, Homo Sapiens; identical to SEQ ID NO: 509721

SEQ ID NO: 512981 - RNA, 64 nt, Homo Sapiens; identical to SEQ ID NO: 509722

SEQ ID NO: 512982 - RNA, 64 nt, Homo Sapiens; identical to SEQ ID NO: 509723

SEQ ID NO: 512983 - RNA, 64 nt, Homo Sapiens; identical to SEQ ID NO: 509724

SEQ ID NO: 512984 - RNA, 64 nt, Homo Sapiens; identical to SEQ ID NO: 509725

SEQ ID NO: 512985 - RNA, 64 nt, Homo Sapiens; identical to SEQ ID NO: 509726

SEQ ID NO: 512986 - RNA, 64 nt, Homo Sapiens; identical to SEQ ID NO: 509727

SEQ ID NO: 512987 - RNA, 64 nt, Homo Sapiens; identical to SEQ ID NO: 509728

SEQ ID NO: 512988 - RNA, 64 nt, Homo Sapiens; identical to SEQ ID NO: 509729

SEQ ID NO: 512989 - RNA, 64 nt, Homo Sapiens; identical to SEQ ID NO: 509730

SEQ ID NO: 512990 - RNA, 64 nt, Homo Sapiens; identical to SEQ ID NO: 509731

SEQ ID NO: 512991 - RNA, 64 nt, Homo Sapiens; identical to SEQ ID NO: 509732

SEQ ID NO: 512992 - RNA, 64 nt, Homo Sapiens; identical to SEQ ID NO: 509733

SEQ ID NO: 512993 - RNA, 64 nt, Homo Sapiens; identical to SEQ ID NO: 509734

SEQ ID NO: 512994 - RNA, 64 nt, Homo Sapiens; identical to SEQ ID NO: 509735

SEQ ID NO: 512995 - RNA, 64 nt, Homo Sapiens; identical to SEQ ID NO: 509736

SEQ ID NO: 512996 - RNA, 64 nt, Homo Sapiens; identical to SEQ ID NO: 509737

SEQ ID NO: 512997 - RNA, 64 nt, Homo Sapiens; identical to SEQ ID NO: 509738

SEQ ID NO: 512998 - RNA, 64 nt, Homo Sapiens; identical to SEQ ID NO: 509739

SEQ ID NO: 512999 - RNA, 64 nt, Homo Sapiens; identical to SEQ ID NO: 509740

SEQ ID NO: 513000 - RNA, 64 nt, Homo Sapiens; identical to SEQ ID NO: 509741

SEQ ID NO: 513001 - RNA, 64 nt, Homo Sapiens; identical to SEQ ID NO: 509742

SEQ ID NO: 513002 - RNA, 64 nt, Homo Sapiens; identical to SEQ ID NO: 509743

SEQ ID NO: 513003 - RNA, 64 nt, Homo Sapiens; identical to SEQ ID NO: 509744

SEQ ID NO: 513004 - RNA, 64 nt, Homo Sapiens; identical to SEQ ID NO: 509745

SEQ ID NO: 513005 - RNA, 64 nt, Homo Sapiens; identical to SEQ ID NO: 509746

SEQ ID NO: 513006 - RNA, 64 nt, Homo Sapiens; identical to SEQ ID NO: 509747

SEQ ID NO: 513007 - RNA, 64 nt, Homo Sapiens; identical to SEQ ID NO: 509748

SEQ ID NO: 513008 - RNA, 64 nt, Homo Sapiens; identical to SEQ ID NO: 509749

SEQ ID NO: 513009 - RNA, 64 nt, Homo Sapiens; identical to SEQ ID NO: 509750

SEQ ID NO: 513010 - RNA, 64 nt, Homo Sapiens; identical to SEQ ID NO: 509751

SEQ ID NO: 513011 - RNA, 64 nt, Homo Sapiens; identical to SEQ ID NO: 509752

SEQ ID NO: 513012 - RNA, 64 nt, Homo Sapiens; identical to SEQ ID NO: 509753

SEQ ID NO: 513013 - RNA, 64 nt, Homo Sapiens; identical to SEQ ID NO: 509754

SEQ ID NO: 513014 - RNA, 64 nt, Homo Sapiens; identical to SEQ ID NO: 509755

SEQ ID NO: 513015 - RNA, 64 nt, Homo Sapiens; identical to SEQ ID NO: 509756

SEQ ID NO: 513016 - RNA, 64 nt, Homo Sapiens; identical to SEQ ID NO: 509757

SEQ ID NO: 513017 - RNA, 64 nt, Homo Sapiens; identical to SEQ ID NO: 509758

SEQ ID NO: 513018 - RNA, 64 nt, Homo Sapiens; identical to SEQ ID NO: 509759

SEQ ID NO: 513019 - RNA, 64 nt, Homo Sapiens; identical to SEQ ID NO: 509760

SEQ ID NO: 513020 - RNA, 64 nt, Homo Sapiens; identical to SEQ ID NO: 509761

SEQ ID NO: 513021 - RNA, 64 nt, Homo Sapiens; identical to SEQ ID NO: 509762

SEQ ID NO: 513022 - RNA, 64 nt, Homo Sapiens; identical to SEQ ID NO: 509763

SEQ ID NO: 513023 - RNA, 64 nt, Homo Sapiens; identical to SEQ ID NO: 509764

SEQ ID NO: 513024 - RNA, 64 nt, Homo Sapiens; identical to SEQ ID NO: 509765

SEQ ID NO: 513025 - RNA, 64 nt, Homo Sapiens; identical to SEQ ID NO: 509766

SEQ ID NO: 513026 - RNA, 64 nt, Homo Sapiens; identical to SEQ ID NO: 509767

SEQ ID NO: 513027 - RNA, 64 nt, Homo Sapiens; identical to SEQ ID NO: 509768

SEQ ID NO: 513028 - RNA, 64 nt, Homo Sapiens; identical to SEQ ID NO: 509769

SEQ ID NO: 513029 - RNA, 64 nt, Homo Sapiens; identical to SEQ ID NO: 509770

SEQ ID NO: 513030 - RNA, 64 nt, Homo Sapiens; identical to SEQ ID NO: 509771

SEQ ID NO: 513031 - RNA, 64 nt, Homo Sapiens; identical to SEQ ID NO: 509772

SEQ ID NO: 513032 - RNA, 64 nt, Homo Sapiens; identical to SEQ ID NO: 509773

SEQ ID NO: 513033 - RNA, 64 nt, Homo Sapiens; identical to SEQ ID NO: 509774

SEQ ID NO: 513034 - RNA, 64 nt, Homo Sapiens; identical to SEQ ID NO: 509775

SEQ ID NO: 513035 - RNA, 64 nt, Homo Sapiens; identical to SEQ ID NO: 509776

SEQ ID NO: 513036 - RNA, 64 nt, Homo Sapiens; identical to SEQ ID NO: 509777

SEQ ID NO: 513037 - RNA, 64 nt, Homo Sapiens; identical to SEQ ID NO: 509778

SEQ ID NO: 513038 - RNA, 64 nt, Homo Sapiens; identical to SEQ ID NO: 509779

SEQ ID NO: 513039 - RNA, 64 nt, Homo Sapiens; identical to SEQ ID NO: 509780

SEQ ID NO: 513040 - RNA, 64 nt, Homo Sapiens; identical to SEQ ID NO: 509781

SEQ ID NO: 513041 - RNA, 64 nt, Homo Sapiens; identical to SEQ ID NO: 509782

SEQ ID NO: 513042 - RNA, 64 nt, Homo Sapiens; identical to SEQ ID NO: 509783

SEQ ID NO: 513043 - RNA, 64 nt, Homo Sapiens; identical to SEQ ID NO: 509784

SEQ ID NO: 513044 - RNA, 64 nt, Homo Sapiens; identical to SEQ ID NO: 509785

SEQ ID NO: 513045 - RNA, 64 nt, Homo Sapiens; identical to SEQ ID NO: 509786

SEQ ID NO: 513046 - RNA, 64 nt, Homo Sapiens; identical to SEQ ID NO: 509787

SEQ ID NO: 513047 - RNA, 64 nt, Homo Sapiens; identical to SEQ ID NO: 509788

SEQ ID NO: 513048 - RNA, 64 nt, Homo Sapiens; identical to SEQ ID NO: 509789

SEQ ID NO: 513049 - RNA, 64 nt, Homo Sapiens; identical to SEQ ID NO: 509790

SEQ ID NO: 513050 - RNA, 64 nt, Homo Sapiens; identical to SEQ ID NO: 509791

SEQ ID NO: 513051 - RNA, 64 nt, Homo Sapiens; identical to SEQ ID NO: 509792

SEQ ID NO: 513052 - RNA, 64 nt, Homo Sapiens; identical to SEQ ID NO: 509793

SEQ ID NO: 513053 - RNA, 64 nt, Homo Sapiens; identical to SEQ ID NO: 509794

SEQ ID NO: 513054 - RNA, 64 nt, Homo Sapiens; identical to SEQ ID NO: 509795

SEQ ID NO: 513055 - RNA, 64 nt, Homo Sapiens; identical to SEQ ID NO: 509796

SEQ ID NO: 513056 - RNA, 64 nt, Homo Sapiens; identical to SEQ ID NO: 509797

SEQ ID NO: 513057 - RNA, 64 nt, Homo Sapiens; identical to SEQ ID NO: 509798

SEQ ID NO: 513058 - RNA, 64 nt, Homo Sapiens; identical to SEQ ID NO: 509799

SEQ ID NO: 513059 - RNA, 64 nt, Homo Sapiens; identical to SEQ ID NO: 509800

SEQ ID NO: 513060 - RNA, 64 nt, Homo Sapiens; identical to SEQ ID NO: 509801

SEQ ID NO: 513061 - RNA, 64 nt, Homo Sapiens; identical to SEQ ID NO: 509802

SEQ ID NO: 513062 - RNA, 64 nt, Homo Sapiens; identical to SEQ ID NO: 509803

SEQ ID NO: 513063 - RNA, 64 nt, Homo Sapiens; identical to SEQ ID NO: 509804

SEQ ID NO: 513064 - RNA, 64 nt, Homo Sapiens; identical to SEQ ID NO: 509805

SEQ ID NO: 513065 - RNA, 64 nt, Homo Sapiens; identical to SEQ ID NO: 509806

SEQ ID NO: 513066 - RNA, 64 nt, Homo Sapiens; identical to SEQ ID NO: 509807

SEQ ID NO: 513067 - RNA, 64 nt, Homo Sapiens; identical to SEQ ID NO: 509808

SEQ ID NO: 513068 - RNA, 64 nt, Homo Sapiens; identical to SEQ ID NO: 509809

SEQ ID NO: 513069 - RNA, 64 nt, Homo Sapiens; identical to SEQ ID NO: 509810

SEQ ID NO: 513070 - RNA, 64 nt, Homo Sapiens; identical to SEQ ID NO: 509811

SEQ ID NO: 513071 - RNA, 64 nt, Homo Sapiens; identical to SEQ ID NO: 509812

SEQ ID NO: 513072 - RNA, 64 nt, Homo Sapiens; identical to SEQ ID NO: 509813

SEQ ID NO: 513073 - RNA, 64 nt, Homo Sapiens; identical to SEQ ID NO: 509814

SEQ ID NO: 513074 - RNA, 64 nt, Homo Sapiens; identical to SEQ ID NO: 509815

SEQ ID NO: 513075 - RNA, 64 nt, Homo Sapiens; identical to SEQ ID NO: 509816

SEQ ID NO: 513076 - RNA, 64 nt, Homo Sapiens; identical to SEQ ID NO: 509817

SEQ ID NO: 513077 - RNA, 64 nt, Homo Sapiens; identical to SEQ ID NO: 509818

SEQ ID NO: 513078 - RNA, 64 nt, Homo Sapiens; identical to SEQ ID NO: 509819

SEQ ID NO: 513079 - RNA, 64 nt, Homo Sapiens; identical to SEQ ID NO: 509820

SEQ ID NO: 513080 - RNA, 64 nt, Homo Sapiens; identical to SEQ ID NO: 509821

SEQ ID NO: 513081 - RNA, 64 nt, Homo Sapiens; identical to SEQ ID NO: 509822

SEQ ID NO: 513082 - RNA, 64 nt, Homo Sapiens; identical to SEQ ID NO: 509823

SEQ ID NO: 513083 - RNA, 64 nt, Homo Sapiens; identical to SEQ ID NO: 509824

SEQ ID NO: 513084 - RNA, 64 nt, Homo Sapiens; identical to SEQ ID NO: 509825

SEQ ID NO: 513085 - RNA, 64 nt, Homo Sapiens; identical to SEQ ID NO: 509826

SEQ ID NO: 513086 - RNA, 64 nt, Homo Sapiens; identical to SEQ ID NO: 509827

SEQ ID NO: 513087 - RNA, 64 nt, Homo Sapiens; identical to SEQ ID NO: 509828

SEQ ID NO: 513088 - RNA, 64 nt, Homo Sapiens; identical to SEQ ID NO: 509829

SEQ ID NO: 513089 - RNA, 64 nt, Homo Sapiens; identical to SEQ ID NO: 509830

SEQ ID NO: 513090 - RNA, 64 nt, Homo Sapiens; identical to SEQ ID NO: 509831

SEQ ID NO: 513091 - RNA, 64 nt, Homo Sapiens; identical to SEQ ID NO: 509832

SEQ ID NO: 513092 - RNA, 64 nt, Homo Sapiens; identical to SEQ ID NO: 509833

SEQ ID NO: 513093 - RNA, 64 nt, Homo Sapiens; identical to SEQ ID NO: 509834

SEQ ID NO: 513094 - RNA, 64 nt, Homo Sapiens; identical to SEQ ID NO: 509835

SEQ ID NO: 513095 - RNA, 64 nt, Homo Sapiens; identical to SEQ ID NO: 509836

SEQ ID NO: 513096 - RNA, 64 nt, Homo Sapiens; identical to SEQ ID NO: 509837

SEQ ID NO: 513097 - RNA, 64 nt, Homo Sapiens; identical to SEQ ID NO: 509838

SEQ ID NO: 513098 - RNA, 64 nt, Homo Sapiens; identical to SEQ ID NO: 509839

SEQ ID NO: 513099 - RNA, 64 nt, Homo Sapiens; identical to SEQ ID NO: 509840

SEQ ID NO: 513100 - RNA, 64 nt, Homo Sapiens; identical to SEQ ID NO: 509841

SEQ ID NO: 513101 - RNA, 64 nt, Homo Sapiens; identical to SEQ ID NO: 509842

SEQ ID NO: 513102 - RNA, 64 nt, Homo Sapiens; identical to SEQ ID NO: 509843

SEQ ID NO: 513103 - RNA, 64 nt, Homo Sapiens; identical to SEQ ID NO: 509844

SEQ ID NO: 513104 - RNA, 64 nt, Homo Sapiens; identical to SEQ ID NO: 509845

SEQ ID NO: 513105 - RNA, 64 nt, Homo Sapiens; identical to SEQ ID NO: 509846

SEQ ID NO: 513106 - RNA, 64 nt, Homo Sapiens; identical to SEQ ID NO: 509847

SEQ ID NO: 513107 - RNA, 64 nt, Homo Sapiens; identical to SEQ ID NO: 509848

SEQ ID NO: 513108 - RNA, 64 nt, Homo Sapiens; identical to SEQ ID NO: 509849

SEQ ID NO: 513109 - RNA, 64 nt, Homo Sapiens; identical to SEQ ID NO: 509850

SEQ ID NO: 513110 - RNA, 64 nt, Homo Sapiens; identical to SEQ ID NO: 509851

SEQ ID NO: 513111 - RNA, 64 nt, Homo Sapiens; identical to SEQ ID NO: 509852

SEQ ID NO: 513112 - RNA, 64 nt, Homo Sapiens; identical to SEQ ID NO: 509853

SEQ ID NO: 513113 - RNA, 64 nt, Homo Sapiens; identical to SEQ ID NO: 509854

SEQ ID NO: 513114 - RNA, 64 nt, Homo Sapiens; identical to SEQ ID NO: 509855

SEQ ID NO: 513115 - RNA, 59 nt, Homo Sapiens; identical to SEQ ID NO: 509856

SEQ ID NO: 513116 - RNA, 64 nt, Homo Sapiens; identical to SEQ ID NO: 509857

SEQ ID NO: 513117 - RNA, 64 nt, Homo Sapiens; identical to SEQ ID NO: 509858

SEQ ID NO: 513118 - RNA, 64 nt, Homo Sapiens; identical to SEQ ID NO: 509859

SEQ ID NO: 513119 - RNA, 64 nt, Homo Sapiens; identical to SEQ ID NO: 509860

SEQ ID NO: 513120 - RNA, 64 nt, Homo Sapiens; identical to SEQ ID NO: 509861

SEQ ID NO: 513121 - RNA, 64 nt, Homo Sapiens; identical to SEQ ID NO: 509862

SEQ ID NO: 513122 - RNA, 64 nt, Homo Sapiens; identical to SEQ ID NO: 509863

SEQ ID NO: 513123 - RNA, 64 nt, Homo Sapiens; identical to SEQ ID NO: 509864

SEQ ID NO: 513124 - RNA, 64 nt, Homo Sapiens; identical to SEQ ID NO: 509865

SEQ ID NO: 513125 - RNA, 64 nt, Homo Sapiens; identical to SEQ ID NO: 509866

SEQ ID NO: 513126 - RNA, 64 nt, Homo Sapiens; identical to SEQ ID NO: 509867

SEQ ID NO: 513127 - RNA, 64 nt, Homo Sapiens; identical to SEQ ID NO: 509868

SEQ ID NO: 513128 - RNA, 64 nt, Homo Sapiens; identical to SEQ ID NO: 509869

SEQ ID NO: 513129 - RNA, 64 nt, Homo Sapiens; identical to SEQ ID NO: 509870

SEQ ID NO: 513130 - RNA, 64 nt, Homo Sapiens; identical to SEQ ID NO: 509871

SEQ ID NO: 513131 - RNA, 64 nt, Homo Sapiens; identical to SEQ ID NO: 509872

SEQ ID NO: 513132 - RNA, 64 nt, Homo Sapiens; identical to SEQ ID NO: 509873

SEQ ID NO: 513133 - RNA, 64 nt, Homo Sapiens; identical to SEQ ID NO: 509874

SEQ ID NO: 513134 - RNA, 64 nt, Homo Sapiens; identical to SEQ ID NO: 509875

SEQ ID NO: 513135 - RNA, 64 nt, Homo Sapiens; identical to SEQ ID NO: 509876

SEQ ID NO: 513136 - RNA, 64 nt, Homo Sapiens; identical to SEQ ID NO: 509877

SEQ ID NO: 513137 - RNA, 64 nt, Homo Sapiens; identical to SEQ ID NO: 509878

SEQ ID NO: 513138 - RNA, 64 nt, Homo Sapiens; identical to SEQ ID NO: 509879

SEQ ID NO: 513139 - RNA, 64 nt, Homo Sapiens; identical to SEQ ID NO: 509880

SEQ ID NO: 513140 - RNA, 64 nt, Homo Sapiens; identical to SEQ ID NO: 509881

SEQ ID NO: 513141 - RNA, 64 nt, Homo Sapiens; identical to SEQ ID NO: 509882

SEQ ID NO: 513142 - RNA, 64 nt, Homo Sapiens; identical to SEQ ID NO: 509883

SEQ ID NO: 513143 - RNA, 64 nt, Homo Sapiens; identical to SEQ ID NO: 509884

SEQ ID NO: 513144 - RNA, 64 nt, Homo Sapiens; identical to SEQ ID NO: 509885

SEQ ID NO: 513145 - RNA, 64 nt, Homo Sapiens; identical to SEQ ID NO: 509886

SEQ ID NO: 513146 - RNA, 64 nt, Homo Sapiens; identical to SEQ ID NO: 509887

SEQ ID NO: 513147 - RNA, 64 nt, Homo Sapiens; identical to SEQ ID NO: 509888

SEQ ID NO: 513148 - RNA, 64 nt, Homo Sapiens; identical to SEQ ID NO: 509889

SEQ ID NO: 513149 - RNA, 64 nt, Homo Sapiens; identical to SEQ ID NO: 509890

SEQ ID NO: 513150 - RNA, 64 nt, Homo Sapiens; identical to SEQ ID NO: 509891

SEQ ID NO: 513151 - RNA, 64 nt, Homo Sapiens; identical to SEQ ID NO: 509892

SEQ ID NO: 513152 - RNA, 64 nt, Homo Sapiens; identical to SEQ ID NO: 509893

SEQ ID NO: 513153 - RNA, 64 nt, Homo Sapiens; identical to SEQ ID NO: 509894

SEQ ID NO: 513154 - RNA, 64 nt, Homo Sapiens; identical to SEQ ID NO: 509895

SEQ ID NO: 513155 - RNA, 64 nt, Homo Sapiens; identical to SEQ ID NO: 509896

SEQ ID NO: 513156 - RNA, 64 nt, Homo Sapiens; identical to SEQ ID NO: 509897

SEQ ID NO: 513157 - RNA, 64 nt, Homo Sapiens; identical to SEQ ID NO: 509898

SEQ ID NO: 513158 - RNA, 64 nt, Homo Sapiens; identical to SEQ ID NO: 509899

SEQ ID NO: 513159 - RNA, 64 nt, Homo Sapiens; identical to SEQ ID NO: 509900

SEQ ID NO: 513160 - RNA, 64 nt, Homo Sapiens; identical to SEQ ID NO: 509901

SEQ ID NO: 513161 - RNA, 64 nt, Homo Sapiens; identical to SEQ ID NO: 509902

SEQ ID NO: 513162 - RNA, 64 nt, Homo Sapiens; identical to SEQ ID NO: 509903

SEQ ID NO: 513163 - RNA, 64 nt, Homo Sapiens; identical to SEQ ID NO: 509904

SEQ ID NO: 513164 - RNA, 64 nt, Homo Sapiens; identical to SEQ ID NO: 509905

SEQ ID NO: 513165 - RNA, 64 nt, Homo Sapiens; identical to SEQ ID NO: 509906

SEQ ID NO: 513166 - RNA, 64 nt, Homo Sapiens; identical to SEQ ID NO: 509907

SEQ ID NO: 513167 - RNA, 64 nt, Homo Sapiens; identical to SEQ ID NO: 509908

SEQ ID NO: 513168 - RNA, 64 nt, Homo Sapiens; identical to SEQ ID NO: 509909

SEQ ID NO: 513169 - RNA, 64 nt, Homo Sapiens; identical to SEQ ID NO: 509910

SEQ ID NO: 513170 - RNA, 64 nt, Homo Sapiens; identical to SEQ ID NO: 509911

SEQ ID NO: 513171 - RNA, 64 nt, Homo Sapiens; identical to SEQ ID NO: 509912

SEQ ID NO: 513172 - RNA, 64 nt, Homo Sapiens; identical to SEQ ID NO: 509913

SEQ ID NO: 513173 - RNA, 64 nt, Homo Sapiens; identical to SEQ ID NO: 509914

SEQ ID NO: 513174 - RNA, 64 nt, Homo Sapiens; identical to SEQ ID NO: 509915

SEQ ID NO: 513175 - RNA, 64 nt, Homo Sapiens; identical to SEQ ID NO: 509916

SEQ ID NO: 513176 - RNA, 64 nt, Homo Sapiens; identical to SEQ ID NO: 509917

SEQ ID NO: 513177 - RNA, 64 nt, Homo Sapiens; identical to SEQ ID NO: 509918

SEQ ID NO: 513178 - RNA, 64 nt, Homo Sapiens; identical to SEQ ID NO: 509919

SEQ ID NO: 513179 - RNA, 64 nt, Homo Sapiens; identical to SEQ ID NO: 509920

SEQ ID NO: 513180 - RNA, 64 nt, Homo Sapiens; identical to SEQ ID NO: 509921

SEQ ID NO: 513181 - RNA, 64 nt, Homo Sapiens; identical to SEQ ID NO: 509922

SEQ ID NO: 513182 - RNA, 64 nt, Homo Sapiens; identical to SEQ ID NO: 509923

SEQ ID NO: 513183 - RNA, 64 nt, Homo Sapiens; identical to SEQ ID NO: 509924

SEQ ID NO: 513184 - RNA, 64 nt, Homo Sapiens; identical to SEQ ID NO: 509925

SEQ ID NO: 513185 - RNA, 64 nt, Homo Sapiens; identical to SEQ ID NO: 509926

SEQ ID NO: 513186 - RNA, 64 nt, Homo Sapiens; identical to SEQ ID NO: 509927

SEQ ID NO: 513187 - RNA, 64 nt, Homo Sapiens; identical to SEQ ID NO: 509928

SEQ ID NO: 513188 - RNA, 64 nt, Homo Sapiens; identical to SEQ ID NO: 509929

SEQ ID NO: 513189 - RNA, 64 nt, Homo Sapiens; identical to SEQ ID NO: 509930

SEQ ID NO: 513190 - RNA, 64 nt, Homo Sapiens; identical to SEQ ID NO: 509931

SEQ ID NO: 513191 - RNA, 64 nt, Homo Sapiens; identical to SEQ ID NO: 509932

SEQ ID NO: 513192 - RNA, 64 nt, Homo Sapiens; identical to SEQ ID NO: 509933

SEQ ID NO: 513193 - RNA, 64 nt, Homo Sapiens; identical to SEQ ID NO: 509934

SEQ ID NO: 513194 - RNA, 64 nt, Homo Sapiens; identical to SEQ ID NO: 509935

SEQ ID NO: 513195 - RNA, 64 nt, Homo Sapiens; identical to SEQ ID NO: 509936

SEQ ID NO: 513196 - RNA, 64 nt, Homo Sapiens; identical to SEQ ID NO: 509937

SEQ ID NO: 513197 - RNA, 64 nt, Homo Sapiens; identical to SEQ ID NO: 509938

SEQ ID NO: 513198 - RNA, 64 nt, Homo Sapiens; identical to SEQ ID NO: 509939

SEQ ID NO: 513199 - RNA, 64 nt, Homo Sapiens; identical to SEQ ID NO: 509940

SEQ ID NO: 513200 - RNA, 64 nt, Homo Sapiens; identical to SEQ ID NO: 509941

SEQ ID NO: 513201 - RNA, 64 nt, Homo Sapiens; identical to SEQ ID NO: 509942

SEQ ID NO: 513202 - RNA, 64 nt, Homo Sapiens; identical to SEQ ID NO: 509943

SEQ ID NO: 513203 - RNA, 64 nt, Homo Sapiens; identical to SEQ ID NO: 509944

SEQ ID NO: 513204 - RNA, 64 nt, Homo Sapiens; identical to SEQ ID NO: 509945

SEQ ID NO: 513205 - RNA, 64 nt, Homo Sapiens; identical to SEQ ID NO: 509946

SEQ ID NO: 513206 - RNA, 64 nt, Homo Sapiens; identical to SEQ ID NO: 509947

SEQ ID NO: 513207 - RNA, 64 nt, Homo Sapiens; identical to SEQ ID NO: 509948

SEQ ID NO: 513208 - RNA, 64 nt, Homo Sapiens; identical to SEQ ID NO: 509949

SEQ ID NO: 513209 - RNA, 64 nt, Homo Sapiens; identical to SEQ ID NO: 509950

SEQ ID NO: 513210 - RNA, 64 nt, Homo Sapiens; identical to SEQ ID NO: 509951

SEQ ID NO: 513211 - RNA, 64 nt, Homo Sapiens; identical to SEQ ID NO: 509952

SEQ ID NO: 513212 - RNA, 64 nt, Homo Sapiens; identical to SEQ ID NO: 509953

SEQ ID NO: 513213 - RNA, 64 nt, Homo Sapiens; identical to SEQ ID NO: 509954

SEQ ID NO: 513214 - RNA, 64 nt, Homo Sapiens; identical to SEQ ID NO: 509955

SEQ ID NO: 513215 - RNA, 64 nt, Homo Sapiens; identical to SEQ ID NO: 509956

SEQ ID NO: 513216 - RNA, 64 nt, Homo Sapiens; identical to SEQ ID NO: 509957

SEQ ID NO: 513217 - RNA, 64 nt, Homo Sapiens; identical to SEQ ID NO: 509958

SEQ ID NO: 513218 - RNA, 64 nt, Homo Sapiens; identical to SEQ ID NO: 509959

SEQ ID NO: 513219 - RNA, 64 nt, Homo Sapiens; identical to SEQ ID NO: 509960

SEQ ID NO: 513220 - RNA, 64 nt, Homo Sapiens; identical to SEQ ID NO: 509961

SEQ ID NO: 513221 - RNA, 64 nt, Homo Sapiens; identical to SEQ ID NO: 509962

SEQ ID NO: 513222 - RNA, 64 nt, Homo Sapiens; identical to SEQ ID NO: 509963

SEQ ID NO: 513223 - RNA, 64 nt, Homo Sapiens; identical to SEQ ID NO: 509964

SEQ ID NO: 513224 - RNA, 64 nt, Homo Sapiens; identical to SEQ ID NO: 509965

SEQ ID NO: 513225 - RNA, 64 nt, Homo Sapiens; identical to SEQ ID NO: 509966

SEQ ID NO: 513226 - RNA, 64 nt, Homo Sapiens; identical to SEQ ID NO: 509967

SEQ ID NO: 513227 - RNA, 64 nt, Homo Sapiens; identical to SEQ ID NO: 509968

SEQ ID NO: 513228 - RNA, 64 nt, Homo Sapiens; identical to SEQ ID NO: 509969

SEQ ID NO: 513229 - RNA, 64 nt, Homo Sapiens; identical to SEQ ID NO: 509970

SEQ ID NO: 513230 - RNA, 64 nt, Homo Sapiens; identical to SEQ ID NO: 509971

SEQ ID NO: 513231 - RNA, 64 nt, Homo Sapiens; identical to SEQ ID NO: 509972

SEQ ID NO: 513232 - RNA, 64 nt, Homo Sapiens; identical to SEQ ID NO: 509973

SEQ ID NO: 513233 - RNA, 64 nt, Homo Sapiens; identical to SEQ ID NO: 509974

SEQ ID NO: 513234 - RNA, 64 nt, Homo Sapiens; identical to SEQ ID NO: 509975

SEQ ID NO: 513235 - RNA, 64 nt, Homo Sapiens; identical to SEQ ID NO: 509976

SEQ ID NO: 513236 - RNA, 64 nt, Homo Sapiens; identical to SEQ ID NO: 509977

SEQ ID NO: 513237 - RNA, 64 nt, Homo Sapiens; identical to SEQ ID NO: 509978

SEQ ID NO: 513238 - RNA, 64 nt, Homo Sapiens; identical to SEQ ID NO: 509979

SEQ ID NO: 513239 - RNA, 64 nt, Homo Sapiens; identical to SEQ ID NO: 509980

SEQ ID NO: 513240 - RNA, 64 nt, Homo Sapiens; identical to SEQ ID NO: 509981

SEQ ID NO: 513241 - RNA, 64 nt, Homo Sapiens; identical to SEQ ID NO: 509982

SEQ ID NO: 513242 - RNA, 64 nt, Homo Sapiens; identical to SEQ ID NO: 509983

SEQ ID NO: 513243 - RNA, 64 nt, Homo Sapiens; identical to SEQ ID NO: 509984

SEQ ID NO: 513244 - RNA, 64 nt, Homo Sapiens; identical to SEQ ID NO: 509985

SEQ ID NO: 513245 - RNA, 64 nt, Homo Sapiens; identical to SEQ ID NO: 509986

SEQ ID NO: 513246 - RNA, 64 nt, Homo Sapiens; identical to SEQ ID NO: 509987

SEQ ID NO: 513247 - RNA, 64 nt, Homo Sapiens; identical to SEQ ID NO: 509988

SEQ ID NO: 513248 - RNA, 64 nt, Homo Sapiens; identical to SEQ ID NO: 509989

SEQ ID NO: 513249 - RNA, 64 nt, Homo Sapiens; identical to SEQ ID NO: 509990

SEQ ID NO: 513250 - RNA, 64 nt, Homo Sapiens; identical to SEQ ID NO: 509991

SEQ ID NO: 513251 - RNA, 64 nt, Homo Sapiens; identical to SEQ ID NO: 509992

SEQ ID NO: 513252 - RNA, 64 nt, Homo Sapiens; identical to SEQ ID NO: 509993

SEQ ID NO: 513253 - RNA, 64 nt, Homo Sapiens; identical to SEQ ID NO: 509994

SEQ ID NO: 513254 - RNA, 64 nt, Homo Sapiens; identical to SEQ ID NO: 509995

SEQ ID NO: 513255 - RNA, 64 nt, Homo Sapiens; identical to SEQ ID NO: 509996

SEQ ID NO: 513256 - RNA, 64 nt, Homo Sapiens; identical to SEQ ID NO: 509997

SEQ ID NO: 513257 - RNA, 64 nt, Homo Sapiens; identical to SEQ ID NO: 509998

SEQ ID NO: 513258 - RNA, 64 nt, Homo Sapiens; identical to SEQ ID NO: 509999

SEQ ID NO: 513259 - RNA, 64 nt, Homo Sapiens; identical to SEQ ID NO: 510000

SEQ ID NO: 513260 - RNA, 64 nt, Homo Sapiens; identical to SEQ ID NO: 510001

SEQ ID NO: 513261 - RNA, 64 nt, Homo Sapiens; identical to SEQ ID NO: 510002

SEQ ID NO: 513262 - RNA, 64 nt, Homo Sapiens; identical to SEQ ID NO: 510003

SEQ ID NO: 513263 - RNA, 64 nt, Homo Sapiens; identical to SEQ ID NO: 510004

SEQ ID NO: 513264 - RNA, 64 nt, Homo Sapiens; identical to SEQ ID NO: 510005

SEQ ID NO: 513265 - RNA, 64 nt, Homo Sapiens; identical to SEQ ID NO: 510006

SEQ ID NO: 513266 - RNA, 64 nt, Homo Sapiens; identical to SEQ ID NO: 510007

SEQ ID NO: 513267 - RNA, 64 nt, Homo Sapiens; identical to SEQ ID NO: 510008

SEQ ID NO: 513268 - RNA, 64 nt, Homo Sapiens; identical to SEQ ID NO: 510009

SEQ ID NO: 513269 - RNA, 64 nt, Homo Sapiens; identical to SEQ ID NO: 510010

SEQ ID NO: 513270 - RNA, 64 nt, Homo Sapiens; identical to SEQ ID NO: 510011

SEQ ID NO: 513271 - RNA, 64 nt, Homo Sapiens; identical to SEQ ID NO: 510012

SEQ ID NO: 513272 - RNA, 64 nt, Homo Sapiens; identical to SEQ ID NO: 510013

SEQ ID NO: 513273 - RNA, 64 nt, Homo Sapiens; identical to SEQ ID NO: 510014

SEQ ID NO: 513274 - RNA, 64 nt, Homo Sapiens; identical to SEQ ID NO: 510015

SEQ ID NO: 513275 - RNA, 64 nt, Homo Sapiens; identical to SEQ ID NO: 510016

SEQ ID NO: 513276 - RNA, 64 nt, Homo Sapiens; identical to SEQ ID NO: 510017

SEQ ID NO: 513277 - RNA, 64 nt, Homo Sapiens; identical to SEQ ID NO: 510018

SEQ ID NO: 513278 - RNA, 64 nt, Homo Sapiens; identical to SEQ ID NO: 510019

SEQ ID NO: 513279 - RNA, 64 nt, Homo Sapiens; identical to SEQ ID NO: 510020

SEQ ID NO: 513280 - RNA, 64 nt, Homo Sapiens; identical to SEQ ID NO: 510021

SEQ ID NO: 513281 - RNA, 64 nt, Homo Sapiens; identical to SEQ ID NO: 510022

SEQ ID NO: 513282 - RNA, 64 nt, Homo Sapiens; identical to SEQ ID NO: 510023

SEQ ID NO: 513283 - RNA, 64 nt, Homo Sapiens; identical to SEQ ID NO: 510024

SEQ ID NO: 513284 - RNA, 64 nt, Homo Sapiens; identical to SEQ ID NO: 510025

SEQ ID NO: 513285 - RNA, 64 nt, Homo Sapiens; identical to SEQ ID NO: 510026

SEQ ID NO: 513286 - RNA, 64 nt, Homo Sapiens; identical to SEQ ID NO: 510027

SEQ ID NO: 513287 - RNA, 64 nt, Homo Sapiens; identical to SEQ ID NO: 510028

SEQ ID NO: 513288 - RNA, 64 nt, Homo Sapiens; identical to SEQ ID NO: 510029

SEQ ID NO: 513289 - RNA, 64 nt, Homo Sapiens; identical to SEQ ID NO: 510030

SEQ ID NO: 513290 - RNA, 64 nt, Homo Sapiens; identical to SEQ ID NO: 510031

SEQ ID NO: 513291 - RNA, 64 nt, Homo Sapiens; identical to SEQ ID NO: 510032

SEQ ID NO: 513292 - RNA, 64 nt, Homo Sapiens; identical to SEQ ID NO: 510033

SEQ ID NO: 513293 - RNA, 64 nt, Homo Sapiens; identical to SEQ ID NO: 510034

SEQ ID NO: 513294 - RNA, 64 nt, Homo Sapiens; identical to SEQ ID NO: 510035

SEQ ID NO: 513295 - RNA, 64 nt, Homo Sapiens; identical to SEQ ID NO: 510036

SEQ ID NO: 513296 - RNA, 64 nt, Homo Sapiens; identical to SEQ ID NO: 510037

SEQ ID NO: 513297 - RNA, 64 nt, Homo Sapiens; identical to SEQ ID NO: 510038

SEQ ID NO: 513298 - RNA, 64 nt, Homo Sapiens; identical to SEQ ID NO: 510039

SEQ ID NO: 513299 - RNA, 64 nt, Homo Sapiens; identical to SEQ ID NO: 510040

SEQ ID NO: 513300 - RNA, 64 nt, Homo Sapiens; identical to SEQ ID NO: 510041

SEQ ID NO: 513301 - RNA, 64 nt, Homo Sapiens; identical to SEQ ID NO: 510042

SEQ ID NO: 513302 - RNA, 64 nt, Homo Sapiens; identical to SEQ ID NO: 510043

SEQ ID NO: 513303 - RNA, 64 nt, Homo Sapiens; identical to SEQ ID NO: 510044

SEQ ID NO: 513304 - RNA, 64 nt, Homo Sapiens; identical to SEQ ID NO: 510045

SEQ ID NO: 513305 - RNA, 64 nt, Homo Sapiens; identical to SEQ ID NO: 510046

SEQ ID NO: 513306 - RNA, 64 nt, Homo Sapiens; identical to SEQ ID NO: 510047

SEQ ID NO: 513307 - RNA, 64 nt, Homo Sapiens; identical to SEQ ID NO: 510048

SEQ ID NO: 513308 - RNA, 64 nt, Homo Sapiens; identical to SEQ ID NO: 510049

SEQ ID NO: 513309 - RNA, 64 nt, Homo Sapiens; identical to SEQ ID NO: 510050

SEQ ID NO: 513310 - RNA, 64 nt, Homo Sapiens; identical to SEQ ID NO: 510051

SEQ ID NO: 513311 - RNA, 64 nt, Homo Sapiens; identical to SEQ ID NO: 510052

SEQ ID NO: 513312 - RNA, 64 nt, Homo Sapiens; identical to SEQ ID NO: 510053

SEQ ID NO: 513313 - RNA, 64 nt, Homo Sapiens; identical to SEQ ID NO: 510054

SEQ ID NO: 513314 - RNA, 64 nt, Homo Sapiens; identical to SEQ ID NO: 510055

SEQ ID NO: 513315 - RNA, 64 nt, Homo Sapiens; identical to SEQ ID NO: 510056

SEQ ID NO: 513316 - RNA, 64 nt, Homo Sapiens; identical to SEQ ID NO: 510057

SEQ ID NO: 513317 - RNA, 64 nt, Homo Sapiens; identical to SEQ ID NO: 510058

SEQ ID NO: 513318 - RNA, 64 nt, Homo Sapiens; identical to SEQ ID NO: 510059

SEQ ID NO: 513319 - RNA, 64 nt, Homo Sapiens; identical to SEQ ID NO: 510060

SEQ ID NO: 513320 - RNA, 64 nt, Homo Sapiens; identical to SEQ ID NO: 510061

SEQ ID NO: 513321 - RNA, 64 nt, Homo Sapiens; identical to SEQ ID NO: 510062

SEQ ID NO: 513322 - RNA, 64 nt, Homo Sapiens; identical to SEQ ID NO: 510063

SEQ ID NO: 513323 - RNA, 64 nt, Homo Sapiens; identical to SEQ ID NO: 510064

SEQ ID NO: 513324 - RNA, 64 nt, Homo Sapiens; identical to SEQ ID NO: 510065

SEQ ID NO: 513325 - RNA, 64 nt, Homo Sapiens; identical to SEQ ID NO: 510066

SEQ ID NO: 513326 - RNA, 64 nt, Homo Sapiens; identical to SEQ ID NO: 510067

SEQ ID NO: 513327 - RNA, 64 nt, Homo Sapiens; identical to SEQ ID NO: 510068

SEQ ID NO: 513328 - RNA, 64 nt, Homo Sapiens; identical to SEQ ID NO: 510069

SEQ ID NO: 513329 - RNA, 64 nt, Homo Sapiens; identical to SEQ ID NO: 510070

SEQ ID NO: 513330 - RNA, 64 nt, Homo Sapiens; identical to SEQ ID NO: 510071

SEQ ID NO: 513331 - RNA, 64 nt, Homo Sapiens; identical to SEQ ID NO: 510072

SEQ ID NO: 513332 - RNA, 64 nt, Homo Sapiens; identical to SEQ ID NO: 510073

SEQ ID NO: 513333 - RNA, 64 nt, Homo Sapiens; identical to SEQ ID NO: 510074

SEQ ID NO: 513334 - RNA, 64 nt, Homo Sapiens; identical to SEQ ID NO: 510075

SEQ ID NO: 513335 - RNA, 64 nt, Homo Sapiens; identical to SEQ ID NO: 510076

SEQ ID NO: 513336 - RNA, 64 nt, Homo Sapiens; identical to SEQ ID NO: 510077

SEQ ID NO: 513337 - RNA, 64 nt, Homo Sapiens; identical to SEQ ID NO: 510078

SEQ ID NO: 513338 - RNA, 64 nt, Homo Sapiens; identical to SEQ ID NO: 510079

SEQ ID NO: 513339 - RNA, 64 nt, Homo Sapiens; identical to SEQ ID NO: 510080

SEQ ID NO: 513340 - RNA, 64 nt, Homo Sapiens; identical to SEQ ID NO: 510081

SEQ ID NO: 513341 - RNA, 64 nt, Homo Sapiens; identical to SEQ ID NO: 510082

SEQ ID NO: 513342 - RNA, 64 nt, Homo Sapiens; identical to SEQ ID NO: 510083

SEQ ID NO: 513343 - RNA, 64 nt, Homo Sapiens; identical to SEQ ID NO: 510084

SEQ ID NO: 513344 - RNA, 64 nt, Homo Sapiens; identical to SEQ ID NO: 510085

SEQ ID NO: 513345 - RNA, 64 nt, Homo Sapiens; identical to SEQ ID NO: 510086

SEQ ID NO: 513346 - RNA, 64 nt, Homo Sapiens; identical to SEQ ID NO: 510087

SEQ ID NO: 513347 - RNA, 64 nt, Homo Sapiens; identical to SEQ ID NO: 510088

SEQ ID NO: 513348 - RNA, 64 nt, Homo Sapiens; identical to SEQ ID NO: 510089

SEQ ID NO: 513349 - RNA, 64 nt, Homo Sapiens; identical to SEQ ID NO: 510090

SEQ ID NO: 513350 - RNA, 64 nt, Homo Sapiens; identical to SEQ ID NO: 510091

SEQ ID NO: 513351 - RNA, 64 nt, Homo Sapiens; identical to SEQ ID NO: 510092

SEQ ID NO: 513352 - RNA, 64 nt, Homo Sapiens; identical to SEQ ID NO: 510093

SEQ ID NO: 513353 - RNA, 64 nt, Homo Sapiens; identical to SEQ ID NO: 510094

SEQ ID NO: 513354 - RNA, 64 nt, Homo Sapiens; identical to SEQ ID NO: 510095

SEQ ID NO: 513355 - RNA, 64 nt, Homo Sapiens; identical to SEQ ID NO: 510096

SEQ ID NO: 513356 - RNA, 64 nt, Homo Sapiens; identical to SEQ ID NO: 510097

SEQ ID NO: 513357 - RNA, 64 nt, Homo Sapiens; identical to SEQ ID NO: 510098

SEQ ID NO: 513358 - RNA, 64 nt, Homo Sapiens; identical to SEQ ID NO: 510099

SEQ ID NO: 513359 - RNA, 64 nt, Homo Sapiens; identical to SEQ ID NO: 509434

SEQ ID NO: 513360 - RNA, 64 nt, Homo Sapiens; identical to SEQ ID NO: 510101

SEQ ID NO: 513361 - RNA, 64 nt, Homo Sapiens; identical to SEQ ID NO: 510102

SEQ ID NO: 513362 - RNA, 64 nt, Homo Sapiens; identical to SEQ ID NO: 510103

SEQ ID NO: 513363 - RNA, 64 nt, Homo Sapiens; identical to SEQ ID NO: 510104

SEQ ID NO: 513364 - RNA, 64 nt, Homo Sapiens; identical to SEQ ID NO: 510105

SEQ ID NO: 513365 - RNA, 64 nt, Homo Sapiens; identical to SEQ ID NO: 510106

SEQ ID NO: 513366 - RNA, 64 nt, Homo Sapiens; identical to SEQ ID NO: 510107

SEQ ID NO: 513367 - RNA, 64 nt, Homo Sapiens; identical to SEQ ID NO: 510108

SEQ ID NO: 513368 - RNA, 64 nt, Homo Sapiens; identical to SEQ ID NO: 510109

SEQ ID NO: 513369 - RNA, 64 nt, Homo Sapiens; identical to SEQ ID NO: 510110

SEQ ID NO: 513370 - RNA, 64 nt, Homo Sapiens; identical to SEQ ID NO: 510111

SEQ ID NO: 513371 - RNA, 64 nt, Homo Sapiens; identical to SEQ ID NO: 510112

SEQ ID NO: 513372 - RNA, 64 nt, Homo Sapiens; identical to SEQ ID NO: 510113

SEQ ID NO: 513373 - RNA, 64 nt, Homo Sapiens; identical to SEQ ID NO: 510114

SEQ ID NO: 513374 - RNA, 64 nt, Homo Sapiens; identical to SEQ ID NO: 510115

SEQ ID NO: 513375 - RNA, 64 nt, Homo Sapiens; identical to SEQ ID NO: 510116

SEQ ID NO: 513376 - RNA, 64 nt, Homo Sapiens; identical to SEQ ID NO: 510117

SEQ ID NO: 513377 - RNA, 64 nt, Homo Sapiens; identical to SEQ ID NO: 510118

SEQ ID NO: 513378 - RNA, 64 nt, Homo Sapiens; identical to SEQ ID NO: 510119

SEQ ID NO: 513379 - RNA, 64 nt, Homo Sapiens; identical to SEQ ID NO: 510120

SEQ ID NO: 513380 - RNA, 64 nt, Homo Sapiens; identical to SEQ ID NO: 510121

SEQ ID NO: 513381 - RNA, 64 nt, Homo Sapiens; identical to SEQ ID NO: 510122

SEQ ID NO: 513382 - RNA, 64 nt, Homo Sapiens; identical to SEQ ID NO: 510123

SEQ ID NO: 513383 - RNA, 64 nt, Homo Sapiens; identical to SEQ ID NO: 510124

SEQ ID NO: 513384 - RNA, 64 nt, Homo Sapiens; identical to SEQ ID NO: 510125

SEQ ID NO: 513385 - RNA, 64 nt, Homo Sapiens; identical to SEQ ID NO: 510126

SEQ ID NO: 513386 - RNA, 64 nt, Homo Sapiens; identical to SEQ ID NO: 510127

SEQ ID NO: 513387 - RNA, 64 nt, Homo Sapiens; identical to SEQ ID NO: 510128

SEQ ID NO: 513388 - RNA, 64 nt, Homo Sapiens; identical to SEQ ID NO: 510129

SEQ ID NO: 513389 - RNA, 64 nt, Homo Sapiens; identical to SEQ ID NO: 510130

SEQ ID NO: 513390 - RNA, 64 nt, Homo Sapiens; identical to SEQ ID NO: 510131

SEQ ID NO: 513391 - RNA, 64 nt, Homo Sapiens; identical to SEQ ID NO: 510132

SEQ ID NO: 513392 - RNA, 64 nt, Homo Sapiens; identical to SEQ ID NO: 510133

SEQ ID NO: 513393 - RNA, 64 nt, Homo Sapiens; identical to SEQ ID NO: 510134

SEQ ID NO: 513394 - RNA, 64 nt, Homo Sapiens; identical to SEQ ID NO: 510135

SEQ ID NO: 513395 - RNA, 64 nt, Homo Sapiens; identical to SEQ ID NO: 510136

SEQ ID NO: 513396 - RNA, 64 nt, Homo Sapiens; identical to SEQ ID NO: 510137

SEQ ID NO: 513397 - RNA, 64 nt, Homo Sapiens; identical to SEQ ID NO: 510138

SEQ ID NO: 513398 - RNA, 64 nt, Homo Sapiens; identical to SEQ ID NO: 510139

SEQ ID NO: 513399 - RNA, 64 nt, Homo Sapiens; identical to SEQ ID NO: 510140

SEQ ID NO: 513400 - RNA, 64 nt, Homo Sapiens; identical to SEQ ID NO: 510141

SEQ ID NO: 513401 - RNA, 64 nt, Homo Sapiens; identical to SEQ ID NO: 510142

SEQ ID NO: 513402 - RNA, 64 nt, Homo Sapiens; identical to SEQ ID NO: 510143

SEQ ID NO: 513403 - RNA, 64 nt, Homo Sapiens; identical to SEQ ID NO: 510144

SEQ ID NO: 513404 - RNA, 64 nt, Homo Sapiens; identical to SEQ ID NO: 510145

SEQ ID NO: 513405 - RNA, 64 nt, Homo Sapiens; identical to SEQ ID NO: 510146

SEQ ID NO: 513406 - RNA, 64 nt, Homo Sapiens; identical to SEQ ID NO: 510147

SEQ ID NO: 513407 - RNA, 64 nt, Homo Sapiens; identical to SEQ ID NO: 510148

SEQ ID NO: 513408 - RNA, 64 nt, Homo Sapiens; identical to SEQ ID NO: 510149

SEQ ID NO: 513409 - RNA, 64 nt, Homo Sapiens; identical to SEQ ID NO: 510150

SEQ ID NO: 513410 - RNA, 64 nt, Homo Sapiens; identical to SEQ ID NO: 510151

SEQ ID NO: 513411 - RNA, 64 nt, Homo Sapiens; identical to SEQ ID NO: 510152

SEQ ID NO: 513412 - RNA, 64 nt, Homo Sapiens; identical to SEQ ID NO: 510153

SEQ ID NO: 513413 - RNA, 64 nt, Homo Sapiens; identical to SEQ ID NO: 510154

SEQ ID NO: 513414 - RNA, 64 nt, Homo Sapiens; identical to SEQ ID NO: 510155

SEQ ID NO: 513415 - RNA, 64 nt, Homo Sapiens; identical to SEQ ID NO: 510156

SEQ ID NO: 513416 - RNA, 64 nt, Homo Sapiens; identical to SEQ ID NO: 510157

SEQ ID NO: 513417 - RNA, 64 nt, Homo Sapiens; identical to SEQ ID NO: 510158

SEQ ID NO: 513418 - RNA, 64 nt, Homo Sapiens; identical to SEQ ID NO: 510159

SEQ ID NO: 513419 - RNA, 64 nt, Homo Sapiens; identical to SEQ ID NO: 510160

SEQ ID NO: 513420 - RNA, 64 nt, Homo Sapiens; identical to SEQ ID NO: 510161

SEQ ID NO: 513421 - RNA, 64 nt, Homo Sapiens; identical to SEQ ID NO: 510162

SEQ ID NO: 513422 - RNA, 64 nt, Homo Sapiens; identical to SEQ ID NO: 510163

SEQ ID NO: 513423 - RNA, 64 nt, Homo Sapiens; identical to SEQ ID NO: 510164

SEQ ID NO: 513424 - RNA, 53 nt, Homo Sapiens; identical to SEQ ID NO: 510165

SEQ ID NO: 513425 - RNA, 64 nt, Homo Sapiens; identical to SEQ ID NO: 510166

SEQ ID NO: 513426 - RNA, 64 nt, Homo Sapiens; identical to SEQ ID NO: 510167

SEQ ID NO: 513427 - RNA, 64 nt, Homo Sapiens; identical to SEQ ID NO: 510168

SEQ ID NO: 513428 - RNA, 64 nt, Homo Sapiens; identical to SEQ ID NO: 510169

SEQ ID NO: 513429 - RNA, 64 nt, Homo Sapiens; identical to SEQ ID NO: 510170

SEQ ID NO: 513430 - RNA, 64 nt, Homo Sapiens; identical to SEQ ID NO: 510171

SEQ ID NO: 513431 - RNA, 64 nt, Homo Sapiens; identical to SEQ ID NO: 510172

SEQ ID NO: 513432 - RNA, 64 nt, Homo Sapiens; identical to SEQ ID NO: 510173

SEQ ID NO: 513433 - RNA, 64 nt, Homo Sapiens; identical to SEQ ID NO: 510174

SEQ ID NO: 513434 - RNA, 64 nt, Homo Sapiens; identical to SEQ ID NO: 510175

SEQ ID NO: 513435 - RNA, 64 nt, Homo Sapiens; identical to SEQ ID NO: 510176

SEQ ID NO: 513436 - RNA, 64 nt, Homo Sapiens; identical to SEQ ID NO: 510177

SEQ ID NO: 513437 - RNA, 64 nt, Homo Sapiens; identical to SEQ ID NO: 510178

SEQ ID NO: 513438 - RNA, 64 nt, Homo Sapiens; identical to SEQ ID NO: 510179

SEQ ID NO: 513439 - RNA, 64 nt, Homo Sapiens; identical to SEQ ID NO: 510180

SEQ ID NO: 513440 - RNA, 64 nt, Homo Sapiens; identical to SEQ ID NO: 510181

SEQ ID NO: 513441 - RNA, 64 nt, Homo Sapiens; identical to SEQ ID NO: 510182

SEQ ID NO: 513442 - RNA, 64 nt, Homo Sapiens; identical to SEQ ID NO: 510183

SEQ ID NO: 513443 - RNA, 64 nt, Homo Sapiens; identical to SEQ ID NO: 510184

SEQ ID NO: 513444 - RNA, 64 nt, Homo Sapiens; identical to SEQ ID NO: 510185

SEQ ID NO: 513445 - RNA, 64 nt, Homo Sapiens; identical to SEQ ID NO: 510186

SEQ ID NO: 513446 - RNA, 64 nt, Homo Sapiens; identical to SEQ ID NO: 510187

SEQ ID NO: 513447 - RNA, 64 nt, Homo Sapiens; identical to SEQ ID NO: 510188

SEQ ID NO: 513448 - RNA, 64 nt, Homo Sapiens; identical to SEQ ID NO: 510189

SEQ ID NO: 513449 - RNA, 64 nt, Homo Sapiens; identical to SEQ ID NO: 510190

SEQ ID NO: 513450 - RNA, 64 nt, Homo Sapiens; identical to SEQ ID NO: 510191

SEQ ID NO: 513451 - RNA, 64 nt, Homo Sapiens; identical to SEQ ID NO: 510192

SEQ ID NO: 513452 - RNA, 64 nt, Homo Sapiens; identical to SEQ ID NO: 510193

SEQ ID NO: 513453 - RNA, 64 nt, Homo Sapiens; identical to SEQ ID NO: 510194

SEQ ID NO: 513454 - RNA, 64 nt, Homo Sapiens; identical to SEQ ID NO: 510195

SEQ ID NO: 513455 - RNA, 64 nt, Homo Sapiens; identical to SEQ ID NO: 510196

SEQ ID NO: 513456 - RNA, 64 nt, Homo Sapiens; identical to SEQ ID NO: 510197

SEQ ID NO: 513457 - RNA, 64 nt, Homo Sapiens; identical to SEQ ID NO: 510198

SEQ ID NO: 513458 - RNA, 64 nt, Homo Sapiens; identical to SEQ ID NO: 510199

SEQ ID NO: 513459 - RNA, 64 nt, Homo Sapiens; identical to SEQ ID NO: 510200

SEQ ID NO: 513460 - RNA, 64 nt, Homo Sapiens; identical to SEQ ID NO: 510201

SEQ ID NO: 513461 - RNA, 64 nt, Homo Sapiens; identical to SEQ ID NO: 510202

SEQ ID NO: 513462 - RNA, 64 nt, Homo Sapiens; identical to SEQ ID NO: 510203

SEQ ID NO: 513463 - RNA, 64 nt, Homo Sapiens; identical to SEQ ID NO: 510204

SEQ ID NO: 513464 - RNA, 64 nt, Homo Sapiens; identical to SEQ ID NO: 510205

SEQ ID NO: 513465 - RNA, 64 nt, Homo Sapiens; identical to SEQ ID NO: 510206

SEQ ID NO: 513466 - RNA, 62 nt, Homo Sapiens; identical to SEQ ID NO: 510207

SEQ ID NO: 513467 - RNA, 64 nt, Homo Sapiens; identical to SEQ ID NO: 510208

SEQ ID NO: 513468 - RNA, 64 nt, Homo Sapiens; identical to SEQ ID NO: 510209

SEQ ID NO: 513469 - RNA, 64 nt, Homo Sapiens; identical to SEQ ID NO: 510210

SEQ ID NO: 513470 - RNA, 64 nt, Homo Sapiens; identical to SEQ ID NO: 510211

SEQ ID NO: 513471 - RNA, 64 nt, Homo Sapiens; identical to SEQ ID NO: 510212

SEQ ID NO: 513472 - RNA, 64 nt, Homo Sapiens; identical to SEQ ID NO: 510213

SEQ ID NO: 513473 - RNA, 64 nt, Homo Sapiens; identical to SEQ ID NO: 510214

SEQ ID NO: 513474 - RNA, 64 nt, Homo Sapiens; identical to SEQ ID NO: 510215

SEQ ID NO: 513475 - RNA, 64 nt, Homo Sapiens; identical to SEQ ID NO: 510216

SEQ ID NO: 513476 - RNA, 64 nt, Homo Sapiens; identical to SEQ ID NO: 510217

SEQ ID NO: 513477 - RNA, 64 nt, Homo Sapiens; identical to SEQ ID NO: 510218

SEQ ID NO: 513478 - RNA, 64 nt, Homo Sapiens; identical to SEQ ID NO: 510219

SEQ ID NO: 513479 - RNA, 64 nt, Homo Sapiens; identical to SEQ ID NO: 510220

SEQ ID NO: 513480 - RNA, 64 nt, Homo Sapiens; identical to SEQ ID NO: 510221

SEQ ID NO: 513481 - RNA, 64 nt, Homo Sapiens; identical to SEQ ID NO: 510222

SEQ ID NO: 513482 - RNA, 64 nt, Homo Sapiens; identical to SEQ ID NO: 510223

SEQ ID NO: 513483 - RNA, 64 nt, Homo Sapiens; identical to SEQ ID NO: 510224

SEQ ID NO: 513484 - RNA, 64 nt, Homo Sapiens; identical to SEQ ID NO: 510225

SEQ ID NO: 513485 - RNA, 64 nt, Homo Sapiens; identical to SEQ ID NO: 510226

SEQ ID NO: 513486 - RNA, 64 nt, Homo Sapiens; identical to SEQ ID NO: 510227

SEQ ID NO: 513487 - RNA, 64 nt, Homo Sapiens; identical to SEQ ID NO: 510228

SEQ ID NO: 513488 - RNA, 64 nt, Homo Sapiens; identical to SEQ ID NO: 510229

SEQ ID NO: 513489 - RNA, 64 nt, Homo Sapiens; identical to SEQ ID NO: 510230

SEQ ID NO: 513490 - RNA, 64 nt, Homo Sapiens; identical to SEQ ID NO: 510231

SEQ ID NO: 513491 - RNA, 64 nt, Homo Sapiens; identical to SEQ ID NO: 510232

SEQ ID NO: 513492 - RNA, 64 nt, Homo Sapiens; identical to SEQ ID NO: 510233

SEQ ID NO: 513493 - RNA, 64 nt, Homo Sapiens; identical to SEQ ID NO: 510234

SEQ ID NO: 513494 - RNA, 64 nt, Homo Sapiens; identical to SEQ ID NO: 510235

SEQ ID NO: 513495 - RNA, 64 nt, Homo Sapiens; identical to SEQ ID NO: 510236

SEQ ID NO: 513496 - RNA, 64 nt, Homo Sapiens; identical to SEQ ID NO: 510237

SEQ ID NO: 513497 - RNA, 64 nt, Homo Sapiens; identical to SEQ ID NO: 510238

SEQ ID NO: 513498 - RNA, 64 nt, Homo Sapiens; identical to SEQ ID NO: 510239

SEQ ID NO: 513499 - RNA, 64 nt, Homo Sapiens; identical to SEQ ID NO: 510240

SEQ ID NO: 513500 - RNA, 64 nt, Homo Sapiens; identical to SEQ ID NO: 510241

SEQ ID NO: 513501 - RNA, 64 nt, Homo Sapiens; identical to SEQ ID NO: 510242

SEQ ID NO: 513502 - RNA, 64 nt, Homo Sapiens; identical to SEQ ID NO: 510243

SEQ ID NO: 513503 - RNA, 64 nt, Homo Sapiens; identical to SEQ ID NO: 510244

SEQ ID NO: 513504 - RNA, 64 nt, Homo Sapiens; identical to SEQ ID NO: 510245

SEQ ID NO: 513505 - RNA, 64 nt, Homo Sapiens; identical to SEQ ID NO: 510246

SEQ ID NO: 513506 - RNA, 64 nt, Homo Sapiens; identical to SEQ ID NO: 510247

SEQ ID NO: 513507 - RNA, 64 nt, Homo Sapiens; identical to SEQ ID NO: 510248

SEQ ID NO: 513508 - RNA, 64 nt, Homo Sapiens; identical to SEQ ID NO: 510249

SEQ ID NO: 513509 - RNA, 64 nt, Homo Sapiens; identical to SEQ ID NO: 510250

SEQ ID NO: 513510 - RNA, 64 nt, Homo Sapiens; identical to SEQ ID NO: 510251

SEQ ID NO: 513511 - RNA, 64 nt, Homo Sapiens; identical to SEQ ID NO: 510252

SEQ ID NO: 513512 - RNA, 64 nt, Homo Sapiens; identical to SEQ ID NO: 510253

SEQ ID NO: 513513 - RNA, 64 nt, Homo Sapiens; identical to SEQ ID NO: 510254

SEQ ID NO: 513514 - RNA, 64 nt, Homo Sapiens; identical to SEQ ID NO: 510255

SEQ ID NO: 513515 - RNA, 64 nt, Homo Sapiens; identical to SEQ ID NO: 510256

SEQ ID NO: 513516 - RNA, 64 nt, Homo Sapiens; identical to SEQ ID NO: 510257

SEQ ID NO: 513517 - RNA, 64 nt, Homo Sapiens; identical to SEQ ID NO: 510258

SEQ ID NO: 513518 - RNA, 64 nt, Homo Sapiens; identical to SEQ ID NO: 510259

SEQ ID NO: 513519 - RNA, 64 nt, Homo Sapiens; identical to SEQ ID NO: 510260

SEQ ID NO: 513520 - RNA, 64 nt, Homo Sapiens; identical to SEQ ID NO: 510261

SEQ ID NO: 513521 - RNA, 64 nt, Homo Sapiens; identical to SEQ ID NO: 510262

SEQ ID NO: 513522 - RNA, 64 nt, Homo Sapiens; identical to SEQ ID NO: 510263

SEQ ID NO: 513523 - RNA, 64 nt, Homo Sapiens; identical to SEQ ID NO: 510264

SEQ ID NO: 513524 - RNA, 64 nt, Homo Sapiens; identical to SEQ ID NO: 510265

SEQ ID NO: 513525 - RNA, 64 nt, Homo Sapiens; identical to SEQ ID NO: 510266

SEQ ID NO: 513526 - RNA, 64 nt, Homo Sapiens; identical to SEQ ID NO: 510267

SEQ ID NO: 513527 - RNA, 64 nt, Homo Sapiens; identical to SEQ ID NO: 510268

SEQ ID NO: 513528 - RNA, 64 nt, Homo Sapiens; identical to SEQ ID NO: 510269

SEQ ID NO: 513529 - RNA, 64 nt, Homo Sapiens; identical to SEQ ID NO: 510270

SEQ ID NO: 513530 - RNA, 64 nt, Homo Sapiens; identical to SEQ ID NO: 510271

SEQ ID NO: 513531 - RNA, 64 nt, Homo Sapiens; identical to SEQ ID NO: 510272

SEQ ID NO: 513532 - RNA, 64 nt, Homo Sapiens; identical to SEQ ID NO: 510273

SEQ ID NO: 513533 - RNA, 64 nt, Homo Sapiens; identical to SEQ ID NO: 510274

SEQ ID NO: 513534 - RNA, 64 nt, Homo Sapiens; identical to SEQ ID NO: 510275

SEQ ID NO: 513535 - RNA, 64 nt, Homo Sapiens; identical to SEQ ID NO: 510276

SEQ ID NO: 513536 - RNA, 64 nt, Homo Sapiens; identical to SEQ ID NO: 510277

SEQ ID NO: 513537 - RNA, 64 nt, Homo Sapiens; identical to SEQ ID NO: 510278

SEQ ID NO: 513538 - RNA, 64 nt, Homo Sapiens; identical to SEQ ID NO: 510279

SEQ ID NO: 513539 - RNA, 64 nt, Homo Sapiens; identical to SEQ ID NO: 510280

SEQ ID NO: 513540 - RNA, 64 nt, Homo Sapiens; identical to SEQ ID NO: 510281

SEQ ID NO: 513541 - RNA, 64 nt, Homo Sapiens; identical to SEQ ID NO: 510282

SEQ ID NO: 513542 - RNA, 64 nt, Homo Sapiens; identical to SEQ ID NO: 510283

SEQ ID NO: 513543 - RNA, 64 nt, Homo Sapiens; identical to SEQ ID NO: 510284

SEQ ID NO: 513544 - RNA, 64 nt, Homo Sapiens; identical to SEQ ID NO: 510285

SEQ ID NO: 513545 - RNA, 64 nt, Homo Sapiens; identical to SEQ ID NO: 510286

SEQ ID NO: 513546 - RNA, 64 nt, Homo Sapiens; identical to SEQ ID NO: 510287

SEQ ID NO: 513547 - RNA, 64 nt, Homo Sapiens; identical to SEQ ID NO: 510288

SEQ ID NO: 513548 - RNA, 64 nt, Homo Sapiens; identical to SEQ ID NO: 510289

SEQ ID NO: 513549 - RNA, 64 nt, Homo Sapiens; identical to SEQ ID NO: 510290

SEQ ID NO: 513550 - RNA, 64 nt, Homo Sapiens; identical to SEQ ID NO: 510291

SEQ ID NO: 513551 - RNA, 64 nt, Homo Sapiens; identical to SEQ ID NO: 510292

SEQ ID NO: 513552 - RNA, 64 nt, Homo Sapiens; identical to SEQ ID NO: 510293

SEQ ID NO: 513553 - RNA, 64 nt, Homo Sapiens; identical to SEQ ID NO: 510294

SEQ ID NO: 513554 - RNA, 64 nt, Homo Sapiens; identical to SEQ ID NO: 510295

SEQ ID NO: 513555 - RNA, 64 nt, Homo Sapiens; identical to SEQ ID NO: 510296

SEQ ID NO: 513556 - RNA, 64 nt, Homo Sapiens; identical to SEQ ID NO: 510297

SEQ ID NO: 513557 - RNA, 64 nt, Homo Sapiens; identical to SEQ ID NO: 510298

SEQ ID NO: 513558 - RNA, 64 nt, Homo Sapiens; identical to SEQ ID NO: 510299

SEQ ID NO: 513559 - RNA, 64 nt, Homo Sapiens; identical to SEQ ID NO: 510300

SEQ ID NO: 513560 - RNA, 64 nt, Homo Sapiens; identical to SEQ ID NO: 510301

SEQ ID NO: 513561 - RNA, 64 nt, Homo Sapiens; identical to SEQ ID NO: 510302

SEQ ID NO: 513562 - RNA, 64 nt, Homo Sapiens; identical to SEQ ID NO: 510303

SEQ ID NO: 513563 - RNA, 64 nt, Homo Sapiens; identical to SEQ ID NO: 510304

SEQ ID NO: 513564 - RNA, 64 nt, Homo Sapiens; identical to SEQ ID NO: 510305

SEQ ID NO: 513565 - RNA, 64 nt, Homo Sapiens; identical to SEQ ID NO: 510306

SEQ ID NO: 513566 - RNA, 64 nt, Homo Sapiens; identical to SEQ ID NO: 510307

SEQ ID NO: 513567 - RNA, 64 nt, Homo Sapiens; identical to SEQ ID NO: 510308

SEQ ID NO: 513568 - RNA, 64 nt, Homo Sapiens; identical to SEQ ID NO: 510309

SEQ ID NO: 513569 - RNA, 64 nt, Homo Sapiens; identical to SEQ ID NO: 510310

SEQ ID NO: 513570 - RNA, 64 nt, Homo Sapiens; identical to SEQ ID NO: 510311

SEQ ID NO: 513571 - RNA, 64 nt, Homo Sapiens; identical to SEQ ID NO: 510312

SEQ ID NO: 513572 - RNA, 64 nt, Homo Sapiens; identical to SEQ ID NO: 510313

SEQ ID NO: 513573 - RNA, 64 nt, Homo Sapiens; identical to SEQ ID NO: 510314

SEQ ID NO: 513574 - RNA, 64 nt, Homo Sapiens; identical to SEQ ID NO: 510315

SEQ ID NO: 513575 - RNA, 64 nt, Homo Sapiens; identical to SEQ ID NO: 510316

SEQ ID NO: 513576 - RNA, 64 nt, Homo Sapiens; identical to SEQ ID NO: 510317

SEQ ID NO: 513577 - RNA, 64 nt, Homo Sapiens; identical to SEQ ID NO: 510318

SEQ ID NO: 513578 - RNA, 64 nt, Homo Sapiens; identical to SEQ ID NO: 510319

SEQ ID NO: 513579 - RNA, 64 nt, Homo Sapiens; identical to SEQ ID NO: 510320

SEQ ID NO: 513580 - RNA, 64 nt, Homo Sapiens; identical to SEQ ID NO: 510321

SEQ ID NO: 513581 - RNA, 64 nt, Homo Sapiens; identical to SEQ ID NO: 510322

SEQ ID NO: 513582 - RNA, 64 nt, Homo Sapiens; identical to SEQ ID NO: 510323

SEQ ID NO: 513583 - RNA, 64 nt, Homo Sapiens; identical to SEQ ID NO: 510324

SEQ ID NO: 513584 - RNA, 64 nt, Homo Sapiens; identical to SEQ ID NO: 510325

SEQ ID NO: 513585 - RNA, 64 nt, Homo Sapiens; identical to SEQ ID NO: 510326

SEQ ID NO: 513586 - RNA, 64 nt, Homo Sapiens; identical to SEQ ID NO: 510327

SEQ ID NO: 513587 - RNA, 64 nt, Homo Sapiens; identical to SEQ ID NO: 510328

SEQ ID NO: 513588 - RNA, 64 nt, Homo Sapiens; identical to SEQ ID NO: 510329

SEQ ID NO: 513589 - RNA, 64 nt, Homo Sapiens; identical to SEQ ID NO: 510330

SEQ ID NO: 513590 - RNA, 64 nt, Homo Sapiens; identical to SEQ ID NO: 510331

SEQ ID NO: 513591 - RNA, 64 nt, Homo Sapiens; identical to SEQ ID NO: 510332

SEQ ID NO: 513592 - RNA, 64 nt, Homo Sapiens; identical to SEQ ID NO: 510333

SEQ ID NO: 513593 - RNA, 64 nt, Homo Sapiens; identical to SEQ ID NO: 510334

SEQ ID NO: 513594 - RNA, 64 nt, Homo Sapiens; identical to SEQ ID NO: 510335

SEQ ID NO: 513595 - RNA, 64 nt, Homo Sapiens; identical to SEQ ID NO: 510336

SEQ ID NO: 513596 - RNA, 64 nt, Homo Sapiens; identical to SEQ ID NO: 510337

SEQ ID NO: 513597 - RNA, 64 nt, Homo Sapiens; identical to SEQ ID NO: 510338

SEQ ID NO: 513598 - RNA, 64 nt, Homo Sapiens; identical to SEQ ID NO: 510339

SEQ ID NO: 513599 - RNA, 64 nt, Homo Sapiens; identical to SEQ ID NO: 510340

SEQ ID NO: 513600 - RNA, 64 nt, Homo Sapiens; identical to SEQ ID NO: 510341

SEQ ID NO: 513601 - RNA, 64 nt, Homo Sapiens; identical to SEQ ID NO: 510342

SEQ ID NO: 513602 - RNA, 64 nt, Homo Sapiens; identical to SEQ ID NO: 510343

SEQ ID NO: 513603 - RNA, 64 nt, Homo Sapiens; identical to SEQ ID NO: 510344

SEQ ID NO: 513604 - RNA, 64 nt, Homo Sapiens; identical to SEQ ID NO: 510345

SEQ ID NO: 513605 - RNA, 64 nt, Homo Sapiens; identical to SEQ ID NO: 510346

SEQ ID NO: 513606 - RNA, 64 nt, Homo Sapiens; identical to SEQ ID NO: 510347

SEQ ID NO: 513607 - RNA, 64 nt, Homo Sapiens; identical to SEQ ID NO: 510348

SEQ ID NO: 513608 - RNA, 64 nt, Homo Sapiens; identical to SEQ ID NO: 510349

SEQ ID NO: 513609 - RNA, 64 nt, Homo Sapiens; identical to SEQ ID NO: 510350

SEQ ID NO: 513610 - RNA, 64 nt, Homo Sapiens; identical to SEQ ID NO: 510351

SEQ ID NO: 513611 - RNA, 64 nt, Homo Sapiens; identical to SEQ ID NO: 510352

SEQ ID NO: 513612 - RNA, 64 nt, Homo Sapiens; identical to SEQ ID NO: 510353

SEQ ID NO: 513613 - RNA, 64 nt, Homo Sapiens; identical to SEQ ID NO: 510354

SEQ ID NO: 513614 - RNA, 64 nt, Homo Sapiens; identical to SEQ ID NO: 510355

SEQ ID NO: 513615 - RNA, 64 nt, Homo Sapiens; identical to SEQ ID NO: 510356

SEQ ID NO: 513616 - RNA, 64 nt, Homo Sapiens; identical to SEQ ID NO: 510357

SEQ ID NO: 513617 - RNA, 64 nt, Homo Sapiens; identical to SEQ ID NO: 510358

SEQ ID NO: 513618 - RNA, 64 nt, Homo Sapiens; identical to SEQ ID NO: 510359

SEQ ID NO: 513619 - RNA, 64 nt, Homo Sapiens; identical to SEQ ID NO: 510360

SEQ ID NO: 513620 - RNA, 64 nt, Homo Sapiens; identical to SEQ ID NO: 510361

SEQ ID NO: 513621 - RNA, 64 nt, Homo Sapiens; identical to SEQ ID NO: 510362

SEQ ID NO: 513622 - RNA, 64 nt, Homo Sapiens; identical to SEQ ID NO: 510363

SEQ ID NO: 513623 - RNA, 64 nt, Homo Sapiens; identical to SEQ ID NO: 510364

SEQ ID NO: 513624 - RNA, 64 nt, Homo Sapiens; identical to SEQ ID NO: 510365

SEQ ID NO: 513625 - RNA, 64 nt, Homo Sapiens; identical to SEQ ID NO: 510366

SEQ ID NO: 513626 - RNA, 64 nt, Homo Sapiens; identical to SEQ ID NO: 510367

SEQ ID NO: 513627 - RNA, 64 nt, Homo Sapiens; identical to SEQ ID NO: 510368

SEQ ID NO: 513628 - RNA, 64 nt, Homo Sapiens; identical to SEQ ID NO: 510369

SEQ ID NO: 513629 - RNA, 64 nt, Homo Sapiens; identical to SEQ ID NO: 510370

SEQ ID NO: 513630 - RNA, 64 nt, Homo Sapiens; identical to SEQ ID NO: 510371

SEQ ID NO: 513631 - RNA, 64 nt, Homo Sapiens; identical to SEQ ID NO: 510372

SEQ ID NO: 513632 - RNA, 64 nt, Homo Sapiens; identical to SEQ ID NO: 510373

SEQ ID NO: 513633 - RNA, 64 nt, Homo Sapiens; identical to SEQ ID NO: 510374

SEQ ID NO: 513634 - RNA, 64 nt, Homo Sapiens; identical to SEQ ID NO: 510375

SEQ ID NO: 513635 - RNA, 64 nt, Homo Sapiens; identical to SEQ ID NO: 510376

SEQ ID NO: 513636 - RNA, 64 nt, Homo Sapiens; identical to SEQ ID NO: 510377

SEQ ID NO: 513637 - RNA, 64 nt, Homo Sapiens; identical to SEQ ID NO: 510378

SEQ ID NO: 513638 - RNA, 64 nt, Homo Sapiens; identical to SEQ ID NO: 510379

SEQ ID NO: 513639 - RNA, 64 nt, Homo Sapiens; identical to SEQ ID NO: 510380

SEQ ID NO: 513640 - RNA, 64 nt, Homo Sapiens; identical to SEQ ID NO: 510381

SEQ ID NO: 513641 - RNA, 64 nt, Homo Sapiens; identical to SEQ ID NO: 510382

SEQ ID NO: 513642 - RNA, 64 nt, Homo Sapiens; identical to SEQ ID NO: 510383

SEQ ID NO: 513643 - RNA, 64 nt, Homo Sapiens; identical to SEQ ID NO: 510384

SEQ ID NO: 513644 - RNA, 64 nt, Homo Sapiens; identical to SEQ ID NO: 510385

SEQ ID NO: 513645 - RNA, 64 nt, Homo Sapiens; identical to SEQ ID NO: 510386

SEQ ID NO: 513646 - RNA, 64 nt, Homo Sapiens; identical to SEQ ID NO: 510387

SEQ ID NO: 513647 - RNA, 64 nt, Homo Sapiens; identical to SEQ ID NO: 510388

SEQ ID NO: 513648 - RNA, 64 nt, Homo Sapiens; identical to SEQ ID NO: 510389

SEQ ID NO: 513649 - RNA, 64 nt, Homo Sapiens; identical to SEQ ID NO: 510390

SEQ ID NO: 513650 - RNA, 64 nt, Homo Sapiens; identical to SEQ ID NO: 510391

SEQ ID NO: 513651 - RNA, 64 nt, Homo Sapiens; identical to SEQ ID NO: 510392

SEQ ID NO: 513652 - RNA, 64 nt, Homo Sapiens; identical to SEQ ID NO: 510393

SEQ ID NO: 513653 - RNA, 64 nt, Homo Sapiens; identical to SEQ ID NO: 510394

SEQ ID NO: 513654 - RNA, 64 nt, Homo Sapiens; identical to SEQ ID NO: 510395

SEQ ID NO: 513655 - RNA, 64 nt, Homo Sapiens; identical to SEQ ID NO: 510396

SEQ ID NO: 513656 - RNA, 64 nt, Homo Sapiens; identical to SEQ ID NO: 510397

SEQ ID NO: 513657 - RNA, 64 nt, Homo Sapiens; identical to SEQ ID NO: 510398

SEQ ID NO: 513658 - RNA, 64 nt, Homo Sapiens; identical to SEQ ID NO: 510399

SEQ ID NO: 513659 - RNA, 64 nt, Homo Sapiens; identical to SEQ ID NO: 510400

SEQ ID NO: 513660 - RNA, 64 nt, Homo Sapiens; identical to SEQ ID NO: 510401

SEQ ID NO: 513661 - RNA, 64 nt, Homo Sapiens; identical to SEQ ID NO: 510402

SEQ ID NO: 513662 - RNA, 64 nt, Homo Sapiens; identical to SEQ ID NO: 510403

SEQ ID NO: 513663 - RNA, 64 nt, Homo Sapiens; identical to SEQ ID NO: 510404

SEQ ID NO: 513664 - RNA, 64 nt, Homo Sapiens; identical to SEQ ID NO: 510405

SEQ ID NO: 513665 - RNA, 64 nt, Homo Sapiens; identical to SEQ ID NO: 510406

SEQ ID NO: 513666 - RNA, 64 nt, Homo Sapiens; identical to SEQ ID NO: 510407

SEQ ID NO: 513667 - RNA, 64 nt, Homo Sapiens; identical to SEQ ID NO: 510408

SEQ ID NO: 513668 - RNA, 64 nt, Homo Sapiens; identical to SEQ ID NO: 510409

SEQ ID NO: 513669 - RNA, 64 nt, Homo Sapiens; identical to SEQ ID NO: 510410

SEQ ID NO: 513670 - RNA, 64 nt, Homo Sapiens; identical to SEQ ID NO: 510411

SEQ ID NO: 513671 - RNA, 64 nt, Homo Sapiens; identical to SEQ ID NO: 510412

SEQ ID NO: 513672 - RNA, 64 nt, Homo Sapiens; identical to SEQ ID NO: 510413

SEQ ID NO: 513673 - RNA, 64 nt, Homo Sapiens; identical to SEQ ID NO: 510414

SEQ ID NO: 513674 - RNA, 64 nt, Homo Sapiens; identical to SEQ ID NO: 510415

SEQ ID NO: 513675 - RNA, 64 nt, Homo Sapiens; identical to SEQ ID NO: 510416

SEQ ID NO: 513676 - RNA, 64 nt, Homo Sapiens; identical to SEQ ID NO: 510417

SEQ ID NO: 513677 - RNA, 64 nt, Homo Sapiens; identical to SEQ ID NO: 510418

SEQ ID NO: 513678 - RNA, 64 nt, Homo Sapiens; identical to SEQ ID NO: 510419

SEQ ID NO: 513679 - RNA, 64 nt, Homo Sapiens; identical to SEQ ID NO: 510420

SEQ ID NO: 513680 - RNA, 64 nt, Homo Sapiens; identical to SEQ ID NO: 510421

SEQ ID NO: 513681 - RNA, 64 nt, Homo Sapiens; identical to SEQ ID NO: 510422

SEQ ID NO: 513682 - RNA, 64 nt, Homo Sapiens; identical to SEQ ID NO: 510423

SEQ ID NO: 513683 - RNA, 64 nt, Homo Sapiens; identical to SEQ ID NO: 510424

SEQ ID NO: 513684 - RNA, 64 nt, Homo Sapiens; identical to SEQ ID NO: 510425

SEQ ID NO: 513685 - RNA, 64 nt, Homo Sapiens; identical to SEQ ID NO: 510426

SEQ ID NO: 513686 - RNA, 64 nt, Homo Sapiens; identical to SEQ ID NO: 510427

SEQ ID NO: 513687 - RNA, 64 nt, Homo Sapiens; identical to SEQ ID NO: 510428

SEQ ID NO: 513688 - RNA, 64 nt, Homo Sapiens; identical to SEQ ID NO: 510429

SEQ ID NO: 513689 - RNA, 64 nt, Homo Sapiens; identical to SEQ ID NO: 510430

SEQ ID NO: 513690 - RNA, 64 nt, Homo Sapiens; identical to SEQ ID NO: 510431

SEQ ID NO: 513691 - RNA, 64 nt, Homo Sapiens; identical to SEQ ID NO: 510432

SEQ ID NO: 513692 - RNA, 64 nt, Homo Sapiens; identical to SEQ ID NO: 510433

SEQ ID NO: 513693 - RNA, 64 nt, Homo Sapiens; identical to SEQ ID NO: 510434

SEQ ID NO: 513694 - RNA, 64 nt, Homo Sapiens; identical to SEQ ID NO: 510435

SEQ ID NO: 513695 - RNA, 64 nt, Homo Sapiens; identical to SEQ ID NO: 510436

SEQ ID NO: 513696 - RNA, 64 nt, Homo Sapiens; identical to SEQ ID NO: 510437

SEQ ID NO: 513697 - RNA, 64 nt, Homo Sapiens; identical to SEQ ID NO: 510438

SEQ ID NO: 513698 - RNA, 64 nt, Homo Sapiens; identical to SEQ ID NO: 510439

SEQ ID NO: 513699 - RNA, 64 nt, Homo Sapiens; identical to SEQ ID NO: 510440

SEQ ID NO: 513700 - RNA, 64 nt, Homo Sapiens; identical to SEQ ID NO: 510441

SEQ ID NO: 513701 - RNA, 64 nt, Homo Sapiens; identical to SEQ ID NO: 510442

SEQ ID NO: 513702 - RNA, 64 nt, Homo Sapiens; identical to SEQ ID NO: 510443

SEQ ID NO: 513703 - RNA, 64 nt, Homo Sapiens; identical to SEQ ID NO: 510444

SEQ ID NO: 513704 - RNA, 64 nt, Homo Sapiens; identical to SEQ ID NO: 510445

SEQ ID NO: 513705 - RNA, 64 nt, Homo Sapiens; identical to SEQ ID NO: 510446

SEQ ID NO: 513706 - RNA, 64 nt, Homo Sapiens; identical to SEQ ID NO: 510447

SEQ ID NO: 513707 - RNA, 64 nt, Homo Sapiens; identical to SEQ ID NO: 510448

SEQ ID NO: 513708 - RNA, 64 nt, Homo Sapiens; identical to SEQ ID NO: 510449

SEQ ID NO: 513709 - RNA, 64 nt, Homo Sapiens; identical to SEQ ID NO: 510450

SEQ ID NO: 513710 - RNA, 64 nt, Homo Sapiens; identical to SEQ ID NO: 510451

SEQ ID NO: 513711 - RNA, 64 nt, Homo Sapiens; identical to SEQ ID NO: 510452

SEQ ID NO: 513712 - RNA, 64 nt, Homo Sapiens; identical to SEQ ID NO: 510453

SEQ ID NO: 513713 - RNA, 64 nt, Homo Sapiens; identical to SEQ ID NO: 510454

SEQ ID NO: 513714 - RNA, 64 nt, Homo Sapiens; identical to SEQ ID NO: 510455

SEQ ID NO: 513715 - RNA, 64 nt, Homo Sapiens; identical to SEQ ID NO: 510456

SEQ ID NO: 513716 - RNA, 64 nt, Homo Sapiens; identical to SEQ ID NO: 510457

SEQ ID NO: 513717 - RNA, 64 nt, Homo Sapiens; identical to SEQ ID NO: 510458

SEQ ID NO: 513718 - RNA, 64 nt, Homo Sapiens; identical to SEQ ID NO: 510459

SEQ ID NO: 513719 - RNA, 64 nt, Homo Sapiens; identical to SEQ ID NO: 510460

SEQ ID NO: 513720 - RNA, 64 nt, Homo Sapiens; identical to SEQ ID NO: 510461

SEQ ID NO: 513721 - RNA, 64 nt, Homo Sapiens; identical to SEQ ID NO: 510462

SEQ ID NO: 513722 - RNA, 64 nt, Homo Sapiens; identical to SEQ ID NO: 510463

SEQ ID NO: 513723 - RNA, 64 nt, Homo Sapiens; identical to SEQ ID NO: 510464

SEQ ID NO: 513724 - RNA, 64 nt, Homo Sapiens; identical to SEQ ID NO: 510465

SEQ ID NO: 513725 - RNA, 64 nt, Homo Sapiens; identical to SEQ ID NO: 510466

SEQ ID NO: 513726 - RNA, 64 nt, Homo Sapiens; identical to SEQ ID NO: 510467

SEQ ID NO: 513727 - RNA, 64 nt, Homo Sapiens; identical to SEQ ID NO: 510468

SEQ ID NO: 513728 - RNA, 64 nt, Homo Sapiens; identical to SEQ ID NO: 510469

SEQ ID NO: 513729 - RNA, 64 nt, Homo Sapiens; identical to SEQ ID NO: 510470

SEQ ID NO: 513730 - RNA, 64 nt, Homo Sapiens; identical to SEQ ID NO: 510471

SEQ ID NO: 513731 - RNA, 64 nt, Homo Sapiens; identical to SEQ ID NO: 510472

SEQ ID NO: 513732 - RNA, 64 nt, Homo Sapiens; identical to SEQ ID NO: 510473

SEQ ID NO: 513733 - RNA, 64 nt, Homo Sapiens; identical to SEQ ID NO: 510474

SEQ ID NO: 513734 - RNA, 64 nt, Homo Sapiens; identical to SEQ ID NO: 510475

SEQ ID NO: 513735 - RNA, 64 nt, Homo Sapiens; identical to SEQ ID NO: 510476

SEQ ID NO: 513736 - RNA, 64 nt, Homo Sapiens; identical to SEQ ID NO: 510477

SEQ ID NO: 513737 - RNA, 64 nt, Homo Sapiens; identical to SEQ ID NO: 510478

SEQ ID NO: 513738 - RNA, 64 nt, Homo Sapiens; identical to SEQ ID NO: 510479

SEQ ID NO: 513739 - RNA, 64 nt, Homo Sapiens; identical to SEQ ID NO: 510480

SEQ ID NO: 513740 - RNA, 64 nt, Homo Sapiens; identical to SEQ ID NO: 510481

SEQ ID NO: 513741 - RNA, 64 nt, Homo Sapiens; identical to SEQ ID NO: 510482

SEQ ID NO: 513742 - RNA, 64 nt, Homo Sapiens; identical to SEQ ID NO: 510483

SEQ ID NO: 513743 - RNA, 64 nt, Homo Sapiens; identical to SEQ ID NO: 510484

SEQ ID NO: 513744 - RNA, 64 nt, Homo Sapiens; identical to SEQ ID NO: 510485

SEQ ID NO: 513745 - RNA, 64 nt, Homo Sapiens; identical to SEQ ID NO: 510486

SEQ ID NO: 513746 - RNA, 64 nt, Homo Sapiens; identical to SEQ ID NO: 510487

SEQ ID NO: 513747 - RNA, 64 nt, Homo Sapiens; identical to SEQ ID NO: 510488

SEQ ID NO: 513748 - RNA, 64 nt, Homo Sapiens; identical to SEQ ID NO: 510489

SEQ ID NO: 513749 - RNA, 64 nt, Homo Sapiens; identical to SEQ ID NO: 510490

SEQ ID NO: 513750 - RNA, 64 nt, Homo Sapiens; identical to SEQ ID NO: 510491

SEQ ID NO: 513751 - RNA, 64 nt, Homo Sapiens; identical to SEQ ID NO: 510492

SEQ ID NO: 513752 - RNA, 64 nt, Homo Sapiens; identical to SEQ ID NO: 510493

SEQ ID NO: 513753 - RNA, 64 nt, Homo Sapiens; identical to SEQ ID NO: 510494

SEQ ID NO: 513754 - RNA, 64 nt, Homo Sapiens; identical to SEQ ID NO: 510495

SEQ ID NO: 513755 - RNA, 64 nt, Homo Sapiens; identical to SEQ ID NO: 510496

SEQ ID NO: 513756 - RNA, 64 nt, Homo Sapiens; identical to SEQ ID NO: 510497

SEQ ID NO: 513757 - RNA, 64 nt, Homo Sapiens; identical to SEQ ID NO: 510498

SEQ ID NO: 513758 - RNA, 64 nt, Homo Sapiens; identical to SEQ ID NO: 510499

SEQ ID NO: 513759 - RNA, 64 nt, Homo Sapiens; identical to SEQ ID NO: 510500

SEQ ID NO: 513760 - RNA, 64 nt, Homo Sapiens; identical to SEQ ID NO: 510501

SEQ ID NO: 513761 - RNA, 64 nt, Homo Sapiens; identical to SEQ ID NO: 510502

SEQ ID NO: 513762 - RNA, 64 nt, Homo Sapiens; identical to SEQ ID NO: 510503

SEQ ID NO: 513763 - RNA, 64 nt, Homo Sapiens; identical to SEQ ID NO: 510504

SEQ ID NO: 513764 - RNA, 64 nt, Homo Sapiens; identical to SEQ ID NO: 510505

SEQ ID NO: 513765 - RNA, 64 nt, Homo Sapiens; identical to SEQ ID NO: 510506

SEQ ID NO: 513766 - RNA, 64 nt, Homo Sapiens; identical to SEQ ID NO: 510507

SEQ ID NO: 513767 - RNA, 64 nt, Homo Sapiens; identical to SEQ ID NO: 510508

SEQ ID NO: 513768 - RNA, 64 nt, Homo Sapiens; identical to SEQ ID NO: 510509

SEQ ID NO: 513769 - RNA, 64 nt, Homo Sapiens; identical to SEQ ID NO: 510510

SEQ ID NO: 513770 - RNA, 64 nt, Homo Sapiens; identical to SEQ ID NO: 510511

SEQ ID NO: 513771 - RNA, 64 nt, Homo Sapiens; identical to SEQ ID NO: 510512

SEQ ID NO: 513772 - RNA, 64 nt, Homo Sapiens; identical to SEQ ID NO: 510513

SEQ ID NO: 513773 - RNA, 64 nt, Homo Sapiens; identical to SEQ ID NO: 510514

SEQ ID NO: 513774 - RNA, 64 nt, Homo Sapiens; identical to SEQ ID NO: 510515

SEQ ID NO: 513775 - RNA, 64 nt, Homo Sapiens; identical to SEQ ID NO: 510516

SEQ ID NO: 513776 - RNA, 64 nt, Homo Sapiens; identical to SEQ ID NO: 510517

SEQ ID NO: 513777 - RNA, 64 nt, Homo Sapiens; identical to SEQ ID NO: 510518

SEQ ID NO: 513778 - RNA, 64 nt, Homo Sapiens; identical to SEQ ID NO: 510519

SEQ ID NO: 513779 - RNA, 64 nt, Homo Sapiens; identical to SEQ ID NO: 510520

SEQ ID NO: 513780 - RNA, 64 nt, Homo Sapiens; identical to SEQ ID NO: 510521

SEQ ID NO: 513781 - RNA, 64 nt, Homo Sapiens; identical to SEQ ID NO: 510522

SEQ ID NO: 513782 - RNA, 64 nt, Homo Sapiens; identical to SEQ ID NO: 510523

SEQ ID NO: 513783 - RNA, 64 nt, Homo Sapiens; identical to SEQ ID NO: 510524

SEQ ID NO: 513784 - RNA, 64 nt, Homo Sapiens; identical to SEQ ID NO: 510525

SEQ ID NO: 513785 - RNA, 64 nt, Homo Sapiens; identical to SEQ ID NO: 510526

SEQ ID NO: 513786 - RNA, 64 nt, Homo Sapiens; identical to SEQ ID NO: 510527

SEQ ID NO: 513787 - RNA, 64 nt, Homo Sapiens; identical to SEQ ID NO: 510528

SEQ ID NO: 513788 - RNA, 64 nt, Homo Sapiens; identical to SEQ ID NO: 510529

SEQ ID NO: 513789 - RNA, 64 nt, Homo Sapiens; identical to SEQ ID NO: 510530

SEQ ID NO: 513790 - RNA, 64 nt, Homo Sapiens; identical to SEQ ID NO: 510531

SEQ ID NO: 513791 - RNA, 64 nt, Homo Sapiens; identical to SEQ ID NO: 510532

SEQ ID NO: 513792 - RNA, 64 nt, Homo Sapiens; identical to SEQ ID NO: 510533

SEQ ID NO: 513793 - RNA, 64 nt, Homo Sapiens; identical to SEQ ID NO: 510534

SEQ ID NO: 513794 - RNA, 64 nt, Homo Sapiens; identical to SEQ ID NO: 510535

SEQ ID NO: 513795 - RNA, 64 nt, Homo Sapiens; identical to SEQ ID NO: 510536

SEQ ID NO: 513796 - RNA, 64 nt, Homo Sapiens; identical to SEQ ID NO: 510537

SEQ ID NO: 513797 - RNA, 64 nt, Homo Sapiens; identical to SEQ ID NO: 510538

SEQ ID NO: 513798 - RNA, 64 nt, Homo Sapiens; identical to SEQ ID NO: 510539

SEQ ID NO: 513799 - RNA, 64 nt, Homo Sapiens; identical to SEQ ID NO: 510540

SEQ ID NO: 513800 - RNA, 64 nt, Homo Sapiens; identical to SEQ ID NO: 510541

SEQ ID NO: 513801 - RNA, 64 nt, Homo Sapiens; identical to SEQ ID NO: 510542

SEQ ID NO: 513802 - RNA, 64 nt, Homo Sapiens; identical to SEQ ID NO: 510543

SEQ ID NO: 513803 - RNA, 64 nt, Homo Sapiens; identical to SEQ ID NO: 510544

SEQ ID NO: 513804 - RNA, 64 nt, Homo Sapiens; identical to SEQ ID NO: 510545

SEQ ID NO: 513805 - RNA, 64 nt, Homo Sapiens; identical to SEQ ID NO: 510546

SEQ ID NO: 513806 - RNA, 64 nt, Homo Sapiens; identical to SEQ ID NO: 510547

SEQ ID NO: 513807 - RNA, 64 nt, Homo Sapiens; identical to SEQ ID NO: 510548

SEQ ID NO: 513808 - RNA, 64 nt, Homo Sapiens; identical to SEQ ID NO: 510549

SEQ ID NO: 513809 - RNA, 64 nt, Homo Sapiens; identical to SEQ ID NO: 510550

SEQ ID NO: 513810 - RNA, 64 nt, Homo Sapiens; identical to SEQ ID NO: 510551

SEQ ID NO: 513811 - RNA, 64 nt, Homo Sapiens; identical to SEQ ID NO: 510552

SEQ ID NO: 513812 - RNA, 64 nt, Homo Sapiens; identical to SEQ ID NO: 510553

SEQ ID NO: 513813 - RNA, 64 nt, Homo Sapiens; identical to SEQ ID NO: 510554

SEQ ID NO: 513814 - RNA, 64 nt, Homo Sapiens; identical to SEQ ID NO: 510555

SEQ ID NO: 513815 - RNA, 64 nt, Homo Sapiens; identical to SEQ ID NO: 510556

SEQ ID NO: 513816 - RNA, 64 nt, Homo Sapiens; identical to SEQ ID NO: 510557

SEQ ID NO: 513817 - RNA, 64 nt, Homo Sapiens; identical to SEQ ID NO: 510558

SEQ ID NO: 513818 - RNA, 64 nt, Homo Sapiens; identical to SEQ ID NO: 510559

SEQ ID NO: 513819 - RNA, 64 nt, Homo Sapiens; identical to SEQ ID NO: 510560

SEQ ID NO: 513820 - RNA, 64 nt, Homo Sapiens; identical to SEQ ID NO: 510561

SEQ ID NO: 513821 - RNA, 64 nt, Homo Sapiens; identical to SEQ ID NO: 510562

SEQ ID NO: 513822 - RNA, 64 nt, Homo Sapiens; identical to SEQ ID NO: 510563

SEQ ID NO: 513823 - RNA, 64 nt, Homo Sapiens; identical to SEQ ID NO: 510564

SEQ ID NO: 513824 - RNA, 64 nt, Homo Sapiens; identical to SEQ ID NO: 510565

SEQ ID NO: 513825 - RNA, 64 nt, Homo Sapiens; identical to SEQ ID NO: 510566

SEQ ID NO: 513826 - RNA, 64 nt, Homo Sapiens; identical to SEQ ID NO: 510567

SEQ ID NO: 513827 - RNA, 64 nt, Homo Sapiens; identical to SEQ ID NO: 510568

SEQ ID NO: 513828 - RNA, 64 nt, Homo Sapiens; identical to SEQ ID NO: 510569

SEQ ID NO: 513829 - RNA, 64 nt, Homo Sapiens; identical to SEQ ID NO: 510570

SEQ ID NO: 513830 - RNA, 64 nt, Homo Sapiens; identical to SEQ ID NO: 510571

SEQ ID NO: 513831 - RNA, 64 nt, Homo Sapiens; identical to SEQ ID NO: 510572

SEQ ID NO: 513832 - RNA, 64 nt, Homo Sapiens; identical to SEQ ID NO: 510573

SEQ ID NO: 513833 - RNA, 64 nt, Homo Sapiens; identical to SEQ ID NO: 510574

SEQ ID NO: 513834 - RNA, 64 nt, Homo Sapiens; identical to SEQ ID NO: 510575

SEQ ID NO: 513835 - RNA, 64 nt, Homo Sapiens; identical to SEQ ID NO: 510576

SEQ ID NO: 513836 - RNA, 64 nt, Homo Sapiens; identical to SEQ ID NO: 510577

SEQ ID NO: 513837 - RNA, 64 nt, Homo Sapiens; identical to SEQ ID NO: 510578

SEQ ID NO: 513838 - RNA, 64 nt, Homo Sapiens; identical to SEQ ID NO: 510579

SEQ ID NO: 513839 - RNA, 64 nt, Homo Sapiens; identical to SEQ ID NO: 510580

SEQ ID NO: 513840 - RNA, 64 nt, Homo Sapiens; identical to SEQ ID NO: 510581

SEQ ID NO: 513841 - RNA, 64 nt, Homo Sapiens; identical to SEQ ID NO: 510582

SEQ ID NO: 513842 - RNA, 64 nt, Homo Sapiens; identical to SEQ ID NO: 510583

SEQ ID NO: 513843 - RNA, 64 nt, Homo Sapiens; identical to SEQ ID NO: 510584

SEQ ID NO: 513844 - RNA, 64 nt, Homo Sapiens; identical to SEQ ID NO: 510585

SEQ ID NO: 513845 - RNA, 64 nt, Homo Sapiens; identical to SEQ ID NO: 510586

SEQ ID NO: 513846 - RNA, 64 nt, Homo Sapiens; identical to SEQ ID NO: 510587

SEQ ID NO: 513847 - RNA, 64 nt, Homo Sapiens; identical to SEQ ID NO: 510588

SEQ ID NO: 513848 - RNA, 64 nt, Homo Sapiens; identical to SEQ ID NO: 510589

SEQ ID NO: 513849 - RNA, 64 nt, Homo Sapiens; identical to SEQ ID NO: 510590

SEQ ID NO: 513850 - RNA, 64 nt, Homo Sapiens; identical to SEQ ID NO: 510591

SEQ ID NO: 513851 - RNA, 64 nt, Homo Sapiens; identical to SEQ ID NO: 510592

SEQ ID NO: 513852 - RNA, 64 nt, Homo Sapiens; identical to SEQ ID NO: 510593

SEQ ID NO: 513853 - RNA, 64 nt, Homo Sapiens; identical to SEQ ID NO: 510594

SEQ ID NO: 513854 - RNA, 64 nt, Homo Sapiens; identical to SEQ ID NO: 510595

SEQ ID NO: 513855 - RNA, 64 nt, Homo Sapiens; identical to SEQ ID NO: 510596

SEQ ID NO: 513856 - RNA, 64 nt, Homo Sapiens; identical to SEQ ID NO: 510597

SEQ ID NO: 513857 - RNA, 64 nt, Homo Sapiens; identical to SEQ ID NO: 510598

SEQ ID NO: 513858 - RNA, 64 nt, Homo Sapiens; identical to SEQ ID NO: 510599

SEQ ID NO: 513859 - RNA, 64 nt, Homo Sapiens; identical to SEQ ID NO: 510600

SEQ ID NO: 513860 - RNA, 64 nt, Homo Sapiens; identical to SEQ ID NO: 510601

SEQ ID NO: 513861 - RNA, 64 nt, Homo Sapiens; identical to SEQ ID NO: 510602

SEQ ID NO: 513862 - RNA, 64 nt, Homo Sapiens; identical to SEQ ID NO: 510603

SEQ ID NO: 513863 - RNA, 64 nt, Homo Sapiens; identical to SEQ ID NO: 510604

SEQ ID NO: 513864 - RNA, 64 nt, Homo Sapiens; identical to SEQ ID NO: 510605

SEQ ID NO: 513865 - RNA, 64 nt, Homo Sapiens; identical to SEQ ID NO: 510606

SEQ ID NO: 513866 - RNA, 64 nt, Homo Sapiens; identical to SEQ ID NO: 510607

SEQ ID NO: 513867 - RNA, 64 nt, Homo Sapiens; identical to SEQ ID NO: 510608

SEQ ID NO: 513868 - RNA, 64 nt, Homo Sapiens; identical to SEQ ID NO: 510609

SEQ ID NO: 513869 - RNA, 64 nt, Homo Sapiens; identical to SEQ ID NO: 510610

SEQ ID NO: 513870 - RNA, 64 nt, Homo Sapiens; identical to SEQ ID NO: 510611

SEQ ID NO: 513871 - RNA, 64 nt, Homo Sapiens; identical to SEQ ID NO: 510612

SEQ ID NO: 513872 - RNA, 64 nt, Homo Sapiens; identical to SEQ ID NO: 510613

SEQ ID NO: 513873 - RNA, 64 nt, Homo Sapiens; identical to SEQ ID NO: 510614

SEQ ID NO: 513874 - RNA, 64 nt, Homo Sapiens; identical to SEQ ID NO: 510615

SEQ ID NO: 513875 - RNA, 64 nt, Homo Sapiens; identical to SEQ ID NO: 510616

SEQ ID NO: 513876 - RNA, 64 nt, Homo Sapiens; identical to SEQ ID NO: 510617

SEQ ID NO: 513877 - RNA, 64 nt, Homo Sapiens; identical to SEQ ID NO: 510618

SEQ ID NO: 513878 - RNA, 64 nt, Homo Sapiens; identical to SEQ ID NO: 510619

SEQ ID NO: 513879 - RNA, 64 nt, Homo Sapiens; identical to SEQ ID NO: 510620

SEQ ID NO: 513880 - RNA, 64 nt, Homo Sapiens; identical to SEQ ID NO: 510621

SEQ ID NO: 513881 - RNA, 64 nt, Homo Sapiens; identical to SEQ ID NO: 510622

SEQ ID NO: 513882 - RNA, 64 nt, Homo Sapiens; identical to SEQ ID NO: 510623

SEQ ID NO: 513883 - RNA, 64 nt, Homo Sapiens; identical to SEQ ID NO: 510624

SEQ ID NO: 513884 - RNA, 64 nt, Homo Sapiens; identical to SEQ ID NO: 510625

SEQ ID NO: 513885 - RNA, 64 nt, Homo Sapiens; identical to SEQ ID NO: 510626

SEQ ID NO: 513886 - RNA, 64 nt, Homo Sapiens; identical to SEQ ID NO: 510627

SEQ ID NO: 513887 - RNA, 64 nt, Homo Sapiens; identical to SEQ ID NO: 510628

SEQ ID NO: 513888 - RNA, 64 nt, Homo Sapiens; identical to SEQ ID NO: 510629

SEQ ID NO: 513889 - RNA, 64 nt, Homo Sapiens; identical to SEQ ID NO: 510630

SEQ ID NO: 513890 - RNA, 64 nt, Homo Sapiens; identical to SEQ ID NO: 510631

SEQ ID NO: 513891 - RNA, 64 nt, Homo Sapiens; identical to SEQ ID NO: 510632

SEQ ID NO: 513892 - RNA, 64 nt, Homo Sapiens; identical to SEQ ID NO: 510633

SEQ ID NO: 513893 - RNA, 64 nt, Homo Sapiens; identical to SEQ ID NO: 510634

SEQ ID NO: 513894 - RNA, 64 nt, Homo Sapiens; identical to SEQ ID NO: 510635

SEQ ID NO: 513895 - RNA, 64 nt, Homo Sapiens; identical to SEQ ID NO: 510636

SEQ ID NO: 513896 - RNA, 64 nt, Homo Sapiens; identical to SEQ ID NO: 510637

SEQ ID NO: 513897 - RNA, 64 nt, Homo Sapiens; identical to SEQ ID NO: 510638

SEQ ID NO: 513898 - RNA, 64 nt, Homo Sapiens; identical to SEQ ID NO: 510639

SEQ ID NO: 513899 - RNA, 64 nt, Homo Sapiens; identical to SEQ ID NO: 510640

SEQ ID NO: 513900 - RNA, 64 nt, Homo Sapiens; identical to SEQ ID NO: 510641

SEQ ID NO: 513901 - RNA, 64 nt, Homo Sapiens; identical to SEQ ID NO: 510642

SEQ ID NO: 513902 - RNA, 64 nt, Homo Sapiens; identical to SEQ ID NO: 510643

SEQ ID NO: 513903 - RNA, 64 nt, Homo Sapiens; identical to SEQ ID NO: 510644

SEQ ID NO: 513904 - RNA, 64 nt, Homo Sapiens; identical to SEQ ID NO: 510645

SEQ ID NO: 513905 - RNA, 64 nt, Homo Sapiens; identical to SEQ ID NO: 510646

SEQ ID NO: 513906 - RNA, 64 nt, Homo Sapiens; identical to SEQ ID NO: 510647

SEQ ID NO: 513907 - RNA, 64 nt, Homo Sapiens; identical to SEQ ID NO: 510648

SEQ ID NO: 513908 - RNA, 64 nt, Homo Sapiens; identical to SEQ ID NO: 510649

SEQ ID NO: 513909 - RNA, 64 nt, Homo Sapiens; identical to SEQ ID NO: 510650

SEQ ID NO: 513910 - RNA, 64 nt, Homo Sapiens; identical to SEQ ID NO: 510651

SEQ ID NO: 513911 - RNA, 64 nt, Homo Sapiens; identical to SEQ ID NO: 510652

SEQ ID NO: 513912 - RNA, 64 nt, Homo Sapiens; identical to SEQ ID NO: 510653

SEQ ID NO: 513913 - RNA, 64 nt, Homo Sapiens; identical to SEQ ID NO: 510654

SEQ ID NO: 513914 - RNA, 64 nt, Homo Sapiens; identical to SEQ ID NO: 510655

SEQ ID NO: 513915 - RNA, 64 nt, Homo Sapiens; identical to SEQ ID NO: 510656

SEQ ID NO: 513916 - RNA, 64 nt, Homo Sapiens; identical to SEQ ID NO: 510657

SEQ ID NO: 513917 - RNA, 64 nt, Homo Sapiens; identical to SEQ ID NO: 510658

SEQ ID NO: 513918 - RNA, 64 nt, Homo Sapiens; identical to SEQ ID NO: 510659

SEQ ID NO: 513919 - RNA, 64 nt, Homo Sapiens; identical to SEQ ID NO: 510660

SEQ ID NO: 513920 - RNA, 64 nt, Homo Sapiens; identical to SEQ ID NO: 510661

SEQ ID NO: 513921 - RNA, 64 nt, Homo Sapiens; identical to SEQ ID NO: 510662

SEQ ID NO: 513922 - RNA, 64 nt, Homo Sapiens; identical to SEQ ID NO: 510663

SEQ ID NO: 513923 - RNA, 64 nt, Homo Sapiens; identical to SEQ ID NO: 510664

SEQ ID NO: 513924 - RNA, 64 nt, Homo Sapiens; identical to SEQ ID NO: 510665

SEQ ID NO: 513925 - RNA, 64 nt, Homo Sapiens; identical to SEQ ID NO: 510666

SEQ ID NO: 513926 - RNA, 64 nt, Homo Sapiens; identical to SEQ ID NO: 510667

SEQ ID NO: 513927 - RNA, 64 nt, Homo Sapiens; identical to SEQ ID NO: 510668

SEQ ID NO: 513928 - RNA, 64 nt, Homo Sapiens; identical to SEQ ID NO: 510669

SEQ ID NO: 513929 - RNA, 64 nt, Homo Sapiens; identical to SEQ ID NO: 510670

SEQ ID NO: 513930 - RNA, 64 nt, Homo Sapiens; identical to SEQ ID NO: 510671

SEQ ID NO: 513931 - RNA, 64 nt, Homo Sapiens; identical to SEQ ID NO: 510672

SEQ ID NO: 513932 - RNA, 64 nt, Homo Sapiens; identical to SEQ ID NO: 510673

SEQ ID NO: 513933 - RNA, 64 nt, Homo Sapiens; identical to SEQ ID NO: 510674

SEQ ID NO: 513934 - RNA, 64 nt, Homo Sapiens; identical to SEQ ID NO: 510675

SEQ ID NO: 513935 - RNA, 64 nt, Homo Sapiens; identical to SEQ ID NO: 510676

SEQ ID NO: 513936 - RNA, 64 nt, Homo Sapiens; identical to SEQ ID NO: 510677

SEQ ID NO: 513937 - RNA, 64 nt, Homo Sapiens; identical to SEQ ID NO: 510678

SEQ ID NO: 513938 - RNA, 64 nt, Homo Sapiens; identical to SEQ ID NO: 510679

SEQ ID NO: 513939 - RNA, 64 nt, Homo Sapiens; identical to SEQ ID NO: 510680

SEQ ID NO: 513940 - RNA, 64 nt, Homo Sapiens; identical to SEQ ID NO: 510681

SEQ ID NO: 513941 - RNA, 64 nt, Homo Sapiens; identical to SEQ ID NO: 510682

SEQ ID NO: 513942 - RNA, 64 nt, Homo Sapiens; identical to SEQ ID NO: 510683

SEQ ID NO: 513943 - RNA, 64 nt, Homo Sapiens; identical to SEQ ID NO: 510684

SEQ ID NO: 513944 - RNA, 64 nt, Homo Sapiens; identical to SEQ ID NO: 510685

SEQ ID NO: 513945 - RNA, 64 nt, Homo Sapiens; identical to SEQ ID NO: 510686

SEQ ID NO: 513946 - RNA, 64 nt, Homo Sapiens; identical to SEQ ID NO: 510687

SEQ ID NO: 513947 - RNA, 64 nt, Homo Sapiens; identical to SEQ ID NO: 510688

SEQ ID NO: 513948 - RNA, 64 nt, Homo Sapiens; identical to SEQ ID NO: 510689

SEQ ID NO: 513949 - RNA, 64 nt, Homo Sapiens; identical to SEQ ID NO: 510690

SEQ ID NO: 513950 - RNA, 64 nt, Homo Sapiens; identical to SEQ ID NO: 510691

SEQ ID NO: 513951 - RNA, 64 nt, Homo Sapiens; identical to SEQ ID NO: 510692

SEQ ID NO: 513952 - RNA, 64 nt, Homo Sapiens; identical to SEQ ID NO: 510693

SEQ ID NO: 513953 - RNA, 64 nt, Homo Sapiens; identical to SEQ ID NO: 510694

SEQ ID NO: 513954 - RNA, 64 nt, Homo Sapiens; identical to SEQ ID NO: 510695

SEQ ID NO: 513955 - RNA, 64 nt, Homo Sapiens; identical to SEQ ID NO: 510696

SEQ ID NO: 513956 - RNA, 64 nt, Homo Sapiens; identical to SEQ ID NO: 510697

SEQ ID NO: 513957 - RNA, 64 nt, Homo Sapiens; identical to SEQ ID NO: 510698

SEQ ID NO: 513958 - RNA, 64 nt, Homo Sapiens; identical to SEQ ID NO: 510699

SEQ ID NO: 513959 - RNA, 64 nt, Homo Sapiens; identical to SEQ ID NO: 510700

SEQ ID NO: 513960 - RNA, 64 nt, Homo Sapiens; identical to SEQ ID NO: 510701

SEQ ID NO: 513961 - RNA, 64 nt, Homo Sapiens; identical to SEQ ID NO: 510702

SEQ ID NO: 513962 - RNA, 64 nt, Homo Sapiens; identical to SEQ ID NO: 510703

SEQ ID NO: 513963 - RNA, 64 nt, Homo Sapiens; identical to SEQ ID NO: 510704

SEQ ID NO: 513964 - RNA, 64 nt, Homo Sapiens; identical to SEQ ID NO: 510705

SEQ ID NO: 513965 - RNA, 64 nt, Homo Sapiens; identical to SEQ ID NO: 510706

SEQ ID NO: 513966 - RNA, 64 nt, Homo Sapiens; identical to SEQ ID NO: 510707

SEQ ID NO: 513967 - RNA, 64 nt, Homo Sapiens; identical to SEQ ID NO: 510708

SEQ ID NO: 513968 - RNA, 64 nt, Homo Sapiens; identical to SEQ ID NO: 510709

SEQ ID NO: 513969 - RNA, 64 nt, Homo Sapiens; identical to SEQ ID NO: 510710

SEQ ID NO: 513970 - RNA, 64 nt, Homo Sapiens; identical to SEQ ID NO: 510711

SEQ ID NO: 513971 - RNA, 64 nt, Homo Sapiens; identical to SEQ ID NO: 510712

SEQ ID NO: 513972 - RNA, 64 nt, Homo Sapiens; identical to SEQ ID NO: 510713

SEQ ID NO: 513973 - RNA, 64 nt, Homo Sapiens; identical to SEQ ID NO: 510714

SEQ ID NO: 513974 - RNA, 64 nt, Homo Sapiens; identical to SEQ ID NO: 510715

SEQ ID NO: 513975 - RNA, 64 nt, Homo Sapiens; identical to SEQ ID NO: 510716

SEQ ID NO: 513976 - RNA, 64 nt, Homo Sapiens; identical to SEQ ID NO: 510717

SEQ ID NO: 513977 - RNA, 64 nt, Homo Sapiens; identical to SEQ ID NO: 510718

SEQ ID NO: 513978 - RNA, 64 nt, Homo Sapiens; identical to SEQ ID NO: 510719

SEQ ID NO: 513979 - RNA, 64 nt, Homo Sapiens; identical to SEQ ID NO: 510720

SEQ ID NO: 513980 - RNA, 64 nt, Homo Sapiens; identical to SEQ ID NO: 510721

SEQ ID NO: 513981 - RNA, 64 nt, Homo Sapiens; identical to SEQ ID NO: 510722

SEQ ID NO: 513982 - RNA, 64 nt, Homo Sapiens; identical to SEQ ID NO: 510723

SEQ ID NO: 513983 - RNA, 64 nt, Homo Sapiens; identical to SEQ ID NO: 510724

SEQ ID NO: 513984 - RNA, 64 nt, Homo Sapiens; identical to SEQ ID NO: 510725

SEQ ID NO: 513985 - RNA, 64 nt, Homo Sapiens; identical to SEQ ID NO: 510726

SEQ ID NO: 513986 - RNA, 64 nt, Homo Sapiens; identical to SEQ ID NO: 510727

SEQ ID NO: 513987 - RNA, 64 nt, Homo Sapiens; identical to SEQ ID NO: 510728

SEQ ID NO: 513988 - RNA, 64 nt, Homo Sapiens; identical to SEQ ID NO: 510729

SEQ ID NO: 513989 - RNA, 64 nt, Homo Sapiens; identical to SEQ ID NO: 510730

SEQ ID NO: 513990 - RNA, 64 nt, Homo Sapiens; identical to SEQ ID NO: 510731

SEQ ID NO: 513991 - RNA, 64 nt, Homo Sapiens; identical to SEQ ID NO: 510732

SEQ ID NO: 513992 - RNA, 64 nt, Homo Sapiens; identical to SEQ ID NO: 510733

SEQ ID NO: 513993 - RNA, 64 nt, Homo Sapiens; identical to SEQ ID NO: 510734

SEQ ID NO: 513994 - RNA, 64 nt, Homo Sapiens; identical to SEQ ID NO: 510735

SEQ ID NO: 513995 - RNA, 64 nt, Homo Sapiens; identical to SEQ ID NO: 510736

SEQ ID NO: 513996 - RNA, 64 nt, Homo Sapiens; identical to SEQ ID NO: 510737

SEQ ID NO: 513997 - RNA, 64 nt, Homo Sapiens; identical to SEQ ID NO: 510738

SEQ ID NO: 513998 - RNA, 64 nt, Homo Sapiens; identical to SEQ ID NO: 510739

SEQ ID NO: 513999 - RNA, 64 nt, Homo Sapiens; identical to SEQ ID NO: 510740

SEQ ID NO: 514000 - RNA, 64 nt, Homo Sapiens; identical to SEQ ID NO: 510741

SEQ ID NO: 514001 - RNA, 64 nt, Homo Sapiens; identical to SEQ ID NO: 510742

SEQ ID NO: 514002 - RNA, 64 nt, Homo Sapiens; identical to SEQ ID NO: 510743

SEQ ID NO: 514003 - RNA, 64 nt, Homo Sapiens; identical to SEQ ID NO: 510744

SEQ ID NO: 514004 - RNA, 64 nt, Homo Sapiens; identical to SEQ ID NO: 510745

SEQ ID NO: 514005 - RNA, 64 nt, Homo Sapiens; identical to SEQ ID NO: 510746

SEQ ID NO: 514006 - RNA, 64 nt, Homo Sapiens; identical to SEQ ID NO: 510747

SEQ ID NO: 514007 - RNA, 64 nt, Homo Sapiens; identical to SEQ ID NO: 510748

SEQ ID NO: 514008 - RNA, 64 nt, Homo Sapiens; identical to SEQ ID NO: 510749

SEQ ID NO: 514009 - RNA, 64 nt, Homo Sapiens; identical to SEQ ID NO: 510750

SEQ ID NO: 514010 - RNA, 64 nt, Homo Sapiens; identical to SEQ ID NO: 510751

SEQ ID NO: 514011 - RNA, 64 nt, Homo Sapiens; identical to SEQ ID NO: 510752

SEQ ID NO: 514012 - RNA, 64 nt, Homo Sapiens; identical to SEQ ID NO: 510753

SEQ ID NO: 514013 - RNA, 64 nt, Homo Sapiens; identical to SEQ ID NO: 510754

SEQ ID NO: 514014 - RNA, 64 nt, Homo Sapiens; identical to SEQ ID NO: 510755

SEQ ID NO: 514015 - RNA, 64 nt, Homo Sapiens; identical to SEQ ID NO: 510756

SEQ ID NO: 514016 - RNA, 64 nt, Homo Sapiens; identical to SEQ ID NO: 510757

SEQ ID NO: 514017 - RNA, 64 nt, Homo Sapiens; identical to SEQ ID NO: 510758

SEQ ID NO: 514018 - RNA, 64 nt, Homo Sapiens; identical to SEQ ID NO: 510759

SEQ ID NO: 514019 - RNA, 64 nt, Homo Sapiens; identical to SEQ ID NO: 510760

SEQ ID NO: 514020 - RNA, 64 nt, Homo Sapiens; identical to SEQ ID NO: 510761

SEQ ID NO: 514021 - RNA, 64 nt, Homo Sapiens; identical to SEQ ID NO: 510762

SEQ ID NO: 514022 - RNA, 64 nt, Homo Sapiens; identical to SEQ ID NO: 510763

SEQ ID NO: 514023 - RNA, 64 nt, Homo Sapiens; identical to SEQ ID NO: 510764

SEQ ID NO: 514024 - RNA, 64 nt, Homo Sapiens; identical to SEQ ID NO: 510765

SEQ ID NO: 514025 - RNA, 64 nt, Homo Sapiens; identical to SEQ ID NO: 510766

SEQ ID NO: 514026 - RNA, 64 nt, Homo Sapiens; identical to SEQ ID NO: 510767

SEQ ID NO: 514027 - RNA, 64 nt, Homo Sapiens; identical to SEQ ID NO: 510768

SEQ ID NO: 514028 - RNA, 64 nt, Homo Sapiens; identical to SEQ ID NO: 510769

SEQ ID NO: 514029 - RNA, 64 nt, Homo Sapiens; identical to SEQ ID NO: 510770

SEQ ID NO: 514030 - RNA, 64 nt, Homo Sapiens; identical to SEQ ID NO: 510771

SEQ ID NO: 514031 - RNA, 64 nt, Homo Sapiens; identical to SEQ ID NO: 510772

SEQ ID NO: 514032 - RNA, 64 nt, Homo Sapiens; identical to SEQ ID NO: 510773

SEQ ID NO: 514033 - RNA, 64 nt, Homo Sapiens; identical to SEQ ID NO: 510774

SEQ ID NO: 514034 - RNA, 64 nt, Homo Sapiens; identical to SEQ ID NO: 510775

SEQ ID NO: 514035 - RNA, 64 nt, Homo Sapiens; identical to SEQ ID NO: 510776

SEQ ID NO: 514036 - RNA, 64 nt, Homo Sapiens; identical to SEQ ID NO: 510777

SEQ ID NO: 514037 - RNA, 64 nt, Homo Sapiens; identical to SEQ ID NO: 510778

SEQ ID NO: 514038 - RNA, 64 nt, Homo Sapiens; identical to SEQ ID NO: 510779

SEQ ID NO: 514039 - RNA, 64 nt, Homo Sapiens; identical to SEQ ID NO: 510780

SEQ ID NO: 514040 - RNA, 64 nt, Homo Sapiens; identical to SEQ ID NO: 510781

SEQ ID NO: 514041 - RNA, 64 nt, Homo Sapiens; identical to SEQ ID NO: 510782

SEQ ID NO: 514042 - RNA, 64 nt, Homo Sapiens; identical to SEQ ID NO: 510783

SEQ ID NO: 514043 - RNA, 64 nt, Homo Sapiens; identical to SEQ ID NO: 510784

SEQ ID NO: 514044 - RNA, 64 nt, Homo Sapiens; identical to SEQ ID NO: 510785

SEQ ID NO: 514045 - RNA, 64 nt, Homo Sapiens; identical to SEQ ID NO: 510786

SEQ ID NO: 514046 - RNA, 64 nt, Homo Sapiens; identical to SEQ ID NO: 510787

SEQ ID NO: 514047 - RNA, 64 nt, Homo Sapiens; identical to SEQ ID NO: 510788

SEQ ID NO: 514048 - RNA, 64 nt, Homo Sapiens; identical to SEQ ID NO: 510789

SEQ ID NO: 514049 - RNA, 64 nt, Homo Sapiens; identical to SEQ ID NO: 510790

SEQ ID NO: 514050 - RNA, 64 nt, Homo Sapiens; identical to SEQ ID NO: 510791

SEQ ID NO: 514051 - RNA, 64 nt, Homo Sapiens; identical to SEQ ID NO: 510792

SEQ ID NO: 514052 - RNA, 64 nt, Homo Sapiens; identical to SEQ ID NO: 510793

SEQ ID NO: 514053 - RNA, 64 nt, Homo Sapiens; identical to SEQ ID NO: 510794

SEQ ID NO: 514054 - RNA, 64 nt, Homo Sapiens; identical to SEQ ID NO: 510795

SEQ ID NO: 514055 - RNA, 64 nt, Homo Sapiens; identical to SEQ ID NO: 510796

SEQ ID NO: 514056 - RNA, 64 nt, Homo Sapiens; identical to SEQ ID NO: 510797

SEQ ID NO: 514057 - RNA, 64 nt, Homo Sapiens; identical to SEQ ID NO: 510798

SEQ ID NO: 514058 - RNA, 64 nt, Homo Sapiens; identical to SEQ ID NO: 510799

SEQ ID NO: 514059 - RNA, 64 nt, Homo Sapiens; identical to SEQ ID NO: 510800

SEQ ID NO: 514060 - RNA, 64 nt, Homo Sapiens; identical to SEQ ID NO: 510801

SEQ ID NO: 514061 - RNA, 64 nt, Homo Sapiens; identical to SEQ ID NO: 510802

SEQ ID NO: 514062 - RNA, 64 nt, Homo Sapiens; identical to SEQ ID NO: 510803

SEQ ID NO: 514063 - RNA, 64 nt, Homo Sapiens; identical to SEQ ID NO: 510804

SEQ ID NO: 514064 - RNA, 64 nt, Homo Sapiens; identical to SEQ ID NO: 510805

SEQ ID NO: 514065 - RNA, 64 nt, Homo Sapiens; identical to SEQ ID NO: 510806

SEQ ID NO: 514066 - RNA, 64 nt, Homo Sapiens; identical to SEQ ID NO: 510807

SEQ ID NO: 514067 - RNA, 64 nt, Homo Sapiens; identical to SEQ ID NO: 510808

SEQ ID NO: 514068 - RNA, 64 nt, Homo Sapiens; identical to SEQ ID NO: 510809

SEQ ID NO: 514069 - RNA, 64 nt, Homo Sapiens; identical to SEQ ID NO: 510810

SEQ ID NO: 514070 - RNA, 64 nt, Homo Sapiens; identical to SEQ ID NO: 510811

SEQ ID NO: 514071 - RNA, 64 nt, Homo Sapiens; identical to SEQ ID NO: 510812

SEQ ID NO: 514072 - RNA, 64 nt, Homo Sapiens; identical to SEQ ID NO: 510813

SEQ ID NO: 514073 - RNA, 64 nt, Homo Sapiens; identical to SEQ ID NO: 510814

SEQ ID NO: 514074 - RNA, 64 nt, Homo Sapiens; identical to SEQ ID NO: 510815

SEQ ID NO: 514075 - RNA, 64 nt, Homo Sapiens; identical to SEQ ID NO: 510816

SEQ ID NO: 514076 - RNA, 64 nt, Homo Sapiens
uuguagauggaauagaagccaucucccuuuucccccgauccaaguuuuuuccuuccucuccuac

SEQ ID NO: 514077 - RNA, 64 nt, Homo Sapiens
gcuguggagucccagagccaugguuacugccuggccgauccaagcccccaggacuccuacgauc

SEQ ID NO: 514078 - RNA, 64 nt, Homo Sapiens
caggccuuucuguaaauaaaccaccccuuucuccccgauccaccucucuuucucgcauaacucc

SEQ ID NO: 514079 - RNA, 64 nt, Homo Sapiens
ucauaauuuguucuuaaguaaagggauuccaaucccgauccaaauuucuauuuagagaaugcuu

SEQ ID NO: 514080 - RNA, 64 nt, Homo Sapiens
ccuuuggaaacugaaugccauaaucucgaucaaaccgauccagaauaccgaagguauggacagg

SEQ ID NO: 514081 - RNA, 64 nt, Homo Sapiens
cagggugcagguaacccuuggucuguaagcaccaccgauccagggaucauugucuaaauagguu

SEQ ID NO: 514082 - RNA, 64 nt, Homo Sapiens
cuagagaccauuuuuaggauacauuguaucgaaaccgauccaacuacaaucaaguuugcuggaa

SEQ ID NO: 514083 - RNA, 64 nt, Homo Sapiens
ucagcguuguggaucccuagagguggcccccugcccgauccaccguccugaggcagaguguuga

SEQ ID NO: 514084 - RNA, 64 nt, Homo Sapiens
gccagcagauucggacuccgcugagggcuguuucccgauccauagauggugccuucucgcugua

SEQ ID NO: 514085 - RNA, 64 nt, Homo Sapiens
agcugccccacagccucagcaucuucagcacuuaccgauccagagccucccggccuucuccggu

SEQ ID NO: 514086 - RNA, 64 nt, Homo Sapiens
uggcuggggcugggcagagaggguaagcugaucuccgauccacaaauaccaccagcugcuucau

SEQ ID NO: 514087 - RNA, 64 nt, Homo Sapiens
acuccgaagagauguagacgaugcuuuaaagccuccgauccauguuccauggaagguacaucag

SEQ ID NO: 514088 - RNA, 64 nt, Homo Sapiens
uuccuagaccucauggcuguagucuguagccuccccgauccaagccccuucgcaggauucgccg

SEQ ID NO: 514089 - RNA, 64 nt, Homo Sapiens
cacuauuacuggcuuuuuuuggccgugcuccugaccgauccagauaaauuacaggggacucaga

SEQ ID NO: 514090 - RNA, 64 nt, Homo Sapiens
uuuaaagaucugguccccuuuaugagaaugcaagccgauccacauccugacuuaagagaucuga

SEQ ID NO: 514091 - RNA, 64 nt, Homo Sapiens
ugaacaaugggagcacauagcccuguugaccugcccgauccagauucccaggccaggcucccga

SEQ ID NO: 514092 - RNA, 64 nt, Homo Sapiens
cagucacgguuccugcagagaccaucccccagacccgauccauuagagauacaacaggaugaau

SEQ ID NO: 514093 - RNA, 64 nt, Homo Sapiens
uccaggugcugccacaugacaggcacggugggcaccgauccacagugggccccgccuuccccag

SEQ ID NO: 514094 - RNA, 64 nt, Homo Sapiens
ucuguguguucccccaaccucucuccauuguguuccgauccauuuaguuacagcgccuccgucu

SEQ ID NO: 514095 - RNA, 64 nt, Homo Sapiens
ccaucccccacccucugagguucuccgccguuacccgauccacuuguucagagugggguagggg

SEQ ID NO: 514096 - RNA, 64 nt, Homo Sapiens
gaagggcuucccaaaccuugacuuggacacaaaaccgauccauaauggcuuuuggcagggacag

SEQ ID NO: 514097 - RNA, 64 nt, Homo Sapiens
ccccaccucccucucggcugugccuuacggagccccgauccaggccuccuguggcuguuggguu

SEQ ID NO: 514098 - RNA, 53 nt, Homo Sapiens
acgccugccgccugcucugaggcccgauccagugggcaggccaaggccugcug

SEQ ID NO: 514099 - RNA, 64 nt, Homo Sapiens
cccaggccccucuguaccauccaaccaaaacccuccgauccagccccuccccucucuucuccuc

SEQ ID NO: 514100 - RNA, 64 nt, Homo Sapiens
cugcagcccucgcugcaguccucuuugaguaucaccgauccaccugugggggcuggugcugugg

SEQ ID NO: 514101 - RNA, 64 nt, Homo Sapiens
uugcauaaguggacccagcucagauguaagaagcccgauccacaagggauagagacgcagauuu

SEQ ID NO: 514102 - RNA, 64 nt, Homo Sapiens
acagguggcuggagcagcugcuuugcaaccugaucaccuugaguucugagcagggacuaggcuu

SEQ ID NO: 514103 - RNA, 64 nt, Homo Sapiens
gcagcugugccaggauagcuggguccauucagagcaccuugagaaguguugcagggagguguua

SEQ ID NO: 514104 - RNA, 64 nt, Homo Sapiens
cuugaacccaaccccagacaguucaggaagcgaucaccuugauguccucauggucaaugaacau

SEQ ID NO: 514105 - RNA, 64 nt, Homo Sapiens
uuggguaaaacccaaggucuucuucuaucacagccaccuugaccuaguuacuuuugccuuucgc

SEQ ID NO: 514106 - RNA, 64 nt, Homo Sapiens
uauccauuacauauuuaguuuuaaaaggaggagucaccuugaauuauuuucugagucaccuuga

SEQ ID NO: 514107 - RNA, 64 nt, Homo Sapiens
aaaaggaggagucaccuugaauuauuuucugagucaccuugaguuauuugaucucucagccugc

SEQ ID NO: 514108 - RNA, 64 nt, Homo Sapiens
agcgauugaccugugcuucugacagcccccgagacaccuugaggaggccgcuccuucccagaca

SEQ ID NO: 514109 - RNA, 64 nt, Homo Sapiens
cguuccccaggggagcuggggaauuccugccaagcaccuugaaugggaggggccucacagaggg

SEQ ID NO: 514110 - RNA, 64 nt, Homo Sapiens
guagaauuuagcguuugguuuccugaacacuugacaccuugaggcugggucacauugcuucuua

SEQ ID NO: 514111 - RNA, 64 nt, Homo Sapiens
cucuccuggcaugaaaauaauaacacaggagcuacaccuugaucuuuccuaguuguccuggugc

SEQ ID NO: 514112 - RNA, 64 nt, Homo Sapiens
aaagcagauuauaguauacaacccaucucuccuccaccuugacaaaacuccaagugauaaccag

SEQ ID NO: 514113 - RNA, 64 nt, Homo Sapiens
caggacgacaccggguucaggaauauguggcuaucaccuugagcacugacaguggccuuccagg

SEQ ID NO: 514114 - RNA, 64 nt, Homo Sapiens
aagagcugggcaacagcuggcuugugaaaugagacaccuugaccaauaugcuuuggguggacgg

SEQ ID NO: 514115 - RNA, 64 nt, Homo Sapiens
ucagggacccaggaacucagcuuccaaacaucugcaccuugaccggacucgccaucccgccgug

SEQ ID NO: 514116 - RNA, 64 nt, Homo Sapiens
ugucuuccucccgagccauggccucugcuagcuccaccuugaaggagccccccacauccucccc

SEQ ID NO: 514117 - RNA, 64 nt, Homo Sapiens
ucacaguguuuuagaguaaaaaggaauuuuuccacaccuugaagccugagagcuaaaaaacuga

SEQ ID NO: 514118 - RNA, 64 nt, Homo Sapiens
augugggcaaacccuucuaccaguuauucaauagcaccuugauauaagcauuaggaaggcuagc

SEQ ID NO: 514119 - RNA, 64 nt, Homo Sapiens; identical to SEQ ID NO: 179925

SEQ ID NO: 514120 - RNA, 64 nt, Homo Sapiens; identical to SEQ ID NO: 179926

SEQ ID NO: 514121 - RNA, 64 nt, Homo Sapiens; identical to SEQ ID NO: 179927

SEQ ID NO: 514122 - RNA, 64 nt, Homo Sapiens; identical to SEQ ID NO: 179928

SEQ ID NO: 514123 - RNA, 64 nt, Homo Sapiens; identical to SEQ ID NO: 179929

SEQ ID NO: 514124 - RNA, 64 nt, Homo Sapiens; identical to SEQ ID NO: 179930

SEQ ID NO: 514125 - RNA, 64 nt, Homo Sapiens; identical to SEQ ID NO: 179931

SEQ ID NO: 514126 - RNA, 64 nt, Homo Sapiens; identical to SEQ ID NO: 179932

SEQ ID NO: 514127 - RNA, 64 nt, Homo Sapiens; identical to SEQ ID NO: 179933

SEQ ID NO: 514128 - RNA, 64 nt, Homo Sapiens; identical to SEQ ID NO: 179934

SEQ ID NO: 514129 - RNA, 64 nt, Homo Sapiens; identical to SEQ ID NO: 179935

SEQ ID NO: 514130 - RNA, 64 nt, Homo Sapiens; identical to SEQ ID NO: 179936

SEQ ID NO: 514131 - RNA, 64 nt, Homo Sapiens; identical to SEQ ID NO: 179937

SEQ ID NO: 514132 - RNA, 64 nt, Homo Sapiens; identical to SEQ ID NO: 179938

SEQ ID NO: 514133 - RNA, 64 nt, Homo Sapiens; identical to SEQ ID NO: 179939

SEQ ID NO: 514134 - RNA, 64 nt, Homo Sapiens; identical to SEQ ID NO: 179940

SEQ ID NO: 514135 - RNA, 64 nt, Homo Sapiens; identical to SEQ ID NO: 179941

SEQ ID NO: 514136 - RNA, 64 nt, Homo Sapiens; identical to SEQ ID NO: 179942

SEQ ID NO: 514137 - RNA, 64 nt, Homo Sapiens; identical to SEQ ID NO: 179943

SEQ ID NO: 514138 - RNA, 64 nt, Homo Sapiens; identical to SEQ ID NO: 439551

SEQ ID NO: 514139 - RNA, 64 nt, Homo Sapiens; identical to SEQ ID NO: 439552

SEQ ID NO: 514140 - RNA, 64 nt, Homo Sapiens; identical to SEQ ID NO: 439553

SEQ ID NO: 514141 - RNA, 64 nt, Homo Sapiens; identical to SEQ ID NO: 439554

SEQ ID NO: 514142 - RNA, 64 nt, Homo Sapiens; identical to SEQ ID NO: 439555

SEQ ID NO: 514143 - RNA, 64 nt, Homo Sapiens; identical to SEQ ID NO: 439556

SEQ ID NO: 514144 - RNA, 64 nt, Homo Sapiens; identical to SEQ ID NO: 439557

SEQ ID NO: 514145 - RNA, 64 nt, Homo Sapiens; identical to SEQ ID NO: 439558

SEQ ID NO: 514146 - RNA, 64 nt, Homo Sapiens; identical to SEQ ID NO: 439559

SEQ ID NO: 514147 - RNA, 64 nt, Homo Sapiens; identical to SEQ ID NO: 439560

SEQ ID NO: 514148 - RNA, 64 nt, Homo Sapiens; identical to SEQ ID NO: 439561

SEQ ID NO: 514149 - RNA, 64 nt, Homo Sapiens; identical to SEQ ID NO: 439562

SEQ ID NO: 514150 - RNA, 64 nt, Homo Sapiens; identical to SEQ ID NO: 439563

SEQ ID NO: 514151 - RNA, 64 nt, Homo Sapiens; identical to SEQ ID NO: 439564

SEQ ID NO: 514152 - RNA, 64 nt, Homo Sapiens; identical to SEQ ID NO: 439565

SEQ ID NO: 514153 - RNA, 64 nt, Homo Sapiens; identical to SEQ ID NO: 439566

SEQ ID NO: 514154 - RNA, 64 nt, Homo Sapiens; identical to SEQ ID NO: 439567

SEQ ID NO: 514155 - RNA, 64 nt, Homo Sapiens; identical to SEQ ID NO: 439568

SEQ ID NO: 514156 - RNA, 64 nt, Homo Sapiens; identical to SEQ ID NO: 439569

SEQ ID NO: 514157 - RNA, 64 nt, Homo Sapiens; identical to SEQ ID NO: 439570

SEQ ID NO: 514158 - RNA, 64 nt, Homo Sapiens; identical to SEQ ID NO: 439571

SEQ ID NO: 514159 - RNA, 64 nt, Homo Sapiens; identical to SEQ ID NO: 439572

SEQ ID NO: 514160 - RNA, 64 nt, Homo Sapiens; identical to SEQ ID NO: 439573

SEQ ID NO: 514161 - RNA, 64 nt, Homo Sapiens; identical to SEQ ID NO: 439574

SEQ ID NO: 514162 - RNA, 64 nt, Homo Sapiens; identical to SEQ ID NO: 439575

SEQ ID NO: 514163 - RNA, 64 nt, Homo Sapiens; identical to SEQ ID NO: 439576

SEQ ID NO: 514164 - RNA, 64 nt, Homo Sapiens; identical to SEQ ID NO: 439577

SEQ ID NO: 514165 - RNA, 64 nt, Homo Sapiens; identical to SEQ ID NO: 439578

SEQ ID NO: 514166 - RNA, 64 nt, Homo Sapiens; identical to SEQ ID NO: 439579

SEQ ID NO: 514167 - RNA, 64 nt, Homo Sapiens; identical to SEQ ID NO: 439580

SEQ ID NO: 514168 - RNA, 64 nt, Homo Sapiens; identical to SEQ ID NO: 439581

SEQ ID NO: 514169 - RNA, 64 nt, Homo Sapiens; identical to SEQ ID NO: 439582

SEQ ID NO: 514170 - RNA, 64 nt, Homo Sapiens; identical to SEQ ID NO: 439583

SEQ ID NO: 514171 - RNA, 64 nt, Homo Sapiens; identical to SEQ ID NO: 439584

SEQ ID NO: 514172 - RNA, 64 nt, Homo Sapiens; identical to SEQ ID NO: 439585

SEQ ID NO: 514173 - RNA, 64 nt, Homo Sapiens; identical to SEQ ID NO: 439586

SEQ ID NO: 514174 - RNA, 64 nt, Homo Sapiens; identical to SEQ ID NO: 439587

SEQ ID NO: 514175 - RNA, 64 nt, Homo Sapiens; identical to SEQ ID NO: 439588

SEQ ID NO: 514176 - RNA, 64 nt, Homo Sapiens; identical to SEQ ID NO: 439589

SEQ ID NO: 514177 - RNA, 64 nt, Homo Sapiens; identical to SEQ ID NO: 439590

SEQ ID NO: 514178 - RNA, 64 nt, Homo Sapiens; identical to SEQ ID NO: 439591

SEQ ID NO: 514179 - RNA, 64 nt, Homo Sapiens; identical to SEQ ID NO: 439592

SEQ ID NO: 514180 - RNA, 64 nt, Homo Sapiens; identical to SEQ ID NO: 439593

SEQ ID NO: 514181 - RNA, 64 nt, Homo Sapiens; identical to SEQ ID NO: 439594

SEQ ID NO: 514182 - RNA, 64 nt, Homo Sapiens; identical to SEQ ID NO: 439595

SEQ ID NO: 514183 - RNA, 64 nt, Homo Sapiens; identical to SEQ ID NO: 439596

SEQ ID NO: 514184 - RNA, 64 nt, Homo Sapiens; identical to SEQ ID NO: 439597

SEQ ID NO: 514185 - RNA, 64 nt, Homo Sapiens; identical to SEQ ID NO: 439598

SEQ ID NO: 514186 - RNA, 64 nt, Homo Sapiens; identical to SEQ ID NO: 179925

SEQ ID NO: 514187 - RNA, 64 nt, Homo Sapiens; identical to SEQ ID NO: 179926

SEQ ID NO: 514188 - RNA, 64 nt, Homo Sapiens; identical to SEQ ID NO: 179927

SEQ ID NO: 514189 - RNA, 64 nt, Homo Sapiens; identical to SEQ ID NO: 179928

SEQ ID NO: 514190 - RNA, 64 nt, Homo Sapiens; identical to SEQ ID NO: 179929

SEQ ID NO: 514191 - RNA, 64 nt, Homo Sapiens; identical to SEQ ID NO: 179930

SEQ ID NO: 514192 - RNA, 64 nt, Homo Sapiens; identical to SEQ ID NO: 179931

SEQ ID NO: 514193 - RNA, 64 nt, Homo Sapiens; identical to SEQ ID NO: 179932

SEQ ID NO: 514194 - RNA, 64 nt, Homo Sapiens; identical to SEQ ID NO: 179933

SEQ ID NO: 514195 - RNA, 64 nt, Homo Sapiens; identical to SEQ ID NO: 179934

SEQ ID NO: 514196 - RNA, 64 nt, Homo Sapiens; identical to SEQ ID NO: 179935

SEQ ID NO: 514197 - RNA, 64 nt, Homo Sapiens; identical to SEQ ID NO: 179936

SEQ ID NO: 514198 - RNA, 64 nt, Homo Sapiens; identical to SEQ ID NO: 179937

SEQ ID NO: 514199 - RNA, 64 nt, Homo Sapiens; identical to SEQ ID NO: 179938

SEQ ID NO: 514200 - RNA, 64 nt, Homo Sapiens; identical to SEQ ID NO: 179939

SEQ ID NO: 514201 - RNA, 64 nt, Homo Sapiens; identical to SEQ ID NO: 179940

SEQ ID NO: 514202 - RNA, 64 nt, Homo Sapiens; identical to SEQ ID NO: 179941

SEQ ID NO: 514203 - RNA, 64 nt, Homo Sapiens; identical to SEQ ID NO: 179942

SEQ ID NO: 514204 - RNA, 64 nt, Homo Sapiens; identical to SEQ ID NO: 179943

SEQ ID NO: 514205 - RNA, 64 nt, Homo Sapiens; identical to SEQ ID NO: 439551

SEQ ID NO: 514206 - RNA, 64 nt, Homo Sapiens; identical to SEQ ID NO: 439552

SEQ ID NO: 514207 - RNA, 64 nt, Homo Sapiens; identical to SEQ ID NO: 439553

SEQ ID NO: 514208 - RNA, 64 nt, Homo Sapiens; identical to SEQ ID NO: 439554

SEQ ID NO: 514209 - RNA, 64 nt, Homo Sapiens; identical to SEQ ID NO: 439555

SEQ ID NO: 514210 - RNA, 64 nt, Homo Sapiens; identical to SEQ ID NO: 439556

SEQ ID NO: 514211 - RNA, 64 nt, Homo Sapiens; identical to SEQ ID NO: 439557

SEQ ID NO: 514212 - RNA, 64 nt, Homo Sapiens; identical to SEQ ID NO: 439558

SEQ ID NO: 514213 - RNA, 64 nt, Homo Sapiens; identical to SEQ ID NO: 439559

SEQ ID NO: 514214 - RNA, 64 nt, Homo Sapiens; identical to SEQ ID NO: 439560

SEQ ID NO: 514215 - RNA, 64 nt, Homo Sapiens; identical to SEQ ID NO: 439561

SEQ ID NO: 514216 - RNA, 64 nt, Homo Sapiens; identical to SEQ ID NO: 439562

SEQ ID NO: 514217 - RNA, 64 nt, Homo Sapiens; identical to SEQ ID NO: 439563

SEQ ID NO: 514218 - RNA, 64 nt, Homo Sapiens; identical to SEQ ID NO: 439564

SEQ ID NO: 514219 - RNA, 64 nt, Homo Sapiens; identical to SEQ ID NO: 439565

SEQ ID NO: 514220 - RNA, 64 nt, Homo Sapiens; identical to SEQ ID NO: 439566

SEQ ID NO: 514221 - RNA, 64 nt, Homo Sapiens; identical to SEQ ID NO: 439567

SEQ ID NO: 514222 - RNA, 64 nt, Homo Sapiens; identical to SEQ ID NO: 439568

SEQ ID NO: 514223 - RNA, 64 nt, Homo Sapiens; identical to SEQ ID NO: 439569

SEQ ID NO: 514224 - RNA, 64 nt, Homo Sapiens; identical to SEQ ID NO: 439570

SEQ ID NO: 514225 - RNA, 64 nt, Homo Sapiens; identical to SEQ ID NO: 439571

SEQ ID NO: 514226 - RNA, 64 nt, Homo Sapiens; identical to SEQ ID NO: 439572

SEQ ID NO: 514227 - RNA, 64 nt, Homo Sapiens; identical to SEQ ID NO: 439573

SEQ ID NO: 514228 - RNA, 64 nt, Homo Sapiens; identical to SEQ ID NO: 439574

SEQ ID NO: 514229 - RNA, 64 nt, Homo Sapiens; identical to SEQ ID NO: 439575

SEQ ID NO: 514230 - RNA, 64 nt, Homo Sapiens; identical to SEQ ID NO: 439576

SEQ ID NO: 514231 - RNA, 64 nt, Homo Sapiens; identical to SEQ ID NO: 439577

SEQ ID NO: 514232 - RNA, 64 nt, Homo Sapiens; identical to SEQ ID NO: 439578

SEQ ID NO: 514233 - RNA, 64 nt, Homo Sapiens; identical to SEQ ID NO: 439579

SEQ ID NO: 514234 - RNA, 64 nt, Homo Sapiens; identical to SEQ ID NO: 439580

SEQ ID NO: 514235 - RNA, 64 nt, Homo Sapiens; identical to SEQ ID NO: 439581

SEQ ID NO: 514236 - RNA, 64 nt, Homo Sapiens; identical to SEQ ID NO: 439582

SEQ ID NO: 514237 - RNA, 64 nt, Homo Sapiens; identical to SEQ ID NO: 439583

SEQ ID NO: 514238 - RNA, 64 nt, Homo Sapiens; identical to SEQ ID NO: 439584

SEQ ID NO: 514239 - RNA, 64 nt, Homo Sapiens; identical to SEQ ID NO: 439585

SEQ ID NO: 514240 - RNA, 64 nt, Homo Sapiens; identical to SEQ ID NO: 439586

SEQ ID NO: 514241 - RNA, 64 nt, Homo Sapiens; identical to SEQ ID NO: 439587

SEQ ID NO: 514242 - RNA, 64 nt, Homo Sapiens; identical to SEQ ID NO: 439588

SEQ ID NO: 514243 - RNA, 64 nt, Homo Sapiens; identical to SEQ ID NO: 439589

SEQ ID NO: 514244 - RNA, 64 nt, Homo Sapiens; identical to SEQ ID NO: 439590

SEQ ID NO: 514245 - RNA, 64 nt, Homo Sapiens; identical to SEQ ID NO: 439591

SEQ ID NO: 514246 - RNA, 64 nt, Homo Sapiens; identical to SEQ ID NO: 439592

SEQ ID NO: 514247 - RNA, 64 nt, Homo Sapiens; identical to SEQ ID NO: 439593

SEQ ID NO: 514248 - RNA, 64 nt, Homo Sapiens; identical to SEQ ID NO: 439594

SEQ ID NO: 514249 - RNA, 64 nt, Homo Sapiens; identical to SEQ ID NO: 439595

SEQ ID NO: 514250 - RNA, 64 nt, Homo Sapiens; identical to SEQ ID NO: 439596

SEQ ID NO: 514251 - RNA, 64 nt, Homo Sapiens; identical to SEQ ID NO: 439597

SEQ ID NO: 514252 - RNA, 64 nt, Homo Sapiens; identical to SEQ ID NO: 439598

SEQ ID NO: 514253 - RNA, 64 nt, Homo Sapiens
cggguuuggggagggagcacucugggacugugagacaaggaagcagggccagcagugagacuau

SEQ ID NO: 514254 - RNA, 64 nt, Homo Sapiens
aguggagcaugaggagggagcaguccagaugccaacaaggaaaugcguuuauggcuacaagagu

SEQ ID NO: 514255 - RNA, 64 nt, Homo Sapiens
aaaccucaguguuuuuccucugcugguuuggggcacaaggaagccuuaggguauggggaaaggc

SEQ ID NO: 514256 - RNA, 64 nt, Homo Sapiens
uuagaaggcccuggaagggaagugaggaggagggacaaggaagaugacuaguuacggaggguga

SEQ ID NO: 514257 - RNA, 64 nt, Homo Sapiens
aaacagcuuauguuuacauaaaauuuuaucauucacaaggaaguuuuaagcacacugucucauu

SEQ ID NO: 514258 - RNA, 64 nt, Homo Sapiens
auggauuagcuauaaaaaaugucaauaagauuguacaaggaaaauuagagaaagucacauuuag

SEQ ID NO: 514259 - RNA, 64 nt, Homo Sapiens
gacgugguuuuagagucuaccuaauauguuaaggacaaggaaaccucugagucuaccuaauaug

SEQ ID NO: 514260 - RNA, 64 nt, Homo Sapiens
aaggaaaccucugagucuaccuaauauguuaaggacaaggaaaccucuggacagugguauauug

SEQ ID NO: 514261 - RNA, 64 nt, Homo Sapiens
ccugugccaauaaaaguuuuacccugucaaguuaacaaggaauguuuugaaaaauuacagcuuc

SEQ ID NO: 514262 - RNA, 64 nt, Homo Sapiens
uaguuuaggagaaaccagcuugaucucuacuaccacaaggaaaaaggaguuguuucugacccac

SEQ ID NO: 514263 - RNA, 64 nt, Homo Sapiens
ucuauauuugucuuccgaucugcugcauacuuugacaaggaaaaggaagccaaaguuuucaaac

SEQ ID NO: 514264 - RNA, 64 nt, Homo Sapiens
caaaguuuucaaacugcugcucuaaagguaccaaacaaggaagcggugcuuggugagucuuggu

SEQ ID NO: 514265 - RNA, 64 nt, Homo Sapiens
gauuuugggauauuaaaaguuaacagaacacugaacaaggaaagaauggcauagaucuaucuuu

SEQ ID NO: 514266 - RNA, 64 nt, Homo Sapiens
gccugaagauucuuucuucugaaagccaagcaccacaaggaaaaaaaaaauuauuaauagcuca

SEQ ID NO: 514267 - RNA, 64 nt, Homo Sapiens
ugacauuuaucagcaaaucucuugcaagaacagcacaaggaaaaucagucuaauaagcugcucu

SEQ ID NO: 514268 - RNA, 64 nt, Homo Sapiens
agcaguguaaguuguauauuacuguuucuuauguacaaggaacaacaauaaaucauauggaaau

SEQ ID NO: 514269 - RNA, 64 nt, Homo Sapiens
cccaccuccaguccccuggacaaucggguacaagagacuuaagguugggcaugggaaggguggg

SEQ ID NO: 514270 - RNA, 64 nt, Homo Sapiens
cauucaucgcucucaaaauuagcuucagugacaaagacuuaaaucucucuccuaucugcagcac

SEQ ID NO: 514271 - RNA, 64 nt, Homo Sapiens
guuccugugauguaacuguaagccuucucgacuuagacuuaaaaaguggucacauagauuaauu

SEQ ID NO: 514272 - RNA, 64 nt, Homo Sapiens
uaacuguugaacucaugaaagaagauaguguaugagacuuaagccaugaguuuuguaucauuuc

SEQ ID NO: 514273 - RNA, 64 nt, Homo Sapiens
uuuuauuuccuguccuuccuauguuuguucuaucagacuuaaccaucuuuggauuucagucuug

SEQ ID NO: 514274 - RNA, 64 nt, Homo Sapiens
uccuuguugagaacaggaaaaugguaggguggaaagacuuaauugacuuuuagauuuagugaag

SEQ ID NO: 514275 - RNA, 64 nt, Homo Sapiens
agcacaauuuccacacugugaaggcaguauuagaagacuuaauuguaaaagcucucuugucacu

SEQ ID NO: 514276 - RNA, 64 nt, Homo Sapiens
uuaauuugaguuccaacuguuaagcauauuucucagacuuaaauuugauuauguccccaucaaa

SEQ ID NO: 514277 - RNA, 64 nt, Homo Sapiens
uauuuuauuauaaauuagauuuaaauauaacaggagacuuaaaauaauuuaaauuugaugcaau

SEQ ID NO: 514278 - RNA, 64 nt, Homo Sapiens
gcaaagcauauuuauugaaccauauuuguauauuagacuuaauauuccauuuucaaacuucuau

SEQ ID NO: 514279 - RNA, 64 nt, Homo Sapiens
caggguucaggucuuccagggauuuucaaguucaagacuuaacuuuucugcucgacucgccccu

SEQ ID NO: 514280 - RNA, 64 nt, Homo Sapiens
ugaucccaucaccagagagguagucuucacucauagacuuaagaucucuccagucccguuguua

SEQ ID NO: 514281 - RNA, 64 nt, Homo Sapiens
uuguccucagccaaggaaaauuuuuaaaggcaacagacuuaaaguaagaaacacucguuuguug

SEQ ID NO: 514282 - RNA, 64 nt, Homo Sapiens
gaaugcuucuagaaacuuccaaccuugaaaaaauagacuuaaauuuuuaaaaauucauaacagc

SEQ ID NO: 514283 - RNA, 64 nt, Homo Sapiens
ccugccacugcacuccagccugggcgcaagaccaagacuuaaacgcaaaaaaaaaaaaaaaaaa

SEQ ID NO: 514284 - RNA, 64 nt, Homo Sapiens
ucuaaaauguaagucaaauauguuuuaauaacaaagacuuaaauggcuuuucucccuagagacu

SEQ ID NO: 514285 - RNA, 64 nt, Homo Sapiens
uguucuuaaaaugcuuuaaccuugaaguugcuugagacuuaagaggucauguugcuuuagguuu

SEQ ID NO: 514286 - RNA, 64 nt, Homo Sapiens
gccuagguacaagcaggacuggcauuagguuaauagacuuaauuuuaacugucaguauuuuggg

SEQ ID NO: 514287 - RNA, 64 nt, Homo Sapiens
agugugguucuaaaguuccuugauuaaugaauacagacuuaacauuuuuaagugugaaugcaag

SEQ ID NO: 514288 - RNA, 64 nt, Homo Sapiens
augucuuauugggcauaaaaagagaagauuuuaaagacuuaauguacucucccauuaaagagga

SEQ ID NO: 514289 - RNA, 64 nt, Homo Sapiens
uaacaacucuucugucauagcaagucccaugaaaagacuuaaugugucauaaagcuucaccaau

SEQ ID NO: 514290 - RNA, 64 nt, Homo Sapiens
cacgauauacaaaaaucaacucaagauggauuaaagacuuaaauauaaaaccuaaaaguauuaa

SEQ ID NO: 514291 - RNA, 64 nt, Homo Sapiens
caggaaaugccauucuggacauaagugcuggaaaagacuuaaugaugaacaccccaaagcaauu

SEQ ID NO: 514292 - RNA, 64 nt, Homo Sapiens
ugccuccauuauuuccuccacaguuuugguauuugucagacauuuguucugcugucuuucuaau

SEQ ID NO: 514293 - RNA, 64 nt, Homo Sapiens
gauuaucaaagcuaauuugacuaguuugaaccucgucagacauucauuccuuuggccauugcca

SEQ ID NO: 514294 - RNA, 64 nt, Homo Sapiens
gaagagguuugagacaggcggcauccugcacugagucagacaagugggagcuguaggaacugca

SEQ ID NO: 514295 - RNA, 64 nt, Homo Sapiens
gcuuucucaccagguucagcaaggaggccugggggucagacaccaauguugagcaccuccugag

SEQ ID NO: 514296 - RNA, 64 nt, Homo Sapiens
auccuuuuaucacacuccucucaagcaagcuauagucagacagaugaugaaaguaacaugaaaa

SEQ ID NO: 514297 - RNA, 64 nt, Homo Sapiens
gggcggcuguacgauguucacaugucugcguuuggucagacaucaucuccuuggcugcccuuug

SEQ ID NO: 514298 - RNA, 64 nt, Homo Sapiens
cugggggccucacucuguuuagcucaggaaggcugucagacaggcugucaccuacccucccugc

SEQ ID NO: 514299 - RNA, 64 nt, Homo Sapiens
cagaguuggagacagaacaaacccagagggcagcgucagacaccugggggagggagggacagag

SEQ ID NO: 514300 - RNA, 64 nt, Homo Sapiens; identical to SEQ ID NO: 444750

SEQ ID NO: 514301 - RNA, 64 nt, Homo Sapiens; identical to SEQ ID NO: 444751

SEQ ID NO: 514302 - RNA, 64 nt, Homo Sapiens; identical to SEQ ID NO: 444752

SEQ ID NO: 514303 - RNA, 64 nt, Homo Sapiens; identical to SEQ ID NO: 444753

SEQ ID NO: 514304 - RNA, 60 nt, Homo Sapiens; identical to SEQ ID NO: 444754

SEQ ID NO: 514305 - RNA, 64 nt, Homo Sapiens; identical to SEQ ID NO: 444755

SEQ ID NO: 514306 - RNA, 64 nt, Homo Sapiens; identical to SEQ ID NO: 444756

SEQ ID NO: 514307 - RNA, 64 nt, Homo Sapiens; identical to SEQ ID NO: 444757

SEQ ID NO: 514308 - RNA, 64 nt, Homo Sapiens; identical to SEQ ID NO: 444758

SEQ ID NO: 514309 - RNA, 64 nt, Homo Sapiens; identical to SEQ ID NO: 444759

SEQ ID NO: 514310 - RNA, 64 nt, Homo Sapiens; identical to SEQ ID NO: 444760

SEQ ID NO: 514311 - RNA, 64 nt, Homo Sapiens; identical to SEQ ID NO: 444761

SEQ ID NO: 514312 - RNA, 52 nt, Homo Sapiens; identical to SEQ ID NO: 444762

SEQ ID NO: 514313 - RNA, 64 nt, Homo Sapiens; identical to SEQ ID NO: 444763

SEQ ID NO: 514314 - RNA, 64 nt, Homo Sapiens; identical to SEQ ID NO: 444764

SEQ ID NO: 514315 - RNA, 64 nt, Homo Sapiens; identical to SEQ ID NO: 444765

SEQ ID NO: 514316 - RNA, 64 nt, Homo Sapiens; identical to SEQ ID NO: 444766

SEQ ID NO: 514317 - RNA, 64 nt, Homo Sapiens; identical to SEQ ID NO: 444767

SEQ ID NO: 514318 - RNA, 64 nt, Homo Sapiens; identical to SEQ ID NO: 444768

SEQ ID NO: 514319 - RNA, 64 nt, Homo Sapiens; identical to SEQ ID NO: 444769

SEQ ID NO: 514320 - RNA, 64 nt, Homo Sapiens; identical to SEQ ID NO: 444770

SEQ ID NO: 514321 - RNA, 64 nt, Homo Sapiens; identical to SEQ ID NO: 444771

SEQ ID NO: 514322 - RNA, 64 nt, Homo Sapiens; identical to SEQ ID NO: 444772

SEQ ID NO: 514323 - RNA, 64 nt, Homo Sapiens; identical to SEQ ID NO: 444773

SEQ ID NO: 514324 - RNA, 64 nt, Homo Sapiens; identical to SEQ ID NO: 444774

SEQ ID NO: 514325 - RNA, 64 nt, Homo Sapiens; identical to SEQ ID NO: 444775

SEQ ID NO: 514326 - RNA, 64 nt, Homo Sapiens; identical to SEQ ID NO: 444776

SEQ ID NO: 514327 - RNA, 64 nt, Homo Sapiens; identical to SEQ ID NO: 444777

SEQ ID NO: 514328 - RNA, 64 nt, Homo Sapiens; identical to SEQ ID NO: 444778

SEQ ID NO: 514329 - RNA, 64 nt, Homo Sapiens; identical to SEQ ID NO: 444779

SEQ ID NO: 514330 - RNA, 64 nt, Homo Sapiens; identical to SEQ ID NO: 444780

SEQ ID NO: 514331 - RNA, 64 nt, Homo Sapiens; identical to SEQ ID NO: 444781

SEQ ID NO: 514332 - RNA, 64 nt, Homo Sapiens; identical to SEQ ID NO: 444782

SEQ ID NO: 514333 - RNA, 64 nt, Homo Sapiens; identical to SEQ ID NO: 444783

SEQ ID NO: 514334 - RNA, 64 nt, Homo Sapiens; identical to SEQ ID NO: 444784

SEQ ID NO: 514335 - RNA, 64 nt, Homo Sapiens; identical to SEQ ID NO: 444785

SEQ ID NO: 514336 - RNA, 64 nt, Homo Sapiens; identical to SEQ ID NO: 444786

SEQ ID NO: 514337 - RNA, 64 nt, Homo Sapiens; identical to SEQ ID NO: 444787

SEQ ID NO: 514338 - RNA, 64 nt, Homo Sapiens; identical to SEQ ID NO: 444788

SEQ ID NO: 514339 - RNA, 60 nt, Homo Sapiens; identical to SEQ ID NO: 444789

SEQ ID NO: 514340 - RNA, 64 nt, Homo Sapiens; identical to SEQ ID NO: 444790

SEQ ID NO: 514341 - RNA, 64 nt, Homo Sapiens; identical to SEQ ID NO: 444791

SEQ ID NO: 514342 - RNA, 64 nt, Homo Sapiens; identical to SEQ ID NO: 444792

SEQ ID NO: 514343 - RNA, 64 nt, Homo Sapiens; identical to SEQ ID NO: 444793

SEQ ID NO: 514344 - RNA, 64 nt, Homo Sapiens; identical to SEQ ID NO: 444794

SEQ ID NO: 514345 - RNA, 64 nt, Homo Sapiens; identical to SEQ ID NO: 444795

SEQ ID NO: 514346 - RNA, 64 nt, Homo Sapiens; identical to SEQ ID NO: 444796

SEQ ID NO: 514347 - RNA, 64 nt, Homo Sapiens; identical to SEQ ID NO: 444797

SEQ ID NO: 514348 - RNA, 64 nt, Homo Sapiens; identical to SEQ ID NO: 444798

SEQ ID NO: 514349 - RNA, 64 nt, Homo Sapiens; identical to SEQ ID NO: 444799

SEQ ID NO: 514350 - RNA, 64 nt, Homo Sapiens; identical to SEQ ID NO: 444800

SEQ ID NO: 514351 - RNA, 64 nt, Homo Sapiens; identical to SEQ ID NO: 444801

SEQ ID NO: 514352 - RNA, 64 nt, Homo Sapiens; identical to SEQ ID NO: 444802

SEQ ID NO: 514353 - RNA, 64 nt, Homo Sapiens; identical to SEQ ID NO: 444803

SEQ ID NO: 514354 - RNA, 64 nt, Homo Sapiens; identical to SEQ ID NO: 444804

SEQ ID NO: 514355 - RNA, 64 nt, Homo Sapiens; identical to SEQ ID NO: 444805

SEQ ID NO: 514356 - RNA, 64 nt, Homo Sapiens; identical to SEQ ID NO: 444806

SEQ ID NO: 514357 - RNA, 60 nt, Homo Sapiens; identical to SEQ ID NO: 444807

SEQ ID NO: 514358 - RNA, 64 nt, Homo Sapiens; identical to SEQ ID NO: 444808

SEQ ID NO: 514359 - RNA, 64 nt, Homo Sapiens; identical to SEQ ID NO: 444809

SEQ ID NO: 514360 - RNA, 64 nt, Homo Sapiens; identical to SEQ ID NO: 444810

SEQ ID NO: 514361 - RNA, 64 nt, Homo Sapiens; identical to SEQ ID NO: 444811

SEQ ID NO: 514362 - RNA, 64 nt, Homo Sapiens; identical to SEQ ID NO: 444812

SEQ ID NO: 514363 - RNA, 51 nt, Homo Sapiens; identical to SEQ ID NO: 444813

SEQ ID NO: 514364 - RNA, 64 nt, Homo Sapiens; identical to SEQ ID NO: 444814

SEQ ID NO: 514365 - RNA, 64 nt, Homo Sapiens; identical to SEQ ID NO: 444815

SEQ ID NO: 514366 - RNA, 64 nt, Homo Sapiens; identical to SEQ ID NO: 444816

SEQ ID NO: 514367 - RNA, 64 nt, Homo Sapiens; identical to SEQ ID NO: 444817

SEQ ID NO: 514368 - RNA, 64 nt, Homo Sapiens; identical to SEQ ID NO: 444818

SEQ ID NO: 514369 - RNA, 62 nt, Homo Sapiens; identical to SEQ ID NO: 444819

SEQ ID NO: 514370 - RNA, 64 nt, Homo Sapiens; identical to SEQ ID NO: 444820

SEQ ID NO: 514371 - RNA, 64 nt, Homo Sapiens; identical to SEQ ID NO: 444821

SEQ ID NO: 514372 - RNA, 64 nt, Homo Sapiens; identical to SEQ ID NO: 444822

SEQ ID NO: 514373 - RNA, 64 nt, Homo Sapiens; identical to SEQ ID NO: 444823

SEQ ID NO: 514374 - RNA, 64 nt, Homo Sapiens; identical to SEQ ID NO: 444824

SEQ ID NO: 514375 - RNA, 64 nt, Homo Sapiens; identical to SEQ ID NO: 444825

SEQ ID NO: 514376 - RNA, 64 nt, Homo Sapiens; identical to SEQ ID NO: 444826

SEQ ID NO: 514377 - RNA, 64 nt, Homo Sapiens; identical to SEQ ID NO: 444827

SEQ ID NO: 514378 - RNA, 64 nt, Homo Sapiens; identical to SEQ ID NO: 444828

SEQ ID NO: 514379 - RNA, 64 nt, Homo Sapiens; identical to SEQ ID NO: 444829

SEQ ID NO: 514380 - RNA, 64 nt, Homo Sapiens; identical to SEQ ID NO: 444830

SEQ ID NO: 514381 - RNA, 64 nt, Homo Sapiens; identical to SEQ ID NO: 444831

SEQ ID NO: 514382 - RNA, 64 nt, Homo Sapiens; identical to SEQ ID NO: 444832

SEQ ID NO: 514383 - RNA, 64 nt, Homo Sapiens; identical to SEQ ID NO: 444833

SEQ ID NO: 514384 - RNA, 64 nt, Homo Sapiens; identical to SEQ ID NO: 444834

SEQ ID NO: 514385 - RNA, 64 nt, Homo Sapiens; identical to SEQ ID NO: 444835

SEQ ID NO: 514386 - RNA, 64 nt, Homo Sapiens; identical to SEQ ID NO: 444836

SEQ ID NO: 514387 - RNA, 64 nt, Homo Sapiens; identical to SEQ ID NO: 444837

SEQ ID NO: 514388 - RNA, 64 nt, Homo Sapiens; identical to SEQ ID NO: 444838

SEQ ID NO: 514389 - RNA, 64 nt, Homo Sapiens; identical to SEQ ID NO: 444839

SEQ ID NO: 514390 - RNA, 64 nt, Homo Sapiens; identical to SEQ ID NO: 444840

SEQ ID NO: 514391 - RNA, 64 nt, Homo Sapiens; identical to SEQ ID NO: 444841

SEQ ID NO: 514392 - RNA, 64 nt, Homo Sapiens; identical to SEQ ID NO: 444842

SEQ ID NO: 514393 - RNA, 64 nt, Homo Sapiens; identical to SEQ ID NO: 444843

SEQ ID NO: 514394 - RNA, 64 nt, Homo Sapiens; identical to SEQ ID NO: 444844

SEQ ID NO: 514395 - RNA, 64 nt, Homo Sapiens; identical to SEQ ID NO: 444845

SEQ ID NO: 514396 - RNA, 64 nt, Homo Sapiens; identical to SEQ ID NO: 444846

SEQ ID NO: 514397 - RNA, 64 nt, Homo Sapiens; identical to SEQ ID NO: 444847

SEQ ID NO: 514398 - RNA, 64 nt, Homo Sapiens; identical to SEQ ID NO: 444848

SEQ ID NO: 514399 - RNA, 64 nt, Homo Sapiens; identical to SEQ ID NO: 444849

SEQ ID NO: 514400 - RNA, 64 nt, Homo Sapiens; identical to SEQ ID NO: 444850

SEQ ID NO: 514401 - RNA, 64 nt, Homo Sapiens; identical to SEQ ID NO: 444851

SEQ ID NO: 514402 - RNA, 64 nt, Homo Sapiens; identical to SEQ ID NO: 444852

SEQ ID NO: 514403 - RNA, 64 nt, Homo Sapiens
uaggugaaugucccuaaguguuuacuguuuuuauccagucaaggauuugcuuuuccuugaacau

SEQ ID NO: 514404 - RNA, 64 nt, Homo Sapiens
gagcuuugguuuucuaauguauuauccccacuugccagucaacuggaccccuuccuccucgguu

SEQ ID NO: 514405 - RNA, 64 nt, Homo Sapiens
ggacugucguggcuccccucaucagcuccccacaccagucaaggcuucucagcuggagaaccgg

SEQ ID NO: 514406 - RNA, 64 nt, Homo Sapiens
aucagagaagaggaaguaaaggacaaucagaacaccagucaaacccaccaaauugcuuuauucc

SEQ ID NO: 514407 - RNA, 64 nt, Homo Sapiens
caacuuaagcuugacuugggguuuguagcgggacccagucaaaccccauucaggucaugguaga

SEQ ID NO: 514408 - RNA, 64 nt, Homo Sapiens
uauggggaaaagagaauuugggguguucugcaagccagucaaaguggcacagcaaaucauauaa

SEQ ID NO: 514409 - RNA, 64 nt, Homo Sapiens
ugguugcucugaaaguaaccauuuacucucaguuccagucaagcagauuggucauacauuccca

SEQ ID NO: 514410 - RNA, 64 nt, Homo Sapiens
gcaaucaaagcagcacauggcuugauuuuaaaaaccagucaagauuuucugauucaaaagugaa

SEQ ID NO: 514411 - RNA, 64 nt, Homo Sapiens
agagugaggaaauuguccuguagucuauugaaaaccagucaaggugguuuuaguucauagauuu

SEQ ID NO: 514412 - RNA, 64 nt, Homo Sapiens
cucguucaucccuggugcuugagccccucaagcuccagucaaugauccaguccuuccccuuuga

SEQ ID NO: 514413 - RNA, 64 nt, Homo Sapiens
uacuuaacuuuacauuccucuuauuuuucaguuuccagucaagauuauaaaaagcaaaugauug

SEQ ID NO: 514414 - RNA, 64 nt, Homo Sapiens
gccugagauauuuuucuacagcuucauagagcaaccagucaaaaccagagcgagaacccucaac

SEQ ID NO: 514415 - RNA, 64 nt, Homo Sapiens
aggaauauuacagcuguaaauuauaugagacuugccagucaaaugcuauuugguuuaaaaaaau

SEQ ID NO: 514416 - RNA, 64 nt, Homo Sapiens
caauggcauuuaauaaauuucacuuuugcugguuccagucaaauggauucaucaauaucaugag

SEQ ID NO: 514417 - RNA, 64 nt, Homo Sapiens
gguaccucguucuuauccuucaagaaaauaccugccagucaacaccgugacaacugccauguca

SEQ ID NO: 514418 - RNA, 64 nt, Homo Sapiens
auggaagagcucacucuauauucuuacaggccuuccagucaauauauccuugaggucauccaua

SEQ ID NO: 514419 - RNA, 64 nt, Homo Sapiens
auaaaaugcacaccaaaaugauauggauaugauuccagucaaaauacuuucacaauuucccuuc

SEQ ID NO: 514420 - RNA, 64 nt, Homo Sapiens
ggcuucaugagaacaguagaaaugaauauguuugccagucaaauguguuuucuuuugaaacugu

SEQ ID NO: 514421 - RNA, 64 nt, Homo Sapiens
uggcuccagagauggucacaugacccaggccuggccagucaaaguagucucuccccuggccaca

SEQ ID NO: 514422 - RNA, 64 nt, Homo Sapiens
ccucuuugaacacucaagauugcauggcaaagacccagucaaaaugauuuaccccugguuaagu

SEQ ID NO: 514423 - RNA, 64 nt, Homo Sapiens
ugguggugguuaaugcuuuguuagauagcuucauccagucaauaguugaaaaguuuucacauaa

SEQ ID NO: 514424 - RNA, 64 nt, Homo Sapiens
uaagcuuuccauuuccuagguaauuuuuuaaaagccagucaaaacaaaaacuuuacugaaaaug

SEQ ID NO: 514425 - RNA, 64 nt, Homo Sapiens
gguuucuuuuguacacauuacuuaaacuuucuuuccagucaacaauauauuguggauuuauuuu

SEQ ID NO: 514426 - RNA, 64 nt, Homo Sapiens
aagggagccaucuuggaagcagauccuccagccuccagucaagucuucagauaauugcaacuuc

SEQ ID NO: 514427 - RNA, 64 nt, Homo Sapiens
acuugaaaaauauuucuuaauuuuuguuuuugcuccagucaauuccugauuauccacaggucaa

SEQ ID NO: 514428 - RNA, 64 nt, Homo Sapiens
auauggagacuucuuuuguguuuacaucagaaaaccagucaaucauuuuugagaaguugcuucu

SEQ ID NO: 514429 - RNA, 64 nt, Homo Sapiens
agggagucccgccacuuccaugguucaaagaugaccagucaaucacccagaccccgagguuguc

SEQ ID NO: 514430 - RNA, 64 nt, Homo Sapiens
ucucugagcaacuuagagacggccagggccacagccagucaagaagacuaucaggaaaggagcu

SEQ ID NO: 514431 - RNA, 64 nt, Homo Sapiens
ccugaaauuuuaaaaaaguuguguaauacgccaaccagucaaguuguguuuuggccagagauuu

SEQ ID NO: 514432 - RNA, 64 nt, Homo Sapiens
ugccaguguaaugaaacugcccuuauuuuaaaagccagucaaagauuccacugauugacauuug

SEQ ID NO: 514433 - RNA, 64 nt, Homo Sapiens
ggaguauugcggcugcacgucucucugccucgaaccagucaaauucuauggaauaaagcgucgc

SEQ ID NO: 514434 - RNA, 64 nt, Homo Sapiens
gcauuuacacuauuucugcuuguuugcauagcaaccagucaagauggacuaguccucauuagca

SEQ ID NO: 514435 - RNA, 64 nt, Homo Sapiens
guuuagagauuaauuuuuacccccuaaggaauauccagucaaagacgcugagugggagcuguca

SEQ ID NO: 514436 - RNA, 64 nt, Homo Sapiens
aaugucgaacucugaaacaaaaguauuuaacgacccagucaaugaaaacugaaucaagaaauga

SEQ ID NO: 514437 - RNA, 64 nt, Homo Sapiens
auggcuugaugugaagacagcaaggaaagaagcaccagucaaguugugaacaagcaccaaauua

SEQ ID NO: 514438 - RNA, 64 nt, Homo Sapiens
ccaauacuuucuuuucuuuaacugcuauauuaucccagucaaaagauagguuaaugacaauugu

SEQ ID NO: 514439 - RNA, 64 nt, Homo Sapiens
acauagcaguguuccauagauuaggcagaaauggccagucaaaccagaaagauuuguagugaca

SEQ ID NO: 514440 - RNA, 64 nt, Homo Sapiens
guauuuucugcugaaaucugcuuuuuaaaagaacccagucaaauuagaugugagaaugguggaa

SEQ ID NO: 514441 - RNA, 64 nt, Homo Sapiens
gugaggguguggccuucacccccuacagccauccccagucaaggccccuuuugagcugccaguu

SEQ ID NO: 514442 - RNA, 64 nt, Homo Sapiens
auccaggcauagggaacuaguuguuucauagcucccagucaaaaagaaagugagagaagcuguu

SEQ ID NO: 514443 - RNA, 64 nt, Homo Sapiens
cucuaguguaccuuccuccucuuacucauccaucccagucaacaugauguugucaaugaaauaa

SEQ ID NO: 514444 - RNA, 64 nt, Homo Sapiens
ccugcaaggagagaaaugcaaccauacaugggcuccagucaacuaugggacugaagguccuaau

SEQ ID NO: 514445 - RNA, 64 nt, Homo Sapiens
ccuuuguggucugcauguuucuugguaagggugcccagucaagugucucugggagcccccucuu

SEQ ID NO: 514446 - RNA, 64 nt, Homo Sapiens
aggagauaaauuugaaaacagauaaauguaacaaccagucaaagaagcaggggaaaaguaagcu

SEQ ID NO: 514447 - RNA, 64 nt, Homo Sapiens
aguuuacgccugauagguaaacaaaucauacuccccagucaagacuucccugacagucccacua

SEQ ID NO: 514448 - RNA, 64 nt, Homo Sapiens
gaaggacuagaauacagcagcuguuauaacacgaccagucaauguggaacaaacuguuucugug

SEQ ID NO: 514449 - RNA, 64 nt, Homo Sapiens
acgccuaagaucauuuugcuagaccucagaaaaaccagucaauuuuuucuugcccaguguggca

SEQ ID NO: 514450 - RNA, 64 nt, Homo Sapiens
ccucugucugaaaugagucggcugccuuccugacccagucaaggucugaugcccaaucagcacg

SEQ ID NO: 514451 - RNA, 64 nt, Homo Sapiens
acaaauaagaucauccuggugaaaagugcgaugcccagucaaucaaaaaaaaagaauaaagaaa

SEQ ID NO: 514452 - RNA, 64 nt, Homo Sapiens
auauuugugcauuacauuucccucugggauuuuaccagucaaacugcugcacuuuauuaccaag

SEQ ID NO: 514453 - RNA, 64 nt, Homo Sapiens
gcaagcuggaguuaauaaucccaaggucucaugaccagucaaggaaugagcauagguagcuugu

SEQ ID NO: 514454 - RNA, 64 nt, Homo Sapiens
uccuauucuaacaugcugucguuauuucagugucccagucaaaucucaccuuguucuaaaauag

SEQ ID NO: 514455 - RNA, 64 nt, Homo Sapiens
uguuucccuauuccucuccuuagaacuuucauagccagucaagcauagaauugcauccauucuu

SEQ ID NO: 514456 - RNA, 64 nt, Homo Sapiens
aacuuguguagcugcagaauaaccaaguggcuauccagucaaguaaauacaguuugcuuacaua

SEQ ID NO: 514457 - RNA, 64 nt, Homo Sapiens
ccacccaggagucugaaggcuaaggcuguugcugccagucaaggucuccagcuccaauacuuau

SEQ ID NO: 514458 - RNA, 64 nt, Homo Sapiens
ucuuaggggagcagaagaaaagcccacccacauaccagucaagcccagagggguguuggagccc

SEQ ID NO: 514459 - RNA, 64 nt, Homo Sapiens
gcuccucugcuccucgcuugcacauccccgucccccagucaagaucugaggcccuggggauccu

SEQ ID NO: 514460 - RNA, 64 nt, Homo Sapiens
uggccuucaaaauuucagcaucauugucuauauuccagucaagcauccugugccaggcucccuu

SEQ ID NO: 514461 - RNA, 64 nt, Homo Sapiens
acuuuuuaccccugaaauuuaaaaaggugaaguuccagucaaccauuuuaacauuguuugguua

SEQ ID NO: 514462 - RNA, 64 nt, Homo Sapiens
ccuacuauguaccaggcaccccuuuguccucaauccagucaacacccuuugaaaauucuauuuu

SEQ ID NO: 514463 - RNA, 64 nt, Homo Sapiens
ugccaacaggguccuuuuaggcagaacccagaaaccagucaaaucuguagagaagcagugugac

SEQ ID NO: 514464 - RNA, 64 nt, Homo Sapiens
uauuuuggggggacagugccaaguccaucuuugcccagucaauucagugauugauagcaauuua

SEQ ID NO: 514465 - RNA, 64 nt, Homo Sapiens
uugucugcuaccuuuuaugaaggagaaagagauuccagucaaaaacucuaacauacuuuagagg

SEQ ID NO: 514466 - RNA, 64 nt, Homo Sapiens
aaagaaccuaauagcaccaacuacuaaguucaguccagucaagacuuuuuguauuugagagaau

SEQ ID NO: 514467 - RNA, 64 nt, Homo Sapiens
uuuuuucuuuuucuagaacucucccacccuucucccagucaacuuaaaugacgcaccauccucc

SEQ ID NO: 514468 - RNA, 64 nt, Homo Sapiens
aacuauuucuuauauaugugggaaacugaaugcuccagucaacaagaagaugaauacaaacaau

SEQ ID NO: 514469 - RNA, 64 nt, Homo Sapiens
gucacuacaacugauuaguugcaagaagggaguuccagucaagaauucauguaccugugaucca

SEQ ID NO: 514470 - RNA, 64 nt, Homo Sapiens
ucguggauguagugauuaaauauuccuagucuuuccagucaacaucuagaguuaucuucuuuau

SEQ ID NO: 514471 - RNA, 64 nt, Homo Sapiens
ucccuccugcagccugaccccagcaucucagaguccagucaaguagagucauuaagcgggaucc

SEQ ID NO: 514472 - RNA, 64 nt, Homo Sapiens; identical to SEQ ID NO: 514471

SEQ ID NO: 514473 - RNA, 64 nt, Homo Sapiens
cuucccccuuccccugagacugguggacugaacuccagucaaguugaguucaagugaaagauuc

SEQ ID NO: 514474 - RNA, 64 nt, Homo Sapiens
uagcuuuaaugcauggaaaaacuucaguuacugaccagucaagagaauuucucaagaaaaaucc

SEQ ID NO: 514475 - RNA, 64 nt, Homo Sapiens
gucaggagauucacagcaacugaucaaagggaguccagucaacgugagcaagcgugauuaugau

SEQ ID NO: 514476 - RNA, 64 nt, Homo Sapiens
ucugaguaguggccacuggggugccuucacugggccagucaacggggggcuccugcccaggcca

SEQ ID NO: 514477 - RNA, 64 nt, Homo Sapiens
cagugagcuguguccucguccccccacccccuucccagucaaggugguggccugggccgcucca

SEQ ID NO: 514478 - RNA, 64 nt, Homo Sapiens
ccugcauaugcagaaugacgagugagcucugcugccagucaaggacugacguacccaucaggac

SEQ ID NO: 514479 - RNA, 64 nt, Homo Sapiens
gaccuuuuuacaaaagaaauguugugaggaaaagccagucaaauuuuguacugcauggguggca

SEQ ID NO: 514480 - RNA, 64 nt, Homo Sapiens
guuucuuuucccuuuuuaccucccccugcccccgccagucaaaggggauuuuuuuuuuuuguau

SEQ ID NO: 514481 - RNA, 64 nt, Homo Sapiens
gugcuucccaaaguggguggucaauugaguacuuccagucaacaggcuuucuucaaugggaugu

SEQ ID NO: 514482 - RNA, 64 nt, Homo Sapiens
uuuacaaagcauccuaaagacucuguuauuguuuccagucaauaaagauucuguggugugacau

SEQ ID NO: 514483 - RNA, 64 nt, Homo Sapiens
guccugucauccauauggugccuggaaauauuuaccagucaaggucaaggucagcaucuguggu

SEQ ID NO: 514484 - RNA, 64 nt, Homo Sapiens
aacugcaucaagacuucaauccugauuagugucuccagucaagcucuggguacugaauugccug

SEQ ID NO: 514485 - RNA, 64 nt, Homo Sapiens
ugggcaaagccuagugaaggugggggugccaggaccagucaaccgagccaccaagagggacgcc

SEQ ID NO: 514486 - RNA, 64 nt, Homo Sapiens
uguuaguucucucucucuaccugcuacuuaguugccagucaaaauaagaaauaaagggaagugu

SEQ ID NO: 514487 - RNA, 64 nt, Homo Sapiens
ccuccagaggaaucuguuugcuuccugauuagauccagucaauguuuuaaagguauugucagag

SEQ ID NO: 514488 - RNA, 64 nt, Homo Sapiens
acuauauauaacuuccuaugcaaauauuuuaccaccagucaauaauacauuuuugccaagacau

SEQ ID NO: 514489 - RNA, 64 nt, Homo Sapiens
ggcaguggaggugggguguuugggaggcugcgugccagucaagaagaaaaagguuugcauucuc

SEQ ID NO: 514490 - RNA, 64 nt, Homo Sapiens
gagcauugcaucccaugagguaaaaagcagaggcccagucaaauugucaugaaaccacuuauuu

SEQ ID NO: 514491 - RNA, 64 nt, Homo Sapiens
auuccucaacugaaaguuuaagaaauaaaaaauuccagucaauuaccugggauaacuacuuuaa

SEQ ID NO: 514492 - RNA, 64 nt, Homo Sapiens
uugguuacuaaauagaaaaccucauauuuucuguccagucaaugcaucuauuuggaacccaagc

SEQ ID NO: 514493 - RNA, 64 nt, Homo Sapiens
guuguccuucuggaaauauaguuuggucuuaauaccagucaaccgaugauauucugauggacug

SEQ ID NO: 514494 - RNA, 64 nt, Homo Sapiens
acugaccacaucugccucugauuuaguuccuuccccagucaacacucuauuuggcucauuuuau

SEQ ID NO: 514495 - RNA, 64 nt, Homo Sapiens
agggcaggaacuugcacaaaaucacacagccaagccagucaaggauggaugcagauccagaggu

SEQ ID NO: 514496 - RNA, 64 nt, Homo Sapiens
ggaaaccacguguucugguuuccaugaugcccauccagucaaucucauggaggguggaguaugg

SEQ ID NO: 514497 - RNA, 64 nt, Homo Sapiens
guaucagagccuuagggugcccccauccccuuccccagucaacuguggcaccuguaaccucccg

SEQ ID NO: 514498 - RNA, 64 nt, Homo Sapiens
ggugauucuggaaguauuggcuauagcggugggcccagucaacucuuccuuguggacuuacgac

SEQ ID NO: 514499 - RNA, 64 nt, Homo Sapiens
aaguuaugcuuuauucacuuccuaccagccaaucccagucaaagcaucauuaaguccugucauc

SEQ ID NO: 514500 - RNA, 64 nt, Homo Sapiens
ccuagauuucaaaaaccuuuugguuugaggcaccccagucaacuuuaccaggguuuuuacuguu

SEQ ID NO: 514501 - RNA, 64 nt, Homo Sapiens
aaagaguuugaaaugucauuuugggaaaagagagccagucaagcuaguaggcugauugugaaga

SEQ ID NO: 514502 - RNA, 64 nt, Homo Sapiens
agaaaucuugaguaaucagaacaguggaaugugaccagucaagugagugaucuaugcugaauaa

SEQ ID NO: 514503 - RNA, 64 nt, Homo Sapiens
ugaggcuggucauaccuccaggaacaauacagagccagucaacuuccuggaauccaagaccaga

SEQ ID NO: 514504 - RNA, 64 nt, Homo Sapiens
auuugauggugguauugugaccacugaauucacuccagucaacagauucagaaugagaauggac

SEQ ID NO: 514505 - RNA, 64 nt, Homo Sapiens
accuugcugauaaaacagauugugauaagaaaagccagucaaaacccaccaaaaccaagauggc

SEQ ID NO: 514506 - RNA, 64 nt, Homo Sapiens
caaggcuaagugcuuugugaucuuaaagguauuuccagucaaggaauuguugcuauugucagca

SEQ ID NO: 514507 - RNA, 64 nt, Homo Sapiens
ucuacagcuaguaaaaugcugaaagauaaguagaccagucaagggaugaaaaaccuaaugcaua

SEQ ID NO: 514508 - RNA, 64 nt, Homo Sapiens
uucagaauauuuccaucaccauguaaccaacacuccagucaagcuuugauaaauugauauaccc

SEQ ID NO: 514509 - RNA, 64 nt, Homo Sapiens
caccgccaccuguaggcuucucaauaaucccagcccagucaaagagugauguaucaguaaugua

SEQ ID NO: 514510 - RNA, 64 nt, Homo Sapiens
ggugagccaggucuagcccaacagucuaaacuauccagucaauaccgagugaaguggcagccag

SEQ ID NO: 514511 - RNA, 64 nt, Homo Sapiens
uugggagccuuggggccagcuggccugcugcucuccagucaaguagcgaagcuccuaccaccca

SEQ ID NO: 514512 - RNA, 64 nt, Homo Sapiens
agaaaaacaggcacaggcucaaaugcaccucauuccagucaagcgggccaucgcaagucacaga

SEQ ID NO: 514513 - RNA, 64 nt, Homo Sapiens
cgagcaggcaaguuccaagucagcccaugauugaccagucaaauaugccagaagaagaauagua

SEQ ID NO: 514514 - RNA, 64 nt, Homo Sapiens
cucacagaaaaaaaccuggcugauuuggauuucuccagucaaaggagccuaggagggaaggcuc

SEQ ID NO: 514515 - RNA, 64 nt, Homo Sapiens
gggacuacuagucccucacuuucccagccauacuccagucaacgauccauugccuuugaugaug

SEQ ID NO: 514516 - RNA, 64 nt, Homo Sapiens
caaccuugaccaaccccagcaauuuuuccaaaagccagucaagggcauuacauuuguuccuggg

SEQ ID NO: 514517 - RNA, 64 nt, Homo Sapiens
augucaacagccagacagggcuccagggcuugucccagucaauacagaguucccucugcugucu

SEQ ID NO: 514518 - RNA, 64 nt, Homo Sapiens
gggaaaaaccauauugccuuguguguugcuuuucccagucaaaagggucugaccuuagaaaguc

SEQ ID NO: 514519 - RNA, 64 nt, Homo Sapiens
aggagauccuggauucuuaauuguuggcuaaguuccagucaaguaggaaucagugcagccugua

SEQ ID NO: 514520 - RNA, 64 nt, Homo Sapiens
uauggaacuaaugcggaggcgcccaucuuagaagccagucaagcgagauucuggaucuugacau

SEQ ID NO: 514521 - RNA, 64 nt, Homo Sapiens
aacuagaaucagcaacgagaaucucaaaccccuuccagucaagguuuucuuccgagcuugucuu

SEQ ID NO: 514522 - RNA, 64 nt, Homo Sapiens
cagaacaccauggaaaaaaccucaacacauggccccagucaagagaagccagugacucccaguu

SEQ ID NO: 514523 - RNA, 64 nt, Homo Sapiens
agaggacacagucccggccugggcugcccccgcuccagucaaugcucacugaaagucugucuua

SEQ ID NO: 514524 - RNA, 64 nt, Homo Sapiens
cccgcacgccgccucacggcccccaugcuucccgccagucaagauggucuguggacuuagggcc

SEQ ID NO: 514525 - RNA, 64 nt, Homo Sapiens
cuccacuuggagggaauuguucuacaaaaucgccccagucaacucgcucugaaucucucugcag

SEQ ID NO: 514526 - RNA, 64 nt, Homo Sapiens
ccaugaagcccaugcggccugguaccugguguccccagucaagcgagucaauguugggaggaag

SEQ ID NO: 514527 - RNA, 64 nt, Homo Sapiens
uccuaguaugcccuguaauuaggaaagagagaccccagucaagcuaagaaugugaugggccaca

SEQ ID NO: 514528 - RNA, 64 nt, Homo Sapiens
aaaaaaagacuucaaucauuugaaaugaaauuggccagucaaaacaacauccaacccaggucau

SEQ ID NO: 514529 - RNA, 64 nt, Homo Sapiens
acaaggcuggcagggugugacauugaaaaccgagccagucaaccaagaagguucugugcugucu

SEQ ID NO: 514530 - RNA, 64 nt, Homo Sapiens
uagucaaaauaaguaaaagaaauauaggaauauuccagucaaucucugaaauguuuaugaaaaa

SEQ ID NO: 514531 - RNA, 64 nt, Homo Sapiens
gaaacaugguggcaacgucucuuuggauguuuuaccagucaaagguccucaggguucuccucuu

SEQ ID NO: 514532 - RNA, 64 nt, Homo Sapiens
gaaagagauaacuauauaacagcuuuuuaacuauccagucaacuuucagcuuuucuacauuuag

SEQ ID NO: 514533 - RNA, 64 nt, Homo Sapiens
aaaagagacuagcauaaggagacuuaacaggaacccagucaaggccauucauggccaugggacc

SEQ ID NO: 514534 - RNA, 64 nt, Homo Sapiens
aucuuuuccagauuauguggagaagaacaaagacccagucaaaggugaagacggauccagacac

SEQ ID NO: 514535 - RNA, 64 nt, Homo Sapiens
cuuuuuuuuuuuuuucuuaacccguucagugcugccagucaaccaagggucugugagugucagc

SEQ ID NO: 514536 - RNA, 64 nt, Homo Sapiens
cuugcaggcuggaagcaccagggaauuaauucccccagucaaccaauggcauccagagagggca

SEQ ID NO: 514537 - RNA, 64 nt, Homo Sapiens
guuuccagaauuucuagagugggugggcaugauuccagucaaugggggaccgcccgugucuaag

SEQ ID NO: 514538 - RNA, 64 nt, Homo Sapiens
uuuuggagggguucacagaauccuggcagcagcuccagucaagaaugucacugguuggcaugau

SEQ ID NO: 514539 - RNA, 64 nt, Homo Sapiens
cccuguagcccccagcuucaggccucagugucugccagucaagcuucacaggcauugugauggg

SEQ ID NO: 514540 - RNA, 64 nt, Homo Sapiens
acaaguguaaugaguguggcaaagccuuuagugaccagucaacacuuaccaucaggccauucau

SEQ ID NO: 514541 - RNA, 64 nt, Homo Sapiens
ugcauuaacguacuuuccccugaaacagagcaacccagucaacaccacagaaccucagcuuuga

SEQ ID NO: 514542 - RNA, 64 nt, Homo Sapiens
aauggcacccagagagggcagggaauuaauucccccagucaaccuuugcaggcuggaagcacca

SEQ ID NO: 514543 - RNA, 64 nt, Homo Sapiens
aaaagccuucaggccccucaccccacccuauggaccagucaaauggcccuguagggggugcacc

SEQ ID NO: 514544 - RNA, 64 nt, Homo Sapiens
cauaaccuucuucuauggguaacauuuuuaucaaccagucaacauucugugagccucugaucca

SEQ ID NO: 514545 - RNA, 62 nt, Homo Sapiens
ucccaccuccagugccaaguucuugugcccauuuccagucaaucuauuaaaccaaaaaguuu

SEQ ID NO: 514546 - RNA, 64 nt, Homo Sapiens
acuucaaauuccuacacuguugugugaccuugauccagucaaccugugugugugugugugugug

SEQ ID NO: 514547 - RNA, 64 nt, Homo Sapiens
acgucuuuauuacccaagucuucucccguccauuccagucaaaucugggcucacucaccccagc

SEQ ID NO: 514548 - RNA, 64 nt, Homo Sapiens
cagaucauuuacauguccuuauuuuccaccucccccagucaaaaugcuuucuaaaucauuuuca

SEQ ID NO: 514549 - RNA, 64 nt, Homo Sapiens
cucauguuaccccagagagacaagaccugagugaccagucaagcguguaugcaggggucaugaa

SEQ ID NO: 514550 - RNA, 64 nt, Homo Sapiens
cggaugcuggccacagaaagggcccgggccuuauccagucaaaguaguucuuaugagcuagcau

SEQ ID NO: 514551 - RNA, 64 nt, Homo Sapiens
uauuaaacagaaauaauguuuuaccaucucuucaccagucaaguugacacguaaaauuaaccau

SEQ ID NO: 514552 - RNA, 64 nt, Homo Sapiens
augacaagguuaaagaaguaagugugugguuaagccagucaauugaaaaaaaaguagaggaaaa

SEQ ID NO: 514553 - RNA, 64 nt, Homo Sapiens
ggaagguugggcuucaaguuaacaggaucagacaccagucaagcagccucaggucaucuugcga

SEQ ID NO: 514554 - RNA, 64 nt, Homo Sapiens
aagcccgccagcuuccugcuccacucagcuccguccagucaaccugaacccacccaguccagcu

SEQ ID NO: 514555 - RNA, 64 nt, Homo Sapiens
guccacagggugccagccucaggaggggaucuggccagucaaggccagccugcagggaggcccc

SEQ ID NO: 514556 - RNA, 64 nt, Homo Sapiens
aauccgccaucuuggcuguagcagccugucuucaccagucaaggaccccugaccaaggugccca

SEQ ID NO: 514557 - RNA, 64 nt, Homo Sapiens
gcucccaacaaggcaucccucuuugagcccuuucccagucaaauucaagaaguagcuccaaagu

SEQ ID NO: 514558 - RNA, 64 nt, Homo Sapiens
gcagugggaucucgauggagcuuuccaccagcugccagucaagguuagacuuacccuccucccu

SEQ ID NO: 514559 - RNA, 64 nt, Homo Sapiens
caguguucucaacuugguuaaggaggaagaaaacccagucaaugaaauucaaugaaauucuugg

SEQ ID NO: 514560 - RNA, 64 nt, Homo Sapiens
gugcuaugguuaugaguguaugugccaguacuuaccagucaaugcauuguggauaugagcuuuc

SEQ ID NO: 514561 - RNA, 64 nt, Homo Sapiens
aacugaaagagaggccuucucauccccaagcucuccagucaacacagggcucccuguggugaca

SEQ ID NO: 514562 - RNA, 64 nt, Homo Sapiens
uugcuacauggggucugggugggggcaaagagacccagucaauuacauguuugguaccaagaaa

SEQ ID NO: 514563 - RNA, 64 nt, Homo Sapiens
uaggaaaaauggaaggugccggggguaaucauggccagucaauaauuauauaaaggaguucaaa

SEQ ID NO: 514564 - RNA, 64 nt, Homo Sapiens
gcacaauacacaacuguauucccccaccaucaggccagucaacuauuccaucccagccagagca

SEQ ID NO: 514565 - RNA, 64 nt, Homo Sapiens
uuaucugguuugauuguauagaacuggcuccuucccagucaagggauagaaaauucaccccucu

SEQ ID NO: 514566 - RNA, 64 nt, Homo Sapiens
uggugaguccucggccuugagguugcugacucucaggcguuaggcagcuggaugacuucccgcu

SEQ ID NO: 514567 - RNA, 64 nt, Homo Sapiens
gucagaagaaaguuggaaacuuuuccuacauauuaggcguuaguaugaggacauuuguuugaau

SEQ ID NO: 514568 - RNA, 64 nt, Homo Sapiens
guuuaugcauucacaaggugacugggauguagagaggcguuagugggcagguggccacagcagg

SEQ ID NO: 514569 - RNA, 64 nt, Homo Sapiens
ccaccugccucggccuccccaaagugcugagauuaggcguuagccaccgcgcccggccagaaau

SEQ ID NO: 514570 - RNA, 64 nt, Homo Sapiens
auaccguuuuuuuguggccugugcugguuuuguuaggcguuagugggucaagaggaaagaaugc

SEQ ID NO: 514571 - RNA, 64 nt, Homo Sapiens
acauuuaugagaauggagucccauucccucuauaaggcguuauucacauccuuucaucagaagc

SEQ ID NO: 514572 - RNA, 64 nt, Homo Sapiens
caugcuuuauuauaaauaaaauucuagcuuugaaaggcguuauguguugaacaguaugcuucag

SEQ ID NO: 514573 - RNA, 64 nt, Homo Sapiens
aaauaauggucaaaagaauaagauucucagguccaggcguuaaauaagccuuuuugagguguag

SEQ ID NO: 514574 - RNA, 64 nt, Homo Sapiens
ugauacaugaagagccaagagcaggaugagguggaggcguuacaacuaccugcucugugugugg

SEQ ID NO: 514575 - RNA, 64 nt, Homo Sapiens
gcauucaacagcaugaauucuguccagcaaaaguaggcguuagaaacuccaagguccagcagag

SEQ ID NO: 514576 - RNA, 64 nt, Homo Sapiens
gggccaccugacagcuggacggggacggaguccaaggcguuauuacagccaguggcacugacaa

SEQ ID NO: 514577 - RNA, 64 nt, Homo Sapiens
cacccgccucggccucccaaagugcugggauuacaggcguuagccacugcgcccggcccgagaa

SEQ ID NO: 514578 - RNA, 64 nt, Homo Sapiens
cagcaagugucaucuacaucaacuaacagcaaaaaggcguuaaacacuucguacuucuguauag

SEQ ID NO: 514579 - RNA, 64 nt, Homo Sapiens
aaacagaugcuguucccgcgcagggcucugacgaaggcguuaagcacaaacuguuucugcaucc

SEQ ID NO: 514580 - RNA, 64 nt, Homo Sapiens
uguggaguccagagugcugccaggacccaggcacaggcguuagcucccguaggagaaaaugggg

SEQ ID NO: 514581 - RNA, 64 nt, Homo Sapiens
uggaaucauaucauaaguauucuaaguagaauccaggcguuagucuccccucagucugaucuug

SEQ ID NO: 514582 - RNA, 64 nt, Homo Sapiens
cuggauauggaggaacaagcaaucuuauuuuggaaggcguuaaaaaauuaucugacaguuacau

SEQ ID NO: 514583 - RNA, 64 nt, Homo Sapiens
uaauacaauuucugcuauaauuuuuguaugcaguaggcguuacuaauaaacauuucugcuguga

SEQ ID NO: 514584 - RNA, 64 nt, Homo Sapiens
ugaucaguucccacucugacaacuggcaaauaccaggcguuaucauccuguaugcauuaacgua

SEQ ID NO: 514585 - RNA, 64 nt, Homo Sapiens
uuguaaaucauucuacuuuugcacuuugaaagaaaggcguuaaucauaaagaagcaagaauggu

SEQ ID NO: 514586 - RNA, 64 nt, Homo Sapiens
gcacucuugaccccgucagcguccaacguggaaaaggcguuaccucuucucccagcgcuggccg

SEQ ID NO: 514587 - RNA, 64 nt, Homo Sapiens
cuuagaagcuaacuucccugagacugcauggcucaggcguuaauaauggacauaaaaagucaua

SEQ ID NO: 514588 - RNA, 64 nt, Homo Sapiens
gcuguguugggggcagcuugugccuggggagcugaggcguuacccugcggggugggggcaucgc

SEQ ID NO: 514589 - RNA, 64 nt, Homo Sapiens
uuuccuacuuauaaaguagauuugagcuuauuuagaguccuaguugagcugggugggugucugu

SEQ ID NO: 514590 - RNA, 64 nt, Homo Sapiens
caaauuccuauuuuuaaauauuccagggauuuuugaguccuauuuacucauuucuuaugaaucu

SEQ ID NO: 514591 - RNA, 64 nt, Homo Sapiens
guucacaucuuguuuccuauccaucaaacucauugaguccuaugcuaaguauuaauuauugcca

SEQ ID NO: 514592 - RNA, 64 nt, Homo Sapiens
uauuaauuauugccaccaucuugauuagauuauagaguccuaaguugauuguacuuaaucuaau

SEQ ID NO: 514593 - RNA, 62 nt, Homo Sapiens
cccccacucugccgugcucacacagacacacccagcugcacacaugaggcaucccacaugac

SEQ ID NO: 514594 - RNA, 62 nt, Homo Sapiens
auggggcugggcugagccagggaggaaggacccagcugcaccuaggagacaccuuuguucuu

SEQ ID NO: 514595 - RNA, 62 nt, Homo Sapiens
ugcguagcccacagagggcccaggccccugcccagcugcagucucccagccuccacuuucag

SEQ ID NO: 514596 - RNA, 62 nt, Homo Sapiens
cccaguuuguguguuugagcucugcauucaggcagcugcaacauuccaguguuugaacuguc

SEQ ID NO: 514597 - RNA, 62 nt, Homo Sapiens
uucugugcucuccaguuuguuuagaaauuggacagcugcaugacugucacagcagagucacc

SEQ ID NO: 514598 - RNA, 62 nt, Homo Sapiens
ggacagacgccaaucacugucaggggccugcgcagcugcaggcguuggcacaccagcucaga

SEQ ID NO: 514599 - RNA, 54 nt, Homo Sapiens; identical to SEQ ID NO: 333546

SEQ ID NO: 514600 - RNA, 62 nt, Homo Sapiens
augacuacagccugaagggcccaggucagcugcagcugcaaaggaagacaggaacuaaaccu

SEQ ID NO: 514601 - RNA, 60 nt, Homo Sapiens; identical to SEQ ID NO: 333548

SEQ ID NO: 514602 - RNA, 62 nt, Homo Sapiens
uggggucgccguaccaggggcccuggcagggucagcugcaagaacaucaaaccagagugccc

SEQ ID NO: 514603 - RNA, 62 nt, Homo Sapiens
cucgguugucucugcggcuccuuagggcagaacagcugcauguggcacuugugacacucacu

SEQ ID NO: 514604 - RNA, 62 nt, Homo Sapiens
uugcugguccaucuggggcccugcugagagcucagcugcaagacugaaucagccuggaaugg

SEQ ID NO: 514605 - RNA, 62 nt, Homo Sapiens
ccucagcuagaguccaagacagagcaaaggcccagcugcagcgguuagaggguggggaggug

SEQ ID NO: 514606 - RNA, 62 nt, Homo Sapiens
aggaauggugucccaaguuggaggcuuugugucagcugcaaauccuaccaguuauguccaag

SEQ ID NO: 514607 - RNA, 62 nt, Homo Sapiens
cucugcuuccagcuuuguguaauucucuuugccagcugcacaaagcugauuuuuuccaaagu

SEQ ID NO: 514608 - RNA, 62 nt, Homo Sapiens
cacagggcgggugggucagcguugacucuuuccagcugcacacucauaugccgugugucuua

SEQ ID NO: 514609 - RNA, 62 nt, Homo Sapiens
ggcccacucagcggcccacauuggccagcauucagcugcacgugugugcugcgugcuucaca

SEQ ID NO: 514610 - RNA, 62 nt, Homo Sapiens
ugagccacuaccugggcaucagucuggaucugcagcugcaguuggagcagcuccgagggagg

SEQ ID NO: 514611 - RNA, 62 nt, Homo Sapiens
gcuguggacuggacccaggagccccggcggcgcagcugcaagguugccaggacccacccuca

SEQ ID NO: 514612 - RNA, 62 nt, Homo Sapiens
ugcugcccaacaugagcagugaucuccaaggccagcugcagggccugcucguacacuugcuc

SEQ ID NO: 514613 - RNA, 62 nt, Homo Sapiens
cuccacucgacacagccugcgguuugcagugccagcugcacguuggagucuccugggaagcu

SEQ ID NO: 514614 - RNA, 62 nt, Homo Sapiens
gacggccggcugccccgcaccaucccucuccccagcugcaaacugagugugccggacccuga

SEQ ID NO: 514615 - RNA, 62 nt, Homo Sapiens
cucuccugccacacagacccgcuggaccaaagcagcugcagccgccuccucguuccucuccu

SEQ ID NO: 514616 - RNA, 62 nt, Homo Sapiens
gaggacgggacccugagccugugugugucgggcagcugcaggguaggcguguguggacauug

SEQ ID NO: 514617 - RNA, 62 nt, Homo Sapiens
gcuaaucuguggccagggugcuggcaugguggcagcugcaaauguccaugcacccagguggc

SEQ ID NO: 514618 - RNA, 62 nt, Homo Sapiens
ccuccccuuagugaccccaagucuguuucccucagcugcauaaggaggcgauauaguuugaa

SEQ ID NO: 514619 - RNA, 62 nt, Homo Sapiens
aggggggagcugaaaggaauuggaaggagaaacagcugcaggugggccugccuggggaaagg

SEQ ID NO: 514620 - RNA, 62 nt, Homo Sapiens
uucaugccggcagcauuuugucuagagucuuccagcugcauccugccuccuaaugcuagguu

SEQ ID NO: 514621 - RNA, 62 nt, Homo Sapiens
ccucgcaaggguggagugggccugucaaaaagcagcugcaaggggucuaccucagagcucuc

SEQ ID NO: 514622 - RNA, 62 nt, Homo Sapiens
gagcccccuuucugaugaugcuucgggcugagcagcugcaggcuucaaaagugugagcccug

SEQ ID NO: 514623 - RNA, 62 nt, Homo Sapiens
guugcauugggcuucuuggcauaaaaggagcucagcugcagcaguccuugcuucccucagaa

SEQ ID NO: 514624 - RNA, 62 nt, Homo Sapiens
agguuaagagacucuuccagccuaaugagucccagcugcauuguggucaagagccgucugag

SEQ ID NO: 514625 - RNA, 62 nt, Homo Sapiens
agcaguuccgggagcggaugcuccggcagaagcagcugcagcaggccacgcaccagcggaag

SEQ ID NO: 514626 - RNA, 62 nt, Homo Sapiens
aggugaccuccccuuccagacugggacacccacagcugcagcgcugccgaccgaacauggcc

SEQ ID NO: 514627 - RNA, 62 nt, Homo Sapiens
ucugcaccaggccggucccuagaggggaacaucagcugcagcggcagaggguggggcugcac

SEQ ID NO: 514628 - RNA, 62 nt, Homo Sapiens
ggcccagggagagguaaccugcuaugccauggcagcugcagagcuuugggaggauuucucag

SEQ ID NO: 514629 - RNA, 62 nt, Homo Sapiens
accguguaaaugagcuccagacggugcggauccagcugcaagucaggugggaagaggaguac

SEQ ID NO: 514630 - RNA, 62 nt, Homo Sapiens
cccuugcucucagcugccaaacauucccccaccagcugcagcucacauugaccgcaacucac

SEQ ID NO: 514631 - RNA, 62 nt, Homo Sapiens
ccagggaugaagaaagacucgcuugauggugacagcugcaaggaaugaacccaagagcaagg

SEQ ID NO: 514632 - RNA, 62 nt, Homo Sapiens
ccucacugaagaagcagauugccaagugccagcagcugcagcaagaauacagccgcaaggag

SEQ ID NO: 514633 - RNA, 62 nt, Homo Sapiens
uggaggaucugauuggcaagcuuaccagucuucagcugcaacaccuguuuaugauccuggcc

SEQ ID NO: 514634 - RNA, 62 nt, Homo Sapiens
cauuucugcaggaggagcagcuggcucagcugcagcugcagauagaaauucuacugcacugc

SEQ ID NO: 514635 - RNA, 62 nt, Homo Sapiens
ugcagacauuucugcaggagcacugccuggcucagcugcagcucuuucuagaaauucuacug

SEQ ID NO: 514636 - RNA, 62 nt, Homo Sapiens
cugcuuagggacuucugugugagaggcuggcccagcugcagagggcugcucugcacccacgg

SEQ ID NO: 514637 - RNA, 62 nt, Homo Sapiens
aacugcagauacugcgggcuuaccaagccacacagcugcagccucagugccugagacuuuuc

SEQ ID NO: 514638 - RNA, 62 nt, Homo Sapiens
ggcuucgugagcaccccaccuaccuucugcgacagcugcagugaggucaccuuccgaaagcc

SEQ ID NO: 514639 - RNA, 62 nt, Homo Sapiens
auuucaacacgcugauggcacacaggcuccaccagcugcagaggacaaguucauucacgugg

SEQ ID NO: 514640 - RNA, 62 nt, Homo Sapiens
acaugaaguguaccuuuucuaaagacgguuuccagcugcaacggcuccacuuugcaggcuug

SEQ ID NO: 514641 - RNA, 62 nt, Homo Sapiens
acgugcuucuuauuccuggcaggcuucaagaacagcugcacaugugccgcuaacugaccgcg

SEQ ID NO: 514642 - RNA, 62 nt, Homo Sapiens
cucccuggcucaagugggcacaggugucugagcagcugcaugcuccccugcuagucaccuac

SEQ ID NO: 514643 - RNA, 62 nt, Homo Sapiens
uugcuugugagaaauggggacaucuggcaccacagcugcaucaaagaugagaaaagccaccc

SEQ ID NO: 514644 - RNA, 64 nt, Homo Sapiens; identical to SEQ ID NO: 511888

SEQ ID NO: 514645 - RNA, 64 nt, Homo Sapiens; identical to SEQ ID NO: 511889

SEQ ID NO: 514646 - RNA, 64 nt, Homo Sapiens; identical to SEQ ID NO: 511890

SEQ ID NO: 514647 - RNA, 64 nt, Homo Sapiens; identical to SEQ ID NO: 511891

SEQ ID NO: 514648 - RNA, 64 nt, Homo Sapiens; identical to SEQ ID NO: 511892

SEQ ID NO: 514649 - RNA, 64 nt, Homo Sapiens; identical to SEQ ID NO: 511893

SEQ ID NO: 514650 - RNA, 64 nt, Homo Sapiens; identical to SEQ ID NO: 511894

SEQ ID NO: 514651 - RNA, 64 nt, Homo Sapiens; identical to SEQ ID NO: 511895

SEQ ID NO: 514652 - RNA, 64 nt, Homo Sapiens; identical to SEQ ID NO: 511896

SEQ ID NO: 514653 - RNA, 64 nt, Homo Sapiens; identical to SEQ ID NO: 511897

SEQ ID NO: 514654 - RNA, 64 nt, Homo Sapiens; identical to SEQ ID NO: 511898

SEQ ID NO: 514655 - RNA, 64 nt, Homo Sapiens; identical to SEQ ID NO: 511899

SEQ ID NO: 514656 - RNA, 64 nt, Homo Sapiens; identical to SEQ ID NO: 511900

SEQ ID NO: 514657 - RNA, 64 nt, Homo Sapiens; identical to SEQ ID NO: 511901

SEQ ID NO: 514658 - RNA, 64 nt, Homo Sapiens; identical to SEQ ID NO: 511902

SEQ ID NO: 514659 - RNA, 64 nt, Homo Sapiens; identical to SEQ ID NO: 219988

SEQ ID NO: 514660 - RNA, 64 nt, Homo Sapiens; identical to SEQ ID NO: 219989

SEQ ID NO: 514661 - RNA, 64 nt, Homo Sapiens; identical to SEQ ID NO: 219990

SEQ ID NO: 514662 - RNA, 64 nt, Homo Sapiens; identical to SEQ ID NO: 219991

SEQ ID NO: 514663 - RNA, 64 nt, Homo Sapiens; identical to SEQ ID NO: 219992

SEQ ID NO: 514664 - RNA, 64 nt, Homo Sapiens; identical to SEQ ID NO: 219993

SEQ ID NO: 514665 - RNA, 64 nt, Homo Sapiens; identical to SEQ ID NO: 219994

SEQ ID NO: 514666 - RNA, 64 nt, Homo Sapiens; identical to SEQ ID NO: 219995

SEQ ID NO: 514667 - RNA, 64 nt, Homo Sapiens; identical to SEQ ID NO: 219996

SEQ ID NO: 514668 - RNA, 64 nt, Homo Sapiens; identical to SEQ ID NO: 219997

SEQ ID NO: 514669 - RNA, 64 nt, Homo Sapiens; identical to SEQ ID NO: 219998

SEQ ID NO: 514670 - RNA, 64 nt, Homo Sapiens; identical to SEQ ID NO: 219999

SEQ ID NO: 514671 - RNA, 64 nt, Homo Sapiens; identical to SEQ ID NO: 220000

SEQ ID NO: 514672 - RNA, 64 nt, Homo Sapiens; identical to SEQ ID NO: 220001

SEQ ID NO: 514673 - RNA, 64 nt, Homo Sapiens; identical to SEQ ID NO: 220002

SEQ ID NO: 514674 - RNA, 64 nt, Homo Sapiens; identical to SEQ ID NO: 220003

SEQ ID NO: 514675 - RNA, 64 nt, Homo Sapiens; identical to SEQ ID NO: 220004

SEQ ID NO: 514676 - RNA, 64 nt, Homo Sapiens; identical to SEQ ID NO: 220005

SEQ ID NO: 514677 - RNA, 64 nt, Homo Sapiens; identical to SEQ ID NO: 220006

SEQ ID NO: 514678 - RNA, 64 nt, Homo Sapiens; identical to SEQ ID NO: 220007

SEQ ID NO: 514679 - RNA, 64 nt, Homo Sapiens; identical to SEQ ID NO: 220008

SEQ ID NO: 514680 - RNA, 64 nt, Homo Sapiens; identical to SEQ ID NO: 220009

SEQ ID NO: 514681 - RNA, 64 nt, Homo Sapiens; identical to SEQ ID NO: 220010

SEQ ID NO: 514682 - RNA, 64 nt, Homo Sapiens; identical to SEQ ID NO: 220011

SEQ ID NO: 514683 - RNA, 64 nt, Homo Sapiens; identical to SEQ ID NO: 220012

SEQ ID NO: 514684 - RNA, 64 nt, Homo Sapiens; identical to SEQ ID NO: 220013

SEQ ID NO: 514685 - RNA, 64 nt, Homo Sapiens; identical to SEQ ID NO: 220014

SEQ ID NO: 514686 - RNA, 64 nt, Homo Sapiens; identical to SEQ ID NO: 220015

SEQ ID NO: 514687 - RNA, 64 nt, Homo Sapiens; identical to SEQ ID NO: 220016

SEQ ID NO: 514688 - RNA, 64 nt, Homo Sapiens; identical to SEQ ID NO: 220017

SEQ ID NO: 514689 - RNA, 64 nt, Homo Sapiens; identical to SEQ ID NO: 220018

SEQ ID NO: 514690 - RNA, 64 nt, Homo Sapiens; identical to SEQ ID NO: 220019

SEQ ID NO: 514691 - RNA, 64 nt, Homo Sapiens; identical to SEQ ID NO: 433597

SEQ ID NO: 514692 - RNA, 64 nt, Homo Sapiens; identical to SEQ ID NO: 433598

SEQ ID NO: 514693 - RNA, 64 nt, Homo Sapiens; identical to SEQ ID NO: 433599

SEQ ID NO: 514694 - RNA, 64 nt, Homo Sapiens; identical to SEQ ID NO: 433600

SEQ ID NO: 514695 - RNA, 64 nt, Homo Sapiens; identical to SEQ ID NO: 433601

SEQ ID NO: 514696 - RNA, 64 nt, Homo Sapiens; identical to SEQ ID NO: 433602

SEQ ID NO: 514697 - RNA, 64 nt, Homo Sapiens; identical to SEQ ID NO: 433603

SEQ ID NO: 514698 - RNA, 64 nt, Homo Sapiens; identical to SEQ ID NO: 433604

SEQ ID NO: 514699 - RNA, 64 nt, Homo Sapiens; identical to SEQ ID NO: 433605

SEQ ID NO: 514700 - RNA, 64 nt, Homo Sapiens; identical to SEQ ID NO: 433606

SEQ ID NO: 514701 - RNA, 64 nt, Homo Sapiens; identical to SEQ ID NO: 433607

SEQ ID NO: 514702 - RNA, 64 nt, Homo Sapiens; identical to SEQ ID NO: 433608

SEQ ID NO: 514703 - RNA, 64 nt, Homo Sapiens; identical to SEQ ID NO: 433609

SEQ ID NO: 514704 - RNA, 64 nt, Homo Sapiens; identical to SEQ ID NO: 433610

SEQ ID NO: 514705 - RNA, 64 nt, Homo Sapiens; identical to SEQ ID NO: 433611

SEQ ID NO: 514706 - RNA, 64 nt, Homo Sapiens; identical to SEQ ID NO: 433612

SEQ ID NO: 514707 - RNA, 64 nt, Homo Sapiens
cucaggcugcagcuggacagaggggacucugggcuauggacacagggugacggugacaaagaug

SEQ ID NO: 514708 - RNA, 64 nt, Homo Sapiens
uggggaggugucacauggugccccuagcuuuauauauggacauggcaggccgauuugggaacca

SEQ ID NO: 514709 - RNA, 64 nt, Homo Sapiens
auauuauuugcagcaagaaguucauucugugcaauauggacauguuugcaaaccauaccaaggg

SEQ ID NO: 514710 - RNA, 64 nt, Homo Sapiens
cugacugggcuacaauccauuguucuuaguccaauauggacacugccuuaggcaauggucuaua

SEQ ID NO: 514711 - RNA, 64 nt, Homo Sapiens
ugcaucuuaaguacuaaggaacuaaucaagacuguauggacacuucuguuguuucuaaugccgu

SEQ ID NO: 514712 - RNA, 64 nt, Homo Sapiens
auuaagucuuuaaaauuuaguuggacaagauuuauauggacaaaauccguuucccucauauauu

SEQ ID NO: 514713 - RNA, 64 nt, Homo Sapiens
aaagccuucuguguaaauauauacugauaaugccuauggacauuuggguaaaacccuguauaga

SEQ ID NO: 514714 - RNA, 64 nt, Homo Sapiens
gugcuuaauuuggaccaaauuuuauuuagcuuaauauggacacugacacauuuugggggguaua

SEQ ID NO: 514715 - RNA, 64 nt, Homo Sapiens; identical to SEQ ID NO: 290194

SEQ ID NO: 514716 - RNA, 64 nt, Homo Sapiens; identical to SEQ ID NO: 290195

SEQ ID NO: 514717 - RNA, 64 nt, Homo Sapiens; identical to SEQ ID NO: 290196

SEQ ID NO: 514718 - RNA, 64 nt, Homo Sapiens; identical to SEQ ID NO: 290197

SEQ ID NO: 514719 - RNA, 64 nt, Homo Sapiens; identical to SEQ ID NO: 290198

SEQ ID NO: 514720 - RNA, 64 nt, Homo Sapiens; identical to SEQ ID NO: 290199

SEQ ID NO: 514721 - RNA, 64 nt, Homo Sapiens; identical to SEQ ID NO: 290200

SEQ ID NO: 514722 - RNA, 64 nt, Homo Sapiens; identical to SEQ ID NO: 290201

SEQ ID NO: 514723 - RNA, 64 nt, Homo Sapiens; identical to SEQ ID NO: 290202

SEQ ID NO: 514724 - RNA, 64 nt, Homo Sapiens; identical to SEQ ID NO: 290203

SEQ ID NO: 514725 - RNA, 64 nt, Homo Sapiens; identical to SEQ ID NO: 290204

SEQ ID NO: 514726 - RNA, 64 nt, Homo Sapiens; identical to SEQ ID NO: 290205

SEQ ID NO: 514727 - RNA, 64 nt, Homo Sapiens; identical to SEQ ID NO: 290206

SEQ ID NO: 514728 - RNA, 64 nt, Homo Sapiens; identical to SEQ ID NO: 290207

SEQ ID NO: 514729 - RNA, 64 nt, Homo Sapiens; identical to SEQ ID NO: 290208

SEQ ID NO: 514730 - RNA, 64 nt, Homo Sapiens; identical to SEQ ID NO: 290209

SEQ ID NO: 514731 - RNA, 64 nt, Homo Sapiens; identical to SEQ ID NO: 290210

SEQ ID NO: 514732 - RNA, 64 nt, Homo Sapiens; identical to SEQ ID NO: 290211

SEQ ID NO: 514733 - RNA, 64 nt, Homo Sapiens; identical to SEQ ID NO: 290212

SEQ ID NO: 514734 - RNA, 64 nt, Homo Sapiens; identical to SEQ ID NO: 290213

SEQ ID NO: 514735 - RNA, 64 nt, Homo Sapiens; identical to SEQ ID NO: 290214

SEQ ID NO: 514736 - RNA, 64 nt, Homo Sapiens; identical to SEQ ID NO: 290215

SEQ ID NO: 514737 - RNA, 64 nt, Homo Sapiens; identical to SEQ ID NO: 290216

SEQ ID NO: 514738 - RNA, 64 nt, Homo Sapiens; identical to SEQ ID NO: 290217

SEQ ID NO: 514739 - RNA, 64 nt, Homo Sapiens; identical to SEQ ID NO: 290218

SEQ ID NO: 514740 - RNA, 64 nt, Homo Sapiens; identical to SEQ ID NO: 290219

SEQ ID NO: 514741 - RNA, 64 nt, Homo Sapiens; identical to SEQ ID NO: 290220

SEQ ID NO: 514742 - RNA, 64 nt, Homo Sapiens; identical to SEQ ID NO: 290221

SEQ ID NO: 514743 - RNA, 64 nt, Homo Sapiens; identical to SEQ ID NO: 290222

SEQ ID NO: 514744 - RNA, 64 nt, Homo Sapiens; identical to SEQ ID NO: 290223

SEQ ID NO: 514745 - RNA, 64 nt, Homo Sapiens; identical to SEQ ID NO: 290224

SEQ ID NO: 514746 - RNA, 64 nt, Homo Sapiens; identical to SEQ ID NO: 290225

SEQ ID NO: 514747 - RNA, 64 nt, Homo Sapiens; identical to SEQ ID NO: 290226

SEQ ID NO: 514748 - RNA, 64 nt, Homo Sapiens; identical to SEQ ID NO: 290227

SEQ ID NO: 514749 - RNA, 64 nt, Homo Sapiens; identical to SEQ ID NO: 290228

SEQ ID NO: 514750 - RNA, 64 nt, Homo Sapiens; identical to SEQ ID NO: 290229

SEQ ID NO: 514751 - RNA, 64 nt, Homo Sapiens; identical to SEQ ID NO: 283135

SEQ ID NO: 514752 - RNA, 64 nt, Homo Sapiens; identical to SEQ ID NO: 283136

SEQ ID NO: 514753 - RNA, 64 nt, Homo Sapiens; identical to SEQ ID NO: 283137

SEQ ID NO: 514754 - RNA, 64 nt, Homo Sapiens; identical to SEQ ID NO: 283138

SEQ ID NO: 514755 - RNA, 64 nt, Homo Sapiens; identical to SEQ ID NO: 283139

SEQ ID NO: 514756 - RNA, 64 nt, Homo Sapiens; identical to SEQ ID NO: 283140

SEQ ID NO: 514757 - RNA, 64 nt, Homo Sapiens; identical to SEQ ID NO: 283141

SEQ ID NO: 514758 - RNA, 64 nt, Homo Sapiens; identical to SEQ ID NO: 283142

SEQ ID NO: 514759 - RNA, 64 nt, Homo Sapiens; identical to SEQ ID NO: 283143

SEQ ID NO: 514760 - RNA, 64 nt, Homo Sapiens; identical to SEQ ID NO: 283144

SEQ ID NO: 514761 - RNA, 64 nt, Homo Sapiens; identical to SEQ ID NO: 283145

SEQ ID NO: 514762 - RNA, 64 nt, Homo Sapiens; identical to SEQ ID NO: 283146

SEQ ID NO: 514763 - RNA, 64 nt, Homo Sapiens; identical to SEQ ID NO: 283147

SEQ ID NO: 514764 - RNA, 64 nt, Homo Sapiens; identical to SEQ ID NO: 283148

SEQ ID NO: 514765 - RNA, 64 nt, Homo Sapiens; identical to SEQ ID NO: 283149

SEQ ID NO: 514766 - RNA, 64 nt, Homo Sapiens; identical to SEQ ID NO: 283150

SEQ ID NO: 514767 - RNA, 64 nt, Homo Sapiens; identical to SEQ ID NO: 283151

SEQ ID NO: 514768 - RNA, 64 nt, Homo Sapiens; identical to SEQ ID NO: 283152

SEQ ID NO: 514769 - RNA, 64 nt, Homo Sapiens; identical to SEQ ID NO: 283153

SEQ ID NO: 514770 - RNA, 64 nt, Homo Sapiens; identical to SEQ ID NO: 283154

SEQ ID NO: 514771 - RNA, 64 nt, Homo Sapiens; identical to SEQ ID NO: 283155

SEQ ID NO: 514772 - RNA, 64 nt, Homo Sapiens; identical to SEQ ID NO: 283156

SEQ ID NO: 514773 - RNA, 64 nt, Homo Sapiens; identical to SEQ ID NO: 283157

SEQ ID NO: 514774 - RNA, 64 nt, Homo Sapiens; identical to SEQ ID NO: 283158

SEQ ID NO: 514775 - RNA, 64 nt, Homo Sapiens; identical to SEQ ID NO: 283159

SEQ ID NO: 514776 - RNA, 64 nt, Homo Sapiens; identical to SEQ ID NO: 283160

SEQ ID NO: 514777 - RNA, 64 nt, Homo Sapiens; identical to SEQ ID NO: 283161

SEQ ID NO: 514778 - RNA, 64 nt, Homo Sapiens; identical to SEQ ID NO: 283162

SEQ ID NO: 514779 - RNA, 64 nt, Homo Sapiens; identical to SEQ ID NO: 283163

SEQ ID NO: 514780 - RNA, 64 nt, Homo Sapiens; identical to SEQ ID NO: 283164

SEQ ID NO: 514781 - RNA, 64 nt, Homo Sapiens; identical to SEQ ID NO: 283165

SEQ ID NO: 514782 - RNA, 64 nt, Homo Sapiens; identical to SEQ ID NO: 283166

SEQ ID NO: 514783 - RNA, 64 nt, Homo Sapiens; identical to SEQ ID NO: 283167

SEQ ID NO: 514784 - RNA, 64 nt, Homo Sapiens; identical to SEQ ID NO: 157920

SEQ ID NO: 514785 - RNA, 64 nt, Homo Sapiens; identical to SEQ ID NO: 157921

SEQ ID NO: 514786 - RNA, 64 nt, Homo Sapiens; identical to SEQ ID NO: 157922

SEQ ID NO: 514787 - RNA, 64 nt, Homo Sapiens; identical to SEQ ID NO: 157923

SEQ ID NO: 514788 - RNA, 64 nt, Homo Sapiens; identical to SEQ ID NO: 157924

SEQ ID NO: 514789 - RNA, 64 nt, Homo Sapiens; identical to SEQ ID NO: 157925

SEQ ID NO: 514790 - RNA, 64 nt, Homo Sapiens; identical to SEQ ID NO: 157926

SEQ ID NO: 514791 - RNA, 64 nt, Homo Sapiens; identical to SEQ ID NO: 157927

SEQ ID NO: 514792 - RNA, 64 nt, Homo Sapiens; identical to SEQ ID NO: 157928

SEQ ID NO: 514793 - RNA, 64 nt, Homo Sapiens; identical to SEQ ID NO: 157929

SEQ ID NO: 514794 - RNA, 64 nt, Homo Sapiens; identical to SEQ ID NO: 157930

SEQ ID NO: 514795 - RNA, 64 nt, Homo Sapiens; identical to SEQ ID NO: 157931

SEQ ID NO: 514796 - RNA, 64 nt, Homo Sapiens; identical to SEQ ID NO: 157932

SEQ ID NO: 514797 - RNA, 64 nt, Homo Sapiens; identical to SEQ ID NO: 157933

SEQ ID NO: 514798 - RNA, 64 nt, Homo Sapiens; identical to SEQ ID NO: 157934

SEQ ID NO: 514799 - RNA, 64 nt, Homo Sapiens; identical to SEQ ID NO: 157935

SEQ ID NO: 514800 - RNA, 64 nt, Homo Sapiens; identical to SEQ ID NO: 157936

SEQ ID NO: 514801 - RNA, 64 nt, Homo Sapiens; identical to SEQ ID NO: 157937

SEQ ID NO: 514802 - RNA, 64 nt, Homo Sapiens; identical to SEQ ID NO: 157938

SEQ ID NO: 514803 - RNA, 64 nt, Homo Sapiens; identical to SEQ ID NO: 157939

SEQ ID NO: 514804 - RNA, 64 nt, Homo Sapiens; identical to SEQ ID NO: 157940

SEQ ID NO: 514805 - RNA, 64 nt, Homo Sapiens; identical to SEQ ID NO: 157941

SEQ ID NO: 514806 - RNA, 64 nt, Homo Sapiens; identical to SEQ ID NO: 157942

SEQ ID NO: 514807 - RNA, 64 nt, Homo Sapiens; identical to SEQ ID NO: 157943

SEQ ID NO: 514808 - RNA, 64 nt, Homo Sapiens; identical to SEQ ID NO: 157944

SEQ ID NO: 514809 - RNA, 64 nt, Homo Sapiens; identical to SEQ ID NO: 157945

SEQ ID NO: 514810 - RNA, 64 nt, Homo Sapiens; identical to SEQ ID NO: 157946

SEQ ID NO: 514811 - RNA, 64 nt, Homo Sapiens; identical to SEQ ID NO: 157947

SEQ ID NO: 514812 - RNA, 64 nt, Homo Sapiens; identical to SEQ ID NO: 157948

SEQ ID NO: 514813 - RNA, 64 nt, Homo Sapiens; identical to SEQ ID NO: 157949

SEQ ID NO: 514814 - RNA, 62 nt, Homo Sapiens; identical to SEQ ID NO: 115690

SEQ ID NO: 514815 - RNA, 64 nt, Homo Sapiens; identical to SEQ ID NO: 157951

SEQ ID NO: 514816 - RNA, 64 nt, Homo Sapiens; identical to SEQ ID NO: 157952

SEQ ID NO: 514817 - RNA, 64 nt, Homo Sapiens; identical to SEQ ID NO: 157953

SEQ ID NO: 514818 - RNA, 64 nt, Homo Sapiens; identical to SEQ ID NO: 157954

SEQ ID NO: 514819 - RNA, 64 nt, Homo Sapiens; identical to SEQ ID NO: 157955

SEQ ID NO: 514820 - RNA, 64 nt, Homo Sapiens; identical to SEQ ID NO: 157956

SEQ ID NO: 514821 - RNA, 64 nt, Homo Sapiens; identical to SEQ ID NO: 157955

SEQ ID NO: 514822 - RNA, 64 nt, Homo Sapiens; identical to SEQ ID NO: 157958

SEQ ID NO: 514823 - RNA, 64 nt, Homo Sapiens; identical to SEQ ID NO: 157959

SEQ ID NO: 514824 - RNA, 64 nt, Homo Sapiens; identical to SEQ ID NO: 157960

SEQ ID NO: 514825 - RNA, 64 nt, Homo Sapiens; identical to SEQ ID NO: 157961

SEQ ID NO: 514826 - RNA, 64 nt, Homo Sapiens; identical to SEQ ID NO: 157962

SEQ ID NO: 514827 - RNA, 64 nt, Homo Sapiens; identical to SEQ ID NO: 157963

SEQ ID NO: 514828 - RNA, 64 nt, Homo Sapiens; identical to SEQ ID NO: 157964

SEQ ID NO: 514829 - RNA, 64 nt, Homo Sapiens; identical to SEQ ID NO: 157965

SEQ ID NO: 514830 - RNA, 64 nt, Homo Sapiens; identical to SEQ ID NO: 157966

SEQ ID NO: 514831 - RNA, 64 nt, Homo Sapiens; identical to SEQ ID NO: 157967

SEQ ID NO: 514832 - RNA, 64 nt, Homo Sapiens; identical to SEQ ID NO: 157968

SEQ ID NO: 514833 - RNA, 64 nt, Homo Sapiens; identical to SEQ ID NO: 157969

SEQ ID NO: 514834 - RNA, 64 nt, Homo Sapiens; identical to SEQ ID NO: 157970

SEQ ID NO: 514835 - RNA, 64 nt, Homo Sapiens; identical to SEQ ID NO: 157971

SEQ ID NO: 514836 - RNA, 64 nt, Homo Sapiens; identical to SEQ ID NO: 157972

SEQ ID NO: 514837 - RNA, 64 nt, Homo Sapiens; identical to SEQ ID NO: 157973

SEQ ID NO: 514838 - RNA, 64 nt, Homo Sapiens; identical to SEQ ID NO: 106172

SEQ ID NO: 514839 - RNA, 64 nt, Homo Sapiens; identical to SEQ ID NO: 106173

SEQ ID NO: 514840 - RNA, 64 nt, Homo Sapiens; identical to SEQ ID NO: 106174

SEQ ID NO: 514841 - RNA, 64 nt, Homo Sapiens; identical to SEQ ID NO: 106175

SEQ ID NO: 514842 - RNA, 64 nt, Homo Sapiens; identical to SEQ ID NO: 106176

SEQ ID NO: 514843 - RNA, 64 nt, Homo Sapiens; identical to SEQ ID NO: 106177

SEQ ID NO: 514844 - RNA, 64 nt, Homo Sapiens; identical to SEQ ID NO: 106178

SEQ ID NO: 514845 - RNA, 64 nt, Homo Sapiens; identical to SEQ ID NO: 106179

SEQ ID NO: 514846 - RNA, 64 nt, Homo Sapiens; identical to SEQ ID NO: 106180

SEQ ID NO: 514847 - RNA, 64 nt, Homo Sapiens; identical to SEQ ID NO: 106181

SEQ ID NO: 514848 - RNA, 64 nt, Homo Sapiens; identical to SEQ ID NO: 106182

SEQ ID NO: 514849 - RNA, 64 nt, Homo Sapiens; identical to SEQ ID NO: 106183

SEQ ID NO: 514850 - RNA, 64 nt, Homo Sapiens; identical to SEQ ID NO: 106184

SEQ ID NO: 514851 - RNA, 64 nt, Homo Sapiens; identical to SEQ ID NO: 106185

SEQ ID NO: 514852 - RNA, 64 nt, Homo Sapiens; identical to SEQ ID NO: 106186

SEQ ID NO: 514853 - RNA, 64 nt, Homo Sapiens; identical to SEQ ID NO: 106187

SEQ ID NO: 514854 - RNA, 64 nt, Homo Sapiens; identical to SEQ ID NO: 106188

SEQ ID NO: 514855 - RNA, 64 nt, Homo Sapiens; identical to SEQ ID NO: 106189

SEQ ID NO: 514856 - RNA, 64 nt, Homo Sapiens; identical to SEQ ID NO: 125388

SEQ ID NO: 514857 - RNA, 64 nt, Homo Sapiens; identical to SEQ ID NO: 125389

SEQ ID NO: 514858 - RNA, 64 nt, Homo Sapiens; identical to SEQ ID NO: 125390

SEQ ID NO: 514859 - RNA, 64 nt, Homo Sapiens; identical to SEQ ID NO: 125391

SEQ ID NO: 514860 - RNA, 64 nt, Homo Sapiens; identical to SEQ ID NO: 125392

SEQ ID NO: 514861 - RNA, 64 nt, Homo Sapiens; identical to SEQ ID NO: 125393

SEQ ID NO: 514862 - RNA, 64 nt, Homo Sapiens; identical to SEQ ID NO: 125394

SEQ ID NO: 514863 - RNA, 64 nt, Homo Sapiens; identical to SEQ ID NO: 125395

SEQ ID NO: 514864 - RNA, 64 nt, Homo Sapiens; identical to SEQ ID NO: 125396

SEQ ID NO: 514865 - RNA, 64 nt, Homo Sapiens; identical to SEQ ID NO: 125397

SEQ ID NO: 514866 - RNA, 64 nt, Homo Sapiens; identical to SEQ ID NO: 125398

SEQ ID NO: 514867 - RNA, 64 nt, Homo Sapiens; identical to SEQ ID NO: 125399

SEQ ID NO: 514868 - RNA, 64 nt, Homo Sapiens; identical to SEQ ID NO: 125400

SEQ ID NO: 514869 - RNA, 64 nt, Homo Sapiens; identical to SEQ ID NO: 125401

SEQ ID NO: 514870 - RNA, 64 nt, Homo Sapiens; identical to SEQ ID NO: 255986

SEQ ID NO: 514871 - RNA, 64 nt, Homo Sapiens; identical to SEQ ID NO: 255987

SEQ ID NO: 514872 - RNA, 64 nt, Homo Sapiens; identical to SEQ ID NO: 255988

SEQ ID NO: 514873 - RNA, 64 nt, Homo Sapiens; identical to SEQ ID NO: 255989

SEQ ID NO: 514874 - RNA, 64 nt, Homo Sapiens; identical to SEQ ID NO: 255990

SEQ ID NO: 514875 - RNA, 64 nt, Homo Sapiens; identical to SEQ ID NO: 255991

SEQ ID NO: 514876 - RNA, 64 nt, Homo Sapiens; identical to SEQ ID NO: 255992

SEQ ID NO: 514877 - RNA, 64 nt, Homo Sapiens; identical to SEQ ID NO: 255993

SEQ ID NO: 514878 - RNA, 64 nt, Homo Sapiens; identical to SEQ ID NO: 255994

SEQ ID NO: 514879 - RNA, 64 nt, Homo Sapiens; identical to SEQ ID NO: 255995

SEQ ID NO: 514880 - RNA, 64 nt, Homo Sapiens; identical to SEQ ID NO: 50853

SEQ ID NO: 514881 - RNA, 64 nt, Homo Sapiens; identical to SEQ ID NO: 50854

SEQ ID NO: 514882 - RNA, 64 nt, Homo Sapiens; identical to SEQ ID NO: 50855

SEQ ID NO: 514883 - RNA, 64 nt, Homo Sapiens; identical to SEQ ID NO: 50856

SEQ ID NO: 514884 - RNA, 64 nt, Homo Sapiens; identical to SEQ ID NO: 50857

SEQ ID NO: 514885 - RNA, 64 nt, Homo Sapiens; identical to SEQ ID NO: 50858

SEQ ID NO: 514886 - RNA, 64 nt, Homo Sapiens; identical to SEQ ID NO: 50859

SEQ ID NO: 514887 - RNA, 64 nt, Homo Sapiens; identical to SEQ ID NO: 50860

SEQ ID NO: 514888 - RNA, 64 nt, Homo Sapiens; identical to SEQ ID NO: 50861

SEQ ID NO: 514889 - RNA, 64 nt, Homo Sapiens; identical to SEQ ID NO: 50862

SEQ ID NO: 514890 - RNA, 64 nt, Homo Sapiens; identical to SEQ ID NO: 50863

SEQ ID NO: 514891 - RNA, 64 nt, Homo Sapiens; identical to SEQ ID NO: 50864

SEQ ID NO: 514892 - RNA, 64 nt, Homo Sapiens; identical to SEQ ID NO: 50865

SEQ ID NO: 514893 - RNA, 64 nt, Homo Sapiens; identical to SEQ ID NO: 50866

SEQ ID NO: 514894 - RNA, 64 nt, Homo Sapiens; identical to SEQ ID NO: 50867

SEQ ID NO: 514895 - RNA, 64 nt, Homo Sapiens; identical to SEQ ID NO: 50868

SEQ ID NO: 514896 - RNA, 64 nt, Homo Sapiens; identical to SEQ ID NO: 50869

SEQ ID NO: 514897 - RNA, 64 nt, Homo Sapiens; identical to SEQ ID NO: 50870

SEQ ID NO: 514898 - RNA, 64 nt, Homo Sapiens; identical to SEQ ID NO: 50871

SEQ ID NO: 514899 - RNA, 64 nt, Homo Sapiens; identical to SEQ ID NO: 50872

SEQ ID NO: 514900 - RNA, 64 nt, Homo Sapiens; identical to SEQ ID NO: 50873

SEQ ID NO: 514901 - RNA, 64 nt, Homo Sapiens; identical to SEQ ID NO: 50874

SEQ ID NO: 514902 - RNA, 64 nt, Homo Sapiens; identical to SEQ ID NO: 50875

SEQ ID NO: 514903 - RNA, 64 nt, Homo Sapiens; identical to SEQ ID NO: 50876

SEQ ID NO: 514904 - RNA, 64 nt, Homo Sapiens; identical to SEQ ID NO: 50877

SEQ ID NO: 514905 - RNA, 64 nt, Homo Sapiens; identical to SEQ ID NO: 50878

SEQ ID NO: 514906 - RNA, 64 nt, Homo Sapiens; identical to SEQ ID NO: 50879

SEQ ID NO: 514907 - RNA, 64 nt, Homo Sapiens; identical to SEQ ID NO: 50880

SEQ ID NO: 514908 - RNA, 64 nt, Homo Sapiens; identical to SEQ ID NO: 50881

SEQ ID NO: 514909 - RNA, 64 nt, Homo Sapiens; identical to SEQ ID NO: 50882

SEQ ID NO: 514910 - RNA, 64 nt, Homo Sapiens; identical to SEQ ID NO: 50883

SEQ ID NO: 514911 - RNA, 64 nt, Homo Sapiens; identical to SEQ ID NO: 50884

SEQ ID NO: 514912 - RNA, 64 nt, Homo Sapiens; identical to SEQ ID NO: 50885

SEQ ID NO: 514913 - RNA, 64 nt, Homo Sapiens; identical to SEQ ID NO: 50886

SEQ ID NO: 514914 - RNA, 64 nt, Homo Sapiens; identical to SEQ ID NO: 50887

SEQ ID NO: 514915 - RNA, 64 nt, Homo Sapiens; identical to SEQ ID NO: 50888

SEQ ID NO: 514916 - RNA, 64 nt, Homo Sapiens; identical to SEQ ID NO: 50889

SEQ ID NO: 514917 - RNA, 64 nt, Homo Sapiens; identical to SEQ ID NO: 50890

SEQ ID NO: 514918 - RNA, 64 nt, Homo Sapiens; identical to SEQ ID NO: 50891

SEQ ID NO: 514919 - RNA, 64 nt, Homo Sapiens; identical to SEQ ID NO: 50892

SEQ ID NO: 514920 - RNA, 64 nt, Homo Sapiens; identical to SEQ ID NO: 50893

SEQ ID NO: 514921 - RNA, 64 nt, Homo Sapiens; identical to SEQ ID NO: 50894

SEQ ID NO: 514922 - RNA, 64 nt, Homo Sapiens; identical to SEQ ID NO: 50895

SEQ ID NO: 514923 - RNA, 64 nt, Homo Sapiens; identical to SEQ ID NO: 50896

SEQ ID NO: 514924 - RNA, 64 nt, Homo Sapiens; identical to SEQ ID NO: 50897

SEQ ID NO: 514925 - RNA, 64 nt, Homo Sapiens; identical to SEQ ID NO: 50898

SEQ ID NO: 514926 - RNA, 64 nt, Homo Sapiens; identical to SEQ ID NO: 50899

SEQ ID NO: 514927 - RNA, 64 nt, Homo Sapiens; identical to SEQ ID NO: 50900

SEQ ID NO: 514928 - RNA, 64 nt, Homo Sapiens; identical to SEQ ID NO: 50901

SEQ ID NO: 514929 - RNA, 64 nt, Homo Sapiens; identical to SEQ ID NO: 50902

SEQ ID NO: 514930 - RNA, 64 nt, Homo Sapiens; identical to SEQ ID NO: 50903

SEQ ID NO: 514931 - RNA, 64 nt, Homo Sapiens; identical to SEQ ID NO: 50904

SEQ ID NO: 514932 - RNA, 64 nt, Homo Sapiens; identical to SEQ ID NO: 50905

SEQ ID NO: 514933 - RNA, 64 nt, Homo Sapiens; identical to SEQ ID NO: 50906

SEQ ID NO: 514934 - RNA, 64 nt, Homo Sapiens; identical to SEQ ID NO: 50907

SEQ ID NO: 514935 - RNA, 64 nt, Homo Sapiens; identical to SEQ ID NO: 50908

SEQ ID NO: 514936 - RNA, 64 nt, Homo Sapiens; identical to SEQ ID NO: 50909

SEQ ID NO: 514937 - RNA, 64 nt, Homo Sapiens; identical to SEQ ID NO: 50910

SEQ ID NO: 514938 - RNA, 64 nt, Homo Sapiens; identical to SEQ ID NO: 50911

SEQ ID NO: 514939 - RNA, 64 nt, Homo Sapiens; identical to SEQ ID NO: 50912

SEQ ID NO: 514940 - RNA, 64 nt, Homo Sapiens; identical to SEQ ID NO: 50913

SEQ ID NO: 514941 - RNA, 64 nt, Homo Sapiens; identical to SEQ ID NO: 50914

SEQ ID NO: 514942 - RNA, 64 nt, Homo Sapiens; identical to SEQ ID NO: 50915

SEQ ID NO: 514943 - RNA, 64 nt, Homo Sapiens; identical to SEQ ID NO: 50916

SEQ ID NO: 514944 - RNA, 64 nt, Homo Sapiens; identical to SEQ ID NO: 50917

SEQ ID NO: 514945 - RNA, 64 nt, Homo Sapiens; identical to SEQ ID NO: 50918

SEQ ID NO: 514946 - RNA, 64 nt, Homo Sapiens; identical to SEQ ID NO: 50919

SEQ ID NO: 514947 - RNA, 64 nt, Homo Sapiens; identical to SEQ ID NO: 50920

SEQ ID NO: 514948 - RNA, 64 nt, Homo Sapiens; identical to SEQ ID NO: 50921

SEQ ID NO: 514949 - RNA, 64 nt, Homo Sapiens; identical to SEQ ID NO: 50922

SEQ ID NO: 514950 - RNA, 64 nt, Homo Sapiens; identical to SEQ ID NO: 50923

SEQ ID NO: 514951 - RNA, 64 nt, Homo Sapiens; identical to SEQ ID NO: 50924

SEQ ID NO: 514952 - RNA, 64 nt, Homo Sapiens; identical to SEQ ID NO: 50925

SEQ ID NO: 514953 - RNA, 64 nt, Homo Sapiens; identical to SEQ ID NO: 50926

SEQ ID NO: 514954 - RNA, 64 nt, Homo Sapiens; identical to SEQ ID NO: 50927

SEQ ID NO: 514955 - RNA, 64 nt, Homo Sapiens; identical to SEQ ID NO: 50928

SEQ ID NO: 514956 - RNA, 64 nt, Homo Sapiens; identical to SEQ ID NO: 494526

SEQ ID NO: 514957 - RNA, 64 nt, Homo Sapiens; identical to SEQ ID NO: 494527

SEQ ID NO: 514958 - RNA, 64 nt, Homo Sapiens; identical to SEQ ID NO: 494528

SEQ ID NO: 514959 - RNA, 64 nt, Homo Sapiens; identical to SEQ ID NO: 494529

SEQ ID NO: 514960 - RNA, 64 nt, Homo Sapiens; identical to SEQ ID NO: 494530

SEQ ID NO: 514961 - RNA, 64 nt, Homo Sapiens; identical to SEQ ID NO: 494531

SEQ ID NO: 514962 - RNA, 64 nt, Homo Sapiens; identical to SEQ ID NO: 494532

SEQ ID NO: 514963 - RNA, 64 nt, Homo Sapiens; identical to SEQ ID NO: 494533

SEQ ID NO: 514964 - RNA, 64 nt, Homo Sapiens; identical to SEQ ID NO: 494534

SEQ ID NO: 514965 - RNA, 64 nt, Homo Sapiens; identical to SEQ ID NO: 494535

SEQ ID NO: 514966 - RNA, 64 nt, Homo Sapiens; identical to SEQ ID NO: 494536

SEQ ID NO: 514967 - RNA, 64 nt, Homo Sapiens; identical to SEQ ID NO: 494537

SEQ ID NO: 514968 - RNA, 64 nt, Homo Sapiens; identical to SEQ ID NO: 494538

SEQ ID NO: 514969 - RNA, 64 nt, Homo Sapiens; identical to SEQ ID NO: 494539

SEQ ID NO: 514970 - RNA, 64 nt, Homo Sapiens; identical to SEQ ID NO: 494540

SEQ ID NO: 514971 - RNA, 64 nt, Homo Sapiens; identical to SEQ ID NO: 494541

SEQ ID NO: 514972 - RNA, 64 nt, Homo Sapiens; identical to SEQ ID NO: 218512

SEQ ID NO: 514973 - RNA, 64 nt, Homo Sapiens; identical to SEQ ID NO: 218513

SEQ ID NO: 514974 - RNA, 64 nt, Homo Sapiens; identical to SEQ ID NO: 218514

SEQ ID NO: 514975 - RNA, 64 nt, Homo Sapiens; identical to SEQ ID NO: 218515

SEQ ID NO: 514976 - RNA, 64 nt, Homo Sapiens; identical to SEQ ID NO: 218516

SEQ ID NO: 514977 - RNA, 64 nt, Homo Sapiens; identical to SEQ ID NO: 218517

SEQ ID NO: 514978 - RNA, 64 nt, Homo Sapiens; identical to SEQ ID NO: 218518

SEQ ID NO: 514979 - RNA, 64 nt, Homo Sapiens; identical to SEQ ID NO: 218519

SEQ ID NO: 514980 - RNA, 64 nt, Homo Sapiens
aaaacucauguggcaguaucugaauuuaaaaaugagagaguauucuguucuguuuaagaggaau

SEQ ID NO: 514981 - RNA, 64 nt, Homo Sapiens
gcaaaaugccaugcagacuucaggauuuaagaacagagaguacuuguuugccuuugauaaaaua

SEQ ID NO: 514982 - RNA, 64 nt, Homo Sapiens
ugguccacaagccuaacuuaugaauaguugcaucagagaguauagucuaguucaacgugagagu

SEQ ID NO: 514983 - RNA, 64 nt, Homo Sapiens
augaugguuaccagaggcugaaacuuaaggagauagagaguagaagcuaaaaauuacaauaauc

SEQ ID NO: 514984 - RNA, 64 nt, Homo Sapiens
aguauuucauugguaccuggacugaaagaucuguagagaguagcguggagaaaggguuuugcaa

SEQ ID NO: 514985 - RNA, 64 nt, Homo Sapiens
auugaagacaaaauauuuggcacuccaaaucaguagagaguaauuauguaaaagugaaagaguu

SEQ ID NO: 514986 - RNA, 64 nt, Homo Sapiens; identical to SEQ ID NO: 99898

SEQ ID NO: 514987 - RNA, 64 nt, Homo Sapiens; identical to SEQ ID NO: 99899

SEQ ID NO: 514988 - RNA, 64 nt, Homo Sapiens; identical to SEQ ID NO: 99900

SEQ ID NO: 514989 - RNA, 64 nt, Homo Sapiens; identical to SEQ ID NO: 99901

SEQ ID NO: 514990 - RNA, 64 nt, Homo Sapiens; identical to SEQ ID NO: 99902

SEQ ID NO: 514991 - RNA, 64 nt, Homo Sapiens; identical to SEQ ID NO: 99903

SEQ ID NO: 514992 - RNA, 64 nt, Homo Sapiens; identical to SEQ ID NO: 99904

SEQ ID NO: 514993 - RNA, 64 nt, Homo Sapiens; identical to SEQ ID NO: 99905

SEQ ID NO: 514994 - RNA, 64 nt, Homo Sapiens; identical to SEQ ID NO: 99906

SEQ ID NO: 514995 - RNA, 64 nt, Homo Sapiens; identical to SEQ ID NO: 99907

SEQ ID NO: 514996 - RNA, 64 nt, Homo Sapiens; identical to SEQ ID NO: 99908

SEQ ID NO: 514997 - RNA, 64 nt, Homo Sapiens; identical to SEQ ID NO: 99909

SEQ ID NO: 514998 - RNA, 64 nt, Homo Sapiens; identical to SEQ ID NO: 99910

SEQ ID NO: 514999 - RNA, 64 nt, Homo Sapiens; identical to SEQ ID NO: 99911

SEQ ID NO: 515000 - RNA, 64 nt, Homo Sapiens; identical to SEQ ID NO: 99912

SEQ ID NO: 515001 - RNA, 64 nt, Homo Sapiens; identical to SEQ ID NO: 99913

SEQ ID NO: 515002 - RNA, 64 nt, Homo Sapiens; identical to SEQ ID NO: 99914

SEQ ID NO: 515003 - RNA, 64 nt, Homo Sapiens; identical to SEQ ID NO: 99915

SEQ ID NO: 515004 - RNA, 64 nt, Homo Sapiens; identical to SEQ ID NO: 99916

SEQ ID NO: 515005 - RNA, 64 nt, Homo Sapiens; identical to SEQ ID NO: 99917

SEQ ID NO: 515006 - RNA, 64 nt, Homo Sapiens; identical to SEQ ID NO: 99918

SEQ ID NO: 515007 - RNA, 64 nt, Homo Sapiens; identical to SEQ ID NO: 99919

SEQ ID NO: 515008 - RNA, 64 nt, Homo Sapiens; identical to SEQ ID NO: 99920

SEQ ID NO: 515009 - RNA, 64 nt, Homo Sapiens; identical to SEQ ID NO: 99921

SEQ ID NO: 515010 - RNA, 64 nt, Homo Sapiens; identical to SEQ ID NO: 99922

SEQ ID NO: 515011 - RNA, 64 nt, Homo Sapiens; identical to SEQ ID NO: 99923

SEQ ID NO: 515012 - RNA, 64 nt, Homo Sapiens; identical to SEQ ID NO: 99924

SEQ ID NO: 515013 - RNA, 64 nt, Homo Sapiens; identical to SEQ ID NO: 99925

SEQ ID NO: 515014 - RNA, 64 nt, Homo Sapiens; identical to SEQ ID NO: 99926

SEQ ID NO: 515015 - RNA, 64 nt, Homo Sapiens; identical to SEQ ID NO: 99927

SEQ ID NO: 515016 - RNA, 64 nt, Homo Sapiens; identical to SEQ ID NO: 99928

SEQ ID NO: 515017 - RNA, 64 nt, Homo Sapiens; identical to SEQ ID NO: 99929

SEQ ID NO: 515018 - RNA, 64 nt, Homo Sapiens; identical to SEQ ID NO: 99930

SEQ ID NO: 515019 - RNA, 64 nt, Homo Sapiens; identical to SEQ ID NO: 99931

SEQ ID NO: 515020 - RNA, 64 nt, Homo Sapiens; identical to SEQ ID NO: 99932

SEQ ID NO: 515021 - RNA, 64 nt, Homo Sapiens; identical to SEQ ID NO: 99933

SEQ ID NO: 515022 - RNA, 64 nt, Homo Sapiens; identical to SEQ ID NO: 99934

SEQ ID NO: 515023 - RNA, 64 nt, Homo Sapiens; identical to SEQ ID NO: 99935

SEQ ID NO: 515024 - RNA, 64 nt, Homo Sapiens; identical to SEQ ID NO: 99936

SEQ ID NO: 515025 - RNA, 64 nt, Homo Sapiens; identical to SEQ ID NO: 99937

SEQ ID NO: 515026 - RNA, 64 nt, Homo Sapiens; identical to SEQ ID NO: 99938

SEQ ID NO: 515027 - RNA, 64 nt, Homo Sapiens; identical to SEQ ID NO: 99939

SEQ ID NO: 515028 - RNA, 64 nt, Homo Sapiens; identical to SEQ ID NO: 99940

SEQ ID NO: 515029 - RNA, 64 nt, Homo Sapiens; identical to SEQ ID NO: 99941

SEQ ID NO: 515030 - RNA, 64 nt, Homo Sapiens; identical to SEQ ID NO: 99942

SEQ ID NO: 515031 - RNA, 64 nt, Homo Sapiens; identical to SEQ ID NO: 99943

SEQ ID NO: 515032 - RNA, 64 nt, Homo Sapiens; identical to SEQ ID NO: 99944

SEQ ID NO: 515033 - RNA, 64 nt, Homo Sapiens; identical to SEQ ID NO: 99945

SEQ ID NO: 515034 - RNA, 64 nt, Homo Sapiens; identical to SEQ ID NO: 99946

SEQ ID NO: 515035 - RNA, 64 nt, Homo Sapiens
uccagacucacaaugucccacuuaacaguuccagagacuaaaugaaacaacagaaauuuauucu

SEQ ID NO: 515036 - RNA, 64 nt, Homo Sapiens
auuuuauaaggcuguugcuaaaauugaauuuugcagacuaaauugauaaguuacuucaauuaua

SEQ ID NO: 515037 - RNA, 64 nt, Homo Sapiens
gucauaauaagcaaauuauuggcuucuuucuucuagacuaaaagaaauuaaagagaugaaacaa

SEQ ID NO: 515038 - RNA, 64 nt, Homo Sapiens
gauaucauuaauuuuauaucaggauucauguaagagacuaaaaaugauccauagugguuaguac

SEQ ID NO: 515039 - RNA, 64 nt, Homo Sapiens
ugaacaagauguugcaugcuuuguuuuacaaugaagacuaaaacagaauuuaacuaaaggguag

SEQ ID NO: 515040 - RNA, 64 nt, Homo Sapiens
uaggacagguacaauuuugguugauuaaauuuucagacuaaauaauuauaagaaagaguaguug

SEQ ID NO: 515041 - RNA, 64 nt, Homo Sapiens
guaauauaucgugggaaggauugaauuaaagcuuagacuaaauagaauucgucauucucaaccu

SEQ ID NO: 515042 - RNA, 64 nt, Homo Sapiens
ccacgaaacugacauuguuaagguccuggaacagagacuaaaucuguuaccauaauguaagaga

SEQ ID NO: 515043 - RNA, 64 nt, Homo Sapiens
guucuuucaaaagaggcaucaacucaguuuaaaaagacuaaaacugcauuguuauuuuuuuuua

SEQ ID NO: 515044 - RNA, 64 nt, Homo Sapiens
ggugcagugugaucugagccauauacaaguuggaagacuaaagaaagacacuuugguaugaugc

SEQ ID NO: 515045 - RNA, 64 nt, Homo Sapiens
ucuuucucaauuaugucagacacuuuuaaccugcagacuaaauuuaacuccuggauuucagcuu

SEQ ID NO: 515046 - RNA, 64 nt, Homo Sapiens
gcaaaaagcaauacuuaauaucuuaaaguacuaaagacuaaaauaaaauauuuuucuuaugaau

SEQ ID NO: 515047 - RNA, 64 nt, Homo Sapiens; identical to SEQ ID NO: 277303

SEQ ID NO: 515048 - RNA, 64 nt, Homo Sapiens; identical to SEQ ID NO: 277304

SEQ ID NO: 515049 - RNA, 64 nt, Homo Sapiens; identical to SEQ ID NO: 277305

SEQ ID NO: 515050 - RNA, 64 nt, Homo Sapiens; identical to SEQ ID NO: 277306

SEQ ID NO: 515051 - RNA, 64 nt, Homo Sapiens; identical to SEQ ID NO: 277307

SEQ ID NO: 515052 - RNA, 64 nt, Homo Sapiens; identical to SEQ ID NO: 277308

SEQ ID NO: 515053 - RNA, 64 nt, Homo Sapiens; identical to SEQ ID NO: 277309

SEQ ID NO: 515054 - RNA, 64 nt, Homo Sapiens; identical to SEQ ID NO: 277310

SEQ ID NO: 515055 - RNA, 64 nt, Homo Sapiens; identical to SEQ ID NO: 277311

SEQ ID NO: 515056 - RNA, 64 nt, Homo Sapiens; identical to SEQ ID NO: 277312

SEQ ID NO: 515057 - RNA, 64 nt, Homo Sapiens; identical to SEQ ID NO: 277313

SEQ ID NO: 515058 - RNA, 64 nt, Homo Sapiens; identical to SEQ ID NO: 277314

SEQ ID NO: 515059 - RNA, 64 nt, Homo Sapiens; identical to SEQ ID NO: 277315

SEQ ID NO: 515060 - RNA, 64 nt, Homo Sapiens; identical to SEQ ID NO: 277316

SEQ ID NO: 515061 - RNA, 64 nt, Homo Sapiens; identical to SEQ ID NO: 277317

SEQ ID NO: 515062 - RNA, 64 nt, Homo Sapiens; identical to SEQ ID NO: 277318

SEQ ID NO: 515063 - RNA, 64 nt, Homo Sapiens; identical to SEQ ID NO: 277319

SEQ ID NO: 515064 - RNA, 64 nt, Homo Sapiens; identical to SEQ ID NO: 277320

SEQ ID NO: 515065 - RNA, 64 nt, Homo Sapiens; identical to SEQ ID NO: 277321

SEQ ID NO: 515066 - RNA, 64 nt, Homo Sapiens; identical to SEQ ID NO: 277322

SEQ ID NO: 515067 - RNA, 62 nt, Homo Sapiens; identical to SEQ ID NO: 277323

SEQ ID NO: 515068 - RNA, 64 nt, Homo Sapiens; identical to SEQ ID NO: 277324

SEQ ID NO: 515069 - RNA, 64 nt, Homo Sapiens; identical to SEQ ID NO: 277325

SEQ ID NO: 515070 - RNA, 64 nt, Homo Sapiens; identical to SEQ ID NO: 277326

SEQ ID NO: 515071 - RNA, 64 nt, Homo Sapiens; identical to SEQ ID NO: 277327

SEQ ID NO: 515072 - RNA, 64 nt, Homo Sapiens; identical to SEQ ID NO: 277328

SEQ ID NO: 515073 - RNA, 64 nt, Homo Sapiens; identical to SEQ ID NO: 277329

SEQ ID NO: 515074 - RNA, 64 nt, Homo Sapiens; identical to SEQ ID NO: 277330

SEQ ID NO: 515075 - RNA, 64 nt, Homo Sapiens; identical to SEQ ID NO: 277331

SEQ ID NO: 515076 - RNA, 64 nt, Homo Sapiens; identical to SEQ ID NO: 277332

SEQ ID NO: 515077 - RNA, 64 nt, Homo Sapiens; identical to SEQ ID NO: 93178

SEQ ID NO: 515078 - RNA, 64 nt, Homo Sapiens; identical to SEQ ID NO: 93179

SEQ ID NO: 515079 - RNA, 64 nt, Homo Sapiens; identical to SEQ ID NO: 93180

SEQ ID NO: 515080 - RNA, 64 nt, Homo Sapiens; identical to SEQ ID NO: 93181

SEQ ID NO: 515081 - RNA, 64 nt, Homo Sapiens; identical to SEQ ID NO: 169676

SEQ ID NO: 515082 - RNA, 64 nt, Homo Sapiens; identical to SEQ ID NO: 169677

SEQ ID NO: 515083 - RNA, 64 nt, Homo Sapiens; identical to SEQ ID NO: 169678

SEQ ID NO: 515084 - RNA, 64 nt, Homo Sapiens; identical to SEQ ID NO: 169679

SEQ ID NO: 515085 - RNA, 64 nt, Homo Sapiens; identical to SEQ ID NO: 169680

SEQ ID NO: 515086 - RNA, 64 nt, Homo Sapiens; identical to SEQ ID NO: 169681

SEQ ID NO: 515087 - RNA, 64 nt, Homo Sapiens; identical to SEQ ID NO: 169682

SEQ ID NO: 515088 - RNA, 64 nt, Homo Sapiens; identical to SEQ ID NO: 169683

SEQ ID NO: 515089 - RNA, 64 nt, Homo Sapiens; identical to SEQ ID NO: 169684

SEQ ID NO: 515090 - RNA, 64 nt, Homo Sapiens; identical to SEQ ID NO: 169685

SEQ ID NO: 515091 - RNA, 64 nt, Homo Sapiens; identical to SEQ ID NO: 169686

SEQ ID NO: 515092 - RNA, 64 nt, Homo Sapiens; identical to SEQ ID NO: 169687

SEQ ID NO: 515093 - RNA, 64 nt, Homo Sapiens; identical to SEQ ID NO: 169688

SEQ ID NO: 515094 - RNA, 64 nt, Homo Sapiens; identical to SEQ ID NO: 169689

SEQ ID NO: 515095 - RNA, 64 nt, Homo Sapiens; identical to SEQ ID NO: 169690

SEQ ID NO: 515096 - RNA, 64 nt, Homo Sapiens; identical to SEQ ID NO: 169691

SEQ ID NO: 515097 - RNA, 64 nt, Homo Sapiens; identical to SEQ ID NO: 169692

SEQ ID NO: 515098 - RNA, 64 nt, Homo Sapiens; identical to SEQ ID NO: 169693

SEQ ID NO: 515099 - RNA, 64 nt, Homo Sapiens; identical to SEQ ID NO: 169694

SEQ ID NO: 515100 - RNA, 64 nt, Homo Sapiens; identical to SEQ ID NO: 169695

SEQ ID NO: 515101 - RNA, 64 nt, Homo Sapiens; identical to SEQ ID NO: 169696

SEQ ID NO: 515102 - RNA, 64 nt, Homo Sapiens; identical to SEQ ID NO: 169697

SEQ ID NO: 515103 - RNA, 64 nt, Homo Sapiens; identical to SEQ ID NO: 169698

SEQ ID NO: 515104 - RNA, 64 nt, Homo Sapiens; identical to SEQ ID NO: 169699

SEQ ID NO: 515105 - RNA, 64 nt, Homo Sapiens; identical to SEQ ID NO: 169700

SEQ ID NO: 515106 - RNA, 64 nt, Homo Sapiens; identical to SEQ ID NO: 169701

SEQ ID NO: 515107 - RNA, 64 nt, Homo Sapiens; identical to SEQ ID NO: 169702

SEQ ID NO: 515108 - RNA, 64 nt, Homo Sapiens; identical to SEQ ID NO: 169703

SEQ ID NO: 515109 - RNA, 64 nt, Homo Sapiens; identical to SEQ ID NO: 169704

SEQ ID NO: 515110 - RNA, 64 nt, Homo Sapiens; identical to SEQ ID NO: 169705

SEQ ID NO: 515111 - RNA, 64 nt, Homo Sapiens; identical to SEQ ID NO: 169706

SEQ ID NO: 515112 - RNA, 64 nt, Homo Sapiens; identical to SEQ ID NO: 169707

SEQ ID NO: 515113 - RNA, 64 nt, Homo Sapiens; identical to SEQ ID NO: 169708

SEQ ID NO: 515114 - RNA, 64 nt, Homo Sapiens; identical to SEQ ID NO: 169709

SEQ ID NO: 515115 - RNA, 64 nt, Homo Sapiens; identical to SEQ ID NO: 169710

SEQ ID NO: 515116 - RNA, 64 nt, Homo Sapiens; identical to SEQ ID NO: 169711

SEQ ID NO: 515117 - RNA, 64 nt, Homo Sapiens; identical to SEQ ID NO: 169712

SEQ ID NO: 515118 - RNA, 64 nt, Homo Sapiens; identical to SEQ ID NO: 169713

SEQ ID NO: 515119 - RNA, 64 nt, Homo Sapiens; identical to SEQ ID NO: 169714

SEQ ID NO: 515120 - RNA, 64 nt, Homo Sapiens; identical to SEQ ID NO: 169715

SEQ ID NO: 515121 - RNA, 64 nt, Homo Sapiens; identical to SEQ ID NO: 169716

SEQ ID NO: 515122 - RNA, 64 nt, Homo Sapiens; identical to SEQ ID NO: 169717

SEQ ID NO: 515123 - RNA, 64 nt, Homo Sapiens; identical to SEQ ID NO: 169718

SEQ ID NO: 515124 - RNA, 64 nt, Homo Sapiens; identical to SEQ ID NO: 169719

SEQ ID NO: 515125 - RNA, 64 nt, Homo Sapiens; identical to SEQ ID NO: 169720

SEQ ID NO: 515126 - RNA, 62 nt, Homo Sapiens; identical to SEQ ID NO: 169721

SEQ ID NO: 515127 - RNA, 64 nt, Homo Sapiens; identical to SEQ ID NO: 169722

SEQ ID NO: 515128 - RNA, 64 nt, Homo Sapiens; identical to SEQ ID NO: 169723

SEQ ID NO: 515129 - RNA, 64 nt, Homo Sapiens; identical to SEQ ID NO: 169724

SEQ ID NO: 515130 - RNA, 64 nt, Homo Sapiens; identical to SEQ ID NO: 169725

SEQ ID NO: 515131 - RNA, 64 nt, Homo Sapiens; identical to SEQ ID NO: 169726

SEQ ID NO: 515132 - RNA, 64 nt, Homo Sapiens; identical to SEQ ID NO: 169727

SEQ ID NO: 515133 - RNA, 64 nt, Homo Sapiens; identical to SEQ ID NO: 169728

SEQ ID NO: 515134 - RNA, 64 nt, Homo Sapiens; identical to SEQ ID NO: 169729

SEQ ID NO: 515135 - RNA, 64 nt, Homo Sapiens; identical to SEQ ID NO: 169730

SEQ ID NO: 515136 - RNA, 64 nt, Homo Sapiens; identical to SEQ ID NO: 169731

SEQ ID NO: 515137 - RNA, 64 nt, Homo Sapiens; identical to SEQ ID NO: 169732

SEQ ID NO: 515138 - RNA, 64 nt, Homo Sapiens; identical to SEQ ID NO: 169733

SEQ ID NO: 515139 - RNA, 64 nt, Homo Sapiens; identical to SEQ ID NO: 169734

SEQ ID NO: 515140 - RNA, 64 nt, Homo Sapiens; identical to SEQ ID NO: 343169

SEQ ID NO: 515141 - RNA, 64 nt, Homo Sapiens; identical to SEQ ID NO: 343170

SEQ ID NO: 515142 - RNA, 64 nt, Homo Sapiens; identical to SEQ ID NO: 343171

SEQ ID NO: 515143 - RNA, 64 nt, Homo Sapiens; identical to SEQ ID NO: 343172

SEQ ID NO: 515144 - RNA, 64 nt, Homo Sapiens; identical to SEQ ID NO: 343173

SEQ ID NO: 515145 - RNA, 64 nt, Homo Sapiens; identical to SEQ ID NO: 343174

SEQ ID NO: 515146 - RNA, 64 nt, Homo Sapiens; identical to SEQ ID NO: 343175

SEQ ID NO: 515147 - RNA, 64 nt, Homo Sapiens; identical to SEQ ID NO: 343176

SEQ ID NO: 515148 - RNA, 64 nt, Homo Sapiens; identical to SEQ ID NO: 343177

SEQ ID NO: 515149 - RNA, 64 nt, Homo Sapiens; identical to SEQ ID NO: 343178

SEQ ID NO: 515150 - RNA, 64 nt, Homo Sapiens; identical to SEQ ID NO: 343179

SEQ ID NO: 515151 - RNA, 64 nt, Homo Sapiens; identical to SEQ ID NO: 343180

SEQ ID NO: 515152 - RNA, 64 nt, Homo Sapiens; identical to SEQ ID NO: 343181

SEQ ID NO: 515153 - RNA, 64 nt, Homo Sapiens; identical to SEQ ID NO: 343182

SEQ ID NO: 515154 - RNA, 64 nt, Homo Sapiens; identical to SEQ ID NO: 343183

SEQ ID NO: 515155 - RNA, 64 nt, Homo Sapiens; identical to SEQ ID NO: 343184

SEQ ID NO: 515156 - RNA, 64 nt, Homo Sapiens; identical to SEQ ID NO: 343185

SEQ ID NO: 515157 - RNA, 64 nt, Homo Sapiens; identical to SEQ ID NO: 343186

SEQ ID NO: 515158 - RNA, 64 nt, Homo Sapiens; identical to SEQ ID NO: 343187

SEQ ID NO: 515159 - RNA, 64 nt, Homo Sapiens; identical to SEQ ID NO: 343188

SEQ ID NO: 515160 - RNA, 64 nt, Homo Sapiens; identical to SEQ ID NO: 343189

SEQ ID NO: 515161 - RNA, 64 nt, Homo Sapiens; identical to SEQ ID NO: 343190

SEQ ID NO: 515162 - RNA, 64 nt, Homo Sapiens; identical to SEQ ID NO: 343191

SEQ ID NO: 515163 - RNA, 64 nt, Homo Sapiens; identical to SEQ ID NO: 343192

SEQ ID NO: 515164 - RNA, 64 nt, Homo Sapiens; identical to SEQ ID NO: 343193

SEQ ID NO: 515165 - RNA, 64 nt, Homo Sapiens; identical to SEQ ID NO: 343194

SEQ ID NO: 515166 - RNA, 64 nt, Homo Sapiens; identical to SEQ ID NO: 343195

SEQ ID NO: 515167 - RNA, 64 nt, Homo Sapiens; identical to SEQ ID NO: 343196

SEQ ID NO: 515168 - RNA, 64 nt, Homo Sapiens; identical to SEQ ID NO: 343197

SEQ ID NO: 515169 - RNA, 64 nt, Homo Sapiens; identical to SEQ ID NO: 343198

SEQ ID NO: 515170 - RNA, 64 nt, Homo Sapiens; identical to SEQ ID NO: 343199

SEQ ID NO: 515171 - RNA, 64 nt, Homo Sapiens; identical to SEQ ID NO: 343200

SEQ ID NO: 515172 - RNA, 64 nt, Homo Sapiens; identical to SEQ ID NO: 343201

SEQ ID NO: 515173 - RNA, 64 nt, Homo Sapiens; identical to SEQ ID NO: 343202

SEQ ID NO: 515174 - RNA, 64 nt, Homo Sapiens; identical to SEQ ID NO: 343203

SEQ ID NO: 515175 - RNA, 64 nt, Homo Sapiens; identical to SEQ ID NO: 343204

SEQ ID NO: 515176 - RNA, 64 nt, Homo Sapiens; identical to SEQ ID NO: 343205

SEQ ID NO: 515177 - RNA, 53 nt, Homo Sapiens; identical to SEQ ID NO: 343206

SEQ ID NO: 515178 - RNA, 64 nt, Homo Sapiens; identical to SEQ ID NO: 343207

SEQ ID NO: 515179 - RNA, 64 nt, Homo Sapiens; identical to SEQ ID NO: 343208

SEQ ID NO: 515180 - RNA, 64 nt, Homo Sapiens; identical to SEQ ID NO: 343209

SEQ ID NO: 515181 - RNA, 64 nt, Homo Sapiens; identical to SEQ ID NO: 343210

SEQ ID NO: 515182 - RNA, 64 nt, Homo Sapiens; identical to SEQ ID NO: 343211

SEQ ID NO: 515183 - RNA, 64 nt, Homo Sapiens; identical to SEQ ID NO: 343212

SEQ ID NO: 515184 - RNA, 64 nt, Homo Sapiens; identical to SEQ ID NO: 343213

SEQ ID NO: 515185 - RNA, 64 nt, Homo Sapiens; identical to SEQ ID NO: 343214

SEQ ID NO: 515186 - RNA, 64 nt, Homo Sapiens; identical to SEQ ID NO: 343215

SEQ ID NO: 515187 - RNA, 64 nt, Homo Sapiens; identical to SEQ ID NO: 343216

SEQ ID NO: 515188 - RNA, 64 nt, Homo Sapiens; identical to SEQ ID NO: 343217

SEQ ID NO: 515189 - RNA, 64 nt, Homo Sapiens; identical to SEQ ID NO: 343218

SEQ ID NO: 515190 - RNA, 64 nt, Homo Sapiens; identical to SEQ ID NO: 343219

SEQ ID NO: 515191 - RNA, 64 nt, Homo Sapiens; identical to SEQ ID NO: 343220

SEQ ID NO: 515192 - RNA, 64 nt, Homo Sapiens; identical to SEQ ID NO: 343221

SEQ ID NO: 515193 - RNA, 64 nt, Homo Sapiens; identical to SEQ ID NO: 343222

SEQ ID NO: 515194 - RNA, 64 nt, Homo Sapiens; identical to SEQ ID NO: 343223

SEQ ID NO: 515195 - RNA, 64 nt, Homo Sapiens; identical to SEQ ID NO: 343224

SEQ ID NO: 515196 - RNA, 64 nt, Homo Sapiens; identical to SEQ ID NO: 343225

SEQ ID NO: 515197 - RNA, 64 nt, Homo Sapiens; identical to SEQ ID NO: 343226

SEQ ID NO: 515198 - RNA, 64 nt, Homo Sapiens; identical to SEQ ID NO: 343227

SEQ ID NO: 515199 - RNA, 64 nt, Homo Sapiens; identical to SEQ ID NO: 343228

SEQ ID NO: 515200 - RNA, 64 nt, Homo Sapiens; identical to SEQ ID NO: 343229

SEQ ID NO: 515201 - RNA, 64 nt, Homo Sapiens; identical to SEQ ID NO: 343230

SEQ ID NO: 515202 - RNA, 64 nt, Homo Sapiens; identical to SEQ ID NO: 343231

SEQ ID NO: 515203 - RNA, 64 nt, Homo Sapiens; identical to SEQ ID NO: 343232

SEQ ID NO: 515204 - RNA, 64 nt, Homo Sapiens; identical to SEQ ID NO: 343233

SEQ ID NO: 515205 - RNA, 64 nt, Homo Sapiens; identical to SEQ ID NO: 343234

SEQ ID NO: 515206 - RNA, 64 nt, Homo Sapiens; identical to SEQ ID NO: 343235

SEQ ID NO: 515207 - RNA, 64 nt, Homo Sapiens; identical to SEQ ID NO: 343236

SEQ ID NO: 515208 - RNA, 64 nt, Homo Sapiens; identical to SEQ ID NO: 343237

SEQ ID NO: 515209 - RNA, 64 nt, Homo Sapiens; identical to SEQ ID NO: 343238

SEQ ID NO: 515210 - RNA, 64 nt, Homo Sapiens; identical to SEQ ID NO: 343239

SEQ ID NO: 515211 - RNA, 64 nt, Homo Sapiens; identical to SEQ ID NO: 343240

SEQ ID NO: 515212 - RNA, 64 nt, Homo Sapiens; identical to SEQ ID NO: 343241

SEQ ID NO: 515213 - RNA, 64 nt, Homo Sapiens; identical to SEQ ID NO: 343242

SEQ ID NO: 515214 - RNA, 64 nt, Homo Sapiens; identical to SEQ ID NO: 343243

SEQ ID NO: 515215 - RNA, 64 nt, Homo Sapiens; identical to SEQ ID NO: 343244

SEQ ID NO: 515216 - RNA, 64 nt, Homo Sapiens; identical to SEQ ID NO: 343245

SEQ ID NO: 515217 - RNA, 64 nt, Homo Sapiens; identical to SEQ ID NO: 343246

SEQ ID NO: 515218 - RNA, 64 nt, Homo Sapiens; identical to SEQ ID NO: 343247

SEQ ID NO: 515219 - RNA, 64 nt, Homo Sapiens; identical to SEQ ID NO: 343248

SEQ ID NO: 515220 - RNA, 64 nt, Homo Sapiens; identical to SEQ ID NO: 343249

SEQ ID NO: 515221 - RNA, 64 nt, Homo Sapiens; identical to SEQ ID NO: 343250

SEQ ID NO: 515222 - RNA, 64 nt, Homo Sapiens; identical to SEQ ID NO: 343251

SEQ ID NO: 515223 - RNA, 64 nt, Homo Sapiens; identical to SEQ ID NO: 343252

SEQ ID NO: 515224 - RNA, 64 nt, Homo Sapiens; identical to SEQ ID NO: 343253

SEQ ID NO: 515225 - RNA, 64 nt, Homo Sapiens; identical to SEQ ID NO: 343254

SEQ ID NO: 515226 - RNA, 64 nt, Homo Sapiens; identical to SEQ ID NO: 343255

SEQ ID NO: 515227 - RNA, 64 nt, Homo Sapiens; identical to SEQ ID NO: 343256

SEQ ID NO: 515228 - RNA, 64 nt, Homo Sapiens; identical to SEQ ID NO: 343257

SEQ ID NO: 515229 - RNA, 64 nt, Homo Sapiens; identical to SEQ ID NO: 343258

SEQ ID NO: 515230 - RNA, 64 nt, Homo Sapiens; identical to SEQ ID NO: 343259

SEQ ID NO: 515231 - RNA, 64 nt, Homo Sapiens; identical to SEQ ID NO: 343260

SEQ ID NO: 515232 - RNA, 64 nt, Homo Sapiens; identical to SEQ ID NO: 343261

SEQ ID NO: 515233 - RNA, 64 nt, Homo Sapiens; identical to SEQ ID NO: 343262

SEQ ID NO: 515234 - RNA, 64 nt, Homo Sapiens; identical to SEQ ID NO: 343263

SEQ ID NO: 515235 - RNA, 64 nt, Homo Sapiens; identical to SEQ ID NO: 343264

SEQ ID NO: 515236 - RNA, 64 nt, Homo Sapiens; identical to SEQ ID NO: 343265

SEQ ID NO: 515237 - RNA, 64 nt, Homo Sapiens; identical to SEQ ID NO: 343266

SEQ ID NO: 515238 - RNA, 64 nt, Homo Sapiens; identical to SEQ ID NO: 343267

SEQ ID NO: 515239 - RNA, 64 nt, Homo Sapiens; identical to SEQ ID NO: 343268

SEQ ID NO: 515240 - RNA, 64 nt, Homo Sapiens; identical to SEQ ID NO: 343269

SEQ ID NO: 515241 - RNA, 64 nt, Homo Sapiens; identical to SEQ ID NO: 343270

SEQ ID NO: 515242 - RNA, 64 nt, Homo Sapiens; identical to SEQ ID NO: 343271

SEQ ID NO: 515243 - RNA, 64 nt, Homo Sapiens; identical to SEQ ID NO: 343272

SEQ ID NO: 515244 - RNA, 64 nt, Homo Sapiens; identical to SEQ ID NO: 343273

SEQ ID NO: 515245 - RNA, 64 nt, Homo Sapiens; identical to SEQ ID NO: 343274

SEQ ID NO: 515246 - RNA, 64 nt, Homo Sapiens; identical to SEQ ID NO: 343275

SEQ ID NO: 515247 - RNA, 64 nt, Homo Sapiens; identical to SEQ ID NO: 343276

SEQ ID NO: 515248 - RNA, 64 nt, Homo Sapiens; identical to SEQ ID NO: 343277

SEQ ID NO: 515249 - RNA, 64 nt, Homo Sapiens; identical to SEQ ID NO: 343278

SEQ ID NO: 515250 - RNA, 64 nt, Homo Sapiens; identical to SEQ ID NO: 343279

SEQ ID NO: 515251 - RNA, 64 nt, Homo Sapiens; identical to SEQ ID NO: 343280

SEQ ID NO: 515252 - RNA, 64 nt, Homo Sapiens; identical to SEQ ID NO: 343281

SEQ ID NO: 515253 - RNA, 64 nt, Homo Sapiens; identical to SEQ ID NO: 343282

SEQ ID NO: 515254 - RNA, 64 nt, Homo Sapiens; identical to SEQ ID NO: 343283

SEQ ID NO: 515255 - RNA, 64 nt, Homo Sapiens; identical to SEQ ID NO: 343284

SEQ ID NO: 515256 - RNA, 64 nt, Homo Sapiens; identical to SEQ ID NO: 343285

SEQ ID NO: 515257 - RNA, 64 nt, Homo Sapiens; identical to SEQ ID NO: 343286

SEQ ID NO: 515258 - RNA, 64 nt, Homo Sapiens; identical to SEQ ID NO: 343287

SEQ ID NO: 515259 - RNA, 64 nt, Homo Sapiens; identical to SEQ ID NO: 343288

SEQ ID NO: 515260 - RNA, 64 nt, Homo Sapiens; identical to SEQ ID NO: 343289

SEQ ID NO: 515261 - RNA, 64 nt, Homo Sapiens; identical to SEQ ID NO: 343290

SEQ ID NO: 515262 - RNA, 64 nt, Homo Sapiens; identical to SEQ ID NO: 343291

SEQ ID NO: 515263 - RNA, 64 nt, Homo Sapiens; identical to SEQ ID NO: 343292

SEQ ID NO: 515264 - RNA, 64 nt, Homo Sapiens; identical to SEQ ID NO: 343293

SEQ ID NO: 515265 - RNA, 64 nt, Homo Sapiens; identical to SEQ ID NO: 343294

SEQ ID NO: 515266 - RNA, 64 nt, Homo Sapiens; identical to SEQ ID NO: 343295

SEQ ID NO: 515267 - RNA, 64 nt, Homo Sapiens; identical to SEQ ID NO: 343296

SEQ ID NO: 515268 - RNA, 64 nt, Homo Sapiens; identical to SEQ ID NO: 343297

SEQ ID NO: 515269 - RNA, 64 nt, Homo Sapiens; identical to SEQ ID NO: 343298

SEQ ID NO: 515270 - RNA, 64 nt, Homo Sapiens; identical to SEQ ID NO: 343299

SEQ ID NO: 515271 - RNA, 64 nt, Homo Sapiens; identical to SEQ ID NO: 343299

SEQ ID NO: 515272 - RNA, 64 nt, Homo Sapiens; identical to SEQ ID NO: 343301

SEQ ID NO: 515273 - RNA, 64 nt, Homo Sapiens; identical to SEQ ID NO: 343302

SEQ ID NO: 515274 - RNA, 64 nt, Homo Sapiens; identical to SEQ ID NO: 343303

SEQ ID NO: 515275 - RNA, 64 nt, Homo Sapiens; identical to SEQ ID NO: 343304

SEQ ID NO: 515276 - RNA, 64 nt, Homo Sapiens; identical to SEQ ID NO: 343305

SEQ ID NO: 515277 - RNA, 64 nt, Homo Sapiens; identical to SEQ ID NO: 343306

SEQ ID NO: 515278 - RNA, 64 nt, Homo Sapiens; identical to SEQ ID NO: 343307

SEQ ID NO: 515279 - RNA, 64 nt, Homo Sapiens; identical to SEQ ID NO: 343308

SEQ ID NO: 515280 - RNA, 64 nt, Homo Sapiens; identical to SEQ ID NO: 343309

SEQ ID NO: 515281 - RNA, 64 nt, Homo Sapiens; identical to SEQ ID NO: 343310

SEQ ID NO: 515282 - RNA, 64 nt, Homo Sapiens; identical to SEQ ID NO: 343311

SEQ ID NO: 515283 - RNA, 62 nt, Homo Sapiens; identical to SEQ ID NO: 343312

SEQ ID NO: 515284 - RNA, 64 nt, Homo Sapiens; identical to SEQ ID NO: 343313

SEQ ID NO: 515285 - RNA, 64 nt, Homo Sapiens; identical to SEQ ID NO: 343314

SEQ ID NO: 515286 - RNA, 64 nt, Homo Sapiens; identical to SEQ ID NO: 343315

SEQ ID NO: 515287 - RNA, 64 nt, Homo Sapiens; identical to SEQ ID NO: 343316

SEQ ID NO: 515288 - RNA, 64 nt, Homo Sapiens; identical to SEQ ID NO: 343317

SEQ ID NO: 515289 - RNA, 64 nt, Homo Sapiens; identical to SEQ ID NO: 343318

SEQ ID NO: 515290 - RNA, 64 nt, Homo Sapiens; identical to SEQ ID NO: 343319

SEQ ID NO: 515291 - RNA, 64 nt, Homo Sapiens; identical to SEQ ID NO: 343320

SEQ ID NO: 515292 - RNA, 64 nt, Homo Sapiens; identical to SEQ ID NO: 343321

SEQ ID NO: 515293 - RNA, 64 nt, Homo Sapiens; identical to SEQ ID NO: 343322

SEQ ID NO: 515294 - RNA, 64 nt, Homo Sapiens; identical to SEQ ID NO: 343323

SEQ ID NO: 515295 - RNA, 64 nt, Homo Sapiens; identical to SEQ ID NO: 343324

SEQ ID NO: 515296 - RNA, 64 nt, Homo Sapiens; identical to SEQ ID NO: 343325

SEQ ID NO: 515297 - RNA, 64 nt, Homo Sapiens; identical to SEQ ID NO: 343326

SEQ ID NO: 515298 - RNA, 64 nt, Homo Sapiens; identical to SEQ ID NO: 343327

SEQ ID NO: 515299 - RNA, 64 nt, Homo Sapiens; identical to SEQ ID NO: 343328

SEQ ID NO: 515300 - RNA, 64 nt, Homo Sapiens; identical to SEQ ID NO: 343329

SEQ ID NO: 515301 - RNA, 64 nt, Homo Sapiens; identical to SEQ ID NO: 343330

SEQ ID NO: 515302 - RNA, 64 nt, Homo Sapiens; identical to SEQ ID NO: 343331

SEQ ID NO: 515303 - RNA, 64 nt, Homo Sapiens; identical to SEQ ID NO: 343332

SEQ ID NO: 515304 - RNA, 64 nt, Homo Sapiens; identical to SEQ ID NO: 343333

SEQ ID NO: 515305 - RNA, 64 nt, Homo Sapiens; identical to SEQ ID NO: 343334

SEQ ID NO: 515306 - RNA, 58 nt, Homo Sapiens; identical to SEQ ID NO: 343335

SEQ ID NO: 515307 - RNA, 64 nt, Homo Sapiens; identical to SEQ ID NO: 343336

SEQ ID NO: 515308 - RNA, 64 nt, Homo Sapiens; identical to SEQ ID NO: 343337

SEQ ID NO: 515309 - RNA, 64 nt, Homo Sapiens; identical to SEQ ID NO: 343338

SEQ ID NO: 515310 - RNA, 64 nt, Homo Sapiens; identical to SEQ ID NO: 343339

SEQ ID NO: 515311 - RNA, 64 nt, Homo Sapiens; identical to SEQ ID NO: 343340

SEQ ID NO: 515312 - RNA, 64 nt, Homo Sapiens; identical to SEQ ID NO: 343341

SEQ ID NO: 515313 - RNA, 64 nt, Homo Sapiens; identical to SEQ ID NO: 343342

SEQ ID NO: 515314 - RNA, 64 nt, Homo Sapiens; identical to SEQ ID NO: 343343

SEQ ID NO: 515315 - RNA, 64 nt, Homo Sapiens; identical to SEQ ID NO: 343344

SEQ ID NO: 515316 - RNA, 64 nt, Homo Sapiens; identical to SEQ ID NO: 343345

SEQ ID NO: 515317 - RNA, 64 nt, Homo Sapiens; identical to SEQ ID NO: 343346

SEQ ID NO: 515318 - RNA, 64 nt, Homo Sapiens; identical to SEQ ID NO: 343347

SEQ ID NO: 515319 - RNA, 64 nt, Homo Sapiens; identical to SEQ ID NO: 343348

SEQ ID NO: 515320 - RNA, 64 nt, Homo Sapiens; identical to SEQ ID NO: 343349

SEQ ID NO: 515321 - RNA, 64 nt, Homo Sapiens; identical to SEQ ID NO: 343350

SEQ ID NO: 515322 - RNA, 64 nt, Homo Sapiens; identical to SEQ ID NO: 343351

SEQ ID NO: 515323 - RNA, 64 nt, Homo Sapiens; identical to SEQ ID NO: 343352

SEQ ID NO: 515324 - RNA, 64 nt, Homo Sapiens; identical to SEQ ID NO: 343353

SEQ ID NO: 515325 - RNA, 64 nt, Homo Sapiens; identical to SEQ ID NO: 343351

SEQ ID NO: 515326 - RNA, 64 nt, Homo Sapiens; identical to SEQ ID NO: 343355

SEQ ID NO: 515327 - RNA, 64 nt, Homo Sapiens; identical to SEQ ID NO: 343356

SEQ ID NO: 515328 - RNA, 64 nt, Homo Sapiens; identical to SEQ ID NO: 343357

SEQ ID NO: 515329 - RNA, 64 nt, Homo Sapiens; identical to SEQ ID NO: 343358

SEQ ID NO: 515330 - RNA, 64 nt, Homo Sapiens; identical to SEQ ID NO: 343359

SEQ ID NO: 515331 - RNA, 64 nt, Homo Sapiens; identical to SEQ ID NO: 343360

SEQ ID NO: 515332 - RNA, 64 nt, Homo Sapiens; identical to SEQ ID NO: 343361

SEQ ID NO: 515333 - RNA, 64 nt, Homo Sapiens; identical to SEQ ID NO: 77261

SEQ ID NO: 515334 - RNA, 64 nt, Homo Sapiens; identical to SEQ ID NO: 77262

SEQ ID NO: 515335 - RNA, 64 nt, Homo Sapiens; identical to SEQ ID NO: 77263

SEQ ID NO: 515336 - RNA, 64 nt, Homo Sapiens; identical to SEQ ID NO: 77264

SEQ ID NO: 515337 - RNA, 64 nt, Homo Sapiens; identical to SEQ ID NO: 77265

SEQ ID NO: 515338 - RNA, 64 nt, Homo Sapiens; identical to SEQ ID NO: 77266

SEQ ID NO: 515339 - RNA, 64 nt, Homo Sapiens; identical to SEQ ID NO: 77267

SEQ ID NO: 515340 - RNA, 64 nt, Homo Sapiens; identical to SEQ ID NO: 77268

SEQ ID NO: 515341 - RNA, 64 nt, Homo Sapiens; identical to SEQ ID NO: 77269

SEQ ID NO: 515342 - RNA, 64 nt, Homo Sapiens; identical to SEQ ID NO: 77270

SEQ ID NO: 515343 - RNA, 64 nt, Homo Sapiens; identical to SEQ ID NO: 77271

SEQ ID NO: 515344 - RNA, 64 nt, Homo Sapiens; identical to SEQ ID NO: 77272

SEQ ID NO: 515345 - RNA, 64 nt, Homo Sapiens; identical to SEQ ID NO: 77273

SEQ ID NO: 515346 - RNA, 64 nt, Homo Sapiens; identical to SEQ ID NO: 77274

SEQ ID NO: 515347 - RNA, 64 nt, Homo Sapiens; identical to SEQ ID NO: 77275

SEQ ID NO: 515348 - RNA, 64 nt, Homo Sapiens; identical to SEQ ID NO: 77276

SEQ ID NO: 515349 - RNA, 64 nt, Homo Sapiens; identical to SEQ ID NO: 168067

SEQ ID NO: 515350 - RNA, 64 nt, Homo Sapiens; identical to SEQ ID NO: 168068

SEQ ID NO: 515351 - RNA, 64 nt, Homo Sapiens; identical to SEQ ID NO: 168069

SEQ ID NO: 515352 - RNA, 64 nt, Homo Sapiens; identical to SEQ ID NO: 168070

SEQ ID NO: 515353 - RNA, 64 nt, Homo Sapiens; identical to SEQ ID NO: 168071

SEQ ID NO: 515354 - RNA, 64 nt, Homo Sapiens; identical to SEQ ID NO: 168072

SEQ ID NO: 515355 - RNA, 64 nt, Homo Sapiens; identical to SEQ ID NO: 168073

SEQ ID NO: 515356 - RNA, 64 nt, Homo Sapiens; identical to SEQ ID NO: 168074

SEQ ID NO: 515357 - RNA, 64 nt, Homo Sapiens; identical to SEQ ID NO: 168075

SEQ ID NO: 515358 - RNA, 64 nt, Homo Sapiens; identical to SEQ ID NO: 168076

SEQ ID NO: 515359 - RNA, 64 nt, Homo Sapiens; identical to SEQ ID NO: 168077

SEQ ID NO: 515360 - RNA, 64 nt, Homo Sapiens; identical to SEQ ID NO: 168078

SEQ ID NO: 515361 - RNA, 64 nt, Homo Sapiens; identical to SEQ ID NO: 168079

SEQ ID NO: 515362 - RNA, 64 nt, Homo Sapiens; identical to SEQ ID NO: 168080

SEQ ID NO: 515363 - RNA, 64 nt, Homo Sapiens; identical to SEQ ID NO: 372672

SEQ ID NO: 515364 - RNA, 64 nt, Homo Sapiens; identical to SEQ ID NO: 372673

SEQ ID NO: 515365 - RNA, 64 nt, Homo Sapiens; identical to SEQ ID NO: 372674

SEQ ID NO: 515366 - RNA, 62 nt, Homo Sapiens; identical to SEQ ID NO: 372675

SEQ ID NO: 515367 - RNA, 64 nt, Homo Sapiens; identical to SEQ ID NO: 372676

SEQ ID NO: 515368 - RNA, 64 nt, Homo Sapiens; identical to SEQ ID NO: 372677

SEQ ID NO: 515369 - RNA, 64 nt, Homo Sapiens
uuuuguauuuuuaguagagaugggguuucaccguaucggcgaggaugaucucuaucucuugacc

SEQ ID NO: 515370 - RNA, 64 nt, Homo Sapiens
ggcucccagccuccuucccgcuacagaaucgcucaucggcgaggcucagcagaaagacccugaa

SEQ ID NO: 515371 - RNA, 64 nt, Homo Sapiens
aaaugaaagcgauucuccuucuauauauuacaacaucggcgaggaucaaauuacauuuauguuc

SEQ ID NO: 515372 - RNA, 64 nt, Homo Sapiens
uuguacuugaagagaacauguuaagagcauaaaaaucggcgauuuaauuaaaugucaguacauu

SEQ ID NO: 515373 - RNA, 64 nt, Homo Sapiens
cacuuuaugcacguauuauugacauuaauaccuaaucggcgagugcccaucugccccaccugcu

SEQ ID NO: 515374 - RNA, 64 nt, Homo Sapiens
ucaaagagcuugauaauuuaguugucaaaagugcaucggcgacauuaucuuuaauuguauguau

SEQ ID NO: 515375 - RNA, 64 nt, Homo Sapiens
accuucuucuuuuaugacauaaauaaauaaaggaaucggcgaacgcguccugcccccaccuccu

SEQ ID NO: 515376 - RNA, 64 nt, Homo Sapiens
gagcacugcaccugccuccacugccacugugugaaucggcgacgcaacacagcuugucucuugc

SEQ ID NO: 515377 - RNA, 64 nt, Homo Sapiens
aaacugcugcggccuuccaacuccugguaucugcaucggcgaauggcccuucuugccuugaucc

SEQ ID NO: 515378 - RNA, 64 nt, Homo Sapiens; identical to SEQ ID NO: 169421

SEQ ID NO: 515379 - RNA, 64 nt, Homo Sapiens; identical to SEQ ID NO: 169422

SEQ ID NO: 515380 - RNA, 64 nt, Homo Sapiens; identical to SEQ ID NO: 169423

SEQ ID NO: 515381 - RNA, 64 nt, Homo Sapiens; identical to SEQ ID NO: 169424

SEQ ID NO: 515382 - RNA, 64 nt, Homo Sapiens; identical to SEQ ID NO: 169425

SEQ ID NO: 515383 - RNA, 64 nt, Homo Sapiens; identical to SEQ ID NO: 169426

SEQ ID NO: 515384 - RNA, 64 nt, Homo Sapiens; identical to SEQ ID NO: 169427

SEQ ID NO: 515385 - RNA, 64 nt, Homo Sapiens; identical to SEQ ID NO: 169428

SEQ ID NO: 515386 - RNA, 64 nt, Homo Sapiens; identical to SEQ ID NO: 169429

SEQ ID NO: 515387 - RNA, 64 nt, Homo Sapiens; identical to SEQ ID NO: 169430

SEQ ID NO: 515388 - RNA, 64 nt, Homo Sapiens; identical to SEQ ID NO: 169431

SEQ ID NO: 515389 - RNA, 64 nt, Homo Sapiens; identical to SEQ ID NO: 169432

SEQ ID NO: 515390 - RNA, 64 nt, Homo Sapiens; identical to SEQ ID NO: 169433

SEQ ID NO: 515391 - RNA, 64 nt, Homo Sapiens; identical to SEQ ID NO: 169434

SEQ ID NO: 515392 - RNA, 64 nt, Homo Sapiens; identical to SEQ ID NO: 169435

SEQ ID NO: 515393 - RNA, 64 nt, Homo Sapiens; identical to SEQ ID NO: 169436

SEQ ID NO: 515394 - RNA, 64 nt, Homo Sapiens; identical to SEQ ID NO: 169437

SEQ ID NO: 515395 - RNA, 64 nt, Homo Sapiens; identical to SEQ ID NO: 169438

SEQ ID NO: 515396 - RNA, 64 nt, Homo Sapiens; identical to SEQ ID NO: 169439

SEQ ID NO: 515397 - RNA, 64 nt, Homo Sapiens; identical to SEQ ID NO: 169440

SEQ ID NO: 515398 - RNA, 64 nt, Homo Sapiens; identical to SEQ ID NO: 169441

SEQ ID NO: 515399 - RNA, 64 nt, Homo Sapiens; identical to SEQ ID NO: 169442

SEQ ID NO: 515400 - RNA, 64 nt, Homo Sapiens; identical to SEQ ID NO: 169443

SEQ ID NO: 515401 - RNA, 64 nt, Homo Sapiens; identical to SEQ ID NO: 169442

SEQ ID NO: 515402 - RNA, 64 nt, Homo Sapiens; identical to SEQ ID NO: 169443

SEQ ID NO: 515403 - RNA, 64 nt, Homo Sapiens
aauuucaaaauugcuaaaauguguuugagcuuuagacuauaacauuuguuguaauaauugcuag

SEQ ID NO: 515404 - RNA, 64 nt, Homo Sapiens
acuuucuacguacuacuccaaagacugugauugugacuauaauacauuuuugguaauuuuuuua

SEQ ID NO: 515405 - RNA, 64 nt, Homo Sapiens
ugucugccccugcccugccugggacccacagggagacuauaaucuccuuauuuuuuuacuccua

SEQ ID NO: 515406 - RNA, 64 nt, Homo Sapiens
uauguccagcacuuuguagccaugggaggaaagggacuauaaaaguguacaauguuaauggaau

SEQ ID NO: 515407 - RNA, 64 nt, Homo Sapiens
uugaaauuuugucuuuaagcagagaguuauuugugacuauaagcuuugugcuuagagaauguau

SEQ ID NO: 515408 - RNA, 64 nt, Homo Sapiens
auguguaauguggauggagacaauuauaagauuugacuauaacuauuuggagggucuuuaacau

SEQ ID NO: 515409 - RNA, 64 nt, Homo Sapiens
uuguggucgacaucaaucuaaagauacagugucugacuauaaccuuguuccaaaaaccuaggca

SEQ ID NO: 515410 - RNA, 64 nt, Homo Sapiens
guuaaaaguggaagaauagaacaacuuuaaaggagacuauaauauuaguuuccuaucugaauua

SEQ ID NO: 515411 - RNA, 64 nt, Homo Sapiens
uuguacaguuauuauagggcuuaaaugugaucaggacuauaauaguuuuuuaauaaucgacuuu

SEQ ID NO: 515412 - RNA, 64 nt, Homo Sapiens
caguagacaauccccacauaaaaaggggcauugagacuauaaagguggauuuuguggaggugag

SEQ ID NO: 515413 - RNA, 64 nt, Homo Sapiens
gucaucuagccccuucgaggugaggccuaucugagacuauaacuuauuccugacccucccuacc

SEQ ID NO: 515414 - RNA, 64 nt, Homo Sapiens
uuugaugccauugagauucaaacaaguguaagaagacuauaacuuguuuaaacacuuuauuuuu

SEQ ID NO: 515415 - RNA, 64 nt, Homo Sapiens
aaaguuuucaacauauuucuuuggaaauccuaaggacuauaauacuugauuugggagcauuuac

SEQ ID NO: 515416 - RNA, 64 nt, Homo Sapiens
aauaagguaaagcauucaaugagauaaacccuaugacuauaagcacaugaaacgaaucaaacug

SEQ ID NO: 515417 - RNA, 64 nt, Homo Sapiens
acgcauauacgaguugguuuaucuuuguguacaugacuauaacccagugaugcugaggucaugu

SEQ ID NO: 515418 - RNA, 64 nt, Homo Sapiens
uggcaacauuuuuauucuucagagucagguaaaugacuauaauaguuugguuucuaaugaaaag

SEQ ID NO: 515419 - RNA, 64 nt, Homo Sapiens
agaauugaagguucuuaucagaugggauacuggggacuauaaacaauggaaauaaagccacugu

SEQ ID NO: 515420 - RNA, 53 nt, Homo Sapiens
agacucuuguuuuaaaaugacuugacuauaaaaaaaaauuaaaaaauaaaaau

SEQ ID NO: 515421 - RNA, 64 nt, Homo Sapiens
agaagcacauaugaacuggaugcaguaggcaguagacuauaagcaccauacagugagccagccu

SEQ ID NO: 515422 - RNA, 64 nt, Homo Sapiens
aggaaaggaggaaagguauccuuagggaugaacagacuauaacuuuccucugugcuacccuuaa

SEQ ID NO: 515423 - RNA, 63 nt, Homo Sapiens
acuaauugugcauuauagaagauuuuccuuuccugacuauaaaucagcauuaaagaaaacauu

SEQ ID NO: 515424 - RNA, 64 nt, Homo Sapiens
acccucccugggucugugugcaccccucacacuggacuauaaauaugacucaucucguccugcc

SEQ ID NO: 515425 - RNA, 64 nt, Homo Sapiens
auuucuauaaagaauauuuugacucugugguaaagacuauaauuugauuggguacagauuuggu

SEQ ID NO: 515426 - RNA, 64 nt, Homo Sapiens
uugagcagugaaggaaggauaaaugcacacuucugacuauaauugaggaucauggacaaugaau

SEQ ID NO: 515427 - RNA, 64 nt, Homo Sapiens
uuagacaucuuucucauucaaaauuuuuguaaaagacuauaaguugaauuuacuucgacuucuu

SEQ ID NO: 515428 - RNA, 64 nt, Homo Sapiens
auaacacugaauuccccuauaguuuaaauacggagacuauaaugaaauuggaaaagaaaaacuc

SEQ ID NO: 515429 - RNA, 64 nt, Homo Sapiens
uaaaaugugucuuuuauuguaaauguacacauuggacuauaauguguuucauuaauauguacac

SEQ ID NO: 515430 - RNA, 64 nt, Homo Sapiens
uaagccuaugagaagauagaucuuuaauagccaugacuauaauuguggcuggaugcuguuaauu

SEQ ID NO: 515431 - RNA, 64 nt, Homo Sapiens
uugauuucuuauugcuguacaaaagagggacauggacuauaacguuugaaauuaucacccauau

SEQ ID NO: 515432 - RNA, 64 nt, Homo Sapiens
cagagccagaugccaugcuuggcagcagcaguaggacuauaaaccacagcugucccccaggauc

SEQ ID NO: 515433 - RNA, 64 nt, Homo Sapiens
cuuuuuggcaauuuuuauugaccuguugaaucuugacuauaaaaugaucugagaaguaaggaag

SEQ ID NO: 515434 - RNA, 64 nt, Homo Sapiens
ccaaacaggcuguuuauggcucuagcugcguacugacuauaaaauagaugcuggacucugguug

SEQ ID NO: 515435 - RNA, 64 nt, Homo Sapiens
ugcuucuauuuauagccucugucaaaagucaaaagacuauaaaugcuuugcaaaaaugguuuca

SEQ ID NO: 515436 - RNA, 64 nt, Homo Sapiens
uagugaguacuagagaguucuguauuuuauuauugacuauaauaauuaguuuaauuagcuuugc

SEQ ID NO: 515437 - RNA, 64 nt, Homo Sapiens
aaauauugaauuaaaaccuuuaucuuuauacguggacuauaauacauguaacccucaugaaaau

SEQ ID NO: 515438 - RNA, 64 nt, Homo Sapiens
aagcugauuauuuaaaucacaucucaguugauaagacuauaagaauuguguuuacaauuuuaua

SEQ ID NO: 515439 - RNA, 64 nt, Homo Sapiens
uauuuccauaauuuauuuggcacuggacugugaagacuauaauugacccauggguggcuaaauc

SEQ ID NO: 515440 - RNA, 64 nt, Homo Sapiens
cuuaugggaccaaauuuaaggcaaacugaaauaugacuauaauucccuagaauuagggcacauu

SEQ ID NO: 515441 - RNA, 64 nt, Homo Sapiens
gggaggcagaauucagguuggugggggagacagggacuauaacagggagcacccacaggucucu

SEQ ID NO: 515442 - RNA, 64 nt, Homo Sapiens
augucuccaucugccuuaccccagacagacuauagacuauaaauccugucuggcagucagcuuc

SEQ ID NO: 515443 - RNA, 64 nt, Homo Sapiens
gucauaaauaaguccuuguguuaggaaaaguugagacuauaagaaucuugggcugggguugucu

SEQ ID NO: 515444 - RNA, 64 nt, Homo Sapiens
auuaaaagaagacuggaagcuguuacuuuggaaugacuauaaacugugaaaguguaaaauagaa

SEQ ID NO: 515445 - RNA, 64 nt, Homo Sapiens
ccucuccuuaaaugcuucuaugcaucccacugcugacuauaaugcaucaauaaaacaguuggca

SEQ ID NO: 515446 - RNA, 64 nt, Homo Sapiens
guuuuagaaacuaaacuuucuagagcaauaaaaugacuauaauguuaaguaaacauaauguuga

SEQ ID NO: 515447 - RNA, 64 nt, Homo Sapiens
ucaguuacaaaugggcauuuaguauaguuauauugacuauaacauguaaguaaauagcuuucua

SEQ ID NO: 515448 - RNA, 64 nt, Homo Sapiens
gcaguucucccaccucagccucucgacuaacagggacuauaaucuugcagcaccaugccgagcu

SEQ ID NO: 515449 - RNA, 64 nt, Homo Sapiens
uuugauuuuguaugcuauuuuuucacuauaggaugacuauaauucuggucacuaaauauacacu

SEQ ID NO: 515450 - RNA, 64 nt, Homo Sapiens
cgaaacgucuaauacuaugacuguuaaaaugucagacuauaacaaauaucuaucuuuuauuuuu

SEQ ID NO: 515451 - RNA, 64 nt, Homo Sapiens
aguguuccacauauauguauauguauauuuuaaugacuauaauguaauaaaguuuauaucaugu

SEQ ID NO: 515452 - RNA, 64 nt, Homo Sapiens
ugucacauuauguaaaaggcagaaacauaccuuugacuauaagaaauuaaaaaaaaaacaccaa

SEQ ID NO: 515453 - RNA, 64 nt, Homo Sapiens
acugaugcugcucuacugcugcacacuuuuucuggacuauaauaaaucugugugacugacugau

SEQ ID NO: 515454 - RNA, 64 nt, Homo Sapiens
caugcuauggcacauauauuaugcugggaacaaugacuauaagaguuugguaccauagugugaa

SEQ ID NO: 515455 - RNA, 64 nt, Homo Sapiens
aacaucauucagaaaacuuuacugugugaauucagacuauaaaaauacuauaaauuaauguaau

SEQ ID NO: 515456 - RNA, 64 nt, Homo Sapiens
gguuguugaaauggccaacacugguacagacacggacuauaaaaaucuccaagcuugugcuuac

SEQ ID NO: 515457 - RNA, 64 nt, Homo Sapiens
uuugagauccauccuuuaucaagaagucugaagcgacuauaaagguuuuugaauucagauuuaa

SEQ ID NO: 515458 - RNA, 64 nt, Homo Sapiens
uuguucuuuuucuuauagguccuucagucuuggagacuauaagggagccucugcacccagggaa

SEQ ID NO: 515459 - RNA, 64 nt, Homo Sapiens
cuuugcuuuuuaaaguuuauaauuagcauugucagacuauaaacuuuuuauauacaauuaggau

SEQ ID NO: 515460 - RNA, 64 nt, Homo Sapiens
cuggccauguuuuucaucauacauauaaccaucagacuauaauuugaaacugcaaaaacacuga

SEQ ID NO: 515461 - RNA, 64 nt, Homo Sapiens
auaacuccuguucugcauagucaugucuaauggagacuauaauucggauccuucucaggaagcu

SEQ ID NO: 515462 - RNA, 64 nt, Homo Sapiens
agugugaacaaaucaaugccaagcuuugcguucugacuauaaaacucuugauguuuacaugcac

SEQ ID NO: 515463 - RNA, 64 nt, Homo Sapiens
auuuaggcuaucauuauguuccgaagagaguucggacuauaaguuugacuaaugcucuauaaau

SEQ ID NO: 515464 - RNA, 64 nt, Homo Sapiens
uaagugcugauugugauuuuuuguuugcuggauugacuauaacucuuguauauuuuuuugucuc

SEQ ID NO: 515465 - RNA, 64 nt, Homo Sapiens
gugaacauuccuuauagaaaccuuucacaugaaugacuauaaacugaagcuuuaaaugagcugu

SEQ ID NO: 515466 - RNA, 64 nt, Homo Sapiens
aauaauuauuuauuacauaauuuaguuguuucuagacuauaaauguugcuaugugccuuauguu

SEQ ID NO: 515467 - RNA, 64 nt, Homo Sapiens
ucuuuugaaaaguaaauuccuuguuuacugguuugacuauaauucucuguuaucuuuacgaggu

SEQ ID NO: 515468 - RNA, 64 nt, Homo Sapiens
uaagcaccauucccuuagaguggauccagguguugacuauaaccagauuuacucuuugcuuacu

SEQ ID NO: 515469 - RNA, 64 nt, Homo Sapiens
aucauuuacaggugguauaaaauccaaaauaucugacuauaaaauauuuuuuugaguuuuuugu

SEQ ID NO: 515470 - RNA, 64 nt, Homo Sapiens
gcuggagcccagcacucacauggcagguuaaugggacuauaaauugcuaauaaacgauucuugu

SEQ ID NO: 515471 - RNA, 64 nt, Homo Sapiens
uucauauuuaaacaaagcaaaaccaugagaagcagacuauaauacagaaagacuauuauuuccu

SEQ ID NO: 515472 - RNA, 64 nt, Homo Sapiens
ugggagccaauuuuugccucauuacaguggcuuugacuauaaugaugaauaaaauauugauuug

SEQ ID NO: 515473 - RNA, 64 nt, Homo Sapiens
guaauugaaaaaaaugcaguuuccuuuaauccuugacuauaaguuauacuauguugcguacaug

SEQ ID NO: 515474 - RNA, 64 nt, Homo Sapiens
ucuguaucuaaauguauaccauccacuuguaaaugacuauaaacuauuaugugauugcuuuuuu

SEQ ID NO: 515475 - RNA, 64 nt, Homo Sapiens
auaggauuaugauuucaucaugcacaauccaaaagacuauaaauccaugggaaacagaauuuca

SEQ ID NO: 515476 - RNA, 64 nt, Homo Sapiens
cuacuuuguuuaauguagagcaggccuuugaaaagacuauaauuacuuuuuguguuaucuggca

SEQ ID NO: 515477 - RNA, 64 nt, Homo Sapiens
uuguuuaaucaauggaauuuuccuccucaucuuugacuauaaaaggcccuuugaagaguuagcu

SEQ ID NO: 515478 - RNA, 64 nt, Homo Sapiens
gugaaaccuaaaggaagugguucuguugcaaauggacuauaaacagggacauuauauucuuaca

SEQ ID NO: 515479 - RNA, 64 nt, Homo Sapiens
ucagaaucuuccuuuggacaaaacaucacuagcugacuauaaaaacaaaagugucaucauugaa

SEQ ID NO: 515480 - RNA, 64 nt, Homo Sapiens
uguucaugagggacugaauaagggccgaagagaugacuauaaaaggaaucacauauuucacaac

SEQ ID NO: 515481 - RNA, 64 nt, Homo Sapiens
uuguaaagguaaaucuaaugaauuaauuauucuugacuauaaccuagaguuugcuuaaaauaca

SEQ ID NO: 515482 - RNA, 64 nt, Homo Sapiens
acuauagcauuguacauuugaaaguaguguucuagacuauaaaaccaaugaacuucuacaugag

SEQ ID NO: 515483 - RNA, 64 nt, Homo Sapiens
ggccaaaauguguuuuuuuuuuaauaaguaacuugacuauaaaauaaagccguccgugggacga

SEQ ID NO: 515484 - RNA, 64 nt, Homo Sapiens
aaauucuagcagaaggccccauggguuagaaaaggacuauaagaauaauuucuuauuuaauuuu

SEQ ID NO: 515485 - RNA, 64 nt, Homo Sapiens
uuuagucugaaacacaauugugcugaaucugucugacuauaacucugaccacacagaaccaggg

SEQ ID NO: 515486 - RNA, 64 nt, Homo Sapiens
gaauccaggucuaaaacacacuagaguagcuggugacuauaaauaauauuuuaaaaugcugugu

SEQ ID NO: 515487 - RNA, 64 nt, Homo Sapiens
aacaaaaaucucauugugucucacuucaauuaaagacuauaaacaaauagaucuauuucccuua

SEQ ID NO: 515488 - RNA, 64 nt, Homo Sapiens
gugcuugguuucaaaagcaaaugucccucauuuugacuauaacuacauaaccucauucugaaua

SEQ ID NO: 515489 - RNA, 64 nt, Homo Sapiens
ucuacucccuugggauuguaagcagucauucaaugacuauaaccacgaagaggacaugguauca

SEQ ID NO: 515490 - RNA, 64 nt, Homo Sapiens
agugauaguggguauucuuguccagcagaaugcugacuauaaguaaauugcaguggcuaggacc

SEQ ID NO: 515491 - RNA, 64 nt, Homo Sapiens
ugacacauggaacuaauggauuuaacaauauaaugacuauaaaauucuuccuugugcuucuaau

SEQ ID NO: 515492 - RNA, 64 nt, Homo Sapiens
uugaaacaaagaguuagcugucuugauauaugaagacuauaaacguuuguccuuuuaauuuguu

SEQ ID NO: 515493 - RNA, 64 nt, Homo Sapiens
uuucaaaugccauggguuacacuuuuaugggcaugacuauaaccauuuuuguaaagaguaagag

SEQ ID NO: 515494 - RNA, 64 nt, Homo Sapiens
augaagaaauuaguccuaacaacacuaugagauggacuauaacuugcccaaauuuuuuuuuuuu

SEQ ID NO: 515495 - RNA, 64 nt, Homo Sapiens
cccacucagcaccaccggccuggccuugccugcagacuauaaacuauaaccacuagcucgacac

SEQ ID NO: 515496 - RNA, 64 nt, Homo Sapiens
acuaugugaaaguuaacugcggagccaagaguuggacuauaauuaaauuaccuuccuuguacuu

SEQ ID NO: 515497 - RNA, 64 nt, Homo Sapiens
uugggugggagaggaaagcaaauuuuauuuucuugacuauaaauuuguuauucuugguaucauu

SEQ ID NO: 515498 - RNA, 64 nt, Homo Sapiens
accugucuccaaaaccaugcuacuuaccuauguggacuauaauauuuccaugagaagcacugca

SEQ ID NO: 515499 - RNA, 64 nt, Homo Sapiens
uaaggggauauuagguuugcuaaauucuuucacagacuauaaaacaaaaaauuuugaggaacac

SEQ ID NO: 515500 - RNA, 64 nt, Homo Sapiens
gcccuacaaagagaaaccaaaugagcugauuacugacuauaaguucucagccuuuauggaccua

SEQ ID NO: 515501 - RNA, 64 nt, Homo Sapiens
uccaagaagaaagcaccaagacaacauuucauaugacuauaaugcauguacuauauaagcugau

SEQ ID NO: 515502 - RNA, 64 nt, Homo Sapiens
gcuccaugggcauggggaaggcacugaaacagaggacuauaaaacauccuucucuuauucucca

SEQ ID NO: 515503 - RNA, 64 nt, Homo Sapiens
gacuuuaugccuugacauauuuuagugggagccagacuauaaggaauaaaaggaaaaacuuucu

SEQ ID NO: 515504 - RNA, 64 nt, Homo Sapiens
uaguucugaguaugcuaaacugugugcuuauauagacuauaaccaguugugccuuccuucgcau

SEQ ID NO: 515505 - RNA, 64 nt, Homo Sapiens
ccacguaucuuccagucucuuuuauaaagucucagacuauaauaaacacagcuugcccaguuua

SEQ ID NO: 515506 - RNA, 64 nt, Homo Sapiens
acggcaaguaagaguuggaaacuuugagaacacagacuauaaaggcagcagcccgaacacuguc

SEQ ID NO: 515507 - RNA, 64 nt, Homo Sapiens
aaaagcauaauuuucucauuacuuuauuuuaugugacuauaauauggacaacuugauguaacug

SEQ ID NO: 515508 - RNA, 64 nt, Homo Sapiens
gguauucuaauaaaauugugugaauucaacugcugacuauaaaugauuaacuggaaaauauauc

SEQ ID NO: 515509 - RNA, 64 nt, Homo Sapiens
uuuaaacaugcaaaauaacuuuuacaaauaaucagacuauaauaaguauuugggguuuuguuug

SEQ ID NO: 515510 - RNA, 64 nt, Homo Sapiens
aaggaugcaccuguacucucucccagcauugauugacuauaagaaagucacaucuaccuauuac

SEQ ID NO: 515511 - RNA, 64 nt, Homo Sapiens
aaggacacaucuguacucugucccagcauugacugacuauaagaagucacaucugccuguuacu

SEQ ID NO: 515512 - RNA, 64 nt, Homo Sapiens
uaugaacucccauuagcuugcuuaucaagucccagacuauaaaucaugccaccccaaauccugg

SEQ ID NO: 515513 - RNA, 64 nt, Homo Sapiens
aguuugauuuaaaauuaugcauuguuauuuuaaggacuauaaagccuuaugaggcucucgcugu

SEQ ID NO: 515514 - RNA, 64 nt, Homo Sapiens
auuucauuaugaacuuuuauuuacaugacucuaagacuauaagaaaaucugauggcagugacaa

SEQ ID NO: 515515 - RNA, 64 nt, Homo Sapiens
augcaguacguucucaggauuuauugcaagcauugacuauaauugugaugagacaaacugaaaa

SEQ ID NO: 515516 - RNA, 64 nt, Homo Sapiens
uaaaaccaaucaauaauagcuagcuauuacugcagacuauaaaaucuggauauagaaaggagac

SEQ ID NO: 515517 - RNA, 64 nt, Homo Sapiens
uuugcgguuagaaucccauggauguuucuucuuugacuauaacaaaaucuggggaggacaaagg

SEQ ID NO: 515518 - RNA, 64 nt, Homo Sapiens
caguuauguaguaucuuuuguuuaaaaaauaagggacuauaaauuugaguuauuuccucauucu

SEQ ID NO: 515519 - RNA, 64 nt, Homo Sapiens
aaaaacuuauuuuauccuucccccuuuacuauaagacuauaaaugucuugcaaguuaaggcuuc

SEQ ID NO: 515520 - RNA, 64 nt, Homo Sapiens
uuuaagaaaaagcuaaaaagaauggaaaucgcaugacuauaacuuaagucuuucuucaaagugc

SEQ ID NO: 515521 - RNA, 64 nt, Homo Sapiens
ugaacuagauagacccugccuuaguagagggugggacuauaaccuuagaggccagaacuugauc

SEQ ID NO: 515522 - RNA, 64 nt, Homo Sapiens
ccucuuucuuguuugucagcaucugaccaucugugacuauaaagcuguuauucuuguuauacca

SEQ ID NO: 515523 - RNA, 64 nt, Homo Sapiens
uaagucuuucuucaaagugcaauggaaaucgcaugacuauaacuuugaagaaaaagcuaaaaag

SEQ ID NO: 515524 - RNA, 64 nt, Homo Sapiens
aagauagguuugagggcauaggacgguuuggucagacuauaaauccugccacugagcagucugg

SEQ ID NO: 515525 - RNA, 64 nt, Homo Sapiens
cuaaacuuuugcgaaagugggucauuuuuuguuugacuauaauagcaggaagaauuauagcaau

SEQ ID NO: 515526 - RNA, 64 nt, Homo Sapiens
acauaaguuuuguuagagguaaaaauuaaauuuggacuauaauguccuugcuuuauuugagaac

SEQ ID NO: 515527 - RNA, 64 nt, Homo Sapiens
aacuggaauauuugucuucagaaaauggaaacaagacuauaaaugauaagcccugucccuagca

SEQ ID NO: 515528 - RNA, 64 nt, Homo Sapiens
cgccugucugcccccucgacgcugcugccacuuugacuauaaccauuuuuggcuaaauaaauga

SEQ ID NO: 515529 - RNA, 64 nt, Homo Sapiens
aguagucuauuggaacaccaacuccagacuaggagacuauaaaccauacaauuguauuucuaga

SEQ ID NO: 515530 - RNA, 64 nt, Homo Sapiens
gaucagcauugugacuuggagauaauaaaauuuagacuauaaacuuggcucccuugccaguguu

SEQ ID NO: 515531 - RNA, 64 nt, Homo Sapiens
uugggcacucccaagggcguuggggucauaaggagacuauaacucuacagauugugaauauauu

SEQ ID NO: 515532 - RNA, 64 nt, Homo Sapiens
auaguggaggguugagaugucaggcaauucaguggacuauaauaacaaaaaacugccuuugaua

SEQ ID NO: 515533 - RNA, 64 nt, Homo Sapiens
auuucacaaaacaggaccugaauaugaaaacagagacuauaaagucagaccagugagcaaaagg

SEQ ID NO: 515534 - RNA, 64 nt, Homo Sapiens
aagcuucccuacugcaaauccccugcacgaucuugacuauaauauggccuggggugcucucaca

SEQ ID NO: 515535 - RNA, 64 nt, Homo Sapiens
aaauggaauuauuucccucuuauauaucaccacagacuauaagguugaagagcuacacauugua

SEQ ID NO: 515536 - RNA, 64 nt, Homo Sapiens
caaacuuuuuuuuuuuuuuauuguuugugaaagugacuauaaccccuuauaguuuaugaauguc

SEQ ID NO: 515537 - RNA, 64 nt, Homo Sapiens
aggucugauaaacugaugaauuuaaugugacauugacuauaagaauuauuuacucggauucuaa

SEQ ID NO: 515538 - RNA, 58 nt, Homo Sapiens
uauuuguuaggacuucaaaugacuugaugacuauaaaauagaaaagaagaaagauuga

SEQ ID NO: 515539 - RNA, 64 nt, Homo Sapiens
gccuaauuucugugauuuccaaccaacaugaaaugacuauaaaugguuuuuuaaugaaaaaaga

SEQ ID NO: 515540 - RNA, 64 nt, Homo Sapiens
cguaaagguaucagggccgggcgcuguggcucaugacuauaaucccagcuguuugagaggccaa

SEQ ID NO: 515541 - RNA, 64 nt, Homo Sapiens
aauauugaaaacgacgauauaauuauuauaaguagacuauaauauauuuaguaauauauauuau

SEQ ID NO: 515542 - RNA, 64 nt, Homo Sapiens
gccuuuggugggaagauaaacuaugaauguggcagacuauaaaaauuguauacugagaaaaauc

SEQ ID NO: 515543 - RNA, 64 nt, Homo Sapiens
uuccuauuugauguguguguugcaagagaauuaggacuauaauuaauuacuaccgugacuggga

SEQ ID NO: 515544 - RNA, 64 nt, Homo Sapiens
auuuauuaccuaggguacaguccuugacagaauugacuauaacguugaacaguccuguaucaaa

SEQ ID NO: 515545 - RNA, 64 nt, Homo Sapiens
gaaaaaagugaauucaaagcaaaaauaacuauuugacuauaauauaggccacaaaaaaucuuga

SEQ ID NO: 515546 - RNA, 64 nt, Homo Sapiens
gagcuuuuuuauuuugggaguuguuuucguuuuugacuauaaaggcuuuguauauuuugauuac

SEQ ID NO: 515547 - RNA, 64 nt, Homo Sapiens
ugugauacaugccgaaugccacacguaaacacuugacuauaaaaacugccccccuccuuuccaa

SEQ ID NO: 515548 - RNA, 64 nt, Homo Sapiens
gagagaaaugaugccguuuuuuaaaugugaagcagacuauaauucucagcucucuuuucuucuu

SEQ ID NO: 515549 - RNA, 64 nt, Homo Sapiens
uuuuacaccauggagaugagaucagcagaauccagacuauaagaaacuacaggacacaugaccu

SEQ ID NO: 515550 - RNA, 64 nt, Homo Sapiens
aacauuugacacacauacucaaaaaaauguaacugacuauaaacacuuuaaccuaaucaucugu

SEQ ID NO: 515551 - RNA, 64 nt, Homo Sapiens
gggauagggacuggagggggugugggguauguaugacuauaaagggaugacgcaaggaguuccu

SEQ ID NO: 515552 - RNA, 64 nt, Homo Sapiens
auaaaucauaguaauaauaugucucauguuugcugacuauaaaacuagaaggaaaagcuuuuaa

SEQ ID NO: 515553 - RNA, 64 nt, Homo Sapiens
aaauguucucuacauguuaguugggaagagauaugacuauaaauaugauuaugaauuuguuuac

SEQ ID NO: 515554 - RNA, 64 nt, Homo Sapiens
gcuagaaggaaaagcaugaagucucauguuugcugacuauaaaaauaaaucauaguaauaauau

SEQ ID NO: 515555 - RNA, 64 nt, Homo Sapiens; identical to SEQ ID NO: 85480

SEQ ID NO: 515556 - RNA, 64 nt, Homo Sapiens; identical to SEQ ID NO: 85481

SEQ ID NO: 515557 - RNA, 64 nt, Homo Sapiens; identical to SEQ ID NO: 85482

SEQ ID NO: 515558 - RNA, 64 nt, Homo Sapiens; identical to SEQ ID NO: 85483

SEQ ID NO: 515559 - RNA, 64 nt, Homo Sapiens; identical to SEQ ID NO: 85484

SEQ ID NO: 515560 - RNA, 64 nt, Homo Sapiens; identical to SEQ ID NO: 85485

SEQ ID NO: 515561 - RNA, 64 nt, Homo Sapiens; identical to SEQ ID NO: 85486

SEQ ID NO: 515562 - RNA, 64 nt, Homo Sapiens; identical to SEQ ID NO: 85487

SEQ ID NO: 515563 - RNA, 64 nt, Homo Sapiens; identical to SEQ ID NO: 85488

SEQ ID NO: 515564 - RNA, 64 nt, Homo Sapiens; identical to SEQ ID NO: 85489

SEQ ID NO: 515565 - RNA, 64 nt, Homo Sapiens; identical to SEQ ID NO: 85490

SEQ ID NO: 515566 - RNA, 64 nt, Homo Sapiens; identical to SEQ ID NO: 85491

SEQ ID NO: 515567 - RNA, 64 nt, Homo Sapiens; identical to SEQ ID NO: 85492

SEQ ID NO: 515568 - RNA, 64 nt, Homo Sapiens; identical to SEQ ID NO: 85493

SEQ ID NO: 515569 - RNA, 64 nt, Homo Sapiens; identical to SEQ ID NO: 85494

SEQ ID NO: 515570 - RNA, 64 nt, Homo Sapiens; identical to SEQ ID NO: 85495

SEQ ID NO: 515571 - RNA, 64 nt, Homo Sapiens; identical to SEQ ID NO: 85496

SEQ ID NO: 515572 - RNA, 64 nt, Homo Sapiens; identical to SEQ ID NO: 85497

SEQ ID NO: 515573 - RNA, 64 nt, Homo Sapiens; identical to SEQ ID NO: 85498

SEQ ID NO: 515574 - RNA, 64 nt, Homo Sapiens; identical to SEQ ID NO: 85499

SEQ ID NO: 515575 - RNA, 64 nt, Homo Sapiens; identical to SEQ ID NO: 85500

SEQ ID NO: 515576 - RNA, 64 nt, Homo Sapiens; identical to SEQ ID NO: 85501

SEQ ID NO: 515577 - RNA, 64 nt, Homo Sapiens; identical to SEQ ID NO: 85502

SEQ ID NO: 515578 - RNA, 64 nt, Homo Sapiens; identical to SEQ ID NO: 85503

SEQ ID NO: 515579 - RNA, 64 nt, Homo Sapiens; identical to SEQ ID NO: 85504

SEQ ID NO: 515580 - RNA, 64 nt, Homo Sapiens; identical to SEQ ID NO: 85505

SEQ ID NO: 515581 - RNA, 64 nt, Homo Sapiens; identical to SEQ ID NO: 85506

SEQ ID NO: 515582 - RNA, 64 nt, Homo Sapiens; identical to SEQ ID NO: 85507

SEQ ID NO: 515583 - RNA, 64 nt, Homo Sapiens; identical to SEQ ID NO: 85508

SEQ ID NO: 515584 - RNA, 64 nt, Homo Sapiens; identical to SEQ ID NO: 85509

SEQ ID NO: 515585 - RNA, 64 nt, Homo Sapiens; identical to SEQ ID NO: 85510

SEQ ID NO: 515586 - RNA, 64 nt, Homo Sapiens; identical to SEQ ID NO: 85511

SEQ ID NO: 515587 - RNA, 64 nt, Homo Sapiens; identical to SEQ ID NO: 85512

SEQ ID NO: 515588 - RNA, 64 nt, Homo Sapiens; identical to SEQ ID NO: 85513

SEQ ID NO: 515589 - RNA, 64 nt, Homo Sapiens; identical to SEQ ID NO: 85514

SEQ ID NO: 515590 - RNA, 64 nt, Homo Sapiens; identical to SEQ ID NO: 85515

SEQ ID NO: 515591 - RNA, 64 nt, Homo Sapiens; identical to SEQ ID NO: 85516

SEQ ID NO: 515592 - RNA, 64 nt, Homo Sapiens; identical to SEQ ID NO: 85517

SEQ ID NO: 515593 - RNA, 64 nt, Homo Sapiens; identical to SEQ ID NO: 85518

SEQ ID NO: 515594 - RNA, 64 nt, Homo Sapiens; identical to SEQ ID NO: 85519

SEQ ID NO: 515595 - RNA, 64 nt, Homo Sapiens; identical to SEQ ID NO: 85520

SEQ ID NO: 515596 - RNA, 64 nt, Homo Sapiens; identical to SEQ ID NO: 85521

SEQ ID NO: 515597 - RNA, 64 nt, Homo Sapiens; identical to SEQ ID NO: 85522

SEQ ID NO: 515598 - RNA, 64 nt, Homo Sapiens; identical to SEQ ID NO: 85523

SEQ ID NO: 515599 - RNA, 60 nt, Homo Sapiens
cauugugaagaggaggaaaagugaaucacggagagagaaaggaaaggauagaaucacagg

SEQ ID NO: 515600 - RNA, 60 nt, Homo Sapiens
augucugugacacaggacggugggaagccugagagagagugaaauuaugugauacacuga

SEQ ID NO: 515601 - RNA, 60 nt, Homo Sapiens
cccacagugguggccucugccucuuuccuggagagagaaggacagugcacggagagguuu

SEQ ID NO: 515602 - RNA, 60 nt, Homo Sapiens
cccuaccugucuuuccugaguguuugaggggagagagagacccacaucuccccaaagaga

SEQ ID NO: 515603 - RNA, 60 nt, Homo Sapiens
cuaccugucuuuccugaguguuugaggggagagagagacccacaucuccccaaagagaug

SEQ ID NO: 515604 - RNA, 60 nt, Homo Sapiens
aggcucacugccaggccagccuccgagagggagagagagagagagaggacagcuugagcc

SEQ ID NO: 515605 - RNA, 60 nt, Homo Sapiens
gcucacugccaggccagccuccgagagggagagagagagagagaggacagcuugagccgg

SEQ ID NO: 515606 - RNA, 60 nt, Homo Sapiens
ucacugccaggccagccuccgagagggagagagagagagagaggacagcuugagccgggc

SEQ ID NO: 515607 - RNA, 60 nt, Homo Sapiens
acugccaggccagccuccgagagggagagagagagagagaggacagcuugagccgggccc

SEQ ID NO: 515608 - RNA, 60 nt, Homo Sapiens
ugccaggccagccuccgagagggagagagagagagagaggacagcuugagccgggccccu

SEQ ID NO: 515609 - RNA, 60 nt, Homo Sapiens
gaucuuacagguaucaggcacaggcaggaagagagagagagagguucuggggaggaaggg

SEQ ID NO: 515610 - RNA, 60 nt, Homo Sapiens
ucuuacagguaucaggcacaggcaggaagagagagagagagguucuggggaggaagggcc

SEQ ID NO: 515611 - RNA, 60 nt, Homo Sapiens
uuacagguaucaggcacaggcaggaagagagagagagagguucuggggaggaagggccag

SEQ ID NO: 515612 - RNA, 60 nt, Homo Sapiens
gagagagagguucuggggaggaagggccaggagagagaucuagaaaguggguucacuaga

SEQ ID NO: 515613 - RNA, 60 nt, Homo Sapiens
ccuuucccugucuggcuucucccuuaagaagagagagauacuuguagaauuggguggggg

SEQ ID NO: 515614 - RNA, 60 nt, Homo Sapiens
ccuuccauuugggauauguuacauuagagugagagagagaauaaggagccuuucuuaugg

SEQ ID NO: 515615 - RNA, 60 nt, Homo Sapiens
uuccauuugggauauguuacauuagagugagagagagaauaaggagccuuucuuauggaa

SEQ ID NO: 515616 - RNA, 60 nt, Homo Sapiens
ugggaccucgaggcucgagcugaagcaggcgagagagaaacagcuacugcgugcgugcgc

SEQ ID NO: 515617 - RNA, 60 nt, Homo Sapiens
ucugucgaagaaagaagcucugucaaguuagagagagacaauguguaggaaauguucuuu

SEQ ID NO: 515618 - RNA, 60 nt, Homo Sapiens
acucuccguccccccggggcccuccggagggagagagagaggaacugcuguuuaucucac

SEQ ID NO: 515619 - RNA, 60 nt, Homo Sapiens
ucuccguccccccggggcccuccggagggagagagagaggaacugcuguuuaucucacuc

SEQ ID NO: 515620 - RNA, 60 nt, Homo Sapiens
aagagcauguacaugggagugagagaaaaagagagagagagacagaguggcgggggcggg

SEQ ID NO: 515621 - RNA, 60 nt, Homo Sapiens
gagcauguacaugggagugagagaaaaagagagagagagacagaguggcgggggcgggga

SEQ ID NO: 515622 - RNA, 60 nt, Homo Sapiens
gcauguacaugggagugagagaaaaagagagagagagacagaguggcgggggcggggagg

SEQ ID NO: 515623 - RNA, 60 nt, Homo Sapiens
aguuccuaaaugauucucacaagcaacccugagagagacagucuugugagggagaucugg

SEQ ID NO: 515624 - RNA, 60 nt, Homo Sapiens
aaacaaaaaacaauggaaaagaugaagcuggagagagaggaaccaguugccaagguagag

SEQ ID NO: 515625 - RNA, 60 nt, Homo Sapiens
gcagcagccucagcagcugucuugguaaaggagagagagagacauggggccaguaauucc

SEQ ID NO: 515626 - RNA, 60 nt, Homo Sapiens
agcagccucagcagcugucuugguaaaggagagagagagacauggggccaguaauuccgg

SEQ ID NO: 515627 - RNA, 60 nt, Homo Sapiens
cagccucagcagcugucuugguaaaggagagagagagacauggggccaguaauuccgggg

SEQ ID NO: 515628 - RNA, 60 nt, Homo Sapiens
gaaacugaggagucugcaauuuggaauauggagagagagacugauuugcugaauuuccuu

SEQ ID NO: 515629 - RNA, 60 nt, Homo Sapiens
aacugaggagucugcaauuuggaauauggagagagagacugauuugcugaauuuccuucu

SEQ ID NO: 515630 - RNA, 60 nt, Homo Sapiens
gaaccacaaugcacauuagcauauuagucugagagagaacuuauaguaaggaaacucacu

SEQ ID NO: 515631 - RNA, 60 nt, Homo Sapiens
ccuggaaacuuugacaagcuuuauuaaguugagagagagagaggggaaaaaaaaaagccu

SEQ ID NO: 515632 - RNA, 60 nt, Homo Sapiens
uggaaacuuugacaagcuuuauuaaguugagagagagagaggggaaaaaaaaaagccuuu

SEQ ID NO: 515633 - RNA, 60 nt, Homo Sapiens
gaaacuuugacaagcuuuauuaaguugagagagagagaggggaaaaaaaaaagccuuucg

SEQ ID NO: 515634 - RNA, 60 nt, Homo Sapiens
cagucauggcccccuuccucgcaggagggagagagagacaggcggccgcggcugggcccu

SEQ ID NO: 515635 - RNA, 60 nt, Homo Sapiens
cacagucauggcccccuucccugcaggagggagagagagaucggcggccgcggcugggcc

SEQ ID NO: 515636 - RNA, 60 nt, Homo Sapiens
guagaugaguacuugccuagaucuguuugagagagagaaagaaauguccagaauaggcaa

SEQ ID NO: 515637 - RNA, 60 nt, Homo Sapiens
aaguagaugaguacuugccuaaaucuguuugagagagagaaugaaauguccagaauaggc

SEQ ID NO: 515638 - RNA, 60 nt, Homo Sapiens
cugggcccagccgggccgugugcagguggagagagagaagguucuccccccuacacccuc

SEQ ID NO: 515639 - RNA, 60 nt, Homo Sapiens
agcugggcccagccgggccgucugcagguggagagagagaggguucuccccccuacaccc

SEQ ID NO: 515640 - RNA, 60 nt, Homo Sapiens
gaauggcgugggaugggggaccuugcugcagagagagaagucucuagagguagaaauuug

SEQ ID NO: 515641 - RNA, 60 nt, Homo Sapiens
ugccgcaaagcacaaggcugugcaccagcugagagagacuagacacaggucucccguccc

SEQ ID NO: 515642 - RNA, 60 nt, Homo Sapiens
aaaagaaaaaugaagaaaagggaagaaagggagagagaagaaauaaaaagaagagaggga

SEQ ID NO: 515643 - RNA, 60 nt, Homo Sapiens
gacuguuaugaaaaacagaagggggauaaagagagagaagcuagggucugcuuuagagaa

SEQ ID NO: 515644 - RNA, 60 nt, Homo Sapiens
ggauccucauaggucagggagagagacagagagagagaaugggacuccaggucuugagga

SEQ ID NO: 515645 - RNA, 60 nt, Homo Sapiens
auggauccucauaggucagggagagagacagagagagagacugggacuccaggucuugag

SEQ ID NO: 515646 - RNA, 60 nt, Homo Sapiens
gagagagagaauggauccucaggucuugaggagagagacagagcacuguucugggacucc

SEQ ID NO: 515647 - RNA, 60 nt, Homo Sapiens
caucugacacuucuuuuggaggacaagggagagagagacuagagccccacaaaacuuugg

SEQ ID NO: 515648 - RNA, 60 nt, Homo Sapiens
cucaucugacacuucuuuugggggacaagggagagagagaggagagccccacaaaacuuu

SEQ ID NO: 515649 - RNA, 60 nt, Homo Sapiens
cucagaguggaaggaggggggagagagagagagagagaucgagacagaaagagagagaga

SEQ ID NO: 515650 - RNA, 60 nt, Homo Sapiens
uccucagaguggaaggaggggagagagagagagagagagagagagacagaaagagagaga

SEQ ID NO: 515651 - RNA, 60 nt, Homo Sapiens
gauccucagaguggaaggaggagagagagagagagagagagagagagacagaaagagaga

SEQ ID NO: 515652 - RNA, 60 nt, Homo Sapiens
gagauccucagaguggaagggagagagagagagagagagagagagagagacagaaagaga

SEQ ID NO: 515653 - RNA, 60 nt, Homo Sapiens
gagagauccucagaguggaagagagagagagagagagagagagagagagagacagaaaga

SEQ ID NO: 515654 - RNA, 60 nt, Homo Sapiens
gagagagauccucagagugggagagagagagagagagagacagagagagagagacagaaa

SEQ ID NO: 515655 - RNA, 60 nt, Homo Sapiens
gagagagagauccucagaguaagagagagagagagagagaagcagagagagagagacaga

SEQ ID NO: 515656 - RNA, 60 nt, Homo Sapiens
gagagagagagauccucagagaaagagagagagagagagaguagcagagagagagagaca

SEQ ID NO: 515657 - RNA, 60 nt, Homo Sapiens
gagagagagagagauccucacagaaagagagagagagagaggguagcagagagagagaga

SEQ ID NO: 515658 - RNA, 60 nt, Homo Sapiens
gagagagagagagagauccugacagaaagagagagagagaaaggguagcagagagagaga

SEQ ID NO: 515659 - RNA, 60 nt, Homo Sapiens
gagagagagagagagagaucgagacagaaagagagagagaggaaggguagcagagagaga

SEQ ID NO: 515660 - RNA, 60 nt, Homo Sapiens
gaaagagagagagagagagaguagcagagagagagagacacugagggcagguugggaagg

SEQ ID NO: 515661 - RNA, 60 nt, Homo Sapiens
cagaaagagagagagagagaggguagcagagagagagagagucugagggcagguugggaa

SEQ ID NO: 515662 - RNA, 60 nt, Homo Sapiens
gacagaaagagagagagagaaaggguagcagagagagagagugucugagggcagguuggg

SEQ ID NO: 515663 - RNA, 60 nt, Homo Sapiens
acuugauucauuaaaaagucgugugugugagagagagaguaauguguguguguguucugu

SEQ ID NO: 515664 - RNA, 60 nt, Homo Sapiens
guacuugauucauuaaaaaggugugugugugagagagagaaaaauguguguguguguucu

SEQ ID NO: 515665 - RNA, 60 nt, Homo Sapiens
uuggagaaggacugggucagagaucuguuggagagagagaauaaagagauuauuuuucau

SEQ ID NO: 515666 - RNA, 60 nt, Homo Sapiens
ggagaaggacugggucagagaucuguuggagagagagaauaaagagauuauuuuucauua

SEQ ID NO: 515667 - RNA, 60 nt, Homo Sapiens
cacacauaaaagcacaaagacagagacgcagagagagagagagagccacggagaggaaaa

SEQ ID NO: 515668 - RNA, 60 nt, Homo Sapiens
cacauaaaagcacaaagacagagacgcagagagagagagagagccacggagaggaaaagc

SEQ ID NO: 515669 - RNA, 60 nt, Homo Sapiens
cauaaaagcacaaagacagagacgcagagagagagagagagccacggagaggaaaagcag

SEQ ID NO: 515670 - RNA, 60 nt, Homo Sapiens
uaaaagcacaaagacagagacgcagagagagagagagagccacggagaggaaaagcagau

SEQ ID NO: 515671 - RNA, 60 nt, Homo Sapiens
gcccagcaccccugcugauaccaccagacagagagagagagcacuugauucuucccgaga

SEQ ID NO: 515672 - RNA, 60 nt, Homo Sapiens
ccagcaccccugcugauaccaccagacagagagagagagcacuugauucuucccgagaua

SEQ ID NO: 515673 - RNA, 60 nt, Homo Sapiens
uccacagguggacaaagggauccccagccagagagagagagaccagccaacagcuugaua

SEQ ID NO: 515674 - RNA, 60 nt, Homo Sapiens
cacagguggacaaagggauccccagccagagagagagagaccagccaacagcuugauaga

SEQ ID NO: 515675 - RNA, 60 nt, Homo Sapiens
cagguggacaaagggauccccagccagagagagagagaccagccaacagcuugauagacc

SEQ ID NO: 515676 - RNA, 60 nt, Homo Sapiens
guguguguguguguguguguguguguggcagagagagagaaagagagagagagagagaaa

SEQ ID NO: 515677 - RNA, 60 nt, Homo Sapiens
guguguguguguguguguguguguggcagagagagagaaagagagagagagagagaaauu

SEQ ID NO: 515678 - RNA, 60 nt, Homo Sapiens
guguguguguguguggcagagagagagaaagagagagagagagagaaauucuguuaaaau

SEQ ID NO: 515679 - RNA, 60 nt, Homo Sapiens
guguguguguguggcagagagagagaaagagagagagagagagaaauucuguuaaaaucu

SEQ ID NO: 515680 - RNA, 60 nt, Homo Sapiens
guguguguguggcagagagagagaaagagagagagagagagaaauucuguuaaaaucuau

SEQ ID NO: 515681 - RNA, 60 nt, Homo Sapiens
guguguguggcagagagagagaaagagagagagagagagaaauucuguuaaaaucuauuc

SEQ ID NO: 515682 - RNA, 60 nt, Homo Sapiens
guguguggcagagagagagaaagagagagagagagagaaauucuguuaaaaucuauucug

SEQ ID NO: 515683 - RNA, 60 nt, Homo Sapiens
gauagcagugaggucagaagucuuucccgggagagagauggccuggguuaucauugcuga

SEQ ID NO: 515684 - RNA, 60 nt, Homo Sapiens
cauaggacugagccaaggaagagucugccugagagagacgcuuggccugugcuuugcugc

SEQ ID NO: 515685 - RNA, 60 nt, Homo Sapiens
aagaccaugcugcauacauuaaaagagagagagagagaaauccaguuccguucugagaga

SEQ ID NO: 515686 - RNA, 60 nt, Homo Sapiens
aaaagaccaugcugcauacagaaaaagagagagagagagauuuccaguuccguucugaga

SEQ ID NO: 515687 - RNA, 60 nt, Homo Sapiens
gaaaaagaccaugcugcauagagaaaaagagagagagagauguuuccaguuccguucuga

SEQ ID NO: 515688 - RNA, 60 nt, Homo Sapiens
gagaaaaagaccaugcugcagagagaaaaagagagagagagcuguuuccaguuccguucu

SEQ ID NO: 515689 - RNA, 60 nt, Homo Sapiens
acugaaaaagcaacuccucucacacagagagagagagaguuucugaaagaucuagugguu

SEQ ID NO: 515690 - RNA, 60 nt, Homo Sapiens
guacugaaaaagcaacuccuuucacacagagagagagagacuuucugaaagaucuagugg

SEQ ID NO: 515691 - RNA, 60 nt, Homo Sapiens
gaguacugaaaaagcaacucgguucacacagagagagagaggcuuucugaaagaucuagu

SEQ ID NO: 515692 - RNA, 60 nt, Homo Sapiens
augugugugugugugugcgugcauaagagagagagagaauugggauguggauggaugugu

SEQ ID NO: 515693 - RNA, 60 nt, Homo Sapiens
auaugugugugugugugugcgugcauaagagagagagagaguugggauguggauggaugu

SEQ ID NO: 515694 - RNA, 60 nt, Homo Sapiens
gaauaugugugugugugugugugugcauaagagagagagauuguugggauguggauggau

SEQ ID NO: 515695 - RNA, 60 nt, Homo Sapiens
gauggaggagaagaacuugggagagagagagagagagaaaggaaaagagagagagagaga

SEQ ID NO: 515696 - RNA, 60 nt, Homo Sapiens
aagauggaggagaagaacuugagagagagagagagagagaggggaaaagagagagagaga

SEQ ID NO: 515697 - RNA, 60 nt, Homo Sapiens
gaaagauggaggagaagaacgagagagagagagagagagaagggggaaaagagagagaga

SEQ ID NO: 515698 - RNA, 60 nt, Homo Sapiens
gagaaagauggaggagaagagagagagagagagagagagaggagggggaaaagagagaga

SEQ ID NO: 515699 - RNA, 60 nt, Homo Sapiens
gagagaaagauggaggagaagagagagagagagagagagaggggagggggaaaagagaga

SEQ ID NO: 515700 - RNA, 60 nt, Homo Sapiens
gagagagaaagauggaggaggagagagagagagagagagagaggggagggggaaaagaga

SEQ ID NO: 515701 - RNA, 60 nt, Homo Sapiens
gagagagagaaagauggagggagagagagagagagagagacagaggggagggggaaaaga

SEQ ID NO: 515702 - RNA, 60 nt, Homo Sapiens
gagagagagagaaagauggagagagagagagagagagagaugcagaggggagggggaaaa

SEQ ID NO: 515703 - RNA, 60 nt, Homo Sapiens
gagagagagagagaaagaugaagagagagagagagagagaauugcagaggggagggggaa

SEQ ID NO: 515704 - RNA, 60 nt, Homo Sapiens
gagagagagagagagaaagaaaaagagagagagagagagagaauugcagaggggaggggg

SEQ ID NO: 515705 - RNA, 60 nt, Homo Sapiens
gagagagagagagagagaaaggaaaagagagagagagagagugaauugcagaggggaggg

SEQ ID NO: 515706 - RNA, 60 nt, Homo Sapiens
gagagagagagagagagagaggggaaaagagagagagagaaagugaauugcagaggggag

SEQ ID NO: 515707 - RNA, 60 nt, Homo Sapiens
gagagagagagagagagagaagggggaaaagagagagagaggaagugaauugcagagggg

SEQ ID NO: 515708 - RNA, 60 nt, Homo Sapiens
gagauggaaugugucugguaccuugauggagagagagaagacucaucugaaucaucaguu

SEQ ID NO: 515709 - RNA, 60 nt, Homo Sapiens
aggagauggaaugugucugguuccuugauggagagagagagaacucaucugaaucaucag

SEQ ID NO: 515710 - RNA, 60 nt, Homo Sapiens
agagguaaaggagggagccaaagaaagagagagagagaaauucgacugggagguucugga

SEQ ID NO: 515711 - RNA, 60 nt, Homo Sapiens
aaagagguaaaggagggagcgaaagaaagagagagagagauguucgacugggagguucug

SEQ ID NO: 515712 - RNA, 60 nt, Homo Sapiens
gaaaagagguaaaggagggauggaaagaaagagagagagaccuguucgacugggagguuc

SEQ ID NO: 515713 - RNA, 60 nt, Homo Sapiens
auggacgugggagaaagcaagugagucagagagagagaggggcuagaaaccuggcuggcu

SEQ ID NO: 515714 - RNA, 60 nt, Homo Sapiens
ggauggacgugggagaaagccugugagucagagagagagaaaggcuagaaaccuggcugg

SEQ ID NO: 515715 - RNA, 60 nt, Homo Sapiens
gggauuugcccuauccacagcauuucccuugagagagaguaucuagggguuucuuggcca

SEQ ID NO: 515716 - RNA, 60 nt, Homo Sapiens
uucaaaaagaaaaaaauaauaaaaauaaaagagagagagaaucagaccuggguggaacuc

SEQ ID NO: 515717 - RNA, 60 nt, Homo Sapiens
caaaaagaaaaaaauaauaaaaauaaaagagagagagaaucagaccuggguggaacucuc

SEQ ID NO: 515718 - RNA, 60 nt, Homo Sapiens
cugggguggacauucagcagagugcgaguggagagagagagaugguguuuacucagaacc

SEQ ID NO: 515719 - RNA, 60 nt, Homo Sapiens
gggguggacauucagcagagugcgaguggagagagagagaugguguuuacucagaaccug

SEQ ID NO: 515720 - RNA, 60 nt, Homo Sapiens
gguggacauucagcagagugcgaguggagagagagagaugguguuuacucagaaccugcu

SEQ ID NO: 515721 - RNA, 60 nt, Homo Sapiens
caaggaaucauuguuuggcauugaaaauaggagagagaucaugagaaauuaccaaaaugu

SEQ ID NO: 515722 - RNA, 60 nt, Homo Sapiens
gaagucuuguucaggguauggggcuaggaugagagagaaugccacagaguaugaaggaag

SEQ ID NO: 515723 - RNA, 60 nt, Homo Sapiens
aagucaacaaagaacuuaccuuggaggauagagagagagaagggaccaauuaugaggacu

SEQ ID NO: 515724 - RNA, 60 nt, Homo Sapiens
gucaacaaagaacuuaccuuggaggauagagagagagaagggaccaauuaugaggacuga

SEQ ID NO: 515725 - RNA, 60 nt, Homo Sapiens
cuuaguguuuggguauauucauuucaaagggagagagagagguuuuuuucuguucugucu

SEQ ID NO: 515726 - RNA, 60 nt, Homo Sapiens
uaguguuuggguauauucauuucaaagggagagagagagguuuuuuucuguucugucuca

SEQ ID NO: 515727 - RNA, 60 nt, Homo Sapiens
guuuugaugcuagagaggaaaaaggacuuggagagagagaaggaauggcugguccagagg

SEQ ID NO: 515728 - RNA, 60 nt, Homo Sapiens
uuugaugcuagagaggaaaaaggacuuggagagagagaaggaauggcugguccagaggcu

SEQ ID NO: 515729 - RNA, 50 nt, Homo Sapiens; identical to SEQ ID NO: 157121

SEQ ID NO: 515730 - RNA, 52 nt, Homo Sapiens; identical to SEQ ID NO: 157122

SEQ ID NO: 515731 - RNA, 54 nt, Homo Sapiens; identical to SEQ ID NO: 157123

SEQ ID NO: 515732 - RNA, 56 nt, Homo Sapiens; identical to SEQ ID NO: 157124

SEQ ID NO: 515733 - RNA, 58 nt, Homo Sapiens; identical to SEQ ID NO: 157125

SEQ ID NO: 515734 - RNA, 60 nt, Homo Sapiens; identical to SEQ ID NO: 157126

SEQ ID NO: 515735 - RNA, 60 nt, Homo Sapiens
uucacugagauggagugagagagagagagagagagagaugacaaggagcacaagaagugg

SEQ ID NO: 515736 - RNA, 60 nt, Homo Sapiens
agggaauaagcaaagggggaagaauugaaagagagagagaagaaagaauacagagagcuu

SEQ ID NO: 515737 - RNA, 60 nt, Homo Sapiens
ggaauaagcaaagggggaagaauugaaagagagagagaagaaagaauacagagagcuuac

SEQ ID NO: 515738 - RNA, 60 nt, Homo Sapiens
cuuuauguguguguaugugugucagagaaagagagagagagagagagaagggaggaugag

SEQ ID NO: 515739 - RNA, 60 nt, Homo Sapiens
uuauguguguguaugugugucagagaaagagagagagagagagagaagggaggaugagaa

SEQ ID NO: 515740 - RNA, 60 nt, Homo Sapiens
auguguguguaugugugucagagaaagagagagagagagagagaagggaggaugagaacg

SEQ ID NO: 515741 - RNA, 60 nt, Homo Sapiens
guguguguaugugugucagagaaagagagagagagagagagaagggaggaugagaacgaa

SEQ ID NO: 515742 - RNA, 60 nt, Homo Sapiens
guguguaugugugucagagaaagagagagagagagagagaagggaggaugagaacgaaug

SEQ ID NO: 515743 - RNA, 60 nt, Homo Sapiens
guguaugugugucagagaaagagagagagagagagagaagggaggaugagaacgaauggg

SEQ ID NO: 515744 - RNA, 60 nt, Homo Sapiens
aagaaccaaaagagaucacaauacucaaaagagagagagagagaaaaaagagagaucuug

SEQ ID NO: 515745 - RNA, 60 nt, Homo Sapiens
gaaccaaaagagaucacaauacucaaaagagagagagagagaaaaaagagagaucuugau

SEQ ID NO: 515746 - RNA, 60 nt, Homo Sapiens
accaaaagagaucacaauacucaaaagagagagagagagaaaaaagagagaucuugaucc

SEQ ID NO: 515747 - RNA, 60 nt, Homo Sapiens
caaaagagaucacaauacucaaaagagagagagagagaaaaaagagagaucuugauccac

SEQ ID NO: 515748 - RNA, 60 nt, Homo Sapiens
ugugcagaaaucaaaugacagagaggaagugagagagagaggugucggggaggugccagg

SEQ ID NO: 515749 - RNA, 60 nt, Homo Sapiens
ugcagaaaucaaaugacagagaggaagugagagagagaggugucggggaggugccaggcu

SEQ ID NO: 515750 - RNA, 60 nt, Homo Sapiens
ggugcuacacagcuagaauagauauauuuagagagagagauauuuuuaagacaaagccca

SEQ ID NO: 515751 - RNA, 60 nt, Homo Sapiens
ugcuacacagcuagaauagauauauuuagagagagagauauuuuuaagacaaagcccaca

SEQ ID NO: 515752 - RNA, 60 nt, Homo Sapiens
gcauuggaagcuuauucuuuuuguucacuggagagagagagaacuguuuacaguuaaucu

SEQ ID NO: 515753 - RNA, 60 nt, Homo Sapiens
auuggaagcuuauucuuuuuguucacuggagagagagagaacuguuuacaguuaaucugu

SEQ ID NO: 515754 - RNA, 60 nt, Homo Sapiens
uggaagcuuauucuuuuuguucacuggagagagagagaacuguuuacaguuaaucugugu

SEQ ID NO: 515755 - RNA, 60 nt, Homo Sapiens
caggaccaucacagcuucugaacugagccggagagagagaauggaauugcugaccccugg

SEQ ID NO: 515756 - RNA, 60 nt, Homo Sapiens
ggaccaucacagcuucugaacugagccggagagagagaauggaauugcugaccccuggaa

SEQ ID NO: 515757 - RNA, 60 nt, Homo Sapiens
aaaaacauagacuggaggagguaauccauggagagagaaaaagaagagggcucaggacaa

SEQ ID NO: 515758 - RNA, 60 nt, Homo Sapiens
uauugauggcaacagucaagauggugugaugagagagaugggaggggcacaaagaggagg

SEQ ID NO: 515759 - RNA, 60 nt, Homo Sapiens
uuauauacuaugaaaagugcaaugaugagagagagagaaaccuuguauuagcauccaaga

SEQ ID NO: 515760 - RNA, 60 nt, Homo Sapiens
aauuauauacuaugaaaagugaaaugaugagagagagagagaccuuguauuagcauccaa

SEQ ID NO: 515761 - RNA, 60 nt, Homo Sapiens
gaaauuauauacuaugaaaaaagaaaugaugagagagagagagaccuuguauuagcaucc

SEQ ID NO: 515762 - RNA, 60 nt, Homo Sapiens
aaaagaguaggaaaaugagaaaaaaaaagagagagagauggagugagacuccaucucaaa

SEQ ID NO: 515763 - RNA, 60 nt, Homo Sapiens
ugaaaagaguaggaaaaugaaaaaaaaaaagagagagagacagagugagacuccaucuca

SEQ ID NO: 515764 - RNA, 60 nt, Homo Sapiens
cagacaagcaaacucaaaauuaggucaagagagagagaccccugccccgaagacuccuaa

SEQ ID NO: 515765 - RNA, 60 nt, Homo Sapiens
cccagacaagcaaacucaaaaauaggucaagagagagagacaccugccccgaagacuccu

SEQ ID NO: 515766 - RNA, 60 nt, Homo Sapiens
augagcaaauguauugcuucgauaccuggagagagagauuucauuaauaauaugagaaau

SEQ ID NO: 515767 - RNA, 60 nt, Homo Sapiens
uuaugagcaaauguauugcuaugauaccuggagagagagauuucauuaauaauaugagaa

SEQ ID NO: 515768 - RNA, 60 nt, Homo Sapiens
aauaauauuaacacaaaaaauuaaaacgaggagagagaaagagcaagaaaagagaaaaua

SEQ ID NO: 515769 - RNA, 60 nt, Homo Sapiens
ggacaggggagugcuggaacggggagucuggagagagacuguuuuguaggagcggguuug

SEQ ID NO: 515770 - RNA, 60 nt, Homo Sapiens
auuggagauguccugaauuugaaaaacagagagagagaauaaaaaaaaaaagaugacaaa

SEQ ID NO: 515771 - RNA, 60 nt, Homo Sapiens
auauuggagauguccugaauaagaaaaacagagagagagauaaaaaaaaaaaagaugaca

SEQ ID NO: 515772 - RNA, 60 nt, Homo Sapiens
cucuuaaaaaaaaaaaaaaaaaaaaaaaaagagagagagagaauaaauagaaaagaaugu

SEQ ID NO: 515773 - RNA, 60 nt, Homo Sapiens
cuuaaaaaaaaaaaaaaaaaaaaaaaaagagagagagagaauaaauagaaaagaaugugg

SEQ ID NO: 515774 - RNA, 60 nt, Homo Sapiens
uaaaaaaaaaaaaaaaaaaaaaaaaagagagagagagaauaaauagaaaagaauguggcu

SEQ ID NO: 515775 - RNA, 60 nt, Homo Sapiens
aauaauguucaacugaaucucacagaugaggagagagaagaaacggaagaggaaguuuau

SEQ ID NO: 515776 - RNA, 60 nt, Homo Sapiens
ggaauggaggaguuguuuggggagggaaaggagagagaaggaaaggagugagguauuucc

SEQ ID NO: 515777 - RNA, 60 nt, Homo Sapiens
ugcuguucguucaaaagugggagagaucuugagagagaaaugacaaauucaaaagagaga

SEQ ID NO: 515778 - RNA, 60 nt, Homo Sapiens
uugagagagaaaugcuguucucaaaagagagagagagauccguaacuccaucugacaaau

SEQ ID NO: 515779 - RNA, 60 nt, Homo Sapiens
ucuugagagagaaaugcuguauucaaaagagagagagagaugcguaacuccaucugacaa

SEQ ID NO: 515780 - RNA, 60 nt, Homo Sapiens
gaucuugagagagaaaugcuaaauucaaaagagagagagaccugcguaacuccaucugac

SEQ ID NO: 515781 - RNA, 60 nt, Homo Sapiens
acuguguugugauucauaguacauuaaaaagagagagagagagaaagaaucccacagggc

SEQ ID NO: 515782 - RNA, 60 nt, Homo Sapiens
uguguugugauucauaguacauuaaaaagagagagagagagaaagaaucccacagggcac

SEQ ID NO: 515783 - RNA, 60 nt, Homo Sapiens
uguugugauucauaguacauuaaaaagagagagagagagaaagaaucccacagggcacua

SEQ ID NO: 515784 - RNA, 60 nt, Homo Sapiens
uugugauucauaguacauuaaaaagagagagagagagaaagaaucccacagggcacuauu

SEQ ID NO: 515785 - RNA, 60 nt, Homo Sapiens
gacuucugcuagguagaggcauuugucuuagagagagagagagcgcgggagagagugaga

SEQ ID NO: 515786 - RNA, 60 nt, Homo Sapiens
cuucugcuagguagaggcauuugucuuagagagagagagagcgcgggagagagugagaga

SEQ ID NO: 515787 - RNA, 60 nt, Homo Sapiens
ucugcuagguagaggcauuugucuuagagagagagagagcgcgggagagagugagagaga

SEQ ID NO: 515788 - RNA, 60 nt, Homo Sapiens
cuuagagagagagagagcgcgggagagagugagagagagugagagcacaaagauaacgca

SEQ ID NO: 515789 - RNA, 60 nt, Homo Sapiens
agagagagugagagcacaaagauaacgcaggagagagagagagaaagaaugagaaagaaa

SEQ ID NO: 515790 - RNA, 60 nt, Homo Sapiens
agagagugagagcacaaagauaacgcaggagagagagagagaaagaaugagaaagaaaag

SEQ ID NO: 515791 - RNA, 60 nt, Homo Sapiens
agagugagagcacaaagauaacgcaggagagagagagagaaagaaugagaaagaaaagga

SEQ ID NO: 515792 - RNA, 60 nt, Homo Sapiens
agugagagcacaaagauaacgcaggagagagagagagaaagaaugagaaagaaaaggaau

SEQ ID NO: 515793 - RNA, 60 nt, Homo Sapiens
acaauagauuauuucuguuuuacuccaaaagagagagagagagugagugugagugugugu

SEQ ID NO: 515794 - RNA, 60 nt, Homo Sapiens
aauagauuauuucuguuuuacuccaaaagagagagagagagugagugugagugugugugu

SEQ ID NO: 515795 - RNA, 60 nt, Homo Sapiens
uagauuauuucuguuuuacuccaaaagagagagagagagugagugugagugugugugugu

SEQ ID NO: 515796 - RNA, 60 nt, Homo Sapiens
auccaaacuuccugcaacauuuucuuagaggagagagagaaauauuaaaagagaaaugaa

SEQ ID NO: 515797 - RNA, 60 nt, Homo Sapiens
ccaaacuuccugcaacauuuucuuagaggagagagagaaauauuaaaagagaaaugaaac

SEQ ID NO: 515798 - RNA, 60 nt, Homo Sapiens
aagucgagacaccaucccagguguguguaagagagagagagagaacagggaggauacaga

SEQ ID NO: 515799 - RNA, 60 nt, Homo Sapiens
gucgagacaccaucccagguguguguaagagagagagagagaacagggaggauacagaag

SEQ ID NO: 515800 - RNA, 60 nt, Homo Sapiens
cgagacaccaucccagguguguguaagagagagagagagaacagggaggauacagaagua

SEQ ID NO: 515801 - RNA, 60 nt, Homo Sapiens
agacaccaucccagguguguguaagagagagagagagaacagggaggauacagaaguauu

SEQ ID NO: 515802 - RNA, 60 nt, Homo Sapiens
ugugagggacaaaaugcaaaaaaagagagagagagagagguaagaugcauuuaauaaaaa

SEQ ID NO: 515803 - RNA, 60 nt, Homo Sapiens
ggugugagggacaaaaugcaaaaaaagagagagagagagagcuaagaugcauuuaauaaa

SEQ ID NO: 515804 - RNA, 60 nt, Homo Sapiens
gaggugugagggacaaaaugaaaaaaaagagagagagagauugcuaagaugcauuuaaua

SEQ ID NO: 515805 - RNA, 60 nt, Homo Sapiens
gagaggugugagggacaaaauaaaaaaaaagagagagagauuuugcuaagaugcauuuaa

SEQ ID NO: 515806 - RNA, 60 nt, Homo Sapiens
uggaaggggcucuggcucccaagaugaagagagagagauuuccuccccuugcuuccaggg

SEQ ID NO: 515807 - RNA, 60 nt, Homo Sapiens
uuuggaaggggcucuggcucggaagaugaagagagagagacuuccuccccuugcuuccag

SEQ ID NO: 515808 - RNA, 60 nt, Homo Sapiens
uuccucagugcccuuuggcuguugaggagugagagagagagagagagagagagagagaga

SEQ ID NO: 515809 - RNA, 60 nt, Homo Sapiens
ccucagugcccuuuggcuguugaggagugagagagagagagagagagagagagagagaga

SEQ ID NO: 515810 - RNA, 60 nt, Homo Sapiens
ucagugcccuuuggcuguugaggagugagagagagagagagagagagagagagagagaga

SEQ ID NO: 515811 - RNA, 60 nt, Homo Sapiens
agugcccuuuggcuguugaggagugagagagagagagagagagagagagagagagagaga

SEQ ID NO: 515812 - RNA, 60 nt, Homo Sapiens
ugcccuuuggcuguugaggagugagagagagagagagagagagagagagagagagagaga

SEQ ID NO: 515813 - RNA, 60 nt, Homo Sapiens
cccuuuggcuguugaggagugagagagagagagagagagagagagagagagagagagaga

SEQ ID NO: 515814 - RNA, 60 nt, Homo Sapiens
cuuuggcuguugaggagugagagagagagagagagagagagagagagagagagagagaga

SEQ ID NO: 515815 - RNA, 60 nt, Homo Sapiens
uuggcuguugaggagugagagagagagagagagagagagagagagagagagagagagaca

SEQ ID NO: 515816 - RNA, 60 nt, Homo Sapiens
ggcuguugaggagugagagagagagagagagagagagagagagagagagagagagacaag

SEQ ID NO: 515817 - RNA, 60 nt, Homo Sapiens
cuguugaggagugagagagagagagagagagagagagagagagagagagagagacaagca

SEQ ID NO: 515818 - RNA, 60 nt, Homo Sapiens
guugaggagugagagagagagagagagagagagagagagagagagagagagacaagcagg

SEQ ID NO: 515819 - RNA, 60 nt, Homo Sapiens
ugaggagugagagagagagagagagagagagagagagagagagagagagacaagcaggag

SEQ ID NO: 515820 - RNA, 60 nt, Homo Sapiens
aggagugagagagagagagagagagagagagagagagagagagagagacaagcaggagcg

SEQ ID NO: 515821 - RNA, 60 nt, Homo Sapiens
gagugagagagagagagagagagagagagagagagagagagagagacaagcaggagcgug

SEQ ID NO: 515822 - RNA, 60 nt, Homo Sapiens
gugagagagagagagagagagagagagagagagagagagagagacaagcaggagcguggc

SEQ ID NO: 515823 - RNA, 60 nt, Homo Sapiens
gagagagagagagagagagagagagagagagagagagagagacaagcaggagcguggcug

SEQ ID NO: 515824 - RNA, 60 nt, Homo Sapiens
gagagagagagagagagagagagagagagagagagagagacaagcaggagcguggcugcu

SEQ ID NO: 515825 - RNA, 60 nt, Homo Sapiens
gagagagagagagagagagagagagagagagagagagacaagcaggagcguggcugcucg

SEQ ID NO: 515826 - RNA, 60 nt, Homo Sapiens
gucacauucgaauucggguggcauccuccggagagagagagaggaaggagauuccacaca

SEQ ID NO: 515827 - RNA, 60 nt, Homo Sapiens
cacauucgaauucggguggcauccuccggagagagagagaggaaggagauuccacacagg

SEQ ID NO: 515828 - RNA, 60 nt, Homo Sapiens
cauucgaauucggguggcauccuccggagagagagagaggaaggagauuccacacagggg

SEQ ID NO: 515829 - RNA, 60 nt, Homo Sapiens
accuagaaacguuuucauucgucauuccaagagagagagaggaaagaaaaauacaacuuu

SEQ ID NO: 515830 - RNA, 60 nt, Homo Sapiens
cuagaaacguuuucauucgucauuccaagagagagagaggaaagaaaaauacaacuuuca

SEQ ID NO: 515831 - RNA, 60 nt, Homo Sapiens
agccuagugggagagagugggggagaggaagagagagagagagcauguauacccguaugu

SEQ ID NO: 515832 - RNA, 60 nt, Homo Sapiens
ccuagugggagagagugggggagaggaagagagagagagagcauguauacccguauguua

SEQ ID NO: 515833 - RNA, 60 nt, Homo Sapiens
uagugggagagagugggggagaggaagagagagagagagcauguauacccguauguuauc

SEQ ID NO: 515834 - RNA, 60 nt, Homo Sapiens
agagugaggagagugugugauagcuagaaagagagagagacagagagauggcaagcacug

SEQ ID NO: 515835 - RNA, 60 nt, Homo Sapiens
agugaggagagugugugauagcuagaaagagagagagacagagagauggcaagcacugag

SEQ ID NO: 515836 - RNA, 60 nt, Homo Sapiens
uaauuuaaaaaguuuauuauaaaaaaaagagagagagauguaaaagagccuugauuuuaa

SEQ ID NO: 515837 - RNA, 60 nt, Homo Sapiens
uguaauuuaaaaaguuuauuaaaaaaaaaagagagagagacauaaaagagccuugauuuu

SEQ ID NO: 515838 - RNA, 60 nt, Homo Sapiens
gcauaaauguaauaacugagauccacaugagagagagacugccuuauuugacuucaaaga

SEQ ID NO: 515839 - RNA, 60 nt, Homo Sapiens
cugcauaaauguaauaacuggaauccacaugagagagagauggccuuauuugacuucaaa

SEQ ID NO: 515840 - RNA, 59 nt, Homo Sapiens
aucuggguguuggugguugcaaaauaaagagagagagagggauaacagcaaaaaaacug

SEQ ID NO: 515841 - RNA, 60 nt, Homo Sapiens
gaucuggguguuggugguugugaaaauaaagagagagagacuggauaacagcaaaaaaac

SEQ ID NO: 515842 - RNA, 60 nt, Homo Sapiens
agagcagauuuuaaaaaaaauggggaaagagagagagaaagcuccauaucugcauuccac

SEQ ID NO: 515843 - RNA, 60 nt, Homo Sapiens
aaagagcagauuuuaaaaaaacuggggaaagagagagagacagcuccauaucugcauucc

SEQ ID NO: 515844 - RNA, 60 nt, Homo Sapiens
aagacccaaguuuugaaucugagagagcgcgagagagaucacaauggagagagaaagaga

SEQ ID NO: 515845 - RNA, 60 nt, Homo Sapiens
gcgagagagaucaagacccagagagaaagagagagagagcguuuuucuagagacaaugga

SEQ ID NO: 515846 - RNA, 60 nt, Homo Sapiens
gcgcgagagagaucaagaccgagagagaaagagagagagacaguuuuucuagagacaaug

SEQ ID NO: 515847 - RNA, 60 nt, Homo Sapiens
gagagagagagcgcgagagaagagacaauggagagagaaaguccuugccacaguuuuucu

SEQ ID NO: 515848 - RNA, 60 nt, Homo Sapiens
ugacauggugggcacacuggcgcccaguaagagagagagagagccaaagcuguccguuuu

SEQ ID NO: 515849 - RNA, 60 nt, Homo Sapiens
acauggugggcacacuggcgcccaguaagagagagagagagccaaagcuguccguuuugc

SEQ ID NO: 515850 - RNA, 60 nt, Homo Sapiens
auggugggcacacuggcgcccaguaagagagagagagagccaaagcuguccguuuugcag

SEQ ID NO: 515851 - RNA, 60 nt, Homo Sapiens
ccaggacacagcucagcuugcucacgcccagagagagaaaaaguuaagcugcugacccug

SEQ ID NO: 515852 - RNA, 60 nt, Homo Sapiens
gucccaaagugaguaaaauccccuagagcagagagagagagagagagagagagugucuuc

SEQ ID NO: 515853 - RNA, 60 nt, Homo Sapiens
cccaaagugaguaaaauccccuagagcagagagagagagagagagagagagugucuucau

SEQ ID NO: 515854 - RNA, 60 nt, Homo Sapiens
caaagugaguaaaauccccuagagcagagagagagagagagagagagagugucuucaugc

SEQ ID NO: 515855 - RNA, 60 nt, Homo Sapiens
aagugaguaaaauccccuagagcagagagagagagagagagagagagugucuucaugcca

SEQ ID NO: 515856 - RNA, 60 nt, Homo Sapiens
gugaguaaaauccccuagagcagagagagagagagagagagagagugucuucaugccaac

SEQ ID NO: 515857 - RNA, 60 nt, Homo Sapiens
gaguaaaauccccuagagcagagagagagagagagagagagagugucuucaugccaacca

SEQ ID NO: 515858 - RNA, 60 nt, Homo Sapiens
guaaaauccccuagagcagagagagagagagagagagagagugucuucaugccaaccaca

SEQ ID NO: 515859 - RNA, 60 nt, Homo Sapiens
aaaauccccuagagcagagagagagagagagagagagagugucuucaugccaaccacagc

SEQ ID NO: 515860 - RNA, 60 nt, Homo Sapiens
ccuuugggucgacauaguauggaaguauuugagagagagaaccuuuccacucccacugcc

SEQ ID NO: 515861 - RNA, 60 nt, Homo Sapiens
uuugggucgacauaguauggaaguauuugagagagagaaccuuuccacucccacugccag

SEQ ID NO: 515862 - RNA, 60 nt, Homo Sapiens
gcacggcugaggcugagucauucagagugagagagagaaacaaauguacuuaagucauca

SEQ ID NO: 515863 - RNA, 60 nt, Homo Sapiens
aagcacggcugaggcugagucauucagagugagagagagaagcaaauguacuuaagucau

SEQ ID NO: 515864 - RNA, 60 nt, Homo Sapiens
gaggacccuccucacuacccugauaauggagagagagacagcaaaugcuuuagaaaucuc

SEQ ID NO: 515865 - RNA, 60 nt, Homo Sapiens
cagaggacccuccucacuacucugauaauggagagagagauugcaaaugcuuuagaaauc

SEQ ID NO: 515866 - RNA, 60 nt, Homo Sapiens
gugauuuuuggccuuguggcagaggagagagagagagaauugaggagaaugguagagagg

SEQ ID NO: 515867 - RNA, 60 nt, Homo Sapiens
augugauuuuuggccuugugggagaggagagagagagagaacugaggagaaugguagaga

SEQ ID NO: 515868 - RNA, 60 nt, Homo Sapiens
gaaugugauuuuuggccuuggaggagaggagagagagagagcacugaggagaaugguaga

SEQ ID NO: 515869 - RNA, 60 nt, Homo Sapiens
gagaaugugauuuuuggccugagaggagaggagagagagauggcacugaggagaauggua

SEQ ID NO: 515870 - RNA, 60 nt, Homo Sapiens
gaaauagaagagaagagccaaaaagagagagagagagaaaagacuccaucucaaaaaaaa

SEQ ID NO: 515871 - RNA, 60 nt, Homo Sapiens
aagaaauagaagagaagagcaaaaaagagagagagagagaugagacuccaucucaaaaaa

SEQ ID NO: 515872 - RNA, 60 nt, Homo Sapiens
gaaagaaauagaagagaagaaaaaaaaagagagagagagaagugagacuccaucucaaaa

SEQ ID NO: 515873 - RNA, 60 nt, Homo Sapiens
gagaaagaaauagaagagaaaaaaaaaaaagagagagagaagagugagacuccaucucaa

SEQ ID NO: 515874 - RNA, 60 nt, Homo Sapiens
gcaguuuccaaggauauguuaagacgaagggagagagaaaagaagagggagggagagaga

SEQ ID NO: 515875 - RNA, 60 nt, Homo Sapiens
gacgaagggagagagaaagcaagagggagggagagagaaaacugaagagaaaugggaaag

SEQ ID NO: 515876 - RNA, 60 nt, Homo Sapiens
ugccaaaguaacagcaaaaaggggauuggagagagagaauugcacugaacucgggauguu

SEQ ID NO: 515877 - RNA, 60 nt, Homo Sapiens
auugccaaaguaacagcaaauuggggauuggagagagagaugugcacugaacucgggaug

SEQ ID NO: 515878 - RNA, 60 nt, Homo Sapiens
cugugaucaugccacugcauuccagccugggagagagagaggaccugucuguugaaaaaa

SEQ ID NO: 515879 - RNA, 60 nt, Homo Sapiens
gugaucaugccacugcauuccagccugggagagagagaggaccugucuguugaaaaaaac

SEQ ID NO: 515880 - RNA, 60 nt, Homo Sapiens
ugggcucagagcucaggagucgccuuaccugagagagauguucuagcugagagggccugg

SEQ ID NO: 515881 - RNA, 60 nt, Homo Sapiens
gucccuguccccagagggaggagcaggcaggagagagaggggaaggagguaugaauccca

SEQ ID NO: 515882 - RNA, 60 nt, Homo Sapiens
uugacuuaagugagggggaaauaaaacccagagagagagagagagcgagagagagagaca

SEQ ID NO: 515883 - RNA, 60 nt, Homo Sapiens
gacuuaagugagggggaaauaaaacccagagagagagagagagcgagagagagagacaug

SEQ ID NO: 515884 - RNA, 60 nt, Homo Sapiens
cuuaagugagggggaaauaaaacccagagagagagagagagcgagagagagagacauguu

SEQ ID NO: 515885 - RNA, 60 nt, Homo Sapiens
uaagugagggggaaauaaaacccagagagagagagagagcgagagagagagacauguuac

SEQ ID NO: 515886 - RNA, 60 nt, Homo Sapiens
ggaaauaaaacccagagagagagagagagcgagagagagagacauguuacuaugaaagac

SEQ ID NO: 515887 - RNA, 60 nt, Homo Sapiens
aaauaaaacccagagagagagagagagcgagagagagagacauguuacuaugaaagacuu

SEQ ID NO: 515888 - RNA, 60 nt, Homo Sapiens
auaaaacccagagagagagagagagcgagagagagagacauguuacuaugaaagacuugu

SEQ ID NO: 515889 - RNA, 60 nt, Homo Sapiens
cagcaguggagugccgggacccucagaguggagagagagacccgggaugugugugcugua

SEQ ID NO: 515890 - RNA, 60 nt, Homo Sapiens
gcaguggagugccgggacccucagaguggagagagagacccgggaugugugugcuguacc

SEQ ID NO: 515891 - RNA, 60 nt, Homo Sapiens
gggcuggcuccucucgccccagggccaggagagagagacacccucgcggcgggcgccccc

SEQ ID NO: 515892 - RNA, 60 nt, Homo Sapiens
cagggcuggcuccucucgccccagggccaggagagagagacgcccucgcggcgggcgccc

SEQ ID NO: 515893 - RNA, 60 nt, Homo Sapiens
gauagaaaacaagcgcaggaaagaagcggggagagagaggaaccaggacacaaaagcagc

SEQ ID NO: 515894 - RNA, 60 nt, Homo Sapiens
cacucauccugagacuuucuuuuugcaguggagagagagaauaaucuaguuggggcaaac

SEQ ID NO: 515895 - RNA, 60 nt, Homo Sapiens
cucauccugagacuuucuuuuugcaguggagagagagaauaaucuaguuggggcaaacac

SEQ ID NO: 515896 - RNA, 60 nt, Homo Sapiens
uugucugcgugugugugugugugugugugagagagagaucugggagcugugugugucugu

SEQ ID NO: 515897 - RNA, 60 nt, Homo Sapiens
ucuugucugcgugugugugugugugugugugagagagagauuugggagcugugugugucu

SEQ ID NO: 515898 - RNA, 60 nt, Homo Sapiens
aucaaguuuuaauuuggguaucuauucugagagagagaugcccgacauuuuuuuucuguu

SEQ ID NO: 515899 - RNA, 60 nt, Homo Sapiens
ugaucaaguuuuaauuuggguuucuauucugagagagagagucccgacauuuuuuuucug

SEQ ID NO: 515900 - RNA, 60 nt, Homo Sapiens
acuauuucuugucccuuuuuccgcaugagagagagagauuagugagccaagaucgcacca

SEQ ID NO: 515901 - RNA, 60 nt, Homo Sapiens
uuacuauuucuugucccuuucaccgcaugagagagagagagcagugagccaagaucgcac

SEQ ID NO: 515902 - RNA, 60 nt, Homo Sapiens
gauuacuauuucuugucccuaccaccgcaugagagagagauugcagugagccaagaucgc

SEQ ID NO: 515903 - RNA, 60 nt, Homo Sapiens
uugacgguuguagauauuuuguaugagagagagagagacugugugugugugugugugugu

SEQ ID NO: 515904 - RNA, 60 nt, Homo Sapiens
cuuugacgguuguagauauuguguaugagagagagagagagugugugugugugugugugu

SEQ ID NO: 515905 - RNA, 60 nt, Homo Sapiens
gacuuugacgguuguagauaguguguaugagagagagagagugugugugugugugugugu

SEQ ID NO: 515906 - RNA, 60 nt, Homo Sapiens
gagacuuugacgguuguagaguguguguaugagagagagagugugugugugugugugugu

SEQ ID NO: 515907 - RNA, 60 nt, Homo Sapiens
aguaaaugggggccguugggcuggugacaagagagagacacagcgccuuugucugucuau

SEQ ID NO: 515908 - RNA, 60 nt, Homo Sapiens
acuccaucucaaaaaauaaauaaauagaaagagagagagaggaaaaaaaaagaaaagaac

SEQ ID NO: 515909 - RNA, 60 nt, Homo Sapiens
uccaucucaaaaaauaaauaaauagaaagagagagagaggaaaaaaaaagaaaagaacac

SEQ ID NO: 515910 - RNA, 60 nt, Homo Sapiens
cuaucuccugcaaccucagugccucagccugagagagagaugagaugcucuuggacuccc

SEQ ID NO: 515911 - RNA, 60 nt, Homo Sapiens
aucuccugcaaccucagugccucagccugagagagagaugagaugcucuuggacucccca

SEQ ID NO: 515912 - RNA, 60 nt, Homo Sapiens
gagacacagagagaaggagaaagagggagggagagagagaaagagagagaaagagagaga

SEQ ID NO: 515913 - RNA, 60 nt, Homo Sapiens
gacacagagagaaggagaaagagggagggagagagagaaagagagagaaagagagagaga

SEQ ID NO: 515914 - RNA, 60 nt, Homo Sapiens
gaaggagaaagagggagggagagagagaaagagagagaaagagagagagagagagagaga

SEQ ID NO: 515915 - RNA, 60 nt, Homo Sapiens
gagggagggagagagagaaagagagagaaagagagagagagagagagagagagaaagcug

SEQ ID NO: 515916 - RNA, 60 nt, Homo Sapiens
gggagggagagagagaaagagagagaaagagagagagagagagagagagagaaagcugaa

SEQ ID NO: 515917 - RNA, 60 nt, Homo Sapiens
gagggagagagagaaagagagagaaagagagagagagagagagagagagaaagcugaacg

SEQ ID NO: 515918 - RNA, 60 nt, Homo Sapiens
gggagagagagaaagagagagaaagagagagagagagagagagagagaaagcugaacgug

SEQ ID NO: 515919 - RNA, 60 nt, Homo Sapiens
gagagagagaaagagagagaaagagagagagagagagagagagagaaagcugaacgugca

SEQ ID NO: 515920 - RNA, 60 nt, Homo Sapiens
gagagagaaagagagagaaagagagagagagagagagagagagaaagcugaacgugcacu

SEQ ID NO: 515921 - RNA, 60 nt, Homo Sapiens
gagagaaagagagagaaagagagagagagagagagagagagaaagcugaacgugcacucu

SEQ ID NO: 515922 - RNA, 60 nt, Homo Sapiens
gagaaagagagagaaagagagagagagagagagagagagaaagcugaacgugcacucuga

SEQ ID NO: 515923 - RNA, 60 nt, Homo Sapiens
gaaagagagagaaagagagagagagagagagagagagaaagcugaacgugcacucugaca

SEQ ID NO: 515924 - RNA, 60 nt, Homo Sapiens
aaaccucaacuguguauuuucugugaaagagagagagaaacaggggcugguagacaagaa

SEQ ID NO: 515925 - RNA, 60 nt, Homo Sapiens
aaaaaccucaacuguguauuaacugugaaagagagagagagccaggggcugguagacaag

SEQ ID NO: 515926 - RNA, 60 nt, Homo Sapiens
cugauaccucuguggggacucagcuggagagagagagaucgcagccaggcgcucuggagc

SEQ ID NO: 515927 - RNA, 60 nt, Homo Sapiens
uccugauaccucuguggggagccagcuggagagagagagagagcagccaggcgcucugga

SEQ ID NO: 515928 - RNA, 60 nt, Homo Sapiens
gauccugauaccucuguggggagccagcuggagagagagauggagcagccaggcgcucug

SEQ ID NO: 515929 - RNA, 60 nt, Homo Sapiens
uauuaaacaaauaccccccuaaaaaugggagagagagaggaaaugcaacuuguauaaaac

SEQ ID NO: 515930 - RNA, 60 nt, Homo Sapiens
gguauuaaacaaauacccccacaaaaaugggagagagagaagaaaugcaacuuguauaaa

SEQ ID NO: 515931 - RNA, 60 nt, Homo Sapiens
agcaucuucaagagaaguaugagagagagagagagagaccgugugugugugugagagaga

SEQ ID NO: 515932 - RNA, 60 nt, Homo Sapiens
ccagcaucuucaagagaagugagagagagagagagagagagugugugugugugugagaga

SEQ ID NO: 515933 - RNA, 60 nt, Homo Sapiens
gaccagcaucuucaagagaagagagagagagagagagagagugugugugugugugugaga

SEQ ID NO: 515934 - RNA, 60 nt, Homo Sapiens
gagaccagcaucuucaagaggagagagagagagagagagaguguguguguguguguguga

SEQ ID NO: 515935 - RNA, 60 nt, Homo Sapiens
gagagaccagcaucuucaaggagagagagagagagagagauugugugugugugugugugu

SEQ ID NO: 515936 - RNA, 60 nt, Homo Sapiens
gagagagaccagcaucuucagugagagagagagagagagaguuugugugugugugugugu

SEQ ID NO: 515937 - RNA, 60 nt, Homo Sapiens
gagagagagaccagcaucuugugugagagagagagagagaguguuugugugugugugugu

SEQ ID NO: 515938 - RNA, 60 nt, Homo Sapiens
gagagagagagaccagcaucgugugugagagagagagagaguguguuugugugugugugu

SEQ ID NO: 515939 - RNA, 60 nt, Homo Sapiens
gagagagagagagaccagcagugugugugagagagagagaguguguguuugugugugugu

SEQ ID NO: 515940 - RNA, 60 nt, Homo Sapiens
gagagagagagagagaccaggugugugugugagagagagaguguguguguuugugugugu

SEQ ID NO: 515941 - RNA, 60 nt, Homo Sapiens
ccuccgcuccuuaaugugaauaugagacgagagagagaagguauuuucaggauuuguuuc

SEQ ID NO: 515942 - RNA, 60 nt, Homo Sapiens
agccuccgcuccuuaaugugucuaugagacgagagagagagaguauuuucaggauuuguu

SEQ ID NO: 515943 - RNA, 60 nt, Homo Sapiens
cugagaucauucaggaguuuuucagaaaaggagagagagguuuuucaacaaaggagugug

SEQ ID NO: 515944 - RNA, 60 nt, Homo Sapiens
gagaaggaggggagccuguccugggaaucagagagagaagagagaacucagcaagccaac

SEQ ID NO: 515945 - RNA, 60 nt, Homo Sapiens
ucauauuucuaaaaggggccaaugcaaaaggagagagaaggacuggauuuaagccaguuu

SEQ ID NO: 515946 - RNA, 60 nt, Homo Sapiens
gaacuaauuuuuuuaaggauacugaaaaaugagagagaguggucgaaugccugaaauuuu

SEQ ID NO: 515947 - RNA, 60 nt, Homo Sapiens
agucuuuguugcuauauuuuguggggcugggagagagagauuagauuauuuugacauggg

SEQ ID NO: 515948 - RNA, 60 nt, Homo Sapiens
ucuuuguugcuauauuuuguggggcugggagagagagauuagauuauuuugacaugggau

SEQ ID NO: 515949 - RNA, 60 nt, Homo Sapiens
aaaaagauuacccaaaaacugucuuuaaaagagagagagagaaaaaaaaaauaguauuug

SEQ ID NO: 515950 - RNA, 60 nt, Homo Sapiens
aaagauuacccaaaaacugucuuuaaaagagagagagagaaaaaaaaaauaguauuugca

SEQ ID NO: 515951 - RNA, 60 nt, Homo Sapiens
agauuacccaaaaacugucuuuaaaagagagagagagaaaaaaaaaauaguauuugcaua

SEQ ID NO: 515952 - RNA, 60 nt, Homo Sapiens
ucgccuuuuccuuccaucaguugaguggcugagagagaagugccucaucccugagccaca

SEQ ID NO: 515953 - RNA, 60 nt, Homo Sapiens
ggacaaaaccgguugaccagaaaaugggcagagagagaugaccucggaagcauuuccaca

SEQ ID NO: 515954 - RNA, 60 nt, Homo Sapiens
ucucauggaugguucucaaagguaaaaaaagagagagaaagagagagagcuagcuguggg

SEQ ID NO: 515955 - RNA, 60 nt, Homo Sapiens
gguucucaaagguaaaaaaagagagagaaagagagagagcuagcugugggauucugugua

SEQ ID NO: 515956 - RNA, 60 nt, Homo Sapiens
ccuguuuccugggcuagucuuggaccccacgagagagaaucguuccucagccucauggug

SEQ ID NO: 515957 - RNA, 60 nt, Homo Sapiens
aucuccguaaaugugcucugcuccucagcugagagagaaaaaaauaaacuguauuuggcu

SEQ ID NO: 515958 - RNA, 60 nt, Homo Sapiens
gugugcguguguguguauauuaaagauggagagagagaguacuggaaaagauguuaacag

SEQ ID NO: 515959 - RNA, 60 nt, Homo Sapiens
gugugugcguguguguguauaguaaagauggagagagagauaacuggaaaagauguuaac

SEQ ID NO: 515960 - RNA, 60 nt, Homo Sapiens
augcuugugccagguggcacugguuccagagagagagaaggcagaauucuuuugguucuu

SEQ ID NO: 515961 - RNA, 60 nt, Homo Sapiens
agaugcuugugccagguggcuuugguuccagagagagagagugcagaauucuuuugguuc

SEQ ID NO: 515962 - RNA, 60 nt, Homo Sapiens
aagaaaugcuguguuuaaucaaaagagagagagagagaaauuaucucaaaaaaaaaaaaa

SEQ ID NO: 515963 - RNA, 60 nt, Homo Sapiens
aaaagaaaugcuguguuuaaaaaaaagagagagagagagaccuuaucucaaaaaaaaaaa

SEQ ID NO: 515964 - RNA, 60 nt, Homo Sapiens
gaaaaagaaaugcuguguuuaaaaaaaagagagagagagagaccuuaucucaaaaaaaaa

SEQ ID NO: 515965 - RNA, 60 nt, Homo Sapiens
gagaaaaagaaaugcuguguaaaaaaaaaagagagagagagagaccuuaucucaaaaaaa

SEQ ID NO: 515966 - RNA, 60 nt, Homo Sapiens
ugcuaaccuuguagcaugugguguguaugagagagagaaauguguguguguguacucugu

SEQ ID NO: 515967 - RNA, 60 nt, Homo Sapiens
aaugcuaaccuuguagcaugguguguguaugagagagagauguguguguguguguacucu

SEQ ID NO: 515968 - RNA, 60 nt, Homo Sapiens
gugugugugugugugugugugagagaaugagagagagacuguauggcugagcaagagaga

SEQ ID NO: 515969 - RNA, 60 nt, Homo Sapiens
cugugugugugugugugugugagagagaaugagagagagauuguauggcugagcaagaga

SEQ ID NO: 515970 - RNA, 60 nt, Homo Sapiens
gagagagagacugugugugugagcaagagagagagagaauuggagggguguuguauggcu

SEQ ID NO: 515971 - RNA, 60 nt, Homo Sapiens
augagagagagacugugugucugagcaagagagagagagaccuggagggguguuguaugg

SEQ ID NO: 515972 - RNA, 60 nt, Homo Sapiens
gaaugagagagagacuguguggcugagcaagagagagagaauccuggagggguguuguau

SEQ ID NO: 515973 - RNA, 60 nt, Homo Sapiens
guauugaaauuuuguucugcuugagagagagagagagaaaaagaaaaauuuccaaaacua

SEQ ID NO: 515974 - RNA, 60 nt, Homo Sapiens
aaguauugaaauuuuguucuuauugagagagagagagagaccaagaaaaauuuccaaaac

SEQ ID NO: 515975 - RNA, 60 nt, Homo Sapiens
gaaaguauugaaauuuuguuacuauugagagagagagagauaccaagaaaaauuuccaaa

SEQ ID NO: 515976 - RNA, 60 nt, Homo Sapiens
gagaaaguauugaaauuuugaaacuauugagagagagagagguaccaagaaaaauuucca

SEQ ID NO: 515977 - RNA, 60 nt, Homo Sapiens
gagagaaaguauugaaauuucaaaacuauugagagagagauugguaccaagaaaaauuuc

SEQ ID NO: 515978 - RNA, 60 nt, Homo Sapiens
uuugaaucuaucuuaaaauacugagguguggagagagagacaggaucaggagcgauagag

SEQ ID NO: 515979 - RNA, 60 nt, Homo Sapiens
ugaaucuaucuuaaaauacugagguguggagagagagacaggaucaggagcgauagagag

SEQ ID NO: 515980 - RNA, 60 nt, Homo Sapiens
guguguguguguguguguguguguguguaugagagagagagagagagacaacagagacag

SEQ ID NO: 515981 - RNA, 60 nt, Homo Sapiens
guguguguguguguguguguguguguaugagagagagagagagagacaacagagacagag

SEQ ID NO: 515982 - RNA, 60 nt, Homo Sapiens
guguguguguguguguguguguguaugagagagagagagagagacaacagagacagagag

SEQ ID NO: 515983 - RNA, 60 nt, Homo Sapiens
guguguguguguguguguguguaugagagagagagagagagacaacagagacagagagag

SEQ ID NO: 515984 - RNA, 60 nt, Homo Sapiens
guguguguguguguguguguaugagagagagagagagagacaacagagacagagagaggc

SEQ ID NO: 515985 - RNA, 60 nt, Homo Sapiens
guguguguguguguguguaugagagagagagagagagacaacagagacagagagaggcag

SEQ ID NO: 515986 - RNA, 60 nt, Homo Sapiens
cagagagaggcagagaggcauagagagacagagagagagacaagaaacagagauagacag

SEQ ID NO: 515987 - RNA, 60 nt, Homo Sapiens
gagagaggcagagaggcauagagagacagagagagagacaagaaacagagauagacagaa

SEQ ID NO: 515988 - RNA, 60 nt, Homo Sapiens
gagaacaauauuugggagagaaaagagagagagagagaaaugucucagaaaaaaaaaaaa

SEQ ID NO: 515989 - RNA, 60 nt, Homo Sapiens
aagagaacaauauuugggagaaaaaagagagagagagagaucugucucagaaaaaaaaaa

SEQ ID NO: 515990 - RNA, 60 nt, Homo Sapiens
gaaagagaacaauauuugggaaaaaaaagagagagagagaacucugucucagaaaaaaaa

SEQ ID NO: 515991 - RNA, 60 nt, Homo Sapiens
gagaaagagaacaauauuugaaaaaaaaaagagagagagaagacucugucucagaaaaaa

SEQ ID NO: 515992 - RNA, 60 nt, Homo Sapiens
uaagaaauuuagagaaaaaugagagagagagagagagacagugcuguucucaggugaaaa

SEQ ID NO: 515993 - RNA, 60 nt, Homo Sapiens
cauaagaaauuuagagaaaaaagagagagagagagagagaaggugcuguucucaggugaa

SEQ ID NO: 515994 - RNA, 60 nt, Homo Sapiens
gacauaagaaauuuagagaaaaaagagagagagagagagaguaggugcuguucucaggug

SEQ ID NO: 515995 - RNA, 60 nt, Homo Sapiens
gagacauaagaaauuuagagugaaaagagagagagagagacuguaggugcuguucucagg

SEQ ID NO: 515996 - RNA, 60 nt, Homo Sapiens
gagagacauaagaaauuuagggugaaaagagagagagagaaacuguaggugcuguucuca

SEQ ID NO: 515997 - RNA, 60 nt, Homo Sapiens
gagagagacauaagaaauuucaggugaaaagagagagagagaaacuguaggugcuguucu

SEQ ID NO: 515998 - RNA, 60 nt, Homo Sapiens
gaacccuuucuggguguuucaacagaaggagagagagaauuugaccaugauaaugcaaau

SEQ ID NO: 515999 - RNA, 60 nt, Homo Sapiens
augaacccuuucuggguguuauaacagaaggagagagagauguugaccaugauaaugcaa

SEQ ID NO: 516000 - RNA, 60 nt, Homo Sapiens
uugggagugguccccaaagagccauuaggagagagagaaagaggaggcugaauuucucaa

SEQ ID NO: 516001 - RNA, 60 nt, Homo Sapiens
aauugggagugguccccaaaaagccauuaggagagagagagagaggaggcugaauuucuc

SEQ ID NO: 516002 - RNA, 60 nt, Homo Sapiens
guagccaagagaaccccacggagagagaaggagagagacaagagagagagagaggagaaa

SEQ ID NO: 516003 - RNA, 60 nt, Homo Sapiens
gagagagacaguagccaagaagaggagaaagagagagaaguccuagagaaagagagagag

SEQ ID NO: 516004 - RNA, 60 nt, Homo Sapiens
agaaagagagagaaggagaggagaaagagagagagagagguucacaacagacauuuccua

SEQ ID NO: 516005 - RNA, 60 nt, Homo Sapiens
ggagaaagagagagaaggaguagagaaagagagagagagagcuucacaacagacauuucc

SEQ ID NO: 516006 - RNA, 60 nt, Homo Sapiens
gaggagaaagagagagaaggccuagagaaagagagagagacugcuucacaacagacauuu

SEQ ID NO: 516007 - RNA, 60 nt, Homo Sapiens
ccacuugcuugauuuaucaugagagaagaggagagagagagagacugagcgcuaggagug

SEQ ID NO: 516008 - RNA, 60 nt, Homo Sapiens
acuugcuugauuuaucaugagagaagaggagagagagagagacugagcgcuaggagugug

SEQ ID NO: 516009 - RNA, 60 nt, Homo Sapiens
uugcuugauuuaucaugagagaagaggagagagagagagacugagcgcuaggagugugug

SEQ ID NO: 516010 - RNA, 60 nt, Homo Sapiens
gcuugauuuaucaugagagaagaggagagagagagagacugagcgcuaggagugugugua

SEQ ID NO: 516011 - RNA, 60 nt, Homo Sapiens
gagguggggagggagacagagacagaaacagagagagacagagacagagagagacugagg

SEQ ID NO: 516012 - RNA, 60 nt, Homo Sapiens
cagagacagaaacagagagagacagagacagagagagacugagggagagacucugaggac

SEQ ID NO: 516013 - RNA, 60 nt, Homo Sapiens
agagacugagggagagacucugaggacauggagagagacucaaagagacuccaagauuca

SEQ ID NO: 516014 - RNA, 60 nt, Homo Sapiens
aagagagcgggagggagggaaggagggagggagagagauagagagagagagagagagaga

SEQ ID NO: 516015 - RNA, 60 nt, Homo Sapiens
gagggagggaaggagggagggagagagauagagagagagagagagagagaggaugugugg

SEQ ID NO: 516016 - RNA, 60 nt, Homo Sapiens
gggagggaaggagggagggagagagauagagagagagagagagagagaggaugugugggc

SEQ ID NO: 516017 - RNA, 60 nt, Homo Sapiens
gagggaaggagggagggagagagauagagagagagagagagagagaggaugugugggccc

SEQ ID NO: 516018 - RNA, 60 nt, Homo Sapiens
gggaaggagggagggagagagauagagagagagagagagagagaggaugugugggcccua

SEQ ID NO: 516019 - RNA, 60 nt, Homo Sapiens
gaaggagggagggagagagauagagagagagagagagagagaggaugugugggcccuaag

SEQ ID NO: 516020 - RNA, 60 nt, Homo Sapiens
gagggagagagauagagagagagagagagagagagagagaggaugugugggcccuaaggc

SEQ ID NO: 516021 - RNA, 60 nt, Homo Sapiens
gggagagagauagagagagagagagagagagagagagaggaugugugggcccuaaggcug

SEQ ID NO: 516022 - RNA, 60 nt, Homo Sapiens
cagaccuugucucaaaaaaucagccugagagagagagagcagaucgcaccacuugcacug

SEQ ID NO: 516023 - RNA, 60 nt, Homo Sapiens
gccagaccuugucucaaaaaugcagccugagagagagagacaagaucgcaccacuugcac

SEQ ID NO: 516024 - RNA, 60 nt, Homo Sapiens
gagccagaccuugucucaaaacugcagccugagagagagagucaagaucgcaccacuugc

SEQ ID NO: 516025 - RNA, 60 nt, Homo Sapiens
ggugguggugagaaguguuggagagagagagagagagaugguguguguguguguguguga

SEQ ID NO: 516026 - RNA, 60 nt, Homo Sapiens
ugggugguggugagaagugugagagagagagagagagagagugugugugugugugugugu

SEQ ID NO: 516027 - RNA, 60 nt, Homo Sapiens
gaugggugguggugagaagugugagagagagagagagagagugugugugugugugugugu

SEQ ID NO: 516028 - RNA, 60 nt, Homo Sapiens
gagaugggugguggugagaagugugagagagagagagagagugugugugugugugugugu

SEQ ID NO: 516029 - RNA, 60 nt, Homo Sapiens
gagagaugggugguggugaggugugugagagagagagagagugugugugugugugugugu

SEQ ID NO: 516030 - RNA, 60 nt, Homo Sapiens
gagagagauggguggugguggugugugugagagagagagagugugugugugugugugugu

SEQ ID NO: 516031 - RNA, 60 nt, Homo Sapiens
gagagagagauggguggugggugugugugugagagagagaaagugugugugugugugugu

SEQ ID NO: 516032 - RNA, 60 nt, Homo Sapiens
acugauggggaaaacaagcuacgaaggagagagagagaaaacacacacacacacacacac

SEQ ID NO: 516033 - RNA, 60 nt, Homo Sapiens
aaacugauggggaaaacaagacacgaaggagagagagagaacacacacacacacacacac

SEQ ID NO: 516034 - RNA, 60 nt, Homo Sapiens
gaaaacugauggggaaaacaacacacgaaggagagagagaacacacacacacacacacac

SEQ ID NO: 516035 - RNA, 60 nt, Homo Sapiens
ccuggccuuuccuuuuguaauaagaaagaagagagagaacuugaugcaaaguccacgaaa

SEQ ID NO: 516036 - RNA, 60 nt, Homo Sapiens
cucugaccucccugcuugcauugggucugggagagagaguggaauauuugguagggaccu

SEQ ID NO: 516037 - RNA, 60 nt, Homo Sapiens
gucauuccccacacacguccuguucaccucgagagagagagagagagagcaccuuucuuc

SEQ ID NO: 516038 - RNA, 60 nt, Homo Sapiens
cauuccccacacacguccuguucaccucgagagagagagagagagagcaccuuucuuccg

SEQ ID NO: 516039 - RNA, 60 nt, Homo Sapiens
uuccccacacacguccuguucaccucgagagagagagagagagagcaccuuucuuccguc

SEQ ID NO: 516040 - RNA, 60 nt, Homo Sapiens
ccccacacacguccuguucaccucgagagagagagagagagagcaccuuucuuccgucug

SEQ ID NO: 516041 - RNA, 60 nt, Homo Sapiens
ccacacacguccuguucaccucgagagagagagagagagagcaccuuucuuccgucuguu

SEQ ID NO: 516042 - RNA, 60 nt, Homo Sapiens
acacacguccuguucaccucgagagagagagagagagagcaccuuucuuccgucuguuca

SEQ ID NO: 516043 - RNA, 60 nt, Homo Sapiens
auuuuaaguguugaggagcagaggugagaagagagagagagagagaaagucaaauaaagu

SEQ ID NO: 516044 - RNA, 60 nt, Homo Sapiens
uuuaaguguugaggagcagaggugagaagagagagagagagagaaagucaaauaaaguca

SEQ ID NO: 516045 - RNA, 60 nt, Homo Sapiens
uaaguguugaggagcagaggugagaagagagagagagagagaaagucaaauaaagucaaa

SEQ ID NO: 516046 - RNA, 60 nt, Homo Sapiens
aguguugaggagcagaggugagaagagagagagagagagaaagucaaauaaagucaaaga

SEQ ID NO: 516047 - RNA, 60 nt, Homo Sapiens
uguugaggagcagaggugagaagagagagagagagagaaagucaaauaaagucaaagacc

SEQ ID NO: 516048 - RNA, 60 nt, Homo Sapiens
aguuaaugaacaugagguaguaaauagagagagagagaagcacccaagacauuuuaauag

SEQ ID NO: 516049 - RNA, 60 nt, Homo Sapiens
agaguuaaugaacaugagguaguaaauagagagagagagacccacccaagacauuuuaau

SEQ ID NO: 516050 - RNA, 60 nt, Homo Sapiens
gaagaguuaaugaacaugagauaguaaauagagagagagacccccacccaagacauuuua

SEQ ID NO: 516051 - RNA, 60 nt, Homo Sapiens
ggaacgcgaacgcuuggaaaaaacuagagagagagagaaugccuagaaauugaaaggcaa

SEQ ID NO: 516052 - RNA, 60 nt, Homo Sapiens
auggaacgcgaacgcuuggaaaaaacuagagagagagagagcgccuagaaauugaaaggc

SEQ ID NO: 516053 - RNA, 60 nt, Homo Sapiens
gaauggaacgcgaacgcuuggcaaaaacuagagagagagagagcgccuagaaauugaaag

SEQ ID NO: 516054 - RNA, 60 nt, Homo Sapiens
gccuagaaauugaaaggcaacuuacagagagagagagagcgaacgggaagaacgggaacg

SEQ ID NO: 516055 - RNA, 60 nt, Homo Sapiens
gcgccuagaaauugaaaggccgcuuacagagagagagagagugaacgggaagaacgggaa

SEQ ID NO: 516056 - RNA, 60 nt, Homo Sapiens
gagcgccuagaaauugaaagaacgcuuacagagagagagaucgugaacgggaagaacggg

SEQ ID NO: 516057 - RNA, 60 nt, Homo Sapiens
gucgagagcgagaacgcauuagagauugcagagagagagccugauuuuugguagacgaag

SEQ ID NO: 516058 - RNA, 60 nt, Homo Sapiens
agaagacagagagauuaaaggagagagagagagagagaggcagauggagauccuuucagg

SEQ ID NO: 516059 - RNA, 60 nt, Homo Sapiens
ggagaagacagagagauuaagggagagagagagagagagaaacagauggagauccuuuca

SEQ ID NO: 516060 - RNA, 60 nt, Homo Sapiens
gaggagaagacagagagauucagggagagagagagagagagcaacagauggagauccuuu

SEQ ID NO: 516061 - RNA, 60 nt, Homo Sapiens
gagaggagaagacagagagauucagggagagagagagagagugcaacagauggagauccu

SEQ ID NO: 516062 - RNA, 60 nt, Homo Sapiens
gagagaggagaagacagagacuuucagggagagagagagauggugcaacagauggagauc

SEQ ID NO: 516063 - RNA, 60 nt, Homo Sapiens
gagagagaggagaagacagauccuuucagggagagagagaccuggugcaacagauggaga

SEQ ID NO: 516064 - RNA, 60 nt, Homo Sapiens
gcauuuccugcugggguccugguuccucaggagagagagaccacagggugagagugagcc

SEQ ID NO: 516065 - RNA, 60 nt, Homo Sapiens
auuuccugcugggguccugguuccucaggagagagagaccacagggugagagugagccag

SEQ ID NO: 516066 - RNA, 60 nt, Homo Sapiens
cauggccuuggcaguuauuuuuccaucaccgagagagagagacagagagagaaaauaaac

SEQ ID NO: 516067 - RNA, 60 nt, Homo Sapiens
uggccuuggcaguuauuuuuccaucaccgagagagagagacagagagagaaaauaaacua

SEQ ID NO: 516068 - RNA, 60 nt, Homo Sapiens
gccuuggcaguuauuuuuccaucaccgagagagagagacagagagagaaaauaaacuacc

SEQ ID NO: 516069 - RNA, 60 nt, Homo Sapiens
uuauuuuuccaucaccgagagagagagacagagagagaaaauaaacuaccccuccuauuc

SEQ ID NO: 516070 - RNA, 60 nt, Homo Sapiens
cuguugaaucagaaacagaugagaaagagagagagagauggaaagagagugagagagaga

SEQ ID NO: 516071 - RNA, 60 nt, Homo Sapiens
ugcuguugaaucagaaacaggagagaaagagagagagagagagaaagagagugagagaga

SEQ ID NO: 516072 - RNA, 60 nt, Homo Sapiens
gaugcuguugaaucagaaacgagagagaaagagagagagagagagaaagagagugagaga

SEQ ID NO: 516073 - RNA, 60 nt, Homo Sapiens
gagagagagagaugcuguuggagugagagagagagagaaagagagugagagagagaaaga

SEQ ID NO: 516074 - RNA, 60 nt, Homo Sapiens
aagagagagagagaugcugugagagugagagagagagagacagagagugagagagagaaa

SEQ ID NO: 516075 - RNA, 60 nt, Homo Sapiens
gaaagagagagagagaugcuaagagagugagagagagagagccagagagugagagagaga

SEQ ID NO: 516076 - RNA, 60 nt, Homo Sapiens
gagaaagagagagagagauggaaagagagugagagagagagagccagagagugagagaga

SEQ ID NO: 516077 - RNA, 60 nt, Homo Sapiens
gagagugagagagagagagacagagagugagagagagaaaguaaccaguuuccagagagc

SEQ ID NO: 516078 - RNA, 60 nt, Homo Sapiens
aagagagugagagagagagagccagagagugagagagagagaguaaccaguuuccagaga

SEQ ID NO: 516079 - RNA, 60 nt, Homo Sapiens
gagacagagaaauaagcauuuguuaaaagagagagagacaugaggccgcugguagacuuu

SEQ ID NO: 516080 - RNA, 60 nt, Homo Sapiens
cagagacagagaaauaagcauuuguuaaaagagagagagaccugaggccgcugguagacu

SEQ ID NO: 516081 - RNA, 60 nt, Homo Sapiens
ccuuguuguuggauaggaaauaaauggagagagagagaagcuuuacaaaggaaauuugaa

SEQ ID NO: 516082 - RNA, 60 nt, Homo Sapiens
agccuuguuguuggauaggaaauaaauggagagagagagacacuuuacaaaggaaauuug

SEQ ID NO: 516083 - RNA, 60 nt, Homo Sapiens
gaagccuuguuguuggauagugaauaaauggagagagagagccacuuuacaaaggaaauu

SEQ ID NO: 516084 - RNA, 60 nt, Homo Sapiens
gaagugcuggggcagggaggcccaggagaugagagagaagguccgaguaggugauagaag

SEQ ID NO: 516085 - RNA, 60 nt, Homo Sapiens
acggaguugccaggagcaaaccaaagugaagagagagauaggaagcugccucggggccac

SEQ ID NO: 516086 - RNA, 60 nt, Homo Sapiens
aaaggucuaaaugcccacuugaaugaagcugagagagagaucuagcaaaagcuaaaacuc

SEQ ID NO: 516087 - RNA, 60 nt, Homo Sapiens
aggucuaaaugcccacuugaaugaagcugagagagagaucuagcaaaagcuaaaacucau

SEQ ID NO: 516088 - RNA, 60 nt, Homo Sapiens
acuccggagugagaagcuuugcccuccuaagagagagagacagagagacagagagagaga

SEQ ID NO: 516089 - RNA, 60 nt, Homo Sapiens
uccggagugagaagcuuugcccuccuaagagagagagacagagagacagagagagagaaa

SEQ ID NO: 516090 - RNA, 60 nt, Homo Sapiens
gcccuccuaagagagagagacagagagacagagagagagaaagagagagugugugggucu

SEQ ID NO: 516091 - RNA, 60 nt, Homo Sapiens
ccuccuaagagagagagacagagagacagagagagagaaagagagagugugugggucuau

SEQ ID NO: 516092 - RNA, 60 nt, Homo Sapiens
auuuaucucugugaccugccagggagaggggagagagagagagaugcuguugagcacaug

SEQ ID NO: 516093 - RNA, 60 nt, Homo Sapiens
uuaucucugugaccugccagggagaggggagagagagagagaugcuguugagcacaugac

SEQ ID NO: 516094 - RNA, 60 nt, Homo Sapiens
aucucugugaccugccagggagaggggagagagagagagaugcuguugagcacaugacaa

SEQ ID NO: 516095 - RNA, 60 nt, Homo Sapiens
cucugugaccugccagggagaggggagagagagagagaugcuguugagcacaugacaaaa

SEQ ID NO: 516096 - RNA, 60 nt, Homo Sapiens
augagagcacaguagcccagccaugugggagagagagagcugggagcuauuuacaaaugu

SEQ ID NO: 516097 - RNA, 60 nt, Homo Sapiens
gcaugagagcacaguagcccguccaugugggagagagagaccugggagcuauuuacaaau

SEQ ID NO: 516098 - RNA, 60 nt, Homo Sapiens
gagcaggaggucggggcacugagagggacagagagagauaggcagagagacagagaggga

SEQ ID NO: 516099 - RNA, 60 nt, Homo Sapiens
gaggggaagagaggcagagagacagagggagagagagacagagacagagagggagagaga

SEQ ID NO: 516100 - RNA, 60 nt, Homo Sapiens
cagaggggaagagaggcagagagacagagggagagagagaaggagacagagagggagaga

SEQ ID NO: 516101 - RNA, 60 nt, Homo Sapiens
gagggagagagagacagaggcagagagggagagagagacaagggagagaaacagaggaga

SEQ ID NO: 516102 - RNA, 60 nt, Homo Sapiens
cagagggagagagagacagagacagagagggagagagagaagagggagagaaacagagga

SEQ ID NO: 516103 - RNA, 60 nt, Homo Sapiens
gaggaggcagagagggagaggauaugaggagagagagacaagguggggagaggggagaga

SEQ ID NO: 516104 - RNA, 60 nt, Homo Sapiens
cagaggaggcagagagggaggagauaugaggagagagagaagagguggggagaggggaga

SEQ ID NO: 516105 - RNA, 60 nt, Homo Sapiens
ugaggagagagagacagaggggggagaggggagagagauaggggagagagaaagagaggu

SEQ ID NO: 516106 - RNA, 60 nt, Homo Sapiens
gagagguggggagaggggaggagaggaggggagagagaaaaaggaggagggagagagaug

SEQ ID NO: 516107 - RNA, 60 nt, Homo Sapiens
gagaggaggggagagagaaaaaggaggagggagagagaugaaaugggggucagggaggga

SEQ ID NO: 516108 - RNA, 60 nt, Homo Sapiens
aagaagaagaagagacacaaaaaagagagagagagagaaggccugauuggaaaaaaaaaa

SEQ ID NO: 516109 - RNA, 60 nt, Homo Sapiens
agaagaagaagaagagacacaaaaaagagagagagagagagugccugauuggaaaaaaaa

SEQ ID NO: 516110 - RNA, 60 nt, Homo Sapiens
gaagaagaagaagaagagacaaaaaaaagagagagagagagagugccugauuggaaaaaa

SEQ ID NO: 516111 - RNA, 60 nt, Homo Sapiens
gagaagaagaagaagaagagaaaaaaaaaagagagagagagagagugccugauuggaaaa

SEQ ID NO: 516112 - RNA, 60 nt, Homo Sapiens
acagaagaaaagcaauugcccaacaucagagagagagaacucagcaucuggcauccaaag

SEQ ID NO: 516113 - RNA, 60 nt, Homo Sapiens
acacagaagaaaagcaauugagcaacaucagagagagagauaucagcaucuggcauccaa

SEQ ID NO: 516114 - RNA, 60 nt, Homo Sapiens
gaaagaaagaaaggcugccugaaagagagagagagagaaaguuauuuggaaagaaagaaa

SEQ ID NO: 516115 - RNA, 60 nt, Homo Sapiens
aagaaagaaagaaaggcugcaagaaagagagagagagagaaaguuauuuggaaagaaaga

SEQ ID NO: 516116 - RNA, 60 nt, Homo Sapiens
gaaagaaagaaagaaaggcugaaagaaagagagagagagaaaaaguuauuuggaaagaaa

SEQ ID NO: 516117 - RNA, 60 nt, Homo Sapiens
gagaaagaaagaaagaaaggaagaaagaaagagagagagagaaaaaguuauuuggaaaga

SEQ ID NO: 516118 - RNA, 60 nt, Homo Sapiens
gaaugcaguugcauugauucgagagagaaagagagagaauaugggcagaggugagagaga

SEQ ID NO: 516119 - RNA, 60 nt, Homo Sapiens
gagagagaaugaaugcaguugugagagagagagagagaaaugccuuuugaaugggcagag

SEQ ID NO: 516120 - RNA, 60 nt, Homo Sapiens
aagagagagaaugaaugcagaggugagagagagagagagaagugccuuuugaaugggcag

SEQ ID NO: 516121 - RNA, 60 nt, Homo Sapiens
gaaagagagagaaugaaugcagaggugagagagagagagaccagugccuuuugaaugggc

SEQ ID NO: 516122 - RNA, 60 nt, Homo Sapiens
gagaaagagagagaaugaaugcagaggugagagagagagacuccagugccuuuugaaugg

SEQ ID NO: 516123 - RNA, 60 nt, Homo Sapiens
gagagaaagagagagaaugagggcagaggugagagagagagacuccagugccuuuugaau

SEQ ID NO: 516124 - RNA, 60 nt, Homo Sapiens
gagcggaggcuaaggacuggggcaucuggagagagagagguauggacacggaguggggcg

SEQ ID NO: 516125 - RNA, 60 nt, Homo Sapiens
gggagcggaggcuaaggacucgggcaucuggagagagagagcuauggacacggagugggg

SEQ ID NO: 516126 - RNA, 60 nt, Homo Sapiens
guguguuuguguguuucaagguguguaugagagagagagugaauuucagugggucucugu

SEQ ID NO: 516127 - RNA, 60 nt, Homo Sapiens
guguguguuuguguguuucaguguguguaugagagagagaaggaauuucagugggucucu

SEQ ID NO: 516128 - RNA, 60 nt, Homo Sapiens
uggugauacuccaacaccguuuucccaugagagagagaacacaaaguguugauccccuuc

SEQ ID NO: 516129 - RNA, 60 nt, Homo Sapiens
acuggugauacuccaacaccucuuucccaugagagagagacuacaaaguguugauccccu

SEQ ID NO: 516130 - RNA, 60 nt, Homo Sapiens
agcaucuguaacagcauuaacugucuuaaagagagagagagagaauuccgaauuggggaa

SEQ ID NO: 516131 - RNA, 60 nt, Homo Sapiens
caucuguaacagcauuaacugucuuaaagagagagagagagaauuccgaauuggggaaca

SEQ ID NO: 516132 - RNA, 60 nt, Homo Sapiens
ucuguaacagcauuaacugucuuaaagagagagagagagaauuccgaauuggggaacaca

SEQ ID NO: 516133 - RNA, 60 nt, Homo Sapiens
uguaacagcauuaacugucuuaaagagagagagagagaauuccgaauuggggaacacacg

SEQ ID NO: 516134 - RNA, 60 nt, Homo Sapiens
gaacgggcccacccacacguuguauauucagagagagagagggagucaaggugugaccgu

SEQ ID NO: 516135 - RNA, 60 nt, Homo Sapiens
acgggcccacccacacguuguauauucagagagagagagggagucaaggugugaccgucg

SEQ ID NO: 516136 - RNA, 60 nt, Homo Sapiens
cugaaagaaagagagaaagaaagaaagaaagagagagaaagaaagaaagaaagaaaggga

SEQ ID NO: 516137 - RNA, 60 nt, Homo Sapiens
uggaaggaaggaaggaaaaagaaagagaaagagagagagagagaaagaaaaagaaagaaa

SEQ ID NO: 516138 - RNA, 60 nt, Homo Sapiens
gaaggaaggaaggaaaaagaaagagaaagagagagagagagaaagaaaaagaaagaaaag

SEQ ID NO: 516139 - RNA, 60 nt, Homo Sapiens
aggaaggaaggaaaaagaaagagaaagagagagagagagaaagaaaaagaaagaaaagua

SEQ ID NO: 516140 - RNA, 60 nt, Homo Sapiens
gaaggaaggaaaaagaaagagaaagagagagagagagaaagaaaaagaaagaaaaguaag

SEQ ID NO: 516141 - RNA, 60 nt, Homo Sapiens
cucgagcucaagaauucaagaccugggcaagagagagagacuuugucucuauuaaaaaua

SEQ ID NO: 516142 - RNA, 60 nt, Homo Sapiens
cgagcucaagaauucaagaccugggcaagagagagagacuuugucucuauuaaaaauaaa

SEQ ID NO: 516143 - RNA, 60 nt, Homo Sapiens
uagacacacaaaacaaacaaacacaugggggagagagacuuggaagaggaggaggaggag

SEQ ID NO: 516144 - RNA, 60 nt, Homo Sapiens
uuggaagaggaggaggaggaggagaaggaggagagagaggggaagagacaaagugggugu

SEQ ID NO: 516145 - RNA, 60 nt, Homo Sapiens
caccauuucccuccucuagaccucaucuuggagagagagauguuggauggggccaucuau

SEQ ID NO: 516146 - RNA, 60 nt, Homo Sapiens
ccauuucccuccucuagaccucaucuuggagagagagauguuggauggggccaucuauuc

SEQ ID NO: 516147 - RNA, 60 nt, Homo Sapiens
ucuccucugcauuuuggguugggagagagagagagagaagguggaaccccgaagccuggc

SEQ ID NO: 516148 - RNA, 60 nt, Homo Sapiens
agucuccucugcauuuuggggcgggagagagagagagagaccguggaaccccgaagccug

SEQ ID NO: 516149 - RNA, 60 nt, Homo Sapiens
gaagucuccucugcauuuuguggcgggagagagagagagaccccguggaaccccgaagcc

SEQ ID NO: 516150 - RNA, 60 nt, Homo Sapiens
gagaagucuccucugcauuuccuggcgggagagagagagaggccccguggaaccccgaag

SEQ ID NO: 516151 - RNA, 60 nt, Homo Sapiens
gagagaagucuccucugcauagccuggcgggagagagagaugggccccguggaaccccga

SEQ ID NO: 516152 - RNA, 60 nt, Homo Sapiens
gcacacaugugucucuguaggugagagagagagagagauuugcgcacgcccuuuugugca

SEQ ID NO: 516153 - RNA, 60 nt, Homo Sapiens
uugcacacaugugucucugucagugagagagagagagagaugugcgcacgcccuuuugug

SEQ ID NO: 516154 - RNA, 60 nt, Homo Sapiens
gauugcacacaugugucucuugcagugagagagagagagaugugugcgcacgcccuuuug

SEQ ID NO: 516155 - RNA, 60 nt, Homo Sapiens
gagauugcacacaugugucuugugcagugagagagagagaugugugugcgcacgcccuuu

SEQ ID NO: 516156 - RNA, 60 nt, Homo Sapiens
gagagauugcacacauguguuuugugcagugagagagagaugugugugugcgcacgcccu

SEQ ID NO: 516157 - RNA, 60 nt, Homo Sapiens
gagagcagaagaaauuccuagagagagcgagagagagagcaaaaaaaaaagcgagcgaga

SEQ ID NO: 516158 - RNA, 60 nt, Homo Sapiens
gcgagagcagaagaaauuccgagagagagcgagagagagaaaaaaaaaaaaagcgagcga

SEQ ID NO: 516159 - RNA, 60 nt, Homo Sapiens
gagagagagagcgagagcagaagcgagcgagagagagagcaagacaaaaaaaaaaaaaaa

SEQ ID NO: 516160 - RNA, 60 nt, Homo Sapiens
gcgagagagagagcgagagcaaaagcgagcgagagagagaaaaagacaaaaaaaaaaaaa

SEQ ID NO: 516161 - RNA, 60 nt, Homo Sapiens
auccacaaauuccaaugucagauggggggagagagagaaacagggucuggugauggcagg

SEQ ID NO: 516162 - RNA, 60 nt, Homo Sapiens
aaauccacaaauuccaaugugggauggggggagagagagacccagggucuggugauggca

SEQ ID NO: 516163 - RNA, 60 nt, Homo Sapiens
aaaaaucacccaccacccccgagagacagagagagagaaaaaacagaaacccgagaaaga

SEQ ID NO: 516164 - RNA, 60 nt, Homo Sapiens
aaaaaaaucacccaccacccgagagagacagagagagagagaaaacagaaacccgagaaa

SEQ ID NO: 516165 - RNA, 60 nt, Homo Sapiens
gagagagagaaaaaaaaucaacccgagaaagagagagacaaccaaaaagagaaaacagaa

SEQ ID NO: 516166 - RNA, 60 nt, Homo Sapiens
gggcccaagagagacagcacgagagagagagagagagaagcagagagagagagagagaaa

SEQ ID NO: 516167 - RNA, 60 nt, Homo Sapiens
aggggcccaagagagacagcaagagagagagagagagagaagcagagagagagagagaga

SEQ ID NO: 516168 - RNA, 60 nt, Homo Sapiens
gaaggggcccaagagagacagaaagagagagagagagagagcagcagagagagagagaga

SEQ ID NO: 516169 - RNA, 60 nt, Homo Sapiens
gagaaggggcccaagagagagagaaagagagagagagagagggcagcagagagagagaga

SEQ ID NO: 516170 - RNA, 60 nt, Homo Sapiens
gagagaaggggcccaagagagagagaaagagagagagagaccgggcagcagagagagaga

SEQ ID NO: 516171 - RNA, 60 nt, Homo Sapiens
gagagagaaggggcccaagagagagagaaagagagagagaccccgggcagcagagagaga

SEQ ID NO: 516172 - RNA, 60 nt, Homo Sapiens
gagagagagagagagagaagcagagagagagagagagaaacccacccccuccccgggcag

SEQ ID NO: 516173 - RNA, 60 nt, Homo Sapiens
aagagagagagagagagagaagcagagagagagagagagacucccacccccuccccgggc

SEQ ID NO: 516174 - RNA, 60 nt, Homo Sapiens
gaaagagagagagagagagagcagcagagagagagagagacccucccacccccuccccgg

SEQ ID NO: 516175 - RNA, 60 nt, Homo Sapiens
gagaaagagagagagagagagggcagcagagagagagagaugcccucccacccccucccc

SEQ ID NO: 516176 - RNA, 60 nt, Homo Sapiens
gagagaaagagagagagagaccgggcagcagagagagagaccugcccucccacccccucc

SEQ ID NO: 516177 - RNA, 60 nt, Homo Sapiens
guaaaggcaguaaugccuucggaaacaagagagagagaaauccauuaaguacaugugcca

SEQ ID NO: 516178 - RNA, 60 nt, Homo Sapiens
aaguaaaggcaguaaugccucaggaaacaagagagagagauuuccauuaaguacaugugc

SEQ ID NO: 516179 - RNA, 60 nt, Homo Sapiens
gaggacaccgaacugggcugggaggagagcgagagagaguuauauauuauauagagagag

SEQ ID NO: 516180 - RNA, 60 nt, Homo Sapiens
cauauauuauauauuauauaagagaauggagagagagaaaagauacagagagucaaauag

SEQ ID NO: 516181 - RNA, 60 nt, Homo Sapiens
aacauauauuauauauuauaagagagaauggagagagagaaaagauacagagagucaaau

SEQ ID NO: 516182 - RNA, 60 nt, Homo Sapiens
cugugacucaaggccacggcucuacuaaaagagagagaggaagcgagagagagagagaaa

SEQ ID NO: 516183 - RNA, 60 nt, Homo Sapiens
cacggcucuacuaaaagagagagaggaagcgagagagagagagaaaaaacaaaaaacaga

SEQ ID NO: 516184 - RNA, 60 nt, Homo Sapiens
cggcucuacuaaaagagagagaggaagcgagagagagagagaaaaaacaaaaaacagaaa

SEQ ID NO: 516185 - RNA, 60 nt, Homo Sapiens
gcucuacuaaaagagagagaggaagcgagagagagagagaaaaaacaaaaaacagaaaac

SEQ ID NO: 516186 - RNA, 60 nt, Homo Sapiens
ucuacuaaaagagagagaggaagcgagagagagagagaaaaaacaaaaaacagaaaacac

SEQ ID NO: 516187 - RNA, 60 nt, Homo Sapiens
cgagaggucccaguacaagguuggugcugagagagagaaccgcuuuaguuuucaaccuug

SEQ ID NO: 516188 - RNA, 60 nt, Homo Sapiens
accgagaggucccaguacaauguuggugcugagagagagacucgcuuuaguuuucaaccu

SEQ ID NO: 516189 - RNA, 60 nt, Homo Sapiens
agagggugggaggucccggacagagccggagagagagacgcgccgccuccuagacucgag

SEQ ID NO: 516190 - RNA, 60 nt, Homo Sapiens
cgagagggugggaggucccgagcagagccggagagagagaagcgccgccuccuagacucg

SEQ ID NO: 516191 - RNA, 60 nt, Homo Sapiens
uccgaagcaauaacaacaccuuuauaaagagagagagagcccccuggugucugcacagcc

SEQ ID NO: 516192 - RNA, 60 nt, Homo Sapiens
gcuccgaagcaauaacaacaccuuuauaaagagagagagauuccccuggugucugcacag

SEQ ID NO: 516193 - RNA, 60 nt, Homo Sapiens
ccuuguuacauuuccugcuaacaugcaagagagagagaaguagcacuguucacuacauua

SEQ ID NO: 516194 - RNA, 60 nt, Homo Sapiens
agccuuguuacauuuccugcuaacaugcaagagagagagaauuagcacuguucacuacau

SEQ ID NO: 516195 - RNA, 60 nt, Homo Sapiens
cagagugcacgugacccgcacagguuugcagagagagaccauucccagacugaggcaggg

SEQ ID NO: 516196 - RNA, 60 nt, Homo Sapiens
uccacuccacucuuccuuaaagauuuacaggagagagaaauccuuaccacccaccaggcc

SEQ ID NO: 516197 - RNA, 60 nt, Homo Sapiens
agaaaacgacauuaggaauucuuuuuuagagagagagauuuuauaggauuuuuuuuucuu

SEQ ID NO: 516198 - RNA, 60 nt, Homo Sapiens
uuagaaaacgacauuaggaauucuuuuuuagagagagagaaauuauaggauuuuuuuuuc

SEQ ID NO: 516199 - RNA, 60 nt, Homo Sapiens
aagacagugguucugauggguucagcccuagagagagagagagaagcggggagaauaaga

SEQ ID NO: 516200 - RNA, 60 nt, Homo Sapiens
gacagugguucugauggguucagcccuagagagagagagagaagcggggagaauaagagu

SEQ ID NO: 516201 - RNA, 60 nt, Homo Sapiens
cagugguucugauggguucagcccuagagagagagagagaagcggggagaauaagagugc

SEQ ID NO: 516202 - RNA, 60 nt, Homo Sapiens
gugguucugauggguucagcccuagagagagagagagaagcggggagaauaagagugcac

SEQ ID NO: 516203 - RNA, 60 nt, Homo Sapiens
agccagaaaguaacacagagcucaugcuuggagagagagagucuuggccauggcuuuccu

SEQ ID NO: 516204 - RNA, 60 nt, Homo Sapiens
ccagaaaguaacacagagcucaugcuuggagagagagagucuuggccauggcuuuccugc

SEQ ID NO: 516205 - RNA, 60 nt, Homo Sapiens
ucuccggaucugucgauuuggagaccuuccgagagagaaccaagggugcagucagcuuaa

SEQ ID NO: 516206 - RNA, 60 nt, Homo Sapiens
auauuuagaaguaaaacacaaaacaaaaaagagagagaaaagaaaagaaaucacaaugua

SEQ ID NO: 516207 - RNA, 60 nt, Homo Sapiens
ucugggccuccagcgcuggguuugucgagugagagagagagaggagcuuggguugcuucc

SEQ ID NO: 516208 - RNA, 60 nt, Homo Sapiens
ugggccuccagcgcuggguuugucgagugagagagagagaggagcuuggguugcuucccu

SEQ ID NO: 516209 - RNA, 60 nt, Homo Sapiens
ggccuccagcgcuggguuugucgagugagagagagagaggagcuuggguugcuucccugu

SEQ ID NO: 516210 - RNA, 60 nt, Homo Sapiens
gaaagucuccagaccaggaagaaggaaagagagagagaaaagaagagggaaggaaagaga

SEQ ID NO: 516211 - RNA, 60 nt, Homo Sapiens
aagaaagucuccagaccagggagaaggaaagagagagagaauagaagagggaaggaaaga

SEQ ID NO: 516212 - RNA, 60 nt, Homo Sapiens
ucaaaauguuacaaccgcuguaaaaugacggagagagagagaaagaaucccagacauuaa

SEQ ID NO: 516213 - RNA, 60 nt, Homo Sapiens
aaaauguuacaaccgcuguaaaaugacggagagagagagaaagaaucccagacauuaacg

SEQ ID NO: 516214 - RNA, 60 nt, Homo Sapiens
aauguuacaaccgcuguaaaaugacggagagagagagaaagaaucccagacauuaacggu

SEQ ID NO: 516215 - RNA, 64 nt, Homo Sapiens; identical to SEQ ID NO: 107849

SEQ ID NO: 516216 - RNA, 64 nt, Homo Sapiens; identical to SEQ ID NO: 107850

SEQ ID NO: 516217 - RNA, 64 nt, Homo Sapiens; identical to SEQ ID NO: 107851

SEQ ID NO: 516218 - RNA, 64 nt, Homo Sapiens; identical to SEQ ID NO: 107852

SEQ ID NO: 516219 - RNA, 64 nt, Homo Sapiens; identical to SEQ ID NO: 107853

SEQ ID NO: 516220 - RNA, 64 nt, Homo Sapiens; identical to SEQ ID NO: 107854

SEQ ID NO: 516221 - RNA, 64 nt, Homo Sapiens; identical to SEQ ID NO: 107855

SEQ ID NO: 516222 - RNA, 64 nt, Homo Sapiens; identical to SEQ ID NO: 107856

SEQ ID NO: 516223 - RNA, 64 nt, Homo Sapiens; identical to SEQ ID NO: 107857

SEQ ID NO: 516224 - RNA, 64 nt, Homo Sapiens; identical to SEQ ID NO: 107858

SEQ ID NO: 516225 - RNA, 64 nt, Homo Sapiens; identical to SEQ ID NO: 107859

SEQ ID NO: 516226 - RNA, 64 nt, Homo Sapiens; identical to SEQ ID NO: 107860

SEQ ID NO: 516227 - RNA, 64 nt, Homo Sapiens; identical to SEQ ID NO: 107861

SEQ ID NO: 516228 - RNA, 64 nt, Homo Sapiens; identical to SEQ ID NO: 107862

SEQ ID NO: 516229 - RNA, 64 nt, Homo Sapiens; identical to SEQ ID NO: 107863

SEQ ID NO: 516230 - RNA, 63 nt, Homo Sapiens; identical to SEQ ID NO: 107864

SEQ ID NO: 516231 - RNA, 64 nt, Homo Sapiens; identical to SEQ ID NO: 107865

SEQ ID NO: 516232 - RNA, 64 nt, Homo Sapiens; identical to SEQ ID NO: 107866

SEQ ID NO: 516233 - RNA, 64 nt, Homo Sapiens; identical to SEQ ID NO: 107867

SEQ ID NO: 516234 - RNA, 64 nt, Homo Sapiens; identical to SEQ ID NO: 107868

SEQ ID NO: 516235 - RNA, 64 nt, Homo Sapiens; identical to SEQ ID NO: 107869

SEQ ID NO: 516236 - RNA, 64 nt, Homo Sapiens; identical to SEQ ID NO: 107870

SEQ ID NO: 516237 - RNA, 64 nt, Homo Sapiens; identical to SEQ ID NO: 107871

SEQ ID NO: 516238 - RNA, 64 nt, Homo Sapiens; identical to SEQ ID NO: 107872

SEQ ID NO: 516239 - RNA, 64 nt, Homo Sapiens; identical to SEQ ID NO: 107873

SEQ ID NO: 516240 - RNA, 64 nt, Homo Sapiens; identical to SEQ ID NO: 107874

SEQ ID NO: 516241 - RNA, 64 nt, Homo Sapiens; identical to SEQ ID NO: 107875

SEQ ID NO: 516242 - RNA, 64 nt, Homo Sapiens; identical to SEQ ID NO: 107876

SEQ ID NO: 516243 - RNA, 64 nt, Homo Sapiens; identical to SEQ ID NO: 107877

SEQ ID NO: 516244 - RNA, 64 nt, Homo Sapiens; identical to SEQ ID NO: 107878

SEQ ID NO: 516245 - RNA, 64 nt, Homo Sapiens; identical to SEQ ID NO: 107879

SEQ ID NO: 516246 - RNA, 64 nt, Homo Sapiens; identical to SEQ ID NO: 107880

SEQ ID NO: 516247 - RNA, 64 nt, Homo Sapiens; identical to SEQ ID NO: 107881

SEQ ID NO: 516248 - RNA, 64 nt, Homo Sapiens; identical to SEQ ID NO: 107882

SEQ ID NO: 516249 - RNA, 64 nt, Homo Sapiens; identical to SEQ ID NO: 107883

SEQ ID NO: 516250 - RNA, 64 nt, Homo Sapiens; identical to SEQ ID NO: 107884

SEQ ID NO: 516251 - RNA, 64 nt, Homo Sapiens; identical to SEQ ID NO: 107885

SEQ ID NO: 516252 - RNA, 64 nt, Homo Sapiens; identical to SEQ ID NO: 107886

SEQ ID NO: 516253 - RNA, 64 nt, Homo Sapiens; identical to SEQ ID NO: 107887

SEQ ID NO: 516254 - RNA, 64 nt, Homo Sapiens; identical to SEQ ID NO: 107888

SEQ ID NO: 516255 - RNA, 64 nt, Homo Sapiens; identical to SEQ ID NO: 107889

SEQ ID NO: 516256 - RNA, 64 nt, Homo Sapiens; identical to SEQ ID NO: 107890

SEQ ID NO: 516257 - RNA, 64 nt, Homo Sapiens; identical to SEQ ID NO: 107891

SEQ ID NO: 516258 - RNA, 64 nt, Homo Sapiens; identical to SEQ ID NO: 107892

SEQ ID NO: 516259 - RNA, 64 nt, Homo Sapiens; identical to SEQ ID NO: 107893

SEQ ID NO: 516260 - RNA, 64 nt, Homo Sapiens; identical to SEQ ID NO: 107894

SEQ ID NO: 516261 - RNA, 64 nt, Homo Sapiens; identical to SEQ ID NO: 107895

SEQ ID NO: 516262 - RNA, 64 nt, Homo Sapiens; identical to SEQ ID NO: 107896

SEQ ID NO: 516263 - RNA, 64 nt, Homo Sapiens; identical to SEQ ID NO: 107897

SEQ ID NO: 516264 - RNA, 64 nt, Homo Sapiens; identical to SEQ ID NO: 107898

SEQ ID NO: 516265 - RNA, 64 nt, Homo Sapiens; identical to SEQ ID NO: 107899

SEQ ID NO: 516266 - RNA, 64 nt, Homo Sapiens; identical to SEQ ID NO: 107900

SEQ ID NO: 516267 - RNA, 64 nt, Homo Sapiens; identical to SEQ ID NO: 107901

SEQ ID NO: 516268 - RNA, 64 nt, Homo Sapiens; identical to SEQ ID NO: 107902

SEQ ID NO: 516269 - RNA, 64 nt, Homo Sapiens; identical to SEQ ID NO: 107903

SEQ ID NO: 516270 - RNA, 64 nt, Homo Sapiens; identical to SEQ ID NO: 107904

SEQ ID NO: 516271 - RNA, 64 nt, Homo Sapiens; identical to SEQ ID NO: 107905

SEQ ID NO: 516272 - RNA, 64 nt, Homo Sapiens; identical to SEQ ID NO: 107906

SEQ ID NO: 516273 - RNA, 64 nt, Homo Sapiens; identical to SEQ ID NO: 107907

SEQ ID NO: 516274 - RNA, 64 nt, Homo Sapiens; identical to SEQ ID NO: 107908

SEQ ID NO: 516275 - RNA, 64 nt, Homo Sapiens; identical to SEQ ID NO: 107909

SEQ ID NO: 516276 - RNA, 64 nt, Homo Sapiens; identical to SEQ ID NO: 107910

SEQ ID NO: 516277 - RNA, 64 nt, Homo Sapiens; identical to SEQ ID NO: 107911

SEQ ID NO: 516278 - RNA, 64 nt, Homo Sapiens; identical to SEQ ID NO: 107912

SEQ ID NO: 516279 - RNA, 64 nt, Homo Sapiens; identical to SEQ ID NO: 107913

SEQ ID NO: 516280 - RNA, 64 nt, Homo Sapiens; identical to SEQ ID NO: 107914

SEQ ID NO: 516281 - RNA, 64 nt, Homo Sapiens; identical to SEQ ID NO: 107915

SEQ ID NO: 516282 - RNA, 64 nt, Homo Sapiens; identical to SEQ ID NO: 107916

SEQ ID NO: 516283 - RNA, 64 nt, Homo Sapiens; identical to SEQ ID NO: 107917

SEQ ID NO: 516284 - RNA, 64 nt, Homo Sapiens; identical to SEQ ID NO: 107918

SEQ ID NO: 516285 - RNA, 64 nt, Homo Sapiens; identical to SEQ ID NO: 107919

SEQ ID NO: 516286 - RNA, 64 nt, Homo Sapiens; identical to SEQ ID NO: 107920

SEQ ID NO: 516287 - RNA, 64 nt, Homo Sapiens; identical to SEQ ID NO: 107921

SEQ ID NO: 516288 - RNA, 64 nt, Homo Sapiens; identical to SEQ ID NO: 107922

SEQ ID NO: 516289 - RNA, 64 nt, Homo Sapiens; identical to SEQ ID NO: 107923

SEQ ID NO: 516290 - RNA, 64 nt, Homo Sapiens; identical to SEQ ID NO: 107924

SEQ ID NO: 516291 - RNA, 64 nt, Homo Sapiens; identical to SEQ ID NO: 107925

SEQ ID NO: 516292 - RNA, 64 nt, Homo Sapiens; identical to SEQ ID NO: 107926

SEQ ID NO: 516293 - RNA, 64 nt, Homo Sapiens; identical to SEQ ID NO: 107927

SEQ ID NO: 516294 - RNA, 64 nt, Homo Sapiens; identical to SEQ ID NO: 107928

SEQ ID NO: 516295 - RNA, 64 nt, Homo Sapiens; identical to SEQ ID NO: 107929

SEQ ID NO: 516296 - RNA, 64 nt, Homo Sapiens; identical to SEQ ID NO: 107930

SEQ ID NO: 516297 - RNA, 64 nt, Homo Sapiens; identical to SEQ ID NO: 107931

SEQ ID NO: 516298 - RNA, 64 nt, Homo Sapiens; identical to SEQ ID NO: 107932

SEQ ID NO: 516299 - RNA, 64 nt, Homo Sapiens; identical to SEQ ID NO: 107933

SEQ ID NO: 516300 - RNA, 64 nt, Homo Sapiens
aaucacagaccacaaggguaacucucauuuggcagacuacuacuuaguaaguacaacauuuuua

SEQ ID NO: 516301 - RNA, 64 nt, Homo Sapiens
aggaaaaauuguguuaccuucauaacuacccaaggacuacuaaaaagaguggaaacuauucuau

SEQ ID NO: 516302 - RNA, 64 nt, Homo Sapiens
auuuuugucacagcauuuucauaccuucaugguggacuacuagucacugcuuccauaaauauug

SEQ ID NO: 516303 - RNA, 64 nt, Homo Sapiens
aaauugguuaacuuuacaaaugucagcuaguuuugacuacuaauugggggaaauuuuagauaau

SEQ ID NO: 516304 - RNA, 64 nt, Homo Sapiens; identical to SEQ ID NO: 385550

SEQ ID NO: 516305 - RNA, 64 nt, Homo Sapiens; identical to SEQ ID NO: 385551

SEQ ID NO: 516306 - RNA, 64 nt, Homo Sapiens; identical to SEQ ID NO: 385552

SEQ ID NO: 516307 - RNA, 64 nt, Homo Sapiens; identical to SEQ ID NO: 385553

SEQ ID NO: 516308 - RNA, 64 nt, Homo Sapiens; identical to SEQ ID NO: 385554

SEQ ID NO: 516309 - RNA, 64 nt, Homo Sapiens; identical to SEQ ID NO: 385555

SEQ ID NO: 516310 - RNA, 64 nt, Homo Sapiens; identical to SEQ ID NO: 385556

SEQ ID NO: 516311 - RNA, 64 nt, Homo Sapiens; identical to SEQ ID NO: 385557

SEQ ID NO: 516312 - RNA, 64 nt, Homo Sapiens; identical to SEQ ID NO: 385558

SEQ ID NO: 516313 - RNA, 64 nt, Homo Sapiens; identical to SEQ ID NO: 385559

SEQ ID NO: 516314 - RNA, 64 nt, Homo Sapiens; identical to SEQ ID NO: 385560

SEQ ID NO: 516315 - RNA, 64 nt, Homo Sapiens; identical to SEQ ID NO: 385561

SEQ ID NO: 516316 - RNA, 64 nt, Homo Sapiens; identical to SEQ ID NO: 385562

SEQ ID NO: 516317 - RNA, 64 nt, Homo Sapiens; identical to SEQ ID NO: 385563

SEQ ID NO: 516318 - RNA, 64 nt, Homo Sapiens; identical to SEQ ID NO: 385564

SEQ ID NO: 516319 - RNA, 64 nt, Homo Sapiens; identical to SEQ ID NO: 385565

SEQ ID NO: 516320 - RNA, 64 nt, Homo Sapiens; identical to SEQ ID NO: 385566

SEQ ID NO: 516321 - RNA, 64 nt, Homo Sapiens; identical to SEQ ID NO: 385567

SEQ ID NO: 516322 - RNA, 64 nt, Homo Sapiens; identical to SEQ ID NO: 385568

SEQ ID NO: 516323 - RNA, 64 nt, Homo Sapiens; identical to SEQ ID NO: 385569

SEQ ID NO: 516324 - RNA, 64 nt, Homo Sapiens; identical to SEQ ID NO: 385570

SEQ ID NO: 516325 - RNA, 64 nt, Homo Sapiens; identical to SEQ ID NO: 385571

SEQ ID NO: 516326 - RNA, 64 nt, Homo Sapiens; identical to SEQ ID NO: 385572

SEQ ID NO: 516327 - RNA, 64 nt, Homo Sapiens; identical to SEQ ID NO: 385573

SEQ ID NO: 516328 - RNA, 64 nt, Homo Sapiens; identical to SEQ ID NO: 385574

SEQ ID NO: 516329 - RNA, 64 nt, Homo Sapiens; identical to SEQ ID NO: 385575

SEQ ID NO: 516330 - RNA, 64 nt, Homo Sapiens; identical to SEQ ID NO: 385576

SEQ ID NO: 516331 - RNA, 64 nt, Homo Sapiens; identical to SEQ ID NO: 385577

SEQ ID NO: 516332 - RNA, 64 nt, Homo Sapiens; identical to SEQ ID NO: 385578

SEQ ID NO: 516333 - RNA, 64 nt, Homo Sapiens; identical to SEQ ID NO: 385579

SEQ ID NO: 516334 - RNA, 64 nt, Homo Sapiens; identical to SEQ ID NO: 385580

SEQ ID NO: 516335 - RNA, 64 nt, Homo Sapiens; identical to SEQ ID NO: 385581

SEQ ID NO: 516336 - RNA, 64 nt, Homo Sapiens; identical to SEQ ID NO: 385582

SEQ ID NO: 516337 - RNA, 64 nt, Homo Sapiens; identical to SEQ ID NO: 385583

SEQ ID NO: 516338 - RNA, 64 nt, Homo Sapiens; identical to SEQ ID NO: 385584

SEQ ID NO: 516339 - RNA, 64 nt, Homo Sapiens; identical to SEQ ID NO: 385585

SEQ ID NO: 516340 - RNA, 64 nt, Homo Sapiens; identical to SEQ ID NO: 385586

SEQ ID NO: 516341 - RNA, 64 nt, Homo Sapiens; identical to SEQ ID NO: 385587

SEQ ID NO: 516342 - RNA, 64 nt, Homo Sapiens; identical to SEQ ID NO: 385588

SEQ ID NO: 516343 - RNA, 64 nt, Homo Sapiens; identical to SEQ ID NO: 443174

SEQ ID NO: 516344 - RNA, 64 nt, Homo Sapiens; identical to SEQ ID NO: 443175

SEQ ID NO: 516345 - RNA, 64 nt, Homo Sapiens; identical to SEQ ID NO: 443176

SEQ ID NO: 516346 - RNA, 64 nt, Homo Sapiens; identical to SEQ ID NO: 443177

SEQ ID NO: 516347 - RNA, 64 nt, Homo Sapiens; identical to SEQ ID NO: 443178

SEQ ID NO: 516348 - RNA, 64 nt, Homo Sapiens; identical to SEQ ID NO: 443179

SEQ ID NO: 516349 - RNA, 64 nt, Homo Sapiens; identical to SEQ ID NO: 443180

SEQ ID NO: 516350 - RNA, 64 nt, Homo Sapiens; identical to SEQ ID NO: 443181

SEQ ID NO: 516351 - RNA, 64 nt, Homo Sapiens; identical to SEQ ID NO: 443182

SEQ ID NO: 516352 - RNA, 64 nt, Homo Sapiens; identical to SEQ ID NO: 443183

SEQ ID NO: 516353 - RNA, 64 nt, Homo Sapiens; identical to SEQ ID NO: 443184

SEQ ID NO: 516354 - RNA, 64 nt, Homo Sapiens; identical to SEQ ID NO: 443185

SEQ ID NO: 516355 - RNA, 64 nt, Homo Sapiens; identical to SEQ ID NO: 443186

SEQ ID NO: 516356 - RNA, 64 nt, Homo Sapiens; identical to SEQ ID NO: 443187

SEQ ID NO: 516357 - RNA, 64 nt, Homo Sapiens; identical to SEQ ID NO: 443188

SEQ ID NO: 516358 - RNA, 64 nt, Homo Sapiens; identical to SEQ ID NO: 443189

SEQ ID NO: 516359 - RNA, 64 nt, Homo Sapiens; identical to SEQ ID NO: 443190

SEQ ID NO: 516360 - RNA, 64 nt, Homo Sapiens; identical to SEQ ID NO: 443191

SEQ ID NO: 516361 - RNA, 64 nt, Homo Sapiens; identical to SEQ ID NO: 443192

SEQ ID NO: 516362 - RNA, 64 nt, Homo Sapiens; identical to SEQ ID NO: 443193

SEQ ID NO: 516363 - RNA, 64 nt, Homo Sapiens; identical to SEQ ID NO: 443194

SEQ ID NO: 516364 - RNA, 64 nt, Homo Sapiens; identical to SEQ ID NO: 443195

SEQ ID NO: 516365 - RNA, 64 nt, Homo Sapiens; identical to SEQ ID NO: 443196

SEQ ID NO: 516366 - RNA, 64 nt, Homo Sapiens; identical to SEQ ID NO: 443197

SEQ ID NO: 516367 - RNA, 64 nt, Homo Sapiens; identical to SEQ ID NO: 443198

SEQ ID NO: 516368 - RNA, 64 nt, Homo Sapiens; identical to SEQ ID NO: 443199

SEQ ID NO: 516369 - RNA, 64 nt, Homo Sapiens; identical to SEQ ID NO: 443200

SEQ ID NO: 516370 - RNA, 64 nt, Homo Sapiens; identical to SEQ ID NO: 443201

SEQ ID NO: 516371 - RNA, 64 nt, Homo Sapiens; identical to SEQ ID NO: 443202

SEQ ID NO: 516372 - RNA, 64 nt, Homo Sapiens; identical to SEQ ID NO: 443203

SEQ ID NO: 516373 - RNA, 64 nt, Homo Sapiens; identical to SEQ ID NO: 443204

SEQ ID NO: 516374 - RNA, 64 nt, Homo Sapiens; identical to SEQ ID NO: 443205

SEQ ID NO: 516375 - RNA, 64 nt, Homo Sapiens; identical to SEQ ID NO: 443206

SEQ ID NO: 516376 - RNA, 64 nt, Homo Sapiens; identical to SEQ ID NO: 443207

SEQ ID NO: 516377 - RNA, 64 nt, Homo Sapiens; identical to SEQ ID NO: 443208

SEQ ID NO: 516378 - RNA, 64 nt, Homo Sapiens; identical to SEQ ID NO: 443209

SEQ ID NO: 516379 - RNA, 64 nt, Homo Sapiens; identical to SEQ ID NO: 443210

SEQ ID NO: 516380 - RNA, 64 nt, Homo Sapiens; identical to SEQ ID NO: 443211

SEQ ID NO: 516381 - RNA, 64 nt, Homo Sapiens; identical to SEQ ID NO: 443212

SEQ ID NO: 516382 - RNA, 64 nt, Homo Sapiens; identical to SEQ ID NO: 443213

SEQ ID NO: 516383 - RNA, 64 nt, Homo Sapiens; identical to SEQ ID NO: 443214

SEQ ID NO: 516384 - RNA, 64 nt, Homo Sapiens; identical to SEQ ID NO: 443215

SEQ ID NO: 516385 - RNA, 64 nt, Homo Sapiens; identical to SEQ ID NO: 443216

SEQ ID NO: 516386 - RNA, 64 nt, Homo Sapiens; identical to SEQ ID NO: 443217

SEQ ID NO: 516387 - RNA, 64 nt, Homo Sapiens; identical to SEQ ID NO: 443218

SEQ ID NO: 516388 - RNA, 64 nt, Homo Sapiens; identical to SEQ ID NO: 443219

SEQ ID NO: 516389 - RNA, 64 nt, Homo Sapiens; identical to SEQ ID NO: 443220

SEQ ID NO: 516390 - RNA, 64 nt, Homo Sapiens; identical to SEQ ID NO: 443221

SEQ ID NO: 516391 - RNA, 64 nt, Homo Sapiens; identical to SEQ ID NO: 443222

SEQ ID NO: 516392 - RNA, 64 nt, Homo Sapiens; identical to SEQ ID NO: 443223

SEQ ID NO: 516393 - RNA, 64 nt, Homo Sapiens; identical to SEQ ID NO: 443224

SEQ ID NO: 516394 - RNA, 64 nt, Homo Sapiens; identical to SEQ ID NO: 443225

SEQ ID NO: 516395 - RNA, 64 nt, Homo Sapiens; identical to SEQ ID NO: 443226

SEQ ID NO: 516396 - RNA, 64 nt, Homo Sapiens; identical to SEQ ID NO: 443227

SEQ ID NO: 516397 - RNA, 64 nt, Homo Sapiens; identical to SEQ ID NO: 443228

SEQ ID NO: 516398 - RNA, 64 nt, Homo Sapiens; identical to SEQ ID NO: 443229

SEQ ID NO: 516399 - RNA, 64 nt, Homo Sapiens; identical to SEQ ID NO: 443230

SEQ ID NO: 516400 - RNA, 64 nt, Homo Sapiens; identical to SEQ ID NO: 443231

SEQ ID NO: 516401 - RNA, 64 nt, Homo Sapiens; identical to SEQ ID NO: 443232

SEQ ID NO: 516402 - RNA, 64 nt, Homo Sapiens; identical to SEQ ID NO: 443233

SEQ ID NO: 516403 - RNA, 64 nt, Homo Sapiens; identical to SEQ ID NO: 443234

SEQ ID NO: 516404 - RNA, 64 nt, Homo Sapiens; identical to SEQ ID NO: 443235

SEQ ID NO: 516405 - RNA, 64 nt, Homo Sapiens; identical to SEQ ID NO: 443236

SEQ ID NO: 516406 - RNA, 64 nt, Homo Sapiens; identical to SEQ ID NO: 443237

SEQ ID NO: 516407 - RNA, 64 nt, Homo Sapiens; identical to SEQ ID NO: 443238

SEQ ID NO: 516408 - RNA, 64 nt, Homo Sapiens; identical to SEQ ID NO: 443239

SEQ ID NO: 516409 - RNA, 64 nt, Homo Sapiens; identical to SEQ ID NO: 37560

SEQ ID NO: 516410 - RNA, 64 nt, Homo Sapiens; identical to SEQ ID NO: 37561

SEQ ID NO: 516411 - RNA, 64 nt, Homo Sapiens; identical to SEQ ID NO: 37562

SEQ ID NO: 516412 - RNA, 64 nt, Homo Sapiens; identical to SEQ ID NO: 37563

SEQ ID NO: 516413 - RNA, 64 nt, Homo Sapiens; identical to SEQ ID NO: 37564

SEQ ID NO: 516414 - RNA, 64 nt, Homo Sapiens; identical to SEQ ID NO: 37565

SEQ ID NO: 516415 - RNA, 64 nt, Homo Sapiens; identical to SEQ ID NO: 37566

SEQ ID NO: 516416 - RNA, 64 nt, Homo Sapiens; identical to SEQ ID NO: 37567

SEQ ID NO: 516417 - RNA, 64 nt, Homo Sapiens; identical to SEQ ID NO: 37568

SEQ ID NO: 516418 - RNA, 64 nt, Homo Sapiens; identical to SEQ ID NO: 37569

SEQ ID NO: 516419 - RNA, 64 nt, Homo Sapiens; identical to SEQ ID NO: 37570

SEQ ID NO: 516420 - RNA, 64 nt, Homo Sapiens; identical to SEQ ID NO: 37571

SEQ ID NO: 516421 - RNA, 64 nt, Homo Sapiens; identical to SEQ ID NO: 37572

SEQ ID NO: 516422 - RNA, 64 nt, Homo Sapiens; identical to SEQ ID NO: 37573

SEQ ID NO: 516423 - RNA, 64 nt, Homo Sapiens; identical to SEQ ID NO: 37574

SEQ ID NO: 516424 - RNA, 64 nt, Homo Sapiens; identical to SEQ ID NO: 37575

SEQ ID NO: 516425 - RNA, 64 nt, Homo Sapiens; identical to SEQ ID NO: 37576

SEQ ID NO: 516426 - RNA, 64 nt, Homo Sapiens; identical to SEQ ID NO: 37577

SEQ ID NO: 516427 - RNA, 64 nt, Homo Sapiens; identical to SEQ ID NO: 37578

SEQ ID NO: 516428 - RNA, 64 nt, Homo Sapiens; identical to SEQ ID NO: 37579

SEQ ID NO: 516429 - RNA, 64 nt, Homo Sapiens; identical to SEQ ID NO: 37580

SEQ ID NO: 516430 - RNA, 64 nt, Homo Sapiens; identical to SEQ ID NO: 37581

SEQ ID NO: 516431 - RNA, 64 nt, Homo Sapiens; identical to SEQ ID NO: 265005

SEQ ID NO: 516432 - RNA, 64 nt, Homo Sapiens; identical to SEQ ID NO: 265006

SEQ ID NO: 516433 - RNA, 64 nt, Homo Sapiens; identical to SEQ ID NO: 265007

SEQ ID NO: 516434 - RNA, 64 nt, Homo Sapiens; identical to SEQ ID NO: 265008

SEQ ID NO: 516435 - RNA, 64 nt, Homo Sapiens; identical to SEQ ID NO: 265009

SEQ ID NO: 516436 - RNA, 64 nt, Homo Sapiens; identical to SEQ ID NO: 265010

SEQ ID NO: 516437 - RNA, 64 nt, Homo Sapiens; identical to SEQ ID NO: 265011

SEQ ID NO: 516438 - RNA, 64 nt, Homo Sapiens; identical to SEQ ID NO: 265012

SEQ ID NO: 516439 - RNA, 64 nt, Homo Sapiens; identical to SEQ ID NO: 265013

SEQ ID NO: 516440 - RNA, 64 nt, Homo Sapiens; identical to SEQ ID NO: 265014

SEQ ID NO: 516441 - RNA, 64 nt, Homo Sapiens; identical to SEQ ID NO: 265015

SEQ ID NO: 516442 - RNA, 64 nt, Homo Sapiens; identical to SEQ ID NO: 265016

SEQ ID NO: 516443 - RNA, 64 nt, Homo Sapiens; identical to SEQ ID NO: 265017

SEQ ID NO: 516444 - RNA, 64 nt, Homo Sapiens; identical to SEQ ID NO: 265018

SEQ ID NO: 516445 - RNA, 64 nt, Homo Sapiens; identical to SEQ ID NO: 265019

SEQ ID NO: 516446 - RNA, 64 nt, Homo Sapiens; identical to SEQ ID NO: 265020

SEQ ID NO: 516447 - RNA, 64 nt, Homo Sapiens; identical to SEQ ID NO: 265021

SEQ ID NO: 516448 - RNA, 64 nt, Homo Sapiens; identical to SEQ ID NO: 265022

SEQ ID NO: 516449 - RNA, 64 nt, Homo Sapiens; identical to SEQ ID NO: 265023

SEQ ID NO: 516450 - RNA, 64 nt, Homo Sapiens; identical to SEQ ID NO: 265024

SEQ ID NO: 516451 - RNA, 64 nt, Homo Sapiens; identical to SEQ ID NO: 265025

SEQ ID NO: 516452 - RNA, 64 nt, Homo Sapiens; identical to SEQ ID NO: 265026

SEQ ID NO: 516453 - RNA, 64 nt, Homo Sapiens; identical to SEQ ID NO: 265027

SEQ ID NO: 516454 - RNA, 64 nt, Homo Sapiens; identical to SEQ ID NO: 265028

SEQ ID NO: 516455 - RNA, 64 nt, Homo Sapiens; identical to SEQ ID NO: 265029

SEQ ID NO: 516456 - RNA, 64 nt, Homo Sapiens; identical to SEQ ID NO: 265030

SEQ ID NO: 516457 - RNA, 64 nt, Homo Sapiens; identical to SEQ ID NO: 265031

SEQ ID NO: 516458 - RNA, 64 nt, Homo Sapiens; identical to SEQ ID NO: 265032

SEQ ID NO: 516459 - RNA, 64 nt, Homo Sapiens; identical to SEQ ID NO: 265033

SEQ ID NO: 516460 - RNA, 64 nt, Homo Sapiens; identical to SEQ ID NO: 265034

SEQ ID NO: 516461 - RNA, 64 nt, Homo Sapiens
gcucaccuucuuccugguaacggguaacgggggcagcgcccaggaucacccagagcugggccuu

SEQ ID NO: 516462 - RNA, 64 nt, Homo Sapiens
cugggccuuaaaggaugcggacucauccucagccagcgcccauguugugauacagggguguuug

SEQ ID NO: 516463 - RNA, 64 nt, Homo Sapiens
uugcauccuuguguuuugcugugguuuuuaaaggagcgcccacgaaguguaguggcugacgauu

SEQ ID NO: 516464 - RNA, 64 nt, Homo Sapiens
guuagggcuggaagacggcaaggagagagggaccagcgcccagcggaagcccagccgugggcuu

SEQ ID NO: 516465 - RNA, 64 nt, Homo Sapiens
cccuucuagcaccuccugacugucacccuuggacagcgcccacauggcuuccaggccacccauc

SEQ ID NO: 516466 - RNA, 64 nt, Homo Sapiens
agacccacuggacucaccucuuggucuaucuuugagcgcccacucaguguguuggcgcuuugcu

SEQ ID NO: 516467 - RNA, 64 nt, Homo Sapiens
guggcccccagccucggccaggccugcucugcucagcgcccaccgcccaccaccccuccugcuu

SEQ ID NO: 516468 - RNA, 64 nt, Homo Sapiens
uagccuccagcagugcggcucagcaauaaaacccagcgcccaggagguggguaaccaaguucac

SEQ ID NO: 516469 - RNA, 64 nt, Homo Sapiens
cucugaacucagcagaaaguggcagucggaggagagcgcccagacucugaaaguccucaugccu

SEQ ID NO: 516470 - RNA, 64 nt, Homo Sapiens
gaaugaaagauacuugaauuauugugcgccugugagcgcccagcuucuguuucauagucuuaac

SEQ ID NO: 516471 - RNA, 64 nt, Homo Sapiens
ucagacuggggccagggaggacgcaugagccgugagcgcccagucuggugccgucuugcaugaa

SEQ ID NO: 516472 - RNA, 54 nt, Homo Sapiens
agaggggcacccaccaguuggcugagcgcccacuucccauuugagcagcuguga

SEQ ID NO: 516473 - RNA, 64 nt, Homo Sapiens
cucagcuuagaaguucgaaacugagucccaccauagcgcccaagaggagaagacucggaauucc

SEQ ID NO: 516474 - RNA, 64 nt, Homo Sapiens
gucccucugugcuuuuucgcccgccucuggagccagcgcccaggugaccucacacccucugggc

SEQ ID NO: 516475 - RNA, 62 nt, Homo Sapiens
ccaagauggacuugcugugaauggugccacacagcgcccacagacugggcccucgcacccuu

SEQ ID NO: 516476 - RNA, 64 nt, Homo Sapiens
guucagauugccccuggggaucuucugugucuucagcgcccagcccugcguguuccuggugaag

SEQ ID NO: 516477 - RNA, 64 nt, Homo Sapiens
ugggcaugagacagucugcaacaggaagcaucccagcgcccacaugaaggcaugagacaucugu

SEQ ID NO: 516478 - RNA, 64 nt, Homo Sapiens
acacgccaagucccguuucguacuccguuuccuuagcgcccauguccugccugugagucggccu

SEQ ID NO: 516479 - RNA, 64 nt, Homo Sapiens
acccguugaauguuuugaaugcccugacucuaccagcgcccauaaaugaucucuagaaggacug

SEQ ID NO: 516480 - RNA, 64 nt, Homo Sapiens
ccgcuaguggcagaugugaacugacaaggagugaagcgcccacccagcggauggacagcaccca

SEQ ID NO: 516481 - RNA, 64 nt, Homo Sapiens
cugcagcucagcugggagcaccuccagucagcccagcgcccauccagaccccaccccgucuacc

SEQ ID NO: 516482 - RNA, 64 nt, Homo Sapiens
uucgggacaccagugcgcaacuccucuggccgccagcgcccacucccucgggggagaccgcagg

SEQ ID NO: 516483 - RNA, 64 nt, Homo Sapiens
cugcugaaggggucccccauuguuuugcuuccccagcgcccaggaugagcgguuuaccaucgag

SEQ ID NO: 516484 - RNA, 64 nt, Homo Sapiens
cugcugugcuccacacccugcaggcgccucgggaagcgcccaaaggauuccccuucacguuggu

SEQ ID NO: 516485 - RNA, 64 nt, Homo Sapiens
aaagaaagaggaagccacggcgugacaucuacaaagcgcccaaucaguguaacuuuuagaccug

SEQ ID NO: 516486 - RNA, 64 nt, Homo Sapiens
agccuugggacuuccuuccaccgucgcccaccucagcgcccaggugaagguacgccacccaccu

SEQ ID NO: 516487 - RNA, 64 nt, Homo Sapiens
gcuacagcugcgccggaucuggcugucacugcacagcgcccacgucgugacagguggcgggugu

SEQ ID NO: 516488 - RNA, 64 nt, Homo Sapiens
cuagucaccgacagcggccuugaagacagagcaaagcgcccacccaggucccccgacugccugu

SEQ ID NO: 516489 - RNA, 64 nt, Homo Sapiens
gacccaacgccaacaccuggugccuucugcagccagcgcccacccauccgugcccggacccuug

SEQ ID NO: 516490 - RNA, 64 nt, Homo Sapiens
cccauggcucgggucaguccggacaagucucgccagcgcccaccagcccgggccaccucguggg

SEQ ID NO: 516491 - RNA, 64 nt, Homo Sapiens
ugugaguggaggcagaggagugaggcccacgggcagcgcccaggagcccaccuuccccucuggc

SEQ ID NO: 516492 - RNA, 64 nt, Homo Sapiens
uuuuuacgcauagcuccgucaagcugccuggaugagcgcccaugcagcaaggcuuggaggaagc

SEQ ID NO: 516493 - RNA, 64 nt, Homo Sapiens
aggacacccaugcaagaggccaguggcggggcccagcgcccagcccccaaagcaagcagggggc

SEQ ID NO: 516494 - RNA, 64 nt, Homo Sapiens
cgcaggggacaccgugccggcuucagacacucccagcgcccacucuuacaggcccaggacugga

SEQ ID NO: 516495 - RNA, 64 nt, Homo Sapiens
gugggcuaaugcugaaggggcagccagucaccagagcgcccaccuggcacaccccccucacccc

SEQ ID NO: 516496 - RNA, 64 nt, Homo Sapiens
uuugcuuuaagaaaaaaggaggcaagguagggagagcgcccacacuguccaugcuccaggcccc

SEQ ID NO: 516497 - RNA, 64 nt, Homo Sapiens
gaaggccacuucucaacuggaccacugcaaucccagcgcccaagggccagugcgccugcuccug

SEQ ID NO: 516498 - RNA, 64 nt, Homo Sapiens
uuuccucacuguuccuguggcccaggccgaagccagcgcccagcccacccccacccgucccagg

SEQ ID NO: 516499 - RNA, 64 nt, Homo Sapiens
cucucgaaagaauuuucugccccgauucccugugagcgcccaccuaggcaggugggcucugcuu

SEQ ID NO: 516500 - RNA, 64 nt, Homo Sapiens
ugggggcugcaguucgacucugugcuggccagcgagcgcccagcuccugacacugcuggagagg

SEQ ID NO: 516501 - RNA, 64 nt, Homo Sapiens
aaaguuccaaagaggugguuucugaggaagucagagcgcccagggccagagcagucaguaaugg

SEQ ID NO: 516502 - RNA, 64 nt, Homo Sapiens
ugcucagccacccucuggcucugauggggacccaagcgcccacgaaacacacuauggaacucug

SEQ ID NO: 516503 - RNA, 64 nt, Homo Sapiens
ccuucuccugcccgagagauccccucgccacuccagcgcccaguagggagugagcuccccagac

SEQ ID NO: 516504 - RNA, 64 nt, Homo Sapiens
ucugaaggaccugcucgcgagcgaacuccagagaagcgcccacaagcaacgguguugucagugu

SEQ ID NO: 516505 - RNA, 64 nt, Homo Sapiens
guagaugagagacagggcagugggaaccuugcuuagcgcccaagcuggcugcugggagagccca

SEQ ID NO: 516506 - RNA, 64 nt, Homo Sapiens
agggcauagggcagccuacccccagcacuguggcagcgcccagggagcaccaugcuggagguca

SEQ ID NO: 516507 - RNA, 64 nt, Homo Sapiens
cuugggcagcaaccccugcagcagaacccccaggagcgcccaggaugcggcugcuucaugagau

SEQ ID NO: 516508 - RNA, 64 nt, Homo Sapiens
gugaggggaugacgcgcugugggugggaggaggcagcgcccaucucagcagcaccaggacugcc

SEQ ID NO: 516509 - RNA, 64 nt, Homo Sapiens
acggaccgcucuuggcuccugacucccaggguacagcgcccaguaacucauccuucauucagag

SEQ ID NO: 516510 - RNA, 64 nt, Homo Sapiens
gcugacagacacaggcccggcuccaggcuccuuuagcgcccaguuggguggaugccugguggca

SEQ ID NO: 516511 - RNA, 64 nt, Homo Sapiens
gcauaucuggucagaacugcagggccuauaugccagcgcccagggaggagucaguaccccuggu

SEQ ID NO: 516512 - RNA, 64 nt, Homo Sapiens
gagccuccccaaggagcgccgcccccugcuccacagcgcccagucccaucgaccacccaagggc

SEQ ID NO: 516513 - RNA, 64 nt, Homo Sapiens
ccugcuggcaucaggucugggguagcaagagagcagcgcccagguccucccuugccccaggcca

SEQ ID NO: 516514 - RNA, 64 nt, Homo Sapiens
agcguggaugucgaugacuuccugggcuccggccagcgcccaacaguaucaguacaugccuaga

SEQ ID NO: 516515 - RNA, 64 nt, Homo Sapiens
ucuggaauuuuccguuuggguagcacagagcuggagcgcccauuacucacacucguccccagcu

SEQ ID NO: 516516 - RNA, 64 nt, Homo Sapiens
gacaguguccacucuggcaaagccagccccgcagagcgcccacggcuucucagccggcuguccc

SEQ ID NO: 516517 - RNA, 64 nt, Homo Sapiens
ggccuuuccucgcucaccaggccugcagaguggaagcgcccagccucggguuauuucagccccg

SEQ ID NO: 516518 - RNA, 64 nt, Homo Sapiens
cacaucuggaaagucggagcggccacuuggccaaagcgcccauccugcugccucccucuggagu

SEQ ID NO: 516519 - RNA, 64 nt, Homo Sapiens
agugcagacuucggggucuccaccccaggccagcagcgcccacugggcuacagcaagccaacag

SEQ ID NO: 516520 - RNA, 64 nt, Homo Sapiens
gcuccaggcucccaccaucuacagaggggcuuacagcgcccauucuggucuuggggaacccauc

SEQ ID NO: 516521 - RNA, 64 nt, Homo Sapiens
agccgacgcccuugccccugccccuaccccugccagcgcccacccccagccagggccccucgcc

SEQ ID NO: 516522 - RNA, 64 nt, Homo Sapiens
uacaggguccaacauagagccggguguccccaacagcgcccaaaggacgcacugagcaacgcua

SEQ ID NO: 516523 - RNA, 64 nt, Homo Sapiens
cugcucugagcugggagcagccagaggcggugcaagcgcccagcuccccagagcuccccaaccu

SEQ ID NO: 516524 - RNA, 64 nt, Homo Sapiens
caagucucugcuuugagucaugucuccacucuccagcgcccauugcccucccuggccucuccac

SEQ ID NO: 516525 - RNA, 64 nt, Homo Sapiens
ucccuaaggcuguccugaccgcgagaugacugagagcgcccacggccagcuccugucuguaugg

SEQ ID NO: 516526 - RNA, 64 nt, Homo Sapiens
cuuauaccaccucucaaccauuacucacacuuccagcgcccagguccaagucugagccugaccu

SEQ ID NO: 516527 - RNA, 64 nt, Homo Sapiens
ugcacuuguuguugauacagccagcugggaaggcagcgcccagcauuccccuaggagcgcuugg

SEQ ID NO: 516528 - RNA, 64 nt, Homo Sapiens
ccuggccggugucacuguggcccggccaccccugagcgcccagcucccuaccuccuggacgucu

SEQ ID NO: 516529 - RNA, 64 nt, Homo Sapiens
cauugacaguccugacgggagcucagggcugcccagcgcccagcgugcacgggacggccccacg

SEQ ID NO: 516530 - RNA, 64 nt, Homo Sapiens
auaugucagcaccuggaaguggagugcaggcugcagcgcccagccaugugggccaggugcauuc

SEQ ID NO: 516531 - RNA, 64 nt, Homo Sapiens
ccugauggcacacaaggagccuccuuccuguagcagcgcccaguuuucauguggauggauugua

SEQ ID NO: 516532 - RNA, 64 nt, Homo Sapiens
gggugaugcagaggccacaggugcugcacgcuccagcgcccacucuagacaucagccuccaggu

SEQ ID NO: 516533 - RNA, 64 nt, Homo Sapiens
cucaguuccuaccuccaagggggaggguccuggaagcgcccacccaggcgccgccccugugcuu

SEQ ID NO: 516534 - RNA, 64 nt, Homo Sapiens
cucgugguaggcaacaagcggcgggcgcgcccgaagcgcccaucuccauucggcccccaggccg

SEQ ID NO: 516535 - RNA, 60 nt, Homo Sapiens
ccagccuucugcccgccccagaccccggccagcgcccaccagaccauccucaagaacuga

SEQ ID NO: 516536 - RNA, 64 nt, Homo Sapiens
cuggccccaagcauggaaacggaaaccggguggcagcgcccagcgcccagugacccccagacgc

SEQ ID NO: 516537 - RNA, 64 nt, Homo Sapiens
acacacagcuccauuaugcauggggagggaccagagcgcccaauacccucaugaacacagggau

SEQ ID NO: 516538 - RNA, 64 nt, Homo Sapiens; identical to SEQ ID NO: 50556

SEQ ID NO: 516539 - RNA, 64 nt, Homo Sapiens; identical to SEQ ID NO: 50557

SEQ ID NO: 516540 - RNA, 64 nt, Homo Sapiens; identical to SEQ ID NO: 50558

SEQ ID NO: 516541 - RNA, 64 nt, Homo Sapiens; identical to SEQ ID NO: 50559

SEQ ID NO: 516542 - RNA, 64 nt, Homo Sapiens; identical to SEQ ID NO: 50560

SEQ ID NO: 516543 - RNA, 64 nt, Homo Sapiens; identical to SEQ ID NO: 50561

SEQ ID NO: 516544 - RNA, 64 nt, Homo Sapiens; identical to SEQ ID NO: 50562

SEQ ID NO: 516545 - RNA, 64 nt, Homo Sapiens; identical to SEQ ID NO: 50563

SEQ ID NO: 516546 - RNA, 64 nt, Homo Sapiens; identical to SEQ ID NO: 50564

SEQ ID NO: 516547 - RNA, 64 nt, Homo Sapiens; identical to SEQ ID NO: 50565

SEQ ID NO: 516548 - RNA, 64 nt, Homo Sapiens; identical to SEQ ID NO: 50566

SEQ ID NO: 516549 - RNA, 64 nt, Homo Sapiens; identical to SEQ ID NO: 50567

SEQ ID NO: 516550 - RNA, 64 nt, Homo Sapiens; identical to SEQ ID NO: 50568

SEQ ID NO: 516551 - RNA, 64 nt, Homo Sapiens; identical to SEQ ID NO: 50569

SEQ ID NO: 516552 - RNA, 64 nt, Homo Sapiens; identical to SEQ ID NO: 50570

SEQ ID NO: 516553 - RNA, 64 nt, Homo Sapiens; identical to SEQ ID NO: 50571

SEQ ID NO: 516554 - RNA, 64 nt, Homo Sapiens; identical to SEQ ID NO: 50572

SEQ ID NO: 516555 - RNA, 64 nt, Homo Sapiens; identical to SEQ ID NO: 50573

SEQ ID NO: 516556 - RNA, 64 nt, Homo Sapiens; identical to SEQ ID NO: 50574

SEQ ID NO: 516557 - RNA, 64 nt, Homo Sapiens; identical to SEQ ID NO: 50575

SEQ ID NO: 516558 - RNA, 64 nt, Homo Sapiens; identical to SEQ ID NO: 50576

SEQ ID NO: 516559 - RNA, 64 nt, Homo Sapiens; identical to SEQ ID NO: 50577

SEQ ID NO: 516560 - RNA, 64 nt, Homo Sapiens; identical to SEQ ID NO: 50578

SEQ ID NO: 516561 - RNA, 64 nt, Homo Sapiens; identical to SEQ ID NO: 50579

SEQ ID NO: 516562 - RNA, 64 nt, Homo Sapiens; identical to SEQ ID NO: 50580

SEQ ID NO: 516563 - RNA, 64 nt, Homo Sapiens; identical to SEQ ID NO: 50581

SEQ ID NO: 516564 - RNA, 64 nt, Homo Sapiens; identical to SEQ ID NO: 50582

SEQ ID NO: 516565 - RNA, 64 nt, Homo Sapiens; identical to SEQ ID NO: 50583

SEQ ID NO: 516566 - RNA, 64 nt, Homo Sapiens; identical to SEQ ID NO: 50584

SEQ ID NO: 516567 - RNA, 64 nt, Homo Sapiens; identical to SEQ ID NO: 50585

SEQ ID NO: 516568 - RNA, 64 nt, Homo Sapiens; identical to SEQ ID NO: 50586

SEQ ID NO: 516569 - RNA, 64 nt, Homo Sapiens; identical to SEQ ID NO: 50587

SEQ ID NO: 516570 - RNA, 64 nt, Homo Sapiens; identical to SEQ ID NO: 50588

SEQ ID NO: 516571 - RNA, 64 nt, Homo Sapiens; identical to SEQ ID NO: 50589

SEQ ID NO: 516572 - RNA, 64 nt, Homo Sapiens; identical to SEQ ID NO: 50590

SEQ ID NO: 516573 - RNA, 64 nt, Homo Sapiens; identical to SEQ ID NO: 50591

SEQ ID NO: 516574 - RNA, 64 nt, Homo Sapiens; identical to SEQ ID NO: 50592

SEQ ID NO: 516575 - RNA, 64 nt, Homo Sapiens; identical to SEQ ID NO: 50593

SEQ ID NO: 516576 - RNA, 64 nt, Homo Sapiens; identical to SEQ ID NO: 50594

SEQ ID NO: 516577 - RNA, 64 nt, Homo Sapiens; identical to SEQ ID NO: 50595

SEQ ID NO: 516578 - RNA, 64 nt, Homo Sapiens; identical to SEQ ID NO: 50596

SEQ ID NO: 516579 - RNA, 64 nt, Homo Sapiens; identical to SEQ ID NO: 50597

SEQ ID NO: 516580 - RNA, 64 nt, Homo Sapiens; identical to SEQ ID NO: 50598

SEQ ID NO: 516581 - RNA, 64 nt, Homo Sapiens; identical to SEQ ID NO: 50599

SEQ ID NO: 516582 - RNA, 64 nt, Homo Sapiens; identical to SEQ ID NO: 50600

SEQ ID NO: 516583 - RNA, 64 nt, Homo Sapiens; identical to SEQ ID NO: 50601

SEQ ID NO: 516584 - RNA, 64 nt, Homo Sapiens; identical to SEQ ID NO: 50602

SEQ ID NO: 516585 - RNA, 64 nt, Homo Sapiens; identical to SEQ ID NO: 50603

SEQ ID NO: 516586 - RNA, 64 nt, Homo Sapiens; identical to SEQ ID NO: 50604

SEQ ID NO: 516587 - RNA, 64 nt, Homo Sapiens; identical to SEQ ID NO: 50605

SEQ ID NO: 516588 - RNA, 64 nt, Homo Sapiens; identical to SEQ ID NO: 50606

SEQ ID NO: 516589 - RNA, 64 nt, Homo Sapiens; identical to SEQ ID NO: 50607

SEQ ID NO: 516590 - RNA, 64 nt, Homo Sapiens; identical to SEQ ID NO: 50608

SEQ ID NO: 516591 - RNA, 64 nt, Homo Sapiens; identical to SEQ ID NO: 50609

SEQ ID NO: 516592 - RNA, 64 nt, Homo Sapiens; identical to SEQ ID NO: 50610

SEQ ID NO: 516593 - RNA, 64 nt, Homo Sapiens; identical to SEQ ID NO: 50611

SEQ ID NO: 516594 - RNA, 64 nt, Homo Sapiens; identical to SEQ ID NO: 50612

SEQ ID NO: 516595 - RNA, 64 nt, Homo Sapiens; identical to SEQ ID NO: 50613

SEQ ID NO: 516596 - RNA, 64 nt, Homo Sapiens; identical to SEQ ID NO: 50614

SEQ ID NO: 516597 - RNA, 64 nt, Homo Sapiens; identical to SEQ ID NO: 50615

SEQ ID NO: 516598 - RNA, 64 nt, Homo Sapiens; identical to SEQ ID NO: 50616

SEQ ID NO: 516599 - RNA, 64 nt, Homo Sapiens; identical to SEQ ID NO: 50617

SEQ ID NO: 516600 - RNA, 64 nt, Homo Sapiens; identical to SEQ ID NO: 50618

SEQ ID NO: 516601 - RNA, 64 nt, Homo Sapiens; identical to SEQ ID NO: 50619

SEQ ID NO: 516602 - RNA, 64 nt, Homo Sapiens; identical to SEQ ID NO: 50620

SEQ ID NO: 516603 - RNA, 64 nt, Homo Sapiens; identical to SEQ ID NO: 50621

SEQ ID NO: 516604 - RNA, 64 nt, Homo Sapiens; identical to SEQ ID NO: 50622

SEQ ID NO: 516605 - RNA, 64 nt, Homo Sapiens; identical to SEQ ID NO: 50623

SEQ ID NO: 516606 - RNA, 64 nt, Homo Sapiens; identical to SEQ ID NO: 50624

SEQ ID NO: 516607 - RNA, 64 nt, Homo Sapiens; identical to SEQ ID NO: 50625

SEQ ID NO: 516608 - RNA, 64 nt, Homo Sapiens; identical to SEQ ID NO: 50626

SEQ ID NO: 516609 - RNA, 64 nt, Homo Sapiens; identical to SEQ ID NO: 50627

SEQ ID NO: 516610 - RNA, 64 nt, Homo Sapiens; identical to SEQ ID NO: 50628

SEQ ID NO: 516611 - RNA, 64 nt, Homo Sapiens; identical to SEQ ID NO: 50629

SEQ ID NO: 516612 - RNA, 64 nt, Homo Sapiens; identical to SEQ ID NO: 50630

SEQ ID NO: 516613 - RNA, 64 nt, Homo Sapiens; identical to SEQ ID NO: 50631

SEQ ID NO: 516614 - RNA, 64 nt, Homo Sapiens; identical to SEQ ID NO: 50632

SEQ ID NO: 516615 - RNA, 64 nt, Homo Sapiens; identical to SEQ ID NO: 50633

SEQ ID NO: 516616 - RNA, 64 nt, Homo Sapiens; identical to SEQ ID NO: 50634

SEQ ID NO: 516617 - RNA, 64 nt, Homo Sapiens; identical to SEQ ID NO: 50635

SEQ ID NO: 516618 - RNA, 64 nt, Homo Sapiens; identical to SEQ ID NO: 50636

SEQ ID NO: 516619 - RNA, 64 nt, Homo Sapiens; identical to SEQ ID NO: 50637

SEQ ID NO: 516620 - RNA, 64 nt, Homo Sapiens; identical to SEQ ID NO: 50638

SEQ ID NO: 516621 - RNA, 64 nt, Homo Sapiens; identical to SEQ ID NO: 50639

SEQ ID NO: 516622 - RNA, 64 nt, Homo Sapiens; identical to SEQ ID NO: 50640

SEQ ID NO: 516623 - RNA, 64 nt, Homo Sapiens; identical to SEQ ID NO: 50641

SEQ ID NO: 516624 - RNA, 64 nt, Homo Sapiens; identical to SEQ ID NO: 50642

SEQ ID NO: 516625 - RNA, 64 nt, Homo Sapiens; identical to SEQ ID NO: 50643

SEQ ID NO: 516626 - RNA, 64 nt, Homo Sapiens; identical to SEQ ID NO: 50644

SEQ ID NO: 516627 - RNA, 64 nt, Homo Sapiens; identical to SEQ ID NO: 80484

SEQ ID NO: 516628 - RNA, 64 nt, Homo Sapiens; identical to SEQ ID NO: 80485

SEQ ID NO: 516629 - RNA, 64 nt, Homo Sapiens; identical to SEQ ID NO: 80486

SEQ ID NO: 516630 - RNA, 64 nt, Homo Sapiens; identical to SEQ ID NO: 80487

SEQ ID NO: 516631 - RNA, 64 nt, Homo Sapiens; identical to SEQ ID NO: 80488

SEQ ID NO: 516632 - RNA, 64 nt, Homo Sapiens; identical to SEQ ID NO: 80489

SEQ ID NO: 516633 - RNA, 64 nt, Homo Sapiens; identical to SEQ ID NO: 80490

SEQ ID NO: 516634 - RNA, 64 nt, Homo Sapiens; identical to SEQ ID NO: 80491

SEQ ID NO: 516635 - RNA, 64 nt, Homo Sapiens; identical to SEQ ID NO: 80492

SEQ ID NO: 516636 - RNA, 64 nt, Homo Sapiens; identical to SEQ ID NO: 80493

SEQ ID NO: 516637 - RNA, 64 nt, Homo Sapiens; identical to SEQ ID NO: 80494

SEQ ID NO: 516638 - RNA, 64 nt, Homo Sapiens; identical to SEQ ID NO: 80495

SEQ ID NO: 516639 - RNA, 64 nt, Homo Sapiens; identical to SEQ ID NO: 80496

SEQ ID NO: 516640 - RNA, 64 nt, Homo Sapiens; identical to SEQ ID NO: 80497

SEQ ID NO: 516641 - RNA, 64 nt, Homo Sapiens; identical to SEQ ID NO: 80498

SEQ ID NO: 516642 - RNA, 64 nt, Homo Sapiens; identical to SEQ ID NO: 80499

SEQ ID NO: 516643 - RNA, 64 nt, Homo Sapiens; identical to SEQ ID NO: 80500

SEQ ID NO: 516644 - RNA, 64 nt, Homo Sapiens; identical to SEQ ID NO: 80501

SEQ ID NO: 516645 - RNA, 64 nt, Homo Sapiens; identical to SEQ ID NO: 80502

SEQ ID NO: 516646 - RNA, 64 nt, Homo Sapiens; identical to SEQ ID NO: 80503

SEQ ID NO: 516647 - RNA, 64 nt, Homo Sapiens; identical to SEQ ID NO: 80504

SEQ ID NO: 516648 - RNA, 64 nt, Homo Sapiens; identical to SEQ ID NO: 80505

SEQ ID NO: 516649 - RNA, 64 nt, Homo Sapiens; identical to SEQ ID NO: 80506

SEQ ID NO: 516650 - RNA, 64 nt, Homo Sapiens; identical to SEQ ID NO: 80507

SEQ ID NO: 516651 - RNA, 64 nt, Homo Sapiens; identical to SEQ ID NO: 80508

SEQ ID NO: 516652 - RNA, 64 nt, Homo Sapiens; identical to SEQ ID NO: 80509

SEQ ID NO: 516653 - RNA, 64 nt, Homo Sapiens; identical to SEQ ID NO: 80510

SEQ ID NO: 516654 - RNA, 64 nt, Homo Sapiens; identical to SEQ ID NO: 80511

SEQ ID NO: 516655 - RNA, 64 nt, Homo Sapiens; identical to SEQ ID NO: 80512

SEQ ID NO: 516656 - RNA, 64 nt, Homo Sapiens; identical to SEQ ID NO: 80513

SEQ ID NO: 516657 - RNA, 64 nt, Homo Sapiens; identical to SEQ ID NO: 80514

SEQ ID NO: 516658 - RNA, 64 nt, Homo Sapiens; identical to SEQ ID NO: 80515

SEQ ID NO: 516659 - RNA, 64 nt, Homo Sapiens; identical to SEQ ID NO: 80516

SEQ ID NO: 516660 - RNA, 64 nt, Homo Sapiens; identical to SEQ ID NO: 80517

SEQ ID NO: 516661 - RNA, 64 nt, Homo Sapiens; identical to SEQ ID NO: 80518

SEQ ID NO: 516662 - RNA, 64 nt, Homo Sapiens; identical to SEQ ID NO: 80519

SEQ ID NO: 516663 - RNA, 64 nt, Homo Sapiens; identical to SEQ ID NO: 474570

SEQ ID NO: 516664 - RNA, 64 nt, Homo Sapiens; identical to SEQ ID NO: 474571

SEQ ID NO: 516665 - RNA, 64 nt, Homo Sapiens; identical to SEQ ID NO: 474572

SEQ ID NO: 516666 - RNA, 64 nt, Homo Sapiens; identical to SEQ ID NO: 474573

SEQ ID NO: 516667 - RNA, 64 nt, Homo Sapiens; identical to SEQ ID NO: 474574

SEQ ID NO: 516668 - RNA, 64 nt, Homo Sapiens; identical to SEQ ID NO: 474575

SEQ ID NO: 516669 - RNA, 64 nt, Homo Sapiens; identical to SEQ ID NO: 474576

SEQ ID NO: 516670 - RNA, 64 nt, Homo Sapiens; identical to SEQ ID NO: 474577

SEQ ID NO: 516671 - RNA, 64 nt, Homo Sapiens; identical to SEQ ID NO: 474578

SEQ ID NO: 516672 - RNA, 64 nt, Homo Sapiens; identical to SEQ ID NO: 474579

SEQ ID NO: 516673 - RNA, 64 nt, Homo Sapiens; identical to SEQ ID NO: 474580

SEQ ID NO: 516674 - RNA, 64 nt, Homo Sapiens; identical to SEQ ID NO: 474581

SEQ ID NO: 516675 - RNA, 64 nt, Homo Sapiens; identical to SEQ ID NO: 474582

SEQ ID NO: 516676 - RNA, 64 nt, Homo Sapiens; identical to SEQ ID NO: 474583

SEQ ID NO: 516677 - RNA, 64 nt, Homo Sapiens; identical to SEQ ID NO: 96836

SEQ ID NO: 516678 - RNA, 64 nt, Homo Sapiens; identical to SEQ ID NO: 96837

SEQ ID NO: 516679 - RNA, 64 nt, Homo Sapiens; identical to SEQ ID NO: 96838

SEQ ID NO: 516680 - RNA, 64 nt, Homo Sapiens; identical to SEQ ID NO: 96839

SEQ ID NO: 516681 - RNA, 64 nt, Homo Sapiens; identical to SEQ ID NO: 96840

SEQ ID NO: 516682 - RNA, 64 nt, Homo Sapiens; identical to SEQ ID NO: 96841

SEQ ID NO: 516683 - RNA, 64 nt, Homo Sapiens; identical to SEQ ID NO: 96842

SEQ ID NO: 516684 - RNA, 64 nt, Homo Sapiens; identical to SEQ ID NO: 96843

SEQ ID NO: 516685 - RNA, 64 nt, Homo Sapiens; identical to SEQ ID NO: 96844

SEQ ID NO: 516686 - RNA, 64 nt, Homo Sapiens; identical to SEQ ID NO: 96845

SEQ ID NO: 516687 - RNA, 64 nt, Homo Sapiens; identical to SEQ ID NO: 96846

SEQ ID NO: 516688 - RNA, 64 nt, Homo Sapiens; identical to SEQ ID NO: 96847

SEQ ID NO: 516689 - RNA, 64 nt, Homo Sapiens; identical to SEQ ID NO: 96848

SEQ ID NO: 516690 - RNA, 64 nt, Homo Sapiens; identical to SEQ ID NO: 96849

SEQ ID NO: 516691 - RNA, 64 nt, Homo Sapiens; identical to SEQ ID NO: 96850

SEQ ID NO: 516692 - RNA, 64 nt, Homo Sapiens; identical to SEQ ID NO: 96851

SEQ ID NO: 516693 - RNA, 64 nt, Homo Sapiens; identical to SEQ ID NO: 96852

SEQ ID NO: 516694 - RNA, 64 nt, Homo Sapiens; identical to SEQ ID NO: 96853

SEQ ID NO: 516695 - RNA, 64 nt, Homo Sapiens; identical to SEQ ID NO: 96854

SEQ ID NO: 516696 - RNA, 64 nt, Homo Sapiens; identical to SEQ ID NO: 96855

SEQ ID NO: 516697 - RNA, 64 nt, Homo Sapiens; identical to SEQ ID NO: 96856

SEQ ID NO: 516698 - RNA, 64 nt, Homo Sapiens; identical to SEQ ID NO: 96857

SEQ ID NO: 516699 - RNA, 64 nt, Homo Sapiens; identical to SEQ ID NO: 96858

SEQ ID NO: 516700 - RNA, 64 nt, Homo Sapiens; identical to SEQ ID NO: 96859

SEQ ID NO: 516701 - RNA, 64 nt, Homo Sapiens; identical to SEQ ID NO: 96860

SEQ ID NO: 516702 - RNA, 64 nt, Homo Sapiens; identical to SEQ ID NO: 96861

SEQ ID NO: 516703 - RNA, 64 nt, Homo Sapiens; identical to SEQ ID NO: 96862

SEQ ID NO: 516704 - RNA, 64 nt, Homo Sapiens; identical to SEQ ID NO: 96863

SEQ ID NO: 516705 - RNA, 64 nt, Homo Sapiens; identical to SEQ ID NO: 96864

SEQ ID NO: 516706 - RNA, 64 nt, Homo Sapiens; identical to SEQ ID NO: 96865

SEQ ID NO: 516707 - RNA, 64 nt, Homo Sapiens; identical to SEQ ID NO: 96866

SEQ ID NO: 516708 - RNA, 64 nt, Homo Sapiens; identical to SEQ ID NO: 96867

SEQ ID NO: 516709 - RNA, 64 nt, Homo Sapiens; identical to SEQ ID NO: 96868

SEQ ID NO: 516710 - RNA, 64 nt, Homo Sapiens; identical to SEQ ID NO: 96869

SEQ ID NO: 516711 - RNA, 64 nt, Homo Sapiens; identical to SEQ ID NO: 96870

SEQ ID NO: 516712 - RNA, 64 nt, Homo Sapiens; identical to SEQ ID NO: 96871

SEQ ID NO: 516713 - RNA, 64 nt, Homo Sapiens; identical to SEQ ID NO: 96872

SEQ ID NO: 516714 - RNA, 64 nt, Homo Sapiens; identical to SEQ ID NO: 96873

SEQ ID NO: 516715 - RNA, 64 nt, Homo Sapiens; identical to SEQ ID NO: 96874

SEQ ID NO: 516716 - RNA, 64 nt, Homo Sapiens; identical to SEQ ID NO: 96875

SEQ ID NO: 516717 - RNA, 64 nt, Homo Sapiens
auuggcccuuuggcucuugcccuuggcucccuugggcagacagcaggcuuaggccauugauauc

SEQ ID NO: 516718 - RNA, 64 nt, Homo Sapiens
gggucugaacugccuccauccuagggcaaccuggggcagacaggccuggugggggguggggaaa

SEQ ID NO: 516719 - RNA, 64 nt, Homo Sapiens
gucgaggcugguaagggaccuucagggagagcugggcagacaggugggagauggagguagggcu

SEQ ID NO: 516720 - RNA, 64 nt, Homo Sapiens
ugagaaagacaucugaggaaaauggaagaccuaaggcagacaggaaggaagcacaaaagacaag

SEQ ID NO: 516721 - RNA, 64 nt, Homo Sapiens
accccaggcagaccgauaaaaagaccuccagauaggcagacagacagauggaccaccaaccugg

SEQ ID NO: 516722 - RNA, 64 nt, Homo Sapiens
cagacuccuaaccaaccagauggacugccagacaggcagacaucagccacauggaauccugaca

SEQ ID NO: 516723 - RNA, 64 nt, Homo Sapiens
gggacuugaaguuguuacuacuuuuugaaguguaggcagacacaugggcgagcgugcaccaucc

SEQ ID NO: 516724 - RNA, 64 nt, Homo Sapiens
gaucugagaaucuuuauugaauuuuguaucugcaggcagacacgaaaacugcguuaaaggcucg

SEQ ID NO: 516725 - RNA, 64 nt, Homo Sapiens
cccaaaaggugacuuaauuaauaaagggcauuugggcagacacacuguguuggaccaacaaagu

SEQ ID NO: 516726 - RNA, 64 nt, Homo Sapiens
gggccugaaaagaggggcugcccuccugcgccaaggcagacacaagcugcgggcugugcggucc

SEQ ID NO: 516727 - RNA, 64 nt, Homo Sapiens
guaaagaugagcaaacauuuggaauuuacaugugggcagacauugggauaacaacuuucaucac

SEQ ID NO: 516728 - RNA, 64 nt, Homo Sapiens
aaguucugaucauuauauaagaagggaaaugccuggcagacaccauguaaguuauaagugucug

SEQ ID NO: 516729 - RNA, 64 nt, Homo Sapiens
gccgagugacuuucuuagucuaacaagggucuguggcagacauuaaugaauuaagaacacauuc

SEQ ID NO: 516730 - RNA, 64 nt, Homo Sapiens
gccgagugacuuucuaacauuaacaagggucuguggcagacauuaaugaauuaagaacacauuc

SEQ ID NO: 516731 - RNA, 64 nt, Homo Sapiens
caagguucugcccuuauggagcucacacuccaguggcagacaaacagaccauaaauaaggaaac

SEQ ID NO: 516732 - RNA, 64 nt, Homo Sapiens
cucaagaccagagacccaacagcagugaucucagggcagacagcccuccacuccagcucugaga

SEQ ID NO: 516733 - RNA, 64 nt, Homo Sapiens
ccgaggaugcgauuuaaaaucuggacagaaaaggggcagacacaguuauugggccaccugacag

SEQ ID NO: 516734 - RNA, 64 nt, Homo Sapiens
ccaaccuugggcuauuugaguauuccuggaggucggcagacaugcugggcacggugacugcggu

SEQ ID NO: 516735 - RNA, 64 nt, Homo Sapiens
acacagagauggaauagaaaagaugagaggcagaggcagacaggcgcuggacagaggggcaggg

SEQ ID NO: 516736 - RNA, 64 nt, Homo Sapiens
cagaggggcaggggagugccaagguuguccuggaggcagacagcccagcugagccuccuuaccu

SEQ ID NO: 516737 - RNA, 64 nt, Homo Sapiens
auguguggcucagugccuggacaaaugaugccauggcagacaguagacagaacaacacuucccu

SEQ ID NO: 516738 - RNA, 64 nt, Homo Sapiens
caaagggugaaauccgcauugauggccucaauguggcagacaucggccuccaugaccugcgcuc

SEQ ID NO: 516739 - RNA, 64 nt, Homo Sapiens
uacucugggucaagagaccagggaugcaggguuaggcagacagguccccagaguccucacccug

SEQ ID NO: 516740 - RNA, 64 nt, Homo Sapiens
aaacccaaaccaaaaacgcaaaccaaagcaggcaggcagacagcugcugggggaaauccugggg

SEQ ID NO: 516741 - RNA, 64 nt, Homo Sapiens
agcacgaaucaugauucugcuuucuguuagcuuaggcagacauugggccuucaccuacaaguuu

SEQ ID NO: 516742 - RNA, 64 nt, Homo Sapiens
gccauuugaaucagggucuccaguuucuagaaaaggcagacacugguugggaccaaagucucca

SEQ ID NO: 516743 - RNA, 64 nt, Homo Sapiens
uucucagacuugggaccugggugccugggauccuggcagacagagguuguguccagacagccag

SEQ ID NO: 516744 - RNA, 64 nt, Homo Sapiens
cucaggaagccggccugcagcaggagcagaggaaggcagacacccacaagaagaugacugaguu

SEQ ID NO: 516745 - RNA, 64 nt, Homo Sapiens
gccaucccaaauacuugggcagcagcucagcaugggcagacaugggggcuguggauucuuccag

SEQ ID NO: 516746 - RNA, 64 nt, Homo Sapiens
uaggaacugagcccaaggaaauagcgggguugcaggcagacauugagcugcgagacaaugggaa

SEQ ID NO: 516747 - RNA, 64 nt, Homo Sapiens
ucuugcgacuccuggcacacgccuccugggaggauccagccaaaagcugugccccaucccccaa

SEQ ID NO: 516748 - RNA, 64 nt, Homo Sapiens
cugugccccaucccccaagccuguccccccuggguccagccaagugggucagacaucaaugucc

SEQ ID NO: 516749 - RNA, 64 nt, Homo Sapiens
acacaagacuucugauuucuuggaugcuauacuguccagccaggaaagucauguguuugcaugc

SEQ ID NO: 516750 - RNA, 64 nt, Homo Sapiens
ggaaucccacggaccucucgggcugcagcucacguccagccaugagagcugaggcccgggcgcu

SEQ ID NO: 516751 - RNA, 64 nt, Homo Sapiens
ccuccugcggcgccuugcccuccuccgaccccuuuccagccaaaguccccccaccccuucagag

SEQ ID NO: 516752 - RNA, 64 nt, Homo Sapiens
ccugucaucuaaccucaguccugccuacugcaguuccagccaaccugcucuuuccugaguucaa

SEQ ID NO: 516753 - RNA, 64 nt, Homo Sapiens
aaaggccuuagugugccccagcagucuggcugcguccagccaccaucacccggaaggaugccca

SEQ ID NO: 516754 - RNA, 64 nt, Homo Sapiens
ggaccccagccuuggcucuuccuccuugccucccuccagccacuuucuagucccucauaccagc

SEQ ID NO: 516755 - RNA, 64 nt, Homo Sapiens
uuccugacuucuaucugggcaaauuccaccaguuuccagccacccugcagcaaacuuuggugua

SEQ ID NO: 516756 - RNA, 64 nt, Homo Sapiens
ccagauagucacagucaagguuggagagucuccuuccagccagugaccuacccaaaccuuuugu

SEQ ID NO: 516757 - RNA, 64 nt, Homo Sapiens
ucguuuuggaggauagcucaaguugaauuuucuuuccagccaguuacccuuucaaccuacccau

SEQ ID NO: 516758 - RNA, 64 nt, Homo Sapiens
uuucuuguacaaccacauggacgggcuguuuugcuccagccacugucuugugagcaugaaguga

SEQ ID NO: 516759 - RNA, 64 nt, Homo Sapiens
aaagugguaagcggagcaaggcugcugcuucccuuccagccagauugcacaaacccuaucaaga

SEQ ID NO: 516760 - RNA, 64 nt, Homo Sapiens
gaacuggucccacacgcaccgccuccguggcuucuccagccauuuccacagaagcccauccgcu

SEQ ID NO: 516761 - RNA, 64 nt, Homo Sapiens
accccaucugcaccugaaucgcuaauaucccagcuccagccagcacccagauuuccacagugcu

SEQ ID NO: 516762 - RNA, 64 nt, Homo Sapiens
cgccuccuguagcaguagggcccccagccagcgcuccagccaaagcggcggccccaggguuaau

SEQ ID NO: 516763 - RNA, 64 nt, Homo Sapiens
uggaggcaaaaggcagcucacggggccuuccauuuccagccaggccucaucugggguagggcca

SEQ ID NO: 516764 - RNA, 64 nt, Homo Sapiens
ccaaucucuucuucuuuaugcccaaagggcucauuccagccauuaccucacucccagccaggcu

SEQ ID NO: 516765 - RNA, 64 nt, Homo Sapiens
auuuuccuuccagcugaggcgcagggccucccuauccagccagcaugccugaaaaucagcacgu

SEQ ID NO: 516766 - RNA, 64 nt, Homo Sapiens
cuccucaugugaccucgcagcugggcuaaccuguuccagccaggcucagacugccuuccugcuu

SEQ ID NO: 516767 - RNA, 64 nt, Homo Sapiens
ccacccacaacccgagaauccgccauccuaaccauccagccaggcuccaccuucuggguggagg

SEQ ID NO: 516768 - RNA, 64 nt, Homo Sapiens
ugacuguccucgacggccuggccaaggccaucguuccagccacuccagccccuccagcuuugga

SEQ ID NO: 516769 - RNA, 64 nt, Homo Sapiens
ccccagcacuuuauguagaggucggggggcccaguccagccaccuugaccagaacgcacaccuc

SEQ ID NO: 516770 - RNA, 64 nt, Homo Sapiens
gaacaaucuuuuauuucuguuauggggucugggcuccagccagauuuguacauguaauguauua

SEQ ID NO: 516771 - RNA, 64 nt, Homo Sapiens
ugucaggcucuccucuugacgucccuccuccaauuccagccacucaaacaucuucacccuaaua

SEQ ID NO: 516772 - RNA, 64 nt, Homo Sapiens
caauuagugcugauaauuccuauguggaaaugauuccagccaugguccccucacuugagcaugu

SEQ ID NO: 516773 - RNA, 64 nt, Homo Sapiens
cuccaucaagugguaauauguuugcagccugcuguccagccaagagugacagauacuucuagug

SEQ ID NO: 516774 - RNA, 64 nt, Homo Sapiens
aaggcuuucccaagcguccucuccuuccccuccguccagccagcugggggcagucgccgagagc

SEQ ID NO: 516775 - RNA, 64 nt, Homo Sapiens
gcuguggccaguggagagccggcucaggucucacuccagccaucggaccuucguguuuuuccgg

SEQ ID NO: 516776 - RNA, 64 nt, Homo Sapiens
acuccaggucucccugucucgucuggggggccccuccagccaguuuuuuugggggguggucccc

SEQ ID NO: 516777 - RNA, 64 nt, Homo Sapiens
caucucaaggagaaacauagccauccaugcucucuccagccagcccaccccuucuggggucacu

SEQ ID NO: 516778 - RNA, 64 nt, Homo Sapiens; identical to SEQ ID NO: 311765

SEQ ID NO: 516779 - RNA, 64 nt, Homo Sapiens; identical to SEQ ID NO: 311766

SEQ ID NO: 516780 - RNA, 64 nt, Homo Sapiens; identical to SEQ ID NO: 311767

SEQ ID NO: 516781 - RNA, 64 nt, Homo Sapiens; identical to SEQ ID NO: 311768

SEQ ID NO: 516782 - RNA, 64 nt, Homo Sapiens; identical to SEQ ID NO: 311769

SEQ ID NO: 516783 - RNA, 64 nt, Homo Sapiens; identical to SEQ ID NO: 311770

SEQ ID NO: 516784 - RNA, 64 nt, Homo Sapiens; identical to SEQ ID NO: 311771

SEQ ID NO: 516785 - RNA, 64 nt, Homo Sapiens; identical to SEQ ID NO: 311772

SEQ ID NO: 516786 - RNA, 64 nt, Homo Sapiens; identical to SEQ ID NO: 311773

SEQ ID NO: 516787 - RNA, 64 nt, Homo Sapiens; identical to SEQ ID NO: 311774

SEQ ID NO: 516788 - RNA, 64 nt, Homo Sapiens; identical to SEQ ID NO: 311775

SEQ ID NO: 516789 - RNA, 64 nt, Homo Sapiens; identical to SEQ ID NO: 311776

SEQ ID NO: 516790 - RNA, 64 nt, Homo Sapiens; identical to SEQ ID NO: 311777

SEQ ID NO: 516791 - RNA, 64 nt, Homo Sapiens; identical to SEQ ID NO: 311778

SEQ ID NO: 516792 - RNA, 64 nt, Homo Sapiens; identical to SEQ ID NO: 311779

SEQ ID NO: 516793 - RNA, 64 nt, Homo Sapiens; identical to SEQ ID NO: 311780

SEQ ID NO: 516794 - RNA, 64 nt, Homo Sapiens; identical to SEQ ID NO: 311781

SEQ ID NO: 516795 - RNA, 64 nt, Homo Sapiens; identical to SEQ ID NO: 311782

SEQ ID NO: 516796 - RNA, 64 nt, Homo Sapiens; identical to SEQ ID NO: 311783

SEQ ID NO: 516797 - RNA, 64 nt, Homo Sapiens; identical to SEQ ID NO: 311784

SEQ ID NO: 516798 - RNA, 64 nt, Homo Sapiens; identical to SEQ ID NO: 311785

SEQ ID NO: 516799 - RNA, 64 nt, Homo Sapiens; identical to SEQ ID NO: 311786

SEQ ID NO: 516800 - RNA, 64 nt, Homo Sapiens; identical to SEQ ID NO: 311787

SEQ ID NO: 516801 - RNA, 64 nt, Homo Sapiens; identical to SEQ ID NO: 311788

SEQ ID NO: 516802 - RNA, 64 nt, Homo Sapiens; identical to SEQ ID NO: 311789

SEQ ID NO: 516803 - RNA, 64 nt, Homo Sapiens; identical to SEQ ID NO: 311790

SEQ ID NO: 516804 - RNA, 64 nt, Homo Sapiens; identical to SEQ ID NO: 311791

SEQ ID NO: 516805 - RNA, 64 nt, Homo Sapiens; identical to SEQ ID NO: 311792

SEQ ID NO: 516806 - RNA, 64 nt, Homo Sapiens; identical to SEQ ID NO: 311793

SEQ ID NO: 516807 - RNA, 64 nt, Homo Sapiens; identical to SEQ ID NO: 311794

SEQ ID NO: 516808 - RNA, 64 nt, Homo Sapiens; identical to SEQ ID NO: 311795

SEQ ID NO: 516809 - RNA, 64 nt, Homo Sapiens; identical to SEQ ID NO: 311796

SEQ ID NO: 516810 - RNA, 64 nt, Homo Sapiens; identical to SEQ ID NO: 311797

SEQ ID NO: 516811 - RNA, 64 nt, Homo Sapiens; identical to SEQ ID NO: 311798

SEQ ID NO: 516812 - RNA, 64 nt, Homo Sapiens; identical to SEQ ID NO: 311799

SEQ ID NO: 516813 - RNA, 64 nt, Homo Sapiens; identical to SEQ ID NO: 311800

SEQ ID NO: 516814 - RNA, 64 nt, Homo Sapiens; identical to SEQ ID NO: 311801

SEQ ID NO: 516815 - RNA, 64 nt, Homo Sapiens; identical to SEQ ID NO: 311802

SEQ ID NO: 516816 - RNA, 51 nt, Homo Sapiens
uuauugcaccaaagaagugauaauuuccacaugauuaauuuccaacaagac

SEQ ID NO: 516817 - RNA, 64 nt, Homo Sapiens
auugcaccaaagaagugauaauuuccacaugauuaauuuccaacaagacacuugggaguuauuu

SEQ ID NO: 516818 - RNA, 64 nt, Homo Sapiens
uucuuccuuucccacuaauaugcacauccagaaaaauuuccaucugagauucuaguacuucaaa

SEQ ID NO: 516819 - RNA, 64 nt, Homo Sapiens
acuuucccagugaggaaaauuucuguguuuucagaauuuccauuucuacuaaccucuuggagaa

SEQ ID NO: 516820 - RNA, 64 nt, Homo Sapiens
ugaucacccuguguucacaggucacuguuaaaugaauuuccaccccuaaagacauguggaggaa

SEQ ID NO: 516821 - RNA, 64 nt, Homo Sapiens
aaacauucaccagaaaccuuuuagugcuuggagcaauuuccauacaggcacggucccgcuuucc

SEQ ID NO: 516822 - RNA, 64 nt, Homo Sapiens
cuuuugugccacgaguguuauuacauggguuuacaauuuccauuaaaaagauagccaauuucca

SEQ ID NO: 516823 - RNA, 64 nt, Homo Sapiens
acauggguuuacaauuuccaucaaaaagauagccaauuuccauuuuugaggggcacaugugggg

SEQ ID NO: 516824 - RNA, 64 nt, Homo Sapiens
guaauacagauaaaauacauccaguguuacuaguaauuuccauguagaaaagagggaaaaaaau

SEQ ID NO: 516825 - RNA, 64 nt, Homo Sapiens
gugcacuuccagaaccagcuggaacucagauaaaaauuuccaggcaauuguguaggauugacaa

SEQ ID NO: 516826 - RNA, 64 nt, Homo Sapiens
caucagaucugcaacacagaaaugcucugccugaaauuuccaccaugccuaggacucaccccau

SEQ ID NO: 516827 - RNA, 64 nt, Homo Sapiens
agucucccagccuucucagagagcuaaaaccagaaauuuccagacucaugaaagcaacccccca

SEQ ID NO: 516828 - RNA, 64 nt, Homo Sapiens
ucacaaggucuuuacuuaugcacauuugugcauaaauuuccacccaauuuccaagacaguugua

SEQ ID NO: 516829 - RNA, 64 nt, Homo Sapiens
uuacuuaugcacauuugugcauaaauuuccacccaauuuccaagacaguuguaucacaaagcug

SEQ ID NO: 516830 - RNA, 64 nt, Homo Sapiens
ugaauuucuuuauuauuuucagccuuuaaaauguaauuuccaucucuugcaaugaauuuguuuc

SEQ ID NO: 516831 - RNA, 64 nt, Homo Sapiens
cuagucuuugagaguuacgguucuuucguagaacaauuuccauguuguuaacuguuguagacuu

SEQ ID NO: 516832 - RNA, 64 nt, Homo Sapiens
accaugggguuuaugaacauuuauaacuuuuuauaauuuccauauuacauuucucauaguaugg

SEQ ID NO: 516833 - RNA, 64 nt, Homo Sapiens
aacucuuaucaaaauauauuuuaccaguuuccagaauuuccaguacaggaccgccugaagagag

SEQ ID NO: 516834 - RNA, 64 nt, Homo Sapiens
cuuaauuguaauuuuuuucuugguuuuacauuuuaauuuccauuaaagccaaaaauauuuaucu

SEQ ID NO: 516835 - RNA, 64 nt, Homo Sapiens
caccccaaauaugguuaaaaaaaucaucacuguuaauuuccagugucacugauuuuuuagcuca

SEQ ID NO: 516836 - RNA, 64 nt, Homo Sapiens
ccuuaauuaucauucaacuuuaggcuuugucaguaauuuccacaaaaauuuccacuucuauauc

SEQ ID NO: 516837 - RNA, 64 nt, Homo Sapiens
ucuauaucuaggcuuugucaugauguuucuagaaaauuuccacucuguaaauaagauuuacaac

SEQ ID NO: 516838 - RNA, 64 nt, Homo Sapiens
uggggauuaacuucugucuuaaagaaaaaucugaaauuuccaucaaaaaccaaaaagcaaacca

SEQ ID NO: 516839 - RNA, 64 nt, Homo Sapiens
ucgcauaagcccuggggcuucaacagcacagcuaaauuuccaaggauguauugacaucuuuccc

SEQ ID NO: 516840 - RNA, 64 nt, Homo Sapiens
aacaacuugauaucauucagcauuaucauaauugaauuuccaaguauuaguagucacuuguuuu

SEQ ID NO: 516841 - RNA, 64 nt, Homo Sapiens
uauuuguggguccgacaguauuuaauuuaaaaaaaauuuccaaaagcaauuaagugggaacauu

SEQ ID NO: 516842 - RNA, 64 nt, Homo Sapiens
caugguaucaucucacuuuuucaaaaaaaaagaaaauuuccaagcgaaagagugagacuccauc

SEQ ID NO: 516843 - RNA, 64 nt, Homo Sapiens
ugggcaugguggcucacaccucagcagcaucggaaauuuccagcgaacacccaagacacaagcu

SEQ ID NO: 516844 - RNA, 64 nt, Homo Sapiens
uaccuggugggaacacgaaauuguuuagaacacgaauuuccauuuccuugcagacaguuauccc

SEQ ID NO: 516845 - RNA, 64 nt, Homo Sapiens
aagaaccaagucagggcagccguuaaccuaacgaaauuuccaugagaaaaacacgcauuugcaa

SEQ ID NO: 516846 - RNA, 64 nt, Homo Sapiens
uaaaacaguuuccauaagguaaaaaucuaauuagaauuuccaaaaacaagagcagaacaguuuu

SEQ ID NO: 516847 - RNA, 64 nt, Homo Sapiens
gcaacuaaucauagugacccuuuccauaggagguaauuuccauacaacagugacauuggaauca

SEQ ID NO: 516848 - RNA, 64 nt, Homo Sapiens
gugacuuuggaauuuagggacuguguguggugcuaauuuccauuugcucuuuacauucaauuuu

SEQ ID NO: 516849 - RNA, 64 nt, Homo Sapiens
guugaaaucaguauuucugaauucaaauugcuugaauuuccaaaauagucaguaaaggaucuaa

SEQ ID NO: 516850 - RNA, 64 nt, Homo Sapiens
acgugaagggcuggaauguauauuaccaaaugggaauuuccauuguagguuuuugcuaguccca

SEQ ID NO: 516851 - RNA, 64 nt, Homo Sapiens
ucugugaaggaucuaaggagacacaugcaccggaaauuuccauaagccaguugcaguuuucagg

SEQ ID NO: 516852 - RNA, 64 nt, Homo Sapiens
ugauuuuauuuuaggagcuuauaaggcaugagacaauuuccauauaaauauauuaauuauugcc

SEQ ID NO: 516853 - RNA, 64 nt, Homo Sapiens
cauuguuucucacuagaccccagggcaccagaugaauuuccaaguuuaaacucuuuccugcagg

SEQ ID NO: 516854 - RNA, 64 nt, Homo Sapiens
uacccccuuuucccugaaccacguccuuuugaauaauuuccagauggauuucuguagccauacc

SEQ ID NO: 516855 - RNA, 64 nt, Homo Sapiens
aaaaaauaaaaagaguaugaagcuuuucuuuuuuaauuuccagguauaugucaauauuuaguaa

SEQ ID NO: 516856 - RNA, 64 nt, Homo Sapiens
uuaaguaauugccuacaauauaugcauaaagccaaauuuccaguguuuuacccacaugacuuau

SEQ ID NO: 516857 - RNA, 64 nt, Homo Sapiens
gaagcauaaaaguauucacuauguuuacauuaaaaauuuccagaaucgguucuucaaauauuuc

SEQ ID NO: 516858 - RNA, 64 nt, Homo Sapiens
auguauagggauucaugauaaacuuuuaaaaguuaauuuccaaaaaguaccuaauguuuugcug

SEQ ID NO: 516859 - RNA, 64 nt, Homo Sapiens
uaagacaugucaccauuaauuucugguuuuggaaaauuuccagauagaaguuuacuuuuuccuc

SEQ ID NO: 516860 - RNA, 64 nt, Homo Sapiens
uguucuuaauccagggcuguugugucaucugaacaauuuccagacagcaggaaacagagaaauu

SEQ ID NO: 516861 - RNA, 64 nt, Homo Sapiens
uaggggaguuuauugccaaaacacuuuagcuaaaaauuuccaguauaaacuguauccuugucug

SEQ ID NO: 516862 - RNA, 64 nt, Homo Sapiens
gagaagagaaaacucacccaagauucuuuauuccaauuuccagauuuugguucuuggagggaaa

SEQ ID NO: 516863 - RNA, 64 nt, Homo Sapiens
aaaaggucacauaguguacuguccuuuuauaugaaauuuccagaacaggccaaucugaagagau

SEQ ID NO: 516864 - RNA, 64 nt, Homo Sapiens
gccaaacuguuuccaaagcaucugcaucguguuuaauuuccauaaguaacguaugagaauucua

SEQ ID NO: 516865 - RNA, 64 nt, Homo Sapiens
uuguucucuauauuuuaaauuguaucaguucuaaaauuuccauuuuuaaauuuuggucacugua

SEQ ID NO: 516866 - RNA, 64 nt, Homo Sapiens
uccucugauagacguuuuuuaauuucguucugcaaauuuccacuucuuccuucauuauuuucca

SEQ ID NO: 516867 - RNA, 64 nt, Homo Sapiens; identical to SEQ ID NO: 214333

SEQ ID NO: 516868 - RNA, 64 nt, Homo Sapiens; identical to SEQ ID NO: 214334

SEQ ID NO: 516869 - RNA, 64 nt, Homo Sapiens
agaaacaccagaagcauuacccagaucucuuucggcuuccuaugcugcaaucuacuauaguacu

SEQ ID NO: 516870 - RNA, 64 nt, Homo Sapiens
uggcagcuuaauggguaauuuuuuuaauucuauggcuuccuaucuguuugucccugauuuuuuu

SEQ ID NO: 516871 - RNA, 64 nt, Homo Sapiens
gggggagggaaccgaguuaucuuccuauuggcuagcuuccuaagacuccuugcuuguuguguug

SEQ ID NO: 516872 - RNA, 64 nt, Homo Sapiens
ggcuagcuuccuaagggggguugcuuguuguguugcuuccuauuguggcuucccaugacacucc

SEQ ID NO: 516873 - RNA, 64 nt, Homo Sapiens
ugaugucaucccacauugguaggcaaauuacuuugcuuccuagcauaaaaaauaaucaucaacc

SEQ ID NO: 516874 - RNA, 64 nt, Homo Sapiens
aaacccuuuguguaucuuuuauaguguauaaguagcuuccuaggaaaaauuauguuuaaggguc

SEQ ID NO: 516875 - RNA, 64 nt, Homo Sapiens
gaggagcacaacagaugccacgucuucgugcauucgccaacacgugcccucacagggccagcgu

SEQ ID NO: 516876 - RNA, 64 nt, Homo Sapiens
ggcugccugugucuucaccuguccuguccaccagcgccaacagccguggggaagccaaggagac

SEQ ID NO: 516877 - RNA, 64 nt, Homo Sapiens
aaaugucacucaaaaauuucuuuuccaugucauucuugggaaugucuuccacaggauuugagaa

SEQ ID NO: 516878 - RNA, 64 nt, Homo Sapiens
uuggaauccuugaguuaauuccagugaagcaaaacuugggaagagucaggauuggccacauugc

SEQ ID NO: 516879 - RNA, 64 nt, Homo Sapiens
aaagaaaauggaacuucuuuucaggaaaaaugcacuugggaaucugcccuguaucacagaagau

SEQ ID NO: 516880 - RNA, 64 nt, Homo Sapiens
aguuggcucuggacguuucugugccaacaggucccuugggaaugcuaaggcugggagagaaagg

SEQ ID NO: 516881 - RNA, 64 nt, Homo Sapiens
acacaguauauaaauaaggacacuuuaaauccuucuugggaauguauuguguauugauugaagu

SEQ ID NO: 516882 - RNA, 64 nt, Homo Sapiens
uuuaagaagaaaucaaacauucucaaaaugagaacuugggaaugcugcccagaacccuggccau

SEQ ID NO: 516883 - RNA, 64 nt, Homo Sapiens
gcaagucugagucuaacaguagguuuccagcugacuugggaacugugugucaucagcaucaccu

SEQ ID NO: 516884 - RNA, 64 nt, Homo Sapiens
ccuuuucuccuuguuauuugcccuucagaaugcacuugggaaaggcugguuccuuagccuccug

SEQ ID NO: 516885 - RNA, 64 nt, Homo Sapiens
aacaaacauguuuuugugaaagcuacugaagugccuugggaaaugagaaaguuuuaauaaguaa

SEQ ID NO: 516886 - RNA, 64 nt, Homo Sapiens
acacccucccucacuacagggucuuuugcaaugacuugggaaaaucgaagcuggucuuuaauga

SEQ ID NO: 516887 - RNA, 64 nt, Homo Sapiens
caggauagcuggaaguaaggauuucaagauguaccuugggaagucccugcauggaggcaacagc

SEQ ID NO: 516888 - RNA, 64 nt, Homo Sapiens
aucagugagugaauucauauuucagagguuggaacuugggaaaagugaugaguacggaaaaguc

SEQ ID NO: 516889 - RNA, 64 nt, Homo Sapiens
uuugccagcauuggaaaaaggagcugucagaagacuugggaaggauagcuaccuggacuuuaca

SEQ ID NO: 516890 - RNA, 64 nt, Homo Sapiens
uguuuauuccagcgaugugauucaaagcaguuaucuugggaaacagaaacuaacgggacugguu

SEQ ID NO: 516891 - RNA, 64 nt, Homo Sapiens
gacccagugaucaugccuacgagggugaggguggcuugggaaccguuccauucaugccuucuug

SEQ ID NO: 516892 - RNA, 64 nt, Homo Sapiens
cugcagccagcgcccacccauccgugcccggacccuugggaaugcccgcggcuccagaggaaaa

SEQ ID NO: 516893 - RNA, 64 nt, Homo Sapiens
ggacggggccuccguugcggggggucggcugcuucuugggaacuuugucguuuccggcgcuggc

SEQ ID NO: 516894 - RNA, 64 nt, Homo Sapiens
uuuuuauccagcucuuuugcucacaucgcguaaccuugggaaagcuguuuaaagucgcugauca

SEQ ID NO: 516895 - RNA, 64 nt, Homo Sapiens
gcaggaauugggaggccuagggugggcaugaaagcuugggaagcacugucgucucucagacagg

SEQ ID NO: 516896 - RNA, 64 nt, Homo Sapiens
cucuacagaggugaaauuccagaugagucagucucuugggaaguguguuuagaaggguucagga

SEQ ID NO: 516897 - RNA, 64 nt, Homo Sapiens
cccacggaauggggaaagcgggaacccuggaguucuugggaaucuuggagccuaaagagaaacc

SEQ ID NO: 516898 - RNA, 64 nt, Homo Sapiens
aaggauauuagcaaaagcagaaguugcuagugaccuugggaagccgaagcugcuuacaguagcu

SEQ ID NO: 516899 - RNA, 64 nt, Homo Sapiens
gagagcagcaccaccccacuggggcauccccagacuugggaaacgugacucuuucuuaaugcca

SEQ ID NO: 516900 - RNA, 64 nt, Homo Sapiens
ugggcuccugcuggcuucugagguuucuugucagcuugggaaagacccaccuuuauuuuugccc

SEQ ID NO: 516901 - RNA, 64 nt, Homo Sapiens
aauuucucucuguccccugagaucugaaggcuaccuugggaagaggcaucagccaucuugcuug

SEQ ID NO: 516902 - RNA, 64 nt, Homo Sapiens
ccuuaaauuuugugcaauaacaaauguaagugugcuugggaauuaaaagcacguugauuuuuua

SEQ ID NO: 516903 - RNA, 64 nt, Homo Sapiens
gggucaccgugucugacaaaaaguuguggcuguucuugggaaagccucacaaaagagaguccuc

SEQ ID NO: 516904 - RNA, 64 nt, Homo Sapiens
cacgccucuuuccgaggugaaggugggaccauuccuugggaaaggauucacaguaagguuuuuu

SEQ ID NO: 516905 - RNA, 64 nt, Homo Sapiens
gauccaaaugaugaugugcaauuucauguuuuaacuugggaaacugaaaguguucccauauagc

SEQ ID NO: 516906 - RNA, 64 nt, Homo Sapiens
ggccugcuuccugucuuugggagaaaacgucuugcuugggaaggggccuuugucuugucaaggu

SEQ ID NO: 516907 - RNA, 64 nt, Homo Sapiens
auuaaaacaugcacaaaaagaugcaucuaccgcucuugggaaauaugucaaaggucuaaaaaua

SEQ ID NO: 516908 - RNA, 64 nt, Homo Sapiens
cccccucacccauuccuagugcucuugguauacacuugggaaaauaauguccuccaggagaaag

SEQ ID NO: 516909 - RNA, 64 nt, Homo Sapiens
cgucuauacaguauaaacuaccucacuugccuuucuugggaaaaaaaaaaugaauggacuuuaa

SEQ ID NO: 516910 - RNA, 64 nt, Homo Sapiens
gcuucauauuugcaacuuuggccugucaggucuccuugggaaagucagagagaugcugaguuag

SEQ ID NO: 516911 - RNA, 64 nt, Homo Sapiens
uucaaguuacaguggaguaugcacaagccaguuucuugggaaaaaugaaggugaugcugccaaa

SEQ ID NO: 516912 - RNA, 64 nt, Homo Sapiens
gcgugcagcagagccuagagugccaacgcuucugcuugggaauugacgacuucugcuugggaac

SEQ ID NO: 516913 - RNA, 64 nt, Homo Sapiens
gccaacgcuucugcuugggaccggacgacuucugcuugggaacuuccuccccuauucccggggc

SEQ ID NO: 516914 - RNA, 64 nt, Homo Sapiens
aauuaauuauaaauauguuuuuugucugacaucccucacuuaccacucaaugaacuacuuaugg

SEQ ID NO: 516915 - RNA, 64 nt, Homo Sapiens
aacucucuuuucuugcaucuccaagagaaaaauccucacuuauuccugaugacaguagcugucu

SEQ ID NO: 516916 - RNA, 64 nt, Homo Sapiens
cuuggcauuugugcagacauacaugccugugucacucacuuagcggcucuggccuuuugcugua

SEQ ID NO: 516917 - RNA, 64 nt, Homo Sapiens
uggugcuaugugaagacucuguguucgcacaguucucacuuaacgcauaccagcaauuauuacu

SEQ ID NO: 516918 - RNA, 64 nt, Homo Sapiens; identical to SEQ ID NO: 215532

SEQ ID NO: 516919 - RNA, 64 nt, Homo Sapiens; identical to SEQ ID NO: 215533

SEQ ID NO: 516920 - RNA, 64 nt, Homo Sapiens; identical to SEQ ID NO: 215534

SEQ ID NO: 516921 - RNA, 64 nt, Homo Sapiens; identical to SEQ ID NO: 215535

SEQ ID NO: 516922 - RNA, 58 nt, Homo Sapiens; identical to SEQ ID NO: 160291

SEQ ID NO: 516923 - RNA, 62 nt, Homo Sapiens
cuccaaggucccuuaaaaagugccuuuuagaggcugggcaugguggcucacgcuuguaaucc

SEQ ID NO: 516924 - RNA, 62 nt, Homo Sapiens
cgaccugcugacccacggucccuggggggccugcugggcaggcaggggcgcccgagcccucu

SEQ ID NO: 516925 - RNA, 62 nt, Homo Sapiens
gcacaucccccaggacuugauccccgagggcggcugggcagacaugggaggcggcgcugcuc

SEQ ID NO: 516926 - RNA, 62 nt, Homo Sapiens
gaaaccccgucucuucuaaaaauacaaaauuagcugggcaugguggugcaugccuguaauuc

SEQ ID NO: 516927 - RNA, 62 nt, Homo Sapiens
gaaguuauucuucauaaaaaauguuaacgugggcugggcaugguggcucaugccuguaaucc

SEQ ID NO: 516928 - RNA, 62 nt, Homo Sapiens
guaaauguugcaaaaagaguuuuccaaguagagcugggcacuacguaaucagccccacaagu

SEQ ID NO: 516929 - RNA, 62 nt, Homo Sapiens
ucuacuaaaaauacaaaaaaaaaaaaaaauuagcugggcaugguggcacacaccuguagucc

SEQ ID NO: 516930 - RNA, 62 nt, Homo Sapiens
aaaacccugugucuacaaaaaauaaaaaauuagcugggcaugacggccagagcccauggucc

SEQ ID NO: 516931 - RNA, 62 nt, Homo Sapiens
uugaucugguuuuugaagucucuuaauuauuggcugggcauggugacucaugccuguaaucc

SEQ ID NO: 516932 - RNA, 62 nt, Homo Sapiens
gugagacuccgucucuacaaaaaauaaauuuagcugggcaugguggugcacaucuguagucc

SEQ ID NO: 516933 - RNA, 62 nt, Homo Sapiens
guggcucacuuugggaggcucuggagccucuggcugggcacacucacccaacaccaguggaa

SEQ ID NO: 516934 - RNA, 62 nt, Homo Sapiens
cacucuauugaccaaacauuuucuggggaagugcugggcauuucccuuggggaaagaggugc

SEQ ID NO: 516935 - RNA, 62 nt, Homo Sapiens
ucauagaugggaugaaugaccuccaggcugcugcugggcaugccugcugucauuggcucucc

SEQ ID NO: 516936 - RNA, 62 nt, Homo Sapiens
agggaucacaucacucuuaaauggggagggaggcugggcaucgucuuuaggaguaggguggg

SEQ ID NO: 516937 - RNA, 62 nt, Homo Sapiens
gucugcucugguaggacuguagcccacgccgagcugggcagcggggccaggcaggccagccc

SEQ ID NO: 516938 - RNA, 62 nt, Homo Sapiens
guccccugcaaggaggcaggcugccccuuccagcugggcagagucagggccugccgagcugc

SEQ ID NO: 516939 - RNA, 62 nt, Homo Sapiens
ggauguagggauagcugauuuuaaaacacucggcugggcacaguggcucacaccuguaaucc

SEQ ID NO: 516940 - RNA, 62 nt, Homo Sapiens
aaacccugucucuacaaaaaauacaaaaauuagcugggcaugguggugcgugccugaagucc

SEQ ID NO: 516941 - RNA, 62 nt, Homo Sapiens
gcaggacgccgccucacgcaagcugggacacugcugggcacggcccuggcguucggcacuag

SEQ ID NO: 516942 - RNA, 62 nt, Homo Sapiens
ggaacaguugacuucccagaaugcagugggcugcugggcaccccucucacgguuggggagga

SEQ ID NO: 516943 - RNA, 62 nt, Homo Sapiens
uguguacugcaugcccacccggguagcaggcugcugggcaguucugcucuguggaggggcgg

SEQ ID NO: 516944 - RNA, 62 nt, Homo Sapiens
gccccacgaagcccccaguggcuggcuguccagcugggcaaacaguggcaccccucccagcu

SEQ ID NO: 516945 - RNA, 62 nt, Homo Sapiens
cuucuguuucaacaacuccuccacugggcagagcugggcaucuggcagggcuggcucugucc

SEQ ID NO: 516946 - RNA, 62 nt, Homo Sapiens
gggaacacaggaaccuaggggaggaggggagcgcugggcauccucaggcuggcggccaaggc

SEQ ID NO: 516947 - RNA, 62 nt, Homo Sapiens
ccugugggucccugcagucgacaucauguuuggcugggcaucgaugccuccuuucugggacu

SEQ ID NO: 516948 - RNA, 62 nt, Homo Sapiens
ccuggaaaaugugaaacugucuccugcaaccugcugggcaugugggccuggcuguguucaau

SEQ ID NO: 516949 - RNA, 62 nt, Homo Sapiens
cuguaagucuguucauuuuaacaacauacagggcugggcacgguggcucacgccuguaaucc

SEQ ID NO: 516950 - RNA, 62 nt, Homo Sapiens
aaaccccgucucuaugaaaaauauaaaaauuagcugggcaugguggcaggcaccuguaaucc

SEQ ID NO: 516951 - RNA, 62 nt, Homo Sapiens
guugaauccauaguguggggcccaugacucuagcugggcaccuuggaccuccagcuggccaa

SEQ ID NO: 516952 - RNA, 62 nt, Homo Sapiens
uaguaaguccucuuccaaagagauggcaauaugcugggcaucuacuuuaaaacaaaguuguc

SEQ ID NO: 516953 - RNA, 62 nt, Homo Sapiens
acucuccccaccccuggcccacuguggugugugcugggcaaauguggccugaaugcuaggua

SEQ ID NO: 516954 - RNA, 62 nt, Homo Sapiens
gcucugccugggacugagcgaguggacuuagggcugggcaggcaguagccaccagagggcag

SEQ ID NO: 516955 - RNA, 62 nt, Homo Sapiens
auagagaucuccucugcaguguagagaccagagcugggcagugcagggcauggagaccugca

SEQ ID NO: 516956 - RNA, 62 nt, Homo Sapiens
aaaaaauaauaauaauaacaauauaagaacuagcugggcaugguggcgcaugcauguagucc

SEQ ID NO: 516957 - RNA, 62 nt, Homo Sapiens
auggcacgcaccugcaguccguacaaaaauuagcugggcaugaaacuccaucucuacuaaaa

SEQ ID NO: 516958 - RNA, 62 nt, Homo Sapiens
guggcucacaccuguaauccugauauauucuggcugggcacaaccugcagaguccagugaaa

SEQ ID NO: 516959 - RNA, 62 nt, Homo Sapiens
guggcucaugccugaaauccaaaguacuucaggcugggcacacagcaaugcugaguucaaga

SEQ ID NO: 516960 - RNA, 62 nt, Homo Sapiens
guggcgcacgccuguaguucuauaaaaaauuagcugggcaugaaccccaucgcuacuaaaaa

SEQ ID NO: 516961 - RNA, 62 nt, Homo Sapiens
guggcucacgccuguaauccaagcacaugauggcugggcaccauccaccucgcuuuaaaaau

SEQ ID NO: 516962 - RNA, 62 nt, Homo Sapiens
uuuggaauuuccuggaugagaaggaagucugggcugggcaugguggcucacgccuguaaccc

SEQ ID NO: 516963 - RNA, 62 nt, Homo Sapiens
aaaccccauuucuacaaaaaauacaaaaauuagcugggcaugguggcacccgccuguagucc

SEQ ID NO: 516964 - RNA, 62 nt, Homo Sapiens
gcucugggaagugaagucauggcugcugggcagcugggcagacauuguucuggaaaucucca

SEQ ID NO: 516965 - RNA, 62 nt, Homo Sapiens
ugggcagagcucugggaaguaaucuccaggcugcugggcagccuacuccccauuguucugga

SEQ ID NO: 516966 - RNA, 62 nt, Homo Sapiens
auggcgagugucuguaauccauacaaaaauuagcugggcaugaaaugccgucucuacuaaaa

SEQ ID NO: 516967 - RNA, 62 nt, Homo Sapiens
guggcuuaugccuguaauccgcguaagcuuuggcugggcauguuuaaauaauuucuuuaaaa

SEQ ID NO: 516968 - RNA, 62 nt, Homo Sapiens
auguggcagugagggacgauggggugaagucagcugggcauucaaagaagcuagacugagaa

SEQ ID NO: 516969 - RNA, 62 nt, Homo Sapiens
aaaccccaugucuacuaaaaauacaaaaauuagcugggcaugguggcacacacuuguagucc

SEQ ID NO: 516970 - RNA, 62 nt, Homo Sapiens
uccaguuuuguuauuuuaacaaauuucucuaggcugggcaugguggcucaugccuauaaucc

SEQ ID NO: 516971 - RNA, 62 nt, Homo Sapiens
gaccuuaucucuacaaaaaaauuuagaaauuagcugggcaugguggcacccaucuguagucc

SEQ ID NO: 516972 - RNA, 62 nt, Homo Sapiens
guggcgggugccuguaauccauacaaaaauuggcugggcaugaaaccccaucucuacuaaaa

SEQ ID NO: 516973 - RNA, 62 nt, Homo Sapiens
gcauaguggcuuaugccugucagaaaagaagggcugggcaagguagggggcaggaagaggag

SEQ ID NO: 516974 - RNA, 62 nt, Homo Sapiens
guggugcacaccugucgucuaauauaaaauuagcugggcauggaaauccugucucuacuaaa

SEQ ID NO: 516975 - RNA, 62 nt, Homo Sapiens
ugggagcaccagcugcggcggguggacagcgagcugggcaccggcuaugacagugaugagga

SEQ ID NO: 516976 - RNA, 62 nt, Homo Sapiens
ugaggaaaggacagccccugaauguuugcagagcugggcaguucuccaccuucucuccacag

SEQ ID NO: 516977 - RNA, 62 nt, Homo Sapiens
agugcagcugauaucguuuggcuugacaggcagcugggcaucccugggacuccuaucaggaa

SEQ ID NO: 516978 - RNA, 62 nt, Homo Sapiens
gugacagugcuagaagacccgacaccuccugggcugggcagauaccaggcuucgugggcaca

SEQ ID NO: 516979 - RNA, 62 nt, Homo Sapiens
acugguccuugugaggaugcaugcccaagggugcugggcauccuggccggugugcuggaugc

SEQ ID NO: 516980 - RNA, 62 nt, Homo Sapiens
ugggagagcuuccagaauccccaugcccggcugcugggcaccucugcugccacaugccguuc

SEQ ID NO: 516981 - RNA, 62 nt, Homo Sapiens
uggacagccccagccaccacugaccccgggaggcugggcaggucugccacagcccugcauac

SEQ ID NO: 516982 - RNA, 62 nt, Homo Sapiens
ccuucaguguggcuggcguucgucccugccccgcugggcagccccacucccugcacgccugc

SEQ ID NO: 516983 - RNA, 62 nt, Homo Sapiens
acaguguuuccaagagcaagugcucacgggaggcugggcaccggcaaccguugucaaggcua

SEQ ID NO: 516984 - RNA, 62 nt, Homo Sapiens
gguacucaggaccucauaggcagcaccccugagcugggcaaauccaagagagcuuaggauga

SEQ ID NO: 516985 - RNA, 64 nt, Homo Sapiens; identical to SEQ ID NO: 196000

SEQ ID NO: 516986 - RNA, 64 nt, Homo Sapiens; identical to SEQ ID NO: 196001

SEQ ID NO: 516987 - RNA, 64 nt, Homo Sapiens; identical to SEQ ID NO: 196002

SEQ ID NO: 516988 - RNA, 64 nt, Homo Sapiens; identical to SEQ ID NO: 196003

SEQ ID NO: 516989 - RNA, 64 nt, Homo Sapiens; identical to SEQ ID NO: 196004

SEQ ID NO: 516990 - RNA, 64 nt, Homo Sapiens; identical to SEQ ID NO: 196005

SEQ ID NO: 516991 - RNA, 64 nt, Homo Sapiens; identical to SEQ ID NO: 196006

SEQ ID NO: 516992 - RNA, 64 nt, Homo Sapiens; identical to SEQ ID NO: 196007

SEQ ID NO: 516993 - RNA, 64 nt, Homo Sapiens; identical to SEQ ID NO: 196008

SEQ ID NO: 516994 - RNA, 64 nt, Homo Sapiens; identical to SEQ ID NO: 196009

SEQ ID NO: 516995 - RNA, 64 nt, Homo Sapiens; identical to SEQ ID NO: 196010

SEQ ID NO: 516996 - RNA, 64 nt, Homo Sapiens; identical to SEQ ID NO: 196011

SEQ ID NO: 516997 - RNA, 64 nt, Homo Sapiens; identical to SEQ ID NO: 196012

SEQ ID NO: 516998 - RNA, 64 nt, Homo Sapiens; identical to SEQ ID NO: 196013

SEQ ID NO: 516999 - RNA, 64 nt, Homo Sapiens; identical to SEQ ID NO: 196014

SEQ ID NO: 517000 - RNA, 64 nt, Homo Sapiens; identical to SEQ ID NO: 196015

SEQ ID NO: 517001 - RNA, 64 nt, Homo Sapiens; identical to SEQ ID NO: 196016

SEQ ID NO: 517002 - RNA, 64 nt, Homo Sapiens; identical to SEQ ID NO: 196017

SEQ ID NO: 517003 - RNA, 64 nt, Homo Sapiens; identical to SEQ ID NO: 196018

SEQ ID NO: 517004 - RNA, 64 nt, Homo Sapiens; identical to SEQ ID NO: 196019

SEQ ID NO: 517005 - RNA, 64 nt, Homo Sapiens; identical to SEQ ID NO: 196020

SEQ ID NO: 517006 - RNA, 64 nt, Homo Sapiens; identical to SEQ ID NO: 196021

SEQ ID NO: 517007 - RNA, 64 nt, Homo Sapiens; identical to SEQ ID NO: 196022

SEQ ID NO: 517008 - RNA, 64 nt, Homo Sapiens; identical to SEQ ID NO: 196023

SEQ ID NO: 517009 - RNA, 64 nt, Homo Sapiens; identical to SEQ ID NO: 196024

SEQ ID NO: 517010 - RNA, 64 nt, Homo Sapiens; identical to SEQ ID NO: 196025

SEQ ID NO: 517011 - RNA, 64 nt, Homo Sapiens; identical to SEQ ID NO: 196026

SEQ ID NO: 517012 - RNA, 64 nt, Homo Sapiens; identical to SEQ ID NO: 196027

SEQ ID NO: 517013 - RNA, 64 nt, Homo Sapiens; identical to SEQ ID NO: 196028

SEQ ID NO: 517014 - RNA, 64 nt, Homo Sapiens; identical to SEQ ID NO: 196029

SEQ ID NO: 517015 - RNA, 64 nt, Homo Sapiens; identical to SEQ ID NO: 196030

SEQ ID NO: 517016 - RNA, 64 nt, Homo Sapiens; identical to SEQ ID NO: 196031

SEQ ID NO: 517017 - RNA, 64 nt, Homo Sapiens
ccauggaguuaggcacuuccuuucauguacauaugguauagaaauugucaggcucucugucagc

SEQ ID NO: 517018 - RNA, 64 nt, Homo Sapiens
gaaaaugacaaagauggcaaucagaagggagagugguauagauauuggcuagugauucuuguuu

SEQ ID NO: 517019 - RNA, 64 nt, Homo Sapiens
cuaccugucauagccuccuuuggcuuaaugggaagguauagaaguuaacaauaguuuauuauug

SEQ ID NO: 517020 - RNA, 64 nt, Homo Sapiens
ucuuagaaagauaauuucaucucagagaacuguagguauagacuucaucuuuuccauugauuag

SEQ ID NO: 517021 - RNA, 64 nt, Homo Sapiens; identical to SEQ ID NO: 223226

SEQ ID NO: 517022 - RNA, 64 nt, Homo Sapiens; identical to SEQ ID NO: 223227

SEQ ID NO: 517023 - RNA, 64 nt, Homo Sapiens; identical to SEQ ID NO: 223228

SEQ ID NO: 517024 - RNA, 64 nt, Homo Sapiens; identical to SEQ ID NO: 223229

SEQ ID NO: 517025 - RNA, 64 nt, Homo Sapiens; identical to SEQ ID NO: 223230

SEQ ID NO: 517026 - RNA, 64 nt, Homo Sapiens; identical to SEQ ID NO: 223231

SEQ ID NO: 517027 - RNA, 64 nt, Homo Sapiens; identical to SEQ ID NO: 223232

SEQ ID NO: 517028 - RNA, 64 nt, Homo Sapiens; identical to SEQ ID NO: 223233

SEQ ID NO: 517029 - RNA, 64 nt, Homo Sapiens; identical to SEQ ID NO: 223234

SEQ ID NO: 517030 - RNA, 64 nt, Homo Sapiens; identical to SEQ ID NO: 223235

SEQ ID NO: 517031 - RNA, 64 nt, Homo Sapiens; identical to SEQ ID NO: 223236

SEQ ID NO: 517032 - RNA, 64 nt, Homo Sapiens; identical to SEQ ID NO: 223237

SEQ ID NO: 517033 - RNA, 64 nt, Homo Sapiens; identical to SEQ ID NO: 223238

SEQ ID NO: 517034 - RNA, 64 nt, Homo Sapiens; identical to SEQ ID NO: 223239

SEQ ID NO: 517035 - RNA, 64 nt, Homo Sapiens; identical to SEQ ID NO: 223240

SEQ ID NO: 517036 - RNA, 64 nt, Homo Sapiens; identical to SEQ ID NO: 223241

SEQ ID NO: 517037 - RNA, 64 nt, Homo Sapiens; identical to SEQ ID NO: 223242

SEQ ID NO: 517038 - RNA, 64 nt, Homo Sapiens; identical to SEQ ID NO: 223243

SEQ ID NO: 517039 - RNA, 64 nt, Homo Sapiens; identical to SEQ ID NO: 223244

SEQ ID NO: 517040 - RNA, 64 nt, Homo Sapiens; identical to SEQ ID NO: 223245

SEQ ID NO: 517041 - RNA, 64 nt, Homo Sapiens; identical to SEQ ID NO: 223246

SEQ ID NO: 517042 - RNA, 64 nt, Homo Sapiens; identical to SEQ ID NO: 223247

SEQ ID NO: 517043 - RNA, 64 nt, Homo Sapiens; identical to SEQ ID NO: 223248

SEQ ID NO: 517044 - RNA, 64 nt, Homo Sapiens; identical to SEQ ID NO: 223249

SEQ ID NO: 517045 - RNA, 64 nt, Homo Sapiens; identical to SEQ ID NO: 223250

SEQ ID NO: 517046 - RNA, 64 nt, Homo Sapiens; identical to SEQ ID NO: 223251

SEQ ID NO: 517047 - RNA, 64 nt, Homo Sapiens; identical to SEQ ID NO: 223252

SEQ ID NO: 517048 - RNA, 64 nt, Homo Sapiens; identical to SEQ ID NO: 223253

SEQ ID NO: 517049 - RNA, 64 nt, Homo Sapiens; identical to SEQ ID NO: 223254

SEQ ID NO: 517050 - RNA, 64 nt, Homo Sapiens; identical to SEQ ID NO: 223255

SEQ ID NO: 517051 - RNA, 64 nt, Homo Sapiens; identical to SEQ ID NO: 223256

SEQ ID NO: 517052 - RNA, 64 nt, Homo Sapiens; identical to SEQ ID NO: 223257

SEQ ID NO: 517053 - RNA, 64 nt, Homo Sapiens; identical to SEQ ID NO: 223258

SEQ ID NO: 517054 - RNA, 64 nt, Homo Sapiens; identical to SEQ ID NO: 223259

SEQ ID NO: 517055 - RNA, 64 nt, Homo Sapiens; identical to SEQ ID NO: 223260

SEQ ID NO: 517056 - RNA, 64 nt, Homo Sapiens; identical to SEQ ID NO: 223261

SEQ ID NO: 517057 - RNA, 64 nt, Homo Sapiens; identical to SEQ ID NO: 223262

SEQ ID NO: 517058 - RNA, 64 nt, Homo Sapiens; identical to SEQ ID NO: 223263

SEQ ID NO: 517059 - RNA, 64 nt, Homo Sapiens; identical to SEQ ID NO: 223264

SEQ ID NO: 517060 - RNA, 64 nt, Homo Sapiens; identical to SEQ ID NO: 223265

SEQ ID NO: 517061 - RNA, 64 nt, Homo Sapiens; identical to SEQ ID NO: 223266

SEQ ID NO: 517062 - RNA, 64 nt, Homo Sapiens; identical to SEQ ID NO: 223267

SEQ ID NO: 517063 - RNA, 64 nt, Homo Sapiens; identical to SEQ ID NO: 223268

SEQ ID NO: 517064 - RNA, 64 nt, Homo Sapiens; identical to SEQ ID NO: 223269

SEQ ID NO: 517065 - RNA, 64 nt, Homo Sapiens; identical to SEQ ID NO: 223270

SEQ ID NO: 517066 - RNA, 64 nt, Homo Sapiens; identical to SEQ ID NO: 223271

SEQ ID NO: 517067 - RNA, 64 nt, Homo Sapiens; identical to SEQ ID NO: 223272

SEQ ID NO: 517068 - RNA, 64 nt, Homo Sapiens; identical to SEQ ID NO: 223273

SEQ ID NO: 517069 - RNA, 64 nt, Homo Sapiens; identical to SEQ ID NO: 223274

SEQ ID NO: 517070 - RNA, 64 nt, Homo Sapiens; identical to SEQ ID NO: 223275

SEQ ID NO: 517071 - RNA, 64 nt, Homo Sapiens; identical to SEQ ID NO: 223276

SEQ ID NO: 517072 - RNA, 64 nt, Homo Sapiens; identical to SEQ ID NO: 223277

SEQ ID NO: 517073 - RNA, 64 nt, Homo Sapiens; identical to SEQ ID NO: 223278

SEQ ID NO: 517074 - RNA, 64 nt, Homo Sapiens; identical to SEQ ID NO: 223279

SEQ ID NO: 517075 - RNA, 64 nt, Homo Sapiens; identical to SEQ ID NO: 223280

SEQ ID NO: 517076 - RNA, 64 nt, Homo Sapiens; identical to SEQ ID NO: 223281

SEQ ID NO: 517077 - RNA, 64 nt, Homo Sapiens; identical to SEQ ID NO: 223282

SEQ ID NO: 517078 - RNA, 64 nt, Homo Sapiens; identical to SEQ ID NO: 223283

SEQ ID NO: 517079 - RNA, 64 nt, Homo Sapiens; identical to SEQ ID NO: 223284

SEQ ID NO: 517080 - RNA, 64 nt, Homo Sapiens; identical to SEQ ID NO: 223285

SEQ ID NO: 517081 - RNA, 64 nt, Homo Sapiens; identical to SEQ ID NO: 223286

SEQ ID NO: 517082 - RNA, 64 nt, Homo Sapiens; identical to SEQ ID NO: 223287

SEQ ID NO: 517083 - RNA, 64 nt, Homo Sapiens; identical to SEQ ID NO: 223288

SEQ ID NO: 517084 - RNA, 64 nt, Homo Sapiens; identical to SEQ ID NO: 223289

SEQ ID NO: 517085 - RNA, 64 nt, Homo Sapiens; identical to SEQ ID NO: 223290

SEQ ID NO: 517086 - RNA, 64 nt, Homo Sapiens; identical to SEQ ID NO: 223291

SEQ ID NO: 517087 - RNA, 64 nt, Homo Sapiens; identical to SEQ ID NO: 223292

SEQ ID NO: 517088 - RNA, 64 nt, Homo Sapiens; identical to SEQ ID NO: 223293

SEQ ID NO: 517089 - RNA, 64 nt, Homo Sapiens; identical to SEQ ID NO: 223294

SEQ ID NO: 517090 - RNA, 64 nt, Homo Sapiens; identical to SEQ ID NO: 223295

SEQ ID NO: 517091 - RNA, 64 nt, Homo Sapiens; identical to SEQ ID NO: 223296

SEQ ID NO: 517092 - RNA, 64 nt, Homo Sapiens; identical to SEQ ID NO: 223297

SEQ ID NO: 517093 - RNA, 64 nt, Homo Sapiens; identical to SEQ ID NO: 223298

SEQ ID NO: 517094 - RNA, 64 nt, Homo Sapiens; identical to SEQ ID NO: 223299

SEQ ID NO: 517095 - RNA, 64 nt, Homo Sapiens; identical to SEQ ID NO: 223300

SEQ ID NO: 517096 - RNA, 64 nt, Homo Sapiens; identical to SEQ ID NO: 223301

SEQ ID NO: 517097 - RNA, 64 nt, Homo Sapiens; identical to SEQ ID NO: 223302

SEQ ID NO: 517098 - RNA, 64 nt, Homo Sapiens; identical to SEQ ID NO: 223303

SEQ ID NO: 517099 - RNA, 64 nt, Homo Sapiens; identical to SEQ ID NO: 223304

SEQ ID NO: 517100 - RNA, 64 nt, Homo Sapiens; identical to SEQ ID NO: 223305

SEQ ID NO: 517101 - RNA, 64 nt, Homo Sapiens; identical to SEQ ID NO: 223306

SEQ ID NO: 517102 - RNA, 64 nt, Homo Sapiens; identical to SEQ ID NO: 223307

SEQ ID NO: 517103 - RNA, 64 nt, Homo Sapiens; identical to SEQ ID NO: 223308

SEQ ID NO: 517104 - RNA, 64 nt, Homo Sapiens; identical to SEQ ID NO: 223309

SEQ ID NO: 517105 - RNA, 64 nt, Homo Sapiens; identical to SEQ ID NO: 223310

SEQ ID NO: 517106 - RNA, 64 nt, Homo Sapiens; identical to SEQ ID NO: 223311

SEQ ID NO: 517107 - RNA, 64 nt, Homo Sapiens; identical to SEQ ID NO: 223312

SEQ ID NO: 517108 - RNA, 64 nt, Homo Sapiens; identical to SEQ ID NO: 223313

SEQ ID NO: 517109 - RNA, 64 nt, Homo Sapiens; identical to SEQ ID NO: 223314

SEQ ID NO: 517110 - RNA, 64 nt, Homo Sapiens; identical to SEQ ID NO: 223315

SEQ ID NO: 517111 - RNA, 64 nt, Homo Sapiens; identical to SEQ ID NO: 223316

SEQ ID NO: 517112 - RNA, 64 nt, Homo Sapiens; identical to SEQ ID NO: 223317

SEQ ID NO: 517113 - RNA, 64 nt, Homo Sapiens; identical to SEQ ID NO: 223318

SEQ ID NO: 517114 - RNA, 64 nt, Homo Sapiens; identical to SEQ ID NO: 223319

SEQ ID NO: 517115 - RNA, 64 nt, Homo Sapiens; identical to SEQ ID NO: 223320

SEQ ID NO: 517116 - RNA, 64 nt, Homo Sapiens; identical to SEQ ID NO: 223321

SEQ ID NO: 517117 - RNA, 64 nt, Homo Sapiens; identical to SEQ ID NO: 223322

SEQ ID NO: 517118 - RNA, 64 nt, Homo Sapiens; identical to SEQ ID NO: 223323

SEQ ID NO: 517119 - RNA, 64 nt, Homo Sapiens; identical to SEQ ID NO: 223324

SEQ ID NO: 517120 - RNA, 64 nt, Homo Sapiens; identical to SEQ ID NO: 223325

SEQ ID NO: 517121 - RNA, 64 nt, Homo Sapiens; identical to SEQ ID NO: 223326

SEQ ID NO: 517122 - RNA, 64 nt, Homo Sapiens; identical to SEQ ID NO: 223327

SEQ ID NO: 517123 - RNA, 64 nt, Homo Sapiens; identical to SEQ ID NO: 223328

SEQ ID NO: 517124 - RNA, 64 nt, Homo Sapiens; identical to SEQ ID NO: 223329

SEQ ID NO: 517125 - RNA, 64 nt, Homo Sapiens; identical to SEQ ID NO: 223330

SEQ ID NO: 517126 - RNA, 64 nt, Homo Sapiens; identical to SEQ ID NO: 223331

SEQ ID NO: 517127 - RNA, 64 nt, Homo Sapiens; identical to SEQ ID NO: 223332

SEQ ID NO: 517128 - RNA, 64 nt, Homo Sapiens; identical to SEQ ID NO: 223333

SEQ ID NO: 517129 - RNA, 64 nt, Homo Sapiens; identical to SEQ ID NO: 223334

SEQ ID NO: 517130 - RNA, 64 nt, Homo Sapiens; identical to SEQ ID NO: 223335

SEQ ID NO: 517131 - RNA, 64 nt, Homo Sapiens; identical to SEQ ID NO: 223336

SEQ ID NO: 517132 - RNA, 64 nt, Homo Sapiens; identical to SEQ ID NO: 223337

SEQ ID NO: 517133 - RNA, 64 nt, Homo Sapiens; identical to SEQ ID NO: 223338

SEQ ID NO: 517134 - RNA, 64 nt, Homo Sapiens; identical to SEQ ID NO: 223339

SEQ ID NO: 517135 - RNA, 64 nt, Homo Sapiens; identical to SEQ ID NO: 223340

SEQ ID NO: 517136 - RNA, 64 nt, Homo Sapiens; identical to SEQ ID NO: 223341

SEQ ID NO: 517137 - RNA, 64 nt, Homo Sapiens; identical to SEQ ID NO: 223342

SEQ ID NO: 517138 - RNA, 64 nt, Homo Sapiens; identical to SEQ ID NO: 223343

SEQ ID NO: 517139 - RNA, 64 nt, Homo Sapiens; identical to SEQ ID NO: 223344

SEQ ID NO: 517140 - RNA, 64 nt, Homo Sapiens; identical to SEQ ID NO: 223345

SEQ ID NO: 517141 - RNA, 64 nt, Homo Sapiens; identical to SEQ ID NO: 223346

SEQ ID NO: 517142 - RNA, 64 nt, Homo Sapiens; identical to SEQ ID NO: 223347

SEQ ID NO: 517143 - RNA, 64 nt, Homo Sapiens; identical to SEQ ID NO: 223348

SEQ ID NO: 517144 - RNA, 64 nt, Homo Sapiens; identical to SEQ ID NO: 223349

SEQ ID NO: 517145 - RNA, 64 nt, Homo Sapiens; identical to SEQ ID NO: 223350

SEQ ID NO: 517146 - RNA, 64 nt, Homo Sapiens; identical to SEQ ID NO: 223351

SEQ ID NO: 517147 - RNA, 64 nt, Homo Sapiens; identical to SEQ ID NO: 223352

SEQ ID NO: 517148 - RNA, 64 nt, Homo Sapiens; identical to SEQ ID NO: 223353

SEQ ID NO: 517149 - RNA, 64 nt, Homo Sapiens; identical to SEQ ID NO: 223354

SEQ ID NO: 517150 - RNA, 64 nt, Homo Sapiens; identical to SEQ ID NO: 223355

SEQ ID NO: 517151 - RNA, 64 nt, Homo Sapiens; identical to SEQ ID NO: 223356

SEQ ID NO: 517152 - RNA, 64 nt, Homo Sapiens; identical to SEQ ID NO: 223357

SEQ ID NO: 517153 - RNA, 64 nt, Homo Sapiens; identical to SEQ ID NO: 223358

SEQ ID NO: 517154 - RNA, 64 nt, Homo Sapiens; identical to SEQ ID NO: 223359

SEQ ID NO: 517155 - RNA, 64 nt, Homo Sapiens; identical to SEQ ID NO: 223360

SEQ ID NO: 517156 - RNA, 64 nt, Homo Sapiens; identical to SEQ ID NO: 223361

SEQ ID NO: 517157 - RNA, 64 nt, Homo Sapiens; identical to SEQ ID NO: 223362

SEQ ID NO: 517158 - RNA, 64 nt, Homo Sapiens; identical to SEQ ID NO: 223363

SEQ ID NO: 517159 - RNA, 64 nt, Homo Sapiens; identical to SEQ ID NO: 223364

SEQ ID NO: 517160 - RNA, 64 nt, Homo Sapiens; identical to SEQ ID NO: 223365

SEQ ID NO: 517161 - RNA, 64 nt, Homo Sapiens; identical to SEQ ID NO: 223366

SEQ ID NO: 517162 - RNA, 64 nt, Homo Sapiens; identical to SEQ ID NO: 223367

SEQ ID NO: 517163 - RNA, 64 nt, Homo Sapiens; identical to SEQ ID NO: 223368

SEQ ID NO: 517164 - RNA, 64 nt, Homo Sapiens; identical to SEQ ID NO: 223369

SEQ ID NO: 517165 - RNA, 64 nt, Homo Sapiens; identical to SEQ ID NO: 223370

SEQ ID NO: 517166 - RNA, 64 nt, Homo Sapiens; identical to SEQ ID NO: 223371

SEQ ID NO: 517167 - RNA, 64 nt, Homo Sapiens; identical to SEQ ID NO: 223372

SEQ ID NO: 517168 - RNA, 64 nt, Homo Sapiens; identical to SEQ ID NO: 223373

SEQ ID NO: 517169 - RNA, 64 nt, Homo Sapiens; identical to SEQ ID NO: 223374

SEQ ID NO: 517170 - RNA, 64 nt, Homo Sapiens; identical to SEQ ID NO: 223375

SEQ ID NO: 517171 - RNA, 64 nt, Homo Sapiens; identical to SEQ ID NO: 223376

SEQ ID NO: 517172 - RNA, 64 nt, Homo Sapiens; identical to SEQ ID NO: 223377

SEQ ID NO: 517173 - RNA, 64 nt, Homo Sapiens; identical to SEQ ID NO: 223378

SEQ ID NO: 517174 - RNA, 64 nt, Homo Sapiens; identical to SEQ ID NO: 223379

SEQ ID NO: 517175 - RNA, 64 nt, Homo Sapiens; identical to SEQ ID NO: 223380

SEQ ID NO: 517176 - RNA, 64 nt, Homo Sapiens; identical to SEQ ID NO: 223381

SEQ ID NO: 517177 - RNA, 64 nt, Homo Sapiens; identical to SEQ ID NO: 223382

SEQ ID NO: 517178 - RNA, 64 nt, Homo Sapiens; identical to SEQ ID NO: 223383

SEQ ID NO: 517179 - RNA, 64 nt, Homo Sapiens; identical to SEQ ID NO: 223384

SEQ ID NO: 517180 - RNA, 64 nt, Homo Sapiens; identical to SEQ ID NO: 223385

SEQ ID NO: 517181 - RNA, 64 nt, Homo Sapiens; identical to SEQ ID NO: 223386

SEQ ID NO: 517182 - RNA, 64 nt, Homo Sapiens; identical to SEQ ID NO: 223387

SEQ ID NO: 517183 - RNA, 64 nt, Homo Sapiens; identical to SEQ ID NO: 223388

SEQ ID NO: 517184 - RNA, 64 nt, Homo Sapiens; identical to SEQ ID NO: 223389

SEQ ID NO: 517185 - RNA, 64 nt, Homo Sapiens; identical to SEQ ID NO: 223390

SEQ ID NO: 517186 - RNA, 64 nt, Homo Sapiens; identical to SEQ ID NO: 223391

SEQ ID NO: 517187 - RNA, 64 nt, Homo Sapiens; identical to SEQ ID NO: 223392

SEQ ID NO: 517188 - RNA, 64 nt, Homo Sapiens; identical to SEQ ID NO: 223393

SEQ ID NO: 517189 - RNA, 64 nt, Homo Sapiens; identical to SEQ ID NO: 223394

SEQ ID NO: 517190 - RNA, 64 nt, Homo Sapiens; identical to SEQ ID NO: 223395

SEQ ID NO: 517191 - RNA, 64 nt, Homo Sapiens; identical to SEQ ID NO: 223396

SEQ ID NO: 517192 - RNA, 64 nt, Homo Sapiens; identical to SEQ ID NO: 223397

SEQ ID NO: 517193 - RNA, 64 nt, Homo Sapiens; identical to SEQ ID NO: 223398

SEQ ID NO: 517194 - RNA, 64 nt, Homo Sapiens; identical to SEQ ID NO: 223399

SEQ ID NO: 517195 - RNA, 64 nt, Homo Sapiens; identical to SEQ ID NO: 223400

SEQ ID NO: 517196 - RNA, 64 nt, Homo Sapiens; identical to SEQ ID NO: 223401

SEQ ID NO: 517197 - RNA, 64 nt, Homo Sapiens; identical to SEQ ID NO: 223402

SEQ ID NO: 517198 - RNA, 56 nt, Homo Sapiens; identical to SEQ ID NO: 223403

SEQ ID NO: 517199 - RNA, 51 nt, Homo Sapiens; identical to SEQ ID NO: 223404

SEQ ID NO: 517200 - RNA, 64 nt, Homo Sapiens; identical to SEQ ID NO: 223405

SEQ ID NO: 517201 - RNA, 64 nt, Homo Sapiens; identical to SEQ ID NO: 223406

SEQ ID NO: 517202 - RNA, 64 nt, Homo Sapiens; identical to SEQ ID NO: 223407

SEQ ID NO: 517203 - RNA, 64 nt, Homo Sapiens; identical to SEQ ID NO: 223408

SEQ ID NO: 517204 - RNA, 64 nt, Homo Sapiens; identical to SEQ ID NO: 223409

SEQ ID NO: 517205 - RNA, 64 nt, Homo Sapiens; identical to SEQ ID NO: 223410

SEQ ID NO: 517206 - RNA, 64 nt, Homo Sapiens; identical to SEQ ID NO: 223411

SEQ ID NO: 517207 - RNA, 64 nt, Homo Sapiens; identical to SEQ ID NO: 223412

SEQ ID NO: 517208 - RNA, 64 nt, Homo Sapiens; identical to SEQ ID NO: 223413

SEQ ID NO: 517209 - RNA, 64 nt, Homo Sapiens; identical to SEQ ID NO: 223414

SEQ ID NO: 517210 - RNA, 64 nt, Homo Sapiens; identical to SEQ ID NO: 223415

SEQ ID NO: 517211 - RNA, 64 nt, Homo Sapiens; identical to SEQ ID NO: 223416

SEQ ID NO: 517212 - RNA, 64 nt, Homo Sapiens; identical to SEQ ID NO: 223417

SEQ ID NO: 517213 - RNA, 64 nt, Homo Sapiens; identical to SEQ ID NO: 223418

SEQ ID NO: 517214 - RNA, 64 nt, Homo Sapiens; identical to SEQ ID NO: 223419

SEQ ID NO: 517215 - RNA, 64 nt, Homo Sapiens; identical to SEQ ID NO: 223420

SEQ ID NO: 517216 - RNA, 64 nt, Homo Sapiens; identical to SEQ ID NO: 223421

SEQ ID NO: 517217 - RNA, 64 nt, Homo Sapiens; identical to SEQ ID NO: 223422

SEQ ID NO: 517218 - RNA, 64 nt, Homo Sapiens; identical to SEQ ID NO: 223423

SEQ ID NO: 517219 - RNA, 64 nt, Homo Sapiens; identical to SEQ ID NO: 223424

SEQ ID NO: 517220 - RNA, 64 nt, Homo Sapiens; identical to SEQ ID NO: 223425

SEQ ID NO: 517221 - RNA, 64 nt, Homo Sapiens; identical to SEQ ID NO: 223426

SEQ ID NO: 517222 - RNA, 64 nt, Homo Sapiens; identical to SEQ ID NO: 223427

SEQ ID NO: 517223 - RNA, 64 nt, Homo Sapiens; identical to SEQ ID NO: 223428

SEQ ID NO: 517224 - RNA, 64 nt, Homo Sapiens; identical to SEQ ID NO: 223429

SEQ ID NO: 517225 - RNA, 64 nt, Homo Sapiens; identical to SEQ ID NO: 223430

SEQ ID NO: 517226 - RNA, 64 nt, Homo Sapiens; identical to SEQ ID NO: 223431

SEQ ID NO: 517227 - RNA, 64 nt, Homo Sapiens; identical to SEQ ID NO: 223432

SEQ ID NO: 517228 - RNA, 64 nt, Homo Sapiens; identical to SEQ ID NO: 223433

SEQ ID NO: 517229 - RNA, 64 nt, Homo Sapiens; identical to SEQ ID NO: 223434

SEQ ID NO: 517230 - RNA, 64 nt, Homo Sapiens; identical to SEQ ID NO: 223435

SEQ ID NO: 517231 - RNA, 64 nt, Homo Sapiens; identical to SEQ ID NO: 223436

SEQ ID NO: 517232 - RNA, 64 nt, Homo Sapiens; identical to SEQ ID NO: 223437

SEQ ID NO: 517233 - RNA, 64 nt, Homo Sapiens; identical to SEQ ID NO: 223438

SEQ ID NO: 517234 - RNA, 64 nt, Homo Sapiens; identical to SEQ ID NO: 223439

SEQ ID NO: 517235 - RNA, 64 nt, Homo Sapiens; identical to SEQ ID NO: 223440

SEQ ID NO: 517236 - RNA, 64 nt, Homo Sapiens; identical to SEQ ID NO: 223441

SEQ ID NO: 517237 - RNA, 64 nt, Homo Sapiens; identical to SEQ ID NO: 223442

SEQ ID NO: 517238 - RNA, 64 nt, Homo Sapiens; identical to SEQ ID NO: 223443

SEQ ID NO: 517239 - RNA, 64 nt, Homo Sapiens; identical to SEQ ID NO: 223444

SEQ ID NO: 517240 - RNA, 64 nt, Homo Sapiens; identical to SEQ ID NO: 223445

SEQ ID NO: 517241 - RNA, 64 nt, Homo Sapiens; identical to SEQ ID NO: 223446

SEQ ID NO: 517242 - RNA, 64 nt, Homo Sapiens; identical to SEQ ID NO: 223447

SEQ ID NO: 517243 - RNA, 64 nt, Homo Sapiens; identical to SEQ ID NO: 223448

SEQ ID NO: 517244 - RNA, 64 nt, Homo Sapiens; identical to SEQ ID NO: 223449

SEQ ID NO: 517245 - RNA, 64 nt, Homo Sapiens; identical to SEQ ID NO: 223450

SEQ ID NO: 517246 - RNA, 64 nt, Homo Sapiens; identical to SEQ ID NO: 223451

SEQ ID NO: 517247 - RNA, 64 nt, Homo Sapiens; identical to SEQ ID NO: 223452

SEQ ID NO: 517248 - RNA, 64 nt, Homo Sapiens; identical to SEQ ID NO: 223453

SEQ ID NO: 517249 - RNA, 64 nt, Homo Sapiens; identical to SEQ ID NO: 223454

SEQ ID NO: 517250 - RNA, 64 nt, Homo Sapiens; identical to SEQ ID NO: 223455

SEQ ID NO: 517251 - RNA, 64 nt, Homo Sapiens; identical to SEQ ID NO: 223456

SEQ ID NO: 517252 - RNA, 64 nt, Homo Sapiens; identical to SEQ ID NO: 223457

SEQ ID NO: 517253 - RNA, 64 nt, Homo Sapiens; identical to SEQ ID NO: 223458

SEQ ID NO: 517254 - RNA, 64 nt, Homo Sapiens; identical to SEQ ID NO: 332183

SEQ ID NO: 517255 - RNA, 64 nt, Homo Sapiens; identical to SEQ ID NO: 332184

SEQ ID NO: 517256 - RNA, 64 nt, Homo Sapiens; identical to SEQ ID NO: 332185

SEQ ID NO: 517257 - RNA, 64 nt, Homo Sapiens; identical to SEQ ID NO: 332186

SEQ ID NO: 517258 - RNA, 64 nt, Homo Sapiens; identical to SEQ ID NO: 332187

SEQ ID NO: 517259 - RNA, 64 nt, Homo Sapiens; identical to SEQ ID NO: 332188

SEQ ID NO: 517260 - RNA, 64 nt, Homo Sapiens; identical to SEQ ID NO: 332189

SEQ ID NO: 517261 - RNA, 64 nt, Homo Sapiens; identical to SEQ ID NO: 332190

SEQ ID NO: 517262 - RNA, 64 nt, Homo Sapiens; identical to SEQ ID NO: 332191

SEQ ID NO: 517263 - RNA, 64 nt, Homo Sapiens; identical to SEQ ID NO: 332192

SEQ ID NO: 517264 - RNA, 64 nt, Homo Sapiens; identical to SEQ ID NO: 332193

SEQ ID NO: 517265 - RNA, 64 nt, Homo Sapiens; identical to SEQ ID NO: 332194

SEQ ID NO: 517266 - RNA, 64 nt, Homo Sapiens
acuuggcagccuugaaguugcuggaggaggacacucccaucagaucgggggcugggagauguuc

SEQ ID NO: 517267 - RNA, 64 nt, Homo Sapiens
accuggcagccccaaaacuguuccuggaggacacucccaucagaccgcugggggccugaagaca

SEQ ID NO: 517268 - RNA, 64 nt, Homo Sapiens
agagagguuucucuaccauuuagacuuaagaugaucccaucaccguuguuauagucuucacuca

SEQ ID NO: 517269 - RNA, 64 nt, Homo Sapiens
aaaagcucugcugcucuuagacccuaauccauaaucccaucaagauugcaucuuggguccauaa

SEQ ID NO: 517270 - RNA, 64 nt, Homo Sapiens
cguuuaucuguuguuugagauauuuugcugccugucccaucagucuggagauaaccauaguugc

SEQ ID NO: 517271 - RNA, 64 nt, Homo Sapiens
ucuuagaauaucuaaacaucuguuagauauuaggucccaucaauuuagaauaucuaagaaucuu

SEQ ID NO: 517272 - RNA, 64 nt, Homo Sapiens
ucuuagaauaucuaagaaucaugcuucuaucaggucccaucaauuucuuaaugacauuucacug

SEQ ID NO: 517273 - RNA, 64 nt, Homo Sapiens
uaaucccaccuuuuggcccuaaauuguuuuuuguucccaucaguuucaggccaggacuggagag

SEQ ID NO: 517274 - RNA, 64 nt, Homo Sapiens
uuccuuccagucaggguguguccuauacaaaacuucccaucaguucuccucaauauuccccauu

SEQ ID NO: 517275 - RNA, 64 nt, Homo Sapiens
cgaauuaccaccugaacuccuauuuauggcuacuucccaucacuccauugaggagcuucaucug

SEQ ID NO: 517276 - RNA, 64 nt, Homo Sapiens
guuuuuugaagguccuccaaaaaacuggauuuccucccaucacuuuuuuuaaaucaagacuuuu

SEQ ID NO: 517277 - RNA, 64 nt, Homo Sapiens
aagcaguuacugaacauccaggaguacaacuccuucccaucauucccauguggaagggucucuc

SEQ ID NO: 517278 - RNA, 64 nt, Homo Sapiens
acuccuucccaucauucccauguggaagggucucucccaucaaggagaacauguggcaucucug

SEQ ID NO: 517279 - RNA, 64 nt, Homo Sapiens
cuacuggccaaguucaagugaguaagccgcgucccccaacuacagcuggagacggggccagcuc

SEQ ID NO: 517280 - RNA, 64 nt, Homo Sapiens
acgugcugacggcaaggggcaauggagugaguuucccaacuaagaaaccacuauuauauauuuu

SEQ ID NO: 517281 - RNA, 64 nt, Homo Sapiens
gaccagcacagaacugaggaacaucugcaggaggcccaacuagugaaaggcuuugccuccgggg

SEQ ID NO: 517282 - RNA, 64 nt, Homo Sapiens
auguggcagcccauggguaugacauaggccaaggcccaacuaacagucaagaaacagcuccucg

SEQ ID NO: 517283 - RNA, 64 nt, Homo Sapiens
uaucuuuuuaaucauaaucaacaucaguuuuugacccaacuaaccuugacuguauucaaacuua

SEQ ID NO: 517284 - RNA, 64 nt, Homo Sapiens
uuacuuauuguuuuuagaauuacuuuuacauuuucccaacuagauggccuagaguccaacauua

SEQ ID NO: 517285 - RNA, 64 nt, Homo Sapiens
aaauuagcugggcaugguggccugugccuauagucccaacuacuuagaggaggaucgcuugauc

SEQ ID NO: 517286 - RNA, 64 nt, Homo Sapiens
ugcauuuaaaaggaauaaccuccuucucccuuuccccaacuacaaaaauguuuggcaacuuugu

SEQ ID NO: 517287 - RNA, 64 nt, Homo Sapiens
aaauuagcuggacaugguggcaaucagcucuagucccaacuacuuggaggcugaagcaggaaga

SEQ ID NO: 517288 - RNA, 64 nt, Homo Sapiens
aggaaccucuguuuucaagaaacacuaccccacccccaacuaggagggaaguuuauaauagccu

SEQ ID NO: 517289 - RNA, 64 nt, Homo Sapiens
auucagucaguauguuuguuauacugcaaauagucccaacuaagacucucaaaaauaaucuuaa

SEQ ID NO: 517290 - RNA, 64 nt, Homo Sapiens
cuggagcccccgaaggauggcuucucugaucucccccaacuagagccuagaguggcaaauggaa

SEQ ID NO: 517291 - RNA, 64 nt, Homo Sapiens
agggacagugaggcagaaggcaugugccuguaaucccaacuacuaauuuagcugggcauggugg

SEQ ID NO: 517292 - RNA, 64 nt, Homo Sapiens
ugggacuacaggcacgugccuccugccucagucucccaacuaagccuccagggcucaaggaucc

SEQ ID NO: 517293 - RNA, 64 nt, Homo Sapiens
cugauuugaucuuuacaaauaaggugacagauaucccaacuacguaaagaaaagacgaauauuu

SEQ ID NO: 517294 - RNA, 64 nt, Homo Sapiens
uuuuguauuuuuaguagagacgugccuggccacgcccaacuaauggauuacaggcgugagccac

SEQ ID NO: 517295 - RNA, 64 nt, Homo Sapiens
uucuaagugccaucaaagcagugugauuucuguucccaacuaggagauuucuaaaauauucuau

SEQ ID NO: 517296 - RNA, 64 nt, Homo Sapiens
caugccaagggguuaaugaaaaaaugagaaaauccccaacuaugcauuuaaccccuugguacug

SEQ ID NO: 517297 - RNA, 64 nt, Homo Sapiens
gcauuucauuuaagauaaggcucauauaguauuacccaacuaguugguaaugugauuauguggu

SEQ ID NO: 517298 - RNA, 55 nt, Homo Sapiens; identical to SEQ ID NO: 130216

SEQ ID NO: 517299 - RNA, 64 nt, Homo Sapiens
uuuuuuaaaaaggaucacgucuaaugcccauuuucccaacuauucuuuccaaaguaagauauaa

SEQ ID NO: 517300 - RNA, 64 nt, Homo Sapiens
aaauuagcugggcaugguggcauauaccuguaaccccaacuacuuggguggcugaggcaggaga

SEQ ID NO: 517301 - RNA, 64 nt, Homo Sapiens
uuuuguguuuuuaauaaagagcaugugccacccacccaacuaauccugaguagcuggauuacag

SEQ ID NO: 517302 - RNA, 64 nt, Homo Sapiens
aaaaucuucuugcgucaaucagauugaccacauucccaacuagagguuuagaaagaggaacacc

SEQ ID NO: 517303 - RNA, 64 nt, Homo Sapiens
cagaaggccgaggcaggagacauaugccuguaaucccaacuacuaaauuagccaaguguggugg

SEQ ID NO: 517304 - RNA, 64 nt, Homo Sapiens
caaccccaccauggccaggacccggagcaacuuucccaacuacccagcuuuggaagcugucaau

SEQ ID NO: 517305 - RNA, 64 nt, Homo Sapiens
ggacacaggagcuccuccaggagcaggcugggaucccaacuaucgcuuguugccucuuuuucaa

SEQ ID NO: 517306 - RNA, 64 nt, Homo Sapiens
aaauuagccaggugugguggcgggcgccuguaaucccaacuacucaggaggcugaggcuagaga

SEQ ID NO: 517307 - RNA, 64 nt, Homo Sapiens
ccacccacaccuaagucacagaauuucuaaguuccccaacuacucucacacccuuuuaaagaua

SEQ ID NO: 517308 - RNA, 64 nt, Homo Sapiens
gccccugcacacucccacccaggacagcccccagcccaacuaggaaagggccaugggcagaggg

SEQ ID NO: 517309 - RNA, 64 nt, Homo Sapiens
aagagcaugguccuucagaaaaggcaauaaacggcccaacuagugcuucuggcgaugacauuuc

SEQ ID NO: 517310 - RNA, 64 nt, Homo Sapiens
ggggcagcagcgcccccacggggcucgcugggcgcccaacuacgacccgcucugcucacucugc

SEQ ID NO: 517311 - RNA, 64 nt, Homo Sapiens
guuugcaaccccaaaccacacuacaaaaaauugccccaacuacaggguccaggaccagaccucu

SEQ ID NO: 517312 - RNA, 64 nt, Homo Sapiens
ggguccuagcugggggccuguaucaugccacggucccaacuacacuggugggcccagguccuug

SEQ ID NO: 517313 - RNA, 64 nt, Homo Sapiens
cacuugauuauguauuucagaaaggcaucauccucccaacuaccuuucauuucagggcauaguc

SEQ ID NO: 517314 - RNA, 64 nt, Homo Sapiens
agccuagugugugugcuuucgagauuuuaauuagcccaacuagacaaccaccuuuccagccaua

SEQ ID NO: 517315 - RNA, 64 nt, Homo Sapiens
gucucgagugccugcaguggaccgggaagaaaggcccaacuaccgcugcaguucuacaggcuac

SEQ ID NO: 517316 - RNA, 64 nt, Homo Sapiens
uugaguauauauuuuaucucuuauaccuguaucucccaacuagaaacagcuccaguguuuuuaa

SEQ ID NO: 517317 - RNA, 64 nt, Homo Sapiens
uagugaugcccuucaccccagggaggugucuguucccaacuaguuuauguggcacugagacauc

SEQ ID NO: 517318 - RNA, 64 nt, Homo Sapiens
uaggguaucgcauacucaaaugguagacaaugaccccaacuaaaucuuccugauguuacacugc

SEQ ID NO: 517319 - RNA, 64 nt, Homo Sapiens
gcaaucauaaaacccuaguugcuuauggcaaugucccaacuauuacagccaaauagcuuauaag

SEQ ID NO: 517320 - RNA, 64 nt, Homo Sapiens
auuguagaguggucuauuucgggguguugaagaccccaacuacuugugauuaauuauugaaagu

SEQ ID NO: 517321 - RNA, 64 nt, Homo Sapiens
gcaugaagaaauucuacuucucucucuucuccuucccaacuacuaguuaggaagugauaaaaca

SEQ ID NO: 517322 - RNA, 64 nt, Homo Sapiens
auucucuucuccacacuuaaugaagauccaaauucccaacuaguguaacauuccuucaaccacu

SEQ ID NO: 517323 - RNA, 64 nt, Homo Sapiens
gucaucgugagguuuucaucgccauuuccagugucccaacuacucugcgccucuggacgugcua

SEQ ID NO: 517324 - RNA, 64 nt, Homo Sapiens
aaauuagcugggcgugguggcgcaugccuguagucccaacuacuagggaggcugaggcaggaga

SEQ ID NO: 517325 - RNA, 64 nt, Homo Sapiens
aauccagugaccucucucucugggacuugguuuccccaacuaaaauuugaaguaguugaauggg

SEQ ID NO: 517326 - RNA, 64 nt, Homo Sapiens
uuuuuuccuuuuagccaucuuuuguucuuguaaucccaacuagauaggcuuuaugcucacauca

SEQ ID NO: 517327 - RNA, 64 nt, Homo Sapiens
uuuauuuuuuauuuuuugcacaugcaccaccauacccaacuaaucaaguaacuaagacuacagg

SEQ ID NO: 517328 - RNA, 64 nt, Homo Sapiens
uaauagccaggggcuacaggcauauaccaccaugcccaacuaauuuuuuaauuuuuuguagaga

SEQ ID NO: 517329 - RNA, 64 nt, Homo Sapiens
caucacguugacauuagaccaaauacuuuugauucccaacuacucguuuguucuuuuucuccuu

SEQ ID NO: 517330 - RNA, 64 nt, Homo Sapiens
ugcauuuaguugaaugaagucuucuuggauuucacccaacuaaaaggauuuuuaaaaauaaaua

SEQ ID NO: 517331 - RNA, 64 nt, Homo Sapiens
aaauaagccaggugugguggugcaugacuguaaucccaacuacucagcaggagaagcacuugaa

SEQ ID NO: 517332 - RNA, 64 nt, Homo Sapiens
uuuuuuuuuuugagacggagucccacucuugucgcccaacuagaguguaguggcacaaucucgg

SEQ ID NO: 517333 - RNA, 64 nt, Homo Sapiens
cugugagcuccuccucugaggcagaguccauugccccaacuagauccuuaacugucccaucugu

SEQ ID NO: 517334 - RNA, 64 nt, Homo Sapiens
aaggauuugucccaggccaaaaauaguccguauccccaacuauucugccugguacugguggggg

SEQ ID NO: 517335 - RNA, 64 nt, Homo Sapiens
aaaaaaaaaauaaagaaaaaucucgauucucguacccaacuaaauggguuuuguucccccucca

SEQ ID NO: 517336 - RNA, 64 nt, Homo Sapiens
ucccaccaugaagagaaagcaaacaaacagaaaccccaacuaggucacaccauuuuucuucuug

SEQ ID NO: 517337 - RNA, 64 nt, Homo Sapiens
ucuccucuucuugaaggccaaccuggagcaguuccccaacuacaccccgccuccccucaucugc

SEQ ID NO: 517338 - RNA, 64 nt, Homo Sapiens
aaguaaaaaugaaaaagacgcaauuuaguuaccucccaacuaaauaugauaucaaaagaauaau

SEQ ID NO: 517339 - RNA, 64 nt, Homo Sapiens
guuacugguuauagaggucuauuccuucuuuucucccaacuacuucagaaaacucaguuucuuu

SEQ ID NO: 517340 - RNA, 64 nt, Homo Sapiens
ugaugugaaaaaggacuauggccacauucaaucgcccaacuacccagacgauuaccggcccagc

SEQ ID NO: 517341 - RNA, 64 nt, Homo Sapiens
ugagaagaaaacaucuauucucuccaaaaaugcacccaacuagcucuauguuuacaaauggaca

SEQ ID NO: 517342 - RNA, 64 nt, Homo Sapiens
ccaggaccccaaugcgacaaguccauuuugcaaacccaacuaaguauuaaaguuuguguguugu

SEQ ID NO: 517343 - RNA, 64 nt, Homo Sapiens
ucacacacgcccacaugacaaucaucugaaaguccccaacuauacacauucuguucaaccaacu

SEQ ID NO: 517344 - RNA, 64 nt, Homo Sapiens
auuugcauuaaauuacagaaauuuaauucagaaccccaacuacuguguuaugcaaaagcaagcu

SEQ ID NO: 517345 - RNA, 64 nt, Homo Sapiens
ugucucugaagacaaauaauuaaaccuuuuuuuucccaacuaaagaauggauuuaauuaaacua

SEQ ID NO: 517346 - RNA, 64 nt, Homo Sapiens
agccaggauugauggcagcugagggaaauucuugcccaacuaaacccagaacucaaacuuaaca

SEQ ID NO: 517347 - RNA, 64 nt, Homo Sapiens
ucagucacugugcuauccuuguggagucuuguggcccaacuaccagagaacgcugucccccgac

SEQ ID NO: 517348 - RNA, 64 nt, Homo Sapiens
cagccuagcacaggcuggcauggcagggcguggucccaacuacuugugacugauucccagccug

SEQ ID NO: 517349 - RNA, 64 nt, Homo Sapiens
gagaggagaaaauuaauaaaucuuaaacuuggugcccaacuauuguaagaaauauuuaauuaca

SEQ ID NO: 517350 - RNA, 64 nt, Homo Sapiens
cccuuagguagaaagauuugacuuauuccaagaacccaacuauguccgacuucuccuauguguc

SEQ ID NO: 517351 - RNA, 64 nt, Homo Sapiens
cggaaggcugaggcaggagaugcgugccuguagucccaacuacuaaauuagccaggcgugacgg

SEQ ID NO: 517352 - RNA, 64 nt, Homo Sapiens
gaauccaggaguaccaaauagaaacuuuuuuuaccccaacuacuuguagauauguuugaauaua

SEQ ID NO: 517353 - RNA, 64 nt, Homo Sapiens
cuggaagcugaagcagcaagcacaccuggccaaucccaacuacuaggauuacagcgugaucuac

SEQ ID NO: 517354 - RNA, 64 nt, Homo Sapiens
cccagcugugcuuaugguacuuggaaagcagucccccaacuaccgcuuucugaucaaggccuua

SEQ ID NO: 517355 - RNA, 64 nt, Homo Sapiens
uacugacccugccuugggccuugcugcugcugcacccaacuacugagcugagaccacugaguac

SEQ ID NO: 517356 - RNA, 64 nt, Homo Sapiens
caaguagcugggauuacaggcacccaccaccaugcccaacuaauuuuuguauuuuuauagagau

SEQ ID NO: 517357 - RNA, 64 nt, Homo Sapiens
caggccagccccaucuugguccugucacccuggccccaacuauuaaagugccauuuccugucug

SEQ ID NO: 517358 - RNA, 64 nt, Homo Sapiens
aacacuuaggacuagaagauuagaaacuaccaaucccaacuacguaauaggaaaauguaggauc

SEQ ID NO: 517359 - RNA, 64 nt, Homo Sapiens
uaccugcauuucccacaugacuuucuggaagccucccaacuauucuugcuuuucccagacagcu

SEQ ID NO: 517360 - RNA, 64 nt, Homo Sapiens
ccuggaaaucccugcccuguucagccccacagcucccaacuauuugguuccugcuccauggucg

SEQ ID NO: 517361 - RNA, 64 nt, Homo Sapiens
ccucagcugccuccccagcucuaucccaaccucucccaacuauaaaacuaggugcugcagcccc

SEQ ID NO: 517362 - RNA, 64 nt, Homo Sapiens
gaaaaagcuauuuucauugguacauuuaaagucccccaacuauggggagguaccaauucuggac

SEQ ID NO: 517363 - RNA, 64 nt, Homo Sapiens
uuggacuucucugcuuuaucuagagugagaauuccccaacuaaaaccucauccggggcuuugga

SEQ ID NO: 517364 - RNA, 62 nt, Homo Sapiens; identical to SEQ ID NO: 130282

SEQ ID NO: 517365 - RNA, 64 nt, Homo Sapiens
uaugcacuuucuugguugugcuuggaggggaaaacccaacuacaauguucuugcgcuuugugca

SEQ ID NO: 517366 - RNA, 64 nt, Homo Sapiens
aucagauauacaugucuagauguuacagcaaagccccaacuaaucuuuagaagcauauuggaac

SEQ ID NO: 517367 - RNA, 64 nt, Homo Sapiens
gauagcuuacauuuccucuuuuugccuuuaucuccccaacuaaaauacaauggggaagaagucu

SEQ ID NO: 517368 - RNA, 64 nt, Homo Sapiens
caccuccuccaccugcuucaaccugcucaagcugcccaacuacagcaagaagagcguccuccgc

SEQ ID NO: 517369 - RNA, 64 nt, Homo Sapiens
ggccucucaccucugugccucugucuccuuguugcccaacuacuaucucagagauauugugagg

SEQ ID NO: 517370 - RNA, 64 nt, Homo Sapiens
gcauagauuccccaaagugaaggcaagaauaugccccaacuaaacaaaugcagagaugaggcua

SEQ ID NO: 517371 - RNA, 64 nt, Homo Sapiens
cuguaagugccuugcggucauuugugucucccuucccaacuagagcaccauacuuucuuguaca

SEQ ID NO: 517372 - RNA, 64 nt, Homo Sapiens
ggaccgauuuggacuugucuaaccuugcuccuuccccaacuaggggcuagaaacucucagucca

SEQ ID NO: 517373 - RNA, 64 nt, Homo Sapiens
aauaaagaauaggcuauaagucguccuuuggcaucccaacuaacaacuuccaaaggucaauaug

SEQ ID NO: 517374 - RNA, 64 nt, Homo Sapiens
aauaaagaguaggcuauaagucauccuuuggcaucccaacuaacaacuucuaaaggucaauaua

SEQ ID NO: 517375 - RNA, 64 nt, Homo Sapiens
cccuaaugaagggccuggagaggccaaacagaaacccaacuaccccuauggggcccagggggaa

SEQ ID NO: 517376 - RNA, 64 nt, Homo Sapiens
ugggaggcugaggcgggagaugcacgcuuguagucccaacuaccaaauuauccuggcggaguua

SEQ ID NO: 517377 - RNA, 64 nt, Homo Sapiens
uuuauuaaaaugugugaaacucucugaaguuaaacccaacuaugaaguaaacacaauugaagcc

SEQ ID NO: 517378 - RNA, 64 nt, Homo Sapiens
cauugccgaguucuuauuuucaccuuuucauaaucccaacuacaauaacaagaauuuuauugac

SEQ ID NO: 517379 - RNA, 64 nt, Homo Sapiens
gugcuugaggcuaccucuacgcuuguuuaacaaacccaacuaaacuguaguuuccgcuuugcuu

SEQ ID NO: 517380 - RNA, 64 nt, Homo Sapiens
guguuucugguuacuaacaggccccuuacugaugcccaacuaaugggaaccauuccuuuauguu

SEQ ID NO: 517381 - RNA, 64 nt, Homo Sapiens
aaaauauauagagcauuuuauugaaacaaaaugucccaacuaaguaacauaaccaaaaauuaaa

SEQ ID NO: 517382 - RNA, 64 nt, Homo Sapiens
uguuaaguagcagagccagaauggacuucagaaucccaacuacaauacaaauguuuauuuaaau

SEQ ID NO: 517383 - RNA, 64 nt, Homo Sapiens
aaaaauuuaccuccuuugcaggccauaggacuagcccaacuaugagaaauagcuguucugugaa

SEQ ID NO: 517384 - RNA, 64 nt, Homo Sapiens
aaaaagccaggcauugguggugugugccuauagucccaacuacuagggaggcugaggugggagg

SEQ ID NO: 517385 - RNA, 64 nt, Homo Sapiens
ccuaauuugcuuuggugggguccuuaaaacauuucccaacuaaagaauagaauuguaaaggaaa

SEQ ID NO: 517386 - RNA, 64 nt, Homo Sapiens
caaccucuauccuggaaccuguccucccuuucuccccaacuaugcaucuguugucugcuccucu

SEQ ID NO: 517387 - RNA, 64 nt, Homo Sapiens
ugggacuacagguacaccacuucugccucagccucccaacuagccuccuggguucaagugauuc

SEQ ID NO: 517388 - RNA, 64 nt, Homo Sapiens
ugcuuguuggccacgggaagugauaucacugguucccaacuagaguauuuaguguguucaguga

SEQ ID NO: 517389 - RNA, 64 nt, Homo Sapiens
uugagaaguggaaaaaaaccaauguuuccauguucccaacuaugcugggaauuguguggguauu

SEQ ID NO: 517390 - RNA, 64 nt, Homo Sapiens
gaagagaggcuaacuagcaagcaagacaacauuacccaacuauagagagauggcaaacacagug

SEQ ID NO: 517391 - RNA, 64 nt, Homo Sapiens
ccaagugucucuugacuggcucaagaauuagggccccaacuacacacccccaagccacagggaa

SEQ ID NO: 517392 - RNA, 64 nt, Homo Sapiens
acgcuggcuccuucuagacauuucuugccacuuccccaacuagaccacuccuagugauuacuga

SEQ ID NO: 517393 - RNA, 64 nt, Homo Sapiens
cuucugugauaaaaugaauucaccacucugguuacccaacuacagaaccuccuuugaucaggcc

SEQ ID NO: 517394 - RNA, 64 nt, Homo Sapiens
cuuauugcuuuaaacaaguuugugcuuaaucugucccaacuaaaauggagcuuauaaacuuacu

SEQ ID NO: 517395 - RNA, 64 nt, Homo Sapiens
ugggaggcugaggcaggagacaaacgccuguaaucccaacuacuaaauuagccaggcauggugg

SEQ ID NO: 517396 - RNA, 64 nt, Homo Sapiens
guugggaucagccuccugucuuguggguaucugccccaacuacugacuuucccagcccuuuggu

SEQ ID NO: 517397 - RNA, 64 nt, Homo Sapiens
ccuauuggagacaauccuuugaucauaaauucuccccaacuauaaaucauuuuaugucuuuauc

SEQ ID NO: 517398 - RNA, 64 nt, Homo Sapiens
cgucuuuugcccaccccccuggcauucagcuggacccaacuaggccaucaugaguggcuucucc

SEQ ID NO: 517399 - RNA, 64 nt, Homo Sapiens
caaguagcugggacuacaggcacacgccaccacacccaacuaauuuuuguauuuuuaguagaga

SEQ ID NO: 517400 - RNA, 64 nt, Homo Sapiens
cugugacaaaugguugaaaaggagucaacauggccccaacuauagugccggaaccuuuucauca

SEQ ID NO: 517401 - RNA, 64 nt, Homo Sapiens
cggcaggcugaggcaguagaugcacaccuguagucccaacuauuaaauuagccagauguggugg

SEQ ID NO: 517402 - RNA, 64 nt, Homo Sapiens
gccuagaagagcuucugaggcaacaaaaagcuuccccaacuaaaagacuccgucacaacaacaa

SEQ ID NO: 517403 - RNA, 64 nt, Homo Sapiens
ccagacuguccugcucacccaagccuguagccuccccaacuacugcagccaagaaacucaccca

SEQ ID NO: 517404 - RNA, 64 nt, Homo Sapiens
cccaccccaaucccaccuucgacugagcccccuacccaacuaccauggaggaaaaaugacuaag

SEQ ID NO: 517405 - RNA, 64 nt, Homo Sapiens
gauaggaaggaaaaugaagaggccucaugacaggcccaacuaggcuuggcaggacauggaauuu

SEQ ID NO: 517406 - RNA, 64 nt, Homo Sapiens
accaaugaaaacaccauucccauuaaccucuucccccaacuaacccaggcccuggcucuguaac

SEQ ID NO: 517407 - RNA, 64 nt, Homo Sapiens
aggguguggcuuuuuuucucuccuuuuuaccaaccccaacuaaacugggaguaagacuuaguca

SEQ ID NO: 517408 - RNA, 64 nt, Homo Sapiens
gaaaucuugcagagguagcuccgaaaccaucuggcccaacuagccucaacugacagcugaggaa

SEQ ID NO: 517409 - RNA, 64 nt, Homo Sapiens
aaaguagccgggcgugguggugggcgccuguagucccaacuacucaggaggcugaggcaggaga

SEQ ID NO: 517410 - RNA, 64 nt, Homo Sapiens
ccacauccaccuccauccccaacccauccucauccccaacuacagccccaaacccagccccaga

SEQ ID NO: 517411 - RNA, 64 nt, Homo Sapiens
aucuuaaaggaagcaggggcuggaugccuuucaucccaacuauucucugugguaucaaaaagaa

SEQ ID NO: 517412 - RNA, 64 nt, Homo Sapiens
ggccugggacccccgcccagccugcccagggcuccccaacuauaggagcagccagcccucugcc

SEQ ID NO: 517413 - RNA, 64 nt, Homo Sapiens
uuuuauauuuuuaguagagacacaugccaccacgcccaacuaaucuaguagcuggcauuacagg

SEQ ID NO: 517414 - RNA, 64 nt, Homo Sapiens
cgggccugacccggccccuacuuccccaccuucccccaacuacccccuuuccccucuucccugu

SEQ ID NO: 517415 - RNA, 64 nt, Homo Sapiens
cccauaacuuucugcuucccggccccuaggaugacccaacuaccgcagugccacccacuccuug

SEQ ID NO: 517416 - RNA, 64 nt, Homo Sapiens
gguuauggucaaucccaaaagucaccacuccauucccaacuagacauuaccaaagugaccuacc

SEQ ID NO: 517417 - RNA, 64 nt, Homo Sapiens
ugaguagcugggauuacaggcaugcgccaccacgcccaacuaauuuuguauuuuuaguagagac

SEQ ID NO: 517418 - RNA, 64 nt, Homo Sapiens
uccugagucaggcgugguggugcgugcaucuagucccaacuauuugggaggcugaggcaggagg

SEQ ID NO: 517419 - RNA, 64 nt, Homo Sapiens
aucagggguguuucaugggaaggucuauaaaucacccaacuaagcugaucaccaccaacaucau

SEQ ID NO: 517420 - RNA, 64 nt, Homo Sapiens
uaucagauaagauucuuugauuuucccgugcucccccaacuaugcauauccucucuugccagcu

SEQ ID NO: 517421 - RNA, 64 nt, Homo Sapiens
caauggaacccuugauuuccuaccucaguguacacccaacuauugguuguaucaguuuguguau

SEQ ID NO: 517422 - RNA, 59 nt, Homo Sapiens; identical to SEQ ID NO: 130340

SEQ ID NO: 517423 - RNA, 64 nt, Homo Sapiens
uuuuguauuuuuaguagagaugcccgccaccacacccaacuaauccaguagcugggaccacagg

SEQ ID NO: 517424 - RNA, 64 nt, Homo Sapiens
ccaaucuggaacaaugucccuccucuuagaaugucccaacuaaagaccaguuaaaauauuaggg

SEQ ID NO: 517425 - RNA, 64 nt, Homo Sapiens
guuucuuugcuuuuuguuuucucaggcuuucccccccaacuaugaacaucacauuuuggugucu

SEQ ID NO: 517426 - RNA, 64 nt, Homo Sapiens
ugucugccaagaucuuucuuuugaauguuuugaacccaacuacuugucauagauguuugacugu

SEQ ID NO: 517427 - RNA, 64 nt, Homo Sapiens
cagcccaggguucccauuuggcuucuggcaguggcccaacuagccaagucugguguucccucau

SEQ ID NO: 517428 - RNA, 64 nt, Homo Sapiens
gcuggagggaugccacaccccucacagggcagcccccaacuacaucuucccugcuuacucucug

SEQ ID NO: 517429 - RNA, 64 nt, Homo Sapiens
cuugccagauuguggucuauguuugaucuguguccccaacuagacagggaguucucugaggaca

SEQ ID NO: 517430 - RNA, 64 nt, Homo Sapiens
uuagaugucagucucguuaccagcagccuuuugacccaacuacggcgcucuauauuuuaguaga

SEQ ID NO: 517431 - RNA, 64 nt, Homo Sapiens
gagcauguuuaaaucuuugcucaaaugaaaaaaucccaacuauuaauucacaaaacuucuugcu

SEQ ID NO: 517432 - RNA, 64 nt, Homo Sapiens
gcgcucuauauuuuaguagacagcagccuuuugacccaacuacauuagaugucaaucucguuac

SEQ ID NO: 517433 - RNA, 64 nt, Homo Sapiens
gugcucugucuuuuaguagacagcagacuuuugacccaacuacauuaggugucacucuuguuac

SEQ ID NO: 517434 - RNA, 64 nt, Homo Sapiens
uuuaccgaaccuaaaacccaacagccauuaagaucccaacuaauucugucucuuccugcuuuag

SEQ ID NO: 517435 - RNA, 64 nt, Homo Sapiens
acugugugguaacagaaagcuucuuaccaauuuccccaacuauguugcacaucagccucauuuu

SEQ ID NO: 517436 - RNA, 64 nt, Homo Sapiens; identical to SEQ ID NO: 43951

SEQ ID NO: 517437 - RNA, 64 nt, Homo Sapiens; identical to SEQ ID NO: 43952

SEQ ID NO: 517438 - RNA, 64 nt, Homo Sapiens; identical to SEQ ID NO: 43953

SEQ ID NO: 517439 - RNA, 64 nt, Homo Sapiens; identical to SEQ ID NO: 43954

SEQ ID NO: 517440 - RNA, 64 nt, Homo Sapiens; identical to SEQ ID NO: 43955

SEQ ID NO: 517441 - RNA, 64 nt, Homo Sapiens; identical to SEQ ID NO: 43956

SEQ ID NO: 517442 - RNA, 64 nt, Homo Sapiens; identical to SEQ ID NO: 43957

SEQ ID NO: 517443 - RNA, 64 nt, Homo Sapiens; identical to SEQ ID NO: 43958

SEQ ID NO: 517444 - RNA, 64 nt, Homo Sapiens; identical to SEQ ID NO: 43959

SEQ ID NO: 517445 - RNA, 64 nt, Homo Sapiens; identical to SEQ ID NO: 43960

SEQ ID NO: 517446 - RNA, 64 nt, Homo Sapiens; identical to SEQ ID NO: 43961

SEQ ID NO: 517447 - RNA, 64 nt, Homo Sapiens; identical to SEQ ID NO: 43962

SEQ ID NO: 517448 - RNA, 64 nt, Homo Sapiens; identical to SEQ ID NO: 43963

SEQ ID NO: 517449 - RNA, 64 nt, Homo Sapiens; identical to SEQ ID NO: 43964

SEQ ID NO: 517450 - RNA, 64 nt, Homo Sapiens; identical to SEQ ID NO: 43965

SEQ ID NO: 517451 - RNA, 64 nt, Homo Sapiens; identical to SEQ ID NO: 43966

SEQ ID NO: 517452 - RNA, 64 nt, Homo Sapiens; identical to SEQ ID NO: 43967

SEQ ID NO: 517453 - RNA, 64 nt, Homo Sapiens; identical to SEQ ID NO: 43968

SEQ ID NO: 517454 - RNA, 64 nt, Homo Sapiens; identical to SEQ ID NO: 43969

SEQ ID NO: 517455 - RNA, 64 nt, Homo Sapiens; identical to SEQ ID NO: 43970

SEQ ID NO: 517456 - RNA, 64 nt, Homo Sapiens; identical to SEQ ID NO: 43971

SEQ ID NO: 517457 - RNA, 64 nt, Homo Sapiens; identical to SEQ ID NO: 43972

SEQ ID NO: 517458 - RNA, 64 nt, Homo Sapiens; identical to SEQ ID NO: 43973

SEQ ID NO: 517459 - RNA, 64 nt, Homo Sapiens; identical to SEQ ID NO: 43974

SEQ ID NO: 517460 - RNA, 64 nt, Homo Sapiens; identical to SEQ ID NO: 43975

SEQ ID NO: 517461 - RNA, 64 nt, Homo Sapiens; identical to SEQ ID NO: 43976

SEQ ID NO: 517462 - RNA, 64 nt, Homo Sapiens; identical to SEQ ID NO: 43977

SEQ ID NO: 517463 - RNA, 64 nt, Homo Sapiens; identical to SEQ ID NO: 43978

SEQ ID NO: 517464 - RNA, 64 nt, Homo Sapiens; identical to SEQ ID NO: 43979

SEQ ID NO: 517465 - RNA, 64 nt, Homo Sapiens; identical to SEQ ID NO: 43980

SEQ ID NO: 517466 - RNA, 64 nt, Homo Sapiens; identical to SEQ ID NO: 43981

SEQ ID NO: 517467 - RNA, 64 nt, Homo Sapiens; identical to SEQ ID NO: 43982

SEQ ID NO: 517468 - RNA, 64 nt, Homo Sapiens; identical to SEQ ID NO: 43983

SEQ ID NO: 517469 - RNA, 64 nt, Homo Sapiens; identical to SEQ ID NO: 43984

SEQ ID NO: 517470 - RNA, 64 nt, Homo Sapiens; identical to SEQ ID NO: 43985

SEQ ID NO: 517471 - RNA, 64 nt, Homo Sapiens; identical to SEQ ID NO: 43986

SEQ ID NO: 517472 - RNA, 64 nt, Homo Sapiens; identical to SEQ ID NO: 43987

SEQ ID NO: 517473 - RNA, 64 nt, Homo Sapiens; identical to SEQ ID NO: 43988

SEQ ID NO: 517474 - RNA, 64 nt, Homo Sapiens; identical to SEQ ID NO: 43951

SEQ ID NO: 517475 - RNA, 64 nt, Homo Sapiens; identical to SEQ ID NO: 43952

SEQ ID NO: 517476 - RNA, 64 nt, Homo Sapiens; identical to SEQ ID NO: 43953

SEQ ID NO: 517477 - RNA, 64 nt, Homo Sapiens; identical to SEQ ID NO: 43954

SEQ ID NO: 517478 - RNA, 64 nt, Homo Sapiens; identical to SEQ ID NO: 43955

SEQ ID NO: 517479 - RNA, 64 nt, Homo Sapiens; identical to SEQ ID NO: 43956

SEQ ID NO: 517480 - RNA, 64 nt, Homo Sapiens; identical to SEQ ID NO: 43957

SEQ ID NO: 517481 - RNA, 64 nt, Homo Sapiens; identical to SEQ ID NO: 43958

SEQ ID NO: 517482 - RNA, 64 nt, Homo Sapiens; identical to SEQ ID NO: 43959

SEQ ID NO: 517483 - RNA, 64 nt, Homo Sapiens; identical to SEQ ID NO: 43960

SEQ ID NO: 517484 - RNA, 64 nt, Homo Sapiens; identical to SEQ ID NO: 43961

SEQ ID NO: 517485 - RNA, 64 nt, Homo Sapiens; identical to SEQ ID NO: 43962

SEQ ID NO: 517486 - RNA, 64 nt, Homo Sapiens; identical to SEQ ID NO: 43963

SEQ ID NO: 517487 - RNA, 64 nt, Homo Sapiens; identical to SEQ ID NO: 43964

SEQ ID NO: 517488 - RNA, 64 nt, Homo Sapiens; identical to SEQ ID NO: 43965

SEQ ID NO: 517489 - RNA, 64 nt, Homo Sapiens; identical to SEQ ID NO: 43966

SEQ ID NO: 517490 - RNA, 64 nt, Homo Sapiens; identical to SEQ ID NO: 43967

SEQ ID NO: 517491 - RNA, 64 nt, Homo Sapiens; identical to SEQ ID NO: 43968

SEQ ID NO: 517492 - RNA, 64 nt, Homo Sapiens; identical to SEQ ID NO: 43969

SEQ ID NO: 517493 - RNA, 64 nt, Homo Sapiens; identical to SEQ ID NO: 43970

SEQ ID NO: 517494 - RNA, 64 nt, Homo Sapiens; identical to SEQ ID NO: 43971

SEQ ID NO: 517495 - RNA, 64 nt, Homo Sapiens; identical to SEQ ID NO: 43972

SEQ ID NO: 517496 - RNA, 64 nt, Homo Sapiens; identical to SEQ ID NO: 43973

SEQ ID NO: 517497 - RNA, 64 nt, Homo Sapiens; identical to SEQ ID NO: 43974

SEQ ID NO: 517498 - RNA, 64 nt, Homo Sapiens; identical to SEQ ID NO: 43975

SEQ ID NO: 517499 - RNA, 64 nt, Homo Sapiens; identical to SEQ ID NO: 43976

SEQ ID NO: 517500 - RNA, 64 nt, Homo Sapiens; identical to SEQ ID NO: 43977

SEQ ID NO: 517501 - RNA, 64 nt, Homo Sapiens; identical to SEQ ID NO: 43978

SEQ ID NO: 517502 - RNA, 64 nt, Homo Sapiens; identical to SEQ ID NO: 43979

SEQ ID NO: 517503 - RNA, 64 nt, Homo Sapiens; identical to SEQ ID NO: 43980

SEQ ID NO: 517504 - RNA, 64 nt, Homo Sapiens; identical to SEQ ID NO: 43981

SEQ ID NO: 517505 - RNA, 64 nt, Homo Sapiens; identical to SEQ ID NO: 43982

SEQ ID NO: 517506 - RNA, 64 nt, Homo Sapiens; identical to SEQ ID NO: 43983

SEQ ID NO: 517507 - RNA, 64 nt, Homo Sapiens; identical to SEQ ID NO: 43984

SEQ ID NO: 517508 - RNA, 64 nt, Homo Sapiens; identical to SEQ ID NO: 43985

SEQ ID NO: 517509 - RNA, 64 nt, Homo Sapiens; identical to SEQ ID NO: 43986

SEQ ID NO: 517510 - RNA, 64 nt, Homo Sapiens; identical to SEQ ID NO: 43987

SEQ ID NO: 517511 - RNA, 64 nt, Homo Sapiens; identical to SEQ ID NO: 43988

SEQ ID NO: 517512 - RNA, 64 nt, Homo Sapiens; identical to SEQ ID NO: 194676

SEQ ID NO: 517513 - RNA, 64 nt, Homo Sapiens; identical to SEQ ID NO: 194677

SEQ ID NO: 517514 - RNA, 64 nt, Homo Sapiens; identical to SEQ ID NO: 194678

SEQ ID NO: 517515 - RNA, 64 nt, Homo Sapiens; identical to SEQ ID NO: 194679

SEQ ID NO: 517516 - RNA, 64 nt, Homo Sapiens; identical to SEQ ID NO: 194680

SEQ ID NO: 517517 - RNA, 64 nt, Homo Sapiens; identical to SEQ ID NO: 194681

SEQ ID NO: 517518 - RNA, 64 nt, Homo Sapiens; identical to SEQ ID NO: 194682

SEQ ID NO: 517519 - RNA, 64 nt, Homo Sapiens; identical to SEQ ID NO: 194683

SEQ ID NO: 517520 - RNA, 64 nt, Homo Sapiens; identical to SEQ ID NO: 194684

SEQ ID NO: 517521 - RNA, 64 nt, Homo Sapiens; identical to SEQ ID NO: 194685

SEQ ID NO: 517522 - RNA, 64 nt, Homo Sapiens; identical to SEQ ID NO: 194686

SEQ ID NO: 517523 - RNA, 64 nt, Homo Sapiens; identical to SEQ ID NO: 194687

SEQ ID NO: 517524 - RNA, 64 nt, Homo Sapiens; identical to SEQ ID NO: 194688

SEQ ID NO: 517525 - RNA, 64 nt, Homo Sapiens; identical to SEQ ID NO: 194689

SEQ ID NO: 517526 - RNA, 64 nt, Homo Sapiens; identical to SEQ ID NO: 194690

SEQ ID NO: 517527 - RNA, 64 nt, Homo Sapiens; identical to SEQ ID NO: 194691

SEQ ID NO: 517528 - RNA, 64 nt, Homo Sapiens; identical to SEQ ID NO: 194692

SEQ ID NO: 517529 - RNA, 64 nt, Homo Sapiens; identical to SEQ ID NO: 194693

SEQ ID NO: 517530 - RNA, 64 nt, Homo Sapiens; identical to SEQ ID NO: 194694

SEQ ID NO: 517531 - RNA, 64 nt, Homo Sapiens; identical to SEQ ID NO: 194695

SEQ ID NO: 517532 - RNA, 64 nt, Homo Sapiens; identical to SEQ ID NO: 194696

SEQ ID NO: 517533 - RNA, 64 nt, Homo Sapiens; identical to SEQ ID NO: 194697

SEQ ID NO: 517534 - RNA, 64 nt, Homo Sapiens; identical to SEQ ID NO: 194698

SEQ ID NO: 517535 - RNA, 64 nt, Homo Sapiens; identical to SEQ ID NO: 194699

SEQ ID NO: 517536 - RNA, 64 nt, Homo Sapiens; identical to SEQ ID NO: 194700

SEQ ID NO: 517537 - RNA, 64 nt, Homo Sapiens; identical to SEQ ID NO: 194701

SEQ ID NO: 517538 - RNA, 64 nt, Homo Sapiens; identical to SEQ ID NO: 194702

SEQ ID NO: 517539 - RNA, 64 nt, Homo Sapiens; identical to SEQ ID NO: 194703

SEQ ID NO: 517540 - RNA, 64 nt, Homo Sapiens; identical to SEQ ID NO: 194704

SEQ ID NO: 517541 - RNA, 64 nt, Homo Sapiens; identical to SEQ ID NO: 194705

SEQ ID NO: 517542 - RNA, 60 nt, Homo Sapiens; identical to SEQ ID NO: 194706

SEQ ID NO: 517543 - RNA, 64 nt, Homo Sapiens; identical to SEQ ID NO: 194707

SEQ ID NO: 517544 - RNA, 64 nt, Homo Sapiens; identical to SEQ ID NO: 194708

SEQ ID NO: 517545 - RNA, 64 nt, Homo Sapiens; identical to SEQ ID NO: 194709

SEQ ID NO: 517546 - RNA, 64 nt, Homo Sapiens; identical to SEQ ID NO: 194710

SEQ ID NO: 517547 - RNA, 64 nt, Homo Sapiens; identical to SEQ ID NO: 194711

SEQ ID NO: 517548 - RNA, 64 nt, Homo Sapiens; identical to SEQ ID NO: 194712

SEQ ID NO: 517549 - RNA, 64 nt, Homo Sapiens; identical to SEQ ID NO: 194713

SEQ ID NO: 517550 - RNA, 64 nt, Homo Sapiens; identical to SEQ ID NO: 194714

SEQ ID NO: 517551 - RNA, 64 nt, Homo Sapiens
aaaaauguuuauugucuucaguacaaaaaguuaaaaccaugauuggauucauaaugcacuuguc

SEQ ID NO: 517552 - RNA, 64 nt, Homo Sapiens
cuuuucucaguacaacagccauagugauucuguuaaccaugaauuugauugugucacuucccug

SEQ ID NO: 517553 - RNA, 64 nt, Homo Sapiens
gauaguuuaggaugacuacagagauuuuuggagaaaccaugacguccuucagauaauucaugug

SEQ ID NO: 517554 - RNA, 64 nt, Homo Sapiens
uacuuuuuuuauuugcuaaauuuuauuauacaaaaaccaugaaguaaaaugucacuuuuuuggu

SEQ ID NO: 517555 - RNA, 64 nt, Homo Sapiens
cucuggcuguuugccugaaguucacagaacacacaaccaugaaaggcuuuuugaggugagaggc

SEQ ID NO: 517556 - RNA, 64 nt, Homo Sapiens
aagacaguuauuguuggaagacugucauguagauaaccaugagcaauggcucgccucagaauca

SEQ ID NO: 517557 - RNA, 64 nt, Homo Sapiens
ugugaccuaagaacaaaacuguaacugcauuagaaaccaugaaaaaauuagauauuguuuugug

SEQ ID NO: 517558 - RNA, 64 nt, Homo Sapiens
uuguuuugugacuuuuagacagugguaaauauagaaccaugaauucuggucacauuccauuucu

SEQ ID NO: 517559 - RNA, 64 nt, Homo Sapiens
gaucugcaacaacccugaagacaacaaggaaagaaaccaugaaagucugucuguacugcagugg

SEQ ID NO: 517560 - RNA, 64 nt, Homo Sapiens
gcagggauucuuaaccuggauagaagccagggguaaccaugaacuugauggaagaaaauguuac

SEQ ID NO: 517561 - RNA, 64 nt, Homo Sapiens
cccaaauggagacacucgcagaccugcaguucucagaccgaaggugcugccuucauccucccca

SEQ ID NO: 517562 - RNA, 64 nt, Homo Sapiens
cauccaaaaccuguuuagcuaagcuagaugcaguagaccgaaacuaccaggcuguagauuugau

SEQ ID NO: 517563 - RNA, 64 nt, Homo Sapiens
uacuacacacuuuaaaccaacugugcagguucauagaccgaagaagaguuuaugacuaaauagu

SEQ ID NO: 517564 - RNA, 64 nt, Homo Sapiens
gcuggacucuuguuucuccuugcacagaacacuaagaccgaaagauuuuguuggguuuuaaaau

SEQ ID NO: 517565 - RNA, 64 nt, Homo Sapiens
agguuuggccuuccauuuuuacugagauuuggcgagaccgaauggaagcguccgcacaguaacu

SEQ ID NO: 517566 - RNA, 64 nt, Homo Sapiens
ccauacacauccccagccagaaguuaguguccgaagaccgaauuuuauuuuacagagcuugaaa

SEQ ID NO: 517567 - RNA, 64 nt, Homo Sapiens
cuuacgcucgugagcgugagaagccauaagagagagaccgaauucuguggcucagcacacagga

SEQ ID NO: 517568 - RNA, 64 nt, Homo Sapiens
uggcaucuuacucuuggcacaaacacuugcuuacagaccgaaacugaccuucccucacccccag

SEQ ID NO: 517569 - RNA, 64 nt, Homo Sapiens
gacaaucuugacaccaauuuuaagaauagcugugagaccgaauuaaagauaaucccuaccaagu

SEQ ID NO: 517570 - RNA, 64 nt, Homo Sapiens
acaauuuagaaucacuuuuccucacaguuagaaaagaccgaaucguuacguacccaguaucaca

SEQ ID NO: 517571 - RNA, 61 nt, Homo Sapiens
auguauuaaugcuguggcuagacuguuaagaagaccgaagccuucuauuaggaaagaguaa

SEQ ID NO: 517572 - RNA, 64 nt, Homo Sapiens
caggggaagaagcaucuucaagcaagggugccuuagaccgaagcaguccacuaucugccagagg

SEQ ID NO: 517573 - RNA, 64 nt, Homo Sapiens
guggccgccacagagaguguuaccaccagcacccagaccgaacccccaccggccaaauguggug

SEQ ID NO: 517574 - RNA, 64 nt, Homo Sapiens
ucuccuacaagucccacugaauuggaguuucaggagaccgaagcccaggcacauguauuuugca

SEQ ID NO: 517575 - RNA, 64 nt, Homo Sapiens
ccucccugggaagauucuuggcugacagguggggagaccgaaucaaucuaggauucucucccug

SEQ ID NO: 517576 - RNA, 59 nt, Homo Sapiens
cugcagaaauuauggccuaacuuccugagagaccgaacccccucaccugaaucccccuc

SEQ ID NO: 517577 - RNA, 64 nt, Homo Sapiens
agcuaugaggccucacugggggcagaacuuggggagaccgaagccggcccuuccacuccccuaa

SEQ ID NO: 517578 - RNA, 64 nt, Homo Sapiens
guuuuagagaggcaagacaaguuugcauuagggaagaccgaaaacuaaauuuuguuuuauuuca

SEQ ID NO: 517579 - RNA, 64 nt, Homo Sapiens
gguugcugagaaacuugucugugucugggccaccagaccgaaauagucaguucuaaucccaugu

SEQ ID NO: 517580 - RNA, 64 nt, Homo Sapiens
ucacucuguugcccaggcuguuguuuuguuuuugagaccgaaucaacaaauuuuuuucuuguuu

SEQ ID NO: 517581 - RNA, 64 nt, Homo Sapiens
cugggaugccugucuugaguggagguggauuuggagaccgaagagcaguguggggggacagaca

SEQ ID NO: 517582 - RNA, 64 nt, Homo Sapiens
cucucucucaaaaaaaaaaaaaaaaaaaaauucuagaccgaaguguacggcagugccaucuggu

SEQ ID NO: 517583 - RNA, 64 nt, Homo Sapiens
ucagaugaguuaaguggucucuuuauaaagagaaagaccgaagcuguugugguauaauuuugcu

SEQ ID NO: 517584 - RNA, 64 nt, Homo Sapiens
ccuggacucagcucacugcccucugccacuucccagaccgaaagucuuuggccauugucucagc

SEQ ID NO: 517585 - RNA, 64 nt, Homo Sapiens
ccaggugcucacgccguaaugccaacacuuugguagaccgaagugggcagaucaccugagguca

SEQ ID NO: 517586 - RNA, 64 nt, Homo Sapiens
agggcggcccaggccccacgcuagaaggcuggcgagaccgaaggcagcaugugaggccucuccu

SEQ ID NO: 517587 - RNA, 64 nt, Homo Sapiens
agaaaagauguagauuuauuucaucauauuauacagaccgaacuguuguauaaauuuauuuacu

SEQ ID NO: 517588 - RNA, 64 nt, Homo Sapiens
ccuugcauggugccccuuccugcauaggacuggaagaccgaaguuuuuuuauggccauauuuuc

SEQ ID NO: 517589 - RNA, 64 nt, Homo Sapiens
ugcauguagcaguuguugggcgaaugguguuuaaagaccgaaaaugaauuguaauuuucuuuuc

SEQ ID NO: 517590 - RNA, 64 nt, Homo Sapiens
ucugaagaguaauaccaaauaaaguuucuuuuguagaccgaacuuggcuuuagcagauguuuuu

SEQ ID NO: 517591 - RNA, 64 nt, Homo Sapiens
ggagaucuuguagccuagauuuuuuuuuaauggcagaccgaaguaaagaagagaaagauuuuuu

SEQ ID NO: 517592 - RNA, 64 nt, Homo Sapiens
uguguagaauuguguucgggaggugggggaucugagaccgaaguggacagugguuaagauugug

SEQ ID NO: 517593 - RNA, 64 nt, Homo Sapiens
ucgaggaacagaugugugugggauggaugaacagagaccgaacgccggacuuucauuuugagga

SEQ ID NO: 517594 - RNA, 64 nt, Homo Sapiens
cuugugcauaaggauuuuuugaagaggggcugguagaccgaagcaggucgucacugggguggga

SEQ ID NO: 517595 - RNA, 64 nt, Homo Sapiens
ucaaaguaaaauccuaguuggcaggauuguaaguagaccgaauucuaauuuuucccaacacaua

SEQ ID NO: 517596 - RNA, 64 nt, Homo Sapiens
gauuaggucacauuacauuaacauuuaggaacccagaccgaaaaguugcugaaagggaaggaga

SEQ ID NO: 517597 - RNA, 64 nt, Homo Sapiens
ucuccugcuuucacugcgguaucacccagucuggagaccgaaaguggagaccugccgccggcuc

SEQ ID NO: 517598 - RNA, 64 nt, Homo Sapiens
guugaaugauuuauuguuacaacaaacuuccugaagaccgaaaacuucugaaauuaauccuuaa

SEQ ID NO: 517599 - RNA, 64 nt, Homo Sapiens
gagauggucugaguuugucucggauuauuuuuucagaccgaaaacuccagguuuuucaauuaaa

SEQ ID NO: 517600 - RNA, 64 nt, Homo Sapiens
aguugaauggggcggcaauugcggggcccaccuuagaccgaaggggaaaacccgcucucucagg

SEQ ID NO: 517601 - RNA, 64 nt, Homo Sapiens
uaauauggaaaaccuaccaggugauugcaaugugagaccgaauggugugccacccuguguuccu

SEQ ID NO: 517602 - RNA, 64 nt, Homo Sapiens
ggguguagccucccgcugauggggggagccauccagaccgaacagcgcccuccacggccgaguc

SEQ ID NO: 517603 - RNA, 64 nt, Homo Sapiens
ugguggcucaugccuguaaucccugcaauuugggagaccgaaugagaaggauugcuugagccca

SEQ ID NO: 517604 - RNA, 64 nt, Homo Sapiens
uuggcuacuguaaagcaguucgggaaaacgaccgagaccgaagaaucuucuucagaggaucacc

SEQ ID NO: 517605 - RNA, 64 nt, Homo Sapiens
gugaaaagcuuucaguggagaccucuuucuuugcagaccgaacaaguggagcaggggcaggcga

SEQ ID NO: 517606 - RNA, 64 nt, Homo Sapiens
gagccuggggaagaaggggguuugaagcccaccaagaccgaaacuggagaagggcuggaccugg

SEQ ID NO: 517607 - RNA, 64 nt, Homo Sapiens
cuuagggucuaaguuguucuggaaaaggaaacugagaccgaaaagugaauaaagaucuaucaaa

SEQ ID NO: 517608 - RNA, 64 nt, Homo Sapiens
ccgcagaaccugccugugucugccugcuuuuaggagaccgaagugagcaucaggccgccacaag

SEQ ID NO: 517609 - RNA, 64 nt, Homo Sapiens
ugucuguuugucagugucugccucauugguugucagaccgaaggguuguaagccagguucaguu

SEQ ID NO: 517610 - RNA, 64 nt, Homo Sapiens
aaaauucuuguauacauuggaguggccacagcgcagaccgaagcuucuuggcuccccuguucaa

SEQ ID NO: 517611 - RNA, 64 nt, Homo Sapiens
ugcagauuccacagucuuaacucagauugaaaagagaccgaaugccugacuuaacaucucuaaa

SEQ ID NO: 517612 - RNA, 64 nt, Homo Sapiens
cacaaauaaauaaugacugucauacauccagaggagaccgaaccugcccagcugauguacuguu

SEQ ID NO: 517613 - RNA, 64 nt, Homo Sapiens
gcaauaaggaacccauccuaguugauuuuaagacagaccgaaaagguaacaaguucuuuuuugg

SEQ ID NO: 517614 - RNA, 64 nt, Homo Sapiens
agaaaguucuggaaugaugaagcuguucaugccaagaccgaaagugcuggcccaguaugagucc

SEQ ID NO: 517615 - RNA, 64 nt, Homo Sapiens
guguuugguuuaaaaagaaggaugcgggauccugagaccgaaggcacugugggucuucccgugg

SEQ ID NO: 517616 - RNA, 64 nt, Homo Sapiens
gcuaaauuuggcuauaaaaauaaaauugaucugagcaccauauaaaauggaauccuggaggguc

SEQ ID NO: 517617 - RNA, 64 nt, Homo Sapiens
cagcauagaaguaacuuacuuaggugugggggaagcaccauaacuuuguuuagcccaaaaccaa

SEQ ID NO: 517618 - RNA, 64 nt, Homo Sapiens
uagaccccuccucccauggcuagaaguggggccugcaccauacaucuguguccgcccccucuac

SEQ ID NO: 517619 - RNA, 64 nt, Homo Sapiens
auuccugaucccauggccaggugguugucuuauugcaccauacuccuugcuuccugaugcuggg

SEQ ID NO: 517620 - RNA, 64 nt, Homo Sapiens
uuauaagcugagaccgguggcucucuucuuaaaagcaccauauuaaaacuuggaaaacuaacug

SEQ ID NO: 517621 - RNA, 64 nt, Homo Sapiens
cgccacacccuucggggggguuuccacccacacugcaccauaacccauuggccuccccaggggc

SEQ ID NO: 517622 - RNA, 64 nt, Homo Sapiens
cuaagcccggggcauaaaacaaggcuacccugacgcaccauaauagcucugugcugaagggugg

SEQ ID NO: 517623 - RNA, 64 nt, Homo Sapiens
accauugucuccacucgccaaccuuugaccaugagcaccauagcugguagacuuuggcagugcc

SEQ ID NO: 517624 - RNA, 64 nt, Homo Sapiens
gggaagauuaguccagugauuacauaagaguugggcaccauaaauucucuauauuuugccuccc

SEQ ID NO: 517625 - RNA, 64 nt, Homo Sapiens
gaaucuuuuugaugucgauguucaacuauuuuuggcaccauaguagaacaugguugcuuucuau

SEQ ID NO: 517626 - RNA, 64 nt, Homo Sapiens
ucacuuugaaacaggccucaucccacuuccaccagcaccauagaagaauaauucugggcagaag

SEQ ID NO: 517627 - RNA, 64 nt, Homo Sapiens
ugauugccacgaugugauugcaauacucuuagaagcaccauauuaucccagacauguucuuuca

SEQ ID NO: 517628 - RNA, 64 nt, Homo Sapiens
uuuccgcuuucaugggacauugccugcauggugugcaccauaggauucauuucuugcuuaugag

SEQ ID NO: 517629 - RNA, 64 nt, Homo Sapiens
gucuuaggggcuugguaguuuggaaaguucuuaggcaccauagaagaacagcagauggcgguga

SEQ ID NO: 517630 - RNA, 64 nt, Homo Sapiens
augugcccccagaugucagaaugaggcgacuagggcaccauacucacuuuccagggcuggggga

SEQ ID NO: 517631 - RNA, 64 nt, Homo Sapiens
gccuagcaguuuaaaccccacuuuccuccacuuagcaccauaggcaagggggcagaucccagag

SEQ ID NO: 517632 - RNA, 64 nt, Homo Sapiens
uguuacugcuguuugcuuuuacuuacuuucaguagcaccauaacgaaguagcuuuaagugaaac

SEQ ID NO: 517633 - RNA, 64 nt, Homo Sapiens
cugcggcuccccuauucagguaggaguggccucugcaccauagccuucuggagacuccggcccc

SEQ ID NO: 517634 - RNA, 64 nt, Homo Sapiens
caacaagaaccaccauucaccugaagugucacuggcaccauaugcuggccaagcugaugaccuu

SEQ ID NO: 517635 - RNA, 64 nt, Homo Sapiens
acugcagcaagaccaaagugauguaccuacuagggcaccauaaucugaaacuagcuaaaccuga

SEQ ID NO: 517636 - RNA, 64 nt, Homo Sapiens
ugacguguguauaguaaaugcaggcccucuggcagcaccauaauuggucgguuacccugagccc

SEQ ID NO: 517637 - RNA, 64 nt, Homo Sapiens
uauugggggaaguuauucaaaagcaggcuuuugagcaccauagucuaaaugccaauaaaaauaa

SEQ ID NO: 517638 - RNA, 64 nt, Homo Sapiens
cacaucucauugaauuugaugguugacuuaauuggcaccauaacuuuguaugauauuauacauu

SEQ ID NO: 517639 - RNA, 64 nt, Homo Sapiens
aaaaccaaguaucacacuuuaauguacaugggccgcaccauaaugagaugugagccuugugcau

SEQ ID NO: 517640 - RNA, 64 nt, Homo Sapiens
ggagaccaaauucuauccugugaggcuuuuaauugcaccauaguaugcucugaguagcuuuaca

SEQ ID NO: 517641 - RNA, 64 nt, Homo Sapiens
uggugagaggaaucguugcugcccccuuccccuagcaccauauaugagucucaaguuuuauuau

SEQ ID NO: 517642 - RNA, 64 nt, Homo Sapiens
uguuuuuagacucauauaauagccuugacaaacugcaccauaggacagcgaaucuuaaccuaac

SEQ ID NO: 517643 - RNA, 64 nt, Homo Sapiens
ggcagcuagaaaugggagggaagcuucuggguaggcaccauaguaggggaaugucuaaagaccc

SEQ ID NO: 517644 - RNA, 64 nt, Homo Sapiens
aaggaagaaugaaauuaaaaggagacuuucuuaagcaccauauagauaggguuauguauaaaag

SEQ ID NO: 517645 - RNA, 64 nt, Homo Sapiens
uuagaucuuguauaaaaagucuaccucuuaauaagcaccauauuaaaugcuguuuuaguauuuu

SEQ ID NO: 517646 - RNA, 64 nt, Homo Sapiens
cuuauggccaacagguggucgggagagaucgcuggcaccauagcaccuggccagcucuguuagu

SEQ ID NO: 517647 - RNA, 64 nt, Homo Sapiens
cccacacaaggagccugcacgccauccccugcuggcaccauagaccauggggucugggagagca

SEQ ID NO: 517648 - RNA, 64 nt, Homo Sapiens
uauauauagcuuaaaauauaauuuuuagcauuuggcaccauauguaugccauuauauuugauuu

SEQ ID NO: 517649 - RNA, 64 nt, Homo Sapiens
uuauuucuucccagaaucucgccauguaguuggggcaccauacaauuaagguuaugcacugccu

SEQ ID NO: 517650 - RNA, 64 nt, Homo Sapiens
uuagaguugaauuugcauauuguuuuguacuuaagcaccauauaacaguuccuguguuucuucu

SEQ ID NO: 517651 - RNA, 64 nt, Homo Sapiens
uccuccccuccaccccacacgccuccuuggucgggcaccauaccgucugccacccuugccccuu

SEQ ID NO: 517652 - RNA, 64 nt, Homo Sapiens
aaaugccacaaggguagucggcucccugucgucugcaccauaguggggagcuuaacugcuuguu

SEQ ID NO: 517653 - RNA, 64 nt, Homo Sapiens
uuuaaacuuuuauuacaagauuucaauuaaacaggcaccauagcacuggcauaccgcuguguga

SEQ ID NO: 517654 - RNA, 64 nt, Homo Sapiens
guuaugcccaauuggaaauaugcugucaguuugugcaccauauggugaccacgccugugcucag

SEQ ID NO: 517655 - RNA, 64 nt, Homo Sapiens
gacuucaccaauggauuacacugagauauccugugcaccauagggggacccagagccaagaaag

SEQ ID NO: 517656 - RNA, 64 nt, Homo Sapiens
cacaggagguuggaaaaaccaauagauugaucaugcaccauaucaacuuguauuaauccuauau

SEQ ID NO: 517657 - RNA, 64 nt, Homo Sapiens
agcuaauuuuuauauuuuuaguagagacaggauugcaccauauuggucagccuggucucaaacu

SEQ ID NO: 517658 - RNA, 64 nt, Homo Sapiens
uaagaaucauugugcuuaauaauaccaagacuaagcaccauaaccaagaaauacuaauguaaag

SEQ ID NO: 517659 - RNA, 64 nt, Homo Sapiens
acucugccagaacugagaagcaucagaccucuacgcaccauaagcaccucugacucccuaacuc

SEQ ID NO: 517660 - RNA, 64 nt, Homo Sapiens
ugugacacaaggaagccaguggggugggagggaggcaccauaaucccucccuaaaacccacaga

SEQ ID NO: 517661 - RNA, 64 nt, Homo Sapiens
uugacacucaaaucaguguuuagucuucugcuuggcaccauagcuuaaccugcaguuucuucaa

SEQ ID NO: 517662 - RNA, 64 nt, Homo Sapiens
uaccaucuuguaacucacuguguuaguauauaaagcaccauaagaaauccaauggcagauaacc

SEQ ID NO: 517663 - RNA, 64 nt, Homo Sapiens
uguauuuugagcuuagugcuaggacugagaggcugcaccauagggaauguaugggagaugguga

SEQ ID NO: 517664 - RNA, 64 nt, Homo Sapiens
uucuuguacauuugugucucggaguguugcuguugcaccauacuagcacacuauaacaucugcu

SEQ ID NO: 517665 - RNA, 64 nt, Homo Sapiens
gaggcgcuagagcccauuccaccccuguccuccagcaccauagaaguaccccccuaccacacac

SEQ ID NO: 517666 - RNA, 64 nt, Homo Sapiens
agggccaauucaaccccauucuuuccagcgccccgcaccauagcaccugcccaccugagaacca

SEQ ID NO: 517667 - RNA, 64 nt, Homo Sapiens
caccacagcacaccucaccacaccacaccgcacugcaccauaccucaccacaucucaccacacc

SEQ ID NO: 517668 - RNA, 64 nt, Homo Sapiens
uauuugagcucauauuuuuauguuucuauuuugggcaccauaacuccagaacuaucacuucaga

SEQ ID NO: 517669 - RNA, 64 nt, Homo Sapiens
agccugcgggacuaggguggggagucugcuggaggcaccauaucugcacccuccgggaagccau

SEQ ID NO: 517670 - RNA, 64 nt, Homo Sapiens
gaagcagagcagagugcgagauccugacccaagagcaccauaacauagcuccgaaagggagagc

SEQ ID NO: 517671 - RNA, 64 nt, Homo Sapiens
uggagcccuccgaggggugucugcaucuuccaccgcaccauaccagaagagccccacgggcuuc

SEQ ID NO: 517672 - RNA, 64 nt, Homo Sapiens
guuuccagcagccaacccuuacgcagccuccagggcaccauacuaauucuuaggguguguacgu

SEQ ID NO: 517673 - RNA, 64 nt, Homo Sapiens
gaaggacuagcagccaaauagaaucagaacacaagcaccauacuuagaauaugaauugauuuug

SEQ ID NO: 517674 - RNA, 64 nt, Homo Sapiens
cccuggaugcugaagacaugucaacggaugccgugcaccauauuccagcagccgcaggcauauc

SEQ ID NO: 517675 - RNA, 64 nt, Homo Sapiens
ccagaaaagaaccauuucuucugccaucuuuuaugcaccauagacaucgagacuccaggggguc

SEQ ID NO: 517676 - RNA, 64 nt, Homo Sapiens
ccuaugcauaaagugcuucuaaaaauacaauaaugcaccauaucuugucauuguuucuuuaaaa

SEQ ID NO: 517677 - RNA, 64 nt, Homo Sapiens
uaaggacugugagagacuguaaaaaaugucauuggcaccauaaauccagaauauuuuaccuuua

SEQ ID NO: 517678 - RNA, 64 nt, Homo Sapiens
uacauguguccauauauuauagccuucaaacccugcaccauaaacuugguuguccccgugaaga

SEQ ID NO: 517679 - RNA, 64 nt, Homo Sapiens
ccagugggggugacugggugcucucaugcuaccagcaccauaaugcccuugguguggacacacc

SEQ ID NO: 517680 - RNA, 64 nt, Homo Sapiens
uagucauuuguucaucuuuacuuuuagcagauuagcaccauaacuaacuuaaaacuaaguuugu

SEQ ID NO: 517681 - RNA, 64 nt, Homo Sapiens
uggccuagcaggauuuauuuuguuuuaaaaaauggcaccauauuuguuguuugcacagagagau

SEQ ID NO: 517682 - RNA, 64 nt, Homo Sapiens
ucugugcggcuccagccucgcccccuccccacgugcaccauaccuggggaguuccugguccagg

SEQ ID NO: 517683 - RNA, 64 nt, Homo Sapiens
aguaaguuaagaaggcauuagucaugguuuggaagcaccauacagggagacagcugugugaaua

SEQ ID NO: 517684 - RNA, 64 nt, Homo Sapiens
ugggagcacugguguucacgugggaccacaggcugcaccauaagacccacucacaauaaaaaaa

SEQ ID NO: 517685 - RNA, 64 nt, Homo Sapiens
accugccuguagcccccaucagacccugccccaagcaccauauggaaauaaaguucuuucuuac

SEQ ID NO: 517686 - RNA, 64 nt, Homo Sapiens
gugugugacuuucacaggacuauaccuuuguagugcaccauaugucaagcuucagccuuuaacc

SEQ ID NO: 517687 - RNA, 64 nt, Homo Sapiens
gucucgcaucuacaggccuuccugaggccacacagcaccauaaaagggucuggucuggugagcu

SEQ ID NO: 517688 - RNA, 64 nt, Homo Sapiens
agugcugcuuuuuuguauacucauggggcugauugcaccauagcugagaacguggaaugcagaa

SEQ ID NO: 517689 - RNA, 64 nt, Homo Sapiens
auagaaauacccaauuauauauucaaauguuucagcaccauauauuuauuuuauuucuaaaggu

SEQ ID NO: 517690 - RNA, 64 nt, Homo Sapiens
acuagauuugccucuucuaagugucuaugagcuugcaccauauuuaauaaauugggaauggguu

SEQ ID NO: 517691 - RNA, 64 nt, Homo Sapiens
cuccuaguggguuugggggguuggguuccugaaugcaccauaaucgcuguaugaaauauuaaaa

SEQ ID NO: 517692 - RNA, 64 nt, Homo Sapiens
cuuugucuuagucaguuugagcugcuauaauaaagcaccauagacuugguggcuuauaaacaac

SEQ ID NO: 517693 - RNA, 64 nt, Homo Sapiens
ugugagugccuauucuaugucaaacacuguguuggcaccauauuuuacaaguuuuuuuccucuu

SEQ ID NO: 517694 - RNA, 64 nt, Homo Sapiens
ugggaacucaacuugaaggucugucuuccaucuggcaccauaaaaacaugaacuuauugcauaa

SEQ ID NO: 517695 - RNA, 64 nt, Homo Sapiens
ugucaaugugcugugcaaauuaugucucugcuaagcaccauaguucagaugccuauuaugggca

SEQ ID NO: 517696 - RNA, 64 nt, Homo Sapiens
caugcaugcaaauuagacaaguggcauggagaaugcaccauacugaaaaggcauauauguacua

SEQ ID NO: 517697 - RNA, 64 nt, Homo Sapiens
auauuucacaagcaauggaauccggacauacgcagcaccauacaaagacucccauuugagacuu

SEQ ID NO: 517698 - RNA, 64 nt, Homo Sapiens
ucaaaauauugguuuuggugugacagcagcaaaggcaccauaagaguacagguaguuuuugagc

SEQ ID NO: 517699 - RNA, 64 nt, Homo Sapiens
augucuccuucacaaucaggcgugggaauaucuggcuuaggacuguuucucucuaagacaccau

SEQ ID NO: 517700 - RNA, 64 nt, Homo Sapiens
gaucacccagcuguguucagaauuuucuuacugugcuuaggacugcacgcaagugagcagacac

SEQ ID NO: 517701 - RNA, 64 nt, Homo Sapiens
cugcuacagaggggcagggccucccccagcccacgcuuaggaaugcuuggccucuggcaggcag

SEQ ID NO: 517702 - RNA, 64 nt, Homo Sapiens
agaaugaaacuuguggagagauggggaaacugaggcuuaggaagccaaccuccccauugcacag

SEQ ID NO: 517703 - RNA, 64 nt, Homo Sapiens
agaagagagaauuggagcugucugaaaaugaaaagcuuaggaccugagaaugacuuucagucuc

SEQ ID NO: 517704 - RNA, 64 nt, Homo Sapiens
gcggcuguugcuccauaacucuugccucacuucugcuuaggaaacacaaucugugcggaaguag

SEQ ID NO: 517705 - RNA, 64 nt, Homo Sapiens
cagaauggaaacggaggccgacaucucccaggcugcuuaggagaccucaccgaagcuuaggccc

SEQ ID NO: 517706 - RNA, 64 nt, Homo Sapiens
aaagggacauggauaugaggauacaucuggacgugcuuaggaacagggugcugguugagggccc

SEQ ID NO: 517707 - RNA, 64 nt, Homo Sapiens
gcuguacucagccuuugcaauuuuuguagauguagcuuaggacgugaguuauuuuuccgcagac

SEQ ID NO: 517708 - RNA, 64 nt, Homo Sapiens
ucaagaauuaaaaguuauucaagaaaaugaacaugcucuucaaaaagaugcacuuaguauuaag

SEQ ID NO: 517709 - RNA, 64 nt, Homo Sapiens
agagaaaacacuuaguucauuggcuuuaguauuugcucuucaccacuacaagcccacuccccuu

SEQ ID NO: 517710 - RNA, 64 nt, Homo Sapiens
gaaaauuggacagauugccuguuucugauuugcugcucuucaucccauuccaggcagccucugu

SEQ ID NO: 517711 - RNA, 64 nt, Homo Sapiens
ccaaccagaccuggaagaacaggccucuccauuugcucuucagaugccacuucuaagaaaagcc

SEQ ID NO: 517712 - RNA, 64 nt, Homo Sapiens
uauauuucacucaaggcuuguacaucugaaguuugcucuucaaggaaugggaaccuuccuguua

SEQ ID NO: 517713 - RNA, 64 nt, Homo Sapiens
auuuuuguuaaaauaugugcucaucuccuaaguagcucuucagagucugaccguaaguaaaaac

SEQ ID NO: 517714 - RNA, 64 nt, Homo Sapiens
ugaacaacaucgcgguggccgagcagaucggggagcucuucauccacugccggcacggcugccg

SEQ ID NO: 517715 - RNA, 64 nt, Homo Sapiens
uguggugucucugcgucuacuccaugggugaccugcucuucaguggcuccucugacaagaccau

SEQ ID NO: 517716 - RNA, 64 nt, Homo Sapiens
acccggugugcacgcuggucuccucacacaacgugcucuucagcggcucccugaaggccaucaa

SEQ ID NO: 517717 - RNA, 64 nt, Homo Sapiens
ugaagccuaaugacaagccaggucuuacagcugggcucuucagaaaaccagguuucuacaucca

SEQ ID NO: 517718 - RNA, 64 nt, Homo Sapiens
gccugguuuguagacuuccaacaucuacacugcugcucuucaccauuggaauucacugugguau

SEQ ID NO: 517719 - RNA, 64 nt, Homo Sapiens
gcauggugguacagaagguaucagucaagcgcaggcucuucagaaaccuagaaacuaaaaagag

SEQ ID NO: 517720 - RNA, 64 nt, Homo Sapiens
aagguucagcacagcuggaauuguacgguagugagcucuucaaaaugaaaacagaaugaccgga

SEQ ID NO: 517721 - RNA, 64 nt, Homo Sapiens
aguggcugacgguccuccuacucugccucuaccugcucuucaccaacauccugcugcucaaccu

SEQ ID NO: 517722 - RNA, 64 nt, Homo Sapiens
cgccgccccccuucauccuccucagccaccugcagcucuucaucaagagggugguccugaagac

SEQ ID NO: 517723 - RNA, 64 nt, Homo Sapiens; identical to SEQ ID NO: 145359

SEQ ID NO: 517724 - RNA, 64 nt, Homo Sapiens; identical to SEQ ID NO: 145360

SEQ ID NO: 517725 - RNA, 64 nt, Homo Sapiens; identical to SEQ ID NO: 145361

SEQ ID NO: 517726 - RNA, 64 nt, Homo Sapiens; identical to SEQ ID NO: 145362

SEQ ID NO: 517727 - RNA, 64 nt, Homo Sapiens; identical to SEQ ID NO: 145363

SEQ ID NO: 517728 - RNA, 64 nt, Homo Sapiens; identical to SEQ ID NO: 145364

SEQ ID NO: 517729 - RNA, 64 nt, Homo Sapiens; identical to SEQ ID NO: 145365

SEQ ID NO: 517730 - RNA, 64 nt, Homo Sapiens; identical to SEQ ID NO: 145366

SEQ ID NO: 517731 - RNA, 64 nt, Homo Sapiens; identical to SEQ ID NO: 145367

SEQ ID NO: 517732 - RNA, 64 nt, Homo Sapiens; identical to SEQ ID NO: 145368

SEQ ID NO: 517733 - RNA, 64 nt, Homo Sapiens; identical to SEQ ID NO: 145369

SEQ ID NO: 517734 - RNA, 64 nt, Homo Sapiens; identical to SEQ ID NO: 145370

SEQ ID NO: 517735 - RNA, 64 nt, Homo Sapiens; identical to SEQ ID NO: 145371

SEQ ID NO: 517736 - RNA, 64 nt, Homo Sapiens; identical to SEQ ID NO: 145372

SEQ ID NO: 517737 - RNA, 64 nt, Homo Sapiens; identical to SEQ ID NO: 145373

SEQ ID NO: 517738 - RNA, 64 nt, Homo Sapiens; identical to SEQ ID NO: 145374

SEQ ID NO: 517739 - RNA, 64 nt, Homo Sapiens; identical to SEQ ID NO: 145375

SEQ ID NO: 517740 - RNA, 64 nt, Homo Sapiens; identical to SEQ ID NO: 145376

SEQ ID NO: 517741 - RNA, 64 nt, Homo Sapiens; identical to SEQ ID NO: 145377

SEQ ID NO: 517742 - RNA, 64 nt, Homo Sapiens; identical to SEQ ID NO: 145378

SEQ ID NO: 517743 - RNA, 64 nt, Homo Sapiens; identical to SEQ ID NO: 145379

SEQ ID NO: 517744 - RNA, 64 nt, Homo Sapiens; identical to SEQ ID NO: 145380

SEQ ID NO: 517745 - RNA, 64 nt, Homo Sapiens; identical to SEQ ID NO: 145381

SEQ ID NO: 517746 - RNA, 64 nt, Homo Sapiens; identical to SEQ ID NO: 145382

SEQ ID NO: 517747 - RNA, 64 nt, Homo Sapiens; identical to SEQ ID NO: 145383

SEQ ID NO: 517748 - RNA, 64 nt, Homo Sapiens; identical to SEQ ID NO: 145384

SEQ ID NO: 517749 - RNA, 64 nt, Homo Sapiens; identical to SEQ ID NO: 145385

SEQ ID NO: 517750 - RNA, 64 nt, Homo Sapiens; identical to SEQ ID NO: 145386

SEQ ID NO: 517751 - RNA, 64 nt, Homo Sapiens; identical to SEQ ID NO: 145387

SEQ ID NO: 517752 - RNA, 64 nt, Homo Sapiens; identical to SEQ ID NO: 145388

SEQ ID NO: 517753 - RNA, 64 nt, Homo Sapiens; identical to SEQ ID NO: 145389

SEQ ID NO: 517754 - RNA, 64 nt, Homo Sapiens; identical to SEQ ID NO: 145390

SEQ ID NO: 517755 - RNA, 64 nt, Homo Sapiens; identical to SEQ ID NO: 145391

SEQ ID NO: 517756 - RNA, 64 nt, Homo Sapiens; identical to SEQ ID NO: 145392

SEQ ID NO: 517757 - RNA, 64 nt, Homo Sapiens; identical to SEQ ID NO: 145393

SEQ ID NO: 517758 - RNA, 64 nt, Homo Sapiens; identical to SEQ ID NO: 145394

SEQ ID NO: 517759 - RNA, 64 nt, Homo Sapiens; identical to SEQ ID NO: 145395

SEQ ID NO: 517760 - RNA, 64 nt, Homo Sapiens; identical to SEQ ID NO: 145396

SEQ ID NO: 517761 - RNA, 64 nt, Homo Sapiens; identical to SEQ ID NO: 145397

SEQ ID NO: 517762 - RNA, 64 nt, Homo Sapiens; identical to SEQ ID NO: 145398

SEQ ID NO: 517763 - RNA, 64 nt, Homo Sapiens; identical to SEQ ID NO: 145399

SEQ ID NO: 517764 - RNA, 64 nt, Homo Sapiens; identical to SEQ ID NO: 151188

SEQ ID NO: 517765 - RNA, 64 nt, Homo Sapiens; identical to SEQ ID NO: 151189

SEQ ID NO: 517766 - RNA, 64 nt, Homo Sapiens; identical to SEQ ID NO: 151190

SEQ ID NO: 517767 - RNA, 64 nt, Homo Sapiens; identical to SEQ ID NO: 151191

SEQ ID NO: 517768 - RNA, 64 nt, Homo Sapiens; identical to SEQ ID NO: 151192

SEQ ID NO: 517769 - RNA, 64 nt, Homo Sapiens; identical to SEQ ID NO: 151193

SEQ ID NO: 517770 - RNA, 64 nt, Homo Sapiens; identical to SEQ ID NO: 151194

SEQ ID NO: 517771 - RNA, 64 nt, Homo Sapiens; identical to SEQ ID NO: 151195

SEQ ID NO: 517772 - RNA, 64 nt, Homo Sapiens; identical to SEQ ID NO: 151196

SEQ ID NO: 517773 - RNA, 64 nt, Homo Sapiens; identical to SEQ ID NO: 151197

SEQ ID NO: 517774 - RNA, 64 nt, Homo Sapiens; identical to SEQ ID NO: 151198

SEQ ID NO: 517775 - RNA, 64 nt, Homo Sapiens; identical to SEQ ID NO: 151199

SEQ ID NO: 517776 - RNA, 64 nt, Homo Sapiens; identical to SEQ ID NO: 151200

SEQ ID NO: 517777 - RNA, 64 nt, Homo Sapiens; identical to SEQ ID NO: 151201

SEQ ID NO: 517778 - RNA, 64 nt, Homo Sapiens; identical to SEQ ID NO: 151202

SEQ ID NO: 517779 - RNA, 64 nt, Homo Sapiens; identical to SEQ ID NO: 151203

SEQ ID NO: 517780 - RNA, 64 nt, Homo Sapiens; identical to SEQ ID NO: 151204

SEQ ID NO: 517781 - RNA, 64 nt, Homo Sapiens; identical to SEQ ID NO: 151205

SEQ ID NO: 517782 - RNA, 64 nt, Homo Sapiens; identical to SEQ ID NO: 151206

SEQ ID NO: 517783 - RNA, 64 nt, Homo Sapiens; identical to SEQ ID NO: 151207

SEQ ID NO: 517784 - RNA, 64 nt, Homo Sapiens; identical to SEQ ID NO: 151208

SEQ ID NO: 517785 - RNA, 64 nt, Homo Sapiens; identical to SEQ ID NO: 151209

SEQ ID NO: 517786 - RNA, 64 nt, Homo Sapiens; identical to SEQ ID NO: 151210

SEQ ID NO: 517787 - RNA, 64 nt, Homo Sapiens; identical to SEQ ID NO: 151211

SEQ ID NO: 517788 - RNA, 64 nt, Homo Sapiens; identical to SEQ ID NO: 151212

SEQ ID NO: 517789 - RNA, 64 nt, Homo Sapiens; identical to SEQ ID NO: 151213

SEQ ID NO: 517790 - RNA, 64 nt, Homo Sapiens; identical to SEQ ID NO: 151214

SEQ ID NO: 517791 - RNA, 64 nt, Homo Sapiens; identical to SEQ ID NO: 151215

SEQ ID NO: 517792 - RNA, 64 nt, Homo Sapiens; identical to SEQ ID NO: 151216

SEQ ID NO: 517793 - RNA, 64 nt, Homo Sapiens; identical to SEQ ID NO: 151217

SEQ ID NO: 517794 - RNA, 64 nt, Homo Sapiens; identical to SEQ ID NO: 151218

SEQ ID NO: 517795 - RNA, 64 nt, Homo Sapiens; identical to SEQ ID NO: 151219

SEQ ID NO: 517796 - RNA, 64 nt, Homo Sapiens; identical to SEQ ID NO: 151220

SEQ ID NO: 517797 - RNA, 64 nt, Homo Sapiens; identical to SEQ ID NO: 151221

SEQ ID NO: 517798 - RNA, 64 nt, Homo Sapiens; identical to SEQ ID NO: 151222

SEQ ID NO: 517799 - RNA, 64 nt, Homo Sapiens; identical to SEQ ID NO: 151223

SEQ ID NO: 517800 - RNA, 64 nt, Homo Sapiens; identical to SEQ ID NO: 151224

SEQ ID NO: 517801 - RNA, 64 nt, Homo Sapiens; identical to SEQ ID NO: 151225

SEQ ID NO: 517802 - RNA, 64 nt, Homo Sapiens; identical to SEQ ID NO: 151226

SEQ ID NO: 517803 - RNA, 64 nt, Homo Sapiens; identical to SEQ ID NO: 151227

SEQ ID NO: 517804 - RNA, 64 nt, Homo Sapiens
aacaucagggugaccacauuaagcccaguauuccaguuggcaccagaagauauggacuuggaau

SEQ ID NO: 517805 - RNA, 64 nt, Homo Sapiens
gcacguggauguaguuuggcucaggugucccugcaguuggcaaggagucaguacucagucccug

SEQ ID NO: 517806 - RNA, 64 nt, Homo Sapiens
aacagccuucuagcacacuuuuaccaaaaaaggaaguuggcaaacuuaauguggaaguuaaccc

SEQ ID NO: 517807 - RNA, 64 nt, Homo Sapiens
gguucugguacuaaaaauugauggacuucaugcaaguuggcaguaccauuuuuaaaaugugaag

SEQ ID NO: 517808 - RNA, 64 nt, Homo Sapiens
aacagacuuccggggaauuuuuucacuuuuuacaaguuggcaaaauaaacaaggaagucagcuc

SEQ ID NO: 517809 - RNA, 64 nt, Homo Sapiens
gcaggugcaggccaacccuucacagcccuuccacaguuggcacucugcaacuguggggccugca

SEQ ID NO: 517810 - RNA, 64 nt, Homo Sapiens
uguuaaguccuuggcuugccaggauuuguguuuuaguuggcaguaauuuuauuuugugaaguga

SEQ ID NO: 517811 - RNA, 64 nt, Homo Sapiens
acucuugacucuugccugccggccacauuacuagaguuggcauggugguagguguuugaacaga

SEQ ID NO: 517812 - RNA, 64 nt, Homo Sapiens
cucuuuaaacacagagaccugccaagacgcccucucguccaacuaugcccaggcugaaguccuc

SEQ ID NO: 517813 - RNA, 64 nt, Homo Sapiens
caguucuguguccucgcacucuggugagggagccucguccaaggccaggauuggcacaagcucc

SEQ ID NO: 517814 - RNA, 64 nt, Homo Sapiens
aaaaacaaaugggaaaauguaaggaguaaccaggucguccaagcagauuauauauuccgcacuc

SEQ ID NO: 517815 - RNA, 64 nt, Homo Sapiens
gauauuaaagggcuaauaaaaaaugagaaaccggucguccaagguggaugcugucaaugcccga

SEQ ID NO: 517816 - RNA, 64 nt, Homo Sapiens
agagagagccguagcccuuuguaaaggcuuucguucguccaaacaacacuugauccaaccaaag

SEQ ID NO: 517817 - RNA, 64 nt, Homo Sapiens
uagaaagguacgaagauacaaaccagaguuguucucguccaagggacugcugaaugucugagag

SEQ ID NO: 517818 - RNA, 64 nt, Homo Sapiens
gaaauacagagagaaccucuuccacuuuuacuuuucguccaaauaaaaugcaugguguaccaga

SEQ ID NO: 517819 - RNA, 64 nt, Homo Sapiens
ugauuaaaaaauucgacaagugggcgcugggaagucguccaagaugggacgguugcgguggguc

SEQ ID NO: 517820 - RNA, 64 nt, Homo Sapiens
uguguuagucuaggcuuagguuacugcuuuauauucguccaaacgcucugggcugauucagagg

SEQ ID NO: 517821 - RNA, 64 nt, Homo Sapiens
aaaacaacuguaauguacuucuuuguuuucuuuuucguccaacuuuaguaauuuauuuuugauu

SEQ ID NO: 517822 - RNA, 64 nt, Homo Sapiens
gugggaggagggcuacagcccacaucccacccccucguccaaucccauaauccaugaugaaagg

SEQ ID NO: 517823 - RNA, 64 nt, Homo Sapiens
auuacagcuuucuagaugcuaauacaugugacuaucguccaauuugcuuucuuuuguagugaca

SEQ ID NO: 517824 - RNA, 64 nt, Homo Sapiens
aguugggacaccaagucugagcuuggaguggcagucguccaaaccccaggaagagagcucuaaa

SEQ ID NO: 517825 - RNA, 64 nt, Homo Sapiens
aaacacuuaacuggauuuuggaauaauaaaacucucguccaauuuggcuuuuaaaaagcaggcu

SEQ ID NO: 517826 - RNA, 64 nt, Homo Sapiens
cccugucucuucagcuucucuggcgucaaguacaucguccaaaugugccuaaagcaugucgaug

SEQ ID NO: 517827 - RNA, 64 nt, Homo Sapiens
aauaggcuguuacauauccuucgugguuccuauaucguccaaaagaacuaagagacuuaagagg

SEQ ID NO: 517828 - RNA, 64 nt, Homo Sapiens
acgucgcaggacaguugugaaaauaacaugacgcucguccaaggccacuuccugagggcaaguc

SEQ ID NO: 517829 - RNA, 64 nt, Homo Sapiens
cccugcagcucugggccaccugcugguguccaccucguccaacagagucguggugcuggaugcu

SEQ ID NO: 517830 - RNA, 64 nt, Homo Sapiens
uccugauucagcacuuugcucuuuuaauaacaaaucguccaaagaucucaaaguaaggguuuuu

SEQ ID NO: 517831 - RNA, 64 nt, Homo Sapiens
gacagcccacggucuggagggggacgaauuccacucguccaagguaggaccugcauccuuccug

SEQ ID NO: 517832 - RNA, 64 nt, Homo Sapiens
ggaugggguggugccuuggucucucuugacuaccucguccaaagagagcacugcccuuagacaa

SEQ ID NO: 517833 - RNA, 64 nt, Homo Sapiens
cuacucuguuccuucacguccucccuucucagccucguccaagcaccgggaagaccuccaggcu

SEQ ID NO: 517834 - RNA, 64 nt, Homo Sapiens
gcuucagggauggaaacaaaagaccucauccagcucguccaaaguccaaaguucucaguuauca

SEQ ID NO: 517835 - RNA, 64 nt, Homo Sapiens
gcauggucccuggagccgagccuucaccacgcacucguccaaguucggaugcgggaaccugguc

SEQ ID NO: 517836 - RNA, 64 nt, Homo Sapiens
cccugagggcagcaggaugguggccuggguggggucguccaacuagguuugcuaaccugagggg

SEQ ID NO: 517837 - RNA, 64 nt, Homo Sapiens
ucuugcguauuucuggaucuccuucccuccuuucucguccaaaucaugaaauguuuggccuuag

SEQ ID NO: 517838 - RNA, 64 nt, Homo Sapiens
agcagugccugcgucccgcuagccaucccgcgugucguccaaaccagccacaacuucagaaagc

SEQ ID NO: 517839 - RNA, 64 nt, Homo Sapiens
cuuccuuugucuaaugugggauuccugacucccuucguccaaggcaccggugugugugugucuu

SEQ ID NO: 517840 - RNA, 64 nt, Homo Sapiens
aagaggaggacaaaaagggggaggagaagguucuucguccaaaggaggaaggagaagaaguaga

SEQ ID NO: 517841 - RNA, 64 nt, Homo Sapiens
cacucccgucaccugccuugacccucuuuucuacucguccaaacgagguuuccagcugacuaga

SEQ ID NO: 517842 - RNA, 64 nt, Homo Sapiens
gguugucuugggguggggcccauccgccgagguggggaccgauaggagaagccgguggguugua

SEQ ID NO: 517843 - RNA, 64 nt, Homo Sapiens
uggguuugggaagagugagggugguuggggagaggggaccgaugugccucauuguuuaguggug

SEQ ID NO: 517844 - RNA, 64 nt, Homo Sapiens
ccugcugguaauaucgggaaagauuuuaaugaaaccaggguagaauuguuuggcaaugcacuga

SEQ ID NO: 517845 - RNA, 64 nt, Homo Sapiens
cucugcggggaggacccgggaccacagcugcuggccaggguagacuuggagcuguccuccagag

SEQ ID NO: 517846 - RNA, 64 nt, Homo Sapiens
auucaaucagagcuccaguugcaucaaguucuccccaggguagacucuugguaccuguggguua

SEQ ID NO: 517847 - RNA, 64 nt, Homo Sapiens
cauggccggguaaagcaaggccacgcuccaaaccccaggguagcccgcucccuucccuccauag

SEQ ID NO: 517848 - RNA, 64 nt, Homo Sapiens
ugugcccuugcucucuaacuucugagcccaccucccaggguaggcaccugggggcaugcaggug

SEQ ID NO: 517849 - RNA, 64 nt, Homo Sapiens
gguaggcaccugggggcaugcaggugcccaccucccaggguaggcaccugggggcaugcaggua

SEQ ID NO: 517850 - RNA, 64 nt, Homo Sapiens
cuaacaacuguccccucacccaccagcuauuuccccaggguagagugggcaauucucaccuuca

SEQ ID NO: 517851 - RNA, 64 nt, Homo Sapiens
ugugucccuguuucaguugcacugggguuggagcccaggguagggguuuccagcuuccccaggc

SEQ ID NO: 517852 - RNA, 64 nt, Homo Sapiens; identical to SEQ ID NO: 441022

SEQ ID NO: 517853 - RNA, 64 nt, Homo Sapiens; identical to SEQ ID NO: 441023

SEQ ID NO: 517854 - RNA, 64 nt, Homo Sapiens; identical to SEQ ID NO: 441024

SEQ ID NO: 517855 - RNA, 64 nt, Homo Sapiens; identical to SEQ ID NO: 441025

SEQ ID NO: 517856 - RNA, 64 nt, Homo Sapiens; identical to SEQ ID NO: 441026

SEQ ID NO: 517857 - RNA, 64 nt, Homo Sapiens; identical to SEQ ID NO: 441027

SEQ ID NO: 517858 - RNA, 64 nt, Homo Sapiens; identical to SEQ ID NO: 441028

SEQ ID NO: 517859 - RNA, 64 nt, Homo Sapiens; identical to SEQ ID NO: 441029

SEQ ID NO: 517860 - RNA, 64 nt, Homo Sapiens; identical to SEQ ID NO: 441030

SEQ ID NO: 517861 - RNA, 64 nt, Homo Sapiens; identical to SEQ ID NO: 441031

SEQ ID NO: 517862 - RNA, 64 nt, Homo Sapiens; identical to SEQ ID NO: 441032

SEQ ID NO: 517863 - RNA, 64 nt, Homo Sapiens; identical to SEQ ID NO: 441033

SEQ ID NO: 517864 - RNA, 64 nt, Homo Sapiens; identical to SEQ ID NO: 441034

SEQ ID NO: 517865 - RNA, 64 nt, Homo Sapiens; identical to SEQ ID NO: 441035

SEQ ID NO: 517866 - RNA, 64 nt, Homo Sapiens; identical to SEQ ID NO: 441036

SEQ ID NO: 517867 - RNA, 64 nt, Homo Sapiens; identical to SEQ ID NO: 441037

SEQ ID NO: 517868 - RNA, 64 nt, Homo Sapiens; identical to SEQ ID NO: 441038

SEQ ID NO: 517869 - RNA, 64 nt, Homo Sapiens; identical to SEQ ID NO: 441039

SEQ ID NO: 517870 - RNA, 64 nt, Homo Sapiens; identical to SEQ ID NO: 441040

SEQ ID NO: 517871 - RNA, 64 nt, Homo Sapiens; identical to SEQ ID NO: 441041

SEQ ID NO: 517872 - RNA, 64 nt, Homo Sapiens; identical to SEQ ID NO: 441042

SEQ ID NO: 517873 - RNA, 63 nt, Homo Sapiens
gguuuuguuuuuuuuuuaaaggaaaugcagccuagucuugagaacauaauuuuauauaaucaa

SEQ ID NO: 517874 - RNA, 63 nt, Homo Sapiens
uaucuaauaagaguucaaagaguuaugaguugaagucuugaaugcaggaaacuaucugauagu

SEQ ID NO: 517875 - RNA, 63 nt, Homo Sapiens
aagugaggccaguguuauuucccgggaguguucagucuugacccuagucacugauuuuuucua

SEQ ID NO: 517876 - RNA, 63 nt, Homo Sapiens
aaagccaaacuccaagaccaaguaaguuagaggagucuugauuuuuuagacuucacugcggag

SEQ ID NO: 517877 - RNA, 63 nt, Homo Sapiens
aacaggucaaggacagcuucccagcagaauuccagucuugagaacaagcaugcaccacggcac

SEQ ID NO: 517878 - RNA, 63 nt, Homo Sapiens
ucauggccucaagucauccuugugcggcaagcuagucuugaacgagacagaaucuugcuaugu

SEQ ID NO: 517879 - RNA, 64 nt, Homo Sapiens; identical to SEQ ID NO: 385306

SEQ ID NO: 517880 - RNA, 64 nt, Homo Sapiens; identical to SEQ ID NO: 385307

SEQ ID NO: 517881 - RNA, 64 nt, Homo Sapiens; identical to SEQ ID NO: 385308

SEQ ID NO: 517882 - RNA, 64 nt, Homo Sapiens; identical to SEQ ID NO: 385309

SEQ ID NO: 517883 - RNA, 64 nt, Homo Sapiens; identical to SEQ ID NO: 385310

SEQ ID NO: 517884 - RNA, 64 nt, Homo Sapiens; identical to SEQ ID NO: 385311

SEQ ID NO: 517885 - RNA, 64 nt, Homo Sapiens; identical to SEQ ID NO: 385312

SEQ ID NO: 517886 - RNA, 64 nt, Homo Sapiens; identical to SEQ ID NO: 385313

SEQ ID NO: 517887 - RNA, 64 nt, Homo Sapiens; identical to SEQ ID NO: 385314

SEQ ID NO: 517888 - RNA, 57 nt, Homo Sapiens; identical to SEQ ID NO: 385315

SEQ ID NO: 517889 - RNA, 64 nt, Homo Sapiens; identical to SEQ ID NO: 385316

SEQ ID NO: 517890 - RNA, 64 nt, Homo Sapiens; identical to SEQ ID NO: 385317

SEQ ID NO: 517891 - RNA, 64 nt, Homo Sapiens; identical to SEQ ID NO: 385318

SEQ ID NO: 517892 - RNA, 64 nt, Homo Sapiens; identical to SEQ ID NO: 385319

SEQ ID NO: 517893 - RNA, 64 nt, Homo Sapiens; identical to SEQ ID NO: 385320

SEQ ID NO: 517894 - RNA, 64 nt, Homo Sapiens; identical to SEQ ID NO: 385321

SEQ ID NO: 517895 - RNA, 64 nt, Homo Sapiens; identical to SEQ ID NO: 385322

SEQ ID NO: 517896 - RNA, 64 nt, Homo Sapiens; identical to SEQ ID NO: 385323

SEQ ID NO: 517897 - RNA, 64 nt, Homo Sapiens; identical to SEQ ID NO: 385324

SEQ ID NO: 517898 - RNA, 64 nt, Homo Sapiens; identical to SEQ ID NO: 385325

SEQ ID NO: 517899 - RNA, 64 nt, Homo Sapiens; identical to SEQ ID NO: 385326

SEQ ID NO: 517900 - RNA, 64 nt, Homo Sapiens; identical to SEQ ID NO: 385327

SEQ ID NO: 517901 - RNA, 64 nt, Homo Sapiens; identical to SEQ ID NO: 385328

SEQ ID NO: 517902 - RNA, 64 nt, Homo Sapiens; identical to SEQ ID NO: 385329

SEQ ID NO: 517903 - RNA, 64 nt, Homo Sapiens; identical to SEQ ID NO: 385330

SEQ ID NO: 517904 - RNA, 64 nt, Homo Sapiens; identical to SEQ ID NO: 385331

SEQ ID NO: 517905 - RNA, 64 nt, Homo Sapiens; identical to SEQ ID NO: 385332

SEQ ID NO: 517906 - RNA, 64 nt, Homo Sapiens; identical to SEQ ID NO: 385333

SEQ ID NO: 517907 - RNA, 64 nt, Homo Sapiens; identical to SEQ ID NO: 385334

SEQ ID NO: 517908 - RNA, 64 nt, Homo Sapiens; identical to SEQ ID NO: 385335

SEQ ID NO: 517909 - RNA, 64 nt, Homo Sapiens; identical to SEQ ID NO: 385336

SEQ ID NO: 517910 - RNA, 64 nt, Homo Sapiens; identical to SEQ ID NO: 385337

SEQ ID NO: 517911 - RNA, 64 nt, Homo Sapiens; identical to SEQ ID NO: 385338

SEQ ID NO: 517912 - RNA, 64 nt, Homo Sapiens; identical to SEQ ID NO: 385339

SEQ ID NO: 517913 - RNA, 64 nt, Homo Sapiens; identical to SEQ ID NO: 385340

SEQ ID NO: 517914 - RNA, 64 nt, Homo Sapiens; identical to SEQ ID NO: 385341

SEQ ID NO: 517915 - RNA, 64 nt, Homo Sapiens; identical to SEQ ID NO: 385342

SEQ ID NO: 517916 - RNA, 64 nt, Homo Sapiens; identical to SEQ ID NO: 385343

SEQ ID NO: 517917 - RNA, 64 nt, Homo Sapiens; identical to SEQ ID NO: 385344

SEQ ID NO: 517918 - RNA, 64 nt, Homo Sapiens; identical to SEQ ID NO: 385345

SEQ ID NO: 517919 - RNA, 64 nt, Homo Sapiens; identical to SEQ ID NO: 385346

SEQ ID NO: 517920 - RNA, 64 nt, Homo Sapiens; identical to SEQ ID NO: 385347

SEQ ID NO: 517921 - RNA, 64 nt, Homo Sapiens; identical to SEQ ID NO: 385348

SEQ ID NO: 517922 - RNA, 64 nt, Homo Sapiens; identical to SEQ ID NO: 385349

SEQ ID NO: 517923 - RNA, 64 nt, Homo Sapiens; identical to SEQ ID NO: 385350

SEQ ID NO: 517924 - RNA, 64 nt, Homo Sapiens; identical to SEQ ID NO: 385351

SEQ ID NO: 517925 - RNA, 64 nt, Homo Sapiens; identical to SEQ ID NO: 385352

SEQ ID NO: 517926 - RNA, 64 nt, Homo Sapiens; identical to SEQ ID NO: 385353

SEQ ID NO: 517927 - RNA, 58 nt, Homo Sapiens; identical to SEQ ID NO: 385354

SEQ ID NO: 517928 - RNA, 64 nt, Homo Sapiens; identical to SEQ ID NO: 385355

SEQ ID NO: 517929 - RNA, 64 nt, Homo Sapiens; identical to SEQ ID NO: 385356

SEQ ID NO: 517930 - RNA, 64 nt, Homo Sapiens; identical to SEQ ID NO: 385357

SEQ ID NO: 517931 - RNA, 64 nt, Homo Sapiens; identical to SEQ ID NO: 385358

SEQ ID NO: 517932 - RNA, 64 nt, Homo Sapiens; identical to SEQ ID NO: 385359

SEQ ID NO: 517933 - RNA, 64 nt, Homo Sapiens; identical to SEQ ID NO: 385360

SEQ ID NO: 517934 - RNA, 64 nt, Homo Sapiens; identical to SEQ ID NO: 385361

SEQ ID NO: 517935 - RNA, 64 nt, Homo Sapiens; identical to SEQ ID NO: 385362

SEQ ID NO: 517936 - RNA, 64 nt, Homo Sapiens; identical to SEQ ID NO: 385363

SEQ ID NO: 517937 - RNA, 64 nt, Homo Sapiens; identical to SEQ ID NO: 385364

SEQ ID NO: 517938 - RNA, 64 nt, Homo Sapiens; identical to SEQ ID NO: 385365

SEQ ID NO: 517939 - RNA, 64 nt, Homo Sapiens; identical to SEQ ID NO: 385366

SEQ ID NO: 517940 - RNA, 64 nt, Homo Sapiens; identical to SEQ ID NO: 385367

SEQ ID NO: 517941 - RNA, 64 nt, Homo Sapiens; identical to SEQ ID NO: 385368

SEQ ID NO: 517942 - RNA, 64 nt, Homo Sapiens; identical to SEQ ID NO: 385369

SEQ ID NO: 517943 - RNA, 64 nt, Homo Sapiens; identical to SEQ ID NO: 385370

SEQ ID NO: 517944 - RNA, 64 nt, Homo Sapiens; identical to SEQ ID NO: 385371

SEQ ID NO: 517945 - RNA, 64 nt, Homo Sapiens; identical to SEQ ID NO: 385372

SEQ ID NO: 517946 - RNA, 64 nt, Homo Sapiens; identical to SEQ ID NO: 385373

SEQ ID NO: 517947 - RNA, 64 nt, Homo Sapiens; identical to SEQ ID NO: 385374

SEQ ID NO: 517948 - RNA, 64 nt, Homo Sapiens; identical to SEQ ID NO: 385375

SEQ ID NO: 517949 - RNA, 64 nt, Homo Sapiens; identical to SEQ ID NO: 385376

SEQ ID NO: 517950 - RNA, 64 nt, Homo Sapiens; identical to SEQ ID NO: 385377

SEQ ID NO: 517951 - RNA, 64 nt, Homo Sapiens; identical to SEQ ID NO: 385378

SEQ ID NO: 517952 - RNA, 64 nt, Homo Sapiens; identical to SEQ ID NO: 385379

SEQ ID NO: 517953 - RNA, 64 nt, Homo Sapiens; identical to SEQ ID NO: 385380

SEQ ID NO: 517954 - RNA, 64 nt, Homo Sapiens; identical to SEQ ID NO: 385381

SEQ ID NO: 517955 - RNA, 64 nt, Homo Sapiens; identical to SEQ ID NO: 385382

SEQ ID NO: 517956 - RNA, 64 nt, Homo Sapiens; identical to SEQ ID NO: 385383

SEQ ID NO: 517957 - RNA, 64 nt, Homo Sapiens; identical to SEQ ID NO: 385384

SEQ ID NO: 517958 - RNA, 64 nt, Homo Sapiens; identical to SEQ ID NO: 385385

SEQ ID NO: 517959 - RNA, 64 nt, Homo Sapiens; identical to SEQ ID NO: 385386

SEQ ID NO: 517960 - RNA, 64 nt, Homo Sapiens; identical to SEQ ID NO: 385387

SEQ ID NO: 517961 - RNA, 64 nt, Homo Sapiens; identical to SEQ ID NO: 385388

SEQ ID NO: 517962 - RNA, 64 nt, Homo Sapiens; identical to SEQ ID NO: 385389

SEQ ID NO: 517963 - RNA, 64 nt, Homo Sapiens; identical to SEQ ID NO: 385390

SEQ ID NO: 517964 - RNA, 64 nt, Homo Sapiens; identical to SEQ ID NO: 385391

SEQ ID NO: 517965 - RNA, 64 nt, Homo Sapiens; identical to SEQ ID NO: 133916

SEQ ID NO: 517966 - RNA, 64 nt, Homo Sapiens; identical to SEQ ID NO: 133917

SEQ ID NO: 517967 - RNA, 64 nt, Homo Sapiens; identical to SEQ ID NO: 133918

SEQ ID NO: 517968 - RNA, 64 nt, Homo Sapiens; identical to SEQ ID NO: 133919

SEQ ID NO: 517969 - RNA, 64 nt, Homo Sapiens; identical to SEQ ID NO: 133920

SEQ ID NO: 517970 - RNA, 64 nt, Homo Sapiens; identical to SEQ ID NO: 133921

SEQ ID NO: 517971 - RNA, 64 nt, Homo Sapiens; identical to SEQ ID NO: 133922

SEQ ID NO: 517972 - RNA, 64 nt, Homo Sapiens; identical to SEQ ID NO: 133923

SEQ ID NO: 517973 - RNA, 64 nt, Homo Sapiens; identical to SEQ ID NO: 133924

SEQ ID NO: 517974 - RNA, 64 nt, Homo Sapiens; identical to SEQ ID NO: 133925

SEQ ID NO: 517975 - RNA, 64 nt, Homo Sapiens; identical to SEQ ID NO: 133926

SEQ ID NO: 517976 - RNA, 64 nt, Homo Sapiens; identical to SEQ ID NO: 133927

SEQ ID NO: 517977 - RNA, 64 nt, Homo Sapiens; identical to SEQ ID NO: 133928

SEQ ID NO: 517978 - RNA, 64 nt, Homo Sapiens; identical to SEQ ID NO: 133929

SEQ ID NO: 517979 - RNA, 64 nt, Homo Sapiens
cugggcacaguggcucacgccuguagucccagcuacuugggaggcugaggcaggagaaucacuu

SEQ ID NO: 517980 - RNA, 64 nt, Homo Sapiens
ccaggcauggugccgcauaacuauaaucccagcuacuugggaggcugaggcaggagaaucgcuu

SEQ ID NO: 517981 - RNA, 64 nt, Homo Sapiens
cugagcaugguggugggcuccuguagucccagcuacuugggaggcugaggcaggagaaucgcuu

SEQ ID NO: 517982 - RNA, 64 nt, Homo Sapiens
cugggugugguggcaugugccuauaaucccagcuacuugggagguugaagcagaauugcuugaa

SEQ ID NO: 517983 - RNA, 64 nt, Homo Sapiens
uaaauucaugguuuuaaagcuaaacguaauuuccacuugggacuagaucacaacugaagauaac

SEQ ID NO: 517984 - RNA, 64 nt, Homo Sapiens
ccaggcauaguggcacacgccuguagucccaguuacuugggaggcugaggcaggagaauugcuu

SEQ ID NO: 517985 - RNA, 64 nt, Homo Sapiens
ccgggcgugguggcaccugccuguaaucccagcuacuugggaggcugaggcaggagaaucgcuu

SEQ ID NO: 517986 - RNA, 64 nt, Homo Sapiens
cugaggcaggagaauugcuucuguagucccagcuacuugggaggcugggccugguggcacacgc

SEQ ID NO: 517987 - RNA, 64 nt, Homo Sapiens
cugaggcaggagaaucgcuuugguggguaccgcuacuugggaggcaaaaauuagccgggugugg

SEQ ID NO: 517988 - RNA, 64 nt, Homo Sapiens
cugaggcacgagauuccuugcuguaaucccagcuacuugggaggccgagcacgguggugcaugc

SEQ ID NO: 517989 - RNA, 64 nt, Homo Sapiens
ccaaggcaggcauaucaacuccuguaaucccaguacuugggagggccgggcacgguggcucacg

SEQ ID NO: 517990 - RNA, 64 nt, Homo Sapiens
acugccugggaacuaggaugcucagaaaacccagacuugggacaggccaagugaagacccaagu

SEQ ID NO: 517991 - RNA, 64 nt, Homo Sapiens
uggggagggguacgaguccaccauccccugaacuacuugggagguuuuauucgcacaucccacc

SEQ ID NO: 517992 - RNA, 64 nt, Homo Sapiens
acacuagguuuucaaagaagcuguauuguauauuacuugggaggauggaaugccaugaaaugua

SEQ ID NO: 517993 - RNA, 64 nt, Homo Sapiens
cugaggcaggagaaucacuucaguaaucccagcuacuugggaggccgggcaugcuggcacgcac

SEQ ID NO: 517994 - RNA, 64 nt, Homo Sapiens
agcuauaaaguaaaacuuggugauuaauagggaaacuugggaauuccuuauucauuaauuuucu

SEQ ID NO: 517995 - RNA, 64 nt, Homo Sapiens
cuuugccaccacgcaacucagagacacaugcuccacuugggagccuguccuggcugaacaagaa

SEQ ID NO: 517996 - RNA, 64 nt, Homo Sapiens
caugucuguaaucccagcuacuguaaucucagcuacuugggaggcugaggcaggagaauugccu

SEQ ID NO: 517997 - RNA, 64 nt, Homo Sapiens
ccaggcaugguggcgugugccaguaaucccagcuacuugggaggcugaggcgcgagaaucgcuu

SEQ ID NO: 517998 - RNA, 64 nt, Homo Sapiens
agaaaccacuguuauguacauaaguucaaggggaacuugggaccaaaaagaccauuguaguaaa

SEQ ID NO: 517999 - RNA, 64 nt, Homo Sapiens
cuaguguuaagaugaugagccuccuagaguuuugacuugggacuacuagaccuuucuuauccuc

SEQ ID NO: 518000 - RNA, 64 nt, Homo Sapiens
ugaccuuucuguccaggugacagauaggcagggcacuugggauacuguuggcuagcagcuguca

SEQ ID NO: 518001 - RNA, 64 nt, Homo Sapiens
guuuaagaagaaaucaaacauucucaaaaugagaacuugggaauacugcccagaacccuggcca

SEQ ID NO: 518002 - RNA, 64 nt, Homo Sapiens
ugcaagucugagucuaacaguagguuuccagcugacuugggaacugugugucaucagcaucacc

SEQ ID NO: 518003 - RNA, 64 nt, Homo Sapiens
cugaggcaggagaaucacuucuguaaucccagcuacuugggacacugggugcgguggcaggugc

SEQ ID NO: 518004 - RNA, 64 nt, Homo Sapiens
gcacuggacuccauucaugccugaccuaugggcuacuugggagauuuucucacuuuaugucucu

SEQ ID NO: 518005 - RNA, 64 nt, Homo Sapiens
ccaggcgugguggcacgugccuguagucccagcuacuugggaggcuaagucaggagaauugcuu

SEQ ID NO: 518006 - RNA, 64 nt, Homo Sapiens
cuacuugggaggcuaagucaggagaauugcuugaacuugggagauggagguugcagugagccaa

SEQ ID NO: 518007 - RNA, 64 nt, Homo Sapiens
gagaaaaaucuggcauacugaauaaauaacauuaacuugggagccaagagcuggguaagccuua

SEQ ID NO: 518008 - RNA, 64 nt, Homo Sapiens
gaaaggaauugaaaauuaauuuacacuaguugcuacuugggaauaaagggcuuuuugagggggg

SEQ ID NO: 518009 - RNA, 64 nt, Homo Sapiens
uaucucugagacaccccgauuggcuggagaauugacuugggagagauaaggagggagggcgggu

SEQ ID NO: 518010 - RNA, 64 nt, Homo Sapiens
uugcuuugagcccacaagguaauggagggcuccuacuugggacagagcccucagcagagaauua

SEQ ID NO: 518011 - RNA, 64 nt, Homo Sapiens
cugaggcgggagaaucgcuucuguaaucccagcuacuugggaggccaggcgugguggcacgugc

SEQ ID NO: 518012 - RNA, 64 nt, Homo Sapiens
agaaaagcaaccccgucucuucauaggcuuuuggacuugggaauagccauugcgcuggcccucu

SEQ ID NO: 518013 - RNA, 64 nt, Homo Sapiens
aaucagugagugaauucauacuucagagguuggaacuugggaaaugugaugaguacggaaaagu

SEQ ID NO: 518014 - RNA, 64 nt, Homo Sapiens
guuugccagcauuggaaaaaagagcugucagaagacuugggaaggauagcuaccuggacuuuac

SEQ ID NO: 518015 - RNA, 64 nt, Homo Sapiens
uucccuauagcuucuaagcaguuucaucagcauuacuugggaaaacguguugcaagucaaccag

SEQ ID NO: 518016 - RNA, 64 nt, Homo Sapiens
ccgggcaugauggugggcaccuguaaucccagcuacuugggaggcugaggcaggagaaucacuu

SEQ ID NO: 518017 - RNA, 64 nt, Homo Sapiens
uggagguugcagugagccaacaagaaucacuugaacuugggaggcuacuugggaggcugaggca

SEQ ID NO: 518018 - RNA, 64 nt, Homo Sapiens
cugaggcacaagaaucacuucuguaaucucagcuacuugggaggccaggugugguggugggcac

SEQ ID NO: 518019 - RNA, 64 nt, Homo Sapiens
uagaguguuaccuccaacucauuugauuucccuuacuugggaaaaugcaguccaguguucucac

SEQ ID NO: 518020 - RNA, 64 nt, Homo Sapiens
ccgggcauggugucaggcaccuguaaucccagcuacuugggaggcugaggcaggagaauugcuu

SEQ ID NO: 518021 - RNA, 64 nt, Homo Sapiens
gggacagucuuuagauauuauuugcuuggagaagacuugggacuaacauggauguuaaggcugu

SEQ ID NO: 518022 - RNA, 64 nt, Homo Sapiens
ggaauaaauuaaaguuuucauauacauucuggauacuugggaggauuucucaaagcuaaagaga

SEQ ID NO: 518023 - RNA, 64 nt, Homo Sapiens
cagcugagaagagagcagacaaagcuacagguuuacuugggagccgagagcugggagaagaggc

SEQ ID NO: 518024 - RNA, 64 nt, Homo Sapiens
gaacgcagagcucccagccuugaccaucagaccuacuugggagauggggcugaugagaacaucg

SEQ ID NO: 518025 - RNA, 64 nt, Homo Sapiens
uuccuguagucuucagugguaagcaguugccccgacuugggauucuuucuggccauuuggacaa

SEQ ID NO: 518026 - RNA, 64 nt, Homo Sapiens
gggacucuagcagcaccucuuguggucucuugggacuugggacaugaagaagaaaccaauguac

SEQ ID NO: 518027 - RNA, 64 nt, Homo Sapiens
acgagcccugguucagucacgccccauccucgucacuugggaccugggacuuggucucuguccu

SEQ ID NO: 518028 - RNA, 64 nt, Homo Sapiens
agcuacacagggagcuagaacguuaggaagagagacuugggaacagaguccaagggagcagcca

SEQ ID NO: 518029 - RNA, 64 nt, Homo Sapiens
aggguggcucaacccacaaaucaacugaucuacuacuugggagacaguggaaggaaagauagag

SEQ ID NO: 518030 - RNA, 64 nt, Homo Sapiens
aaauaggcagauauagcuuuuuaaaauauaaaguacuugggauuuugcauuauuuuucuuaaua

SEQ ID NO: 518031 - RNA, 64 nt, Homo Sapiens
cugggugugggggcgugcgccuguagucccagcuacuugggaggcugaggcaggagaauugcuu

SEQ ID NO: 518032 - RNA, 64 nt, Homo Sapiens
aguguuguauuuuucugcaaaauagugaauugguacuugggagacuucuguucuuuguugaaaa

SEQ ID NO: 518033 - RNA, 64 nt, Homo Sapiens
gaugaacaaaauacuauagcaugcaugccacugcacuugggaccucaucaugucaguugaaucg

SEQ ID NO: 518034 - RNA, 64 nt, Homo Sapiens
uauguagacuagcacagagugguacauccuaaaaacuugggaaacacagcaacccaugacuucc

SEQ ID NO: 518035 - RNA, 64 nt, Homo Sapiens
ucagcuuaaugacccagggguguauuuuugaaggacuugggagcucucuuugaaaggcaaacaa

SEQ ID NO: 518036 - RNA, 64 nt, Homo Sapiens
ugucuuucccugugugugaaaucuuaacgucucuacuugggaacgcugaucccauucauuuaga

SEQ ID NO: 518037 - RNA, 64 nt, Homo Sapiens
ucuggucuaagugggccuccccuguagcuaauggacuugggauuccgaugucccugaauaucag

SEQ ID NO: 518038 - RNA, 64 nt, Homo Sapiens
cuaaggcucucaaaacgggccuucugugcuguccacuugggaagucuagccacuccucccagcu

SEQ ID NO: 518039 - RNA, 64 nt, Homo Sapiens
uggaggccaagauuguaccaggagaauugcuugaacuugggaggcuacuugggaggcugaggca

SEQ ID NO: 518040 - RNA, 64 nt, Homo Sapiens
cugaggcaggagaauugcuucuguaauccuagcuacuugggaggccgggcgugguggugggugc

SEQ ID NO: 518041 - RNA, 64 nt, Homo Sapiens
cugaggcaggagaauugcuucuguagucucagcuacuugggaggcugggcuuaguggugcaugc

SEQ ID NO: 518042 - RNA, 64 nt, Homo Sapiens
cugaggcaggagagugcuugcuguaaucccagcuacuugggaggccgggcgugguggcaggugc

SEQ ID NO: 518043 - RNA, 64 nt, Homo Sapiens
gaaagagaagguuuuuaaggaggggcuucugaauacuugggagauacggaacggaccaaggacc

SEQ ID NO: 518044 - RNA, 64 nt, Homo Sapiens
caaaauuaugagugagcuguuaacucuaaaauguacuugggagauaggccaagcgagaggucau

SEQ ID NO: 518045 - RNA, 64 nt, Homo Sapiens
gcuggucgcaguggcuuacacuuguaacccuagaacuugggaggcugaggugggcggauuacuu

SEQ ID NO: 518046 - RNA, 64 nt, Homo Sapiens
ccgggugugguagugcaugccuguagucccagcuacuugggaggcugaagugggaggauggccu

SEQ ID NO: 518047 - RNA, 64 nt, Homo Sapiens; identical to SEQ ID NO: 275345

SEQ ID NO: 518048 - RNA, 64 nt, Homo Sapiens; identical to SEQ ID NO: 275346

SEQ ID NO: 518049 - RNA, 64 nt, Homo Sapiens; identical to SEQ ID NO: 275347

SEQ ID NO: 518050 - RNA, 64 nt, Homo Sapiens; identical to SEQ ID NO: 275348

SEQ ID NO: 518051 - RNA, 64 nt, Homo Sapiens; identical to SEQ ID NO: 275349

SEQ ID NO: 518052 - RNA, 64 nt, Homo Sapiens; identical to SEQ ID NO: 275350

SEQ ID NO: 518053 - RNA, 64 nt, Homo Sapiens; identical to SEQ ID NO: 275351

SEQ ID NO: 518054 - RNA, 64 nt, Homo Sapiens; identical to SEQ ID NO: 275352

SEQ ID NO: 518055 - RNA, 64 nt, Homo Sapiens; identical to SEQ ID NO: 275353

SEQ ID NO: 518056 - RNA, 64 nt, Homo Sapiens; identical to SEQ ID NO: 275354

SEQ ID NO: 518057 - RNA, 64 nt, Homo Sapiens; identical to SEQ ID NO: 275355

SEQ ID NO: 518058 - RNA, 64 nt, Homo Sapiens; identical to SEQ ID NO: 275356

SEQ ID NO: 518059 - RNA, 64 nt, Homo Sapiens; identical to SEQ ID NO: 275357

SEQ ID NO: 518060 - RNA, 64 nt, Homo Sapiens; identical to SEQ ID NO: 275358

SEQ ID NO: 518061 - RNA, 64 nt, Homo Sapiens; identical to SEQ ID NO: 275359

SEQ ID NO: 518062 - RNA, 64 nt, Homo Sapiens; identical to SEQ ID NO: 275360

SEQ ID NO: 518063 - RNA, 64 nt, Homo Sapiens; identical to SEQ ID NO: 275361

SEQ ID NO: 518064 - RNA, 64 nt, Homo Sapiens; identical to SEQ ID NO: 275362

SEQ ID NO: 518065 - RNA, 64 nt, Homo Sapiens; identical to SEQ ID NO: 97063

SEQ ID NO: 518066 - RNA, 64 nt, Homo Sapiens; identical to SEQ ID NO: 97064

SEQ ID NO: 518067 - RNA, 64 nt, Homo Sapiens; identical to SEQ ID NO: 97065

SEQ ID NO: 518068 - RNA, 64 nt, Homo Sapiens; identical to SEQ ID NO: 97066

SEQ ID NO: 518069 - RNA, 64 nt, Homo Sapiens; identical to SEQ ID NO: 97067

SEQ ID NO: 518070 - RNA, 64 nt, Homo Sapiens; identical to SEQ ID NO: 97068

SEQ ID NO: 518071 - RNA, 64 nt, Homo Sapiens; identical to SEQ ID NO: 97069

SEQ ID NO: 518072 - RNA, 64 nt, Homo Sapiens; identical to SEQ ID NO: 97070

SEQ ID NO: 518073 - RNA, 64 nt, Homo Sapiens; identical to SEQ ID NO: 97071

SEQ ID NO: 518074 - RNA, 64 nt, Homo Sapiens; identical to SEQ ID NO: 97072

SEQ ID NO: 518075 - RNA, 64 nt, Homo Sapiens; identical to SEQ ID NO: 97073

SEQ ID NO: 518076 - RNA, 64 nt, Homo Sapiens; identical to SEQ ID NO: 97074

SEQ ID NO: 518077 - RNA, 64 nt, Homo Sapiens; identical to SEQ ID NO: 97075

SEQ ID NO: 518078 - RNA, 64 nt, Homo Sapiens; identical to SEQ ID NO: 97076

SEQ ID NO: 518079 - RNA, 64 nt, Homo Sapiens; identical to SEQ ID NO: 97077

SEQ ID NO: 518080 - RNA, 64 nt, Homo Sapiens; identical to SEQ ID NO: 97078

SEQ ID NO: 518081 - RNA, 64 nt, Homo Sapiens; identical to SEQ ID NO: 97079

SEQ ID NO: 518082 - RNA, 64 nt, Homo Sapiens; identical to SEQ ID NO: 97080

SEQ ID NO: 518083 - RNA, 64 nt, Homo Sapiens; identical to SEQ ID NO: 97081

SEQ ID NO: 518084 - RNA, 64 nt, Homo Sapiens; identical to SEQ ID NO: 97082

SEQ ID NO: 518085 - RNA, 64 nt, Homo Sapiens; identical to SEQ ID NO: 97083

SEQ ID NO: 518086 - RNA, 64 nt, Homo Sapiens; identical to SEQ ID NO: 97084

SEQ ID NO: 518087 - RNA, 64 nt, Homo Sapiens; identical to SEQ ID NO: 97085

SEQ ID NO: 518088 - RNA, 64 nt, Homo Sapiens; identical to SEQ ID NO: 97086

SEQ ID NO: 518089 - RNA, 64 nt, Homo Sapiens; identical to SEQ ID NO: 97087

SEQ ID NO: 518090 - RNA, 64 nt, Homo Sapiens
aaauuuacacagacucugaauacaugcucggucacucauugagaaauuucauuugaguuaaauu

SEQ ID NO: 518091 - RNA, 64 nt, Homo Sapiens
ggccaugcuggucaugucuauccguugaaugaagcucauugauuguggcacuuggccaggacgc

SEQ ID NO: 518092 - RNA, 64 nt, Homo Sapiens
cucauuugucuuccuacccuacucacauaauucacucauugacucacucauucaccagauauuu

SEQ ID NO: 518093 - RNA, 64 nt, Homo Sapiens
cccagcuucuggaaauggcagaagagaggguuuucucauugaaugggggugggggcucgugugu

SEQ ID NO: 518094 - RNA, 64 nt, Homo Sapiens
gcagaguggaugcaguuuguagcuuucagagugucucauugagucuagaucauugaaccaacac

SEQ ID NO: 518095 - RNA, 64 nt, Homo Sapiens
uucucaucuuuucauauaccucuaacccccgguacucauugaaucauugaugagguaucucaau

SEQ ID NO: 518096 - RNA, 64 nt, Homo Sapiens
ucuuuuccuaucagaauguuggccuugcucagcucucauugagagaggaauuugguauucuggu

SEQ ID NO: 518097 - RNA, 64 nt, Homo Sapiens
aaagguagggccaauuaaggugcuuccuguucugcucauugaucauauuugcauuugaaaggau

SEQ ID NO: 518098 - RNA, 64 nt, Homo Sapiens; identical to SEQ ID NO: 124927

SEQ ID NO: 518099 - RNA, 64 nt, Homo Sapiens; identical to SEQ ID NO: 124928

SEQ ID NO: 518100 - RNA, 64 nt, Homo Sapiens; identical to SEQ ID NO: 124929

SEQ ID NO: 518101 - RNA, 64 nt, Homo Sapiens; identical to SEQ ID NO: 124930

SEQ ID NO: 518102 - RNA, 64 nt, Homo Sapiens; identical to SEQ ID NO: 124931

SEQ ID NO: 518103 - RNA, 64 nt, Homo Sapiens; identical to SEQ ID NO: 124932

SEQ ID NO: 518104 - RNA, 64 nt, Homo Sapiens; identical to SEQ ID NO: 124933

SEQ ID NO: 518105 - RNA, 64 nt, Homo Sapiens; identical to SEQ ID NO: 124934

SEQ ID NO: 518106 - RNA, 64 nt, Homo Sapiens; identical to SEQ ID NO: 124935

SEQ ID NO: 518107 - RNA, 64 nt, Homo Sapiens; identical to SEQ ID NO: 124936

SEQ ID NO: 518108 - RNA, 64 nt, Homo Sapiens; identical to SEQ ID NO: 124937

SEQ ID NO: 518109 - RNA, 64 nt, Homo Sapiens; identical to SEQ ID NO: 124938

SEQ ID NO: 518110 - RNA, 64 nt, Homo Sapiens; identical to SEQ ID NO: 124939

SEQ ID NO: 518111 - RNA, 64 nt, Homo Sapiens; identical to SEQ ID NO: 124940

SEQ ID NO: 518112 - RNA, 64 nt, Homo Sapiens; identical to SEQ ID NO: 124941

SEQ ID NO: 518113 - RNA, 64 nt, Homo Sapiens; identical to SEQ ID NO: 124942

SEQ ID NO: 518114 - RNA, 64 nt, Homo Sapiens; identical to SEQ ID NO: 124943

SEQ ID NO: 518115 - RNA, 64 nt, Homo Sapiens; identical to SEQ ID NO: 124944

SEQ ID NO: 518116 - RNA, 64 nt, Homo Sapiens; identical to SEQ ID NO: 124945

SEQ ID NO: 518117 - RNA, 64 nt, Homo Sapiens; identical to SEQ ID NO: 124946

SEQ ID NO: 518118 - RNA, 64 nt, Homo Sapiens; identical to SEQ ID NO: 124947

SEQ ID NO: 518119 - RNA, 64 nt, Homo Sapiens; identical to SEQ ID NO: 124948

SEQ ID NO: 518120 - RNA, 64 nt, Homo Sapiens; identical to SEQ ID NO: 124949

SEQ ID NO: 518121 - RNA, 64 nt, Homo Sapiens; identical to SEQ ID NO: 124950

SEQ ID NO: 518122 - RNA, 64 nt, Homo Sapiens; identical to SEQ ID NO: 124951

SEQ ID NO: 518123 - RNA, 64 nt, Homo Sapiens; identical to SEQ ID NO: 124952

SEQ ID NO: 518124 - RNA, 64 nt, Homo Sapiens; identical to SEQ ID NO: 124953

SEQ ID NO: 518125 - RNA, 64 nt, Homo Sapiens; identical to SEQ ID NO: 124954

SEQ ID NO: 518126 - RNA, 64 nt, Homo Sapiens; identical to SEQ ID NO: 124955

SEQ ID NO: 518127 - RNA, 64 nt, Homo Sapiens; identical to SEQ ID NO: 124956

SEQ ID NO: 518128 - RNA, 64 nt, Homo Sapiens; identical to SEQ ID NO: 124957

SEQ ID NO: 518129 - RNA, 64 nt, Homo Sapiens; identical to SEQ ID NO: 124958

SEQ ID NO: 518130 - RNA, 64 nt, Homo Sapiens; identical to SEQ ID NO: 124959

SEQ ID NO: 518131 - RNA, 64 nt, Homo Sapiens; identical to SEQ ID NO: 124960

SEQ ID NO: 518132 - RNA, 64 nt, Homo Sapiens; identical to SEQ ID NO: 124961

SEQ ID NO: 518133 - RNA, 64 nt, Homo Sapiens; identical to SEQ ID NO: 124962

SEQ ID NO: 518134 - RNA, 64 nt, Homo Sapiens; identical to SEQ ID NO: 124963

SEQ ID NO: 518135 - RNA, 64 nt, Homo Sapiens; identical to SEQ ID NO: 124964

SEQ ID NO: 518136 - RNA, 64 nt, Homo Sapiens; identical to SEQ ID NO: 124965

SEQ ID NO: 518137 - RNA, 64 nt, Homo Sapiens; identical to SEQ ID NO: 124966

SEQ ID NO: 518138 - RNA, 64 nt, Homo Sapiens; identical to SEQ ID NO: 124967

SEQ ID NO: 518139 - RNA, 63 nt, Homo Sapiens; identical to SEQ ID NO: 124968

SEQ ID NO: 518140 - RNA, 64 nt, Homo Sapiens; identical to SEQ ID NO: 124969

SEQ ID NO: 518141 - RNA, 64 nt, Homo Sapiens; identical to SEQ ID NO: 124970

SEQ ID NO: 518142 - RNA, 64 nt, Homo Sapiens; identical to SEQ ID NO: 124971

SEQ ID NO: 518143 - RNA, 64 nt, Homo Sapiens; identical to SEQ ID NO: 124972

SEQ ID NO: 518144 - RNA, 64 nt, Homo Sapiens; identical to SEQ ID NO: 124973

SEQ ID NO: 518145 - RNA, 64 nt, Homo Sapiens; identical to SEQ ID NO: 124974

SEQ ID NO: 518146 - RNA, 64 nt, Homo Sapiens; identical to SEQ ID NO: 124975

SEQ ID NO: 518147 - RNA, 64 nt, Homo Sapiens; identical to SEQ ID NO: 124976

SEQ ID NO: 518148 - RNA, 64 nt, Homo Sapiens; identical to SEQ ID NO: 124977

SEQ ID NO: 518149 - RNA, 64 nt, Homo Sapiens; identical to SEQ ID NO: 124977

SEQ ID NO: 518150 - RNA, 64 nt, Homo Sapiens; identical to SEQ ID NO: 124979

SEQ ID NO: 518151 - RNA, 64 nt, Homo Sapiens; identical to SEQ ID NO: 124980

SEQ ID NO: 518152 - RNA, 64 nt, Homo Sapiens; identical to SEQ ID NO: 124981

SEQ ID NO: 518153 - RNA, 64 nt, Homo Sapiens; identical to SEQ ID NO: 124982

SEQ ID NO: 518154 - RNA, 64 nt, Homo Sapiens; identical to SEQ ID NO: 124983

SEQ ID NO: 518155 - RNA, 64 nt, Homo Sapiens; identical to SEQ ID NO: 124984

SEQ ID NO: 518156 - RNA, 64 nt, Homo Sapiens; identical to SEQ ID NO: 124985

SEQ ID NO: 518157 - RNA, 64 nt, Homo Sapiens; identical to SEQ ID NO: 124986

SEQ ID NO: 518158 - RNA, 64 nt, Homo Sapiens; identical to SEQ ID NO: 124987

SEQ ID NO: 518159 - RNA, 64 nt, Homo Sapiens; identical to SEQ ID NO: 124988

SEQ ID NO: 518160 - RNA, 64 nt, Homo Sapiens; identical to SEQ ID NO: 124989

SEQ ID NO: 518161 - RNA, 64 nt, Homo Sapiens; identical to SEQ ID NO: 124990

SEQ ID NO: 518162 - RNA, 64 nt, Homo Sapiens; identical to SEQ ID NO: 124991

SEQ ID NO: 518163 - RNA, 64 nt, Homo Sapiens; identical to SEQ ID NO: 124992

SEQ ID NO: 518164 - RNA, 64 nt, Homo Sapiens; identical to SEQ ID NO: 124993

SEQ ID NO: 518165 - RNA, 64 nt, Homo Sapiens; identical to SEQ ID NO: 124994

SEQ ID NO: 518166 - RNA, 64 nt, Homo Sapiens; identical to SEQ ID NO: 124995

SEQ ID NO: 518167 - RNA, 64 nt, Homo Sapiens; identical to SEQ ID NO: 124996

SEQ ID NO: 518168 - RNA, 64 nt, Homo Sapiens; identical to SEQ ID NO: 124997

SEQ ID NO: 518169 - RNA, 64 nt, Homo Sapiens; identical to SEQ ID NO: 124998

SEQ ID NO: 518170 - RNA, 64 nt, Homo Sapiens; identical to SEQ ID NO: 124999

SEQ ID NO: 518171 - RNA, 64 nt, Homo Sapiens; identical to SEQ ID NO: 125000

SEQ ID NO: 518172 - RNA, 64 nt, Homo Sapiens; identical to SEQ ID NO: 125001

SEQ ID NO: 518173 - RNA, 64 nt, Homo Sapiens; identical to SEQ ID NO: 125002

SEQ ID NO: 518174 - RNA, 64 nt, Homo Sapiens; identical to SEQ ID NO: 376494

SEQ ID NO: 518175 - RNA, 64 nt, Homo Sapiens; identical to SEQ ID NO: 376495

SEQ ID NO: 518176 - RNA, 64 nt, Homo Sapiens; identical to SEQ ID NO: 376496

SEQ ID NO: 518177 - RNA, 64 nt, Homo Sapiens; identical to SEQ ID NO: 376497

SEQ ID NO: 518178 - RNA, 64 nt, Homo Sapiens; identical to SEQ ID NO: 376498

SEQ ID NO: 518179 - RNA, 64 nt, Homo Sapiens; identical to SEQ ID NO: 376499

SEQ ID NO: 518180 - RNA, 64 nt, Homo Sapiens; identical to SEQ ID NO: 56439

SEQ ID NO: 518181 - RNA, 64 nt, Homo Sapiens; identical to SEQ ID NO: 56440

SEQ ID NO: 518182 - RNA, 64 nt, Homo Sapiens; identical to SEQ ID NO: 56441

SEQ ID NO: 518183 - RNA, 64 nt, Homo Sapiens; identical to SEQ ID NO: 56442

SEQ ID NO: 518184 - RNA, 64 nt, Homo Sapiens; identical to SEQ ID NO: 56443

SEQ ID NO: 518185 - RNA, 64 nt, Homo Sapiens; identical to SEQ ID NO: 56444

SEQ ID NO: 518186 - RNA, 64 nt, Homo Sapiens; identical to SEQ ID NO: 56445

SEQ ID NO: 518187 - RNA, 64 nt, Homo Sapiens; identical to SEQ ID NO: 56446

SEQ ID NO: 518188 - RNA, 64 nt, Homo Sapiens; identical to SEQ ID NO: 56447

SEQ ID NO: 518189 - RNA, 64 nt, Homo Sapiens; identical to SEQ ID NO: 56448

SEQ ID NO: 518190 - RNA, 64 nt, Homo Sapiens; identical to SEQ ID NO: 56449

SEQ ID NO: 518191 - RNA, 64 nt, Homo Sapiens; identical to SEQ ID NO: 56450

SEQ ID NO: 518192 - RNA, 64 nt, Homo Sapiens; identical to SEQ ID NO: 56451

SEQ ID NO: 518193 - RNA, 64 nt, Homo Sapiens; identical to SEQ ID NO: 56452

SEQ ID NO: 518194 - RNA, 64 nt, Homo Sapiens; identical to SEQ ID NO: 56453

SEQ ID NO: 518195 - RNA, 64 nt, Homo Sapiens; identical to SEQ ID NO: 56454

SEQ ID NO: 518196 - RNA, 64 nt, Homo Sapiens; identical to SEQ ID NO: 56455

SEQ ID NO: 518197 - RNA, 64 nt, Homo Sapiens; identical to SEQ ID NO: 56456

SEQ ID NO: 518198 - RNA, 64 nt, Homo Sapiens; identical to SEQ ID NO: 56457

SEQ ID NO: 518199 - RNA, 64 nt, Homo Sapiens; identical to SEQ ID NO: 56458

SEQ ID NO: 518200 - RNA, 64 nt, Homo Sapiens; identical to SEQ ID NO: 56459

SEQ ID NO: 518201 - RNA, 64 nt, Homo Sapiens; identical to SEQ ID NO: 56460

SEQ ID NO: 518202 - RNA, 64 nt, Homo Sapiens; identical to SEQ ID NO: 56461

SEQ ID NO: 518203 - RNA, 64 nt, Homo Sapiens; identical to SEQ ID NO: 56462

SEQ ID NO: 518204 - RNA, 64 nt, Homo Sapiens; identical to SEQ ID NO: 56463

SEQ ID NO: 518205 - RNA, 64 nt, Homo Sapiens; identical to SEQ ID NO: 56464

SEQ ID NO: 518206 - RNA, 64 nt, Homo Sapiens; identical to SEQ ID NO: 56465

SEQ ID NO: 518207 - RNA, 64 nt, Homo Sapiens; identical to SEQ ID NO: 56466

SEQ ID NO: 518208 - RNA, 64 nt, Homo Sapiens; identical to SEQ ID NO: 56467

SEQ ID NO: 518209 - RNA, 50 nt, Homo Sapiens; identical to SEQ ID NO: 56468

SEQ ID NO: 518210 - RNA, 64 nt, Homo Sapiens; identical to SEQ ID NO: 56469

SEQ ID NO: 518211 - RNA, 64 nt, Homo Sapiens; identical to SEQ ID NO: 56470

SEQ ID NO: 518212 - RNA, 64 nt, Homo Sapiens; identical to SEQ ID NO: 56471

SEQ ID NO: 518213 - RNA, 64 nt, Homo Sapiens; identical to SEQ ID NO: 56472

SEQ ID NO: 518214 - RNA, 64 nt, Homo Sapiens; identical to SEQ ID NO: 56473

SEQ ID NO: 518215 - RNA, 64 nt, Homo Sapiens; identical to SEQ ID NO: 56474

SEQ ID NO: 518216 - RNA, 64 nt, Homo Sapiens; identical to SEQ ID NO: 56475

SEQ ID NO: 518217 - RNA, 64 nt, Homo Sapiens; identical to SEQ ID NO: 56476

SEQ ID NO: 518218 - RNA, 64 nt, Homo Sapiens; identical to SEQ ID NO: 56477

SEQ ID NO: 518219 - RNA, 64 nt, Homo Sapiens; identical to SEQ ID NO: 56478

SEQ ID NO: 518220 - RNA, 64 nt, Homo Sapiens; identical to SEQ ID NO: 56479

SEQ ID NO: 518221 - RNA, 64 nt, Homo Sapiens; identical to SEQ ID NO: 56480

SEQ ID NO: 518222 - RNA, 64 nt, Homo Sapiens; identical to SEQ ID NO: 56481

SEQ ID NO: 518223 - RNA, 64 nt, Homo Sapiens; identical to SEQ ID NO: 56482

SEQ ID NO: 518224 - RNA, 64 nt, Homo Sapiens; identical to SEQ ID NO: 56483

SEQ ID NO: 518225 - RNA, 64 nt, Homo Sapiens; identical to SEQ ID NO: 56484

SEQ ID NO: 518226 - RNA, 64 nt, Homo Sapiens; identical to SEQ ID NO: 56485

SEQ ID NO: 518227 - RNA, 64 nt, Homo Sapiens; identical to SEQ ID NO: 56486

SEQ ID NO: 518228 - RNA, 64 nt, Homo Sapiens; identical to SEQ ID NO: 56487

SEQ ID NO: 518229 - RNA, 64 nt, Homo Sapiens; identical to SEQ ID NO: 56488

SEQ ID NO: 518230 - RNA, 64 nt, Homo Sapiens; identical to SEQ ID NO: 56489

SEQ ID NO: 518231 - RNA, 64 nt, Homo Sapiens; identical to SEQ ID NO: 56490

SEQ ID NO: 518232 - RNA, 64 nt, Homo Sapiens; identical to SEQ ID NO: 56491

SEQ ID NO: 518233 - RNA, 64 nt, Homo Sapiens; identical to SEQ ID NO: 56492

SEQ ID NO: 518234 - RNA, 64 nt, Homo Sapiens; identical to SEQ ID NO: 56493

SEQ ID NO: 518235 - RNA, 64 nt, Homo Sapiens; identical to SEQ ID NO: 56494

SEQ ID NO: 518236 - RNA, 64 nt, Homo Sapiens; identical to SEQ ID NO: 56495

SEQ ID NO: 518237 - RNA, 64 nt, Homo Sapiens; identical to SEQ ID NO: 56496

SEQ ID NO: 518238 - RNA, 64 nt, Homo Sapiens; identical to SEQ ID NO: 56497

SEQ ID NO: 518239 - RNA, 64 nt, Homo Sapiens; identical to SEQ ID NO: 56498

SEQ ID NO: 518240 - RNA, 64 nt, Homo Sapiens; identical to SEQ ID NO: 56499

SEQ ID NO: 518241 - RNA, 64 nt, Homo Sapiens; identical to SEQ ID NO: 56500

SEQ ID NO: 518242 - RNA, 64 nt, Homo Sapiens; identical to SEQ ID NO: 56501

SEQ ID NO: 518243 - RNA, 64 nt, Homo Sapiens; identical to SEQ ID NO: 56502

SEQ ID NO: 518244 - RNA, 64 nt, Homo Sapiens; identical to SEQ ID NO: 56503

SEQ ID NO: 518245 - RNA, 64 nt, Homo Sapiens; identical to SEQ ID NO: 56504

SEQ ID NO: 518246 - RNA, 64 nt, Homo Sapiens; identical to SEQ ID NO: 56505

SEQ ID NO: 518247 - RNA, 64 nt, Homo Sapiens; identical to SEQ ID NO: 56506

SEQ ID NO: 518248 - RNA, 64 nt, Homo Sapiens; identical to SEQ ID NO: 56507

SEQ ID NO: 518249 - RNA, 64 nt, Homo Sapiens; identical to SEQ ID NO: 56508

SEQ ID NO: 518250 - RNA, 64 nt, Homo Sapiens; identical to SEQ ID NO: 56509

SEQ ID NO: 518251 - RNA, 64 nt, Homo Sapiens; identical to SEQ ID NO: 56510

SEQ ID NO: 518252 - RNA, 64 nt, Homo Sapiens; identical to SEQ ID NO: 56511

SEQ ID NO: 518253 - RNA, 64 nt, Homo Sapiens; identical to SEQ ID NO: 56512

SEQ ID NO: 518254 - RNA, 64 nt, Homo Sapiens; identical to SEQ ID NO: 56513

SEQ ID NO: 518255 - RNA, 64 nt, Homo Sapiens; identical to SEQ ID NO: 56514

SEQ ID NO: 518256 - RNA, 64 nt, Homo Sapiens; identical to SEQ ID NO: 56515

SEQ ID NO: 518257 - RNA, 64 nt, Homo Sapiens; identical to SEQ ID NO: 56516

SEQ ID NO: 518258 - RNA, 64 nt, Homo Sapiens; identical to SEQ ID NO: 56517

SEQ ID NO: 518259 - RNA, 64 nt, Homo Sapiens; identical to SEQ ID NO: 56518

SEQ ID NO: 518260 - RNA, 64 nt, Homo Sapiens; identical to SEQ ID NO: 56519

SEQ ID NO: 518261 - RNA, 64 nt, Homo Sapiens; identical to SEQ ID NO: 56520

SEQ ID NO: 518262 - RNA, 64 nt, Homo Sapiens; identical to SEQ ID NO: 56521

SEQ ID NO: 518263 - RNA, 64 nt, Homo Sapiens; identical to SEQ ID NO: 56522

SEQ ID NO: 518264 - RNA, 64 nt, Homo Sapiens; identical to SEQ ID NO: 56523

SEQ ID NO: 518265 - RNA, 64 nt, Homo Sapiens; identical to SEQ ID NO: 56524

SEQ ID NO: 518266 - RNA, 64 nt, Homo Sapiens; identical to SEQ ID NO: 56525

SEQ ID NO: 518267 - RNA, 64 nt, Homo Sapiens; identical to SEQ ID NO: 56526

SEQ ID NO: 518268 - RNA, 64 nt, Homo Sapiens; identical to SEQ ID NO: 56527

SEQ ID NO: 518269 - RNA, 64 nt, Homo Sapiens; identical to SEQ ID NO: 56528

SEQ ID NO: 518270 - RNA, 64 nt, Homo Sapiens; identical to SEQ ID NO: 56529

SEQ ID NO: 518271 - RNA, 64 nt, Homo Sapiens; identical to SEQ ID NO: 56530

SEQ ID NO: 518272 - RNA, 64 nt, Homo Sapiens; identical to SEQ ID NO: 56531

SEQ ID NO: 518273 - RNA, 64 nt, Homo Sapiens; identical to SEQ ID NO: 56532

SEQ ID NO: 518274 - RNA, 64 nt, Homo Sapiens; identical to SEQ ID NO: 56533

SEQ ID NO: 518275 - RNA, 64 nt, Homo Sapiens; identical to SEQ ID NO: 56534

SEQ ID NO: 518276 - RNA, 59 nt, Homo Sapiens; identical to SEQ ID NO: 56535

SEQ ID NO: 518277 - RNA, 64 nt, Homo Sapiens; identical to SEQ ID NO: 56536

SEQ ID NO: 518278 - RNA, 64 nt, Homo Sapiens; identical to SEQ ID NO: 56537

SEQ ID NO: 518279 - RNA, 64 nt, Homo Sapiens; identical to SEQ ID NO: 56538

SEQ ID NO: 518280 - RNA, 64 nt, Homo Sapiens; identical to SEQ ID NO: 56539

SEQ ID NO: 518281 - RNA, 64 nt, Homo Sapiens; identical to SEQ ID NO: 56540

SEQ ID NO: 518282 - RNA, 64 nt, Homo Sapiens; identical to SEQ ID NO: 56541

SEQ ID NO: 518283 - RNA, 64 nt, Homo Sapiens; identical to SEQ ID NO: 56542

SEQ ID NO: 518284 - RNA, 64 nt, Homo Sapiens; identical to SEQ ID NO: 56543

SEQ ID NO: 518285 - RNA, 64 nt, Homo Sapiens; identical to SEQ ID NO: 56544

SEQ ID NO: 518286 - RNA, 64 nt, Homo Sapiens; identical to SEQ ID NO: 56545

SEQ ID NO: 518287 - RNA, 64 nt, Homo Sapiens; identical to SEQ ID NO: 56546

SEQ ID NO: 518288 - RNA, 64 nt, Homo Sapiens; identical to SEQ ID NO: 56547

SEQ ID NO: 518289 - RNA, 64 nt, Homo Sapiens; identical to SEQ ID NO: 56548

SEQ ID NO: 518290 - RNA, 64 nt, Homo Sapiens; identical to SEQ ID NO: 56549

SEQ ID NO: 518291 - RNA, 64 nt, Homo Sapiens; identical to SEQ ID NO: 56550

SEQ ID NO: 518292 - RNA, 64 nt, Homo Sapiens; identical to SEQ ID NO: 56551

SEQ ID NO: 518293 - RNA, 64 nt, Homo Sapiens; identical to SEQ ID NO: 56552

SEQ ID NO: 518294 - RNA, 64 nt, Homo Sapiens; identical to SEQ ID NO: 56553

SEQ ID NO: 518295 - RNA, 64 nt, Homo Sapiens; identical to SEQ ID NO: 56554

SEQ ID NO: 518296 - RNA, 64 nt, Homo Sapiens; identical to SEQ ID NO: 56555

SEQ ID NO: 518297 - RNA, 64 nt, Homo Sapiens; identical to SEQ ID NO: 56556

SEQ ID NO: 518298 - RNA, 62 nt, Homo Sapiens; identical to SEQ ID NO: 56557

SEQ ID NO: 518299 - RNA, 58 nt, Homo Sapiens; identical to SEQ ID NO: 56558

SEQ ID NO: 518300 - RNA, 64 nt, Homo Sapiens; identical to SEQ ID NO: 56559

SEQ ID NO: 518301 - RNA, 64 nt, Homo Sapiens; identical to SEQ ID NO: 56560

SEQ ID NO: 518302 - RNA, 64 nt, Homo Sapiens; identical to SEQ ID NO: 56561

SEQ ID NO: 518303 - RNA, 64 nt, Homo Sapiens; identical to SEQ ID NO: 56562

SEQ ID NO: 518304 - RNA, 64 nt, Homo Sapiens; identical to SEQ ID NO: 56563

SEQ ID NO: 518305 - RNA, 64 nt, Homo Sapiens; identical to SEQ ID NO: 56564

SEQ ID NO: 518306 - RNA, 64 nt, Homo Sapiens; identical to SEQ ID NO: 56565

SEQ ID NO: 518307 - RNA, 64 nt, Homo Sapiens; identical to SEQ ID NO: 56566

SEQ ID NO: 518308 - RNA, 64 nt, Homo Sapiens; identical to SEQ ID NO: 56567

SEQ ID NO: 518309 - RNA, 64 nt, Homo Sapiens; identical to SEQ ID NO: 56568

SEQ ID NO: 518310 - RNA, 64 nt, Homo Sapiens; identical to SEQ ID NO: 56569

SEQ ID NO: 518311 - RNA, 64 nt, Homo Sapiens; identical to SEQ ID NO: 56570

SEQ ID NO: 518312 - RNA, 64 nt, Homo Sapiens; identical to SEQ ID NO: 56571

SEQ ID NO: 518313 - RNA, 64 nt, Homo Sapiens; identical to SEQ ID NO: 56572

SEQ ID NO: 518314 - RNA, 64 nt, Homo Sapiens; identical to SEQ ID NO: 56573

SEQ ID NO: 518315 - RNA, 64 nt, Homo Sapiens; identical to SEQ ID NO: 56574

SEQ ID NO: 518316 - RNA, 64 nt, Homo Sapiens; identical to SEQ ID NO: 56575

SEQ ID NO: 518317 - RNA, 64 nt, Homo Sapiens; identical to SEQ ID NO: 56576

SEQ ID NO: 518318 - RNA, 64 nt, Homo Sapiens; identical to SEQ ID NO: 56577

SEQ ID NO: 518319 - RNA, 64 nt, Homo Sapiens; identical to SEQ ID NO: 56578

SEQ ID NO: 518320 - RNA, 64 nt, Homo Sapiens; identical to SEQ ID NO: 56579

SEQ ID NO: 518321 - RNA, 64 nt, Homo Sapiens; identical to SEQ ID NO: 56580

SEQ ID NO: 518322 - RNA, 64 nt, Homo Sapiens; identical to SEQ ID NO: 56581

SEQ ID NO: 518323 - RNA, 64 nt, Homo Sapiens; identical to SEQ ID NO: 56582

SEQ ID NO: 518324 - RNA, 64 nt, Homo Sapiens; identical to SEQ ID NO: 156540

SEQ ID NO: 518325 - RNA, 64 nt, Homo Sapiens; identical to SEQ ID NO: 156541

SEQ ID NO: 518326 - RNA, 64 nt, Homo Sapiens; identical to SEQ ID NO: 156542

SEQ ID NO: 518327 - RNA, 64 nt, Homo Sapiens; identical to SEQ ID NO: 156543

SEQ ID NO: 518328 - RNA, 64 nt, Homo Sapiens; identical to SEQ ID NO: 156544

SEQ ID NO: 518329 - RNA, 64 nt, Homo Sapiens; identical to SEQ ID NO: 156545

SEQ ID NO: 518330 - RNA, 64 nt, Homo Sapiens; identical to SEQ ID NO: 156546

SEQ ID NO: 518331 - RNA, 64 nt, Homo Sapiens; identical to SEQ ID NO: 156547

SEQ ID NO: 518332 - RNA, 64 nt, Homo Sapiens; identical to SEQ ID NO: 156548

SEQ ID NO: 518333 - RNA, 64 nt, Homo Sapiens; identical to SEQ ID NO: 156549

SEQ ID NO: 518334 - RNA, 64 nt, Homo Sapiens; identical to SEQ ID NO: 156550

SEQ ID NO: 518335 - RNA, 64 nt, Homo Sapiens; identical to SEQ ID NO: 156551

SEQ ID NO: 518336 - RNA, 64 nt, Homo Sapiens; identical to SEQ ID NO: 156552

SEQ ID NO: 518337 - RNA, 64 nt, Homo Sapiens; identical to SEQ ID NO: 156553

SEQ ID NO: 518338 - RNA, 64 nt, Homo Sapiens; identical to SEQ ID NO: 156554

SEQ ID NO: 518339 - RNA, 64 nt, Homo Sapiens
aauggggugggggugggagaggagguagauggggaagaaauaccccagacccaacaaaccucca

SEQ ID NO: 518340 - RNA, 64 nt, Homo Sapiens
cauuuuuagcccuuugacguggcuuaugccauucaagaaauaaaaagcaagagaaucagcuuug

SEQ ID NO: 518341 - RNA, 64 nt, Homo Sapiens
gaccuaaguccucgccgggccauggcucccagccaagaaauaaguacacacuaauaggcguggg

SEQ ID NO: 518342 - RNA, 64 nt, Homo Sapiens
cugacagcgguagaugccugugaggagcuacuacaagaaauagacaucaccccauuucuccuug

SEQ ID NO: 518343 - RNA, 64 nt, Homo Sapiens
ucgcuacucuguuucauagaaauccccauccaucaagaaauaugaaaguuaaggcuguaauaug

SEQ ID NO: 518344 - RNA, 64 nt, Homo Sapiens
ucaaugaugucuuuccauauucuuaucugggcuuaagaaauacauucuguauuuuuccagauuc

SEQ ID NO: 518345 - RNA, 64 nt, Homo Sapiens
uuccacuauuaugcguaaugcucagcuuuuuguaaagaaauauuuaauuguauuuuguguuuau

SEQ ID NO: 518346 - RNA, 64 nt, Homo Sapiens
uuugaaugauuugcugucacagacuauuugguagaagaaauauuuuucaccugagagaggaaga

SEQ ID NO: 518347 - RNA, 64 nt, Homo Sapiens
auaccauaagcauguauuaucuaagcacuugaucaagaaauauacauguuguacaagcucucaa

SEQ ID NO: 518348 - RNA, 64 nt, Homo Sapiens
uauauauauauacacacauacaaucaacacuuuuaagaaauauaaggaauuauucuuuucucac

SEQ ID NO: 518349 - RNA, 64 nt, Homo Sapiens
ggcaaaagagaacaucuuuuguucccacuauagcaagaaauaaaccccagguagcagaacucac

SEQ ID NO: 518350 - RNA, 64 nt, Homo Sapiens
cacucuaauuuuuaaaguaaaugguguacuuugcaagaaauaaguuuucccccgaggguuuucc

SEQ ID NO: 518351 - RNA, 64 nt, Homo Sapiens
auaauauaaaaccaucaaaugguauuuaccacugaagaaauauguuuuaauaauuuuuuaauga

SEQ ID NO: 518352 - RNA, 64 nt, Homo Sapiens
uagaguucagucccuagaagaaaaaaagaaaaaaaagaaauacacacagcaagacucuaucuca

SEQ ID NO: 518353 - RNA, 64 nt, Homo Sapiens
gaccagugucucuacuuuaaaguuccccccaaaaaagaaauacuacuucuacuccugcucuccu

SEQ ID NO: 518354 - RNA, 64 nt, Homo Sapiens
ugugucaugauuaauguguaccugcuguauccagaagaaauaauuuucucuuaacuuaauuuuu

SEQ ID NO: 518355 - RNA, 64 nt, Homo Sapiens
aagcacuuucucuuaacuuauuuuauaacaaaucaagaaauaugaaaucuagaggaucucuccu

SEQ ID NO: 518356 - RNA, 64 nt, Homo Sapiens
gugauuuuuaaaggauuaauggauauuaacucaaaagaaauagguaugaggguaaucgagauga

SEQ ID NO: 518357 - RNA, 64 nt, Homo Sapiens
agacaagacuaugauaucaauccugccuaaggcaaagaaauauacaaucagaaucacagaaaaa

SEQ ID NO: 518358 - RNA, 64 nt, Homo Sapiens
gaaaacugaggcaguuaacccggagguaaaacaaaagaaauauuagcaacauucgccauacuag

SEQ ID NO: 518359 - RNA, 64 nt, Homo Sapiens
gguacuuuacagcaacauucucgcugaagcacuuaagaaauaaaauuaguaauggcggaaacug

SEQ ID NO: 518360 - RNA, 64 nt, Homo Sapiens
ugaugaugugucuacuuuuuaguaauguauacaaaagaaauaugcauagaagucgugaauacua

SEQ ID NO: 518361 - RNA, 64 nt, Homo Sapiens
aggcauuuucaucuuuauuaguauuauuuucuaaaagaaauaggagaugcagcaagcuuauuaa

SEQ ID NO: 518362 - RNA, 64 nt, Homo Sapiens
aaugauggcagcaauuaagguuauguugaaaugcaagaaauaacgaagcugcuuuugaauuuug

SEQ ID NO: 518363 - RNA, 64 nt, Homo Sapiens
aauaacugcugguggaaagaagccaauggaaagaaagaaauauuaaguuuaacugaaauuaaua

SEQ ID NO: 518364 - RNA, 64 nt, Homo Sapiens
agaauuauuaguaauuugcuuaucaccuucaaagaagaaauaaggugggaacacagccaaacca

SEQ ID NO: 518365 - RNA, 64 nt, Homo Sapiens
gaauaauaaacauucauguacccacuaucagguuaagaaauagaacauuuauuaauauguagga

SEQ ID NO: 518366 - RNA, 64 nt, Homo Sapiens
agaaauagaacauuuauuaauauguaggaauguuaagaaauaaaacauuuaauaagaucucaga

SEQ ID NO: 518367 - RNA, 64 nt, Homo Sapiens
aaacucuuuuucuauaauacuaaauugugauuauaagaaauaguccaaauguuucugaagaauu

SEQ ID NO: 518368 - RNA, 64 nt, Homo Sapiens
cguaccuaaugcacacuuuaucuuuuauuguacaaagaaauaguguacaaaauucuuugguuuc

SEQ ID NO: 518369 - RNA, 64 nt, Homo Sapiens
ucagcuauuuuaaagaggaaauuaaauauuauaaaagaaauaguaaagauaaguuauccucacu

SEQ ID NO: 518370 - RNA, 64 nt, Homo Sapiens
aguaccuacuugaaaggaucauugugcggauuaaaagaaauaauauauguaaagcacuuuaaca

SEQ ID NO: 518371 - RNA, 64 nt, Homo Sapiens
accaagaggugauuuuuguacaaacuaauauaaaaagaaauaaauuggacuaacauucacguau

SEQ ID NO: 518372 - RNA, 64 nt, Homo Sapiens
aaccuucauuccuugaaucaugaauagagcaggcaagaaauacaagacuuuuaacaguccuucg

SEQ ID NO: 518373 - RNA, 64 nt, Homo Sapiens
cucccuucaauuaagaaauuaauuuagaguuuugaagaaauaguuaauugauaaagcucuguuu

SEQ ID NO: 518374 - RNA, 64 nt, Homo Sapiens
uauuucuaaaggcuauauugauuauuauaaaaugaagaaauaugcaaauuuuuaaaggggaagu

SEQ ID NO: 518375 - RNA, 64 nt, Homo Sapiens
uauuuaugaauuauaaauaugaauuuaauuacuaaagaaauaaaaauaaugguguaaagccaac

SEQ ID NO: 518376 - RNA, 64 nt, Homo Sapiens
ggaaucugaauaagcuuccaaaauuuuuuuuuuuaagaaauaaagggagcuguguaguggguca

SEQ ID NO: 518377 - RNA, 64 nt, Homo Sapiens
agcuuuguuuagucuuuauacugcaaacuauuuaaagaaauauguauucuguaaaagaaaaaaa

SEQ ID NO: 518378 - RNA, 64 nt, Homo Sapiens
uauuucagcaaacuuguugaauuuauuuuuaagaaagaaauacuguauugggaaguuacuguua

SEQ ID NO: 518379 - RNA, 64 nt, Homo Sapiens
cuguaccacuguuguaacaugggaagacgugaagaagaaauaaucugagcuuuaauuauuuaua

SEQ ID NO: 518380 - RNA, 64 nt, Homo Sapiens
aaaaccaaaaagaugccccuuuuuuuguagggauaagaaauacauuuguuuuauacuucuaugc

SEQ ID NO: 518381 - RNA, 64 nt, Homo Sapiens
gcccauuguauuaggccguucuuggauugcuauaaagaaauaccugagacuggguaauuugguu

SEQ ID NO: 518382 - RNA, 64 nt, Homo Sapiens
cagacauaauaagagguguaaaaacuaucacaggaagaaauaaaaacagauuuuugaaggugag

SEQ ID NO: 518383 - RNA, 64 nt, Homo Sapiens
uauuaccaaacuuauagaaauaaaaauuauuagaaagaaauacuaugaacaauugaaugccaac

SEQ ID NO: 518384 - RNA, 64 nt, Homo Sapiens
cuaggaagacacagaauaccaaaucugacuccacaagaaauagauguugugaauagagcuugcu

SEQ ID NO: 518385 - RNA, 64 nt, Homo Sapiens
aaacagcuggaagaagaaauugcuagauuacccaaagaaauagaucaguuggagaaaauacaaa

SEQ ID NO: 518386 - RNA, 64 nt, Homo Sapiens
aguuggagaaaauacaaaacaauucaaagcucuuaagaaauaaagcuguucaacuugaaaauga

SEQ ID NO: 518387 - RNA, 64 nt, Homo Sapiens
uuaaggaguuuuucccaagaagaaaaguauuuaaaagaaauaccagugagugccuuaaaguugg

SEQ ID NO: 518388 - RNA, 64 nt, Homo Sapiens
gguaucacagccuaaagaaauuaucuuuuugcaaaagaaauauuaaaugauuuagcagucucca

SEQ ID NO: 518389 - RNA, 64 nt, Homo Sapiens
uuuuuucaaauaagaaaauuuaacaauaagaaauaagaaauaauacuguaaagucuauucuguu

SEQ ID NO: 518390 - RNA, 64 nt, Homo Sapiens
aaauaauuuuuuucaaauaauucuguuuaacaauaagaaauaaguguuguuacuguaaagucua

SEQ ID NO: 518391 - RNA, 64 nt, Homo Sapiens
gacgaacacauuugcaggaacuaaaauccauuucaagaaauaaaaggaugagaacuucuaaaau

SEQ ID NO: 518392 - RNA, 64 nt, Homo Sapiens
gauuccuaauaauggcaugguguagcugacacucaagaaauagggugaauuguggaaaauguca

SEQ ID NO: 518393 - RNA, 64 nt, Homo Sapiens
guggcuuacugugucugaagauacugacaugcagaagaaauaagugcauucuucugcuuuucac

SEQ ID NO: 518394 - RNA, 64 nt, Homo Sapiens
aggguugauuuuuuugcucuccauuuugacuugcaagaaauaauaccucaagauaaucugauuu

SEQ ID NO: 518395 - RNA, 64 nt, Homo Sapiens
uuuuuuguucacaugaccaaaaaaagccuuuuuuaagaaauaaagccuugaaaaacaaagaccu

SEQ ID NO: 518396 - RNA, 64 nt, Homo Sapiens
cucagaagagaaauggggcuuauaacuuuugucaaagaaauacuaauguguuugguuuuggaaa

SEQ ID NO: 518397 - RNA, 64 nt, Homo Sapiens
gaugucauagccugaagauucuuaagacuauuuuaagaaauagauaauuuaagaaauagacuua

SEQ ID NO: 518398 - RNA, 64 nt, Homo Sapiens
cuuacuuaagacuauuuuaauuuguuguuaauuuaagaaauagauacuggcuuuaacaauaauu

SEQ ID NO: 518399 - RNA, 64 nt, Homo Sapiens
aaauauuuuaauguuucuugaucuucacuuuuauaagaaauaggguugauggaaauacacuguu

SEQ ID NO: 518400 - RNA, 64 nt, Homo Sapiens
ccuuaagauauuaacugagaacuauuauauuuccaagaaauauuagugucuugaauuguaggug

SEQ ID NO: 518401 - RNA, 64 nt, Homo Sapiens
augacuucuggaacuuacuuugaaauauauacagaagaaauaauuauuuuuuaaagaugcauuu

SEQ ID NO: 518402 - RNA, 64 nt, Homo Sapiens
caauauauggacuuuauuuugaauccauagauuaaagaaauaugaauagagagauggguggcag

SEQ ID NO: 518403 - RNA, 60 nt, Homo Sapiens
uaucagaaaaauguauauaauaggcaaggaaagaaauacaguacuguuucuggacccuua

SEQ ID NO: 518404 - RNA, 64 nt, Homo Sapiens
ugaugcuguacacauauuugaagggucuuucucaaagaaauauuaagcauguuuuguugcucag

SEQ ID NO: 518405 - RNA, 64 nt, Homo Sapiens
guuccuacucaguaaacaggugugaugaguuaacaagaaauaacacuguuugagaacuagcuuu

SEQ ID NO: 518406 - RNA, 64 nt, Homo Sapiens
uccccagcaccagcuauugguguaccuauaauuuaagaaauagucuauguaaagucacaaauua

SEQ ID NO: 518407 - RNA, 64 nt, Homo Sapiens
uuguauuuuugugcuaaugugcaaacauguacagaagaaauagaauacauguucaugcaaauau

SEQ ID NO: 518408 - RNA, 64 nt, Homo Sapiens
acauugcuaaaauaaaaaauacaccuuaauuuuuaagaaauaauuuaaaugaaacaauuuccau

SEQ ID NO: 518409 - RNA, 64 nt, Homo Sapiens
uuuuuuauauauugguguaaacauaauauucuucaagaaauaauguugaaagccuacucaggaa

SEQ ID NO: 518410 - RNA, 64 nt, Homo Sapiens
ugaguaaaaucccuuguucuguacuauaucauccaagaaauauugcagauguuuuuccuaaaaa

SEQ ID NO: 518411 - RNA, 64 nt, Homo Sapiens
aacuacggguagaaaacauaaaucuuuuacgcagaagaaauaaauauaucaaauaaguaucaca

SEQ ID NO: 518412 - RNA, 64 nt, Homo Sapiens
ugaaaaugaagagagaggguuuuaccauccugagaagaaauaaugauggaaacauguuuaaugu

SEQ ID NO: 518413 - RNA, 64 nt, Homo Sapiens
gcgagacuccgucucaaaaacaaaaaaaaaagaaaagaaauauauuuuauucauucacauuagg

SEQ ID NO: 518414 - RNA, 64 nt, Homo Sapiens
uauaacacugaccucuggaaaauauuuuguucacaagaaauaauaaaguauaaugauuuguugc

SEQ ID NO: 518415 - RNA, 64 nt, Homo Sapiens
acccuaccacuaacaaaaugaacaaaaaauuccuaagaaauacccuuuuguuuaaauuuaauga

SEQ ID NO: 518416 - RNA, 64 nt, Homo Sapiens
uauaguuuuuauuuacccauguugcuauuuugcaaagaaauaaucaaccaguuaaguuauaccu

SEQ ID NO: 518417 - RNA, 64 nt, Homo Sapiens
aaggaaauguacaauuuuauaucaaguuggaaccaagaaauagcauuuacaaucuuaagaaauu

SEQ ID NO: 518418 - RNA, 64 nt, Homo Sapiens
uuagcugaguacuauauaauuguaacuauuuaugaagaaauauucuuuguguuuuggcagguuu

SEQ ID NO: 518419 - RNA, 64 nt, Homo Sapiens
caaucaaaauuauauaaagucuucuccaguaauuaagaaauacauaugcaaauucuuuugugau

SEQ ID NO: 518420 - RNA, 64 nt, Homo Sapiens
aaaagcagcuuaaauuacuuuucuuuucuacauuaagaaauauauucucaacauuuucagugag

SEQ ID NO: 518421 - RNA, 64 nt, Homo Sapiens
ugucaaauaagcauauuuccauuuuuauuacugaaagaaauaugggcauuuucauucuuuaaag

SEQ ID NO: 518422 - RNA, 64 nt, Homo Sapiens
uuacugaaagaaauaugggcauuuucauucuuuaaagaaauaaagcacaagaauuuuaucucaa

SEQ ID NO: 518423 - RNA, 64 nt, Homo Sapiens
uugaaaaauaaaauuuuaacccaaaugaauaacuaagaaauauaaaacaagcacaaaaucuuag

SEQ ID NO: 518424 - RNA, 64 nt, Homo Sapiens
gaaacaaacuuuuugccaauagaccuagggaucuaagaaauagaauuagggagaguuuacacuu

SEQ ID NO: 518425 - RNA, 64 nt, Homo Sapiens
uaucaaaaaccuagagaccaaucauauaucugaaaagaaauacccauuaaaaauucugccuccu

SEQ ID NO: 518426 - RNA, 64 nt, Homo Sapiens
aaaaauagcucaagacacaguuaaucgagaagaaaagaaauauguacagaaccauaaagaacca

SEQ ID NO: 518427 - RNA, 64 nt, Homo Sapiens
uaguugcuuacgugaagcucaagauaccuguagaaagaaauaugguauauuuguauaguuuuua

SEQ ID NO: 518428 - RNA, 64 nt, Homo Sapiens
acaacaaaggggaacuauauuagaauguauauuuaagaaauaaacacaugaaaauauuccuuag

SEQ ID NO: 518429 - RNA, 64 nt, Homo Sapiens
gguagcaguagagaauuuauaagugugguagaaaaagaaauaauuugcagaaaaguugauugca

SEQ ID NO: 518430 - RNA, 64 nt, Homo Sapiens
guccaaacguugcauggauucacaacagaauucuaagaaauauacuaaauuuuaaaagcugaaa

SEQ ID NO: 518431 - RNA, 64 nt, Homo Sapiens
uagcagcaucacucaccaguuccuaucucauuagaagaaauagggacgugguuccaacauucac

SEQ ID NO: 518432 - RNA, 64 nt, Homo Sapiens
uccuuccacuuugaccccauacuacugagcccugaagaaauaagaggugcgcgccaggaugugg

SEQ ID NO: 518433 - RNA, 64 nt, Homo Sapiens
uaagauccgagcagaacugaagcuagcagaaggcaagaaauaaccaagagcaaacacauucaaa

SEQ ID NO: 518434 - RNA, 64 nt, Homo Sapiens
gcauuuuugaaaguuacauauucuccacugcuuuaagaaauaauucaguucacuuucaccuugg

SEQ ID NO: 518435 - RNA, 64 nt, Homo Sapiens
acuaacagagaucuugggacauuuauuuguuuuaaagaaauauuuaugguuauggaaacgcuug

SEQ ID NO: 518436 - RNA, 64 nt, Homo Sapiens
aaucuguuuuccugaguauaaauaagaguauuuaaagaaauaauuuggauugcuuuuguuuuuu

SEQ ID NO: 518437 - RNA, 64 nt, Homo Sapiens
ucugcuucuuaaagaaucagccgagacaccauaaaagaaauaggcuuuuugugccuuuugcugu

SEQ ID NO: 518438 - RNA, 64 nt, Homo Sapiens
aaaaggcgaacucugccuuggagagguagaugauaagaaauaaaaagguguuuauaacuauuuu

SEQ ID NO: 518439 - RNA, 64 nt, Homo Sapiens
gguucuugggccaugcuccguguguggauaaggaaagaaauacuguuucugggacucucccaca

SEQ ID NO: 518440 - RNA, 64 nt, Homo Sapiens
aaguaacuugccaaagguuaaggacaaugaggcaaagaaauaucuagguauuguuucccagaug

SEQ ID NO: 518441 - RNA, 64 nt, Homo Sapiens
ccaaaugucuuuuagaagaugcagaggucagacuaagaaauauuuuuauagagugucucagggu

SEQ ID NO: 518442 - RNA, 64 nt, Homo Sapiens
acagauggcuucacugaaguuauuccaaauauuuaagaaauaauaccaggcuuuuauaaacuuu

SEQ ID NO: 518443 - RNA, 64 nt, Homo Sapiens
cuguggaacauccagaaaacuuuaacauucuucaaagaaauagaaaacacaauccuaaaauuua

SEQ ID NO: 518444 - RNA, 64 nt, Homo Sapiens
aaauauuucccaguauaaugauacaucguagccuaagaaauauuuucucaauguaauucccuuc

SEQ ID NO: 518445 - RNA, 64 nt, Homo Sapiens
ucagcucugggggucauuuaccaguuuguuguagaagaaauaaucagguaaguuaaaaguucau

SEQ ID NO: 518446 - RNA, 64 nt, Homo Sapiens
uaguaaaacaaccuuuuauuagugaugacuaccaaagaaauacaaccaacacugaaaacuuugu

SEQ ID NO: 518447 - RNA, 64 nt, Homo Sapiens
ucuguguaacuugaucuucuucuuaucaguacagaagaaauauuuugagagcucaauauuugua

SEQ ID NO: 518448 - RNA, 64 nt, Homo Sapiens
uuuucuguaguaaaacuuuuaaauauuauuuuaaaagaaauauguauauaaauaucucuauauu

SEQ ID NO: 518449 - RNA, 64 nt, Homo Sapiens
uguuuguuuuaaauguaaauugagaaucuuuuauaagaaauaaaagcauuauugggugccuuug

SEQ ID NO: 518450 - RNA, 64 nt, Homo Sapiens
gugaaaaucauggaguugggauaucucucaauuaaagaaauacauugugaacuaucagcuacaa

SEQ ID NO: 518451 - RNA, 64 nt, Homo Sapiens
gcguaucacauaacuuuuuugcaaaaaauauaaaaagaaauaaacuucaauguauuuuuuauua

SEQ ID NO: 518452 - RNA, 64 nt, Homo Sapiens
gagauauagcccuuaaaaugcaauauuaagaacaaagaaauagaaaaugguuuagauaucuuuc

SEQ ID NO: 518453 - RNA, 64 nt, Homo Sapiens
guaaguagguaauuuuauuauuuaaaguccuauuaagaaauauuugucuuaaauauauaggaca

SEQ ID NO: 518454 - RNA, 64 nt, Homo Sapiens
aacugaugauauccuauccugggaauguuacuagaagaaauaucacaguauacaugauauagca

SEQ ID NO: 518455 - RNA, 64 nt, Homo Sapiens
aaauuguaaucagcaguaaaggaugguggaugaaaagaaauaaugggcguauaauuugaggagu

SEQ ID NO: 518456 - RNA, 64 nt, Homo Sapiens
ucagguaagcuucucagggcccaugagagaaggaaagaaauauugggguggcuuuuauggacuu

SEQ ID NO: 518457 - RNA, 64 nt, Homo Sapiens
uccugaaugcaugucguuccaccccucagguccuaagaaauaagaagcuguaugcaugggcauu

SEQ ID NO: 518458 - RNA, 64 nt, Homo Sapiens
acagagccacuagaucucaucuugcccaccauuuaagaaauaucacauuaucagccagcccagc

SEQ ID NO: 518459 - RNA, 64 nt, Homo Sapiens
ugcaguuauccaggagaaagagaauggaaaugacaagaaauaucuuguucugcaguguugaaac

SEQ ID NO: 518460 - RNA, 64 nt, Homo Sapiens
uaaagggaaugauuggggggaaaaacuggugaaaaagaaauauaaaaaggacccuaaaaagaau

SEQ ID NO: 518461 - RNA, 64 nt, Homo Sapiens
aaaggacccuaaaaagaauucugcaaaauaagagaagaaauaauuugugacagguaauagaaua

SEQ ID NO: 518462 - RNA, 64 nt, Homo Sapiens
gacuggauguaccaccaacuauguaauuuuguguaagaaauacagccucaugucaaauauuuag

SEQ ID NO: 518463 - RNA, 64 nt, Homo Sapiens
cagcaugagagggaugaggcccaguuguuagauuaagaaauagaaagccaguuuaacgcauugc

SEQ ID NO: 518464 - RNA, 64 nt, Homo Sapiens
uuacuauugaguaaacuacacugaaauuuggaaaaagaaauacuaugcauuuugagauggaaaa

SEQ ID NO: 518465 - RNA, 64 nt, Homo Sapiens
acgacaacuuauuuuuaaucauaaaaagcauuugaagaaauagucagaucuugaagaaaaucau

SEQ ID NO: 518466 - RNA, 64 nt, Homo Sapiens
cagguauauaagaccacgauuaccugucuuauggaagaaauauggagcaauauuuuuuaaugug

SEQ ID NO: 518467 - RNA, 64 nt, Homo Sapiens
auauauuuuuaugucauugauaaauggcaaaggaaagaaauaaucggugaaauauuuauaugca

SEQ ID NO: 518468 - RNA, 64 nt, Homo Sapiens
auguuuccaauucagguacaaguauguuuuaaagaagaaauaaguuucccaaucagccaauuua

SEQ ID NO: 518469 - RNA, 64 nt, Homo Sapiens
uuuaaacacauccuauauaucaugucaaucuggcaagaaauaugacuugcuuuuugcugagcuu

SEQ ID NO: 518470 - RNA, 64 nt, Homo Sapiens
cugaugcacuauauagaacgaauuuggguuuuuaaagaaauauuaaaaguuagguacuguaagu

SEQ ID NO: 518471 - RNA, 64 nt, Homo Sapiens
guccuguaucauacuuuuuucuuuaagacuuuuuaagaaauauuacuuaaacauguggcuugcu

SEQ ID NO: 518472 - RNA, 64 nt, Homo Sapiens
cuguauaaagggauugguagucaaaacauguacaaagaaauaccuguaaaacuguuuugucuca

SEQ ID NO: 518473 - RNA, 64 nt, Homo Sapiens
caaaucaaagauauuugguagucaaaauaaguaaaagaaauauaggaauauuccagucaaucuc

SEQ ID NO: 518474 - RNA, 64 nt, Homo Sapiens
agccacacgccacagucagcgucugcugcuugugaagaaauagccuaccagguacaggauauuc

SEQ ID NO: 518475 - RNA, 64 nt, Homo Sapiens
guauauuaagagaggagcucauuucagauuccuaaagaaauagacauuuuacuguuauuuugaa

SEQ ID NO: 518476 - RNA, 64 nt, Homo Sapiens
aauuuugaauguauaaaagauuuuaaaauaauagaagaaauagaguuugcuuucuccagagaaa

SEQ ID NO: 518477 - RNA, 64 nt, Homo Sapiens
gaguaucacuaugugaagaauuuaaaaaauaaacaagaaauauuguauucacuuuaagugauag

SEQ ID NO: 518478 - RNA, 64 nt, Homo Sapiens
uuuugcugaggaguugugaacaaguucuauuuuuaagaaauagcucugaauauuaagugaaaag

SEQ ID NO: 518479 - RNA, 64 nt, Homo Sapiens
uuucuagguugucggagcuguacagauacagguaaagaaauauuaacucugaccaaaucuuuca

SEQ ID NO: 518480 - RNA, 64 nt, Homo Sapiens
uagagaaaaaaaauuaaaaagaaacaaagucuccaagaaauaugggacuaugugaaaagaccaa

SEQ ID NO: 518481 - RNA, 64 nt, Homo Sapiens
caagagcaaacacagucaaaaacuagcagaaggcaagaaauaacuaaaaucagcagaacucaag

SEQ ID NO: 518482 - RNA, 64 nt, Homo Sapiens
cuuuguuaaaagguguaagacuggaauaaauggaaagaaauaccauauacauagauggaaaaac

SEQ ID NO: 518483 - RNA, 64 nt, Homo Sapiens
auauacauccuauagaaacucacaaauaaugcauaagaaauauauauauaauauauguauguau

SEQ ID NO: 518484 - RNA, 64 nt, Homo Sapiens
gggaaacauagcaagaccccaucucuuaaaaaaaaagaaauauauagacauauaucugcauuga

SEQ ID NO: 518485 - RNA, 64 nt, Homo Sapiens
auuacaggagcaauuaagguuuaguaauaaaaauaagaaauaaagacagauuuuagagcaaaaa

SEQ ID NO: 518486 - RNA, 64 nt, Homo Sapiens
uacagugacagauuuuagaguuguuaauaaaaauaagaaauagccuaaaaggaugucuaaaugu

SEQ ID NO: 518487 - RNA, 64 nt, Homo Sapiens
gugacuuaacuacuuuaucuccauuuuguaguugaagaaauaaguucagagagaaagauuccuu

SEQ ID NO: 518488 - RNA, 64 nt, Homo Sapiens
cuugaaaaauaaaaaguaccaaaauucauucaagaagaaauagauaccagccugagcaacaugg

SEQ ID NO: 518489 - RNA, 64 nt, Homo Sapiens
cacccaaguauuuuaaaguaugugucucuaaaggaagaaauacauauuuuuauuugacuauguu

SEQ ID NO: 518490 - RNA, 64 nt, Homo Sapiens
guucuugguguuugugaaaauccuauaagauuuaaagaaauauauauauacuuuuuuucuuuuu

SEQ ID NO: 518491 - RNA, 64 nt, Homo Sapiens
aguugacauaauacuuuguaaauugaauuuuuuaaagaaauaggcauuugauaaccagcuuggc

SEQ ID NO: 518492 - RNA, 64 nt, Homo Sapiens
agagaauuggaacaaaaccuugugacuuuuagguaagaaauaggcaugaugauaagcuaugcag

SEQ ID NO: 518493 - RNA, 64 nt, Homo Sapiens
uauucauugagccuaguuccuuguuauaaaauacaagaaauaagacauucaggcauuuucccuu

SEQ ID NO: 518494 - RNA, 64 nt, Homo Sapiens
acuaguccuguucuaggcuuaguggaagcuaguaaagaaauauaauucauggaucaggcucaua

SEQ ID NO: 518495 - RNA, 64 nt, Homo Sapiens
ugagacuggguaauuuauaaaguccauucuugcaaagaaauaccugcacaaaaucaacuguauu

SEQ ID NO: 518496 - RNA, 64 nt, Homo Sapiens
agacgaagaauagggagaaaucuccaaaaaaaaaaagaaauaaaggccacauagcaagacccug

SEQ ID NO: 518497 - RNA, 64 nt, Homo Sapiens
ucugugacuaggaaaaaauuuaaaguaguaaaagaagaaauaguucuguaauaacuagaacaaa

SEQ ID NO: 518498 - RNA, 64 nt, Homo Sapiens
gaauuuuuauuuuugaaguuagauggcuuacaaaaagaaauauuguggugauagcaaaaucaag

SEQ ID NO: 518499 - RNA, 64 nt, Homo Sapiens
gcuuauuuuaaacuuuugacuuuaugugaagaggaagaaauauagaauaucagccuuuuauaau

SEQ ID NO: 518500 - RNA, 64 nt, Homo Sapiens
cuauuuggaucacauuucucuuuuugccuggcagaagaaauagaagauuuugcuaauacuacuu

SEQ ID NO: 518501 - RNA, 64 nt, Homo Sapiens; identical to SEQ ID NO: 58312

SEQ ID NO: 518502 - RNA, 64 nt, Homo Sapiens; identical to SEQ ID NO: 58313

SEQ ID NO: 518503 - RNA, 64 nt, Homo Sapiens; identical to SEQ ID NO: 58314

SEQ ID NO: 518504 - RNA, 64 nt, Homo Sapiens; identical to SEQ ID NO: 58315

SEQ ID NO: 518505 - RNA, 64 nt, Homo Sapiens; identical to SEQ ID NO: 58316

SEQ ID NO: 518506 - RNA, 64 nt, Homo Sapiens; identical to SEQ ID NO: 58317

SEQ ID NO: 518507 - RNA, 64 nt, Homo Sapiens; identical to SEQ ID NO: 58318

SEQ ID NO: 518508 - RNA, 64 nt, Homo Sapiens; identical to SEQ ID NO: 58319

SEQ ID NO: 518509 - RNA, 64 nt, Homo Sapiens; identical to SEQ ID NO: 58320

SEQ ID NO: 518510 - RNA, 64 nt, Homo Sapiens; identical to SEQ ID NO: 58321

SEQ ID NO: 518511 - RNA, 64 nt, Homo Sapiens; identical to SEQ ID NO: 58322

SEQ ID NO: 518512 - RNA, 64 nt, Homo Sapiens; identical to SEQ ID NO: 58323

SEQ ID NO: 518513 - RNA, 64 nt, Homo Sapiens; identical to SEQ ID NO: 58324

SEQ ID NO: 518514 - RNA, 64 nt, Homo Sapiens; identical to SEQ ID NO: 58325

SEQ ID NO: 518515 - RNA, 64 nt, Homo Sapiens; identical to SEQ ID NO: 58326

SEQ ID NO: 518516 - RNA, 64 nt, Homo Sapiens; identical to SEQ ID NO: 58327

SEQ ID NO: 518517 - RNA, 64 nt, Homo Sapiens; identical to SEQ ID NO: 58328

SEQ ID NO: 518518 - RNA, 64 nt, Homo Sapiens; identical to SEQ ID NO: 58329

SEQ ID NO: 518519 - RNA, 64 nt, Homo Sapiens; identical to SEQ ID NO: 58330

SEQ ID NO: 518520 - RNA, 64 nt, Homo Sapiens; identical to SEQ ID NO: 58331

SEQ ID NO: 518521 - RNA, 64 nt, Homo Sapiens; identical to SEQ ID NO: 58332

SEQ ID NO: 518522 - RNA, 64 nt, Homo Sapiens; identical to SEQ ID NO: 58333

SEQ ID NO: 518523 - RNA, 64 nt, Homo Sapiens; identical to SEQ ID NO: 58334

SEQ ID NO: 518524 - RNA, 64 nt, Homo Sapiens; identical to SEQ ID NO: 58335

SEQ ID NO: 518525 - RNA, 64 nt, Homo Sapiens; identical to SEQ ID NO: 58336

SEQ ID NO: 518526 - RNA, 64 nt, Homo Sapiens; identical to SEQ ID NO: 58337

SEQ ID NO: 518527 - RNA, 64 nt, Homo Sapiens; identical to SEQ ID NO: 58338

SEQ ID NO: 518528 - RNA, 64 nt, Homo Sapiens; identical to SEQ ID NO: 58339

SEQ ID NO: 518529 - RNA, 64 nt, Homo Sapiens; identical to SEQ ID NO: 58340

SEQ ID NO: 518530 - RNA, 64 nt, Homo Sapiens; identical to SEQ ID NO: 58341

SEQ ID NO: 518531 - RNA, 64 nt, Homo Sapiens; identical to SEQ ID NO: 58342

SEQ ID NO: 518532 - RNA, 64 nt, Homo Sapiens; identical to SEQ ID NO: 58343

SEQ ID NO: 518533 - RNA, 64 nt, Homo Sapiens; identical to SEQ ID NO: 58344

SEQ ID NO: 518534 - RNA, 64 nt, Homo Sapiens; identical to SEQ ID NO: 58345

SEQ ID NO: 518535 - RNA, 64 nt, Homo Sapiens; identical to SEQ ID NO: 58346

SEQ ID NO: 518536 - RNA, 64 nt, Homo Sapiens; identical to SEQ ID NO: 58347

SEQ ID NO: 518537 - RNA, 64 nt, Homo Sapiens; identical to SEQ ID NO: 58348

SEQ ID NO: 518538 - RNA, 64 nt, Homo Sapiens; identical to SEQ ID NO: 58349

SEQ ID NO: 518539 - RNA, 64 nt, Homo Sapiens; identical to SEQ ID NO: 58350

SEQ ID NO: 518540 - RNA, 64 nt, Homo Sapiens; identical to SEQ ID NO: 58351

SEQ ID NO: 518541 - RNA, 64 nt, Homo Sapiens; identical to SEQ ID NO: 58352

SEQ ID NO: 518542 - RNA, 64 nt, Homo Sapiens; identical to SEQ ID NO: 58353

SEQ ID NO: 518543 - RNA, 64 nt, Homo Sapiens; identical to SEQ ID NO: 58354

SEQ ID NO: 518544 - RNA, 64 nt, Homo Sapiens; identical to SEQ ID NO: 58355

SEQ ID NO: 518545 - RNA, 64 nt, Homo Sapiens; identical to SEQ ID NO: 58356

SEQ ID NO: 518546 - RNA, 64 nt, Homo Sapiens; identical to SEQ ID NO: 58357

SEQ ID NO: 518547 - RNA, 64 nt, Homo Sapiens; identical to SEQ ID NO: 58358

SEQ ID NO: 518548 - RNA, 64 nt, Homo Sapiens; identical to SEQ ID NO: 58359

SEQ ID NO: 518549 - RNA, 64 nt, Homo Sapiens; identical to SEQ ID NO: 58360

SEQ ID NO: 518550 - RNA, 64 nt, Homo Sapiens; identical to SEQ ID NO: 58361

SEQ ID NO: 518551 - RNA, 64 nt, Homo Sapiens; identical to SEQ ID NO: 58362

SEQ ID NO: 518552 - RNA, 64 nt, Homo Sapiens; identical to SEQ ID NO: 58363

SEQ ID NO: 518553 - RNA, 64 nt, Homo Sapiens; identical to SEQ ID NO: 58364

SEQ ID NO: 518554 - RNA, 64 nt, Homo Sapiens; identical to SEQ ID NO: 58365

SEQ ID NO: 518555 - RNA, 64 nt, Homo Sapiens; identical to SEQ ID NO: 58366

SEQ ID NO: 518556 - RNA, 64 nt, Homo Sapiens; identical to SEQ ID NO: 58367

SEQ ID NO: 518557 - RNA, 64 nt, Homo Sapiens; identical to SEQ ID NO: 58368

SEQ ID NO: 518558 - RNA, 64 nt, Homo Sapiens; identical to SEQ ID NO: 58369

SEQ ID NO: 518559 - RNA, 64 nt, Homo Sapiens; identical to SEQ ID NO: 58370

SEQ ID NO: 518560 - RNA, 64 nt, Homo Sapiens; identical to SEQ ID NO: 58371

SEQ ID NO: 518561 - RNA, 64 nt, Homo Sapiens; identical to SEQ ID NO: 58372

SEQ ID NO: 518562 - RNA, 64 nt, Homo Sapiens; identical to SEQ ID NO: 58373

SEQ ID NO: 518563 - RNA, 64 nt, Homo Sapiens; identical to SEQ ID NO: 58374

SEQ ID NO: 518564 - RNA, 64 nt, Homo Sapiens; identical to SEQ ID NO: 58375

SEQ ID NO: 518565 - RNA, 64 nt, Homo Sapiens; identical to SEQ ID NO: 58376

SEQ ID NO: 518566 - RNA, 64 nt, Homo Sapiens; identical to SEQ ID NO: 58377

SEQ ID NO: 518567 - RNA, 64 nt, Homo Sapiens; identical to SEQ ID NO: 58378

SEQ ID NO: 518568 - RNA, 64 nt, Homo Sapiens; identical to SEQ ID NO: 58379

SEQ ID NO: 518569 - RNA, 64 nt, Homo Sapiens; identical to SEQ ID NO: 58380

SEQ ID NO: 518570 - RNA, 64 nt, Homo Sapiens; identical to SEQ ID NO: 58381

SEQ ID NO: 518571 - RNA, 64 nt, Homo Sapiens; identical to SEQ ID NO: 58382

SEQ ID NO: 518572 - RNA, 64 nt, Homo Sapiens; identical to SEQ ID NO: 58383

SEQ ID NO: 518573 - RNA, 64 nt, Homo Sapiens; identical to SEQ ID NO: 58384

SEQ ID NO: 518574 - RNA, 64 nt, Homo Sapiens; identical to SEQ ID NO: 58385

SEQ ID NO: 518575 - RNA, 64 nt, Homo Sapiens; identical to SEQ ID NO: 58386

SEQ ID NO: 518576 - RNA, 64 nt, Homo Sapiens; identical to SEQ ID NO: 58387

SEQ ID NO: 518577 - RNA, 64 nt, Homo Sapiens; identical to SEQ ID NO: 58388

SEQ ID NO: 518578 - RNA, 64 nt, Homo Sapiens; identical to SEQ ID NO: 58389

SEQ ID NO: 518579 - RNA, 64 nt, Homo Sapiens; identical to SEQ ID NO: 58390

SEQ ID NO: 518580 - RNA, 64 nt, Homo Sapiens; identical to SEQ ID NO: 58391

SEQ ID NO: 518581 - RNA, 64 nt, Homo Sapiens; identical to SEQ ID NO: 58392

SEQ ID NO: 518582 - RNA, 64 nt, Homo Sapiens; identical to SEQ ID NO: 58393

SEQ ID NO: 518583 - RNA, 64 nt, Homo Sapiens; identical to SEQ ID NO: 58394

SEQ ID NO: 518584 - RNA, 64 nt, Homo Sapiens; identical to SEQ ID NO: 58395

SEQ ID NO: 518585 - RNA, 64 nt, Homo Sapiens; identical to SEQ ID NO: 58396

SEQ ID NO: 518586 - RNA, 64 nt, Homo Sapiens; identical to SEQ ID NO: 58397

SEQ ID NO: 518587 - RNA, 64 nt, Homo Sapiens; identical to SEQ ID NO: 58398

SEQ ID NO: 518588 - RNA, 64 nt, Homo Sapiens; identical to SEQ ID NO: 58399

SEQ ID NO: 518589 - RNA, 64 nt, Homo Sapiens; identical to SEQ ID NO: 58400

SEQ ID NO: 518590 - RNA, 64 nt, Homo Sapiens; identical to SEQ ID NO: 58401

SEQ ID NO: 518591 - RNA, 64 nt, Homo Sapiens; identical to SEQ ID NO: 58402

SEQ ID NO: 518592 - RNA, 64 nt, Homo Sapiens; identical to SEQ ID NO: 58403

SEQ ID NO: 518593 - RNA, 64 nt, Homo Sapiens; identical to SEQ ID NO: 58404

SEQ ID NO: 518594 - RNA, 64 nt, Homo Sapiens; identical to SEQ ID NO: 58405

SEQ ID NO: 518595 - RNA, 64 nt, Homo Sapiens; identical to SEQ ID NO: 58406

SEQ ID NO: 518596 - RNA, 64 nt, Homo Sapiens; identical to SEQ ID NO: 58407

SEQ ID NO: 518597 - RNA, 64 nt, Homo Sapiens; identical to SEQ ID NO: 58408

SEQ ID NO: 518598 - RNA, 64 nt, Homo Sapiens; identical to SEQ ID NO: 58409

SEQ ID NO: 518599 - RNA, 64 nt, Homo Sapiens; identical to SEQ ID NO: 58410

SEQ ID NO: 518600 - RNA, 64 nt, Homo Sapiens; identical to SEQ ID NO: 58411

SEQ ID NO: 518601 - RNA, 64 nt, Homo Sapiens; identical to SEQ ID NO: 58412

SEQ ID NO: 518602 - RNA, 64 nt, Homo Sapiens; identical to SEQ ID NO: 58413

SEQ ID NO: 518603 - RNA, 64 nt, Homo Sapiens; identical to SEQ ID NO: 58414

SEQ ID NO: 518604 - RNA, 64 nt, Homo Sapiens; identical to SEQ ID NO: 58415

SEQ ID NO: 518605 - RNA, 64 nt, Homo Sapiens; identical to SEQ ID NO: 58416

SEQ ID NO: 518606 - RNA, 64 nt, Homo Sapiens; identical to SEQ ID NO: 58417

SEQ ID NO: 518607 - RNA, 64 nt, Homo Sapiens; identical to SEQ ID NO: 58418

SEQ ID NO: 518608 - RNA, 64 nt, Homo Sapiens; identical to SEQ ID NO: 58419

SEQ ID NO: 518609 - RNA, 64 nt, Homo Sapiens; identical to SEQ ID NO: 58420

SEQ ID NO: 518610 - RNA, 64 nt, Homo Sapiens; identical to SEQ ID NO: 58421

SEQ ID NO: 518611 - RNA, 64 nt, Homo Sapiens; identical to SEQ ID NO: 58422

SEQ ID NO: 518612 - RNA, 64 nt, Homo Sapiens; identical to SEQ ID NO: 58423

SEQ ID NO: 518613 - RNA, 64 nt, Homo Sapiens; identical to SEQ ID NO: 58424

SEQ ID NO: 518614 - RNA, 64 nt, Homo Sapiens; identical to SEQ ID NO: 58425

SEQ ID NO: 518615 - RNA, 64 nt, Homo Sapiens; identical to SEQ ID NO: 58426

SEQ ID NO: 518616 - RNA, 64 nt, Homo Sapiens; identical to SEQ ID NO: 58427

SEQ ID NO: 518617 - RNA, 64 nt, Homo Sapiens; identical to SEQ ID NO: 58428

SEQ ID NO: 518618 - RNA, 64 nt, Homo Sapiens; identical to SEQ ID NO: 58429

SEQ ID NO: 518619 - RNA, 64 nt, Homo Sapiens; identical to SEQ ID NO: 58430

SEQ ID NO: 518620 - RNA, 64 nt, Homo Sapiens; identical to SEQ ID NO: 58431

SEQ ID NO: 518621 - RNA, 64 nt, Homo Sapiens; identical to SEQ ID NO: 58432

SEQ ID NO: 518622 - RNA, 64 nt, Homo Sapiens; identical to SEQ ID NO: 58433

SEQ ID NO: 518623 - RNA, 64 nt, Homo Sapiens; identical to SEQ ID NO: 58434

SEQ ID NO: 518624 - RNA, 64 nt, Homo Sapiens; identical to SEQ ID NO: 58435

SEQ ID NO: 518625 - RNA, 50 nt, Homo Sapiens; identical to SEQ ID NO: 58436

SEQ ID NO: 518626 - RNA, 64 nt, Homo Sapiens; identical to SEQ ID NO: 58437

SEQ ID NO: 518627 - RNA, 64 nt, Homo Sapiens; identical to SEQ ID NO: 58438

SEQ ID NO: 518628 - RNA, 64 nt, Homo Sapiens; identical to SEQ ID NO: 58439

SEQ ID NO: 518629 - RNA, 64 nt, Homo Sapiens; identical to SEQ ID NO: 58440

SEQ ID NO: 518630 - RNA, 64 nt, Homo Sapiens; identical to SEQ ID NO: 58441

SEQ ID NO: 518631 - RNA, 64 nt, Homo Sapiens; identical to SEQ ID NO: 58442

SEQ ID NO: 518632 - RNA, 64 nt, Homo Sapiens; identical to SEQ ID NO: 58443

SEQ ID NO: 518633 - RNA, 64 nt, Homo Sapiens; identical to SEQ ID NO: 58444

SEQ ID NO: 518634 - RNA, 64 nt, Homo Sapiens; identical to SEQ ID NO: 58445

SEQ ID NO: 518635 - RNA, 64 nt, Homo Sapiens; identical to SEQ ID NO: 58446

SEQ ID NO: 518636 - RNA, 64 nt, Homo Sapiens; identical to SEQ ID NO: 58447

SEQ ID NO: 518637 - RNA, 64 nt, Homo Sapiens; identical to SEQ ID NO: 58448

SEQ ID NO: 518638 - RNA, 64 nt, Homo Sapiens; identical to SEQ ID NO: 58449

SEQ ID NO: 518639 - RNA, 64 nt, Homo Sapiens; identical to SEQ ID NO: 58450

SEQ ID NO: 518640 - RNA, 64 nt, Homo Sapiens; identical to SEQ ID NO: 58451

SEQ ID NO: 518641 - RNA, 64 nt, Homo Sapiens; identical to SEQ ID NO: 58452

SEQ ID NO: 518642 - RNA, 64 nt, Homo Sapiens; identical to SEQ ID NO: 58453

SEQ ID NO: 518643 - RNA, 64 nt, Homo Sapiens; identical to SEQ ID NO: 58454

SEQ ID NO: 518644 - RNA, 64 nt, Homo Sapiens; identical to SEQ ID NO: 58455

SEQ ID NO: 518645 - RNA, 64 nt, Homo Sapiens; identical to SEQ ID NO: 58456

SEQ ID NO: 518646 - RNA, 64 nt, Homo Sapiens; identical to SEQ ID NO: 58457

SEQ ID NO: 518647 - RNA, 64 nt, Homo Sapiens; identical to SEQ ID NO: 58458

SEQ ID NO: 518648 - RNA, 64 nt, Homo Sapiens; identical to SEQ ID NO: 58459

SEQ ID NO: 518649 - RNA, 64 nt, Homo Sapiens; identical to SEQ ID NO: 58460

SEQ ID NO: 518650 - RNA, 64 nt, Homo Sapiens; identical to SEQ ID NO: 58461

SEQ ID NO: 518651 - RNA, 64 nt, Homo Sapiens; identical to SEQ ID NO: 58462

SEQ ID NO: 518652 - RNA, 64 nt, Homo Sapiens; identical to SEQ ID NO: 58463

SEQ ID NO: 518653 - RNA, 64 nt, Homo Sapiens; identical to SEQ ID NO: 58464

SEQ ID NO: 518654 - RNA, 64 nt, Homo Sapiens; identical to SEQ ID NO: 58465

SEQ ID NO: 518655 - RNA, 64 nt, Homo Sapiens; identical to SEQ ID NO: 58466

SEQ ID NO: 518656 - RNA, 64 nt, Homo Sapiens; identical to SEQ ID NO: 58467

SEQ ID NO: 518657 - RNA, 64 nt, Homo Sapiens; identical to SEQ ID NO: 235935

SEQ ID NO: 518658 - RNA, 64 nt, Homo Sapiens; identical to SEQ ID NO: 235936

SEQ ID NO: 518659 - RNA, 64 nt, Homo Sapiens; identical to SEQ ID NO: 235937

SEQ ID NO: 518660 - RNA, 64 nt, Homo Sapiens; identical to SEQ ID NO: 235938

SEQ ID NO: 518661 - RNA, 64 nt, Homo Sapiens; identical to SEQ ID NO: 235939

SEQ ID NO: 518662 - RNA, 64 nt, Homo Sapiens; identical to SEQ ID NO: 235940

SEQ ID NO: 518663 - RNA, 64 nt, Homo Sapiens; identical to SEQ ID NO: 235941

SEQ ID NO: 518664 - RNA, 64 nt, Homo Sapiens; identical to SEQ ID NO: 235942

SEQ ID NO: 518665 - RNA, 64 nt, Homo Sapiens; identical to SEQ ID NO: 235943

SEQ ID NO: 518666 - RNA, 64 nt, Homo Sapiens; identical to SEQ ID NO: 235944

SEQ ID NO: 518667 - RNA, 64 nt, Homo Sapiens; identical to SEQ ID NO: 235945

SEQ ID NO: 518668 - RNA, 64 nt, Homo Sapiens; identical to SEQ ID NO: 235946

SEQ ID NO: 518669 - RNA, 64 nt, Homo Sapiens; identical to SEQ ID NO: 235947

SEQ ID NO: 518670 - RNA, 64 nt, Homo Sapiens; identical to SEQ ID NO: 235948

SEQ ID NO: 518671 - RNA, 64 nt, Homo Sapiens; identical to SEQ ID NO: 235949

SEQ ID NO: 518672 - RNA, 64 nt, Homo Sapiens; identical to SEQ ID NO: 235950

SEQ ID NO: 518673 - RNA, 64 nt, Homo Sapiens; identical to SEQ ID NO: 235951

SEQ ID NO: 518674 - RNA, 64 nt, Homo Sapiens; identical to SEQ ID NO: 235952

SEQ ID NO: 518675 - RNA, 64 nt, Homo Sapiens; identical to SEQ ID NO: 235953

SEQ ID NO: 518676 - RNA, 64 nt, Homo Sapiens; identical to SEQ ID NO: 235954

SEQ ID NO: 518677 - RNA, 64 nt, Homo Sapiens; identical to SEQ ID NO: 235955

SEQ ID NO: 518678 - RNA, 64 nt, Homo Sapiens; identical to SEQ ID NO: 235956

SEQ ID NO: 518679 - RNA, 64 nt, Homo Sapiens; identical to SEQ ID NO: 235957

SEQ ID NO: 518680 - RNA, 64 nt, Homo Sapiens; identical to SEQ ID NO: 235958

SEQ ID NO: 518681 - RNA, 64 nt, Homo Sapiens; identical to SEQ ID NO: 235959

SEQ ID NO: 518682 - RNA, 64 nt, Homo Sapiens; identical to SEQ ID NO: 235960

SEQ ID NO: 518683 - RNA, 64 nt, Homo Sapiens; identical to SEQ ID NO: 235961

SEQ ID NO: 518684 - RNA, 64 nt, Homo Sapiens; identical to SEQ ID NO: 235962

SEQ ID NO: 518685 - RNA, 64 nt, Homo Sapiens; identical to SEQ ID NO: 235963

SEQ ID NO: 518686 - RNA, 64 nt, Homo Sapiens; identical to SEQ ID NO: 235964

SEQ ID NO: 518687 - RNA, 64 nt, Homo Sapiens; identical to SEQ ID NO: 235965

SEQ ID NO: 518688 - RNA, 64 nt, Homo Sapiens; identical to SEQ ID NO: 235966

SEQ ID NO: 518689 - RNA, 64 nt, Homo Sapiens; identical to SEQ ID NO: 235967

SEQ ID NO: 518690 - RNA, 64 nt, Homo Sapiens; identical to SEQ ID NO: 235968

SEQ ID NO: 518691 - RNA, 64 nt, Homo Sapiens; identical to SEQ ID NO: 235969

SEQ ID NO: 518692 - RNA, 64 nt, Homo Sapiens; identical to SEQ ID NO: 235970

SEQ ID NO: 518693 - RNA, 64 nt, Homo Sapiens; identical to SEQ ID NO: 235971

SEQ ID NO: 518694 - RNA, 64 nt, Homo Sapiens; identical to SEQ ID NO: 235972

SEQ ID NO: 518695 - RNA, 64 nt, Homo Sapiens; identical to SEQ ID NO: 235973

SEQ ID NO: 518696 - RNA, 64 nt, Homo Sapiens; identical to SEQ ID NO: 235974

SEQ ID NO: 518697 - RNA, 58 nt, Homo Sapiens; identical to SEQ ID NO: 235975

SEQ ID NO: 518698 - RNA, 64 nt, Homo Sapiens; identical to SEQ ID NO: 235976

SEQ ID NO: 518699 - RNA, 64 nt, Homo Sapiens; identical to SEQ ID NO: 235977

SEQ ID NO: 518700 - RNA, 64 nt, Homo Sapiens; identical to SEQ ID NO: 235978

SEQ ID NO: 518701 - RNA, 64 nt, Homo Sapiens; identical to SEQ ID NO: 235979

SEQ ID NO: 518702 - RNA, 64 nt, Homo Sapiens; identical to SEQ ID NO: 235980

SEQ ID NO: 518703 - RNA, 64 nt, Homo Sapiens; identical to SEQ ID NO: 235981

SEQ ID NO: 518704 - RNA, 64 nt, Homo Sapiens; identical to SEQ ID NO: 235981

SEQ ID NO: 518705 - RNA, 64 nt, Homo Sapiens; identical to SEQ ID NO: 235983

SEQ ID NO: 518706 - RNA, 64 nt, Homo Sapiens; identical to SEQ ID NO: 235984

SEQ ID NO: 518707 - RNA, 64 nt, Homo Sapiens; identical to SEQ ID NO: 235985

SEQ ID NO: 518708 - RNA, 64 nt, Homo Sapiens; identical to SEQ ID NO: 235986

SEQ ID NO: 518709 - RNA, 64 nt, Homo Sapiens; identical to SEQ ID NO: 235987

SEQ ID NO: 518710 - RNA, 64 nt, Homo Sapiens; identical to SEQ ID NO: 235988

SEQ ID NO: 518711 - RNA, 64 nt, Homo Sapiens; identical to SEQ ID NO: 235989

SEQ ID NO: 518712 - RNA, 64 nt, Homo Sapiens; identical to SEQ ID NO: 235990

SEQ ID NO: 518713 - RNA, 64 nt, Homo Sapiens; identical to SEQ ID NO: 235991

SEQ ID NO: 518714 - RNA, 64 nt, Homo Sapiens; identical to SEQ ID NO: 235992

SEQ ID NO: 518715 - RNA, 64 nt, Homo Sapiens; identical to SEQ ID NO: 385550

SEQ ID NO: 518716 - RNA, 64 nt, Homo Sapiens; identical to SEQ ID NO: 385551

SEQ ID NO: 518717 - RNA, 64 nt, Homo Sapiens; identical to SEQ ID NO: 385552

SEQ ID NO: 518718 - RNA, 64 nt, Homo Sapiens; identical to SEQ ID NO: 385553

SEQ ID NO: 518719 - RNA, 64 nt, Homo Sapiens; identical to SEQ ID NO: 385554

SEQ ID NO: 518720 - RNA, 64 nt, Homo Sapiens; identical to SEQ ID NO: 385555

SEQ ID NO: 518721 - RNA, 64 nt, Homo Sapiens; identical to SEQ ID NO: 385556

SEQ ID NO: 518722 - RNA, 64 nt, Homo Sapiens; identical to SEQ ID NO: 385557

SEQ ID NO: 518723 - RNA, 64 nt, Homo Sapiens; identical to SEQ ID NO: 385558

SEQ ID NO: 518724 - RNA, 64 nt, Homo Sapiens; identical to SEQ ID NO: 385559

SEQ ID NO: 518725 - RNA, 64 nt, Homo Sapiens; identical to SEQ ID NO: 385560

SEQ ID NO: 518726 - RNA, 64 nt, Homo Sapiens; identical to SEQ ID NO: 385561

SEQ ID NO: 518727 - RNA, 64 nt, Homo Sapiens; identical to SEQ ID NO: 385562

SEQ ID NO: 518728 - RNA, 64 nt, Homo Sapiens; identical to SEQ ID NO: 385563

SEQ ID NO: 518729 - RNA, 64 nt, Homo Sapiens; identical to SEQ ID NO: 385564

SEQ ID NO: 518730 - RNA, 64 nt, Homo Sapiens; identical to SEQ ID NO: 385565

SEQ ID NO: 518731 - RNA, 64 nt, Homo Sapiens; identical to SEQ ID NO: 385566

SEQ ID NO: 518732 - RNA, 64 nt, Homo Sapiens; identical to SEQ ID NO: 385567

SEQ ID NO: 518733 - RNA, 64 nt, Homo Sapiens; identical to SEQ ID NO: 385568

SEQ ID NO: 518734 - RNA, 64 nt, Homo Sapiens; identical to SEQ ID NO: 385569

SEQ ID NO: 518735 - RNA, 64 nt, Homo Sapiens; identical to SEQ ID NO: 385570

SEQ ID NO: 518736 - RNA, 64 nt, Homo Sapiens; identical to SEQ ID NO: 385571

SEQ ID NO: 518737 - RNA, 64 nt, Homo Sapiens; identical to SEQ ID NO: 385572

SEQ ID NO: 518738 - RNA, 64 nt, Homo Sapiens; identical to SEQ ID NO: 385573

SEQ ID NO: 518739 - RNA, 64 nt, Homo Sapiens; identical to SEQ ID NO: 385574

SEQ ID NO: 518740 - RNA, 64 nt, Homo Sapiens; identical to SEQ ID NO: 385575

SEQ ID NO: 518741 - RNA, 64 nt, Homo Sapiens; identical to SEQ ID NO: 385576

SEQ ID NO: 518742 - RNA, 64 nt, Homo Sapiens; identical to SEQ ID NO: 385577

SEQ ID NO: 518743 - RNA, 64 nt, Homo Sapiens; identical to SEQ ID NO: 385578

SEQ ID NO: 518744 - RNA, 64 nt, Homo Sapiens; identical to SEQ ID NO: 385579

SEQ ID NO: 518745 - RNA, 64 nt, Homo Sapiens; identical to SEQ ID NO: 385580

SEQ ID NO: 518746 - RNA, 64 nt, Homo Sapiens; identical to SEQ ID NO: 385581

SEQ ID NO: 518747 - RNA, 64 nt, Homo Sapiens; identical to SEQ ID NO: 385582

SEQ ID NO: 518748 - RNA, 64 nt, Homo Sapiens; identical to SEQ ID NO: 385583

SEQ ID NO: 518749 - RNA, 64 nt, Homo Sapiens; identical to SEQ ID NO: 385584

SEQ ID NO: 518750 - RNA, 64 nt, Homo Sapiens; identical to SEQ ID NO: 385585

SEQ ID NO: 518751 - RNA, 64 nt, Homo Sapiens; identical to SEQ ID NO: 385586

SEQ ID NO: 518752 - RNA, 64 nt, Homo Sapiens; identical to SEQ ID NO: 385587

SEQ ID NO: 518753 - RNA, 64 nt, Homo Sapiens; identical to SEQ ID NO: 385588

SEQ ID NO: 518754 - RNA, 64 nt, Homo Sapiens; identical to SEQ ID NO: 220362

SEQ ID NO: 518755 - RNA, 64 nt, Homo Sapiens; identical to SEQ ID NO: 220363

SEQ ID NO: 518756 - RNA, 64 nt, Homo Sapiens; identical to SEQ ID NO: 220364

SEQ ID NO: 518757 - RNA, 64 nt, Homo Sapiens; identical to SEQ ID NO: 220365

SEQ ID NO: 518758 - RNA, 64 nt, Homo Sapiens; identical to SEQ ID NO: 220366

SEQ ID NO: 518759 - RNA, 64 nt, Homo Sapiens; identical to SEQ ID NO: 220367

SEQ ID NO: 518760 - RNA, 64 nt, Homo Sapiens; identical to SEQ ID NO: 220368

SEQ ID NO: 518761 - RNA, 64 nt, Homo Sapiens; identical to SEQ ID NO: 220369

SEQ ID NO: 518762 - RNA, 64 nt, Homo Sapiens; identical to SEQ ID NO: 220370

SEQ ID NO: 518763 - RNA, 64 nt, Homo Sapiens; identical to SEQ ID NO: 220371

SEQ ID NO: 518764 - RNA, 64 nt, Homo Sapiens; identical to SEQ ID NO: 220372

SEQ ID NO: 518765 - RNA, 64 nt, Homo Sapiens; identical to SEQ ID NO: 220373

SEQ ID NO: 518766 - RNA, 64 nt, Homo Sapiens; identical to SEQ ID NO: 220374

SEQ ID NO: 518767 - RNA, 64 nt, Homo Sapiens; identical to SEQ ID NO: 220375

SEQ ID NO: 518768 - RNA, 64 nt, Homo Sapiens; identical to SEQ ID NO: 220376

SEQ ID NO: 518769 - RNA, 64 nt, Homo Sapiens; identical to SEQ ID NO: 220377

SEQ ID NO: 518770 - RNA, 64 nt, Homo Sapiens; identical to SEQ ID NO: 220378

SEQ ID NO: 518771 - RNA, 64 nt, Homo Sapiens; identical to SEQ ID NO: 220379

SEQ ID NO: 518772 - RNA, 64 nt, Homo Sapiens; identical to SEQ ID NO: 220380

SEQ ID NO: 518773 - RNA, 64 nt, Homo Sapiens; identical to SEQ ID NO: 220381

SEQ ID NO: 518774 - RNA, 64 nt, Homo Sapiens; identical to SEQ ID NO: 220382

SEQ ID NO: 518775 - RNA, 64 nt, Homo Sapiens; identical to SEQ ID NO: 220383

SEQ ID NO: 518776 - RNA, 64 nt, Homo Sapiens; identical to SEQ ID NO: 220384

SEQ ID NO: 518777 - RNA, 64 nt, Homo Sapiens; identical to SEQ ID NO: 220385

SEQ ID NO: 518778 - RNA, 64 nt, Homo Sapiens; identical to SEQ ID NO: 220386

SEQ ID NO: 518779 - RNA, 64 nt, Homo Sapiens; identical to SEQ ID NO: 220387

SEQ ID NO: 518780 - RNA, 64 nt, Homo Sapiens; identical to SEQ ID NO: 220388

SEQ ID NO: 518781 - RNA, 64 nt, Homo Sapiens; identical to SEQ ID NO: 220389

SEQ ID NO: 518782 - RNA, 64 nt, Homo Sapiens; identical to SEQ ID NO: 220390

SEQ ID NO: 518783 - RNA, 64 nt, Homo Sapiens; identical to SEQ ID NO: 220391

SEQ ID NO: 518784 - RNA, 64 nt, Homo Sapiens; identical to SEQ ID NO: 220392

SEQ ID NO: 518785 - RNA, 64 nt, Homo Sapiens; identical to SEQ ID NO: 220393

SEQ ID NO: 518786 - RNA, 64 nt, Homo Sapiens; identical to SEQ ID NO: 220394

SEQ ID NO: 518787 - RNA, 64 nt, Homo Sapiens; identical to SEQ ID NO: 220395

SEQ ID NO: 518788 - RNA, 64 nt, Homo Sapiens; identical to SEQ ID NO: 220396

SEQ ID NO: 518789 - RNA, 64 nt, Homo Sapiens; identical to SEQ ID NO: 220397

SEQ ID NO: 518790 - RNA, 64 nt, Homo Sapiens; identical to SEQ ID NO: 220398

SEQ ID NO: 518791 - RNA, 64 nt, Homo Sapiens; identical to SEQ ID NO: 220399

SEQ ID NO: 518792 - RNA, 64 nt, Homo Sapiens; identical to SEQ ID NO: 220400

SEQ ID NO: 518793 - RNA, 64 nt, Homo Sapiens; identical to SEQ ID NO: 220401

SEQ ID NO: 518794 - RNA, 64 nt, Homo Sapiens; identical to SEQ ID NO: 220402

SEQ ID NO: 518795 - RNA, 64 nt, Homo Sapiens; identical to SEQ ID NO: 220403

SEQ ID NO: 518796 - RNA, 64 nt, Homo Sapiens; identical to SEQ ID NO: 220404

SEQ ID NO: 518797 - RNA, 64 nt, Homo Sapiens; identical to SEQ ID NO: 220405

SEQ ID NO: 518798 - RNA, 64 nt, Homo Sapiens; identical to SEQ ID NO: 220406

SEQ ID NO: 518799 - RNA, 64 nt, Homo Sapiens; identical to SEQ ID NO: 220407

SEQ ID NO: 518800 - RNA, 64 nt, Homo Sapiens; identical to SEQ ID NO: 220408

SEQ ID NO: 518801 - RNA, 64 nt, Homo Sapiens; identical to SEQ ID NO: 220409

SEQ ID NO: 518802 - RNA, 64 nt, Homo Sapiens; identical to SEQ ID NO: 220410

SEQ ID NO: 518803 - RNA, 64 nt, Homo Sapiens; identical to SEQ ID NO: 220411

SEQ ID NO: 518804 - RNA, 64 nt, Homo Sapiens; identical to SEQ ID NO: 220412

SEQ ID NO: 518805 - RNA, 64 nt, Homo Sapiens; identical to SEQ ID NO: 220413

SEQ ID NO: 518806 - RNA, 64 nt, Homo Sapiens; identical to SEQ ID NO: 220414

SEQ ID NO: 518807 - RNA, 64 nt, Homo Sapiens; identical to SEQ ID NO: 220415

SEQ ID NO: 518808 - RNA, 64 nt, Homo Sapiens; identical to SEQ ID NO: 220416

SEQ ID NO: 518809 - RNA, 64 nt, Homo Sapiens; identical to SEQ ID NO: 220417

SEQ ID NO: 518810 - RNA, 64 nt, Homo Sapiens; identical to SEQ ID NO: 220418

SEQ ID NO: 518811 - RNA, 64 nt, Homo Sapiens; identical to SEQ ID NO: 220419

SEQ ID NO: 518812 - RNA, 64 nt, Homo Sapiens; identical to SEQ ID NO: 220420

SEQ ID NO: 518813 - RNA, 64 nt, Homo Sapiens; identical to SEQ ID NO: 220421

SEQ ID NO: 518814 - RNA, 64 nt, Homo Sapiens; identical to SEQ ID NO: 220422

SEQ ID NO: 518815 - RNA, 64 nt, Homo Sapiens; identical to SEQ ID NO: 76114

SEQ ID NO: 518816 - RNA, 64 nt, Homo Sapiens; identical to SEQ ID NO: 76115

SEQ ID NO: 518817 - RNA, 64 nt, Homo Sapiens; identical to SEQ ID NO: 76116

SEQ ID NO: 518818 - RNA, 64 nt, Homo Sapiens; identical to SEQ ID NO: 76117

SEQ ID NO: 518819 - RNA, 64 nt, Homo Sapiens; identical to SEQ ID NO: 76118

SEQ ID NO: 518820 - RNA, 64 nt, Homo Sapiens; identical to SEQ ID NO: 76119

SEQ ID NO: 518821 - RNA, 64 nt, Homo Sapiens; identical to SEQ ID NO: 76120

SEQ ID NO: 518822 - RNA, 64 nt, Homo Sapiens; identical to SEQ ID NO: 76121

SEQ ID NO: 518823 - RNA, 64 nt, Homo Sapiens; identical to SEQ ID NO: 76122

SEQ ID NO: 518824 - RNA, 64 nt, Homo Sapiens; identical to SEQ ID NO: 76123

SEQ ID NO: 518825 - RNA, 64 nt, Homo Sapiens; identical to SEQ ID NO: 76124

SEQ ID NO: 518826 - RNA, 64 nt, Homo Sapiens; identical to SEQ ID NO: 76125

SEQ ID NO: 518827 - RNA, 64 nt, Homo Sapiens; identical to SEQ ID NO: 76126

SEQ ID NO: 518828 - RNA, 64 nt, Homo Sapiens; identical to SEQ ID NO: 76127

SEQ ID NO: 518829 - RNA, 64 nt, Homo Sapiens; identical to SEQ ID NO: 76128

SEQ ID NO: 518830 - RNA, 64 nt, Homo Sapiens; identical to SEQ ID NO: 76129

SEQ ID NO: 518831 - RNA, 64 nt, Homo Sapiens; identical to SEQ ID NO: 76130

SEQ ID NO: 518832 - RNA, 64 nt, Homo Sapiens; identical to SEQ ID NO: 76131

SEQ ID NO: 518833 - RNA, 64 nt, Homo Sapiens; identical to SEQ ID NO: 76132

SEQ ID NO: 518834 - RNA, 64 nt, Homo Sapiens; identical to SEQ ID NO: 76133

SEQ ID NO: 518835 - RNA, 64 nt, Homo Sapiens; identical to SEQ ID NO: 76134

SEQ ID NO: 518836 - RNA, 64 nt, Homo Sapiens; identical to SEQ ID NO: 76135

SEQ ID NO: 518837 - RNA, 64 nt, Homo Sapiens; identical to SEQ ID NO: 76136

SEQ ID NO: 518838 - RNA, 64 nt, Homo Sapiens; identical to SEQ ID NO: 76137

SEQ ID NO: 518839 - RNA, 64 nt, Homo Sapiens; identical to SEQ ID NO: 76138

SEQ ID NO: 518840 - RNA, 64 nt, Homo Sapiens; identical to SEQ ID NO: 76139

SEQ ID NO: 518841 - RNA, 64 nt, Homo Sapiens; identical to SEQ ID NO: 76140

SEQ ID NO: 518842 - RNA, 64 nt, Homo Sapiens; identical to SEQ ID NO: 76141

SEQ ID NO: 518843 - RNA, 64 nt, Homo Sapiens; identical to SEQ ID NO: 76142

SEQ ID NO: 518844 - RNA, 64 nt, Homo Sapiens; identical to SEQ ID NO: 76143

SEQ ID NO: 518845 - RNA, 64 nt, Homo Sapiens; identical to SEQ ID NO: 76144

SEQ ID NO: 518846 - RNA, 64 nt, Homo Sapiens; identical to SEQ ID NO: 76145

SEQ ID NO: 518847 - RNA, 64 nt, Homo Sapiens; identical to SEQ ID NO: 76146

SEQ ID NO: 518848 - RNA, 64 nt, Homo Sapiens; identical to SEQ ID NO: 76147

SEQ ID NO: 518849 - RNA, 64 nt, Homo Sapiens; identical to SEQ ID NO: 76148

SEQ ID NO: 518850 - RNA, 64 nt, Homo Sapiens; identical to SEQ ID NO: 76149

SEQ ID NO: 518851 - RNA, 64 nt, Homo Sapiens; identical to SEQ ID NO: 76150

SEQ ID NO: 518852 - RNA, 64 nt, Homo Sapiens; identical to SEQ ID NO: 76151

SEQ ID NO: 518853 - RNA, 64 nt, Homo Sapiens; identical to SEQ ID NO: 76152

SEQ ID NO: 518854 - RNA, 64 nt, Homo Sapiens; identical to SEQ ID NO: 76153

SEQ ID NO: 518855 - RNA, 64 nt, Homo Sapiens; identical to SEQ ID NO: 76154

SEQ ID NO: 518856 - RNA, 64 nt, Homo Sapiens; identical to SEQ ID NO: 126797

SEQ ID NO: 518857 - RNA, 64 nt, Homo Sapiens; identical to SEQ ID NO: 126798

SEQ ID NO: 518858 - RNA, 64 nt, Homo Sapiens; identical to SEQ ID NO: 126799

SEQ ID NO: 518859 - RNA, 64 nt, Homo Sapiens; identical to SEQ ID NO: 126800

SEQ ID NO: 518860 - RNA, 64 nt, Homo Sapiens; identical to SEQ ID NO: 126801

SEQ ID NO: 518861 - RNA, 64 nt, Homo Sapiens; identical to SEQ ID NO: 126802

SEQ ID NO: 518862 - RNA, 64 nt, Homo Sapiens; identical to SEQ ID NO: 126803

SEQ ID NO: 518863 - RNA, 64 nt, Homo Sapiens; identical to SEQ ID NO: 126804

SEQ ID NO: 518864 - RNA, 64 nt, Homo Sapiens; identical to SEQ ID NO: 126805

SEQ ID NO: 518865 - RNA, 64 nt, Homo Sapiens; identical to SEQ ID NO: 126806

SEQ ID NO: 518866 - RNA, 64 nt, Homo Sapiens; identical to SEQ ID NO: 126807

SEQ ID NO: 518867 - RNA, 64 nt, Homo Sapiens; identical to SEQ ID NO: 126808

SEQ ID NO: 518868 - RNA, 64 nt, Homo Sapiens; identical to SEQ ID NO: 126809

SEQ ID NO: 518869 - RNA, 64 nt, Homo Sapiens; identical to SEQ ID NO: 209092

SEQ ID NO: 518870 - RNA, 64 nt, Homo Sapiens; identical to SEQ ID NO: 209093

SEQ ID NO: 518871 - RNA, 64 nt, Homo Sapiens; identical to SEQ ID NO: 209094

SEQ ID NO: 518872 - RNA, 64 nt, Homo Sapiens; identical to SEQ ID NO: 209095

SEQ ID NO: 518873 - RNA, 64 nt, Homo Sapiens; identical to SEQ ID NO: 209096

SEQ ID NO: 518874 - RNA, 64 nt, Homo Sapiens; identical to SEQ ID NO: 209097

SEQ ID NO: 518875 - RNA, 64 nt, Homo Sapiens; identical to SEQ ID NO: 209098

SEQ ID NO: 518876 - RNA, 64 nt, Homo Sapiens; identical to SEQ ID NO: 209099

SEQ ID NO: 518877 - RNA, 64 nt, Homo Sapiens; identical to SEQ ID NO: 209100

SEQ ID NO: 518878 - RNA, 64 nt, Homo Sapiens; identical to SEQ ID NO: 209101

SEQ ID NO: 518879 - RNA, 64 nt, Homo Sapiens; identical to SEQ ID NO: 209102

SEQ ID NO: 518880 - RNA, 64 nt, Homo Sapiens; identical to SEQ ID NO: 209103

SEQ ID NO: 518881 - RNA, 64 nt, Homo Sapiens; identical to SEQ ID NO: 209104

SEQ ID NO: 518882 - RNA, 64 nt, Homo Sapiens; identical to SEQ ID NO: 209105

SEQ ID NO: 518883 - RNA, 64 nt, Homo Sapiens; identical to SEQ ID NO: 209106

SEQ ID NO: 518884 - RNA, 64 nt, Homo Sapiens; identical to SEQ ID NO: 209107

SEQ ID NO: 518885 - RNA, 64 nt, Homo Sapiens; identical to SEQ ID NO: 209108

SEQ ID NO: 518886 - RNA, 64 nt, Homo Sapiens; identical to SEQ ID NO: 209109

SEQ ID NO: 518887 - RNA, 64 nt, Homo Sapiens; identical to SEQ ID NO: 209110

SEQ ID NO: 518888 - RNA, 64 nt, Homo Sapiens; identical to SEQ ID NO: 209111

SEQ ID NO: 518889 - RNA, 64 nt, Homo Sapiens; identical to SEQ ID NO: 209112

SEQ ID NO: 518890 - RNA, 64 nt, Homo Sapiens; identical to SEQ ID NO: 209113

SEQ ID NO: 518891 - RNA, 59 nt, Homo Sapiens; identical to SEQ ID NO: 209114

SEQ ID NO: 518892 - RNA, 64 nt, Homo Sapiens; identical to SEQ ID NO: 209115

SEQ ID NO: 518893 - RNA, 64 nt, Homo Sapiens; identical to SEQ ID NO: 209116

SEQ ID NO: 518894 - RNA, 64 nt, Homo Sapiens; identical to SEQ ID NO: 209117

SEQ ID NO: 518895 - RNA, 64 nt, Homo Sapiens; identical to SEQ ID NO: 209118

SEQ ID NO: 518896 - RNA, 64 nt, Homo Sapiens; identical to SEQ ID NO: 209119

SEQ ID NO: 518897 - RNA, 64 nt, Homo Sapiens; identical to SEQ ID NO: 209120

SEQ ID NO: 518898 - RNA, 64 nt, Homo Sapiens; identical to SEQ ID NO: 209121

SEQ ID NO: 518899 - RNA, 64 nt, Homo Sapiens; identical to SEQ ID NO: 209122

SEQ ID NO: 518900 - RNA, 64 nt, Homo Sapiens; identical to SEQ ID NO: 209123

SEQ ID NO: 518901 - RNA, 64 nt, Homo Sapiens; identical to SEQ ID NO: 209124

SEQ ID NO: 518902 - RNA, 64 nt, Homo Sapiens; identical to SEQ ID NO: 209125

SEQ ID NO: 518903 - RNA, 64 nt, Homo Sapiens; identical to SEQ ID NO: 209126

SEQ ID NO: 518904 - RNA, 64 nt, Homo Sapiens; identical to SEQ ID NO: 209127

SEQ ID NO: 518905 - RNA, 64 nt, Homo Sapiens; identical to SEQ ID NO: 209128

SEQ ID NO: 518906 - RNA, 64 nt, Homo Sapiens; identical to SEQ ID NO: 209129

SEQ ID NO: 518907 - RNA, 64 nt, Homo Sapiens; identical to SEQ ID NO: 209130

SEQ ID NO: 518908 - RNA, 64 nt, Homo Sapiens; identical to SEQ ID NO: 209131

SEQ ID NO: 518909 - RNA, 64 nt, Homo Sapiens; identical to SEQ ID NO: 209132

SEQ ID NO: 518910 - RNA, 64 nt, Homo Sapiens; identical to SEQ ID NO: 209133

SEQ ID NO: 518911 - RNA, 64 nt, Homo Sapiens; identical to SEQ ID NO: 209134

SEQ ID NO: 518912 - RNA, 64 nt, Homo Sapiens; identical to SEQ ID NO: 209135

SEQ ID NO: 518913 - RNA, 64 nt, Homo Sapiens; identical to SEQ ID NO: 209136

SEQ ID NO: 518914 - RNA, 64 nt, Homo Sapiens; identical to SEQ ID NO: 209137

SEQ ID NO: 518915 - RNA, 64 nt, Homo Sapiens; identical to SEQ ID NO: 209138

SEQ ID NO: 518916 - RNA, 64 nt, Homo Sapiens; identical to SEQ ID NO: 209139

SEQ ID NO: 518917 - RNA, 64 nt, Homo Sapiens; identical to SEQ ID NO: 209140

SEQ ID NO: 518918 - RNA, 64 nt, Homo Sapiens; identical to SEQ ID NO: 209141

SEQ ID NO: 518919 - RNA, 64 nt, Homo Sapiens; identical to SEQ ID NO: 209142

SEQ ID NO: 518920 - RNA, 64 nt, Homo Sapiens; identical to SEQ ID NO: 209143

SEQ ID NO: 518921 - RNA, 64 nt, Homo Sapiens; identical to SEQ ID NO: 209144

SEQ ID NO: 518922 - RNA, 64 nt, Homo Sapiens; identical to SEQ ID NO: 209145

SEQ ID NO: 518923 - RNA, 64 nt, Homo Sapiens
uugcucuuauaacugguagaaacaguucuucaccuaacagcauaaacauaauauauuucuguua

SEQ ID NO: 518924 - RNA, 64 nt, Homo Sapiens
aauuuauagaguauugauguuuuuuuaaauuuguuaacagcauuuuugaaaauuguauguuuua

SEQ ID NO: 518925 - RNA, 64 nt, Homo Sapiens
cuugcuguuuucacuugguaccacaguucuggccuaacagcagaaaaauaguucagcaaguagc

SEQ ID NO: 518926 - RNA, 64 nt, Homo Sapiens
auaauuccauccuaggaaagcccugcacguugaguaacagcagcucugugucucccucacugaa

SEQ ID NO: 518927 - RNA, 64 nt, Homo Sapiens
ccgaugaugucucuacuacuggaucuaucuguauuaacagcaauguuacucucaaugaaacugc

SEQ ID NO: 518928 - RNA, 64 nt, Homo Sapiens
cuggacaguggaaaccaagagcaggaucgcaaaguaacagcaucagacucuucugcccuccucu

SEQ ID NO: 518929 - RNA, 64 nt, Homo Sapiens
gggaagcaaauaucuuaccaaacaucuaagccucuaacagcacaaagccugccuuagggcuggc

SEQ ID NO: 518930 - RNA, 64 nt, Homo Sapiens
cuugaaaaaauagacuuaaaguuuuaaaaauucauaacagcaacacacauaaagucaaacaaau

SEQ ID NO: 518931 - RNA, 64 nt, Homo Sapiens
ucccuuccuucccccuccuuagugauuuuuucuuuaacagcauaaguaaagaggacuuucuggu

SEQ ID NO: 518932 - RNA, 64 nt, Homo Sapiens
cucaagcaucacgccuagcaguuucugguuccuuuaacagcaaaaggaaagagagguucugauu

SEQ ID NO: 518933 - RNA, 64 nt, Homo Sapiens; identical to SEQ ID NO: 506898

SEQ ID NO: 518934 - RNA, 64 nt, Homo Sapiens; identical to SEQ ID NO: 506899

SEQ ID NO: 518935 - RNA, 64 nt, Homo Sapiens; identical to SEQ ID NO: 506900

SEQ ID NO: 518936 - RNA, 64 nt, Homo Sapiens; identical to SEQ ID NO: 506901

SEQ ID NO: 518937 - RNA, 64 nt, Homo Sapiens; identical to SEQ ID NO: 506902

SEQ ID NO: 518938 - RNA, 64 nt, Homo Sapiens; identical to SEQ ID NO: 506903

SEQ ID NO: 518939 - RNA, 64 nt, Homo Sapiens; identical to SEQ ID NO: 506904

SEQ ID NO: 518940 - RNA, 64 nt, Homo Sapiens; identical to SEQ ID NO: 506905

SEQ ID NO: 518941 - RNA, 64 nt, Homo Sapiens; identical to SEQ ID NO: 506906

SEQ ID NO: 518942 - RNA, 64 nt, Homo Sapiens; identical to SEQ ID NO: 506907

SEQ ID NO: 518943 - RNA, 64 nt, Homo Sapiens; identical to SEQ ID NO: 506908

SEQ ID NO: 518944 - RNA, 64 nt, Homo Sapiens; identical to SEQ ID NO: 506909

SEQ ID NO: 518945 - RNA, 64 nt, Homo Sapiens; identical to SEQ ID NO: 506910

SEQ ID NO: 518946 - RNA, 64 nt, Homo Sapiens; identical to SEQ ID NO: 506911

SEQ ID NO: 518947 - RNA, 64 nt, Homo Sapiens; identical to SEQ ID NO: 129516

SEQ ID NO: 518948 - RNA, 64 nt, Homo Sapiens; identical to SEQ ID NO: 129517

SEQ ID NO: 518949 - RNA, 64 nt, Homo Sapiens; identical to SEQ ID NO: 129518

SEQ ID NO: 518950 - RNA, 64 nt, Homo Sapiens; identical to SEQ ID NO: 129519

SEQ ID NO: 518951 - RNA, 64 nt, Homo Sapiens; identical to SEQ ID NO: 129520

SEQ ID NO: 518952 - RNA, 64 nt, Homo Sapiens; identical to SEQ ID NO: 129521

SEQ ID NO: 518953 - RNA, 64 nt, Homo Sapiens; identical to SEQ ID NO: 129522

SEQ ID NO: 518954 - RNA, 64 nt, Homo Sapiens; identical to SEQ ID NO: 129523

SEQ ID NO: 518955 - RNA, 64 nt, Homo Sapiens; identical to SEQ ID NO: 129524

SEQ ID NO: 518956 - RNA, 64 nt, Homo Sapiens; identical to SEQ ID NO: 129525

SEQ ID NO: 518957 - RNA, 59 nt, Homo Sapiens; identical to SEQ ID NO: 129526

SEQ ID NO: 518958 - RNA, 64 nt, Homo Sapiens; identical to SEQ ID NO: 129527

SEQ ID NO: 518959 - RNA, 64 nt, Homo Sapiens; identical to SEQ ID NO: 129528

SEQ ID NO: 518960 - RNA, 64 nt, Homo Sapiens; identical to SEQ ID NO: 129529

SEQ ID NO: 518961 - RNA, 64 nt, Homo Sapiens; identical to SEQ ID NO: 129530

SEQ ID NO: 518962 - RNA, 64 nt, Homo Sapiens; identical to SEQ ID NO: 129531

SEQ ID NO: 518963 - RNA, 64 nt, Homo Sapiens; identical to SEQ ID NO: 129532

SEQ ID NO: 518964 - RNA, 53 nt, Homo Sapiens; identical to SEQ ID NO: 129533

SEQ ID NO: 518965 - RNA, 64 nt, Homo Sapiens; identical to SEQ ID NO: 129534

SEQ ID NO: 518966 - RNA, 64 nt, Homo Sapiens; identical to SEQ ID NO: 129535

SEQ ID NO: 518967 - RNA, 64 nt, Homo Sapiens; identical to SEQ ID NO: 129536

SEQ ID NO: 518968 - RNA, 64 nt, Homo Sapiens; identical to SEQ ID NO: 129537

SEQ ID NO: 518969 - RNA, 64 nt, Homo Sapiens; identical to SEQ ID NO: 129538

SEQ ID NO: 518970 - RNA, 64 nt, Homo Sapiens; identical to SEQ ID NO: 129539

SEQ ID NO: 518971 - RNA, 64 nt, Homo Sapiens; identical to SEQ ID NO: 129540

SEQ ID NO: 518972 - RNA, 64 nt, Homo Sapiens; identical to SEQ ID NO: 129541

SEQ ID NO: 518973 - RNA, 64 nt, Homo Sapiens; identical to SEQ ID NO: 129542

SEQ ID NO: 518974 - RNA, 64 nt, Homo Sapiens; identical to SEQ ID NO: 129543

SEQ ID NO: 518975 - RNA, 64 nt, Homo Sapiens; identical to SEQ ID NO: 129544

SEQ ID NO: 518976 - RNA, 64 nt, Homo Sapiens; identical to SEQ ID NO: 129545

SEQ ID NO: 518977 - RNA, 64 nt, Homo Sapiens; identical to SEQ ID NO: 129546

SEQ ID NO: 518978 - RNA, 64 nt, Homo Sapiens; identical to SEQ ID NO: 129547

SEQ ID NO: 518979 - RNA, 64 nt, Homo Sapiens; identical to SEQ ID NO: 129548

SEQ ID NO: 518980 - RNA, 64 nt, Homo Sapiens; identical to SEQ ID NO: 129549

SEQ ID NO: 518981 - RNA, 64 nt, Homo Sapiens; identical to SEQ ID NO: 129550

SEQ ID NO: 518982 - RNA, 64 nt, Homo Sapiens; identical to SEQ ID NO: 129551

SEQ ID NO: 518983 - RNA, 64 nt, Homo Sapiens; identical to SEQ ID NO: 129552

SEQ ID NO: 518984 - RNA, 64 nt, Homo Sapiens; identical to SEQ ID NO: 129553

SEQ ID NO: 518985 - RNA, 64 nt, Homo Sapiens; identical to SEQ ID NO: 129554

SEQ ID NO: 518986 - RNA, 64 nt, Homo Sapiens; identical to SEQ ID NO: 129555

SEQ ID NO: 518987 - RNA, 64 nt, Homo Sapiens; identical to SEQ ID NO: 129556

SEQ ID NO: 518988 - RNA, 64 nt, Homo Sapiens; identical to SEQ ID NO: 129557

SEQ ID NO: 518989 - RNA, 64 nt, Homo Sapiens; identical to SEQ ID NO: 173314

SEQ ID NO: 518990 - RNA, 64 nt, Homo Sapiens; identical to SEQ ID NO: 173315

SEQ ID NO: 518991 - RNA, 64 nt, Homo Sapiens; identical to SEQ ID NO: 173316

SEQ ID NO: 518992 - RNA, 64 nt, Homo Sapiens; identical to SEQ ID NO: 173317

SEQ ID NO: 518993 - RNA, 64 nt, Homo Sapiens; identical to SEQ ID NO: 173318

SEQ ID NO: 518994 - RNA, 64 nt, Homo Sapiens; identical to SEQ ID NO: 173319

SEQ ID NO: 518995 - RNA, 64 nt, Homo Sapiens; identical to SEQ ID NO: 173320

SEQ ID NO: 518996 - RNA, 64 nt, Homo Sapiens; identical to SEQ ID NO: 173321

SEQ ID NO: 518997 - RNA, 64 nt, Homo Sapiens; identical to SEQ ID NO: 173322

SEQ ID NO: 518998 - RNA, 64 nt, Homo Sapiens; identical to SEQ ID NO: 173323

SEQ ID NO: 518999 - RNA, 64 nt, Homo Sapiens; identical to SEQ ID NO: 173324

SEQ ID NO: 519000 - RNA, 64 nt, Homo Sapiens; identical to SEQ ID NO: 173325

SEQ ID NO: 519001 - RNA, 64 nt, Homo Sapiens; identical to SEQ ID NO: 173326

SEQ ID NO: 519002 - RNA, 64 nt, Homo Sapiens; identical to SEQ ID NO: 173327

SEQ ID NO: 519003 - RNA, 64 nt, Homo Sapiens; identical to SEQ ID NO: 173328

SEQ ID NO: 519004 - RNA, 64 nt, Homo Sapiens; identical to SEQ ID NO: 76226

SEQ ID NO: 519005 - RNA, 64 nt, Homo Sapiens; identical to SEQ ID NO: 76227

SEQ ID NO: 519006 - RNA, 64 nt, Homo Sapiens; identical to SEQ ID NO: 76228

SEQ ID NO: 519007 - RNA, 64 nt, Homo Sapiens; identical to SEQ ID NO: 76229

SEQ ID NO: 519008 - RNA, 64 nt, Homo Sapiens; identical to SEQ ID NO: 76230

SEQ ID NO: 519009 - RNA, 64 nt, Homo Sapiens; identical to SEQ ID NO: 76231

SEQ ID NO: 519010 - RNA, 64 nt, Homo Sapiens; identical to SEQ ID NO: 76232

SEQ ID NO: 519011 - RNA, 64 nt, Homo Sapiens; identical to SEQ ID NO: 76233

SEQ ID NO: 519012 - RNA, 64 nt, Homo Sapiens; identical to SEQ ID NO: 76234

SEQ ID NO: 519013 - RNA, 64 nt, Homo Sapiens; identical to SEQ ID NO: 76235

SEQ ID NO: 519014 - RNA, 64 nt, Homo Sapiens; identical to SEQ ID NO: 76236

SEQ ID NO: 519015 - RNA, 64 nt, Homo Sapiens; identical to SEQ ID NO: 76237

SEQ ID NO: 519016 - RNA, 64 nt, Homo Sapiens; identical to SEQ ID NO: 76238

SEQ ID NO: 519017 - RNA, 64 nt, Homo Sapiens; identical to SEQ ID NO: 76239

SEQ ID NO: 519018 - RNA, 64 nt, Homo Sapiens; identical to SEQ ID NO: 76240

SEQ ID NO: 519019 - RNA, 64 nt, Homo Sapiens; identical to SEQ ID NO: 76241

SEQ ID NO: 519020 - RNA, 64 nt, Homo Sapiens; identical to SEQ ID NO: 76242

SEQ ID NO: 519021 - RNA, 64 nt, Homo Sapiens; identical to SEQ ID NO: 76243

SEQ ID NO: 519022 - RNA, 64 nt, Homo Sapiens
aguaggaugaugauucaaaguucucuauaccaagauaugcuagguccucuugccccagaaguaa

SEQ ID NO: 519023 - RNA, 64 nt, Homo Sapiens
uguugaagauauuuuggguaaucucuucuagaauauaugcuaacucauuauccauggcucauua

SEQ ID NO: 519024 - RNA, 64 nt, Homo Sapiens
gcguuucaauauuuaagauuguuauaccaucuuuauaugcuauuaugaaauaaaagcaucuuag

SEQ ID NO: 519025 - RNA, 64 nt, Homo Sapiens
auacuaauuaauaaguaaacucuaagaaucugaaauaugcuacuagcacccucuagcuccauau

SEQ ID NO: 519026 - RNA, 64 nt, Homo Sapiens
ucuccacucacaugcugauauacuuucuacuacaauaugcuauagcuuuauggaacucagggug

SEQ ID NO: 519027 - RNA, 64 nt, Homo Sapiens
agcuaugacagaguaggaauugagaaauuauuucauaugcuacaguauugaaauguggaugcug

SEQ ID NO: 519028 - RNA, 64 nt, Homo Sapiens
ucagcuuuggaccacaauaauuucacuguagaugauaugcuaggaucaaaguuaaacagcauuc

SEQ ID NO: 519029 - RNA, 64 nt, Homo Sapiens
cuuaagcagaacaagggaagauugauauuuuuggauaugcuauagcagcuuucuccuaugaaau

SEQ ID NO: 519030 - RNA, 64 nt, Homo Sapiens
cuggagugaggacggugaugcccuguguguauuaauaugcuauguaaggcugggcgugguggcu

SEQ ID NO: 519031 - RNA, 64 nt, Homo Sapiens
auauguguguguguauauauauauauauauauauauaugcuauauaaaguuuaaaugaaaugcu

SEQ ID NO: 519032 - RNA, 64 nt, Homo Sapiens
uuguuugauuuuuucuuuuacaaaagugguucuaauaugcuaguuucagcuccuuacaaauuac

SEQ ID NO: 519033 - RNA, 64 nt, Homo Sapiens
uaggcaccauguguguggcuggugcuaguagaguauaugcuaucaaacauuccccuuccaaucu

SEQ ID NO: 519034 - RNA, 64 nt, Homo Sapiens
gucugugcgccccuuguuggagccacaauucagcgguaccuagacuuccugugcccaggguguc

SEQ ID NO: 519035 - RNA, 64 nt, Homo Sapiens
acagauccaggaccugccccugggaccauggagcgguaccuaaaaaggagccccacuggcuguu

SEQ ID NO: 519036 - RNA, 64 nt, Homo Sapiens
uucccccagaggcccuccuguccgaaaagaaaaggaccuugauucugagcccagggucggaacc

SEQ ID NO: 519037 - RNA, 64 nt, Homo Sapiens
ucgcuggcagaguugggucaagugcccucuccuugaccuugagaugaaggucaagagcacaggg

SEQ ID NO: 519038 - RNA, 64 nt, Homo Sapiens
auuaaaauauuaggaagaaacaaggacaaauuuagaccuugaauccgaagagauaaagcuuacu

SEQ ID NO: 519039 - RNA, 64 nt, Homo Sapiens
uuaccagcaucagagagcuucccauuugcaucuagaccuugaauuuauauuuauugaucaaguu

SEQ ID NO: 519040 - RNA, 64 nt, Homo Sapiens
cuuuuccuccuagugcuaucauuagucacauaaugaccuugauuuuauuuuaggagcuuauaag

SEQ ID NO: 519041 - RNA, 64 nt, Homo Sapiens
aaaguuugggggggggguugugaagauuuagggggaccuugauagagaacuuuauaaacuucuu

SEQ ID NO: 519042 - RNA, 64 nt, Homo Sapiens
aaauuuuauaaugcuuguucuguuaacucaccgggaccuugaggguccaaugggaccuugaggg

SEQ ID NO: 519043 - RNA, 64 nt, Homo Sapiens
cuguuaacucaccgggaccuugaggguccaaugggaccuugaggguuuucucugaaauauacaa

SEQ ID NO: 519044 - RNA, 64 nt, Homo Sapiens
aaucagacuaucugucugugagccaggcaggcaggaccuugaggagugucagcaucuacaguac

SEQ ID NO: 519045 - RNA, 64 nt, Homo Sapiens
cggaaccugagugacagccucugcugaauguccugaccuugaacuaccuuggcuaccacagguu

SEQ ID NO: 519046 - RNA, 64 nt, Homo Sapiens
uuagaugggaaagugaggggcuugagaaagugggugggaggagggaaggauuuuuuaggagccu

SEQ ID NO: 519047 - RNA, 64 nt, Homo Sapiens
cacaagcccagcugaagaacagaauggagggcucugggaggaggcagcucacuggagagccuac

SEQ ID NO: 519048 - RNA, 64 nt, Homo Sapiens
accuccgccuccagggcgcagccuccugaguagcugggaggacaggcauaugccaccacaucac

SEQ ID NO: 519049 - RNA, 64 nt, Homo Sapiens
gcaccuaugguuccagcuacucaggaggcugaggugggaggaucgcuugugccuuggaggucaa

SEQ ID NO: 519050 - RNA, 64 nt, Homo Sapiens
gugccugaagucccagauacuuggggggcugaggugggaggaucucuugagccugggaggucaa

SEQ ID NO: 519051 - RNA, 64 nt, Homo Sapiens
acgccuguaauccuagcacuuugggaggccaaggugggaggauugcuugagcucaggaguuuga

SEQ ID NO: 519052 - RNA, 64 nt, Homo Sapiens
ggagcccacccaggcacagccaccacuuugcaagugggaggaggggagaaggggagacaaaacc

SEQ ID NO: 519053 - RNA, 64 nt, Homo Sapiens
agcaccaugccaucggcgcuccagucugucuggcugggaggaaagugcugggcaucuuacagua

SEQ ID NO: 519054 - RNA, 64 nt, Homo Sapiens
agggaaacgcugaugagacgaccacaggcuccccugggaggacggcagcaucccaccagccugc

SEQ ID NO: 519055 - RNA, 64 nt, Homo Sapiens
cagccaaaucuugcgacuccucccccaagccuccugggaggaucuccagccaagcugugcccca

SEQ ID NO: 519056 - RNA, 64 nt, Homo Sapiens
gggaaagggcugggccucacguuaggaauaguggugggaggaagccaccccugccaggccccag

SEQ ID NO: 519057 - RNA, 64 nt, Homo Sapiens
cuaaugaaauaccugaaacaaguucccugcuugaugggaggaucuuugaucuucucaaacaucu

SEQ ID NO: 519058 - RNA, 64 nt, Homo Sapiens
auaacccaggucuuaaggacccucccacuaggacugggaggagaagucuuuguggaauggauag

SEQ ID NO: 519059 - RNA, 64 nt, Homo Sapiens
cucuuucucucggagggugcagagcuggguuccuugggaggaaguuguaguggugaugaugaug

SEQ ID NO: 519060 - RNA, 64 nt, Homo Sapiens
uuccgagcauccgccgccucuuuucugcugggucugggaggagggaggcugggaggccgcucgg

SEQ ID NO: 519061 - RNA, 64 nt, Homo Sapiens
acaccuguaaccucagcacuuugggaggcagaggugggaggaucacuuagguccaggaguucga

SEQ ID NO: 519062 - RNA, 64 nt, Homo Sapiens
uguaucugugucccagcuaauugggagggugaguugggaggauuguuugagccuaggagaggga

SEQ ID NO: 519063 - RNA, 64 nt, Homo Sapiens
gcaucuauagucccugcuauuugagaggcugaggugggaggaucauuugagugcaggaguucaa

SEQ ID NO: 519064 - RNA, 64 nt, Homo Sapiens
accccuguagucccagcuacuugggaggcugaggugggaggauugcuugaacccaagaggucga

SEQ ID NO: 519065 - RNA, 64 nt, Homo Sapiens
gaucgaucgcuugagccugguuaggaggcugagaugggaggauuacaccuguagucccagcuac

SEQ ID NO: 519066 - RNA, 64 nt, Homo Sapiens
acuugagcacaggaguuugauugggaggccgaggugggaggaucacaccuauaaucccaacacu

SEQ ID NO: 519067 - RNA, 64 nt, Homo Sapiens
gguguucagccagucguuugggggcagagaggccugggaggaaaugagcagauugagugaugcu

SEQ ID NO: 519068 - RNA, 64 nt, Homo Sapiens
uuacccagaauacuugccgcgugggggaagacuuugggaggauuagucccccacuggggggacg

SEQ ID NO: 519069 - RNA, 64 nt, Homo Sapiens
gggaggucaugagccaaggaugacuugcuguugcugggaggaaggaugaggugugagacagacu

SEQ ID NO: 519070 - RNA, 64 nt, Homo Sapiens
uauuugagaaauacuaccuucugugguuuuagcaugggaggacuaggcuagugucugcgcguca

SEQ ID NO: 519071 - RNA, 64 nt, Homo Sapiens
ugccucacuacaggggggccaguuggaaagccacugggaggaaaagcagagguucaugggacac

SEQ ID NO: 519072 - RNA, 64 nt, Homo Sapiens
aggaggaagaggaggaaggcuggggagucaggggugggaggagaaaccaauagaguugguuggg

SEQ ID NO: 519073 - RNA, 64 nt, Homo Sapiens
aaacaacccagcccaguuaacccauccaagacugugggaggaguaccgcaccagacccucaaaa

SEQ ID NO: 519074 - RNA, 64 nt, Homo Sapiens
ugaaugcauguaggcacaugacuguccaguuuggugggaggaacggucaacaggguuagcuauc

SEQ ID NO: 519075 - RNA, 64 nt, Homo Sapiens
aaacagugaggucuauuggaaaguuagccuucagugggaggaguggcaaaggcacgcagggcag

SEQ ID NO: 519076 - RNA, 64 nt, Homo Sapiens
gggauuucacuaagggcuggagaaggggggaauaugggaggauuaucuccuaucacagggagcg

SEQ ID NO: 519077 - RNA, 64 nt, Homo Sapiens
aagaaagggaagaauuaggugcaggcggguugggugggaggagggccaaggcucaucuugagaa

SEQ ID NO: 519078 - RNA, 64 nt, Homo Sapiens
aagaaagggaagaauuaggugcaggcggguugggugggaggagggaguuuguugccacugagaa

SEQ ID NO: 519079 - RNA, 64 nt, Homo Sapiens
cuggagagagcacagugaaauggaauucgucuucugggaggaagagugaggaaggagacagggg

SEQ ID NO: 519080 - RNA, 64 nt, Homo Sapiens
aaucaccguugacgcaucuuaaagggaaacaaugugggaggaaguugaaaaaauaacaguuuaa

SEQ ID NO: 519081 - RNA, 64 nt, Homo Sapiens
cccucuugcugccugccugucugcugagguaaggugggaggagggcuacagcccacaucccacc

SEQ ID NO: 519082 - RNA, 64 nt, Homo Sapiens
guugauuguaccuucccaagcccgcccagugggaugggaggaggaggagaaggggggccuuggg

SEQ ID NO: 519083 - RNA, 64 nt, Homo Sapiens
ccccagcccucauccagcucccaucugaguauuuugggaggagcuagaaggaaaauggaaaccc

SEQ ID NO: 519084 - RNA, 64 nt, Homo Sapiens
uggggaccagggggucuuggaguugauucugaccugggaggaucugucuucaccccaaaacuuc

SEQ ID NO: 519085 - RNA, 64 nt, Homo Sapiens
acaucgguaguccuggcuacuagagagguugaggugggaggaucacuugaaccugggagguggg

SEQ ID NO: 519086 - RNA, 64 nt, Homo Sapiens
accuguaguccgagguacucaggaggcagagacgugggaggaucgcuugagccugggagauuga

SEQ ID NO: 519087 - RNA, 64 nt, Homo Sapiens
gcacuagguaaagcccagugaaugucucuuggcaugggaggaguuaaagagguuggaagggaag

SEQ ID NO: 519088 - RNA, 64 nt, Homo Sapiens
cacuuauuuuugaaaaugauauaauguauauauaugggaggaaaggccacauuuuguaccuguu

SEQ ID NO: 519089 - RNA, 64 nt, Homo Sapiens
aaccaucacaagauucccucaagggaggggauguugggaggagaugcuuuacaacuucaggcua

SEQ ID NO: 519090 - RNA, 64 nt, Homo Sapiens
agcugaguuaagaaaauucuggcaugcuuagcacugggaggaaagcccccgcgugaaaugagaa

SEQ ID NO: 519091 - RNA, 64 nt, Homo Sapiens
gcucuguccuaccuccacucucugccccuaaagaugggaggagaccagcgguccaugggucugg

SEQ ID NO: 519092 - RNA, 64 nt, Homo Sapiens
ggacgggcaagugagaggggagggagggaaguccugggaggauccugagcugcuguugcagucu

SEQ ID NO: 519093 - RNA, 64 nt, Homo Sapiens
cugcuuugaugcauggcuauaaucccagccgaggugggaggaucacuugaguccagguucaaga

SEQ ID NO: 519094 - RNA, 64 nt, Homo Sapiens
gcgccugcagucccagcuacuugggaggcugaguugggaggaucacuugagccugggagguuga

SEQ ID NO: 519095 - RNA, 64 nt, Homo Sapiens
ucucaggcuaugccauggcaagacccugcugcuuugggaggauugacuugggaggagacugagg

SEQ ID NO: 519096 - RNA, 64 nt, Homo Sapiens
cugaggagacccugcugcuugugacagccugacuugggaggagaguaugauuuugaggacgacu

SEQ ID NO: 519097 - RNA, 64 nt, Homo Sapiens
acuugaauguaggaucacuugagucccaguuacuugggaggaucgggcaugguggcccaagucu

SEQ ID NO: 519098 - RNA, 64 nt, Homo Sapiens
gcuucagcccaggaguuugaacucggggcugaggugggaggauuucaugccuguaauccuagca

SEQ ID NO: 519099 - RNA, 64 nt, Homo Sapiens
cuucugccuacaaaucagggguaaaaauaccuguugggaggagaaaugagaacauagaggaaag

SEQ ID NO: 519100 - RNA, 64 nt, Homo Sapiens
gcacacuucugcuuuauguguguguguauggggaugggaggacuuaacggaaguugaaccaguu

SEQ ID NO: 519101 - RNA, 64 nt, Homo Sapiens
caaccacuuucggagaaugagccaggucagucacugggaggaccugugaaagaaaguuggucac

SEQ ID NO: 519102 - RNA, 64 nt, Homo Sapiens
augccuguaaucccagcacuuugggaggcugaagugggaggacugcuugggcccaagaauucag

SEQ ID NO: 519103 - RNA, 64 nt, Homo Sapiens
gcuugagcccaugaggcccauauggagguugaggugggaggaucgugccuguagucccagcuac

SEQ ID NO: 519104 - RNA, 64 nt, Homo Sapiens
gcuugagcccaggaguuugauuaggaggccaaggugggaggaucacucuuguaaucccaaaacu

SEQ ID NO: 519105 - RNA, 64 nt, Homo Sapiens
gcagaaauuggaguggauggguucugccuuaaauugggaggacuccaagccgggaaggaaaauu

SEQ ID NO: 519106 - RNA, 64 nt, Homo Sapiens
uguuuuugauugaacuuguucauuuuguuuugcuugggaggaaaauaaacaauuuuacuuuuuu

SEQ ID NO: 519107 - RNA, 64 nt, Homo Sapiens
caaaagacucuguaccuauuuuucccccuaggggugggaggaagucccaaagcacaaagcaguu

SEQ ID NO: 519108 - RNA, 64 nt, Homo Sapiens
gcgugugcggcuccagcccaggugcuauuuaacaugggaggagagacuugugaauuuuucuaaa

SEQ ID NO: 519109 - RNA, 64 nt, Homo Sapiens
gagcaccuacuauaugcagaaggggaggccgaggugggaggaucauuggaucucaggaguucga

SEQ ID NO: 519110 - RNA, 64 nt, Homo Sapiens
gugcuuguaguuccagcuacucaggaggcugaggugggaggaugacuugaacgcaggaggcuga

SEQ ID NO: 519111 - RNA, 64 nt, Homo Sapiens
cuggugccagugccugugcccacucugugccugcugggaggaggcccaggcucucugguggccg

SEQ ID NO: 519112 - RNA, 64 nt, Homo Sapiens
gcaccuguggucccagcuacucgggaggcuguggugggaggauugcuugaguccaggagguuga

SEQ ID NO: 519113 - RNA, 64 nt, Homo Sapiens
cugucuggucaugaccccauuagguauggagagcugggaggaggcauugucacuucccaccagg

SEQ ID NO: 519114 - RNA, 64 nt, Homo Sapiens
ugaggugagucauggccucuugcuggcaauggggugggaggaguacccccaaguccucucacuc

SEQ ID NO: 519115 - RNA, 64 nt, Homo Sapiens
acagguccugggaaagaagugggaucuagggcccugggaggagguugagccuggggaaggaaaa

SEQ ID NO: 519116 - RNA, 64 nt, Homo Sapiens
ggcugccugcugaagucugaaguggggucuggccugggaggaggucugauaagugccuucaagg

SEQ ID NO: 519117 - RNA, 64 nt, Homo Sapiens
acuugaacccaagaggcagagucccaggcugaggugggaggauccaugguggcacacaccugua

SEQ ID NO: 519118 - RNA, 64 nt, Homo Sapiens
agguggguggaucacuugaguaaucccagcacuuugggaggacauggcacaggggucacaccug

SEQ ID NO: 519119 - RNA, 64 nt, Homo Sapiens
gccugagaccaggagguugaucaggaggcuugggugggaggauuccgccuguagucccagcuac

SEQ ID NO: 519120 - RNA, 64 nt, Homo Sapiens
acuggagcucgggaguucaaucaggaggccgaggugggaggaucaccuguggaaucccagcacu

SEQ ID NO: 519121 - RNA, 64 nt, Homo Sapiens
auuugugcccagguugaggcuugggaggcugaagugggaggaucacaccuguaguccaagcuac

SEQ ID NO: 519122 - RNA, 64 nt, Homo Sapiens
aguugagccccagaguucaauugggaggccaaggugggaggaucacaccuguaaucccugcacu

SEQ ID NO: 519123 - RNA, 64 nt, Homo Sapiens
caaucauuacucauaaccuuugagagauggcaaaugggaggaguguuagucuuuguuuuggaau

SEQ ID NO: 519124 - RNA, 64 nt, Homo Sapiens
acugagaaacacagucauugucuuagguguucuaugggaggaagugaauagagccuuuaggaac

SEQ ID NO: 519125 - RNA, 64 nt, Homo Sapiens
acacauggaaucccagcacuuugggaggccgaggugggaggaucacuugagcccaggaguucga

SEQ ID NO: 519126 - RNA, 64 nt, Homo Sapiens
acaucaguagucccagcuacucugcaggcugaggugggaggauugcuugaacccaggaggucga

SEQ ID NO: 519127 - RNA, 64 nt, Homo Sapiens; identical to SEQ ID NO: 302274

SEQ ID NO: 519128 - RNA, 64 nt, Homo Sapiens; identical to SEQ ID NO: 302275

SEQ ID NO: 519129 - RNA, 64 nt, Homo Sapiens; identical to SEQ ID NO: 302276

SEQ ID NO: 519130 - RNA, 64 nt, Homo Sapiens; identical to SEQ ID NO: 302277

SEQ ID NO: 519131 - RNA, 64 nt, Homo Sapiens; identical to SEQ ID NO: 302278

SEQ ID NO: 519132 - RNA, 64 nt, Homo Sapiens; identical to SEQ ID NO: 302279

SEQ ID NO: 519133 - RNA, 64 nt, Homo Sapiens; identical to SEQ ID NO: 302280

SEQ ID NO: 519134 - RNA, 64 nt, Homo Sapiens; identical to SEQ ID NO: 302281

SEQ ID NO: 519135 - RNA, 64 nt, Homo Sapiens; identical to SEQ ID NO: 302282

SEQ ID NO: 519136 - RNA, 64 nt, Homo Sapiens; identical to SEQ ID NO: 302283

SEQ ID NO: 519137 - RNA, 64 nt, Homo Sapiens; identical to SEQ ID NO: 302284

SEQ ID NO: 519138 - RNA, 64 nt, Homo Sapiens; identical to SEQ ID NO: 302285

SEQ ID NO: 519139 - RNA, 64 nt, Homo Sapiens; identical to SEQ ID NO: 302286

SEQ ID NO: 519140 - RNA, 64 nt, Homo Sapiens; identical to SEQ ID NO: 302287

SEQ ID NO: 519141 - RNA, 64 nt, Homo Sapiens; identical to SEQ ID NO: 302288

SEQ ID NO: 519142 - RNA, 64 nt, Homo Sapiens; identical to SEQ ID NO: 302289

SEQ ID NO: 519143 - RNA, 64 nt, Homo Sapiens; identical to SEQ ID NO: 302290

SEQ ID NO: 519144 - RNA, 64 nt, Homo Sapiens; identical to SEQ ID NO: 302291

SEQ ID NO: 519145 - RNA, 64 nt, Homo Sapiens; identical to SEQ ID NO: 302292

SEQ ID NO: 519146 - RNA, 64 nt, Homo Sapiens; identical to SEQ ID NO: 302293

SEQ ID NO: 519147 - RNA, 64 nt, Homo Sapiens; identical to SEQ ID NO: 302294

SEQ ID NO: 519148 - RNA, 64 nt, Homo Sapiens; identical to SEQ ID NO: 302295

SEQ ID NO: 519149 - RNA, 64 nt, Homo Sapiens; identical to SEQ ID NO: 302296

SEQ ID NO: 519150 - RNA, 64 nt, Homo Sapiens; identical to SEQ ID NO: 302297

SEQ ID NO: 519151 - RNA, 64 nt, Homo Sapiens; identical to SEQ ID NO: 302298

SEQ ID NO: 519152 - RNA, 64 nt, Homo Sapiens; identical to SEQ ID NO: 302299

SEQ ID NO: 519153 - RNA, 53 nt, Homo Sapiens; identical to SEQ ID NO: 244527

SEQ ID NO: 519154 - RNA, 64 nt, Homo Sapiens; identical to SEQ ID NO: 244528

SEQ ID NO: 519155 - RNA, 64 nt, Homo Sapiens; identical to SEQ ID NO: 244529

SEQ ID NO: 519156 - RNA, 64 nt, Homo Sapiens; identical to SEQ ID NO: 244530

SEQ ID NO: 519157 - RNA, 64 nt, Homo Sapiens; identical to SEQ ID NO: 244531

SEQ ID NO: 519158 - RNA, 64 nt, Homo Sapiens; identical to SEQ ID NO: 244532

SEQ ID NO: 519159 - RNA, 64 nt, Homo Sapiens; identical to SEQ ID NO: 244533

SEQ ID NO: 519160 - RNA, 64 nt, Homo Sapiens; identical to SEQ ID NO: 244534

SEQ ID NO: 519161 - RNA, 64 nt, Homo Sapiens; identical to SEQ ID NO: 244535

SEQ ID NO: 519162 - RNA, 64 nt, Homo Sapiens; identical to SEQ ID NO: 244536

SEQ ID NO: 519163 - RNA, 64 nt, Homo Sapiens; identical to SEQ ID NO: 244537

SEQ ID NO: 519164 - RNA, 64 nt, Homo Sapiens; identical to SEQ ID NO: 244538

SEQ ID NO: 519165 - RNA, 64 nt, Homo Sapiens; identical to SEQ ID NO: 244539

SEQ ID NO: 519166 - RNA, 64 nt, Homo Sapiens; identical to SEQ ID NO: 244540

SEQ ID NO: 519167 - RNA, 64 nt, Homo Sapiens; identical to SEQ ID NO: 244541

SEQ ID NO: 519168 - RNA, 64 nt, Homo Sapiens
cgaucaaauuugagaaucacaggucuaggauacgacggggaaaacagaaaugugggguggucag

SEQ ID NO: 519169 - RNA, 64 nt, Homo Sapiens
cagggccggcagggugcuucgggagcccccugcuacggggaaaggcauguguuucuugcuggug

SEQ ID NO: 519170 - RNA, 64 nt, Homo Sapiens
auuuuaaucuaagugguuauaacaguggauucugacggggaagguguagcucuguucucuucgg

SEQ ID NO: 519171 - RNA, 64 nt, Homo Sapiens
auccccgagccacugagugccuccauuuucauuaacggggaaacucucaaaucagauuuacaau

SEQ ID NO: 519172 - RNA, 64 nt, Homo Sapiens
ugaagccaggagaagaagaggucucaauguacauacggggaaacgagaaucauccagucuuacu

SEQ ID NO: 519173 - RNA, 64 nt, Homo Sapiens
uaauaccacccuuucaagauucuucaccuauaagacggggaaaauaacuuucugaaccucagag

SEQ ID NO: 519174 - RNA, 64 nt, Homo Sapiens
ccaacucuggccccuuucucagugcuaucugaugacggggaaacaaaauuauucucugagaggg

SEQ ID NO: 519175 - RNA, 64 nt, Homo Sapiens
accugacagcuaguuacauagaaaggcugaggcaacggggaaagguugaaggccagucugugua

SEQ ID NO: 519176 - RNA, 64 nt, Homo Sapiens
ugcauuuucuucagaauuauuaguccugaacgcuacggggaaaacaaagauuucaguagaauuu

SEQ ID NO: 519177 - RNA, 64 nt, Homo Sapiens
guuuucuucagguuacuuuuuaauaaugauuaaaacggggaacuucauuaucaugagcaugguu

SEQ ID NO: 519178 - RNA, 64 nt, Homo Sapiens
caggucgggcgcaggauucagccggagggaagggacggggaagccgagcuccagagcaacgacc

SEQ ID NO: 519179 - RNA, 64 nt, Homo Sapiens
cuuaccuaugucccuucucaugccuuucccuccaacggggaaagccaacuccaucucuaagugc

SEQ ID NO: 519180 - RNA, 64 nt, Homo Sapiens
cuguuuaauucuagauauaggaaaugugcgcuaaacggggaaacccaaagccuucagcgaacgu

SEQ ID NO: 519181 - RNA, 64 nt, Homo Sapiens
uguguaugggcccaguucccgaauaacccuuccuacggggaaucuguggacccacuaugaaugu

SEQ ID NO: 519182 - RNA, 64 nt, Homo Sapiens
ugagggcacggugucgaggggcuggagaggacauacggggaaauccacgggagaagcuggaggu

SEQ ID NO: 519183 - RNA, 64 nt, Homo Sapiens
gugugagacaaaacaaagccggcugggagagaagacggggaaguccuuccggcccuuaaaacug

SEQ ID NO: 519184 - RNA, 64 nt, Homo Sapiens
cccauuucacgacuccucugagacuaauugggaaacggggaaauucuuggaauuuuuuuuuuaa

SEQ ID NO: 519185 - RNA, 56 nt, Homo Sapiens
gcucccugcugugugccugccgugucacggggaagaucuguggagaagaugacuaa

SEQ ID NO: 519186 - RNA, 64 nt, Homo Sapiens
cucccccacaaauaaugaacagcagaaagacuggacggggaaaccuaucaauccugcccccagc

SEQ ID NO: 519187 - RNA, 64 nt, Homo Sapiens
uccuaaaauuagucuggcucauacuuucagacaaacggggaauuuuauggcugcaauaaaaagc

SEQ ID NO: 519188 - RNA, 64 nt, Homo Sapiens
gugacuuucuacucaccaagguugaagaaaggaaacggggaaaaucaaaagggguucaaacccc

SEQ ID NO: 519189 - RNA, 64 nt, Homo Sapiens
uccccuggcccggugggaagcccagacgaggaggacggggaaccggauuacgugaauggggagg

SEQ ID NO: 519190 - RNA, 64 nt, Homo Sapiens
uuaaauauuaaaaguaguucugguuuauuaaucaacggggaaaacaucuucuccaaaaaacuug

SEQ ID NO: 519191 - RNA, 64 nt, Homo Sapiens
uggacagcaucuccucagauggugaauuaugugcacggggaaaccuccugaguggaaguuucau

SEQ ID NO: 519192 - RNA, 64 nt, Homo Sapiens
ccggggcagucugacugucggugcccucccaggaacggggaaggccuccgucugugugaaaggg

SEQ ID NO: 519193 - RNA, 64 nt, Homo Sapiens
uuuagaaaugcuguuuucuuguuuggaaaguaacacggggaaacccuuuuauuuuuaggauauu

SEQ ID NO: 519194 - RNA, 64 nt, Homo Sapiens
cuauuguuccccagauaauguucccucaaauagcacggggaagcaacugccuuucaaggguaau

SEQ ID NO: 519195 - RNA, 64 nt, Homo Sapiens
ucccuugcugcaggcuguugagaagacugaggcuacggggaacuaggagcagccucaagcccag

SEQ ID NO: 519196 - RNA, 64 nt, Homo Sapiens
ucugaauuacuugguauuuagaacuccuagcaccacggggaagaauagagguaucaucaaacgu

SEQ ID NO: 519197 - RNA, 64 nt, Homo Sapiens
gguccauaguucuucacauugugaguauaugaauacggggaaauagaacccccuccccaccacc

SEQ ID NO: 519198 - RNA, 64 nt, Homo Sapiens
caguaaugaucccauuaccagauaagauugacugacggggaaaaaaaaaaaaaaagaauggggu

SEQ ID NO: 519199 - RNA, 64 nt, Homo Sapiens
uuggguagagagguuaagaagaggaggaagugagacggggaagggaggagcaccuugcuucacu

SEQ ID NO: 519200 - RNA, 64 nt, Homo Sapiens
cccuuguuggggcauugagaauaucaugagugccacggggaaggggaguagggaugucuuuucc

SEQ ID NO: 519201 - RNA, 64 nt, Homo Sapiens
gaaauuuuaaugcaaauacauacauuccugaaagacggggaauuaaauuacuaauuuuuuuuuu

SEQ ID NO: 519202 - RNA, 64 nt, Homo Sapiens
uggagccuugguguauuuuucaggcccaccugucacggggaacaggggggucaccccgaccccu

SEQ ID NO: 519203 - RNA, 64 nt, Homo Sapiens
gugauggaugacaacagguuguugacauuggccaacggggaacgcauccggcuccaagcacacu

SEQ ID NO: 519204 - RNA, 64 nt, Homo Sapiens
cccacccagggagcgguuucuaccaacacaugauacggggaagaaagcagggguuugcaugugc

SEQ ID NO: 519205 - RNA, 64 nt, Homo Sapiens
ggauuuuccgucucucccucucccggagggagacacggggaacgccagagaaggggcuucccug

SEQ ID NO: 519206 - RNA, 64 nt, Homo Sapiens
ugaggguagcgagcaacuggcuugagcagacagaacggggaagacuccacucugucccgagggg

SEQ ID NO: 519207 - RNA, 64 nt, Homo Sapiens
ugcaggguggugggggcgugagacaguuccgaggacggggaaauugugcgcugguggucucgug

SEQ ID NO: 519208 - RNA, 64 nt, Homo Sapiens
ggggacccacggggugugacgaucaacaagggucacggggaauaaacugagcaggaagaggaug

SEQ ID NO: 519209 - RNA, 64 nt, Homo Sapiens
ggauuaaaaugccuggcgugcucaccguaacaccacggggaaggcugugugccuuuucucaucc

SEQ ID NO: 519210 - RNA, 64 nt, Homo Sapiens
aagaggaacuuacuuguguaucacuuuugaugaaacggggaaccgcacuccugugaacaguuuu

SEQ ID NO: 519211 - RNA, 64 nt, Homo Sapiens
caucuuucccuucuaguuuugaagcuggauugauacggggaaaagucacuaauagaauaucucu

SEQ ID NO: 519212 - RNA, 64 nt, Homo Sapiens
auagcaauauuuaaagaugcggggggagggggaaacggggaacuucacauacucacacggggca

SEQ ID NO: 519213 - RNA, 64 nt, Homo Sapiens
guguacguacauggggaccugucugcauauacacacggggaaugccagaagaaggcccagucug

SEQ ID NO: 519214 - RNA, 64 nt, Homo Sapiens
uaccuguauacguuagugaaagcuguuuacuguaacggggaaaaccagauucuuugcaucuggg

SEQ ID NO: 519215 - RNA, 64 nt, Homo Sapiens
uucaccggaagcagaugccgccaugagcgagaugacggggaauacagcacugcuugcucaggug

SEQ ID NO: 519216 - RNA, 64 nt, Homo Sapiens
cuuguaucuucaguuggagguguaguauucaaaaacggggaaugaaggcaggaaggaggcugga

SEQ ID NO: 519217 - RNA, 64 nt, Homo Sapiens
uuuuggaguagaaccaggggagugggugggaggcacggggaagggacggggauaguaagagaua

SEQ ID NO: 519218 - RNA, 64 nt, Homo Sapiens
cagaaugauucaacauuuucgugauacacuaaucacggggaaccuaucuuguucugugacugaa

SEQ ID NO: 519219 - RNA, 64 nt, Homo Sapiens
uuuccuuuccucgugcuuguccaccccuccccucacggggaaggggggagggaagcgugccucc

SEQ ID NO: 519220 - RNA, 64 nt, Homo Sapiens
acauggagccugagccagagucccagcccuggggacggggaaggugauggagcguccccaaagc

SEQ ID NO: 519221 - RNA, 64 nt, Homo Sapiens
ugagagagaggaugcuaagcagaagucagcugucacggggaaggugauguuaggacagagugag

SEQ ID NO: 519222 - RNA, 64 nt, Homo Sapiens
ugaggcucagagcagcaggucucauuucuuacagacggggaaacguccuccugagucccguagc

SEQ ID NO: 519223 - RNA, 64 nt, Homo Sapiens
auccagauccgaccacuagaucauccuuauaccgacggggaaacggaggccagagagggcgugg

SEQ ID NO: 519224 - RNA, 64 nt, Homo Sapiens
uccccaagccaccaauuggauggaugaauguuugacggggaagaggaaggguaggaggaugcau

SEQ ID NO: 519225 - RNA, 64 nt, Homo Sapiens
guuguuucugucugauuuuaauugcugucuaaugacggggaaagcacgaugaaaagauguacaa

SEQ ID NO: 519226 - RNA, 64 nt, Homo Sapiens
accgugggucaccaaugccagaaaaccagacaucacggggaaagaauguugcuuacuuuuuacc

SEQ ID NO: 519227 - RNA, 64 nt, Homo Sapiens
auaauucuagcgggggaccugggagauaauuccuacggggaauucuuaaaacugugcucaacua

SEQ ID NO: 519228 - RNA, 64 nt, Homo Sapiens
cggaaugggcaacuuucgccccuguggggaggggacggggaaggaagaaagaauuuaaaggacc

SEQ ID NO: 519229 - RNA, 64 nt, Homo Sapiens
ccuguccaccuaugucuuuguaucuacauucuugacggggaaggaacuuccucugggaaccuuu

SEQ ID NO: 519230 - RNA, 64 nt, Homo Sapiens
gcccuccuagagccaaccucaguugaugccuucccagagucaaccuccugugacgcccucccag

SEQ ID NO: 519231 - RNA, 64 nt, Homo Sapiens
gcccucccagagccaaccucgggugacacccucccagagucaaccucaugugacaccuuaccgg

SEQ ID NO: 519232 - RNA, 64 nt, Homo Sapiens
cauugccauguggaaggcaagccaggcucacucacagagucaaggccugcucccuguagggucc

SEQ ID NO: 519233 - RNA, 64 nt, Homo Sapiens
gcuuuugaauuaugcuuuguagaguuuugucauucagagucagccaggaccauaccgggucuug

SEQ ID NO: 519234 - RNA, 64 nt, Homo Sapiens
ggcggagaggggugguccuggaggcccaaugcuucagagucaucucuguccugcccgggaugca

SEQ ID NO: 519235 - RNA, 64 nt, Homo Sapiens
guguacauacuguauuucuagauucuccuuuguacagagucacuucacaagucaagcuacuguu

SEQ ID NO: 519236 - RNA, 64 nt, Homo Sapiens
cuuacagcuggggaaacugaggccuggaauggcccagagucaccaaggcaaaguuggggcuggu

SEQ ID NO: 519237 - RNA, 64 nt, Homo Sapiens
ccuugccgcugccuccaggaagcccaccuugagccagagucaagggcugcagcacugcccgaua

SEQ ID NO: 519238 - RNA, 64 nt, Homo Sapiens
ugggagcuggaagaaggggcauuggguacccaggcagagucaggagagguggucuuugaaguaa

SEQ ID NO: 519239 - RNA, 64 nt, Homo Sapiens
caggccugggucuagaauucuugcugcugcuuugcagagucaacagcccaucagcccauguuuu

SEQ ID NO: 519240 - RNA, 64 nt, Homo Sapiens
acaggccccgaggagcccgacaccugacacuaaccagagucagcgcauaaccuacucggauccc

SEQ ID NO: 519241 - RNA, 64 nt, Homo Sapiens
aguuagguuugguuugguuuguugcaaagaacuccagagucagucuaaaaauguaggcuuucau

SEQ ID NO: 519242 - RNA, 64 nt, Homo Sapiens
aaauauuguagggagaaaaaggaccacuguccuacagagucaggcagagucaacccccaacuga

SEQ ID NO: 519243 - RNA, 64 nt, Homo Sapiens
ccccaacugaggaccacuguaugccccuaggggacagagucaacguuaugccggauguugccag

SEQ ID NO: 519244 - RNA, 64 nt, Homo Sapiens
ucccacccccuuccaccuccaucagucaugugugcagagucagugcucgggaucccgggcccag

SEQ ID NO: 519245 - RNA, 64 nt, Homo Sapiens
uacguuagguucugcggauaaaggaggaauaagacagagucaggagaacuguuccuugugguuu

SEQ ID NO: 519246 - RNA, 64 nt, Homo Sapiens
gagagaugaaaauaauaggugccuuuggcucacccagagucaggaggagaacaucaucuuaaua

SEQ ID NO: 519247 - RNA, 64 nt, Homo Sapiens
gacuugaguucauuucccagcuuuuucaugucuucagagucacacauucaucugaaauguguaa

SEQ ID NO: 519248 - RNA, 64 nt, Homo Sapiens
aaauuuucucaucuaaaauuuacacuggauuuguuaggggaauguguuuuucuuugaaguuuua

SEQ ID NO: 519249 - RNA, 64 nt, Homo Sapiens
auguguggguacaugugagggugugugcuugguuuaggggaaguuguguauguauguguguggu

SEQ ID NO: 519250 - RNA, 64 nt, Homo Sapiens
ggaaggccagggguucacaugccaucugauauccuaggggaaaauuccuuccucacagucugua

SEQ ID NO: 519251 - RNA, 64 nt, Homo Sapiens
aaauugccauuuuucgggugugggcagaacugcuuaggggaaugccugggaucaaguaggaaaa

SEQ ID NO: 519252 - RNA, 64 nt, Homo Sapiens
ggaacuuggcacuggggacucauguuuggaaucguaggggaacaucuggcuguuaaucacuugc

SEQ ID NO: 519253 - RNA, 64 nt, Homo Sapiens
agguuuccugcagcucgcuaccuaaguguuucuguaggggaaggagccaauuaagaaaaagugu

SEQ ID NO: 519254 - RNA, 64 nt, Homo Sapiens
aaagcgucuguuguuacccauuuaguggucaguauaggggaaugaaaaacauuggaauuuuugu

SEQ ID NO: 519255 - RNA, 64 nt, Homo Sapiens
uuacguugaucucuuaaauuuuacaacagcuauuuaggggaaugugaaguaauggugaugcuua

SEQ ID NO: 519256 - RNA, 64 nt, Homo Sapiens
ccugcaguucccaggaccccauccucucagaagguaggggaagggcgggaggauugagaaggga

SEQ ID NO: 519257 - RNA, 64 nt, Homo Sapiens
gggaggauugagaagggacaagccaccuugaccguaggggaaggaggaaugugggcugggggaa

SEQ ID NO: 519258 - RNA, 64 nt, Homo Sapiens
uaauaagaaaucccaauuuuaacaugggaacuuuuaggggaaccgugacuauuuacauguaauc

SEQ ID NO: 519259 - RNA, 64 nt, Homo Sapiens
gcaguccuguucuaaauccugaauuuuuaaaucauaggggaaaacccaagggcgaaagucauug

SEQ ID NO: 519260 - RNA, 64 nt, Homo Sapiens; identical to SEQ ID NO: 184076

SEQ ID NO: 519261 - RNA, 64 nt, Homo Sapiens; identical to SEQ ID NO: 184077

SEQ ID NO: 519262 - RNA, 64 nt, Homo Sapiens; identical to SEQ ID NO: 184078

SEQ ID NO: 519263 - RNA, 64 nt, Homo Sapiens; identical to SEQ ID NO: 184079

SEQ ID NO: 519264 - RNA, 64 nt, Homo Sapiens; identical to SEQ ID NO: 184080

SEQ ID NO: 519265 - RNA, 64 nt, Homo Sapiens; identical to SEQ ID NO: 184081

SEQ ID NO: 519266 - RNA, 64 nt, Homo Sapiens; identical to SEQ ID NO: 184082

SEQ ID NO: 519267 - RNA, 64 nt, Homo Sapiens; identical to SEQ ID NO: 184083

SEQ ID NO: 519268 - RNA, 64 nt, Homo Sapiens; identical to SEQ ID NO: 184084

SEQ ID NO: 519269 - RNA, 64 nt, Homo Sapiens; identical to SEQ ID NO: 184085

SEQ ID NO: 519270 - RNA, 64 nt, Homo Sapiens; identical to SEQ ID NO: 184086

SEQ ID NO: 519271 - RNA, 64 nt, Homo Sapiens; identical to SEQ ID NO: 184087

SEQ ID NO: 519272 - RNA, 64 nt, Homo Sapiens; identical to SEQ ID NO: 184088

SEQ ID NO: 519273 - RNA, 64 nt, Homo Sapiens; identical to SEQ ID NO: 184089

SEQ ID NO: 519274 - RNA, 64 nt, Homo Sapiens; identical to SEQ ID NO: 184090

SEQ ID NO: 519275 - RNA, 64 nt, Homo Sapiens; identical to SEQ ID NO: 184091

SEQ ID NO: 519276 - RNA, 64 nt, Homo Sapiens
acucaucccuggucgucuaucccaguguguguuuaacauucacagcccagaaccacagaugugu

SEQ ID NO: 519277 - RNA, 64 nt, Homo Sapiens
ucaacauuccaggguugguaauguuggaugaugaaacauucauuuuuaccuuguggaugcuagu

SEQ ID NO: 519278 - RNA, 64 nt, Homo Sapiens
ggacuugagagcauuuuauuuuugaauuuguuggaacauucaaaaaacauucagaaaaugaagu

SEQ ID NO: 519279 - RNA, 64 nt, Homo Sapiens
aaaugaaguuuugaauuuguucgcauuuauguaaaacauucagauaccaaugcgaacagguagu

SEQ ID NO: 519280 - RNA, 64 nt, Homo Sapiens
ucuuauuuuauauugaaauguaauacaguauuuuaacauucaccagauaaauguauucaacaug

SEQ ID NO: 519281 - RNA, 64 nt, Homo Sapiens
gcuuauuuguuacagacuguaccaaccaaauucaaacauucacugacuugcaucccagcuuucc

SEQ ID NO: 519282 - RNA, 64 nt, Homo Sapiens
ccguuuauguuucucaucuacuucaaaccuucagaacauucaaaagaaugaacacuauacuuug

SEQ ID NO: 519283 - RNA, 64 nt, Homo Sapiens
uucugauauacauugcuugaucauguuguuauaaaacauucaaauuuaguaacaucuugcuuag

SEQ ID NO: 519284 - RNA, 64 nt, Homo Sapiens
uauggauucaugauggcuguuuuuuuacaugauuaacauucacuauauuacaaucauuuuauau

SEQ ID NO: 519285 - RNA, 64 nt, Homo Sapiens
aaaauaguaaguuucucuuuuuuaucacauaaaaaacauucagugaaugucugaggcuaccagg

SEQ ID NO: 519286 - RNA, 64 nt, Homo Sapiens
guaagguuuaauaaaauuaaaaaucauaugccacaacauucauuauaaauugucacacaaugga

SEQ ID NO: 519287 - RNA, 64 nt, Homo Sapiens
uuucuaaaauugucugccaauuauugagaaauguaacauucaaauauaauauauuguuugugaa

SEQ ID NO: 519288 - RNA, 64 nt, Homo Sapiens
cucaauacucaagaaucuugcaagacaguuauuaaacauucauagcuugaaauugcccauggug

SEQ ID NO: 519289 - RNA, 64 nt, Homo Sapiens
ucauaggguuuggcaugcugcucgguacaugguuaacauucauaaauggugggggcccuuacug

SEQ ID NO: 519290 - RNA, 64 nt, Homo Sapiens
ggcaccaauccuagacucacgugugccccagaauaacauucagacucucagcuggucuuguguu

SEQ ID NO: 519291 - RNA, 64 nt, Homo Sapiens
uugcaugacuccccauacauguugcagcuuugaaaacauucaucucagaguuagguauaaagac

SEQ ID NO: 519292 - RNA, 64 nt, Homo Sapiens
gaguugcccuacaaauuucauuuggcagcgccauaacauucauuuaaaaaguuuaugaaaacau

SEQ ID NO: 519293 - RNA, 64 nt, Homo Sapiens
cagcgccauaacauucauuuaaaaaguuuaugaaaacauucauuugaaaguuccaugcagcuuu

SEQ ID NO: 519294 - RNA, 64 nt, Homo Sapiens
auuaguuauaaauaaauaaccaaaaauguauguaaacauucaaaugauuaucugaacaaaugag

SEQ ID NO: 519295 - RNA, 64 nt, Homo Sapiens
uugaguuauaugauguuuauuugaaugacuguugaacauucaaauuuguauuauuuggagauga

SEQ ID NO: 519296 - RNA, 64 nt, Homo Sapiens
auuuaauugaaucgugugucuuucucuagggaguaacauucaacucggagugggcaccucugug

SEQ ID NO: 519297 - RNA, 64 nt, Homo Sapiens
caguaaaaugacauccacgugccuucccuggggaaacauucagggaaaauucuuuaucauguuu

SEQ ID NO: 519298 - RNA, 58 nt, Homo Sapiens; identical to SEQ ID NO: 345086

SEQ ID NO: 519299 - RNA, 64 nt, Homo Sapiens
caaacacauucuccuuugaauuguuaaaauucagaacauucaaaauaacuguuuugcuacaacc

SEQ ID NO: 519300 - RNA, 64 nt, Homo Sapiens
auguauuguucauuaagcuaauuucaugauuaagaacauucaacaauuagaagguggaggaguc

SEQ ID NO: 519301 - RNA, 64 nt, Homo Sapiens
caugaguauauguucuuggaagucucgggcaagaaacauucaugaacuauagcaugcuuugaag

SEQ ID NO: 519302 - RNA, 64 nt, Homo Sapiens
gguccuaccauuucuguucagaaauucacuguaaaacauucaggauaacuuaauuucuuuuccu

SEQ ID NO: 519303 - RNA, 64 nt, Homo Sapiens
uggaaucagcugaaagcugucuauguguuucaauaacauucacuuaguuucuuucauuuggggg

SEQ ID NO: 519304 - RNA, 64 nt, Homo Sapiens
cagaacuagguagaaacagaguuccagugaugaaaacauucaagcuccaguauuaaugaaauag

SEQ ID NO: 519305 - RNA, 64 nt, Homo Sapiens
gucaccugaaagagaaauggggaaaacuuugaggaacauucaauuguaagaaaaaucugcuaga

SEQ ID NO: 519306 - RNA, 64 nt, Homo Sapiens
aaugauuacaguuuucauuugaaaacauuuaauaaacauucaauuuuuacuucaguuaacaaaa

SEQ ID NO: 519307 - RNA, 64 nt, Homo Sapiens
uuuagguccuacuacauuguaugaagaaccuccuaacauucaaucccacaggaagacccuuaaa

SEQ ID NO: 519308 - RNA, 64 nt, Homo Sapiens
uuuugaaggacaaguauaugggaaugggagugagaacauucacuuaagggguaucucugcuaca

SEQ ID NO: 519309 - RNA, 64 nt, Homo Sapiens
ucugaauuucucuguggcaauggacacuuguuuaaacauucacacccaucucaaaccuacacuu

SEQ ID NO: 519310 - RNA, 64 nt, Homo Sapiens; identical to SEQ ID NO: 389302

SEQ ID NO: 519311 - RNA, 64 nt, Homo Sapiens; identical to SEQ ID NO: 389303

SEQ ID NO: 519312 - RNA, 64 nt, Homo Sapiens; identical to SEQ ID NO: 389304

SEQ ID NO: 519313 - RNA, 64 nt, Homo Sapiens; identical to SEQ ID NO: 389305

SEQ ID NO: 519314 - RNA, 64 nt, Homo Sapiens; identical to SEQ ID NO: 389306

SEQ ID NO: 519315 - RNA, 64 nt, Homo Sapiens; identical to SEQ ID NO: 389307

SEQ ID NO: 519316 - RNA, 64 nt, Homo Sapiens; identical to SEQ ID NO: 389308

SEQ ID NO: 519317 - RNA, 64 nt, Homo Sapiens; identical to SEQ ID NO: 389309

SEQ ID NO: 519318 - RNA, 64 nt, Homo Sapiens; identical to SEQ ID NO: 389310

SEQ ID NO: 519319 - RNA, 64 nt, Homo Sapiens; identical to SEQ ID NO: 389311

SEQ ID NO: 519320 - RNA, 64 nt, Homo Sapiens; identical to SEQ ID NO: 389312

SEQ ID NO: 519321 - RNA, 64 nt, Homo Sapiens; identical to SEQ ID NO: 389313

SEQ ID NO: 519322 - RNA, 64 nt, Homo Sapiens; identical to SEQ ID NO: 389314

SEQ ID NO: 519323 - RNA, 64 nt, Homo Sapiens; identical to SEQ ID NO: 389315

SEQ ID NO: 519324 - RNA, 64 nt, Homo Sapiens; identical to SEQ ID NO: 389316

SEQ ID NO: 519325 - RNA, 64 nt, Homo Sapiens; identical to SEQ ID NO: 389317

SEQ ID NO: 519326 - RNA, 64 nt, Homo Sapiens; identical to SEQ ID NO: 389318

SEQ ID NO: 519327 - RNA, 64 nt, Homo Sapiens; identical to SEQ ID NO: 389319

SEQ ID NO: 519328 - RNA, 64 nt, Homo Sapiens; identical to SEQ ID NO: 389320

SEQ ID NO: 519329 - RNA, 64 nt, Homo Sapiens; identical to SEQ ID NO: 389321

SEQ ID NO: 519330 - RNA, 64 nt, Homo Sapiens; identical to SEQ ID NO: 119725

SEQ ID NO: 519331 - RNA, 64 nt, Homo Sapiens; identical to SEQ ID NO: 119726

SEQ ID NO: 519332 - RNA, 64 nt, Homo Sapiens; identical to SEQ ID NO: 119727

SEQ ID NO: 519333 - RNA, 64 nt, Homo Sapiens; identical to SEQ ID NO: 119728

SEQ ID NO: 519334 - RNA, 64 nt, Homo Sapiens; identical to SEQ ID NO: 119729

SEQ ID NO: 519335 - RNA, 64 nt, Homo Sapiens; identical to SEQ ID NO: 119730

SEQ ID NO: 519336 - RNA, 64 nt, Homo Sapiens; identical to SEQ ID NO: 119731

SEQ ID NO: 519337 - RNA, 64 nt, Homo Sapiens; identical to SEQ ID NO: 119732

SEQ ID NO: 519338 - RNA, 64 nt, Homo Sapiens; identical to SEQ ID NO: 119733

SEQ ID NO: 519339 - RNA, 64 nt, Homo Sapiens; identical to SEQ ID NO: 119734

SEQ ID NO: 519340 - RNA, 64 nt, Homo Sapiens; identical to SEQ ID NO: 119735

SEQ ID NO: 519341 - RNA, 64 nt, Homo Sapiens; identical to SEQ ID NO: 119736

SEQ ID NO: 519342 - RNA, 64 nt, Homo Sapiens; identical to SEQ ID NO: 119737

SEQ ID NO: 519343 - RNA, 64 nt, Homo Sapiens; identical to SEQ ID NO: 119738

SEQ ID NO: 519344 - RNA, 64 nt, Homo Sapiens; identical to SEQ ID NO: 119739

SEQ ID NO: 519345 - RNA, 64 nt, Homo Sapiens; identical to SEQ ID NO: 119740

SEQ ID NO: 519346 - RNA, 62 nt, Homo Sapiens; identical to SEQ ID NO: 119741

SEQ ID NO: 519347 - RNA, 64 nt, Homo Sapiens; identical to SEQ ID NO: 119742

SEQ ID NO: 519348 - RNA, 64 nt, Homo Sapiens; identical to SEQ ID NO: 119743

SEQ ID NO: 519349 - RNA, 64 nt, Homo Sapiens; identical to SEQ ID NO: 119744

SEQ ID NO: 519350 - RNA, 64 nt, Homo Sapiens; identical to SEQ ID NO: 119745

SEQ ID NO: 519351 - RNA, 64 nt, Homo Sapiens; identical to SEQ ID NO: 119746

SEQ ID NO: 519352 - RNA, 64 nt, Homo Sapiens; identical to SEQ ID NO: 119747

SEQ ID NO: 519353 - RNA, 64 nt, Homo Sapiens; identical to SEQ ID NO: 119748

SEQ ID NO: 519354 - RNA, 64 nt, Homo Sapiens; identical to SEQ ID NO: 119749

SEQ ID NO: 519355 - RNA, 64 nt, Homo Sapiens; identical to SEQ ID NO: 119750

SEQ ID NO: 519356 - RNA, 64 nt, Homo Sapiens; identical to SEQ ID NO: 119751

SEQ ID NO: 519357 - RNA, 64 nt, Homo Sapiens; identical to SEQ ID NO: 119752

SEQ ID NO: 519358 - RNA, 64 nt, Homo Sapiens; identical to SEQ ID NO: 119753

SEQ ID NO: 519359 - RNA, 64 nt, Homo Sapiens; identical to SEQ ID NO: 119754

SEQ ID NO: 519360 - RNA, 64 nt, Homo Sapiens; identical to SEQ ID NO: 119755

SEQ ID NO: 519361 - RNA, 64 nt, Homo Sapiens; identical to SEQ ID NO: 119756

SEQ ID NO: 519362 - RNA, 64 nt, Homo Sapiens; identical to SEQ ID NO: 119757

SEQ ID NO: 519363 - RNA, 64 nt, Homo Sapiens; identical to SEQ ID NO: 119758

SEQ ID NO: 519364 - RNA, 64 nt, Homo Sapiens; identical to SEQ ID NO: 119759

SEQ ID NO: 519365 - RNA, 64 nt, Homo Sapiens; identical to SEQ ID NO: 119760

SEQ ID NO: 519366 - RNA, 64 nt, Homo Sapiens; identical to SEQ ID NO: 119761

SEQ ID NO: 519367 - RNA, 64 nt, Homo Sapiens; identical to SEQ ID NO: 119762

SEQ ID NO: 519368 - RNA, 64 nt, Homo Sapiens; identical to SEQ ID NO: 119763

SEQ ID NO: 519369 - RNA, 64 nt, Homo Sapiens; identical to SEQ ID NO: 119764

SEQ ID NO: 519370 - RNA, 64 nt, Homo Sapiens; identical to SEQ ID NO: 119765

SEQ ID NO: 519371 - RNA, 64 nt, Homo Sapiens; identical to SEQ ID NO: 119766

SEQ ID NO: 519372 - RNA, 64 nt, Homo Sapiens; identical to SEQ ID NO: 119767

SEQ ID NO: 519373 - RNA, 64 nt, Homo Sapiens; identical to SEQ ID NO: 119768

SEQ ID NO: 519374 - RNA, 64 nt, Homo Sapiens; identical to SEQ ID NO: 119769

SEQ ID NO: 519375 - RNA, 64 nt, Homo Sapiens; identical to SEQ ID NO: 119770

SEQ ID NO: 519376 - RNA, 64 nt, Homo Sapiens; identical to SEQ ID NO: 119771

SEQ ID NO: 519377 - RNA, 64 nt, Homo Sapiens; identical to SEQ ID NO: 119772

SEQ ID NO: 519378 - RNA, 64 nt, Homo Sapiens; identical to SEQ ID NO: 119773

SEQ ID NO: 519379 - RNA, 64 nt, Homo Sapiens; identical to SEQ ID NO: 119774

SEQ ID NO: 519380 - RNA, 64 nt, Homo Sapiens; identical to SEQ ID NO: 119775

SEQ ID NO: 519381 - RNA, 64 nt, Homo Sapiens; identical to SEQ ID NO: 119776

SEQ ID NO: 519382 - RNA, 64 nt, Homo Sapiens; identical to SEQ ID NO: 119777

SEQ ID NO: 519383 - RNA, 64 nt, Homo Sapiens; identical to SEQ ID NO: 119778

SEQ ID NO: 519384 - RNA, 64 nt, Homo Sapiens; identical to SEQ ID NO: 119779

SEQ ID NO: 519385 - RNA, 64 nt, Homo Sapiens; identical to SEQ ID NO: 119780

SEQ ID NO: 519386 - RNA, 64 nt, Homo Sapiens; identical to SEQ ID NO: 119781

SEQ ID NO: 519387 - RNA, 64 nt, Homo Sapiens; identical to SEQ ID NO: 119782

SEQ ID NO: 519388 - RNA, 64 nt, Homo Sapiens; identical to SEQ ID NO: 119783

SEQ ID NO: 519389 - RNA, 64 nt, Homo Sapiens; identical to SEQ ID NO: 119784

SEQ ID NO: 519390 - RNA, 64 nt, Homo Sapiens; identical to SEQ ID NO: 119785

SEQ ID NO: 519391 - RNA, 64 nt, Homo Sapiens; identical to SEQ ID NO: 119786

SEQ ID NO: 519392 - RNA, 64 nt, Homo Sapiens; identical to SEQ ID NO: 119787

SEQ ID NO: 519393 - RNA, 64 nt, Homo Sapiens; identical to SEQ ID NO: 119788

SEQ ID NO: 519394 - RNA, 64 nt, Homo Sapiens; identical to SEQ ID NO: 119789

SEQ ID NO: 519395 - RNA, 64 nt, Homo Sapiens; identical to SEQ ID NO: 119790

SEQ ID NO: 519396 - RNA, 64 nt, Homo Sapiens; identical to SEQ ID NO: 119791

SEQ ID NO: 519397 - RNA, 64 nt, Homo Sapiens; identical to SEQ ID NO: 119792

SEQ ID NO: 519398 - RNA, 64 nt, Homo Sapiens; identical to SEQ ID NO: 119793

SEQ ID NO: 519399 - RNA, 64 nt, Homo Sapiens; identical to SEQ ID NO: 119794

SEQ ID NO: 519400 - RNA, 64 nt, Homo Sapiens; identical to SEQ ID NO: 119795

SEQ ID NO: 519401 - RNA, 64 nt, Homo Sapiens; identical to SEQ ID NO: 119796

SEQ ID NO: 519402 - RNA, 64 nt, Homo Sapiens; identical to SEQ ID NO: 119795

SEQ ID NO: 519403 - RNA, 64 nt, Homo Sapiens; identical to SEQ ID NO: 119798

SEQ ID NO: 519404 - RNA, 64 nt, Homo Sapiens; identical to SEQ ID NO: 119799

SEQ ID NO: 519405 - RNA, 64 nt, Homo Sapiens; identical to SEQ ID NO: 119800

SEQ ID NO: 519406 - RNA, 64 nt, Homo Sapiens; identical to SEQ ID NO: 119801

SEQ ID NO: 519407 - RNA, 64 nt, Homo Sapiens; identical to SEQ ID NO: 119802

SEQ ID NO: 519408 - RNA, 64 nt, Homo Sapiens; identical to SEQ ID NO: 119803

SEQ ID NO: 519409 - RNA, 64 nt, Homo Sapiens; identical to SEQ ID NO: 119804

SEQ ID NO: 519410 - RNA, 64 nt, Homo Sapiens; identical to SEQ ID NO: 119805

SEQ ID NO: 519411 - RNA, 64 nt, Homo Sapiens; identical to SEQ ID NO: 119806

SEQ ID NO: 519412 - RNA, 64 nt, Homo Sapiens; identical to SEQ ID NO: 119807

SEQ ID NO: 519413 - RNA, 64 nt, Homo Sapiens; identical to SEQ ID NO: 119808

SEQ ID NO: 519414 - RNA, 64 nt, Homo Sapiens; identical to SEQ ID NO: 119809

SEQ ID NO: 519415 - RNA, 64 nt, Homo Sapiens; identical to SEQ ID NO: 119810

SEQ ID NO: 519416 - RNA, 64 nt, Homo Sapiens; identical to SEQ ID NO: 119811

SEQ ID NO: 519417 - RNA, 64 nt, Homo Sapiens; identical to SEQ ID NO: 119812

SEQ ID NO: 519418 - RNA, 64 nt, Homo Sapiens; identical to SEQ ID NO: 119813

SEQ ID NO: 519419 - RNA, 64 nt, Homo Sapiens; identical to SEQ ID NO: 119814

SEQ ID NO: 519420 - RNA, 64 nt, Homo Sapiens; identical to SEQ ID NO: 119815

SEQ ID NO: 519421 - RNA, 64 nt, Homo Sapiens; identical to SEQ ID NO: 119816

SEQ ID NO: 519422 - RNA, 64 nt, Homo Sapiens; identical to SEQ ID NO: 119817

SEQ ID NO: 519423 - RNA, 64 nt, Homo Sapiens; identical to SEQ ID NO: 119818

SEQ ID NO: 519424 - RNA, 64 nt, Homo Sapiens; identical to SEQ ID NO: 119819

SEQ ID NO: 519425 - RNA, 64 nt, Homo Sapiens; identical to SEQ ID NO: 119820

SEQ ID NO: 519426 - RNA, 64 nt, Homo Sapiens; identical to SEQ ID NO: 119821

SEQ ID NO: 519427 - RNA, 64 nt, Homo Sapiens; identical to SEQ ID NO: 119822

SEQ ID NO: 519428 - RNA, 64 nt, Homo Sapiens; identical to SEQ ID NO: 119823

SEQ ID NO: 519429 - RNA, 64 nt, Homo Sapiens; identical to SEQ ID NO: 119824

SEQ ID NO: 519430 - RNA, 64 nt, Homo Sapiens; identical to SEQ ID NO: 119825

SEQ ID NO: 519431 - RNA, 64 nt, Homo Sapiens; identical to SEQ ID NO: 119826

SEQ ID NO: 519432 - RNA, 64 nt, Homo Sapiens; identical to SEQ ID NO: 119827

SEQ ID NO: 519433 - RNA, 64 nt, Homo Sapiens; identical to SEQ ID NO: 119828

SEQ ID NO: 519434 - RNA, 64 nt, Homo Sapiens; identical to SEQ ID NO: 119829

SEQ ID NO: 519435 - RNA, 64 nt, Homo Sapiens; identical to SEQ ID NO: 119830

SEQ ID NO: 519436 - RNA, 64 nt, Homo Sapiens; identical to SEQ ID NO: 119831

SEQ ID NO: 519437 - RNA, 64 nt, Homo Sapiens; identical to SEQ ID NO: 119832

SEQ ID NO: 519438 - RNA, 64 nt, Homo Sapiens; identical to SEQ ID NO: 119833

SEQ ID NO: 519439 - RNA, 64 nt, Homo Sapiens; identical to SEQ ID NO: 119834

SEQ ID NO: 519440 - RNA, 64 nt, Homo Sapiens; identical to SEQ ID NO: 119835

SEQ ID NO: 519441 - RNA, 64 nt, Homo Sapiens; identical to SEQ ID NO: 119836

SEQ ID NO: 519442 - RNA, 64 nt, Homo Sapiens; identical to SEQ ID NO: 119837

SEQ ID NO: 519443 - RNA, 64 nt, Homo Sapiens; identical to SEQ ID NO: 119838

SEQ ID NO: 519444 - RNA, 64 nt, Homo Sapiens; identical to SEQ ID NO: 119839

SEQ ID NO: 519445 - RNA, 64 nt, Homo Sapiens; identical to SEQ ID NO: 361150

SEQ ID NO: 519446 - RNA, 64 nt, Homo Sapiens; identical to SEQ ID NO: 361151

SEQ ID NO: 519447 - RNA, 64 nt, Homo Sapiens; identical to SEQ ID NO: 361152

SEQ ID NO: 519448 - RNA, 64 nt, Homo Sapiens; identical to SEQ ID NO: 361153

SEQ ID NO: 519449 - RNA, 64 nt, Homo Sapiens; identical to SEQ ID NO: 361154

SEQ ID NO: 519450 - RNA, 64 nt, Homo Sapiens; identical to SEQ ID NO: 361155

SEQ ID NO: 519451 - RNA, 64 nt, Homo Sapiens; identical to SEQ ID NO: 361156

SEQ ID NO: 519452 - RNA, 64 nt, Homo Sapiens; identical to SEQ ID NO: 361157

SEQ ID NO: 519453 - RNA, 64 nt, Homo Sapiens; identical to SEQ ID NO: 361158

SEQ ID NO: 519454 - RNA, 64 nt, Homo Sapiens; identical to SEQ ID NO: 361159

SEQ ID NO: 519455 - RNA, 64 nt, Homo Sapiens; identical to SEQ ID NO: 361160

SEQ ID NO: 519456 - RNA, 64 nt, Homo Sapiens; identical to SEQ ID NO: 361161

SEQ ID NO: 519457 - RNA, 64 nt, Homo Sapiens; identical to SEQ ID NO: 361162

SEQ ID NO: 519458 - RNA, 64 nt, Homo Sapiens; identical to SEQ ID NO: 361163

SEQ ID NO: 519459 - RNA, 64 nt, Homo Sapiens; identical to SEQ ID NO: 361164

SEQ ID NO: 519460 - RNA, 64 nt, Homo Sapiens; identical to SEQ ID NO: 361165

SEQ ID NO: 519461 - RNA, 64 nt, Homo Sapiens; identical to SEQ ID NO: 361166

SEQ ID NO: 519462 - RNA, 64 nt, Homo Sapiens; identical to SEQ ID NO: 361167

SEQ ID NO: 519463 - RNA, 64 nt, Homo Sapiens; identical to SEQ ID NO: 361168

SEQ ID NO: 519464 - RNA, 64 nt, Homo Sapiens; identical to SEQ ID NO: 361169

SEQ ID NO: 519465 - RNA, 64 nt, Homo Sapiens; identical to SEQ ID NO: 361170

SEQ ID NO: 519466 - RNA, 64 nt, Homo Sapiens; identical to SEQ ID NO: 361171

SEQ ID NO: 519467 - RNA, 64 nt, Homo Sapiens; identical to SEQ ID NO: 433911

SEQ ID NO: 519468 - RNA, 64 nt, Homo Sapiens; identical to SEQ ID NO: 433912

SEQ ID NO: 519469 - RNA, 64 nt, Homo Sapiens; identical to SEQ ID NO: 433913

SEQ ID NO: 519470 - RNA, 64 nt, Homo Sapiens; identical to SEQ ID NO: 433914

SEQ ID NO: 519471 - RNA, 64 nt, Homo Sapiens; identical to SEQ ID NO: 433915

SEQ ID NO: 519472 - RNA, 64 nt, Homo Sapiens; identical to SEQ ID NO: 433916

SEQ ID NO: 519473 - RNA, 64 nt, Homo Sapiens; identical to SEQ ID NO: 433917

SEQ ID NO: 519474 - RNA, 64 nt, Homo Sapiens; identical to SEQ ID NO: 433918

SEQ ID NO: 519475 - RNA, 64 nt, Homo Sapiens; identical to SEQ ID NO: 433919

SEQ ID NO: 519476 - RNA, 64 nt, Homo Sapiens; identical to SEQ ID NO: 433920

SEQ ID NO: 519477 - RNA, 64 nt, Homo Sapiens; identical to SEQ ID NO: 433921

SEQ ID NO: 519478 - RNA, 64 nt, Homo Sapiens; identical to SEQ ID NO: 433922

SEQ ID NO: 519479 - RNA, 64 nt, Homo Sapiens; identical to SEQ ID NO: 433923

SEQ ID NO: 519480 - RNA, 61 nt, Homo Sapiens; identical to SEQ ID NO: 433924

SEQ ID NO: 519481 - RNA, 64 nt, Homo Sapiens; identical to SEQ ID NO: 433925

SEQ ID NO: 519482 - RNA, 60 nt, Homo Sapiens; identical to SEQ ID NO: 433926

SEQ ID NO: 519483 - RNA, 64 nt, Homo Sapiens; identical to SEQ ID NO: 433927

SEQ ID NO: 519484 - RNA, 64 nt, Homo Sapiens; identical to SEQ ID NO: 433928

SEQ ID NO: 519485 - RNA, 64 nt, Homo Sapiens; identical to SEQ ID NO: 433929

SEQ ID NO: 519486 - RNA, 64 nt, Homo Sapiens; identical to SEQ ID NO: 433930

SEQ ID NO: 519487 - RNA, 64 nt, Homo Sapiens; identical to SEQ ID NO: 433931

SEQ ID NO: 519488 - RNA, 64 nt, Homo Sapiens; identical to SEQ ID NO: 433932

SEQ ID NO: 519489 - RNA, 64 nt, Homo Sapiens; identical to SEQ ID NO: 433933

SEQ ID NO: 519490 - RNA, 64 nt, Homo Sapiens; identical to SEQ ID NO: 433934

SEQ ID NO: 519491 - RNA, 64 nt, Homo Sapiens; identical to SEQ ID NO: 433935

SEQ ID NO: 519492 - RNA, 64 nt, Homo Sapiens; identical to SEQ ID NO: 433936

SEQ ID NO: 519493 - RNA, 64 nt, Homo Sapiens; identical to SEQ ID NO: 433937

SEQ ID NO: 519494 - RNA, 64 nt, Homo Sapiens; identical to SEQ ID NO: 433938

SEQ ID NO: 519495 - RNA, 64 nt, Homo Sapiens; identical to SEQ ID NO: 433939

SEQ ID NO: 519496 - RNA, 64 nt, Homo Sapiens; identical to SEQ ID NO: 433940

SEQ ID NO: 519497 - RNA, 64 nt, Homo Sapiens; identical to SEQ ID NO: 433941

SEQ ID NO: 519498 - RNA, 64 nt, Homo Sapiens; identical to SEQ ID NO: 433942

SEQ ID NO: 519499 - RNA, 64 nt, Homo Sapiens; identical to SEQ ID NO: 215540

SEQ ID NO: 519500 - RNA, 64 nt, Homo Sapiens; identical to SEQ ID NO: 215541

SEQ ID NO: 519501 - RNA, 64 nt, Homo Sapiens; identical to SEQ ID NO: 215542

SEQ ID NO: 519502 - RNA, 64 nt, Homo Sapiens; identical to SEQ ID NO: 215543

SEQ ID NO: 519503 - RNA, 64 nt, Homo Sapiens; identical to SEQ ID NO: 215544

SEQ ID NO: 519504 - RNA, 64 nt, Homo Sapiens; identical to SEQ ID NO: 215545

SEQ ID NO: 519505 - RNA, 64 nt, Homo Sapiens; identical to SEQ ID NO: 215546

SEQ ID NO: 519506 - RNA, 64 nt, Homo Sapiens; identical to SEQ ID NO: 215547

SEQ ID NO: 519507 - RNA, 64 nt, Homo Sapiens; identical to SEQ ID NO: 215548

SEQ ID NO: 519508 - RNA, 64 nt, Homo Sapiens; identical to SEQ ID NO: 215549

SEQ ID NO: 519509 - RNA, 64 nt, Homo Sapiens; identical to SEQ ID NO: 215550

SEQ ID NO: 519510 - RNA, 64 nt, Homo Sapiens; identical to SEQ ID NO: 215551

SEQ ID NO: 519511 - RNA, 64 nt, Homo Sapiens; identical to SEQ ID NO: 215552

SEQ ID NO: 519512 - RNA, 64 nt, Homo Sapiens; identical to SEQ ID NO: 215553

SEQ ID NO: 519513 - RNA, 64 nt, Homo Sapiens; identical to SEQ ID NO: 215554

SEQ ID NO: 519514 - RNA, 64 nt, Homo Sapiens; identical to SEQ ID NO: 215555

SEQ ID NO: 519515 - RNA, 64 nt, Homo Sapiens; identical to SEQ ID NO: 215556

SEQ ID NO: 519516 - RNA, 64 nt, Homo Sapiens; identical to SEQ ID NO: 215557

SEQ ID NO: 519517 - RNA, 64 nt, Homo Sapiens; identical to SEQ ID NO: 215558

SEQ ID NO: 519518 - RNA, 64 nt, Homo Sapiens; identical to SEQ ID NO: 215559

SEQ ID NO: 519519 - RNA, 64 nt, Homo Sapiens; identical to SEQ ID NO: 215560

SEQ ID NO: 519520 - RNA, 64 nt, Homo Sapiens; identical to SEQ ID NO: 215561

SEQ ID NO: 519521 - RNA, 64 nt, Homo Sapiens; identical to SEQ ID NO: 215562

SEQ ID NO: 519522 - RNA, 64 nt, Homo Sapiens; identical to SEQ ID NO: 215563

SEQ ID NO: 519523 - RNA, 64 nt, Homo Sapiens; identical to SEQ ID NO: 215564

SEQ ID NO: 519524 - RNA, 64 nt, Homo Sapiens; identical to SEQ ID NO: 215565

SEQ ID NO: 519525 - RNA, 64 nt, Homo Sapiens; identical to SEQ ID NO: 215566

SEQ ID NO: 519526 - RNA, 64 nt, Homo Sapiens; identical to SEQ ID NO: 215567

SEQ ID NO: 519527 - RNA, 64 nt, Homo Sapiens; identical to SEQ ID NO: 215568

SEQ ID NO: 519528 - RNA, 64 nt, Homo Sapiens
gugaugcaacauuauguggcugaaaaagaauauaaaaagcuagacucuacccucuaaggguuua

SEQ ID NO: 519529 - RNA, 64 nt, Homo Sapiens
uaaaauauuguggcaucaacuacuuuuaaaguagaaaagcuauccauuuuauacaaucacugau

SEQ ID NO: 519530 - RNA, 64 nt, Homo Sapiens
guaucuaacuccagucuuacagauaacuaaggcaaaaagcuaaauaaacaauauguaaccucua

SEQ ID NO: 519531 - RNA, 64 nt, Homo Sapiens
uucccuuuaugauaguuucuuaauuuuuucuaucaaaagcuaaauauggcacacuuguucuuua

SEQ ID NO: 519532 - RNA, 64 nt, Homo Sapiens
gugugagugucuuaaagcauaaccacaaacugcaaaaagcuagguaagcuauuuuguugcagcu

SEQ ID NO: 519533 - RNA, 64 nt, Homo Sapiens
caggagaaagaagguaaaaaaugauuuuuuuaagaaaagcuauuuuauugcagcucuuucccaa

SEQ ID NO: 519534 - RNA, 64 nt, Homo Sapiens
ucauuuuauaagcauaucauuuaaaaagcuucuaaaaagcuauuucgccaggcacgguggcuca

SEQ ID NO: 519535 - RNA, 64 nt, Homo Sapiens
caucucaaaaauaaauaaauauauauaaaaaauaaaaagcuauuucuaguuuauuucacuauaa

SEQ ID NO: 519536 - RNA, 64 nt, Homo Sapiens
cuaguuuauuucacuauaaaguuuugcuuuauuaaaaagcuaauaaacagcuauuaaucacagu

SEQ ID NO: 519537 - RNA, 64 nt, Homo Sapiens
agaucagaaauucaaaaacucagaauaaaaaugaaaaagcuacaagcauauaugagaagagaac

SEQ ID NO: 519538 - RNA, 64 nt, Homo Sapiens
aaguacauuaaggcacguagaagguaggaguaagaaaagcuaagagaagcaaaacaaacaaagc

SEQ ID NO: 519539 - RNA, 64 nt, Homo Sapiens
uuucaaaaauuaauuugaacauacuguuccauacaaaagcuauuucugaacuauaagcccauuu

SEQ ID NO: 519540 - RNA, 64 nt, Homo Sapiens
gugacaaguacauguuccuugugcucuaaauaacaaaagcuagggggacagcguaucuguacca

SEQ ID NO: 519541 - RNA, 64 nt, Homo Sapiens
acugaacaaauuugauguuaacuacagccaacucaaaagcuaaauagagaccuuuaagcaaacu

SEQ ID NO: 519542 - RNA, 64 nt, Homo Sapiens
gauauacagauaucagcuuaaagaaaagaaacacaaaagcuauaugauacguaaauuauagaaa

SEQ ID NO: 519543 - RNA, 64 nt, Homo Sapiens
uaaaauauaagaucugagauugaauauuuucauuaaaagcuacaguuuugugaaucuuugugcu

SEQ ID NO: 519544 - RNA, 64 nt, Homo Sapiens
acaaaguuccaaaaugccaaauucuuauuuuuuaaaaagcuaguucuauaaaauacugguauua

SEQ ID NO: 519545 - RNA, 64 nt, Homo Sapiens
gcaauaacauucuccugcguuacugacaucacucaaaagcuaaaggcaggcacguugacuguuu

SEQ ID NO: 519546 - RNA, 64 nt, Homo Sapiens
aaacagcgacauagccauacuuaaguucuauuuuaaaagcuaucgaggcugauuuuucuuuuuu

SEQ ID NO: 519547 - RNA, 64 nt, Homo Sapiens
guuuuugguuuuuaagcuaacuacaaaucuaguaaaaagcuaucugaaauucacaaauaucaug

SEQ ID NO: 519548 - RNA, 64 nt, Homo Sapiens
augccaugugaagaaguuguggaaauguagaauaaaaagcuaaagcugccaaauuucuguugaa

SEQ ID NO: 519549 - RNA, 64 nt, Homo Sapiens
caaaaagcaaccuuuucauuuucacuaagaguuuaaaagcuauuguauuauuaaaaagucuuua

SEQ ID NO: 519550 - RNA, 64 nt, Homo Sapiens
uuuacaaugcuuguuucaaagaaccaacagaaaaaaaagcuaagaaaacugagaacuaacauua

SEQ ID NO: 519551 - RNA, 64 nt, Homo Sapiens
gagcccuuagaacguggguauuuuuuuucuugagaaaagcuaaugcaccuacagauggccccca

SEQ ID NO: 519552 - RNA, 64 nt, Homo Sapiens
cuucuguguaugaagcaaaugucgauguuuugaaaaaagcuaggagaugacuuugaaugaaugc

SEQ ID NO: 519553 - RNA, 64 nt, Homo Sapiens
ccuagagcucaagaaagcugguccaggagguugaaaaagcuauuuuguuguuaaauuauuuucu

SEQ ID NO: 519554 - RNA, 64 nt, Homo Sapiens
aaguguuguaacaauaauccauaacuagauugugaaaagcuaacuuuauccauaugccuuugca

SEQ ID NO: 519555 - RNA, 64 nt, Homo Sapiens
aagucuugagugcuuuguaggacucaaauuucagaaaagcuaccuccauuaaauaugggagggg

SEQ ID NO: 519556 - RNA, 64 nt, Homo Sapiens
aaaguuuguguguugugucccuucucugaaucagaaaagcuauuccacccccaggcaaggcuga

SEQ ID NO: 519557 - RNA, 64 nt, Homo Sapiens
aucuuuacguacuguaacugucuaaugaaaaacaaaaagcuaacugagccugcaucuucuugca

SEQ ID NO: 519558 - RNA, 64 nt, Homo Sapiens
gcuacaaaagggcagccuagagggcagaacagagaaaagcuagacaaaaugauaagaucagcca

SEQ ID NO: 519559 - RNA, 64 nt, Homo Sapiens
agaaaucugacgucaaugcaauuauccauuauuuaaaagcuauaaaaauagaacaggcaucauu

SEQ ID NO: 519560 - RNA, 64 nt, Homo Sapiens
uguuuaauaaaacaaaaagagaaauccuuaaucuaaaagcuaaauuauuuuugaauggaaauac

SEQ ID NO: 519561 - RNA, 64 nt, Homo Sapiens
acgugcauuuuugguacuuuuuuuuuuguuuucuaaaagcuacauaaaggccuuauuugacauu

SEQ ID NO: 519562 - RNA, 64 nt, Homo Sapiens
cucuaacaggagaacauaaaaaagcuggaaggaaaaaagcuauuaauaagcaugugccagugug

SEQ ID NO: 519563 - RNA, 64 nt, Homo Sapiens
ucguaauguuguuacuaaauucacccaagggaauaaaagcuacuauuaaaugugcacaucuuau

SEQ ID NO: 519564 - RNA, 62 nt, Homo Sapiens
uuuuguuuuacuguuauaguaaauaaaacauuuaaaaagcuauggauguacuaccuuuucaa

SEQ ID NO: 519565 - RNA, 64 nt, Homo Sapiens
ggagaaaaagcagaaguguacucagucauaacccaaaagcuacgucagccuuucuucuuuucau

SEQ ID NO: 519566 - RNA, 64 nt, Homo Sapiens; identical to SEQ ID NO: 84813

SEQ ID NO: 519567 - RNA, 64 nt, Homo Sapiens; identical to SEQ ID NO: 84814

SEQ ID NO: 519568 - RNA, 64 nt, Homo Sapiens; identical to SEQ ID NO: 84815

SEQ ID NO: 519569 - RNA, 64 nt, Homo Sapiens; identical to SEQ ID NO: 84816

SEQ ID NO: 519570 - RNA, 64 nt, Homo Sapiens; identical to SEQ ID NO: 84817

SEQ ID NO: 519571 - RNA, 64 nt, Homo Sapiens; identical to SEQ ID NO: 84818

SEQ ID NO: 519572 - RNA, 64 nt, Homo Sapiens; identical to SEQ ID NO: 84819

SEQ ID NO: 519573 - RNA, 64 nt, Homo Sapiens; identical to SEQ ID NO: 84820

SEQ ID NO: 519574 - RNA, 64 nt, Homo Sapiens; identical to SEQ ID NO: 84821

SEQ ID NO: 519575 - RNA, 64 nt, Homo Sapiens; identical to SEQ ID NO: 84822

SEQ ID NO: 519576 - RNA, 64 nt, Homo Sapiens; identical to SEQ ID NO: 84823

SEQ ID NO: 519577 - RNA, 64 nt, Homo Sapiens; identical to SEQ ID NO: 84824

SEQ ID NO: 519578 - RNA, 64 nt, Homo Sapiens; identical to SEQ ID NO: 84825

SEQ ID NO: 519579 - RNA, 64 nt, Homo Sapiens; identical to SEQ ID NO: 84826

SEQ ID NO: 519580 - RNA, 64 nt, Homo Sapiens; identical to SEQ ID NO: 84827

SEQ ID NO: 519581 - RNA, 64 nt, Homo Sapiens; identical to SEQ ID NO: 84828

SEQ ID NO: 519582 - RNA, 64 nt, Homo Sapiens; identical to SEQ ID NO: 84829

SEQ ID NO: 519583 - RNA, 64 nt, Homo Sapiens; identical to SEQ ID NO: 84830

SEQ ID NO: 519584 - RNA, 64 nt, Homo Sapiens; identical to SEQ ID NO: 84831

SEQ ID NO: 519585 - RNA, 64 nt, Homo Sapiens; identical to SEQ ID NO: 84832

SEQ ID NO: 519586 - RNA, 64 nt, Homo Sapiens; identical to SEQ ID NO: 84833

SEQ ID NO: 519587 - RNA, 64 nt, Homo Sapiens; identical to SEQ ID NO: 84834

SEQ ID NO: 519588 - RNA, 64 nt, Homo Sapiens; identical to SEQ ID NO: 84835

SEQ ID NO: 519589 - RNA, 64 nt, Homo Sapiens; identical to SEQ ID NO: 84836

SEQ ID NO: 519590 - RNA, 64 nt, Homo Sapiens; identical to SEQ ID NO: 84837

SEQ ID NO: 519591 - RNA, 64 nt, Homo Sapiens; identical to SEQ ID NO: 84838

SEQ ID NO: 519592 - RNA, 64 nt, Homo Sapiens; identical to SEQ ID NO: 84839

SEQ ID NO: 519593 - RNA, 64 nt, Homo Sapiens; identical to SEQ ID NO: 84840

SEQ ID NO: 519594 - RNA, 64 nt, Homo Sapiens; identical to SEQ ID NO: 84841

SEQ ID NO: 519595 - RNA, 64 nt, Homo Sapiens; identical to SEQ ID NO: 84842

SEQ ID NO: 519596 - RNA, 64 nt, Homo Sapiens; identical to SEQ ID NO: 84843

SEQ ID NO: 519597 - RNA, 64 nt, Homo Sapiens; identical to SEQ ID NO: 84844

SEQ ID NO: 519598 - RNA, 64 nt, Homo Sapiens; identical to SEQ ID NO: 84845

SEQ ID NO: 519599 - RNA, 64 nt, Homo Sapiens; identical to SEQ ID NO: 84846

SEQ ID NO: 519600 - RNA, 64 nt, Homo Sapiens; identical to SEQ ID NO: 84847

SEQ ID NO: 519601 - RNA, 64 nt, Homo Sapiens; identical to SEQ ID NO: 84848

SEQ ID NO: 519602 - RNA, 64 nt, Homo Sapiens; identical to SEQ ID NO: 84849

SEQ ID NO: 519603 - RNA, 64 nt, Homo Sapiens; identical to SEQ ID NO: 84850

SEQ ID NO: 519604 - RNA, 64 nt, Homo Sapiens; identical to SEQ ID NO: 84851

SEQ ID NO: 519605 - RNA, 64 nt, Homo Sapiens; identical to SEQ ID NO: 84852

SEQ ID NO: 519606 - RNA, 64 nt, Homo Sapiens; identical to SEQ ID NO: 84853

SEQ ID NO: 519607 - RNA, 64 nt, Homo Sapiens; identical to SEQ ID NO: 84854

SEQ ID NO: 519608 - RNA, 64 nt, Homo Sapiens; identical to SEQ ID NO: 84855

SEQ ID NO: 519609 - RNA, 64 nt, Homo Sapiens; identical to SEQ ID NO: 84856

SEQ ID NO: 519610 - RNA, 64 nt, Homo Sapiens; identical to SEQ ID NO: 84857

SEQ ID NO: 519611 - RNA, 64 nt, Homo Sapiens; identical to SEQ ID NO: 84858

SEQ ID NO: 519612 - RNA, 64 nt, Homo Sapiens; identical to SEQ ID NO: 84859

SEQ ID NO: 519613 - RNA, 64 nt, Homo Sapiens; identical to SEQ ID NO: 84860

SEQ ID NO: 519614 - RNA, 64 nt, Homo Sapiens; identical to SEQ ID NO: 266331

SEQ ID NO: 519615 - RNA, 64 nt, Homo Sapiens; identical to SEQ ID NO: 266332

SEQ ID NO: 519616 - RNA, 64 nt, Homo Sapiens; identical to SEQ ID NO: 266333

SEQ ID NO: 519617 - RNA, 64 nt, Homo Sapiens; identical to SEQ ID NO: 266334

SEQ ID NO: 519618 - RNA, 64 nt, Homo Sapiens; identical to SEQ ID NO: 266335

SEQ ID NO: 519619 - RNA, 64 nt, Homo Sapiens; identical to SEQ ID NO: 266336

SEQ ID NO: 519620 - RNA, 64 nt, Homo Sapiens; identical to SEQ ID NO: 266337

SEQ ID NO: 519621 - RNA, 64 nt, Homo Sapiens; identical to SEQ ID NO: 266338

SEQ ID NO: 519622 - RNA, 64 nt, Homo Sapiens; identical to SEQ ID NO: 266339

SEQ ID NO: 519623 - RNA, 64 nt, Homo Sapiens; identical to SEQ ID NO: 266340

SEQ ID NO: 519624 - RNA, 64 nt, Homo Sapiens; identical to SEQ ID NO: 266341

SEQ ID NO: 519625 - RNA, 64 nt, Homo Sapiens; identical to SEQ ID NO: 266342

SEQ ID NO: 519626 - RNA, 64 nt, Homo Sapiens; identical to SEQ ID NO: 266343

SEQ ID NO: 519627 - RNA, 64 nt, Homo Sapiens; identical to SEQ ID NO: 266344

SEQ ID NO: 519628 - RNA, 64 nt, Homo Sapiens; identical to SEQ ID NO: 266345

SEQ ID NO: 519629 - RNA, 64 nt, Homo Sapiens; identical to SEQ ID NO: 266346

SEQ ID NO: 519630 - RNA, 64 nt, Homo Sapiens; identical to SEQ ID NO: 266347

SEQ ID NO: 519631 - RNA, 64 nt, Homo Sapiens; identical to SEQ ID NO: 266348

SEQ ID NO: 519632 - RNA, 64 nt, Homo Sapiens; identical to SEQ ID NO: 266349

SEQ ID NO: 519633 - RNA, 64 nt, Homo Sapiens; identical to SEQ ID NO: 266350

SEQ ID NO: 519634 - RNA, 64 nt, Homo Sapiens; identical to SEQ ID NO: 266351

SEQ ID NO: 519635 - RNA, 64 nt, Homo Sapiens; identical to SEQ ID NO: 266352

SEQ ID NO: 519636 - RNA, 64 nt, Homo Sapiens; identical to SEQ ID NO: 266353

SEQ ID NO: 519637 - RNA, 64 nt, Homo Sapiens; identical to SEQ ID NO: 266354

SEQ ID NO: 519638 - RNA, 64 nt, Homo Sapiens; identical to SEQ ID NO: 266355

SEQ ID NO: 519639 - RNA, 64 nt, Homo Sapiens; identical to SEQ ID NO: 266356

SEQ ID NO: 519640 - RNA, 64 nt, Homo Sapiens; identical to SEQ ID NO: 266357

SEQ ID NO: 519641 - RNA, 64 nt, Homo Sapiens; identical to SEQ ID NO: 266358

SEQ ID NO: 519642 - RNA, 64 nt, Homo Sapiens; identical to SEQ ID NO: 266359

SEQ ID NO: 519643 - RNA, 64 nt, Homo Sapiens; identical to SEQ ID NO: 266360

SEQ ID NO: 519644 - RNA, 64 nt, Homo Sapiens; identical to SEQ ID NO: 266361

SEQ ID NO: 519645 - RNA, 64 nt, Homo Sapiens; identical to SEQ ID NO: 266362

SEQ ID NO: 519646 - RNA, 64 nt, Homo Sapiens; identical to SEQ ID NO: 266363

SEQ ID NO: 519647 - RNA, 64 nt, Homo Sapiens; identical to SEQ ID NO: 266364

SEQ ID NO: 519648 - RNA, 64 nt, Homo Sapiens; identical to SEQ ID NO: 266365

SEQ ID NO: 519649 - RNA, 64 nt, Homo Sapiens; identical to SEQ ID NO: 266366

SEQ ID NO: 519650 - RNA, 64 nt, Homo Sapiens; identical to SEQ ID NO: 266367

SEQ ID NO: 519651 - RNA, 64 nt, Homo Sapiens; identical to SEQ ID NO: 84890

SEQ ID NO: 519652 - RNA, 64 nt, Homo Sapiens; identical to SEQ ID NO: 84891

SEQ ID NO: 519653 - RNA, 64 nt, Homo Sapiens; identical to SEQ ID NO: 84892

SEQ ID NO: 519654 - RNA, 64 nt, Homo Sapiens; identical to SEQ ID NO: 84893

SEQ ID NO: 519655 - RNA, 64 nt, Homo Sapiens; identical to SEQ ID NO: 84894

SEQ ID NO: 519656 - RNA, 64 nt, Homo Sapiens; identical to SEQ ID NO: 84895

SEQ ID NO: 519657 - RNA, 64 nt, Homo Sapiens; identical to SEQ ID NO: 84896

SEQ ID NO: 519658 - RNA, 64 nt, Homo Sapiens; identical to SEQ ID NO: 84897

SEQ ID NO: 519659 - RNA, 64 nt, Homo Sapiens; identical to SEQ ID NO: 84898

SEQ ID NO: 519660 - RNA, 64 nt, Homo Sapiens; identical to SEQ ID NO: 84899

SEQ ID NO: 519661 - RNA, 64 nt, Homo Sapiens; identical to SEQ ID NO: 84900

SEQ ID NO: 519662 - RNA, 64 nt, Homo Sapiens; identical to SEQ ID NO: 84901

SEQ ID NO: 519663 - RNA, 64 nt, Homo Sapiens; identical to SEQ ID NO: 84902

SEQ ID NO: 519664 - RNA, 64 nt, Homo Sapiens; identical to SEQ ID NO: 84903

SEQ ID NO: 519665 - RNA, 64 nt, Homo Sapiens; identical to SEQ ID NO: 84904

SEQ ID NO: 519666 - RNA, 64 nt, Homo Sapiens; identical to SEQ ID NO: 84905

SEQ ID NO: 519667 - RNA, 52 nt, Homo Sapiens; identical to SEQ ID NO: 84906

SEQ ID NO: 519668 - RNA, 64 nt, Homo Sapiens; identical to SEQ ID NO: 84907

SEQ ID NO: 519669 - RNA, 64 nt, Homo Sapiens; identical to SEQ ID NO: 84908

SEQ ID NO: 519670 - RNA, 64 nt, Homo Sapiens; identical to SEQ ID NO: 84909

SEQ ID NO: 519671 - RNA, 64 nt, Homo Sapiens; identical to SEQ ID NO: 84910

SEQ ID NO: 519672 - RNA, 64 nt, Homo Sapiens; identical to SEQ ID NO: 84911

SEQ ID NO: 519673 - RNA, 64 nt, Homo Sapiens; identical to SEQ ID NO: 84912

SEQ ID NO: 519674 - RNA, 64 nt, Homo Sapiens; identical to SEQ ID NO: 84913

SEQ ID NO: 519675 - RNA, 64 nt, Homo Sapiens; identical to SEQ ID NO: 84914

SEQ ID NO: 519676 - RNA, 64 nt, Homo Sapiens; identical to SEQ ID NO: 84915

SEQ ID NO: 519677 - RNA, 64 nt, Homo Sapiens; identical to SEQ ID NO: 84916

SEQ ID NO: 519678 - RNA, 64 nt, Homo Sapiens; identical to SEQ ID NO: 84917

SEQ ID NO: 519679 - RNA, 64 nt, Homo Sapiens; identical to SEQ ID NO: 84918

SEQ ID NO: 519680 - RNA, 64 nt, Homo Sapiens; identical to SEQ ID NO: 84919

SEQ ID NO: 519681 - RNA, 64 nt, Homo Sapiens; identical to SEQ ID NO: 84920

SEQ ID NO: 519682 - RNA, 64 nt, Homo Sapiens; identical to SEQ ID NO: 84921

SEQ ID NO: 519683 - RNA, 64 nt, Homo Sapiens; identical to SEQ ID NO: 84922

SEQ ID NO: 519684 - RNA, 64 nt, Homo Sapiens; identical to SEQ ID NO: 84923

SEQ ID NO: 519685 - RNA, 64 nt, Homo Sapiens; identical to SEQ ID NO: 84924

SEQ ID NO: 519686 - RNA, 64 nt, Homo Sapiens; identical to SEQ ID NO: 84925

SEQ ID NO: 519687 - RNA, 64 nt, Homo Sapiens; identical to SEQ ID NO: 84926

SEQ ID NO: 519688 - RNA, 64 nt, Homo Sapiens; identical to SEQ ID NO: 84927

SEQ ID NO: 519689 - RNA, 64 nt, Homo Sapiens; identical to SEQ ID NO: 84928

SEQ ID NO: 519690 - RNA, 64 nt, Homo Sapiens; identical to SEQ ID NO: 84929

SEQ ID NO: 519691 - RNA, 64 nt, Homo Sapiens; identical to SEQ ID NO: 84930

SEQ ID NO: 519692 - RNA, 64 nt, Homo Sapiens; identical to SEQ ID NO: 84931

SEQ ID NO: 519693 - RNA, 64 nt, Homo Sapiens; identical to SEQ ID NO: 84932

SEQ ID NO: 519694 - RNA, 64 nt, Homo Sapiens; identical to SEQ ID NO: 84933

SEQ ID NO: 519695 - RNA, 64 nt, Homo Sapiens; identical to SEQ ID NO: 84934

SEQ ID NO: 519696 - RNA, 64 nt, Homo Sapiens; identical to SEQ ID NO: 84935

SEQ ID NO: 519697 - RNA, 64 nt, Homo Sapiens; identical to SEQ ID NO: 84936

SEQ ID NO: 519698 - RNA, 64 nt, Homo Sapiens; identical to SEQ ID NO: 84937

SEQ ID NO: 519699 - RNA, 64 nt, Homo Sapiens; identical to SEQ ID NO: 84938

SEQ ID NO: 519700 - RNA, 64 nt, Homo Sapiens; identical to SEQ ID NO: 84939

SEQ ID NO: 519701 - RNA, 64 nt, Homo Sapiens; identical to SEQ ID NO: 84940

SEQ ID NO: 519702 - RNA, 64 nt, Homo Sapiens; identical to SEQ ID NO: 84941

SEQ ID NO: 519703 - RNA, 64 nt, Homo Sapiens; identical to SEQ ID NO: 84942

SEQ ID NO: 519704 - RNA, 64 nt, Homo Sapiens; identical to SEQ ID NO: 84943

SEQ ID NO: 519705 - RNA, 64 nt, Homo Sapiens; identical to SEQ ID NO: 84944

SEQ ID NO: 519706 - RNA, 64 nt, Homo Sapiens; identical to SEQ ID NO: 84945

SEQ ID NO: 519707 - RNA, 64 nt, Homo Sapiens; identical to SEQ ID NO: 84946

SEQ ID NO: 519708 - RNA, 64 nt, Homo Sapiens; identical to SEQ ID NO: 84947

SEQ ID NO: 519709 - RNA, 64 nt, Homo Sapiens; identical to SEQ ID NO: 84948

SEQ ID NO: 519710 - RNA, 64 nt, Homo Sapiens; identical to SEQ ID NO: 84949

SEQ ID NO: 519711 - RNA, 64 nt, Homo Sapiens; identical to SEQ ID NO: 84950

SEQ ID NO: 519712 - RNA, 64 nt, Homo Sapiens; identical to SEQ ID NO: 84951

SEQ ID NO: 519713 - RNA, 64 nt, Homo Sapiens; identical to SEQ ID NO: 84952

SEQ ID NO: 519714 - RNA, 64 nt, Homo Sapiens; identical to SEQ ID NO: 84953

SEQ ID NO: 519715 - RNA, 64 nt, Homo Sapiens; identical to SEQ ID NO: 84954

SEQ ID NO: 519716 - RNA, 64 nt, Homo Sapiens; identical to SEQ ID NO: 84955

SEQ ID NO: 519717 - RNA, 64 nt, Homo Sapiens; identical to SEQ ID NO: 84956

SEQ ID NO: 519718 - RNA, 64 nt, Homo Sapiens; identical to SEQ ID NO: 84957

SEQ ID NO: 519719 - RNA, 64 nt, Homo Sapiens; identical to SEQ ID NO: 84958

SEQ ID NO: 519720 - RNA, 64 nt, Homo Sapiens; identical to SEQ ID NO: 84959

SEQ ID NO: 519721 - RNA, 64 nt, Homo Sapiens; identical to SEQ ID NO: 84960

SEQ ID NO: 519722 - RNA, 64 nt, Homo Sapiens; identical to SEQ ID NO: 84961

SEQ ID NO: 519723 - RNA, 64 nt, Homo Sapiens; identical to SEQ ID NO: 84962

SEQ ID NO: 519724 - RNA, 64 nt, Homo Sapiens; identical to SEQ ID NO: 84963

SEQ ID NO: 519725 - RNA, 64 nt, Homo Sapiens; identical to SEQ ID NO: 84964

SEQ ID NO: 519726 - RNA, 64 nt, Homo Sapiens; identical to SEQ ID NO: 84965

SEQ ID NO: 519727 - RNA, 64 nt, Homo Sapiens; identical to SEQ ID NO: 84966

SEQ ID NO: 519728 - RNA, 64 nt, Homo Sapiens; identical to SEQ ID NO: 84967

SEQ ID NO: 519729 - RNA, 64 nt, Homo Sapiens; identical to SEQ ID NO: 84968

SEQ ID NO: 519730 - RNA, 64 nt, Homo Sapiens; identical to SEQ ID NO: 84969

SEQ ID NO: 519731 - RNA, 64 nt, Homo Sapiens; identical to SEQ ID NO: 84970

SEQ ID NO: 519732 - RNA, 64 nt, Homo Sapiens; identical to SEQ ID NO: 84971

SEQ ID NO: 519733 - RNA, 64 nt, Homo Sapiens; identical to SEQ ID NO: 84972

SEQ ID NO: 519734 - RNA, 58 nt, Homo Sapiens; identical to SEQ ID NO: 84973

SEQ ID NO: 519735 - RNA, 64 nt, Homo Sapiens; identical to SEQ ID NO: 84974

SEQ ID NO: 519736 - RNA, 64 nt, Homo Sapiens; identical to SEQ ID NO: 84975

SEQ ID NO: 519737 - RNA, 64 nt, Homo Sapiens; identical to SEQ ID NO: 84976

SEQ ID NO: 519738 - RNA, 64 nt, Homo Sapiens; identical to SEQ ID NO: 84977

SEQ ID NO: 519739 - RNA, 64 nt, Homo Sapiens; identical to SEQ ID NO: 84978

SEQ ID NO: 519740 - RNA, 64 nt, Homo Sapiens; identical to SEQ ID NO: 84979

SEQ ID NO: 519741 - RNA, 64 nt, Homo Sapiens; identical to SEQ ID NO: 84980

SEQ ID NO: 519742 - RNA, 64 nt, Homo Sapiens; identical to SEQ ID NO: 84981

SEQ ID NO: 519743 - RNA, 64 nt, Homo Sapiens; identical to SEQ ID NO: 84982

SEQ ID NO: 519744 - RNA, 64 nt, Homo Sapiens; identical to SEQ ID NO: 84983

SEQ ID NO: 519745 - RNA, 64 nt, Homo Sapiens; identical to SEQ ID NO: 84984

SEQ ID NO: 519746 - RNA, 64 nt, Homo Sapiens; identical to SEQ ID NO: 84985

SEQ ID NO: 519747 - RNA, 64 nt, Homo Sapiens; identical to SEQ ID NO: 84986

SEQ ID NO: 519748 - RNA, 64 nt, Homo Sapiens; identical to SEQ ID NO: 84987

SEQ ID NO: 519749 - RNA, 64 nt, Homo Sapiens; identical to SEQ ID NO: 84988

SEQ ID NO: 519750 - RNA, 64 nt, Homo Sapiens; identical to SEQ ID NO: 84989

SEQ ID NO: 519751 - RNA, 64 nt, Homo Sapiens; identical to SEQ ID NO: 84990

SEQ ID NO: 519752 - RNA, 64 nt, Homo Sapiens; identical to SEQ ID NO: 84991

SEQ ID NO: 519753 - RNA, 64 nt, Homo Sapiens; identical to SEQ ID NO: 84992

SEQ ID NO: 519754 - RNA, 64 nt, Homo Sapiens; identical to SEQ ID NO: 84993

SEQ ID NO: 519755 - RNA, 64 nt, Homo Sapiens; identical to SEQ ID NO: 84994

SEQ ID NO: 519756 - RNA, 64 nt, Homo Sapiens; identical to SEQ ID NO: 84995

SEQ ID NO: 519757 - RNA, 64 nt, Homo Sapiens; identical to SEQ ID NO: 84996

SEQ ID NO: 519758 - RNA, 64 nt, Homo Sapiens; identical to SEQ ID NO: 84997

SEQ ID NO: 519759 - RNA, 64 nt, Homo Sapiens; identical to SEQ ID NO: 84998

SEQ ID NO: 519760 - RNA, 64 nt, Homo Sapiens; identical to SEQ ID NO: 84999

SEQ ID NO: 519761 - RNA, 64 nt, Homo Sapiens; identical to SEQ ID NO: 85000

SEQ ID NO: 519762 - RNA, 64 nt, Homo Sapiens; identical to SEQ ID NO: 85001

SEQ ID NO: 519763 - RNA, 64 nt, Homo Sapiens; identical to SEQ ID NO: 85002

SEQ ID NO: 519764 - RNA, 64 nt, Homo Sapiens; identical to SEQ ID NO: 85003

SEQ ID NO: 519765 - RNA, 64 nt, Homo Sapiens; identical to SEQ ID NO: 349054

SEQ ID NO: 519766 - RNA, 64 nt, Homo Sapiens; identical to SEQ ID NO: 349055

SEQ ID NO: 519767 - RNA, 64 nt, Homo Sapiens; identical to SEQ ID NO: 349056

SEQ ID NO: 519768 - RNA, 64 nt, Homo Sapiens; identical to SEQ ID NO: 349057

SEQ ID NO: 519769 - RNA, 64 nt, Homo Sapiens; identical to SEQ ID NO: 349058

SEQ ID NO: 519770 - RNA, 64 nt, Homo Sapiens; identical to SEQ ID NO: 349059

SEQ ID NO: 519771 - RNA, 64 nt, Homo Sapiens; identical to SEQ ID NO: 349060

SEQ ID NO: 519772 - RNA, 64 nt, Homo Sapiens; identical to SEQ ID NO: 349061

SEQ ID NO: 519773 - RNA, 64 nt, Homo Sapiens; identical to SEQ ID NO: 349062

SEQ ID NO: 519774 - RNA, 64 nt, Homo Sapiens; identical to SEQ ID NO: 349063

SEQ ID NO: 519775 - RNA, 64 nt, Homo Sapiens; identical to SEQ ID NO: 349064

SEQ ID NO: 519776 - RNA, 64 nt, Homo Sapiens; identical to SEQ ID NO: 349065

SEQ ID NO: 519777 - RNA, 64 nt, Homo Sapiens; identical to SEQ ID NO: 349066

SEQ ID NO: 519778 - RNA, 64 nt, Homo Sapiens; identical to SEQ ID NO: 349067

SEQ ID NO: 519779 - RNA, 64 nt, Homo Sapiens; identical to SEQ ID NO: 349068

SEQ ID NO: 519780 - RNA, 64 nt, Homo Sapiens; identical to SEQ ID NO: 349069

SEQ ID NO: 519781 - RNA, 64 nt, Homo Sapiens; identical to SEQ ID NO: 212919

SEQ ID NO: 519782 - RNA, 64 nt, Homo Sapiens; identical to SEQ ID NO: 212920

SEQ ID NO: 519783 - RNA, 64 nt, Homo Sapiens; identical to SEQ ID NO: 212921

SEQ ID NO: 519784 - RNA, 64 nt, Homo Sapiens; identical to SEQ ID NO: 212922

SEQ ID NO: 519785 - RNA, 64 nt, Homo Sapiens; identical to SEQ ID NO: 212923

SEQ ID NO: 519786 - RNA, 64 nt, Homo Sapiens; identical to SEQ ID NO: 212924

SEQ ID NO: 519787 - RNA, 64 nt, Homo Sapiens; identical to SEQ ID NO: 212925

SEQ ID NO: 519788 - RNA, 64 nt, Homo Sapiens; identical to SEQ ID NO: 212926

SEQ ID NO: 519789 - RNA, 64 nt, Homo Sapiens; identical to SEQ ID NO: 212927

SEQ ID NO: 519790 - RNA, 64 nt, Homo Sapiens; identical to SEQ ID NO: 212928

SEQ ID NO: 519791 - RNA, 64 nt, Homo Sapiens; identical to SEQ ID NO: 93597

SEQ ID NO: 519792 - RNA, 64 nt, Homo Sapiens; identical to SEQ ID NO: 93598

SEQ ID NO: 519793 - RNA, 64 nt, Homo Sapiens; identical to SEQ ID NO: 93599

SEQ ID NO: 519794 - RNA, 64 nt, Homo Sapiens; identical to SEQ ID NO: 93600

SEQ ID NO: 519795 - RNA, 64 nt, Homo Sapiens; identical to SEQ ID NO: 93601

SEQ ID NO: 519796 - RNA, 64 nt, Homo Sapiens; identical to SEQ ID NO: 93602

SEQ ID NO: 519797 - RNA, 64 nt, Homo Sapiens; identical to SEQ ID NO: 93603

SEQ ID NO: 519798 - RNA, 64 nt, Homo Sapiens; identical to SEQ ID NO: 93604

SEQ ID NO: 519799 - RNA, 64 nt, Homo Sapiens; identical to SEQ ID NO: 93605

SEQ ID NO: 519800 - RNA, 64 nt, Homo Sapiens; identical to SEQ ID NO: 93606

SEQ ID NO: 519801 - RNA, 64 nt, Homo Sapiens; identical to SEQ ID NO: 93607

SEQ ID NO: 519802 - RNA, 64 nt, Homo Sapiens; identical to SEQ ID NO: 93608

SEQ ID NO: 519803 - RNA, 64 nt, Homo Sapiens; identical to SEQ ID NO: 93609

SEQ ID NO: 519804 - RNA, 64 nt, Homo Sapiens; identical to SEQ ID NO: 93610

SEQ ID NO: 519805 - RNA, 64 nt, Homo Sapiens; identical to SEQ ID NO: 93611

SEQ ID NO: 519806 - RNA, 64 nt, Homo Sapiens; identical to SEQ ID NO: 93612

SEQ ID NO: 519807 - RNA, 64 nt, Homo Sapiens; identical to SEQ ID NO: 93613

SEQ ID NO: 519808 - RNA, 64 nt, Homo Sapiens; identical to SEQ ID NO: 93614

SEQ ID NO: 519809 - RNA, 64 nt, Homo Sapiens; identical to SEQ ID NO: 93615

SEQ ID NO: 519810 - RNA, 64 nt, Homo Sapiens; identical to SEQ ID NO: 93616

SEQ ID NO: 519811 - RNA, 64 nt, Homo Sapiens; identical to SEQ ID NO: 93617

SEQ ID NO: 519812 - RNA, 64 nt, Homo Sapiens; identical to SEQ ID NO: 93618

SEQ ID NO: 519813 - RNA, 64 nt, Homo Sapiens; identical to SEQ ID NO: 93619

SEQ ID NO: 519814 - RNA, 64 nt, Homo Sapiens; identical to SEQ ID NO: 93620

SEQ ID NO: 519815 - RNA, 64 nt, Homo Sapiens; identical to SEQ ID NO: 93621

SEQ ID NO: 519816 - RNA, 64 nt, Homo Sapiens; identical to SEQ ID NO: 93622

SEQ ID NO: 519817 - RNA, 64 nt, Homo Sapiens
gugcuuauuuuaauaaaacuaacaccacggugcuuuuauacauuugucaggcagacguuuauac

SEQ ID NO: 519818 - RNA, 64 nt, Homo Sapiens
accacggugcuuuuauacauuugucaggcagacguuuauacaacuaaagaaaauagauuugcau

SEQ ID NO: 519819 - RNA, 64 nt, Homo Sapiens
cuaagaaauguguuuauaauagaguacaguuguuuuuauacacuuuaauaucaacuguuuggua

SEQ ID NO: 519820 - RNA, 64 nt, Homo Sapiens
uugaggagaaaacaaagugugaguaaacagcuuauuuauacauugaauuuuccaaaaaucuaag

SEQ ID NO: 519821 - RNA, 64 nt, Homo Sapiens
aaaucucccaaaagagauaaccaguaucugaagguuuauacaauauuuacacaguggcuacaau

SEQ ID NO: 519822 - RNA, 64 nt, Homo Sapiens
uuucuauuucaaguaaagcuuugaguuacuuguuuuuauacauauucaucauguacccuuuauu

SEQ ID NO: 519823 - RNA, 64 nt, Homo Sapiens
uucugaaaacaaugaaaagauuacaaauuggaccuuuauacauuuuaauuugaaaaccuugcug

SEQ ID NO: 519824 - RNA, 64 nt, Homo Sapiens
ugagauagcuauuuugauagaaaaacaaaugcuguuuauacauaguuuaugauauuguuuuucu

SEQ ID NO: 519825 - RNA, 64 nt, Homo Sapiens
aggucaaguaacauuuacuacuuaaucggcauuauuuauacaagaaacuauuccaggacuaauu

SEQ ID NO: 519826 - RNA, 64 nt, Homo Sapiens
uguaucacaucgaaaaguguucauauucucgaguuuuauacaguuacauuggucaccuaaauac

SEQ ID NO: 519827 - RNA, 64 nt, Homo Sapiens
gucacaaaaauggugguuuguauaaaugcaugauuuuauacauacuauugauguuuccagaaaa

SEQ ID NO: 519828 - RNA, 64 nt, Homo Sapiens
auaauuuaacuaauuuaaacagaauuauaucuaauuuauacaaauuuauacauaucagaaaagu

SEQ ID NO: 519829 - RNA, 64 nt, Homo Sapiens
ucagaaaaguagaauuauaucagcuucaucaauuuuuauacauauuuccuauuuuaaaaccaug

SEQ ID NO: 519830 - RNA, 64 nt, Homo Sapiens
agacaugauagagaaaagaucagaaagaaaugucuuuauacaaaugucuagacagcacgcaguu

SEQ ID NO: 519831 - RNA, 64 nt, Homo Sapiens
cuccaaaaaaaaaaacaacuuuuaaauuuguauuuuuauacaacugauuaauaaaaguucauuu

SEQ ID NO: 519832 - RNA, 64 nt, Homo Sapiens
uuagcacaugaaggauagaucaguuaacugaccuuuuauacaaggaaggaggacugagguucag

SEQ ID NO: 519833 - RNA, 64 nt, Homo Sapiens
cucucucucucuuuuuuuuuuuuacuuuacauauuuuauacaaugucauucauaacuauggcuu

SEQ ID NO: 519834 - RNA, 64 nt, Homo Sapiens
guugguacaauuaugaggguaguacugggugcuuuuuauacaacuuuccaucccccacacaguu

SEQ ID NO: 519835 - RNA, 64 nt, Homo Sapiens
auuucccuaauuuauuuuaaagaagcaccucuauuuuauacaucaugugcauuuuaaaucucca

SEQ ID NO: 519836 - RNA, 64 nt, Homo Sapiens
agucuuuaagucauucuaaauauuuagguaguuauuuauacaagcauccucccaauuuguucug

SEQ ID NO: 519837 - RNA, 64 nt, Homo Sapiens
uauuuuccgaauguaucauuguacuuuuucauauuuuauacauuguacugaaaaaugcuuuuua

SEQ ID NO: 519838 - RNA, 64 nt, Homo Sapiens
uugcuauuucuauuuccuuccucuauuguauuauuuuauacaauagaaauuuaaauucuuucuu

SEQ ID NO: 519839 - RNA, 64 nt, Homo Sapiens
cauuuuggaugauuaaagaagguuuguucuauauuuuauacauguguuuauguuuaaauacuag

SEQ ID NO: 519840 - RNA, 64 nt, Homo Sapiens
guacauguacauaguaaaguagguaaaucuagaguuuauacaguugauuaaggcuuucuuuggu

SEQ ID NO: 519841 - RNA, 64 nt, Homo Sapiens
aagaaauuaauuuuguguugcuuucagcacaucuuuuauacaugaaaacugaugaggcaugcag

SEQ ID NO: 519842 - RNA, 64 nt, Homo Sapiens
uauuaaguucuggauauuuauguuuuguuuauaauuuauacaucaauaccuuggggcagggaca

SEQ ID NO: 519843 - RNA, 64 nt, Homo Sapiens
uaauuuauuucuaauaauaagaugcaugcaauuuuuuauacaaauaaaaauaaaugcaaugauu

SEQ ID NO: 519844 - RNA, 64 nt, Homo Sapiens
aaaaccaaugagugucaagcgugaagaaacccguuuuauacaauaaaguaucaauaaacgggga

SEQ ID NO: 519845 - RNA, 64 nt, Homo Sapiens
uugcugaaguauuuaaaucuuauccuuguaucuuuuuauacauauuugaaaauaagcuuauaug

SEQ ID NO: 519846 - RNA, 64 nt, Homo Sapiens
aaaaagguaguuuuaauaaacaagacacaacguuuuuauacaacauacuuuaaaauauuaagga

SEQ ID NO: 519847 - RNA, 64 nt, Homo Sapiens
ucuggaugcuaaaacuuagaccaacaaacuguacuuuauacaaucaagcaguuguuucccauuc

SEQ ID NO: 519848 - RNA, 64 nt, Homo Sapiens
gaggaagggcuuauggacugcuggccgagaaccauuuauacauaagaacaaagauuggaaaaag

SEQ ID NO: 519849 - RNA, 64 nt, Homo Sapiens
gucaugcauauuuucucauaagacaaauuguguuuuuauacagacauuuuauacaaacuuuuau

SEQ ID NO: 519850 - RNA, 64 nt, Homo Sapiens
cuuuuauagacaaauuguguccuauucgaaacauuuuauacaaaacucucugggugacaugaua

SEQ ID NO: 519851 - RNA, 64 nt, Homo Sapiens
cuccuguuauucugggauaaacuaaagcuuccuguuuauacacaggauaaucuuauuuaucuaa

SEQ ID NO: 519852 - RNA, 64 nt, Homo Sapiens
ugaguucucuugguaaguuccagaauuaaccacuuuuauacauccaagacuuugggccucuuga

SEQ ID NO: 519853 - RNA, 64 nt, Homo Sapiens
acucacaguaccuaugacuuuuacuguccaccaguuuauacagaguuaaaacaaaggaacuaac

SEQ ID NO: 519854 - RNA, 64 nt, Homo Sapiens
uuccauauagucuauucauuaaagguaauaacauuuuauacaauuguuuaagcuacuaacgaua

SEQ ID NO: 519855 - RNA, 64 nt, Homo Sapiens
uuuucuauuuccgacaaugcgcauuucgaagauuuuuauacauguuggauuugcauuuuaaccu

SEQ ID NO: 519856 - RNA, 64 nt, Homo Sapiens
aauuauuacaaaaagcagugaggaagugguguucuuuauacaucgcuauugaaauaguucugua

SEQ ID NO: 519857 - RNA, 64 nt, Homo Sapiens
gcaggcauaugaaacuccacgaaaugaaagcuaauuuauacacagugugccagcuuacaaugug

SEQ ID NO: 519858 - RNA, 64 nt, Homo Sapiens
ugccaggcuccccuaauucaucuuaaucaggauuuuuauacagcuuagauccucuaguuugauc

SEQ ID NO: 519859 - RNA, 64 nt, Homo Sapiens
guagguuguauacuuacauuuuuucuuuccuuaauuuauacaugauccuuuuuccuuaauuuau

SEQ ID NO: 519860 - RNA, 64 nt, Homo Sapiens
uuuccuuaauuuauacaugauccuuuuuccuuaauuuauacaugauccaggcacauuugaaauu

SEQ ID NO: 519861 - RNA, 64 nt, Homo Sapiens
uuuuuauaaagcagauuuuacuggcagauugauauuuauacacuguuggggauaggaaguauau

SEQ ID NO: 519862 - RNA, 64 nt, Homo Sapiens
auuuagcauuauaauacaucuccagaaaucauauuuuauacauaucaauagaagauggacaaau

SEQ ID NO: 519863 - RNA, 64 nt, Homo Sapiens
auauguuacuagaaauaaaauauaaaauagaguauuuauacaauaucgcuuuuguggaagugca

SEQ ID NO: 519864 - RNA, 64 nt, Homo Sapiens
uauuucuaaugaaaaaaacuauaacauauuuauuuuuauacauuguuaguaauaaaugccuaua

SEQ ID NO: 519865 - RNA, 64 nt, Homo Sapiens
auuucuaccgagaauuaaaagguuucagagaauguuuauacauugcacuguuuauggcugcuau

SEQ ID NO: 519866 - RNA, 64 nt, Homo Sapiens
agucugcauuugcacuuuuucauggcaaaucagauuuauacaggauaaaauaagcuuggccuag

SEQ ID NO: 519867 - RNA, 64 nt, Homo Sapiens
acgaguugaucucggccagcauauaacuuaugcauuuauacacuccccuuuuuauauaauaauu

SEQ ID NO: 519868 - RNA, 64 nt, Homo Sapiens; identical to SEQ ID NO: 131192

SEQ ID NO: 519869 - RNA, 64 nt, Homo Sapiens; identical to SEQ ID NO: 131193

SEQ ID NO: 519870 - RNA, 64 nt, Homo Sapiens; identical to SEQ ID NO: 131194

SEQ ID NO: 519871 - RNA, 64 nt, Homo Sapiens; identical to SEQ ID NO: 131195

SEQ ID NO: 519872 - RNA, 64 nt, Homo Sapiens; identical to SEQ ID NO: 131196

SEQ ID NO: 519873 - RNA, 64 nt, Homo Sapiens; identical to SEQ ID NO: 131197

SEQ ID NO: 519874 - RNA, 64 nt, Homo Sapiens; identical to SEQ ID NO: 131198

SEQ ID NO: 519875 - RNA, 64 nt, Homo Sapiens; identical to SEQ ID NO: 131199

SEQ ID NO: 519876 - RNA, 64 nt, Homo Sapiens; identical to SEQ ID NO: 131200

SEQ ID NO: 519877 - RNA, 64 nt, Homo Sapiens; identical to SEQ ID NO: 131201

SEQ ID NO: 519878 - RNA, 64 nt, Homo Sapiens; identical to SEQ ID NO: 131202

SEQ ID NO: 519879 - RNA, 64 nt, Homo Sapiens; identical to SEQ ID NO: 131203

SEQ ID NO: 519880 - RNA, 64 nt, Homo Sapiens; identical to SEQ ID NO: 131204

SEQ ID NO: 519881 - RNA, 64 nt, Homo Sapiens; identical to SEQ ID NO: 131205

SEQ ID NO: 519882 - RNA, 64 nt, Homo Sapiens; identical to SEQ ID NO: 131206

SEQ ID NO: 519883 - RNA, 64 nt, Homo Sapiens; identical to SEQ ID NO: 131207

SEQ ID NO: 519884 - RNA, 64 nt, Homo Sapiens
aaugaauggccuucccuucuugaaugauaggugcucaauaaaugaugcugaaugggugaauagu

SEQ ID NO: 519885 - RNA, 64 nt, Homo Sapiens
cugaaugggugaauaguugacacauaguaggcacucaauaaauggagccucgcccagugccugg

SEQ ID NO: 519886 - RNA, 64 nt, Homo Sapiens
cugggccauuaacaaauaaagacaugcaaaaguuucaauaaaaauuauuuuccaaagaguaaua

SEQ ID NO: 519887 - RNA, 64 nt, Homo Sapiens
caaauguauggaaacauuuuacuuugcuuucaaaucaauaaagucuaacugaggcauuucagua

SEQ ID NO: 519888 - RNA, 64 nt, Homo Sapiens
acagauugcuaguauagucaacaguauuuggcuaucaauaaagaaucucuuuaagaucucaccc

SEQ ID NO: 519889 - RNA, 64 nt, Homo Sapiens
acuguccaaaugaauuuuguuguuaauugagaagucaauaaaauggauuaaacugacagaaaaa

SEQ ID NO: 519890 - RNA, 64 nt, Homo Sapiens
ucuuguaaccagauacauaaagagcucuuacaacucaauaaaaggcaaguaauuuaaaaauagg

SEQ ID NO: 519891 - RNA, 64 nt, Homo Sapiens
uguaacaaaauaucacaugcauaaauauuauguaucaauaaaauuuuuuaaugggcaaaggauu

SEQ ID NO: 519892 - RNA, 64 nt, Homo Sapiens
ugacuuuguuugucaguuauuaaaauaaacgcauucaauaaauauguuagaauuuuuugguugu

SEQ ID NO: 519893 - RNA, 64 nt, Homo Sapiens
gacuugcuacguuccguuauacacuuaaaaugacucaauaaaauaaaucuuaaagacacaaugc

SEQ ID NO: 519894 - RNA, 64 nt, Homo Sapiens
ugcuuuuugagauguugagagacauuuuagaaugucaauaaauuuuuacauacguuuguguggu

SEQ ID NO: 519895 - RNA, 64 nt, Homo Sapiens
gcccggacaugucuugcuaauuguaaucuaguugucaauaaaugauuuguuacuguauccucau

SEQ ID NO: 519896 - RNA, 64 nt, Homo Sapiens
guguucuccaaacaugauggaacgaaauuagaaaucaauaaaauuugggaaauucacaaauaug

SEQ ID NO: 519897 - RNA, 64 nt, Homo Sapiens
ugcacuccagcuugagcaacacagugauacugucucaauaaauaaauaaauagaagaaaucaug

SEQ ID NO: 519898 - RNA, 64 nt, Homo Sapiens
uugaacauuuuuuuucuauuuaacagucuaucaaucaauaaauguuauuccaaacauuaaauuu

SEQ ID NO: 519899 - RNA, 64 nt, Homo Sapiens
gcuuccuaauagcagcuuggcccugcucugcuggucaauaaaaccugagcugcuaaaugaauau

SEQ ID NO: 519900 - RNA, 64 nt, Homo Sapiens
ugauuccugaaaguaguaauugaaauuaaagacaucaauaaaaaauuuuauauaauuugguuug

SEQ ID NO: 519901 - RNA, 64 nt, Homo Sapiens
uguuaguaaauaaauggggcaugugaauuauaucucaauaaaguaagugggugaauuauauggu

SEQ ID NO: 519902 - RNA, 64 nt, Homo Sapiens
ugcauaaaccaaugaguuagugauuuauuuuucuucaauaaagucuaauagcucugcuaguaau

SEQ ID NO: 519903 - RNA, 64 nt, Homo Sapiens
aaugaccuguucuuguucuaguauuuuaugcaugucaauaaaggagcagaacagaaaaugugau

SEQ ID NO: 519904 - RNA, 64 nt, Homo Sapiens
auguagacauuuaaaaucaauuaauuuuuucaaaucaauaaauuaauauacauucugcuuugaa

SEQ ID NO: 519905 - RNA, 64 nt, Homo Sapiens
uuuuuuauucugaucuccauaaagugccuacccuucaauaaaacauugacuuguccaaauuuca

SEQ ID NO: 519906 - RNA, 64 nt, Homo Sapiens
gaauugacugaacuucccaaauuucuguaucaauucaauaaauguucuuaaugugccuaaguua

SEQ ID NO: 519907 - RNA, 64 nt, Homo Sapiens
uacgcauucacgcuguaaguuacauuucgaucuuucaauaaagaacuuuccaacuauuauauaa

SEQ ID NO: 519908 - RNA, 64 nt, Homo Sapiens
aauccuaggaaagggcucagccugugauaggcauucaauaaauacuccaaugcugucauuccuu

SEQ ID NO: 519909 - RNA, 64 nt, Homo Sapiens
cugugauuuggggccguuuguacucugcauguauucaauaaauucaauucagcaauaguuauca

SEQ ID NO: 519910 - RNA, 64 nt, Homo Sapiens
caauuugacuauuauaggccagcuuuccauuuagucaauaaaagcguacauuuuuaguuacuua

SEQ ID NO: 519911 - RNA, 64 nt, Homo Sapiens
ugacuauauguaaugcagugcuaucccaauauuuucaauaaaggacuuuaugcauucagugauu

SEQ ID NO: 519912 - RNA, 64 nt, Homo Sapiens
cuuguugaaugaacagccugcacagaguaggugcucaauaaagagcaccuagugcagugcuggg

SEQ ID NO: 519913 - RNA, 64 nt, Homo Sapiens
aucucuagauugguccuugugcugugaucacugaucaauaaauuuacacggcuuugggguacaa

SEQ ID NO: 519914 - RNA, 64 nt, Homo Sapiens
auucacaccuaaauguauacugcuguuguuuauuucaauaaaaauuggcuacuuguauucuuua

SEQ ID NO: 519915 - RNA, 64 nt, Homo Sapiens
uauucuuagauacugaaagaauuuuuaauuuuuuucaauaaagagcuucuggcgaacugauuuu

SEQ ID NO: 519916 - RNA, 64 nt, Homo Sapiens
cacaguucguuuaguuacuguacacucuguuuguucaauaaacugcauaucaacuucccacaaa

SEQ ID NO: 519917 - RNA, 64 nt, Homo Sapiens
ugacuggaauacaccuuuggaacggaauucuuuaucaauaaaguuucacaauccgucccucuuc

SEQ ID NO: 519918 - RNA, 64 nt, Homo Sapiens
agugcugcugcucccgcccgaggcucaugacaacucaauaaagcacugcuuuuauuuuuugcag

SEQ ID NO: 519919 - RNA, 64 nt, Homo Sapiens
gucuucaauuugagaaaggugagaaauaauguuuucaauaaaugagauucauaccauuguugac

SEQ ID NO: 519920 - RNA, 64 nt, Homo Sapiens
aguaaaugcugaaauaaaaugauuaaugcauuuaucaauaaaagccuuugaaaauacuuuggau

SEQ ID NO: 519921 - RNA, 64 nt, Homo Sapiens
aauagucuugcagaaaaugaaugaauaccuuuguucaauaaaggaaauaugcacugcucacuuu

SEQ ID NO: 519922 - RNA, 64 nt, Homo Sapiens
gggaaagauaggacuaaaguugugccaaacuauaucaauaaauuccauguuuagcagaaauagg

SEQ ID NO: 519923 - RNA, 64 nt, Homo Sapiens
uauuaggauaccacuuuucauugcaaaguuugugucaauaaagucauuaauuuuaaacauauau

SEQ ID NO: 519924 - RNA, 64 nt, Homo Sapiens
uaauaauaauaaaaccuuccagugagacuccaucucaauaaaauuacuccagccugggugacag

SEQ ID NO: 519925 - RNA, 64 nt, Homo Sapiens
ccaaaacuguucuuugaaaauugaaaagagaaaaucaauaaaacuagaguaaaaaucagugaaa

SEQ ID NO: 519926 - RNA, 64 nt, Homo Sapiens
ccugaauauguacuuuuaacacaagagagacuauucaauaaaaacucacugggucuuucauguc

SEQ ID NO: 519927 - RNA, 64 nt, Homo Sapiens
uucuuuuuuauauuguccuccaccuccaucauuuucaauaaaagauagggcuuuugcucccuug

SEQ ID NO: 519928 - RNA, 64 nt, Homo Sapiens
auuucucuugaaaauaauuuccucaaagcccaagucaauaaauguuaucagccagucuuccaaa

SEQ ID NO: 519929 - RNA, 64 nt, Homo Sapiens
uaaauauauauaauuuuuauuugucaaauauaccucaauaaagauggaaaaaaaucgaaauuca

SEQ ID NO: 519930 - RNA, 64 nt, Homo Sapiens
uacuuacuacucagcaauaaaaaugaaguaacuuucaauaaaugcaauauuauuggcagacauu

SEQ ID NO: 519931 - RNA, 64 nt, Homo Sapiens
auauauauaaaauuuauuguaugaaaauuaagccucaauaaacgugauuauaaaaaacaagucu

SEQ ID NO: 519932 - RNA, 64 nt, Homo Sapiens
uuaacuauugugauugcugcucuacaguaagugcucaauaaauguaaaaugcugaagugccugg

SEQ ID NO: 519933 - RNA, 64 nt, Homo Sapiens
cucccccucaugaccuaaacugccuucuccguugucaauaaagcugugaacuugccuagaacuc

SEQ ID NO: 519934 - RNA, 64 nt, Homo Sapiens
uuacuucagguuuguggacuguaaauugcucaucucaauaaaaugugcuguaaaguguuuuauu

SEQ ID NO: 519935 - RNA, 64 nt, Homo Sapiens
caucguaaguccaaaauauuccuugacuuacaucucaauaaaccugucuaggaauacagaagcu

SEQ ID NO: 519936 - RNA, 64 nt, Homo Sapiens
uuuauugaaaugucuuugggacaucacugaaauuucaauaaauuuuuuucccccucucuuuaaa

SEQ ID NO: 519937 - RNA, 64 nt, Homo Sapiens
acugagcagcuuuguuugggugcauuaucgguucucaauaaauuuuaaaaacuuuauagggacu

SEQ ID NO: 519938 - RNA, 64 nt, Homo Sapiens
uuucucuagaauauuguuuuuuuguuuucaaccaucaauaaagugaaccuuauguguauuuuau

SEQ ID NO: 519939 - RNA, 64 nt, Homo Sapiens
auaaaauauaaauuaaaaaauugggccaccuauuucaauaaaaaugaguucuguuucacaaguu

SEQ ID NO: 519940 - RNA, 64 nt, Homo Sapiens
uuugugcaauaaguggaagggaugucauccuucuucaauaaaugcugaaugacauucaagcuga

SEQ ID NO: 519941 - RNA, 64 nt, Homo Sapiens
agaccacugagaaaaucuuuauuuacaauaaauuucaauaaaauuugcauaaauauauucccaa

SEQ ID NO: 519942 - RNA, 64 nt, Homo Sapiens
uguuuaacaaguuacccaguuuacugucaagaaaucaauaaauguggucacucacuguguuugg

SEQ ID NO: 519943 - RNA, 64 nt, Homo Sapiens
uguuuaacgaguuaauuucauuauuguuaccagcucaauaaaugaggucauacauuguguuugg

SEQ ID NO: 519944 - RNA, 64 nt, Homo Sapiens
acuacagaauuuagucaacauuuuauauaauguuucaauaaauguuucuuucaauaaagauacu

SEQ ID NO: 519945 - RNA, 64 nt, Homo Sapiens
aacauuuuauauaauguuucaauaaauguuucuuucaauaaagauacuaugugcccuucauagu

SEQ ID NO: 519946 - RNA, 64 nt, Homo Sapiens
ccaauauccuugaugaacauugaugugaaaauccucaauaaaauacuggcaaaccgaauccagc

SEQ ID NO: 519947 - RNA, 64 nt, Homo Sapiens
cccugggaugcaaggcugguucaacauacgcaaaucaauaaauguaauccagcauauaaacaga

SEQ ID NO: 519948 - RNA, 64 nt, Homo Sapiens
gccagcacccaaauaagccuggcaugcaguggccucaauaaaaugugacuguauugagucauuu

SEQ ID NO: 519949 - RNA, 64 nt, Homo Sapiens
ggauuugacagcauauccaaauaugucagcaauuucaauaaacaugacuguacucaacaaacca

SEQ ID NO: 519950 - RNA, 64 nt, Homo Sapiens
uuuauugcguaccuccuauaucucaucuucaccaucaauaaacagaucagcagaaauaggguuu

SEQ ID NO: 519951 - RNA, 64 nt, Homo Sapiens
uauuuugagugccuaagagucauucuuucauucaucaauaaaugaagucagaacuagaauuguu

SEQ ID NO: 519952 - RNA, 64 nt, Homo Sapiens
caugugcuagauuggaguggggaagugugucaaaucaauaaaugaauaaauucaauaaaugccu

SEQ ID NO: 519953 - RNA, 64 nt, Homo Sapiens
uggggaagugugucaaaucaauaaaugaauaaauucaauaaaugccuauaaccagcucugguuu

SEQ ID NO: 519954 - RNA, 64 nt, Homo Sapiens
uggccuuucacuucugccuucuguugagaauuaucaccaugacaccugccauaccguauagaga

SEQ ID NO: 519955 - RNA, 64 nt, Homo Sapiens
acagaguagagaacaacuggcagcuuugaaaaaacaccaugaagaagaaaucguucaucauaag

SEQ ID NO: 519956 - RNA, 64 nt, Homo Sapiens
aaagaaaugaucucugcuucauuugugccucccucaccaugaccccacucuuaccauaguggcu

SEQ ID NO: 519957 - RNA, 64 nt, Homo Sapiens
ccagauuguuucugguucccugccacuauaaaaacaccaugagagcauacucauacauguuccc

SEQ ID NO: 519958 - RNA, 64 nt, Homo Sapiens
gauggguaaauucucagauuaguuaacacaaucccaccaugaggagggcacagauuccccagaa

SEQ ID NO: 519959 - RNA, 64 nt, Homo Sapiens
uuuggugacuugaggcuggacuaccucccaccaccaccaugaaguuggaaggauagacugcccc

SEQ ID NO: 519960 - RNA, 64 nt, Homo Sapiens
caaaggcaagacuuuucaaugugacccacacacucaccaugaggugcaguaucaagcuaacaag

SEQ ID NO: 519961 - RNA, 64 nt, Homo Sapiens
ugcaaaacgagacagaagagagcaagauaguuuccaccaugagguuuuggacaaaauagagagg

SEQ ID NO: 519962 - RNA, 64 nt, Homo Sapiens
gaugcuaguccaaugagcugaugagaaagucucacaccaugaaaauaaauggacaaaugaguaa

SEQ ID NO: 519963 - RNA, 64 nt, Homo Sapiens
guggcuuuuaaaauaaagaacagcaaaaugccugcaccaugacucauuuuguuguucaggucaa

SEQ ID NO: 519964 - RNA, 64 nt, Homo Sapiens
acagggucaucgaccaacaaucggaggcgcaggacaccaugaagucacccgaggggaauggcag

SEQ ID NO: 519965 - RNA, 64 nt, Homo Sapiens
cuguccagccagcaggaugcaucacugcuccugucaccaugauucccucuagguccugugccuc

SEQ ID NO: 519966 - RNA, 64 nt, Homo Sapiens
agugacuagcuucgugcaguuuucauucauaauccaccaugaacuagagauuucucacaaguua

SEQ ID NO: 519967 - RNA, 64 nt, Homo Sapiens
uuugccuuuguggaaaacugacaguucugugcuucaccaugagggaauuucuuggccuacuagg

SEQ ID NO: 519968 - RNA, 64 nt, Homo Sapiens
gguguccuucuaaggagauggguggccccuaacccaccaugacuagucaccaugaggucacugg

SEQ ID NO: 519969 - RNA, 64 nt, Homo Sapiens
ucacugggguggccccuaacgcagauuaauuagucaccaugagguguuuggaaacacagucguu

SEQ ID NO: 519970 - RNA, 64 nt, Homo Sapiens
ccuauggauccgugaccaaugugagggucaacagcaccaugacaacccugcaggugcucacccu

SEQ ID NO: 519971 - RNA, 64 nt, Homo Sapiens
gagugccugugugucuaccucucugaagccugagcaccaugauucccacagccagcucuuggcu

SEQ ID NO: 519972 - RNA, 64 nt, Homo Sapiens
ccaucagguuaauccccuguccccaccccuuagacaccaugacccagagcagguuccuccacug

SEQ ID NO: 519973 - RNA, 64 nt, Homo Sapiens
cuggcuuuccacaaacucucucaccuucucucuucaccaugagauccuugcaugccuccucagc

SEQ ID NO: 519974 - RNA, 64 nt, Homo Sapiens
acagggagugaggggccuuucagccaagaacccacaccaugaagaaggcugacaguucuguugg

SEQ ID NO: 519975 - RNA, 64 nt, Homo Sapiens
gcugcccggggcugagggcagggcuuugcucugacaccaugacagccugccccuuggcuucuca

SEQ ID NO: 519976 - RNA, 64 nt, Homo Sapiens
uauugcagguuuuccuuuggaauauggauaaauacaccaugauacggaaacuagaaggacauca

SEQ ID NO: 519977 - RNA, 64 nt, Homo Sapiens
uaaauacaccaugauacggaaacuagaaggacaucaccaugaugugguagcuugugacuuuucu

SEQ ID NO: 519978 - RNA, 64 nt, Homo Sapiens; identical to SEQ ID NO: 159774

SEQ ID NO: 519979 - RNA, 64 nt, Homo Sapiens; identical to SEQ ID NO: 159775

SEQ ID NO: 519980 - RNA, 64 nt, Homo Sapiens; identical to SEQ ID NO: 159776

SEQ ID NO: 519981 - RNA, 64 nt, Homo Sapiens; identical to SEQ ID NO: 159777

SEQ ID NO: 519982 - RNA, 64 nt, Homo Sapiens; identical to SEQ ID NO: 159778

SEQ ID NO: 519983 - RNA, 64 nt, Homo Sapiens; identical to SEQ ID NO: 159779

SEQ ID NO: 519984 - RNA, 64 nt, Homo Sapiens; identical to SEQ ID NO: 159780

SEQ ID NO: 519985 - RNA, 64 nt, Homo Sapiens; identical to SEQ ID NO: 159781

SEQ ID NO: 519986 - RNA, 64 nt, Homo Sapiens; identical to SEQ ID NO: 159782

SEQ ID NO: 519987 - RNA, 64 nt, Homo Sapiens; identical to SEQ ID NO: 159783

SEQ ID NO: 519988 - RNA, 64 nt, Homo Sapiens; identical to SEQ ID NO: 159784

SEQ ID NO: 519989 - RNA, 64 nt, Homo Sapiens; identical to SEQ ID NO: 159785

SEQ ID NO: 519990 - RNA, 64 nt, Homo Sapiens; identical to SEQ ID NO: 159786

SEQ ID NO: 519991 - RNA, 64 nt, Homo Sapiens; identical to SEQ ID NO: 159787

SEQ ID NO: 519992 - RNA, 64 nt, Homo Sapiens; identical to SEQ ID NO: 159788

SEQ ID NO: 519993 - RNA, 64 nt, Homo Sapiens; identical to SEQ ID NO: 159789

SEQ ID NO: 519994 - RNA, 64 nt, Homo Sapiens; identical to SEQ ID NO: 159790

SEQ ID NO: 519995 - RNA, 64 nt, Homo Sapiens; identical to SEQ ID NO: 159791

SEQ ID NO: 519996 - RNA, 64 nt, Homo Sapiens; identical to SEQ ID NO: 159792

SEQ ID NO: 519997 - RNA, 64 nt, Homo Sapiens; identical to SEQ ID NO: 159793

SEQ ID NO: 519998 - RNA, 64 nt, Homo Sapiens; identical to SEQ ID NO: 159794

SEQ ID NO: 519999 - RNA, 64 nt, Homo Sapiens; identical to SEQ ID NO: 159795

SEQ ID NO: 520000 - RNA, 64 nt, Homo Sapiens; identical to SEQ ID NO: 159796

SEQ ID NO: 520001 - RNA, 64 nt, Homo Sapiens; identical to SEQ ID NO: 159797

SEQ ID NO: 520002 - RNA, 64 nt, Homo Sapiens; identical to SEQ ID NO: 159798

SEQ ID NO: 520003 - RNA, 64 nt, Homo Sapiens; identical to SEQ ID NO: 159799

SEQ ID NO: 520004 - RNA, 64 nt, Homo Sapiens; identical to SEQ ID NO: 159800

SEQ ID NO: 520005 - RNA, 64 nt, Homo Sapiens; identical to SEQ ID NO: 159801

SEQ ID NO: 520006 - RNA, 64 nt, Homo Sapiens; identical to SEQ ID NO: 159802

SEQ ID NO: 520007 - RNA, 64 nt, Homo Sapiens; identical to SEQ ID NO: 159803

SEQ ID NO: 520008 - RNA, 64 nt, Homo Sapiens; identical to SEQ ID NO: 159804

SEQ ID NO: 520009 - RNA, 64 nt, Homo Sapiens; identical to SEQ ID NO: 159805

SEQ ID NO: 520010 - RNA, 64 nt, Homo Sapiens; identical to SEQ ID NO: 159806

SEQ ID NO: 520011 - RNA, 64 nt, Homo Sapiens; identical to SEQ ID NO: 159807

SEQ ID NO: 520012 - RNA, 64 nt, Homo Sapiens; identical to SEQ ID NO: 159808

SEQ ID NO: 520013 - RNA, 64 nt, Homo Sapiens; identical to SEQ ID NO: 159809

SEQ ID NO: 520014 - RNA, 64 nt, Homo Sapiens; identical to SEQ ID NO: 159810

SEQ ID NO: 520015 - RNA, 64 nt, Homo Sapiens; identical to SEQ ID NO: 159811

SEQ ID NO: 520016 - RNA, 64 nt, Homo Sapiens; identical to SEQ ID NO: 159812

SEQ ID NO: 520017 - RNA, 64 nt, Homo Sapiens; identical to SEQ ID NO: 124017

SEQ ID NO: 520018 - RNA, 64 nt, Homo Sapiens; identical to SEQ ID NO: 124018

SEQ ID NO: 520019 - RNA, 64 nt, Homo Sapiens; identical to SEQ ID NO: 124019

SEQ ID NO: 520020 - RNA, 64 nt, Homo Sapiens; identical to SEQ ID NO: 124020

SEQ ID NO: 520021 - RNA, 64 nt, Homo Sapiens; identical to SEQ ID NO: 124021

SEQ ID NO: 520022 - RNA, 64 nt, Homo Sapiens; identical to SEQ ID NO: 124022

SEQ ID NO: 520023 - RNA, 64 nt, Homo Sapiens; identical to SEQ ID NO: 124023

SEQ ID NO: 520024 - RNA, 64 nt, Homo Sapiens; identical to SEQ ID NO: 124024

SEQ ID NO: 520025 - RNA, 64 nt, Homo Sapiens; identical to SEQ ID NO: 124025

SEQ ID NO: 520026 - RNA, 64 nt, Homo Sapiens; identical to SEQ ID NO: 124026

SEQ ID NO: 520027 - RNA, 64 nt, Homo Sapiens; identical to SEQ ID NO: 124027

SEQ ID NO: 520028 - RNA, 64 nt, Homo Sapiens; identical to SEQ ID NO: 124028

SEQ ID NO: 520029 - RNA, 64 nt, Homo Sapiens; identical to SEQ ID NO: 70765

SEQ ID NO: 520030 - RNA, 64 nt, Homo Sapiens; identical to SEQ ID NO: 70766

SEQ ID NO: 520031 - RNA, 64 nt, Homo Sapiens; identical to SEQ ID NO: 70767

SEQ ID NO: 520032 - RNA, 64 nt, Homo Sapiens; identical to SEQ ID NO: 70768

SEQ ID NO: 520033 - RNA, 64 nt, Homo Sapiens; identical to SEQ ID NO: 70769

SEQ ID NO: 520034 - RNA, 64 nt, Homo Sapiens; identical to SEQ ID NO: 70770

SEQ ID NO: 520035 - RNA, 64 nt, Homo Sapiens; identical to SEQ ID NO: 70771

SEQ ID NO: 520036 - RNA, 64 nt, Homo Sapiens; identical to SEQ ID NO: 70772

SEQ ID NO: 520037 - RNA, 64 nt, Homo Sapiens; identical to SEQ ID NO: 70773

SEQ ID NO: 520038 - RNA, 64 nt, Homo Sapiens; identical to SEQ ID NO: 70774

SEQ ID NO: 520039 - RNA, 64 nt, Homo Sapiens; identical to SEQ ID NO: 70775

SEQ ID NO: 520040 - RNA, 64 nt, Homo Sapiens; identical to SEQ ID NO: 70776

SEQ ID NO: 520041 - RNA, 64 nt, Homo Sapiens; identical to SEQ ID NO: 70777

SEQ ID NO: 520042 - RNA, 64 nt, Homo Sapiens; identical to SEQ ID NO: 70778

SEQ ID NO: 520043 - RNA, 64 nt, Homo Sapiens; identical to SEQ ID NO: 70779

SEQ ID NO: 520044 - RNA, 64 nt, Homo Sapiens; identical to SEQ ID NO: 70780

SEQ ID NO: 520045 - RNA, 64 nt, Homo Sapiens; identical to SEQ ID NO: 70781

SEQ ID NO: 520046 - RNA, 64 nt, Homo Sapiens; identical to SEQ ID NO: 70782

SEQ ID NO: 520047 - RNA, 64 nt, Homo Sapiens; identical to SEQ ID NO: 70783

SEQ ID NO: 520048 - RNA, 64 nt, Homo Sapiens; identical to SEQ ID NO: 70784

SEQ ID NO: 520049 - RNA, 64 nt, Homo Sapiens; identical to SEQ ID NO: 70785

SEQ ID NO: 520050 - RNA, 64 nt, Homo Sapiens; identical to SEQ ID NO: 70786

SEQ ID NO: 520051 - RNA, 64 nt, Homo Sapiens; identical to SEQ ID NO: 70787

SEQ ID NO: 520052 - RNA, 64 nt, Homo Sapiens; identical to SEQ ID NO: 70788

SEQ ID NO: 520053 - RNA, 64 nt, Homo Sapiens; identical to SEQ ID NO: 70789

SEQ ID NO: 520054 - RNA, 64 nt, Homo Sapiens; identical to SEQ ID NO: 70790

SEQ ID NO: 520055 - RNA, 64 nt, Homo Sapiens; identical to SEQ ID NO: 70791

SEQ ID NO: 520056 - RNA, 64 nt, Homo Sapiens; identical to SEQ ID NO: 70792

SEQ ID NO: 520057 - RNA, 64 nt, Homo Sapiens; identical to SEQ ID NO: 70793

SEQ ID NO: 520058 - RNA, 64 nt, Homo Sapiens; identical to SEQ ID NO: 70794

SEQ ID NO: 520059 - RNA, 64 nt, Homo Sapiens; identical to SEQ ID NO: 70795

SEQ ID NO: 520060 - RNA, 64 nt, Homo Sapiens; identical to SEQ ID NO: 70796

SEQ ID NO: 520061 - RNA, 64 nt, Homo Sapiens; identical to SEQ ID NO: 70797

SEQ ID NO: 520062 - RNA, 64 nt, Homo Sapiens; identical to SEQ ID NO: 70798

SEQ ID NO: 520063 - RNA, 64 nt, Homo Sapiens; identical to SEQ ID NO: 70799

SEQ ID NO: 520064 - RNA, 64 nt, Homo Sapiens; identical to SEQ ID NO: 70800

SEQ ID NO: 520065 - RNA, 64 nt, Homo Sapiens; identical to SEQ ID NO: 70801

SEQ ID NO: 520066 - RNA, 64 nt, Homo Sapiens; identical to SEQ ID NO: 70802

SEQ ID NO: 520067 - RNA, 64 nt, Homo Sapiens; identical to SEQ ID NO: 70803

SEQ ID NO: 520068 - RNA, 64 nt, Homo Sapiens; identical to SEQ ID NO: 70804

SEQ ID NO: 520069 - RNA, 64 nt, Homo Sapiens; identical to SEQ ID NO: 70805

SEQ ID NO: 520070 - RNA, 64 nt, Homo Sapiens; identical to SEQ ID NO: 70806

SEQ ID NO: 520071 - RNA, 64 nt, Homo Sapiens; identical to SEQ ID NO: 70807

SEQ ID NO: 520072 - RNA, 64 nt, Homo Sapiens; identical to SEQ ID NO: 70808

SEQ ID NO: 520073 - RNA, 64 nt, Homo Sapiens; identical to SEQ ID NO: 70809

SEQ ID NO: 520074 - RNA, 64 nt, Homo Sapiens; identical to SEQ ID NO: 70810

SEQ ID NO: 520075 - RNA, 64 nt, Homo Sapiens; identical to SEQ ID NO: 70811

SEQ ID NO: 520076 - RNA, 64 nt, Homo Sapiens; identical to SEQ ID NO: 70812

SEQ ID NO: 520077 - RNA, 64 nt, Homo Sapiens; identical to SEQ ID NO: 70813

SEQ ID NO: 520078 - RNA, 64 nt, Homo Sapiens; identical to SEQ ID NO: 70814

SEQ ID NO: 520079 - RNA, 64 nt, Homo Sapiens; identical to SEQ ID NO: 70814

SEQ ID NO: 520080 - RNA, 64 nt, Homo Sapiens; identical to SEQ ID NO: 70816

SEQ ID NO: 520081 - RNA, 64 nt, Homo Sapiens; identical to SEQ ID NO: 70817

SEQ ID NO: 520082 - RNA, 64 nt, Homo Sapiens; identical to SEQ ID NO: 70818

SEQ ID NO: 520083 - RNA, 64 nt, Homo Sapiens; identical to SEQ ID NO: 70819

SEQ ID NO: 520084 - RNA, 64 nt, Homo Sapiens; identical to SEQ ID NO: 70820

SEQ ID NO: 520085 - RNA, 64 nt, Homo Sapiens; identical to SEQ ID NO: 70821

SEQ ID NO: 520086 - RNA, 64 nt, Homo Sapiens; identical to SEQ ID NO: 70822

SEQ ID NO: 520087 - RNA, 64 nt, Homo Sapiens; identical to SEQ ID NO: 70823

SEQ ID NO: 520088 - RNA, 64 nt, Homo Sapiens; identical to SEQ ID NO: 70824

SEQ ID NO: 520089 - RNA, 64 nt, Homo Sapiens; identical to SEQ ID NO: 70825

SEQ ID NO: 520090 - RNA, 64 nt, Homo Sapiens; identical to SEQ ID NO: 70826

SEQ ID NO: 520091 - RNA, 64 nt, Homo Sapiens; identical to SEQ ID NO: 70827

SEQ ID NO: 520092 - RNA, 64 nt, Homo Sapiens; identical to SEQ ID NO: 70828

SEQ ID NO: 520093 - RNA, 64 nt, Homo Sapiens; identical to SEQ ID NO: 70829

SEQ ID NO: 520094 - RNA, 64 nt, Homo Sapiens
uucgcaacuguccuuuuggguuacuuuaauuucucauucauaauauaaauauuuugauuugguu

SEQ ID NO: 520095 - RNA, 64 nt, Homo Sapiens
uuaagugauucauguauaccguauaguuaaaaaccauucauauuggcaacuucucuuuaccuca

SEQ ID NO: 520096 - RNA, 64 nt, Homo Sapiens
caauacucaagaaucuugcaagacaguuauuaaacauucauagcuugaaauugcccaugguggg

SEQ ID NO: 520097 - RNA, 64 nt, Homo Sapiens
auaggguuuggcaugcugcucgguacaugguuaacauucauaaauggugggggcccuuacugug

SEQ ID NO: 520098 - RNA, 64 nt, Homo Sapiens
guugauuccuaagcagaaaauuucggaagaagugcauucauacaaagugagaguaggaagacuc

SEQ ID NO: 520099 - RNA, 64 nt, Homo Sapiens
ccagucagagagcacaucuaguucaacaucagagcauucauaccaaagagaacucaugaaugua

SEQ ID NO: 520100 - RNA, 64 nt, Homo Sapiens
aaucaccaggggauuuuuuucaaauuuggcugcacauucauaccgcauguagcucagugguuuc

SEQ ID NO: 520101 - RNA, 64 nt, Homo Sapiens
uggcaguuaaacacauacucacuuugugcuaacccauucauaguugaaaucuuuguucaucucc

SEQ ID NO: 520102 - RNA, 64 nt, Homo Sapiens
gggacagcuaaguaccaaaugacuaauccauugacauucauaauucgcccccaaaaauacugaa

SEQ ID NO: 520103 - RNA, 64 nt, Homo Sapiens
uugcaaauauuacuauuuuccuuuucugacuuaucauucauaagaaauuuaacauuccauguaa

SEQ ID NO: 520104 - RNA, 64 nt, Homo Sapiens
aagaggugacccuguguuuuuugugauauugaggcauucauacagagcugcaguuagacggggu

SEQ ID NO: 520105 - RNA, 64 nt, Homo Sapiens
ggggagucagcagcacccauuuguacauauaggucauucauacaucacauuuuaaauuggggac

SEQ ID NO: 520106 - RNA, 64 nt, Homo Sapiens
uguauauauauguauguauauacacacguacauacauucauauauauacauauauacauaaugu

SEQ ID NO: 520107 - RNA, 64 nt, Homo Sapiens
guucaagaaguauucguacucuagccuuuuuaaucauucauagauagaagucuuuguacccacu

SEQ ID NO: 520108 - RNA, 64 nt, Homo Sapiens
agaagucuuuguacccacuccuuauguuucuuuucauucauaaacagguguauaaggaacaaug

SEQ ID NO: 520109 - RNA, 64 nt, Homo Sapiens
ugaaaauagacuuuuaaaaccuccuuguuugucccauucauauaguuuaaaggugugauuugua

SEQ ID NO: 520110 - RNA, 64 nt, Homo Sapiens
uuugucuagaaggaguaaaaguagaguuuaugaucauucauagcugggugaucauaguuucgag

SEQ ID NO: 520111 - RNA, 64 nt, Homo Sapiens
aagaauucugguguuuacacuauaggcacauuaccauucauagucaguauuagcaauacuggaa

SEQ ID NO: 520112 - RNA, 64 nt, Homo Sapiens
ggauuaaugcauuuugcugcaaaauguaaaacuccauucauaguauaaauauuaggcauaaauu

SEQ ID NO: 520113 - RNA, 64 nt, Homo Sapiens; identical to SEQ ID NO: 100778

SEQ ID NO: 520114 - RNA, 64 nt, Homo Sapiens; identical to SEQ ID NO: 100779

SEQ ID NO: 520115 - RNA, 64 nt, Homo Sapiens; identical to SEQ ID NO: 100780

SEQ ID NO: 520116 - RNA, 64 nt, Homo Sapiens; identical to SEQ ID NO: 100781

SEQ ID NO: 520117 - RNA, 64 nt, Homo Sapiens; identical to SEQ ID NO: 100782

SEQ ID NO: 520118 - RNA, 64 nt, Homo Sapiens; identical to SEQ ID NO: 100783

SEQ ID NO: 520119 - RNA, 64 nt, Homo Sapiens; identical to SEQ ID NO: 100784

SEQ ID NO: 520120 - RNA, 64 nt, Homo Sapiens; identical to SEQ ID NO: 100785

SEQ ID NO: 520121 - RNA, 64 nt, Homo Sapiens; identical to SEQ ID NO: 100786

SEQ ID NO: 520122 - RNA, 64 nt, Homo Sapiens; identical to SEQ ID NO: 100787

SEQ ID NO: 520123 - RNA, 64 nt, Homo Sapiens; identical to SEQ ID NO: 100788

SEQ ID NO: 520124 - RNA, 64 nt, Homo Sapiens; identical to SEQ ID NO: 100789

SEQ ID NO: 520125 - RNA, 64 nt, Homo Sapiens; identical to SEQ ID NO: 100790

SEQ ID NO: 520126 - RNA, 64 nt, Homo Sapiens
gaaaggacagcagucaccuccgacaaugcuccguucuauggaauauugauuaacugcauuuugg

SEQ ID NO: 520127 - RNA, 64 nt, Homo Sapiens
gcauaacuaaacuugucaauuuagaguuuauuuuucuauggauacuauuaaaugucucaaauug

SEQ ID NO: 520128 - RNA, 64 nt, Homo Sapiens
uauuaucagcucacacauguaaacuggagaaaauucuauggaaccaagcucucauuauggacug

SEQ ID NO: 520129 - RNA, 64 nt, Homo Sapiens
acaguuugaggagcaaggucaccaaaguugcuggucuauggacacuaagaagcucccaugugac

SEQ ID NO: 520130 - RNA, 64 nt, Homo Sapiens
aaaucauggcaauaauagaagauuaugaaggauuucuauggaggacauaaaugcugcaucuuuc

SEQ ID NO: 520131 - RNA, 64 nt, Homo Sapiens
uuaucauuaaaauuaucauuaaaauugccuuauuucuauggacucagaggaaugauguuuuagu

SEQ ID NO: 520132 - RNA, 64 nt, Homo Sapiens
cuaucuaacuggcauuuguguuucuugcgaguauuuugaagaaacaggccguugaccccaucuu

SEQ ID NO: 520133 - RNA, 64 nt, Homo Sapiens
augaaguacaucagccugucuuagccugagcugcuuugaagaccauggggucuuguguuuccaa

SEQ ID NO: 520134 - RNA, 64 nt, Homo Sapiens
caacagucuauagaguauuagaagauuuuuacauuuugaagaaggggagcaaaucuaaaaaaaa

SEQ ID NO: 520135 - RNA, 64 nt, Homo Sapiens
agccuuaagaaaaaagaaaaugagcaagcaaauauuugaagaaauguauaaaaccauagauuuc

SEQ ID NO: 520136 - RNA, 64 nt, Homo Sapiens
cucagacuugguuuugccaaaacucuugguaauuuuugaagauagacugucuuaucaccaagga

SEQ ID NO: 520137 - RNA, 64 nt, Homo Sapiens
cuucuuuucaucuguaccacacccuggugaaaccuuugaagacauaaaaaaaaccugucugaga

SEQ ID NO: 520138 - RNA, 64 nt, Homo Sapiens
aaaaaauugaaugauaaauagagaauucauaacauuugaagaucuguucccuguuaccuuuuug

SEQ ID NO: 520139 - RNA, 64 nt, Homo Sapiens
gauauuuuaucucauuugaguauucuuaacaauuuuugaagaaggaauugcacuuuuuaauaaa

SEQ ID NO: 520140 - RNA, 64 nt, Homo Sapiens
caggauaugugauacugugugguugguguggaguuuugaagaaggggcuguguuugggccacgu

SEQ ID NO: 520141 - RNA, 64 nt, Homo Sapiens
uugcaaaauacuuguaucugacacuuaggucuuguuugaagaauuuccuuucuggaagguuuua

SEQ ID NO: 520142 - RNA, 64 nt, Homo Sapiens
uuucuucuagacaucucaaaaaaaggccaaggaguuugaagauugaagaugguuccauggaaga

SEQ ID NO: 520143 - RNA, 64 nt, Homo Sapiens
ucacuucaaccuaacagcuauauauaauggucuauuugaagagcgugcuuuuuuaacacuuaua

SEQ ID NO: 520144 - RNA, 64 nt, Homo Sapiens
ugcuguaucguucagucucuuguggcaauagcacuuugaagaaaauagagaauuuaauauaugg

SEQ ID NO: 520145 - RNA, 64 nt, Homo Sapiens
auuaauuuuggcuggaccaauauaaaaaauuguauuugaagaauugauacuuuaacuuggaccu

SEQ ID NO: 520146 - RNA, 64 nt, Homo Sapiens
gcaugggggccucagggcagccugccuggaguacuuugaagaugucaucccauugucuucugac

SEQ ID NO: 520147 - RNA, 64 nt, Homo Sapiens
uuuuggaaaaaaaaagauuuaaaauaauuccugguuugaagaaauaacaaauuaaaagcuauau

SEQ ID NO: 520148 - RNA, 64 nt, Homo Sapiens
auaaacgguuaacaauauuagguggacauauuuguuugaagagauaggugaaagauaguugaaa

SEQ ID NO: 520149 - RNA, 64 nt, Homo Sapiens
ugauacuuuuucauucacauucaagaauuaauuuuuugaagauuuaaguuacauaauggaauua

SEQ ID NO: 520150 - RNA, 64 nt, Homo Sapiens
guuucaauauagaaggaauuagcuauuaaagguauuugaagaaacuauagguauaguggugaau

SEQ ID NO: 520151 - RNA, 64 nt, Homo Sapiens
aagaguaauuuuucuagauuagaccagucagguuuuugaagacauauagguaacuuccacagaa

SEQ ID NO: 520152 - RNA, 64 nt, Homo Sapiens
uucugguaaugaucugucucaggguauguguauuuuugaagaguguuauguccuuaguuuuaau

SEQ ID NO: 520153 - RNA, 64 nt, Homo Sapiens
ggaacgcuuuccuagugcaauuuuaggaguaaaguuugaagagauaaaaauagccaaagauagg

SEQ ID NO: 520154 - RNA, 64 nt, Homo Sapiens
cacagaacaauguauuagaauuuccagcuguggguuugaagacuuagggggacauccagaacgu

SEQ ID NO: 520155 - RNA, 64 nt, Homo Sapiens
aaauuucuuauuugaaaaguugaaauuuaugagcuuugaagauugcuaaauuaaauaauuuaua

SEQ ID NO: 520156 - RNA, 64 nt, Homo Sapiens
aaaguuguuuuacagcuguguuuuuuugcagugauuugaagaccgugcuauuugucaguagcca

SEQ ID NO: 520157 - RNA, 64 nt, Homo Sapiens
ugagcagugagugaccaggcauaauccagguaacuuugaagagaauuuucagugacuaauaggg

SEQ ID NO: 520158 - RNA, 64 nt, Homo Sapiens
uuuaccuaaaauggugauuuccagccuuuacugcuuugaagaaacagaauuuguaaagguaugc

SEQ ID NO: 520159 - RNA, 64 nt, Homo Sapiens
aaaugagccguaagucugcagaauucccuucuacuuugaagagaaggggauaggaauguauauu

SEQ ID NO: 520160 - RNA, 64 nt, Homo Sapiens
ugacagugccuaaaaguacaauugguaaaggaaauuugaagagacaaaaauugugcuauauauc

SEQ ID NO: 520161 - RNA, 64 nt, Homo Sapiens
gucauuuuuucauucgagucaaaacauggggaauuuugaagauuuuucagcuaugcaauaugac

SEQ ID NO: 520162 - RNA, 64 nt, Homo Sapiens
acauuaaccagaaagcuuaauucuuaauuguuaauuugaagaacaggacagaauuaaccaagga

SEQ ID NO: 520163 - RNA, 64 nt, Homo Sapiens
uuuguguccguaguucuguagugaaaugcuaaauuuugaagaguauagaucuagauauuagcua

SEQ ID NO: 520164 - RNA, 64 nt, Homo Sapiens
gccagcauuuaugguagaauuuccaaaaucauaauuugaagaagcccucuguauggguuagauu

SEQ ID NO: 520165 - RNA, 64 nt, Homo Sapiens
gugaggaaaaccuauguuugccuggauuccucacuuugaagaguuuccaguaguuagcuuucuu

SEQ ID NO: 520166 - RNA, 64 nt, Homo Sapiens
aaauuuuuagccuuaaaguuuuacaucuauacauuuugaagaugcaccuugucaagggcucugu

SEQ ID NO: 520167 - RNA, 64 nt, Homo Sapiens
uacuaugcaauaggguaacuccugacuuaaugguuuugaagauuuaggaaacauugacccagaa

SEQ ID NO: 520168 - RNA, 64 nt, Homo Sapiens
uaaguuuuauaggaauuugcuuccuaagucuacuuuugaagaggaaaacaggaacguaccauau

SEQ ID NO: 520169 - RNA, 64 nt, Homo Sapiens
ugggaagaaaaagauuaagaaaaagcaagauaauuuugaagaaggacgagaggaagaggcauga

SEQ ID NO: 520170 - RNA, 64 nt, Homo Sapiens
cacaugaguuaagauugugacugaucaugauuuauuugaagauggagcacugcugauuuaugaa

SEQ ID NO: 520171 - RNA, 64 nt, Homo Sapiens
ucagacauaaugauuuauuugaaggcuuguuuuauuugaagaaaagcauauugccaaaaauucu

SEQ ID NO: 520172 - RNA, 64 nt, Homo Sapiens
agaaauuuuguuucauauuaggaauaaaguuuauuuugaagaaagauauuguuucuuuagucuc

SEQ ID NO: 520173 - RNA, 64 nt, Homo Sapiens
gggucuggagcugcuacagcauggccaggccugguuugaagaccaucugagggaggcacagcga

SEQ ID NO: 520174 - RNA, 64 nt, Homo Sapiens
gaucuucagccacaugcuguccuugaagcagcuauuugaagauguguuuucugaggaaaacagg

SEQ ID NO: 520175 - RNA, 64 nt, Homo Sapiens
aaccauuagcaugcuaguuguccuaauggaaauuuuugaagaguuuuucaauauauacccuacc

SEQ ID NO: 520176 - RNA, 64 nt, Homo Sapiens
auucauuauagcagaacuuuaaauuucccagcuuuuugaagauuuaagcuacacuauuaguacu

SEQ ID NO: 520177 - RNA, 64 nt, Homo Sapiens
ccaugccagagaauaaacucuuucaagcaucaucuuugaagagucguguggugugaauugguuu

SEQ ID NO: 520178 - RNA, 64 nt, Homo Sapiens
uaaaacuuucacaugcaaccaauguauaucugaguuugaagauguuuauauaggguauuuuuuc

SEQ ID NO: 520179 - RNA, 64 nt, Homo Sapiens
aggaugacuggauacuuuuugaaaucugacuuucuuugaagauguauguuaagcaaaaacaugu

SEQ ID NO: 520180 - RNA, 64 nt, Homo Sapiens
ugaguuauuucagaaaaaacuauaaaagcuauauuuugaagacuuaaucccacuuuacaaagaa

SEQ ID NO: 520181 - RNA, 64 nt, Homo Sapiens
uucucuagccuuccaccagcucuugcuacccucuuuugaagauggagccuccccuaggagcacg

SEQ ID NO: 520182 - RNA, 64 nt, Homo Sapiens
agcaugagaauggacuaauacacuccucaaauguuuugaagauuguugcaccuuggaacuacca

SEQ ID NO: 520183 - RNA, 64 nt, Homo Sapiens
agaaagacaaucucggcaugcauuauuucuuuguuuugaagauucacucauguugcaugcaucu

SEQ ID NO: 520184 - RNA, 64 nt, Homo Sapiens
acauaagugggaaccaaagaaaaaaugugacaaguuugaagacacagaaagagucaucugaugu

SEQ ID NO: 520185 - RNA, 64 nt, Homo Sapiens
cucaauuuuccuuugagggaacccucccccacccuuugaagaguucaaguucuguacagguuuu

SEQ ID NO: 520186 - RNA, 64 nt, Homo Sapiens
uggaaugaagugugaucagccacuuguggaauucuuugaagagcucagaggcuuccaagugauc

SEQ ID NO: 520187 - RNA, 64 nt, Homo Sapiens
ucagaggcuuccaagugaucugcuccugaacaaguuugaagaccuauuguuucauagacccaag

SEQ ID NO: 520188 - RNA, 64 nt, Homo Sapiens
uguguuugcuuacucuugaucaagugugagacaguuugaagacugugcuaccauacaaagugaa

SEQ ID NO: 520189 - RNA, 64 nt, Homo Sapiens
uaagaaguauuaauuuuuuaaaagacaaaucaacuuugaagacacaaaaguuaauuggaagaaa

SEQ ID NO: 520190 - RNA, 64 nt, Homo Sapiens
gauacacucaaccaucuauauauguuuuaaaugcuuugaagacuugauaaaacaaaaacaaaag

SEQ ID NO: 520191 - RNA, 64 nt, Homo Sapiens
cccaguucacucuaguuucaaagaaaaugauaacuuugaagaugucuuuuguuuuuuuauaucc

SEQ ID NO: 520192 - RNA, 64 nt, Homo Sapiens
ucuuucuguccagaaggcaaagauguguuugcaauuugaagauaccaaauuguuuuguggaaau

SEQ ID NO: 520193 - RNA, 64 nt, Homo Sapiens
gaaguguacucucuacaaugcaaagaagauacaguuugaagacaaguuacaucuuaauuccauc

SEQ ID NO: 520194 - RNA, 64 nt, Homo Sapiens
gauucuuucaacaaguaauucuaauuuucuuucuuuugaagauaaaucguuuaaauucucuuuc

SEQ ID NO: 520195 - RNA, 64 nt, Homo Sapiens
cuuuaaagcagugaaucugaucuguuaaaauauauuugaagaccaauuuggaaugaaguaaggu

SEQ ID NO: 520196 - RNA, 64 nt, Homo Sapiens
caggccgaucgccagcuccgcuccugcuccuggguuugaagaugggccuugccagccucugcug

SEQ ID NO: 520197 - RNA, 64 nt, Homo Sapiens
aaagacaugguauuuguucaaaggccuuugauccuuugaagaaguucuucagcuguggguccua

SEQ ID NO: 520198 - RNA, 64 nt, Homo Sapiens
ugccuuuuggguaauguuaauucuuaauucaacauuugaagaugacuguuuugauuuuuggauu

SEQ ID NO: 520199 - RNA, 64 nt, Homo Sapiens
cuggaguaggcuguuauuucaaagcucacaaaccuuugaagaaacuuccugaccacucuuauaa

SEQ ID NO: 520200 - RNA, 64 nt, Homo Sapiens
ucaguuucugccucuuuuuguggugccuuuuuacuuugaagaaagaaagucuagaauggguccc

SEQ ID NO: 520201 - RNA, 64 nt, Homo Sapiens
aguccuguuugcagggaagcgggcucugggagacuuugaagaccgcaaccuggcuaagauagag

SEQ ID NO: 520202 - RNA, 64 nt, Homo Sapiens
ugugggaggaaggaauacauuugaagaaauauauuuugaagagguguuggguguuaugaauucu

SEQ ID NO: 520203 - RNA, 64 nt, Homo Sapiens
uauauuuugaagaggugugggguguuaugaauucuuugaagaaacuguggaucucuacuuguug

SEQ ID NO: 520204 - RNA, 64 nt, Homo Sapiens
uaccuguucuuccagaagaguugaacucucaagcuuugaagaccccuguuuaaauggccccugu

SEQ ID NO: 520205 - RNA, 61 nt, Homo Sapiens
aaagcaacaauaugguauaacaacaagugaauuugaagacucauuuaaaauauuguguuau

SEQ ID NO: 520206 - RNA, 64 nt, Homo Sapiens
acucauuuaaaauauuguguuauuuauaaagucauuugaagaauauucagcacaaaauuaaauu

SEQ ID NO: 520207 - RNA, 64 nt, Homo Sapiens
uuuuauaucaaauauaccguucuauaguacauauuuugaagaauaguacauauuuugaagaauu

SEQ ID NO: 520208 - RNA, 64 nt, Homo Sapiens
uucuauaguacauauuuugauuuuuaguacauauuuugaagaauuuagauucacaaacuuugua

SEQ ID NO: 520209 - RNA, 64 nt, Homo Sapiens
auacauacacucacucugucugguauaggcuaauuuugaagaacucccauaaguuucugcugcu

SEQ ID NO: 520210 - RNA, 64 nt, Homo Sapiens
gucagucuuugaaaaaagaacguauuuuuugugcuuugaagaucucugaagaauuucuuuuaua

SEQ ID NO: 520211 - RNA, 64 nt, Homo Sapiens
auccauauaacaauucaguaacaaagguuuaaaguuugaagauuauuuuuuaaaaagguaaaug

SEQ ID NO: 520212 - RNA, 64 nt, Homo Sapiens
uacugcccacuugucaaguucagcccaccaucuguuugaagauuauaugaaguuuaaauucuag

SEQ ID NO: 520213 - RNA, 64 nt, Homo Sapiens
guucuucauucugacuguugaggggagguuuuccuuugaagaguuuucaucccagacucagcug

SEQ ID NO: 520214 - RNA, 64 nt, Homo Sapiens
accaggaaguugaguuuucaagaugccuuguugcuuugaagaagggagugaugucaauucucuu

SEQ ID NO: 520215 - RNA, 64 nt, Homo Sapiens
gcauaucagacgccuugguuugguggugcugggcuuugaagauacucuagagaaaaccaauaua

SEQ ID NO: 520216 - RNA, 64 nt, Homo Sapiens
ccagccaucguagugcuuuaguacugcuuauuuguuugaagaauuagucuccauaacccccaaa

SEQ ID NO: 520217 - RNA, 64 nt, Homo Sapiens
caaaucuccugugaucuauguguuacaaguuuauuuugaagagauuucaagauaaguguaauuu

SEQ ID NO: 520218 - RNA, 64 nt, Homo Sapiens
aauguggaaaaaguaagaggacuacucagcacuguuugaagauugccucuucuacagcuucuga

SEQ ID NO: 520219 - RNA, 64 nt, Homo Sapiens
uaauuccuuacuuuggcuauggguggagggugaguuugaagagguucugauuuucuuguaaccu

SEQ ID NO: 520220 - RNA, 64 nt, Homo Sapiens
cccauuuuaagaaccgugcauuugaagaaguacuuuugaagacuugguuuucuuagcuuuugaa

SEQ ID NO: 520221 - RNA, 64 nt, Homo Sapiens
uacuuuugaagacucccauuucuuagcuuuugaauuugaagaagaacuguucccucuuugguuu

SEQ ID NO: 520222 - RNA, 64 nt, Homo Sapiens
cuccaucaucuuccgcgcaggugccaacccagccuuugaagaggcuguggggucugugaucacc

SEQ ID NO: 520223 - RNA, 64 nt, Homo Sapiens
ggacaucuuaggcuggccagacuucagcuguuccuuugaagaaaaagacacagacaaagugaca

SEQ ID NO: 520224 - RNA, 64 nt, Homo Sapiens
uugucagguaagacauugugucucuuuucggacuuuugaagauuucagcggaugggcggaaugg

SEQ ID NO: 520225 - RNA, 64 nt, Homo Sapiens
cugcacacguuccuuguccaauucucccauugauuuugaagauuugggguaucucccuggggug

SEQ ID NO: 520226 - RNA, 64 nt, Homo Sapiens
acacuuugaggcaucguguccaauucagagcgaguuugaagaugcuggcugaagauuauacuuu

SEQ ID NO: 520227 - RNA, 64 nt, Homo Sapiens
auacuuuuuuugagacagggaugaagagcuugaguuugaagauuagauuucagccccaucccca

SEQ ID NO: 520228 - RNA, 64 nt, Homo Sapiens
uauggauacagauuauauauucauacccauuguauuugaagauaauauaacaguuugauuucug

SEQ ID NO: 520229 - RNA, 64 nt, Homo Sapiens
guguuaaugucauaauaaagaauugguaauugcauuugaagaauucuguuugguuagagaauaa

SEQ ID NO: 520230 - RNA, 64 nt, Homo Sapiens
uacacagaauuuuuacagaagcuuuuauuaauuuuuugaagaaggccaauaugcaacugauccc

SEQ ID NO: 520231 - RNA, 64 nt, Homo Sapiens
ugucauuuaaucugcuugcuuaaagauugacccauuugaagaucuggcaaaagagaaucaccau

SEQ ID NO: 520232 - RNA, 64 nt, Homo Sapiens
gcuucccaaacggguucuagacuuggguguuugauuugaagaguuacgcauuuauuucacuauu

SEQ ID NO: 520233 - RNA, 64 nt, Homo Sapiens
cuuuuuaaaaagggagugacuuucaugaagucaguuugaagaaggagguugggagcauguuggu

SEQ ID NO: 520234 - RNA, 64 nt, Homo Sapiens
cagugguaggagcagugaagcuguacuuugcuuauuugaagaauuuuucaagggauaaggccuu

SEQ ID NO: 520235 - RNA, 64 nt, Homo Sapiens
aucccuaccccucucccccagagagcuggggugcuuugaagauaaccucugaccuucucaucaa

SEQ ID NO: 520236 - RNA, 64 nt, Homo Sapiens
aaggucacagugauguggagucgccgcacccaucuuugaagauagccagugucccuggaugagg

SEQ ID NO: 520237 - RNA, 64 nt, Homo Sapiens
auuccccccgccaccuguacucacccucacgcucuuugaagaaaaaaaaaaaaaucaccuugug

SEQ ID NO: 520238 - RNA, 64 nt, Homo Sapiens
aagcaaaaacaagaacaaaaaaucauuuguuugcuuugaagaaacuguccauacuuaaagacca

SEQ ID NO: 520239 - RNA, 64 nt, Homo Sapiens
gauugaagagaacguccaccaauggcuuugugcuuuugaagaugaaaaaaaaaaaaaagaaggc

SEQ ID NO: 520240 - RNA, 64 nt, Homo Sapiens
aaauggugcuauauguuuauuuauaaguuagaacuuugaagagggccauguuuggggcuuuauu

SEQ ID NO: 520241 - RNA, 64 nt, Homo Sapiens
uauauuguauguguuuauuccuguguccaaaauuuuugaagauaacaucucuauaugaagauac

SEQ ID NO: 520242 - RNA, 64 nt, Homo Sapiens; identical to SEQ ID NO: 315524

SEQ ID NO: 520243 - RNA, 64 nt, Homo Sapiens; identical to SEQ ID NO: 315525

SEQ ID NO: 520244 - RNA, 64 nt, Homo Sapiens; identical to SEQ ID NO: 315526

SEQ ID NO: 520245 - RNA, 64 nt, Homo Sapiens; identical to SEQ ID NO: 315527

SEQ ID NO: 520246 - RNA, 64 nt, Homo Sapiens; identical to SEQ ID NO: 315528

SEQ ID NO: 520247 - RNA, 64 nt, Homo Sapiens; identical to SEQ ID NO: 315529

SEQ ID NO: 520248 - RNA, 64 nt, Homo Sapiens; identical to SEQ ID NO: 315530

SEQ ID NO: 520249 - RNA, 64 nt, Homo Sapiens; identical to SEQ ID NO: 315531

SEQ ID NO: 520250 - RNA, 64 nt, Homo Sapiens; identical to SEQ ID NO: 315532

SEQ ID NO: 520251 - RNA, 64 nt, Homo Sapiens; identical to SEQ ID NO: 315533

SEQ ID NO: 520252 - RNA, 64 nt, Homo Sapiens; identical to SEQ ID NO: 315534

SEQ ID NO: 520253 - RNA, 64 nt, Homo Sapiens; identical to SEQ ID NO: 315535

SEQ ID NO: 520254 - RNA, 64 nt, Homo Sapiens; identical to SEQ ID NO: 315536

SEQ ID NO: 520255 - RNA, 64 nt, Homo Sapiens; identical to SEQ ID NO: 315537

SEQ ID NO: 520256 - RNA, 64 nt, Homo Sapiens; identical to SEQ ID NO: 315538

SEQ ID NO: 520257 - RNA, 64 nt, Homo Sapiens; identical to SEQ ID NO: 315539

SEQ ID NO: 520258 - RNA, 64 nt, Homo Sapiens
ugaguuauuauaaaaauugguuaauuguauaggaagaugacaguauuuuuuucaaguuaucaua

SEQ ID NO: 520259 - RNA, 64 nt, Homo Sapiens
aguauuuuuuucaaguuaucauaaaaaguaauucagaugacauuugagaaguaggggaaaggga

SEQ ID NO: 520260 - RNA, 64 nt, Homo Sapiens
uuacucaacaaauauuuaucucauaugcaaguaaagaugacaauuggcugggacaguuacuggu

SEQ ID NO: 520261 - RNA, 64 nt, Homo Sapiens
ggggagcaccauccucauuaugggccagggccugagaugacagucacuacucacaccguggucc

SEQ ID NO: 520262 - RNA, 64 nt, Homo Sapiens
gauaggagagaaauaaaagauuugauauuuuuugagaugacacucaagcaucaggcugagauuu

SEQ ID NO: 520263 - RNA, 64 nt, Homo Sapiens
uuugcauuuugccaucugaaguucauuaaucuuuagaugacaaaaaagcaaaaaguucccagaa

SEQ ID NO: 520264 - RNA, 64 nt, Homo Sapiens
caucugaaacccccuccgcaaagcuuugaugaacagaugacaaaaaagcucuagggguuucaga

SEQ ID NO: 520265 - RNA, 64 nt, Homo Sapiens
cacgcaugcuggguauaggcacaaauagcucauuagaugacauuacucuucacuuccucagccu

SEQ ID NO: 520266 - RNA, 64 nt, Homo Sapiens
cuguguugaaauacauuuuuuugauuuuuuccaaagaugacaagauaaggaaacguaauuauga

SEQ ID NO: 520267 - RNA, 64 nt, Homo Sapiens
uagaggggcauucacaaggcacaccagugcaagcagaugacaaaaaggugcagaaggcaaucuu

SEQ ID NO: 520268 - RNA, 64 nt, Homo Sapiens
cuauuuaaaggcacuauuauaaauuuauccuauaagaugacaauguuuacucaaagucuaacau

SEQ ID NO: 520269 - RNA, 64 nt, Homo Sapiens
cgucugucccaaacucccccagcccugagcugggagaugacagggggaaagaggcccucucaag

SEQ ID NO: 520270 - RNA, 64 nt, Homo Sapiens
gcuccuccccggagucccccagcacagucccaggagaugacaggaaggaagcaccagggcaagg

SEQ ID NO: 520271 - RNA, 64 nt, Homo Sapiens
ggauguggguaaacuaagguaaaggggaugauauuccacaaacuaauuaugcacacagaaaauc

SEQ ID NO: 520272 - RNA, 64 nt, Homo Sapiens
ucucuuuucuuacucuggcaaaccugugagugauuccacaaagauacaguauuacuuagcuauc

SEQ ID NO: 520273 - RNA, 64 nt, Homo Sapiens
guuuaguuguagaauaaaacuuugugguggcuuauccacaaacagucaguaagugaaacauuuu

SEQ ID NO: 520274 - RNA, 64 nt, Homo Sapiens
aucuagccaacuaaaauggacaauucuaagaucuuccacaaaacuucccaguaaaugaggcaag

SEQ ID NO: 520275 - RNA, 64 nt, Homo Sapiens
ccaaaccagcucauuucaaccuccagaccuggaauccacaaaagucuuuggacuacguucuugg

SEQ ID NO: 520276 - RNA, 64 nt, Homo Sapiens
uagcggccacaugguuuuuauaccuggguuuuuauccacaaaggcugcauuccaaacagcaucc

SEQ ID NO: 520277 - RNA, 64 nt, Homo Sapiens
cuuaguggcccacaauauauguuagcagcaucaguccacaaacacuagcuaacuccaagagauc

SEQ ID NO: 520278 - RNA, 64 nt, Homo Sapiens
aacagcagaccaacauauagcaagaaugcauuauuccacaaaaauugaaaccuuuuaaggaugc

SEQ ID NO: 520279 - RNA, 64 nt, Homo Sapiens
acaaauguaaagaauguggcaaaccuuuggaugauccacaaaccuuaaugaacaugagaaaauu

SEQ ID NO: 520280 - RNA, 64 nt, Homo Sapiens
caaaugugaagaauauggcaaagccugugaaugguccacaaaccugaaugagcagaagaaaauu

SEQ ID NO: 520281 - RNA, 64 nt, Homo Sapiens
caaaugugaaaaacguggcagagccuucagaccauccacaaaccuuuaugaaaauucauauuug

SEQ ID NO: 520282 - RNA, 64 nt, Homo Sapiens
uaugaaaauucauauuugagaguagaagauucauuccacaaacuuacauugagaagauaugaaa

SEQ ID NO: 520283 - RNA, 64 nt, Homo Sapiens
aaguucuauucugauuuuaauuuaaaaucuugaauccacaaauauuuaaaguguaaaaucauuu

SEQ ID NO: 520284 - RNA, 64 nt, Homo Sapiens
aguauuucuaaauaugccuuucaaacauuaaagauccacaaagcuaguuagaagaauuccuucu

SEQ ID NO: 520285 - RNA, 64 nt, Homo Sapiens
acuacaaauucuugugaguccuaauuccuccuuauccacaaaacagucaauguucccguggagu

SEQ ID NO: 520286 - RNA, 64 nt, Homo Sapiens
uagucauuuggucaaaccaaugacaaaaccgccuuccacaaaaguugaaauaagaaacaagagu

SEQ ID NO: 520287 - RNA, 64 nt, Homo Sapiens
ccaccacuucuuuuauaacuuuucaucucaggccucccucaaccgauucuacauauucuuuaaa

SEQ ID NO: 520288 - RNA, 64 nt, Homo Sapiens
cccagcccacagguguuuauucgccccucauuuaucccucaacccaguuccuucagcuuccauu

SEQ ID NO: 520289 - RNA, 64 nt, Homo Sapiens
ccaauaggaggaucccaggacugcugucuuccccucccucaaccuugcugcucccucaaccuuc

SEQ ID NO: 520290 - RNA, 64 nt, Homo Sapiens
uuccugcugucuuccccuccggccaaguugcugcucccucaaccuaaaguuaaucucuuggucu

SEQ ID NO: 520291 - RNA, 64 nt, Homo Sapiens
agacagagugggggucuccaucuguuuucucuucucccucaaauacaggcuguuuucaucgugu

SEQ ID NO: 520292 - RNA, 64 nt, Homo Sapiens
acuaauauuauauguuacaauaagccuccauuagucccucaaaacgaugauauaaauaagucug

SEQ ID NO: 520293 - RNA, 64 nt, Homo Sapiens
cacuuugccuacuguuagguuccugggguacgggucccucaaacacaagucuugaaucaguccu

SEQ ID NO: 520294 - RNA, 64 nt, Homo Sapiens
gcaagugauuggguaacccggccccucuggcccuucccucaagcccagugaggaggugggugga

SEQ ID NO: 520295 - RNA, 64 nt, Homo Sapiens
aggcaguugcccagccucuugccccaccugcagcucccucaaagcgucacuuuauuucauucgg

SEQ ID NO: 520296 - RNA, 64 nt, Homo Sapiens
caccagaugugacaguguuguuggugacauuuagucccucaagcugagagcaaacuggcuugaa

SEQ ID NO: 520297 - RNA, 64 nt, Homo Sapiens; identical to SEQ ID NO: 64767

SEQ ID NO: 520298 - RNA, 64 nt, Homo Sapiens; identical to SEQ ID NO: 64768

SEQ ID NO: 520299 - RNA, 64 nt, Homo Sapiens; identical to SEQ ID NO: 64769

SEQ ID NO: 520300 - RNA, 64 nt, Homo Sapiens; identical to SEQ ID NO: 64770

SEQ ID NO: 520301 - RNA, 64 nt, Homo Sapiens; identical to SEQ ID NO: 64771

SEQ ID NO: 520302 - RNA, 64 nt, Homo Sapiens; identical to SEQ ID NO: 64772

SEQ ID NO: 520303 - RNA, 64 nt, Homo Sapiens; identical to SEQ ID NO: 64773

SEQ ID NO: 520304 - RNA, 64 nt, Homo Sapiens; identical to SEQ ID NO: 64774

SEQ ID NO: 520305 - RNA, 64 nt, Homo Sapiens; identical to SEQ ID NO: 64775

SEQ ID NO: 520306 - RNA, 64 nt, Homo Sapiens; identical to SEQ ID NO: 64776

SEQ ID NO: 520307 - RNA, 64 nt, Homo Sapiens; identical to SEQ ID NO: 64777

SEQ ID NO: 520308 - RNA, 64 nt, Homo Sapiens; identical to SEQ ID NO: 64778

SEQ ID NO: 520309 - RNA, 64 nt, Homo Sapiens; identical to SEQ ID NO: 64779

SEQ ID NO: 520310 - RNA, 64 nt, Homo Sapiens; identical to SEQ ID NO: 64780

SEQ ID NO: 520311 - RNA, 64 nt, Homo Sapiens; identical to SEQ ID NO: 64781

SEQ ID NO: 520312 - RNA, 64 nt, Homo Sapiens; identical to SEQ ID NO: 64782

SEQ ID NO: 520313 - RNA, 64 nt, Homo Sapiens; identical to SEQ ID NO: 64783

SEQ ID NO: 520314 - RNA, 64 nt, Homo Sapiens; identical to SEQ ID NO: 64784

SEQ ID NO: 520315 - RNA, 64 nt, Homo Sapiens; identical to SEQ ID NO: 64785

SEQ ID NO: 520316 - RNA, 64 nt, Homo Sapiens; identical to SEQ ID NO: 64786

SEQ ID NO: 520317 - RNA, 64 nt, Homo Sapiens; identical to SEQ ID NO: 64787

SEQ ID NO: 520318 - RNA, 64 nt, Homo Sapiens; identical to SEQ ID NO: 64788

SEQ ID NO: 520319 - RNA, 64 nt, Homo Sapiens; identical to SEQ ID NO: 64789

SEQ ID NO: 520320 - RNA, 64 nt, Homo Sapiens; identical to SEQ ID NO: 64790

SEQ ID NO: 520321 - RNA, 64 nt, Homo Sapiens; identical to SEQ ID NO: 64791

SEQ ID NO: 520322 - RNA, 64 nt, Homo Sapiens; identical to SEQ ID NO: 64792

SEQ ID NO: 520323 - RNA, 64 nt, Homo Sapiens; identical to SEQ ID NO: 64793

SEQ ID NO: 520324 - RNA, 64 nt, Homo Sapiens; identical to SEQ ID NO: 64794

SEQ ID NO: 520325 - RNA, 64 nt, Homo Sapiens; identical to SEQ ID NO: 64795

SEQ ID NO: 520326 - RNA, 64 nt, Homo Sapiens; identical to SEQ ID NO: 64796

SEQ ID NO: 520327 - RNA, 64 nt, Homo Sapiens; identical to SEQ ID NO: 64797

SEQ ID NO: 520328 - RNA, 64 nt, Homo Sapiens; identical to SEQ ID NO: 64798

SEQ ID NO: 520329 - RNA, 64 nt, Homo Sapiens; identical to SEQ ID NO: 64799

SEQ ID NO: 520330 - RNA, 64 nt, Homo Sapiens; identical to SEQ ID NO: 64800

SEQ ID NO: 520331 - RNA, 64 nt, Homo Sapiens; identical to SEQ ID NO: 64801

SEQ ID NO: 520332 - RNA, 64 nt, Homo Sapiens; identical to SEQ ID NO: 64802

SEQ ID NO: 520333 - RNA, 64 nt, Homo Sapiens; identical to SEQ ID NO: 64803

SEQ ID NO: 520334 - RNA, 64 nt, Homo Sapiens; identical to SEQ ID NO: 412069

SEQ ID NO: 520335 - RNA, 64 nt, Homo Sapiens; identical to SEQ ID NO: 412070

SEQ ID NO: 520336 - RNA, 64 nt, Homo Sapiens
gccagugcagucugauuucuuuugcuuuugucaguaauggaaucuuuuguuuuuaaaauguaca

SEQ ID NO: 520337 - RNA, 64 nt, Homo Sapiens
augguagacaguucaugcaguauaugaauugccauaauggaaauaaucugauuuuauuuuuaca

SEQ ID NO: 520338 - RNA, 64 nt, Homo Sapiens
uuacaaauuacuagugcuauuuucauuauuauuguaauggaaaaaucuguggacuagaauaaaa

SEQ ID NO: 520339 - RNA, 64 nt, Homo Sapiens
ucacagaaaaauaggcacuuugggccaaaagcucuaauggaacauuuuuaguggugauuugggg

SEQ ID NO: 520340 - RNA, 64 nt, Homo Sapiens
uuuuaucuaauuauuuugguuguuaauauggugauaauggaaagucaaguuaaauuuuaaauau

SEQ ID NO: 520341 - RNA, 64 nt, Homo Sapiens
ccuuuagauaaucaguaugaaaaguucccauuuauaauggaaaugaaaauucuuaacuaaacua

SEQ ID NO: 520342 - RNA, 64 nt, Homo Sapiens
aaucauagcuuacagaugguauaacuguauuauauaauggaauuuucuuuaggugugggaaaac

SEQ ID NO: 520343 - RNA, 64 nt, Homo Sapiens
uuacauauugcuuaucacuuuuucuccauuuuaauaauggaaugaacuaaaauaaacaagaaca

SEQ ID NO: 520344 - RNA, 64 nt, Homo Sapiens
uauaucgaccagaauguugugauuuaaagagaacuaauggaaguggauugaauacagcagucuc

SEQ ID NO: 520345 - RNA, 64 nt, Homo Sapiens
uuucugaccuuguaccucucuuugaugguaaccauaauggaagagauucuggcuagugucuauc

SEQ ID NO: 520346 - RNA, 64 nt, Homo Sapiens
augggaggaaagggacuauaaaaguguacaauguuaauggaaugauacgguaccugaaagccuu

SEQ ID NO: 520347 - RNA, 64 nt, Homo Sapiens
ucuuuguuuagcaaacucacuggaaaugaacacuuaauggaauuuuuaagucuguucuguuagg

SEQ ID NO: 520348 - RNA, 64 nt, Homo Sapiens
cgcaguaauguucugcacaacaguauuguaauuguaauggaaucauaaccugcuaacuaguuug

SEQ ID NO: 520349 - RNA, 64 nt, Homo Sapiens
ccacccaaugaaugaugaugguauaguaugugcauaauggaaaguuaccuuacugaaaaaaaaa

SEQ ID NO: 520350 - RNA, 64 nt, Homo Sapiens
acaacuauuuuuuuaauauuagccuucuagucuguaauggaaauuguauauuuugauagaaguu

SEQ ID NO: 520351 - RNA, 64 nt, Homo Sapiens
aaauuaauaggggaaauggcacuuaauagagguuuaauggaaugaaguacuuucaacccauuga

SEQ ID NO: 520352 - RNA, 64 nt, Homo Sapiens
gucucccugagccuguaguuggaagugacgacuguaauggaaugaugucuuguauagaaaugcc

SEQ ID NO: 520353 - RNA, 64 nt, Homo Sapiens
gacccccuccccugaaaacggccuguguguucuguaauggaacuagcaagggcuccagcaucca

SEQ ID NO: 520354 - RNA, 64 nt, Homo Sapiens
ugggccuagggaggcccaucgguccucaccuuccuaauggaagcgugaggaguggauaaggggu

SEQ ID NO: 520355 - RNA, 64 nt, Homo Sapiens
auucaccaauuuuaaaguuuaauaacuuuuuaguuaauggaagacuucagcauguaucuguaga

SEQ ID NO: 520356 - RNA, 64 nt, Homo Sapiens
caaaacaaaucagguccugagaaaaagugacauuuaauggaaagaaugucaguuacauucagca

SEQ ID NO: 520357 - RNA, 64 nt, Homo Sapiens
cugcaauaauuaguuuuaauggguggccauauaguaauggaaagauguaguuggguggauuuug

SEQ ID NO: 520358 - RNA, 64 nt, Homo Sapiens
guacuccccacaccuaagacggccuuuuguuuauuaauggaagaucuuaguuaauaauacagua

SEQ ID NO: 520359 - RNA, 64 nt, Homo Sapiens
aauaagcuguaagaauugagcagagauuucuucuuaauggaaguaaaauuagaugcagagaauu

SEQ ID NO: 520360 - RNA, 56 nt, Homo Sapiens
gugagugauuagagaaaccccuccaauaauggaauggcaauucuaggggcuuauag

SEQ ID NO: 520361 - RNA, 64 nt, Homo Sapiens
gggucugggauuauuuuaaaagagggagggggguuaauggaacucccugacuguaagugguggg

SEQ ID NO: 520362 - RNA, 64 nt, Homo Sapiens
uaaacugaaaaaaggagcccagacuuagagaugcuaauggaauucaggcccgagcuggcagaag

SEQ ID NO: 520363 - RNA, 64 nt, Homo Sapiens
ugguacaaauuguucauguuauuaaaucuuuuuuuaauggaaugagugcuguuugagggauuuu

SEQ ID NO: 520364 - RNA, 64 nt, Homo Sapiens
ugaaaaccuccacagcaacauuuuuaauauuuuuuaauggaacacaucuggguuggucugugga

SEQ ID NO: 520365 - RNA, 64 nt, Homo Sapiens
uaaugaaacacccugggguugugguaagaauaacuaauggaaaauuuccaggucauuuuuuuuu

SEQ ID NO: 520366 - RNA, 64 nt, Homo Sapiens
agacaaaacacaucuucuuauagaacuuacauuuuaauggaaauacaacuuuguuccuuccucc

SEQ ID NO: 520367 - RNA, 64 nt, Homo Sapiens
cucacuucauuugaauauaaaaauauuguuuccuuaauggaauuuaaaaauuaguugaaaaaaa

SEQ ID NO: 520368 - RNA, 64 nt, Homo Sapiens
auuucauaugaagccaaguccaaacuuaaaauuuuaauggaaacaguuuuuuuuuguuuuaagg

SEQ ID NO: 520369 - RNA, 64 nt, Homo Sapiens
cuguuuguaugugguggcuuggaguggcuguucuuaauggaaaaauguggcuaggcgaggagcu

SEQ ID NO: 520370 - RNA, 64 nt, Homo Sapiens
uccaauuuacagauaguaugguacguuaucacuguaauggaauauaauaacgcaugggaauucu

SEQ ID NO: 520371 - RNA, 64 nt, Homo Sapiens
guuuacagauccccaagccuacacacuuguugauuaauggaaauauguaagacucgggauuagu

SEQ ID NO: 520372 - RNA, 64 nt, Homo Sapiens
cauaaguagaauaggugacccuuccugucacagguaauggaaaagucugcuuucauuccgugug

SEQ ID NO: 520373 - RNA, 64 nt, Homo Sapiens
uaaagaaaaauuacagaauggagaaaccuguaaguaauggaaggugaacuguacuuaaauugca

SEQ ID NO: 520374 - RNA, 64 nt, Homo Sapiens
guagcaaauucacuaaacuuuuuuaauuguccuguaauggaacaugaaguugauauagucucau

SEQ ID NO: 520375 - RNA, 64 nt, Homo Sapiens
ugaaaauuuaacccuuuauuuuuuacagauagaauaauggaaaucuaccuacuuuuaagucuaa

SEQ ID NO: 520376 - RNA, 64 nt, Homo Sapiens
aggaaaaauuagucgaaaaugguauagccgaauauaauggaaauaaucagaaguugcaaaagau

SEQ ID NO: 520377 - RNA, 64 nt, Homo Sapiens
aagauuuggucucucauuuuuuuuucauuuuuuuuaauggaaauaaaagaucaauuuggcacuu

SEQ ID NO: 520378 - RNA, 64 nt, Homo Sapiens
uuaaauaaaauguauacuucuaaauauggcuuauuaauggaaugacuucauacauuuauauaug

SEQ ID NO: 520379 - RNA, 64 nt, Homo Sapiens
cauuuaucggcauuguccaaaauauuuuauucuuuaauggaaaaagccauuaauauucaaauga

SEQ ID NO: 520380 - RNA, 64 nt, Homo Sapiens
ggcggccauggauuugcccuugauucuauuuugcuaauggaagauagaaaggagagaagguuuu

SEQ ID NO: 520381 - RNA, 64 nt, Homo Sapiens
acucuuacugagauacccucucaccccaaauguguaauggaaaauuuuuaauuaagaaaaacuu

SEQ ID NO: 520382 - RNA, 64 nt, Homo Sapiens
guauaauuuauagaauuucagugcaguucauucuuaauggaaaaucugaaaccuaaauugcaga

SEQ ID NO: 520383 - RNA, 60 nt, Homo Sapiens
gaauaaaaguuacuacgugaaaaaucccaguaauggaaugaagguaauauugauaagcua

SEQ ID NO: 520384 - RNA, 64 nt, Homo Sapiens
agacuugaauauuuggcugauauuuucuggaaauuaauggaaugagccucucaccucaagggaa

SEQ ID NO: 520385 - RNA, 64 nt, Homo Sapiens
gcacucaguucuuggcugccguccuguggcagcuuaauggaacaaaaauuacagacuuugguga

SEQ ID NO: 520386 - RNA, 64 nt, Homo Sapiens
aaugauuacuuagaucaauuauuuagcaguggacuaauggaagcuacagagcagggaagggaag

SEQ ID NO: 520387 - RNA, 64 nt, Homo Sapiens
uauaauuugauauucauagaguugugccuaccuuuaauggaaaaauacaugucagauacuuaga

SEQ ID NO: 520388 - RNA, 64 nt, Homo Sapiens
gacauauuaauaaacaauaaagacuuuaccugucuaauggaaaaccuggagaagucgucaggaa

SEQ ID NO: 520389 - RNA, 64 nt, Homo Sapiens
uaccuuucuguucaucaccacacagcagaauuucuaauggaaguuuguugugaauguaaaggag

SEQ ID NO: 520390 - RNA, 64 nt, Homo Sapiens
uguguguaguucuuucaaguuguaggaaacauuuuaauggaauuuaaacucaaaaacuugaaua

SEQ ID NO: 520391 - RNA, 64 nt, Homo Sapiens
uauuugguuuaaaaaaauuauugcaaucucaaguuaauggaauauuuuuaaaucccacauucag

SEQ ID NO: 520392 - RNA, 64 nt, Homo Sapiens
uuuagcaaauauauuuuuauauguguauggcauauaauggaaauaauucuuugagcaacagaag

SEQ ID NO: 520393 - RNA, 64 nt, Homo Sapiens
aaaauaagggauagcuuugcaaccacuauuguuuuaauggaaagcaaaaaacccccccaaacuu

SEQ ID NO: 520394 - RNA, 64 nt, Homo Sapiens
ggcuuuucaguucuguggcuguuuagacuguccguaauggaaugguaaaacuccaugaauuugc

SEQ ID NO: 520395 - RNA, 64 nt, Homo Sapiens
aucauuaguaaaugagucuguaguuacuaaacccuaauggaauaauuauuaaugaaagauuuuu

SEQ ID NO: 520396 - RNA, 64 nt, Homo Sapiens
auugauaugauuauucuuugcuagccucucuuacuaauggaauuauauacuggccaguaaaaug

SEQ ID NO: 520397 - RNA, 64 nt, Homo Sapiens
aggccucugaauggcuaagggcacuagaaauuucuaauggaaaguuuggauuacugcugucuga

SEQ ID NO: 520398 - RNA, 64 nt, Homo Sapiens
aaugcacuacaaaguuaagagguaacuuuuuuuguaauggaagaaaguuaguuugcuuuaagca

SEQ ID NO: 520399 - RNA, 64 nt, Homo Sapiens
ugucuguuuugugguguauaugaaguaaucaaaauaauggaaagaacaagcagauuuuaaauuu

SEQ ID NO: 520400 - RNA, 64 nt, Homo Sapiens
aaggugaagcuuuuuauaaaauaauaagaagucauaauggaaucagguacaggcgggaaacuga

SEQ ID NO: 520401 - RNA, 64 nt, Homo Sapiens
ugccaugaauuaccuggauggucugcccaaugaauaauggaaaaggcagagaaaucuaagcugu

SEQ ID NO: 520402 - RNA, 64 nt, Homo Sapiens
uauauuggaaucuguaucaguggaggacuuugaauaauggaaucuacauuuucccaguaauuug

SEQ ID NO: 520403 - RNA, 64 nt, Homo Sapiens
gagccgguuucuuauccuaaauaggaucaaauucuaauggaauuuccuagcaagacuuuacaag

SEQ ID NO: 520404 - RNA, 64 nt, Homo Sapiens
gcucacucuauacaaaaccaggccuuccagucaauaauggaagaaggucauccauauucuuaca

SEQ ID NO: 520405 - RNA, 64 nt, Homo Sapiens
auuuaaauugaagugacaaauuaagaaauuuucauaauggaaugaagaaauagucucccuucaa

SEQ ID NO: 520406 - RNA, 64 nt, Homo Sapiens
auacagcgaagagacaaucuguagcccagcuugauaauggaacuuaguuagcugucuguugucu

SEQ ID NO: 520407 - RNA, 64 nt, Homo Sapiens
uaacuagugcugugauuuuccuguaacuguaauguaauggaaauuuguggguaaaauguuagaa

SEQ ID NO: 520408 - RNA, 64 nt, Homo Sapiens
ugucaagagggggcaagucaaggaacuggaaugauaauggaaacccuccucccaagcacuucaa

SEQ ID NO: 520409 - RNA, 64 nt, Homo Sapiens
uuuuggcaaauguauauucagaccaacuucauacuaauggaacaugcacuucacuuccacuuca

SEQ ID NO: 520410 - RNA, 64 nt, Homo Sapiens
cuauuucuaauuuuucucuuuaagaacuuauuaauaauggaauauugugaacaauuuagaucuu

SEQ ID NO: 520411 - RNA, 64 nt, Homo Sapiens
ugauuuugccaagcucuuacucacucuguacacguaauggaaacucuuacacuguugcugaagg

SEQ ID NO: 520412 - RNA, 64 nt, Homo Sapiens
uaguguaagcugauaaaaacagaggaaggcuauuuaauggaaguguuuagaaccuaaguauuag

SEQ ID NO: 520413 - RNA, 64 nt, Homo Sapiens
gagagacaaaagcaugguuauaauaaaaggcagcuaauggaaaguaaugaaaggaccaccaaaa

SEQ ID NO: 520414 - RNA, 64 nt, Homo Sapiens
acgaucuccuggucugauuccuuugggucucuaauaauggaaacugcaaggaucagcauaaagu

SEQ ID NO: 520415 - RNA, 64 nt, Homo Sapiens
uuucagaccaugaaugaauguuuccauuuuuuucuaauggaaugugagaguuuacuuuuauuuu

SEQ ID NO: 520416 - RNA, 64 nt, Homo Sapiens
aaaauaaauacgccauuggcaauacuucauaauguaauggaauuguuuggggaacacuuacugu

SEQ ID NO: 520417 - RNA, 64 nt, Homo Sapiens
caaauguaugacuauuuagaguguuuauaagagauaauggaacugaacuuucacucaauuaauu

SEQ ID NO: 520418 - RNA, 64 nt, Homo Sapiens
cuuuuaacuuagagauuaggcugaaaaaaauaaguaauggaauucaccuuugcaucuuuugugu

SEQ ID NO: 520419 - RNA, 64 nt, Homo Sapiens
uguaugugauuuaaaauggaaauagauguguguuuaauggaauugaagucugaaaaggaaguag

SEQ ID NO: 520420 - RNA, 64 nt, Homo Sapiens
aaaaaaaaaaaaagacaaagccucuuaauaaauuuaauggaacuauacauagaacagcagcucu

SEQ ID NO: 520421 - RNA, 64 nt, Homo Sapiens
cgcugaagucagucuuucuucagcuucccuuucauaauggaaaugaacuuauuaucuugagagc

SEQ ID NO: 520422 - RNA, 64 nt, Homo Sapiens
uagcgagauccugucuaaaaaaauaaaaaauaaauaauggaacacagcaaguccuaggaaguag

SEQ ID NO: 520423 - RNA, 64 nt, Homo Sapiens
uucaagaauuaauuuuuugaagauuuaaguuacauaauggaauuaggcauguggaacaccaaac

SEQ ID NO: 520424 - RNA, 64 nt, Homo Sapiens
cuuuaagguauuuuaaaauuuuaaaaaauaagauuaauggaagacugaaacaaaccuagcauuu

SEQ ID NO: 520425 - RNA, 64 nt, Homo Sapiens
ggugucagaugcuggaauuuagcuugucugugauuaauggaauuuauuaucuuacacuuauuca

SEQ ID NO: 520426 - RNA, 64 nt, Homo Sapiens
aauggcaaugugaguagguuuucuucaaauugcauaauggaacaaaaauaaaaggaaaacaugu

SEQ ID NO: 520427 - RNA, 64 nt, Homo Sapiens
guaugguuuaauguguccaaaugaauuaacuacauaauggaaaaggcaggcaggcacucaagaa

SEQ ID NO: 520428 - RNA, 64 nt, Homo Sapiens
ggacaaaaaaaaucaagugcaugaauaaacuugauaauggaaacuauuaauaucaaauucacuu

SEQ ID NO: 520429 - RNA, 64 nt, Homo Sapiens
ucucgguguaaaaagcugaccugcuugucccugguaauggaaugaagaggaaggcuucugucuc

SEQ ID NO: 520430 - RNA, 64 nt, Homo Sapiens
aaaaugaggggaacuucaauuaaacuuagcaucuuaauggaagaucuuucuucaugaucagaca

SEQ ID NO: 520431 - RNA, 64 nt, Homo Sapiens
aaaggggaauucucuuuuccaagguuucuauauguaauggaacaaagcuauuuggaagcuucaa

SEQ ID NO: 520432 - RNA, 64 nt, Homo Sapiens
cacagagguguugcagcguaugacagaacuuggcuaauggaauuaguaguuuucuauguuuuaa

SEQ ID NO: 520433 - RNA, 61 nt, Homo Sapiens
gguauaauuuugcagcuguaucaaaccauucuaauggaaaauuuuuacaggaaccugguaa

SEQ ID NO: 520434 - RNA, 64 nt, Homo Sapiens
ucugcauuaauauaccaucccaaaauauauuuaauaauggaauaugaaaaauccgugaguauuc

SEQ ID NO: 520435 - RNA, 64 nt, Homo Sapiens
aaaguuguuacuuuuuucuagaagaccaaguagauaauggaaccgcuccuucaucguaaauuua

SEQ ID NO: 520436 - RNA, 64 nt, Homo Sapiens
cuauuuuauaaugguacguuccaguauguauuuuuaauggaacccuaaaacacaaauacaacug

SEQ ID NO: 520437 - RNA, 64 nt, Homo Sapiens
gaacucggcuguuaggccauaaagcagaaugaauuaauggaaaauuugaaugagggauaaauag

SEQ ID NO: 520438 - RNA, 64 nt, Homo Sapiens
cacaaaacuuaagauggcccuugcacaugaauguuaauggaaaaaaacuuuugccuguaagaau

SEQ ID NO: 520439 - RNA, 64 nt, Homo Sapiens
aaaaauucucauuauuugcauaacauaggacaauuaauggaaaagacaggaaaauucuccuuga

SEQ ID NO: 520440 - RNA, 64 nt, Homo Sapiens
auuauugguguuuacccagucaucuuuaggagacuaauggaaaucauaggaaguauggcaugaa

SEQ ID NO: 520441 - RNA, 64 nt, Homo Sapiens
augaaaggaagugacaauacucagccuuacccuuuaauggaaaaucaucuuaaaaugcuacccu

SEQ ID NO: 520442 - RNA, 64 nt, Homo Sapiens
accaggcacagaaacagacaauuuuugaguuuuguaauggaagaguauacacaagaaaugucau

SEQ ID NO: 520443 - RNA, 64 nt, Homo Sapiens
uagagaacucuuucaucccuggggggaaugaaaauaauggaauuagagaaucuaauuguugccc

SEQ ID NO: 520444 - RNA, 64 nt, Homo Sapiens
gguguuggcauuggugucugugagcaagaugauguaauggaaagguacagaaugcuauuucacu

SEQ ID NO: 520445 - RNA, 64 nt, Homo Sapiens
gcguccccggccacgucugugcucuguccuuguguaauggaaugcaaaaaagccaagcccuccg

SEQ ID NO: 520446 - RNA, 64 nt, Homo Sapiens
ccagucugucuguuguacugguaauuuaacucuguaauggaauaguuugcugccaacuauuuau

SEQ ID NO: 520447 - RNA, 64 nt, Homo Sapiens
ccucuuccaacccuccauuagcucaauuuugagauaauggaaaauugacuggaaauucaaaacu

SEQ ID NO: 520448 - RNA, 64 nt, Homo Sapiens
uucaguauuuugagaauugccauauuaauuuuuauaauggaaaacuuaauaaauugcuacuguu

SEQ ID NO: 520449 - RNA, 64 nt, Homo Sapiens
aaauuuuuaggaccaauacaaaauaacaaaaauguaauggaaucagacugaauuaaaguaaggc

SEQ ID NO: 520450 - RNA, 64 nt, Homo Sapiens
gcugauuucgagaacuuucaaaaucucacauagcuaauggaaguugcuuucugcuuucuuauga

SEQ ID NO: 520451 - RNA, 64 nt, Homo Sapiens
uuccaauggaaauauuauauaccacauuuuuuguuaauggaaauaaaugucuucauucccaugu

SEQ ID NO: 520452 - RNA, 64 nt, Homo Sapiens
auuuuuucaaguuguaaauaauuuauuuaauauuuaauggaaguguauuuauuuuacagcucau

SEQ ID NO: 520453 - RNA, 64 nt, Homo Sapiens
cuaauugaauauaucuaugagggcauguauuaguuaauggaaaaaaaaauacaacacuaacaau

SEQ ID NO: 520454 - RNA, 64 nt, Homo Sapiens
uauuucuucauuguaccuuaguccaggaagaaauuaauggaauauggugugcuaauuaucacua

SEQ ID NO: 520455 - RNA, 64 nt, Homo Sapiens
aaguaaacugcuuaucccgauccugugccccucauaauggaagagaaggcuguguuuauucuuu

SEQ ID NO: 520456 - RNA, 64 nt, Homo Sapiens
uucaaaggacgggaguauucccccauugugcucuuaauggaaaugagcauccugguauaauuac

SEQ ID NO: 520457 - RNA, 64 nt, Homo Sapiens
auauuugcauguaacccaaaagcccugucucaacuaauggaaauaccaguguagugcaggaaac

SEQ ID NO: 520458 - RNA, 64 nt, Homo Sapiens
gcuucacuguuucuuggugaaaauauuacggcaauaauggaacuccuagguaagaguaaaugag

SEQ ID NO: 520459 - RNA, 64 nt, Homo Sapiens
aaaacgguauaauuaauaauucaagaguuccauuuaauggaaauuucauucuauucuuuuucuc

SEQ ID NO: 520460 - RNA, 64 nt, Homo Sapiens
uaagcuuuauguuucaagaaaaauggcauacagauaauggaaaagggaauauugaaagguuuua

SEQ ID NO: 520461 - RNA, 64 nt, Homo Sapiens
aacuacuguagacuauugaauauagagacaauuuuaauggaaauuuaccuuuuaaaguuuagua

SEQ ID NO: 520462 - RNA, 64 nt, Homo Sapiens
uagacaauguauguacaauccaaauagaggagcuuaauggaauccuuuuaggagacugguuggu

SEQ ID NO: 520463 - RNA, 64 nt, Homo Sapiens
uucauuaagggcuaauagauuuccauuuuucaauuaauggaaagggaaugcuacuauaccuacu

SEQ ID NO: 520464 - RNA, 64 nt, Homo Sapiens
aaaaaauuauguucaaauuuguacauuaaugaaauaauggaacuugugguuagagggaaagaac

SEQ ID NO: 520465 - RNA, 64 nt, Homo Sapiens
gauuucaaaaucuaccagcagacaagaauauagauaauggaaaacagaauacuguccuuuuuuu

SEQ ID NO: 520466 - RNA, 64 nt, Homo Sapiens
uuuuacuacugagggaaauagccaaaaaggcaaauaauggaaaaauaguaaacauuaaguaaau

SEQ ID NO: 520467 - RNA, 64 nt, Homo Sapiens
uugauacuauaauagaaugagacauaaaaugaauuaauggaaacauauccacacuguacuguga

SEQ ID NO: 520468 - RNA, 64 nt, Homo Sapiens
uucuguacugcuuaugguuguaggauucagggguuaauggaaucacagaaaugauauucugcaa

SEQ ID NO: 520469 - RNA, 64 nt, Homo Sapiens
ugaccauuuuucuguugcauuagaccuuuacagguaauggaacaugagcuucacccauauuaaa

SEQ ID NO: 520470 - RNA, 64 nt, Homo Sapiens
cuuaaacauaaaugucaauauauauuuaaaauaauaauggaaacauaggaaaucagcuauuuaa

SEQ ID NO: 520471 - RNA, 64 nt, Homo Sapiens
auguuuuaaugaaauucuuaaauuaacaucuuuuuaauggaacauuuaagugaauauaugaaua

SEQ ID NO: 520472 - RNA, 64 nt, Homo Sapiens
uuaacuugguugcuaauuacaagaaugaaaauuauaauggaaaaggacaaaauaauauaccagc

SEQ ID NO: 520473 - RNA, 64 nt, Homo Sapiens
cagccacugacugcuuggguugggcugugaaugauaauggaauggcuggagucugcuguuguca

SEQ ID NO: 520474 - RNA, 64 nt, Homo Sapiens
ccugggaacagggaggaugggauuaguggaagcuuaauggaaaaggaaaguuaugauccuccaa

SEQ ID NO: 520475 - RNA, 64 nt, Homo Sapiens
uuuuuuaacagcaauggaggaaguuaacaauuuuuaauggaaagagcauguuagagcaaacaaa

SEQ ID NO: 520476 - RNA, 64 nt, Homo Sapiens
acugccuuacuguacauacaccacagcaggaugcuaauggaauuagacuaacuugaaaagaaaa

SEQ ID NO: 520477 - RNA, 59 nt, Homo Sapiens
auugguuaaaaugugauuuuuagcuugacuaauggaauguuacacacuccuuucacuga

SEQ ID NO: 520478 - RNA, 64 nt, Homo Sapiens
cagauuuuucaucauaucauuaauuuuauaaauauaauggaaaauuugcaaugacacaugaauu

SEQ ID NO: 520479 - RNA, 64 nt, Homo Sapiens
augagccugcauaaagugaacuucaaauauuguuuaauggaauguguauuugauugauucgagu

SEQ ID NO: 520480 - RNA, 64 nt, Homo Sapiens
ccuucucaggucauucacggagcagggauguagguaauggaaagcaaauggcuuagacuaaaug

SEQ ID NO: 520481 - RNA, 64 nt, Homo Sapiens
uuuggcauaaagggcauuugcccucaaaaaaagcuaauggaauagaaucauuuugugaaugucc

SEQ ID NO: 520482 - RNA, 64 nt, Homo Sapiens
cuguuacucaggcugguagcuguuguuauauuuuuaauggaaaucuguuuuuuuugguuguccu

SEQ ID NO: 520483 - RNA, 64 nt, Homo Sapiens
caacuugauauacaaguuuauaaaguagaauaaauaauggaaagaucauaguuguauauauuuu

SEQ ID NO: 520484 - RNA, 64 nt, Homo Sapiens
cauguucacauccugugaacuuuuuuggcuuuuguaauggaaucuuguuguuuuuacuuuuuuu

SEQ ID NO: 520485 - RNA, 64 nt, Homo Sapiens
uaaaccugaaauugguguguaaaaauuguuguuuuaauggaauggacuuccaacuagacaaaga

SEQ ID NO: 520486 - RNA, 64 nt, Homo Sapiens
uugucuuugaccuugaauuuaaauuuucaauaguuaauggaaagcacauccauucuugcuguuu

SEQ ID NO: 520487 - RNA, 64 nt, Homo Sapiens
uguagaucaaugaauaagacucuauaauuucaauuaauggaaguauuaaaacagugaagacuuc

SEQ ID NO: 520488 - RNA, 64 nt, Homo Sapiens
gggaagagcaacaguaacucaccauauaucgaccuaauggaaaucuuguacaguauugccauga

SEQ ID NO: 520489 - RNA, 64 nt, Homo Sapiens
cucauguaagauguugcuaggauguaacacuagguaauggaaaauagaguaugauuuuaacaau

SEQ ID NO: 520490 - RNA, 64 nt, Homo Sapiens
gguucguccugagucaucuaugauuaauuuccauuaauggaaauaaggcauggcaccuauaccu

SEQ ID NO: 520491 - RNA, 64 nt, Homo Sapiens
aaaaugcggaugccuacaguauaaacagauuauguaauggaagagauauugccaacuuaaucag

SEQ ID NO: 520492 - RNA, 64 nt, Homo Sapiens
ugauuugaguucacugugcuuccugggacuauuguaauggaauaugggagucugucuaaugaag

SEQ ID NO: 520493 - RNA, 64 nt, Homo Sapiens
caccgucaacaugaauucgcacacauucaguaacuaauggaacacuaccguggagaggauuuug

SEQ ID NO: 520494 - RNA, 64 nt, Homo Sapiens
cauauauucaacaugaauuuuaucauucuccuccuaauggaaugucuuccuuauagaaauguuc

SEQ ID NO: 520495 - RNA, 64 nt, Homo Sapiens
gaaacuuuaaaauuuauuuugguuuaucccaaaauaauggaaaauguccaguuguguuuuguaa

SEQ ID NO: 520496 - RNA, 58 nt, Homo Sapiens
uugucaaggucuauaauuagaauacaacuaauggaaacaucuauaaagaagaauacau

SEQ ID NO: 520497 - RNA, 55 nt, Homo Sapiens
auaccaauaagucagccugaugcucuaauggaaaaauggcccucuucaagccugg

SEQ ID NO: 520498 - RNA, 64 nt, Homo Sapiens
guuggaauggcuauccuacuaugcuguucuuugguaauggaauaaauugacccaaggaccgaau

SEQ ID NO: 520499 - RNA, 64 nt, Homo Sapiens
uuugagaucuuuguuuauguuuauuagaagaggguaauggaaacugaucauggaaacauuuaaa

SEQ ID NO: 520500 - RNA, 64 nt, Homo Sapiens
ggugaaaaaguuagauauucuagacuuguuuuaguaauggaaacucuuaccuccacauauuauc

SEQ ID NO: 520501 - RNA, 64 nt, Homo Sapiens
guuaauaguuuuaagugaauuuuugaccuuaucuuaauggaaaacgguuaacuccaaacacaaa

SEQ ID NO: 520502 - RNA, 64 nt, Homo Sapiens
ucaguauuuguguuuuuacauuuuaugguuaauuuaauggaagaugaaagggcauugcaaaguu

SEQ ID NO: 520503 - RNA, 64 nt, Homo Sapiens
uaauggauaucuguauucaauauuugacaaaaucuaauggaaaccauccauuuacucaugauaa

SEQ ID NO: 520504 - RNA, 64 nt, Homo Sapiens
uacaguaaaucucccaggccuucagauuucuacauaauggaagaauauguuuuuaacccugaga

SEQ ID NO: 520505 - RNA, 64 nt, Homo Sapiens
caugcaauugcauaauuguucugaggguuauggauaauggaauauguguuuguacauuccuguu

SEQ ID NO: 520506 - RNA, 64 nt, Homo Sapiens
caauaacuaucaaauuggcuaucagaauucacuguaauggaauuuugccucuaauaacauaaag

SEQ ID NO: 520507 - RNA, 64 nt, Homo Sapiens
uugaaucaaacugaaaaaguauuuccuuauagcuuaauggaaaggcuacuaggaaaaaccagaa

SEQ ID NO: 520508 - RNA, 64 nt, Homo Sapiens
acccaauaugaaacaucuucucccaacacugcuuuaauggaaguucuaggaaccaauuuagcuc

SEQ ID NO: 520509 - RNA, 64 nt, Homo Sapiens
cucuugcuguucugaggccuuaaaaccaaaaaaauaauggaaugauugcaucacugcgaggaag

SEQ ID NO: 520510 - RNA, 64 nt, Homo Sapiens
uaugaucuuaagaaauuacuuaccaggguuacuguaauggaauucagaacuuuauagaguugcc

SEQ ID NO: 520511 - RNA, 64 nt, Homo Sapiens
accacuuuuaucuauucuuuagggaauggaacuuuaauggaagaugcccucaucagcugagggc

SEQ ID NO: 520512 - RNA, 64 nt, Homo Sapiens
aaagcuaaugcucuaguugacauuguagcaaagcuaauggaaauuguccauauauguuaauuuu

SEQ ID NO: 520513 - RNA, 64 nt, Homo Sapiens
aaauggauuuagaauaauaaaauguauaacauguuaauggaaaaaaucaugguuaguaaacacu

SEQ ID NO: 520514 - RNA, 64 nt, Homo Sapiens
aacuugaccaaaaauuugucaaaucaguacuuuuuaauggaaacuuuuaaguuauuaguuuuua

SEQ ID NO: 520515 - RNA, 64 nt, Homo Sapiens
ccuuuccugcuauaaaggagagaauuucuacaauuaauggaauuaccaaagcugaaauuuaaug

SEQ ID NO: 520516 - RNA, 64 nt, Homo Sapiens
uguaaauagaaacguguauacaaacuaauagaauuaauggaauaauuggacuuaaaaucuaauu

SEQ ID NO: 520517 - RNA, 64 nt, Homo Sapiens
caaggaaagugaaacuuugggacauuacaauguguaauggaaacccugagucaagaguugagga

SEQ ID NO: 520518 - RNA, 64 nt, Homo Sapiens
auauaccuauucuugaaguauaaugaucaagguauaauggaaaaguaagaauugcaucuuuaca

SEQ ID NO: 520519 - RNA, 64 nt, Homo Sapiens
auugguaucuugcacccgugggagucgggacauauaauggaaaggcccucgggaaguuccgcgu

SEQ ID NO: 520520 - RNA, 64 nt, Homo Sapiens
uugucuuggaaauuuguuguaaaagccauauuucuaauggaaaaucagguguuuacaggaaaga

SEQ ID NO: 520521 - RNA, 64 nt, Homo Sapiens
uucuuuguguaugcauguuugaauuaaaagaaaguaauggaagaauugaucgaugaauuaagug

SEQ ID NO: 520522 - RNA, 64 nt, Homo Sapiens
acuugaaacauuuuauguauuaguuuugaaauaauaauggaaaguggcuaugcaguuugaauau

SEQ ID NO: 520523 - RNA, 64 nt, Homo Sapiens
auguacacuggauauguuguuaaacacgugucuauaauggaaacauuuacaauaaauauucugc

SEQ ID NO: 520524 - RNA, 64 nt, Homo Sapiens
auucuacaguuaaccauuagcaugcuaguuguccuaauggaaauuuuugaagaguuuuucaaua

SEQ ID NO: 520525 - RNA, 64 nt, Homo Sapiens
uguuuggaguggagaagggcagcaccucuguguuuaauggaaauagcccauagucuccuggauu

SEQ ID NO: 520526 - RNA, 64 nt, Homo Sapiens
uuaaacuuuggccugaacaguuuuuucuuuuucuuaauggaagaagauauuuaauaucuuaaaa

SEQ ID NO: 520527 - RNA, 64 nt, Homo Sapiens
guuccccuggaaaagcugcuguauuuuuaauuuuuaauggaauguagcuuuuaaaauccuguca

SEQ ID NO: 520528 - RNA, 64 nt, Homo Sapiens
gauauacucuuuuaaguuuagccccaauauaggguaauggaaauuuccugcccucuggguuccc

SEQ ID NO: 520529 - RNA, 64 nt, Homo Sapiens
ucagcacaaguugggggaggcaggcaauggaauauaauggaauauucuugagacugaucacaaa

SEQ ID NO: 520530 - RNA, 64 nt, Homo Sapiens
ugccuaacuuauuggagcacaucaguuucuuggguaauggaaaacauuaccuagaguugccagu

SEQ ID NO: 520531 - RNA, 64 nt, Homo Sapiens
uauauuuuuauauaagacguagaggauauaagauuaauggaauguugcauuuuagugguuaggg

SEQ ID NO: 520532 - RNA, 64 nt, Homo Sapiens
aaagacugaugaagaaauuuauaaucaaagcucauaauggaaaauuaauaacagcuccuuuauu

SEQ ID NO: 520533 - RNA, 64 nt, Homo Sapiens
uacaacuguuuuaaaacuuugaucucuuucucuuuaauggaauccauuuuccucucccgaagga

SEQ ID NO: 520534 - RNA, 64 nt, Homo Sapiens
auaaauaagaaagaauguuuagaaagacuuuagguaauggaaauuggaguuaguauuugugagu

SEQ ID NO: 520535 - RNA, 64 nt, Homo Sapiens
uaacauuaaacaccaaauauucucgauuuccuuuuaauggaaaaagucagccauucuccaagga

SEQ ID NO: 520536 - RNA, 64 nt, Homo Sapiens
auaagucuaggaguuagaaacauucuuuauauaguaauggaaacuguuauuuauuuguuuggcu

SEQ ID NO: 520537 - RNA, 64 nt, Homo Sapiens
uguguucugagggucauuaugcuucauuucuacuuaauggaacuuaaaaaagaaaacauaugau

SEQ ID NO: 520538 - RNA, 64 nt, Homo Sapiens
accuugcuccuacuucuuuuaggucuuuauuuuguaauggaauucuuuguacuuuuccaagcuc

SEQ ID NO: 520539 - RNA, 64 nt, Homo Sapiens
aauuuuuuaaaaaauuuuaaagguacuacauuuauaauggaaggccaaacauucuccaguaagc

SEQ ID NO: 520540 - RNA, 64 nt, Homo Sapiens
cuuuauuuaagcacuuaggcauguguauuuugcuuaauggaauguccaguguguaauccgcucc

SEQ ID NO: 520541 - RNA, 64 nt, Homo Sapiens
caacuccaaaucaauucuaaaaacuucaagcacuuaauggaaagguaaauggucagauaaaaau

SEQ ID NO: 520542 - RNA, 64 nt, Homo Sapiens
cauucaacacaaaauaaacuagaaggccagaggauaauggaauaaaagaucauugcaauuacuu

SEQ ID NO: 520543 - RNA, 64 nt, Homo Sapiens
uagaauaccuaugguuagggcuucugaacuaaaauaauggaaaauuuuaacaauuuguauagug

SEQ ID NO: 520544 - RNA, 64 nt, Homo Sapiens
gagacauaugugugcguguggaugucuacaugguuaauggaaagcacugugcucugaaguggau

SEQ ID NO: 520545 - RNA, 64 nt, Homo Sapiens
gcuuaguuguuuuugagauuuuuuagucaacacauaauggaaacuucuuucuucuaaaaguugc

SEQ ID NO: 520546 - RNA, 64 nt, Homo Sapiens
uuauaauaaagagcaauuuguaacugaguggcacuaauggaagaaagugcugcucaaaggaagu

SEQ ID NO: 520547 - RNA, 64 nt, Homo Sapiens
caagugaguugaauaguugcuuaauuuugauuuuuaauggaaaguuguauccauuaaccugggc

SEQ ID NO: 520548 - RNA, 64 nt, Homo Sapiens
aauuuaguaauggacuauacugggugcuaauugauaauggaaauuaagaaugcaucuuuauaaa

SEQ ID NO: 520549 - RNA, 64 nt, Homo Sapiens
gaguagugauaugaaaaugggaugaauugguaaauaauggaaauuguuuccaaguugcaucaaa

SEQ ID NO: 520550 - RNA, 64 nt, Homo Sapiens
aaguuaaguaggugccagaacuguugggugaauuuaauggaaucguaauaucuucucuggaggc

SEQ ID NO: 520551 - RNA, 64 nt, Homo Sapiens
auguauaacaagccaaacaucauuugucacugaauaauggaauugucucugauuugcaaaugca

SEQ ID NO: 520552 - RNA, 64 nt, Homo Sapiens
aaaaaaaagaggaaaacccuuucuuuauauacaauaauggaaaauaauauuaaaagucacaaug

SEQ ID NO: 520553 - RNA, 64 nt, Homo Sapiens
auggcuggacuuucuuuugaaguugccauggauauaauggaauucauuagcauuaacaggugau

SEQ ID NO: 520554 - RNA, 64 nt, Homo Sapiens
aaaauaggcagauuuccuuuagauaauauuuuucuaauggaaauaguggaacaaaauguuauau

SEQ ID NO: 520555 - RNA, 64 nt, Homo Sapiens
uuuguagcauuuuucuaauaaaaauauauauuuuuaauggaaaguauuaugacaaaugaaagag

SEQ ID NO: 520556 - RNA, 64 nt, Homo Sapiens
ucuagguugaccuuguguuuuagaaauuugcacuuaauggaauuugcauuucagagauguguua

SEQ ID NO: 520557 - RNA, 64 nt, Homo Sapiens
uagcguuagaggaaacacauagagcuggaacuguuaauggaaagcagucacagcugaguuuucg

SEQ ID NO: 520558 - RNA, 64 nt, Homo Sapiens
uacuauaccaguaagugccacuucugugucuuucuaauggaaaugaguagaauugcugaaaguc

SEQ ID NO: 520559 - RNA, 64 nt, Homo Sapiens
uuccgucauuuaauguuuucaacuguaauugucuuaauggaaauguuaaaauucauaucugauu

SEQ ID NO: 520560 - RNA, 64 nt, Homo Sapiens
ugaguugggaaaagagguggcauuucugaucggauaauggaauacucucauuuauuuuaugaca

SEQ ID NO: 520561 - RNA, 64 nt, Homo Sapiens
ucuuuuaagaugcugucuuacauuaaugagcaucuaauggaaagaagguaugaguugcacugag

SEQ ID NO: 520562 - RNA, 64 nt, Homo Sapiens
aggaaucaccguuuugagaguuaaagaggucuuauaauggaacuacagaauugcauuuuugcuu

SEQ ID NO: 520563 - RNA, 64 nt, Homo Sapiens
uccauuuucaaacugaagcauuuuggaacaaagauaauggaaccacaccuauaaaaacccaaau

SEQ ID NO: 520564 - RNA, 64 nt, Homo Sapiens
gaacauugguagguaacaagaguauugaauuuuauaauggaacaaauguuagcuaugaaauuuu

SEQ ID NO: 520565 - RNA, 64 nt, Homo Sapiens
uuuuuugugauguaugaaacucacuucuguguuauaauggaaggugaugcuugucugguaauaa

SEQ ID NO: 520566 - RNA, 64 nt, Homo Sapiens
ugugacacugugggugaaauucccuuauugccuauaauggaauacuuagguuggaccuggaaua

SEQ ID NO: 520567 - RNA, 64 nt, Homo Sapiens
aagucgacauauuuauagugcuuagagaccaaacuaauggaaggcagacuauuuacagcuuagu

SEQ ID NO: 520568 - RNA, 64 nt, Homo Sapiens
ugguaugugauauaaaucguguguuucauaugcauaauggaauuuaacguaauugugaauagga

SEQ ID NO: 520569 - RNA, 64 nt, Homo Sapiens
gcuuuuuugcaaaugcauucacuuugacaccauauaauggaacagaagcucugguauguuacug

SEQ ID NO: 520570 - RNA, 64 nt, Homo Sapiens
ugagccuacaguaagacacuucuaucagcaguguuaauggaagaaauuccuaccaaugggcaau

SEQ ID NO: 520571 - RNA, 64 nt, Homo Sapiens
uuaauacugggcccugaaaugacacccaauuuguuaauggaauuaugaagaacagcaauauaau

SEQ ID NO: 520572 - RNA, 64 nt, Homo Sapiens
uuuauuuuuuaagaaacugcuaauacuuucucccuaauggaagcccugaucccccagagagcua

SEQ ID NO: 520573 - RNA, 64 nt, Homo Sapiens
aguagcuagaaauaauuauguggaaaaaaaugaauaauggaaaauagugagucucaaauuguuc

SEQ ID NO: 520574 - RNA, 64 nt, Homo Sapiens
gaacgacuuuucuguaaucuguuuaucucccacuuaauggaaaggcaaagggguaccccaaauc

SEQ ID NO: 520575 - RNA, 64 nt, Homo Sapiens
ugauccacuaacuuuuuuuuucuuggcccaugauuaauggaauguauguaacuagguaggguuc

SEQ ID NO: 520576 - RNA, 64 nt, Homo Sapiens
aaauauuaauuuuaauauuauaacaaccugaaaauaauggaaaagagguuuuugaauuuuuuuu

SEQ ID NO: 520577 - RNA, 64 nt, Homo Sapiens
cucgcgaggguuaaucuucugaaaaggccuuuuguaauggaaaucgacgcuuccagacaaggcg

SEQ ID NO: 520578 - RNA, 64 nt, Homo Sapiens
aaaaaacaguaaaagugaaacaaugguguugcuuuaauggaaaaauagaguuaguuuugcagca

SEQ ID NO: 520579 - RNA, 64 nt, Homo Sapiens
ugucuuauuuguaaauaagugucaugugucaugcuaauggaaaacugauuuuaucaugaaaacu

SEQ ID NO: 520580 - RNA, 64 nt, Homo Sapiens
ucaugggggugggucccucauuggagguggggccuaauggaagguugagauuugauccccagug

SEQ ID NO: 520581 - RNA, 64 nt, Homo Sapiens
aucuucccucagcuuccuauaacaagaaaguccauaauggaauguggauagugucuugcaccca

SEQ ID NO: 520582 - RNA, 64 nt, Homo Sapiens
cauuuaugauuuuccauaauaugacacauggaacuaauggaauaaacaauauaaugacuauaaa

SEQ ID NO: 520583 - RNA, 64 nt, Homo Sapiens
uuucaaagguuuuauucaaagagaauuuuaauacuaauggaaugaugaaccauauucucauugu

SEQ ID NO: 520584 - RNA, 64 nt, Homo Sapiens
uuccguuacaugugcguacccuguauuauacauauaauggaaugcaggugacaggauuuccuuc

SEQ ID NO: 520585 - RNA, 64 nt, Homo Sapiens
uccugcauaacaacacuggguuuuuuuuuuuuuuuaauggaaaguugaguuaaaauauuucgau

SEQ ID NO: 520586 - RNA, 64 nt, Homo Sapiens
aagcuaaccaaaguaucuccaaacuguggacacuuaauggaaccucuauuuucuuaaaaaaugu

SEQ ID NO: 520587 - RNA, 64 nt, Homo Sapiens
cacuccccucucccucuuuccaggugcucuauuuuaauggaaaaaugucuggaggggcagugua

SEQ ID NO: 520588 - RNA, 64 nt, Homo Sapiens
agguaauuuuuaggauguguaagggucuuccuauuaauggaagaagccaaauacaugcauagaa

SEQ ID NO: 520589 - RNA, 64 nt, Homo Sapiens
ggcacauuuugcagccuuuuugcuugauugcauguaauggaaaugcccuauauuuuccugcaaa

SEQ ID NO: 520590 - RNA, 64 nt, Homo Sapiens
aguuagucccuucucucuuccuugcuuucucuucuaauggaauaugcguaguucccuggggccu

SEQ ID NO: 520591 - RNA, 64 nt, Homo Sapiens
augcagaaucuacccaauaccacacugcccccauuaauggaauuaaauugggaaaaacaauauu

SEQ ID NO: 520592 - RNA, 64 nt, Homo Sapiens
uauuaggcaagucaguugaaaaugcucgugcugcuaauggaauuagagugcguucauuuuacag

SEQ ID NO: 520593 - RNA, 64 nt, Homo Sapiens
uguuuuuguugugugugcagggagggcaguuuucuaauggaaugguuugggaauauccauguac

SEQ ID NO: 520594 - RNA, 64 nt, Homo Sapiens
ugguggagauacugagcaugucuuauugagucccuaauggaaauggugaucaacaaaagguuau

SEQ ID NO: 520595 - RNA, 64 nt, Homo Sapiens
caaaggcauuugaaauaggauuuuacuuaaacaauaauggaacacaggaguauuuaaagugaag

SEQ ID NO: 520596 - RNA, 64 nt, Homo Sapiens
cagguuguuguacacuuacaguacgugucaaccauaauggaacauccacaaaugcaucaauuau

SEQ ID NO: 520597 - RNA, 64 nt, Homo Sapiens
cucaaauggaacaggauuuuuugaugcuuugcucuaauggaacuguuuaaaaaauuuuuuuuuc

SEQ ID NO: 520598 - RNA, 64 nt, Homo Sapiens
auauucuaaccuguucuaaccucuaagcauuuucuaauggaacaaaauagaugagguggaugaa

SEQ ID NO: 520599 - RNA, 64 nt, Homo Sapiens
agcuuucuucugacugugacucugcugaagcuccuaauggaaaaugcuguguugaacucuucac

SEQ ID NO: 520600 - RNA, 64 nt, Homo Sapiens
gugaucuucaguugcaccucaaacaauauaguaauaauggaauucuuuccauuaaaauauucug

SEQ ID NO: 520601 - RNA, 64 nt, Homo Sapiens
cauuuuucuuugaaaggguccacugaaaccuauauaauggaauagaguuuuuuccaagcaaccu

SEQ ID NO: 520602 - RNA, 64 nt, Homo Sapiens
aacacccaaaauaaguagaaaauaagacgguguauaauggaauucacaauauggaaauuacuga

SEQ ID NO: 520603 - RNA, 64 nt, Homo Sapiens
gauucucccaugcucaugugucucuguccuaaacuaauggaagcacucuguaaaaagcaaaauc

SEQ ID NO: 520604 - RNA, 64 nt, Homo Sapiens
aguuuagaaucuuucaggugaaucagauucccgcuaauggaagacuacauuucuggcugauccc

SEQ ID NO: 520605 - RNA, 64 nt, Homo Sapiens
ccacuuuuucauuguaaugauguuaguuuugggguaauggaaacuccucauuuuuacugaacau

SEQ ID NO: 520606 - RNA, 64 nt, Homo Sapiens
aagacuuccaaccucacggacuuucucgucuguauaauggaagcacuaccuuccugggccucag

SEQ ID NO: 520607 - RNA, 64 nt, Homo Sapiens
acgagaucaguagugcuaucccaagggcaccccuuaauggaaacuacggcccagggggaagaug

SEQ ID NO: 520608 - RNA, 64 nt, Homo Sapiens
uaccaggggaggcagugucuugcuguccaugauguaauggaagcguuaagucagggaagagcag

SEQ ID NO: 520609 - RNA, 64 nt, Homo Sapiens
aagguguacaugugcaugugucaccaaaagcuuauaauggaacuaauaaaaugcuuuacuuuuu

SEQ ID NO: 520610 - RNA, 64 nt, Homo Sapiens
augaaagggaaaaaaauugacaaauuuuaaagauuaauggaaucauuggauauuguguuuuaac

SEQ ID NO: 520611 - RNA, 64 nt, Homo Sapiens
uuuucuuuggcuuuuccaguguauuucuugaaguuaauggaaacuuccaagaacaagaacccua

SEQ ID NO: 520612 - RNA, 64 nt, Homo Sapiens
ccgaucuuaagguguguuuucuagaaaaguucccuaauggaauucaugaguuugggggucucag

SEQ ID NO: 520613 - RNA, 64 nt, Homo Sapiens
uaaccuauuuuuguucugguuugguucgguuaucuaauggaaagguaacuggcaaugcacuuga

SEQ ID NO: 520614 - RNA, 64 nt, Homo Sapiens
gcuuagugucguacuuuacacaucauagguguucuaauggaagcaaggacuggagaagcaaaga

SEQ ID NO: 520615 - RNA, 64 nt, Homo Sapiens
cuggcauuccucucuuuaaaauuucuaccgaacuuaauggaauggaaaaagcaaacucauccac

SEQ ID NO: 520616 - RNA, 64 nt, Homo Sapiens
uuagguaauauaacugauaauauacugaaacauauaauggaagaugcagaugauaaaacuaauu

SEQ ID NO: 520617 - RNA, 64 nt, Homo Sapiens
gauauugacaaauggagacuccuaccucaauaguuaauggaauaauaagaggcuacuguugugu

SEQ ID NO: 520618 - RNA, 64 nt, Homo Sapiens
uucacauacuguuacugaagaaagcaccaagucuuaauggaacaaagaccauagaaugaauuau

SEQ ID NO: 520619 - RNA, 64 nt, Homo Sapiens
uuauagaacuauauaauaauauggacuugcuguguaauggaauuaaagugcuuuugcacaauaa

SEQ ID NO: 520620 - RNA, 64 nt, Homo Sapiens
uagcaauaggaauuuguacuauuuaagcaaucuuuaauggaaaauauguguguaagaauggaug

SEQ ID NO: 520621 - RNA, 64 nt, Homo Sapiens
uuccaguucuuuuuucagcuucuuuauuuccuccuaauggaaacauuaucuuuaaaaguugcau

SEQ ID NO: 520622 - RNA, 64 nt, Homo Sapiens
ugcauuccuuccuucgggaauuguauucaaaauguaauggaaaguaauuguugaccuccugcuu

SEQ ID NO: 520623 - RNA, 64 nt, Homo Sapiens
gcgcauauauauauauguauaaaaaauaauaaaauaauggaagaugaugguguucucuaguaag

SEQ ID NO: 520624 - RNA, 64 nt, Homo Sapiens
uuuuuuauuuugcagugugcugcaggaaagaauuuaauggaagugaugccaaauauuucuguau

SEQ ID NO: 520625 - RNA, 64 nt, Homo Sapiens
cagaaacccuucagugcuacauuuuguggcuuuuuaauggaaaccaagccaauguuauagacgu

SEQ ID NO: 520626 - RNA, 64 nt, Homo Sapiens
caggcccuacccugcaaugggauucgcuuucauuuaauggaaacuucugggacugaugcccaac

SEQ ID NO: 520627 - RNA, 64 nt, Homo Sapiens
ucagaaauaaguuacaaaucuuuguagaugaaaauaauggaaggaauguggagcaauaaaugua

SEQ ID NO: 520628 - RNA, 64 nt, Homo Sapiens
uguacacuagcauaauauuuguggcauauccguguaauggaagauuaugcaggcauuaaaauau

SEQ ID NO: 520629 - RNA, 64 nt, Homo Sapiens
guucuaugugcaguccaauauaacuuuuuugcaauaauggaaacucuagagucgggcaguccaa

SEQ ID NO: 520630 - RNA, 64 nt, Homo Sapiens
uguaggugcuguucucagguuugacuuuuuuuuuuaauggaaacauaccagcagcuggugagau

SEQ ID NO: 520631 - RNA, 64 nt, Homo Sapiens
ccuuugagaaccuggguguaaaugugaucuaguguaauggaagagaucuaguguaaugaaauaa

SEQ ID NO: 520632 - RNA, 64 nt, Homo Sapiens
gucaauuggucaucuggcuguugaaggaagcaaauaauggaauuuacauaauuccauuaagugg

SEQ ID NO: 520633 - RNA, 64 nt, Homo Sapiens
auuugaugugagaaacaauuuacuugaaugugccuaauggaaccacuuggauauuuuaugauuu

SEQ ID NO: 520634 - RNA, 64 nt, Homo Sapiens
uuuuugaggccuggaugaacguuuguggacuaccuaauggaauaccagccccuaugaguagggu

SEQ ID NO: 520635 - RNA, 64 nt, Homo Sapiens
ugguguugaaggacuucucauuuggugagaacaguaauggaaaaaacuguuuuauagucauuga

SEQ ID NO: 520636 - RNA, 64 nt, Homo Sapiens
augcuguacuaaaauaugcauuuguauggaauauuaauggaaacuaccaaaaacuagacauuau

SEQ ID NO: 520637 - RNA, 64 nt, Homo Sapiens
ccuggacaccaaggaaacagugauaugcuguauuuaauggaaaagcuggcucucgagucucuuc

SEQ ID NO: 520638 - RNA, 64 nt, Homo Sapiens
gcacauauuaguaacccaguaaaaaagcagcaaguaauggaauuaaacuuuccaaauaaaaaaa

SEQ ID NO: 520639 - RNA, 64 nt, Homo Sapiens
uguacaaaugccuaguuguguaguguucuccacauaauggaaaaauaaaagguagagaaacuug

SEQ ID NO: 520640 - RNA, 64 nt, Homo Sapiens
ugguuaaaguggaugagguuccuuggggaugaaauaauggaagcaagcgggcuugcugcuucac

SEQ ID NO: 520641 - RNA, 64 nt, Homo Sapiens
cugaauuuuuaaauguucacucuggcuuaccuguuaauggaagaauuugcauaauaucuacuua

SEQ ID NO: 520642 - RNA, 64 nt, Homo Sapiens
ccagaagucccuuuccuguucugucucuucauuguaauggaaguuucaguugggcaugagccug

SEQ ID NO: 520643 - RNA, 64 nt, Homo Sapiens
gucauuauagaugaguuuugccaguucaagaauuuaauggaaucagauauuguaagcauucuug

SEQ ID NO: 520644 - RNA, 64 nt, Homo Sapiens
gauagcuuuuuguucuaucuuguacagaaaacaguaauggaaucacucauguucagaaccuugu

SEQ ID NO: 520645 - RNA, 58 nt, Homo Sapiens
uugcucuuucugcagcauagcuugucaauaauggaaacaccaaaaacuguauuauuug

SEQ ID NO: 520646 - RNA, 64 nt, Homo Sapiens
ugcaaccuucuagugauccaaauaaacaccucuuuaauggaagcaaggaaauuaauauuaguaa

SEQ ID NO: 520647 - RNA, 64 nt, Homo Sapiens
uaaacuuuaaacaguuagcuaauggaauggcaaauaauggaacacccauaaaaauuuaaaaaga

SEQ ID NO: 520648 - RNA, 64 nt, Homo Sapiens
uagccauuuuucaaagcaauuuaguggugguauguaauggaacuccaucaaugagguaucuucu

SEQ ID NO: 520649 - RNA, 64 nt, Homo Sapiens
uuggauccaaggaggguguaagagccuucagccuuaauggaaggucuugaauacucugcccucu

SEQ ID NO: 520650 - RNA, 64 nt, Homo Sapiens
caaaguauucauauuucuuauucaucuaauguaauaauggaagccucuuauuugaauugauuuu

SEQ ID NO: 520651 - RNA, 64 nt, Homo Sapiens
uaauggguaggggugcauugauuuuuccacaguauaauggaaaacuuuguaaauagcaguucac

SEQ ID NO: 520652 - RNA, 64 nt, Homo Sapiens
cuguuauccaucaaaagugaauuaagugagagaguaauggaaaaaaaaucacuuaauuaguacc

SEQ ID NO: 520653 - RNA, 64 nt, Homo Sapiens
aaccauuuuccucuucugaagcuuuguuuuuuucuaauggaauggcaggucugaauaagaccua

SEQ ID NO: 520654 - RNA, 64 nt, Homo Sapiens
gauuggaugaauguucucaagaauauaucauaucuaauggaaaagagcauuuugugagaaaaau

SEQ ID NO: 520655 - RNA, 64 nt, Homo Sapiens
aaauagaagcauaucuaacauaucauugccuuaauaauggaacauuuuuuaagaucugauaugc

SEQ ID NO: 520656 - RNA, 64 nt, Homo Sapiens
cuaggcauaaacagguuuuagcuuaguguuccaauaauggaacagauauaaauaacucccacau

SEQ ID NO: 520657 - RNA, 64 nt, Homo Sapiens
ucacaaaagaucaauuccaacuggaacacauucuuaauggaacaagguuuaaauuuuuagaucu

SEQ ID NO: 520658 - RNA, 64 nt, Homo Sapiens
ucaaaguuaagggauuugcugaagacuguaaaguuaauggaagaauugagacaaaaauccagug

SEQ ID NO: 520659 - RNA, 64 nt, Homo Sapiens
gggguaauagaagaaaaaguaaauugggaggacuuaauggaaggucuuuuaaaaaguuaacuug

SEQ ID NO: 520660 - RNA, 64 nt, Homo Sapiens
cuuaagugauuacacuuuugcucaaauugaagcuuaauggaauuauaauucucaggauaguauu

SEQ ID NO: 520661 - RNA, 64 nt, Homo Sapiens
aguaaaaaguauuacgaugaaauuguuaggguauuaauggaacaaacccaguuucacucucuug

SEQ ID NO: 520662 - RNA, 64 nt, Homo Sapiens
gagauggucuugguuuuucacuuaacaaauuuuuuaauggaaucuuuguuuuuguucuccaucu

SEQ ID NO: 520663 - RNA, 64 nt, Homo Sapiens
aaaaaggugguguuuucauuuuuguauaauacuuuaauggaaugcuuuuuaaaaaaauauaaaa

SEQ ID NO: 520664 - RNA, 64 nt, Homo Sapiens
uuguuucaucuucacguauggaugcuagugccuuuaauggaagguaaagaauguuuugcuaguu

SEQ ID NO: 520665 - RNA, 64 nt, Homo Sapiens
aggccucccaggauggcgagcuccaguaagaugauaauggaaagcagcagcuuguugguuguca

SEQ ID NO: 520666 - RNA, 64 nt, Homo Sapiens
agaguccagaggggaggugagguuaaaaccugaguaauggaaaagcuuuuagaguagaaacaca

SEQ ID NO: 520667 - RNA, 64 nt, Homo Sapiens
uguuuuauuaaaaguaguuuuaaauuaauggauuuaauggaauuguaauuuuaaacauuuaauu

SEQ ID NO: 520668 - RNA, 64 nt, Homo Sapiens
aaauccauuaacauucuaacuaugguuuagggauuaauggaacccucaaccacuuugccacucc

SEQ ID NO: 520669 - RNA, 64 nt, Homo Sapiens
uuuuugaugugauuauaaugaauucauaaaauguuaauggaagcuguauuguacuagauugcca

SEQ ID NO: 520670 - RNA, 64 nt, Homo Sapiens
ggcuuaauuugaugacauaauacuuggauauaguuaauggaauuagcauuucugaaguuauucc

SEQ ID NO: 520671 - RNA, 64 nt, Homo Sapiens
aaucgaaauaugcucuauaguaaugucauuauuuuaauggaaucuuaaaccuaugauggaauuc

SEQ ID NO: 520672 - RNA, 64 nt, Homo Sapiens
aagugugcauuuauuagcuauuccagauuuauauuaauggaagguuuuuguuuaccauaaauug

SEQ ID NO: 520673 - RNA, 64 nt, Homo Sapiens
guaguaugaugaacaaucauaacuguagccucacuaauggaaaauaaucgcacauuuaaaacau

SEQ ID NO: 520674 - RNA, 64 nt, Homo Sapiens
cuuauggaaaagaggugagccuuugugaagaacauaauggaaaagugcauguacgggaaauaac

SEQ ID NO: 520675 - RNA, 64 nt, Homo Sapiens
gauaaaugaacacaccacucugaggcuaauuaccuaauggaauacaagagcaauggucacccgu

SEQ ID NO: 520676 - RNA, 64 nt, Homo Sapiens
gacaagaugaauuugagaagccaaauggaauuuuuaauggaaaccauuuaucagauuaaucucu

SEQ ID NO: 520677 - RNA, 64 nt, Homo Sapiens
uccaucaguggucaccuugagggauuagacauucuaauggaauguccuggcuccacccuccagc

SEQ ID NO: 520678 - RNA, 64 nt, Homo Sapiens
acaccacuggucuguaguaccagaauuguuuuguuaauggaaaguuuaaguaaauuauauugua

SEQ ID NO: 520679 - RNA, 64 nt, Homo Sapiens
gaaaaaccuuauuuucuucgguuuuugaaaaacauaauggaaauaaaacaggauauugacauaa

SEQ ID NO: 520680 - RNA, 64 nt, Homo Sapiens
aucuuccauuguguuuuucuuuauggacaggagcuaauggaagugacagucauguucaaaggaa

SEQ ID NO: 520681 - RNA, 64 nt, Homo Sapiens
aaacugggaugaagaugugcaaagucacagaauguaauggaaguccugaugguuacagaguaag

SEQ ID NO: 520682 - RNA, 64 nt, Homo Sapiens
caauuuuuuucauucuuccuauuuuuuaaaacaguaauggaacaaccaaagaugguguacucua

SEQ ID NO: 520683 - RNA, 64 nt, Homo Sapiens
caaauggcaaaucuugaaauaaauauggucgcacuaauggaagaaaagggaagguaaauggcau

SEQ ID NO: 520684 - RNA, 64 nt, Homo Sapiens
acaucucauuauuuuauugugaaaggaggaaaaauaauggaaacggagggacugauuuuuauag

SEQ ID NO: 520685 - RNA, 64 nt, Homo Sapiens
cuacuaagauacuccauauuuuaggggcaaguaauaauggaaugagggggcuggcaucauguau

SEQ ID NO: 520686 - RNA, 64 nt, Homo Sapiens
aaaugaucaaaaaaagaauguacauuaugcuuuuuaauggaacucaaguuuacacugcuuaaag

SEQ ID NO: 520687 - RNA, 64 nt, Homo Sapiens
uuuaaauuguauacaauacuaggguggcucaaccuaauggaauugagagccagagagaggagug

SEQ ID NO: 520688 - RNA, 64 nt, Homo Sapiens
ucauuggugauguuuggaaaauagaagacaucucuaauggaaucaugggggaaacggguuggaa

SEQ ID NO: 520689 - RNA, 64 nt, Homo Sapiens
cuaacccuuuaacaaauguguacauguuuacaaguaauggaaaugcgucuauaauacuccugcc

SEQ ID NO: 520690 - RNA, 64 nt, Homo Sapiens
aggcugggcugcucagucccuucaugggucuugcuaauggaaaguagcauauaugugcuuuaaa

SEQ ID NO: 520691 - RNA, 64 nt, Homo Sapiens
aucauuuugacagcaucuuccucccuccuuuaauuaauggaaucuucugaauuuucccugaaug

SEQ ID NO: 520692 - RNA, 64 nt, Homo Sapiens
aguugugacuuaggcaggagucgaccuccucaaguaauggaacgauuucaaaggcaggcugccc

SEQ ID NO: 520693 - RNA, 64 nt, Homo Sapiens
gcuguucacuugauuaguugccuuuaauauuacauaauggaauguuuugaugcuaugugacuug

SEQ ID NO: 520694 - RNA, 64 nt, Homo Sapiens
acuaugugauuuuuuaaauguccccuuuaguauuuaauggaaaauugguuccugcaaaagacaa

SEQ ID NO: 520695 - RNA, 64 nt, Homo Sapiens
ugggccuuuccauuaggguuuugcuuaugugaaguaauggaauuauguugguuauuuucuuuau

SEQ ID NO: 520696 - RNA, 64 nt, Homo Sapiens
uuauacuuccccaaaaaacaagcuuuacuggaauuaauggaaaauauuaugucaaucuuaggaa

SEQ ID NO: 520697 - RNA, 64 nt, Homo Sapiens
agugucgcuuaugaaaguacgauguacaguaacuuaauggaagugcugacucuagcaucagccu

SEQ ID NO: 520698 - RNA, 64 nt, Homo Sapiens
gaaacauaauuuuuuuuuucucacugaagcucaauaauggaacucuuuuuuuuuuuuuuuuuaa

SEQ ID NO: 520699 - RNA, 64 nt, Homo Sapiens
uauuuuucaaauacugauaucuuuggagucuguguaauggaaugggcgcuuaucagcauuguuu

SEQ ID NO: 520700 - RNA, 64 nt, Homo Sapiens
uugaugaugccuuugcuggguuccagcacuaaaguaauggaacuaaguugccaucugguuugcc

SEQ ID NO: 520701 - RNA, 64 nt, Homo Sapiens
aaaaacaacuuucuguucuccagaaaguguucuuuaauggaaagauuucuucuuuucacuuuac

SEQ ID NO: 520702 - RNA, 64 nt, Homo Sapiens
aaugggaaacacuugauaaauuagcugucacuaauaauggaauuucauuugauggggucacuug

SEQ ID NO: 520703 - RNA, 62 nt, Homo Sapiens
gaguugucuuuucugacagugaauaaaaccaggauaauggaacccacccccauccuauuccu

SEQ ID NO: 520704 - RNA, 64 nt, Homo Sapiens
uuaucaauuguccuauuuuaauuaauuuuccacuuaauggaagauagaaauggcauuucuccua

SEQ ID NO: 520705 - RNA, 64 nt, Homo Sapiens
uaagcugaacuucuuucuuuaaccaugugcacuuuaauggaaggaaguacgugccugaaacuga

SEQ ID NO: 520706 - RNA, 64 nt, Homo Sapiens
aaacucuaaagcuuuaauauauucgguuuguauguaauggaagcacggggcuagaguuuccaca

SEQ ID NO: 520707 - RNA, 64 nt, Homo Sapiens
cucuagcauucucuuuaaauacugacgcaauccuuaauggaaaagagauuucaugaagcaaauu

SEQ ID NO: 520708 - RNA, 64 nt, Homo Sapiens
gcucugaacuuggagcuacuucacacucuacucuuaauggaaacuugaacuaaugauagauagu

SEQ ID NO: 520709 - RNA, 64 nt, Homo Sapiens
cauauauuuucuuucauauuuguaaaauuauauuuaauggaauucuuuucuuugauuaucaagg

SEQ ID NO: 520710 - RNA, 64 nt, Homo Sapiens
guacauccuggucacuucugacuucuguuuuuacuaauggaagcuuugcaaauugaauucucag

SEQ ID NO: 520711 - RNA, 64 nt, Homo Sapiens
aacugcuaaauucuauguuaaauacugugcagaauaauggaaacauuacaguucauaauaggua

SEQ ID NO: 520712 - RNA, 64 nt, Homo Sapiens
uuuauuuagaaucgugaauugacauaaucuuggguaauggaacggagaucugcaacauaucuuu

SEQ ID NO: 520713 - RNA, 64 nt, Homo Sapiens
agauuuuuagauaaguguaauauacuugaucaauuaauggaaucauauuguuuucguagauuuu

SEQ ID NO: 520714 - RNA, 64 nt, Homo Sapiens
uuguagagaccuugcuuuaauuugaagcacaaccuaauggaaaacaaguccuuauuauagacua

SEQ ID NO: 520715 - RNA, 64 nt, Homo Sapiens
uguaaugaccaaguccccuaaucauauaaguugguaauggaagcguguuccugagugguccuga

SEQ ID NO: 520716 - RNA, 64 nt, Homo Sapiens
aauguuguaauaaaauaauccaggaaaugacugguaauggaaaauuuaugaauguaacugugca

SEQ ID NO: 520717 - RNA, 64 nt, Homo Sapiens
ucuucuaaaagggccgugacucaaggaaaguuuuuaauggaaaguugagccagaacuaaaccag

SEQ ID NO: 520718 - RNA, 64 nt, Homo Sapiens
gagcaggcuggagaggagauggcuaauagcuguuuaauggaaaccugcugggcuggagggaguu

SEQ ID NO: 520719 - RNA, 64 nt, Homo Sapiens
acgugguuuacguaacuuuaaacuguaacagccuuaauggaagaccaaaugguuuuuuauaugu

SEQ ID NO: 520720 - RNA, 64 nt, Homo Sapiens
aauaugauacaaguggcaucaggaaaugaggaaauaauggaacuauuuuuuuuaaguggaggua

SEQ ID NO: 520721 - RNA, 64 nt, Homo Sapiens
uaaacuaagcaagguccuggguuguuugaguggauaauggaaacugaaaggugacgugcaaaac

SEQ ID NO: 520722 - RNA, 64 nt, Homo Sapiens
uugauucauccuugaaaucaguauaaugugcuauuaauggaaccaauaguaauucgaggacuag

SEQ ID NO: 520723 - RNA, 64 nt, Homo Sapiens
uuuucugugccccuaucuucccgccgcugguuuguaauggaaccagcccccgcgcccccgcccu

SEQ ID NO: 520724 - RNA, 64 nt, Homo Sapiens
cugaagaaaucuuggggaggucuguauagggccauaauggaauuguccccggcagccagugcuc

SEQ ID NO: 520725 - RNA, 64 nt, Homo Sapiens
uaucuaucuaucuguucucaaaacguuugugccauaauggaaaauccggugcugacucggccuu

SEQ ID NO: 520726 - RNA, 64 nt, Homo Sapiens
auggguccagaaaacaugaucauuuucuagaccuuaauggaauauagaggauuagaaaaaucac

SEQ ID NO: 520727 - RNA, 64 nt, Homo Sapiens
ucugacuauucaaugguaaaugucaguccuguuuuaauggaauaccacauuagaaagcauucaa

SEQ ID NO: 520728 - RNA, 64 nt, Homo Sapiens
gcuggaaaucugcagggggaggcuuacuuaaccuuaauggaaacuuaaaugcuagguuuguaga

SEQ ID NO: 520729 - RNA, 64 nt, Homo Sapiens
uuccacaagucacccugugacuucaauaaauauuuaauggaaggaccacaccugacccauaggu

SEQ ID NO: 520730 - RNA, 64 nt, Homo Sapiens
ucuauaaauacaaacaaauagaauguuuauagaauaauggaacauaauaacauuauucaaaauu

SEQ ID NO: 520731 - RNA, 64 nt, Homo Sapiens
agaggaaaauuggcaccucaucuuuuaaaggcaguaauggaauugauuuucaguaacugaauuu

SEQ ID NO: 520732 - RNA, 64 nt, Homo Sapiens
uuuaauaggggaagguaguuuauggaaauauuuuuaauggaauaguuuucccuuaauauguauc

SEQ ID NO: 520733 - RNA, 64 nt, Homo Sapiens
acacacagaugugggcuuugauuuccaaguaauauaauggaagagaaaucucauacucccccac

SEQ ID NO: 520734 - RNA, 64 nt, Homo Sapiens
ccaaauucuuuauucuuccuugagcuaagcagaauaauggaauauaauaugucuucauaauaua

SEQ ID NO: 520735 - RNA, 63 nt, Homo Sapiens
aacuguagguuauuuaaaauaaauuccuacaacuuaauggaaacuuaagugucugccucuuug

SEQ ID NO: 520736 - RNA, 64 nt, Homo Sapiens
guuccaugauuuugcuuaaauuaauacuuuuaaguaauggaacuuuuuucaaaggcaaauuuaa

SEQ ID NO: 520737 - RNA, 64 nt, Homo Sapiens
gcaaaacuuucuuuuuuaaaaauuuucauuuauuuaauggaaacuugcccauuuucacaugucu

SEQ ID NO: 520738 - RNA, 64 nt, Homo Sapiens
uauuuuuuauauauuuuguuauuuauucuuuuaauaauggaauuuuuuuaaaaaguauuuugua

SEQ ID NO: 520739 - RNA, 64 nt, Homo Sapiens
guguugccugccaccacccuuagagguuauucuguaauggaaaagaauauguaucauggaagaa

SEQ ID NO: 520740 - RNA, 64 nt, Homo Sapiens
uuuucuguaauuuucuuacccauuuucgacaguguaauggaaauaguggauuuuggauuccaaa

SEQ ID NO: 520741 - RNA, 64 nt, Homo Sapiens
uuauuuacaauauaacacugccuuaauuuguguauaauggaaagaacauacaguaaugcacagu

SEQ ID NO: 520742 - RNA, 64 nt, Homo Sapiens
cacgacgccagugggugcuucaacauuagcaagauaauggaaauuaaugugacuuaggugcugu

SEQ ID NO: 520743 - RNA, 64 nt, Homo Sapiens
gaauauuuuccauuagauuuggugacucugacauuaauggaagaaaauuuuauugucuguuuuu

SEQ ID NO: 520744 - RNA, 64 nt, Homo Sapiens
caaauuaaauugauacagaagauuucaguagauguaauggaagcuguuuaacaaguauagccuu

SEQ ID NO: 520745 - RNA, 64 nt, Homo Sapiens
auugacccucuaugauauguugucuuaaaauuguuaauggaaguaauccacccaaaucuauugu

SEQ ID NO: 520746 - RNA, 64 nt, Homo Sapiens
cauccaucauuuaacuguaugccuuuccauauguuaauggaaagcuuuucuuaggccuaggguc

SEQ ID NO: 520747 - RNA, 64 nt, Homo Sapiens
aaaugaauucaccccucccaccucuuucuucaauuaauggaaaacuguuaagggaagcugauac

SEQ ID NO: 520748 - RNA, 64 nt, Homo Sapiens
ugaauuagccugaccacagguggucacuguaggcuaauggaaaauacccaagggagggcaaagc

SEQ ID NO: 520749 - RNA, 64 nt, Homo Sapiens
guaggagcaucuggugacagagaaacugugaauguaauggaaacuuugaaugcuguuuugugaa

SEQ ID NO: 520750 - RNA, 64 nt, Homo Sapiens
aauaaaaguaaaugaaaaaccauuaaauuugguuuaauggaaaguaagcaaaaggauguuauuu

SEQ ID NO: 520751 - RNA, 64 nt, Homo Sapiens
aaacuucuuuuuacucuaaucauuuuuaaaauacuaauggaagaacuuucuagcacuuuaccac

SEQ ID NO: 520752 - RNA, 64 nt, Homo Sapiens
auugggggaaaacaacaaaugucuugaagcauauuaauggaauuaguuucuaauguggcaaacu

SEQ ID NO: 520753 - RNA, 64 nt, Homo Sapiens
uuguucaacugcgaaauagaguguuugcuuuugauaauggaaaauuguauucguuuuaaaauuc

SEQ ID NO: 520754 - RNA, 64 nt, Homo Sapiens
uaaauugacaacucuguaggauuuacuagcaagcuaauggaaacaugauuuucggggaagaaaa

SEQ ID NO: 520755 - RNA, 64 nt, Homo Sapiens
ucucaauuugaguaaucugaucguucuuucuagcuaauggaaaaugauuuuacuuagcaauguu

SEQ ID NO: 520756 - RNA, 64 nt, Homo Sapiens
agugagaggcagcccccuagaaacucuucaggcguaauggaaaaucagcucaaaugagaucagg

SEQ ID NO: 520757 - RNA, 64 nt, Homo Sapiens
cagauuccacaguggcaagaaacaucauucuacauaauggaaaacauuuacaucaaaucccacu

SEQ ID NO: 520758 - RNA, 64 nt, Homo Sapiens
auugcuuaaaauaaugguacuauguaaaauuguauaauggaauacaauaaaagguaaaacuuau

SEQ ID NO: 520759 - RNA, 64 nt, Homo Sapiens
caagucuauuaugacaaaccaggaacuaauucuauaauggaaaacuauccauucugaauaauag

SEQ ID NO: 520760 - RNA, 64 nt, Homo Sapiens
aguucuagaagauauaggaucuucuauaguagguuaauggaaaauacaaaaacaaacaaacaua

SEQ ID NO: 520761 - RNA, 64 nt, Homo Sapiens
cuacaaaugcauuucuaaagccauuguaguccuguaauggaagcaucuagcaugucgucaaagc

SEQ ID NO: 520762 - RNA, 64 nt, Homo Sapiens
uaugauaggucaggggcuagguguugaacuuaguuaauggaagacugagagcagaacagguuug

SEQ ID NO: 520763 - RNA, 64 nt, Homo Sapiens
ugcguguguguagacacacacgcauacacacauauaauggaagcaauaagccauucuaagagcu

SEQ ID NO: 520764 - RNA, 64 nt, Homo Sapiens
uugggugaauuagagggguaauuuuuugcagcuuuaauggaauaauuuuucaagcagauugcac

SEQ ID NO: 520765 - RNA, 64 nt, Homo Sapiens
ggucuccaagaaguuuuauugauuuaaucauaaauaauggaaauggaaauuguauaguuucauu

SEQ ID NO: 520766 - RNA, 64 nt, Homo Sapiens
aauuaguucuguagaugacacuacccaagaaaucuaauggaaugcagaauuuggaaccaugcug

SEQ ID NO: 520767 - RNA, 64 nt, Homo Sapiens
cauaacuugggaucccgggcguggauugcaauuguaauggaagguuuucaaagauugauuuggu

SEQ ID NO: 520768 - RNA, 64 nt, Homo Sapiens
uuaaguuaaauguuaauacuuuauuguuuugauguaauggaacuuaaggauaaaagaccauaau

SEQ ID NO: 520769 - RNA, 64 nt, Homo Sapiens
gccaagagcgucagguggcaaugugauguuuuaguaauggaaaauggaagaauaaaauucaaga

SEQ ID NO: 520770 - RNA, 64 nt, Homo Sapiens
agccagugcagucugauuucuuuugcuuuugucaguaauggaaucuuuuguuuuuaaaauguac

SEQ ID NO: 520771 - RNA, 64 nt, Homo Sapiens
guuacaaauuacuagugcuauuuucauuauuauuguaauggaaaaaucuguggacuagaauaaa

SEQ ID NO: 520772 - RNA, 64 nt, Homo Sapiens
uuuauguagauaaaauuugccuccugguaacccuguaauggauggggcccagaaaugaaauauu

SEQ ID NO: 520773 - RNA, 64 nt, Homo Sapiens
cuccugugcuagaugguagccagagaauuuuauaguaauggagguuagcccuuaaucucuucau

SEQ ID NO: 520774 - RNA, 64 nt, Homo Sapiens
ugugaugagaaauugcagcaccucuaucucgcagguaauggaguaguuuguuauugguagucua

SEQ ID NO: 520775 - RNA, 64 nt, Homo Sapiens
ccgcaguaauguucugcacaacaguauuguaauuguaauggaaucauaaccugcuaacuaguuu

SEQ ID NO: 520776 - RNA, 64 nt, Homo Sapiens
uacaacuauuuuuuuaauauuagccuucuagucuguaauggaaauuguauauuuugauagaagu

SEQ ID NO: 520777 - RNA, 64 nt, Homo Sapiens
ucacagccccagaggauuccauauaaaagacauuguaauggaguggauugaacucacagaugga

SEQ ID NO: 520778 - RNA, 64 nt, Homo Sapiens
gaguuggauggagauaaacagcucccaucccuggguaauggaugguaagaugauggagauuccu

SEQ ID NO: 520779 - RNA, 64 nt, Homo Sapiens
cgucucccugagccuguaguuggaagugacgacuguaauggaaugaugucuuguauagaaaugc

SEQ ID NO: 520780 - RNA, 64 nt, Homo Sapiens
ugacccccuccccugaaaacagccuguguguucuguaauggaacaagcaagggcuccagcaucc

SEQ ID NO: 520781 - RNA, 64 nt, Homo Sapiens
uaguguccagucagcugagcaggagcagguccuuguaauggagugaguggcacagccuggcacc

SEQ ID NO: 520782 - RNA, 64 nt, Homo Sapiens
gcugcaauaauuaguuuuaagggguggccauauaguaauggaaaaauguaguuggguggauuuu

SEQ ID NO: 520783 - RNA, 64 nt, Homo Sapiens
auccaauuuacagauaguauuguacguuaucacuguaauggaauguaauaacgcaugggaauuc

SEQ ID NO: 520784 - RNA, 64 nt, Homo Sapiens
acauaaguagaauaggugacgcuuccugucacagguaauggaaaggucugcuuucauuccgugu

SEQ ID NO: 520785 - RNA, 64 nt, Homo Sapiens
guaaagaaaaauuacagaauagagaaaccuguaaguaauggaaggugaacuguacuuaaauugc

SEQ ID NO: 520786 - RNA, 64 nt, Homo Sapiens
aguagcaaauucacuaaacuuuuuuaauuguccuguaauggaacgugaaguugauauagucuca

SEQ ID NO: 520787 - RNA, 64 nt, Homo Sapiens
cuagggguggauugggagguaaauuuacgugauuguaauggaggagaaaagcugugaaggaagg

SEQ ID NO: 520788 - RNA, 64 nt, Homo Sapiens
gaggagagcugugcuuucuaccccaaaguuguugguaauggagccggucugcccuuccuacaaa

SEQ ID NO: 520789 - RNA, 64 nt, Homo Sapiens
uacucuuacugagauacccucucaccccaaauguguaauggaaaauuuuuaauuaagaaaaacu

SEQ ID NO: 520790 - RNA, 59 nt, Homo Sapiens
gaauaaaaguuacuacgugaaaaaucccaguaauggaaugaagguaauauugauaagcu

SEQ ID NO: 520791 - RNA, 64 nt, Homo Sapiens
agagggaccagcuggggggcaggggggagaggggguaauggaggccaagccugcagcuuucugg

SEQ ID NO: 520792 - RNA, 64 nt, Homo Sapiens
uuaagguaaaacagcuuuuuacucuguuauugugguaauggacagaauauuacauacaaaaaua

SEQ ID NO: 520793 - RNA, 64 nt, Homo Sapiens
cacagaauacacuuagauugauaggaaagaacucguaauggaguuugaguaaagaaaaugacug

SEQ ID NO: 520794 - RNA, 64 nt, Homo Sapiens
aggcuuuucaguucuguggcuguuuagacuguccguaauggaaugguaaaacuccaugaauuug

SEQ ID NO: 520795 - RNA, 64 nt, Homo Sapiens
ccaaauuauagguagcugauugaaacuguaaacaguaauggacgcaaaugacuacaauccauag

SEQ ID NO: 520796 - RNA, 64 nt, Homo Sapiens
aaaugcacuacaaaguuaagagguaacuuuuuuuguaauggaagcaaguuaguuugcuuuaagc

SEQ ID NO: 520797 - RNA, 64 nt, Homo Sapiens
cuguaaucauuuuauaaucuuaacuuuuaaaauuguaauggagguaauaugaauauaaaucuug

SEQ ID NO: 520798 - RNA, 64 nt, Homo Sapiens
uuauucuaacuugagaucaguuuuguuucugauaguaauggacuuaggaucuuauguaaacagu

SEQ ID NO: 520799 - RNA, 64 nt, Homo Sapiens
acuuaauaaauuugugugauugcccauauaauugguaauggauacugguuuuuuuuucuugauu

SEQ ID NO: 520800 - RNA, 64 nt, Homo Sapiens
aaagaagagggccagcuuaagguguuugacuguuguaauggagugaaauuucugucugguucuu

SEQ ID NO: 520801 - RNA, 64 nt, Homo Sapiens
uuaacuagugcugugauuuuacuguaacuguaauguaauggaaaauuguggguaaaauguuaga

SEQ ID NO: 520802 - RNA, 64 nt, Homo Sapiens
cuuuucaucaaaaagccuuaggauuuuugacuuuguaauggauugauucaauuauaauuguaau

SEQ ID NO: 520803 - RNA, 64 nt, Homo Sapiens
uuugacuuuguaauggauucauucaauuauaauuguaauggauuaaagcuaaauuuuguuacug

SEQ ID NO: 520804 - RNA, 64 nt, Homo Sapiens
acagaauggaaauaagagauuuaacagaacagaaguaauggauauaaucaagugucugcugcca

SEQ ID NO: 520805 - RNA, 64 nt, Homo Sapiens
uuuagcuaaugauguacuucggugaagugaagauguaauggagaaaucuggaaacagaggaacc

SEQ ID NO: 520806 - RNA, 64 nt, Homo Sapiens
cuuuuuuuuggcaggucugcuaguaccaaaguaaguaauggaguagaaacaacgucucuagcaa

SEQ ID NO: 520807 - RNA, 64 nt, Homo Sapiens
cugauuuugccaagcucuuagucacucuguacacguaauggaaauucuuacacuguugcugaag

SEQ ID NO: 520808 - RNA, 64 nt, Homo Sapiens
gggcaggucaucucuuauugcagaaccaacgaguguaauggagauuguuugcuauucugugugu

SEQ ID NO: 520809 - RNA, 64 nt, Homo Sapiens
ugggggaagcagcuuccauuauccuguaguauagguaauggaguggucucacaaaaagcaaucc

SEQ ID NO: 520810 - RNA, 64 nt, Homo Sapiens
uaaaauaaauacgccauuggcaauacuucauaauguaauggaauuguuuggggaacacuuacug

SEQ ID NO: 520811 - RNA, 64 nt, Homo Sapiens
gcuuuuaacuuagagauuaggcugaaaaaaauaaguaauggaauucaccuuugcaucuuuugug

SEQ ID NO: 520812 - RNA, 64 nt, Homo Sapiens
aaagaaaauguaaaagugcuaacaaggcugccaaguaauggagaaguaugguuagucuucauau

SEQ ID NO: 520813 - RNA, 64 nt, Homo Sapiens
ucgucuguggaacaucacaaguaucgaaaauacaguaauggauguuuccuuucuaauccacauu

SEQ ID NO: 520814 - RNA, 64 nt, Homo Sapiens
ucaaccuacuuuguaaccaaagaagcaaagcuguguaauggaguuugguuuuuuuuuguuguuu

SEQ ID NO: 520815 - RNA, 64 nt, Homo Sapiens
guugccccucaccucagagcucccccaaaggccaguaauggauccccggccucagucccuacuc

SEQ ID NO: 520816 - RNA, 64 nt, Homo Sapiens
aaccaucagcugccucucgaauggaagaacagugguaauggauuaacauccuauuuuguuguac

SEQ ID NO: 520817 - RNA, 64 nt, Homo Sapiens
gucucgguguaaaaagcugaccugcuugucccugguaauggaauuaagaggaaggcuucugucu

SEQ ID NO: 520818 - RNA, 64 nt, Homo Sapiens
ugaccaguccacacugauaagauggccauguaggguaauggagacucagggucccuuccuccaa

SEQ ID NO: 520819 - RNA, 64 nt, Homo Sapiens
aaaaggggaauucucuuuucaaagguuucuauauguaauggaaccaagcuauuuggaagcuuca

SEQ ID NO: 520820 - RNA, 64 nt, Homo Sapiens
uuugugugaagaaaugaacuucaugcccgcugcaguaauggacggccuaacacccugccgguuu

SEQ ID NO: 520821 - RNA, 64 nt, Homo Sapiens
gccguuuguaccuguaucagcugaaaggucgauuguaauggauuaauuuaaaccuuguuuguaa

SEQ ID NO: 520822 - RNA, 64 nt, Homo Sapiens
cugacuggaaugugaucccuauaaucucugacuuguaauggaccaugcucucuugcauauuuau

SEQ ID NO: 520823 - RNA, 64 nt, Homo Sapiens
uugcuuuaaaaugucugccugaaauuuuagcaagguaauggauuucugaagcuguagcuuagug

SEQ ID NO: 520824 - RNA, 64 nt, Homo Sapiens
aaccaggcacagaaacagacuauuuuugaguuuuguaauggaaguguauacacaagaaauguca

SEQ ID NO: 520825 - RNA, 64 nt, Homo Sapiens
ugguccucuaaagccccucaaguugcuuauuuguguaauggauguuugccacaucccuggacuc

SEQ ID NO: 520826 - RNA, 64 nt, Homo Sapiens
ggguguuggcauuggugucuuugagcaagaugauguaauggaaauguacagaaugcuauuucac

SEQ ID NO: 520827 - RNA, 64 nt, Homo Sapiens
agcguccccggccacgucugugcucuguccuuguguaauggaaugcaaaaaagccaagcccucc

SEQ ID NO: 520828 - RNA, 64 nt, Homo Sapiens
uccagucugucuguuguacugguaauuuaacucuguaauggaauaguuugcugccaacuauuua

SEQ ID NO: 520829 - RNA, 64 nt, Homo Sapiens
uaaauuuuuaggaccaauacaaaauaacaaaaauguaauggaaucagacugaauuaaaguaagg

SEQ ID NO: 520830 - RNA, 63 nt, Homo Sapiens
cauggugggggauucacugauucaguuugcaaaguaauggagaagcuguagaacaauguggaa

SEQ ID NO: 520831 - RNA, 64 nt, Homo Sapiens
acugguaguguucugauuugugagucgacacucaguaauggaugucuuaaucguguagaccuga

SEQ ID NO: 520832 - RNA, 64 nt, Homo Sapiens
guuuaacaaguuucccaaaaaagucuacacaggaguaauggacugaaauguucauaccugagca

SEQ ID NO: 520833 - RNA, 64 nt, Homo Sapiens
uggcuugaaaaauacgguagcuuuuauuuguaaaguaauggauccuuagccaauuuauaaggga

SEQ ID NO: 520834 - RNA, 64 nt, Homo Sapiens
auccacuguucaguuucauaucucugcaaugacuguaauggacggaauuaaucucuuuucagau

SEQ ID NO: 520835 - RNA, 64 nt, Homo Sapiens
acgugcauuaaaauggaguuuaucucacacauuuguaauggauauaaauauguguuuuauagaa

SEQ ID NO: 520836 - RNA, 64 nt, Homo Sapiens
augaccauuuuucuguugcauuagaccuuuacagguaauggaacaugagcuucacccauauuaa

SEQ ID NO: 520837 - RNA, 64 nt, Homo Sapiens
ugcuuuaugaaaauaauagugucuucuauggcauguaauggauaccuaauaccgaugaguuaaa

SEQ ID NO: 520838 - RNA, 64 nt, Homo Sapiens
guaauaguauuacagaaaaaugagcgauuaaauaguaauggauacaauuaaggagcaacuauuu

SEQ ID NO: 520839 - RNA, 64 nt, Homo Sapiens
uuuguuuuuuguguaauuugguauauuguuuugaguaauggaugaagugaguacucaacauuug

SEQ ID NO: 520840 - RNA, 64 nt, Homo Sapiens
uuaaagcauuccccaaagauaagcuacucacccuguaauggaucuaucccugccugugacuuuc

SEQ ID NO: 520841 - RNA, 64 nt, Homo Sapiens
gccuucucaggucauucacggagcagggauguagguaauggaaaacaaauggcuuagacuaaau

SEQ ID NO: 520842 - RNA, 64 nt, Homo Sapiens
ccauguucacauccugugaauuuuuuuggcuuuuguaauggaauguuguuguuuuuacuuuuuu

SEQ ID NO: 520843 - RNA, 64 nt, Homo Sapiens
acucauguaagauguugcuaugauguaacacuagguaauggaaauuagaguaugauuuuaacaa

SEQ ID NO: 520844 - RNA, 64 nt, Homo Sapiens
aaaaaugcggaugccuacaggauaaacagauuauguaauggaagagauauugccaacuuaauca

SEQ ID NO: 520845 - RNA, 64 nt, Homo Sapiens
augauuugaguucacugugcguccugggacuauuguaauggaaucugggagucugucuaaugaa

SEQ ID NO: 520846 - RNA, 64 nt, Homo Sapiens
ugaaaaaaacuguaauaauugagauguaauaaauguaauggaugcgaagaauacauccuugaga

SEQ ID NO: 520847 - RNA, 64 nt, Homo Sapiens
uggcugaaauuugagguccuggcugagccaaggaguaauggaccagaucuaccucaguauucaa

SEQ ID NO: 520848 - RNA, 64 nt, Homo Sapiens
ugcuuuagaggcuaaguugcuuugagcccacaagguaauggagggcuccuacuugggacagagc

SEQ ID NO: 520849 - RNA, 64 nt, Homo Sapiens
uguuggaauggcuauccuacuaugcuguucuuugguaauggaauaaauugacccaaggaccgaa

SEQ ID NO: 520850 - RNA, 64 nt, Homo Sapiens
cuuugagaucuuuguuuauguuuauuagaagaggguaauggaaacugaucauggaaacauuuaa

SEQ ID NO: 520851 - RNA, 64 nt, Homo Sapiens
uggugaaaaaguuagauauucuagacuuguuuuaguaauggaaacucuuaccuccacauauuau

SEQ ID NO: 520852 - RNA, 64 nt, Homo Sapiens
acaauaacuaucaaauuggcuaucagaauucacuguaauggaauuuugccucuaauaacauaaa

SEQ ID NO: 520853 - RNA, 64 nt, Homo Sapiens
ugucaguuacacaagcucuagucucaaaaugaaaguaauggagaaagacacugaaauuuagaaa

SEQ ID NO: 520854 - RNA, 64 nt, Homo Sapiens
aauuuuuaaaauuguuuauauaaagccugaaaauguaauggaugugaggaauugaaaauuaugc

SEQ ID NO: 520855 - RNA, 64 nt, Homo Sapiens
uuaugaucuuaagaaauuaccuaccaggguuacuguaauggaauccagaacuuuauagaguugc

SEQ ID NO: 520856 - RNA, 64 nt, Homo Sapiens
cggggauggaaauaaaugaccaauucccuuacaaguaauggagccacugggucuguccccaccc

SEQ ID NO: 520857 - RNA, 64 nt, Homo Sapiens
agcagcaggccaucaggaacagaucaagaccuauguaauggacauuuuguuaaaaucuacuccu

SEQ ID NO: 520858 - RNA, 64 nt, Homo Sapiens
agagugggaaaaaagagauccucugauaugugaaguaauggacaaaaucauuaaugccaacuug

SEQ ID NO: 520859 - RNA, 64 nt, Homo Sapiens
ccaaggaaagugaaacuuugagacauuacaauguguaauggaaagccugagucaagaguugagg

SEQ ID NO: 520860 - RNA, 64 nt, Homo Sapiens
augcacacuuuuaauuuuguaguguuuuaugcauguaauggacuguguaaacaggauuauuauu

SEQ ID NO: 520861 - RNA, 64 nt, Homo Sapiens
gggccaaucaaaugugauaaguaugucuuuuuguguaauggacuaauuauguuguauuuaguca

SEQ ID NO: 520862 - RNA, 64 nt, Homo Sapiens
gaguuaucaaggcacauucugcagugcuaccaugguaauggacagagcaaaccccugugguccg

SEQ ID NO: 520863 - RNA, 64 nt, Homo Sapiens
gaguuaucgaggcacauacugcagugcuaccacgguaauggacagagccaaggccuugggagca

SEQ ID NO: 520864 - RNA, 64 nt, Homo Sapiens
uuagcagcacguguucccgacauaacauuguacuguaauggagugagcguagcagcucagcucu

SEQ ID NO: 520865 - RNA, 64 nt, Homo Sapiens
uuucuuuguguaugcauguuugaauuaaaagaaaguaauggaagaauugaucgaugaauuaagu

SEQ ID NO: 520866 - RNA, 64 nt, Homo Sapiens
ugccuguauuaauuuuaguuuugagucaggauuuguaauggagugggaaauguguuucucugga

SEQ ID NO: 520867 - RNA, 64 nt, Homo Sapiens
ggauauacucuuuuaaguuuagccccaauauaggguaauggaaauuuccugcccucuggguucc

SEQ ID NO: 520868 - RNA, 64 nt, Homo Sapiens
gugccuaacuuauuggagcacaucaguuucuuggguaauggaaaacauuaccuagaguugccag

SEQ ID NO: 520869 - RNA, 64 nt, Homo Sapiens
uauaaauaagaaagaauguuuagaaagacuuuagguaauggaaaauggaguuaguauuugugag

SEQ ID NO: 520870 - RNA, 64 nt, Homo Sapiens
cauaagucuaggaguuagaaucauucuuuauauaguaauggaaauuguuauuuauuuguuuggc

SEQ ID NO: 520871 - RNA, 64 nt, Homo Sapiens
uaccuugcuccuacuucuuucaggucuuuauuuuguaauggaauccuuuguacuuuuccaagcu

SEQ ID NO: 520872 - RNA, 64 nt, Homo Sapiens
aaauuaagauucucugcccagcaaacagucuaguguaauggaucaaaaaaaaauuacaaauggg

SEQ ID NO: 520873 - RNA, 64 nt, Homo Sapiens
ucuuuucacuaggguauaagaaagugagaguaauguaauggagcaaggaagaacaaucacaaau

SEQ ID NO: 520874 - RNA, 64 nt, Homo Sapiens
aagacuagugcuuugugcauuaucuuucuaagcgguaauggagguguaaauggagaaacaauca

SEQ ID NO: 520875 - RNA, 64 nt, Homo Sapiens
auguggaauuguagugccauuucuuuuuccaaauguaauggauugcccugugucuaccaggagc

SEQ ID NO: 520876 - RNA, 64 nt, Homo Sapiens
gaagugaaggcuuuagaugugggaccccccuaauguaauggauuucucaauacuguaugaauaa

SEQ ID NO: 520877 - RNA, 64 nt, Homo Sapiens
gcccuagauccgaauaagauccgaauaagaauauguaauggaccaggcgcagugccucacgccu

SEQ ID NO: 520878 - RNA, 64 nt, Homo Sapiens
auuuguagcaguaauaacugcaggucacuuguauguaauggaugugagguagccgaaguuuggu

SEQ ID NO: 520879 - RNA, 64 nt, Homo Sapiens
cccauauugauaugcuggcaauauaggaugguauguaauggacagaacugaugcagaugguuga

SEQ ID NO: 520880 - RNA, 64 nt, Homo Sapiens
aauuuuucucuguuacaucaguaauauuguuaaaguaauggauagaaccauaacuuacacauga

SEQ ID NO: 520881 - RNA, 64 nt, Homo Sapiens
auacaggauguuaauaaugaauggaaauaauuuaguaauggacuuaaaugggugcuaauugaua

SEQ ID NO: 520882 - RNA, 64 nt, Homo Sapiens
agcaaacagaauuaccugagggaugcacaaauaaguaauggaugucauagcucacuagggagaa

SEQ ID NO: 520883 - RNA, 64 nt, Homo Sapiens
uggaaguacauaaaguaauaacuguuagaauuagguaauggauaugaaagagaaaaugcuuucu

SEQ ID NO: 520884 - RNA, 64 nt, Homo Sapiens
caggaugagaaucuaagauauauuauuaauaaauguaauggauuuuuuuuuuguauacguguuu

SEQ ID NO: 520885 - RNA, 64 nt, Homo Sapiens
gacaaucaggaagaacagaaauggauaaaguaguguaauggauuaaaccugagggcaaaaagga

SEQ ID NO: 520886 - RNA, 64 nt, Homo Sapiens
gacacguuugauaguuaacauuucuuugugaaagguaauggacucacaaggggaagaaacaugc

SEQ ID NO: 520887 - RNA, 64 nt, Homo Sapiens
ucucgcgaggguuaaucuucggaaaaggccuuuuguaauggaaaccgacgcuuccagacaaggc

SEQ ID NO: 520888 - RNA, 64 nt, Homo Sapiens
guacccaaacauguauuuuaccuuaaugaauaaaguaauggaucagagaagguacucaaaaaau

SEQ ID NO: 520889 - RNA, 64 nt, Homo Sapiens
auuggguaauaaaaugacagaagugauuggaaauguaauggauaugaaaaugcuugguuaugua

SEQ ID NO: 520890 - RNA, 64 nt, Homo Sapiens
cuguauuagaagaaaauaaggaugguccaaaauuguaauggaguguguaucuguacucucugca

SEQ ID NO: 520891 - RNA, 64 nt, Homo Sapiens
uggcacauuuugcagccuuuuugcuugauugcauguaauggaaaugcccuauauuuuccugcaa

SEQ ID NO: 520892 - RNA, 64 nt, Homo Sapiens
cacuuuccaauguacucaagaaaauugaacaaauguaauggaucaauuuaaaauauuuuauuuc

SEQ ID NO: 520893 - RNA, 64 nt, Homo Sapiens
uuucaaagugcccagacuguguacaaagacacauguaauggagauuguacagguuguuuuuuug

SEQ ID NO: 520894 - RNA, 64 nt, Homo Sapiens
ugccaaauaauuaugugcacagaggccaaauauaguaauggagggcuauuuauaggggaaaaca

SEQ ID NO: 520895 - RNA, 64 nt, Homo Sapiens
aucuuauuuaucuaaacuaaaauauaaaauuuuuguaauggauaaaauuacuuacagguuauuc

SEQ ID NO: 520896 - RNA, 64 nt, Homo Sapiens
cccacuuuuucauuguaauguuguuaguuuugggguaauggaaaauccucauuuuuacugaaca

SEQ ID NO: 520897 - RNA, 64 nt, Homo Sapiens
cuaccaggggaggcagugucgugcuguccaugauguaauggaaggguuaagucagggaagagca

SEQ ID NO: 520898 - RNA, 64 nt, Homo Sapiens
uuuauagaacuauauaauaauauggacuugcuguguaauggaauuaaagugcuuuugcacaaua

SEQ ID NO: 520899 - RNA, 64 nt, Homo Sapiens
uuguuuuuuuaagcuucccuugagagaauaaaugguaauggagagaacuauuuaacaagguccu

SEQ ID NO: 520900 - RNA, 51 nt, Homo Sapiens
cagacaaagcggagcucuagaguaauggagagugauggaaacaaaguguac

SEQ ID NO: 520901 - RNA, 64 nt, Homo Sapiens
uugcauuccuuccuucgggaauuguauucaaaauguaauggaaaguaauuguugaccuccugcu

SEQ ID NO: 520902 - RNA, 64 nt, Homo Sapiens
auguacacuagcauaauauuuguggcauauccguguaauggaagauuaugcaggcauuaaaaua

SEQ ID NO: 520903 - RNA, 64 nt, Homo Sapiens
aaaauaagauaugagaauauaaagcucuuuuaauguaauggacaguaguggauucccaaauuuc

SEQ ID NO: 520904 - RNA, 64 nt, Homo Sapiens
accuuugagaaccuggguguaaaugugaucuaguguaauggaagugaucuaguguaaugaaaua

SEQ ID NO: 520905 - RNA, 64 nt, Homo Sapiens
augguguugaaggacuucucauuuggugagaacaguaauggaaaaaacuguuuuauagucauug

SEQ ID NO: 520906 - RNA, 64 nt, Homo Sapiens
uuuaaaggcugagaaauuuuuuauuuaucaaaauguaauggauuacagaaugaguaugcaaguu

SEQ ID NO: 520907 - RNA, 64 nt, Homo Sapiens
gauauggggcuuuuuagccaauuguguguugugaguaauggacauggcaauaugggugggggga

SEQ ID NO: 520908 - RNA, 64 nt, Homo Sapiens
gaagaauuucccagccaucugaagaaaguucuacguaauggaggggcaccucaacugaggaggg

SEQ ID NO: 520909 - RNA, 64 nt, Homo Sapiens
ugcacauauuaguaacccagaaaaaaagcagcaaguaauggaaucaaacuuuccaaauaaaaaa

SEQ ID NO: 520910 - RNA, 64 nt, Homo Sapiens
uuguagcccauuugaauuuuucuugcaguuuaagguaauggauacuucggguugcaaccuuguc

SEQ ID NO: 520911 - RNA, 64 nt, Homo Sapiens
cggccaacccuguguguuauucugagucuuacccguaauggagccggacacaccuggagcagcc

SEQ ID NO: 520912 - RNA, 64 nt, Homo Sapiens
accagaagucccuuuccuguucugucucuucauuguaauggaaguuucaguugggcaugagccu

SEQ ID NO: 520913 - RNA, 64 nt, Homo Sapiens
ggauagcuuuuuguucuaucuuguacagaaaacaguaauggaaucacucauguucagaaccuug

SEQ ID NO: 520914 - RNA, 64 nt, Homo Sapiens
uuagccauuuuucaaagcaauuuaguggugguauguaauggaacuccaucaaugagguaucuuc

SEQ ID NO: 520915 - RNA, 64 nt, Homo Sapiens
aucaagccacucggcggcaggauccaaggaggguguaauggagcucagccuuaauggaagguug

SEQ ID NO: 520916 - RNA, 64 nt, Homo Sapiens
acuguuauccaucaaaagugcauuaagugagagaguaauggaaacaaaaucacuuaauuaguac

SEQ ID NO: 520917 - RNA, 64 nt, Homo Sapiens
uagaguccagaggggaggugagguuaaaaccugaguaauggaaaagcuuuuagaguagaaacac

SEQ ID NO: 520918 - RNA, 64 nt, Homo Sapiens
uuuuuuuacucaucuuugaagugacccuagggaaguaauggauuagcaggaguaaaggaagaaa

SEQ ID NO: 520919 - RNA, 64 nt, Homo Sapiens
guuugcaaacacacagcggcugauuccagccuugguaauggagaugauuuuaaaguggugcauu

SEQ ID NO: 520920 - RNA, 64 nt, Homo Sapiens
agagcuaccacccaauggagauacuaaauccaugguaauggaccaucgagggcaaccuccagag

SEQ ID NO: 520921 - RNA, 64 nt, Homo Sapiens
gcaaguagccugucuuccuuuaaguaaguagccuguaauggauguacuacuuugccacuggaau

SEQ ID NO: 520922 - RNA, 64 nt, Homo Sapiens
aaaacugggaugaagaugugcaaagucacagaauguaauggaaguccugaugguuacagaguaa

SEQ ID NO: 520923 - RNA, 64 nt, Homo Sapiens
acaauuuuuuucauucuuccaauuuuuuaaaacaguaauggaacgaccaaagaugguguacucu

SEQ ID NO: 520924 - RNA, 64 nt, Homo Sapiens
aucuuugaaaucuuuuucaaaggacuguaguuuuguaauggacuuuucaagccuuccuuccauu

SEQ ID NO: 520925 - RNA, 64 nt, Homo Sapiens
ucuaacccuuuaacaaauguguacauguuuacaaguaauggaaaugcgucuauaauacuccugc

SEQ ID NO: 520926 - RNA, 64 nt, Homo Sapiens
gacaagucuguuauuaggaauaauccuuagccauguaauggagaaaggagcagucagcauucuu

SEQ ID NO: 520927 - RNA, 64 nt, Homo Sapiens
aauauuaagcaauuucuaguuauuauucuagccaguaauggacuucagaaucuuuuauuacaca

SEQ ID NO: 520928 - RNA, 64 nt, Homo Sapiens
ccuaucccauacauuugacacaaaagaaguguugguaauggauaaauaacauaucccgggcaga

SEQ ID NO: 520929 - RNA, 64 nt, Homo Sapiens
aaagaaccuccuuggaaaaauuaauugcuuuuucguaauggauucucuaugcuaaugcucucuc

SEQ ID NO: 520930 - RNA, 64 nt, Homo Sapiens
gaguugugacuuaggcaggagucgaccuccucaaguaauggaacgauuucaaaggcaggcugcc

SEQ ID NO: 520931 - RNA, 64 nt, Homo Sapiens
auaucguaaaaauagagauauauuuuguaucuuaguaauggaucagauuaggccaguucaggug

SEQ ID NO: 520932 - RNA, 64 nt, Homo Sapiens
gaaaacgcagcauacuuggcugguuugauuuuguguaauggaugguccuuugguugcuccuccu

SEQ ID NO: 520933 - RNA, 64 nt, Homo Sapiens
augggccuuuccauuaggguuuugcuuaugugaaguaauggaauuauguugguuauuuucuuua

SEQ ID NO: 520934 - RNA, 64 nt, Homo Sapiens
guauuuuucaaauacugauaucuuuggagucuguguaauggaaucggcgcuuaucagcauuguu

SEQ ID NO: 520935 - RNA, 64 nt, Homo Sapiens
uuugaugaugccuuugcuggcuuccagcacuaaaguaauggaaccaaguugccaucugguuugc

SEQ ID NO: 520936 - RNA, 64 nt, Homo Sapiens
agauaauucaaacugauuagaauuuaauauucuuguaauggacuauagaucacaaagcucaagg

SEQ ID NO: 520937 - RNA, 64 nt, Homo Sapiens
ccuguauuuuaaaaagaaauacaaaguuguaaaaguaauggauuucuuuggaugcugaaugcag

SEQ ID NO: 520938 - RNA, 64 nt, Homo Sapiens
aaaacucuaaagcuuuaauauauucgguuuguauguaauggaagcacggggcuagaguuuccac

SEQ ID NO: 520939 - RNA, 64 nt, Homo Sapiens
augucaccuuucauuuuauaguguucaucauugaguaauggauuaagugaaaauccaggaguau

SEQ ID NO: 520940 - RNA, 64 nt, Homo Sapiens
ugucuauugaacacuuaaaauuaauuagaaugugguaauggacauauuacugagccucuccauu

SEQ ID NO: 520941 - RNA, 64 nt, Homo Sapiens
auuuauuuagaaucgugaauugacauaaucuuggguaauggaacggagaucugcaacauaucuu

SEQ ID NO: 520942 - RNA, 64 nt, Homo Sapiens
uuauaaugcuauuuguacauuaccaugauuuauuguaauggaguagaguaugugauaguaucug

SEQ ID NO: 520943 - RNA, 64 nt, Homo Sapiens
cuguaaugaccaaguccccuaaucauauaaguugguaauggaaggguguuccugagugguccug

SEQ ID NO: 520944 - RNA, 64 nt, Homo Sapiens
aaauguuguaauaaaauaauacaggaaaugacugguaauggaaauuuuaugaauguaacugugc

SEQ ID NO: 520945 - RNA, 64 nt, Homo Sapiens
uaauauuucuuaaaacaaaauuuauuuuuaguugguaauggauacucagaauuacucaaaucaa

SEQ ID NO: 520946 - RNA, 64 nt, Homo Sapiens
aaaguuuccucauaaaacucaguacuaucuauugguaauggaugcauauauguauguacauguu

SEQ ID NO: 520947 - RNA, 64 nt, Homo Sapiens
ugcauugaaaacaaccuaaauauucaucagugggguaauggaugaauaaaauaugauauauuca

SEQ ID NO: 520948 - RNA, 64 nt, Homo Sapiens
ucaucgcuggugcuccgacaaaaaaaaugcugcuguaauggaccaagagccugcagggaacaga

SEQ ID NO: 520949 - RNA, 64 nt, Homo Sapiens
cggguucaagcaauuaacugccucagcuucccuaguaauggauuacaggcgcccgccaccacgc

SEQ ID NO: 520950 - RNA, 64 nt, Homo Sapiens
uuuaaucuuacacagcuaaauuauuuuaaauaaaguaauggaccuuuaagaacuaaaauauauu

SEQ ID NO: 520951 - RNA, 64 nt, Homo Sapiens
cuuuucugugccccuaucuuuccgccgcugguuuguaauggaaccagcccccgcgcccccgccc

SEQ ID NO: 520952 - RNA, 64 nt, Homo Sapiens
gagaggaaaauuggcaccucaucuuuuaaaggcaguaauggaauugauuuucaguaacugaauu

SEQ ID NO: 520953 - RNA, 64 nt, Homo Sapiens
guaagauuaaguuaggcagucuucuaccaaauguguaauggagauugccucaaaauugugucca

SEQ ID NO: 520954 - RNA, 64 nt, Homo Sapiens
uguuccaugauuuugcuuaaauuaauacuuuuaaguaauggaacuuuuuucaaaggcaaauuua

SEQ ID NO: 520955 - RNA, 64 nt, Homo Sapiens
uuugccuuucaaccuuguuuuacaguucugcaguguaauggaggacgggcaacgugcaugugca

SEQ ID NO: 520956 - RNA, 64 nt, Homo Sapiens
aguguugccugccaccacccauagagguuauucuguaauggaaaggaauauguaucauggaaga

SEQ ID NO: 520957 - RNA, 64 nt, Homo Sapiens
uuuuucuguaauuuucuuacacauuuucgacaguguaauggaaauaguggauuuuggauuccaa

SEQ ID NO: 520958 - RNA, 64 nt, Homo Sapiens
ccaaauuaaauugauacagaugauuucaguagauguaauggaagauguuuaacaaguauagccu

SEQ ID NO: 520959 - RNA, 64 nt, Homo Sapiens
aaggggaaguaguagaauucagaaaggacacagcguaauggagaauaccaaacccaguguuagg

SEQ ID NO: 520960 - RNA, 64 nt, Homo Sapiens
ugguuccuucugccugacccugggagacauaucaguaauggauguacaaaagcaggucuguuuu

SEQ ID NO: 520961 - RNA, 64 nt, Homo Sapiens
cguaggagcaucuggugacaaagaaacugugaauguaauggaaacuuugaaugcuguuuuguga

SEQ ID NO: 520962 - RNA, 64 nt, Homo Sapiens
uaaaauuuaaaaaauuaacagccaagucacaaagguaauggauugcacauagacuaaggaauaa

SEQ ID NO: 520963 - RNA, 64 nt, Homo Sapiens
ugcuguuggaaaaugagagcgaucacauggagcaguaauggagcaaagaccagccaucccaguu

SEQ ID NO: 520964 - RNA, 64 nt, Homo Sapiens
cagugagaggcagcccccuagaaacucuucaggcguaauggaaaaucagcucaaaugagaucag

SEQ ID NO: 520965 - RNA, 64 nt, Homo Sapiens
gcuacaaaugcauuucuaaagccauuguaguccuguaauggaagcaucuagcaugucgucaaag

SEQ ID NO: 520966 - RNA, 64 nt, Homo Sapiens
caugguaauuuguggauuuuuuuuucauacucaaguaauggaggcuagaaaugaagagaaccuu

SEQ ID NO: 520967 - RNA, 64 nt, Homo Sapiens
uuauggguagaagaccauguuuuguucuuuuaauguaauggagcaagugagauguuaagcccac

SEQ ID NO: 520968 - RNA, 64 nt, Homo Sapiens
ucccagcccuggggguuuaaagaagaggagucaaguaauggaggagucuaguccguccuggcac

SEQ ID NO: 520969 - RNA, 64 nt, Homo Sapiens
gcauaacuugggaucccggguguggauugcaauuguaauggaagguuuucaaagauugauuugg

SEQ ID NO: 520970 - RNA, 64 nt, Homo Sapiens
gguggcaacuggguggcacuuacaggacaccccuguaauggauugcuucaaaauuaggaaauac

SEQ ID NO: 520971 - RNA, 64 nt, Homo Sapiens
auaugaauuuaaaccuaguaccauccaaaaccauguaauggauuuuaagaaucuguuaggccuu

SEQ ID NO: 520972 - RNA, 64 nt, Homo Sapiens
cuuaaguuaaauguuaauacuuuauuguuuugauguaauggaacuuaaggauaaaagaccauaa

SEQ ID NO: 520973 - RNA, 64 nt, Homo Sapiens
agccaagagcgucagguggcaaugugauguuuuaguaauggaaauuggaagaauaaaauucaag

SEQ ID NO: 520974 - RNA, 64 nt, Homo Sapiens
gaggaucacuggagcccaggaguuugaggcugcagcgagcuaugaucgcgccacuacacuccag

SEQ ID NO: 520975 - RNA, 64 nt, Homo Sapiens
gaagaucacgugagcccaggaguuugaggcugcagcgagcuaugaucacaucacuguacuccag

SEQ ID NO: 520976 - RNA, 64 nt, Homo Sapiens
gcucccagcaagagccaagauggggauuacaggugcgagcuacuugccucagccucccaaagug

SEQ ID NO: 520977 - RNA, 64 nt, Homo Sapiens
cuucauauacuucuauuagcagugaugauggaaggcgagcuaagaggagacuuagauccagugg

SEQ ID NO: 520978 - RNA, 50 nt, Homo Sapiens
gccugaggaaccggcggugagcgagcuagagucggucaaggagaauaacu

SEQ ID NO: 520979 - RNA, 64 nt, Homo Sapiens
uggaaagacgucuguguuuugcagcuguuguguggcgagcuauuuucaccugaggacagaugau

SEQ ID NO: 520980 - RNA, 64 nt, Homo Sapiens
agcugaccuuucgggaagccgccccagcugcuuggcgagcuaaccuagcagagcuuuuguuaau

SEQ ID NO: 520981 - RNA, 64 nt, Homo Sapiens
cgaucaucuuugcuacaggcuggcagacacuaaagcgagcuacaguucccugguugaguagguu

SEQ ID NO: 520982 - RNA, 64 nt, Homo Sapiens
cugaggacagagcugguggggcgcgggggggcuggcgagcuacuguaaacuuuaaagaauuccu

SEQ ID NO: 520983 - RNA, 64 nt, Homo Sapiens
cuugucauuaaucgauagaacugccaguucucaagcgagcuaaugagcuccaccaacucucggc

SEQ ID NO: 520984 - RNA, 64 nt, Homo Sapiens
aggguguuuauguaaaacuaaaugagugcaggcagcgagcuacacuuuuuuuuuuccuaaaugg

SEQ ID NO: 520985 - RNA, 64 nt, Homo Sapiens
auggcaaaacaacuggaaggauuuaaaaaaaugugcgagcuaauggcagccgaaugaaaaaaaa

SEQ ID NO: 520986 - RNA, 64 nt, Homo Sapiens
cugaacucuucuccaucuccgaguuggccccaaagcgagcuauggauugguucacccuugcucu

SEQ ID NO: 520987 - RNA, 64 nt, Homo Sapiens
aaaagacgucuccuaagcauggucaccuauagaagcgagcuaccucugccucccaacuccucaa

SEQ ID NO: 520988 - RNA, 64 nt, Homo Sapiens
aagcugaagguauccaaauugcugagggggcugggcgagcuacccaaagguggcuaaggcagag

SEQ ID NO: 520989 - RNA, 64 nt, Homo Sapiens
ggccuguuggcuugugaaauauccaccuggagcggcgagcuagaggcccuucaggucaccaaac

SEQ ID NO: 520990 - RNA, 64 nt, Homo Sapiens
guggcguguagggaacacugcccuggcucagcgugcgagcuaagguggugauguaugcgauggg

SEQ ID NO: 520991 - RNA, 64 nt, Homo Sapiens
gcauuucauucugccucaguuguuguuauuaaaagcgagcuauugcuuucuccagacuuuugua

SEQ ID NO: 520992 - RNA, 64 nt, Homo Sapiens
gcagauuuuaagaaauuauaauguguucauuuauuuccaccacauuuucuuucagggagacuuc

SEQ ID NO: 520993 - RNA, 64 nt, Homo Sapiens
uagagugaaagacuuccuagcacccuauugccaguuccaccaacucucauuccugcuucccucu

SEQ ID NO: 520994 - RNA, 64 nt, Homo Sapiens
aaaccaucgggagcuaagaaaauagaaucuaugcuuccaccaauaaauugucucguuuauuuua

SEQ ID NO: 520995 - RNA, 64 nt, Homo Sapiens
uuuaauugaagggcauuaaucuccauuucuuauuuuccaccaaaaggaaaguaguuauuccuag

SEQ ID NO: 520996 - RNA, 64 nt, Homo Sapiens
uacuagguuuguaauauugggguucaaggccaaauuccaccacugcucuggaguuacagaucug

SEQ ID NO: 520997 - RNA, 64 nt, Homo Sapiens
cgccucccgcagccccgagcccagaccucuguccuuccaccaauuccacaucccucugccccuc

SEQ ID NO: 520998 - RNA, 64 nt, Homo Sapiens
gguaucugcugccucugaaaguagaacuguucauuuccaccaaguuccuggauuuucuuucuau

SEQ ID NO: 520999 - RNA, 64 nt, Homo Sapiens
auuaaucucuaaaauucuaggauuucccuaaaaauuccaccaggucacaaauauaguugaacaa

SEQ ID NO: 521000 - RNA, 57 nt, Homo Sapiens
agccucucaggaagcauugaugaaucauuccaccaagaaaacaaacaagcaccuacc

SEQ ID NO: 521001 - RNA, 64 nt, Homo Sapiens
uaucggccgugauacauuuuuuaauucauuuguuuuccaccauuauauuuuuauacuuuucagu

SEQ ID NO: 521002 - RNA, 64 nt, Homo Sapiens
cauacccucuaagccagcaaaccauacaaaauuuuuccaccacaaaaaaaacaggaaaaaaaga

SEQ ID NO: 521003 - RNA, 64 nt, Homo Sapiens
acucaucucccuuccuucuccugugugcauagcauuccaccaggucacaccuuuuaggcaccua

SEQ ID NO: 521004 - RNA, 64 nt, Homo Sapiens
guaaugccaaugaaagugcugaguucauaugcacuuccaccaaacccuuccccuucccaaaaca

SEQ ID NO: 521005 - RNA, 64 nt, Homo Sapiens
ugcagagauuugaaguuugggcucuacucauuccuuccaccaucccaucuucuguagccccucc

SEQ ID NO: 521006 - RNA, 64 nt, Homo Sapiens; identical to SEQ ID NO: 23340

SEQ ID NO: 521007 - RNA, 64 nt, Homo Sapiens; identical to SEQ ID NO: 23341

SEQ ID NO: 521008 - RNA, 64 nt, Homo Sapiens; identical to SEQ ID NO: 23342

SEQ ID NO: 521009 - RNA, 64 nt, Homo Sapiens; identical to SEQ ID NO: 23343

SEQ ID NO: 521010 - RNA, 64 nt, Homo Sapiens; identical to SEQ ID NO: 23344

SEQ ID NO: 521011 - RNA, 64 nt, Homo Sapiens; identical to SEQ ID NO: 23345

SEQ ID NO: 521012 - RNA, 64 nt, Homo Sapiens; identical to SEQ ID NO: 23346

SEQ ID NO: 521013 - RNA, 64 nt, Homo Sapiens; identical to SEQ ID NO: 23347

SEQ ID NO: 521014 - RNA, 64 nt, Homo Sapiens; identical to SEQ ID NO: 23348

SEQ ID NO: 521015 - RNA, 64 nt, Homo Sapiens; identical to SEQ ID NO: 23349

SEQ ID NO: 521016 - RNA, 64 nt, Homo Sapiens; identical to SEQ ID NO: 23350

SEQ ID NO: 521017 - RNA, 64 nt, Homo Sapiens; identical to SEQ ID NO: 23351

SEQ ID NO: 521018 - RNA, 64 nt, Homo Sapiens; identical to SEQ ID NO: 23352

SEQ ID NO: 521019 - RNA, 64 nt, Homo Sapiens; identical to SEQ ID NO: 23353

SEQ ID NO: 521020 - RNA, 64 nt, Homo Sapiens; identical to SEQ ID NO: 23354

SEQ ID NO: 521021 - RNA, 64 nt, Homo Sapiens; identical to SEQ ID NO: 23355

SEQ ID NO: 521022 - RNA, 64 nt, Homo Sapiens; identical to SEQ ID NO: 23356

SEQ ID NO: 521023 - RNA, 64 nt, Homo Sapiens; identical to SEQ ID NO: 23357

SEQ ID NO: 521024 - RNA, 64 nt, Homo Sapiens; identical to SEQ ID NO: 23358

SEQ ID NO: 521025 - RNA, 64 nt, Homo Sapiens; identical to SEQ ID NO: 23359

SEQ ID NO: 521026 - RNA, 64 nt, Homo Sapiens; identical to SEQ ID NO: 23360

SEQ ID NO: 521027 - RNA, 64 nt, Homo Sapiens; identical to SEQ ID NO: 23361

SEQ ID NO: 521028 - RNA, 64 nt, Homo Sapiens; identical to SEQ ID NO: 23362

SEQ ID NO: 521029 - RNA, 64 nt, Homo Sapiens; identical to SEQ ID NO: 23363

SEQ ID NO: 521030 - RNA, 64 nt, Homo Sapiens; identical to SEQ ID NO: 23364

SEQ ID NO: 521031 - RNA, 64 nt, Homo Sapiens; identical to SEQ ID NO: 23365

SEQ ID NO: 521032 - RNA, 64 nt, Homo Sapiens; identical to SEQ ID NO: 23366

SEQ ID NO: 521033 - RNA, 64 nt, Homo Sapiens; identical to SEQ ID NO: 23367

SEQ ID NO: 521034 - RNA, 64 nt, Homo Sapiens; identical to SEQ ID NO: 23368

SEQ ID NO: 521035 - RNA, 64 nt, Homo Sapiens; identical to SEQ ID NO: 23369

SEQ ID NO: 521036 - RNA, 64 nt, Homo Sapiens; identical to SEQ ID NO: 23370

SEQ ID NO: 521037 - RNA, 64 nt, Homo Sapiens; identical to SEQ ID NO: 23371

SEQ ID NO: 521038 - RNA, 64 nt, Homo Sapiens; identical to SEQ ID NO: 23372

SEQ ID NO: 521039 - RNA, 64 nt, Homo Sapiens; identical to SEQ ID NO: 23373

SEQ ID NO: 521040 - RNA, 64 nt, Homo Sapiens; identical to SEQ ID NO: 23374

SEQ ID NO: 521041 - RNA, 64 nt, Homo Sapiens; identical to SEQ ID NO: 23375

SEQ ID NO: 521042 - RNA, 64 nt, Homo Sapiens; identical to SEQ ID NO: 23376

SEQ ID NO: 521043 - RNA, 64 nt, Homo Sapiens; identical to SEQ ID NO: 23377

SEQ ID NO: 521044 - RNA, 64 nt, Homo Sapiens; identical to SEQ ID NO: 23378

SEQ ID NO: 521045 - RNA, 64 nt, Homo Sapiens; identical to SEQ ID NO: 23379

SEQ ID NO: 521046 - RNA, 64 nt, Homo Sapiens; identical to SEQ ID NO: 23380

SEQ ID NO: 521047 - RNA, 64 nt, Homo Sapiens; identical to SEQ ID NO: 23381

SEQ ID NO: 521048 - RNA, 64 nt, Homo Sapiens; identical to SEQ ID NO: 23382

SEQ ID NO: 521049 - RNA, 64 nt, Homo Sapiens; identical to SEQ ID NO: 23383

SEQ ID NO: 521050 - RNA, 64 nt, Homo Sapiens; identical to SEQ ID NO: 23384

SEQ ID NO: 521051 - RNA, 64 nt, Homo Sapiens; identical to SEQ ID NO: 23385

SEQ ID NO: 521052 - RNA, 64 nt, Homo Sapiens; identical to SEQ ID NO: 23386

SEQ ID NO: 521053 - RNA, 64 nt, Homo Sapiens; identical to SEQ ID NO: 23387

SEQ ID NO: 521054 - RNA, 64 nt, Homo Sapiens; identical to SEQ ID NO: 23388

SEQ ID NO: 521055 - RNA, 64 nt, Homo Sapiens; identical to SEQ ID NO: 23389

SEQ ID NO: 521056 - RNA, 64 nt, Homo Sapiens; identical to SEQ ID NO: 23390

SEQ ID NO: 521057 - RNA, 64 nt, Homo Sapiens; identical to SEQ ID NO: 23391

SEQ ID NO: 521058 - RNA, 64 nt, Homo Sapiens; identical to SEQ ID NO: 23392

SEQ ID NO: 521059 - RNA, 64 nt, Homo Sapiens; identical to SEQ ID NO: 23393

SEQ ID NO: 521060 - RNA, 64 nt, Homo Sapiens; identical to SEQ ID NO: 23394

SEQ ID NO: 521061 - RNA, 64 nt, Homo Sapiens; identical to SEQ ID NO: 23395

SEQ ID NO: 521062 - RNA, 64 nt, Homo Sapiens; identical to SEQ ID NO: 23396

SEQ ID NO: 521063 - RNA, 64 nt, Homo Sapiens; identical to SEQ ID NO: 23397

SEQ ID NO: 521064 - RNA, 64 nt, Homo Sapiens; identical to SEQ ID NO: 23398

SEQ ID NO: 521065 - RNA, 64 nt, Homo Sapiens; identical to SEQ ID NO: 23399

SEQ ID NO: 521066 - RNA, 64 nt, Homo Sapiens; identical to SEQ ID NO: 23400

SEQ ID NO: 521067 - RNA, 64 nt, Homo Sapiens; identical to SEQ ID NO: 23401

SEQ ID NO: 521068 - RNA, 64 nt, Homo Sapiens; identical to SEQ ID NO: 23402

SEQ ID NO: 521069 - RNA, 64 nt, Homo Sapiens; identical to SEQ ID NO: 23403

SEQ ID NO: 521070 - RNA, 64 nt, Homo Sapiens; identical to SEQ ID NO: 23404

SEQ ID NO: 521071 - RNA, 64 nt, Homo Sapiens; identical to SEQ ID NO: 23405

SEQ ID NO: 521072 - RNA, 64 nt, Homo Sapiens; identical to SEQ ID NO: 23406

SEQ ID NO: 521073 - RNA, 64 nt, Homo Sapiens; identical to SEQ ID NO: 23407

SEQ ID NO: 521074 - RNA, 64 nt, Homo Sapiens; identical to SEQ ID NO: 23408

SEQ ID NO: 521075 - RNA, 64 nt, Homo Sapiens; identical to SEQ ID NO: 23409

SEQ ID NO: 521076 - RNA, 64 nt, Homo Sapiens; identical to SEQ ID NO: 23410

SEQ ID NO: 521077 - RNA, 64 nt, Homo Sapiens; identical to SEQ ID NO: 23411

SEQ ID NO: 521078 - RNA, 64 nt, Homo Sapiens; identical to SEQ ID NO: 23412

SEQ ID NO: 521079 - RNA, 64 nt, Homo Sapiens; identical to SEQ ID NO: 23413

SEQ ID NO: 521080 - RNA, 64 nt, Homo Sapiens; identical to SEQ ID NO: 23414

SEQ ID NO: 521081 - RNA, 64 nt, Homo Sapiens; identical to SEQ ID NO: 23415

SEQ ID NO: 521082 - RNA, 64 nt, Homo Sapiens; identical to SEQ ID NO: 23416

SEQ ID NO: 521083 - RNA, 64 nt, Homo Sapiens; identical to SEQ ID NO: 23417

SEQ ID NO: 521084 - RNA, 64 nt, Homo Sapiens; identical to SEQ ID NO: 23418

SEQ ID NO: 521085 - RNA, 64 nt, Homo Sapiens; identical to SEQ ID NO: 23419

SEQ ID NO: 521086 - RNA, 64 nt, Homo Sapiens; identical to SEQ ID NO: 23420

SEQ ID NO: 521087 - RNA, 64 nt, Homo Sapiens; identical to SEQ ID NO: 23421

SEQ ID NO: 521088 - RNA, 64 nt, Homo Sapiens; identical to SEQ ID NO: 23422

SEQ ID NO: 521089 - RNA, 64 nt, Homo Sapiens; identical to SEQ ID NO: 23423

SEQ ID NO: 521090 - RNA, 64 nt, Homo Sapiens; identical to SEQ ID NO: 23424

SEQ ID NO: 521091 - RNA, 64 nt, Homo Sapiens; identical to SEQ ID NO: 23425

SEQ ID NO: 521092 - RNA, 64 nt, Homo Sapiens; identical to SEQ ID NO: 23426

SEQ ID NO: 521093 - RNA, 64 nt, Homo Sapiens; identical to SEQ ID NO: 23427

SEQ ID NO: 521094 - RNA, 64 nt, Homo Sapiens; identical to SEQ ID NO: 23428

SEQ ID NO: 521095 - RNA, 64 nt, Homo Sapiens; identical to SEQ ID NO: 23429

SEQ ID NO: 521096 - RNA, 64 nt, Homo Sapiens; identical to SEQ ID NO: 23430

SEQ ID NO: 521097 - RNA, 64 nt, Homo Sapiens; identical to SEQ ID NO: 23431

SEQ ID NO: 521098 - RNA, 64 nt, Homo Sapiens; identical to SEQ ID NO: 23432

SEQ ID NO: 521099 - RNA, 64 nt, Homo Sapiens; identical to SEQ ID NO: 23433

SEQ ID NO: 521100 - RNA, 64 nt, Homo Sapiens; identical to SEQ ID NO: 23434

SEQ ID NO: 521101 - RNA, 64 nt, Homo Sapiens; identical to SEQ ID NO: 23435

SEQ ID NO: 521102 - RNA, 64 nt, Homo Sapiens; identical to SEQ ID NO: 23436

SEQ ID NO: 521103 - RNA, 64 nt, Homo Sapiens; identical to SEQ ID NO: 23437

SEQ ID NO: 521104 - RNA, 64 nt, Homo Sapiens; identical to SEQ ID NO: 23438

SEQ ID NO: 521105 - RNA, 64 nt, Homo Sapiens; identical to SEQ ID NO: 23439

SEQ ID NO: 521106 - RNA, 64 nt, Homo Sapiens; identical to SEQ ID NO: 23440

SEQ ID NO: 521107 - RNA, 64 nt, Homo Sapiens; identical to SEQ ID NO: 23441

SEQ ID NO: 521108 - RNA, 64 nt, Homo Sapiens; identical to SEQ ID NO: 23442

SEQ ID NO: 521109 - RNA, 64 nt, Homo Sapiens; identical to SEQ ID NO: 23443

SEQ ID NO: 521110 - RNA, 64 nt, Homo Sapiens; identical to SEQ ID NO: 23444

SEQ ID NO: 521111 - RNA, 64 nt, Homo Sapiens; identical to SEQ ID NO: 23445

SEQ ID NO: 521112 - RNA, 64 nt, Homo Sapiens; identical to SEQ ID NO: 23446

SEQ ID NO: 521113 - RNA, 64 nt, Homo Sapiens; identical to SEQ ID NO: 23447

SEQ ID NO: 521114 - RNA, 64 nt, Homo Sapiens; identical to SEQ ID NO: 23448

SEQ ID NO: 521115 - RNA, 64 nt, Homo Sapiens; identical to SEQ ID NO: 23449

SEQ ID NO: 521116 - RNA, 64 nt, Homo Sapiens; identical to SEQ ID NO: 23450

SEQ ID NO: 521117 - RNA, 64 nt, Homo Sapiens; identical to SEQ ID NO: 23451

SEQ ID NO: 521118 - RNA, 64 nt, Homo Sapiens; identical to SEQ ID NO: 23452

SEQ ID NO: 521119 - RNA, 64 nt, Homo Sapiens; identical to SEQ ID NO: 111122

SEQ ID NO: 521120 - RNA, 64 nt, Homo Sapiens; identical to SEQ ID NO: 111123

SEQ ID NO: 521121 - RNA, 64 nt, Homo Sapiens; identical to SEQ ID NO: 111124

SEQ ID NO: 521122 - RNA, 64 nt, Homo Sapiens; identical to SEQ ID NO: 111125

SEQ ID NO: 521123 - RNA, 64 nt, Homo Sapiens; identical to SEQ ID NO: 111126

SEQ ID NO: 521124 - RNA, 64 nt, Homo Sapiens; identical to SEQ ID NO: 111127

SEQ ID NO: 521125 - RNA, 64 nt, Homo Sapiens; identical to SEQ ID NO: 111128

SEQ ID NO: 521126 - RNA, 64 nt, Homo Sapiens; identical to SEQ ID NO: 111129

SEQ ID NO: 521127 - RNA, 64 nt, Homo Sapiens; identical to SEQ ID NO: 111130

SEQ ID NO: 521128 - RNA, 64 nt, Homo Sapiens; identical to SEQ ID NO: 111131

SEQ ID NO: 521129 - RNA, 64 nt, Homo Sapiens; identical to SEQ ID NO: 111132

SEQ ID NO: 521130 - RNA, 64 nt, Homo Sapiens; identical to SEQ ID NO: 111133

SEQ ID NO: 521131 - RNA, 64 nt, Homo Sapiens; identical to SEQ ID NO: 111134

SEQ ID NO: 521132 - RNA, 64 nt, Homo Sapiens; identical to SEQ ID NO: 111135

SEQ ID NO: 521133 - RNA, 64 nt, Homo Sapiens; identical to SEQ ID NO: 111136

SEQ ID NO: 521134 - RNA, 64 nt, Homo Sapiens; identical to SEQ ID NO: 111137

SEQ ID NO: 521135 - RNA, 64 nt, Homo Sapiens; identical to SEQ ID NO: 111138

SEQ ID NO: 521136 - RNA, 64 nt, Homo Sapiens; identical to SEQ ID NO: 111139

SEQ ID NO: 521137 - RNA, 64 nt, Homo Sapiens; identical to SEQ ID NO: 111140

SEQ ID NO: 521138 - RNA, 64 nt, Homo Sapiens; identical to SEQ ID NO: 111141

SEQ ID NO: 521139 - RNA, 64 nt, Homo Sapiens; identical to SEQ ID NO: 111142

SEQ ID NO: 521140 - RNA, 64 nt, Homo Sapiens; identical to SEQ ID NO: 111143

SEQ ID NO: 521141 - RNA, 64 nt, Homo Sapiens; identical to SEQ ID NO: 111144

SEQ ID NO: 521142 - RNA, 64 nt, Homo Sapiens; identical to SEQ ID NO: 111145

SEQ ID NO: 521143 - RNA, 64 nt, Homo Sapiens; identical to SEQ ID NO: 111146

SEQ ID NO: 521144 - RNA, 64 nt, Homo Sapiens; identical to SEQ ID NO: 111147

SEQ ID NO: 521145 - RNA, 64 nt, Homo Sapiens; identical to SEQ ID NO: 111148

SEQ ID NO: 521146 - RNA, 64 nt, Homo Sapiens; identical to SEQ ID NO: 111149

SEQ ID NO: 521147 - RNA, 64 nt, Homo Sapiens; identical to SEQ ID NO: 111150

SEQ ID NO: 521148 - RNA, 64 nt, Homo Sapiens; identical to SEQ ID NO: 111151

SEQ ID NO: 521149 - RNA, 64 nt, Homo Sapiens; identical to SEQ ID NO: 111152

SEQ ID NO: 521150 - RNA, 64 nt, Homo Sapiens; identical to SEQ ID NO: 111153

SEQ ID NO: 521151 - RNA, 64 nt, Homo Sapiens; identical to SEQ ID NO: 111154

SEQ ID NO: 521152 - RNA, 64 nt, Homo Sapiens; identical to SEQ ID NO: 111155

SEQ ID NO: 521153 - RNA, 64 nt, Homo Sapiens; identical to SEQ ID NO: 111156

SEQ ID NO: 521154 - RNA, 64 nt, Homo Sapiens; identical to SEQ ID NO: 111157

SEQ ID NO: 521155 - RNA, 64 nt, Homo Sapiens; identical to SEQ ID NO: 111158

SEQ ID NO: 521156 - RNA, 64 nt, Homo Sapiens; identical to SEQ ID NO: 111159

SEQ ID NO: 521157 - RNA, 64 nt, Homo Sapiens; identical to SEQ ID NO: 111160

SEQ ID NO: 521158 - RNA, 64 nt, Homo Sapiens; identical to SEQ ID NO: 111161

SEQ ID NO: 521159 - RNA, 64 nt, Homo Sapiens; identical to SEQ ID NO: 111162

SEQ ID NO: 521160 - RNA, 64 nt, Homo Sapiens; identical to SEQ ID NO: 111163

SEQ ID NO: 521161 - RNA, 64 nt, Homo Sapiens; identical to SEQ ID NO: 111164

SEQ ID NO: 521162 - RNA, 64 nt, Homo Sapiens; identical to SEQ ID NO: 111165

SEQ ID NO: 521163 - RNA, 64 nt, Homo Sapiens; identical to SEQ ID NO: 111166

SEQ ID NO: 521164 - RNA, 64 nt, Homo Sapiens; identical to SEQ ID NO: 111167

SEQ ID NO: 521165 - RNA, 64 nt, Homo Sapiens; identical to SEQ ID NO: 111168

SEQ ID NO: 521166 - RNA, 64 nt, Homo Sapiens; identical to SEQ ID NO: 111169

SEQ ID NO: 521167 - RNA, 64 nt, Homo Sapiens; identical to SEQ ID NO: 111170

SEQ ID NO: 521168 - RNA, 64 nt, Homo Sapiens; identical to SEQ ID NO: 111171

SEQ ID NO: 521169 - RNA, 64 nt, Homo Sapiens; identical to SEQ ID NO: 111172

SEQ ID NO: 521170 - RNA, 64 nt, Homo Sapiens; identical to SEQ ID NO: 111173

SEQ ID NO: 521171 - RNA, 64 nt, Homo Sapiens; identical to SEQ ID NO: 111174

SEQ ID NO: 521172 - RNA, 64 nt, Homo Sapiens; identical to SEQ ID NO: 111175

SEQ ID NO: 521173 - RNA, 64 nt, Homo Sapiens; identical to SEQ ID NO: 111176

SEQ ID NO: 521174 - RNA, 64 nt, Homo Sapiens; identical to SEQ ID NO: 111177

SEQ ID NO: 521175 - RNA, 64 nt, Homo Sapiens; identical to SEQ ID NO: 111178

SEQ ID NO: 521176 - RNA, 64 nt, Homo Sapiens; identical to SEQ ID NO: 111179

SEQ ID NO: 521177 - RNA, 64 nt, Homo Sapiens; identical to SEQ ID NO: 111180

SEQ ID NO: 521178 - RNA, 64 nt, Homo Sapiens; identical to SEQ ID NO: 111181

SEQ ID NO: 521179 - RNA, 64 nt, Homo Sapiens; identical to SEQ ID NO: 111182

SEQ ID NO: 521180 - RNA, 64 nt, Homo Sapiens; identical to SEQ ID NO: 111183

SEQ ID NO: 521181 - RNA, 64 nt, Homo Sapiens; identical to SEQ ID NO: 111184

SEQ ID NO: 521182 - RNA, 64 nt, Homo Sapiens; identical to SEQ ID NO: 111185

SEQ ID NO: 521183 - RNA, 64 nt, Homo Sapiens; identical to SEQ ID NO: 111186

SEQ ID NO: 521184 - RNA, 64 nt, Homo Sapiens; identical to SEQ ID NO: 111187

SEQ ID NO: 521185 - RNA, 64 nt, Homo Sapiens; identical to SEQ ID NO: 111188

SEQ ID NO: 521186 - RNA, 64 nt, Homo Sapiens; identical to SEQ ID NO: 111189

SEQ ID NO: 521187 - RNA, 64 nt, Homo Sapiens; identical to SEQ ID NO: 111190

SEQ ID NO: 521188 - RNA, 64 nt, Homo Sapiens; identical to SEQ ID NO: 111191

SEQ ID NO: 521189 - RNA, 64 nt, Homo Sapiens; identical to SEQ ID NO: 111192

SEQ ID NO: 521190 - RNA, 64 nt, Homo Sapiens; identical to SEQ ID NO: 111193

SEQ ID NO: 521191 - RNA, 64 nt, Homo Sapiens; identical to SEQ ID NO: 111194

SEQ ID NO: 521192 - RNA, 64 nt, Homo Sapiens; identical to SEQ ID NO: 111195

SEQ ID NO: 521193 - RNA, 64 nt, Homo Sapiens; identical to SEQ ID NO: 111196

SEQ ID NO: 521194 - RNA, 64 nt, Homo Sapiens; identical to SEQ ID NO: 111197

SEQ ID NO: 521195 - RNA, 64 nt, Homo Sapiens; identical to SEQ ID NO: 111198

SEQ ID NO: 521196 - RNA, 64 nt, Homo Sapiens; identical to SEQ ID NO: 111199

SEQ ID NO: 521197 - RNA, 64 nt, Homo Sapiens; identical to SEQ ID NO: 111200

SEQ ID NO: 521198 - RNA, 64 nt, Homo Sapiens; identical to SEQ ID NO: 111201

SEQ ID NO: 521199 - RNA, 64 nt, Homo Sapiens; identical to SEQ ID NO: 111202

SEQ ID NO: 521200 - RNA, 64 nt, Homo Sapiens; identical to SEQ ID NO: 111203

SEQ ID NO: 521201 - RNA, 64 nt, Homo Sapiens; identical to SEQ ID NO: 111204

SEQ ID NO: 521202 - RNA, 64 nt, Homo Sapiens; identical to SEQ ID NO: 111205

SEQ ID NO: 521203 - RNA, 64 nt, Homo Sapiens; identical to SEQ ID NO: 111206

SEQ ID NO: 521204 - RNA, 64 nt, Homo Sapiens; identical to SEQ ID NO: 111207

SEQ ID NO: 521205 - RNA, 64 nt, Homo Sapiens; identical to SEQ ID NO: 111208

SEQ ID NO: 521206 - RNA, 64 nt, Homo Sapiens; identical to SEQ ID NO: 111209

SEQ ID NO: 521207 - RNA, 64 nt, Homo Sapiens; identical to SEQ ID NO: 111210

SEQ ID NO: 521208 - RNA, 64 nt, Homo Sapiens; identical to SEQ ID NO: 111211

SEQ ID NO: 521209 - RNA, 64 nt, Homo Sapiens; identical to SEQ ID NO: 111212

SEQ ID NO: 521210 - RNA, 64 nt, Homo Sapiens; identical to SEQ ID NO: 111213

SEQ ID NO: 521211 - RNA, 64 nt, Homo Sapiens; identical to SEQ ID NO: 111214

SEQ ID NO: 521212 - RNA, 64 nt, Homo Sapiens; identical to SEQ ID NO: 111215

SEQ ID NO: 521213 - RNA, 64 nt, Homo Sapiens; identical to SEQ ID NO: 111216

SEQ ID NO: 521214 - RNA, 64 nt, Homo Sapiens; identical to SEQ ID NO: 111217

SEQ ID NO: 521215 - RNA, 64 nt, Homo Sapiens; identical to SEQ ID NO: 111218

SEQ ID NO: 521216 - RNA, 64 nt, Homo Sapiens; identical to SEQ ID NO: 111219

SEQ ID NO: 521217 - RNA, 64 nt, Homo Sapiens; identical to SEQ ID NO: 111220

SEQ ID NO: 521218 - RNA, 64 nt, Homo Sapiens; identical to SEQ ID NO: 111221

SEQ ID NO: 521219 - RNA, 64 nt, Homo Sapiens; identical to SEQ ID NO: 111222

SEQ ID NO: 521220 - RNA, 64 nt, Homo Sapiens; identical to SEQ ID NO: 111223

SEQ ID NO: 521221 - RNA, 64 nt, Homo Sapiens; identical to SEQ ID NO: 111224

SEQ ID NO: 521222 - RNA, 64 nt, Homo Sapiens; identical to SEQ ID NO: 111225

SEQ ID NO: 521223 - RNA, 64 nt, Homo Sapiens; identical to SEQ ID NO: 111226

SEQ ID NO: 521224 - RNA, 64 nt, Homo Sapiens; identical to SEQ ID NO: 111227

SEQ ID NO: 521225 - RNA, 64 nt, Homo Sapiens; identical to SEQ ID NO: 111228

SEQ ID NO: 521226 - RNA, 64 nt, Homo Sapiens; identical to SEQ ID NO: 111229

SEQ ID NO: 521227 - RNA, 64 nt, Homo Sapiens; identical to SEQ ID NO: 111230

SEQ ID NO: 521228 - RNA, 64 nt, Homo Sapiens; identical to SEQ ID NO: 111231

SEQ ID NO: 521229 - RNA, 64 nt, Homo Sapiens; identical to SEQ ID NO: 111232

SEQ ID NO: 521230 - RNA, 64 nt, Homo Sapiens; identical to SEQ ID NO: 111233

SEQ ID NO: 521231 - RNA, 64 nt, Homo Sapiens; identical to SEQ ID NO: 111234

SEQ ID NO: 521232 - RNA, 64 nt, Homo Sapiens; identical to SEQ ID NO: 111235

SEQ ID NO: 521233 - RNA, 64 nt, Homo Sapiens; identical to SEQ ID NO: 111236

SEQ ID NO: 521234 - RNA, 64 nt, Homo Sapiens; identical to SEQ ID NO: 111237

SEQ ID NO: 521235 - RNA, 64 nt, Homo Sapiens; identical to SEQ ID NO: 111238

SEQ ID NO: 521236 - RNA, 64 nt, Homo Sapiens; identical to SEQ ID NO: 111239

SEQ ID NO: 521237 - RNA, 64 nt, Homo Sapiens; identical to SEQ ID NO: 111240

SEQ ID NO: 521238 - RNA, 64 nt, Homo Sapiens; identical to SEQ ID NO: 111241

SEQ ID NO: 521239 - RNA, 64 nt, Homo Sapiens; identical to SEQ ID NO: 111242

SEQ ID NO: 521240 - RNA, 64 nt, Homo Sapiens; identical to SEQ ID NO: 111243

SEQ ID NO: 521241 - RNA, 64 nt, Homo Sapiens; identical to SEQ ID NO: 111244

SEQ ID NO: 521242 - RNA, 64 nt, Homo Sapiens; identical to SEQ ID NO: 111245

SEQ ID NO: 521243 - RNA, 64 nt, Homo Sapiens; identical to SEQ ID NO: 111246

SEQ ID NO: 521244 - RNA, 64 nt, Homo Sapiens; identical to SEQ ID NO: 111247

SEQ ID NO: 521245 - RNA, 64 nt, Homo Sapiens; identical to SEQ ID NO: 111248

SEQ ID NO: 521246 - RNA, 64 nt, Homo Sapiens; identical to SEQ ID NO: 111249

SEQ ID NO: 521247 - RNA, 64 nt, Homo Sapiens; identical to SEQ ID NO: 111250

SEQ ID NO: 521248 - RNA, 64 nt, Homo Sapiens; identical to SEQ ID NO: 111251

SEQ ID NO: 521249 - RNA, 64 nt, Homo Sapiens; identical to SEQ ID NO: 111252

SEQ ID NO: 521250 - RNA, 64 nt, Homo Sapiens; identical to SEQ ID NO: 111253

SEQ ID NO: 521251 - RNA, 64 nt, Homo Sapiens; identical to SEQ ID NO: 111254

SEQ ID NO: 521252 - RNA, 64 nt, Homo Sapiens; identical to SEQ ID NO: 111255

SEQ ID NO: 521253 - RNA, 64 nt, Homo Sapiens; identical to SEQ ID NO: 111256

SEQ ID NO: 521254 - RNA, 64 nt, Homo Sapiens; identical to SEQ ID NO: 111257

SEQ ID NO: 521255 - RNA, 64 nt, Homo Sapiens; identical to SEQ ID NO: 111258

SEQ ID NO: 521256 - RNA, 64 nt, Homo Sapiens; identical to SEQ ID NO: 111259

SEQ ID NO: 521257 - RNA, 64 nt, Homo Sapiens; identical to SEQ ID NO: 111260

SEQ ID NO: 521258 - RNA, 64 nt, Homo Sapiens; identical to SEQ ID NO: 111261

SEQ ID NO: 521259 - RNA, 64 nt, Homo Sapiens; identical to SEQ ID NO: 111262

SEQ ID NO: 521260 - RNA, 64 nt, Homo Sapiens; identical to SEQ ID NO: 111263

SEQ ID NO: 521261 - RNA, 64 nt, Homo Sapiens; identical to SEQ ID NO: 111264

SEQ ID NO: 521262 - RNA, 64 nt, Homo Sapiens; identical to SEQ ID NO: 111265

SEQ ID NO: 521263 - RNA, 64 nt, Homo Sapiens; identical to SEQ ID NO: 111266

SEQ ID NO: 521264 - RNA, 64 nt, Homo Sapiens; identical to SEQ ID NO: 111267

SEQ ID NO: 521265 - RNA, 64 nt, Homo Sapiens; identical to SEQ ID NO: 111268

SEQ ID NO: 521266 - RNA, 64 nt, Homo Sapiens; identical to SEQ ID NO: 111269

SEQ ID NO: 521267 - RNA, 64 nt, Homo Sapiens; identical to SEQ ID NO: 111270

SEQ ID NO: 521268 - RNA, 64 nt, Homo Sapiens; identical to SEQ ID NO: 111271

SEQ ID NO: 521269 - RNA, 64 nt, Homo Sapiens; identical to SEQ ID NO: 111272

SEQ ID NO: 521270 - RNA, 64 nt, Homo Sapiens; identical to SEQ ID NO: 111273

SEQ ID NO: 521271 - RNA, 64 nt, Homo Sapiens; identical to SEQ ID NO: 111274

SEQ ID NO: 521272 - RNA, 64 nt, Homo Sapiens; identical to SEQ ID NO: 111275

SEQ ID NO: 521273 - RNA, 64 nt, Homo Sapiens; identical to SEQ ID NO: 111276

SEQ ID NO: 521274 - RNA, 64 nt, Homo Sapiens; identical to SEQ ID NO: 111277

SEQ ID NO: 521275 - RNA, 64 nt, Homo Sapiens; identical to SEQ ID NO: 111278

SEQ ID NO: 521276 - RNA, 64 nt, Homo Sapiens; identical to SEQ ID NO: 111279

SEQ ID NO: 521277 - RNA, 64 nt, Homo Sapiens; identical to SEQ ID NO: 111280

SEQ ID NO: 521278 - RNA, 64 nt, Homo Sapiens; identical to SEQ ID NO: 111281

SEQ ID NO: 521279 - RNA, 64 nt, Homo Sapiens; identical to SEQ ID NO: 111282

SEQ ID NO: 521280 - RNA, 64 nt, Homo Sapiens; identical to SEQ ID NO: 111283

SEQ ID NO: 521281 - RNA, 64 nt, Homo Sapiens; identical to SEQ ID NO: 111284

SEQ ID NO: 521282 - RNA, 64 nt, Homo Sapiens; identical to SEQ ID NO: 111285

SEQ ID NO: 521283 - RNA, 64 nt, Homo Sapiens; identical to SEQ ID NO: 111286

SEQ ID NO: 521284 - RNA, 64 nt, Homo Sapiens; identical to SEQ ID NO: 111287

SEQ ID NO: 521285 - RNA, 64 nt, Homo Sapiens; identical to SEQ ID NO: 111288

SEQ ID NO: 521286 - RNA, 64 nt, Homo Sapiens; identical to SEQ ID NO: 111289

SEQ ID NO: 521287 - RNA, 64 nt, Homo Sapiens; identical to SEQ ID NO: 111290

SEQ ID NO: 521288 - RNA, 64 nt, Homo Sapiens; identical to SEQ ID NO: 111291

SEQ ID NO: 521289 - RNA, 64 nt, Homo Sapiens; identical to SEQ ID NO: 111292

SEQ ID NO: 521290 - RNA, 64 nt, Homo Sapiens; identical to SEQ ID NO: 111293

SEQ ID NO: 521291 - RNA, 64 nt, Homo Sapiens; identical to SEQ ID NO: 111294

SEQ ID NO: 521292 - RNA, 64 nt, Homo Sapiens; identical to SEQ ID NO: 111295

SEQ ID NO: 521293 - RNA, 64 nt, Homo Sapiens; identical to SEQ ID NO: 111296

SEQ ID NO: 521294 - RNA, 64 nt, Homo Sapiens; identical to SEQ ID NO: 111297

SEQ ID NO: 521295 - RNA, 64 nt, Homo Sapiens; identical to SEQ ID NO: 111298

SEQ ID NO: 521296 - RNA, 64 nt, Homo Sapiens; identical to SEQ ID NO: 111299

SEQ ID NO: 521297 - RNA, 64 nt, Homo Sapiens; identical to SEQ ID NO: 111300

SEQ ID NO: 521298 - RNA, 64 nt, Homo Sapiens; identical to SEQ ID NO: 111301

SEQ ID NO: 521299 - RNA, 64 nt, Homo Sapiens; identical to SEQ ID NO: 111302

SEQ ID NO: 521300 - RNA, 64 nt, Homo Sapiens; identical to SEQ ID NO: 111303

SEQ ID NO: 521301 - RNA, 64 nt, Homo Sapiens; identical to SEQ ID NO: 111304

SEQ ID NO: 521302 - RNA, 64 nt, Homo Sapiens; identical to SEQ ID NO: 365461

SEQ ID NO: 521303 - RNA, 64 nt, Homo Sapiens; identical to SEQ ID NO: 365462

SEQ ID NO: 521304 - RNA, 64 nt, Homo Sapiens; identical to SEQ ID NO: 365463

SEQ ID NO: 521305 - RNA, 64 nt, Homo Sapiens; identical to SEQ ID NO: 365464

SEQ ID NO: 521306 - RNA, 64 nt, Homo Sapiens; identical to SEQ ID NO: 365465

SEQ ID NO: 521307 - RNA, 64 nt, Homo Sapiens; identical to SEQ ID NO: 365466

SEQ ID NO: 521308 - RNA, 64 nt, Homo Sapiens; identical to SEQ ID NO: 365467

SEQ ID NO: 521309 - RNA, 64 nt, Homo Sapiens; identical to SEQ ID NO: 365468

SEQ ID NO: 521310 - RNA, 64 nt, Homo Sapiens; identical to SEQ ID NO: 365469

SEQ ID NO: 521311 - RNA, 64 nt, Homo Sapiens; identical to SEQ ID NO: 365470

SEQ ID NO: 521312 - RNA, 64 nt, Homo Sapiens; identical to SEQ ID NO: 365471

SEQ ID NO: 521313 - RNA, 64 nt, Homo Sapiens; identical to SEQ ID NO: 365472

SEQ ID NO: 521314 - RNA, 64 nt, Homo Sapiens; identical to SEQ ID NO: 365473

SEQ ID NO: 521315 - RNA, 64 nt, Homo Sapiens; identical to SEQ ID NO: 365474

SEQ ID NO: 521316 - RNA, 64 nt, Homo Sapiens; identical to SEQ ID NO: 365475

SEQ ID NO: 521317 - RNA, 64 nt, Homo Sapiens; identical to SEQ ID NO: 365476

SEQ ID NO: 521318 - RNA, 64 nt, Homo Sapiens; identical to SEQ ID NO: 365477

SEQ ID NO: 521319 - RNA, 64 nt, Homo Sapiens; identical to SEQ ID NO: 365478

SEQ ID NO: 521320 - RNA, 64 nt, Homo Sapiens; identical to SEQ ID NO: 365479

SEQ ID NO: 521321 - RNA, 62 nt, Homo Sapiens; identical to SEQ ID NO: 365480

SEQ ID NO: 521322 - RNA, 64 nt, Homo Sapiens; identical to SEQ ID NO: 365481

SEQ ID NO: 521323 - RNA, 64 nt, Homo Sapiens; identical to SEQ ID NO: 365482

SEQ ID NO: 521324 - RNA, 64 nt, Homo Sapiens; identical to SEQ ID NO: 365483

SEQ ID NO: 521325 - RNA, 64 nt, Homo Sapiens; identical to SEQ ID NO: 365484

SEQ ID NO: 521326 - RNA, 64 nt, Homo Sapiens; identical to SEQ ID NO: 365485

SEQ ID NO: 521327 - RNA, 64 nt, Homo Sapiens; identical to SEQ ID NO: 365486

SEQ ID NO: 521328 - RNA, 64 nt, Homo Sapiens; identical to SEQ ID NO: 365487

SEQ ID NO: 521329 - RNA, 64 nt, Homo Sapiens; identical to SEQ ID NO: 365488

SEQ ID NO: 521330 - RNA, 64 nt, Homo Sapiens; identical to SEQ ID NO: 365489

SEQ ID NO: 521331 - RNA, 64 nt, Homo Sapiens; identical to SEQ ID NO: 365490

SEQ ID NO: 521332 - RNA, 64 nt, Homo Sapiens; identical to SEQ ID NO: 365491

SEQ ID NO: 521333 - RNA, 64 nt, Homo Sapiens; identical to SEQ ID NO: 365492

SEQ ID NO: 521334 - RNA, 64 nt, Homo Sapiens; identical to SEQ ID NO: 365493

SEQ ID NO: 521335 - RNA, 64 nt, Homo Sapiens; identical to SEQ ID NO: 365494

SEQ ID NO: 521336 - RNA, 64 nt, Homo Sapiens; identical to SEQ ID NO: 365495

SEQ ID NO: 521337 - RNA, 64 nt, Homo Sapiens; identical to SEQ ID NO: 365496

SEQ ID NO: 521338 - RNA, 64 nt, Homo Sapiens; identical to SEQ ID NO: 365497

SEQ ID NO: 521339 - RNA, 64 nt, Homo Sapiens; identical to SEQ ID NO: 365498

SEQ ID NO: 521340 - RNA, 64 nt, Homo Sapiens; identical to SEQ ID NO: 365499

SEQ ID NO: 521341 - RNA, 64 nt, Homo Sapiens; identical to SEQ ID NO: 365500

SEQ ID NO: 521342 - RNA, 64 nt, Homo Sapiens; identical to SEQ ID NO: 365501

SEQ ID NO: 521343 - RNA, 64 nt, Homo Sapiens; identical to SEQ ID NO: 365502

SEQ ID NO: 521344 - RNA, 64 nt, Homo Sapiens; identical to SEQ ID NO: 365503

SEQ ID NO: 521345 - RNA, 64 nt, Homo Sapiens; identical to SEQ ID NO: 365504

SEQ ID NO: 521346 - RNA, 56 nt, Homo Sapiens; identical to SEQ ID NO: 365505

SEQ ID NO: 521347 - RNA, 64 nt, Homo Sapiens; identical to SEQ ID NO: 365506

SEQ ID NO: 521348 - RNA, 64 nt, Homo Sapiens; identical to SEQ ID NO: 365507

SEQ ID NO: 521349 - RNA, 64 nt, Homo Sapiens; identical to SEQ ID NO: 365508

SEQ ID NO: 521350 - RNA, 64 nt, Homo Sapiens; identical to SEQ ID NO: 365509

SEQ ID NO: 521351 - RNA, 64 nt, Homo Sapiens; identical to SEQ ID NO: 365510

SEQ ID NO: 521352 - RNA, 64 nt, Homo Sapiens; identical to SEQ ID NO: 365511

SEQ ID NO: 521353 - RNA, 64 nt, Homo Sapiens; identical to SEQ ID NO: 365512

SEQ ID NO: 521354 - RNA, 64 nt, Homo Sapiens; identical to SEQ ID NO: 365513

SEQ ID NO: 521355 - RNA, 64 nt, Homo Sapiens; identical to SEQ ID NO: 365514

SEQ ID NO: 521356 - RNA, 64 nt, Homo Sapiens; identical to SEQ ID NO: 365515

SEQ ID NO: 521357 - RNA, 64 nt, Homo Sapiens; identical to SEQ ID NO: 365516

SEQ ID NO: 521358 - RNA, 64 nt, Homo Sapiens; identical to SEQ ID NO: 365517

SEQ ID NO: 521359 - RNA, 64 nt, Homo Sapiens; identical to SEQ ID NO: 365518

SEQ ID NO: 521360 - RNA, 64 nt, Homo Sapiens; identical to SEQ ID NO: 365519

SEQ ID NO: 521361 - RNA, 64 nt, Homo Sapiens; identical to SEQ ID NO: 365520

SEQ ID NO: 521362 - RNA, 64 nt, Homo Sapiens; identical to SEQ ID NO: 365521

SEQ ID NO: 521363 - RNA, 64 nt, Homo Sapiens; identical to SEQ ID NO: 365522

SEQ ID NO: 521364 - RNA, 64 nt, Homo Sapiens; identical to SEQ ID NO: 365523

SEQ ID NO: 521365 - RNA, 64 nt, Homo Sapiens; identical to SEQ ID NO: 365524

SEQ ID NO: 521366 - RNA, 64 nt, Homo Sapiens; identical to SEQ ID NO: 365525

SEQ ID NO: 521367 - RNA, 64 nt, Homo Sapiens; identical to SEQ ID NO: 219898

SEQ ID NO: 521368 - RNA, 64 nt, Homo Sapiens; identical to SEQ ID NO: 219899

SEQ ID NO: 521369 - RNA, 64 nt, Homo Sapiens; identical to SEQ ID NO: 219900

SEQ ID NO: 521370 - RNA, 64 nt, Homo Sapiens; identical to SEQ ID NO: 219901

SEQ ID NO: 521371 - RNA, 64 nt, Homo Sapiens; identical to SEQ ID NO: 219902

SEQ ID NO: 521372 - RNA, 64 nt, Homo Sapiens; identical to SEQ ID NO: 219903

SEQ ID NO: 521373 - RNA, 64 nt, Homo Sapiens
uauuaccaauguggguguaaauuuuuaaaaaaugauuauugauagaaguuuggcaggaaaauuc

SEQ ID NO: 521374 - RNA, 64 nt, Homo Sapiens
uggucaaaagucaaaauaguauuagaauauugaaauuauugauagcuuucauaaucucagcuuu

SEQ ID NO: 521375 - RNA, 64 nt, Homo Sapiens
aaaauauccuuucuccacgguugucccacugcugauuauugagauuuugcuuguggaucuccac

SEQ ID NO: 521376 - RNA, 64 nt, Homo Sapiens
ugggugagcuauuuguauauugagccuucuuuuuauuauugaguaaccacuagacuaccaggga

SEQ ID NO: 521377 - RNA, 64 nt, Homo Sapiens
guaggacagcuaagaaauuaauauuaauaucaaaauuauugauaaucuuaaauuauugauuauu

SEQ ID NO: 521378 - RNA, 64 nt, Homo Sapiens
uuaauauuaauaucaaaauuauugauaaucuuaaauuauugauuauuccuuaacgcacuccauu

SEQ ID NO: 521379 - RNA, 64 nt, Homo Sapiens
agaggccuaaagaggacugugaguaauguaaacuauuauugaguauguagaaugauuuuguuaa

SEQ ID NO: 521380 - RNA, 64 nt, Homo Sapiens
guacuuuuguauuuugauaugaaagucagaggugauuauugauaauugcacugaauuuaaaucu

SEQ ID NO: 521381 - RNA, 64 nt, Homo Sapiens
uauccuacuacuuuuaaucugauuuuucuucaggauuauugaguagguugugaauuuucuuucu

SEQ ID NO: 521382 - RNA, 64 nt, Homo Sapiens
auuucuuaaaugaagagacuuucauucuuuaaauauuauugacuuacaguuuaaaaauaaauaa

SEQ ID NO: 521383 - RNA, 64 nt, Homo Sapiens
auauauauauacauauauauauaucaaguuuuaaauuauugauaguucaucuggauuaccaaaa

SEQ ID NO: 521384 - RNA, 64 nt, Homo Sapiens
aaauacuugaaugagcuuguauuauaacauuaauauuauugagaguaucugcuuuccaggcuga

SEQ ID NO: 521385 - RNA, 64 nt, Homo Sapiens
uauuagaauauguuaguuaucuuucuccaagcaaauuauugaacuuuauguauacuagccuggc

SEQ ID NO: 521386 - RNA, 64 nt, Homo Sapiens
gccuaugaauuuaaaaccaggauuuccgggaauuauuauugaaaacuaaucaaaguugugugau

SEQ ID NO: 521387 - RNA, 64 nt, Homo Sapiens
ugagaccuuaaugacaaaucuagauuuuaaauguauuauugaccacuaucuuuccaaacuuugu

SEQ ID NO: 521388 - RNA, 64 nt, Homo Sapiens
gacagcuuguggaacuaauuguugccuucagaguauuauugacaauucuggugcugaugaauag

SEQ ID NO: 521389 - RNA, 64 nt, Homo Sapiens
uauaauuuacauaccauaaguuuagaguaacagcauuauugagaaugucgaugaccuuuuuuuc

SEQ ID NO: 521390 - RNA, 64 nt, Homo Sapiens
acaguaugaaguaaaacuauaaaguagcuaauccauuauugaucaauuuguccuagauaaggau

SEQ ID NO: 521391 - RNA, 64 nt, Homo Sapiens
aaauguagcaguuugcauauuugugcaugaauugauuauugagauuucuauugccauuuuuuau

SEQ ID NO: 521392 - RNA, 64 nt, Homo Sapiens
cauuucaaauuuauaccagcagaacaugguagggauuauugaaugcuuauggacugagaaaggg

SEQ ID NO: 521393 - RNA, 64 nt, Homo Sapiens
gcagaauguauaucaucccaucugaaaaacacuaauuauugacaugugcaucuguacaauaaac

SEQ ID NO: 521394 - RNA, 64 nt, Homo Sapiens
uuaaauaaucaaauauaucuacuacauuguuuauauuauugaauaaaguauauuuuccaaaugu

SEQ ID NO: 521395 - RNA, 64 nt, Homo Sapiens
gaucaggaauacucuuccaggaguacaaaauuacauuauugauaguuaagcucuuaauugugua

SEQ ID NO: 521396 - RNA, 64 nt, Homo Sapiens
cuuccaacuaaaauuacaauauuuuuagguuaaaauuauugagauauaaagcagccauugggaa

SEQ ID NO: 521397 - RNA, 64 nt, Homo Sapiens
aguaauuaaacuuuaacugauuguuaaagagugaauuauugaauauuuaucaaaacucauuuuc

SEQ ID NO: 521398 - RNA, 64 nt, Homo Sapiens
uagaagaugcugcagggaaagucauugccacuaaauuauugagcuuuugacagcauuugugacu

SEQ ID NO: 521399 - RNA, 64 nt, Homo Sapiens
uguuguugcaguuguuuugaaacaaaauuauccuauuauugaccauugcuagagacccacaucc

SEQ ID NO: 521400 - RNA, 64 nt, Homo Sapiens
caucuagcugcaaagaaggcuagggaaugucuuuauuauugauugucaugugccuugauaagca

SEQ ID NO: 521401 - RNA, 64 nt, Homo Sapiens
cugcagaagugcagggcaccaguaaacaccauguauuauugaagaugaaucuguuuguauguau

SEQ ID NO: 521402 - RNA, 64 nt, Homo Sapiens
gagaaugauaagaugagggaaggaaaaggcauucauuauugacuuacaugucaguaaggucugc

SEQ ID NO: 521403 - RNA, 64 nt, Homo Sapiens
ggaaugaaaucauuuauaaagaacaacuguuucuauuauugaaaauuguauguaaaacuauuua

SEQ ID NO: 521404 - RNA, 64 nt, Homo Sapiens
acuauuuaaaauagaauagaaggauacacacccaauuauugauagcauugucucuggagauuga

SEQ ID NO: 521405 - RNA, 64 nt, Homo Sapiens
cugacuacauuucuagagucagagcuugaucaccacaacucaauuauuucggcaucuuuucacc

SEQ ID NO: 521406 - RNA, 64 nt, Homo Sapiens
uugguuccacucagcaucaagaagacagggacaaacaacucaagugucuuaacagcugcuggag

SEQ ID NO: 521407 - RNA, 64 nt, Homo Sapiens
uucauauauuauuccguauuacaggauucccuccacaacucaguuauauucacuuucauuuuug

SEQ ID NO: 521408 - RNA, 64 nt, Homo Sapiens
aauacuaacugcugauuuugaaugcaguuguuguacaacucauauuauuggaggauuuggucag

SEQ ID NO: 521409 - RNA, 64 nt, Homo Sapiens
gauucuaguggcaguauucuuguaaccuguuagacguggauauaccucuucaggauggccuccu

SEQ ID NO: 521410 - RNA, 64 nt, Homo Sapiens
uuguggaaaucauccaauuaaugguuagaaacuucguggauaguuuguacuucacugaauugug

SEQ ID NO: 521411 - RNA, 64 nt, Homo Sapiens
ucaguguccacacacccaccugcugccagaggaccguggauaccgccaggcuggggccaugggc

SEQ ID NO: 521412 - RNA, 64 nt, Homo Sapiens
aaacuuugacgacgcugagaauuccaggacgcuccguggauaauucaguauccgaagcgggugg

SEQ ID NO: 521413 - RNA, 64 nt, Homo Sapiens
caagucaucauaaacuagguauugcauugcuauccguggauacagacgcuuagcucuuaaaaga

SEQ ID NO: 521414 - RNA, 64 nt, Homo Sapiens
uaagggagcuacgcugugguuuauucuuaaguuacguggauaaacuaaccucuaacagaaauau

SEQ ID NO: 521415 - RNA, 64 nt, Homo Sapiens
ggaacacaugccauccaaguuugugaaaucaaugcguggauaaacagaguaagccgguaaaugu

SEQ ID NO: 521416 - RNA, 64 nt, Homo Sapiens
gggugccuugcccuggucuaauccaggacauagccguggauacguccaaaaauccccagaaccu

SEQ ID NO: 521417 - RNA, 64 nt, Homo Sapiens
gagcuuauucagguuuccuguccuugcugugggucguggauaagaauucagcaaggcuuucaua

SEQ ID NO: 521418 - RNA, 64 nt, Homo Sapiens
uuucuuauuguuaccacauguucaccuuuaucagcguggauacugucagcaugaguacauauuu

SEQ ID NO: 521419 - RNA, 59 nt, Homo Sapiens
gcauccuaacaaaccguuaggaacagccccguggauacugaaguuuuuuuuaugguagu

SEQ ID NO: 521420 - RNA, 64 nt, Homo Sapiens
gcgggugagguuccgacacugaucccagagaugccguggauacgccagggucccagggggaauc

SEQ ID NO: 521421 - RNA, 64 nt, Homo Sapiens
gcugcccagaaugcacagcgaugguaagagacaccguggauauucuucaucagaagcuuuaauc

SEQ ID NO: 521422 - RNA, 64 nt, Homo Sapiens
gccagaacacuuaggagggucaacaccuucugaacguggauagucuccagagaccuaauggccu

SEQ ID NO: 521423 - RNA, 64 nt, Homo Sapiens
ucuguacuauuucaucugguuggugauauguuugcguggauacguaaauuguuuuucauaauag

SEQ ID NO: 521424 - RNA, 64 nt, Homo Sapiens
ucccucaggugcggugacagcaaucgucugggcucguggauaugugcugagaugccuuucaaug

SEQ ID NO: 521425 - RNA, 64 nt, Homo Sapiens
guuaaauguaaugggaagguggcagacuuaagaacguggauaugaagugccuagaaccaccaca

SEQ ID NO: 521426 - RNA, 64 nt, Homo Sapiens
guuguuagguuuuuguguaagauucuugcuguagcguggauagcugugauuggugagucaaccg

SEQ ID NO: 521427 - RNA, 64 nt, Homo Sapiens
aagguuuuuaaaacauggauggaugaaaggacagcguggauaaagucacuaagcucaagugcuu

SEQ ID NO: 521428 - RNA, 64 nt, Homo Sapiens
gcucgcucucuccugcaaugauugaugaucacuccguggauagagaggcacacugucagaggug

SEQ ID NO: 521429 - RNA, 64 nt, Homo Sapiens
cugaauuccaagcuccacuggcauuucagucugacguggauaaagaagaagauaagaaagaggu

SEQ ID NO: 521430 - RNA, 64 nt, Homo Sapiens
acuuuagacaccacccagccgauucagaaauuuacguggauaggugacauaugggaagacaaca

SEQ ID NO: 521431 - RNA, 64 nt, Homo Sapiens
uuuccugcugugaaaacucaucuuucauuuuugccguggauaggcgcuuuuauuaauuguuguc

SEQ ID NO: 521432 - RNA, 64 nt, Homo Sapiens
cuccucaucaguguguaaauaauuugcacugaaacguggauacagagccacgaguuuggauguu

SEQ ID NO: 521433 - RNA, 64 nt, Homo Sapiens
ugggccagccuggauauacaaaguguaucuguuacguggauauaauuaacaaugagaaagagag

SEQ ID NO: 521434 - RNA, 64 nt, Homo Sapiens
gaaaugugcacacuaauauuuaguuuugcuuucucguggauaauauuaagcacuuacucugcag

SEQ ID NO: 521435 - RNA, 64 nt, Homo Sapiens
gguguugagccuggacugugggaggaaagagcugcguggauagauucaaacuuccugugguagu

SEQ ID NO: 521436 - RNA, 64 nt, Homo Sapiens
gugggacuaauguauugguaacagaaaguaaagccguggauacgagguaacggaaaccucaauc

SEQ ID NO: 521437 - RNA, 64 nt, Homo Sapiens
ggcuguguuccucgggcucuucuggaccuugcaccguggauaccaggccaugugccaugguauu

SEQ ID NO: 521438 - RNA, 64 nt, Homo Sapiens
ccccugcagguucugacaggaacagcauggauuccguggauagcuguugcagucucaagaagac

SEQ ID NO: 521439 - RNA, 64 nt, Homo Sapiens
uuaaagcagucuugcaggucgcuccuuucccagccguggauaaaaacugaagcuaggaaucuaa

SEQ ID NO: 521440 - RNA, 64 nt, Homo Sapiens
cacacuuugaagaauacagaccccaguaucuagucguggauauaauuaaaacgcugaagaccau

SEQ ID NO: 521441 - RNA, 64 nt, Homo Sapiens
ccagauuuaucaaauggucaugcccacugggagccguggauaugcguggggacauccuggguca

SEQ ID NO: 521442 - RNA, 64 nt, Homo Sapiens; identical to SEQ ID NO: 168425

SEQ ID NO: 521443 - RNA, 64 nt, Homo Sapiens; identical to SEQ ID NO: 168426

SEQ ID NO: 521444 - RNA, 64 nt, Homo Sapiens; identical to SEQ ID NO: 168427

SEQ ID NO: 521445 - RNA, 64 nt, Homo Sapiens; identical to SEQ ID NO: 168428

SEQ ID NO: 521446 - RNA, 64 nt, Homo Sapiens; identical to SEQ ID NO: 168429

SEQ ID NO: 521447 - RNA, 64 nt, Homo Sapiens; identical to SEQ ID NO: 168430

SEQ ID NO: 521448 - RNA, 64 nt, Homo Sapiens; identical to SEQ ID NO: 168431

SEQ ID NO: 521449 - RNA, 64 nt, Homo Sapiens; identical to SEQ ID NO: 168432

SEQ ID NO: 521450 - RNA, 64 nt, Homo Sapiens; identical to SEQ ID NO: 168433

SEQ ID NO: 521451 - RNA, 64 nt, Homo Sapiens; identical to SEQ ID NO: 168434

SEQ ID NO: 521452 - RNA, 64 nt, Homo Sapiens; identical to SEQ ID NO: 168435

SEQ ID NO: 521453 - RNA, 64 nt, Homo Sapiens; identical to SEQ ID NO: 168436

SEQ ID NO: 521454 - RNA, 64 nt, Homo Sapiens; identical to SEQ ID NO: 168437

SEQ ID NO: 521455 - RNA, 64 nt, Homo Sapiens; identical to SEQ ID NO: 168438

SEQ ID NO: 521456 - RNA, 64 nt, Homo Sapiens; identical to SEQ ID NO: 168439

SEQ ID NO: 521457 - RNA, 64 nt, Homo Sapiens; identical to SEQ ID NO: 168440

SEQ ID NO: 521458 - RNA, 64 nt, Homo Sapiens; identical to SEQ ID NO: 168441

SEQ ID NO: 521459 - RNA, 64 nt, Homo Sapiens; identical to SEQ ID NO: 168442

SEQ ID NO: 521460 - RNA, 64 nt, Homo Sapiens; identical to SEQ ID NO: 168443

SEQ ID NO: 521461 - RNA, 64 nt, Homo Sapiens; identical to SEQ ID NO: 168444

SEQ ID NO: 521462 - RNA, 64 nt, Homo Sapiens; identical to SEQ ID NO: 168445

SEQ ID NO: 521463 - RNA, 64 nt, Homo Sapiens; identical to SEQ ID NO: 168446

SEQ ID NO: 521464 - RNA, 64 nt, Homo Sapiens; identical to SEQ ID NO: 327018

SEQ ID NO: 521465 - RNA, 64 nt, Homo Sapiens; identical to SEQ ID NO: 327019

SEQ ID NO: 521466 - RNA, 64 nt, Homo Sapiens; identical to SEQ ID NO: 327020

SEQ ID NO: 521467 - RNA, 64 nt, Homo Sapiens; identical to SEQ ID NO: 327021

SEQ ID NO: 521468 - RNA, 64 nt, Homo Sapiens; identical to SEQ ID NO: 327022

SEQ ID NO: 521469 - RNA, 64 nt, Homo Sapiens; identical to SEQ ID NO: 327023

SEQ ID NO: 521470 - RNA, 64 nt, Homo Sapiens; identical to SEQ ID NO: 327024

SEQ ID NO: 521471 - RNA, 64 nt, Homo Sapiens; identical to SEQ ID NO: 327025

SEQ ID NO: 521472 - RNA, 64 nt, Homo Sapiens; identical to SEQ ID NO: 327026

SEQ ID NO: 521473 - RNA, 64 nt, Homo Sapiens; identical to SEQ ID NO: 327027

SEQ ID NO: 521474 - RNA, 64 nt, Homo Sapiens; identical to SEQ ID NO: 327028

SEQ ID NO: 521475 - RNA, 64 nt, Homo Sapiens; identical to SEQ ID NO: 327029

SEQ ID NO: 521476 - RNA, 64 nt, Homo Sapiens; identical to SEQ ID NO: 327030

SEQ ID NO: 521477 - RNA, 64 nt, Homo Sapiens; identical to SEQ ID NO: 327031

SEQ ID NO: 521478 - RNA, 64 nt, Homo Sapiens; identical to SEQ ID NO: 327032

SEQ ID NO: 521479 - RNA, 64 nt, Homo Sapiens; identical to SEQ ID NO: 327033

SEQ ID NO: 521480 - RNA, 64 nt, Homo Sapiens; identical to SEQ ID NO: 327034

SEQ ID NO: 521481 - RNA, 64 nt, Homo Sapiens; identical to SEQ ID NO: 327035

SEQ ID NO: 521482 - RNA, 64 nt, Homo Sapiens; identical to SEQ ID NO: 168425

SEQ ID NO: 521483 - RNA, 64 nt, Homo Sapiens; identical to SEQ ID NO: 168426

SEQ ID NO: 521484 - RNA, 64 nt, Homo Sapiens; identical to SEQ ID NO: 168427

SEQ ID NO: 521485 - RNA, 64 nt, Homo Sapiens; identical to SEQ ID NO: 168428

SEQ ID NO: 521486 - RNA, 64 nt, Homo Sapiens; identical to SEQ ID NO: 168429

SEQ ID NO: 521487 - RNA, 64 nt, Homo Sapiens; identical to SEQ ID NO: 168430

SEQ ID NO: 521488 - RNA, 64 nt, Homo Sapiens; identical to SEQ ID NO: 168431

SEQ ID NO: 521489 - RNA, 64 nt, Homo Sapiens; identical to SEQ ID NO: 168432

SEQ ID NO: 521490 - RNA, 64 nt, Homo Sapiens; identical to SEQ ID NO: 168433

SEQ ID NO: 521491 - RNA, 64 nt, Homo Sapiens; identical to SEQ ID NO: 168434

SEQ ID NO: 521492 - RNA, 64 nt, Homo Sapiens; identical to SEQ ID NO: 168435

SEQ ID NO: 521493 - RNA, 64 nt, Homo Sapiens; identical to SEQ ID NO: 168436

SEQ ID NO: 521494 - RNA, 64 nt, Homo Sapiens; identical to SEQ ID NO: 168437

SEQ ID NO: 521495 - RNA, 64 nt, Homo Sapiens; identical to SEQ ID NO: 168438

SEQ ID NO: 521496 - RNA, 64 nt, Homo Sapiens; identical to SEQ ID NO: 168439

SEQ ID NO: 521497 - RNA, 64 nt, Homo Sapiens; identical to SEQ ID NO: 168440

SEQ ID NO: 521498 - RNA, 64 nt, Homo Sapiens; identical to SEQ ID NO: 168441

SEQ ID NO: 521499 - RNA, 64 nt, Homo Sapiens; identical to SEQ ID NO: 168442

SEQ ID NO: 521500 - RNA, 64 nt, Homo Sapiens; identical to SEQ ID NO: 168443

SEQ ID NO: 521501 - RNA, 64 nt, Homo Sapiens; identical to SEQ ID NO: 168444

SEQ ID NO: 521502 - RNA, 64 nt, Homo Sapiens; identical to SEQ ID NO: 168445

SEQ ID NO: 521503 - RNA, 64 nt, Homo Sapiens; identical to SEQ ID NO: 168446

SEQ ID NO: 521504 - RNA, 64 nt, Homo Sapiens; identical to SEQ ID NO: 327018

SEQ ID NO: 521505 - RNA, 64 nt, Homo Sapiens; identical to SEQ ID NO: 327019

SEQ ID NO: 521506 - RNA, 64 nt, Homo Sapiens; identical to SEQ ID NO: 327020

SEQ ID NO: 521507 - RNA, 64 nt, Homo Sapiens; identical to SEQ ID NO: 327021

SEQ ID NO: 521508 - RNA, 64 nt, Homo Sapiens; identical to SEQ ID NO: 327022

SEQ ID NO: 521509 - RNA, 64 nt, Homo Sapiens; identical to SEQ ID NO: 327023

SEQ ID NO: 521510 - RNA, 64 nt, Homo Sapiens; identical to SEQ ID NO: 327024

SEQ ID NO: 521511 - RNA, 64 nt, Homo Sapiens; identical to SEQ ID NO: 327025

SEQ ID NO: 521512 - RNA, 64 nt, Homo Sapiens; identical to SEQ ID NO: 327026

SEQ ID NO: 521513 - RNA, 64 nt, Homo Sapiens; identical to SEQ ID NO: 327027

SEQ ID NO: 521514 - RNA, 64 nt, Homo Sapiens; identical to SEQ ID NO: 327028

SEQ ID NO: 521515 - RNA, 64 nt, Homo Sapiens; identical to SEQ ID NO: 327029

SEQ ID NO: 521516 - RNA, 64 nt, Homo Sapiens; identical to SEQ ID NO: 327030

SEQ ID NO: 521517 - RNA, 64 nt, Homo Sapiens; identical to SEQ ID NO: 327031

SEQ ID NO: 521518 - RNA, 64 nt, Homo Sapiens; identical to SEQ ID NO: 327032

SEQ ID NO: 521519 - RNA, 64 nt, Homo Sapiens; identical to SEQ ID NO: 327033

SEQ ID NO: 521520 - RNA, 64 nt, Homo Sapiens; identical to SEQ ID NO: 327034

SEQ ID NO: 521521 - RNA, 64 nt, Homo Sapiens; identical to SEQ ID NO: 327035

SEQ ID NO: 521522 - RNA, 64 nt, Homo Sapiens; identical to SEQ ID NO: 485099

SEQ ID NO: 521523 - RNA, 64 nt, Homo Sapiens; identical to SEQ ID NO: 485100

SEQ ID NO: 521524 - RNA, 64 nt, Homo Sapiens; identical to SEQ ID NO: 485101

SEQ ID NO: 521525 - RNA, 64 nt, Homo Sapiens; identical to SEQ ID NO: 485102

SEQ ID NO: 521526 - RNA, 64 nt, Homo Sapiens; identical to SEQ ID NO: 485103

SEQ ID NO: 521527 - RNA, 64 nt, Homo Sapiens; identical to SEQ ID NO: 485104

SEQ ID NO: 521528 - RNA, 64 nt, Homo Sapiens; identical to SEQ ID NO: 485105

SEQ ID NO: 521529 - RNA, 64 nt, Homo Sapiens; identical to SEQ ID NO: 485106

SEQ ID NO: 521530 - RNA, 64 nt, Homo Sapiens; identical to SEQ ID NO: 485107

SEQ ID NO: 521531 - RNA, 64 nt, Homo Sapiens; identical to SEQ ID NO: 485108

SEQ ID NO: 521532 - RNA, 64 nt, Homo Sapiens; identical to SEQ ID NO: 485109

SEQ ID NO: 521533 - RNA, 64 nt, Homo Sapiens; identical to SEQ ID NO: 485110

SEQ ID NO: 521534 - RNA, 64 nt, Homo Sapiens; identical to SEQ ID NO: 485111

SEQ ID NO: 521535 - RNA, 64 nt, Homo Sapiens; identical to SEQ ID NO: 485112

SEQ ID NO: 521536 - RNA, 64 nt, Homo Sapiens; identical to SEQ ID NO: 485113

SEQ ID NO: 521537 - RNA, 64 nt, Homo Sapiens; identical to SEQ ID NO: 485114

SEQ ID NO: 521538 - RNA, 64 nt, Homo Sapiens; identical to SEQ ID NO: 485115

SEQ ID NO: 521539 - RNA, 64 nt, Homo Sapiens; identical to SEQ ID NO: 485116

SEQ ID NO: 521540 - RNA, 64 nt, Homo Sapiens; identical to SEQ ID NO: 485117

SEQ ID NO: 521541 - RNA, 64 nt, Homo Sapiens; identical to SEQ ID NO: 485118

SEQ ID NO: 521542 - RNA, 64 nt, Homo Sapiens; identical to SEQ ID NO: 245406

SEQ ID NO: 521543 - RNA, 64 nt, Homo Sapiens; identical to SEQ ID NO: 245407

SEQ ID NO: 521544 - RNA, 64 nt, Homo Sapiens; identical to SEQ ID NO: 245408

SEQ ID NO: 521545 - RNA, 64 nt, Homo Sapiens; identical to SEQ ID NO: 245409

SEQ ID NO: 521546 - RNA, 64 nt, Homo Sapiens; identical to SEQ ID NO: 245410

SEQ ID NO: 521547 - RNA, 64 nt, Homo Sapiens; identical to SEQ ID NO: 245411

SEQ ID NO: 521548 - RNA, 64 nt, Homo Sapiens; identical to SEQ ID NO: 425218

SEQ ID NO: 521549 - RNA, 64 nt, Homo Sapiens; identical to SEQ ID NO: 425219

SEQ ID NO: 521550 - RNA, 64 nt, Homo Sapiens; identical to SEQ ID NO: 425220

SEQ ID NO: 521551 - RNA, 64 nt, Homo Sapiens; identical to SEQ ID NO: 425221

SEQ ID NO: 521552 - RNA, 64 nt, Homo Sapiens; identical to SEQ ID NO: 425222

SEQ ID NO: 521553 - RNA, 64 nt, Homo Sapiens; identical to SEQ ID NO: 425223

SEQ ID NO: 521554 - RNA, 64 nt, Homo Sapiens; identical to SEQ ID NO: 425224

SEQ ID NO: 521555 - RNA, 64 nt, Homo Sapiens; identical to SEQ ID NO: 425225

SEQ ID NO: 521556 - RNA, 64 nt, Homo Sapiens; identical to SEQ ID NO: 425226

SEQ ID NO: 521557 - RNA, 64 nt, Homo Sapiens; identical to SEQ ID NO: 425227

SEQ ID NO: 521558 - RNA, 64 nt, Homo Sapiens; identical to SEQ ID NO: 425228

SEQ ID NO: 521559 - RNA, 64 nt, Homo Sapiens; identical to SEQ ID NO: 425229

SEQ ID NO: 521560 - RNA, 64 nt, Homo Sapiens
acuguugcugaaauguggcuuuggcauuguuggauuucauaaaaaauuucuggcaggaagucuu

SEQ ID NO: 521561 - RNA, 64 nt, Homo Sapiens
uaaaaaauaaaaguaucuccuagucccuuaauuuuuucauaaauauuucuggcuuuugaguagu

SEQ ID NO: 521562 - RNA, 64 nt, Homo Sapiens
uuuaaaauaauuauuuuugaaacuaaaaauuuuguuucauaaauuaugauuauauuuccuauau

SEQ ID NO: 521563 - RNA, 64 nt, Homo Sapiens
aagcagaucaacuuaaaggauuuuuuuccuuucuuuucauaaugauauaaaacuagaaagggac

SEQ ID NO: 521564 - RNA, 64 nt, Homo Sapiens
auaaagcuuaaaaauugucugggaaucugaaauguuucauaaaaauugaugugcugugauauga

SEQ ID NO: 521565 - RNA, 64 nt, Homo Sapiens
acaauucagcaaauauuuccauccaagaggaagcuuucauaaaagauacucugauccuuacaga

SEQ ID NO: 521566 - RNA, 64 nt, Homo Sapiens
cuggaaguauuuaauaaguugcaaaugcaguuccuuucauaauaucucagcaccagaaacaaaa

SEQ ID NO: 521567 - RNA, 64 nt, Homo Sapiens
caaaauaucacugacucaucccuacccauauucuuuucauaaaacccacucaccagguacaaua

SEQ ID NO: 521568 - RNA, 64 nt, Homo Sapiens
gaaugauuuaaauugaaguguucaauuaagaaauuuucauaauguuuugaagaaauagucuccc

SEQ ID NO: 521569 - RNA, 64 nt, Homo Sapiens
aagcacuuugcuauguagcuccuguuuucuucauuuucauaauguaaaauauauuuuucucaua

SEQ ID NO: 521570 - RNA, 64 nt, Homo Sapiens
uacucuuuguauacaaguguuuauuaguauugcuuuucauaauucugucucacugaaaaccuua

SEQ ID NO: 521571 - RNA, 64 nt, Homo Sapiens
gauugggaauauguaaacucaacuggagauuuuuuuucauaaaaauuuauauaguuccagcccu

SEQ ID NO: 521572 - RNA, 64 nt, Homo Sapiens
gagaauaaauaacuguuuuguguugguuggugguuuucauaaucuuauuucuguacuggaacua

SEQ ID NO: 521573 - RNA, 64 nt, Homo Sapiens
auuauucugcaauauuguaauucauaguuugacuuuucauaagcaaauaaaucccuaggaugua

SEQ ID NO: 521574 - RNA, 64 nt, Homo Sapiens
cugcuuucuuaugacuguuuuuauaaauaaacuguuucauaaauaauguauacuggaaaauugu

SEQ ID NO: 521575 - RNA, 64 nt, Homo Sapiens
ccaaaaucuccaaaccucugaaaacugaaauauuuuucauaaauuaggcguaaauucuaugccc

SEQ ID NO: 521576 - RNA, 64 nt, Homo Sapiens
ggcuuuuucugcaaugagcagcagcugacugaauuuucauaagaaacuuggacugcaggacuua

SEQ ID NO: 521577 - RNA, 64 nt, Homo Sapiens
aggacuuaaucuguagucuuuagacaacaguugcuuucauaaagacuaguucuuaucaaccuug

SEQ ID NO: 521578 - RNA, 64 nt, Homo Sapiens
cacuuccuuggaauauagcuuuugaguauucagauuucauaaaagugaaaauacagaaggggug

SEQ ID NO: 521579 - RNA, 64 nt, Homo Sapiens
cauuuagcaauccaggccuccaguagcaauuugcuuucauaaucugcuuuugaccaucaccucc

SEQ ID NO: 521580 - RNA, 64 nt, Homo Sapiens
auauauuguguauguuaaaaguguucuacauuuuuuucauaauuuuuaucugguagaacaauau

SEQ ID NO: 521581 - RNA, 64 nt, Homo Sapiens
ggcaaaguuuacagaaccauugaugugguuugcauuucauaaaacaguuucuaauuuuuaaaac

SEQ ID NO: 521582 - RNA, 64 nt, Homo Sapiens
ccauacauuuuuagagucagagauaacuuugaaauuucauaaguuugauauucaguggauacaa

SEQ ID NO: 521583 - RNA, 64 nt, Homo Sapiens
gauuaauugaagaaauaaaauauuucggauaagguuucauaauuuacaaaugggaauuucauuu

SEQ ID NO: 521584 - RNA, 64 nt, Homo Sapiens
gugacacugauaaagccuuuuuuagggaaaauuguuucauaaauugucccugauuuuauuuucu

SEQ ID NO: 521585 - RNA, 64 nt, Homo Sapiens
gagcacuguugugauaacacauugguaacaguuguuucauaaauuuagcacuguuaaagcacga

SEQ ID NO: 521586 - RNA, 64 nt, Homo Sapiens
aaguccuguucuucuuuagauaaacaagagacauuuucauaauugcuuucuagcaaucagcuuu

SEQ ID NO: 521587 - RNA, 64 nt, Homo Sapiens
acaaauaauuucccuuggguuggaggggaagugauuucauaaauuaauuagaaagccaucuuua

SEQ ID NO: 521588 - RNA, 64 nt, Homo Sapiens
auuggaaaucaguuccugacauaguaaaguuugcuuucauaacugcagcaaaaaaggucaacuu

SEQ ID NO: 521589 - RNA, 64 nt, Homo Sapiens
ugauaguuuccauaacagagccuuuucauaaccuuuucauaacaauaacaugauaguuuccuaa

SEQ ID NO: 521590 - RNA, 64 nt, Homo Sapiens
uuuucauaacaugauaguuuuaguuuccuaaccuuuucauaaccauuagcuuuucauaacauga

SEQ ID NO: 521591 - RNA, 64 nt, Homo Sapiens
ugauaguuuccuaaccuuuuauucaauauuagcuuuucauaacaaguucaguuguuuuuaaaag

SEQ ID NO: 521592 - RNA, 64 nt, Homo Sapiens
ugauaguauugguuauuuuauuaucuuguaaagauuucauaaaauaaauauuguacuacugugc

SEQ ID NO: 521593 - RNA, 64 nt, Homo Sapiens
aauuuaaaaaucacuggauuuauuuuugccuuuauuucauaaguauaaauaguauuuuacaucu

SEQ ID NO: 521594 - RNA, 64 nt, Homo Sapiens
uuuugcacaacuguaacccuguuguuacuuuauauuucauaaucaggcaaaaauacuuacaguu

SEQ ID NO: 521595 - RNA, 64 nt, Homo Sapiens
uaauucuucuaaauuaccacuugccauuaagcuauuucauaauaaauucuguacaguuuccccc

SEQ ID NO: 521596 - RNA, 64 nt, Homo Sapiens
ugccuccuuugcuuggcccucugcuauacauguguuucauaaccgaacaaauaaaacuaggaac

SEQ ID NO: 521597 - RNA, 64 nt, Homo Sapiens
guggacaauuggaggcauuuauuuuaucaacaaauuucauaauuaaaagaacuuaucuugcagc

SEQ ID NO: 521598 - RNA, 64 nt, Homo Sapiens
aaucccauggcaaaggguaacuuguccauuuagcuuucauaagauaaaaagagaaaaagagaaa

SEQ ID NO: 521599 - RNA, 64 nt, Homo Sapiens
ucacucaagaaaaaugcagcuguuguaaaaguguuuucauaaguaacauagcuuuaguuuuugc

SEQ ID NO: 521600 - RNA, 64 nt, Homo Sapiens
ucgcagucucagcuuauggugcuuucaaugaaccuuucauaaaucaugcaccaccuguuugcuu

SEQ ID NO: 521601 - RNA, 64 nt, Homo Sapiens
aagaguguugccugaggccccuaagacuuuucaguuucauaaggacucacucauucaguuacuc

SEQ ID NO: 521602 - RNA, 64 nt, Homo Sapiens
guuuuuuaaaauuguucuccaguguccagcauuuuuucauaaguuuuguucuggcagugaguca

SEQ ID NO: 521603 - RNA, 64 nt, Homo Sapiens
guauggaucguaaaauuuuaagcacuaaaaauuuuuucauaaccuuucauaauaaaguuuaaua

SEQ ID NO: 521604 - RNA, 64 nt, Homo Sapiens
uaaaauuuuaagcacuaaaaauuuuuucauaaccuuucauaauaaaguuuaauaauagguuuau

SEQ ID NO: 521605 - RNA, 64 nt, Homo Sapiens
uugccagaggcagaaauggucuggguauaagcuauuucauaaaagcagcuuuaaauugucagua

SEQ ID NO: 521606 - RNA, 64 nt, Homo Sapiens
ugucuuaauuucuaacauuaucuuugcuuuuauguuucauaaaaauuugucauuauuuaugcug

SEQ ID NO: 521607 - RNA, 64 nt, Homo Sapiens
aaacguaggguguguaugugcaggauaauagguuuuucauaaaguccugggaacccuaguucca

SEQ ID NO: 521608 - RNA, 64 nt, Homo Sapiens
auauacugguauagcuuccaugugguccuguuuuuuucauaacaguuuugugccugcuuuuugc

SEQ ID NO: 521609 - RNA, 64 nt, Homo Sapiens
ucuaguaccucaaugcgauucugagauauuugaauuucauaaaauuguaacugaaauuuaaaau

SEQ ID NO: 521610 - RNA, 64 nt, Homo Sapiens
aaauaauugcuuguuuucuagccuggcaagauauuuucauaaaagagggauaacaaugcugauu

SEQ ID NO: 521611 - RNA, 64 nt, Homo Sapiens
uacuuuucuaucauuaaucauuuuaguuuucuuauuucauaaucuaaagagcauuuaacaugcc

SEQ ID NO: 521612 - RNA, 64 nt, Homo Sapiens
aguggaagguuucacuaagucaugauauuugacuuuucauaaguguugaucuggaugaguuaua

SEQ ID NO: 521613 - RNA, 64 nt, Homo Sapiens
aguggaagguuucacuaaguaaugguauuugacuuuucauaaguguugaucuagaugaguuaua

SEQ ID NO: 521614 - RNA, 64 nt, Homo Sapiens
cugaaacaacuugccccaagucuaaaaucuaaaauuucauaauuuauaugcacaaaacuacuuu

SEQ ID NO: 521615 - RNA, 64 nt, Homo Sapiens
cauguuguuguguguauauguaauauuaguuggcuuucauaaauggauuguguaucugugcuuc

SEQ ID NO: 521616 - RNA, 64 nt, Homo Sapiens
gcuaauugcauaagaaagaguugcauguauaggauuucauaaagucauucuaaauauagaagug

SEQ ID NO: 521617 - RNA, 64 nt, Homo Sapiens
cacaaagacgugcacaggaggcuaccccagcuccuuucauaagaaaaggcugauggguggauua

SEQ ID NO: 521618 - RNA, 64 nt, Homo Sapiens
agucaaaauaauaaaacuaaaacuuauugcauauuuucauaaucuucacucauuaccuagagua

SEQ ID NO: 521619 - RNA, 64 nt, Homo Sapiens
auuaaaugcuuuaagaaaugauuaugaacauuuuuuucauaaaaguaagaacauacauuuugaa

SEQ ID NO: 521620 - RNA, 64 nt, Homo Sapiens
cagaauugauccuguggcugcucaggaauagauuuuucauaaagcagaaguacgugaguuguuc

SEQ ID NO: 521621 - RNA, 64 nt, Homo Sapiens
aggaaaauccauucuuagaaaaggaauauuuuguuuucauaaagcuauaaaguuuuauaaagaa

SEQ ID NO: 521622 - RNA, 64 nt, Homo Sapiens
aaaaacuaugucaguauuuuauuuuacauuucuauuucauaaugaagauuaaaauaaagcuacc

SEQ ID NO: 521623 - RNA, 64 nt, Homo Sapiens
ccucaagagcauuuuuaagcguuuguaucauuucuuucauaaaaugaaaguuagagaacauuau

SEQ ID NO: 521624 - RNA, 64 nt, Homo Sapiens
ugguaguaguaacuuaccuuaucaucaaaugguguuucauaacugccagagaaaaugaauugca

SEQ ID NO: 521625 - RNA, 64 nt, Homo Sapiens
uuuaagggacccacugcaagcaaugcacugauguuuucauaauguuauagcguaacagacuaca

SEQ ID NO: 521626 - RNA, 64 nt, Homo Sapiens
agaccucaguuuauagcguagugcuaaaauaaucuuucauaaagacuggcuucauucugaauuu

SEQ ID NO: 521627 - RNA, 64 nt, Homo Sapiens
uuaauuguugaaaauugcauucaauuuuguauauuuucauaauuaugccuaguuguguugccca

SEQ ID NO: 521628 - RNA, 64 nt, Homo Sapiens
cuauggccuguuuaagauggaugacaacauauucuuucauaaaauuaauucugaauuucaugua

SEQ ID NO: 521629 - RNA, 64 nt, Homo Sapiens
uugcaauuagguuuuugacuguuaaaauggauauuuucauaaaaaugguguucugaauuuugcu

SEQ ID NO: 521630 - RNA, 64 nt, Homo Sapiens
ucaaguauguucaguauaaaauaaguuaaucccauuucauaauguaaaucauauuuuuguuauu

SEQ ID NO: 521631 - RNA, 64 nt, Homo Sapiens
aacguuuuauuggagcauagagauguccaccuguuuucauaaauauccuccaugggcuaaaucc

SEQ ID NO: 521632 - RNA, 64 nt, Homo Sapiens
uuuauggcaugucuucuauuuccuacaaauuaacuuucauaaauuauuuuuuaaauguauucau

SEQ ID NO: 521633 - RNA, 64 nt, Homo Sapiens
guuuaaaugcugauauuuggugaugaauagauauuuucauaagauuaauccauauguggacuag

SEQ ID NO: 521634 - RNA, 64 nt, Homo Sapiens
ccaguuuuuacauuccguuaauaauaacuccagauuucauaauuuuuuuucugccauuucccaa

SEQ ID NO: 521635 - RNA, 64 nt, Homo Sapiens
acaaauuuuccuucauauuucuacaaaggacuuauuucauaauugauuugggaaauauucuuua

SEQ ID NO: 521636 - RNA, 64 nt, Homo Sapiens
cguaugaguuuuaccuuuucagugccauagucuuuuucauaauacuuaccaggaauauuuucua

SEQ ID NO: 521637 - RNA, 64 nt, Homo Sapiens
cagcaaguacagaugcaagcauuuaacauauuuguuucauaauucaucccaagguuuuuuucuc

SEQ ID NO: 521638 - RNA, 64 nt, Homo Sapiens
caacagaugguuaaacugauuaggaaauuaaguuuuucauaaggaauacauuuccuggguaacu

SEQ ID NO: 521639 - RNA, 64 nt, Homo Sapiens
gacuuuuguauuauacaaggaauagacuugacuuuuucauaauguuuuauguaaccuguuacaa

SEQ ID NO: 521640 - RNA, 64 nt, Homo Sapiens
agggagguguuacuuucauuguauauaggucuuauuucauaaacagauauccuguaucaaauaa

SEQ ID NO: 521641 - RNA, 64 nt, Homo Sapiens
acuucuauuaaguuauugaugcaauuugauauuuuuucauaaucuauauuuaaacaaaauuaca

SEQ ID NO: 521642 - RNA, 64 nt, Homo Sapiens
aaacuacguuaauuuuaccuauuuuuuuuuauuauuucauaagacccauuguagcauauguuug

SEQ ID NO: 521643 - RNA, 64 nt, Homo Sapiens
ccuuggaaagcuucuuauaacuggucuacaaagauuucauaacugaggugaugauaguuggccu

SEQ ID NO: 521644 - RNA, 64 nt, Homo Sapiens
gauuggcuggcuauaaccaccccaguuaaaccauuuucauaauuaguagugccagcaauagugg

SEQ ID NO: 521645 - RNA, 64 nt, Homo Sapiens
uuucccaugcuguggaaaguuuauugagaacuuguuucauaaauggauaucccuacuaugacug

SEQ ID NO: 521646 - RNA, 64 nt, Homo Sapiens
uuuguauuuuuaaaugaaaaaaaauucuuaauauuuucauaaaacuuuuauaauucccauccua

SEQ ID NO: 521647 - RNA, 64 nt, Homo Sapiens
uuuuaagauacauacuaucugaauaaagaauauuuuucauaauacuuuccugacauuguuuuca

SEQ ID NO: 521648 - RNA, 64 nt, Homo Sapiens
uuuuuaaccagccuaauaaauaagucuuacuacuuuucauaauauuucauaauaguuaaaagua

SEQ ID NO: 521649 - RNA, 64 nt, Homo Sapiens
gccuaauaaauaagucuuacuacuuuucauaauauuucauaauaguuaaaaguagguguuuuuu

SEQ ID NO: 521650 - RNA, 64 nt, Homo Sapiens
ucuuuggacaaaaguagguuauauuucauguaaauuucauaaauuuccuuuuauucuaacggga

SEQ ID NO: 521651 - RNA, 64 nt, Homo Sapiens
aucaugaauacuuuuccaggcagcgucuuguccuuuucauaauaacccccauacagacauuuga

SEQ ID NO: 521652 - RNA, 64 nt, Homo Sapiens
ugagggaucccaaaaaaagauauacaugugauaauuucauaaaggaauuuuaauuuuacucuuu

SEQ ID NO: 521653 - RNA, 64 nt, Homo Sapiens
ugguaacauguaccuucaugacugcccuauguaguuucauaauugccacagaguauuguuuaaa

SEQ ID NO: 521654 - RNA, 64 nt, Homo Sapiens
cagugcggucuauguggagaugcugcagauccugcugccgcacuucagcgacgugaggaccuca

SEQ ID NO: 521655 - RNA, 64 nt, Homo Sapiens
ccacauccuggccagcugcuggcagaacuccuggcugccgcacgggaacucauggguguguuac

SEQ ID NO: 521656 - RNA, 64 nt, Homo Sapiens; identical to SEQ ID NO: 434045

SEQ ID NO: 521657 - RNA, 64 nt, Homo Sapiens; identical to SEQ ID NO: 434046

SEQ ID NO: 521658 - RNA, 64 nt, Homo Sapiens
ggaacuguacaaauauuuauaccaaaaauauagauaagaaaagguggggcuauacuagcaacaa

SEQ ID NO: 521659 - RNA, 64 nt, Homo Sapiens
aauggugccaaguaaugugaaugcuaauacugcuuaagaaaauuaaguuacuuuugcaaaacag

SEQ ID NO: 521660 - RNA, 64 nt, Homo Sapiens
acagauauguccaaggaaguugagcuauagggaguaagaaaaagcaucaugauaacgucuaguc

SEQ ID NO: 521661 - RNA, 64 nt, Homo Sapiens
auggcauuuagccaaaggccuuuucagccaggaguaagaaaagaugguuagugauauuuggaaa

SEQ ID NO: 521662 - RNA, 64 nt, Homo Sapiens
cuuuugauuugucauauuccuggucauaaaacauuaagaaaauuauggcuguugcugucauuac

SEQ ID NO: 521663 - RNA, 64 nt, Homo Sapiens
uuaagacaguucagugcauauauaguagaagccuuaagaaaaaagaaaaugagcaagcaaauau

SEQ ID NO: 521664 - RNA, 64 nt, Homo Sapiens
agauagaauuuuuuacuguuuuuuacuguuuucuuaagaaaacaguuaaaucauuaugcauuca

SEQ ID NO: 521665 - RNA, 64 nt, Homo Sapiens
cuagugggcaaaugucauuguuaccucuguguguuaagaaaauaaaaauauuuucuaaaggucu

SEQ ID NO: 521666 - RNA, 64 nt, Homo Sapiens
auugaguaugaguguguuuuuggcuaucaaagaauaagaaaauuacaucuucaacaugucacac

SEQ ID NO: 521667 - RNA, 64 nt, Homo Sapiens
ccugagaucaguuauuccuaaucacugaaaccuuuaagaaaagcuucaaauagagcuguucaac

SEQ ID NO: 521668 - RNA, 64 nt, Homo Sapiens
caacaaggaaguaaaaccaacucaguaccuguuuuaagaaaaaauuguuuuauauuguuugaua

SEQ ID NO: 521669 - RNA, 64 nt, Homo Sapiens
uaaaaugagguuuauuuuaucugaauauuccagguaagaaaauauggcucacguauuuaagagc

SEQ ID NO: 521670 - RNA, 64 nt, Homo Sapiens
uaguucaacucuaauuuuauauauggaucugccauaagaaaaucuaaaaugaauuucuauauga

SEQ ID NO: 521671 - RNA, 64 nt, Homo Sapiens
agaaauuauauuuauuagaagaaaacuggaauauuaagaaaaugaaaucuucccaaauguugug

SEQ ID NO: 521672 - RNA, 64 nt, Homo Sapiens
acccaugcaugauguagagaaaaaaaagaugggguaagaaaacucugcguuaauuauugaggaa

SEQ ID NO: 521673 - RNA, 64 nt, Homo Sapiens
gucuuggagaaugggucagauccuugccaaaaaauaagaaaacugcaaaaaaggcuucauccca

SEQ ID NO: 521674 - RNA, 64 nt, Homo Sapiens
guucuucaggagggccgacccaaaguaggcagaauaagaaaauauuuugggaauuuuacagagu

SEQ ID NO: 521675 - RNA, 64 nt, Homo Sapiens
aaauauacauaugagaagaacacggaauuuauuuuaagaaaaaaagaugagagcuuuaugaguu

SEQ ID NO: 521676 - RNA, 64 nt, Homo Sapiens
uuguauacuaauauuaagaauaccuacgaaauacuaagaaaaauaaauuaagaaaaaauaaaac

SEQ ID NO: 521677 - RNA, 64 nt, Homo Sapiens
uaaaacuaccuacgaaauacauccugacucaaauuaagaaaaaaaaugugugggucuuguuugg

SEQ ID NO: 521678 - RNA, 64 nt, Homo Sapiens
gggcaugugcaaagcaagcaaggaacauuugggguaagaaaacaaacaugaggcaaaagaaaaa

SEQ ID NO: 521679 - RNA, 64 nt, Homo Sapiens
acaaacaugaggcaaaagaaaaaauacauguuuuuaagaaaacauugagcagagaacugcagcc

SEQ ID NO: 521680 - RNA, 64 nt, Homo Sapiens
agucuccuacauagcaguguuauuuauguacagauaagaaaaccauaugucagccaaagauuuu

SEQ ID NO: 521681 - RNA, 64 nt, Homo Sapiens
uaauaauagcccugagauguuucuaacauuuaaauaagaaaaaaaucaaaucgaagucagccug

SEQ ID NO: 521682 - RNA, 64 nt, Homo Sapiens
aaguauuuuuauuaccaauaaauuuaaaauuuuuuaagaaaaauauuuuuauccuagggccaag

SEQ ID NO: 521683 - RNA, 64 nt, Homo Sapiens
ugaaauguaaaauuuuuaugaucugauucaguuuuaagaaaacaugaaugaacuagaagauauu

SEQ ID NO: 521684 - RNA, 64 nt, Homo Sapiens
aaaguuugagcaccugauuaucuauaacauuuuguaagaaaauacuguuuaguuuggguucauu

SEQ ID NO: 521685 - RNA, 64 nt, Homo Sapiens
aauuucauaguauugguuuugauuacuauuacuuuaagaaaaucaacuacaaccugcaauuuaa

SEQ ID NO: 521686 - RNA, 64 nt, Homo Sapiens
auuaauuucuuucaagcaacgcugcuaaaccaauuaagaaaauaacugcuuuuccagacacaag

SEQ ID NO: 521687 - RNA, 64 nt, Homo Sapiens
acauuuccagucauucagcuaaugggcauuguguuaagaaaagagaccagcuuaacuuauaaug

SEQ ID NO: 521688 - RNA, 64 nt, Homo Sapiens
aguuuaucuagcacuugugaaacauuugucauauuaagaaaaaaaaaauaaaaaggacuacuua

SEQ ID NO: 521689 - RNA, 64 nt, Homo Sapiens
aaaaaggacuacuuaaacauuguacuuuuuauuguaagaaaaauugaacuuauucuuaagaaau

SEQ ID NO: 521690 - RNA, 64 nt, Homo Sapiens
ggagguaguuccaaaaaagugcuuuauugcuguuuaagaaaaauagcccggcggucccuguuuu

SEQ ID NO: 521691 - RNA, 64 nt, Homo Sapiens
caaacagcaggaaucggugggaggaacaaugccuuaagaaaaaaggcuggguuuucugaagucu

SEQ ID NO: 521692 - RNA, 64 nt, Homo Sapiens
aucauuaacucuccuaaaauguguuucauucuaguaagaaaaccucaaaggauauuguaggaua

SEQ ID NO: 521693 - RNA, 64 nt, Homo Sapiens
agcaucugcucauuauguuuggaauugcuuucuauaagaaaauugcccacuacuacuaacuuga

SEQ ID NO: 521694 - RNA, 64 nt, Homo Sapiens
uugggaaauauauauguuucacuggggugcuuuuuaagaaaaauucuuuauucaagauaccuga

SEQ ID NO: 521695 - RNA, 64 nt, Homo Sapiens
cuuguaaugaucgaauacccgagaaacacugguuuaagaaaaacucugaugcacaguaaaaucc

SEQ ID NO: 521696 - RNA, 64 nt, Homo Sapiens
guguacucuagaaauggagauaauuuuuuucaaauaagaaaauuuaacaauaagaaauaagaaa

SEQ ID NO: 521697 - RNA, 64 nt, Homo Sapiens
ggaagauucuuuuaaaaauuuuaaaaaaugcuaauaagaaaauugucagagaugguauuaccuu

SEQ ID NO: 521698 - RNA, 64 nt, Homo Sapiens
uuuugucuaaaaugccucagugcaucuguauaaguaagaaaauauaagagaauauuuuaaguau

SEQ ID NO: 521699 - RNA, 64 nt, Homo Sapiens
auauugcuucuucuccuaugcugccauaaaacauuaagaaaauccagcagcucccccuccccca

SEQ ID NO: 521700 - RNA, 64 nt, Homo Sapiens
uugcaaacacauuaaaacagaaaaaggguaaguauaagaaaauaauggauagauuuuuggaacg

SEQ ID NO: 521701 - RNA, 64 nt, Homo Sapiens
uauuaaaauuaucuuugaaauuggaacugauucauaagaaaaguaugguuggucucuaauauau

SEQ ID NO: 521702 - RNA, 64 nt, Homo Sapiens
aauggcuucacuugaauuuaacaguccagacugguaagaaaauucugugaagugacaugucaga

SEQ ID NO: 521703 - RNA, 64 nt, Homo Sapiens
uucauaguggacuguuuagaggguuaauugcuucuaagaaaaguggaaaugauuuugguguuuu

SEQ ID NO: 521704 - RNA, 64 nt, Homo Sapiens
auuuaauccauucuuaauauuuuaaaacuuuuguuaagaaaaacugccaguuugugcuuuugaa

SEQ ID NO: 521705 - RNA, 64 nt, Homo Sapiens
gguauagagaucugauaacuugaauucagaauauuaagaaaaugaaguaacugauuuucuaaaa

SEQ ID NO: 521706 - RNA, 64 nt, Homo Sapiens
auaagaaacuuauuucucauaucaacuuagucaauaagaaaauauauucuuucaaaggaacauu

SEQ ID NO: 521707 - RNA, 64 nt, Homo Sapiens
caggccucuccauuugcucuucagaugccacuucuaagaaaagccuaaucacaguuuuuccugg

SEQ ID NO: 521708 - RNA, 64 nt, Homo Sapiens
caauaucuggguacuguauguuccuaaaaugccauaagaaaauguuuuacaaguggcuuuacau

SEQ ID NO: 521709 - RNA, 64 nt, Homo Sapiens
auaaagacguauguuugaccgguaaucuuucaaauaagaaaaaauuccucuguaaagaucagau

SEQ ID NO: 521710 - RNA, 64 nt, Homo Sapiens
guuuuuccccuugugcugcuacagccaguuauaguaagaaaaagugcucauuuuuauuguuuuu

SEQ ID NO: 521711 - RNA, 64 nt, Homo Sapiens
auaugugggaaaugauuuaauguaggcucuguuuuaagaaaacauuuggugcugaauauguccu

SEQ ID NO: 521712 - RNA, 64 nt, Homo Sapiens
uggaagacaauucauguuugccauaaguggccuuuaagaaaacauacaaaacaaauaggcuuuu

SEQ ID NO: 521713 - RNA, 64 nt, Homo Sapiens
uuuuaaauuuagauuauguauuccuuuugaaacauaagaaaaacauuuaaaccuaugcugaaaa

SEQ ID NO: 521714 - RNA, 64 nt, Homo Sapiens
caacuccaauaugcuaaaaguuaaauaugguauuuaagaaaauagucauguaugcaauugagaa

SEQ ID NO: 521715 - RNA, 51 nt, Homo Sapiens
agcaacaacagcagaguugauuaagaaaaaugaagaaaaaacgcaaaaaga

SEQ ID NO: 521716 - RNA, 64 nt, Homo Sapiens
gcaauuaaaguuuuucuuccaugaguugaguccuuaagaaaaugauuccaguuacucauuuugc

SEQ ID NO: 521717 - RNA, 56 nt, Homo Sapiens
gccacagcacaaaguuuuaaugucuuuaagaaaaagaaaucaaucugcagaaaugu

SEQ ID NO: 521718 - RNA, 64 nt, Homo Sapiens
uuuaaauauuacaccuucagaaccauaacaugcuuaagaaaacuuucccaaaauguugaccuag

SEQ ID NO: 521719 - RNA, 64 nt, Homo Sapiens
guaucagguucugggaggcaacagcauuaagugauaagaaaaggagacauucuggcaaagccaa

SEQ ID NO: 521720 - RNA, 64 nt, Homo Sapiens
uuacuggaauuaaaaauauauuuuaacaggaauuuaagaaaauagacuuuaauauugauuauau

SEQ ID NO: 521721 - RNA, 64 nt, Homo Sapiens
accuuuauaugauauacuaugagaauuuucaaaauaagaaaauauuggauuucuccaaaucugg

SEQ ID NO: 521722 - RNA, 64 nt, Homo Sapiens
auuauggaaauguugucuuuuauacuuaguuauauaagaaaaaagggaguuaugcaauuaauau

SEQ ID NO: 521723 - RNA, 64 nt, Homo Sapiens
guuuuauuuuuuucccuuuagcauugcaugugaauaagaaaauaauguuuaaagaaaaaaaaaa

SEQ ID NO: 521724 - RNA, 64 nt, Homo Sapiens
uguuucuuucugguuaaaaaaaggaaaaaccaucuaagaaaauauauauguauguaugugugua

SEQ ID NO: 521725 - RNA, 64 nt, Homo Sapiens
aagcuuuuaaccuaucuuaacaacuuacugaacauaagaaaauuuacacuagagagaaagccua

SEQ ID NO: 521726 - RNA, 64 nt, Homo Sapiens
aagcuuuucaccgauacucaauccuuaguacacauaagaaaauucauacuggggagaaacccca

SEQ ID NO: 521727 - RNA, 64 nt, Homo Sapiens
aagcuuuuaaccaguccucacaccuuaugagacauaagaaaauucauaguaaagagaaacccua

SEQ ID NO: 521728 - RNA, 64 nt, Homo Sapiens
guuguuuuaacuaguucucgaacuuuacuaugcauaagaaaauucaaacuggagagaaacucua

SEQ ID NO: 521729 - RNA, 64 nt, Homo Sapiens
aacuaaauguaguugucacaauguucaaucuguguaagaaaacaugaaacugucauaaugguga

SEQ ID NO: 521730 - RNA, 64 nt, Homo Sapiens
auaugaggagacauucugucuuaugucuagaaaguaagaaaacagugugauggcaaggugcuug

SEQ ID NO: 521731 - RNA, 64 nt, Homo Sapiens
uugagggcccaaguccacaaugaaagaaaauugauaagaaaacuaaguuuauucaaugcuaauu

SEQ ID NO: 521732 - RNA, 64 nt, Homo Sapiens
uuaaguuuauucagauaaguauacauaaauauuuuaagaaaaauuuucauuguaaaaugaacaa

SEQ ID NO: 521733 - RNA, 64 nt, Homo Sapiens
auguauuuuugucauauguaguaacuucuuaaucuaagaaaauucacaucuaagaaaauuuacu

SEQ ID NO: 521734 - RNA, 64 nt, Homo Sapiens
uacuguaacuucuuaaucuaaauauauccacaucuaagaaaauuuugucuuacauaaucacaau

SEQ ID NO: 521735 - RNA, 64 nt, Homo Sapiens
aaaacauaaaaacaucacacuaaucuuggaggaauaagaaaaauuguacauccauuaaauguac

SEQ ID NO: 521736 - RNA, 64 nt, Homo Sapiens
uuuaaccauuaacuugucaaauuacaaucacaguuaagaaaaugauguaaaauucuguuuugug

SEQ ID NO: 521737 - RNA, 64 nt, Homo Sapiens
uguagcugcugcgccacccaccaucaaaggaauauaagaaaaguaaugaagaaucacgauuuca

SEQ ID NO: 521738 - RNA, 64 nt, Homo Sapiens
gugguuuuauuacaaaugcaaauuucuauaaauuuaagaaaacaaguauauaauuuacuuugua

SEQ ID NO: 521739 - RNA, 64 nt, Homo Sapiens
auuuuuuaaaagguaucacuauauccugagauuguaagaaaagcugguucaguuuaacugaaga

SEQ ID NO: 521740 - RNA, 64 nt, Homo Sapiens
auaucuaggaguuucuuagauugauuuuucuuuuuaagaaaaaaugaaccgccaugccuggccc

SEQ ID NO: 521741 - RNA, 64 nt, Homo Sapiens
caaauuaaauccuugcaggaagagaaauuaacacuaagaaaaagucaucaauauuuuucaacuu

SEQ ID NO: 521742 - RNA, 64 nt, Homo Sapiens
gaucuuuuguacuucucauaaccuaaugucagacuaagaaaaauaaaauaucugagaguaaaua

SEQ ID NO: 521743 - RNA, 64 nt, Homo Sapiens
ccauuaagacaaaagcaauguguucaugaagacuuaagaaaaaugucacuacugcaacauuagg

SEQ ID NO: 521744 - RNA, 64 nt, Homo Sapiens
gauuacuuuuccuguugauuguucaaauauaauuuaagaaaauuccacuuaauaggcuuaccua

SEQ ID NO: 521745 - RNA, 64 nt, Homo Sapiens
cuauuucuguucauauuaaucaacucaauuguuuuaagaaaacuuguguucaagcuccuguggg

SEQ ID NO: 521746 - RNA, 64 nt, Homo Sapiens
aaguguaacaaauucucgcucuaagugggucacuuaagaaaaaaccuucucuuuauuggugguc

SEQ ID NO: 521747 - RNA, 64 nt, Homo Sapiens
acagagguguugaguugcaggauaucuagcaauuuaagaaaauguggaaaaaauauuuuuauug

SEQ ID NO: 521748 - RNA, 64 nt, Homo Sapiens
aagaugagccugaaucaucucauguaccugacaguaagaaaauacucuggcuggucucaguggc

SEQ ID NO: 521749 - RNA, 64 nt, Homo Sapiens
aguauacacuggcacauaauuuuuuaaaaaguuuuaagaaaagauucauuuggaauuuuauuca

SEQ ID NO: 521750 - RNA, 64 nt, Homo Sapiens
cacuagaagaaaucagcaggucuaaucccaccaguaagaaaacuaccacuucuugauuuuuaca

SEQ ID NO: 521751 - RNA, 64 nt, Homo Sapiens
gugccucugcaagauacuaacacaaagcucauguuaagaaaacaguugaggacucagaagucag

SEQ ID NO: 521752 - RNA, 64 nt, Homo Sapiens
uuaaacauuucuuguaaaaagcugagacaguuuguaagaaaagaauccuuaaaaucuagauuua

SEQ ID NO: 521753 - RNA, 64 nt, Homo Sapiens
cacugucgucgucuccccacuuucccucuuccuuuaagaaaacuuacuaaaaaauguuucauug

SEQ ID NO: 521754 - RNA, 64 nt, Homo Sapiens
cguuuucagaccuaaaggaaauguuuggucauguuaagaaaacaaauuauucauucauaugaug

SEQ ID NO: 521755 - RNA, 64 nt, Homo Sapiens
uuaagugacaaauguuagaagaacauuuguacuuuaagaaaaauuuuucuguuacaacuuacag

SEQ ID NO: 521756 - RNA, 64 nt, Homo Sapiens
aacaaauuuaucaugaaauuaaugccaaugauuguaagaaaacaugugacuuacuaauggcugc

SEQ ID NO: 521757 - RNA, 64 nt, Homo Sapiens
gaugcuguacaaggcaaauaauuaacugagaauguaagaaaauuuuccagcacuuuaauggcca

SEQ ID NO: 521758 - RNA, 64 nt, Homo Sapiens
uccagcacuuuaauggccaaaauguuaucaugauuaagaaaauuguucugauuucuuuuuaaca

SEQ ID NO: 521759 - RNA, 64 nt, Homo Sapiens
aaccgcuuguaugauuuucaaacacaccuaacuuuaagaaaaaggaaauuuuuaauugagugua

SEQ ID NO: 521760 - RNA, 64 nt, Homo Sapiens
aucaacauuuuuugugcuuuucugaagcauaauuuaagaaaaacaauuauacaaucaaacuaga

SEQ ID NO: 521761 - RNA, 64 nt, Homo Sapiens
ugguugccauuuguguucuuuugcagaacucugauaagaaaaguguucaauuuguauuuaagca

SEQ ID NO: 521762 - RNA, 64 nt, Homo Sapiens
aaucauuugguuuuugaguuguuuuuucuuaauguaagaaaaauuguauuuuuuuuacaaguau

SEQ ID NO: 521763 - RNA, 64 nt, Homo Sapiens
aauguauaaaauuccauuuuuaucugucaaaauuuaagaaaacaaguuuuaacuuucugaagaa

SEQ ID NO: 521764 - RNA, 64 nt, Homo Sapiens
uuuuuugucauuuuuuguguugcuuuugugccuuuaagaaaauacaacucucauuuaauauuca

SEQ ID NO: 521765 - RNA, 64 nt, Homo Sapiens
cacuuugugguggccuuuauccaaaaagaggcaauaagaaaagaccaguauuuuacuucaaaag

SEQ ID NO: 521766 - RNA, 64 nt, Homo Sapiens
acuggcuucauuucugugaauggugauuuguuuauaagaaaaaagucaguuuugaaccaagaau

SEQ ID NO: 521767 - RNA, 64 nt, Homo Sapiens
aacacaauuuuaccauuugauaauagaaucagauuaagaaaauuuuaauuccuugcugguaauc

SEQ ID NO: 521768 - RNA, 64 nt, Homo Sapiens
cucaauaauaauaauaauaauaaugaugauacucuaagaaaaaaaucucaacauacuucauuua

SEQ ID NO: 521769 - RNA, 64 nt, Homo Sapiens
guggaagagagaugagaaaauugagagcuauuauuaagaaaaacaguugagagaggaagaauuu

SEQ ID NO: 521770 - RNA, 64 nt, Homo Sapiens
auuaugaacuuuuauuuacaugacucuaagacuauaagaaaaucugauggcagugacaaagugc

SEQ ID NO: 521771 - RNA, 64 nt, Homo Sapiens
uguaauuuuugccuuuguuuaagccuggaacuuguaagaaaaugaaaauuuaauuuuuuuuucu

SEQ ID NO: 521772 - RNA, 64 nt, Homo Sapiens
guguuaaagauagaauuuguuuuaggacaaauuuuaagaaaaugugggaauaccaaauguccuu

SEQ ID NO: 521773 - RNA, 64 nt, Homo Sapiens
uuuaagaaaaugugggaauaccaaauguccuuuauaagaaaaauaaauuuuauuuuaagggaca

SEQ ID NO: 521774 - RNA, 64 nt, Homo Sapiens
gaaaucauauuaaaagugaaaaucauccaucacauaagaaaauauuagacuuuuauaggcuuga

SEQ ID NO: 521775 - RNA, 64 nt, Homo Sapiens
ggaacaaauuuuuaucuaaaaccugggaguaagguaagaaaaauccaagcagaugauugauaaa

SEQ ID NO: 521776 - RNA, 64 nt, Homo Sapiens
uuaacauuauagauacucugauuaauuacuugauuaagaaaaaaaaauauaguucugauugggu

SEQ ID NO: 521777 - RNA, 64 nt, Homo Sapiens
agcuuaaaauguuuaaauauaaaucuucaaugucuaagaaaacuuuuauuaccacaaaacagca

SEQ ID NO: 521778 - RNA, 64 nt, Homo Sapiens
gacaugaugucaagaaguaucugcuugaccuuucuaagaaaaagggauucuuaucuuacucuga

SEQ ID NO: 521779 - RNA, 64 nt, Homo Sapiens
agguccuguguuaaacuguuuagugcucuguuuuuaagaaaacaaauguugaaccucacacuuu

SEQ ID NO: 521780 - RNA, 64 nt, Homo Sapiens
ggcuccaggggagggagcuggggaggccaggguauaagaaaagcaucagaacucucagcuuggc

SEQ ID NO: 521781 - RNA, 64 nt, Homo Sapiens
accucccuuuugacagagauuagaaguacuucuuuaagaaaaaaauaaauuugagaaauuguau

SEQ ID NO: 521782 - RNA, 64 nt, Homo Sapiens
ucugcuauacaggaaaaccaaguaaauauagccauaagaaaauacaucuuugauuuuucauuca

SEQ ID NO: 521783 - RNA, 64 nt, Homo Sapiens
ugaacucuuucaauugagauaaugagcucugugguaagaaaaaacuucgagcacuuuucuaacu

SEQ ID NO: 521784 - RNA, 64 nt, Homo Sapiens
cuggaugucacuggccacuggagucucagcuaccuaagaaaaacgagaaggugagauaagcccu

SEQ ID NO: 521785 - RNA, 64 nt, Homo Sapiens
agauuuauuuauuuaagacaauuuuuuacauuauuaagaaaaaagccaaagggaaauaucauuu

SEQ ID NO: 521786 - RNA, 64 nt, Homo Sapiens
uaacacacauauaaacaucaagcugcaggcuguuuaagaaaaaaagugauguaccaugaaacaa

SEQ ID NO: 521787 - RNA, 64 nt, Homo Sapiens
gaaaucuuacaaguaugaauaaugugccaaagccuaagaaaacccucaauucuuaauagauaua

SEQ ID NO: 521788 - RNA, 64 nt, Homo Sapiens
caguuguuaaaauuuuguugaacaucagggaguuuaagaaaacccugcaaguauaaugaauuug

SEQ ID NO: 521789 - RNA, 64 nt, Homo Sapiens
gguucuugguuuuaauggauaggcugaauuggauuaagaaaaguugaaugccaccuaugguaau

SEQ ID NO: 521790 - RNA, 64 nt, Homo Sapiens
uaucaacuccaugccaucucccaaaauaauugucuaagaaaacuugaaaguguaagguuuuaac

SEQ ID NO: 521791 - RNA, 64 nt, Homo Sapiens
auagagugaguuuguguguaauaaaccuuaaguguaagaaaauuaaauauauguuagucuaaag

SEQ ID NO: 521792 - RNA, 64 nt, Homo Sapiens
uaagcuuuuaaagugaagagugucaaaauaucuuuaagaaaauaaaaaacauaagugcaacuac

SEQ ID NO: 521793 - RNA, 64 nt, Homo Sapiens
caugcuggagagaaacacuaaucuuuauuacacauaagaaaauuaagcuuuuaaacaguccuca

SEQ ID NO: 521794 - RNA, 64 nt, Homo Sapiens
cauacuggagagaaaaucuacagucuaguaaacauaagaaaauuuaaauccuucagcugauucu

SEQ ID NO: 521795 - RNA, 64 nt, Homo Sapiens
cacuucaaaacagaagggcaaagaacuuaaguuuuaagaaaaaguuuauaagaaaauggaggca

SEQ ID NO: 521796 - RNA, 64 nt, Homo Sapiens
gaggcaaagaacuuaaguuuggaaauuggguuuauaagaaaaugaguagagcugcaccuaaaga

SEQ ID NO: 521797 - RNA, 64 nt, Homo Sapiens
uguuaauggugggguuuucugcuuuguuuuuauuuaagaaaauaaacacgacauauuuaaagaa

SEQ ID NO: 521798 - RNA, 64 nt, Homo Sapiens
uggggauuggaugaaagucaaagguugucuacuuuaagaaaauaaaauacccugaauggagccc

SEQ ID NO: 521799 - RNA, 64 nt, Homo Sapiens
gacauaacuuugaauguuuuaacagcaagaauuuuaagaaaagauaaacaccauuuuauuuauu

SEQ ID NO: 521800 - RNA, 64 nt, Homo Sapiens
cuaaugguauuuuaaucauuauuuuugccugucauaagaaaacucuuagcugaaauggccgaaa

SEQ ID NO: 521801 - RNA, 64 nt, Homo Sapiens
aauuuuuaccuggugaacuuguuuaagcauaauuuaagaaaaaaacuuguuuuuuauuauuguu

SEQ ID NO: 521802 - RNA, 64 nt, Homo Sapiens
gaugaaaaauuaggguacacguaauuaaauuuauuaagaaaauauaucucagggcuuaugaaau

SEQ ID NO: 521803 - RNA, 64 nt, Homo Sapiens
ccguguuugucucuucuggauccaaucaguagcuuaagaaaaaacaggaaccauaguugacagu

SEQ ID NO: 521804 - RNA, 64 nt, Homo Sapiens
caaaaggcauuucccacccuccccucuucccugguaagaaaaaggucuugcucuccuagguagc

SEQ ID NO: 521805 - RNA, 64 nt, Homo Sapiens; identical to SEQ ID NO: 256603

SEQ ID NO: 521806 - RNA, 64 nt, Homo Sapiens; identical to SEQ ID NO: 256604

SEQ ID NO: 521807 - RNA, 64 nt, Homo Sapiens; identical to SEQ ID NO: 256605

SEQ ID NO: 521808 - RNA, 64 nt, Homo Sapiens; identical to SEQ ID NO: 256606

SEQ ID NO: 521809 - RNA, 64 nt, Homo Sapiens; identical to SEQ ID NO: 256607

SEQ ID NO: 521810 - RNA, 64 nt, Homo Sapiens; identical to SEQ ID NO: 256608

SEQ ID NO: 521811 - RNA, 64 nt, Homo Sapiens; identical to SEQ ID NO: 256609

SEQ ID NO: 521812 - RNA, 64 nt, Homo Sapiens; identical to SEQ ID NO: 256610

SEQ ID NO: 521813 - RNA, 64 nt, Homo Sapiens; identical to SEQ ID NO: 256611

SEQ ID NO: 521814 - RNA, 64 nt, Homo Sapiens; identical to SEQ ID NO: 256612

SEQ ID NO: 521815 - RNA, 64 nt, Homo Sapiens; identical to SEQ ID NO: 256613

SEQ ID NO: 521816 - RNA, 64 nt, Homo Sapiens; identical to SEQ ID NO: 256614

SEQ ID NO: 521817 - RNA, 64 nt, Homo Sapiens; identical to SEQ ID NO: 256615

SEQ ID NO: 521818 - RNA, 64 nt, Homo Sapiens; identical to SEQ ID NO: 256616

SEQ ID NO: 521819 - RNA, 64 nt, Homo Sapiens; identical to SEQ ID NO: 256617

SEQ ID NO: 521820 - RNA, 64 nt, Homo Sapiens; identical to SEQ ID NO: 256618

SEQ ID NO: 521821 - RNA, 64 nt, Homo Sapiens; identical to SEQ ID NO: 256619

SEQ ID NO: 521822 - RNA, 64 nt, Homo Sapiens; identical to SEQ ID NO: 256620

SEQ ID NO: 521823 - RNA, 64 nt, Homo Sapiens; identical to SEQ ID NO: 256621

SEQ ID NO: 521824 - RNA, 64 nt, Homo Sapiens; identical to SEQ ID NO: 256622

SEQ ID NO: 521825 - RNA, 64 nt, Homo Sapiens; identical to SEQ ID NO: 256623

SEQ ID NO: 521826 - RNA, 64 nt, Homo Sapiens; identical to SEQ ID NO: 256624

SEQ ID NO: 521827 - RNA, 64 nt, Homo Sapiens; identical to SEQ ID NO: 256625

SEQ ID NO: 521828 - RNA, 64 nt, Homo Sapiens; identical to SEQ ID NO: 256626

SEQ ID NO: 521829 - RNA, 64 nt, Homo Sapiens; identical to SEQ ID NO: 256627

SEQ ID NO: 521830 - RNA, 64 nt, Homo Sapiens; identical to SEQ ID NO: 256628

SEQ ID NO: 521831 - RNA, 64 nt, Homo Sapiens; identical to SEQ ID NO: 256629

SEQ ID NO: 521832 - RNA, 64 nt, Homo Sapiens; identical to SEQ ID NO: 256630

SEQ ID NO: 521833 - RNA, 64 nt, Homo Sapiens; identical to SEQ ID NO: 256631

SEQ ID NO: 521834 - RNA, 64 nt, Homo Sapiens; identical to SEQ ID NO: 256632

SEQ ID NO: 521835 - RNA, 64 nt, Homo Sapiens; identical to SEQ ID NO: 256633

SEQ ID NO: 521836 - RNA, 64 nt, Homo Sapiens; identical to SEQ ID NO: 256634

SEQ ID NO: 521837 - RNA, 64 nt, Homo Sapiens; identical to SEQ ID NO: 256635

SEQ ID NO: 521838 - RNA, 64 nt, Homo Sapiens; identical to SEQ ID NO: 256636

SEQ ID NO: 521839 - RNA, 64 nt, Homo Sapiens; identical to SEQ ID NO: 256637

SEQ ID NO: 521840 - RNA, 64 nt, Homo Sapiens; identical to SEQ ID NO: 256638

SEQ ID NO: 521841 - RNA, 64 nt, Homo Sapiens; identical to SEQ ID NO: 256639

SEQ ID NO: 521842 - RNA, 64 nt, Homo Sapiens; identical to SEQ ID NO: 256640

SEQ ID NO: 521843 - RNA, 64 nt, Homo Sapiens; identical to SEQ ID NO: 256641

SEQ ID NO: 521844 - RNA, 64 nt, Homo Sapiens; identical to SEQ ID NO: 256642

SEQ ID NO: 521845 - RNA, 64 nt, Homo Sapiens; identical to SEQ ID NO: 256643

SEQ ID NO: 521846 - RNA, 64 nt, Homo Sapiens; identical to SEQ ID NO: 256644

SEQ ID NO: 521847 - RNA, 64 nt, Homo Sapiens; identical to SEQ ID NO: 256645

SEQ ID NO: 521848 - RNA, 64 nt, Homo Sapiens; identical to SEQ ID NO: 256646

SEQ ID NO: 521849 - RNA, 64 nt, Homo Sapiens; identical to SEQ ID NO: 256647

SEQ ID NO: 521850 - RNA, 64 nt, Homo Sapiens; identical to SEQ ID NO: 256648

SEQ ID NO: 521851 - RNA, 64 nt, Homo Sapiens; identical to SEQ ID NO: 256649

SEQ ID NO: 521852 - RNA, 64 nt, Homo Sapiens; identical to SEQ ID NO: 256650

SEQ ID NO: 521853 - RNA, 64 nt, Homo Sapiens; identical to SEQ ID NO: 256651

SEQ ID NO: 521854 - RNA, 64 nt, Homo Sapiens; identical to SEQ ID NO: 256652

SEQ ID NO: 521855 - RNA, 64 nt, Homo Sapiens; identical to SEQ ID NO: 256653

SEQ ID NO: 521856 - RNA, 57 nt, Homo Sapiens; identical to SEQ ID NO: 256654

SEQ ID NO: 521857 - RNA, 64 nt, Homo Sapiens; identical to SEQ ID NO: 256655

SEQ ID NO: 521858 - RNA, 64 nt, Homo Sapiens; identical to SEQ ID NO: 256656

SEQ ID NO: 521859 - RNA, 64 nt, Homo Sapiens; identical to SEQ ID NO: 256657

SEQ ID NO: 521860 - RNA, 64 nt, Homo Sapiens; identical to SEQ ID NO: 256658

SEQ ID NO: 521861 - RNA, 64 nt, Homo Sapiens; identical to SEQ ID NO: 256659

SEQ ID NO: 521862 - RNA, 64 nt, Homo Sapiens; identical to SEQ ID NO: 256660

SEQ ID NO: 521863 - RNA, 64 nt, Homo Sapiens; identical to SEQ ID NO: 256661

SEQ ID NO: 521864 - RNA, 64 nt, Homo Sapiens; identical to SEQ ID NO: 256662

SEQ ID NO: 521865 - RNA, 64 nt, Homo Sapiens; identical to SEQ ID NO: 256663

SEQ ID NO: 521866 - RNA, 64 nt, Homo Sapiens; identical to SEQ ID NO: 256664

SEQ ID NO: 521867 - RNA, 64 nt, Homo Sapiens; identical to SEQ ID NO: 256665

SEQ ID NO: 521868 - RNA, 64 nt, Homo Sapiens; identical to SEQ ID NO: 256666

SEQ ID NO: 521869 - RNA, 64 nt, Homo Sapiens; identical to SEQ ID NO: 256667

SEQ ID NO: 521870 - RNA, 64 nt, Homo Sapiens; identical to SEQ ID NO: 256668

SEQ ID NO: 521871 - RNA, 64 nt, Homo Sapiens; identical to SEQ ID NO: 256669

SEQ ID NO: 521872 - RNA, 64 nt, Homo Sapiens; identical to SEQ ID NO: 256670

SEQ ID NO: 521873 - RNA, 64 nt, Homo Sapiens; identical to SEQ ID NO: 256671

SEQ ID NO: 521874 - RNA, 64 nt, Homo Sapiens; identical to SEQ ID NO: 256672

SEQ ID NO: 521875 - RNA, 64 nt, Homo Sapiens; identical to SEQ ID NO: 256673

SEQ ID NO: 521876 - RNA, 64 nt, Homo Sapiens; identical to SEQ ID NO: 256674

SEQ ID NO: 521877 - RNA, 64 nt, Homo Sapiens; identical to SEQ ID NO: 256675

SEQ ID NO: 521878 - RNA, 64 nt, Homo Sapiens; identical to SEQ ID NO: 256676

SEQ ID NO: 521879 - RNA, 64 nt, Homo Sapiens; identical to SEQ ID NO: 256677

SEQ ID NO: 521880 - RNA, 64 nt, Homo Sapiens; identical to SEQ ID NO: 256678

SEQ ID NO: 521881 - RNA, 64 nt, Homo Sapiens; identical to SEQ ID NO: 256679

SEQ ID NO: 521882 - RNA, 64 nt, Homo Sapiens; identical to SEQ ID NO: 256680

SEQ ID NO: 521883 - RNA, 64 nt, Homo Sapiens; identical to SEQ ID NO: 256681

SEQ ID NO: 521884 - RNA, 64 nt, Homo Sapiens; identical to SEQ ID NO: 256682

SEQ ID NO: 521885 - RNA, 64 nt, Homo Sapiens; identical to SEQ ID NO: 256683

SEQ ID NO: 521886 - RNA, 64 nt, Homo Sapiens; identical to SEQ ID NO: 256684

SEQ ID NO: 521887 - RNA, 64 nt, Homo Sapiens; identical to SEQ ID NO: 256685

SEQ ID NO: 521888 - RNA, 64 nt, Homo Sapiens; identical to SEQ ID NO: 256686

SEQ ID NO: 521889 - RNA, 64 nt, Homo Sapiens; identical to SEQ ID NO: 256687

SEQ ID NO: 521890 - RNA, 64 nt, Homo Sapiens; identical to SEQ ID NO: 256688

SEQ ID NO: 521891 - RNA, 64 nt, Homo Sapiens; identical to SEQ ID NO: 256689

SEQ ID NO: 521892 - RNA, 64 nt, Homo Sapiens; identical to SEQ ID NO: 256690

SEQ ID NO: 521893 - RNA, 64 nt, Homo Sapiens; identical to SEQ ID NO: 256691

SEQ ID NO: 521894 - RNA, 64 nt, Homo Sapiens; identical to SEQ ID NO: 256692

SEQ ID NO: 521895 - RNA, 64 nt, Homo Sapiens; identical to SEQ ID NO: 256693

SEQ ID NO: 521896 - RNA, 64 nt, Homo Sapiens; identical to SEQ ID NO: 256694

SEQ ID NO: 521897 - RNA, 64 nt, Homo Sapiens; identical to SEQ ID NO: 256695

SEQ ID NO: 521898 - RNA, 64 nt, Homo Sapiens; identical to SEQ ID NO: 256696

SEQ ID NO: 521899 - RNA, 64 nt, Homo Sapiens; identical to SEQ ID NO: 256697

SEQ ID NO: 521900 - RNA, 64 nt, Homo Sapiens; identical to SEQ ID NO: 256698

SEQ ID NO: 521901 - RNA, 64 nt, Homo Sapiens; identical to SEQ ID NO: 256699

SEQ ID NO: 521902 - RNA, 64 nt, Homo Sapiens; identical to SEQ ID NO: 256700

SEQ ID NO: 521903 - RNA, 64 nt, Homo Sapiens; identical to SEQ ID NO: 256701

SEQ ID NO: 521904 - RNA, 64 nt, Homo Sapiens; identical to SEQ ID NO: 256702

SEQ ID NO: 521905 - RNA, 64 nt, Homo Sapiens; identical to SEQ ID NO: 256703

SEQ ID NO: 521906 - RNA, 64 nt, Homo Sapiens; identical to SEQ ID NO: 256704

SEQ ID NO: 521907 - RNA, 64 nt, Homo Sapiens; identical to SEQ ID NO: 256705

SEQ ID NO: 521908 - RNA, 64 nt, Homo Sapiens; identical to SEQ ID NO: 256706

SEQ ID NO: 521909 - RNA, 64 nt, Homo Sapiens; identical to SEQ ID NO: 256707

SEQ ID NO: 521910 - RNA, 64 nt, Homo Sapiens; identical to SEQ ID NO: 256708

SEQ ID NO: 521911 - RNA, 64 nt, Homo Sapiens; identical to SEQ ID NO: 256709

SEQ ID NO: 521912 - RNA, 64 nt, Homo Sapiens; identical to SEQ ID NO: 256710

SEQ ID NO: 521913 - RNA, 64 nt, Homo Sapiens; identical to SEQ ID NO: 256711

SEQ ID NO: 521914 - RNA, 64 nt, Homo Sapiens; identical to SEQ ID NO: 256712

SEQ ID NO: 521915 - RNA, 64 nt, Homo Sapiens; identical to SEQ ID NO: 256713

SEQ ID NO: 521916 - RNA, 64 nt, Homo Sapiens; identical to SEQ ID NO: 256714

SEQ ID NO: 521917 - RNA, 64 nt, Homo Sapiens; identical to SEQ ID NO: 256715

SEQ ID NO: 521918 - RNA, 64 nt, Homo Sapiens; identical to SEQ ID NO: 256716

SEQ ID NO: 521919 - RNA, 64 nt, Homo Sapiens; identical to SEQ ID NO: 256717

SEQ ID NO: 521920 - RNA, 64 nt, Homo Sapiens; identical to SEQ ID NO: 256718

SEQ ID NO: 521921 - RNA, 64 nt, Homo Sapiens; identical to SEQ ID NO: 256719

SEQ ID NO: 521922 - RNA, 64 nt, Homo Sapiens; identical to SEQ ID NO: 256720

SEQ ID NO: 521923 - RNA, 64 nt, Homo Sapiens; identical to SEQ ID NO: 256721

SEQ ID NO: 521924 - RNA, 64 nt, Homo Sapiens; identical to SEQ ID NO: 256722

SEQ ID NO: 521925 - RNA, 64 nt, Homo Sapiens; identical to SEQ ID NO: 256723

SEQ ID NO: 521926 - RNA, 64 nt, Homo Sapiens; identical to SEQ ID NO: 256724

SEQ ID NO: 521927 - RNA, 64 nt, Homo Sapiens; identical to SEQ ID NO: 256725

SEQ ID NO: 521928 - RNA, 64 nt, Homo Sapiens; identical to SEQ ID NO: 256726

SEQ ID NO: 521929 - RNA, 64 nt, Homo Sapiens; identical to SEQ ID NO: 256727

SEQ ID NO: 521930 - RNA, 64 nt, Homo Sapiens; identical to SEQ ID NO: 256728

SEQ ID NO: 521931 - RNA, 64 nt, Homo Sapiens; identical to SEQ ID NO: 256729

SEQ ID NO: 521932 - RNA, 64 nt, Homo Sapiens; identical to SEQ ID NO: 256730

SEQ ID NO: 521933 - RNA, 64 nt, Homo Sapiens; identical to SEQ ID NO: 256731

SEQ ID NO: 521934 - RNA, 64 nt, Homo Sapiens; identical to SEQ ID NO: 256732

SEQ ID NO: 521935 - RNA, 64 nt, Homo Sapiens; identical to SEQ ID NO: 256733

SEQ ID NO: 521936 - RNA, 64 nt, Homo Sapiens; identical to SEQ ID NO: 256734

SEQ ID NO: 521937 - RNA, 64 nt, Homo Sapiens; identical to SEQ ID NO: 256735

SEQ ID NO: 521938 - RNA, 64 nt, Homo Sapiens; identical to SEQ ID NO: 256736

SEQ ID NO: 521939 - RNA, 64 nt, Homo Sapiens; identical to SEQ ID NO: 256737

SEQ ID NO: 521940 - RNA, 64 nt, Homo Sapiens; identical to SEQ ID NO: 256738

SEQ ID NO: 521941 - RNA, 64 nt, Homo Sapiens; identical to SEQ ID NO: 256739

SEQ ID NO: 521942 - RNA, 64 nt, Homo Sapiens; identical to SEQ ID NO: 256740

SEQ ID NO: 521943 - RNA, 64 nt, Homo Sapiens; identical to SEQ ID NO: 256741

SEQ ID NO: 521944 - RNA, 64 nt, Homo Sapiens; identical to SEQ ID NO: 256742

SEQ ID NO: 521945 - RNA, 64 nt, Homo Sapiens; identical to SEQ ID NO: 256743

SEQ ID NO: 521946 - RNA, 64 nt, Homo Sapiens; identical to SEQ ID NO: 256744

SEQ ID NO: 521947 - RNA, 64 nt, Homo Sapiens; identical to SEQ ID NO: 256745

SEQ ID NO: 521948 - RNA, 64 nt, Homo Sapiens; identical to SEQ ID NO: 256746

SEQ ID NO: 521949 - RNA, 64 nt, Homo Sapiens; identical to SEQ ID NO: 256747

SEQ ID NO: 521950 - RNA, 64 nt, Homo Sapiens; identical to SEQ ID NO: 256748

SEQ ID NO: 521951 - RNA, 64 nt, Homo Sapiens; identical to SEQ ID NO: 256749

SEQ ID NO: 521952 - RNA, 64 nt, Homo Sapiens; identical to SEQ ID NO: 256750

SEQ ID NO: 521953 - RNA, 64 nt, Homo Sapiens; identical to SEQ ID NO: 256751

SEQ ID NO: 521954 - RNA, 64 nt, Homo Sapiens; identical to SEQ ID NO: 256752

SEQ ID NO: 521955 - RNA, 64 nt, Homo Sapiens; identical to SEQ ID NO: 256753

SEQ ID NO: 521956 - RNA, 64 nt, Homo Sapiens; identical to SEQ ID NO: 256754

SEQ ID NO: 521957 - RNA, 64 nt, Homo Sapiens; identical to SEQ ID NO: 256755

SEQ ID NO: 521958 - RNA, 64 nt, Homo Sapiens
uaugacaaccaaaaaugucugcagcaacccuggcccacucuaguugugcauuacaggauauuua

SEQ ID NO: 521959 - RNA, 64 nt, Homo Sapiens
uuuagauuucaaaccuuagggccuacucccuuuuccacucuaucaagcaggggcuggugggggu

SEQ ID NO: 521960 - RNA, 64 nt, Homo Sapiens
acuacucauagagcuuguuuuugagaguucuuuuccacucuacuuguuuuacaaagucaggugu

SEQ ID NO: 521961 - RNA, 64 nt, Homo Sapiens
ucucuacaugucaaucaaucucagaacaaagggcccacucuaguucuugcuuuuuuuuuuauga

SEQ ID NO: 521962 - RNA, 64 nt, Homo Sapiens
ugcuggaugugauccugggaccagcuugucccagccacucuagcucaacagugcuuggcccccg

SEQ ID NO: 521963 - RNA, 64 nt, Homo Sapiens
uccuacugcuuuggccuccccuuggaaucuaccgccacucuacaaaauaaacugcuauccuccc

SEQ ID NO: 521964 - RNA, 64 nt, Homo Sapiens; identical to SEQ ID NO: 98311

SEQ ID NO: 521965 - RNA, 64 nt, Homo Sapiens; identical to SEQ ID NO: 98312

SEQ ID NO: 521966 - RNA, 64 nt, Homo Sapiens; identical to SEQ ID NO: 98313

SEQ ID NO: 521967 - RNA, 64 nt, Homo Sapiens; identical to SEQ ID NO: 98314

SEQ ID NO: 521968 - RNA, 64 nt, Homo Sapiens; identical to SEQ ID NO: 98315

SEQ ID NO: 521969 - RNA, 64 nt, Homo Sapiens; identical to SEQ ID NO: 98316

SEQ ID NO: 521970 - RNA, 64 nt, Homo Sapiens; identical to SEQ ID NO: 98317

SEQ ID NO: 521971 - RNA, 64 nt, Homo Sapiens; identical to SEQ ID NO: 98318

SEQ ID NO: 521972 - RNA, 64 nt, Homo Sapiens; identical to SEQ ID NO: 98319

SEQ ID NO: 521973 - RNA, 64 nt, Homo Sapiens; identical to SEQ ID NO: 98320

SEQ ID NO: 521974 - RNA, 64 nt, Homo Sapiens; identical to SEQ ID NO: 98321

SEQ ID NO: 521975 - RNA, 64 nt, Homo Sapiens; identical to SEQ ID NO: 98322

SEQ ID NO: 521976 - RNA, 64 nt, Homo Sapiens; identical to SEQ ID NO: 98323

SEQ ID NO: 521977 - RNA, 64 nt, Homo Sapiens; identical to SEQ ID NO: 98324

SEQ ID NO: 521978 - RNA, 64 nt, Homo Sapiens; identical to SEQ ID NO: 98325

SEQ ID NO: 521979 - RNA, 64 nt, Homo Sapiens; identical to SEQ ID NO: 98326

SEQ ID NO: 521980 - RNA, 64 nt, Homo Sapiens; identical to SEQ ID NO: 98327

SEQ ID NO: 521981 - RNA, 64 nt, Homo Sapiens; identical to SEQ ID NO: 98328

SEQ ID NO: 521982 - RNA, 64 nt, Homo Sapiens; identical to SEQ ID NO: 98329

SEQ ID NO: 521983 - RNA, 64 nt, Homo Sapiens; identical to SEQ ID NO: 98330

SEQ ID NO: 521984 - RNA, 64 nt, Homo Sapiens; identical to SEQ ID NO: 98331

SEQ ID NO: 521985 - RNA, 64 nt, Homo Sapiens; identical to SEQ ID NO: 98332

SEQ ID NO: 521986 - RNA, 64 nt, Homo Sapiens; identical to SEQ ID NO: 98333

SEQ ID NO: 521987 - RNA, 64 nt, Homo Sapiens; identical to SEQ ID NO: 98334

SEQ ID NO: 521988 - RNA, 64 nt, Homo Sapiens; identical to SEQ ID NO: 98335

SEQ ID NO: 521989 - RNA, 64 nt, Homo Sapiens; identical to SEQ ID NO: 98336

SEQ ID NO: 521990 - RNA, 64 nt, Homo Sapiens; identical to SEQ ID NO: 98337

SEQ ID NO: 521991 - RNA, 64 nt, Homo Sapiens; identical to SEQ ID NO: 98338

SEQ ID NO: 521992 - RNA, 64 nt, Homo Sapiens; identical to SEQ ID NO: 98339

SEQ ID NO: 521993 - RNA, 64 nt, Homo Sapiens; identical to SEQ ID NO: 98340

SEQ ID NO: 521994 - RNA, 64 nt, Homo Sapiens; identical to SEQ ID NO: 98341

SEQ ID NO: 521995 - RNA, 64 nt, Homo Sapiens; identical to SEQ ID NO: 98342

SEQ ID NO: 521996 - RNA, 64 nt, Homo Sapiens; identical to SEQ ID NO: 98343

SEQ ID NO: 521997 - RNA, 64 nt, Homo Sapiens; identical to SEQ ID NO: 98344

SEQ ID NO: 521998 - RNA, 64 nt, Homo Sapiens; identical to SEQ ID NO: 98345

SEQ ID NO: 521999 - RNA, 64 nt, Homo Sapiens; identical to SEQ ID NO: 98346

SEQ ID NO: 522000 - RNA, 64 nt, Homo Sapiens; identical to SEQ ID NO: 98347

SEQ ID NO: 522001 - RNA, 64 nt, Homo Sapiens; identical to SEQ ID NO: 98348

SEQ ID NO: 522002 - RNA, 64 nt, Homo Sapiens; identical to SEQ ID NO: 98349

SEQ ID NO: 522003 - RNA, 64 nt, Homo Sapiens; identical to SEQ ID NO: 98350

SEQ ID NO: 522004 - RNA, 64 nt, Homo Sapiens; identical to SEQ ID NO: 98351

SEQ ID NO: 522005 - RNA, 64 nt, Homo Sapiens; identical to SEQ ID NO: 98352

SEQ ID NO: 522006 - RNA, 64 nt, Homo Sapiens; identical to SEQ ID NO: 98353

SEQ ID NO: 522007 - RNA, 64 nt, Homo Sapiens; identical to SEQ ID NO: 98354

SEQ ID NO: 522008 - RNA, 64 nt, Homo Sapiens; identical to SEQ ID NO: 98355

SEQ ID NO: 522009 - RNA, 64 nt, Homo Sapiens; identical to SEQ ID NO: 98356

SEQ ID NO: 522010 - RNA, 64 nt, Homo Sapiens; identical to SEQ ID NO: 98357

SEQ ID NO: 522011 - RNA, 64 nt, Homo Sapiens; identical to SEQ ID NO: 98358

SEQ ID NO: 522012 - RNA, 64 nt, Homo Sapiens; identical to SEQ ID NO: 98359

SEQ ID NO: 522013 - RNA, 64 nt, Homo Sapiens; identical to SEQ ID NO: 98360

SEQ ID NO: 522014 - RNA, 64 nt, Homo Sapiens; identical to SEQ ID NO: 98361

SEQ ID NO: 522015 - RNA, 64 nt, Homo Sapiens; identical to SEQ ID NO: 98362

SEQ ID NO: 522016 - RNA, 64 nt, Homo Sapiens; identical to SEQ ID NO: 98363

SEQ ID NO: 522017 - RNA, 64 nt, Homo Sapiens; identical to SEQ ID NO: 98364

SEQ ID NO: 522018 - RNA, 64 nt, Homo Sapiens; identical to SEQ ID NO: 98365

SEQ ID NO: 522019 - RNA, 64 nt, Homo Sapiens; identical to SEQ ID NO: 98366

SEQ ID NO: 522020 - RNA, 64 nt, Homo Sapiens; identical to SEQ ID NO: 98367

SEQ ID NO: 522021 - RNA, 64 nt, Homo Sapiens; identical to SEQ ID NO: 98368

SEQ ID NO: 522022 - RNA, 64 nt, Homo Sapiens; identical to SEQ ID NO: 98369

SEQ ID NO: 522023 - RNA, 64 nt, Homo Sapiens; identical to SEQ ID NO: 98370

SEQ ID NO: 522024 - RNA, 64 nt, Homo Sapiens; identical to SEQ ID NO: 98371

SEQ ID NO: 522025 - RNA, 64 nt, Homo Sapiens; identical to SEQ ID NO: 98372

SEQ ID NO: 522026 - RNA, 64 nt, Homo Sapiens; identical to SEQ ID NO: 98373

SEQ ID NO: 522027 - RNA, 64 nt, Homo Sapiens; identical to SEQ ID NO: 98374

SEQ ID NO: 522028 - RNA, 64 nt, Homo Sapiens; identical to SEQ ID NO: 98375

SEQ ID NO: 522029 - RNA, 64 nt, Homo Sapiens; identical to SEQ ID NO: 98376

SEQ ID NO: 522030 - RNA, 64 nt, Homo Sapiens; identical to SEQ ID NO: 98377

SEQ ID NO: 522031 - RNA, 64 nt, Homo Sapiens; identical to SEQ ID NO: 98378

SEQ ID NO: 522032 - RNA, 64 nt, Homo Sapiens; identical to SEQ ID NO: 98379

SEQ ID NO: 522033 - RNA, 64 nt, Homo Sapiens; identical to SEQ ID NO: 98380

SEQ ID NO: 522034 - RNA, 64 nt, Homo Sapiens; identical to SEQ ID NO: 98381

SEQ ID NO: 522035 - RNA, 64 nt, Homo Sapiens; identical to SEQ ID NO: 98382

SEQ ID NO: 522036 - RNA, 64 nt, Homo Sapiens; identical to SEQ ID NO: 98383

SEQ ID NO: 522037 - RNA, 64 nt, Homo Sapiens; identical to SEQ ID NO: 98384

SEQ ID NO: 522038 - RNA, 64 nt, Homo Sapiens; identical to SEQ ID NO: 98385

SEQ ID NO: 522039 - RNA, 64 nt, Homo Sapiens; identical to SEQ ID NO: 98386

SEQ ID NO: 522040 - RNA, 64 nt, Homo Sapiens; identical to SEQ ID NO: 98387

SEQ ID NO: 522041 - RNA, 64 nt, Homo Sapiens; identical to SEQ ID NO: 98388

SEQ ID NO: 522042 - RNA, 64 nt, Homo Sapiens; identical to SEQ ID NO: 98389

SEQ ID NO: 522043 - RNA, 64 nt, Homo Sapiens; identical to SEQ ID NO: 98390

SEQ ID NO: 522044 - RNA, 64 nt, Homo Sapiens; identical to SEQ ID NO: 98391

SEQ ID NO: 522045 - RNA, 64 nt, Homo Sapiens; identical to SEQ ID NO: 98392

SEQ ID NO: 522046 - RNA, 64 nt, Homo Sapiens; identical to SEQ ID NO: 98393

SEQ ID NO: 522047 - RNA, 64 nt, Homo Sapiens; identical to SEQ ID NO: 98394

SEQ ID NO: 522048 - RNA, 64 nt, Homo Sapiens; identical to SEQ ID NO: 98395

SEQ ID NO: 522049 - RNA, 64 nt, Homo Sapiens; identical to SEQ ID NO: 98396

SEQ ID NO: 522050 - RNA, 64 nt, Homo Sapiens; identical to SEQ ID NO: 98397

SEQ ID NO: 522051 - RNA, 64 nt, Homo Sapiens; identical to SEQ ID NO: 98398

SEQ ID NO: 522052 - RNA, 64 nt, Homo Sapiens; identical to SEQ ID NO: 98399

SEQ ID NO: 522053 - RNA, 64 nt, Homo Sapiens; identical to SEQ ID NO: 98400

SEQ ID NO: 522054 - RNA, 64 nt, Homo Sapiens; identical to SEQ ID NO: 98401

SEQ ID NO: 522055 - RNA, 64 nt, Homo Sapiens; identical to SEQ ID NO: 98402

SEQ ID NO: 522056 - RNA, 64 nt, Homo Sapiens; identical to SEQ ID NO: 98403

SEQ ID NO: 522057 - RNA, 64 nt, Homo Sapiens; identical to SEQ ID NO: 98404

SEQ ID NO: 522058 - RNA, 64 nt, Homo Sapiens; identical to SEQ ID NO: 98405

SEQ ID NO: 522059 - RNA, 64 nt, Homo Sapiens; identical to SEQ ID NO: 98406

SEQ ID NO: 522060 - RNA, 64 nt, Homo Sapiens; identical to SEQ ID NO: 98407

SEQ ID NO: 522061 - RNA, 64 nt, Homo Sapiens; identical to SEQ ID NO: 98408

SEQ ID NO: 522062 - RNA, 64 nt, Homo Sapiens; identical to SEQ ID NO: 98409

SEQ ID NO: 522063 - RNA, 64 nt, Homo Sapiens; identical to SEQ ID NO: 98410

SEQ ID NO: 522064 - RNA, 64 nt, Homo Sapiens; identical to SEQ ID NO: 98411

SEQ ID NO: 522065 - RNA, 64 nt, Homo Sapiens; identical to SEQ ID NO: 98412

SEQ ID NO: 522066 - RNA, 64 nt, Homo Sapiens; identical to SEQ ID NO: 98413

SEQ ID NO: 522067 - RNA, 64 nt, Homo Sapiens; identical to SEQ ID NO: 98414

SEQ ID NO: 522068 - RNA, 64 nt, Homo Sapiens; identical to SEQ ID NO: 98415

SEQ ID NO: 522069 - RNA, 64 nt, Homo Sapiens; identical to SEQ ID NO: 98416

SEQ ID NO: 522070 - RNA, 64 nt, Homo Sapiens; identical to SEQ ID NO: 98417

SEQ ID NO: 522071 - RNA, 64 nt, Homo Sapiens; identical to SEQ ID NO: 98418

SEQ ID NO: 522072 - RNA, 64 nt, Homo Sapiens; identical to SEQ ID NO: 98419

SEQ ID NO: 522073 - RNA, 64 nt, Homo Sapiens; identical to SEQ ID NO: 98420

SEQ ID NO: 522074 - RNA, 64 nt, Homo Sapiens; identical to SEQ ID NO: 98421

SEQ ID NO: 522075 - RNA, 64 nt, Homo Sapiens; identical to SEQ ID NO: 98422

SEQ ID NO: 522076 - RNA, 64 nt, Homo Sapiens; identical to SEQ ID NO: 98423

SEQ ID NO: 522077 - RNA, 64 nt, Homo Sapiens; identical to SEQ ID NO: 98424

SEQ ID NO: 522078 - RNA, 64 nt, Homo Sapiens; identical to SEQ ID NO: 98425

SEQ ID NO: 522079 - RNA, 64 nt, Homo Sapiens; identical to SEQ ID NO: 98426

SEQ ID NO: 522080 - RNA, 64 nt, Homo Sapiens; identical to SEQ ID NO: 98427

SEQ ID NO: 522081 - RNA, 64 nt, Homo Sapiens; identical to SEQ ID NO: 98428

SEQ ID NO: 522082 - RNA, 64 nt, Homo Sapiens; identical to SEQ ID NO: 98429

SEQ ID NO: 522083 - RNA, 64 nt, Homo Sapiens; identical to SEQ ID NO: 98430

SEQ ID NO: 522084 - RNA, 64 nt, Homo Sapiens; identical to SEQ ID NO: 98431

SEQ ID NO: 522085 - RNA, 64 nt, Homo Sapiens; identical to SEQ ID NO: 98432

SEQ ID NO: 522086 - RNA, 64 nt, Homo Sapiens; identical to SEQ ID NO: 98433

SEQ ID NO: 522087 - RNA, 64 nt, Homo Sapiens; identical to SEQ ID NO: 98434

SEQ ID NO: 522088 - RNA, 64 nt, Homo Sapiens; identical to SEQ ID NO: 98435

SEQ ID NO: 522089 - RNA, 64 nt, Homo Sapiens; identical to SEQ ID NO: 98436

SEQ ID NO: 522090 - RNA, 64 nt, Homo Sapiens; identical to SEQ ID NO: 98437

SEQ ID NO: 522091 - RNA, 64 nt, Homo Sapiens; identical to SEQ ID NO: 98438

SEQ ID NO: 522092 - RNA, 64 nt, Homo Sapiens; identical to SEQ ID NO: 98439

SEQ ID NO: 522093 - RNA, 64 nt, Homo Sapiens; identical to SEQ ID NO: 98440

SEQ ID NO: 522094 - RNA, 64 nt, Homo Sapiens; identical to SEQ ID NO: 98441

SEQ ID NO: 522095 - RNA, 64 nt, Homo Sapiens; identical to SEQ ID NO: 98442

SEQ ID NO: 522096 - RNA, 64 nt, Homo Sapiens; identical to SEQ ID NO: 98443

SEQ ID NO: 522097 - RNA, 64 nt, Homo Sapiens; identical to SEQ ID NO: 98444

SEQ ID NO: 522098 - RNA, 64 nt, Homo Sapiens; identical to SEQ ID NO: 98445

SEQ ID NO: 522099 - RNA, 64 nt, Homo Sapiens; identical to SEQ ID NO: 98446

SEQ ID NO: 522100 - RNA, 64 nt, Homo Sapiens; identical to SEQ ID NO: 98447

SEQ ID NO: 522101 - RNA, 64 nt, Homo Sapiens; identical to SEQ ID NO: 98448

SEQ ID NO: 522102 - RNA, 64 nt, Homo Sapiens; identical to SEQ ID NO: 98449

SEQ ID NO: 522103 - RNA, 64 nt, Homo Sapiens; identical to SEQ ID NO: 98450

SEQ ID NO: 522104 - RNA, 64 nt, Homo Sapiens; identical to SEQ ID NO: 98451

SEQ ID NO: 522105 - RNA, 64 nt, Homo Sapiens; identical to SEQ ID NO: 98452

SEQ ID NO: 522106 - RNA, 64 nt, Homo Sapiens; identical to SEQ ID NO: 98453

SEQ ID NO: 522107 - RNA, 64 nt, Homo Sapiens; identical to SEQ ID NO: 98454

SEQ ID NO: 522108 - RNA, 64 nt, Homo Sapiens; identical to SEQ ID NO: 98455

SEQ ID NO: 522109 - RNA, 64 nt, Homo Sapiens; identical to SEQ ID NO: 98456

SEQ ID NO: 522110 - RNA, 64 nt, Homo Sapiens; identical to SEQ ID NO: 98457

SEQ ID NO: 522111 - RNA, 64 nt, Homo Sapiens; identical to SEQ ID NO: 98458

SEQ ID NO: 522112 - RNA, 64 nt, Homo Sapiens; identical to SEQ ID NO: 98459

SEQ ID NO: 522113 - RNA, 64 nt, Homo Sapiens; identical to SEQ ID NO: 98460

SEQ ID NO: 522114 - RNA, 64 nt, Homo Sapiens; identical to SEQ ID NO: 98461

SEQ ID NO: 522115 - RNA, 64 nt, Homo Sapiens; identical to SEQ ID NO: 98462

SEQ ID NO: 522116 - RNA, 64 nt, Homo Sapiens; identical to SEQ ID NO: 98463

SEQ ID NO: 522117 - RNA, 64 nt, Homo Sapiens; identical to SEQ ID NO: 98464

SEQ ID NO: 522118 - RNA, 64 nt, Homo Sapiens; identical to SEQ ID NO: 98465

SEQ ID NO: 522119 - RNA, 64 nt, Homo Sapiens; identical to SEQ ID NO: 98466

SEQ ID NO: 522120 - RNA, 64 nt, Homo Sapiens; identical to SEQ ID NO: 98467

SEQ ID NO: 522121 - RNA, 64 nt, Homo Sapiens; identical to SEQ ID NO: 98468

SEQ ID NO: 522122 - RNA, 64 nt, Homo Sapiens; identical to SEQ ID NO: 98469

SEQ ID NO: 522123 - RNA, 64 nt, Homo Sapiens; identical to SEQ ID NO: 98470

SEQ ID NO: 522124 - RNA, 64 nt, Homo Sapiens; identical to SEQ ID NO: 98471

SEQ ID NO: 522125 - RNA, 64 nt, Homo Sapiens; identical to SEQ ID NO: 98472

SEQ ID NO: 522126 - RNA, 64 nt, Homo Sapiens; identical to SEQ ID NO: 98473

SEQ ID NO: 522127 - RNA, 64 nt, Homo Sapiens; identical to SEQ ID NO: 98474

SEQ ID NO: 522128 - RNA, 64 nt, Homo Sapiens; identical to SEQ ID NO: 98475

SEQ ID NO: 522129 - RNA, 64 nt, Homo Sapiens; identical to SEQ ID NO: 98476

SEQ ID NO: 522130 - RNA, 64 nt, Homo Sapiens; identical to SEQ ID NO: 98477

SEQ ID NO: 522131 - RNA, 64 nt, Homo Sapiens; identical to SEQ ID NO: 98478

SEQ ID NO: 522132 - RNA, 64 nt, Homo Sapiens; identical to SEQ ID NO: 98479

SEQ ID NO: 522133 - RNA, 64 nt, Homo Sapiens; identical to SEQ ID NO: 98480

SEQ ID NO: 522134 - RNA, 64 nt, Homo Sapiens; identical to SEQ ID NO: 98481

SEQ ID NO: 522135 - RNA, 64 nt, Homo Sapiens; identical to SEQ ID NO: 98482

SEQ ID NO: 522136 - RNA, 64 nt, Homo Sapiens; identical to SEQ ID NO: 98483

SEQ ID NO: 522137 - RNA, 64 nt, Homo Sapiens; identical to SEQ ID NO: 98484

SEQ ID NO: 522138 - RNA, 64 nt, Homo Sapiens; identical to SEQ ID NO: 98485

SEQ ID NO: 522139 - RNA, 64 nt, Homo Sapiens; identical to SEQ ID NO: 98486

SEQ ID NO: 522140 - RNA, 64 nt, Homo Sapiens; identical to SEQ ID NO: 98487

SEQ ID NO: 522141 - RNA, 64 nt, Homo Sapiens; identical to SEQ ID NO: 98488

SEQ ID NO: 522142 - RNA, 64 nt, Homo Sapiens; identical to SEQ ID NO: 98489

SEQ ID NO: 522143 - RNA, 64 nt, Homo Sapiens; identical to SEQ ID NO: 98490

SEQ ID NO: 522144 - RNA, 64 nt, Homo Sapiens; identical to SEQ ID NO: 98491

SEQ ID NO: 522145 - RNA, 64 nt, Homo Sapiens; identical to SEQ ID NO: 98492

SEQ ID NO: 522146 - RNA, 64 nt, Homo Sapiens; identical to SEQ ID NO: 98493

SEQ ID NO: 522147 - RNA, 64 nt, Homo Sapiens; identical to SEQ ID NO: 98494

SEQ ID NO: 522148 - RNA, 64 nt, Homo Sapiens; identical to SEQ ID NO: 98495

SEQ ID NO: 522149 - RNA, 64 nt, Homo Sapiens; identical to SEQ ID NO: 98496

SEQ ID NO: 522150 - RNA, 64 nt, Homo Sapiens; identical to SEQ ID NO: 98497

SEQ ID NO: 522151 - RNA, 64 nt, Homo Sapiens; identical to SEQ ID NO: 98498

SEQ ID NO: 522152 - RNA, 64 nt, Homo Sapiens; identical to SEQ ID NO: 98499

SEQ ID NO: 522153 - RNA, 64 nt, Homo Sapiens; identical to SEQ ID NO: 98500

SEQ ID NO: 522154 - RNA, 64 nt, Homo Sapiens; identical to SEQ ID NO: 98501

SEQ ID NO: 522155 - RNA, 64 nt, Homo Sapiens; identical to SEQ ID NO: 98502

SEQ ID NO: 522156 - RNA, 64 nt, Homo Sapiens; identical to SEQ ID NO: 98503

SEQ ID NO: 522157 - RNA, 64 nt, Homo Sapiens; identical to SEQ ID NO: 98504

SEQ ID NO: 522158 - RNA, 64 nt, Homo Sapiens; identical to SEQ ID NO: 144190

SEQ ID NO: 522159 - RNA, 64 nt, Homo Sapiens; identical to SEQ ID NO: 144191

SEQ ID NO: 522160 - RNA, 64 nt, Homo Sapiens; identical to SEQ ID NO: 144192

SEQ ID NO: 522161 - RNA, 64 nt, Homo Sapiens; identical to SEQ ID NO: 144193

SEQ ID NO: 522162 - RNA, 64 nt, Homo Sapiens; identical to SEQ ID NO: 144194

SEQ ID NO: 522163 - RNA, 64 nt, Homo Sapiens; identical to SEQ ID NO: 144195

SEQ ID NO: 522164 - RNA, 64 nt, Homo Sapiens; identical to SEQ ID NO: 144196

SEQ ID NO: 522165 - RNA, 64 nt, Homo Sapiens; identical to SEQ ID NO: 144197

SEQ ID NO: 522166 - RNA, 64 nt, Homo Sapiens; identical to SEQ ID NO: 144198

SEQ ID NO: 522167 - RNA, 64 nt, Homo Sapiens; identical to SEQ ID NO: 144199

SEQ ID NO: 522168 - RNA, 64 nt, Homo Sapiens; identical to SEQ ID NO: 144200

SEQ ID NO: 522169 - RNA, 64 nt, Homo Sapiens; identical to SEQ ID NO: 144201

SEQ ID NO: 522170 - RNA, 64 nt, Homo Sapiens; identical to SEQ ID NO: 144202

SEQ ID NO: 522171 - RNA, 64 nt, Homo Sapiens; identical to SEQ ID NO: 144203

SEQ ID NO: 522172 - RNA, 64 nt, Homo Sapiens; identical to SEQ ID NO: 144204

SEQ ID NO: 522173 - RNA, 64 nt, Homo Sapiens; identical to SEQ ID NO: 144205

SEQ ID NO: 522174 - RNA, 64 nt, Homo Sapiens; identical to SEQ ID NO: 144206

SEQ ID NO: 522175 - RNA, 64 nt, Homo Sapiens; identical to SEQ ID NO: 144207

SEQ ID NO: 522176 - RNA, 64 nt, Homo Sapiens; identical to SEQ ID NO: 144208

SEQ ID NO: 522177 - RNA, 64 nt, Homo Sapiens; identical to SEQ ID NO: 144209

SEQ ID NO: 522178 - RNA, 64 nt, Homo Sapiens; identical to SEQ ID NO: 144210

SEQ ID NO: 522179 - RNA, 64 nt, Homo Sapiens; identical to SEQ ID NO: 144211

SEQ ID NO: 522180 - RNA, 64 nt, Homo Sapiens; identical to SEQ ID NO: 144212

SEQ ID NO: 522181 - RNA, 64 nt, Homo Sapiens; identical to SEQ ID NO: 144213

SEQ ID NO: 522182 - RNA, 64 nt, Homo Sapiens; identical to SEQ ID NO: 144214

SEQ ID NO: 522183 - RNA, 64 nt, Homo Sapiens; identical to SEQ ID NO: 144215

SEQ ID NO: 522184 - RNA, 64 nt, Homo Sapiens; identical to SEQ ID NO: 144216

SEQ ID NO: 522185 - RNA, 64 nt, Homo Sapiens; identical to SEQ ID NO: 144217

SEQ ID NO: 522186 - RNA, 64 nt, Homo Sapiens; identical to SEQ ID NO: 144218

SEQ ID NO: 522187 - RNA, 64 nt, Homo Sapiens; identical to SEQ ID NO: 144219

SEQ ID NO: 522188 - RNA, 64 nt, Homo Sapiens; identical to SEQ ID NO: 144220

SEQ ID NO: 522189 - RNA, 64 nt, Homo Sapiens; identical to SEQ ID NO: 144221

SEQ ID NO: 522190 - RNA, 64 nt, Homo Sapiens; identical to SEQ ID NO: 144222

SEQ ID NO: 522191 - RNA, 64 nt, Homo Sapiens; identical to SEQ ID NO: 144223

SEQ ID NO: 522192 - RNA, 64 nt, Homo Sapiens; identical to SEQ ID NO: 144224

SEQ ID NO: 522193 - RNA, 64 nt, Homo Sapiens; identical to SEQ ID NO: 144225

SEQ ID NO: 522194 - RNA, 64 nt, Homo Sapiens; identical to SEQ ID NO: 144226

SEQ ID NO: 522195 - RNA, 64 nt, Homo Sapiens; identical to SEQ ID NO: 144227

SEQ ID NO: 522196 - RNA, 64 nt, Homo Sapiens; identical to SEQ ID NO: 144228

SEQ ID NO: 522197 - RNA, 64 nt, Homo Sapiens; identical to SEQ ID NO: 144229

SEQ ID NO: 522198 - RNA, 64 nt, Homo Sapiens; identical to SEQ ID NO: 144230

SEQ ID NO: 522199 - RNA, 64 nt, Homo Sapiens; identical to SEQ ID NO: 144231

SEQ ID NO: 522200 - RNA, 64 nt, Homo Sapiens; identical to SEQ ID NO: 144232

SEQ ID NO: 522201 - RNA, 64 nt, Homo Sapiens; identical to SEQ ID NO: 144233

SEQ ID NO: 522202 - RNA, 64 nt, Homo Sapiens; identical to SEQ ID NO: 144234

SEQ ID NO: 522203 - RNA, 64 nt, Homo Sapiens; identical to SEQ ID NO: 144235

SEQ ID NO: 522204 - RNA, 64 nt, Homo Sapiens; identical to SEQ ID NO: 144236

SEQ ID NO: 522205 - RNA, 64 nt, Homo Sapiens; identical to SEQ ID NO: 144237

SEQ ID NO: 522206 - RNA, 64 nt, Homo Sapiens; identical to SEQ ID NO: 144238

SEQ ID NO: 522207 - RNA, 64 nt, Homo Sapiens; identical to SEQ ID NO: 144239

SEQ ID NO: 522208 - RNA, 64 nt, Homo Sapiens; identical to SEQ ID NO: 144240

SEQ ID NO: 522209 - RNA, 64 nt, Homo Sapiens; identical to SEQ ID NO: 144241

SEQ ID NO: 522210 - RNA, 64 nt, Homo Sapiens; identical to SEQ ID NO: 144242

SEQ ID NO: 522211 - RNA, 64 nt, Homo Sapiens; identical to SEQ ID NO: 144243

SEQ ID NO: 522212 - RNA, 64 nt, Homo Sapiens; identical to SEQ ID NO: 144244

SEQ ID NO: 522213 - RNA, 64 nt, Homo Sapiens; identical to SEQ ID NO: 144245

SEQ ID NO: 522214 - RNA, 64 nt, Homo Sapiens; identical to SEQ ID NO: 144246

SEQ ID NO: 522215 - RNA, 64 nt, Homo Sapiens; identical to SEQ ID NO: 144247

SEQ ID NO: 522216 - RNA, 64 nt, Homo Sapiens; identical to SEQ ID NO: 144248

SEQ ID NO: 522217 - RNA, 64 nt, Homo Sapiens; identical to SEQ ID NO: 144249

SEQ ID NO: 522218 - RNA, 64 nt, Homo Sapiens; identical to SEQ ID NO: 144250

SEQ ID NO: 522219 - RNA, 64 nt, Homo Sapiens; identical to SEQ ID NO: 144251

SEQ ID NO: 522220 - RNA, 64 nt, Homo Sapiens; identical to SEQ ID NO: 144252

SEQ ID NO: 522221 - RNA, 64 nt, Homo Sapiens; identical to SEQ ID NO: 144253

SEQ ID NO: 522222 - RNA, 64 nt, Homo Sapiens; identical to SEQ ID NO: 144254

SEQ ID NO: 522223 - RNA, 64 nt, Homo Sapiens; identical to SEQ ID NO: 144255

SEQ ID NO: 522224 - RNA, 64 nt, Homo Sapiens
gauuaugucucauggagaccaguaagaaaaucauuuaucugaaggugaaaugcagaguuggaua

SEQ ID NO: 522225 - RNA, 64 nt, Homo Sapiens
ggaauggaguguucuaaccaauugccuuuucuuguuaucugagcucuccuauauuaucauacuc

SEQ ID NO: 522226 - RNA, 64 nt, Homo Sapiens
acauugaaugaaacuauuuuaccugaacuagauuuuaucugaaaguagguagaauuuuugcuau

SEQ ID NO: 522227 - RNA, 64 nt, Homo Sapiens
uugaaaugauugaccuuuaaauuuuugccaaauguuaucugaaauugucuaugaauaccaucua

SEQ ID NO: 522228 - RNA, 52 nt, Homo Sapiens
aggcuauuucuggauguugagauuaucugauuucaagguacugaaggacaaa

SEQ ID NO: 522229 - RNA, 64 nt, Homo Sapiens
uuuuggggaggaacuacacagucgugauuagaauuuaucugaugguuuuguauuauaacuugua

SEQ ID NO: 522230 - RNA, 57 nt, Homo Sapiens
ggaagcuggaauucguaugacggagucuuaucugaacuacacuuacugaacagcuug

SEQ ID NO: 522231 - RNA, 64 nt, Homo Sapiens
gaaggccuuuugaguucugcuggacaggagcacuuuaucugaagacaaacucauuuaaucaucu

SEQ ID NO: 522232 - RNA, 64 nt, Homo Sapiens
ggcaccuuguuuaugaagaauaaaaaaugauuuguuaucugaagagaauaaauuuuaaauucuc

SEQ ID NO: 522233 - RNA, 64 nt, Homo Sapiens
cagucuuccuguauuuuaugugcaucauagugauuuaucugagcuuagugacccccaucuugua

SEQ ID NO: 522234 - RNA, 64 nt, Homo Sapiens
cucuuuauauauauuauuucugcaguuaccauccuuaucugaguuaucacaguucaugaaucua

SEQ ID NO: 522235 - RNA, 64 nt, Homo Sapiens
auagauucugguguuaaaauagacuggaucuguauuaucugaggguuaguaacuaaugcuuagc

SEQ ID NO: 522236 - RNA, 64 nt, Homo Sapiens
ccuucauuuggcaagggaagucuuuuuaacuaguuuaucugaugauuuucuuacaugagcuuuu

SEQ ID NO: 522237 - RNA, 64 nt, Homo Sapiens
aacaagcaaucuuauuuuggaaggcguuaaaaaauuaucugacaguuacaugguaacagugaau

SEQ ID NO: 522238 - RNA, 64 nt, Homo Sapiens
uuuuaaauggacaagcaauaggggguugaaguguuuaucugauuuguuuaaaauuuuguauauc

SEQ ID NO: 522239 - RNA, 64 nt, Homo Sapiens
cagcuuuuucauaaggaaaauacuuuauuugcuuuuaucugagaauuucucaguaugaaaauga

SEQ ID NO: 522240 - RNA, 64 nt, Homo Sapiens
ucuuuggaaacuauaacauaauccugcuugacccuuaucugaccugcuggaguauuuucuaaua

SEQ ID NO: 522241 - RNA, 64 nt, Homo Sapiens
uaggagauacaaacuuuguaaggaaaauccaugguuaucugagaaauauuucuguggaaauaug

SEQ ID NO: 522242 - RNA, 64 nt, Homo Sapiens; identical to SEQ ID NO: 264456

SEQ ID NO: 522243 - RNA, 64 nt, Homo Sapiens; identical to SEQ ID NO: 264457

SEQ ID NO: 522244 - RNA, 64 nt, Homo Sapiens; identical to SEQ ID NO: 264458

SEQ ID NO: 522245 - RNA, 64 nt, Homo Sapiens; identical to SEQ ID NO: 264459

SEQ ID NO: 522246 - RNA, 64 nt, Homo Sapiens; identical to SEQ ID NO: 264460

SEQ ID NO: 522247 - RNA, 64 nt, Homo Sapiens; identical to SEQ ID NO: 264461

SEQ ID NO: 522248 - RNA, 64 nt, Homo Sapiens; identical to SEQ ID NO: 264460

SEQ ID NO: 522249 - RNA, 64 nt, Homo Sapiens
aaaauagaaucauuaggccaggcgugguggcucaugcuuguaaucccagcacuuugguaggcug

SEQ ID NO: 522250 - RNA, 64 nt, Homo Sapiens
aaaauuacaaaaauuagccggccaugguggcaggugcuuguaaucccagcuacuugggaggcug

SEQ ID NO: 522251 - RNA, 64 nt, Homo Sapiens
aacacgcacacacaaauggaucauugguuucugaugcuuguacacuuugcuuuuggggucuaug

SEQ ID NO: 522252 - RNA, 64 nt, Homo Sapiens
ccagcauguuucacagaguauccuggguagucugugcuuguaaugcgccugcaccgccucugcg

SEQ ID NO: 522253 - RNA, 64 nt, Homo Sapiens
uuuuaucaguaauaggugucaguuuuuaaaaaauugcuuguaggcugagcgcgguggcucacgc

SEQ ID NO: 522254 - RNA, 64 nt, Homo Sapiens
gacagagugagacucugucuccaaaaaaaaacuuugcuuguauauuauuuuugccuuacagugg

SEQ ID NO: 522255 - RNA, 64 nt, Homo Sapiens
ucuuuugcuuaaaucaguuggaguuugugucuguugcuuguaaucaagccuuuauggcugcugg

SEQ ID NO: 522256 - RNA, 64 nt, Homo Sapiens
accaagaaagcuucuucagagugaagaaucuuaaugcuuguaauuuaaacauuuguuccuggag

SEQ ID NO: 522257 - RNA, 64 nt, Homo Sapiens
auucugagacuuuauuugcguccuaacaguguugugcuuguaugcccagccuaaacagggagag

SEQ ID NO: 522258 - RNA, 64 nt, Homo Sapiens
guuguggguaucauuccaaaguagagggauaagaugcuuguagauuaauaagguagucauuccu

SEQ ID NO: 522259 - RNA, 64 nt, Homo Sapiens
aguuucuuaucuuuuuugguuuauucucaggaguugcuuguacauucuugggcaauugcagaua

SEQ ID NO: 522260 - RNA, 64 nt, Homo Sapiens
aaaaauacaaaaauuagcugggugcaguggcgcaugcuuguaaucccagcuacucaggaggcag

SEQ ID NO: 522261 - RNA, 64 nt, Homo Sapiens
auccacuuuuuagugcaacaagagcuccauguuaugcuuguaauaaauuauuuacacgggagcu

SEQ ID NO: 522262 - RNA, 64 nt, Homo Sapiens
agcuccaggcuccugccagcuggaggugaaacugugcuuguauccccagccacgaagagcugga

SEQ ID NO: 522263 - RNA, 64 nt, Homo Sapiens
auugauuaaaauuuaucuuuuuuauuaucuuacaugcuuguaucuucaguuggagguguaguau

SEQ ID NO: 522264 - RNA, 64 nt, Homo Sapiens
acauuuuguugugcuaugagccucuguaaucaaaugcuuguacucagaagagaguguaaaauca

SEQ ID NO: 522265 - RNA, 64 nt, Homo Sapiens
aacuaccgucauucugcucauguuucuucuugaccucuugcauaaucuuuuuguuuucuagaca

SEQ ID NO: 522266 - RNA, 64 nt, Homo Sapiens
aguuauaguuguggauaaaggggagaauuuauugcucuugcaaaccaauuauggaaagcaacuu

SEQ ID NO: 522267 - RNA, 64 nt, Homo Sapiens
cucuggccuggcugggccacugcccucuguccaucucuugcagugguggggucggacgccgugg

SEQ ID NO: 522268 - RNA, 64 nt, Homo Sapiens
guggacucugcacaguccucugcccucuguccgucucuugcagugguggggucagaugcugugg

SEQ ID NO: 522269 - RNA, 64 nt, Homo Sapiens
uacuuauuaucagaauuucugaaaccuuuacaaaaauucugauuuauuccauuaauggccgguu

SEQ ID NO: 522270 - RNA, 64 nt, Homo Sapiens
aaaacuuauuaaaaaauaggauuuacuuuuuucuaauucugaccuaagaaaaauaaugagaaca

SEQ ID NO: 522271 - RNA, 64 nt, Homo Sapiens
uacauugcuugaaaaugaguuuauaaaacauucaaauucugauacaucuugcuuagucauguug

SEQ ID NO: 522272 - RNA, 64 nt, Homo Sapiens
auuauuuauaaguauaaaaucuugacccuauuugaauucugagcauauaggaaauauuucugca

SEQ ID NO: 522273 - RNA, 64 nt, Homo Sapiens
augacaucauaauacuggaugaaaacuugcauagaauucugauuaaauagugggucuguuucac

SEQ ID NO: 522274 - RNA, 64 nt, Homo Sapiens
uugugguaaagacuguuuguacccuucaugaaauaauucugaaguugccaucaguuuuacuaau

SEQ ID NO: 522275 - RNA, 64 nt, Homo Sapiens
guagcuugagccugaaaugcaaaacccauggaggaauucugaagccauugucuccuugaguacc

SEQ ID NO: 522276 - RNA, 64 nt, Homo Sapiens
aauuuaaaaaacuaucuuuuugcuuacaguuuuaaauucugaacaauucucucuuauaugugua

SEQ ID NO: 522277 - RNA, 64 nt, Homo Sapiens
ggcuaccucuuaccuaacaucugaccuggcaucuaauucugauucuggcuuuaagccuucaaaa

SEQ ID NO: 522278 - RNA, 64 nt, Homo Sapiens
acuaacucaaauacacauuugcuacuguuguaagaauucugauugauuugauugggaugaaugc

SEQ ID NO: 522279 - RNA, 64 nt, Homo Sapiens
cauauagucuuaaauuaucauaauggaguguuaaaauucugauuaaaaauuucagcucuuauuu

SEQ ID NO: 522280 - RNA, 64 nt, Homo Sapiens
guugccuuuuuuuucaucuccugaucacaauuaaaauucugacaccaaguaccagccguccaaa

SEQ ID NO: 522281 - RNA, 64 nt, Homo Sapiens
ucuucaguuaguguaaacugcaaauacuacagauaauucugauaauaaaaugauaugcacgcug

SEQ ID NO: 522282 - RNA, 64 nt, Homo Sapiens
aaagggaaaccuauauuuauguaacuguauacugaauucugacaaaauaaaaaaagauaccuua

SEQ ID NO: 522283 - RNA, 64 nt, Homo Sapiens
uuuuuuaaauuuauggcuaucaugcaauguuaguaauucugaagcauaucuguaaucauaucua

SEQ ID NO: 522284 - RNA, 64 nt, Homo Sapiens
aaaagcauacaucaugauuaugaaaaguguuuucaauucugaaacacuauagaugucuauacug

SEQ ID NO: 522285 - RNA, 64 nt, Homo Sapiens
auauaguaugaaagccaggugcuagcaacagacaaauucugagcccaauaugcuuuauacugcu

SEQ ID NO: 522286 - RNA, 64 nt, Homo Sapiens
aaaauaaauguugaucagcagaccacguauuuaaaauucugaaucuucugggacaggguuguaa

SEQ ID NO: 522287 - RNA, 64 nt, Homo Sapiens
uguguuucuguuuugacuuucugaaguuucucuuaauucugauuguguacauucugaacauuuu

SEQ ID NO: 522288 - RNA, 64 nt, Homo Sapiens
aaaauggucuuugauuaauauuucucaagguuaaaauucugaguuugauaaguuaugauuuaua

SEQ ID NO: 522289 - RNA, 64 nt, Homo Sapiens
gcaauuuuuuuuuguucccuaaaauacuauauuaaauucugaauuacaggcuaaaauuaguuuu

SEQ ID NO: 522290 - RNA, 64 nt, Homo Sapiens
uguuuuuaauguauuugugcguacaauuuuauauaauucugaaaaugguucuacuuccuguaau

SEQ ID NO: 522291 - RNA, 64 nt, Homo Sapiens
gcuuuuccacguagacuuaugcaaaaaccuaguaaauucugaauguagaugaaauagugaugua

SEQ ID NO: 522292 - RNA, 64 nt, Homo Sapiens
ucaauguuuugcuuuuacucagaagaaaauuucuaauucugaacguaccaugguguuccuuaaa

SEQ ID NO: 522293 - RNA, 64 nt, Homo Sapiens
gugcagggagccccaacccuugugauuuacguggaauucugacaugagauuuuuccaacaagca

SEQ ID NO: 522294 - RNA, 64 nt, Homo Sapiens
gaaugaauggauuuuuuguugcaggggaggaggcaauucugaaugcccagggggaagggagggg

SEQ ID NO: 522295 - RNA, 64 nt, Homo Sapiens
uguuguauuaggaacauguuuccaagucauuaugaauucugacuuagcauucuccuuuugaccg

SEQ ID NO: 522296 - RNA, 64 nt, Homo Sapiens
uuugaaauaaugucaacaguugguuggacuuugaaauucugaccaugcaaaaaguaucuguuua

SEQ ID NO: 522297 - RNA, 64 nt, Homo Sapiens
cccaugcacccuuggagacuagauggccagaaagaauucugacuugccuuuggaaggggcaauu

SEQ ID NO: 522298 - RNA, 64 nt, Homo Sapiens
uuuugucagaaaagagauuuagacauucacccuaaauucugaauuaaaauacaaaauuggauca

SEQ ID NO: 522299 - RNA, 64 nt, Homo Sapiens
ucgucuuuucugagaaacauauaggauuucuuaaaauucugaauguaacaagauagccaaaagc

SEQ ID NO: 522300 - RNA, 64 nt, Homo Sapiens
acuucuccccacccuccagaagggguccacguugaauucugaaucaucuugaaaauaagauucc

SEQ ID NO: 522301 - RNA, 64 nt, Homo Sapiens
cucuggcuaauauuuuaauaagcucacagcagauaauucugagaucaugggugagggguggugc

SEQ ID NO: 522302 - RNA, 64 nt, Homo Sapiens
guacacuuucugucucaaacugguuaagagaaugaauucugaauucucuggcagcauaauuuug

SEQ ID NO: 522303 - RNA, 64 nt, Homo Sapiens
uuuccuaugacuaauucacaccugaaaauaacagaauucugaagcaaaugaauucaaccucagc

SEQ ID NO: 522304 - RNA, 64 nt, Homo Sapiens
ugaucauaaugaguuaaaaggugaauagagaaaaaauucugaacgaaauuuuauaacaguuuca

SEQ ID NO: 522305 - RNA, 64 nt, Homo Sapiens
aaggaaaagaaacugacaugaacugcaggaaauuaauucugaagagcugauuugcuuuuuauua

SEQ ID NO: 522306 - RNA, 64 nt, Homo Sapiens
uaugcggugacauggaugaauuccgcaggaaggaaauucugacagcaguggaauaguaccagcc

SEQ ID NO: 522307 - RNA, 64 nt, Homo Sapiens
uucuguuuugaacuaauucucauuuucagagaguaauucugaaaauggucauaugauauuccuu

SEQ ID NO: 522308 - RNA, 64 nt, Homo Sapiens
uccugagauacugacuagcaugaaaggaguuuuaaauucugagcgaacuuacuccuucguugac

SEQ ID NO: 522309 - RNA, 64 nt, Homo Sapiens
guaggcaaacaaauuuugccuugccauuccaaggaauucugagaucacucacccuccugguaca

SEQ ID NO: 522310 - RNA, 64 nt, Homo Sapiens
ccucccaauucuguguaaucaagaauaccuccuuaauucugagagcaugaauauuugaccuuaa

SEQ ID NO: 522311 - RNA, 64 nt, Homo Sapiens
auaaggccuuuagaaucugacacaucuggguucaaauucugaaacugucacuuauuaccuguau

SEQ ID NO: 522312 - RNA, 64 nt, Homo Sapiens
uucugcuugucuuucuugagcuuuuuggaaggauaauucugauaaggcacucaagaaacguaca

SEQ ID NO: 522313 - RNA, 64 nt, Homo Sapiens
uaugcauagcaaggagaugcagagccgccaggaaaauucugaguuccagcacaauuuucuuugg

SEQ ID NO: 522314 - RNA, 64 nt, Homo Sapiens
uacuguguaugcuuuugaauuuuauuuuuaggaaaauucugaagccagcuaucacagguuuguu

SEQ ID NO: 522315 - RNA, 64 nt, Homo Sapiens
uaaaauuuguggugcuccuguaacaguaagaacuaauucugaaauaaaagacaucuccuaaugc

SEQ ID NO: 522316 - RNA, 64 nt, Homo Sapiens
aagguuguaggaugugucacaagagacuuuugacaauucugaggaaccuuguguccaguuguua

SEQ ID NO: 522317 - RNA, 64 nt, Homo Sapiens
ugaauuccuucuucacuguuguuuguauuuaugaaauucugaaauuauggggaaucagcguaau

SEQ ID NO: 522318 - RNA, 64 nt, Homo Sapiens
guugaaaaucaacccaauaauucuguauuaacugaauucugaacuuuucaggagguacugugag

SEQ ID NO: 522319 - RNA, 64 nt, Homo Sapiens
uaucauguugaagucaaauuuggauuuuccaccaaauucugaauuuguagacauacuuguacgc

SEQ ID NO: 522320 - RNA, 64 nt, Homo Sapiens
acccaguaacucuugggauuaauuuuaugaaauaaauucugagcugcugcuuuugauauaguca

SEQ ID NO: 522321 - RNA, 64 nt, Homo Sapiens
gauucuuugagcccaggaguucaaggcugcagugaauucugaucgcaccacugaacuccagccc

SEQ ID NO: 522322 - RNA, 64 nt, Homo Sapiens
cgccaccucuccaggggcggcaugaagaagucacaauucugaccauacagauugcccuccccgg

SEQ ID NO: 522323 - RNA, 64 nt, Homo Sapiens
cuaggggaauaggagaagccagcauggccagugcaauucugagggggucugagugggaccucaa

SEQ ID NO: 522324 - RNA, 64 nt, Homo Sapiens
ugcagaaaugcagacauacacagugaauagaacaaauucugacuguagguggaguuugugauug

SEQ ID NO: 522325 - RNA, 64 nt, Homo Sapiens
caugccuucuuuguagguggugaaaguuugcuuaaauucugauaagauauauauaguguauuug

SEQ ID NO: 522326 - RNA, 64 nt, Homo Sapiens
uuuuuauagugguuuuuaagguuuuaagauugucaauucugacuuuuuuuuuucuacugggauu

SEQ ID NO: 522327 - RNA, 64 nt, Homo Sapiens; identical to SEQ ID NO: 38562

SEQ ID NO: 522328 - RNA, 64 nt, Homo Sapiens; identical to SEQ ID NO: 38563

SEQ ID NO: 522329 - RNA, 64 nt, Homo Sapiens; identical to SEQ ID NO: 38564

SEQ ID NO: 522330 - RNA, 64 nt, Homo Sapiens; identical to SEQ ID NO: 38565

SEQ ID NO: 522331 - RNA, 64 nt, Homo Sapiens; identical to SEQ ID NO: 38566

SEQ ID NO: 522332 - RNA, 64 nt, Homo Sapiens; identical to SEQ ID NO: 38567

SEQ ID NO: 522333 - RNA, 64 nt, Homo Sapiens; identical to SEQ ID NO: 38568

SEQ ID NO: 522334 - RNA, 64 nt, Homo Sapiens; identical to SEQ ID NO: 38569

SEQ ID NO: 522335 - RNA, 64 nt, Homo Sapiens; identical to SEQ ID NO: 38570

SEQ ID NO: 522336 - RNA, 64 nt, Homo Sapiens; identical to SEQ ID NO: 38571

SEQ ID NO: 522337 - RNA, 64 nt, Homo Sapiens; identical to SEQ ID NO: 38572

SEQ ID NO: 522338 - RNA, 64 nt, Homo Sapiens; identical to SEQ ID NO: 38573

SEQ ID NO: 522339 - RNA, 64 nt, Homo Sapiens; identical to SEQ ID NO: 38574

SEQ ID NO: 522340 - RNA, 64 nt, Homo Sapiens; identical to SEQ ID NO: 38575

SEQ ID NO: 522341 - RNA, 64 nt, Homo Sapiens; identical to SEQ ID NO: 38576

SEQ ID NO: 522342 - RNA, 64 nt, Homo Sapiens; identical to SEQ ID NO: 38577

SEQ ID NO: 522343 - RNA, 64 nt, Homo Sapiens; identical to SEQ ID NO: 38578

SEQ ID NO: 522344 - RNA, 64 nt, Homo Sapiens; identical to SEQ ID NO: 38579

SEQ ID NO: 522345 - RNA, 64 nt, Homo Sapiens; identical to SEQ ID NO: 38580

SEQ ID NO: 522346 - RNA, 64 nt, Homo Sapiens; identical to SEQ ID NO: 38581

SEQ ID NO: 522347 - RNA, 64 nt, Homo Sapiens; identical to SEQ ID NO: 38582

SEQ ID NO: 522348 - RNA, 64 nt, Homo Sapiens; identical to SEQ ID NO: 38583

SEQ ID NO: 522349 - RNA, 64 nt, Homo Sapiens; identical to SEQ ID NO: 38584

SEQ ID NO: 522350 - RNA, 64 nt, Homo Sapiens; identical to SEQ ID NO: 38585

SEQ ID NO: 522351 - RNA, 64 nt, Homo Sapiens; identical to SEQ ID NO: 38586

SEQ ID NO: 522352 - RNA, 64 nt, Homo Sapiens; identical to SEQ ID NO: 38587

SEQ ID NO: 522353 - RNA, 64 nt, Homo Sapiens; identical to SEQ ID NO: 38588

SEQ ID NO: 522354 - RNA, 64 nt, Homo Sapiens; identical to SEQ ID NO: 38589

SEQ ID NO: 522355 - RNA, 64 nt, Homo Sapiens; identical to SEQ ID NO: 38590

SEQ ID NO: 522356 - RNA, 64 nt, Homo Sapiens; identical to SEQ ID NO: 38591

SEQ ID NO: 522357 - RNA, 64 nt, Homo Sapiens; identical to SEQ ID NO: 38592

SEQ ID NO: 522358 - RNA, 64 nt, Homo Sapiens; identical to SEQ ID NO: 38593

SEQ ID NO: 522359 - RNA, 64 nt, Homo Sapiens; identical to SEQ ID NO: 154522

SEQ ID NO: 522360 - RNA, 64 nt, Homo Sapiens; identical to SEQ ID NO: 154523

SEQ ID NO: 522361 - RNA, 64 nt, Homo Sapiens; identical to SEQ ID NO: 154524

SEQ ID NO: 522362 - RNA, 64 nt, Homo Sapiens; identical to SEQ ID NO: 154525

SEQ ID NO: 522363 - RNA, 64 nt, Homo Sapiens; identical to SEQ ID NO: 154526

SEQ ID NO: 522364 - RNA, 64 nt, Homo Sapiens; identical to SEQ ID NO: 154527

SEQ ID NO: 522365 - RNA, 64 nt, Homo Sapiens; identical to SEQ ID NO: 154528

SEQ ID NO: 522366 - RNA, 64 nt, Homo Sapiens; identical to SEQ ID NO: 154529

SEQ ID NO: 522367 - RNA, 64 nt, Homo Sapiens; identical to SEQ ID NO: 154530

SEQ ID NO: 522368 - RNA, 64 nt, Homo Sapiens; identical to SEQ ID NO: 154531

SEQ ID NO: 522369 - RNA, 64 nt, Homo Sapiens; identical to SEQ ID NO: 154532

SEQ ID NO: 522370 - RNA, 64 nt, Homo Sapiens; identical to SEQ ID NO: 154533

SEQ ID NO: 522371 - RNA, 64 nt, Homo Sapiens; identical to SEQ ID NO: 154534

SEQ ID NO: 522372 - RNA, 64 nt, Homo Sapiens; identical to SEQ ID NO: 154535

SEQ ID NO: 522373 - RNA, 64 nt, Homo Sapiens; identical to SEQ ID NO: 154536

SEQ ID NO: 522374 - RNA, 64 nt, Homo Sapiens; identical to SEQ ID NO: 154537

SEQ ID NO: 522375 - RNA, 64 nt, Homo Sapiens; identical to SEQ ID NO: 154538

SEQ ID NO: 522376 - RNA, 64 nt, Homo Sapiens; identical to SEQ ID NO: 154539

SEQ ID NO: 522377 - RNA, 64 nt, Homo Sapiens; identical to SEQ ID NO: 154540

SEQ ID NO: 522378 - RNA, 64 nt, Homo Sapiens; identical to SEQ ID NO: 154541

SEQ ID NO: 522379 - RNA, 64 nt, Homo Sapiens; identical to SEQ ID NO: 154542

SEQ ID NO: 522380 - RNA, 64 nt, Homo Sapiens; identical to SEQ ID NO: 154543

SEQ ID NO: 522381 - RNA, 64 nt, Homo Sapiens; identical to SEQ ID NO: 154544

SEQ ID NO: 522382 - RNA, 64 nt, Homo Sapiens; identical to SEQ ID NO: 154545

SEQ ID NO: 522383 - RNA, 64 nt, Homo Sapiens; identical to SEQ ID NO: 154546

SEQ ID NO: 522384 - RNA, 64 nt, Homo Sapiens; identical to SEQ ID NO: 154547

SEQ ID NO: 522385 - RNA, 64 nt, Homo Sapiens; identical to SEQ ID NO: 154548

SEQ ID NO: 522386 - RNA, 64 nt, Homo Sapiens; identical to SEQ ID NO: 154549

SEQ ID NO: 522387 - RNA, 64 nt, Homo Sapiens; identical to SEQ ID NO: 154550

SEQ ID NO: 522388 - RNA, 64 nt, Homo Sapiens; identical to SEQ ID NO: 154551

SEQ ID NO: 522389 - RNA, 64 nt, Homo Sapiens
gcacuuaaaaucuaugaguuuuuacuuuuuacugggaauggaaaguguggugaagaucauucaa

SEQ ID NO: 522390 - RNA, 64 nt, Homo Sapiens
ugaagcugggcagcgucugcucuguguucuguguggaauggagaaaaaaacgccugcccugcug

SEQ ID NO: 522391 - RNA, 64 nt, Homo Sapiens
gaaugggguaaaccacagucgaaaugguagacugggaauggaaacccuggaaccugagucccaa

SEQ ID NO: 522392 - RNA, 63 nt, Homo Sapiens
uggguucaucucaucacauuccugccugccuauggaauggagcaucccuguguccugcaguga

SEQ ID NO: 522393 - RNA, 64 nt, Homo Sapiens
ugcccacaggagguccugaucugaggaauggaauggaauggagagagcuccgucauguagccug

SEQ ID NO: 522394 - RNA, 64 nt, Homo Sapiens
ggagaugcccacaggaggucgccugcugaggaauggaauggaaugaacagagcuccgucaugua

SEQ ID NO: 522395 - RNA, 64 nt, Homo Sapiens
ggaauggagaugcccacaggauguagccugcugaggaauggaauuuacugaacagagcuccguc

SEQ ID NO: 522396 - RNA, 64 nt, Homo Sapiens
uaaaauugggaugagcccuaaaagggggaauggaggaauggaaagcacaaggguugugaaugug

SEQ ID NO: 522397 - RNA, 64 nt, Homo Sapiens
aauggaaauaaaauugggauugaaugugaaagggggaauggaggggaauguugcacaaggguug

SEQ ID NO: 522398 - RNA, 64 nt, Homo Sapiens
cucagguucccaggggcccgggaguccaaauacuggaauggaggguuggaggcagccuuccuug

SEQ ID NO: 522399 - RNA, 64 nt, Homo Sapiens
cuuggcagugcucucguagaccccucggugauguggaauggacaggugccucgcaagagagcaa

SEQ ID NO: 522400 - RNA, 64 nt, Homo Sapiens
gauuuguuggcguaauuuuuagagggaauggaaaggaauggaaauuauuugauuuuauucuugc

SEQ ID NO: 522401 - RNA, 64 nt, Homo Sapiens
ggaauggaaagauuuguugguuauucuugcagagggaauggaaaagccuaacaguuauuugauu

SEQ ID NO: 522402 - RNA, 64 nt, Homo Sapiens
uuguuuuggaaugucccccacuuggagaguuugaggaauggaaaugagaaucggaggagaaaua

SEQ ID NO: 522403 - RNA, 64 nt, Homo Sapiens
ggaacguaaaauccauuucagccugccgccccuuggaauggagggucuucuagggaccagaaac

SEQ ID NO: 522404 - RNA, 64 nt, Homo Sapiens
ggcucaccuggggauuugggcaacacacaggaauggaauggacagaggcugaccccucacuuga

SEQ ID NO: 522405 - RNA, 64 nt, Homo Sapiens
ggacaggcucaccuggggaucuugacaacacacaggaauggaauacucugaggcugaccccuca

SEQ ID NO: 522406 - RNA, 64 nt, Homo Sapiens
guggacccuacuauucauguugcaguacaucaaaggaauggauguggaagagaauauuccuacu

SEQ ID NO: 522407 - RNA, 64 nt, Homo Sapiens
augguguuccauugccucuuuucuuuugguccagggaauggagaaucaugcuugguuuucuuuu

SEQ ID NO: 522408 - RNA, 64 nt, Homo Sapiens
aauucucacaagaguggguugauucgcucuugcaggaauggauggcucaguuaguucuggaaug

SEQ ID NO: 522409 - RNA, 64 nt, Homo Sapiens
cgcucuugcaggaauggauggcucaguuaguucuggaauggauuauuaaaggcuuucucaugag

SEQ ID NO: 522410 - RNA, 64 nt, Homo Sapiens
uauugguugguucauaugauucccgccucccucuggaauggauaaccuguacuuauuuuucucu

SEQ ID NO: 522411 - RNA, 64 nt, Homo Sapiens
uguagcacucaugucgucccuuuguuucagaacuggaauggagaaaucuuucaagucguagcac

SEQ ID NO: 522412 - RNA, 64 nt, Homo Sapiens
cuacucuaggccuuaaacugucaguuuuuuauuuggaauggaugagcuuucauuuucuguuuau

SEQ ID NO: 522413 - RNA, 64 nt, Homo Sapiens
gugugacacaggccugacucccgucuucuacucaggaauggaauugaaauguacugaguggauu

SEQ ID NO: 522414 - RNA, 64 nt, Homo Sapiens
cugaagccaaagcugggcucaguggggaaggucaggaauggagaaauugccuuuucucguuagc

SEQ ID NO: 522415 - RNA, 64 nt, Homo Sapiens
aguuggagaucauuauucuaagugaaauaacucaggaauggagaaccaaauauuguacauccuc

SEQ ID NO: 522416 - RNA, 64 nt, Homo Sapiens
ucguccuaccgugcagccacuggacacucgugauggaauggaaacuguggagaugagaaggugg

SEQ ID NO: 522417 - RNA, 64 nt, Homo Sapiens
ggacagcaagcacaggugaggcagugugcucgugggaauggaaaucggagcgggggugaggggg

SEQ ID NO: 522418 - RNA, 64 nt, Homo Sapiens
gaagcuggcuuaguaccagcuagagcugcuugguuggaggaaguugaguugggggaccuggcaa

SEQ ID NO: 522419 - RNA, 64 nt, Homo Sapiens
cuccaaguagaggggagaccaucaucagggguccuggaggaagcacuguuuggacccaggccuc

SEQ ID NO: 522420 - RNA, 64 nt, Homo Sapiens
gugauacguacauacgcauucaugaugacuucgcuggaggaaaggauuucugcaagucgacuau

SEQ ID NO: 522421 - RNA, 64 nt, Homo Sapiens
acauguuggcuuuucucuuguuccuuuuaugcauuggaggaaaauccugccagcccuacggaag

SEQ ID NO: 522422 - RNA, 64 nt, Homo Sapiens
guaccuuggcuuggcucuugugcuguuuacucauuggaggaacauuaggccagcccuacagaag

SEQ ID NO: 522423 - RNA, 64 nt, Homo Sapiens
ggguugcaggugaccagcaugacucaugaacagguggaggaaagugaggagagguagccaugcu

SEQ ID NO: 522424 - RNA, 64 nt, Homo Sapiens
uggggaaagugguuagggagaagaugauucaccuuggaggaagccuggaggaacagguucuuag

SEQ ID NO: 522425 - RNA, 64 nt, Homo Sapiens
gguucuuagaagaugauucauacuccugcagggcuggaggaacaagcuagccccuggggcugag

SEQ ID NO: 522426 - RNA, 64 nt, Homo Sapiens
aaugcauuacuaccacagauauucaaggaagcaguggaggaaaguccuaauuuuuaacacuaaa

SEQ ID NO: 522427 - RNA, 64 nt, Homo Sapiens
aaaaggauggcaugaaagaaggugagauuguggcuggaggaagauauguguucccaagugguga

SEQ ID NO: 522428 - RNA, 64 nt, Homo Sapiens
cuguccuuuguuauuauccugcauuuuacgucuuuggaggaacagcucccuaguggcuuccucc

SEQ ID NO: 522429 - RNA, 64 nt, Homo Sapiens
uaaggagggacaagaaucaauggauaagcguggguggaggaagauccaaacagaaaagugcaaa

SEQ ID NO: 522430 - RNA, 64 nt, Homo Sapiens
caaaguuauuccccaucuuccaaggguugaauucuggaggaagaagacacauuccuaguucccc

SEQ ID NO: 522431 - RNA, 64 nt, Homo Sapiens
uugcagguggguugggcaggcuccuagccacacuuggaggaaaggguccuuguugauguuucuu

SEQ ID NO: 522432 - RNA, 64 nt, Homo Sapiens
ccccuguaacguuaccuaccaggagcgccacacauggaggaaagcugcugccaggauggagcag

SEQ ID NO: 522433 - RNA, 64 nt, Homo Sapiens
cgggcaaauugaaaguauaagggaugagcccuaauggaggaaguggaggaauggaaauaaaauu

SEQ ID NO: 522434 - RNA, 64 nt, Homo Sapiens
gaaauaaaauugggaugagcugugaaagggggaauggaggaauguguugcacaaggguugugaa

SEQ ID NO: 522435 - RNA, 64 nt, Homo Sapiens
gcacgguggagagaaagugauagcccaccuggguuggaggaagguccaguucacauuuauuugg

SEQ ID NO: 522436 - RNA, 64 nt, Homo Sapiens
cuugacucuuacacacuggaucaugaagcaagaauggaggaauccaacuuuaaaacugcucauu

SEQ ID NO: 522437 - RNA, 64 nt, Homo Sapiens
gucagguaaccaagggacugaggauacagaaggcuggaggaaaccucaguaugaagagcggaug

SEQ ID NO: 522438 - RNA, 64 nt, Homo Sapiens
cgagccucaaaauuugcugcguuuuugauggacauggaggaauucucggguuucauauuuugcu

SEQ ID NO: 522439 - RNA, 64 nt, Homo Sapiens
aacacucagacaucuaguaccagggauuauuaauuggaggaagauuuaugguuaugggucuggc

SEQ ID NO: 522440 - RNA, 64 nt, Homo Sapiens
cauuaagacgcaacucauuuuauaucaacacgcuuggaggaaagggacucagggaagggagcag

SEQ ID NO: 522441 - RNA, 64 nt, Homo Sapiens
gggggcaguggcagcccuggggcccuuucccuucuggaggaagcacaagccucagggaagggga

SEQ ID NO: 522442 - RNA, 64 nt, Homo Sapiens
cugacgcucuguguauugcucuuugaaucgaguuuggaggaagaguugaguuguaugaguggcg

SEQ ID NO: 522443 - RNA, 64 nt, Homo Sapiens
cagucaucuccuuggugaaaaaaugaaguuuauuuggaggaacauggaggaaugucaucuuccu

SEQ ID NO: 522444 - RNA, 64 nt, Homo Sapiens
ucaucuuccuaaaugaaguugucuuuccaccuauuggaggaauggagaagaaagugcauuuauu

SEQ ID NO: 522445 - RNA, 64 nt, Homo Sapiens
acuuaccuaucacuacaacaaguguaacucuggauggaggaauacacugucauuccaaagguac

SEQ ID NO: 522446 - RNA, 63 nt, Homo Sapiens
uguaaaagaugaaaauguuugaauuuuaggggcuggaggaagaugucacaaagugucagauga

SEQ ID NO: 522447 - RNA, 64 nt, Homo Sapiens
aaagcaugcauucuagcacaaugaauuccucauuuggaggaaaaaaaagaaauuccuauuugaa

SEQ ID NO: 522448 - RNA, 64 nt, Homo Sapiens
guggggaagccuuggaaugcgcugucuccguaaauggaggaaauugcugcaaguuagugaaaca

SEQ ID NO: 522449 - RNA, 64 nt, Homo Sapiens
gagcacaugucaugcuagccggaggaauuuuacauggaggaagucaaccuauuuaacuuuuugu

SEQ ID NO: 522450 - RNA, 64 nt, Homo Sapiens
uuacauggaggaagugagcauauuuaacuuuuuguggaggaauuucucucauuccagcccaacc

SEQ ID NO: 522451 - RNA, 64 nt, Homo Sapiens
aagcugccuggaugagcgcccaugcagcaaggcuuggaggaagcgucagugcccuggagauccc

SEQ ID NO: 522452 - RNA, 64 nt, Homo Sapiens
gcucuccccacugucagcaacagcacuuccuucguggaggaaguggacucgaauccuggaggag

SEQ ID NO: 522453 - RNA, 64 nt, Homo Sapiens
gcuggcugcugcugccucgcgcgcugggguuccauggaggaacugggccugccgccccggccuc

SEQ ID NO: 522454 - RNA, 64 nt, Homo Sapiens
cggccucaccugcugcccgcaugcuggggucccauggaggaaccaggccuggcgccccggccuc

SEQ ID NO: 522455 - RNA, 64 nt, Homo Sapiens
ccacccagcaagcucucuccugcuguucccugcguggaggaagcuggggaggaagccccaucuc

SEQ ID NO: 522456 - RNA, 64 nt, Homo Sapiens
gggaagcccagggguccugucagauccuucucucuggaggaagaucagguacugagcaaggccc

SEQ ID NO: 522457 - RNA, 64 nt, Homo Sapiens
aucaguccuguccuuggcaaccgauaggugaggcuggaggaagaacagcggaacaaugacugcc

SEQ ID NO: 522458 - RNA, 64 nt, Homo Sapiens
ucuugauuaauguugaaaaacugacuuuugcagauggaggaauugcuguauuuaauggcauagg

SEQ ID NO: 522459 - RNA, 64 nt, Homo Sapiens
ccaggcaucauuaaacaagcaauuguguuguuccuggaggaagcggagagcugagauuggaggg

SEQ ID NO: 522460 - RNA, 64 nt, Homo Sapiens
gagaguaaagcuucuaggcagaccgcaggaauccuggaggaacaggagacugguugcaaggugu

SEQ ID NO: 522461 - RNA, 64 nt, Homo Sapiens
aagaaaaugacacauugauaucaagguacaguuauggaggaaagugcaggucagcaguaagguu

SEQ ID NO: 522462 - RNA, 64 nt, Homo Sapiens
cgcccccaugauccaguuacucacaggaacagcauggaggaaaccucaugagaccggcucacua

SEQ ID NO: 522463 - RNA, 64 nt, Homo Sapiens
uagacuugaguagucuuuggaaacuugugucaguuggaggaaaaaccuccauacacugaggcag

SEQ ID NO: 522464 - RNA, 64 nt, Homo Sapiens
gggaggagaaaugagaacauagaggaaagccucuuggaggaaaggugcuuggaccaagucucag

SEQ ID NO: 522465 - RNA, 64 nt, Homo Sapiens
uugaacuucuccaugaccugaagcguuccuucccuggaggaacucugguugcagggcuaaacuu

SEQ ID NO: 522466 - RNA, 64 nt, Homo Sapiens
agauguucgucagccaauucccacaaacugcugguggaggaagauggcagaaacgugauguguc

SEQ ID NO: 522467 - RNA, 64 nt, Homo Sapiens
cgcgccgccccgagcuggagaaaugaauccagcguggaggaaggcugcccucccucccacaaac

SEQ ID NO: 522468 - RNA, 64 nt, Homo Sapiens
gaggccuaaaaaggaagugaguuuauacugcaguuggaggaacugccugcagccuugaggaaaa

SEQ ID NO: 522469 - RNA, 64 nt, Homo Sapiens
gguaggaagaacaaacccuugucccuuugccauguggaggaaagugccugccucugguccgagc

SEQ ID NO: 522470 - RNA, 64 nt, Homo Sapiens
ccuccuccagggcccucugcagaccaggcugagauggaggaaccugcuaaaaucgauggagaug

SEQ ID NO: 522471 - RNA, 64 nt, Homo Sapiens
ccugcugcagcugcaggcauucugaggggcaacguggaggaagggccagggaugcaugggauuu

SEQ ID NO: 522472 - RNA, 64 nt, Homo Sapiens
ugggguaauugcauucgucucuaacaauucuguauggaggaaggcccaaaggaguggacauuuc

SEQ ID NO: 522473 - RNA, 64 nt, Homo Sapiens
ugucagaaauguuugcccugauggcagacugagcuggaggaagaggaaacuggauugccaaggc

SEQ ID NO: 522474 - RNA, 64 nt, Homo Sapiens
uggaaugaaauuccuccuuccccccaucucugaguggaggaagcccaccaaucugcccuuugca

SEQ ID NO: 522475 - RNA, 64 nt, Homo Sapiens
gccauagggucugcagccugcuggggcuaagcgguggaggaaggcucugucacuccaggcauau

SEQ ID NO: 522476 - RNA, 64 nt, Homo Sapiens
cuucacaaggcucagugacaaaccugaagaagauuggaggaaccuugaagagugagaaacaccu

SEQ ID NO: 522477 - RNA, 64 nt, Homo Sapiens
cucuuguccaaauaguggauugggcagacuggccuggaggaaaugcuagaacagagggaaagga

SEQ ID NO: 522478 - RNA, 64 nt, Homo Sapiens
auccugccccuuccuucuugccuguagcuccugcuggaggaagaggauuccagccuguuggccc

SEQ ID NO: 522479 - RNA, 64 nt, Homo Sapiens
uucauuaccauaaucacaaccacugcgcaaaauguggaggaaaaggaugaucaugacaaacaau

SEQ ID NO: 522480 - RNA, 64 nt, Homo Sapiens
uacuguauuuaaaaaaaccugacauugaaguuguuggaggaauguuauuccaagaaucuacaau

SEQ ID NO: 522481 - RNA, 64 nt, Homo Sapiens
uuguuacaugaaagguugaaauauugagugguugaaagugaacugcuguuugccugauugguaa

SEQ ID NO: 522482 - RNA, 64 nt, Homo Sapiens
ccagacuuaauugguauuuguucuugcauuggccaaagugaaaauuuuuuuuuuucuuuugaaa

SEQ ID NO: 522483 - RNA, 64 nt, Homo Sapiens
aacuguuggcaggcaguaucgauuuuaugaagagaaagugaaguuugaaaacuuuucaaacuuu

SEQ ID NO: 522484 - RNA, 64 nt, Homo Sapiens
caauccaauuuuucagauuugauaaugcuuuuccaaagugaaaauaagauacacaauaaucauu

SEQ ID NO: 522485 - RNA, 64 nt, Homo Sapiens
aaauacuucuaauuuuuuucccuaaacauuuuuaaaagugaaauaugggaagagcuuuacagac

SEQ ID NO: 522486 - RNA, 64 nt, Homo Sapiens
ccuagaguuuuaauuaccuuuauaauguuucuuaaaagugaaacuuagauacaauugugauugg

SEQ ID NO: 522487 - RNA, 64 nt, Homo Sapiens
gcuauuugccuaguaggauuuaaaaaauauuuucaaagugaagcugagagagaaucuuggaaac

SEQ ID NO: 522488 - RNA, 64 nt, Homo Sapiens
gauguucugcaggcccagcaaacucaucauguccaaagugaaacuuuuucucuuuccugucucc

SEQ ID NO: 522489 - RNA, 64 nt, Homo Sapiens
aauguagaagaaagcaaaaaauaaaauaaguccuaaagugaagaagccaucaauuuuaacauuu

SEQ ID NO: 522490 - RNA, 64 nt, Homo Sapiens
uuauagaaauuacuggagccaugucuacaaaagcaaagugaagugaugagcugaaaagugauca

SEQ ID NO: 522491 - RNA, 64 nt, Homo Sapiens
caauaccaagcuucugauuccuccucacauaugaaaagugaaaguugugaguuguuuuccucuu

SEQ ID NO: 522492 - RNA, 64 nt, Homo Sapiens
uuuuucagaagcgacauuucauauauaggugccaaaagugaaucggggugcggagagugggaac

SEQ ID NO: 522493 - RNA, 64 nt, Homo Sapiens
auugcuugaaguaagcaacuagaaaauccucagcaaagugaagacucucguguucuuuuccaga

SEQ ID NO: 522494 - RNA, 64 nt, Homo Sapiens
gaccucguuuugauguaucgcugaagaagcucuaaaagugaagacugaguaaggacauuucuga

SEQ ID NO: 522495 - RNA, 64 nt, Homo Sapiens
auuucuauguauuaacucuucuacuaauaucugaaaagugaaagacuccuuaugugaggaaaug

SEQ ID NO: 522496 - RNA, 64 nt, Homo Sapiens
aggggaaacuguuuaauaucgccuacuggggaagaaagugaaggguuauuguuuucugucauuu

SEQ ID NO: 522497 - RNA, 64 nt, Homo Sapiens
uccaauuccuccucuucuucagaaucaucuucagaaagugaacuugaacaugagagaagcagaa

SEQ ID NO: 522498 - RNA, 64 nt, Homo Sapiens
gucaaaggaaaaucuuaaaagagaacacaccaaaaaagugaaagagaaauugaaagggaaaaaa

SEQ ID NO: 522499 - RNA, 64 nt, Homo Sapiens
cugacugagagaaagauggucgucuccagcagagaaagugaacagcauuuguuggaaggugaug

SEQ ID NO: 522500 - RNA, 64 nt, Homo Sapiens
cccuggggggaaauaucauucuuacuaugguuagaaagugaauuagaaauuucagcucaguuuc

SEQ ID NO: 522501 - RNA, 64 nt, Homo Sapiens
auggaagcagcauuacuuuauccuaaagugaauuaaagugaaucuuaauuuuauguccuuuuuu

SEQ ID NO: 522502 - RNA, 64 nt, Homo Sapiens
aaagugaaucauggaagcagguccuuuuuuuccuaaagugaauuggaauuuuuguuaauuuuau

SEQ ID NO: 522503 - RNA, 64 nt, Homo Sapiens
uaaccacaacugagaccuaagaaccuuguauuuaaaagugaauuccuggcaacuuggauacuug

SEQ ID NO: 522504 - RNA, 64 nt, Homo Sapiens
ugacaguccuugcucucaggcuacuuuucaaggcaaagugaagaagauaauuugggaccuaugu

SEQ ID NO: 522505 - RNA, 64 nt, Homo Sapiens
cauuaugauugaaaaacauaaaaacuaacauaggaaagugaaugaucaguuacuuaugauauau

SEQ ID NO: 522506 - RNA, 64 nt, Homo Sapiens
uuaugauauauuuuguuuccucuugugguuuaauaaagugaagugugugugugugugugugugu

SEQ ID NO: 522507 - RNA, 64 nt, Homo Sapiens
cuucuuguguuaaacuaaaaauuuacaagagaagaaagugaaagcaaaugggguuucacaaaua

SEQ ID NO: 522508 - RNA, 64 nt, Homo Sapiens
acuuuccucacaccuggaagaaacaaaguaggaaaaagugaacaggggaugucaaaucgauucu

SEQ ID NO: 522509 - RNA, 64 nt, Homo Sapiens
ugcaauguaacauagguaucugaugagccugcauaaagugaagcucaaauauuguuuaauggaa

SEQ ID NO: 522510 - RNA, 64 nt, Homo Sapiens
uucuguagaucagaugaauucucaucucucuauuaaagugaauauccucuggucauuucagacu

SEQ ID NO: 522511 - RNA, 64 nt, Homo Sapiens
gugcacagugugaaguuuaaugagaggacuggcuaaagugaaguaggaccagcgacaagacuca

SEQ ID NO: 522512 - RNA, 64 nt, Homo Sapiens
cauaguaacauauguuuuaguaugauguaggcuaaaagugaaauuguaaaaggggaaauuagua

SEQ ID NO: 522513 - RNA, 64 nt, Homo Sapiens
uugucaagagaucuuucagaaaauauaagccuuuaaagugaagaagaggagccaguugugcugg

SEQ ID NO: 522514 - RNA, 64 nt, Homo Sapiens
uaagagaaaaccauuuuuaaucuuaguuaaaauuaaagugaauuaguaguauaucauuuuacua

SEQ ID NO: 522515 - RNA, 64 nt, Homo Sapiens
aggccaucauagcugauccuuacugcuaauaccaaaagugaaagaagaaaaaacagaagacaaa

SEQ ID NO: 522516 - RNA, 64 nt, Homo Sapiens
uuuugcuuagaaauaaaauaaauuuaagaaaucuaaagugaaaaacacugaggagaaaauuguc

SEQ ID NO: 522517 - RNA, 64 nt, Homo Sapiens
cgcaaggcugggguagcccccuccaguacaccccaaagugaaagggauaagagugcagccccag

SEQ ID NO: 522518 - RNA, 64 nt, Homo Sapiens
ucuacgccaaaacagacgggaaagggaacaaaauaaagugaaauccaauacacgccugugugag

SEQ ID NO: 522519 - RNA, 64 nt, Homo Sapiens
cauuuaaaaaggaagagaaaaguggauaauagacaaagugaaaaaaaugcuuuccuaaaaugau

SEQ ID NO: 522520 - RNA, 64 nt, Homo Sapiens
uaauuugaggcacagaagaaauauguauauuuaaaaagugaauauugaauauacauauauauau

SEQ ID NO: 522521 - RNA, 64 nt, Homo Sapiens
ggaaacaacuagcaaaaagaaguagaaaaagaaaaaagugaaaaaagaaagagaaaaaagauaa

SEQ ID NO: 522522 - RNA, 64 nt, Homo Sapiens
accaguuucaaaaccuucaagugauauguggaaaaaagugaaugagaccucugauaggggguuu

SEQ ID NO: 522523 - RNA, 64 nt, Homo Sapiens
guaagagaauuuauuuacuaaaugcacuauguauaaagugaaagauaguuuacuuaucugacuu

SEQ ID NO: 522524 - RNA, 64 nt, Homo Sapiens
aaguuaaaaaagaaauggggacuaacaguuuuagaaagugaaaaaauacaggggucaaaaccag

SEQ ID NO: 522525 - RNA, 64 nt, Homo Sapiens
acaaaaaugaaaauauuuauguaaauugagacucaaagugaaauauugaaaggaaguuaucuug

SEQ ID NO: 522526 - RNA, 64 nt, Homo Sapiens
ugugacccuaaugaaagaauguauaugauccuggaaagugaacugggugaccuaggaccucuga

SEQ ID NO: 522527 - RNA, 64 nt, Homo Sapiens
aggacuacauuaacucuuauuguuguguuucugaaaagugaaauuuaaaaagcagccugaaaaa

SEQ ID NO: 522528 - RNA, 64 nt, Homo Sapiens
aagcauguccacugacaaacacccaccagcuggaaaagugaagggcagggcccaauccuuccag

SEQ ID NO: 522529 - RNA, 64 nt, Homo Sapiens
aaagaagcgaauaaguaugcagaaucgauuaaaaaaagugaagaggagcaaguggccaaacauc

SEQ ID NO: 522530 - RNA, 64 nt, Homo Sapiens
gauuuguauacaaauguuuuauuccagucuucccaaagugaaaauaguuacccagcuguuuaau

SEQ ID NO: 522531 - RNA, 64 nt, Homo Sapiens
guaucuuucaacuguuuaguacuuguuucuauuuaaagugaaauaauaagugugacaacuuaaa

SEQ ID NO: 522532 - RNA, 64 nt, Homo Sapiens
auaauucacuaauguuuuauauucauauauuaggaaagugaacuuagcaagcuuuuuggaauuu

SEQ ID NO: 522533 - RNA, 64 nt, Homo Sapiens
ucagcagacuucuuucagcagcucguguuuuucuaaagugaaaggcaugguuuguccugcuuag

SEQ ID NO: 522534 - RNA, 64 nt, Homo Sapiens
ugaugcucaguauuugcagacauagaaauggaagaaagugaacuaaccacagucgggaaacaag

SEQ ID NO: 522535 - RNA, 64 nt, Homo Sapiens
aguucacuccaaaucaguagggcuuuaauauguaaaagugaaagcuggccagugauccucauga

SEQ ID NO: 522536 - RNA, 64 nt, Homo Sapiens
auacaaaauaagacuaauuuuacccuaaagugcaaaagugaaacggugaaaaggggacaguuuu

SEQ ID NO: 522537 - RNA, 64 nt, Homo Sapiens
uuuuacaaguuagagggaugaaauacgagaaaagaaagugaaaggaggaaaauguauuuaaaag

SEQ ID NO: 522538 - RNA, 64 nt, Homo Sapiens
aauaagucacagagaauguauuacuagaaagugaaaagugaauaguauuucagagagacauaag

SEQ ID NO: 522539 - RNA, 64 nt, Homo Sapiens
gugaauaaauaagucacagaacauaaguuacuagaaagugaaaagcuuucuguauuucagagag

SEQ ID NO: 522540 - RNA, 64 nt, Homo Sapiens
auaaacacaaaauuguuaguauccugauuuuugaaaagugaauuauuuugguuuugccuauacc

SEQ ID NO: 522541 - RNA, 64 nt, Homo Sapiens
uucuugcugugucgaacaauacuuguugacugugaaagugaauuguguucuacugaguaagaug

SEQ ID NO: 522542 - RNA, 64 nt, Homo Sapiens
aauagcuauuuugcuuaaauuucuacaguauguaaaagugaaaaaaugaugaagacgggugcac

SEQ ID NO: 522543 - RNA, 64 nt, Homo Sapiens
aggacugguuuuguuuuuauauauauaaaaaaaaaaagugaaaacaccaaugugugaaaugccu

SEQ ID NO: 522544 - RNA, 64 nt, Homo Sapiens
gaggaacuccugccacgccacugugucaugaaggaaagugaaagggaacgaggaaguaggaaug

SEQ ID NO: 522545 - RNA, 64 nt, Homo Sapiens
cacgccaaccccagaaaauaccccacaugccagaaaagugaaguccuagguguuuccaucuaug

SEQ ID NO: 522546 - RNA, 64 nt, Homo Sapiens
aguggggaagaaaccuccccaggaaauuggaauuaaagugaaaaaucauucuggagguggcaug

SEQ ID NO: 522547 - RNA, 64 nt, Homo Sapiens
ugaagcagaugaguuuguagcagggccacaaaacaaagugaaacguccaggggaacccaacagu

SEQ ID NO: 522548 - RNA, 64 nt, Homo Sapiens
aauuucaaauaggaaucauaucacuuguugugcaaaagugaauucgcuggaauuggcuuguggg

SEQ ID NO: 522549 - RNA, 64 nt, Homo Sapiens
aaaaaagcucuggacaccuuauuuaaaaaagcaaaaagugaaaacauuguuuguggaggauuac

SEQ ID NO: 522550 - RNA, 64 nt, Homo Sapiens
guccagugguauuggcauuguuucuuggcuuaugaaagugaaaaguuuaaucaguuaacggaaa

SEQ ID NO: 522551 - RNA, 64 nt, Homo Sapiens
aacauuaaaggugaaugugaaauugauuuuggaaaaagugaaauuuguuuguguggugccagga

SEQ ID NO: 522552 - RNA, 64 nt, Homo Sapiens; identical to SEQ ID NO: 159163

SEQ ID NO: 522553 - RNA, 64 nt, Homo Sapiens; identical to SEQ ID NO: 159164

SEQ ID NO: 522554 - RNA, 64 nt, Homo Sapiens; identical to SEQ ID NO: 159165

SEQ ID NO: 522555 - RNA, 64 nt, Homo Sapiens; identical to SEQ ID NO: 159166

SEQ ID NO: 522556 - RNA, 64 nt, Homo Sapiens; identical to SEQ ID NO: 159167

SEQ ID NO: 522557 - RNA, 64 nt, Homo Sapiens; identical to SEQ ID NO: 159168

SEQ ID NO: 522558 - RNA, 64 nt, Homo Sapiens; identical to SEQ ID NO: 159169

SEQ ID NO: 522559 - RNA, 64 nt, Homo Sapiens; identical to SEQ ID NO: 159170

SEQ ID NO: 522560 - RNA, 64 nt, Homo Sapiens; identical to SEQ ID NO: 159171

SEQ ID NO: 522561 - RNA, 64 nt, Homo Sapiens; identical to SEQ ID NO: 159172

SEQ ID NO: 522562 - RNA, 64 nt, Homo Sapiens; identical to SEQ ID NO: 159173

SEQ ID NO: 522563 - RNA, 64 nt, Homo Sapiens; identical to SEQ ID NO: 159174

SEQ ID NO: 522564 - RNA, 64 nt, Homo Sapiens; identical to SEQ ID NO: 159175

SEQ ID NO: 522565 - RNA, 64 nt, Homo Sapiens; identical to SEQ ID NO: 159176

SEQ ID NO: 522566 - RNA, 64 nt, Homo Sapiens; identical to SEQ ID NO: 159177

SEQ ID NO: 522567 - RNA, 64 nt, Homo Sapiens; identical to SEQ ID NO: 159178

SEQ ID NO: 522568 - RNA, 64 nt, Homo Sapiens; identical to SEQ ID NO: 159179

SEQ ID NO: 522569 - RNA, 64 nt, Homo Sapiens; identical to SEQ ID NO: 159180

SEQ ID NO: 522570 - RNA, 64 nt, Homo Sapiens; identical to SEQ ID NO: 159181

SEQ ID NO: 522571 - RNA, 64 nt, Homo Sapiens; identical to SEQ ID NO: 159182

SEQ ID NO: 522572 - RNA, 64 nt, Homo Sapiens; identical to SEQ ID NO: 159183

SEQ ID NO: 522573 - RNA, 64 nt, Homo Sapiens; identical to SEQ ID NO: 159184

SEQ ID NO: 522574 - RNA, 64 nt, Homo Sapiens; identical to SEQ ID NO: 159185

SEQ ID NO: 522575 - RNA, 64 nt, Homo Sapiens; identical to SEQ ID NO: 159186

SEQ ID NO: 522576 - RNA, 64 nt, Homo Sapiens; identical to SEQ ID NO: 159187

SEQ ID NO: 522577 - RNA, 64 nt, Homo Sapiens; identical to SEQ ID NO: 159188

SEQ ID NO: 522578 - RNA, 64 nt, Homo Sapiens; identical to SEQ ID NO: 159189

SEQ ID NO: 522579 - RNA, 64 nt, Homo Sapiens; identical to SEQ ID NO: 159190

SEQ ID NO: 522580 - RNA, 64 nt, Homo Sapiens; identical to SEQ ID NO: 159191

SEQ ID NO: 522581 - RNA, 64 nt, Homo Sapiens; identical to SEQ ID NO: 159192

SEQ ID NO: 522582 - RNA, 64 nt, Homo Sapiens; identical to SEQ ID NO: 159193

SEQ ID NO: 522583 - RNA, 64 nt, Homo Sapiens; identical to SEQ ID NO: 159194

SEQ ID NO: 522584 - RNA, 64 nt, Homo Sapiens; identical to SEQ ID NO: 159195

SEQ ID NO: 522585 - RNA, 64 nt, Homo Sapiens; identical to SEQ ID NO: 159196

SEQ ID NO: 522586 - RNA, 64 nt, Homo Sapiens; identical to SEQ ID NO: 159197

SEQ ID NO: 522587 - RNA, 64 nt, Homo Sapiens; identical to SEQ ID NO: 159198

SEQ ID NO: 522588 - RNA, 64 nt, Homo Sapiens; identical to SEQ ID NO: 159199

SEQ ID NO: 522589 - RNA, 64 nt, Homo Sapiens; identical to SEQ ID NO: 159200

SEQ ID NO: 522590 - RNA, 64 nt, Homo Sapiens; identical to SEQ ID NO: 159201

SEQ ID NO: 522591 - RNA, 64 nt, Homo Sapiens
uggaacuuggcacuggggacucauguuuggaaucguaggggaacaucuggcuguuaaucacuug

SEQ ID NO: 522592 - RNA, 64 nt, Homo Sapiens
cagguuuccugcagcucgcuaccuaaguguuucuguaggggaaggagccaauuaagaaaaagug

SEQ ID NO: 522593 - RNA, 64 nt, Homo Sapiens
accggaggagcaauuggggauccaggugucagagguaggggaaccaggggcaagcuggggcuga

SEQ ID NO: 522594 - RNA, 64 nt, Homo Sapiens
ccgcgcaggccuccggggggccggggcuuaccauguaggggaggggagaucuauccacauaccu

SEQ ID NO: 522595 - RNA, 64 nt, Homo Sapiens
uccugcaguucccaggaccccauccucucagaagguaggggaagggcgggaggauugagaaggg

SEQ ID NO: 522596 - RNA, 64 nt, Homo Sapiens
cgggaggauugagaagggacaagccaccuugaccguaggggaaggaggaaugugggcuggggga

SEQ ID NO: 522597 - RNA, 64 nt, Homo Sapiens
agguugggguguagggccuuagaagcuccccagaguaggggagacagacuguugggccaacagg

SEQ ID NO: 522598 - RNA, 64 nt, Homo Sapiens
gaagggacauggcugagcugggcaguuccagccuguaggggaguccuugggugggcaccacccu

SEQ ID NO: 522599 - RNA, 64 nt, Homo Sapiens
uuccucugcucacaguucuuaccaaaagcccaagguaggggagugaggcuauacgugacaaaug

SEQ ID NO: 522600 - RNA, 64 nt, Homo Sapiens
cccucacacaccaccgagaugcacagagcgggccguaggggacccgccugccagggggugacug

SEQ ID NO: 522601 - RNA, 64 nt, Homo Sapiens
gaaauaaugggauuagaaacaaacaaaacucuuaaguccuaaaaguucucaauguagaggcaua

SEQ ID NO: 522602 - RNA, 64 nt, Homo Sapiens
aggccggaugaaacuucucaguccagcaguuuccaguccuaacaaaugcucccaccugaauuug

SEQ ID NO: 522603 - RNA, 64 nt, Homo Sapiens
ugaagcaccucagaaugugaccaagauaggcugaaguccuaacuccugguuagggcugaggacc

SEQ ID NO: 522604 - RNA, 64 nt, Homo Sapiens
guagaaucugaaauaaacaggccugcucauuuucaguccuaaucggauguccauguccucacag

SEQ ID NO: 522605 - RNA, 64 nt, Homo Sapiens
uuugguggagaauuucuuaccagcaaagcaaauuccuuaacacccccacccauccaguucuccu

SEQ ID NO: 522606 - RNA, 64 nt, Homo Sapiens
ccuguccugcccagaccaacaccuccucccugacccuuaacacuggcuaagggggugugugccc

SEQ ID NO: 522607 - RNA, 64 nt, Homo Sapiens
aggacuuagccucaguugacgauaguaacaauggccuuaacaucuaccuuaacagcuaccuauu

SEQ ID NO: 522608 - RNA, 64 nt, Homo Sapiens
caguugacgauaguaacaauggccuuaacaucuaccuuaacagcuaccuauuacagccguauuc

SEQ ID NO: 522609 - RNA, 64 nt, Homo Sapiens; identical to SEQ ID NO: 44019

SEQ ID NO: 522610 - RNA, 64 nt, Homo Sapiens; identical to SEQ ID NO: 44020

SEQ ID NO: 522611 - RNA, 64 nt, Homo Sapiens; identical to SEQ ID NO: 44021

SEQ ID NO: 522612 - RNA, 64 nt, Homo Sapiens; identical to SEQ ID NO: 44022

SEQ ID NO: 522613 - RNA, 64 nt, Homo Sapiens; identical to SEQ ID NO: 44023

SEQ ID NO: 522614 - RNA, 64 nt, Homo Sapiens; identical to SEQ ID NO: 44024

SEQ ID NO: 522615 - RNA, 64 nt, Homo Sapiens; identical to SEQ ID NO: 44025

SEQ ID NO: 522616 - RNA, 64 nt, Homo Sapiens; identical to SEQ ID NO: 44026

SEQ ID NO: 522617 - RNA, 64 nt, Homo Sapiens; identical to SEQ ID NO: 44027

SEQ ID NO: 522618 - RNA, 64 nt, Homo Sapiens; identical to SEQ ID NO: 44028

SEQ ID NO: 522619 - RNA, 64 nt, Homo Sapiens; identical to SEQ ID NO: 44029

SEQ ID NO: 522620 - RNA, 64 nt, Homo Sapiens; identical to SEQ ID NO: 44030

SEQ ID NO: 522621 - RNA, 64 nt, Homo Sapiens; identical to SEQ ID NO: 44031

SEQ ID NO: 522622 - RNA, 64 nt, Homo Sapiens; identical to SEQ ID NO: 44032

SEQ ID NO: 522623 - RNA, 64 nt, Homo Sapiens; identical to SEQ ID NO: 44033

SEQ ID NO: 522624 - RNA, 64 nt, Homo Sapiens; identical to SEQ ID NO: 44034

SEQ ID NO: 522625 - RNA, 64 nt, Homo Sapiens; identical to SEQ ID NO: 44035

SEQ ID NO: 522626 - RNA, 64 nt, Homo Sapiens; identical to SEQ ID NO: 44036

SEQ ID NO: 522627 - RNA, 64 nt, Homo Sapiens; identical to SEQ ID NO: 44037

SEQ ID NO: 522628 - RNA, 64 nt, Homo Sapiens; identical to SEQ ID NO: 44038

SEQ ID NO: 522629 - RNA, 64 nt, Homo Sapiens; identical to SEQ ID NO: 44039

SEQ ID NO: 522630 - RNA, 64 nt, Homo Sapiens; identical to SEQ ID NO: 44040

SEQ ID NO: 522631 - RNA, 64 nt, Homo Sapiens; identical to SEQ ID NO: 44041

SEQ ID NO: 522632 - RNA, 64 nt, Homo Sapiens; identical to SEQ ID NO: 44042

SEQ ID NO: 522633 - RNA, 64 nt, Homo Sapiens; identical to SEQ ID NO: 44043

SEQ ID NO: 522634 - RNA, 64 nt, Homo Sapiens; identical to SEQ ID NO: 44044

SEQ ID NO: 522635 - RNA, 64 nt, Homo Sapiens; identical to SEQ ID NO: 44045

SEQ ID NO: 522636 - RNA, 64 nt, Homo Sapiens; identical to SEQ ID NO: 44046

SEQ ID NO: 522637 - RNA, 51 nt, Homo Sapiens; identical to SEQ ID NO: 44047

SEQ ID NO: 522638 - RNA, 64 nt, Homo Sapiens; identical to SEQ ID NO: 44048

SEQ ID NO: 522639 - RNA, 64 nt, Homo Sapiens; identical to SEQ ID NO: 44049

SEQ ID NO: 522640 - RNA, 64 nt, Homo Sapiens; identical to SEQ ID NO: 44050

SEQ ID NO: 522641 - RNA, 64 nt, Homo Sapiens; identical to SEQ ID NO: 44051

SEQ ID NO: 522642 - RNA, 64 nt, Homo Sapiens; identical to SEQ ID NO: 44052

SEQ ID NO: 522643 - RNA, 64 nt, Homo Sapiens; identical to SEQ ID NO: 44053

SEQ ID NO: 522644 - RNA, 64 nt, Homo Sapiens; identical to SEQ ID NO: 44054

SEQ ID NO: 522645 - RNA, 64 nt, Homo Sapiens; identical to SEQ ID NO: 44055

SEQ ID NO: 522646 - RNA, 64 nt, Homo Sapiens
uggaacaucuccuauguaccaggcacugugcuaagugcuggaauacauuaucucauugaauuau

SEQ ID NO: 522647 - RNA, 64 nt, Homo Sapiens
ggcuggaggaguaaguggcuuugcaauaaaaugggugcuggagucuaaaaugauacccugggug

SEQ ID NO: 522648 - RNA, 64 nt, Homo Sapiens
uguaggcuuggagguaaagaacugaagauaacuggugcuggauagaggagccuuauuuuuuauu

SEQ ID NO: 522649 - RNA, 64 nt, Homo Sapiens
uuuaccuuuuuccccccuuuuuuuuaaauggagugugcuggaugucucuauaauuuuauucaga

SEQ ID NO: 522650 - RNA, 64 nt, Homo Sapiens
ccuuggcuguuggcagugagugagccuggcucuugugcuggauggagcccaggcgggagcggug

SEQ ID NO: 522651 - RNA, 64 nt, Homo Sapiens
agaaagcaggggcuacaagagggaauccccgaaggugcuggaggugggagcaggagauugagaa

SEQ ID NO: 522652 - RNA, 64 nt, Homo Sapiens
gcaccaccuucuucccugaaagguuguccaggcugugcuggacagggccuggagccaagggaug

SEQ ID NO: 522653 - RNA, 64 nt, Homo Sapiens
acccgcaccgugagucuggcucaucucccgcgcggugcuggacaccugcaggagcuggagccgg

SEQ ID NO: 522654 - RNA, 64 nt, Homo Sapiens
aucauggaaccagucagcccucuguggagucauugugcuggaccucugaaaagaucugcagggg

SEQ ID NO: 522655 - RNA, 64 nt, Homo Sapiens
cucucugcucugacccuucucaggcccgccugaugugcuggaccaucccccugcugccacggcc

SEQ ID NO: 522656 - RNA, 64 nt, Homo Sapiens
cuggggagacgaugcuguugcuuugcagaucacagugcuggaagcaggaacccaggguaagugc

SEQ ID NO: 522657 - RNA, 64 nt, Homo Sapiens
ccagaccaaagagaagaugguuaccauggugucagugcuggaggaucugauuggcaagcuuacc

SEQ ID NO: 522658 - RNA, 64 nt, Homo Sapiens
aggcugccagaacuuguuggagucucuggcuugugugcuggauggugcgccaccuuacuuugga

SEQ ID NO: 522659 - RNA, 64 nt, Homo Sapiens
aaaugcacuuuuacugugcuucugcuguuggagagugcuggaggucuguggaguccucagucac

SEQ ID NO: 522660 - RNA, 64 nt, Homo Sapiens
gcuggggagaaugaagagcuaaaauagauccuaggugcuggaugcuuugucauccaugcgugca

SEQ ID NO: 522661 - RNA, 64 nt, Homo Sapiens
cuccauucuagaugcuucccuuguauccagugaugugcuggagcuggcuuugccaagcuuguga

SEQ ID NO: 522662 - RNA, 64 nt, Homo Sapiens
aaaacgggagcuauuucacagaacuaaguagggucccaagaaaagcucccaaugggagcccacg

SEQ ID NO: 522663 - RNA, 64 nt, Homo Sapiens
ccaacuaaggacucucaaaccuuacuaccuaacgcccaagaaaacugggguuccugguggauuu

SEQ ID NO: 522664 - RNA, 64 nt, Homo Sapiens
ccaggugcuuuccagacuccauccaggcuccucucccaagaaaucagcccuccucucccaagaa

SEQ ID NO: 522665 - RNA, 64 nt, Homo Sapiens
ccaggcuccucucccaagaacacagcccuccucucccaagaaaugaagaacugauuggggcuuc

SEQ ID NO: 522666 - RNA, 64 nt, Homo Sapiens
ccccgggacuuuaccccagcgcaucucaaccucacccaagaaacaggguccuacagacaaggug

SEQ ID NO: 522667 - RNA, 64 nt, Homo Sapiens
ccuacuaauuccucugcacuugacuuccagcggucccaagaacagccgcucagaggcuucagcc

SEQ ID NO: 522668 - RNA, 64 nt, Homo Sapiens
cagucauuucagaggcagcagaugcccagggagacccaagaaagagucagguuagggagcagug

SEQ ID NO: 522669 - RNA, 64 nt, Homo Sapiens
auccaaauacucuuacuuuaaaaaauuuccuuuccccaagaaucuccuugggacuuugacuuau

SEQ ID NO: 522670 - RNA, 64 nt, Homo Sapiens
cgacgaaagcgacggaccaaaagaaauuuccugccccaagaagcaugggauccaggaaggggcg

SEQ ID NO: 522671 - RNA, 64 nt, Homo Sapiens
auguuccuaaguaagucaggucccuaagccccgucccaagaagugacacaaguggccaacaucc

SEQ ID NO: 522672 - RNA, 64 nt, Homo Sapiens
ggauguuagcauucauuagaguaugaggaugagucccaagaagguucuuuggaaggaggacgaa

SEQ ID NO: 522673 - RNA, 64 nt, Homo Sapiens
uuaagugggcuuccauuccauggauuuaaucagucccaagaagaucaaacucagcaguacuugg

SEQ ID NO: 522674 - RNA, 64 nt, Homo Sapiens
caagcaggaaugccucuugucuuuuaaacagaugcccaagaaggucccccuuccucccauacug

SEQ ID NO: 522675 - RNA, 64 nt, Homo Sapiens
gcccuagaaauugauguggcuauaugaaccuuuccccaagaaggauaugguauguaugcuaaau

SEQ ID NO: 522676 - RNA, 64 nt, Homo Sapiens
ccaugggaacgccaacuggaagcucugcuggacacccaagaaagguguuaaccacguguauaac

SEQ ID NO: 522677 - RNA, 64 nt, Homo Sapiens
uuuuuuuaagggccuuggagugccaauuuuacaacccaagaauuuaaaagugaaauuaaccucc

SEQ ID NO: 522678 - RNA, 64 nt, Homo Sapiens
aauauauuaaaaagauauuuauuauuauugucaucccaagaaaaguuaauacuaucauaguaau

SEQ ID NO: 522679 - RNA, 64 nt, Homo Sapiens
aagauauuuuaaaaauuuauacuauuauugucaucccaagaaaaauuaauacuaucauguuaau

SEQ ID NO: 522680 - RNA, 64 nt, Homo Sapiens
cucccugguucaagugauucuccugccucauccucccaagaagcugagauuacagaugaccacc

SEQ ID NO: 522681 - RNA, 64 nt, Homo Sapiens
auaccuagagacgcugcuggggaaggucagcacacccaagaacuuugggagugugugucuguuu

SEQ ID NO: 522682 - RNA, 64 nt, Homo Sapiens
cuccugagugaucccauuucuuaaucaguguagccccaagaaggcuggggcuauuuaccagggu

SEQ ID NO: 522683 - RNA, 64 nt, Homo Sapiens
ggcaaugaguguguuggcuugugaucugggaacucccaagaacagcaggcccaccuaccuucaa

SEQ ID NO: 522684 - RNA, 64 nt, Homo Sapiens
gugggcaccggaaaggaggggacuucuccugcaccccaagaagugguggggagauugcugcccc

SEQ ID NO: 522685 - RNA, 64 nt, Homo Sapiens
agccaagcccccagccccgaucugcagauccugccccaagaagcugggguggugggggcaguaa

SEQ ID NO: 522686 - RNA, 64 nt, Homo Sapiens
gcgggagccaggccugagugcccaguuccaggaucgagccuaaauguaucuccuuaguuaacaa

SEQ ID NO: 522687 - RNA, 64 nt, Homo Sapiens
uuaaaaagacgcagggcaccugugagcgcaggagcgagccuaaggccacccagcggcagcgccc

SEQ ID NO: 522688 - RNA, 64 nt, Homo Sapiens
caguacuggagaacuuggcauggaucagcaaugacgagccuacauggaggacguagaauuucac

SEQ ID NO: 522689 - RNA, 64 nt, Homo Sapiens
uuuaauguuguccaggaaacccuggcuugcuugccgagccuaaugaaagggaaagucagcuuuc

SEQ ID NO: 522690 - RNA, 64 nt, Homo Sapiens
cucuuccaaagacuccccccagguacagugccuucgagccuacaagccccgagagaaugaugaa

SEQ ID NO: 522691 - RNA, 64 nt, Homo Sapiens
ccgcgggaggcggaagagaccccacucucuaucacgagccuaacuacagaccucccccggacag

SEQ ID NO: 522692 - RNA, 64 nt, Homo Sapiens
ggugccuggagcagagggacccacaagugccucccgagccuagauccuggcucggaccacugca

SEQ ID NO: 522693 - RNA, 64 nt, Homo Sapiens
cugucgccaucccacuggcuaguauuuccugccccgagccuaugcagucagcaugucauccaca

SEQ ID NO: 522694 - RNA, 64 nt, Homo Sapiens
gucaucacucaauauugcgaagcacaugccccaucgagccuacugggcagagcagcagagcagg

SEQ ID NO: 522695 - RNA, 64 nt, Homo Sapiens
acacuugccaaguaauccugucucagauuuuuugcgagccuaaagaaugaagaggugcgccguu

SEQ ID NO: 522696 - RNA, 64 nt, Homo Sapiens
cguguccuaccuccgucuucgccaaggccccgcccgagccuaguuguucucccccugaaugugu

SEQ ID NO: 522697 - RNA, 64 nt, Homo Sapiens
ucaacuugcugauauuuuaguaguuaacagcuuccgagccuaucaugcaauuuggagucuguca

SEQ ID NO: 522698 - RNA, 64 nt, Homo Sapiens
ggcccaccugccucugucucacugaacuagaagccgagccuagaaacuaacacagccaucaagg

SEQ ID NO: 522699 - RNA, 64 nt, Homo Sapiens
cuuagcugguggccagccugacuggcuuccugggcgagccuaguagcuccugcaggcaggggca

SEQ ID NO: 522700 - RNA, 64 nt, Homo Sapiens
cuucaucauaguaugaaguguugaaaauuaauaacgagccuaguuuaggaaaaagcugcuuaaa

SEQ ID NO: 522701 - RNA, 64 nt, Homo Sapiens
cauauacauaaugagauauuuugggaauaggacccgagccuaaacacaaaauucauugaugugu

SEQ ID NO: 522702 - RNA, 64 nt, Homo Sapiens
aggacuuucauaccgacaacaugaagcaggaaaacgagccuaagagacuccuccaaaucuuaaa

SEQ ID NO: 522703 - RNA, 64 nt, Homo Sapiens
gcgugcccuggucuguugagacaaaugaggaaaccgagccuaugggcauguuugucgucguccu

SEQ ID NO: 522704 - RNA, 64 nt, Homo Sapiens
gccccuucucgccgagccguggggcgcgggcggccgagccuauacauaguguacaggagacauc

SEQ ID NO: 522705 - RNA, 64 nt, Homo Sapiens
agguugugguggggcaagaucgcaccauugcacccgagccuaggcaacaagagugaaauuccgu

SEQ ID NO: 522706 - RNA, 64 nt, Homo Sapiens
ucucuuugcacauccugcuuaaugaauaaauaaacgagccuauuucaagaagugccaguugauc

SEQ ID NO: 522707 - RNA, 64 nt, Homo Sapiens
ggagucccgggacagagugcgucucuggcccugccgagccuaugggccucucacccccaaggcu

SEQ ID NO: 522708 - RNA, 64 nt, Homo Sapiens
gccagcuguggcagcgcauuaguuuuggcgcaagcgagccuaugcugcagggucacuuuuggcu

SEQ ID NO: 522709 - RNA, 64 nt, Homo Sapiens
ggagcuugagggagggcuggcgcaucuauagggucgagccuagguuccucaugggcgaucacuc

SEQ ID NO: 522710 - RNA, 64 nt, Homo Sapiens
agauuguggacuuuuuggguauuaccccagggcccaacaguaaaauucugccugaaaacaaugu

SEQ ID NO: 522711 - RNA, 64 nt, Homo Sapiens
aauuacgguucaaaaaugucgaacagaugauaugcaacaguaccuuuagccacagaaucaguaa

SEQ ID NO: 522712 - RNA, 64 nt, Homo Sapiens
uuugcuaaucuuacuaauagaaauauaaaaauagcaacaguaucggccuaccuuuuuaaaggac

SEQ ID NO: 522713 - RNA, 64 nt, Homo Sapiens
uauaucuauuucucuagggauugauuuuuuuugacaacaguacaauauuccaguauuugugugu

SEQ ID NO: 522714 - RNA, 64 nt, Homo Sapiens
uggugugaaagacuaaaucaucggaagcccuccucaacaguagcccguuuacacguggcuuccc

SEQ ID NO: 522715 - RNA, 64 nt, Homo Sapiens
guuugagaauuacuggguuacaggugauucuuuucaacaguaauugccaauuuaacagucucau

SEQ ID NO: 522716 - RNA, 64 nt, Homo Sapiens
acaucuuuaauccgccuaaucagguucugcguuacaacaguaacgaaaugaaagaacuuguuca

SEQ ID NO: 522717 - RNA, 64 nt, Homo Sapiens
uuugaaacuagaagucaaaauuuauuuucucuaucaacaguagugguaaccauuaagaaauguu

SEQ ID NO: 522718 - RNA, 64 nt, Homo Sapiens
uuaggagggagcuuuuugaaggaagacuuauuaacaacaguaauucagcaaaugacguugauuu

SEQ ID NO: 522719 - RNA, 64 nt, Homo Sapiens
caaaucauucacaaacagaauaaaacagagccaacaacaguauuuuaagggucacuugccuccu

SEQ ID NO: 522720 - RNA, 64 nt, Homo Sapiens
uuaaccauugacaagaaugguuugaaauauaacucaacaguauacuguuaaggaggucucaggu

SEQ ID NO: 522721 - RNA, 64 nt, Homo Sapiens
uccuacugaaauuucuuaggauaaaucugauaggcaacaguagccuuaaggcauuuucaugcuc

SEQ ID NO: 522722 - RNA, 64 nt, Homo Sapiens
cuguugaugguuuuugcaagagaauucagcagcucaacaguaaugaaagugaagaacagagucc

SEQ ID NO: 522723 - RNA, 64 nt, Homo Sapiens
aagacgcuugacuuauuaaggacuuuaaccuacucaacaguauuucauauccauugugguuagu

SEQ ID NO: 522724 - RNA, 64 nt, Homo Sapiens
aguugucugaaaagccagcucuugaaccucuucacaacaguaucaacacuggcuucucccgguu

SEQ ID NO: 522725 - RNA, 64 nt, Homo Sapiens
aagacuguaagccugugugugccacuguuugcuucaacaguauauccuaauaagccucaccuau

SEQ ID NO: 522726 - RNA, 64 nt, Homo Sapiens; identical to SEQ ID NO: 152997

SEQ ID NO: 522727 - RNA, 64 nt, Homo Sapiens; identical to SEQ ID NO: 152998

SEQ ID NO: 522728 - RNA, 64 nt, Homo Sapiens; identical to SEQ ID NO: 152999

SEQ ID NO: 522729 - RNA, 64 nt, Homo Sapiens; identical to SEQ ID NO: 153000

SEQ ID NO: 522730 - RNA, 64 nt, Homo Sapiens; identical to SEQ ID NO: 153001

SEQ ID NO: 522731 - RNA, 64 nt, Homo Sapiens; identical to SEQ ID NO: 153002

SEQ ID NO: 522732 - RNA, 64 nt, Homo Sapiens; identical to SEQ ID NO: 153003

SEQ ID NO: 522733 - RNA, 64 nt, Homo Sapiens; identical to SEQ ID NO: 153004

SEQ ID NO: 522734 - RNA, 64 nt, Homo Sapiens; identical to SEQ ID NO: 153005

SEQ ID NO: 522735 - RNA, 64 nt, Homo Sapiens; identical to SEQ ID NO: 153006

SEQ ID NO: 522736 - RNA, 64 nt, Homo Sapiens; identical to SEQ ID NO: 153007

SEQ ID NO: 522737 - RNA, 58 nt, Homo Sapiens
acccuacccuggcagggaccguggggaacacagcuacaugguuagcugacagucagcu

SEQ ID NO: 522738 - RNA, 58 nt, Homo Sapiens
caguggggcuggcaucaaggccccaccucacagcuacucccaacccugcccugcccca

SEQ ID NO: 522739 - RNA, 58 nt, Homo Sapiens
auucccaguaaagauaccauauaaguggcacagcuaauuuugccuaaggucacagcua

SEQ ID NO: 522740 - RNA, 58 nt, Homo Sapiens
aaguggcacagcuaauauucccuaaggucacagcuaaucagauaagugaaguaauuug

SEQ ID NO: 522741 - RNA, 58 nt, Homo Sapiens
uggggacugucugcuggcucucacggcccacagcuaggcggcccacagcuaggugggg

SEQ ID NO: 522742 - RNA, 58 nt, Homo Sapiens
uggggucacggcccacagcuucacggcccacagcuagguucaucagcacagcaugggg

SEQ ID NO: 522743 - RNA, 58 nt, Homo Sapiens
agggccauucaaauuguugguguugcaucacagcuaccuuaacuguuuuuaacaugga

SEQ ID NO: 522744 - RNA, 58 nt, Homo Sapiens
ucaccccccccacccccgccuugccacacacagcuaauauucuaaugguaaauuucuc

SEQ ID NO: 522745 - RNA, 58 nt, Homo Sapiens
gagagguuaagugucuugcccgaggucacacagcuaucugcaugucccacaacucccc

SEQ ID NO: 522746 - RNA, 58 nt, Homo Sapiens
aaaaguuaaccaagccuaugcuuguagucacagcuacucgggaggccgaggugggagg

SEQ ID NO: 522747 - RNA, 58 nt, Homo Sapiens
acaaaaccgaaaaagcaaaaucugacuucacagcuauggggguggcauucacuuaggg

SEQ ID NO: 522748 - RNA, 58 nt, Homo Sapiens
cugcaaagggcaaauuauaaaauaacuucacagcuacuuccacagaaugucaggacca

SEQ ID NO: 522749 - RNA, 58 nt, Homo Sapiens
gagggaacucugccaccugcgugcaacccacagcuaaaguaaauucaaugacacuacu

SEQ ID NO: 522750 - RNA, 58 nt, Homo Sapiens
cuacaagagggaaagaaggcaaaaacggcacagcuaucuccaaacacaucugaguuca

SEQ ID NO: 522751 - RNA, 58 nt, Homo Sapiens
ggacaugcugaagccaaagccaauaacacacagcuaacacacagcucccauaaccgcu

SEQ ID NO: 522752 - RNA, 58 nt, Homo Sapiens
caaugccauccucaaacacugcaggcaucacagcuaacaauugugaagucgucuuaac

SEQ ID NO: 522753 - RNA, 64 nt, Homo Sapiens; identical to SEQ ID NO: 111815

SEQ ID NO: 522754 - RNA, 64 nt, Homo Sapiens; identical to SEQ ID NO: 111816

SEQ ID NO: 522755 - RNA, 64 nt, Homo Sapiens; identical to SEQ ID NO: 111817

SEQ ID NO: 522756 - RNA, 64 nt, Homo Sapiens; identical to SEQ ID NO: 111818

SEQ ID NO: 522757 - RNA, 64 nt, Homo Sapiens; identical to SEQ ID NO: 111819

SEQ ID NO: 522758 - RNA, 64 nt, Homo Sapiens; identical to SEQ ID NO: 111820

SEQ ID NO: 522759 - RNA, 64 nt, Homo Sapiens; identical to SEQ ID NO: 111821

SEQ ID NO: 522760 - RNA, 64 nt, Homo Sapiens; identical to SEQ ID NO: 111822

SEQ ID NO: 522761 - RNA, 64 nt, Homo Sapiens; identical to SEQ ID NO: 111823

SEQ ID NO: 522762 - RNA, 64 nt, Homo Sapiens; identical to SEQ ID NO: 111824

SEQ ID NO: 522763 - RNA, 64 nt, Homo Sapiens; identical to SEQ ID NO: 111825

SEQ ID NO: 522764 - RNA, 64 nt, Homo Sapiens; identical to SEQ ID NO: 111826

SEQ ID NO: 522765 - RNA, 64 nt, Homo Sapiens; identical to SEQ ID NO: 111827

SEQ ID NO: 522766 - RNA, 64 nt, Homo Sapiens; identical to SEQ ID NO: 111828

SEQ ID NO: 522767 - RNA, 64 nt, Homo Sapiens; identical to SEQ ID NO: 111829

SEQ ID NO: 522768 - RNA, 64 nt, Homo Sapiens; identical to SEQ ID NO: 373477

SEQ ID NO: 522769 - RNA, 64 nt, Homo Sapiens; identical to SEQ ID NO: 373478

SEQ ID NO: 522770 - RNA, 64 nt, Homo Sapiens; identical to SEQ ID NO: 373479

SEQ ID NO: 522771 - RNA, 64 nt, Homo Sapiens; identical to SEQ ID NO: 373480

SEQ ID NO: 522772 - RNA, 64 nt, Homo Sapiens; identical to SEQ ID NO: 373481

SEQ ID NO: 522773 - RNA, 64 nt, Homo Sapiens; identical to SEQ ID NO: 373482

SEQ ID NO: 522774 - RNA, 64 nt, Homo Sapiens; identical to SEQ ID NO: 373483

SEQ ID NO: 522775 - RNA, 64 nt, Homo Sapiens; identical to SEQ ID NO: 373484

SEQ ID NO: 522776 - RNA, 64 nt, Homo Sapiens; identical to SEQ ID NO: 373485

SEQ ID NO: 522777 - RNA, 64 nt, Homo Sapiens; identical to SEQ ID NO: 373486

SEQ ID NO: 522778 - RNA, 64 nt, Homo Sapiens; identical to SEQ ID NO: 373487

SEQ ID NO: 522779 - RNA, 64 nt, Homo Sapiens; identical to SEQ ID NO: 373488

SEQ ID NO: 522780 - RNA, 64 nt, Homo Sapiens; identical to SEQ ID NO: 373489

SEQ ID NO: 522781 - RNA, 64 nt, Homo Sapiens; identical to SEQ ID NO: 373490

SEQ ID NO: 522782 - RNA, 64 nt, Homo Sapiens; identical to SEQ ID NO: 373491

SEQ ID NO: 522783 - RNA, 64 nt, Homo Sapiens; identical to SEQ ID NO: 373492

SEQ ID NO: 522784 - RNA, 64 nt, Homo Sapiens; identical to SEQ ID NO: 373493

SEQ ID NO: 522785 - RNA, 64 nt, Homo Sapiens; identical to SEQ ID NO: 373494

SEQ ID NO: 522786 - RNA, 64 nt, Homo Sapiens; identical to SEQ ID NO: 373495

SEQ ID NO: 522787 - RNA, 64 nt, Homo Sapiens; identical to SEQ ID NO: 373496

SEQ ID NO: 522788 - RNA, 64 nt, Homo Sapiens; identical to SEQ ID NO: 373497

SEQ ID NO: 522789 - RNA, 64 nt, Homo Sapiens; identical to SEQ ID NO: 373498

SEQ ID NO: 522790 - RNA, 64 nt, Homo Sapiens; identical to SEQ ID NO: 373499

SEQ ID NO: 522791 - RNA, 64 nt, Homo Sapiens; identical to SEQ ID NO: 373500

SEQ ID NO: 522792 - RNA, 64 nt, Homo Sapiens; identical to SEQ ID NO: 373501

SEQ ID NO: 522793 - RNA, 64 nt, Homo Sapiens; identical to SEQ ID NO: 373502

SEQ ID NO: 522794 - RNA, 64 nt, Homo Sapiens; identical to SEQ ID NO: 373503

SEQ ID NO: 522795 - RNA, 64 nt, Homo Sapiens; identical to SEQ ID NO: 373504

SEQ ID NO: 522796 - RNA, 64 nt, Homo Sapiens; identical to SEQ ID NO: 373505

SEQ ID NO: 522797 - RNA, 64 nt, Homo Sapiens; identical to SEQ ID NO: 373506

SEQ ID NO: 522798 - RNA, 64 nt, Homo Sapiens; identical to SEQ ID NO: 373507

SEQ ID NO: 522799 - RNA, 64 nt, Homo Sapiens; identical to SEQ ID NO: 373508

SEQ ID NO: 522800 - RNA, 64 nt, Homo Sapiens; identical to SEQ ID NO: 373509

SEQ ID NO: 522801 - RNA, 64 nt, Homo Sapiens; identical to SEQ ID NO: 373510

SEQ ID NO: 522802 - RNA, 64 nt, Homo Sapiens; identical to SEQ ID NO: 373511

SEQ ID NO: 522803 - RNA, 64 nt, Homo Sapiens; identical to SEQ ID NO: 373512

SEQ ID NO: 522804 - RNA, 64 nt, Homo Sapiens; identical to SEQ ID NO: 373513

SEQ ID NO: 522805 - RNA, 64 nt, Homo Sapiens; identical to SEQ ID NO: 373514

SEQ ID NO: 522806 - RNA, 64 nt, Homo Sapiens; identical to SEQ ID NO: 373515

SEQ ID NO: 522807 - RNA, 64 nt, Homo Sapiens; identical to SEQ ID NO: 373516

SEQ ID NO: 522808 - RNA, 64 nt, Homo Sapiens; identical to SEQ ID NO: 373517

SEQ ID NO: 522809 - RNA, 64 nt, Homo Sapiens; identical to SEQ ID NO: 373518

SEQ ID NO: 522810 - RNA, 64 nt, Homo Sapiens; identical to SEQ ID NO: 373519

SEQ ID NO: 522811 - RNA, 64 nt, Homo Sapiens; identical to SEQ ID NO: 373520

SEQ ID NO: 522812 - RNA, 64 nt, Homo Sapiens; identical to SEQ ID NO: 373521

SEQ ID NO: 522813 - RNA, 64 nt, Homo Sapiens; identical to SEQ ID NO: 373522

SEQ ID NO: 522814 - RNA, 64 nt, Homo Sapiens; identical to SEQ ID NO: 373523

SEQ ID NO: 522815 - RNA, 64 nt, Homo Sapiens; identical to SEQ ID NO: 373524

SEQ ID NO: 522816 - RNA, 64 nt, Homo Sapiens; identical to SEQ ID NO: 373525

SEQ ID NO: 522817 - RNA, 64 nt, Homo Sapiens; identical to SEQ ID NO: 373526

SEQ ID NO: 522818 - RNA, 64 nt, Homo Sapiens; identical to SEQ ID NO: 373527

SEQ ID NO: 522819 - RNA, 64 nt, Homo Sapiens; identical to SEQ ID NO: 373528

SEQ ID NO: 522820 - RNA, 64 nt, Homo Sapiens; identical to SEQ ID NO: 373529

SEQ ID NO: 522821 - RNA, 64 nt, Homo Sapiens; identical to SEQ ID NO: 373530

SEQ ID NO: 522822 - RNA, 64 nt, Homo Sapiens; identical to SEQ ID NO: 373531

SEQ ID NO: 522823 - RNA, 64 nt, Homo Sapiens; identical to SEQ ID NO: 373532

SEQ ID NO: 522824 - RNA, 64 nt, Homo Sapiens; identical to SEQ ID NO: 373533

SEQ ID NO: 522825 - RNA, 64 nt, Homo Sapiens; identical to SEQ ID NO: 373534

SEQ ID NO: 522826 - RNA, 64 nt, Homo Sapiens; identical to SEQ ID NO: 373535

SEQ ID NO: 522827 - RNA, 64 nt, Homo Sapiens; identical to SEQ ID NO: 373536

SEQ ID NO: 522828 - RNA, 64 nt, Homo Sapiens; identical to SEQ ID NO: 373537

SEQ ID NO: 522829 - RNA, 64 nt, Homo Sapiens; identical to SEQ ID NO: 373538

SEQ ID NO: 522830 - RNA, 64 nt, Homo Sapiens; identical to SEQ ID NO: 373539

SEQ ID NO: 522831 - RNA, 64 nt, Homo Sapiens; identical to SEQ ID NO: 373540

SEQ ID NO: 522832 - RNA, 64 nt, Homo Sapiens; identical to SEQ ID NO: 373541

SEQ ID NO: 522833 - RNA, 64 nt, Homo Sapiens; identical to SEQ ID NO: 373542

SEQ ID NO: 522834 - RNA, 64 nt, Homo Sapiens; identical to SEQ ID NO: 373543

SEQ ID NO: 522835 - RNA, 64 nt, Homo Sapiens; identical to SEQ ID NO: 373544

SEQ ID NO: 522836 - RNA, 64 nt, Homo Sapiens; identical to SEQ ID NO: 373545

SEQ ID NO: 522837 - RNA, 64 nt, Homo Sapiens; identical to SEQ ID NO: 373546

SEQ ID NO: 522838 - RNA, 64 nt, Homo Sapiens; identical to SEQ ID NO: 373547

SEQ ID NO: 522839 - RNA, 64 nt, Homo Sapiens; identical to SEQ ID NO: 373548

SEQ ID NO: 522840 - RNA, 64 nt, Homo Sapiens; identical to SEQ ID NO: 373549

SEQ ID NO: 522841 - RNA, 64 nt, Homo Sapiens; identical to SEQ ID NO: 373550

SEQ ID NO: 522842 - RNA, 64 nt, Homo Sapiens; identical to SEQ ID NO: 373551

SEQ ID NO: 522843 - RNA, 64 nt, Homo Sapiens; identical to SEQ ID NO: 373552

SEQ ID NO: 522844 - RNA, 64 nt, Homo Sapiens; identical to SEQ ID NO: 373553

SEQ ID NO: 522845 - RNA, 64 nt, Homo Sapiens; identical to SEQ ID NO: 373554

SEQ ID NO: 522846 - RNA, 64 nt, Homo Sapiens; identical to SEQ ID NO: 373555

SEQ ID NO: 522847 - RNA, 64 nt, Homo Sapiens; identical to SEQ ID NO: 373556

SEQ ID NO: 522848 - RNA, 64 nt, Homo Sapiens; identical to SEQ ID NO: 373557

SEQ ID NO: 522849 - RNA, 64 nt, Homo Sapiens; identical to SEQ ID NO: 373558

SEQ ID NO: 522850 - RNA, 64 nt, Homo Sapiens; identical to SEQ ID NO: 373559

SEQ ID NO: 522851 - RNA, 64 nt, Homo Sapiens; identical to SEQ ID NO: 373560

SEQ ID NO: 522852 - RNA, 64 nt, Homo Sapiens; identical to SEQ ID NO: 373561

SEQ ID NO: 522853 - RNA, 64 nt, Homo Sapiens; identical to SEQ ID NO: 373562

SEQ ID NO: 522854 - RNA, 64 nt, Homo Sapiens; identical to SEQ ID NO: 373563

SEQ ID NO: 522855 - RNA, 64 nt, Homo Sapiens; identical to SEQ ID NO: 373564

SEQ ID NO: 522856 - RNA, 64 nt, Homo Sapiens; identical to SEQ ID NO: 373565

SEQ ID NO: 522857 - RNA, 64 nt, Homo Sapiens; identical to SEQ ID NO: 373566

SEQ ID NO: 522858 - RNA, 64 nt, Homo Sapiens; identical to SEQ ID NO: 373567

SEQ ID NO: 522859 - RNA, 64 nt, Homo Sapiens; identical to SEQ ID NO: 373568

SEQ ID NO: 522860 - RNA, 64 nt, Homo Sapiens; identical to SEQ ID NO: 373569

SEQ ID NO: 522861 - RNA, 64 nt, Homo Sapiens; identical to SEQ ID NO: 373570

SEQ ID NO: 522862 - RNA, 64 nt, Homo Sapiens; identical to SEQ ID NO: 373571

SEQ ID NO: 522863 - RNA, 64 nt, Homo Sapiens; identical to SEQ ID NO: 373572

SEQ ID NO: 522864 - RNA, 64 nt, Homo Sapiens; identical to SEQ ID NO: 373573

SEQ ID NO: 522865 - RNA, 64 nt, Homo Sapiens; identical to SEQ ID NO: 373574

SEQ ID NO: 522866 - RNA, 64 nt, Homo Sapiens; identical to SEQ ID NO: 373575

SEQ ID NO: 522867 - RNA, 64 nt, Homo Sapiens; identical to SEQ ID NO: 373576

SEQ ID NO: 522868 - RNA, 64 nt, Homo Sapiens; identical to SEQ ID NO: 373577

SEQ ID NO: 522869 - RNA, 64 nt, Homo Sapiens; identical to SEQ ID NO: 373578

SEQ ID NO: 522870 - RNA, 64 nt, Homo Sapiens; identical to SEQ ID NO: 373579

SEQ ID NO: 522871 - RNA, 64 nt, Homo Sapiens; identical to SEQ ID NO: 373580

SEQ ID NO: 522872 - RNA, 64 nt, Homo Sapiens; identical to SEQ ID NO: 373581

SEQ ID NO: 522873 - RNA, 64 nt, Homo Sapiens; identical to SEQ ID NO: 373582

SEQ ID NO: 522874 - RNA, 64 nt, Homo Sapiens; identical to SEQ ID NO: 373583

SEQ ID NO: 522875 - RNA, 64 nt, Homo Sapiens; identical to SEQ ID NO: 373584

SEQ ID NO: 522876 - RNA, 64 nt, Homo Sapiens; identical to SEQ ID NO: 373585

SEQ ID NO: 522877 - RNA, 64 nt, Homo Sapiens; identical to SEQ ID NO: 373586

SEQ ID NO: 522878 - RNA, 64 nt, Homo Sapiens; identical to SEQ ID NO: 373587

SEQ ID NO: 522879 - RNA, 64 nt, Homo Sapiens; identical to SEQ ID NO: 373588

SEQ ID NO: 522880 - RNA, 64 nt, Homo Sapiens; identical to SEQ ID NO: 373589

SEQ ID NO: 522881 - RNA, 64 nt, Homo Sapiens; identical to SEQ ID NO: 373590

SEQ ID NO: 522882 - RNA, 64 nt, Homo Sapiens; identical to SEQ ID NO: 373591

SEQ ID NO: 522883 - RNA, 64 nt, Homo Sapiens; identical to SEQ ID NO: 373592

SEQ ID NO: 522884 - RNA, 64 nt, Homo Sapiens; identical to SEQ ID NO: 373593

SEQ ID NO: 522885 - RNA, 64 nt, Homo Sapiens; identical to SEQ ID NO: 373594

SEQ ID NO: 522886 - RNA, 64 nt, Homo Sapiens; identical to SEQ ID NO: 373595

SEQ ID NO: 522887 - RNA, 64 nt, Homo Sapiens; identical to SEQ ID NO: 373596

SEQ ID NO: 522888 - RNA, 64 nt, Homo Sapiens; identical to SEQ ID NO: 373597

SEQ ID NO: 522889 - RNA, 64 nt, Homo Sapiens; identical to SEQ ID NO: 373598

SEQ ID NO: 522890 - RNA, 64 nt, Homo Sapiens; identical to SEQ ID NO: 373599

SEQ ID NO: 522891 - RNA, 64 nt, Homo Sapiens; identical to SEQ ID NO: 373600

SEQ ID NO: 522892 - RNA, 64 nt, Homo Sapiens; identical to SEQ ID NO: 373601

SEQ ID NO: 522893 - RNA, 64 nt, Homo Sapiens; identical to SEQ ID NO: 373602

SEQ ID NO: 522894 - RNA, 64 nt, Homo Sapiens; identical to SEQ ID NO: 373603

SEQ ID NO: 522895 - RNA, 64 nt, Homo Sapiens; identical to SEQ ID NO: 373604

SEQ ID NO: 522896 - RNA, 64 nt, Homo Sapiens; identical to SEQ ID NO: 373605

SEQ ID NO: 522897 - RNA, 64 nt, Homo Sapiens; identical to SEQ ID NO: 373606

SEQ ID NO: 522898 - RNA, 64 nt, Homo Sapiens; identical to SEQ ID NO: 373607

SEQ ID NO: 522899 - RNA, 64 nt, Homo Sapiens; identical to SEQ ID NO: 373608

SEQ ID NO: 522900 - RNA, 64 nt, Homo Sapiens; identical to SEQ ID NO: 373609

SEQ ID NO: 522901 - RNA, 64 nt, Homo Sapiens; identical to SEQ ID NO: 373610

SEQ ID NO: 522902 - RNA, 64 nt, Homo Sapiens; identical to SEQ ID NO: 373611

SEQ ID NO: 522903 - RNA, 64 nt, Homo Sapiens; identical to SEQ ID NO: 373612

SEQ ID NO: 522904 - RNA, 64 nt, Homo Sapiens; identical to SEQ ID NO: 373613

SEQ ID NO: 522905 - RNA, 64 nt, Homo Sapiens; identical to SEQ ID NO: 373614

SEQ ID NO: 522906 - RNA, 64 nt, Homo Sapiens; identical to SEQ ID NO: 373615

SEQ ID NO: 522907 - RNA, 64 nt, Homo Sapiens; identical to SEQ ID NO: 373616

SEQ ID NO: 522908 - RNA, 64 nt, Homo Sapiens; identical to SEQ ID NO: 373617

SEQ ID NO: 522909 - RNA, 64 nt, Homo Sapiens; identical to SEQ ID NO: 373618

SEQ ID NO: 522910 - RNA, 64 nt, Homo Sapiens; identical to SEQ ID NO: 373619

SEQ ID NO: 522911 - RNA, 64 nt, Homo Sapiens; identical to SEQ ID NO: 373620

SEQ ID NO: 522912 - RNA, 64 nt, Homo Sapiens; identical to SEQ ID NO: 373621

SEQ ID NO: 522913 - RNA, 64 nt, Homo Sapiens; identical to SEQ ID NO: 373622

SEQ ID NO: 522914 - RNA, 64 nt, Homo Sapiens; identical to SEQ ID NO: 373623

SEQ ID NO: 522915 - RNA, 64 nt, Homo Sapiens; identical to SEQ ID NO: 373624

SEQ ID NO: 522916 - RNA, 64 nt, Homo Sapiens; identical to SEQ ID NO: 373625

SEQ ID NO: 522917 - RNA, 64 nt, Homo Sapiens; identical to SEQ ID NO: 373626

SEQ ID NO: 522918 - RNA, 64 nt, Homo Sapiens; identical to SEQ ID NO: 373627

SEQ ID NO: 522919 - RNA, 64 nt, Homo Sapiens; identical to SEQ ID NO: 373628

SEQ ID NO: 522920 - RNA, 64 nt, Homo Sapiens; identical to SEQ ID NO: 373629

SEQ ID NO: 522921 - RNA, 64 nt, Homo Sapiens; identical to SEQ ID NO: 373630

SEQ ID NO: 522922 - RNA, 64 nt, Homo Sapiens; identical to SEQ ID NO: 373631

SEQ ID NO: 522923 - RNA, 64 nt, Homo Sapiens; identical to SEQ ID NO: 373632

SEQ ID NO: 522924 - RNA, 64 nt, Homo Sapiens; identical to SEQ ID NO: 373633

SEQ ID NO: 522925 - RNA, 64 nt, Homo Sapiens; identical to SEQ ID NO: 373634

SEQ ID NO: 522926 - RNA, 64 nt, Homo Sapiens; identical to SEQ ID NO: 373635

SEQ ID NO: 522927 - RNA, 64 nt, Homo Sapiens; identical to SEQ ID NO: 373636

SEQ ID NO: 522928 - RNA, 64 nt, Homo Sapiens; identical to SEQ ID NO: 373637

SEQ ID NO: 522929 - RNA, 64 nt, Homo Sapiens; identical to SEQ ID NO: 373638

SEQ ID NO: 522930 - RNA, 64 nt, Homo Sapiens; identical to SEQ ID NO: 373639

SEQ ID NO: 522931 - RNA, 64 nt, Homo Sapiens; identical to SEQ ID NO: 373640

SEQ ID NO: 522932 - RNA, 64 nt, Homo Sapiens; identical to SEQ ID NO: 373641

SEQ ID NO: 522933 - RNA, 64 nt, Homo Sapiens; identical to SEQ ID NO: 373642

SEQ ID NO: 522934 - RNA, 64 nt, Homo Sapiens; identical to SEQ ID NO: 373643

SEQ ID NO: 522935 - RNA, 64 nt, Homo Sapiens; identical to SEQ ID NO: 373644

SEQ ID NO: 522936 - RNA, 64 nt, Homo Sapiens; identical to SEQ ID NO: 373645

SEQ ID NO: 522937 - RNA, 64 nt, Homo Sapiens; identical to SEQ ID NO: 373646

SEQ ID NO: 522938 - RNA, 64 nt, Homo Sapiens; identical to SEQ ID NO: 373647

SEQ ID NO: 522939 - RNA, 64 nt, Homo Sapiens; identical to SEQ ID NO: 373648

SEQ ID NO: 522940 - RNA, 64 nt, Homo Sapiens; identical to SEQ ID NO: 373649

SEQ ID NO: 522941 - RNA, 64 nt, Homo Sapiens; identical to SEQ ID NO: 373650

SEQ ID NO: 522942 - RNA, 64 nt, Homo Sapiens; identical to SEQ ID NO: 373651

SEQ ID NO: 522943 - RNA, 64 nt, Homo Sapiens; identical to SEQ ID NO: 373652

SEQ ID NO: 522944 - RNA, 64 nt, Homo Sapiens; identical to SEQ ID NO: 373653

SEQ ID NO: 522945 - RNA, 64 nt, Homo Sapiens; identical to SEQ ID NO: 373654

SEQ ID NO: 522946 - RNA, 64 nt, Homo Sapiens; identical to SEQ ID NO: 373655

SEQ ID NO: 522947 - RNA, 64 nt, Homo Sapiens; identical to SEQ ID NO: 373656

SEQ ID NO: 522948 - RNA, 64 nt, Homo Sapiens; identical to SEQ ID NO: 373657

SEQ ID NO: 522949 - RNA, 64 nt, Homo Sapiens; identical to SEQ ID NO: 373658

SEQ ID NO: 522950 - RNA, 64 nt, Homo Sapiens; identical to SEQ ID NO: 373659

SEQ ID NO: 522951 - RNA, 64 nt, Homo Sapiens; identical to SEQ ID NO: 373660

SEQ ID NO: 522952 - RNA, 64 nt, Homo Sapiens; identical to SEQ ID NO: 373661

SEQ ID NO: 522953 - RNA, 63 nt, Homo Sapiens
gauggucauguacacaaagacauucgugaugcuuagaaccaaggaauuaaagcagagagaagc

SEQ ID NO: 522954 - RNA, 63 nt, Homo Sapiens
uucaaacauuggggccuucuucauagccaggauuagaaccacugcagacauguuuacuaauga

SEQ ID NO: 522955 - RNA, 63 nt, Homo Sapiens
ggucuguaacaaaaguacuucugggucuaggacuagaaccaguguggcuacuguauugacauu

SEQ ID NO: 522956 - RNA, 63 nt, Homo Sapiens
caagauucaccuguguuuugugcuucacugucuuagaaccaaguauuuaaauacuggggaaau

SEQ ID NO: 522957 - RNA, 63 nt, Homo Sapiens
uugaauuuccaaaauagucaguaaaggaucuaauagaaccagaauuauuugggugaauucugc

SEQ ID NO: 522958 - RNA, 63 nt, Homo Sapiens
gguauuuugguguucacuuacgaagcauacaacuagaaccauauccaagcagacucuggguug

SEQ ID NO: 522959 - RNA, 63 nt, Homo Sapiens
caccuguccuuuccauagcccuuuuuggaccuuuagaaccacagaugauaggaccagcccaau

SEQ ID NO: 522960 - RNA, 63 nt, Homo Sapiens
cuuuucaguuacagaguccaguggaccauuuuguagaaccaugcagcucccugcggaaggugg

SEQ ID NO: 522961 - RNA, 64 nt, Homo Sapiens; identical to SEQ ID NO: 348295

SEQ ID NO: 522962 - RNA, 64 nt, Homo Sapiens; identical to SEQ ID NO: 348296

SEQ ID NO: 522963 - RNA, 64 nt, Homo Sapiens; identical to SEQ ID NO: 348297

SEQ ID NO: 522964 - RNA, 64 nt, Homo Sapiens; identical to SEQ ID NO: 348298

SEQ ID NO: 522965 - RNA, 64 nt, Homo Sapiens; identical to SEQ ID NO: 348299

SEQ ID NO: 522966 - RNA, 64 nt, Homo Sapiens; identical to SEQ ID NO: 348300

SEQ ID NO: 522967 - RNA, 64 nt, Homo Sapiens; identical to SEQ ID NO: 348301

SEQ ID NO: 522968 - RNA, 64 nt, Homo Sapiens; identical to SEQ ID NO: 348302

SEQ ID NO: 522969 - RNA, 64 nt, Homo Sapiens; identical to SEQ ID NO: 348303

SEQ ID NO: 522970 - RNA, 64 nt, Homo Sapiens; identical to SEQ ID NO: 348304

SEQ ID NO: 522971 - RNA, 64 nt, Homo Sapiens; identical to SEQ ID NO: 348305

SEQ ID NO: 522972 - RNA, 64 nt, Homo Sapiens; identical to SEQ ID NO: 348306

SEQ ID NO: 522973 - RNA, 64 nt, Homo Sapiens; identical to SEQ ID NO: 348307

SEQ ID NO: 522974 - RNA, 64 nt, Homo Sapiens; identical to SEQ ID NO: 348308

SEQ ID NO: 522975 - RNA, 64 nt, Homo Sapiens; identical to SEQ ID NO: 348309

SEQ ID NO: 522976 - RNA, 64 nt, Homo Sapiens; identical to SEQ ID NO: 348310

SEQ ID NO: 522977 - RNA, 64 nt, Homo Sapiens; identical to SEQ ID NO: 348311

SEQ ID NO: 522978 - RNA, 64 nt, Homo Sapiens; identical to SEQ ID NO: 348312

SEQ ID NO: 522979 - RNA, 64 nt, Homo Sapiens; identical to SEQ ID NO: 348313

SEQ ID NO: 522980 - RNA, 64 nt, Homo Sapiens; identical to SEQ ID NO: 348314

SEQ ID NO: 522981 - RNA, 64 nt, Homo Sapiens; identical to SEQ ID NO: 348315

SEQ ID NO: 522982 - RNA, 64 nt, Homo Sapiens; identical to SEQ ID NO: 348316

SEQ ID NO: 522983 - RNA, 64 nt, Homo Sapiens; identical to SEQ ID NO: 348317

SEQ ID NO: 522984 - RNA, 64 nt, Homo Sapiens; identical to SEQ ID NO: 348318

SEQ ID NO: 522985 - RNA, 64 nt, Homo Sapiens; identical to SEQ ID NO: 348319

SEQ ID NO: 522986 - RNA, 64 nt, Homo Sapiens; identical to SEQ ID NO: 348320

SEQ ID NO: 522987 - RNA, 64 nt, Homo Sapiens; identical to SEQ ID NO: 348321

SEQ ID NO: 522988 - RNA, 64 nt, Homo Sapiens; identical to SEQ ID NO: 348322

SEQ ID NO: 522989 - RNA, 64 nt, Homo Sapiens; identical to SEQ ID NO: 348323

SEQ ID NO: 522990 - RNA, 64 nt, Homo Sapiens; identical to SEQ ID NO: 348324

SEQ ID NO: 522991 - RNA, 64 nt, Homo Sapiens; identical to SEQ ID NO: 348325

SEQ ID NO: 522992 - RNA, 64 nt, Homo Sapiens; identical to SEQ ID NO: 348326

SEQ ID NO: 522993 - RNA, 64 nt, Homo Sapiens; identical to SEQ ID NO: 348327

SEQ ID NO: 522994 - RNA, 64 nt, Homo Sapiens; identical to SEQ ID NO: 348328

SEQ ID NO: 522995 - RNA, 50 nt, Homo Sapiens; identical to SEQ ID NO: 348329

SEQ ID NO: 522996 - RNA, 64 nt, Homo Sapiens; identical to SEQ ID NO: 348330

SEQ ID NO: 522997 - RNA, 64 nt, Homo Sapiens; identical to SEQ ID NO: 348331

SEQ ID NO: 522998 - RNA, 64 nt, Homo Sapiens; identical to SEQ ID NO: 348332

SEQ ID NO: 522999 - RNA, 64 nt, Homo Sapiens; identical to SEQ ID NO: 348333

SEQ ID NO: 523000 - RNA, 64 nt, Homo Sapiens; identical to SEQ ID NO: 348334

SEQ ID NO: 523001 - RNA, 64 nt, Homo Sapiens; identical to SEQ ID NO: 348335

SEQ ID NO: 523002 - RNA, 64 nt, Homo Sapiens
auguaauaaauagucugcugauucuagaguagacaaucuggacucacagcuauucauaaccuau

SEQ ID NO: 523003 - RNA, 64 nt, Homo Sapiens
auuuucuauaggauaauugcuggcagaauauaauaaucuggacugucaaguaugaauaaaggug

SEQ ID NO: 523004 - RNA, 64 nt, Homo Sapiens
gggcauuauuaauaauuaucuuguaaugaacuuaaaucuggacuguuccaggcaaaccagacuu

SEQ ID NO: 523005 - RNA, 64 nt, Homo Sapiens
ugcuguacaaaggcaacagcaacuuaaaaaagaaaaucuggacaauagauguggacuccaaggg

SEQ ID NO: 523006 - RNA, 64 nt, Homo Sapiens
gguuauucccugcaccucgaggccgcugcgggccaaucuggagugaaacacggggaccugaagg

SEQ ID NO: 523007 - RNA, 64 nt, Homo Sapiens
ugcucuggugugggaaugcaggccuaaugacagaaaucuggagaagccagaaauacagauuugu

SEQ ID NO: 523008 - RNA, 64 nt, Homo Sapiens
uauuauaaaggagaaagaagauacaagguggggaaaucuggaaaaagauuucagacauuaggcu

SEQ ID NO: 523009 - RNA, 64 nt, Homo Sapiens
auuauuuugagaggugggugauaugugagagagaaaucuggaaccuucuucuggguagauacag

SEQ ID NO: 523010 - RNA, 64 nt, Homo Sapiens
uuuuuauuauuuaugccacgucaguggggcaagaaaucuggagugagugaagaaagcuaaguug

SEQ ID NO: 523011 - RNA, 64 nt, Homo Sapiens
uggaaucaggaagaaaagcuauguucauacucuaaaucuggauauuaaaauuggaagagacuuc

SEQ ID NO: 523012 - RNA, 64 nt, Homo Sapiens
augcaacauuguccuuaauuccuaauagcuaauuaaucuggaauauguuuauaucugcaaaaaa

SEQ ID NO: 523013 - RNA, 64 nt, Homo Sapiens
cguuugaguucacaagagucgguucuugaccgugaaucuggagcuaguuaugugaagucaccaa

SEQ ID NO: 523014 - RNA, 64 nt, Homo Sapiens
uaacuuuagccaguggaauugcagggcaggaaaaaaucuggaaugcaaaagcuaagccuggauu

SEQ ID NO: 523015 - RNA, 64 nt, Homo Sapiens
ugcuugcaaaggugccaggcuuggccguuccucuaaucuggacugcaaaaggucagccuugggg

SEQ ID NO: 523016 - RNA, 64 nt, Homo Sapiens
cuagaagcuggaggacuagaaccuggagggcuggaaucuggagagcuagaaccuggagggcuag

SEQ ID NO: 523017 - RNA, 64 nt, Homo Sapiens
cuagaaccuggagggcuagaaccuggagggcuagaaucuggagagcuagaaccuggagggcuag

SEQ ID NO: 523018 - RNA, 64 nt, Homo Sapiens
cuagaaucuggagagcuagaaccuggagggcuagaaucuggagagcuagaaccuggagggcuag

SEQ ID NO: 523019 - RNA, 64 nt, Homo Sapiens
uagaaccuagaagggcuagaaccuggagggcuggaaucuggagagcuagaaccuggagggcuag

SEQ ID NO: 523020 - RNA, 64 nt, Homo Sapiens; identical to SEQ ID NO: 523019

SEQ ID NO: 523021 - RNA, 63 nt, Homo Sapiens
gaauuuugauugccuuuaaaguuacuauucuguaucauugauucaucaagaaaaccuagaucu

SEQ ID NO: 523022 - RNA, 63 nt, Homo Sapiens
gaaaaccuagaucugcacucaccucacuguucaaucauugagugguaaaggacagaaguauuu

SEQ ID NO: 523023 - RNA, 63 nt, Homo Sapiens
uuauaauuggugcuauuugaucauuuuaugaauaucauugauuauuucuaugauccuuuuuug

SEQ ID NO: 523024 - RNA, 63 nt, Homo Sapiens
uauauucuuauuggaaauguuggcuucauuucaaucauugaagacccuggugguauuuuauuu

SEQ ID NO: 523025 - RNA, 63 nt, Homo Sapiens
cgcucaugauuugauagauugcuagucauccauaucauugaaguugcuaaaauaccccucaca

SEQ ID NO: 523026 - RNA, 63 nt, Homo Sapiens
cauuggaucuuuaaauaggaguuauuguuuuuaaucauugaauuauucugccaaaccaaucau

SEQ ID NO: 523027 - RNA, 63 nt, Homo Sapiens
uuuguagcuuucagagugucucauugagucuagaucauugaaccaacacuuaaccaaaugucc

SEQ ID NO: 523028 - RNA, 63 nt, Homo Sapiens
uuucauauaccucuaacccccgguacucauugaaucauugaugagguaucucaauugagauuu

SEQ ID NO: 523029 - RNA, 63 nt, Homo Sapiens
aggugaaggauuauuucuauugauugggugaagaucauugauucauugggauggaaggaucau

SEQ ID NO: 523030 - RNA, 63 nt, Homo Sapiens
gggugaagaucauugauuaguugggauggaaggaucauugauugugcuuucuuggaaagauca

SEQ ID NO: 523031 - RNA, 64 nt, Homo Sapiens; identical to SEQ ID NO: 285262

SEQ ID NO: 523032 - RNA, 64 nt, Homo Sapiens; identical to SEQ ID NO: 285263

SEQ ID NO: 523033 - RNA, 64 nt, Homo Sapiens; identical to SEQ ID NO: 285264

SEQ ID NO: 523034 - RNA, 64 nt, Homo Sapiens; identical to SEQ ID NO: 285265

SEQ ID NO: 523035 - RNA, 64 nt, Homo Sapiens; identical to SEQ ID NO: 285266

SEQ ID NO: 523036 - RNA, 64 nt, Homo Sapiens; identical to SEQ ID NO: 285267

SEQ ID NO: 523037 - RNA, 64 nt, Homo Sapiens; identical to SEQ ID NO: 285268

SEQ ID NO: 523038 - RNA, 64 nt, Homo Sapiens; identical to SEQ ID NO: 285269

SEQ ID NO: 523039 - RNA, 64 nt, Homo Sapiens; identical to SEQ ID NO: 285270

SEQ ID NO: 523040 - RNA, 64 nt, Homo Sapiens; identical to SEQ ID NO: 285271

SEQ ID NO: 523041 - RNA, 64 nt, Homo Sapiens; identical to SEQ ID NO: 285272

SEQ ID NO: 523042 - RNA, 64 nt, Homo Sapiens; identical to SEQ ID NO: 285273

SEQ ID NO: 523043 - RNA, 64 nt, Homo Sapiens; identical to SEQ ID NO: 285274

SEQ ID NO: 523044 - RNA, 64 nt, Homo Sapiens; identical to SEQ ID NO: 285275

SEQ ID NO: 523045 - RNA, 64 nt, Homo Sapiens; identical to SEQ ID NO: 285276

SEQ ID NO: 523046 - RNA, 64 nt, Homo Sapiens; identical to SEQ ID NO: 285277

SEQ ID NO: 523047 - RNA, 64 nt, Homo Sapiens; identical to SEQ ID NO: 285278

SEQ ID NO: 523048 - RNA, 64 nt, Homo Sapiens; identical to SEQ ID NO: 285279

SEQ ID NO: 523049 - RNA, 64 nt, Homo Sapiens; identical to SEQ ID NO: 285280

SEQ ID NO: 523050 - RNA, 64 nt, Homo Sapiens; identical to SEQ ID NO: 285281

SEQ ID NO: 523051 - RNA, 64 nt, Homo Sapiens; identical to SEQ ID NO: 285282

SEQ ID NO: 523052 - RNA, 64 nt, Homo Sapiens; identical to SEQ ID NO: 285283

SEQ ID NO: 523053 - RNA, 64 nt, Homo Sapiens; identical to SEQ ID NO: 285284

SEQ ID NO: 523054 - RNA, 64 nt, Homo Sapiens; identical to SEQ ID NO: 285285

SEQ ID NO: 523055 - RNA, 64 nt, Homo Sapiens; identical to SEQ ID NO: 285286

SEQ ID NO: 523056 - RNA, 64 nt, Homo Sapiens; identical to SEQ ID NO: 285287

SEQ ID NO: 523057 - RNA, 64 nt, Homo Sapiens; identical to SEQ ID NO: 285288

SEQ ID NO: 523058 - RNA, 64 nt, Homo Sapiens; identical to SEQ ID NO: 285289

SEQ ID NO: 523059 - RNA, 64 nt, Homo Sapiens; identical to SEQ ID NO: 285290

SEQ ID NO: 523060 - RNA, 61 nt, Homo Sapiens; identical to SEQ ID NO: 285291

SEQ ID NO: 523061 - RNA, 64 nt, Homo Sapiens; identical to SEQ ID NO: 285292

SEQ ID NO: 523062 - RNA, 64 nt, Homo Sapiens; identical to SEQ ID NO: 285293

SEQ ID NO: 523063 - RNA, 64 nt, Homo Sapiens; identical to SEQ ID NO: 285294

SEQ ID NO: 523064 - RNA, 64 nt, Homo Sapiens; identical to SEQ ID NO: 285295

SEQ ID NO: 523065 - RNA, 64 nt, Homo Sapiens; identical to SEQ ID NO: 285296

SEQ ID NO: 523066 - RNA, 64 nt, Homo Sapiens; identical to SEQ ID NO: 285297

SEQ ID NO: 523067 - RNA, 64 nt, Homo Sapiens; identical to SEQ ID NO: 285298

SEQ ID NO: 523068 - RNA, 64 nt, Homo Sapiens; identical to SEQ ID NO: 285299

SEQ ID NO: 523069 - RNA, 64 nt, Homo Sapiens; identical to SEQ ID NO: 285300

SEQ ID NO: 523070 - RNA, 64 nt, Homo Sapiens
uuuuagagaauaagauuguucuuaagaagucuuagcugucuaaucauuuugaaggcugucuaca

SEQ ID NO: 523071 - RNA, 64 nt, Homo Sapiens
cuuaagaagucuuagcugucccuccauuuugaaggcugucuacauuuuuaccaagcauuuucag

SEQ ID NO: 523072 - RNA, 64 nt, Homo Sapiens; identical to SEQ ID NO: 109963

SEQ ID NO: 523073 - RNA, 64 nt, Homo Sapiens; identical to SEQ ID NO: 109964

SEQ ID NO: 523074 - RNA, 64 nt, Homo Sapiens; identical to SEQ ID NO: 109965

SEQ ID NO: 523075 - RNA, 64 nt, Homo Sapiens; identical to SEQ ID NO: 109966

SEQ ID NO: 523076 - RNA, 64 nt, Homo Sapiens; identical to SEQ ID NO: 109967

SEQ ID NO: 523077 - RNA, 64 nt, Homo Sapiens; identical to SEQ ID NO: 109968

SEQ ID NO: 523078 - RNA, 64 nt, Homo Sapiens; identical to SEQ ID NO: 109969

SEQ ID NO: 523079 - RNA, 64 nt, Homo Sapiens; identical to SEQ ID NO: 109970

SEQ ID NO: 523080 - RNA, 64 nt, Homo Sapiens; identical to SEQ ID NO: 109971

SEQ ID NO: 523081 - RNA, 64 nt, Homo Sapiens; identical to SEQ ID NO: 109972

SEQ ID NO: 523082 - RNA, 64 nt, Homo Sapiens; identical to SEQ ID NO: 109973

SEQ ID NO: 523083 - RNA, 64 nt, Homo Sapiens; identical to SEQ ID NO: 109974

SEQ ID NO: 523084 - RNA, 64 nt, Homo Sapiens; identical to SEQ ID NO: 109975

SEQ ID NO: 523085 - RNA, 64 nt, Homo Sapiens; identical to SEQ ID NO: 109976

SEQ ID NO: 523086 - RNA, 64 nt, Homo Sapiens; identical to SEQ ID NO: 109977

SEQ ID NO: 523087 - RNA, 64 nt, Homo Sapiens; identical to SEQ ID NO: 109978

SEQ ID NO: 523088 - RNA, 64 nt, Homo Sapiens; identical to SEQ ID NO: 109979

SEQ ID NO: 523089 - RNA, 64 nt, Homo Sapiens; identical to SEQ ID NO: 109980

SEQ ID NO: 523090 - RNA, 64 nt, Homo Sapiens; identical to SEQ ID NO: 109981

SEQ ID NO: 523091 - RNA, 64 nt, Homo Sapiens; identical to SEQ ID NO: 109982

SEQ ID NO: 523092 - RNA, 64 nt, Homo Sapiens; identical to SEQ ID NO: 109983

SEQ ID NO: 523093 - RNA, 64 nt, Homo Sapiens; identical to SEQ ID NO: 109984

SEQ ID NO: 523094 - RNA, 64 nt, Homo Sapiens; identical to SEQ ID NO: 109985

SEQ ID NO: 523095 - RNA, 64 nt, Homo Sapiens; identical to SEQ ID NO: 109986

SEQ ID NO: 523096 - RNA, 64 nt, Homo Sapiens; identical to SEQ ID NO: 109987

SEQ ID NO: 523097 - RNA, 64 nt, Homo Sapiens; identical to SEQ ID NO: 109988

SEQ ID NO: 523098 - RNA, 64 nt, Homo Sapiens; identical to SEQ ID NO: 109989

SEQ ID NO: 523099 - RNA, 64 nt, Homo Sapiens; identical to SEQ ID NO: 109990

SEQ ID NO: 523100 - RNA, 64 nt, Homo Sapiens; identical to SEQ ID NO: 109991

SEQ ID NO: 523101 - RNA, 52 nt, Homo Sapiens; identical to SEQ ID NO: 109992

SEQ ID NO: 523102 - RNA, 64 nt, Homo Sapiens; identical to SEQ ID NO: 109993

SEQ ID NO: 523103 - RNA, 64 nt, Homo Sapiens; identical to SEQ ID NO: 109994

SEQ ID NO: 523104 - RNA, 64 nt, Homo Sapiens; identical to SEQ ID NO: 109995

SEQ ID NO: 523105 - RNA, 64 nt, Homo Sapiens; identical to SEQ ID NO: 109996

SEQ ID NO: 523106 - RNA, 64 nt, Homo Sapiens; identical to SEQ ID NO: 109997

SEQ ID NO: 523107 - RNA, 64 nt, Homo Sapiens; identical to SEQ ID NO: 109998

SEQ ID NO: 523108 - RNA, 64 nt, Homo Sapiens; identical to SEQ ID NO: 109999

SEQ ID NO: 523109 - RNA, 64 nt, Homo Sapiens; identical to SEQ ID NO: 110000

SEQ ID NO: 523110 - RNA, 63 nt, Homo Sapiens
uuguaaaggccauucauuuguucaaagaauuguggguggaagugucagaguuacucaucccuu

SEQ ID NO: 523111 - RNA, 63 nt, Homo Sapiens
uggggcccuggcaucacacauaaaguaaaacuuggguggaaccgggaaacuugggaauagcua

SEQ ID NO: 523112 - RNA, 63 nt, Homo Sapiens
uuucacuagauuuggaaagaagaaagaggauaaggguggaaaggcugagcagaaagguacucu

SEQ ID NO: 523113 - RNA, 63 nt, Homo Sapiens
uccacugguuccagcugacaguggccguccuacggguggaagcacugaccguauccagaaguu

SEQ ID NO: 523114 - RNA, 63 nt, Homo Sapiens
gaauaugaauauuguggagucuguccagauaccggguggaagacugguuuugaucaguuuaag

SEQ ID NO: 523115 - RNA, 63 nt, Homo Sapiens
uuuggacaauaaagaaucuaaaauggguggggaggguggaagaaaugguggacuguaucucuc

SEQ ID NO: 523116 - RNA, 63 nt, Homo Sapiens
gggugcuugggugaucucugcuucauuagucauggguggaagaaaaaccacaccccccgcacc

SEQ ID NO: 523117 - RNA, 63 nt, Homo Sapiens
aaauuggggguuuaaacauuaaguaggagcuugggguggaagagggacagccggcugggccac

SEQ ID NO: 523118 - RNA, 63 nt, Homo Sapiens
aacccagagccacccgcuaugagcacaggccggggguggaaggcccaguagagcugcccuucc

SEQ ID NO: 523119 - RNA, 63 nt, Homo Sapiens
gggaauucauaugaucugccagagccucuccagggguggaauacauguccuggacuaagccaa

SEQ ID NO: 523120 - RNA, 63 nt, Homo Sapiens
gcacuggcuucagcaggcguuuuggucacugccggguggaauauguccccauucucauggccc

SEQ ID NO: 523121 - RNA, 63 nt, Homo Sapiens
gggucuccucuccccagccacugcaggguugugggguggaacaagaaggugggcuagggccuc

SEQ ID NO: 523122 - RNA, 63 nt, Homo Sapiens
agcuugccucuuugagaaaccaccagccgggcaggguggaaggcugcaugucgggcuuaaggu

SEQ ID NO: 523123 - RNA, 63 nt, Homo Sapiens
aucccagugaguaaauuauuagagaaggggccaggguggaacagggcaauugucagucuuuuu

SEQ ID NO: 523124 - RNA, 63 nt, Homo Sapiens
agcagggcucuggagggauuaucccaaggcuggggguggaaggcugggaccgcggugggugga

SEQ ID NO: 523125 - RNA, 63 nt, Homo Sapiens
ccaaggcuggggguggaaggcugggaccgcgguggguggaauccaggaggucuucagaguuuc

SEQ ID NO: 523126 - RNA, 64 nt, Homo Sapiens
ucucuuacauccuucccaaaaaacccuaaaucugagucaguaauccuauuucucaauagucuuu

SEQ ID NO: 523127 - RNA, 64 nt, Homo Sapiens
ucucuaaaaauccuucccaaaagcccuaaaucugagucaguaauccuauuucucaauagucuuu

SEQ ID NO: 523128 - RNA, 64 nt, Homo Sapiens; identical to SEQ ID NO: 114632

SEQ ID NO: 523129 - RNA, 64 nt, Homo Sapiens; identical to SEQ ID NO: 114633

SEQ ID NO: 523130 - RNA, 64 nt, Homo Sapiens; identical to SEQ ID NO: 114632

SEQ ID NO: 523131 - RNA, 64 nt, Homo Sapiens; identical to SEQ ID NO: 114633

SEQ ID NO: 523132 - RNA, 64 nt, Homo Sapiens; identical to SEQ ID NO: 114636

SEQ ID NO: 523133 - RNA, 64 nt, Homo Sapiens; identical to SEQ ID NO: 114637

SEQ ID NO: 523134 - RNA, 64 nt, Homo Sapiens; identical to SEQ ID NO: 114638

SEQ ID NO: 523135 - RNA, 64 nt, Homo Sapiens; identical to SEQ ID NO: 114639

SEQ ID NO: 523136 - RNA, 64 nt, Homo Sapiens; identical to SEQ ID NO: 114640

SEQ ID NO: 523137 - RNA, 64 nt, Homo Sapiens; identical to SEQ ID NO: 114641

SEQ ID NO: 523138 - RNA, 64 nt, Homo Sapiens; identical to SEQ ID NO: 114642

SEQ ID NO: 523139 - RNA, 64 nt, Homo Sapiens; identical to SEQ ID NO: 114643

SEQ ID NO: 523140 - RNA, 64 nt, Homo Sapiens; identical to SEQ ID NO: 114644

SEQ ID NO: 523141 - RNA, 64 nt, Homo Sapiens; identical to SEQ ID NO: 114645

SEQ ID NO: 523142 - RNA, 64 nt, Homo Sapiens; identical to SEQ ID NO: 114646

SEQ ID NO: 523143 - RNA, 64 nt, Homo Sapiens; identical to SEQ ID NO: 114647

SEQ ID NO: 523144 - RNA, 64 nt, Homo Sapiens; identical to SEQ ID NO: 114648

SEQ ID NO: 523145 - RNA, 64 nt, Homo Sapiens; identical to SEQ ID NO: 114649

SEQ ID NO: 523146 - RNA, 64 nt, Homo Sapiens; identical to SEQ ID NO: 114650

SEQ ID NO: 523147 - RNA, 64 nt, Homo Sapiens; identical to SEQ ID NO: 114651

SEQ ID NO: 523148 - RNA, 64 nt, Homo Sapiens; identical to SEQ ID NO: 114652

SEQ ID NO: 523149 - RNA, 64 nt, Homo Sapiens; identical to SEQ ID NO: 114653

SEQ ID NO: 523150 - RNA, 64 nt, Homo Sapiens; identical to SEQ ID NO: 114654

SEQ ID NO: 523151 - RNA, 64 nt, Homo Sapiens; identical to SEQ ID NO: 114655

SEQ ID NO: 523152 - RNA, 64 nt, Homo Sapiens; identical to SEQ ID NO: 114656

SEQ ID NO: 523153 - RNA, 64 nt, Homo Sapiens; identical to SEQ ID NO: 114657

SEQ ID NO: 523154 - RNA, 64 nt, Homo Sapiens; identical to SEQ ID NO: 114658

SEQ ID NO: 523155 - RNA, 64 nt, Homo Sapiens; identical to SEQ ID NO: 114659

SEQ ID NO: 523156 - RNA, 64 nt, Homo Sapiens; identical to SEQ ID NO: 114660

SEQ ID NO: 523157 - RNA, 64 nt, Homo Sapiens; identical to SEQ ID NO: 114661

SEQ ID NO: 523158 - RNA, 64 nt, Homo Sapiens; identical to SEQ ID NO: 114662

SEQ ID NO: 523159 - RNA, 64 nt, Homo Sapiens; identical to SEQ ID NO: 114663

SEQ ID NO: 523160 - RNA, 64 nt, Homo Sapiens; identical to SEQ ID NO: 114664

SEQ ID NO: 523161 - RNA, 64 nt, Homo Sapiens; identical to SEQ ID NO: 114665

SEQ ID NO: 523162 - RNA, 64 nt, Homo Sapiens; identical to SEQ ID NO: 114666

SEQ ID NO: 523163 - RNA, 64 nt, Homo Sapiens; identical to SEQ ID NO: 114667

SEQ ID NO: 523164 - RNA, 64 nt, Homo Sapiens; identical to SEQ ID NO: 114668

SEQ ID NO: 523165 - RNA, 64 nt, Homo Sapiens; identical to SEQ ID NO: 114669

SEQ ID NO: 523166 - RNA, 64 nt, Homo Sapiens; identical to SEQ ID NO: 114670

SEQ ID NO: 523167 - RNA, 64 nt, Homo Sapiens; identical to SEQ ID NO: 114671

SEQ ID NO: 523168 - RNA, 64 nt, Homo Sapiens; identical to SEQ ID NO: 114672

SEQ ID NO: 523169 - RNA, 64 nt, Homo Sapiens; identical to SEQ ID NO: 114673

SEQ ID NO: 523170 - RNA, 64 nt, Homo Sapiens; identical to SEQ ID NO: 114674

SEQ ID NO: 523171 - RNA, 64 nt, Homo Sapiens; identical to SEQ ID NO: 114675

SEQ ID NO: 523172 - RNA, 64 nt, Homo Sapiens; identical to SEQ ID NO: 114676

SEQ ID NO: 523173 - RNA, 64 nt, Homo Sapiens; identical to SEQ ID NO: 114677

SEQ ID NO: 523174 - RNA, 64 nt, Homo Sapiens; identical to SEQ ID NO: 114678

SEQ ID NO: 523175 - RNA, 64 nt, Homo Sapiens; identical to SEQ ID NO: 114679

SEQ ID NO: 523176 - RNA, 64 nt, Homo Sapiens; identical to SEQ ID NO: 114680

SEQ ID NO: 523177 - RNA, 64 nt, Homo Sapiens; identical to SEQ ID NO: 114681

SEQ ID NO: 523178 - RNA, 64 nt, Homo Sapiens; identical to SEQ ID NO: 114682

SEQ ID NO: 523179 - RNA, 64 nt, Homo Sapiens; identical to SEQ ID NO: 114683

SEQ ID NO: 523180 - RNA, 64 nt, Homo Sapiens; identical to SEQ ID NO: 114684

SEQ ID NO: 523181 - RNA, 64 nt, Homo Sapiens; identical to SEQ ID NO: 114685

SEQ ID NO: 523182 - RNA, 64 nt, Homo Sapiens; identical to SEQ ID NO: 114686

SEQ ID NO: 523183 - RNA, 64 nt, Homo Sapiens; identical to SEQ ID NO: 114687

SEQ ID NO: 523184 - RNA, 64 nt, Homo Sapiens; identical to SEQ ID NO: 114688

SEQ ID NO: 523185 - RNA, 64 nt, Homo Sapiens; identical to SEQ ID NO: 114689

SEQ ID NO: 523186 - RNA, 64 nt, Homo Sapiens; identical to SEQ ID NO: 114690

SEQ ID NO: 523187 - RNA, 64 nt, Homo Sapiens; identical to SEQ ID NO: 114691

SEQ ID NO: 523188 - RNA, 64 nt, Homo Sapiens; identical to SEQ ID NO: 196427

SEQ ID NO: 523189 - RNA, 64 nt, Homo Sapiens; identical to SEQ ID NO: 196428

SEQ ID NO: 523190 - RNA, 64 nt, Homo Sapiens; identical to SEQ ID NO: 196429

SEQ ID NO: 523191 - RNA, 64 nt, Homo Sapiens; identical to SEQ ID NO: 196430

SEQ ID NO: 523192 - RNA, 64 nt, Homo Sapiens; identical to SEQ ID NO: 196431

SEQ ID NO: 523193 - RNA, 64 nt, Homo Sapiens; identical to SEQ ID NO: 196432

SEQ ID NO: 523194 - RNA, 64 nt, Homo Sapiens; identical to SEQ ID NO: 196433

SEQ ID NO: 523195 - RNA, 64 nt, Homo Sapiens; identical to SEQ ID NO: 196434

SEQ ID NO: 523196 - RNA, 64 nt, Homo Sapiens; identical to SEQ ID NO: 196435

SEQ ID NO: 523197 - RNA, 64 nt, Homo Sapiens; identical to SEQ ID NO: 196436

SEQ ID NO: 523198 - RNA, 64 nt, Homo Sapiens; identical to SEQ ID NO: 196437

SEQ ID NO: 523199 - RNA, 64 nt, Homo Sapiens; identical to SEQ ID NO: 196438

SEQ ID NO: 523200 - RNA, 64 nt, Homo Sapiens; identical to SEQ ID NO: 196439

SEQ ID NO: 523201 - RNA, 64 nt, Homo Sapiens; identical to SEQ ID NO: 196440

SEQ ID NO: 523202 - RNA, 64 nt, Homo Sapiens; identical to SEQ ID NO: 196441

SEQ ID NO: 523203 - RNA, 57 nt, Homo Sapiens; identical to SEQ ID NO: 196442

SEQ ID NO: 523204 - RNA, 64 nt, Homo Sapiens; identical to SEQ ID NO: 196443

SEQ ID NO: 523205 - RNA, 64 nt, Homo Sapiens; identical to SEQ ID NO: 196444

SEQ ID NO: 523206 - RNA, 64 nt, Homo Sapiens; identical to SEQ ID NO: 196445

SEQ ID NO: 523207 - RNA, 64 nt, Homo Sapiens; identical to SEQ ID NO: 196446

SEQ ID NO: 523208 - RNA, 64 nt, Homo Sapiens; identical to SEQ ID NO: 196447

SEQ ID NO: 523209 - RNA, 64 nt, Homo Sapiens
ccagagccuuguggcuuguacaguuuugaaacucccguucuauuuuaugaugguugauaauagu

SEQ ID NO: 523210 - RNA, 64 nt, Homo Sapiens
gccguggccuuugccgagacucggaggcggcgccccguucuagggcuguggcccugagacugca

SEQ ID NO: 523211 - RNA, 64 nt, Homo Sapiens
ugccgauggcugccuccggcgggccaacucugcaccguucuagggccugccccgccacgcuccu

SEQ ID NO: 523212 - RNA, 64 nt, Homo Sapiens
gauuuaauaaagucaaacuauaaccacugagaucccguucuauucuggcccuguuaagacggcu

SEQ ID NO: 523213 - RNA, 64 nt, Homo Sapiens
uaauaucaacagaaccuuguagugucuggaauacccguucuauguuuggacuuucaucauaaga

SEQ ID NO: 523214 - RNA, 64 nt, Homo Sapiens
uuuuauaacuugcauuacauguuguaagcaugguccguucuauaccuuuuucuggucauaauga

SEQ ID NO: 523215 - RNA, 64 nt, Homo Sapiens
ccucuugguuuugauacuuuaaaaucuguggcacccguucuacaugaauuaucaauauuuggua

SEQ ID NO: 523216 - RNA, 64 nt, Homo Sapiens
ucugaaacagggugauagcugaacuuggcagguaccguucuaaagacaauuccuuugcauaucu

SEQ ID NO: 523217 - RNA, 64 nt, Homo Sapiens
agucccucuuugccuuggccuccagaugcacaagccguucuaccagugauuccugaggaaguau

SEQ ID NO: 523218 - RNA, 64 nt, Homo Sapiens
auuuuuuuaagcauagacagggggguucuugcugccguucuaaugggccaagggcacagguuac

SEQ ID NO: 523219 - RNA, 64 nt, Homo Sapiens
ucugugugacaguuaacugccauuaauuaauuagccguucuaaaaguuuauuuacaauaucaaa

SEQ ID NO: 523220 - RNA, 64 nt, Homo Sapiens
ggcuugcacucaggagagaaccacccccaagucuccguucuacugccgugaacucauguguugc

SEQ ID NO: 523221 - RNA, 64 nt, Homo Sapiens
uagucauacuuuauauucaauugauauauaauaaccguucuaaccucuuccaggaaaauauuuu

SEQ ID NO: 523222 - RNA, 64 nt, Homo Sapiens
caguuucaaaauuugauucaguuuauguuuuauuccguucuaaaauauuggagaugaggaaaau

SEQ ID NO: 523223 - RNA, 64 nt, Homo Sapiens
gaaagaaaggacagcagucaccuccgacaaugcuccguucuauggaauauugauuaacugcauu

SEQ ID NO: 523224 - RNA, 64 nt, Homo Sapiens
acugccuccccagucaccaagggccccagcuggcccguucuacucaccuaagugccgccugacc

SEQ ID NO: 523225 - RNA, 64 nt, Homo Sapiens
gacugaguagaugaauuauugaaugugagauaauccguucuagagaauaacuaugaaagcuugc

SEQ ID NO: 523226 - RNA, 64 nt, Homo Sapiens
auacuugugaaaucgugcaugaggccccagggcaccguucuagaacaacgucacuucacacagg

SEQ ID NO: 523227 - RNA, 64 nt, Homo Sapiens
aagccacuguuuuauagcaacggggcaguauuaaccguucuagaccaugccaaacgcauucacu

SEQ ID NO: 523228 - RNA, 64 nt, Homo Sapiens
cccagccaugauaauaaagcccagggagaggaacccguucuaucccaguggaagaccccagccc

SEQ ID NO: 523229 - RNA, 64 nt, Homo Sapiens
aggacuuaccauccacaaugcaccacggaagaggccguucuaugaaaaacugacacagacugua

SEQ ID NO: 523230 - RNA, 64 nt, Homo Sapiens
aaaagcaauucugacuguccaggagcuaaucugaccguucuauuguguggaugaccacauaaga

SEQ ID NO: 523231 - RNA, 64 nt, Homo Sapiens
auaacaauacagaggaacuauuauauuacaaaauccguucuaccagcauuuuuuccuguuaacu

SEQ ID NO: 523232 - RNA, 64 nt, Homo Sapiens
auuuucuacccacuucuuaauauugacagcuuccccguucuauuuaauguccaaaaauguuucc

SEQ ID NO: 523233 - RNA, 64 nt, Homo Sapiens
guaagagucuuguuuuuuauucagauugggaaauccguucuauuuugugaauuugggacauaau

SEQ ID NO: 523234 - RNA, 64 nt, Homo Sapiens
caguugcuuccucccaugagccaagguggugucagagggcaacuggaugacucgcaguaccaca

SEQ ID NO: 523235 - RNA, 64 nt, Homo Sapiens
ggaaggaagacaaagaagguaggaacggaauuuugagggcaaagaaaccuguguuuccauggaa

SEQ ID NO: 523236 - RNA, 64 nt, Homo Sapiens
ggagagagcgccuccagucuuauccccuggaguagagggcaagacugguuuuuuagggagaugg

SEQ ID NO: 523237 - RNA, 64 nt, Homo Sapiens
agaaggaaguacccuggggaacccaggcugcuaagagggcaaggccuuggguaagucgcgccug

SEQ ID NO: 523238 - RNA, 64 nt, Homo Sapiens
gcgccggcucauguucccuuuaguuuauuuuugugagggcaaaggggaggaaaugggguucugu

SEQ ID NO: 523239 - RNA, 64 nt, Homo Sapiens
ccuggagaccccuuuuuugcccccagguuccccagagggcaacgccaucaguagcaguguggug

SEQ ID NO: 523240 - RNA, 64 nt, Homo Sapiens
cacagcccaauaguaucacagcaggauuacuccagagggcaaaacaagccuccauuuuccccaa

SEQ ID NO: 523241 - RNA, 64 nt, Homo Sapiens
aucuugugugccccgucccaugacagagagguaggagggcaaacuugacccuuucuugggaagg

SEQ ID NO: 523242 - RNA, 64 nt, Homo Sapiens; identical to SEQ ID NO: 88257

SEQ ID NO: 523243 - RNA, 64 nt, Homo Sapiens; identical to SEQ ID NO: 88258

SEQ ID NO: 523244 - RNA, 64 nt, Homo Sapiens; identical to SEQ ID NO: 88259

SEQ ID NO: 523245 - RNA, 64 nt, Homo Sapiens; identical to SEQ ID NO: 88260

SEQ ID NO: 523246 - RNA, 64 nt, Homo Sapiens; identical to SEQ ID NO: 88261

SEQ ID NO: 523247 - RNA, 64 nt, Homo Sapiens; identical to SEQ ID NO: 88262

SEQ ID NO: 523248 - RNA, 64 nt, Homo Sapiens; identical to SEQ ID NO: 88263

SEQ ID NO: 523249 - RNA, 64 nt, Homo Sapiens; identical to SEQ ID NO: 88264

SEQ ID NO: 523250 - RNA, 64 nt, Homo Sapiens; identical to SEQ ID NO: 88265

SEQ ID NO: 523251 - RNA, 64 nt, Homo Sapiens; identical to SEQ ID NO: 88266

SEQ ID NO: 523252 - RNA, 64 nt, Homo Sapiens; identical to SEQ ID NO: 88267

SEQ ID NO: 523253 - RNA, 64 nt, Homo Sapiens; identical to SEQ ID NO: 88268

SEQ ID NO: 523254 - RNA, 64 nt, Homo Sapiens; identical to SEQ ID NO: 88269

SEQ ID NO: 523255 - RNA, 64 nt, Homo Sapiens; identical to SEQ ID NO: 88270

SEQ ID NO: 523256 - RNA, 64 nt, Homo Sapiens; identical to SEQ ID NO: 88271

SEQ ID NO: 523257 - RNA, 64 nt, Homo Sapiens; identical to SEQ ID NO: 88269

SEQ ID NO: 523258 - RNA, 64 nt, Homo Sapiens; identical to SEQ ID NO: 88273

SEQ ID NO: 523259 - RNA, 64 nt, Homo Sapiens; identical to SEQ ID NO: 88274

SEQ ID NO: 523260 - RNA, 64 nt, Homo Sapiens; identical to SEQ ID NO: 88275

SEQ ID NO: 523261 - RNA, 64 nt, Homo Sapiens; identical to SEQ ID NO: 88276

SEQ ID NO: 523262 - RNA, 64 nt, Homo Sapiens; identical to SEQ ID NO: 88277

SEQ ID NO: 523263 - RNA, 64 nt, Homo Sapiens; identical to SEQ ID NO: 88278

SEQ ID NO: 523264 - RNA, 64 nt, Homo Sapiens; identical to SEQ ID NO: 88279

SEQ ID NO: 523265 - RNA, 64 nt, Homo Sapiens; identical to SEQ ID NO: 88280

SEQ ID NO: 523266 - RNA, 64 nt, Homo Sapiens; identical to SEQ ID NO: 88281

SEQ ID NO: 523267 - RNA, 64 nt, Homo Sapiens; identical to SEQ ID NO: 88282

SEQ ID NO: 523268 - RNA, 64 nt, Homo Sapiens; identical to SEQ ID NO: 88283

SEQ ID NO: 523269 - RNA, 64 nt, Homo Sapiens; identical to SEQ ID NO: 88284

SEQ ID NO: 523270 - RNA, 64 nt, Homo Sapiens; identical to SEQ ID NO: 88285

SEQ ID NO: 523271 - RNA, 64 nt, Homo Sapiens; identical to SEQ ID NO: 88286

SEQ ID NO: 523272 - RNA, 64 nt, Homo Sapiens; identical to SEQ ID NO: 88287

SEQ ID NO: 523273 - RNA, 64 nt, Homo Sapiens; identical to SEQ ID NO: 88288

SEQ ID NO: 523274 - RNA, 64 nt, Homo Sapiens; identical to SEQ ID NO: 88289

SEQ ID NO: 523275 - RNA, 64 nt, Homo Sapiens; identical to SEQ ID NO: 88290

SEQ ID NO: 523276 - RNA, 64 nt, Homo Sapiens; identical to SEQ ID NO: 88291

SEQ ID NO: 523277 - RNA, 64 nt, Homo Sapiens; identical to SEQ ID NO: 88292

SEQ ID NO: 523278 - RNA, 64 nt, Homo Sapiens; identical to SEQ ID NO: 88293

SEQ ID NO: 523279 - RNA, 64 nt, Homo Sapiens; identical to SEQ ID NO: 88294

SEQ ID NO: 523280 - RNA, 64 nt, Homo Sapiens; identical to SEQ ID NO: 88295

SEQ ID NO: 523281 - RNA, 64 nt, Homo Sapiens; identical to SEQ ID NO: 88296

SEQ ID NO: 523282 - RNA, 64 nt, Homo Sapiens; identical to SEQ ID NO: 88297

SEQ ID NO: 523283 - RNA, 64 nt, Homo Sapiens; identical to SEQ ID NO: 88298

SEQ ID NO: 523284 - RNA, 64 nt, Homo Sapiens; identical to SEQ ID NO: 88299

SEQ ID NO: 523285 - RNA, 64 nt, Homo Sapiens; identical to SEQ ID NO: 88300

SEQ ID NO: 523286 - RNA, 64 nt, Homo Sapiens; identical to SEQ ID NO: 88298

SEQ ID NO: 523287 - RNA, 64 nt, Homo Sapiens; identical to SEQ ID NO: 88302

SEQ ID NO: 523288 - RNA, 64 nt, Homo Sapiens; identical to SEQ ID NO: 88300

SEQ ID NO: 523289 - RNA, 64 nt, Homo Sapiens; identical to SEQ ID NO: 88304

SEQ ID NO: 523290 - RNA, 64 nt, Homo Sapiens; identical to SEQ ID NO: 88305

SEQ ID NO: 523291 - RNA, 64 nt, Homo Sapiens; identical to SEQ ID NO: 88306

SEQ ID NO: 523292 - RNA, 64 nt, Homo Sapiens; identical to SEQ ID NO: 88307

SEQ ID NO: 523293 - RNA, 64 nt, Homo Sapiens; identical to SEQ ID NO: 88299

SEQ ID NO: 523294 - RNA, 64 nt, Homo Sapiens; identical to SEQ ID NO: 88309

SEQ ID NO: 523295 - RNA, 64 nt, Homo Sapiens; identical to SEQ ID NO: 88310

SEQ ID NO: 523296 - RNA, 64 nt, Homo Sapiens; identical to SEQ ID NO: 88311

SEQ ID NO: 523297 - RNA, 64 nt, Homo Sapiens; identical to SEQ ID NO: 88312

SEQ ID NO: 523298 - RNA, 64 nt, Homo Sapiens; identical to SEQ ID NO: 88313

SEQ ID NO: 523299 - RNA, 64 nt, Homo Sapiens; identical to SEQ ID NO: 88314

SEQ ID NO: 523300 - RNA, 64 nt, Homo Sapiens; identical to SEQ ID NO: 88315

SEQ ID NO: 523301 - RNA, 64 nt, Homo Sapiens; identical to SEQ ID NO: 88316

SEQ ID NO: 523302 - RNA, 64 nt, Homo Sapiens; identical to SEQ ID NO: 88317

SEQ ID NO: 523303 - RNA, 64 nt, Homo Sapiens; identical to SEQ ID NO: 88318

SEQ ID NO: 523304 - RNA, 64 nt, Homo Sapiens; identical to SEQ ID NO: 88319

SEQ ID NO: 523305 - RNA, 64 nt, Homo Sapiens; identical to SEQ ID NO: 88320

SEQ ID NO: 523306 - RNA, 64 nt, Homo Sapiens; identical to SEQ ID NO: 88321

SEQ ID NO: 523307 - RNA, 64 nt, Homo Sapiens; identical to SEQ ID NO: 88322

SEQ ID NO: 523308 - RNA, 64 nt, Homo Sapiens; identical to SEQ ID NO: 88323

SEQ ID NO: 523309 - RNA, 64 nt, Homo Sapiens; identical to SEQ ID NO: 88324

SEQ ID NO: 523310 - RNA, 64 nt, Homo Sapiens; identical to SEQ ID NO: 88325

SEQ ID NO: 523311 - RNA, 64 nt, Homo Sapiens; identical to SEQ ID NO: 88326

SEQ ID NO: 523312 - RNA, 64 nt, Homo Sapiens; identical to SEQ ID NO: 88327

SEQ ID NO: 523313 - RNA, 64 nt, Homo Sapiens; identical to SEQ ID NO: 88328

SEQ ID NO: 523314 - RNA, 64 nt, Homo Sapiens; identical to SEQ ID NO: 88329

SEQ ID NO: 523315 - RNA, 64 nt, Homo Sapiens; identical to SEQ ID NO: 88330

SEQ ID NO: 523316 - RNA, 64 nt, Homo Sapiens; identical to SEQ ID NO: 476781

SEQ ID NO: 523317 - RNA, 64 nt, Homo Sapiens; identical to SEQ ID NO: 476782

SEQ ID NO: 523318 - RNA, 64 nt, Homo Sapiens; identical to SEQ ID NO: 24182

SEQ ID NO: 523319 - RNA, 64 nt, Homo Sapiens; identical to SEQ ID NO: 24183

SEQ ID NO: 523320 - RNA, 64 nt, Homo Sapiens; identical to SEQ ID NO: 24184

SEQ ID NO: 523321 - RNA, 64 nt, Homo Sapiens; identical to SEQ ID NO: 24185

SEQ ID NO: 523322 - RNA, 64 nt, Homo Sapiens; identical to SEQ ID NO: 24186

SEQ ID NO: 523323 - RNA, 64 nt, Homo Sapiens; identical to SEQ ID NO: 24187

SEQ ID NO: 523324 - RNA, 64 nt, Homo Sapiens; identical to SEQ ID NO: 24188

SEQ ID NO: 523325 - RNA, 64 nt, Homo Sapiens; identical to SEQ ID NO: 24189

SEQ ID NO: 523326 - RNA, 64 nt, Homo Sapiens; identical to SEQ ID NO: 24190

SEQ ID NO: 523327 - RNA, 64 nt, Homo Sapiens; identical to SEQ ID NO: 24191

SEQ ID NO: 523328 - RNA, 64 nt, Homo Sapiens; identical to SEQ ID NO: 24192

SEQ ID NO: 523329 - RNA, 64 nt, Homo Sapiens; identical to SEQ ID NO: 24193

SEQ ID NO: 523330 - RNA, 64 nt, Homo Sapiens; identical to SEQ ID NO: 24194

SEQ ID NO: 523331 - RNA, 64 nt, Homo Sapiens; identical to SEQ ID NO: 24195

SEQ ID NO: 523332 - RNA, 64 nt, Homo Sapiens; identical to SEQ ID NO: 24196

SEQ ID NO: 523333 - RNA, 64 nt, Homo Sapiens; identical to SEQ ID NO: 24197

SEQ ID NO: 523334 - RNA, 64 nt, Homo Sapiens; identical to SEQ ID NO: 24198

SEQ ID NO: 523335 - RNA, 64 nt, Homo Sapiens; identical to SEQ ID NO: 24199

SEQ ID NO: 523336 - RNA, 64 nt, Homo Sapiens; identical to SEQ ID NO: 24200

SEQ ID NO: 523337 - RNA, 64 nt, Homo Sapiens; identical to SEQ ID NO: 24201

SEQ ID NO: 523338 - RNA, 64 nt, Homo Sapiens; identical to SEQ ID NO: 24202

SEQ ID NO: 523339 - RNA, 64 nt, Homo Sapiens; identical to SEQ ID NO: 24203

SEQ ID NO: 523340 - RNA, 64 nt, Homo Sapiens; identical to SEQ ID NO: 24204

SEQ ID NO: 523341 - RNA, 64 nt, Homo Sapiens; identical to SEQ ID NO: 24205

SEQ ID NO: 523342 - RNA, 64 nt, Homo Sapiens; identical to SEQ ID NO: 24206

SEQ ID NO: 523343 - RNA, 64 nt, Homo Sapiens; identical to SEQ ID NO: 24207

SEQ ID NO: 523344 - RNA, 64 nt, Homo Sapiens; identical to SEQ ID NO: 24208

SEQ ID NO: 523345 - RNA, 64 nt, Homo Sapiens; identical to SEQ ID NO: 24209

SEQ ID NO: 523346 - RNA, 64 nt, Homo Sapiens; identical to SEQ ID NO: 24210

SEQ ID NO: 523347 - RNA, 64 nt, Homo Sapiens; identical to SEQ ID NO: 24211

SEQ ID NO: 523348 - RNA, 64 nt, Homo Sapiens; identical to SEQ ID NO: 24212

SEQ ID NO: 523349 - RNA, 64 nt, Homo Sapiens; identical to SEQ ID NO: 24213

SEQ ID NO: 523350 - RNA, 64 nt, Homo Sapiens; identical to SEQ ID NO: 24214

SEQ ID NO: 523351 - RNA, 64 nt, Homo Sapiens; identical to SEQ ID NO: 24215

SEQ ID NO: 523352 - RNA, 64 nt, Homo Sapiens; identical to SEQ ID NO: 24216

SEQ ID NO: 523353 - RNA, 64 nt, Homo Sapiens; identical to SEQ ID NO: 24217

SEQ ID NO: 523354 - RNA, 64 nt, Homo Sapiens; identical to SEQ ID NO: 24218

SEQ ID NO: 523355 - RNA, 64 nt, Homo Sapiens; identical to SEQ ID NO: 24219

SEQ ID NO: 523356 - RNA, 64 nt, Homo Sapiens; identical to SEQ ID NO: 24220

SEQ ID NO: 523357 - RNA, 64 nt, Homo Sapiens; identical to SEQ ID NO: 24221

SEQ ID NO: 523358 - RNA, 64 nt, Homo Sapiens; identical to SEQ ID NO: 24222

SEQ ID NO: 523359 - RNA, 64 nt, Homo Sapiens; identical to SEQ ID NO: 24223

SEQ ID NO: 523360 - RNA, 64 nt, Homo Sapiens; identical to SEQ ID NO: 24224

SEQ ID NO: 523361 - RNA, 64 nt, Homo Sapiens; identical to SEQ ID NO: 24225

SEQ ID NO: 523362 - RNA, 64 nt, Homo Sapiens; identical to SEQ ID NO: 24226

SEQ ID NO: 523363 - RNA, 64 nt, Homo Sapiens; identical to SEQ ID NO: 24227

SEQ ID NO: 523364 - RNA, 64 nt, Homo Sapiens; identical to SEQ ID NO: 24228

SEQ ID NO: 523365 - RNA, 64 nt, Homo Sapiens; identical to SEQ ID NO: 24229

SEQ ID NO: 523366 - RNA, 64 nt, Homo Sapiens; identical to SEQ ID NO: 24230

SEQ ID NO: 523367 - RNA, 64 nt, Homo Sapiens; identical to SEQ ID NO: 24231

SEQ ID NO: 523368 - RNA, 64 nt, Homo Sapiens; identical to SEQ ID NO: 24232

SEQ ID NO: 523369 - RNA, 64 nt, Homo Sapiens; identical to SEQ ID NO: 24233

SEQ ID NO: 523370 - RNA, 64 nt, Homo Sapiens; identical to SEQ ID NO: 24234

SEQ ID NO: 523371 - RNA, 64 nt, Homo Sapiens; identical to SEQ ID NO: 24235

SEQ ID NO: 523372 - RNA, 64 nt, Homo Sapiens; identical to SEQ ID NO: 24236

SEQ ID NO: 523373 - RNA, 64 nt, Homo Sapiens; identical to SEQ ID NO: 24237

SEQ ID NO: 523374 - RNA, 64 nt, Homo Sapiens; identical to SEQ ID NO: 24238

SEQ ID NO: 523375 - RNA, 64 nt, Homo Sapiens; identical to SEQ ID NO: 24239

SEQ ID NO: 523376 - RNA, 64 nt, Homo Sapiens; identical to SEQ ID NO: 24240

SEQ ID NO: 523377 - RNA, 64 nt, Homo Sapiens; identical to SEQ ID NO: 24241

SEQ ID NO: 523378 - RNA, 64 nt, Homo Sapiens; identical to SEQ ID NO: 24242

SEQ ID NO: 523379 - RNA, 64 nt, Homo Sapiens; identical to SEQ ID NO: 24243

SEQ ID NO: 523380 - RNA, 64 nt, Homo Sapiens; identical to SEQ ID NO: 24244

SEQ ID NO: 523381 - RNA, 64 nt, Homo Sapiens; identical to SEQ ID NO: 24245

SEQ ID NO: 523382 - RNA, 64 nt, Homo Sapiens; identical to SEQ ID NO: 24246

SEQ ID NO: 523383 - RNA, 64 nt, Homo Sapiens; identical to SEQ ID NO: 24247

SEQ ID NO: 523384 - RNA, 64 nt, Homo Sapiens; identical to SEQ ID NO: 24248

SEQ ID NO: 523385 - RNA, 64 nt, Homo Sapiens; identical to SEQ ID NO: 24249

SEQ ID NO: 523386 - RNA, 64 nt, Homo Sapiens; identical to SEQ ID NO: 24250

SEQ ID NO: 523387 - RNA, 64 nt, Homo Sapiens; identical to SEQ ID NO: 24251

SEQ ID NO: 523388 - RNA, 64 nt, Homo Sapiens; identical to SEQ ID NO: 24252

SEQ ID NO: 523389 - RNA, 64 nt, Homo Sapiens; identical to SEQ ID NO: 24253

SEQ ID NO: 523390 - RNA, 64 nt, Homo Sapiens; identical to SEQ ID NO: 24254

SEQ ID NO: 523391 - RNA, 64 nt, Homo Sapiens; identical to SEQ ID NO: 24255

SEQ ID NO: 523392 - RNA, 64 nt, Homo Sapiens; identical to SEQ ID NO: 24256

SEQ ID NO: 523393 - RNA, 64 nt, Homo Sapiens; identical to SEQ ID NO: 24257

SEQ ID NO: 523394 - RNA, 64 nt, Homo Sapiens; identical to SEQ ID NO: 24258

SEQ ID NO: 523395 - RNA, 64 nt, Homo Sapiens; identical to SEQ ID NO: 24259

SEQ ID NO: 523396 - RNA, 64 nt, Homo Sapiens; identical to SEQ ID NO: 24260

SEQ ID NO: 523397 - RNA, 64 nt, Homo Sapiens; identical to SEQ ID NO: 24261

SEQ ID NO: 523398 - RNA, 64 nt, Homo Sapiens; identical to SEQ ID NO: 24262

SEQ ID NO: 523399 - RNA, 64 nt, Homo Sapiens; identical to SEQ ID NO: 24263

SEQ ID NO: 523400 - RNA, 64 nt, Homo Sapiens; identical to SEQ ID NO: 24264

SEQ ID NO: 523401 - RNA, 64 nt, Homo Sapiens; identical to SEQ ID NO: 24265

SEQ ID NO: 523402 - RNA, 64 nt, Homo Sapiens; identical to SEQ ID NO: 24266

SEQ ID NO: 523403 - RNA, 64 nt, Homo Sapiens; identical to SEQ ID NO: 24267

SEQ ID NO: 523404 - RNA, 64 nt, Homo Sapiens; identical to SEQ ID NO: 24268

SEQ ID NO: 523405 - RNA, 64 nt, Homo Sapiens; identical to SEQ ID NO: 24269

SEQ ID NO: 523406 - RNA, 64 nt, Homo Sapiens; identical to SEQ ID NO: 24270

SEQ ID NO: 523407 - RNA, 64 nt, Homo Sapiens; identical to SEQ ID NO: 24271

SEQ ID NO: 523408 - RNA, 64 nt, Homo Sapiens; identical to SEQ ID NO: 24272

SEQ ID NO: 523409 - RNA, 64 nt, Homo Sapiens; identical to SEQ ID NO: 24273

SEQ ID NO: 523410 - RNA, 64 nt, Homo Sapiens; identical to SEQ ID NO: 24274

SEQ ID NO: 523411 - RNA, 64 nt, Homo Sapiens; identical to SEQ ID NO: 24275

SEQ ID NO: 523412 - RNA, 64 nt, Homo Sapiens; identical to SEQ ID NO: 24276

SEQ ID NO: 523413 - RNA, 64 nt, Homo Sapiens; identical to SEQ ID NO: 24277

SEQ ID NO: 523414 - RNA, 64 nt, Homo Sapiens; identical to SEQ ID NO: 24278

SEQ ID NO: 523415 - RNA, 64 nt, Homo Sapiens; identical to SEQ ID NO: 24279

SEQ ID NO: 523416 - RNA, 64 nt, Homo Sapiens; identical to SEQ ID NO: 24280

SEQ ID NO: 523417 - RNA, 64 nt, Homo Sapiens; identical to SEQ ID NO: 24281

SEQ ID NO: 523418 - RNA, 64 nt, Homo Sapiens; identical to SEQ ID NO: 24282

SEQ ID NO: 523419 - RNA, 64 nt, Homo Sapiens; identical to SEQ ID NO: 24283

SEQ ID NO: 523420 - RNA, 64 nt, Homo Sapiens; identical to SEQ ID NO: 24284

SEQ ID NO: 523421 - RNA, 64 nt, Homo Sapiens; identical to SEQ ID NO: 24285

SEQ ID NO: 523422 - RNA, 64 nt, Homo Sapiens; identical to SEQ ID NO: 24286

SEQ ID NO: 523423 - RNA, 64 nt, Homo Sapiens; identical to SEQ ID NO: 24287

SEQ ID NO: 523424 - RNA, 64 nt, Homo Sapiens; identical to SEQ ID NO: 24288

SEQ ID NO: 523425 - RNA, 64 nt, Homo Sapiens; identical to SEQ ID NO: 24289

SEQ ID NO: 523426 - RNA, 64 nt, Homo Sapiens; identical to SEQ ID NO: 24290

SEQ ID NO: 523427 - RNA, 64 nt, Homo Sapiens; identical to SEQ ID NO: 24291

SEQ ID NO: 523428 - RNA, 64 nt, Homo Sapiens; identical to SEQ ID NO: 24292

SEQ ID NO: 523429 - RNA, 64 nt, Homo Sapiens; identical to SEQ ID NO: 24293

SEQ ID NO: 523430 - RNA, 64 nt, Homo Sapiens; identical to SEQ ID NO: 24294

SEQ ID NO: 523431 - RNA, 64 nt, Homo Sapiens; identical to SEQ ID NO: 24295

SEQ ID NO: 523432 - RNA, 64 nt, Homo Sapiens; identical to SEQ ID NO: 24296

SEQ ID NO: 523433 - RNA, 64 nt, Homo Sapiens; identical to SEQ ID NO: 24297

SEQ ID NO: 523434 - RNA, 64 nt, Homo Sapiens; identical to SEQ ID NO: 24298

SEQ ID NO: 523435 - RNA, 64 nt, Homo Sapiens; identical to SEQ ID NO: 24299

SEQ ID NO: 523436 - RNA, 64 nt, Homo Sapiens; identical to SEQ ID NO: 24300

SEQ ID NO: 523437 - RNA, 64 nt, Homo Sapiens; identical to SEQ ID NO: 24301

SEQ ID NO: 523438 - RNA, 64 nt, Homo Sapiens; identical to SEQ ID NO: 24302

SEQ ID NO: 523439 - RNA, 64 nt, Homo Sapiens; identical to SEQ ID NO: 24303

SEQ ID NO: 523440 - RNA, 64 nt, Homo Sapiens; identical to SEQ ID NO: 24304

SEQ ID NO: 523441 - RNA, 64 nt, Homo Sapiens; identical to SEQ ID NO: 24305

SEQ ID NO: 523442 - RNA, 64 nt, Homo Sapiens; identical to SEQ ID NO: 24306

SEQ ID NO: 523443 - RNA, 64 nt, Homo Sapiens; identical to SEQ ID NO: 24307

SEQ ID NO: 523444 - RNA, 64 nt, Homo Sapiens; identical to SEQ ID NO: 24308

SEQ ID NO: 523445 - RNA, 64 nt, Homo Sapiens; identical to SEQ ID NO: 24309

SEQ ID NO: 523446 - RNA, 64 nt, Homo Sapiens; identical to SEQ ID NO: 24310

SEQ ID NO: 523447 - RNA, 64 nt, Homo Sapiens; identical to SEQ ID NO: 24311

SEQ ID NO: 523448 - RNA, 64 nt, Homo Sapiens; identical to SEQ ID NO: 24312

SEQ ID NO: 523449 - RNA, 64 nt, Homo Sapiens; identical to SEQ ID NO: 24313

SEQ ID NO: 523450 - RNA, 64 nt, Homo Sapiens; identical to SEQ ID NO: 24314

SEQ ID NO: 523451 - RNA, 64 nt, Homo Sapiens; identical to SEQ ID NO: 24315

SEQ ID NO: 523452 - RNA, 64 nt, Homo Sapiens; identical to SEQ ID NO: 24316

SEQ ID NO: 523453 - RNA, 64 nt, Homo Sapiens; identical to SEQ ID NO: 24317

SEQ ID NO: 523454 - RNA, 64 nt, Homo Sapiens; identical to SEQ ID NO: 24318

SEQ ID NO: 523455 - RNA, 64 nt, Homo Sapiens; identical to SEQ ID NO: 24319

SEQ ID NO: 523456 - RNA, 64 nt, Homo Sapiens; identical to SEQ ID NO: 24320

SEQ ID NO: 523457 - RNA, 64 nt, Homo Sapiens; identical to SEQ ID NO: 24321

SEQ ID NO: 523458 - RNA, 64 nt, Homo Sapiens; identical to SEQ ID NO: 24322

SEQ ID NO: 523459 - RNA, 64 nt, Homo Sapiens; identical to SEQ ID NO: 24323

SEQ ID NO: 523460 - RNA, 64 nt, Homo Sapiens; identical to SEQ ID NO: 24324

SEQ ID NO: 523461 - RNA, 64 nt, Homo Sapiens; identical to SEQ ID NO: 24325

SEQ ID NO: 523462 - RNA, 64 nt, Homo Sapiens; identical to SEQ ID NO: 24326

SEQ ID NO: 523463 - RNA, 64 nt, Homo Sapiens; identical to SEQ ID NO: 24327

SEQ ID NO: 523464 - RNA, 64 nt, Homo Sapiens
agugcuuccccuucugugcuucucugccaggggcuccggcuaccgacucuuucaugagcgccaa

SEQ ID NO: 523465 - RNA, 64 nt, Homo Sapiens
auccccgcagagucuccgguagcccggcccgcccuccggcuacaaugccugagcagcgccucgg

SEQ ID NO: 523466 - RNA, 64 nt, Homo Sapiens
ggagcugagaagucugggagugaggagaucccaguccggcuaagcuugguggagcauuuuccca

SEQ ID NO: 523467 - RNA, 64 nt, Homo Sapiens
uuuuuguauuuuuaguagagcacccgccaccacauccggcuaaucgaguagcugggacuacagg

SEQ ID NO: 523468 - RNA, 64 nt, Homo Sapiens
aaaaaauaaugguaguaaaggauuauacguuaucuccggcuagagucucuaggccuuacuuugu

SEQ ID NO: 523469 - RNA, 64 nt, Homo Sapiens
ccagaaagaaaagugagccagaggaguagaggucuccggcuauuuuggaaccuagagcuggagu

SEQ ID NO: 523470 - RNA, 64 nt, Homo Sapiens
aaauuagcuggucgcgguggcuucugccugugauuccggcuacuugggaggcugaggugggagg

SEQ ID NO: 523471 - RNA, 64 nt, Homo Sapiens
ucccucccagcuccaccccgcaagcaccauccccuccggcuaagcaggcgcaagggaggcccag

SEQ ID NO: 523472 - RNA, 64 nt, Homo Sapiens
uuuuguauuuuuaguagagacgcgugccaccauguccggcuaauugaguagcugggauuacggg

SEQ ID NO: 523473 - RNA, 64 nt, Homo Sapiens
cuucuucauaccauucuccuaagucacugaccauuccggcuaugaguguuaaagauuaggauug

SEQ ID NO: 523474 - RNA, 64 nt, Homo Sapiens
aguagggaagagauucucaaaugagaaaaagggcuccggcuauaugggcaacaaagagggaaga

SEQ ID NO: 523475 - RNA, 64 nt, Homo Sapiens
uuuuguauuuuuaguagagacgcacaccaccacguccggcuaauugaguagcugggacuacaug

SEQ ID NO: 523476 - RNA, 64 nt, Homo Sapiens
gacagugguagaguccuagggaugaacucagguuuccggcuacuguaacugugucaggauugag

SEQ ID NO: 523477 - RNA, 64 nt, Homo Sapiens
cgagaggcugauccaagaacggcuuggcagccaguccggcuaaguggagcucagagcggauggg

SEQ ID NO: 523478 - RNA, 64 nt, Homo Sapiens
gauucgacagaggcuggaggcaaguacaccgugcuccggcuaaugaaguaaagaagcugaugcg

SEQ ID NO: 523479 - RNA, 64 nt, Homo Sapiens
gcccugcaagcugcuuuaucuggaagccuccacauccggcuaugaggaaaucuuuguacugucu

SEQ ID NO: 523480 - RNA, 60 nt, Homo Sapiens
ggcuucuggaaaucuguggccacucgagugcccaaggagcccccugagauucgaauccuc

SEQ ID NO: 523481 - RNA, 60 nt, Homo Sapiens
gccuuuagccuggaccaaagggaagugaggcccaaggagcuuacccaagcuguggcagcc

SEQ ID NO: 523482 - RNA, 60 nt, Homo Sapiens
cacaggucccgagccaacggggcuuucauacccaaggaucuguuuccuugcugaaaauga

SEQ ID NO: 523483 - RNA, 60 nt, Homo Sapiens
gccaaccuccucagggcgcccuggcuucuccccaaggagaugaggagcggugaugccagc

SEQ ID NO: 523484 - RNA, 60 nt, Homo Sapiens
guaggucguuucuguguucuagagucccuucccaaggaauuccuucagggaaggaaccac

SEQ ID NO: 523485 - RNA, 60 nt, Homo Sapiens
uaugcuaagugaaacgugggccauccuuggcccaaggaacucuuucaauguuauuuucuc

SEQ ID NO: 523486 - RNA, 60 nt, Homo Sapiens
uuagcuucaauccuggcagcaccugguagacccaaggacuuggguggaucaggacaccug

SEQ ID NO: 523487 - RNA, 60 nt, Homo Sapiens
aagagaagcuuccggcaacccugcaacccacccaaggaggcuacuggaucggggauuccc

SEQ ID NO: 523488 - RNA, 60 nt, Homo Sapiens
acugaaaccauuucuaaccacaacccuuggcccaaggacuugguacaggaagggagaagg

SEQ ID NO: 523489 - RNA, 60 nt, Homo Sapiens
cagguggccuggccacucuggagaaagaaacccaaggaaagugagcacccaacuggaugc

SEQ ID NO: 523490 - RNA, 60 nt, Homo Sapiens
gccuaugaaaagguccugauacagugaagacccaaggaagcaaacugaggaagcuacaac

SEQ ID NO: 523491 - RNA, 60 nt, Homo Sapiens
ggucaucuaagugcuguccaacugagaaaccccaaggaugaugcaggcaccagagcaggg

SEQ ID NO: 523492 - RNA, 60 nt, Homo Sapiens
uuugggggguccugcuacacuccaccgauccccaaggaaguauaauaaacgauacccagc

SEQ ID NO: 523493 - RNA, 60 nt, Homo Sapiens
caaaguauagaaacauguucauugcacacacccaaggagaagagcucaagcgcuuggaag

SEQ ID NO: 523494 - RNA, 60 nt, Homo Sapiens
gcccaguguggaugucucuuacagagggggcccaaggaaucaccaccccgcuucagugua

SEQ ID NO: 523495 - RNA, 60 nt, Homo Sapiens
acuuagaagacauuuuuguacaugcucuuccccaaggauuguacguauuauacaaauaga

SEQ ID NO: 523496 - RNA, 60 nt, Homo Sapiens
acguuugguacaaucgacaucccucucccacccaaggagaugcuccaggcaucacugauu

SEQ ID NO: 523497 - RNA, 60 nt, Homo Sapiens
uggcuguuaaccacccgccccuuggagugccccaaggaggccacuggcacuugccugcug

SEQ ID NO: 523498 - RNA, 60 nt, Homo Sapiens
gcugggaguugcucaggcaugacauccagccccaaggauguguggucauguuuacauugu

SEQ ID NO: 523499 - RNA, 60 nt, Homo Sapiens
ggaaacaacuuuuccaaaauguuacugcggcccaaggacaucucuaucccaucccuuccu

SEQ ID NO: 523500 - RNA, 60 nt, Homo Sapiens
cccucuccuugacccccagucccagccccccccaaggaccugcacugccccccacauucu

SEQ ID NO: 523501 - RNA, 60 nt, Homo Sapiens
cccccuucgcugggaguggagccggcuucccccaaggacuggggacccuccagaagccca

SEQ ID NO: 523502 - RNA, 60 nt, Homo Sapiens
cuucacacaagaaccaccucucccgcaguucccaaggacuugucauuucauguucuuauu

SEQ ID NO: 523503 - RNA, 60 nt, Homo Sapiens
uuuagaccuguuuuguaaauaaagcuguuucccaaggaaagagaugaauauuuaacacuc

SEQ ID NO: 523504 - RNA, 60 nt, Homo Sapiens
cauccauucccaucuuucgggcuccuuaggcccaaggauggcaugugacuggucccugca

SEQ ID NO: 523505 - RNA, 60 nt, Homo Sapiens
ccauuuuccucuuaagguuuccucuacaaccccaaggacuuucaugauuauccucaggga

SEQ ID NO: 523506 - RNA, 60 nt, Homo Sapiens
uggggguggugcugacucagccgccuauuccccaaggagcuucagggcaguccuucuggc

SEQ ID NO: 523507 - RNA, 60 nt, Homo Sapiens
gggauaucaacuuggaggagaacaccuagacccaaggacuuuuuucugcccaaggaacac

SEQ ID NO: 523508 - RNA, 60 nt, Homo Sapiens
agaacaccuagacccaaggacuuuuuucugcccaaggaacacaguuuccuucagcuccca

SEQ ID NO: 523509 - RNA, 60 nt, Homo Sapiens
cauuccccuuuucccuccugugcucugucccccaaggagucauggaacucaggguacugg

SEQ ID NO: 523510 - RNA, 60 nt, Homo Sapiens
cugucuacuggcugcaugugcugugaauaucccaaggaacuggcuguggaaugcguguuu

SEQ ID NO: 523511 - RNA, 60 nt, Homo Sapiens
ugccaccagguacuaaguccgaaaaguguccccaaggaaguguaggaauuauguuucgca

SEQ ID NO: 523512 - RNA, 60 nt, Homo Sapiens
ucugcuguacaaacaggugagaccuccucacccaaggagucggaaauucuccaggcaaau

SEQ ID NO: 523513 - RNA, 60 nt, Homo Sapiens
cacuucugggaaauugaagugucuucuguucccaaggaagcuccuuccuguuuguuuugu

SEQ ID NO: 523514 - RNA, 60 nt, Homo Sapiens
agaguggggagaggcacuuaaucuguaacccccaaggaggaaauaacuaagagauucuuc

SEQ ID NO: 523515 - RNA, 60 nt, Homo Sapiens
ggcacggggccuccgagcuccagcuccguucccaaggauacucgugaagaccccaucugu

SEQ ID NO: 523516 - RNA, 60 nt, Homo Sapiens
uacccccaucuuucucccucggggagacgacccaaggaauuucagaguauuuuguuuggc

SEQ ID NO: 523517 - RNA, 64 nt, Homo Sapiens
ggucuaucuuuuaaagccugaucuggugugaauaaucaacuaggaaaucuaaacuuggauaaca

SEQ ID NO: 523518 - RNA, 64 nt, Homo Sapiens
uacacaguauggcaaauggauaaaauauuguggcaucaacuacuuuuaaaguagaaaagcuauc

SEQ ID NO: 523519 - RNA, 64 nt, Homo Sapiens
ucuauguaguuaauuaaaguuaaaguuucugcagaucaacuacucaaacuacuaaauacauuua

SEQ ID NO: 523520 - RNA, 64 nt, Homo Sapiens
cucaucgugaucuuggaaaucaauaaagucaaauaucaacuaaagacuuacauuaucuuucuca

SEQ ID NO: 523521 - RNA, 64 nt, Homo Sapiens
cucacccaagguguuagguuucacauauauauucaucaacuauuuuagaagauuuaauucuauc

SEQ ID NO: 523522 - RNA, 64 nt, Homo Sapiens
auaucauaguucugugguaguaauuuuuuuaaauaucaacuaaaugcuuaaaaaagcauugagu

SEQ ID NO: 523523 - RNA, 64 nt, Homo Sapiens
aauuuuauaacuuaaagaaagaaacuaaauuugaaucaacuauugaauuggaaauaaguauaag

SEQ ID NO: 523524 - RNA, 64 nt, Homo Sapiens
uaaacgaagagagucuuucuaauugagaagggggaucaacuaaaauaagugucagacuauuagg

SEQ ID NO: 523525 - RNA, 64 nt, Homo Sapiens
agcccauauaaaugaggcucagcccgagccauggaucaacuaggucaucaucuuacucaucuua

SEQ ID NO: 523526 - RNA, 64 nt, Homo Sapiens
ccgcaucccaacaacccagguuaaaaggaaacagaucaacuacaaguuuugccaacaauucccc

SEQ ID NO: 523527 - RNA, 64 nt, Homo Sapiens
gauauuuauaaaugaaguaucuuaauagauuauuaucaacuagaucacuugaauauuuaugauu

SEQ ID NO: 523528 - RNA, 64 nt, Homo Sapiens
uccaccuaagaucuugccccuguuaaguggugaaaucaacuagaggugguuccuacaaguuguu

SEQ ID NO: 523529 - RNA, 64 nt, Homo Sapiens
agcaaaguuauggucgauuucuauucuugaaagaaucaacuacagugaauccuuugcauuugaa

SEQ ID NO: 523530 - RNA, 64 nt, Homo Sapiens
uuguauggcauaggacuggcauuauauagcagaaaucaacuacuguacaauuucuugggguuaa

SEQ ID NO: 523531 - RNA, 64 nt, Homo Sapiens
gaauauagagggcuuaugauucagauuguuaucuaucaacuauaagcccacuguuaauauucua

SEQ ID NO: 523532 - RNA, 64 nt, Homo Sapiens
uauuuaagacugauaauuuucuuuuguaaagagaaucaacuagggauguauuacaugacuguuu

SEQ ID NO: 523533 - RNA, 64 nt, Homo Sapiens
acuauuuuugcuauaaguucuuauuuauaaugaaaucaacuaaaugcacagguucuugaaaacg

SEQ ID NO: 523534 - RNA, 64 nt, Homo Sapiens
uuuguuaucacuaagugauauuuuuuccauguaaaucaacuaucuuaacauauuguaaauguuc

SEQ ID NO: 523535 - RNA, 64 nt, Homo Sapiens
uuauuucagcaauaggagacaucuguaguguuaaaucaacuaaaguauucauuauccuaacacc

SEQ ID NO: 523536 - RNA, 64 nt, Homo Sapiens
aacaaacucaguggucaaaacucuaauuagaugaaucaacuagauauaaaaugauuuguaaugu

SEQ ID NO: 523537 - RNA, 64 nt, Homo Sapiens
aguuaagagucucaguugauaagcccugugguguaucaacuacuaguaauugugcaguaaagua

SEQ ID NO: 523538 - RNA, 64 nt, Homo Sapiens
uuuaaauuuuacuagcaaaagucuuaggugaacaaucaacuaguauuuguugagcuccuauuug

SEQ ID NO: 523539 - RNA, 64 nt, Homo Sapiens
uucucagugaaauuuuugggcaucaugaagaacgaucaacuaucuucuaauuugaaucuauagu

SEQ ID NO: 523540 - RNA, 64 nt, Homo Sapiens
gcaagaaguucuauuuaauggagaugucauguauaucaacuauucugguuuagauaacuuagau

SEQ ID NO: 523541 - RNA, 64 nt, Homo Sapiens
agcccaucggcuacgccacauggcuccugaagugaucaacuaugcuuuggcaccccagaauuug

SEQ ID NO: 523542 - RNA, 64 nt, Homo Sapiens
guuaauuuugaaaaauggaaagacacagcaagccaucaacuaugccacaacguucaagauagag

SEQ ID NO: 523543 - RNA, 64 nt, Homo Sapiens
aaugaaucuauauguucuguauaaauaggauugaaucaacuagauuauuuuguauuuuaaauac

SEQ ID NO: 523544 - RNA, 64 nt, Homo Sapiens
agccaggcaccccuuuuaagcaguccaggagaucaucaacuaaguguuuuccuuccuuucuuuc

SEQ ID NO: 523545 - RNA, 64 nt, Homo Sapiens
caaccuaucuguucugucucccaauguaccacuuaucaacuaaucccucuccucucugauuccu

SEQ ID NO: 523546 - RNA, 64 nt, Homo Sapiens
auauauaacaaauaauauauuaaaaaacccauccaucaacuaaaacauuauauguauacaucag

SEQ ID NO: 523547 - RNA, 64 nt, Homo Sapiens
uaauuaccccauuauuaaauucaaguccuugaaaaucaacuagagauuauaaagucucuaaaga

SEQ ID NO: 523548 - RNA, 64 nt, Homo Sapiens
cuguuuaguuuacauuguaacauucuauuguaaaaucaacuaaaauucagacuuuuagcaggac

SEQ ID NO: 523549 - RNA, 64 nt, Homo Sapiens
auuuaaaagaagaggaagacauccuaugacugacaucaacuaaacaugccucaugauccuuuug

SEQ ID NO: 523550 - RNA, 64 nt, Homo Sapiens
agcucugcuaguaauugauuucaauggaugagugaucaacuaauugaauaaaugaugcaaguug

SEQ ID NO: 523551 - RNA, 64 nt, Homo Sapiens
uuuagcuugguaaauuuuucuuaugacaacuuagaucaacuauuaagguauuuaauauucuuuu

SEQ ID NO: 523552 - RNA, 64 nt, Homo Sapiens
ccaugcuauuuguucuucaagaacuuucucugccaucaacuacuauucaaaaccucaaauccac

SEQ ID NO: 523553 - RNA, 64 nt, Homo Sapiens
ugagcagauaacccugcuuauuuggugugguuaaaucaacuagcuucugcuaauagccccaauu

SEQ ID NO: 523554 - RNA, 64 nt, Homo Sapiens
gaaaacguucagacccauccuguuaguaugucaaaucaacuaagacuggcaggguauuaacucc

SEQ ID NO: 523555 - RNA, 64 nt, Homo Sapiens
caggaugcaaaaacguuauugggggguuguaaauaucaacuauucaacaguuuaggaugcaauu

SEQ ID NO: 523556 - RNA, 64 nt, Homo Sapiens
aauaguacugaaaugauucucuauguuguaaaugaucaacuacaauauucaggaagcacauuua

SEQ ID NO: 523557 - RNA, 64 nt, Homo Sapiens
uauaaagcuuuaaguugucaacuuuguucuaaauaucaacuagcgcaagugaauacugaagauu

SEQ ID NO: 523558 - RNA, 64 nt, Homo Sapiens
uugaaaaugcuauuggaggagucacacuaauacuaucaacuaucagucuucccacagcuucaau

SEQ ID NO: 523559 - RNA, 64 nt, Homo Sapiens
ggauauuucagcuguuguuuccaaauggcaaaucaucaacuaaaagcacuuguuucaaguuuug

SEQ ID NO: 523560 - RNA, 64 nt, Homo Sapiens
uaauugcaagguuucuacucaaagcagaagaggaaucaacuaguauaacucugaucuuuuacau

SEQ ID NO: 523561 - RNA, 64 nt, Homo Sapiens
ucucggggguguucugcucaucccuuccaacugcaucaacuaacgccacugcucagugcacuuc

SEQ ID NO: 523562 - RNA, 64 nt, Homo Sapiens
cuuucuuuuaucaaguaauugauggaaaaugcuaaucaacuaccgugcagauaggugauguugg

SEQ ID NO: 523563 - RNA, 64 nt, Homo Sapiens
ucuauuuuauaauuauauuugacauuuuguucacaucaacuaauguucaccuguagaagagaac

SEQ ID NO: 523564 - RNA, 64 nt, Homo Sapiens
cuuuuuuggcauguccuuaaaaagaggauuugaaaucaacuauaugcuaccaagaacuuuagga

SEQ ID NO: 523565 - RNA, 64 nt, Homo Sapiens
ucaguagaguccacuucugcccuggagaccacaaaucaacuagcuccauuuacagccauuucua

SEQ ID NO: 523566 - RNA, 53 nt, Homo Sapiens
ugccugaacagaaucauccuaggaucaacuauuucccacagccaacagauuga

SEQ ID NO: 523567 - RNA, 64 nt, Homo Sapiens
agggcuuucauugucugacucauaaugguucaggaucaacuaucaucaaacggaaggauuaacu

SEQ ID NO: 523568 - RNA, 64 nt, Homo Sapiens
gaaauguucuuaagaugaauacaccugccuuuggaucaacuauuuaaacauuguaugcauuuug

SEQ ID NO: 523569 - RNA, 64 nt, Homo Sapiens
uauaagagauacucaauaaauaaauauuugucaaaucaacuaauugauuccuugugaccuaauu

SEQ ID NO: 523570 - RNA, 64 nt, Homo Sapiens
uauuaaaaucuguugaaauaacucuuaggaaauuaucaacuaauuuuuucagaucaguaucuuc

SEQ ID NO: 523571 - RNA, 64 nt, Homo Sapiens
ucuggaugauauggaaaacacugccauauuuuaaaucaacuacuccacguguuuuuccauccaa

SEQ ID NO: 523572 - RNA, 64 nt, Homo Sapiens
guuauccucuaaauaggcaucuuuuuucugugucaucaacuauguucuugcauucuggguuugg

SEQ ID NO: 523573 - RNA, 64 nt, Homo Sapiens
accacccagaaaacaguccucuaagcuuuuaaaaaucaacuauuacaguccaugaucugaccaa

SEQ ID NO: 523574 - RNA, 64 nt, Homo Sapiens
ggaugauuggaauuauuaauaaauuugaacacugaucaacuauaucuuuuuaugaggcaauugg

SEQ ID NO: 523575 - RNA, 64 nt, Homo Sapiens
caguauggugguccuggaaaggacauuuuugaagaucaacuauaucuuccugugcauuccgaug

SEQ ID NO: 523576 - RNA, 64 nt, Homo Sapiens
uuguauaaaacuguaacauuacuguacagaguacaucaacuauuuucagcccaaaaaggugcca

SEQ ID NO: 523577 - RNA, 64 nt, Homo Sapiens
ucagagagagacugaggguugacaaauaaacuguaucaacuaaacuuugauauaaaccagaaug

SEQ ID NO: 523578 - RNA, 64 nt, Homo Sapiens
aucaaaagagcgauuugcugcauagcauuuuagcaucaacuacauaaaaccacagauugcaaag

SEQ ID NO: 523579 - RNA, 64 nt, Homo Sapiens
ucaugacuaucuauugguucgucuugauguuucuaucaacuauauaucuguacauaauugcuuu

SEQ ID NO: 523580 - RNA, 64 nt, Homo Sapiens
auuggaaaauacauaucacuacagacauaguaguaucaacuagccaauuuuuuuuuuuucucag

SEQ ID NO: 523581 - RNA, 64 nt, Homo Sapiens
ucguaaguuuggaugaaagugcaagauguggaacaucaacuaccuauuuuccuuggguuuuucc

SEQ ID NO: 523582 - RNA, 64 nt, Homo Sapiens
aaagcuuacaauuagucuuccacugugugacuuaaucaacuauaggucaauggaccuuucuuug

SEQ ID NO: 523583 - RNA, 64 nt, Homo Sapiens
agaauucaacugucucaagauuuaauacaacaagaucaacuagaacuucaguugagagugacuu

SEQ ID NO: 523584 - RNA, 64 nt, Homo Sapiens
ggaggagagagggucuccaggaaguugagcagguaucaacuaggcuccuggaaacagacaggga

SEQ ID NO: 523585 - RNA, 64 nt, Homo Sapiens
uuuaacaucauuuuuucaacuuuuaagauauaauaucaacuauucuaaauacagguaaugguau

SEQ ID NO: 523586 - RNA, 64 nt, Homo Sapiens
uuuggaacauaagucacuaugcagacuaauaaacaucaacuagagagaacucccaacugcuguu

SEQ ID NO: 523587 - RNA, 64 nt, Homo Sapiens
caaaccuauguucguaaugagagauuuuauaaggaucaacuaagaaauggaaggcaggugaaga

SEQ ID NO: 523588 - RNA, 64 nt, Homo Sapiens
ucuuccauguaaaauaauuuagguauuaugaugcaucaacuaguaauaucaaaaaauguuucua

SEQ ID NO: 523589 - RNA, 64 nt, Homo Sapiens
guccauaggaaccacccccaugaccaccaccaacaucaacuaaagguucuuggaggguauguca

SEQ ID NO: 523590 - RNA, 64 nt, Homo Sapiens
uuauauagucccguuaggguuuaaaaccauauugaucaacuagaaagaaaaauaugaaaagaga

SEQ ID NO: 523591 - RNA, 64 nt, Homo Sapiens
ugaagacauguauccauaagaaggagugcucuucaucaacuaauagagcaccuaccacaguguc

SEQ ID NO: 523592 - RNA, 64 nt, Homo Sapiens
cugugcuuccugaggagcaggccggauguaaguuaucaacuauaaauaaaaccaagacuuccgu

SEQ ID NO: 523593 - RNA, 64 nt, Homo Sapiens
aguuuccagaaacuuugacuugaaauguuugcagaucaacuauaagcacaaagaagagauaacu

SEQ ID NO: 523594 - RNA, 64 nt, Homo Sapiens
guacacaguauggucuuuggaaauauaauaaaacaucaacuaacuuggacuaauugugaggaag

SEQ ID NO: 523595 - RNA, 64 nt, Homo Sapiens
aaauaugaaaucagcauuccguucugagcuccucaucaacuacaucagcgagacuaaagacaaa

SEQ ID NO: 523596 - RNA, 64 nt, Homo Sapiens
caagucacucacuuaaaauggaagauccucagagaucaacuagcacucugagaccaugaccuug

SEQ ID NO: 523597 - RNA, 64 nt, Homo Sapiens
uuuguauuuaagcaaacagugaacgacguuugcaaucaacuaaaaauucgucuaucgaauuagg

SEQ ID NO: 523598 - RNA, 64 nt, Homo Sapiens
aaaaauuuucuaaucugcauugaauacauuucaaaucaacuauuaacacaauguaaugagugaa

SEQ ID NO: 523599 - RNA, 64 nt, Homo Sapiens
auagcuucauccauaugaaaaauuauaccaaauuaucaacuagaccuaccuuuucaguuauuuu

SEQ ID NO: 523600 - RNA, 64 nt, Homo Sapiens
uuacccuaccuucuccccuuaguugaugcaaaguaucaacuacuaagguggaaaauuuucuuac

SEQ ID NO: 523601 - RNA, 64 nt, Homo Sapiens
uaaugaaagaugcuugaaauguuuaaugcaggacaucaacuacauguucagaauuuaguagauu

SEQ ID NO: 523602 - RNA, 64 nt, Homo Sapiens
uucaaaaauuuauuuuugauggaaauccuaguccaucaacuaauuguucaaaauaaggcuuguu

SEQ ID NO: 523603 - RNA, 64 nt, Homo Sapiens
gugccaauaaucgucauaggcuucugcacguuggaucaacuaauguuguuuacaauauagauga

SEQ ID NO: 523604 - RNA, 64 nt, Homo Sapiens
uucuccuuuguuuuuguaguuuucaccaaagaugaucaacuagaaauguuaaguggcuaugcaa

SEQ ID NO: 523605 - RNA, 64 nt, Homo Sapiens
acagaagcauuucacauaaauguugguuucagucaucaacuacccaugaauuccugcccaagga

SEQ ID NO: 523606 - RNA, 64 nt, Homo Sapiens
aagcaauaauaaaaugaaacgaagaauuacuuuaaucaacuaacucuuuaaaaauuaaguggaa

SEQ ID NO: 523607 - RNA, 64 nt, Homo Sapiens
uauaaaggaucauuugaaacuguugauuccaaacaucaacuaauauuauauagucaucaguaga

SEQ ID NO: 523608 - RNA, 64 nt, Homo Sapiens
gugaagaacucugugaaggauggaacuuucagauaucaacuauuuagaguccagagggagccau

SEQ ID NO: 523609 - RNA, 64 nt, Homo Sapiens
augcacuguaacaucucugauauauuuuuguuucaucaacuaaguuacugugucucauguuuug

SEQ ID NO: 523610 - RNA, 64 nt, Homo Sapiens
aaccaaaauccagggcacucgguguugaguauucaucaacuaaggcagccaaaacaaagaacug

SEQ ID NO: 523611 - RNA, 64 nt, Homo Sapiens
uuuuuucagucugacaaccaguacugaacccuuuaucaacuauggaugccugaaaccucagaua

SEQ ID NO: 523612 - RNA, 64 nt, Homo Sapiens
auguauaacauuuguacauggccuuuaaaauuguaucaacuagaaauaaaauugcaugaguauu

SEQ ID NO: 523613 - RNA, 64 nt, Homo Sapiens
cagugguuuguuaaauuuaggccagcucagcauaaucaacuagaucucaauucaagcuggauua

SEQ ID NO: 523614 - RNA, 64 nt, Homo Sapiens
gaaaauuaagguguccaccuuuuguuccauucugaucaacuaaaggaguacauuuuuaaaauuu

SEQ ID NO: 523615 - RNA, 64 nt, Homo Sapiens
auuuucuggugccaacacucauucaucauucccgaucaacuaggaugaauuuaagacugugcua

SEQ ID NO: 523616 - RNA, 64 nt, Homo Sapiens
ccaccauccuuucucuggcuucuuuuagcaaguuaucaacuaaucacuaacuccuuccuuuucc

SEQ ID NO: 523617 - RNA, 64 nt, Homo Sapiens
aaaucuaauguaugaaugugacucaccaauuuuuaucaacuaauuccuuuuuuuuauuaaaggc

SEQ ID NO: 523618 - RNA, 64 nt, Homo Sapiens
ucauaauuuaauuguuugaaauuacauuaaauaaaucaacuaauuaaauacuaaaguuuuguuc

SEQ ID NO: 523619 - RNA, 64 nt, Homo Sapiens
ggaaguccagaugcggguuaauguuccuucauucaucaacuaggcauuauauuugugcuuaaag

SEQ ID NO: 523620 - RNA, 64 nt, Homo Sapiens
cuaccacucuacucuaagauccuuacugucucagaucaacuacuggcaagaccaucuccuggaa

SEQ ID NO: 523621 - RNA, 64 nt, Homo Sapiens
aguacaugggacuggugauaaccaaacauuugaaaucaacuacagaagucuuacagucaccugu

SEQ ID NO: 523622 - RNA, 63 nt, Homo Sapiens
aucaugcuuccuuuguguucuaugcaauaaagucaucaacuacgagaaacagccuguguuuuu

SEQ ID NO: 523623 - RNA, 64 nt, Homo Sapiens
cuaaaaauuguguacaggauuccaucuuaaagacaucaacuauuuuuacugaaauuguaaaaua

SEQ ID NO: 523624 - RNA, 64 nt, Homo Sapiens
ucuuggagucaaugaucucuaaacaaacuggauuaucaacuauuuacaacgucuauacaguaua

SEQ ID NO: 523625 - RNA, 64 nt, Homo Sapiens
aaaaaaaaaaaaacccaauuuggauaccaaauuaaucaacuaauuugagcuaucuggccuuacu

SEQ ID NO: 523626 - RNA, 64 nt, Homo Sapiens
aaauuauuauaauucagccuucaaacuacuacugaucaacuaaaggaaagcuaauaagguauuu

SEQ ID NO: 523627 - RNA, 64 nt, Homo Sapiens
augauaaauccauuuugaagcuggaaaucuuucuaucaacuauauugaauuguuuucuuacacc

SEQ ID NO: 523628 - RNA, 64 nt, Homo Sapiens
aauauguuucaagcaucacacuuuucuggcauaaaucaacuauggacaauacuuucaguguccc

SEQ ID NO: 523629 - RNA, 64 nt, Homo Sapiens
gaaaaucuauagacugaaugcaguuccaaacaaaaucaacuaagaauuuucuaggaucuuucaa

SEQ ID NO: 523630 - RNA, 64 nt, Homo Sapiens
ggguaccaggcaccauucucaguguuucaccuggaucaacuaaugcgucccucaccucagcccu

SEQ ID NO: 523631 - RNA, 64 nt, Homo Sapiens
cugcuagugacuuaguagccgucuuggugaucagaucaacuaucccagcaucacagugccugug

SEQ ID NO: 523632 - RNA, 64 nt, Homo Sapiens
gauuuagugaucaaauugugugugagguucgcuuaucaacuaauuggcugacaugaagcuguug

SEQ ID NO: 523633 - RNA, 64 nt, Homo Sapiens
uucaguauguuggcauuacuacuuaaagagacauaucaacuaaaccauuaacagauuaaaagag

SEQ ID NO: 523634 - RNA, 64 nt, Homo Sapiens
auucuauuccauguuugcacaccucagaccaaucaucaacuaccauuuaacucaguuucuaggc

SEQ ID NO: 523635 - RNA, 64 nt, Homo Sapiens
gaaacauuuguuguuaagccuuuucaguuaucagaucaacuaaauuugaaucauggaccauaac

SEQ ID NO: 523636 - RNA, 64 nt, Homo Sapiens
uuguaaaugcaaguuuuuuaagaggaauauuuuuaucaacuauuucucccuucuuguacaaucc

SEQ ID NO: 523637 - RNA, 62 nt, Homo Sapiens
gaaucuuggcccucagaggggagugucuuggggcaucaacuacuggccuccccccagggaug

SEQ ID NO: 523638 - RNA, 64 nt, Homo Sapiens
ucgacaucucugaagacagguuauuuuauaaaagaucaacuaucauguuaagaauguacaguuu

SEQ ID NO: 523639 - RNA, 64 nt, Homo Sapiens
uacucauaugaucacuuuucuuuuuagauacuacaucaacuagauucaggaguauaucauuugc

SEQ ID NO: 523640 - RNA, 64 nt, Homo Sapiens
ccaagauggugagcucugauugcuucaguuggucaucaacuauuuucccuugacugcuguccug

SEQ ID NO: 523641 - RNA, 64 nt, Homo Sapiens
uuuguuuuggcauuuuuuugugugaaguaaauuaaucaacuagagaggugcaaaacguucucag

SEQ ID NO: 523642 - RNA, 64 nt, Homo Sapiens
auuacacagcuuuguuuuuuauucgauaugaaaaaucaacuaaguauuuuugacuaaauuauug

SEQ ID NO: 523643 - RNA, 64 nt, Homo Sapiens
auggagagcaagacagagaaaaaaguuguaucagaucaacuaaaguguuuuaauugugauguca

SEQ ID NO: 523644 - RNA, 64 nt, Homo Sapiens
aguauaguaacaacuaugauuuuuuuaauuuucuaucaacuaauauuuaguggaaaguaauaau

SEQ ID NO: 523645 - RNA, 64 nt, Homo Sapiens
aaauucuaguuucaaguaucgagcuucuauaacuaucaacuauccacuucaagaugauuuaauu

SEQ ID NO: 523646 - RNA, 64 nt, Homo Sapiens
guuguacuuuaaaaauuuaccauacacaucagccaucaacuaaauaaauugcucacaguuauua

SEQ ID NO: 523647 - RNA, 64 nt, Homo Sapiens
aauuaguugccugacuuugguuaaacaaaaaacuaucaacuacaugguaugggggauuucaaac

SEQ ID NO: 523648 - RNA, 64 nt, Homo Sapiens
acccuauaugccugaauacucaucuuuauggcugaucaacuacagcaggaccuaaagggagccc

SEQ ID NO: 523649 - RNA, 64 nt, Homo Sapiens; identical to SEQ ID NO: 340781

SEQ ID NO: 523650 - RNA, 64 nt, Homo Sapiens; identical to SEQ ID NO: 340782

SEQ ID NO: 523651 - RNA, 64 nt, Homo Sapiens; identical to SEQ ID NO: 340783

SEQ ID NO: 523652 - RNA, 64 nt, Homo Sapiens; identical to SEQ ID NO: 340784

SEQ ID NO: 523653 - RNA, 64 nt, Homo Sapiens; identical to SEQ ID NO: 340785

SEQ ID NO: 523654 - RNA, 64 nt, Homo Sapiens; identical to SEQ ID NO: 340786

SEQ ID NO: 523655 - RNA, 64 nt, Homo Sapiens; identical to SEQ ID NO: 340787

SEQ ID NO: 523656 - RNA, 64 nt, Homo Sapiens; identical to SEQ ID NO: 340788

SEQ ID NO: 523657 - RNA, 64 nt, Homo Sapiens; identical to SEQ ID NO: 340789

SEQ ID NO: 523658 - RNA, 64 nt, Homo Sapiens; identical to SEQ ID NO: 340790

SEQ ID NO: 523659 - RNA, 64 nt, Homo Sapiens; identical to SEQ ID NO: 340791

SEQ ID NO: 523660 - RNA, 64 nt, Homo Sapiens; identical to SEQ ID NO: 340792

SEQ ID NO: 523661 - RNA, 64 nt, Homo Sapiens; identical to SEQ ID NO: 340793

SEQ ID NO: 523662 - RNA, 64 nt, Homo Sapiens; identical to SEQ ID NO: 340794

SEQ ID NO: 523663 - RNA, 64 nt, Homo Sapiens; identical to SEQ ID NO: 340795

SEQ ID NO: 523664 - RNA, 64 nt, Homo Sapiens; identical to SEQ ID NO: 340796

SEQ ID NO: 523665 - RNA, 64 nt, Homo Sapiens; identical to SEQ ID NO: 340797

SEQ ID NO: 523666 - RNA, 64 nt, Homo Sapiens; identical to SEQ ID NO: 340798

SEQ ID NO: 523667 - RNA, 64 nt, Homo Sapiens; identical to SEQ ID NO: 340799

SEQ ID NO: 523668 - RNA, 64 nt, Homo Sapiens; identical to SEQ ID NO: 340800

SEQ ID NO: 523669 - RNA, 64 nt, Homo Sapiens; identical to SEQ ID NO: 340801

SEQ ID NO: 523670 - RNA, 64 nt, Homo Sapiens; identical to SEQ ID NO: 340802

SEQ ID NO: 523671 - RNA, 64 nt, Homo Sapiens; identical to SEQ ID NO: 340803

SEQ ID NO: 523672 - RNA, 64 nt, Homo Sapiens; identical to SEQ ID NO: 340804

SEQ ID NO: 523673 - RNA, 64 nt, Homo Sapiens; identical to SEQ ID NO: 340805

SEQ ID NO: 523674 - RNA, 64 nt, Homo Sapiens; identical to SEQ ID NO: 340806

SEQ ID NO: 523675 - RNA, 64 nt, Homo Sapiens; identical to SEQ ID NO: 340807

SEQ ID NO: 523676 - RNA, 64 nt, Homo Sapiens; identical to SEQ ID NO: 340808

SEQ ID NO: 523677 - RNA, 64 nt, Homo Sapiens; identical to SEQ ID NO: 340809

SEQ ID NO: 523678 - RNA, 64 nt, Homo Sapiens; identical to SEQ ID NO: 340810

SEQ ID NO: 523679 - RNA, 64 nt, Homo Sapiens; identical to SEQ ID NO: 340811

SEQ ID NO: 523680 - RNA, 64 nt, Homo Sapiens; identical to SEQ ID NO: 340812

SEQ ID NO: 523681 - RNA, 64 nt, Homo Sapiens; identical to SEQ ID NO: 340813

SEQ ID NO: 523682 - RNA, 64 nt, Homo Sapiens; identical to SEQ ID NO: 340814

SEQ ID NO: 523683 - RNA, 64 nt, Homo Sapiens; identical to SEQ ID NO: 340815

SEQ ID NO: 523684 - RNA, 64 nt, Homo Sapiens; identical to SEQ ID NO: 340816

SEQ ID NO: 523685 - RNA, 64 nt, Homo Sapiens; identical to SEQ ID NO: 340817

SEQ ID NO: 523686 - RNA, 64 nt, Homo Sapiens; identical to SEQ ID NO: 340818

SEQ ID NO: 523687 - RNA, 64 nt, Homo Sapiens; identical to SEQ ID NO: 340819

SEQ ID NO: 523688 - RNA, 64 nt, Homo Sapiens; identical to SEQ ID NO: 340820

SEQ ID NO: 523689 - RNA, 64 nt, Homo Sapiens; identical to SEQ ID NO: 340821

SEQ ID NO: 523690 - RNA, 64 nt, Homo Sapiens; identical to SEQ ID NO: 340822

SEQ ID NO: 523691 - RNA, 64 nt, Homo Sapiens; identical to SEQ ID NO: 340823

SEQ ID NO: 523692 - RNA, 64 nt, Homo Sapiens; identical to SEQ ID NO: 340824

SEQ ID NO: 523693 - RNA, 64 nt, Homo Sapiens; identical to SEQ ID NO: 340825

SEQ ID NO: 523694 - RNA, 64 nt, Homo Sapiens; identical to SEQ ID NO: 340826

SEQ ID NO: 523695 - RNA, 64 nt, Homo Sapiens; identical to SEQ ID NO: 340827

SEQ ID NO: 523696 - RNA, 64 nt, Homo Sapiens; identical to SEQ ID NO: 340828

SEQ ID NO: 523697 - RNA, 64 nt, Homo Sapiens; identical to SEQ ID NO: 340829

SEQ ID NO: 523698 - RNA, 64 nt, Homo Sapiens; identical to SEQ ID NO: 340830

SEQ ID NO: 523699 - RNA, 64 nt, Homo Sapiens; identical to SEQ ID NO: 340831

SEQ ID NO: 523700 - RNA, 64 nt, Homo Sapiens; identical to SEQ ID NO: 340832

SEQ ID NO: 523701 - RNA, 64 nt, Homo Sapiens; identical to SEQ ID NO: 340833

SEQ ID NO: 523702 - RNA, 64 nt, Homo Sapiens; identical to SEQ ID NO: 340834

SEQ ID NO: 523703 - RNA, 64 nt, Homo Sapiens; identical to SEQ ID NO: 340835

SEQ ID NO: 523704 - RNA, 64 nt, Homo Sapiens; identical to SEQ ID NO: 340836

SEQ ID NO: 523705 - RNA, 64 nt, Homo Sapiens; identical to SEQ ID NO: 340837

SEQ ID NO: 523706 - RNA, 64 nt, Homo Sapiens; identical to SEQ ID NO: 340838

SEQ ID NO: 523707 - RNA, 64 nt, Homo Sapiens; identical to SEQ ID NO: 340839

SEQ ID NO: 523708 - RNA, 64 nt, Homo Sapiens; identical to SEQ ID NO: 340840

SEQ ID NO: 523709 - RNA, 64 nt, Homo Sapiens; identical to SEQ ID NO: 340841

SEQ ID NO: 523710 - RNA, 64 nt, Homo Sapiens; identical to SEQ ID NO: 340842

SEQ ID NO: 523711 - RNA, 64 nt, Homo Sapiens; identical to SEQ ID NO: 340843

SEQ ID NO: 523712 - RNA, 64 nt, Homo Sapiens; identical to SEQ ID NO: 340844

SEQ ID NO: 523713 - RNA, 64 nt, Homo Sapiens; identical to SEQ ID NO: 340845

SEQ ID NO: 523714 - RNA, 64 nt, Homo Sapiens; identical to SEQ ID NO: 340846

SEQ ID NO: 523715 - RNA, 64 nt, Homo Sapiens; identical to SEQ ID NO: 340847

SEQ ID NO: 523716 - RNA, 64 nt, Homo Sapiens; identical to SEQ ID NO: 340848

SEQ ID NO: 523717 - RNA, 64 nt, Homo Sapiens; identical to SEQ ID NO: 340849

SEQ ID NO: 523718 - RNA, 64 nt, Homo Sapiens; identical to SEQ ID NO: 340850

SEQ ID NO: 523719 - RNA, 64 nt, Homo Sapiens; identical to SEQ ID NO: 340851

SEQ ID NO: 523720 - RNA, 64 nt, Homo Sapiens; identical to SEQ ID NO: 340852

SEQ ID NO: 523721 - RNA, 64 nt, Homo Sapiens; identical to SEQ ID NO: 340853

SEQ ID NO: 523722 - RNA, 64 nt, Homo Sapiens; identical to SEQ ID NO: 340854

SEQ ID NO: 523723 - RNA, 64 nt, Homo Sapiens; identical to SEQ ID NO: 340855

SEQ ID NO: 523724 - RNA, 64 nt, Homo Sapiens; identical to SEQ ID NO: 340856

SEQ ID NO: 523725 - RNA, 64 nt, Homo Sapiens; identical to SEQ ID NO: 340857

SEQ ID NO: 523726 - RNA, 64 nt, Homo Sapiens; identical to SEQ ID NO: 340858

SEQ ID NO: 523727 - RNA, 64 nt, Homo Sapiens; identical to SEQ ID NO: 340859

SEQ ID NO: 523728 - RNA, 64 nt, Homo Sapiens; identical to SEQ ID NO: 340860

SEQ ID NO: 523729 - RNA, 64 nt, Homo Sapiens; identical to SEQ ID NO: 340861

SEQ ID NO: 523730 - RNA, 64 nt, Homo Sapiens; identical to SEQ ID NO: 340862

SEQ ID NO: 523731 - RNA, 64 nt, Homo Sapiens; identical to SEQ ID NO: 340863

SEQ ID NO: 523732 - RNA, 64 nt, Homo Sapiens; identical to SEQ ID NO: 340864

SEQ ID NO: 523733 - RNA, 64 nt, Homo Sapiens; identical to SEQ ID NO: 340865

SEQ ID NO: 523734 - RNA, 64 nt, Homo Sapiens; identical to SEQ ID NO: 115977

SEQ ID NO: 523735 - RNA, 64 nt, Homo Sapiens; identical to SEQ ID NO: 115978

SEQ ID NO: 523736 - RNA, 64 nt, Homo Sapiens; identical to SEQ ID NO: 115979

SEQ ID NO: 523737 - RNA, 64 nt, Homo Sapiens; identical to SEQ ID NO: 115980

SEQ ID NO: 523738 - RNA, 64 nt, Homo Sapiens; identical to SEQ ID NO: 115981

SEQ ID NO: 523739 - RNA, 64 nt, Homo Sapiens; identical to SEQ ID NO: 115982

SEQ ID NO: 523740 - RNA, 64 nt, Homo Sapiens; identical to SEQ ID NO: 115983

SEQ ID NO: 523741 - RNA, 64 nt, Homo Sapiens; identical to SEQ ID NO: 115984

SEQ ID NO: 523742 - RNA, 64 nt, Homo Sapiens; identical to SEQ ID NO: 115985

SEQ ID NO: 523743 - RNA, 64 nt, Homo Sapiens; identical to SEQ ID NO: 115986

SEQ ID NO: 523744 - RNA, 64 nt, Homo Sapiens; identical to SEQ ID NO: 115987

SEQ ID NO: 523745 - RNA, 64 nt, Homo Sapiens; identical to SEQ ID NO: 115988

SEQ ID NO: 523746 - RNA, 64 nt, Homo Sapiens; identical to SEQ ID NO: 115989

SEQ ID NO: 523747 - RNA, 64 nt, Homo Sapiens; identical to SEQ ID NO: 115990

SEQ ID NO: 523748 - RNA, 64 nt, Homo Sapiens; identical to SEQ ID NO: 115991

SEQ ID NO: 523749 - RNA, 64 nt, Homo Sapiens; identical to SEQ ID NO: 115992

SEQ ID NO: 523750 - RNA, 64 nt, Homo Sapiens; identical to SEQ ID NO: 115993

SEQ ID NO: 523751 - RNA, 64 nt, Homo Sapiens; identical to SEQ ID NO: 115994

SEQ ID NO: 523752 - RNA, 64 nt, Homo Sapiens; identical to SEQ ID NO: 115995

SEQ ID NO: 523753 - RNA, 64 nt, Homo Sapiens; identical to SEQ ID NO: 115996

SEQ ID NO: 523754 - RNA, 64 nt, Homo Sapiens; identical to SEQ ID NO: 115997

SEQ ID NO: 523755 - RNA, 64 nt, Homo Sapiens; identical to SEQ ID NO: 115998

SEQ ID NO: 523756 - RNA, 64 nt, Homo Sapiens; identical to SEQ ID NO: 115999

SEQ ID NO: 523757 - RNA, 64 nt, Homo Sapiens; identical to SEQ ID NO: 116000

SEQ ID NO: 523758 - RNA, 64 nt, Homo Sapiens; identical to SEQ ID NO: 116001

SEQ ID NO: 523759 - RNA, 64 nt, Homo Sapiens; identical to SEQ ID NO: 116002

SEQ ID NO: 523760 - RNA, 64 nt, Homo Sapiens; identical to SEQ ID NO: 116003

SEQ ID NO: 523761 - RNA, 64 nt, Homo Sapiens; identical to SEQ ID NO: 116004

SEQ ID NO: 523762 - RNA, 64 nt, Homo Sapiens; identical to SEQ ID NO: 116005

SEQ ID NO: 523763 - RNA, 64 nt, Homo Sapiens; identical to SEQ ID NO: 116006

SEQ ID NO: 523764 - RNA, 64 nt, Homo Sapiens; identical to SEQ ID NO: 116007

SEQ ID NO: 523765 - RNA, 64 nt, Homo Sapiens; identical to SEQ ID NO: 116008

SEQ ID NO: 523766 - RNA, 64 nt, Homo Sapiens; identical to SEQ ID NO: 116009

SEQ ID NO: 523767 - RNA, 64 nt, Homo Sapiens; identical to SEQ ID NO: 116010

SEQ ID NO: 523768 - RNA, 64 nt, Homo Sapiens; identical to SEQ ID NO: 116011

SEQ ID NO: 523769 - RNA, 64 nt, Homo Sapiens; identical to SEQ ID NO: 116012

SEQ ID NO: 523770 - RNA, 64 nt, Homo Sapiens; identical to SEQ ID NO: 116013

SEQ ID NO: 523771 - RNA, 64 nt, Homo Sapiens; identical to SEQ ID NO: 116014

SEQ ID NO: 523772 - RNA, 64 nt, Homo Sapiens; identical to SEQ ID NO: 116015

SEQ ID NO: 523773 - RNA, 64 nt, Homo Sapiens; identical to SEQ ID NO: 116016

SEQ ID NO: 523774 - RNA, 64 nt, Homo Sapiens; identical to SEQ ID NO: 116017

SEQ ID NO: 523775 - RNA, 64 nt, Homo Sapiens; identical to SEQ ID NO: 116018

SEQ ID NO: 523776 - RNA, 64 nt, Homo Sapiens; identical to SEQ ID NO: 116019

SEQ ID NO: 523777 - RNA, 64 nt, Homo Sapiens; identical to SEQ ID NO: 116020

SEQ ID NO: 523778 - RNA, 64 nt, Homo Sapiens; identical to SEQ ID NO: 116021

SEQ ID NO: 523779 - RNA, 64 nt, Homo Sapiens; identical to SEQ ID NO: 116022

SEQ ID NO: 523780 - RNA, 64 nt, Homo Sapiens; identical to SEQ ID NO: 116023

SEQ ID NO: 523781 - RNA, 64 nt, Homo Sapiens; identical to SEQ ID NO: 116024

SEQ ID NO: 523782 - RNA, 64 nt, Homo Sapiens; identical to SEQ ID NO: 116025

SEQ ID NO: 523783 - RNA, 64 nt, Homo Sapiens; identical to SEQ ID NO: 116026

SEQ ID NO: 523784 - RNA, 64 nt, Homo Sapiens; identical to SEQ ID NO: 116027

SEQ ID NO: 523785 - RNA, 64 nt, Homo Sapiens; identical to SEQ ID NO: 116028

SEQ ID NO: 523786 - RNA, 64 nt, Homo Sapiens; identical to SEQ ID NO: 116029

SEQ ID NO: 523787 - RNA, 64 nt, Homo Sapiens; identical to SEQ ID NO: 116030

SEQ ID NO: 523788 - RNA, 64 nt, Homo Sapiens; identical to SEQ ID NO: 116031

SEQ ID NO: 523789 - RNA, 64 nt, Homo Sapiens; identical to SEQ ID NO: 116032

SEQ ID NO: 523790 - RNA, 64 nt, Homo Sapiens; identical to SEQ ID NO: 116033

SEQ ID NO: 523791 - RNA, 64 nt, Homo Sapiens; identical to SEQ ID NO: 116034

SEQ ID NO: 523792 - RNA, 64 nt, Homo Sapiens; identical to SEQ ID NO: 116035

SEQ ID NO: 523793 - RNA, 64 nt, Homo Sapiens; identical to SEQ ID NO: 116036

SEQ ID NO: 523794 - RNA, 64 nt, Homo Sapiens; identical to SEQ ID NO: 116037

SEQ ID NO: 523795 - RNA, 64 nt, Homo Sapiens; identical to SEQ ID NO: 116038

SEQ ID NO: 523796 - RNA, 64 nt, Homo Sapiens; identical to SEQ ID NO: 116039

SEQ ID NO: 523797 - RNA, 64 nt, Homo Sapiens; identical to SEQ ID NO: 116040

SEQ ID NO: 523798 - RNA, 64 nt, Homo Sapiens; identical to SEQ ID NO: 116041

SEQ ID NO: 523799 - RNA, 64 nt, Homo Sapiens; identical to SEQ ID NO: 116042

SEQ ID NO: 523800 - RNA, 64 nt, Homo Sapiens; identical to SEQ ID NO: 116043

SEQ ID NO: 523801 - RNA, 64 nt, Homo Sapiens; identical to SEQ ID NO: 116044

SEQ ID NO: 523802 - RNA, 64 nt, Homo Sapiens; identical to SEQ ID NO: 116045

SEQ ID NO: 523803 - RNA, 64 nt, Homo Sapiens; identical to SEQ ID NO: 116046

SEQ ID NO: 523804 - RNA, 64 nt, Homo Sapiens; identical to SEQ ID NO: 116047

SEQ ID NO: 523805 - RNA, 64 nt, Homo Sapiens; identical to SEQ ID NO: 116048

SEQ ID NO: 523806 - RNA, 64 nt, Homo Sapiens; identical to SEQ ID NO: 116049

SEQ ID NO: 523807 - RNA, 64 nt, Homo Sapiens; identical to SEQ ID NO: 116050

SEQ ID NO: 523808 - RNA, 64 nt, Homo Sapiens; identical to SEQ ID NO: 116051

SEQ ID NO: 523809 - RNA, 64 nt, Homo Sapiens; identical to SEQ ID NO: 116052

SEQ ID NO: 523810 - RNA, 64 nt, Homo Sapiens; identical to SEQ ID NO: 116053

SEQ ID NO: 523811 - RNA, 64 nt, Homo Sapiens; identical to SEQ ID NO: 116054

SEQ ID NO: 523812 - RNA, 64 nt, Homo Sapiens; identical to SEQ ID NO: 116055

SEQ ID NO: 523813 - RNA, 64 nt, Homo Sapiens; identical to SEQ ID NO: 116056

SEQ ID NO: 523814 - RNA, 64 nt, Homo Sapiens; identical to SEQ ID NO: 116057

SEQ ID NO: 523815 - RNA, 64 nt, Homo Sapiens; identical to SEQ ID NO: 116058

SEQ ID NO: 523816 - RNA, 64 nt, Homo Sapiens; identical to SEQ ID NO: 116059

SEQ ID NO: 523817 - RNA, 64 nt, Homo Sapiens; identical to SEQ ID NO: 116060

SEQ ID NO: 523818 - RNA, 64 nt, Homo Sapiens; identical to SEQ ID NO: 116061

SEQ ID NO: 523819 - RNA, 64 nt, Homo Sapiens; identical to SEQ ID NO: 116062

SEQ ID NO: 523820 - RNA, 64 nt, Homo Sapiens; identical to SEQ ID NO: 116063

SEQ ID NO: 523821 - RNA, 64 nt, Homo Sapiens; identical to SEQ ID NO: 116064

SEQ ID NO: 523822 - RNA, 64 nt, Homo Sapiens; identical to SEQ ID NO: 116065

SEQ ID NO: 523823 - RNA, 64 nt, Homo Sapiens; identical to SEQ ID NO: 116066

SEQ ID NO: 523824 - RNA, 64 nt, Homo Sapiens; identical to SEQ ID NO: 116067

SEQ ID NO: 523825 - RNA, 64 nt, Homo Sapiens; identical to SEQ ID NO: 116068

SEQ ID NO: 523826 - RNA, 64 nt, Homo Sapiens; identical to SEQ ID NO: 116069

SEQ ID NO: 523827 - RNA, 64 nt, Homo Sapiens; identical to SEQ ID NO: 116070

SEQ ID NO: 523828 - RNA, 64 nt, Homo Sapiens; identical to SEQ ID NO: 116071

SEQ ID NO: 523829 - RNA, 64 nt, Homo Sapiens; identical to SEQ ID NO: 116072

SEQ ID NO: 523830 - RNA, 64 nt, Homo Sapiens; identical to SEQ ID NO: 116073

SEQ ID NO: 523831 - RNA, 64 nt, Homo Sapiens; identical to SEQ ID NO: 116074

SEQ ID NO: 523832 - RNA, 64 nt, Homo Sapiens; identical to SEQ ID NO: 116075

SEQ ID NO: 523833 - RNA, 64 nt, Homo Sapiens; identical to SEQ ID NO: 116076

SEQ ID NO: 523834 - RNA, 64 nt, Homo Sapiens; identical to SEQ ID NO: 116077

SEQ ID NO: 523835 - RNA, 64 nt, Homo Sapiens; identical to SEQ ID NO: 116078

SEQ ID NO: 523836 - RNA, 64 nt, Homo Sapiens; identical to SEQ ID NO: 116079

SEQ ID NO: 523837 - RNA, 64 nt, Homo Sapiens; identical to SEQ ID NO: 116080

SEQ ID NO: 523838 - RNA, 64 nt, Homo Sapiens; identical to SEQ ID NO: 116081

SEQ ID NO: 523839 - RNA, 64 nt, Homo Sapiens; identical to SEQ ID NO: 116082

SEQ ID NO: 523840 - RNA, 64 nt, Homo Sapiens; identical to SEQ ID NO: 116083

SEQ ID NO: 523841 - RNA, 64 nt, Homo Sapiens; identical to SEQ ID NO: 116084

SEQ ID NO: 523842 - RNA, 64 nt, Homo Sapiens; identical to SEQ ID NO: 116085

SEQ ID NO: 523843 - RNA, 64 nt, Homo Sapiens; identical to SEQ ID NO: 116086

SEQ ID NO: 523844 - RNA, 64 nt, Homo Sapiens; identical to SEQ ID NO: 116087

SEQ ID NO: 523845 - RNA, 64 nt, Homo Sapiens; identical to SEQ ID NO: 116088

SEQ ID NO: 523846 - RNA, 64 nt, Homo Sapiens; identical to SEQ ID NO: 116089

SEQ ID NO: 523847 - RNA, 64 nt, Homo Sapiens; identical to SEQ ID NO: 116090

SEQ ID NO: 523848 - RNA, 64 nt, Homo Sapiens; identical to SEQ ID NO: 116091

SEQ ID NO: 523849 - RNA, 64 nt, Homo Sapiens; identical to SEQ ID NO: 116092

SEQ ID NO: 523850 - RNA, 64 nt, Homo Sapiens; identical to SEQ ID NO: 116093

SEQ ID NO: 523851 - RNA, 64 nt, Homo Sapiens; identical to SEQ ID NO: 116094

SEQ ID NO: 523852 - RNA, 64 nt, Homo Sapiens; identical to SEQ ID NO: 116095

SEQ ID NO: 523853 - RNA, 64 nt, Homo Sapiens; identical to SEQ ID NO: 116096

SEQ ID NO: 523854 - RNA, 64 nt, Homo Sapiens; identical to SEQ ID NO: 116097

SEQ ID NO: 523855 - RNA, 64 nt, Homo Sapiens; identical to SEQ ID NO: 116098

SEQ ID NO: 523856 - RNA, 64 nt, Homo Sapiens; identical to SEQ ID NO: 116099

SEQ ID NO: 523857 - RNA, 64 nt, Homo Sapiens; identical to SEQ ID NO: 116100

SEQ ID NO: 523858 - RNA, 64 nt, Homo Sapiens; identical to SEQ ID NO: 116101

SEQ ID NO: 523859 - RNA, 64 nt, Homo Sapiens; identical to SEQ ID NO: 116102

SEQ ID NO: 523860 - RNA, 64 nt, Homo Sapiens; identical to SEQ ID NO: 116103

SEQ ID NO: 523861 - RNA, 64 nt, Homo Sapiens; identical to SEQ ID NO: 116104

SEQ ID NO: 523862 - RNA, 64 nt, Homo Sapiens; identical to SEQ ID NO: 116105

SEQ ID NO: 523863 - RNA, 64 nt, Homo Sapiens; identical to SEQ ID NO: 116106

SEQ ID NO: 523864 - RNA, 64 nt, Homo Sapiens; identical to SEQ ID NO: 116107

SEQ ID NO: 523865 - RNA, 64 nt, Homo Sapiens; identical to SEQ ID NO: 116108

SEQ ID NO: 523866 - RNA, 64 nt, Homo Sapiens; identical to SEQ ID NO: 116109

SEQ ID NO: 523867 - RNA, 64 nt, Homo Sapiens; identical to SEQ ID NO: 116110

SEQ ID NO: 523868 - RNA, 64 nt, Homo Sapiens; identical to SEQ ID NO: 116111

SEQ ID NO: 523869 - RNA, 64 nt, Homo Sapiens; identical to SEQ ID NO: 116112

SEQ ID NO: 523870 - RNA, 64 nt, Homo Sapiens; identical to SEQ ID NO: 116113

SEQ ID NO: 523871 - RNA, 64 nt, Homo Sapiens; identical to SEQ ID NO: 116114

SEQ ID NO: 523872 - RNA, 64 nt, Homo Sapiens; identical to SEQ ID NO: 116115

SEQ ID NO: 523873 - RNA, 64 nt, Homo Sapiens; identical to SEQ ID NO: 116116

SEQ ID NO: 523874 - RNA, 64 nt, Homo Sapiens; identical to SEQ ID NO: 116117

SEQ ID NO: 523875 - RNA, 64 nt, Homo Sapiens; identical to SEQ ID NO: 116118

SEQ ID NO: 523876 - RNA, 64 nt, Homo Sapiens; identical to SEQ ID NO: 116119

SEQ ID NO: 523877 - RNA, 64 nt, Homo Sapiens; identical to SEQ ID NO: 116120

SEQ ID NO: 523878 - RNA, 64 nt, Homo Sapiens; identical to SEQ ID NO: 116121

SEQ ID NO: 523879 - RNA, 64 nt, Homo Sapiens; identical to SEQ ID NO: 116122

SEQ ID NO: 523880 - RNA, 64 nt, Homo Sapiens; identical to SEQ ID NO: 116123

SEQ ID NO: 523881 - RNA, 64 nt, Homo Sapiens; identical to SEQ ID NO: 116124

SEQ ID NO: 523882 - RNA, 64 nt, Homo Sapiens; identical to SEQ ID NO: 116125

SEQ ID NO: 523883 - RNA, 64 nt, Homo Sapiens; identical to SEQ ID NO: 116126

SEQ ID NO: 523884 - RNA, 64 nt, Homo Sapiens; identical to SEQ ID NO: 116127

SEQ ID NO: 523885 - RNA, 64 nt, Homo Sapiens; identical to SEQ ID NO: 116128

SEQ ID NO: 523886 - RNA, 64 nt, Homo Sapiens; identical to SEQ ID NO: 116129

SEQ ID NO: 523887 - RNA, 64 nt, Homo Sapiens; identical to SEQ ID NO: 116130

SEQ ID NO: 523888 - RNA, 64 nt, Homo Sapiens; identical to SEQ ID NO: 116131

SEQ ID NO: 523889 - RNA, 64 nt, Homo Sapiens; identical to SEQ ID NO: 116132

SEQ ID NO: 523890 - RNA, 64 nt, Homo Sapiens; identical to SEQ ID NO: 116133

SEQ ID NO: 523891 - RNA, 64 nt, Homo Sapiens; identical to SEQ ID NO: 116134

SEQ ID NO: 523892 - RNA, 64 nt, Homo Sapiens; identical to SEQ ID NO: 116135

SEQ ID NO: 523893 - RNA, 64 nt, Homo Sapiens; identical to SEQ ID NO: 116136

SEQ ID NO: 523894 - RNA, 64 nt, Homo Sapiens; identical to SEQ ID NO: 116137

SEQ ID NO: 523895 - RNA, 64 nt, Homo Sapiens; identical to SEQ ID NO: 116138

SEQ ID NO: 523896 - RNA, 64 nt, Homo Sapiens; identical to SEQ ID NO: 116139

SEQ ID NO: 523897 - RNA, 64 nt, Homo Sapiens; identical to SEQ ID NO: 116140

SEQ ID NO: 523898 - RNA, 64 nt, Homo Sapiens; identical to SEQ ID NO: 116141

SEQ ID NO: 523899 - RNA, 64 nt, Homo Sapiens; identical to SEQ ID NO: 116142

SEQ ID NO: 523900 - RNA, 64 nt, Homo Sapiens; identical to SEQ ID NO: 116143

SEQ ID NO: 523901 - RNA, 64 nt, Homo Sapiens; identical to SEQ ID NO: 116144

SEQ ID NO: 523902 - RNA, 64 nt, Homo Sapiens; identical to SEQ ID NO: 116145

SEQ ID NO: 523903 - RNA, 64 nt, Homo Sapiens; identical to SEQ ID NO: 116146

SEQ ID NO: 523904 - RNA, 64 nt, Homo Sapiens; identical to SEQ ID NO: 116147

SEQ ID NO: 523905 - RNA, 64 nt, Homo Sapiens; identical to SEQ ID NO: 116148

SEQ ID NO: 523906 - RNA, 64 nt, Homo Sapiens; identical to SEQ ID NO: 116149

SEQ ID NO: 523907 - RNA, 64 nt, Homo Sapiens; identical to SEQ ID NO: 116150

SEQ ID NO: 523908 - RNA, 64 nt, Homo Sapiens; identical to SEQ ID NO: 116151

SEQ ID NO: 523909 - RNA, 64 nt, Homo Sapiens; identical to SEQ ID NO: 116152

SEQ ID NO: 523910 - RNA, 64 nt, Homo Sapiens; identical to SEQ ID NO: 116153

SEQ ID NO: 523911 - RNA, 64 nt, Homo Sapiens; identical to SEQ ID NO: 116154

SEQ ID NO: 523912 - RNA, 64 nt, Homo Sapiens; identical to SEQ ID NO: 116155

SEQ ID NO: 523913 - RNA, 64 nt, Homo Sapiens; identical to SEQ ID NO: 116156

SEQ ID NO: 523914 - RNA, 64 nt, Homo Sapiens; identical to SEQ ID NO: 116157

SEQ ID NO: 523915 - RNA, 64 nt, Homo Sapiens; identical to SEQ ID NO: 116158

SEQ ID NO: 523916 - RNA, 64 nt, Homo Sapiens; identical to SEQ ID NO: 116159

SEQ ID NO: 523917 - RNA, 64 nt, Homo Sapiens; identical to SEQ ID NO: 116160

SEQ ID NO: 523918 - RNA, 64 nt, Homo Sapiens; identical to SEQ ID NO: 116161

SEQ ID NO: 523919 - RNA, 64 nt, Homo Sapiens; identical to SEQ ID NO: 116162

SEQ ID NO: 523920 - RNA, 64 nt, Homo Sapiens; identical to SEQ ID NO: 116163

SEQ ID NO: 523921 - RNA, 64 nt, Homo Sapiens; identical to SEQ ID NO: 116164

SEQ ID NO: 523922 - RNA, 64 nt, Homo Sapiens; identical to SEQ ID NO: 116165

SEQ ID NO: 523923 - RNA, 64 nt, Homo Sapiens; identical to SEQ ID NO: 116166

SEQ ID NO: 523924 - RNA, 64 nt, Homo Sapiens; identical to SEQ ID NO: 116167

SEQ ID NO: 523925 - RNA, 64 nt, Homo Sapiens; identical to SEQ ID NO: 116168

SEQ ID NO: 523926 - RNA, 64 nt, Homo Sapiens; identical to SEQ ID NO: 116169

SEQ ID NO: 523927 - RNA, 64 nt, Homo Sapiens; identical to SEQ ID NO: 116170

SEQ ID NO: 523928 - RNA, 64 nt, Homo Sapiens; identical to SEQ ID NO: 116171

SEQ ID NO: 523929 - RNA, 64 nt, Homo Sapiens; identical to SEQ ID NO: 116172

SEQ ID NO: 523930 - RNA, 64 nt, Homo Sapiens; identical to SEQ ID NO: 116173

SEQ ID NO: 523931 - RNA, 64 nt, Homo Sapiens; identical to SEQ ID NO: 116174

SEQ ID NO: 523932 - RNA, 64 nt, Homo Sapiens; identical to SEQ ID NO: 116175

SEQ ID NO: 523933 - RNA, 64 nt, Homo Sapiens; identical to SEQ ID NO: 116176

SEQ ID NO: 523934 - RNA, 64 nt, Homo Sapiens; identical to SEQ ID NO: 116177

SEQ ID NO: 523935 - RNA, 64 nt, Homo Sapiens; identical to SEQ ID NO: 116178

SEQ ID NO: 523936 - RNA, 64 nt, Homo Sapiens; identical to SEQ ID NO: 116179

SEQ ID NO: 523937 - RNA, 64 nt, Homo Sapiens; identical to SEQ ID NO: 116180

SEQ ID NO: 523938 - RNA, 64 nt, Homo Sapiens; identical to SEQ ID NO: 116181

SEQ ID NO: 523939 - RNA, 64 nt, Homo Sapiens; identical to SEQ ID NO: 116182

SEQ ID NO: 523940 - RNA, 64 nt, Homo Sapiens; identical to SEQ ID NO: 116183

SEQ ID NO: 523941 - RNA, 64 nt, Homo Sapiens; identical to SEQ ID NO: 116184

SEQ ID NO: 523942 - RNA, 64 nt, Homo Sapiens; identical to SEQ ID NO: 116185

SEQ ID NO: 523943 - RNA, 64 nt, Homo Sapiens; identical to SEQ ID NO: 116186

SEQ ID NO: 523944 - RNA, 64 nt, Homo Sapiens; identical to SEQ ID NO: 116187

SEQ ID NO: 523945 - RNA, 64 nt, Homo Sapiens; identical to SEQ ID NO: 116188

SEQ ID NO: 523946 - RNA, 64 nt, Homo Sapiens; identical to SEQ ID NO: 116189

SEQ ID NO: 523947 - RNA, 64 nt, Homo Sapiens; identical to SEQ ID NO: 116190

SEQ ID NO: 523948 - RNA, 64 nt, Homo Sapiens; identical to SEQ ID NO: 116191

SEQ ID NO: 523949 - RNA, 64 nt, Homo Sapiens; identical to SEQ ID NO: 116192

SEQ ID NO: 523950 - RNA, 64 nt, Homo Sapiens; identical to SEQ ID NO: 116193

SEQ ID NO: 523951 - RNA, 64 nt, Homo Sapiens; identical to SEQ ID NO: 116194

SEQ ID NO: 523952 - RNA, 64 nt, Homo Sapiens; identical to SEQ ID NO: 116195

SEQ ID NO: 523953 - RNA, 64 nt, Homo Sapiens; identical to SEQ ID NO: 116196

SEQ ID NO: 523954 - RNA, 64 nt, Homo Sapiens; identical to SEQ ID NO: 116197

SEQ ID NO: 523955 - RNA, 64 nt, Homo Sapiens; identical to SEQ ID NO: 116198

SEQ ID NO: 523956 - RNA, 64 nt, Homo Sapiens; identical to SEQ ID NO: 116199

SEQ ID NO: 523957 - RNA, 64 nt, Homo Sapiens; identical to SEQ ID NO: 116200

SEQ ID NO: 523958 - RNA, 64 nt, Homo Sapiens; identical to SEQ ID NO: 116201

SEQ ID NO: 523959 - RNA, 64 nt, Homo Sapiens; identical to SEQ ID NO: 116202

SEQ ID NO: 523960 - RNA, 64 nt, Homo Sapiens; identical to SEQ ID NO: 116203

SEQ ID NO: 523961 - RNA, 64 nt, Homo Sapiens; identical to SEQ ID NO: 116204

SEQ ID NO: 523962 - RNA, 64 nt, Homo Sapiens; identical to SEQ ID NO: 116205

SEQ ID NO: 523963 - RNA, 64 nt, Homo Sapiens; identical to SEQ ID NO: 116206

SEQ ID NO: 523964 - RNA, 64 nt, Homo Sapiens; identical to SEQ ID NO: 116207

SEQ ID NO: 523965 - RNA, 64 nt, Homo Sapiens; identical to SEQ ID NO: 116208

SEQ ID NO: 523966 - RNA, 64 nt, Homo Sapiens; identical to SEQ ID NO: 116209

SEQ ID NO: 523967 - RNA, 64 nt, Homo Sapiens; identical to SEQ ID NO: 116210

SEQ ID NO: 523968 - RNA, 64 nt, Homo Sapiens; identical to SEQ ID NO: 116211

SEQ ID NO: 523969 - RNA, 64 nt, Homo Sapiens; identical to SEQ ID NO: 116212

SEQ ID NO: 523970 - RNA, 64 nt, Homo Sapiens; identical to SEQ ID NO: 116213

SEQ ID NO: 523971 - RNA, 64 nt, Homo Sapiens; identical to SEQ ID NO: 116214

SEQ ID NO: 523972 - RNA, 64 nt, Homo Sapiens; identical to SEQ ID NO: 116215

SEQ ID NO: 523973 - RNA, 64 nt, Homo Sapiens; identical to SEQ ID NO: 116216

SEQ ID NO: 523974 - RNA, 64 nt, Homo Sapiens; identical to SEQ ID NO: 116217

SEQ ID NO: 523975 - RNA, 64 nt, Homo Sapiens; identical to SEQ ID NO: 116218

SEQ ID NO: 523976 - RNA, 64 nt, Homo Sapiens; identical to SEQ ID NO: 116219

SEQ ID NO: 523977 - RNA, 64 nt, Homo Sapiens; identical to SEQ ID NO: 116220

SEQ ID NO: 523978 - RNA, 64 nt, Homo Sapiens; identical to SEQ ID NO: 116221

SEQ ID NO: 523979 - RNA, 64 nt, Homo Sapiens; identical to SEQ ID NO: 116222

SEQ ID NO: 523980 - RNA, 64 nt, Homo Sapiens; identical to SEQ ID NO: 116223

SEQ ID NO: 523981 - RNA, 64 nt, Homo Sapiens; identical to SEQ ID NO: 116224

SEQ ID NO: 523982 - RNA, 64 nt, Homo Sapiens; identical to SEQ ID NO: 116225

SEQ ID NO: 523983 - RNA, 64 nt, Homo Sapiens; identical to SEQ ID NO: 116226

SEQ ID NO: 523984 - RNA, 64 nt, Homo Sapiens; identical to SEQ ID NO: 116227

SEQ ID NO: 523985 - RNA, 64 nt, Homo Sapiens; identical to SEQ ID NO: 116228

SEQ ID NO: 523986 - RNA, 64 nt, Homo Sapiens; identical to SEQ ID NO: 116229

SEQ ID NO: 523987 - RNA, 64 nt, Homo Sapiens; identical to SEQ ID NO: 116230

SEQ ID NO: 523988 - RNA, 64 nt, Homo Sapiens; identical to SEQ ID NO: 116231

SEQ ID NO: 523989 - RNA, 64 nt, Homo Sapiens; identical to SEQ ID NO: 116232

SEQ ID NO: 523990 - RNA, 64 nt, Homo Sapiens; identical to SEQ ID NO: 116233

SEQ ID NO: 523991 - RNA, 64 nt, Homo Sapiens; identical to SEQ ID NO: 116234

SEQ ID NO: 523992 - RNA, 64 nt, Homo Sapiens; identical to SEQ ID NO: 116235

SEQ ID NO: 523993 - RNA, 64 nt, Homo Sapiens; identical to SEQ ID NO: 116236

SEQ ID NO: 523994 - RNA, 64 nt, Homo Sapiens; identical to SEQ ID NO: 116237

SEQ ID NO: 523995 - RNA, 64 nt, Homo Sapiens; identical to SEQ ID NO: 116238

SEQ ID NO: 523996 - RNA, 64 nt, Homo Sapiens; identical to SEQ ID NO: 116239

SEQ ID NO: 523997 - RNA, 64 nt, Homo Sapiens; identical to SEQ ID NO: 116240

SEQ ID NO: 523998 - RNA, 64 nt, Homo Sapiens; identical to SEQ ID NO: 116241

SEQ ID NO: 523999 - RNA, 64 nt, Homo Sapiens; identical to SEQ ID NO: 116242

SEQ ID NO: 524000 - RNA, 64 nt, Homo Sapiens; identical to SEQ ID NO: 116243

SEQ ID NO: 524001 - RNA, 64 nt, Homo Sapiens; identical to SEQ ID NO: 116244

SEQ ID NO: 524002 - RNA, 64 nt, Homo Sapiens; identical to SEQ ID NO: 116245

SEQ ID NO: 524003 - RNA, 64 nt, Homo Sapiens; identical to SEQ ID NO: 116246

SEQ ID NO: 524004 - RNA, 64 nt, Homo Sapiens; identical to SEQ ID NO: 116247

SEQ ID NO: 524005 - RNA, 64 nt, Homo Sapiens; identical to SEQ ID NO: 116248

SEQ ID NO: 524006 - RNA, 64 nt, Homo Sapiens; identical to SEQ ID NO: 116249

SEQ ID NO: 524007 - RNA, 64 nt, Homo Sapiens; identical to SEQ ID NO: 116250

SEQ ID NO: 524008 - RNA, 64 nt, Homo Sapiens; identical to SEQ ID NO: 116251

SEQ ID NO: 524009 - RNA, 64 nt, Homo Sapiens; identical to SEQ ID NO: 116252

SEQ ID NO: 524010 - RNA, 64 nt, Homo Sapiens; identical to SEQ ID NO: 116253

SEQ ID NO: 524011 - RNA, 64 nt, Homo Sapiens; identical to SEQ ID NO: 116254

SEQ ID NO: 524012 - RNA, 64 nt, Homo Sapiens; identical to SEQ ID NO: 116255

SEQ ID NO: 524013 - RNA, 64 nt, Homo Sapiens; identical to SEQ ID NO: 116256

SEQ ID NO: 524014 - RNA, 64 nt, Homo Sapiens; identical to SEQ ID NO: 116257

SEQ ID NO: 524015 - RNA, 64 nt, Homo Sapiens; identical to SEQ ID NO: 116258

SEQ ID NO: 524016 - RNA, 64 nt, Homo Sapiens; identical to SEQ ID NO: 116259

SEQ ID NO: 524017 - RNA, 64 nt, Homo Sapiens; identical to SEQ ID NO: 116260

SEQ ID NO: 524018 - RNA, 64 nt, Homo Sapiens; identical to SEQ ID NO: 116261

SEQ ID NO: 524019 - RNA, 64 nt, Homo Sapiens; identical to SEQ ID NO: 116262

SEQ ID NO: 524020 - RNA, 64 nt, Homo Sapiens; identical to SEQ ID NO: 116263

SEQ ID NO: 524021 - RNA, 64 nt, Homo Sapiens; identical to SEQ ID NO: 116264

SEQ ID NO: 524022 - RNA, 64 nt, Homo Sapiens; identical to SEQ ID NO: 116265

SEQ ID NO: 524023 - RNA, 64 nt, Homo Sapiens; identical to SEQ ID NO: 116266

SEQ ID NO: 524024 - RNA, 64 nt, Homo Sapiens; identical to SEQ ID NO: 116267

SEQ ID NO: 524025 - RNA, 64 nt, Homo Sapiens; identical to SEQ ID NO: 116268

SEQ ID NO: 524026 - RNA, 64 nt, Homo Sapiens; identical to SEQ ID NO: 116269

SEQ ID NO: 524027 - RNA, 64 nt, Homo Sapiens; identical to SEQ ID NO: 116270

SEQ ID NO: 524028 - RNA, 64 nt, Homo Sapiens; identical to SEQ ID NO: 116271

SEQ ID NO: 524029 - RNA, 64 nt, Homo Sapiens; identical to SEQ ID NO: 116272

SEQ ID NO: 524030 - RNA, 64 nt, Homo Sapiens; identical to SEQ ID NO: 116273

SEQ ID NO: 524031 - RNA, 64 nt, Homo Sapiens; identical to SEQ ID NO: 116274

SEQ ID NO: 524032 - RNA, 64 nt, Homo Sapiens; identical to SEQ ID NO: 116275

SEQ ID NO: 524033 - RNA, 64 nt, Homo Sapiens; identical to SEQ ID NO: 116276

SEQ ID NO: 524034 - RNA, 64 nt, Homo Sapiens; identical to SEQ ID NO: 116277

SEQ ID NO: 524035 - RNA, 64 nt, Homo Sapiens; identical to SEQ ID NO: 116278

SEQ ID NO: 524036 - RNA, 64 nt, Homo Sapiens; identical to SEQ ID NO: 116279

SEQ ID NO: 524037 - RNA, 64 nt, Homo Sapiens; identical to SEQ ID NO: 116280

SEQ ID NO: 524038 - RNA, 64 nt, Homo Sapiens; identical to SEQ ID NO: 116281

SEQ ID NO: 524039 - RNA, 64 nt, Homo Sapiens; identical to SEQ ID NO: 116282

SEQ ID NO: 524040 - RNA, 64 nt, Homo Sapiens; identical to SEQ ID NO: 116283

SEQ ID NO: 524041 - RNA, 64 nt, Homo Sapiens; identical to SEQ ID NO: 116284

SEQ ID NO: 524042 - RNA, 64 nt, Homo Sapiens; identical to SEQ ID NO: 116285

SEQ ID NO: 524043 - RNA, 64 nt, Homo Sapiens; identical to SEQ ID NO: 116286

SEQ ID NO: 524044 - RNA, 64 nt, Homo Sapiens; identical to SEQ ID NO: 116287

SEQ ID NO: 524045 - RNA, 64 nt, Homo Sapiens; identical to SEQ ID NO: 116288

SEQ ID NO: 524046 - RNA, 64 nt, Homo Sapiens; identical to SEQ ID NO: 116289

SEQ ID NO: 524047 - RNA, 64 nt, Homo Sapiens; identical to SEQ ID NO: 116290

SEQ ID NO: 524048 - RNA, 64 nt, Homo Sapiens; identical to SEQ ID NO: 116291

SEQ ID NO: 524049 - RNA, 64 nt, Homo Sapiens; identical to SEQ ID NO: 116292

SEQ ID NO: 524050 - RNA, 64 nt, Homo Sapiens; identical to SEQ ID NO: 116293

SEQ ID NO: 524051 - RNA, 64 nt, Homo Sapiens; identical to SEQ ID NO: 116294

SEQ ID NO: 524052 - RNA, 64 nt, Homo Sapiens; identical to SEQ ID NO: 116295

SEQ ID NO: 524053 - RNA, 64 nt, Homo Sapiens; identical to SEQ ID NO: 116296

SEQ ID NO: 524054 - RNA, 64 nt, Homo Sapiens; identical to SEQ ID NO: 116297

SEQ ID NO: 524055 - RNA, 64 nt, Homo Sapiens; identical to SEQ ID NO: 116298

SEQ ID NO: 524056 - RNA, 64 nt, Homo Sapiens; identical to SEQ ID NO: 116299

SEQ ID NO: 524057 - RNA, 64 nt, Homo Sapiens; identical to SEQ ID NO: 116300

SEQ ID NO: 524058 - RNA, 64 nt, Homo Sapiens; identical to SEQ ID NO: 116301

SEQ ID NO: 524059 - RNA, 64 nt, Homo Sapiens; identical to SEQ ID NO: 116302

SEQ ID NO: 524060 - RNA, 64 nt, Homo Sapiens; identical to SEQ ID NO: 116303

SEQ ID NO: 524061 - RNA, 64 nt, Homo Sapiens; identical to SEQ ID NO: 116304

SEQ ID NO: 524062 - RNA, 64 nt, Homo Sapiens; identical to SEQ ID NO: 116305

SEQ ID NO: 524063 - RNA, 64 nt, Homo Sapiens; identical to SEQ ID NO: 116306

SEQ ID NO: 524064 - RNA, 64 nt, Homo Sapiens; identical to SEQ ID NO: 116307

SEQ ID NO: 524065 - RNA, 64 nt, Homo Sapiens; identical to SEQ ID NO: 116308

SEQ ID NO: 524066 - RNA, 64 nt, Homo Sapiens; identical to SEQ ID NO: 116309

SEQ ID NO: 524067 - RNA, 64 nt, Homo Sapiens; identical to SEQ ID NO: 116310

SEQ ID NO: 524068 - RNA, 64 nt, Homo Sapiens; identical to SEQ ID NO: 116311

SEQ ID NO: 524069 - RNA, 64 nt, Homo Sapiens; identical to SEQ ID NO: 116312

SEQ ID NO: 524070 - RNA, 64 nt, Homo Sapiens; identical to SEQ ID NO: 116313

SEQ ID NO: 524071 - RNA, 64 nt, Homo Sapiens; identical to SEQ ID NO: 116314

SEQ ID NO: 524072 - RNA, 64 nt, Homo Sapiens; identical to SEQ ID NO: 116315

SEQ ID NO: 524073 - RNA, 64 nt, Homo Sapiens; identical to SEQ ID NO: 116316

SEQ ID NO: 524074 - RNA, 64 nt, Homo Sapiens; identical to SEQ ID NO: 116317

SEQ ID NO: 524075 - RNA, 64 nt, Homo Sapiens; identical to SEQ ID NO: 116318

SEQ ID NO: 524076 - RNA, 64 nt, Homo Sapiens; identical to SEQ ID NO: 116319

SEQ ID NO: 524077 - RNA, 64 nt, Homo Sapiens; identical to SEQ ID NO: 116320

SEQ ID NO: 524078 - RNA, 64 nt, Homo Sapiens; identical to SEQ ID NO: 116321

SEQ ID NO: 524079 - RNA, 64 nt, Homo Sapiens; identical to SEQ ID NO: 116322

SEQ ID NO: 524080 - RNA, 64 nt, Homo Sapiens; identical to SEQ ID NO: 116323

SEQ ID NO: 524081 - RNA, 64 nt, Homo Sapiens; identical to SEQ ID NO: 116324

SEQ ID NO: 524082 - RNA, 64 nt, Homo Sapiens; identical to SEQ ID NO: 116325

SEQ ID NO: 524083 - RNA, 64 nt, Homo Sapiens; identical to SEQ ID NO: 116326

SEQ ID NO: 524084 - RNA, 64 nt, Homo Sapiens; identical to SEQ ID NO: 116327

SEQ ID NO: 524085 - RNA, 64 nt, Homo Sapiens; identical to SEQ ID NO: 116328

SEQ ID NO: 524086 - RNA, 64 nt, Homo Sapiens; identical to SEQ ID NO: 116329

SEQ ID NO: 524087 - RNA, 64 nt, Homo Sapiens; identical to SEQ ID NO: 116330

SEQ ID NO: 524088 - RNA, 64 nt, Homo Sapiens; identical to SEQ ID NO: 116331

SEQ ID NO: 524089 - RNA, 64 nt, Homo Sapiens; identical to SEQ ID NO: 116332

SEQ ID NO: 524090 - RNA, 64 nt, Homo Sapiens; identical to SEQ ID NO: 116333

SEQ ID NO: 524091 - RNA, 64 nt, Homo Sapiens; identical to SEQ ID NO: 116334

SEQ ID NO: 524092 - RNA, 64 nt, Homo Sapiens; identical to SEQ ID NO: 116335

SEQ ID NO: 524093 - RNA, 64 nt, Homo Sapiens; identical to SEQ ID NO: 116336

SEQ ID NO: 524094 - RNA, 64 nt, Homo Sapiens; identical to SEQ ID NO: 116337

SEQ ID NO: 524095 - RNA, 64 nt, Homo Sapiens; identical to SEQ ID NO: 116338

SEQ ID NO: 524096 - RNA, 64 nt, Homo Sapiens; identical to SEQ ID NO: 116339

SEQ ID NO: 524097 - RNA, 64 nt, Homo Sapiens; identical to SEQ ID NO: 116340

SEQ ID NO: 524098 - RNA, 64 nt, Homo Sapiens; identical to SEQ ID NO: 116341

SEQ ID NO: 524099 - RNA, 64 nt, Homo Sapiens; identical to SEQ ID NO: 116342

SEQ ID NO: 524100 - RNA, 64 nt, Homo Sapiens; identical to SEQ ID NO: 116343

SEQ ID NO: 524101 - RNA, 64 nt, Homo Sapiens; identical to SEQ ID NO: 116344

SEQ ID NO: 524102 - RNA, 64 nt, Homo Sapiens; identical to SEQ ID NO: 116345

SEQ ID NO: 524103 - RNA, 64 nt, Homo Sapiens; identical to SEQ ID NO: 116346

SEQ ID NO: 524104 - RNA, 64 nt, Homo Sapiens; identical to SEQ ID NO: 116347

SEQ ID NO: 524105 - RNA, 64 nt, Homo Sapiens; identical to SEQ ID NO: 116348

SEQ ID NO: 524106 - RNA, 64 nt, Homo Sapiens; identical to SEQ ID NO: 116349

SEQ ID NO: 524107 - RNA, 64 nt, Homo Sapiens; identical to SEQ ID NO: 116350

SEQ ID NO: 524108 - RNA, 64 nt, Homo Sapiens; identical to SEQ ID NO: 116351

SEQ ID NO: 524109 - RNA, 64 nt, Homo Sapiens; identical to SEQ ID NO: 116352

SEQ ID NO: 524110 - RNA, 64 nt, Homo Sapiens; identical to SEQ ID NO: 116353

SEQ ID NO: 524111 - RNA, 64 nt, Homo Sapiens; identical to SEQ ID NO: 116354

SEQ ID NO: 524112 - RNA, 64 nt, Homo Sapiens; identical to SEQ ID NO: 116355

SEQ ID NO: 524113 - RNA, 64 nt, Homo Sapiens; identical to SEQ ID NO: 116356

SEQ ID NO: 524114 - RNA, 64 nt, Homo Sapiens; identical to SEQ ID NO: 116357

SEQ ID NO: 524115 - RNA, 64 nt, Homo Sapiens; identical to SEQ ID NO: 116358

SEQ ID NO: 524116 - RNA, 64 nt, Homo Sapiens; identical to SEQ ID NO: 116359

SEQ ID NO: 524117 - RNA, 64 nt, Homo Sapiens; identical to SEQ ID NO: 116360

SEQ ID NO: 524118 - RNA, 64 nt, Homo Sapiens; identical to SEQ ID NO: 116361

SEQ ID NO: 524119 - RNA, 64 nt, Homo Sapiens; identical to SEQ ID NO: 116362

SEQ ID NO: 524120 - RNA, 64 nt, Homo Sapiens; identical to SEQ ID NO: 116363

SEQ ID NO: 524121 - RNA, 64 nt, Homo Sapiens; identical to SEQ ID NO: 116364

SEQ ID NO: 524122 - RNA, 64 nt, Homo Sapiens; identical to SEQ ID NO: 116365

SEQ ID NO: 524123 - RNA, 64 nt, Homo Sapiens; identical to SEQ ID NO: 116366

SEQ ID NO: 524124 - RNA, 64 nt, Homo Sapiens; identical to SEQ ID NO: 116367

SEQ ID NO: 524125 - RNA, 64 nt, Homo Sapiens; identical to SEQ ID NO: 116368

SEQ ID NO: 524126 - RNA, 64 nt, Homo Sapiens; identical to SEQ ID NO: 264086

SEQ ID NO: 524127 - RNA, 64 nt, Homo Sapiens; identical to SEQ ID NO: 264087

SEQ ID NO: 524128 - RNA, 64 nt, Homo Sapiens; identical to SEQ ID NO: 264088

SEQ ID NO: 524129 - RNA, 64 nt, Homo Sapiens; identical to SEQ ID NO: 264089

SEQ ID NO: 524130 - RNA, 64 nt, Homo Sapiens; identical to SEQ ID NO: 264090

SEQ ID NO: 524131 - RNA, 64 nt, Homo Sapiens; identical to SEQ ID NO: 264091

SEQ ID NO: 524132 - RNA, 64 nt, Homo Sapiens; identical to SEQ ID NO: 264092

SEQ ID NO: 524133 - RNA, 64 nt, Homo Sapiens; identical to SEQ ID NO: 264093

SEQ ID NO: 524134 - RNA, 64 nt, Homo Sapiens; identical to SEQ ID NO: 264094

SEQ ID NO: 524135 - RNA, 64 nt, Homo Sapiens; identical to SEQ ID NO: 264095

SEQ ID NO: 524136 - RNA, 64 nt, Homo Sapiens
augggaccagcucuggccagccuuucuugcuguuaggggcuaccccuuuuugcucauuucccag

SEQ ID NO: 524137 - RNA, 64 nt, Homo Sapiens
cucccucaggaggcugaauugccagagaggcuccaggggcuagaaccagguggaccagguggug

SEQ ID NO: 524138 - RNA, 64 nt, Homo Sapiens; identical to SEQ ID NO: 88200

SEQ ID NO: 524139 - RNA, 64 nt, Homo Sapiens; identical to SEQ ID NO: 88201

SEQ ID NO: 524140 - RNA, 64 nt, Homo Sapiens; identical to SEQ ID NO: 88202

SEQ ID NO: 524141 - RNA, 64 nt, Homo Sapiens; identical to SEQ ID NO: 88203

SEQ ID NO: 524142 - RNA, 64 nt, Homo Sapiens; identical to SEQ ID NO: 88204

SEQ ID NO: 524143 - RNA, 64 nt, Homo Sapiens; identical to SEQ ID NO: 88205

SEQ ID NO: 524144 - RNA, 64 nt, Homo Sapiens; identical to SEQ ID NO: 88206

SEQ ID NO: 524145 - RNA, 64 nt, Homo Sapiens; identical to SEQ ID NO: 88207

SEQ ID NO: 524146 - RNA, 64 nt, Homo Sapiens; identical to SEQ ID NO: 88208

SEQ ID NO: 524147 - RNA, 64 nt, Homo Sapiens; identical to SEQ ID NO: 88209

SEQ ID NO: 524148 - RNA, 64 nt, Homo Sapiens; identical to SEQ ID NO: 88210

SEQ ID NO: 524149 - RNA, 64 nt, Homo Sapiens; identical to SEQ ID NO: 88211

SEQ ID NO: 524150 - RNA, 64 nt, Homo Sapiens; identical to SEQ ID NO: 88212

SEQ ID NO: 524151 - RNA, 64 nt, Homo Sapiens; identical to SEQ ID NO: 88213

SEQ ID NO: 524152 - RNA, 64 nt, Homo Sapiens; identical to SEQ ID NO: 88214

SEQ ID NO: 524153 - RNA, 64 nt, Homo Sapiens; identical to SEQ ID NO: 88215

SEQ ID NO: 524154 - RNA, 64 nt, Homo Sapiens; identical to SEQ ID NO: 88216

SEQ ID NO: 524155 - RNA, 64 nt, Homo Sapiens; identical to SEQ ID NO: 88217

SEQ ID NO: 524156 - RNA, 64 nt, Homo Sapiens; identical to SEQ ID NO: 88218

SEQ ID NO: 524157 - RNA, 64 nt, Homo Sapiens; identical to SEQ ID NO: 88219

SEQ ID NO: 524158 - RNA, 64 nt, Homo Sapiens; identical to SEQ ID NO: 88220

SEQ ID NO: 524159 - RNA, 64 nt, Homo Sapiens; identical to SEQ ID NO: 88221

SEQ ID NO: 524160 - RNA, 64 nt, Homo Sapiens; identical to SEQ ID NO: 88222

SEQ ID NO: 524161 - RNA, 64 nt, Homo Sapiens; identical to SEQ ID NO: 88223

SEQ ID NO: 524162 - RNA, 64 nt, Homo Sapiens; identical to SEQ ID NO: 88224

SEQ ID NO: 524163 - RNA, 64 nt, Homo Sapiens; identical to SEQ ID NO: 88225

SEQ ID NO: 524164 - RNA, 64 nt, Homo Sapiens; identical to SEQ ID NO: 88226

SEQ ID NO: 524165 - RNA, 64 nt, Homo Sapiens; identical to SEQ ID NO: 88227

SEQ ID NO: 524166 - RNA, 64 nt, Homo Sapiens; identical to SEQ ID NO: 88228

SEQ ID NO: 524167 - RNA, 64 nt, Homo Sapiens; identical to SEQ ID NO: 88229

SEQ ID NO: 524168 - RNA, 64 nt, Homo Sapiens; identical to SEQ ID NO: 88230

SEQ ID NO: 524169 - RNA, 64 nt, Homo Sapiens; identical to SEQ ID NO: 88231

SEQ ID NO: 524170 - RNA, 64 nt, Homo Sapiens; identical to SEQ ID NO: 88232

SEQ ID NO: 524171 - RNA, 64 nt, Homo Sapiens; identical to SEQ ID NO: 88233

SEQ ID NO: 524172 - RNA, 64 nt, Homo Sapiens; identical to SEQ ID NO: 88234

SEQ ID NO: 524173 - RNA, 64 nt, Homo Sapiens; identical to SEQ ID NO: 88235

SEQ ID NO: 524174 - RNA, 64 nt, Homo Sapiens; identical to SEQ ID NO: 88236

SEQ ID NO: 524175 - RNA, 64 nt, Homo Sapiens; identical to SEQ ID NO: 88237

SEQ ID NO: 524176 - RNA, 64 nt, Homo Sapiens; identical to SEQ ID NO: 88238

SEQ ID NO: 524177 - RNA, 64 nt, Homo Sapiens; identical to SEQ ID NO: 88239

SEQ ID NO: 524178 - RNA, 64 nt, Homo Sapiens; identical to SEQ ID NO: 88240

SEQ ID NO: 524179 - RNA, 64 nt, Homo Sapiens; identical to SEQ ID NO: 88241

SEQ ID NO: 524180 - RNA, 64 nt, Homo Sapiens; identical to SEQ ID NO: 88242

SEQ ID NO: 524181 - RNA, 64 nt, Homo Sapiens; identical to SEQ ID NO: 88243

SEQ ID NO: 524182 - RNA, 64 nt, Homo Sapiens; identical to SEQ ID NO: 88244

SEQ ID NO: 524183 - RNA, 64 nt, Homo Sapiens; identical to SEQ ID NO: 88245

SEQ ID NO: 524184 - RNA, 64 nt, Homo Sapiens; identical to SEQ ID NO: 88246

SEQ ID NO: 524185 - RNA, 64 nt, Homo Sapiens; identical to SEQ ID NO: 88247

SEQ ID NO: 524186 - RNA, 64 nt, Homo Sapiens; identical to SEQ ID NO: 88248

SEQ ID NO: 524187 - RNA, 61 nt, Homo Sapiens; identical to SEQ ID NO: 88249

SEQ ID NO: 524188 - RNA, 64 nt, Homo Sapiens; identical to SEQ ID NO: 88250

SEQ ID NO: 524189 - RNA, 64 nt, Homo Sapiens; identical to SEQ ID NO: 88251

SEQ ID NO: 524190 - RNA, 64 nt, Homo Sapiens; identical to SEQ ID NO: 88252

SEQ ID NO: 524191 - RNA, 64 nt, Homo Sapiens; identical to SEQ ID NO: 88253

SEQ ID NO: 524192 - RNA, 64 nt, Homo Sapiens; identical to SEQ ID NO: 88254

SEQ ID NO: 524193 - RNA, 64 nt, Homo Sapiens; identical to SEQ ID NO: 88255

SEQ ID NO: 524194 - RNA, 64 nt, Homo Sapiens; identical to SEQ ID NO: 88256

SEQ ID NO: 524195 - RNA, 64 nt, Homo Sapiens
aucaaagcugucauguuggaucaguaucagcccaugguuucaggcccguaucgaacuuuuguuc

SEQ ID NO: 524196 - RNA, 64 nt, Homo Sapiens
aguaugaaccagcuuucuuuuuuuuaucuuuauaugguuucagagagagugauuuuuuaaaaau

SEQ ID NO: 524197 - RNA, 64 nt, Homo Sapiens
ugguuacauaucaaaacaucacauuuuaaggcaaugguuucacaagcaauaaaagacaaaugca

SEQ ID NO: 524198 - RNA, 64 nt, Homo Sapiens
uccuuuugaacacguucgaccuuccuccaauaguugguuucaaaaaaggagagugauugauuuu

SEQ ID NO: 524199 - RNA, 64 nt, Homo Sapiens
uuuucauuuaaauucucugauggagggacaacaaugguuucaacuguaugcccaugccugaucc

SEQ ID NO: 524200 - RNA, 64 nt, Homo Sapiens
cuccacuggccucuaaaauuauauuagccaagagugguuucauuugagugccuucguguguaug

SEQ ID NO: 524201 - RNA, 64 nt, Homo Sapiens
ccugaggcaauuagacacuuaaguaaauaggaauugguuucacgguaccccauggagcugggcu

SEQ ID NO: 524202 - RNA, 64 nt, Homo Sapiens
uuaguuaccuuauaguuacugaguuacaguucugugguuucaugaaguucaugcagcuguggca

SEQ ID NO: 524203 - RNA, 64 nt, Homo Sapiens
cauuuccucaaaaguaauuuauuuuuacagcuucugguuucacaugaaauuguuugcgcuacug

SEQ ID NO: 524204 - RNA, 64 nt, Homo Sapiens
ccucuucuucccaggugugccaaggaauuaaucuugguuucacuacaauuaaaauucacuccuu

SEQ ID NO: 524205 - RNA, 64 nt, Homo Sapiens
aagagacugaauuucuggguccuugcagcugugaugguuucagagcucagacugaucaggcauc

SEQ ID NO: 524206 - RNA, 64 nt, Homo Sapiens
uuaaaucagcuuuacaucauuuuuacauaucaagugguuucauguuaaaaaacaaacuccuagu

SEQ ID NO: 524207 - RNA, 64 nt, Homo Sapiens
cuuuuuaaccccucugugcuucgagaguugcuucugguuucacaccugcugcuucgugucucac

SEQ ID NO: 524208 - RNA, 64 nt, Homo Sapiens
ucggauggcaccuuuuggcuuaaacaugcgggccugguuucacaauuuaugaucagggauuuua

SEQ ID NO: 524209 - RNA, 64 nt, Homo Sapiens
acuaacaaaagugccucauccaaauuuguucuuuugguuucaucucgcuggcaucagugugcag

SEQ ID NO: 524210 - RNA, 64 nt, Homo Sapiens
auuuugcacugugaaauagcgccuucauuugggcugguuucaucaucagaauuguuauuaugca

SEQ ID NO: 524211 - RNA, 64 nt, Homo Sapiens
uugcaguggaacacugagucacaaauaaaucauuugguuucacuauuauuuccauucauuuagc

SEQ ID NO: 524212 - RNA, 64 nt, Homo Sapiens
ggcuaauuagaauguguuauguccuacucaccggugguuucaauaacaugagucgauaaauguu

SEQ ID NO: 524213 - RNA, 64 nt, Homo Sapiens
uuacauaaauaauagagcagugaagaauuaggcuugguuucaggcagcgggcagauuccaggaa

SEQ ID NO: 524214 - RNA, 64 nt, Homo Sapiens
gugagcugcuauauauuauugacuacauggaccuugguuucaaaagcugcuucaaaucacucuu

SEQ ID NO: 524215 - RNA, 64 nt, Homo Sapiens
guguuugugguuuaggagcugaaagaaaacccuuugguuucauuucuuccuuuuuuagauuuuu

SEQ ID NO: 524216 - RNA, 61 nt, Homo Sapiens
ucuugcaucuuccuuuuuuaauuuuggaaauugguuucaaaggccuggcagccuuguauag

SEQ ID NO: 524217 - RNA, 64 nt, Homo Sapiens
auaacucggcaucuugacgauagucccauuugggugguuucagcugcacuaucuguaugaaaug

SEQ ID NO: 524218 - RNA, 64 nt, Homo Sapiens
uaccaaccaaacccuaaauugaaagacaaaacuaugguuucagucaacauauucaugaauuagg

SEQ ID NO: 524219 - RNA, 64 nt, Homo Sapiens
aaaaaauaaacgauaaauauugaaucaauuacuuugguuucauggcuagaacuguuaguauugu

SEQ ID NO: 524220 - RNA, 64 nt, Homo Sapiens
ggcauuugcuuguccugcauugcauuaaacugaaugguuucacaugcauuuuuauugaaaggcc

SEQ ID NO: 524221 - RNA, 64 nt, Homo Sapiens
augcccccuccccaauuccugaacucccccauggugguuucauggguuugaagcuaccaccauu

SEQ ID NO: 524222 - RNA, 64 nt, Homo Sapiens
ucucuccuuucagggcuuuaccguucugccucagugguuucaaaccuaaagguucccucuccac

SEQ ID NO: 524223 - RNA, 64 nt, Homo Sapiens
agaagcagcaagaauggaccuuuuuaaucagauuugguuucaucauacagaagugguauuuugg

SEQ ID NO: 524224 - RNA, 64 nt, Homo Sapiens
caaaaccuuuucuccugugugcccuaauuguguuugguuucagauuagacaauguuauuuauua

SEQ ID NO: 524225 - RNA, 64 nt, Homo Sapiens; identical to SEQ ID NO: 348710

SEQ ID NO: 524226 - RNA, 64 nt, Homo Sapiens; identical to SEQ ID NO: 348711

SEQ ID NO: 524227 - RNA, 64 nt, Homo Sapiens; identical to SEQ ID NO: 348712

SEQ ID NO: 524228 - RNA, 64 nt, Homo Sapiens; identical to SEQ ID NO: 348713

SEQ ID NO: 524229 - RNA, 64 nt, Homo Sapiens; identical to SEQ ID NO: 348714

SEQ ID NO: 524230 - RNA, 64 nt, Homo Sapiens; identical to SEQ ID NO: 348715

SEQ ID NO: 524231 - RNA, 64 nt, Homo Sapiens; identical to SEQ ID NO: 348716

SEQ ID NO: 524232 - RNA, 64 nt, Homo Sapiens; identical to SEQ ID NO: 348717

SEQ ID NO: 524233 - RNA, 64 nt, Homo Sapiens; identical to SEQ ID NO: 348718

SEQ ID NO: 524234 - RNA, 64 nt, Homo Sapiens; identical to SEQ ID NO: 348719

SEQ ID NO: 524235 - RNA, 64 nt, Homo Sapiens; identical to SEQ ID NO: 348720

SEQ ID NO: 524236 - RNA, 64 nt, Homo Sapiens; identical to SEQ ID NO: 348721

SEQ ID NO: 524237 - RNA, 64 nt, Homo Sapiens; identical to SEQ ID NO: 348722

SEQ ID NO: 524238 - RNA, 64 nt, Homo Sapiens; identical to SEQ ID NO: 348723

SEQ ID NO: 524239 - RNA, 64 nt, Homo Sapiens; identical to SEQ ID NO: 348724

SEQ ID NO: 524240 - RNA, 64 nt, Homo Sapiens; identical to SEQ ID NO: 348725

SEQ ID NO: 524241 - RNA, 64 nt, Homo Sapiens; identical to SEQ ID NO: 348726

SEQ ID NO: 524242 - RNA, 64 nt, Homo Sapiens; identical to SEQ ID NO: 348727

SEQ ID NO: 524243 - RNA, 64 nt, Homo Sapiens; identical to SEQ ID NO: 348728

SEQ ID NO: 524244 - RNA, 64 nt, Homo Sapiens; identical to SEQ ID NO: 348729

SEQ ID NO: 524245 - RNA, 64 nt, Homo Sapiens; identical to SEQ ID NO: 348730

SEQ ID NO: 524246 - RNA, 64 nt, Homo Sapiens; identical to SEQ ID NO: 348731

SEQ ID NO: 524247 - RNA, 64 nt, Homo Sapiens
caaagaauacucaagucuuuuucuucuuauggaaucaucgaaacugcuauuuaucauaaucacc

SEQ ID NO: 524248 - RNA, 64 nt, Homo Sapiens
gauuuccagaaaagccucuuaauuuuaugcuuucucaucgaaguaauguacccuuuuuuucuga

SEQ ID NO: 524249 - RNA, 64 nt, Homo Sapiens
ggcaugguuugcuuaggaguucagaguuccuucaucaucgaaauagugauuaagugaucccaga

SEQ ID NO: 524250 - RNA, 64 nt, Homo Sapiens
aauaguuauggaaaauucggucacguaauuacucucaucgaaggacucauuacaacaaacaggg

SEQ ID NO: 524251 - RNA, 64 nt, Homo Sapiens
gcugcucggggagguggcagcagaagacagggagucaucgaagguuuguaacugaaacgcacca

SEQ ID NO: 524252 - RNA, 64 nt, Homo Sapiens
aauucauaucugaaaccauuuuagaagggagaagucaucgaaguauuuucugaguguugagaag

SEQ ID NO: 524253 - RNA, 64 nt, Homo Sapiens
aggugaaaugagaagcuaucaguaacagcuacucucaucgaaagcacuuuauuauuuuacggag

SEQ ID NO: 524254 - RNA, 64 nt, Homo Sapiens
acuuucuguaacaauuaaccuuauacuuuguuugucaucgaauauuuguugaaugcaugucagg

SEQ ID NO: 524255 - RNA, 64 nt, Homo Sapiens
caauuagcuagauaauucaagcagaaauccauuuucaucgaaauugccugugugcacauauuuu

SEQ ID NO: 524256 - RNA, 64 nt, Homo Sapiens
uggugaaacuauuucaggccaaauuuuaaaauuaucaucgaaggaagaauaaaugguguuuugg

SEQ ID NO: 524257 - RNA, 64 nt, Homo Sapiens
uuauuugagaaguagagcucacaccuggcccucuucaucgaauugauuacaggcguaagccacu

SEQ ID NO: 524258 - RNA, 64 nt, Homo Sapiens
cugccaccacuuuuggauuuuaugggaggcuccuucaucgaaugcuaaaccuuugaguagaguc

SEQ ID NO: 524259 - RNA, 64 nt, Homo Sapiens
guauaaaaauugcaguaucuaaaauguugaaaaaucaucgaaaucugcaaagccaaacagcugc

SEQ ID NO: 524260 - RNA, 64 nt, Homo Sapiens
ccaguggaggggacccuuuuuucauaaucuuuagucaucgaauccuucuugcauuuuugguauc

SEQ ID NO: 524261 - RNA, 64 nt, Homo Sapiens
gauuaauaaccugccagucccagaucacacaucaucaucgaagucuuccccaguuauaaagagg

SEQ ID NO: 524262 - RNA, 64 nt, Homo Sapiens
auacauccuugagagagaugccuuaaaccaaagcucaucgaagauagauuuguaugugugaaag

SEQ ID NO: 524263 - RNA, 64 nt, Homo Sapiens
uccuauuuacugaucacaaaugagcucauuaaugucaucgaaacauuuauuguaaccuaacaga

SEQ ID NO: 524264 - RNA, 64 nt, Homo Sapiens
ucagccaguuccuguaauuuauugucguguauagucaucgaauacaucauccaacauuauugag

SEQ ID NO: 524265 - RNA, 64 nt, Homo Sapiens
aguuaguguucuaugguuuaaauuagcauagcaaucaucgaacuuggauuucaaaugcaauaga

SEQ ID NO: 524266 - RNA, 64 nt, Homo Sapiens
uaauggggggacagacuugauuucuugguagccaucaucgaaacuggaauguucacugacgucu

SEQ ID NO: 524267 - RNA, 64 nt, Homo Sapiens
gauuuguuuggaaagcuacaaguugugauaauggucaucgaauguauaaauuagaauaaaauau

SEQ ID NO: 524268 - RNA, 64 nt, Homo Sapiens
uguucccuggucccccugaagccugcaaacguugucaucgaagggaaggguggggggcagcugc

SEQ ID NO: 524269 - RNA, 64 nt, Homo Sapiens
ccugguuucaggauggaucaaucacacgugcuucucaucgaaacaguugucuaguucuuccuuc

SEQ ID NO: 524270 - RNA, 64 nt, Homo Sapiens
cucacugguaauauuuuuaagaaacaugaagcaaucaucgaagacaggaacgaaauaccuccca

SEQ ID NO: 524271 - RNA, 64 nt, Homo Sapiens
gauuguguaucugugcuucuacaguauccccuucucaucgaagguaaauuccacugaaaauuua

SEQ ID NO: 524272 - RNA, 64 nt, Homo Sapiens
acgccuuuggaggaagcacucaaccaguacucugucaucgaagagaccagcucugacacagacu

SEQ ID NO: 524273 - RNA, 64 nt, Homo Sapiens
aaggguguacuuccuacauccaauuucccuuaauucaucgaaguuuauuuuuauguugaaacag

SEQ ID NO: 524274 - RNA, 64 nt, Homo Sapiens
gcagcuuuuucugaacuucauuuuuaaccauaguucaucgaaauuagacacuaugugcuuuuuu

SEQ ID NO: 524275 - RNA, 64 nt, Homo Sapiens
gggcccccauaauaaguuccuaaagcaugggaucucaucgaauaagacucaucauuuaauccuu

SEQ ID NO: 524276 - RNA, 64 nt, Homo Sapiens
cuucuuuuccgagucauaccccaugaucaaaguuucaucgaaaacuacgcagggaucuuccacu

SEQ ID NO: 524277 - RNA, 64 nt, Homo Sapiens
uccagaaauuuauccacuguuuaaauauagaccaucaucgaaacugccagaagaacucaugguu

SEQ ID NO: 524278 - RNA, 64 nt, Homo Sapiens
uuauguuucuuugcuuacuuaaauuuuacaguagucaucgaaaguugauauuugucuuuuuuuu

SEQ ID NO: 524279 - RNA, 64 nt, Homo Sapiens
ccacacauguucacagcucacacgcccucuccauucaucgaacuucucagugucccugucccug

SEQ ID NO: 524280 - RNA, 64 nt, Homo Sapiens
caugcuggagagaaaccuuauauauugcuauucaucaucgaacugauuuuucagauaucguuca

SEQ ID NO: 524281 - RNA, 64 nt, Homo Sapiens
accaguuuagauuucaagaaaaaauaaauggaaaucaucgaaaauucauuucacauuaaugguc

SEQ ID NO: 524282 - RNA, 64 nt, Homo Sapiens
uacuaauuccacaccuuuuaggaaaaacaggucuucaucgaauccuggaaguccaauguggcaa

SEQ ID NO: 524283 - RNA, 63 nt, Homo Sapiens
acagcacagcaguacuccacauuguuuccuauuuggacauagacuucauuuccuuucaguaua

SEQ ID NO: 524284 - RNA, 63 nt, Homo Sapiens
uuuuaaacuuccuaaaauuaggaauuagguaguuggacauagucugugaccuuuaugucguug

SEQ ID NO: 524285 - RNA, 63 nt, Homo Sapiens
acagaugaaccaaaaauguacgggauuucuauauggacauagcccgguagacugaauaucuga

SEQ ID NO: 524286 - RNA, 63 nt, Homo Sapiens
ccaccagguccuuuauguguacuucauggaacuuggacauacaucuggcagugguuuugaguu

SEQ ID NO: 524287 - RNA, 63 nt, Homo Sapiens
caaaauaacuuggcaaacuugugcaucucuuguuggacauaggcuccucuguuggacauauaa

SEQ ID NO: 524288 - RNA, 63 nt, Homo Sapiens
agugcaucucuuguuggacaucagcuccucuguuggacauauacuaaacacuaaguuuaauuu

SEQ ID NO: 524289 - RNA, 63 nt, Homo Sapiens
auuguuuuaaagaggauauauuauuuagaaaaauggacauaugaauauuauuaaaaauugagu

SEQ ID NO: 524290 - RNA, 63 nt, Homo Sapiens
uucuauuaacuaaaaugagguaagccauuauuuuggacauagaaacagaucuuuguaucuugu

SEQ ID NO: 524291 - RNA, 63 nt, Homo Sapiens
ugaaaucuuuuugucuuuaucugaaauuucccuuggacauaugcacaccaaaggaaagguaaa

SEQ ID NO: 524292 - RNA, 63 nt, Homo Sapiens
uagacugguuuuuguuguugaauccuaagccauuggacauaugcgugcucaucagagcaugcc

SEQ ID NO: 524293 - RNA, 63 nt, Homo Sapiens; identical to SEQ ID NO: 252244

SEQ ID NO: 524294 - RNA, 63 nt, Homo Sapiens; identical to SEQ ID NO: 252245

SEQ ID NO: 524295 - RNA, 63 nt, Homo Sapiens; identical to SEQ ID NO: 252246

SEQ ID NO: 524296 - RNA, 63 nt, Homo Sapiens; identical to SEQ ID NO: 252247

SEQ ID NO: 524297 - RNA, 63 nt, Homo Sapiens; identical to SEQ ID NO: 252248

SEQ ID NO: 524298 - RNA, 63 nt, Homo Sapiens; identical to SEQ ID NO: 252249

SEQ ID NO: 524299 - RNA, 63 nt, Homo Sapiens; identical to SEQ ID NO: 252250

SEQ ID NO: 524300 - RNA, 63 nt, Homo Sapiens; identical to SEQ ID NO: 252251

SEQ ID NO: 524301 - RNA, 63 nt, Homo Sapiens; identical to SEQ ID NO: 252252

SEQ ID NO: 524302 - RNA, 63 nt, Homo Sapiens; identical to SEQ ID NO: 252253

SEQ ID NO: 524303 - RNA, 63 nt, Homo Sapiens; identical to SEQ ID NO: 252254

SEQ ID NO: 524304 - RNA, 63 nt, Homo Sapiens; identical to SEQ ID NO: 252255

SEQ ID NO: 524305 - RNA, 63 nt, Homo Sapiens; identical to SEQ ID NO: 252256

SEQ ID NO: 524306 - RNA, 63 nt, Homo Sapiens; identical to SEQ ID NO: 252257

SEQ ID NO: 524307 - RNA, 63 nt, Homo Sapiens; identical to SEQ ID NO: 252258

SEQ ID NO: 524308 - RNA, 63 nt, Homo Sapiens; identical to SEQ ID NO: 252259

SEQ ID NO: 524309 - RNA, 63 nt, Homo Sapiens; identical to SEQ ID NO: 252260

SEQ ID NO: 524310 - RNA, 63 nt, Homo Sapiens; identical to SEQ ID NO: 252261

SEQ ID NO: 524311 - RNA, 63 nt, Homo Sapiens; identical to SEQ ID NO: 252262

SEQ ID NO: 524312 - RNA, 63 nt, Homo Sapiens; identical to SEQ ID NO: 252263

SEQ ID NO: 524313 - RNA, 63 nt, Homo Sapiens; identical to SEQ ID NO: 252264

SEQ ID NO: 524314 - RNA, 65 nt, Homo Sapiens; identical to SEQ ID NO: 252265

SEQ ID NO: 524315 - RNA, 65 nt, Homo Sapiens; identical to SEQ ID NO: 252266

SEQ ID NO: 524316 - RNA, 65 nt, Homo Sapiens; identical to SEQ ID NO: 252267

SEQ ID NO: 524317 - RNA, 65 nt, Homo Sapiens; identical to SEQ ID NO: 252268

SEQ ID NO: 524318 - RNA, 65 nt, Homo Sapiens; identical to SEQ ID NO: 252269

SEQ ID NO: 524319 - RNA, 65 nt, Homo Sapiens; identical to SEQ ID NO: 252270

SEQ ID NO: 524320 - RNA, 65 nt, Homo Sapiens; identical to SEQ ID NO: 252271

SEQ ID NO: 524321 - RNA, 65 nt, Homo Sapiens; identical to SEQ ID NO: 252272

SEQ ID NO: 524322 - RNA, 65 nt, Homo Sapiens; identical to SEQ ID NO: 252273

SEQ ID NO: 524323 - RNA, 65 nt, Homo Sapiens; identical to SEQ ID NO: 252274

SEQ ID NO: 524324 - RNA, 65 nt, Homo Sapiens; identical to SEQ ID NO: 252275

SEQ ID NO: 524325 - RNA, 65 nt, Homo Sapiens; identical to SEQ ID NO: 252276

SEQ ID NO: 524326 - RNA, 65 nt, Homo Sapiens; identical to SEQ ID NO: 252277

SEQ ID NO: 524327 - RNA, 65 nt, Homo Sapiens; identical to SEQ ID NO: 252278

SEQ ID NO: 524328 - RNA, 65 nt, Homo Sapiens; identical to SEQ ID NO: 252279

SEQ ID NO: 524329 - RNA, 65 nt, Homo Sapiens; identical to SEQ ID NO: 252280

SEQ ID NO: 524330 - RNA, 65 nt, Homo Sapiens; identical to SEQ ID NO: 252281

SEQ ID NO: 524331 - RNA, 65 nt, Homo Sapiens; identical to SEQ ID NO: 252282

SEQ ID NO: 524332 - RNA, 65 nt, Homo Sapiens; identical to SEQ ID NO: 252283

SEQ ID NO: 524333 - RNA, 65 nt, Homo Sapiens; identical to SEQ ID NO: 252284

SEQ ID NO: 524334 - RNA, 65 nt, Homo Sapiens; identical to SEQ ID NO: 252285

SEQ ID NO: 524335 - RNA, 65 nt, Homo Sapiens; identical to SEQ ID NO: 252286

SEQ ID NO: 524336 - RNA, 65 nt, Homo Sapiens; identical to SEQ ID NO: 252287

SEQ ID NO: 524337 - RNA, 65 nt, Homo Sapiens; identical to SEQ ID NO: 252288

SEQ ID NO: 524338 - RNA, 65 nt, Homo Sapiens; identical to SEQ ID NO: 252289

SEQ ID NO: 524339 - RNA, 65 nt, Homo Sapiens; identical to SEQ ID NO: 252290

SEQ ID NO: 524340 - RNA, 65 nt, Homo Sapiens; identical to SEQ ID NO: 252291

SEQ ID NO: 524341 - RNA, 65 nt, Homo Sapiens; identical to SEQ ID NO: 252292

SEQ ID NO: 524342 - RNA, 65 nt, Homo Sapiens; identical to SEQ ID NO: 252293

SEQ ID NO: 524343 - RNA, 65 nt, Homo Sapiens; identical to SEQ ID NO: 252294

SEQ ID NO: 524344 - RNA, 65 nt, Homo Sapiens; identical to SEQ ID NO: 252295

SEQ ID NO: 524345 - RNA, 65 nt, Homo Sapiens; identical to SEQ ID NO: 252296

SEQ ID NO: 524346 - RNA, 65 nt, Homo Sapiens; identical to SEQ ID NO: 252297

SEQ ID NO: 524347 - RNA, 65 nt, Homo Sapiens; identical to SEQ ID NO: 252298

SEQ ID NO: 524348 - RNA, 60 nt, Homo Sapiens; identical to SEQ ID NO: 252299

SEQ ID NO: 524349 - RNA, 60 nt, Homo Sapiens; identical to SEQ ID NO: 252300

SEQ ID NO: 524350 - RNA, 60 nt, Homo Sapiens; identical to SEQ ID NO: 252301

SEQ ID NO: 524351 - RNA, 60 nt, Homo Sapiens; identical to SEQ ID NO: 252302

SEQ ID NO: 524352 - RNA, 60 nt, Homo Sapiens; identical to SEQ ID NO: 252303

SEQ ID NO: 524353 - RNA, 60 nt, Homo Sapiens; identical to SEQ ID NO: 252304

SEQ ID NO: 524354 - RNA, 60 nt, Homo Sapiens; identical to SEQ ID NO: 252305

SEQ ID NO: 524355 - RNA, 60 nt, Homo Sapiens; identical to SEQ ID NO: 252306

SEQ ID NO: 524356 - RNA, 60 nt, Homo Sapiens; identical to SEQ ID NO: 252307

SEQ ID NO: 524357 - RNA, 60 nt, Homo Sapiens; identical to SEQ ID NO: 252308

SEQ ID NO: 524358 - RNA, 60 nt, Homo Sapiens; identical to SEQ ID NO: 252309

SEQ ID NO: 524359 - RNA, 60 nt, Homo Sapiens; identical to SEQ ID NO: 252310

SEQ ID NO: 524360 - RNA, 60 nt, Homo Sapiens; identical to SEQ ID NO: 252311

SEQ ID NO: 524361 - RNA, 60 nt, Homo Sapiens; identical to SEQ ID NO: 252312

SEQ ID NO: 524362 - RNA, 60 nt, Homo Sapiens; identical to SEQ ID NO: 252313

SEQ ID NO: 524363 - RNA, 60 nt, Homo Sapiens; identical to SEQ ID NO: 252314

SEQ ID NO: 524364 - RNA, 60 nt, Homo Sapiens; identical to SEQ ID NO: 252315

SEQ ID NO: 524365 - RNA, 60 nt, Homo Sapiens; identical to SEQ ID NO: 252316

SEQ ID NO: 524366 - RNA, 60 nt, Homo Sapiens; identical to SEQ ID NO: 252317

SEQ ID NO: 524367 - RNA, 60 nt, Homo Sapiens; identical to SEQ ID NO: 252318

SEQ ID NO: 524368 - RNA, 60 nt, Homo Sapiens; identical to SEQ ID NO: 252319

SEQ ID NO: 524369 - RNA, 60 nt, Homo Sapiens; identical to SEQ ID NO: 252320

SEQ ID NO: 524370 - RNA, 60 nt, Homo Sapiens; identical to SEQ ID NO: 252321

SEQ ID NO: 524371 - RNA, 60 nt, Homo Sapiens; identical to SEQ ID NO: 252322

SEQ ID NO: 524372 - RNA, 60 nt, Homo Sapiens; identical to SEQ ID NO: 252323

SEQ ID NO: 524373 - RNA, 60 nt, Homo Sapiens; identical to SEQ ID NO: 252324

SEQ ID NO: 524374 - RNA, 60 nt, Homo Sapiens; identical to SEQ ID NO: 252325

SEQ ID NO: 524375 - RNA, 60 nt, Homo Sapiens; identical to SEQ ID NO: 252326

SEQ ID NO: 524376 - RNA, 60 nt, Homo Sapiens; identical to SEQ ID NO: 252327

SEQ ID NO: 524377 - RNA, 60 nt, Homo Sapiens; identical to SEQ ID NO: 252328

SEQ ID NO: 524378 - RNA, 60 nt, Homo Sapiens; identical to SEQ ID NO: 252329

SEQ ID NO: 524379 - RNA, 60 nt, Homo Sapiens; identical to SEQ ID NO: 252330

SEQ ID NO: 524380 - RNA, 60 nt, Homo Sapiens; identical to SEQ ID NO: 252331

SEQ ID NO: 524381 - RNA, 60 nt, Homo Sapiens; identical to SEQ ID NO: 252332

SEQ ID NO: 524382 - RNA, 60 nt, Homo Sapiens; identical to SEQ ID NO: 252333

SEQ ID NO: 524383 - RNA, 60 nt, Homo Sapiens; identical to SEQ ID NO: 252334

SEQ ID NO: 524384 - RNA, 60 nt, Homo Sapiens; identical to SEQ ID NO: 252335

SEQ ID NO: 524385 - RNA, 60 nt, Homo Sapiens; identical to SEQ ID NO: 252336

SEQ ID NO: 524386 - RNA, 60 nt, Homo Sapiens; identical to SEQ ID NO: 252337

SEQ ID NO: 524387 - RNA, 60 nt, Homo Sapiens; identical to SEQ ID NO: 252338

SEQ ID NO: 524388 - RNA, 60 nt, Homo Sapiens; identical to SEQ ID NO: 252339

SEQ ID NO: 524389 - RNA, 60 nt, Homo Sapiens; identical to SEQ ID NO: 252340

SEQ ID NO: 524390 - RNA, 60 nt, Homo Sapiens; identical to SEQ ID NO: 252341

SEQ ID NO: 524391 - RNA, 60 nt, Homo Sapiens; identical to SEQ ID NO: 252342

SEQ ID NO: 524392 - RNA, 60 nt, Homo Sapiens; identical to SEQ ID NO: 252343

SEQ ID NO: 524393 - RNA, 60 nt, Homo Sapiens; identical to SEQ ID NO: 252344

SEQ ID NO: 524394 - RNA, 60 nt, Homo Sapiens; identical to SEQ ID NO: 252345

SEQ ID NO: 524395 - RNA, 60 nt, Homo Sapiens; identical to SEQ ID NO: 252346

SEQ ID NO: 524396 - RNA, 60 nt, Homo Sapiens; identical to SEQ ID NO: 252347

SEQ ID NO: 524397 - RNA, 60 nt, Homo Sapiens; identical to SEQ ID NO: 252348

SEQ ID NO: 524398 - RNA, 60 nt, Homo Sapiens; identical to SEQ ID NO: 252349

SEQ ID NO: 524399 - RNA, 60 nt, Homo Sapiens; identical to SEQ ID NO: 252350

SEQ ID NO: 524400 - RNA, 60 nt, Homo Sapiens; identical to SEQ ID NO: 252351

SEQ ID NO: 524401 - RNA, 60 nt, Homo Sapiens; identical to SEQ ID NO: 252352

SEQ ID NO: 524402 - RNA, 60 nt, Homo Sapiens; identical to SEQ ID NO: 252353

SEQ ID NO: 524403 - RNA, 60 nt, Homo Sapiens; identical to SEQ ID NO: 252354

SEQ ID NO: 524404 - RNA, 60 nt, Homo Sapiens; identical to SEQ ID NO: 252355

SEQ ID NO: 524405 - RNA, 60 nt, Homo Sapiens; identical to SEQ ID NO: 252356

SEQ ID NO: 524406 - RNA, 60 nt, Homo Sapiens; identical to SEQ ID NO: 252357

SEQ ID NO: 524407 - RNA, 60 nt, Homo Sapiens; identical to SEQ ID NO: 252358

SEQ ID NO: 524408 - RNA, 60 nt, Homo Sapiens; identical to SEQ ID NO: 252359

SEQ ID NO: 524409 - RNA, 60 nt, Homo Sapiens; identical to SEQ ID NO: 252360

SEQ ID NO: 524410 - RNA, 60 nt, Homo Sapiens; identical to SEQ ID NO: 252361

SEQ ID NO: 524411 - RNA, 60 nt, Homo Sapiens; identical to SEQ ID NO: 252362

SEQ ID NO: 524412 - RNA, 60 nt, Homo Sapiens; identical to SEQ ID NO: 252363

SEQ ID NO: 524413 - RNA, 60 nt, Homo Sapiens; identical to SEQ ID NO: 252364

SEQ ID NO: 524414 - RNA, 60 nt, Homo Sapiens; identical to SEQ ID NO: 252365

SEQ ID NO: 524415 - RNA, 60 nt, Homo Sapiens; identical to SEQ ID NO: 252366

SEQ ID NO: 524416 - RNA, 60 nt, Homo Sapiens; identical to SEQ ID NO: 252367

SEQ ID NO: 524417 - RNA, 60 nt, Homo Sapiens; identical to SEQ ID NO: 252368

SEQ ID NO: 524418 - RNA, 60 nt, Homo Sapiens; identical to SEQ ID NO: 252369

SEQ ID NO: 524419 - RNA, 60 nt, Homo Sapiens; identical to SEQ ID NO: 252370

SEQ ID NO: 524420 - RNA, 60 nt, Homo Sapiens; identical to SEQ ID NO: 252371

SEQ ID NO: 524421 - RNA, 60 nt, Homo Sapiens; identical to SEQ ID NO: 252372

SEQ ID NO: 524422 - RNA, 60 nt, Homo Sapiens; identical to SEQ ID NO: 252373

SEQ ID NO: 524423 - RNA, 60 nt, Homo Sapiens; identical to SEQ ID NO: 252374

SEQ ID NO: 524424 - RNA, 60 nt, Homo Sapiens; identical to SEQ ID NO: 252375

SEQ ID NO: 524425 - RNA, 60 nt, Homo Sapiens; identical to SEQ ID NO: 252376

SEQ ID NO: 524426 - RNA, 60 nt, Homo Sapiens; identical to SEQ ID NO: 252377

SEQ ID NO: 524427 - RNA, 60 nt, Homo Sapiens; identical to SEQ ID NO: 252378

SEQ ID NO: 524428 - RNA, 60 nt, Homo Sapiens; identical to SEQ ID NO: 252379

SEQ ID NO: 524429 - RNA, 60 nt, Homo Sapiens; identical to SEQ ID NO: 252380

SEQ ID NO: 524430 - RNA, 60 nt, Homo Sapiens; identical to SEQ ID NO: 252381

SEQ ID NO: 524431 - RNA, 60 nt, Homo Sapiens; identical to SEQ ID NO: 252382

SEQ ID NO: 524432 - RNA, 60 nt, Homo Sapiens; identical to SEQ ID NO: 252383

SEQ ID NO: 524433 - RNA, 60 nt, Homo Sapiens; identical to SEQ ID NO: 252384

SEQ ID NO: 524434 - RNA, 60 nt, Homo Sapiens; identical to SEQ ID NO: 252385

SEQ ID NO: 524435 - RNA, 60 nt, Homo Sapiens; identical to SEQ ID NO: 252386

SEQ ID NO: 524436 - RNA, 60 nt, Homo Sapiens; identical to SEQ ID NO: 252387

SEQ ID NO: 524437 - RNA, 60 nt, Homo Sapiens; identical to SEQ ID NO: 252388

SEQ ID NO: 524438 - RNA, 60 nt, Homo Sapiens; identical to SEQ ID NO: 252389

SEQ ID NO: 524439 - RNA, 60 nt, Homo Sapiens; identical to SEQ ID NO: 252390

SEQ ID NO: 524440 - RNA, 60 nt, Homo Sapiens; identical to SEQ ID NO: 252391

SEQ ID NO: 524441 - RNA, 60 nt, Homo Sapiens; identical to SEQ ID NO: 252392

SEQ ID NO: 524442 - RNA, 60 nt, Homo Sapiens; identical to SEQ ID NO: 252393

SEQ ID NO: 524443 - RNA, 60 nt, Homo Sapiens; identical to SEQ ID NO: 252394

SEQ ID NO: 524444 - RNA, 60 nt, Homo Sapiens; identical to SEQ ID NO: 252395

SEQ ID NO: 524445 - RNA, 60 nt, Homo Sapiens; identical to SEQ ID NO: 252396

SEQ ID NO: 524446 - RNA, 60 nt, Homo Sapiens; identical to SEQ ID NO: 252397

SEQ ID NO: 524447 - RNA, 60 nt, Homo Sapiens; identical to SEQ ID NO: 252398

SEQ ID NO: 524448 - RNA, 60 nt, Homo Sapiens; identical to SEQ ID NO: 252399

SEQ ID NO: 524449 - RNA, 60 nt, Homo Sapiens; identical to SEQ ID NO: 252400

SEQ ID NO: 524450 - RNA, 60 nt, Homo Sapiens; identical to SEQ ID NO: 252401

SEQ ID NO: 524451 - RNA, 60 nt, Homo Sapiens; identical to SEQ ID NO: 252402

SEQ ID NO: 524452 - RNA, 60 nt, Homo Sapiens; identical to SEQ ID NO: 252403

SEQ ID NO: 524453 - RNA, 60 nt, Homo Sapiens; identical to SEQ ID NO: 252404

SEQ ID NO: 524454 - RNA, 60 nt, Homo Sapiens; identical to SEQ ID NO: 252405

SEQ ID NO: 524455 - RNA, 60 nt, Homo Sapiens; identical to SEQ ID NO: 252406

SEQ ID NO: 524456 - RNA, 60 nt, Homo Sapiens; identical to SEQ ID NO: 252407

SEQ ID NO: 524457 - RNA, 60 nt, Homo Sapiens; identical to SEQ ID NO: 252408

SEQ ID NO: 524458 - RNA, 60 nt, Homo Sapiens; identical to SEQ ID NO: 252409

SEQ ID NO: 524459 - RNA, 60 nt, Homo Sapiens; identical to SEQ ID NO: 252410

SEQ ID NO: 524460 - RNA, 60 nt, Homo Sapiens; identical to SEQ ID NO: 252411

SEQ ID NO: 524461 - RNA, 60 nt, Homo Sapiens; identical to SEQ ID NO: 252412

SEQ ID NO: 524462 - RNA, 60 nt, Homo Sapiens; identical to SEQ ID NO: 252413

SEQ ID NO: 524463 - RNA, 60 nt, Homo Sapiens; identical to SEQ ID NO: 252414

SEQ ID NO: 524464 - RNA, 60 nt, Homo Sapiens; identical to SEQ ID NO: 252415

SEQ ID NO: 524465 - RNA, 60 nt, Homo Sapiens; identical to SEQ ID NO: 252416

SEQ ID NO: 524466 - RNA, 60 nt, Homo Sapiens; identical to SEQ ID NO: 252417

SEQ ID NO: 524467 - RNA, 60 nt, Homo Sapiens; identical to SEQ ID NO: 252418

SEQ ID NO: 524468 - RNA, 60 nt, Homo Sapiens; identical to SEQ ID NO: 252419

SEQ ID NO: 524469 - RNA, 60 nt, Homo Sapiens; identical to SEQ ID NO: 252420

SEQ ID NO: 524470 - RNA, 60 nt, Homo Sapiens; identical to SEQ ID NO: 252421

SEQ ID NO: 524471 - RNA, 60 nt, Homo Sapiens; identical to SEQ ID NO: 252422

SEQ ID NO: 524472 - RNA, 60 nt, Homo Sapiens; identical to SEQ ID NO: 252423

SEQ ID NO: 524473 - RNA, 60 nt, Homo Sapiens; identical to SEQ ID NO: 252424

SEQ ID NO: 524474 - RNA, 60 nt, Homo Sapiens; identical to SEQ ID NO: 252425

SEQ ID NO: 524475 - RNA, 60 nt, Homo Sapiens; identical to SEQ ID NO: 252426

SEQ ID NO: 524476 - RNA, 60 nt, Homo Sapiens; identical to SEQ ID NO: 252427

SEQ ID NO: 524477 - RNA, 60 nt, Homo Sapiens; identical to SEQ ID NO: 252428

SEQ ID NO: 524478 - RNA, 60 nt, Homo Sapiens; identical to SEQ ID NO: 252429

SEQ ID NO: 524479 - RNA, 60 nt, Homo Sapiens; identical to SEQ ID NO: 252430

SEQ ID NO: 524480 - RNA, 60 nt, Homo Sapiens; identical to SEQ ID NO: 252431

SEQ ID NO: 524481 - RNA, 60 nt, Homo Sapiens; identical to SEQ ID NO: 252432

SEQ ID NO: 524482 - RNA, 60 nt, Homo Sapiens; identical to SEQ ID NO: 252433

SEQ ID NO: 524483 - RNA, 60 nt, Homo Sapiens; identical to SEQ ID NO: 252434

SEQ ID NO: 524484 - RNA, 60 nt, Homo Sapiens; identical to SEQ ID NO: 252435

SEQ ID NO: 524485 - RNA, 60 nt, Homo Sapiens; identical to SEQ ID NO: 252436

SEQ ID NO: 524486 - RNA, 60 nt, Homo Sapiens; identical to SEQ ID NO: 252437

SEQ ID NO: 524487 - RNA, 60 nt, Homo Sapiens; identical to SEQ ID NO: 252438

SEQ ID NO: 524488 - RNA, 60 nt, Homo Sapiens; identical to SEQ ID NO: 252439

SEQ ID NO: 524489 - RNA, 60 nt, Homo Sapiens; identical to SEQ ID NO: 252440

SEQ ID NO: 524490 - RNA, 60 nt, Homo Sapiens; identical to SEQ ID NO: 252441

SEQ ID NO: 524491 - RNA, 60 nt, Homo Sapiens; identical to SEQ ID NO: 252442

SEQ ID NO: 524492 - RNA, 60 nt, Homo Sapiens; identical to SEQ ID NO: 252443

SEQ ID NO: 524493 - RNA, 60 nt, Homo Sapiens; identical to SEQ ID NO: 252444

SEQ ID NO: 524494 - RNA, 60 nt, Homo Sapiens; identical to SEQ ID NO: 252445

SEQ ID NO: 524495 - RNA, 60 nt, Homo Sapiens; identical to SEQ ID NO: 252446

SEQ ID NO: 524496 - RNA, 60 nt, Homo Sapiens; identical to SEQ ID NO: 252447

SEQ ID NO: 524497 - RNA, 60 nt, Homo Sapiens; identical to SEQ ID NO: 252448

SEQ ID NO: 524498 - RNA, 60 nt, Homo Sapiens; identical to SEQ ID NO: 252449

SEQ ID NO: 524499 - RNA, 60 nt, Homo Sapiens; identical to SEQ ID NO: 252450

SEQ ID NO: 524500 - RNA, 60 nt, Homo Sapiens; identical to SEQ ID NO: 252451

SEQ ID NO: 524501 - RNA, 60 nt, Homo Sapiens; identical to SEQ ID NO: 252452

SEQ ID NO: 524502 - RNA, 60 nt, Homo Sapiens; identical to SEQ ID NO: 252453

SEQ ID NO: 524503 - RNA, 60 nt, Homo Sapiens; identical to SEQ ID NO: 252454

SEQ ID NO: 524504 - RNA, 60 nt, Homo Sapiens; identical to SEQ ID NO: 252455

SEQ ID NO: 524505 - RNA, 60 nt, Homo Sapiens; identical to SEQ ID NO: 252456

SEQ ID NO: 524506 - RNA, 60 nt, Homo Sapiens; identical to SEQ ID NO: 252457

SEQ ID NO: 524507 - RNA, 60 nt, Homo Sapiens; identical to SEQ ID NO: 252458

SEQ ID NO: 524508 - RNA, 60 nt, Homo Sapiens; identical to SEQ ID NO: 252459

SEQ ID NO: 524509 - RNA, 52 nt, Homo Sapiens; identical to SEQ ID NO: 252460

SEQ ID NO: 524510 - RNA, 60 nt, Homo Sapiens; identical to SEQ ID NO: 252461

SEQ ID NO: 524511 - RNA, 60 nt, Homo Sapiens; identical to SEQ ID NO: 252462

SEQ ID NO: 524512 - RNA, 60 nt, Homo Sapiens; identical to SEQ ID NO: 252463

SEQ ID NO: 524513 - RNA, 60 nt, Homo Sapiens; identical to SEQ ID NO: 252464

SEQ ID NO: 524514 - RNA, 60 nt, Homo Sapiens; identical to SEQ ID NO: 252465

SEQ ID NO: 524515 - RNA, 60 nt, Homo Sapiens; identical to SEQ ID NO: 252466

SEQ ID NO: 524516 - RNA, 60 nt, Homo Sapiens; identical to SEQ ID NO: 252467

SEQ ID NO: 524517 - RNA, 60 nt, Homo Sapiens; identical to SEQ ID NO: 252468

SEQ ID NO: 524518 - RNA, 60 nt, Homo Sapiens; identical to SEQ ID NO: 252469

SEQ ID NO: 524519 - RNA, 60 nt, Homo Sapiens; identical to SEQ ID NO: 252470

SEQ ID NO: 524520 - RNA, 60 nt, Homo Sapiens; identical to SEQ ID NO: 252471

SEQ ID NO: 524521 - RNA, 60 nt, Homo Sapiens; identical to SEQ ID NO: 252472

SEQ ID NO: 524522 - RNA, 60 nt, Homo Sapiens; identical to SEQ ID NO: 252473

SEQ ID NO: 524523 - RNA, 60 nt, Homo Sapiens; identical to SEQ ID NO: 252474

SEQ ID NO: 524524 - RNA, 60 nt, Homo Sapiens; identical to SEQ ID NO: 252475

SEQ ID NO: 524525 - RNA, 60 nt, Homo Sapiens; identical to SEQ ID NO: 252476

SEQ ID NO: 524526 - RNA, 60 nt, Homo Sapiens; identical to SEQ ID NO: 252477

SEQ ID NO: 524527 - RNA, 60 nt, Homo Sapiens; identical to SEQ ID NO: 252478

SEQ ID NO: 524528 - RNA, 60 nt, Homo Sapiens; identical to SEQ ID NO: 252479

SEQ ID NO: 524529 - RNA, 60 nt, Homo Sapiens; identical to SEQ ID NO: 252480

SEQ ID NO: 524530 - RNA, 60 nt, Homo Sapiens; identical to SEQ ID NO: 252481

SEQ ID NO: 524531 - RNA, 60 nt, Homo Sapiens; identical to SEQ ID NO: 252482

SEQ ID NO: 524532 - RNA, 60 nt, Homo Sapiens; identical to SEQ ID NO: 252483

SEQ ID NO: 524533 - RNA, 60 nt, Homo Sapiens; identical to SEQ ID NO: 252484

SEQ ID NO: 524534 - RNA, 60 nt, Homo Sapiens; identical to SEQ ID NO: 252485

SEQ ID NO: 524535 - RNA, 60 nt, Homo Sapiens; identical to SEQ ID NO: 252486

SEQ ID NO: 524536 - RNA, 60 nt, Homo Sapiens; identical to SEQ ID NO: 252487

SEQ ID NO: 524537 - RNA, 60 nt, Homo Sapiens; identical to SEQ ID NO: 252488

SEQ ID NO: 524538 - RNA, 60 nt, Homo Sapiens; identical to SEQ ID NO: 252489

SEQ ID NO: 524539 - RNA, 60 nt, Homo Sapiens; identical to SEQ ID NO: 252490

SEQ ID NO: 524540 - RNA, 60 nt, Homo Sapiens; identical to SEQ ID NO: 252491

SEQ ID NO: 524541 - RNA, 60 nt, Homo Sapiens; identical to SEQ ID NO: 252492

SEQ ID NO: 524542 - RNA, 60 nt, Homo Sapiens; identical to SEQ ID NO: 252493

SEQ ID NO: 524543 - RNA, 60 nt, Homo Sapiens; identical to SEQ ID NO: 252494

SEQ ID NO: 524544 - RNA, 60 nt, Homo Sapiens; identical to SEQ ID NO: 252495

SEQ ID NO: 524545 - RNA, 60 nt, Homo Sapiens; identical to SEQ ID NO: 252496

SEQ ID NO: 524546 - RNA, 60 nt, Homo Sapiens; identical to SEQ ID NO: 252497

SEQ ID NO: 524547 - RNA, 60 nt, Homo Sapiens; identical to SEQ ID NO: 252498

SEQ ID NO: 524548 - RNA, 60 nt, Homo Sapiens; identical to SEQ ID NO: 252499

SEQ ID NO: 524549 - RNA, 60 nt, Homo Sapiens; identical to SEQ ID NO: 252500

SEQ ID NO: 524550 - RNA, 60 nt, Homo Sapiens; identical to SEQ ID NO: 252501

SEQ ID NO: 524551 - RNA, 60 nt, Homo Sapiens; identical to SEQ ID NO: 252502

SEQ ID NO: 524552 - RNA, 60 nt, Homo Sapiens; identical to SEQ ID NO: 252503

SEQ ID NO: 524553 - RNA, 60 nt, Homo Sapiens; identical to SEQ ID NO: 252504

SEQ ID NO: 524554 - RNA, 60 nt, Homo Sapiens; identical to SEQ ID NO: 252505

SEQ ID NO: 524555 - RNA, 60 nt, Homo Sapiens; identical to SEQ ID NO: 252506

SEQ ID NO: 524556 - RNA, 60 nt, Homo Sapiens; identical to SEQ ID NO: 252507

SEQ ID NO: 524557 - RNA, 60 nt, Homo Sapiens; identical to SEQ ID NO: 252508

SEQ ID NO: 524558 - RNA, 60 nt, Homo Sapiens; identical to SEQ ID NO: 252509

SEQ ID NO: 524559 - RNA, 60 nt, Homo Sapiens; identical to SEQ ID NO: 252510

SEQ ID NO: 524560 - RNA, 60 nt, Homo Sapiens; identical to SEQ ID NO: 252511

SEQ ID NO: 524561 - RNA, 60 nt, Homo Sapiens; identical to SEQ ID NO: 252512

SEQ ID NO: 524562 - RNA, 60 nt, Homo Sapiens; identical to SEQ ID NO: 252513

SEQ ID NO: 524563 - RNA, 60 nt, Homo Sapiens; identical to SEQ ID NO: 252514

SEQ ID NO: 524564 - RNA, 60 nt, Homo Sapiens; identical to SEQ ID NO: 252515

SEQ ID NO: 524565 - RNA, 60 nt, Homo Sapiens; identical to SEQ ID NO: 252516

SEQ ID NO: 524566 - RNA, 60 nt, Homo Sapiens; identical to SEQ ID NO: 252517

SEQ ID NO: 524567 - RNA, 60 nt, Homo Sapiens; identical to SEQ ID NO: 252518

SEQ ID NO: 524568 - RNA, 60 nt, Homo Sapiens; identical to SEQ ID NO: 252519

SEQ ID NO: 524569 - RNA, 60 nt, Homo Sapiens; identical to SEQ ID NO: 252520

SEQ ID NO: 524570 - RNA, 60 nt, Homo Sapiens; identical to SEQ ID NO: 252521

SEQ ID NO: 524571 - RNA, 60 nt, Homo Sapiens; identical to SEQ ID NO: 252522

SEQ ID NO: 524572 - RNA, 60 nt, Homo Sapiens; identical to SEQ ID NO: 252523

SEQ ID NO: 524573 - RNA, 60 nt, Homo Sapiens; identical to SEQ ID NO: 252524

SEQ ID NO: 524574 - RNA, 60 nt, Homo Sapiens; identical to SEQ ID NO: 252525

SEQ ID NO: 524575 - RNA, 60 nt, Homo Sapiens; identical to SEQ ID NO: 252526

SEQ ID NO: 524576 - RNA, 60 nt, Homo Sapiens; identical to SEQ ID NO: 252527

SEQ ID NO: 524577 - RNA, 60 nt, Homo Sapiens; identical to SEQ ID NO: 252528

SEQ ID NO: 524578 - RNA, 60 nt, Homo Sapiens; identical to SEQ ID NO: 252529

SEQ ID NO: 524579 - RNA, 60 nt, Homo Sapiens; identical to SEQ ID NO: 252530

SEQ ID NO: 524580 - RNA, 60 nt, Homo Sapiens; identical to SEQ ID NO: 252531

SEQ ID NO: 524581 - RNA, 60 nt, Homo Sapiens; identical to SEQ ID NO: 252532

SEQ ID NO: 524582 - RNA, 60 nt, Homo Sapiens; identical to SEQ ID NO: 252533

SEQ ID NO: 524583 - RNA, 60 nt, Homo Sapiens; identical to SEQ ID NO: 252534

SEQ ID NO: 524584 - RNA, 60 nt, Homo Sapiens; identical to SEQ ID NO: 252535

SEQ ID NO: 524585 - RNA, 60 nt, Homo Sapiens; identical to SEQ ID NO: 252536

SEQ ID NO: 524586 - RNA, 60 nt, Homo Sapiens; identical to SEQ ID NO: 252537

SEQ ID NO: 524587 - RNA, 60 nt, Homo Sapiens; identical to SEQ ID NO: 252538

SEQ ID NO: 524588 - RNA, 60 nt, Homo Sapiens; identical to SEQ ID NO: 252539

SEQ ID NO: 524589 - RNA, 60 nt, Homo Sapiens; identical to SEQ ID NO: 252540

SEQ ID NO: 524590 - RNA, 60 nt, Homo Sapiens; identical to SEQ ID NO: 252541

SEQ ID NO: 524591 - RNA, 60 nt, Homo Sapiens; identical to SEQ ID NO: 252542

SEQ ID NO: 524592 - RNA, 60 nt, Homo Sapiens; identical to SEQ ID NO: 252543

SEQ ID NO: 524593 - RNA, 60 nt, Homo Sapiens; identical to SEQ ID NO: 252544

SEQ ID NO: 524594 - RNA, 60 nt, Homo Sapiens; identical to SEQ ID NO: 252545

SEQ ID NO: 524595 - RNA, 60 nt, Homo Sapiens; identical to SEQ ID NO: 252546

SEQ ID NO: 524596 - RNA, 60 nt, Homo Sapiens; identical to SEQ ID NO: 252547

SEQ ID NO: 524597 - RNA, 60 nt, Homo Sapiens; identical to SEQ ID NO: 252548

SEQ ID NO: 524598 - RNA, 60 nt, Homo Sapiens; identical to SEQ ID NO: 252549

SEQ ID NO: 524599 - RNA, 60 nt, Homo Sapiens; identical to SEQ ID NO: 252550

SEQ ID NO: 524600 - RNA, 60 nt, Homo Sapiens; identical to SEQ ID NO: 252551

SEQ ID NO: 524601 - RNA, 60 nt, Homo Sapiens; identical to SEQ ID NO: 252552

SEQ ID NO: 524602 - RNA, 60 nt, Homo Sapiens; identical to SEQ ID NO: 252553

SEQ ID NO: 524603 - RNA, 60 nt, Homo Sapiens; identical to SEQ ID NO: 252554

SEQ ID NO: 524604 - RNA, 60 nt, Homo Sapiens; identical to SEQ ID NO: 252555

SEQ ID NO: 524605 - RNA, 60 nt, Homo Sapiens; identical to SEQ ID NO: 252556

SEQ ID NO: 524606 - RNA, 51 nt, Homo Sapiens; identical to SEQ ID NO: 252557

SEQ ID NO: 524607 - RNA, 60 nt, Homo Sapiens; identical to SEQ ID NO: 252558

SEQ ID NO: 524608 - RNA, 60 nt, Homo Sapiens; identical to SEQ ID NO: 252559

SEQ ID NO: 524609 - RNA, 60 nt, Homo Sapiens; identical to SEQ ID NO: 252560

SEQ ID NO: 524610 - RNA, 60 nt, Homo Sapiens; identical to SEQ ID NO: 252561

SEQ ID NO: 524611 - RNA, 60 nt, Homo Sapiens; identical to SEQ ID NO: 252562

SEQ ID NO: 524612 - RNA, 60 nt, Homo Sapiens; identical to SEQ ID NO: 252563

SEQ ID NO: 524613 - RNA, 60 nt, Homo Sapiens; identical to SEQ ID NO: 252564

SEQ ID NO: 524614 - RNA, 60 nt, Homo Sapiens; identical to SEQ ID NO: 252565

SEQ ID NO: 524615 - RNA, 60 nt, Homo Sapiens; identical to SEQ ID NO: 252566

SEQ ID NO: 524616 - RNA, 60 nt, Homo Sapiens; identical to SEQ ID NO: 252567

SEQ ID NO: 524617 - RNA, 60 nt, Homo Sapiens; identical to SEQ ID NO: 252568

SEQ ID NO: 524618 - RNA, 60 nt, Homo Sapiens; identical to SEQ ID NO: 252569

SEQ ID NO: 524619 - RNA, 60 nt, Homo Sapiens; identical to SEQ ID NO: 252570

SEQ ID NO: 524620 - RNA, 60 nt, Homo Sapiens; identical to SEQ ID NO: 252571

SEQ ID NO: 524621 - RNA, 60 nt, Homo Sapiens; identical to SEQ ID NO: 252572

SEQ ID NO: 524622 - RNA, 60 nt, Homo Sapiens; identical to SEQ ID NO: 252573

SEQ ID NO: 524623 - RNA, 60 nt, Homo Sapiens; identical to SEQ ID NO: 252574

SEQ ID NO: 524624 - RNA, 60 nt, Homo Sapiens; identical to SEQ ID NO: 252575

SEQ ID NO: 524625 - RNA, 60 nt, Homo Sapiens; identical to SEQ ID NO: 252576

SEQ ID NO: 524626 - RNA, 60 nt, Homo Sapiens; identical to SEQ ID NO: 252577

SEQ ID NO: 524627 - RNA, 60 nt, Homo Sapiens; identical to SEQ ID NO: 252578

SEQ ID NO: 524628 - RNA, 60 nt, Homo Sapiens; identical to SEQ ID NO: 252579

SEQ ID NO: 524629 - RNA, 60 nt, Homo Sapiens; identical to SEQ ID NO: 252580

SEQ ID NO: 524630 - RNA, 60 nt, Homo Sapiens; identical to SEQ ID NO: 252581

SEQ ID NO: 524631 - RNA, 60 nt, Homo Sapiens; identical to SEQ ID NO: 252582

SEQ ID NO: 524632 - RNA, 60 nt, Homo Sapiens; identical to SEQ ID NO: 252583

SEQ ID NO: 524633 - RNA, 60 nt, Homo Sapiens; identical to SEQ ID NO: 252584

SEQ ID NO: 524634 - RNA, 60 nt, Homo Sapiens; identical to SEQ ID NO: 252585

SEQ ID NO: 524635 - RNA, 60 nt, Homo Sapiens; identical to SEQ ID NO: 252586

SEQ ID NO: 524636 - RNA, 60 nt, Homo Sapiens; identical to SEQ ID NO: 252587

SEQ ID NO: 524637 - RNA, 60 nt, Homo Sapiens; identical to SEQ ID NO: 252588

SEQ ID NO: 524638 - RNA, 60 nt, Homo Sapiens; identical to SEQ ID NO: 252589

SEQ ID NO: 524639 - RNA, 60 nt, Homo Sapiens; identical to SEQ ID NO: 252590

SEQ ID NO: 524640 - RNA, 60 nt, Homo Sapiens; identical to SEQ ID NO: 252591

SEQ ID NO: 524641 - RNA, 60 nt, Homo Sapiens; identical to SEQ ID NO: 252592

SEQ ID NO: 524642 - RNA, 60 nt, Homo Sapiens; identical to SEQ ID NO: 252593

SEQ ID NO: 524643 - RNA, 60 nt, Homo Sapiens; identical to SEQ ID NO: 252594

SEQ ID NO: 524644 - RNA, 60 nt, Homo Sapiens; identical to SEQ ID NO: 252595

SEQ ID NO: 524645 - RNA, 60 nt, Homo Sapiens; identical to SEQ ID NO: 252596

SEQ ID NO: 524646 - RNA, 64 nt, Homo Sapiens
aauccuaauguucugggacuaucauuugaacuaaucaaggaauacaaggaauucagcuguugaa

SEQ ID NO: 524647 - RNA, 64 nt, Homo Sapiens
cagcuguugaaaucauuugacugccuuacacaucucaaggaauuaguccauccaaaggaccaac

SEQ ID NO: 524648 - RNA, 64 nt, Homo Sapiens
uggaaaauaccaaaugaacguacaguacaacauuucaaggaaaugaauauauuguuagaccagg

SEQ ID NO: 524649 - RNA, 64 nt, Homo Sapiens
uuuugcuuagaauagaauggaacaaguuuaaauuucaaggaaauaugaaggcacuuccuuuuuu

SEQ ID NO: 524650 - RNA, 64 nt, Homo Sapiens
aaaaccaauuuugccacagcucuauguauagcuaucaaggaaaucuccauaaauuacuuagucu

SEQ ID NO: 524651 - RNA, 64 nt, Homo Sapiens
aacuacaguguaaacauaucuauuuugggggcagucaaggaauaaagagcuucuuagaguagua

SEQ ID NO: 524652 - RNA, 64 nt, Homo Sapiens
uucaauauucugccuuucagaaaacaaaugauuuucaaggaauaugauagucuaaaaaaugauc

SEQ ID NO: 524653 - RNA, 64 nt, Homo Sapiens
uuuaaguaccagccaaguacacacgaugauagcuucaaggaauacaacugacuuuaugauauga

SEQ ID NO: 524654 - RNA, 64 nt, Homo Sapiens
ucaaggaauacaacugacuuuaugauaugaauuuucaaggaacguaucuuauauggauuuugaa

SEQ ID NO: 524655 - RNA, 64 nt, Homo Sapiens
uaaaugcaauugaauucccagaaaaaugauuguuucaaggaagugacaguucuacuuuagaagu

SEQ ID NO: 524656 - RNA, 64 nt, Homo Sapiens
cguaggugaaaaaagaugggccauuaaggauucuucaaggaaaacauuccucaaaaugaucuuu

SEQ ID NO: 524657 - RNA, 64 nt, Homo Sapiens
agagucuuccaggugggcauuucaaccaacucagucaaggaacccaugacaaagaaagucauuu

SEQ ID NO: 524658 - RNA, 64 nt, Homo Sapiens
acgugcuucaaauauccauauuaaccacuauuuuucaaggaaguauggaaaaguacacucuguc

SEQ ID NO: 524659 - RNA, 64 nt, Homo Sapiens
ucuuacagaaccuuuaaacacagcaaaaacuuuuucaaggaaaaugguuuucacacuauuucag

SEQ ID NO: 524660 - RNA, 64 nt, Homo Sapiens
acaucuggccagggguagcuaauucaaaucaauuucaaggaaaauuuaauaggcgagcaaauaa

SEQ ID NO: 524661 - RNA, 64 nt, Homo Sapiens
aagggaaccccggggaaugggaggacaggauuuuucaaggaaccuuuuucaaugaaagagaagg

SEQ ID NO: 524662 - RNA, 64 nt, Homo Sapiens
uuaagauuucgagcagaauuuaucuaaauguguuucaaggaaacacaaucgcugaaccaaaacg

SEQ ID NO: 524663 - RNA, 64 nt, Homo Sapiens
caguuuaauuuugauauauuggccaugucugacuucaaggaacuaaagguauacaaauaaauaa

SEQ ID NO: 524664 - RNA, 64 nt, Homo Sapiens
aagguaagaaagcugauagccaugaaucuugcugucaaggaagaacauugugauuauugaaguu

SEQ ID NO: 524665 - RNA, 64 nt, Homo Sapiens
uuugccaaacugaauggucucuuugacagcccugucaaggaauaccaacagaauauugauucuc

SEQ ID NO: 524666 - RNA, 64 nt, Homo Sapiens
gagccacucagaaaaggcccauggccauggagcuucaaggaaagaaaccccucaguuuuuuccg

SEQ ID NO: 524667 - RNA, 64 nt, Homo Sapiens
aaugagucuaauaucaagcccaaaaggaagaaaaucaaggaaagaagucacuuuugaaugugaa

SEQ ID NO: 524668 - RNA, 64 nt, Homo Sapiens
agggaugaaaucaguuuggauuacaaaucaccccucaaggaaccgugugggagaucaagaauug

SEQ ID NO: 524669 - RNA, 62 nt, Homo Sapiens
aagacgucaucuucuucuaaaagggccgugacucaaggaaaguuuuuaauggaaaguugagc

SEQ ID NO: 524670 - RNA, 64 nt, Homo Sapiens
cgagaugccacaauuccuuggaugggggagaaguucaaggaauuucugcucggccacgcggugg

SEQ ID NO: 524671 - RNA, 64 nt, Homo Sapiens; identical to SEQ ID NO: 81753

SEQ ID NO: 524672 - RNA, 64 nt, Homo Sapiens; identical to SEQ ID NO: 81754

SEQ ID NO: 524673 - RNA, 64 nt, Homo Sapiens; identical to SEQ ID NO: 81755

SEQ ID NO: 524674 - RNA, 64 nt, Homo Sapiens; identical to SEQ ID NO: 81756

SEQ ID NO: 524675 - RNA, 64 nt, Homo Sapiens; identical to SEQ ID NO: 81757

SEQ ID NO: 524676 - RNA, 64 nt, Homo Sapiens; identical to SEQ ID NO: 81758

SEQ ID NO: 524677 - RNA, 64 nt, Homo Sapiens; identical to SEQ ID NO: 81759

SEQ ID NO: 524678 - RNA, 64 nt, Homo Sapiens; identical to SEQ ID NO: 81760

SEQ ID NO: 524679 - RNA, 61 nt, Homo Sapiens; identical to SEQ ID NO: 81761

SEQ ID NO: 524680 - RNA, 64 nt, Homo Sapiens; identical to SEQ ID NO: 81762

SEQ ID NO: 524681 - RNA, 64 nt, Homo Sapiens; identical to SEQ ID NO: 81763

SEQ ID NO: 524682 - RNA, 64 nt, Homo Sapiens; identical to SEQ ID NO: 81764

SEQ ID NO: 524683 - RNA, 64 nt, Homo Sapiens; identical to SEQ ID NO: 81765

SEQ ID NO: 524684 - RNA, 64 nt, Homo Sapiens; identical to SEQ ID NO: 81766

SEQ ID NO: 524685 - RNA, 64 nt, Homo Sapiens; identical to SEQ ID NO: 81767

SEQ ID NO: 524686 - RNA, 64 nt, Homo Sapiens; identical to SEQ ID NO: 81768

SEQ ID NO: 524687 - RNA, 64 nt, Homo Sapiens; identical to SEQ ID NO: 81769

SEQ ID NO: 524688 - RNA, 56 nt, Homo Sapiens; identical to SEQ ID NO: 81770

SEQ ID NO: 524689 - RNA, 64 nt, Homo Sapiens; identical to SEQ ID NO: 81771

SEQ ID NO: 524690 - RNA, 64 nt, Homo Sapiens; identical to SEQ ID NO: 81772

SEQ ID NO: 524691 - RNA, 64 nt, Homo Sapiens; identical to SEQ ID NO: 81773

SEQ ID NO: 524692 - RNA, 64 nt, Homo Sapiens; identical to SEQ ID NO: 81774

SEQ ID NO: 524693 - RNA, 64 nt, Homo Sapiens; identical to SEQ ID NO: 81775

SEQ ID NO: 524694 - RNA, 64 nt, Homo Sapiens; identical to SEQ ID NO: 81776

SEQ ID NO: 524695 - RNA, 64 nt, Homo Sapiens; identical to SEQ ID NO: 81777

SEQ ID NO: 524696 - RNA, 64 nt, Homo Sapiens; identical to SEQ ID NO: 81778

SEQ ID NO: 524697 - RNA, 64 nt, Homo Sapiens; identical to SEQ ID NO: 81779

SEQ ID NO: 524698 - RNA, 64 nt, Homo Sapiens; identical to SEQ ID NO: 81780

SEQ ID NO: 524699 - RNA, 64 nt, Homo Sapiens; identical to SEQ ID NO: 81781

SEQ ID NO: 524700 - RNA, 64 nt, Homo Sapiens; identical to SEQ ID NO: 81782

SEQ ID NO: 524701 - RNA, 64 nt, Homo Sapiens; identical to SEQ ID NO: 81783

SEQ ID NO: 524702 - RNA, 64 nt, Homo Sapiens; identical to SEQ ID NO: 81784

SEQ ID NO: 524703 - RNA, 64 nt, Homo Sapiens; identical to SEQ ID NO: 81785

SEQ ID NO: 524704 - RNA, 64 nt, Homo Sapiens; identical to SEQ ID NO: 81786

SEQ ID NO: 524705 - RNA, 64 nt, Homo Sapiens; identical to SEQ ID NO: 81787

SEQ ID NO: 524706 - RNA, 64 nt, Homo Sapiens; identical to SEQ ID NO: 81788

SEQ ID NO: 524707 - RNA, 64 nt, Homo Sapiens; identical to SEQ ID NO: 81789

SEQ ID NO: 524708 - RNA, 64 nt, Homo Sapiens; identical to SEQ ID NO: 81790

SEQ ID NO: 524709 - RNA, 64 nt, Homo Sapiens; identical to SEQ ID NO: 81791

SEQ ID NO: 524710 - RNA, 64 nt, Homo Sapiens; identical to SEQ ID NO: 81792

SEQ ID NO: 524711 - RNA, 64 nt, Homo Sapiens; identical to SEQ ID NO: 81793

SEQ ID NO: 524712 - RNA, 64 nt, Homo Sapiens; identical to SEQ ID NO: 81794

SEQ ID NO: 524713 - RNA, 64 nt, Homo Sapiens; identical to SEQ ID NO: 81795

SEQ ID NO: 524714 - RNA, 64 nt, Homo Sapiens; identical to SEQ ID NO: 81796

SEQ ID NO: 524715 - RNA, 64 nt, Homo Sapiens; identical to SEQ ID NO: 81797

SEQ ID NO: 524716 - RNA, 64 nt, Homo Sapiens; identical to SEQ ID NO: 81798

SEQ ID NO: 524717 - RNA, 64 nt, Homo Sapiens; identical to SEQ ID NO: 81799

SEQ ID NO: 524718 - RNA, 64 nt, Homo Sapiens; identical to SEQ ID NO: 81800

SEQ ID NO: 524719 - RNA, 64 nt, Homo Sapiens; identical to SEQ ID NO: 81801

SEQ ID NO: 524720 - RNA, 64 nt, Homo Sapiens; identical to SEQ ID NO: 81802

SEQ ID NO: 524721 - RNA, 64 nt, Homo Sapiens; identical to SEQ ID NO: 233025

SEQ ID NO: 524722 - RNA, 64 nt, Homo Sapiens; identical to SEQ ID NO: 233026

SEQ ID NO: 524723 - RNA, 64 nt, Homo Sapiens; identical to SEQ ID NO: 233027

SEQ ID NO: 524724 - RNA, 64 nt, Homo Sapiens; identical to SEQ ID NO: 233028

SEQ ID NO: 524725 - RNA, 64 nt, Homo Sapiens; identical to SEQ ID NO: 233029

SEQ ID NO: 524726 - RNA, 64 nt, Homo Sapiens; identical to SEQ ID NO: 233030

SEQ ID NO: 524727 - RNA, 64 nt, Homo Sapiens; identical to SEQ ID NO: 233031

SEQ ID NO: 524728 - RNA, 64 nt, Homo Sapiens; identical to SEQ ID NO: 233032

SEQ ID NO: 524729 - RNA, 64 nt, Homo Sapiens; identical to SEQ ID NO: 233033

SEQ ID NO: 524730 - RNA, 64 nt, Homo Sapiens; identical to SEQ ID NO: 233034

SEQ ID NO: 524731 - RNA, 64 nt, Homo Sapiens; identical to SEQ ID NO: 233035

SEQ ID NO: 524732 - RNA, 64 nt, Homo Sapiens; identical to SEQ ID NO: 233036

SEQ ID NO: 524733 - RNA, 64 nt, Homo Sapiens; identical to SEQ ID NO: 233037

SEQ ID NO: 524734 - RNA, 64 nt, Homo Sapiens; identical to SEQ ID NO: 233038

SEQ ID NO: 524735 - RNA, 64 nt, Homo Sapiens; identical to SEQ ID NO: 233039

SEQ ID NO: 524736 - RNA, 64 nt, Homo Sapiens; identical to SEQ ID NO: 233040

SEQ ID NO: 524737 - RNA, 64 nt, Homo Sapiens; identical to SEQ ID NO: 233041

SEQ ID NO: 524738 - RNA, 64 nt, Homo Sapiens; identical to SEQ ID NO: 233042

SEQ ID NO: 524739 - RNA, 64 nt, Homo Sapiens; identical to SEQ ID NO: 233043

SEQ ID NO: 524740 - RNA, 64 nt, Homo Sapiens; identical to SEQ ID NO: 233044

SEQ ID NO: 524741 - RNA, 64 nt, Homo Sapiens; identical to SEQ ID NO: 233045

SEQ ID NO: 524742 - RNA, 64 nt, Homo Sapiens; identical to SEQ ID NO: 233046

SEQ ID NO: 524743 - RNA, 64 nt, Homo Sapiens; identical to SEQ ID NO: 233047

SEQ ID NO: 524744 - RNA, 64 nt, Homo Sapiens; identical to SEQ ID NO: 233048

SEQ ID NO: 524745 - RNA, 64 nt, Homo Sapiens; identical to SEQ ID NO: 233049

SEQ ID NO: 524746 - RNA, 64 nt, Homo Sapiens; identical to SEQ ID NO: 233050

SEQ ID NO: 524747 - RNA, 64 nt, Homo Sapiens; identical to SEQ ID NO: 233051

SEQ ID NO: 524748 - RNA, 64 nt, Homo Sapiens; identical to SEQ ID NO: 233052

SEQ ID NO: 524749 - RNA, 64 nt, Homo Sapiens; identical to SEQ ID NO: 233053

SEQ ID NO: 524750 - RNA, 64 nt, Homo Sapiens; identical to SEQ ID NO: 233054

SEQ ID NO: 524751 - RNA, 64 nt, Homo Sapiens; identical to SEQ ID NO: 233055

SEQ ID NO: 524752 - RNA, 64 nt, Homo Sapiens; identical to SEQ ID NO: 233055

SEQ ID NO: 524753 - RNA, 64 nt, Homo Sapiens; identical to SEQ ID NO: 233057

SEQ ID NO: 524754 - RNA, 64 nt, Homo Sapiens; identical to SEQ ID NO: 296446

SEQ ID NO: 524755 - RNA, 64 nt, Homo Sapiens; identical to SEQ ID NO: 296447

SEQ ID NO: 524756 - RNA, 64 nt, Homo Sapiens; identical to SEQ ID NO: 296448

SEQ ID NO: 524757 - RNA, 64 nt, Homo Sapiens; identical to SEQ ID NO: 296449

SEQ ID NO: 524758 - RNA, 64 nt, Homo Sapiens; identical to SEQ ID NO: 296450

SEQ ID NO: 524759 - RNA, 64 nt, Homo Sapiens; identical to SEQ ID NO: 296451

SEQ ID NO: 524760 - RNA, 64 nt, Homo Sapiens; identical to SEQ ID NO: 296452

SEQ ID NO: 524761 - RNA, 64 nt, Homo Sapiens; identical to SEQ ID NO: 296453

SEQ ID NO: 524762 - RNA, 64 nt, Homo Sapiens; identical to SEQ ID NO: 296454

SEQ ID NO: 524763 - RNA, 64 nt, Homo Sapiens; identical to SEQ ID NO: 296455

SEQ ID NO: 524764 - RNA, 64 nt, Homo Sapiens; identical to SEQ ID NO: 159322

SEQ ID NO: 524765 - RNA, 64 nt, Homo Sapiens; identical to SEQ ID NO: 159323

SEQ ID NO: 524766 - RNA, 64 nt, Homo Sapiens; identical to SEQ ID NO: 159324

SEQ ID NO: 524767 - RNA, 64 nt, Homo Sapiens; identical to SEQ ID NO: 159325

SEQ ID NO: 524768 - RNA, 64 nt, Homo Sapiens; identical to SEQ ID NO: 159326

SEQ ID NO: 524769 - RNA, 64 nt, Homo Sapiens; identical to SEQ ID NO: 159327

SEQ ID NO: 524770 - RNA, 64 nt, Homo Sapiens; identical to SEQ ID NO: 159328

SEQ ID NO: 524771 - RNA, 64 nt, Homo Sapiens; identical to SEQ ID NO: 159329

SEQ ID NO: 524772 - RNA, 64 nt, Homo Sapiens; identical to SEQ ID NO: 159330

SEQ ID NO: 524773 - RNA, 64 nt, Homo Sapiens; identical to SEQ ID NO: 159331

SEQ ID NO: 524774 - RNA, 64 nt, Homo Sapiens; identical to SEQ ID NO: 159332

SEQ ID NO: 524775 - RNA, 64 nt, Homo Sapiens; identical to SEQ ID NO: 159333

SEQ ID NO: 524776 - RNA, 64 nt, Homo Sapiens; identical to SEQ ID NO: 159334

SEQ ID NO: 524777 - RNA, 64 nt, Homo Sapiens; identical to SEQ ID NO: 159335

SEQ ID NO: 524778 - RNA, 64 nt, Homo Sapiens; identical to SEQ ID NO: 159336

SEQ ID NO: 524779 - RNA, 64 nt, Homo Sapiens; identical to SEQ ID NO: 159337

SEQ ID NO: 524780 - RNA, 64 nt, Homo Sapiens; identical to SEQ ID NO: 159338

SEQ ID NO: 524781 - RNA, 64 nt, Homo Sapiens; identical to SEQ ID NO: 159339

SEQ ID NO: 524782 - RNA, 64 nt, Homo Sapiens; identical to SEQ ID NO: 159340

SEQ ID NO: 524783 - RNA, 64 nt, Homo Sapiens; identical to SEQ ID NO: 159341

SEQ ID NO: 524784 - RNA, 64 nt, Homo Sapiens; identical to SEQ ID NO: 159342

SEQ ID NO: 524785 - RNA, 64 nt, Homo Sapiens; identical to SEQ ID NO: 159343

SEQ ID NO: 524786 - RNA, 64 nt, Homo Sapiens; identical to SEQ ID NO: 159344

SEQ ID NO: 524787 - RNA, 64 nt, Homo Sapiens; identical to SEQ ID NO: 159345

SEQ ID NO: 524788 - RNA, 64 nt, Homo Sapiens; identical to SEQ ID NO: 159346

SEQ ID NO: 524789 - RNA, 64 nt, Homo Sapiens; identical to SEQ ID NO: 159347

SEQ ID NO: 524790 - RNA, 64 nt, Homo Sapiens; identical to SEQ ID NO: 159348

SEQ ID NO: 524791 - RNA, 64 nt, Homo Sapiens; identical to SEQ ID NO: 159349

SEQ ID NO: 524792 - RNA, 64 nt, Homo Sapiens; identical to SEQ ID NO: 159350

SEQ ID NO: 524793 - RNA, 64 nt, Homo Sapiens; identical to SEQ ID NO: 159351

SEQ ID NO: 524794 - RNA, 64 nt, Homo Sapiens; identical to SEQ ID NO: 159352

SEQ ID NO: 524795 - RNA, 64 nt, Homo Sapiens; identical to SEQ ID NO: 159353

SEQ ID NO: 524796 - RNA, 64 nt, Homo Sapiens; identical to SEQ ID NO: 159354

SEQ ID NO: 524797 - RNA, 64 nt, Homo Sapiens; identical to SEQ ID NO: 159355

SEQ ID NO: 524798 - RNA, 64 nt, Homo Sapiens; identical to SEQ ID NO: 159356

SEQ ID NO: 524799 - RNA, 64 nt, Homo Sapiens; identical to SEQ ID NO: 159357

SEQ ID NO: 524800 - RNA, 64 nt, Homo Sapiens; identical to SEQ ID NO: 159358

SEQ ID NO: 524801 - RNA, 64 nt, Homo Sapiens; identical to SEQ ID NO: 159359

SEQ ID NO: 524802 - RNA, 64 nt, Homo Sapiens; identical to SEQ ID NO: 159360

SEQ ID NO: 524803 - RNA, 64 nt, Homo Sapiens; identical to SEQ ID NO: 159361

SEQ ID NO: 524804 - RNA, 64 nt, Homo Sapiens; identical to SEQ ID NO: 159362

SEQ ID NO: 524805 - RNA, 64 nt, Homo Sapiens; identical to SEQ ID NO: 159363

SEQ ID NO: 524806 - RNA, 64 nt, Homo Sapiens; identical to SEQ ID NO: 159364

SEQ ID NO: 524807 - RNA, 64 nt, Homo Sapiens; identical to SEQ ID NO: 159365

SEQ ID NO: 524808 - RNA, 64 nt, Homo Sapiens; identical to SEQ ID NO: 159366

SEQ ID NO: 524809 - RNA, 64 nt, Homo Sapiens; identical to SEQ ID NO: 159365

SEQ ID NO: 524810 - RNA, 64 nt, Homo Sapiens; identical to SEQ ID NO: 159368

SEQ ID NO: 524811 - RNA, 64 nt, Homo Sapiens; identical to SEQ ID NO: 159369

SEQ ID NO: 524812 - RNA, 64 nt, Homo Sapiens; identical to SEQ ID NO: 159370

SEQ ID NO: 524813 - RNA, 64 nt, Homo Sapiens; identical to SEQ ID NO: 159371

SEQ ID NO: 524814 - RNA, 64 nt, Homo Sapiens; identical to SEQ ID NO: 159372

SEQ ID NO: 524815 - RNA, 64 nt, Homo Sapiens; identical to SEQ ID NO: 159373

SEQ ID NO: 524816 - RNA, 64 nt, Homo Sapiens; identical to SEQ ID NO: 159374

SEQ ID NO: 524817 - RNA, 64 nt, Homo Sapiens; identical to SEQ ID NO: 159375

SEQ ID NO: 524818 - RNA, 64 nt, Homo Sapiens; identical to SEQ ID NO: 159376

SEQ ID NO: 524819 - RNA, 64 nt, Homo Sapiens; identical to SEQ ID NO: 159377

SEQ ID NO: 524820 - RNA, 64 nt, Homo Sapiens; identical to SEQ ID NO: 209724

SEQ ID NO: 524821 - RNA, 64 nt, Homo Sapiens; identical to SEQ ID NO: 209725

SEQ ID NO: 524822 - RNA, 64 nt, Homo Sapiens; identical to SEQ ID NO: 209726

SEQ ID NO: 524823 - RNA, 64 nt, Homo Sapiens; identical to SEQ ID NO: 209727

SEQ ID NO: 524824 - RNA, 64 nt, Homo Sapiens; identical to SEQ ID NO: 209728

SEQ ID NO: 524825 - RNA, 64 nt, Homo Sapiens; identical to SEQ ID NO: 209729

SEQ ID NO: 524826 - RNA, 64 nt, Homo Sapiens; identical to SEQ ID NO: 209730

SEQ ID NO: 524827 - RNA, 64 nt, Homo Sapiens; identical to SEQ ID NO: 209731

SEQ ID NO: 524828 - RNA, 64 nt, Homo Sapiens; identical to SEQ ID NO: 209732

SEQ ID NO: 524829 - RNA, 64 nt, Homo Sapiens; identical to SEQ ID NO: 209733

SEQ ID NO: 524830 - RNA, 63 nt, Homo Sapiens; identical to SEQ ID NO: 209734

SEQ ID NO: 524831 - RNA, 64 nt, Homo Sapiens; identical to SEQ ID NO: 209735

SEQ ID NO: 524832 - RNA, 64 nt, Homo Sapiens; identical to SEQ ID NO: 209736

SEQ ID NO: 524833 - RNA, 64 nt, Homo Sapiens; identical to SEQ ID NO: 209737

SEQ ID NO: 524834 - RNA, 64 nt, Homo Sapiens; identical to SEQ ID NO: 209738

SEQ ID NO: 524835 - RNA, 64 nt, Homo Sapiens; identical to SEQ ID NO: 209739

SEQ ID NO: 524836 - RNA, 64 nt, Homo Sapiens; identical to SEQ ID NO: 209740

SEQ ID NO: 524837 - RNA, 64 nt, Homo Sapiens; identical to SEQ ID NO: 209741

SEQ ID NO: 524838 - RNA, 64 nt, Homo Sapiens; identical to SEQ ID NO: 209742

SEQ ID NO: 524839 - RNA, 64 nt, Homo Sapiens; identical to SEQ ID NO: 209743

SEQ ID NO: 524840 - RNA, 64 nt, Homo Sapiens; identical to SEQ ID NO: 209744

SEQ ID NO: 524841 - RNA, 64 nt, Homo Sapiens; identical to SEQ ID NO: 209745

SEQ ID NO: 524842 - RNA, 64 nt, Homo Sapiens; identical to SEQ ID NO: 209746

SEQ ID NO: 524843 - RNA, 64 nt, Homo Sapiens; identical to SEQ ID NO: 209747

SEQ ID NO: 524844 - RNA, 64 nt, Homo Sapiens; identical to SEQ ID NO: 209748

SEQ ID NO: 524845 - RNA, 64 nt, Homo Sapiens; identical to SEQ ID NO: 209749

SEQ ID NO: 524846 - RNA, 64 nt, Homo Sapiens; identical to SEQ ID NO: 209750

SEQ ID NO: 524847 - RNA, 64 nt, Homo Sapiens; identical to SEQ ID NO: 209751

SEQ ID NO: 524848 - RNA, 64 nt, Homo Sapiens; identical to SEQ ID NO: 209752

SEQ ID NO: 524849 - RNA, 64 nt, Homo Sapiens; identical to SEQ ID NO: 209753

SEQ ID NO: 524850 - RNA, 64 nt, Homo Sapiens; identical to SEQ ID NO: 209754

SEQ ID NO: 524851 - RNA, 64 nt, Homo Sapiens; identical to SEQ ID NO: 209755

SEQ ID NO: 524852 - RNA, 64 nt, Homo Sapiens; identical to SEQ ID NO: 209756

SEQ ID NO: 524853 - RNA, 64 nt, Homo Sapiens; identical to SEQ ID NO: 209757

SEQ ID NO: 524854 - RNA, 64 nt, Homo Sapiens; identical to SEQ ID NO: 209758

SEQ ID NO: 524855 - RNA, 64 nt, Homo Sapiens; identical to SEQ ID NO: 209759

SEQ ID NO: 524856 - RNA, 64 nt, Homo Sapiens; identical to SEQ ID NO: 209760

SEQ ID NO: 524857 - RNA, 64 nt, Homo Sapiens; identical to SEQ ID NO: 209761

SEQ ID NO: 524858 - RNA, 64 nt, Homo Sapiens; identical to SEQ ID NO: 209762

SEQ ID NO: 524859 - RNA, 64 nt, Homo Sapiens; identical to SEQ ID NO: 209763

SEQ ID NO: 524860 - RNA, 64 nt, Homo Sapiens; identical to SEQ ID NO: 209764

SEQ ID NO: 524861 - RNA, 64 nt, Homo Sapiens; identical to SEQ ID NO: 209765

SEQ ID NO: 524862 - RNA, 64 nt, Homo Sapiens; identical to SEQ ID NO: 209766

SEQ ID NO: 524863 - RNA, 64 nt, Homo Sapiens; identical to SEQ ID NO: 209767

SEQ ID NO: 524864 - RNA, 64 nt, Homo Sapiens; identical to SEQ ID NO: 209768

SEQ ID NO: 524865 - RNA, 64 nt, Homo Sapiens; identical to SEQ ID NO: 209769

SEQ ID NO: 524866 - RNA, 64 nt, Homo Sapiens; identical to SEQ ID NO: 209770

SEQ ID NO: 524867 - RNA, 64 nt, Homo Sapiens; identical to SEQ ID NO: 209771

SEQ ID NO: 524868 - RNA, 64 nt, Homo Sapiens; identical to SEQ ID NO: 209772

SEQ ID NO: 524869 - RNA, 64 nt, Homo Sapiens; identical to SEQ ID NO: 209773

SEQ ID NO: 524870 - RNA, 64 nt, Homo Sapiens; identical to SEQ ID NO: 209774

SEQ ID NO: 524871 - RNA, 64 nt, Homo Sapiens; identical to SEQ ID NO: 209775

SEQ ID NO: 524872 - RNA, 64 nt, Homo Sapiens; identical to SEQ ID NO: 209776

SEQ ID NO: 524873 - RNA, 64 nt, Homo Sapiens; identical to SEQ ID NO: 209777

SEQ ID NO: 524874 - RNA, 64 nt, Homo Sapiens; identical to SEQ ID NO: 209778

SEQ ID NO: 524875 - RNA, 64 nt, Homo Sapiens; identical to SEQ ID NO: 209779

SEQ ID NO: 524876 - RNA, 64 nt, Homo Sapiens; identical to SEQ ID NO: 209780

SEQ ID NO: 524877 - RNA, 64 nt, Homo Sapiens; identical to SEQ ID NO: 209781

SEQ ID NO: 524878 - RNA, 64 nt, Homo Sapiens; identical to SEQ ID NO: 209782

SEQ ID NO: 524879 - RNA, 64 nt, Homo Sapiens; identical to SEQ ID NO: 209783

SEQ ID NO: 524880 - RNA, 64 nt, Homo Sapiens; identical to SEQ ID NO: 209784

SEQ ID NO: 524881 - RNA, 64 nt, Homo Sapiens; identical to SEQ ID NO: 209785

SEQ ID NO: 524882 - RNA, 64 nt, Homo Sapiens; identical to SEQ ID NO: 209786

SEQ ID NO: 524883 - RNA, 64 nt, Homo Sapiens; identical to SEQ ID NO: 209787

SEQ ID NO: 524884 - RNA, 64 nt, Homo Sapiens; identical to SEQ ID NO: 209788

SEQ ID NO: 524885 - RNA, 64 nt, Homo Sapiens; identical to SEQ ID NO: 209789

SEQ ID NO: 524886 - RNA, 64 nt, Homo Sapiens; identical to SEQ ID NO: 209790

SEQ ID NO: 524887 - RNA, 64 nt, Homo Sapiens; identical to SEQ ID NO: 209791

SEQ ID NO: 524888 - RNA, 64 nt, Homo Sapiens; identical to SEQ ID NO: 209792

SEQ ID NO: 524889 - RNA, 64 nt, Homo Sapiens; identical to SEQ ID NO: 209793

SEQ ID NO: 524890 - RNA, 64 nt, Homo Sapiens; identical to SEQ ID NO: 209794

SEQ ID NO: 524891 - RNA, 64 nt, Homo Sapiens; identical to SEQ ID NO: 209795

SEQ ID NO: 524892 - RNA, 64 nt, Homo Sapiens; identical to SEQ ID NO: 209796

SEQ ID NO: 524893 - RNA, 64 nt, Homo Sapiens; identical to SEQ ID NO: 209797

SEQ ID NO: 524894 - RNA, 64 nt, Homo Sapiens; identical to SEQ ID NO: 209798

SEQ ID NO: 524895 - RNA, 64 nt, Homo Sapiens; identical to SEQ ID NO: 209799

SEQ ID NO: 524896 - RNA, 64 nt, Homo Sapiens; identical to SEQ ID NO: 209800

SEQ ID NO: 524897 - RNA, 64 nt, Homo Sapiens; identical to SEQ ID NO: 209801

SEQ ID NO: 524898 - RNA, 64 nt, Homo Sapiens; identical to SEQ ID NO: 209802

SEQ ID NO: 524899 - RNA, 64 nt, Homo Sapiens; identical to SEQ ID NO: 209803

SEQ ID NO: 524900 - RNA, 64 nt, Homo Sapiens; identical to SEQ ID NO: 209804

SEQ ID NO: 524901 - RNA, 64 nt, Homo Sapiens; identical to SEQ ID NO: 209805

SEQ ID NO: 524902 - RNA, 64 nt, Homo Sapiens; identical to SEQ ID NO: 209806

SEQ ID NO: 524903 - RNA, 64 nt, Homo Sapiens; identical to SEQ ID NO: 209807

SEQ ID NO: 524904 - RNA, 64 nt, Homo Sapiens; identical to SEQ ID NO: 209808

SEQ ID NO: 524905 - RNA, 64 nt, Homo Sapiens; identical to SEQ ID NO: 209809

SEQ ID NO: 524906 - RNA, 64 nt, Homo Sapiens; identical to SEQ ID NO: 209810

SEQ ID NO: 524907 - RNA, 64 nt, Homo Sapiens; identical to SEQ ID NO: 209811

SEQ ID NO: 524908 - RNA, 64 nt, Homo Sapiens; identical to SEQ ID NO: 209812

SEQ ID NO: 524909 - RNA, 64 nt, Homo Sapiens; identical to SEQ ID NO: 209813

SEQ ID NO: 524910 - RNA, 64 nt, Homo Sapiens; identical to SEQ ID NO: 209814

SEQ ID NO: 524911 - RNA, 64 nt, Homo Sapiens
gauugaggcuguugaccugggcaguagcuccucccauggccaguggucagugggagggugugcc

SEQ ID NO: 524912 - RNA, 64 nt, Homo Sapiens
uggucagugggagggugugcccugcgccugucugcauggccacugggcauguguguugggagca

SEQ ID NO: 524913 - RNA, 64 nt, Homo Sapiens
ccaggugcuggccagaugccuugaucacagccuccauggccaggggccugucaagccaggggcc

SEQ ID NO: 524914 - RNA, 64 nt, Homo Sapiens
ggggucauauguuuauuuuugaguagacuuggggcauggccauuggcucucaggagugugacca

SEQ ID NO: 524915 - RNA, 64 nt, Homo Sapiens
gaacccugaagaagcauguccacugcagaggacccauggccaugcuuuccuugagcucucugga

SEQ ID NO: 524916 - RNA, 64 nt, Homo Sapiens
uggcccuuccccgggugaggccguuuggaauuaacauggccaguguuucacacaagauuggguu

SEQ ID NO: 524917 - RNA, 64 nt, Homo Sapiens
cccuauccuacuugcccauaugagcacggcuccccauggccacauacuccugcaaagcuuuuau

SEQ ID NO: 524918 - RNA, 64 nt, Homo Sapiens
agcaccugcccuaccugcccccugccuuuccauccauggccagcugcuaaggucuuggaacuug

SEQ ID NO: 524919 - RNA, 64 nt, Homo Sapiens
uggaggcaggggcuuccugguguccugucaucaucauggccagccaggucccucucauuuagcc

SEQ ID NO: 524920 - RNA, 64 nt, Homo Sapiens
gccucuguguuuggggggcccaccucccaggguccauggccaggggccccugacucaccccggu

SEQ ID NO: 524921 - RNA, 64 nt, Homo Sapiens
cacuguuugcagugucucuggacaugcagcccuacauggccaccuccauuccccuggacccagg

SEQ ID NO: 524922 - RNA, 64 nt, Homo Sapiens
aacuucuacaggaucagagaggaucuugcucauucauggccauauccacaugcccauggccacu

SEQ ID NO: 524923 - RNA, 64 nt, Homo Sapiens
ggaucuugcucauucauggccauauccacaugcccauggccacucaguagauuguugaaaaagc

SEQ ID NO: 524924 - RNA, 64 nt, Homo Sapiens
ggucauacacagggcuggaccucacgcagacuggcauggccauggguccagaggauacuacugg

SEQ ID NO: 524925 - RNA, 64 nt, Homo Sapiens
uuccagaugguuccauggaguucugaucuuugggcauggccaggggaagcagaagggagacucu

SEQ ID NO: 524926 - RNA, 64 nt, Homo Sapiens
guuuuaucucagcagggaacgguaucauguacuucauggccaguugaugcacauauuucaccac

SEQ ID NO: 524927 - RNA, 64 nt, Homo Sapiens
cagaagaaauaaauuagguauaucagcaagcauucauggccauuucaaauauauccacauucuu

SEQ ID NO: 524928 - RNA, 64 nt, Homo Sapiens
uggguguggcccggugguggugcacuggugacuucauggccacgccagcugcggggacgcacuu

SEQ ID NO: 524929 - RNA, 64 nt, Homo Sapiens
ccucuaccuccuguccucaggccgugcggcacgacauggccagcacgcagaaggagcccucccg

SEQ ID NO: 524930 - RNA, 64 nt, Homo Sapiens
cuucuccaacaggguucuuggugaugcuggcagccauggccauggcagcggguggcauccaggc

SEQ ID NO: 524931 - RNA, 64 nt, Homo Sapiens
ccuucuucaacgccaucuccacucuuguggucaucauggccagcacgccgcucuucacuguggu

SEQ ID NO: 524932 - RNA, 64 nt, Homo Sapiens
agcccuggagugggcagagaguauuguggggaggcauggccagugggacuaguguucccuccau

SEQ ID NO: 524933 - RNA, 64 nt, Homo Sapiens
uagagcgagcccagcagcccuaaaaggcugccuucauggccaucuagccccaguucagggcagc

SEQ ID NO: 524934 - RNA, 64 nt, Homo Sapiens
cgcuggcuggcccccugauccauugugucugagccauggccagcucucagugacugugaaagga

SEQ ID NO: 524935 - RNA, 64 nt, Homo Sapiens
ggcuccagcugggguuuggugaaguugcauuugccauggccacuaaaugaagacaaaauacuca

SEQ ID NO: 524936 - RNA, 64 nt, Homo Sapiens; identical to SEQ ID NO: 61460

SEQ ID NO: 524937 - RNA, 64 nt, Homo Sapiens; identical to SEQ ID NO: 61461

SEQ ID NO: 524938 - RNA, 64 nt, Homo Sapiens; identical to SEQ ID NO: 61462

SEQ ID NO: 524939 - RNA, 64 nt, Homo Sapiens; identical to SEQ ID NO: 61463

SEQ ID NO: 524940 - RNA, 64 nt, Homo Sapiens; identical to SEQ ID NO: 61464

SEQ ID NO: 524941 - RNA, 64 nt, Homo Sapiens; identical to SEQ ID NO: 61465

SEQ ID NO: 524942 - RNA, 64 nt, Homo Sapiens; identical to SEQ ID NO: 61466

SEQ ID NO: 524943 - RNA, 64 nt, Homo Sapiens; identical to SEQ ID NO: 61467

SEQ ID NO: 524944 - RNA, 64 nt, Homo Sapiens; identical to SEQ ID NO: 61468

SEQ ID NO: 524945 - RNA, 64 nt, Homo Sapiens; identical to SEQ ID NO: 61469

SEQ ID NO: 524946 - RNA, 64 nt, Homo Sapiens; identical to SEQ ID NO: 61470

SEQ ID NO: 524947 - RNA, 64 nt, Homo Sapiens; identical to SEQ ID NO: 61471

SEQ ID NO: 524948 - RNA, 64 nt, Homo Sapiens; identical to SEQ ID NO: 61472

SEQ ID NO: 524949 - RNA, 64 nt, Homo Sapiens; identical to SEQ ID NO: 61473

SEQ ID NO: 524950 - RNA, 64 nt, Homo Sapiens; identical to SEQ ID NO: 61474

SEQ ID NO: 524951 - RNA, 64 nt, Homo Sapiens; identical to SEQ ID NO: 61475

SEQ ID NO: 524952 - RNA, 64 nt, Homo Sapiens; identical to SEQ ID NO: 61476

SEQ ID NO: 524953 - RNA, 64 nt, Homo Sapiens; identical to SEQ ID NO: 61477

SEQ ID NO: 524954 - RNA, 64 nt, Homo Sapiens; identical to SEQ ID NO: 61478

SEQ ID NO: 524955 - RNA, 64 nt, Homo Sapiens; identical to SEQ ID NO: 61479

SEQ ID NO: 524956 - RNA, 64 nt, Homo Sapiens; identical to SEQ ID NO: 61480

SEQ ID NO: 524957 - RNA, 64 nt, Homo Sapiens; identical to SEQ ID NO: 61481

SEQ ID NO: 524958 - RNA, 64 nt, Homo Sapiens; identical to SEQ ID NO: 61482

SEQ ID NO: 524959 - RNA, 64 nt, Homo Sapiens; identical to SEQ ID NO: 61483

SEQ ID NO: 524960 - RNA, 64 nt, Homo Sapiens; identical to SEQ ID NO: 61484

SEQ ID NO: 524961 - RNA, 64 nt, Homo Sapiens; identical to SEQ ID NO: 61485

SEQ ID NO: 524962 - RNA, 64 nt, Homo Sapiens; identical to SEQ ID NO: 61486

SEQ ID NO: 524963 - RNA, 64 nt, Homo Sapiens; identical to SEQ ID NO: 61487

SEQ ID NO: 524964 - RNA, 64 nt, Homo Sapiens; identical to SEQ ID NO: 61488

SEQ ID NO: 524965 - RNA, 64 nt, Homo Sapiens; identical to SEQ ID NO: 61489

SEQ ID NO: 524966 - RNA, 64 nt, Homo Sapiens; identical to SEQ ID NO: 61490

SEQ ID NO: 524967 - RNA, 64 nt, Homo Sapiens; identical to SEQ ID NO: 61491

SEQ ID NO: 524968 - RNA, 64 nt, Homo Sapiens; identical to SEQ ID NO: 61492

SEQ ID NO: 524969 - RNA, 64 nt, Homo Sapiens; identical to SEQ ID NO: 61493

SEQ ID NO: 524970 - RNA, 64 nt, Homo Sapiens; identical to SEQ ID NO: 61494

SEQ ID NO: 524971 - RNA, 64 nt, Homo Sapiens
agcaguccgggucuggguuugucccacaaaaucacaggagcacuguauguuccucucuuuugga

SEQ ID NO: 524972 - RNA, 64 nt, Homo Sapiens
uccaaagcggccacgcccacaauccgacagcccccaggagcagguccagggaugaugcagcccc

SEQ ID NO: 524973 - RNA, 64 nt, Homo Sapiens
aggcagccugagcucuuggauguggucagcucuccaggagcaaguccuguguggcaaaacugcc

SEQ ID NO: 524974 - RNA, 64 nt, Homo Sapiens
uguggagauggcgcccuguccugccaaggggcgccaggagcagagccagggccuggcgagcugg

SEQ ID NO: 524975 - RNA, 64 nt, Homo Sapiens
ccuaccggaguuacaaaagucacaggacguccagcaggagcagauccaggagcagcucauauga

SEQ ID NO: 524976 - RNA, 64 nt, Homo Sapiens
ugauuaauauuaggacguccagcaggagcagauccaggagcagcucauaugauccccacagucg

SEQ ID NO: 524977 - RNA, 64 nt, Homo Sapiens
ccaccccauggucgagguuccuaguacccccuggcaggagcaacuccacccuggggccuugccc

SEQ ID NO: 524978 - RNA, 64 nt, Homo Sapiens
cucacuccaagggcuuggccucucgccccccaggcaggagcaccgacugugagccacuuccacu

SEQ ID NO: 524979 - RNA, 64 nt, Homo Sapiens
cuaggugaggggugagggcccagaugacaccacccaggagcaccgaccugagggccacuguccu

SEQ ID NO: 524980 - RNA, 64 nt, Homo Sapiens
ugcugaccaguuuucccuucauccuccagggccacaggagcacgcuccacaagacaccugugac

SEQ ID NO: 524981 - RNA, 64 nt, Homo Sapiens
aguguuccuggcaugaccaggauuccugugaaagcaggagcagcagcaagccgucccgggccug

SEQ ID NO: 524982 - RNA, 64 nt, Homo Sapiens
ucacauccccagcugaugcucaauaaaacucagccaggagcauauggagaugcugacagccagg

SEQ ID NO: 524983 - RNA, 64 nt, Homo Sapiens
accugagauuucuaagcuugcccaggagcagccccaggagcacauccaugacacgaggccaguc

SEQ ID NO: 524984 - RNA, 64 nt, Homo Sapiens
cccaggagcacaaccugagaacgaggccaguccccaggagcagccacaugcuuuucuccaugac

SEQ ID NO: 524985 - RNA, 64 nt, Homo Sapiens
cagggcccaauuccuggccuggcgcugacauuaacaggagcaacuugugcccagcccugugcua

SEQ ID NO: 524986 - RNA, 64 nt, Homo Sapiens
acagaguccuccucuuggaagaaccagaacccaccaggagcaccgccuuucccucuccugcuga

SEQ ID NO: 524987 - RNA, 64 nt, Homo Sapiens
uggcugguuugaagccccagugccccauuuuaagcaggagcagggaauuuugcaaauggccccu

SEQ ID NO: 524988 - RNA, 64 nt, Homo Sapiens
cugccaccccuucuaccucaagcccucucccagacaggagcaggccggcucccagugucugccc

SEQ ID NO: 524989 - RNA, 64 nt, Homo Sapiens
cuccuucccucccuccucacgucaggcuguggagcaggagcacagcaguucuggcuguugucca

SEQ ID NO: 524990 - RNA, 64 nt, Homo Sapiens
caaguagagauuacacccagaacaccauuccuuccaggagcaguaggugggagguuugacccag

SEQ ID NO: 524991 - RNA, 64 nt, Homo Sapiens
cagugccgugguggccaaccggacccaggccuuccaggagcaggagcaggggcaggggcagggg

SEQ ID NO: 524992 - RNA, 64 nt, Homo Sapiens
cgugguggccaaccggacccaggccuuccaggagcaggagcaggggcaggggcaggggcaggga

SEQ ID NO: 524993 - RNA, 64 nt, Homo Sapiens
cagagcuagcccaccucaugauuucucccuaagucaggagcaugaaaaagggaaagaaaauguu

SEQ ID NO: 524994 - RNA, 64 nt, Homo Sapiens
ugcagugggcgcccacacugcacugacggggcugcaggagcaggcaccuccccagagcuccccg

SEQ ID NO: 524995 - RNA, 64 nt, Homo Sapiens
cacugaugcuagagggugauagggccagggcaggcaggagcaggggaagaagugguggagccuc

SEQ ID NO: 524996 - RNA, 64 nt, Homo Sapiens
gcccucugaagcaugggccgaguucaucucuuaccaggagcaagccugggacccugccagucuc

SEQ ID NO: 524997 - RNA, 64 nt, Homo Sapiens
uaggccauuucuaugccaagggaaugaagagcuacaggagcauuuggagagugagaacgacaaa

SEQ ID NO: 524998 - RNA, 64 nt, Homo Sapiens
ggcucacaccuuguaauccccuucaccauaaggccaggagcaguuugaucuucuacauacaaga

SEQ ID NO: 524999 - RNA, 64 nt, Homo Sapiens
ccgaaaaaggagacaguuccugugaucuccuuugcaggagcauagaauaguuuggguaccagga

SEQ ID NO: 525000 - RNA, 64 nt, Homo Sapiens
cagaaggcgucugggccuaaggauccauggaagucaggagcauuaaaucccaaaccaaaucaac

SEQ ID NO: 525001 - RNA, 64 nt, Homo Sapiens
cuaagggaauuccaagaucaacaggagcagggagcaggagcacuagagaagacuuucagagcuc

SEQ ID NO: 525002 - RNA, 64 nt, Homo Sapiens
gagcaggagcacucuaagggacuuucagagcucacaggagcaggagagaacacacagagagaag

SEQ ID NO: 525003 - RNA, 64 nt, Homo Sapiens
aggagguucaaguauggaggguaggagugcaacccaggagcaacgcucaagguggccgagaugc

SEQ ID NO: 525004 - RNA, 64 nt, Homo Sapiens
gaaggccccugauggagcuauuucuuccuaguaucaggagcaauugagaccccucaggaguuuc

SEQ ID NO: 525005 - RNA, 64 nt, Homo Sapiens
cugaggagaagaucgagcgaacccagcgggacaucaggagcauccaggaggcucucgcccgcaa

SEQ ID NO: 525006 - RNA, 64 nt, Homo Sapiens
ggggcagcuccgggcucaggaagccggccugcagcaggagcagaggaaggcagacacccacaag

SEQ ID NO: 525007 - RNA, 64 nt, Homo Sapiens
ucuccucccugacagcuacaccuuccagcaggugcaggagcacacggaccagauuuggaaguuc

SEQ ID NO: 525008 - RNA, 64 nt, Homo Sapiens
gaugcuaccucggaagcugaagcggauccuccggcaggagcacuggccgucuuuugaaaacuug

SEQ ID NO: 525009 - RNA, 64 nt, Homo Sapiens
gggugccaaggggcaggggcagugggggcucgggcaggagcaccccccagacuccccgugcccg

SEQ ID NO: 525010 - RNA, 64 nt, Homo Sapiens
caucuuccgcacaccccugcagcucgacccgcagcaggagcagcagcuguuccggcgccuggaa

SEQ ID NO: 525011 - RNA, 64 nt, Homo Sapiens
acuccagugcugcgcucuuggaaaaauguguguucaggagcaugugugucuuuugaaauacgaa

SEQ ID NO: 525012 - RNA, 64 nt, Homo Sapiens
caagaccacagaaaagagaaccugcccguggggccaggagcaccgcuggccaacugaccaucua

SEQ ID NO: 525013 - RNA, 64 nt, Homo Sapiens
ggaaaaacaucuagcuuauggugaucaacacugacaggagcacaacagccauuaaccauacagu

SEQ ID NO: 525014 - RNA, 64 nt, Homo Sapiens
acuaugccugugugaaaguauacaaaauacuacacaggagcauccuguuuuuagguuuugcuau

SEQ ID NO: 525015 - RNA, 64 nt, Homo Sapiens
cggccaagcuccugcccagauguugacccucacccagcgugagcugucacauaguaggagcuuc

SEQ ID NO: 525016 - RNA, 64 nt, Homo Sapiens
aaaaaguucagcaaagucauacacucccuguggccagcgugaacagagccaugccccacccucc

SEQ ID NO: 525017 - RNA, 64 nt, Homo Sapiens
ugggaaugaucuagaaaacuacugaccucuaaagcagcgugagaucugaacacagaagguguga

SEQ ID NO: 525018 - RNA, 64 nt, Homo Sapiens
uccugccaugcaguguugcgcaggaacuuggccucagcgugagauggcuucauucuggacuaga

SEQ ID NO: 525019 - RNA, 64 nt, Homo Sapiens
uugggggauuuuucaguggaaugaccugaaaccucagcgugaaucaucuuccaccucagcaacc

SEQ ID NO: 525020 - RNA, 64 nt, Homo Sapiens
uaccuggccccuccccaaauaagugcugggauuacagcgugagcccacccaccucgacuuccca

SEQ ID NO: 525021 - RNA, 64 nt, Homo Sapiens
gcaugauaugucucuguaaagugaucagcaguugcagcgugaaaauaaauacuuuaacucaggg

SEQ ID NO: 525022 - RNA, 64 nt, Homo Sapiens
gcaaagaaaaagacuuuugugcagccucgucuuacagcgugacugagcauagggucauggagca

SEQ ID NO: 525023 - RNA, 64 nt, Homo Sapiens
agcugagccccagcugugaucauccagcaugaugcagcgugaggacagcugagcagggaccggg

SEQ ID NO: 525024 - RNA, 64 nt, Homo Sapiens
auaucuuucaggcauuaagggaucauugcaagagcagcgugacugacauuaugaaggccuguac

SEQ ID NO: 525025 - RNA, 64 nt, Homo Sapiens
gaccacgacuccaucucuucucauuccagauuuccagcgugaagcaggcccaagcuagggaagg

SEQ ID NO: 525026 - RNA, 64 nt, Homo Sapiens
cucacagggggcuucugauaaccuagucuauacacagcgugaacgaacagaagggaaaucugcu

SEQ ID NO: 525027 - RNA, 64 nt, Homo Sapiens
gagaggcugaggauggcagggcuggaagggccaucagcgugacccucauuuucaagaaggggaa

SEQ ID NO: 525028 - RNA, 64 nt, Homo Sapiens
cacaugcuagucugauugccucuguguccugccucagcgugacuccccacucaccuggcucucu

SEQ ID NO: 525029 - RNA, 64 nt, Homo Sapiens
aaucauguuaccauuacaaaugggauauaagaggcagcgugaaagcagaugagcuguggacuag

SEQ ID NO: 525030 - RNA, 64 nt, Homo Sapiens
gaccugggcucuuggccgugggcagggaagaggccagcgugaagggcauuggggagcccagccc

SEQ ID NO: 525031 - RNA, 64 nt, Homo Sapiens
aggugugagacagacuugacgcagaucaggaugucagcgugauguccguaaaaguggaagagag

SEQ ID NO: 525032 - RNA, 64 nt, Homo Sapiens
uucuuuggugguucaagucucauuugacauaagacagcgugauguacugagagguauugucgag

SEQ ID NO: 525033 - RNA, 64 nt, Homo Sapiens
ugucgaggccauuucucuuugccacugagaaaugcagcgugacugacucuguugcuaccuguca

SEQ ID NO: 525034 - RNA, 64 nt, Homo Sapiens
gcaggcagaucaccugaggucgggaguucgagaccagcgugaccaacguggagaaacccccguc

SEQ ID NO: 525035 - RNA, 64 nt, Homo Sapiens
gugagcuacuugagagcaggguuuaugccuucaucagcgugaccccugugccugcagccucaua

SEQ ID NO: 525036 - RNA, 64 nt, Homo Sapiens
cagauccagaagaaaggccuggcguguggccaaacagcgugaaaccuuggcacaggacugagga

SEQ ID NO: 525037 - RNA, 64 nt, Homo Sapiens
gaaggggcauuauuugugcacugagaacaccgcgcagcgugacugugaguugcucauaccgugc

SEQ ID NO: 525038 - RNA, 64 nt, Homo Sapiens
ccucacccagagucaggggaagaauacuggagaccagcgugaacgcccucauccugagaaggcc

SEQ ID NO: 525039 - RNA, 64 nt, Homo Sapiens
gaggcuuccagguacuucacaccuggaaccuugccagcgugaagucagcucacucccugcuccc

SEQ ID NO: 525040 - RNA, 64 nt, Homo Sapiens
agcucuuuuguuuacuguuucauuguuugaaaugcagcgugaguuuuggaugggccugccuuaa

SEQ ID NO: 525041 - RNA, 64 nt, Homo Sapiens
uguauaucgauggcuuaacauuuuuuuuuauuagcagcgugauuuagacuguuuaugauaagcu

SEQ ID NO: 525042 - RNA, 64 nt, Homo Sapiens
gguggaggaggacacuuggaagcacagugaucaccagcgugaguacuccacgcagcuggcagag

SEQ ID NO: 525043 - RNA, 64 nt, Homo Sapiens
ucauuauuuuuguacauuuuuguauauacugggacagcgugaaacacuggaauccuucauggac

SEQ ID NO: 525044 - RNA, 64 nt, Homo Sapiens
agccacuugacuggcacacaccccuccggacauccagcgugacggagcccacacugccaccuug

SEQ ID NO: 525045 - RNA, 64 nt, Homo Sapiens
gaagaucuggaaugagaacugacuugugaaaccucagcgugaagggacauaucacugaccuuca

SEQ ID NO: 525046 - RNA, 64 nt, Homo Sapiens
agugcuacaaaaagaauuaguaauguggugugggcagcgugacauuuuaugucccacccaaaaa

SEQ ID NO: 525047 - RNA, 64 nt, Homo Sapiens
ccagacauccugcaaccuggugccugacccuucucagcgugaccaugacaggcucaucagccug

SEQ ID NO: 525048 - RNA, 64 nt, Homo Sapiens
caguuauuuucuacgcuaccagagggaccacagucagcgugaagaaacccccuacccccacccc

SEQ ID NO: 525049 - RNA, 64 nt, Homo Sapiens
cuucaucucaaaaaaaaaaauccagccugggcaacagcgugagacugagauaaucccacugcau

SEQ ID NO: 525050 - RNA, 64 nt, Homo Sapiens
accucagccagucuuaugaaauguguauucaucucagcgugaauuucgcgucuggucuuagagc

SEQ ID NO: 525051 - RNA, 64 nt, Homo Sapiens
uauuuggggauuccucagggucucacuuuccucccagcgugacuggcauguuucuguuuuggug

SEQ ID NO: 525052 - RNA, 64 nt, Homo Sapiens
auauacuucacugguguacauuuuaugcaaaagucagcgugacaccaaaaacagcaggccaucu

SEQ ID NO: 525053 - RNA, 64 nt, Homo Sapiens
gguaugggccagcaguuuccugccagauauugcccagcgugaggagcgaucucagcaggccuau

SEQ ID NO: 525054 - RNA, 64 nt, Homo Sapiens
uuugcuccagguggcaguacaagcuggcggccugcagcgugagcugugggagaggggucgugcg

SEQ ID NO: 525055 - RNA, 64 nt, Homo Sapiens
acccgcugccuuugcgucaccacagccuuggucacagcgugaccuuggugccuccgacggguca

SEQ ID NO: 525056 - RNA, 64 nt, Homo Sapiens
ucguggucgcgcagaugccggguucccugcugcacagcgugaccaucaacacagguuuuuaggu

SEQ ID NO: 525057 - RNA, 64 nt, Homo Sapiens
ucucugaaucccgggacccccuucccgcagccaccagcgugagcagccccugugcgugauccuc

SEQ ID NO: 525058 - RNA, 64 nt, Homo Sapiens
gacacccccagagccagugccccaucuuaagcaucagcgugacgugaccucucuguuucugcuu

SEQ ID NO: 525059 - RNA, 64 nt, Homo Sapiens
gcuguagauagaacaacgcucuguuccucugaagcagcgugauuugcccgggugagggcucugc

SEQ ID NO: 525060 - RNA, 64 nt, Homo Sapiens
cauucauucuuccaacaguuucaagucuucgagucagcgugacuagcugucagccuucaagaug

SEQ ID NO: 525061 - RNA, 64 nt, Homo Sapiens
uaccacaccuggccaaucccaagugcuaggauuacagcgugauccuacccgccuuagucuccca

SEQ ID NO: 525062 - RNA, 64 nt, Homo Sapiens
uuuccuuuuuugaguccuguguggcucuuugaaucagcgugaaacugaggcuccagcucccugu

SEQ ID NO: 525063 - RNA, 64 nt, Homo Sapiens
gugugucuucccuggauagcaccuagagggcacgcagcgugaggacccuggcugugccgagugc

SEQ ID NO: 525064 - RNA, 64 nt, Homo Sapiens
agggcccgagagaccugauguuguucucuccauccagcgugaccgcacagaaaucccagaccug

SEQ ID NO: 525065 - RNA, 64 nt, Homo Sapiens
aaugaugccagagaaggcuugggaaauuguacuucagcgugauagccugugucuucuuaauuug

SEQ ID NO: 525066 - RNA, 64 nt, Homo Sapiens
aacugcucacuuccuuaaauugucuuuuuucccccagcgugaaauguauccauuuauaacugcc

SEQ ID NO: 525067 - RNA, 64 nt, Homo Sapiens
guguuaauacucaugauaauuauuagggaccuggcagcgugauuggaguauggauguuuccgua

SEQ ID NO: 525068 - RNA, 64 nt, Homo Sapiens
agaggcacucugcccucuucccuauaaaaucacacagcgugauuuuacaaggucccguggcacc

SEQ ID NO: 525069 - RNA, 64 nt, Homo Sapiens
guggaaaugaguggagggggauugucuuucaacgcagcgugagucuaaugguugaauaaaacuu

SEQ ID NO: 525070 - RNA, 64 nt, Homo Sapiens
acuugcugaucugugggcgcucccacccgugugccagcgugacggcucgggguguccgcucccc

SEQ ID NO: 525071 - RNA, 64 nt, Homo Sapiens
ucagcuuggaccaagacaaaccucuucgggaagccagcgugagccugaccuaaccuuccugucu

SEQ ID NO: 525072 - RNA, 64 nt, Homo Sapiens
gaguagaagcuggagugccuugugccuuuacgaucagcgugacaaguaggggacuuucccacac

SEQ ID NO: 525073 - RNA, 64 nt, Homo Sapiens
caugaaaauaagccuggagagggccugugguagacagcgugaaucuucuccacuggaguuagga

SEQ ID NO: 525074 - RNA, 64 nt, Homo Sapiens
gugcaggaagcggaggcgcaggaccucaccgcgccagcgugaaguucccgggcauggucaugaa

SEQ ID NO: 525075 - RNA, 64 nt, Homo Sapiens
ugguggaucaugacaaggaguccacccaugagaacagcgugagccuagcaucuuccccucaccu

SEQ ID NO: 525076 - RNA, 64 nt, Homo Sapiens
cuuacaacucacuaguauagauuagacguugagacagcgugauauuccuuucauuuuauuaugc

SEQ ID NO: 525077 - RNA, 64 nt, Homo Sapiens
guggggaaguugcacagcaggggacuuggggauacagcgugaagugccagccagaauugguggc

SEQ ID NO: 525078 - RNA, 64 nt, Homo Sapiens
ggugaaaaauuaguaaauagcuucacaaaagaggcagcgugauaccuuuaguguuuucuagaau

SEQ ID NO: 525079 - RNA, 64 nt, Homo Sapiens
ggauguguugugccuugugucugucauguguggccagcgugauuguauagaauccagaguaugu

SEQ ID NO: 525080 - RNA, 64 nt, Homo Sapiens
cauuuugcgcgcacaauaguaaccuggguaaaugcagcgugaagggauuuuagucacacguggu

SEQ ID NO: 525081 - RNA, 64 nt, Homo Sapiens
auaaagugaagaggccuacucaccauuaucccugcagcgugacaccuuuugauugucacugacc

SEQ ID NO: 525082 - RNA, 64 nt, Homo Sapiens
gccaguggcaucugcgcggcugucgagggaccugcagcgugagaagggaaagauuuauggccuc

SEQ ID NO: 525083 - RNA, 64 nt, Homo Sapiens
ccucccacaguccaccccagcucgcaagaagagacagcgugaugucugagguggacaaagagcu

SEQ ID NO: 525084 - RNA, 64 nt, Homo Sapiens
cucagaagaaccuggaguaauugugccugaagcucagcgugaagucugaaauaugcaacagaag

SEQ ID NO: 525085 - RNA, 64 nt, Homo Sapiens
auaacaguuccaggauaacacugauuccugacaacagcgugagauuucaacagaacuuguuugg

SEQ ID NO: 525086 - RNA, 64 nt, Homo Sapiens
cuucagccuggagcccuggucuccugacugggugcagcgugagguccugaugcucgggccccaa

SEQ ID NO: 525087 - RNA, 64 nt, Homo Sapiens
gaaagcugauuucucugugacucccauuaggucacagcgugacucucagagacaccccuaaagg

SEQ ID NO: 525088 - RNA, 64 nt, Homo Sapiens
auuuucuaauaaaucuuuucaugcuacaccaguucagcgugagauucacugaaugcugcaccac

SEQ ID NO: 525089 - RNA, 64 nt, Homo Sapiens
ggccacagccccucuuggcuaggcaucccaaguccagcgugaagugagaagggccagagggucc

SEQ ID NO: 525090 - RNA, 64 nt, Homo Sapiens
uaauuuuuaaucaguuugcuuuuccaccauccuucagcgugaauucccuuaagugacuccaggu

SEQ ID NO: 525091 - RNA, 64 nt, Homo Sapiens
cgauguucuugauuuucccagagaagcaaauaaacagcgugaacagccccaguuccuggaguuc

SEQ ID NO: 525092 - RNA, 64 nt, Homo Sapiens
cccccgccuaggccucccaaagugcuggguuuaccagcgugagccaccacgcugggcuuccugc

SEQ ID NO: 525093 - RNA, 64 nt, Homo Sapiens
acgggacucuggucugcugucaucacccacugugcagcgugaggaggcguaguuuugaaacuca

SEQ ID NO: 525094 - RNA, 64 nt, Homo Sapiens
ugcccccagggaacacugggagcagaggcucacccagcgugaacgaaacacagccuucugcugc

SEQ ID NO: 525095 - RNA, 64 nt, Homo Sapiens
gagauaggucaucagcccaggcauccuugccuugcagcgugacccucuuuccaccaacccuccu

SEQ ID NO: 525096 - RNA, 64 nt, Homo Sapiens
aucucccuccaggaagcugcugccaccaccuaaccagcgugaaagccugagucccaccagaagg

SEQ ID NO: 525097 - RNA, 64 nt, Homo Sapiens
cuccuucccuucaugauaagccagugccagcauccagcgugagcagacgucggggagacuggga

SEQ ID NO: 525098 - RNA, 64 nt, Homo Sapiens
acggacaggaggugaugccaacaugaaauguagacagcgugaaucauuugugugggcaauccca

SEQ ID NO: 525099 - RNA, 64 nt, Homo Sapiens
accggcaggguucaacagacgccaauuggugggacagcgugaugggccugugcauucuagacca

SEQ ID NO: 525100 - RNA, 64 nt, Homo Sapiens
caacuuuucuagugugccacaaaugcuuccuacucagcgugaccuaaaagcaccagagaaaauc

SEQ ID NO: 525101 - RNA, 64 nt, Homo Sapiens
gaugccucuuuaacacuugauuuccacccucgagcagcgugagauuuugccaguugacaagauu

SEQ ID NO: 525102 - RNA, 64 nt, Homo Sapiens
gccgagaucacgccacugcacuccagccuggugacagcgugagacucuuuaaaaaaagaaauua

SEQ ID NO: 525103 - RNA, 64 nt, Homo Sapiens
uaaaguucacaggcagaucagagaagacugucuucagcgugaacacuucacagucaugaaaacu

SEQ ID NO: 525104 - RNA, 64 nt, Homo Sapiens
accguggccuguccacgguccagguccaucucagcagcgugagggugcacucaggguguuguua

SEQ ID NO: 525105 - RNA, 64 nt, Homo Sapiens
caguggauugugggaggcucuugcuuacacuaaucagcgugaccuggaccugcugggcaggauc

SEQ ID NO: 525106 - RNA, 64 nt, Homo Sapiens
uucuguguugccuuuggaagcaucuuucugugcucagcgugagucugaagcaggcgccagggcc

SEQ ID NO: 525107 - RNA, 64 nt, Homo Sapiens
ccagggcccgggaagcaaaucccagcgagggccccagcgugaaguggcgcucgaaguugaucuc

SEQ ID NO: 525108 - RNA, 64 nt, Homo Sapiens
ucagggguuguccacuuuacugucgccaccuggacagcgugaccggauuuuggcaugcguggcc

SEQ ID NO: 525109 - RNA, 63 nt, Homo Sapiens
uuuuagggagagaacaauaccuaagauugucugagcuuccaucuuucucauauuuccuaagca

SEQ ID NO: 525110 - RNA, 63 nt, Homo Sapiens
gagugaguuaguacauauuaauccugguuguugagcuuccagacuaccccguccaaaguuuga

SEQ ID NO: 525111 - RNA, 63 nt, Homo Sapiens
aagaccuguggcuacugguagagaauuggaauaagcuuccaacaauggacuguagagauuaau

SEQ ID NO: 525112 - RNA, 63 nt, Homo Sapiens
ugguguaaagccaacucgaggggaaucugaauaagcuuccaaaauuuuuuuuuuuaagaaaua

SEQ ID NO: 525113 - RNA, 63 nt, Homo Sapiens
acacccagaagaggccuuucccaucuggagagaagcuuccagaccagcccuucacacaccaca

SEQ ID NO: 525114 - RNA, 63 nt, Homo Sapiens
acagccaggagaggccuuuaccaccuggagagaagcuuccagaccagccccucacaccacagc

SEQ ID NO: 525115 - RNA, 63 nt, Homo Sapiens
acagccaggagaggccguuccugccuggagagaagcuuccagaccagcccuucacaccacagc

SEQ ID NO: 525116 - RNA, 63 nt, Homo Sapiens
cuguaguugguuuccuuccugugucccuuugcaagcuuccaggcgaucuaaggugucauuucu

SEQ ID NO: 525117 - RNA, 63 nt, Homo Sapiens
uuacacuagcuuguguuuugugcuacguauaccagcuuccaaaauuagcaucucauugagcca

SEQ ID NO: 525118 - RNA, 63 nt, Homo Sapiens
auguggugguucugggcaacgaucaaggaaaauagcuuccagaauuuuuuuuuucuuaaauau

SEQ ID NO: 525119 - RNA, 63 nt, Homo Sapiens
ccuuuggaucuuccauguucagacaccuuccucagcuuccaugucccuguuucccuuguauca

SEQ ID NO: 525120 - RNA, 63 nt, Homo Sapiens
ccuucuccagcccuuggggcgaggggcagggccagcuuccauccuccagggaauggccuccau

SEQ ID NO: 525121 - RNA, 63 nt, Homo Sapiens
uucuguucagauuggcagugugcacuauuaaaaagcuuccaucucccggcugggcacgguggc

SEQ ID NO: 525122 - RNA, 63 nt, Homo Sapiens
aacucugucucaaaaauaauaauaauaaaaaaaagcuuccaucucccagcccuucuugcaagc

SEQ ID NO: 525123 - RNA, 63 nt, Homo Sapiens
aaaaucuuagcgguggaccugggagauuugagaagcuuccagaaacaguuuaaacaagccagc

SEQ ID NO: 525124 - RNA, 63 nt, Homo Sapiens
ugccgcggccggaggaguuuuguuguugguuuuagcuuccaguggcuucuuucugcggggcau

SEQ ID NO: 525125 - RNA, 63 nt, Homo Sapiens
cccgaggcgugcuuccuuccugauugucucuagagcuuccaaguccugggaaugugcggggcc

SEQ ID NO: 525126 - RNA, 63 nt, Homo Sapiens
ucuggucaggaacccucagggacccaggaacucagcuuccaaacaucugcaccuugaccggac

SEQ ID NO: 525127 - RNA, 63 nt, Homo Sapiens
uuggccccaggaccugaucugaguucugcuggcagcuuccagaggauugccuuuuuugaggac

SEQ ID NO: 525128 - RNA, 63 nt, Homo Sapiens
aucucaggcgaugcuugugaugaagcauuuuuuagcuuccaccacuuaccaggaacugccugu

SEQ ID NO: 525129 - RNA, 63 nt, Homo Sapiens
agucccagagaugaagcucccucccagaagugcagcuuccaaauggccgugcccgaugugcac

SEQ ID NO: 525130 - RNA, 63 nt, Homo Sapiens
ggugccugagaugaaacuucgucccugagaugaagcuuccaaacgaaagugccagagaugaaa

SEQ ID NO: 525131 - RNA, 63 nt, Homo Sapiens
agugcccgaggcagcccuucgcuccugaggucaagcuuccaaacugaagugaagcuccccaag

SEQ ID NO: 525132 - RNA, 63 nt, Homo Sapiens
ggcuagaaauaaaauagccauuuucuugaaacaagcuuccaagauguuuaugauauggugucu

SEQ ID NO: 525133 - RNA, 63 nt, Homo Sapiens
uuggcauuuuuucuagaaccaauuggugccacaagcuuccaagugcuguuccaucccagcuug

SEQ ID NO: 525134 - RNA, 63 nt, Homo Sapiens
ugggcuacacggagaccgggccugggcacagacagcuuccaccauccucucccugcaguuugu

SEQ ID NO: 525135 - RNA, 63 nt, Homo Sapiens
caucucugcccaagcuuccucccuaugcucuacagcuuccagacgccuucuauccagccggca

SEQ ID NO: 525136 - RNA, 63 nt, Homo Sapiens
agaaugcaccagucaucagcuauucaguugguaagcuuccaggaaaaaggacaggcagaaaga

SEQ ID NO: 525137 - RNA, 63 nt, Homo Sapiens
uugauacuuguuuucaaaccaguauacaagauaagcuuccaggcugcauagaaggaggagagg

SEQ ID NO: 525138 - RNA, 64 nt, Homo Sapiens; identical to SEQ ID NO: 383727

SEQ ID NO: 525139 - RNA, 64 nt, Homo Sapiens; identical to SEQ ID NO: 383728

SEQ ID NO: 525140 - RNA, 64 nt, Homo Sapiens
ugggugcccauggauaguacaaugugggcacaugucuacacaugaacccuaugcauggaggguc

SEQ ID NO: 525141 - RNA, 64 nt, Homo Sapiens
ucugaaccuucuuuguuaaagggccugccaggagucuacacagcacaccacuggcugccaguca

SEQ ID NO: 525142 - RNA, 64 nt, Homo Sapiens
aaauuauucucaucucaaugccaaaaagauaguuucuacacaucaccugcuugcugaugucuau

SEQ ID NO: 525143 - RNA, 64 nt, Homo Sapiens
uuuaaacaaacacucaacguacauauguacauaaucuacacauauuuauaucacauaucuaguu

SEQ ID NO: 525144 - RNA, 64 nt, Homo Sapiens
guaaggguaguagaaggaaaugcagcuauggucuucuacacacuaaguuaucaagccugcauuu

SEQ ID NO: 525145 - RNA, 64 nt, Homo Sapiens
aaaguuaaccugacacagaaguagcuacacagaaucuacacagcuuuuucuuggacgaauucag

SEQ ID NO: 525146 - RNA, 64 nt, Homo Sapiens
caggagucucuucuguucugcauuuaccuggugggaacacgaaauuguuuagaacacgaauuuc

SEQ ID NO: 525147 - RNA, 64 nt, Homo Sapiens
uuccauuuaccuggugggaauuaucccuuguuuagaacacgaauuggcuccuccuugcagacag

SEQ ID NO: 525148 - RNA, 64 nt, Homo Sapiens; identical to SEQ ID NO: 430264

SEQ ID NO: 525149 - RNA, 64 nt, Homo Sapiens; identical to SEQ ID NO: 430265

SEQ ID NO: 525150 - RNA, 55 nt, Homo Sapiens; identical to SEQ ID NO: 430266

SEQ ID NO: 525151 - RNA, 64 nt, Homo Sapiens; identical to SEQ ID NO: 430267

SEQ ID NO: 525152 - RNA, 64 nt, Homo Sapiens; identical to SEQ ID NO: 430268

SEQ ID NO: 525153 - RNA, 64 nt, Homo Sapiens; identical to SEQ ID NO: 430269

SEQ ID NO: 525154 - RNA, 64 nt, Homo Sapiens; identical to SEQ ID NO: 430270

SEQ ID NO: 525155 - RNA, 64 nt, Homo Sapiens; identical to SEQ ID NO: 430271

SEQ ID NO: 525156 - RNA, 64 nt, Homo Sapiens; identical to SEQ ID NO: 430272

SEQ ID NO: 525157 - RNA, 64 nt, Homo Sapiens; identical to SEQ ID NO: 430273

SEQ ID NO: 525158 - RNA, 64 nt, Homo Sapiens; identical to SEQ ID NO: 430274

SEQ ID NO: 525159 - RNA, 64 nt, Homo Sapiens; identical to SEQ ID NO: 430275

SEQ ID NO: 525160 - RNA, 64 nt, Homo Sapiens; identical to SEQ ID NO: 430276

SEQ ID NO: 525161 - RNA, 64 nt, Homo Sapiens; identical to SEQ ID NO: 430277

SEQ ID NO: 525162 - RNA, 64 nt, Homo Sapiens; identical to SEQ ID NO: 430278

SEQ ID NO: 525163 - RNA, 64 nt, Homo Sapiens; identical to SEQ ID NO: 430279

SEQ ID NO: 525164 - RNA, 64 nt, Homo Sapiens; identical to SEQ ID NO: 430280

SEQ ID NO: 525165 - RNA, 64 nt, Homo Sapiens; identical to SEQ ID NO: 430281

SEQ ID NO: 525166 - RNA, 64 nt, Homo Sapiens; identical to SEQ ID NO: 430282

SEQ ID NO: 525167 - RNA, 64 nt, Homo Sapiens; identical to SEQ ID NO: 430283

SEQ ID NO: 525168 - RNA, 64 nt, Homo Sapiens; identical to SEQ ID NO: 430284

SEQ ID NO: 525169 - RNA, 64 nt, Homo Sapiens; identical to SEQ ID NO: 430285

SEQ ID NO: 525170 - RNA, 64 nt, Homo Sapiens; identical to SEQ ID NO: 430286

SEQ ID NO: 525171 - RNA, 64 nt, Homo Sapiens; identical to SEQ ID NO: 430287

SEQ ID NO: 525172 - RNA, 64 nt, Homo Sapiens; identical to SEQ ID NO: 430288

SEQ ID NO: 525173 - RNA, 64 nt, Homo Sapiens; identical to SEQ ID NO: 430289

SEQ ID NO: 525174 - RNA, 64 nt, Homo Sapiens; identical to SEQ ID NO: 430290

SEQ ID NO: 525175 - RNA, 64 nt, Homo Sapiens; identical to SEQ ID NO: 430291

SEQ ID NO: 525176 - RNA, 64 nt, Homo Sapiens; identical to SEQ ID NO: 430292

SEQ ID NO: 525177 - RNA, 64 nt, Homo Sapiens; identical to SEQ ID NO: 430293

SEQ ID NO: 525178 - RNA, 64 nt, Homo Sapiens; identical to SEQ ID NO: 430294

SEQ ID NO: 525179 - RNA, 64 nt, Homo Sapiens; identical to SEQ ID NO: 430295

SEQ ID NO: 525180 - RNA, 64 nt, Homo Sapiens; identical to SEQ ID NO: 430296

SEQ ID NO: 525181 - RNA, 64 nt, Homo Sapiens; identical to SEQ ID NO: 430297

SEQ ID NO: 525182 - RNA, 64 nt, Homo Sapiens; identical to SEQ ID NO: 430298

SEQ ID NO: 525183 - RNA, 64 nt, Homo Sapiens; identical to SEQ ID NO: 430299

SEQ ID NO: 525184 - RNA, 64 nt, Homo Sapiens; identical to SEQ ID NO: 430300

SEQ ID NO: 525185 - RNA, 64 nt, Homo Sapiens; identical to SEQ ID NO: 430301

SEQ ID NO: 525186 - RNA, 64 nt, Homo Sapiens; identical to SEQ ID NO: 430302

SEQ ID NO: 525187 - RNA, 64 nt, Homo Sapiens; identical to SEQ ID NO: 430303

SEQ ID NO: 525188 - RNA, 64 nt, Homo Sapiens; identical to SEQ ID NO: 430304

SEQ ID NO: 525189 - RNA, 64 nt, Homo Sapiens; identical to SEQ ID NO: 430305

SEQ ID NO: 525190 - RNA, 64 nt, Homo Sapiens; identical to SEQ ID NO: 430306

SEQ ID NO: 525191 - RNA, 64 nt, Homo Sapiens; identical to SEQ ID NO: 430307

SEQ ID NO: 525192 - RNA, 64 nt, Homo Sapiens; identical to SEQ ID NO: 430308

SEQ ID NO: 525193 - RNA, 64 nt, Homo Sapiens; identical to SEQ ID NO: 430309

SEQ ID NO: 525194 - RNA, 64 nt, Homo Sapiens; identical to SEQ ID NO: 430310

SEQ ID NO: 525195 - RNA, 64 nt, Homo Sapiens; identical to SEQ ID NO: 430311

SEQ ID NO: 525196 - RNA, 64 nt, Homo Sapiens; identical to SEQ ID NO: 430312

SEQ ID NO: 525197 - RNA, 64 nt, Homo Sapiens; identical to SEQ ID NO: 430313

SEQ ID NO: 525198 - RNA, 64 nt, Homo Sapiens; identical to SEQ ID NO: 430314

SEQ ID NO: 525199 - RNA, 64 nt, Homo Sapiens; identical to SEQ ID NO: 430315

SEQ ID NO: 525200 - RNA, 64 nt, Homo Sapiens; identical to SEQ ID NO: 430316

SEQ ID NO: 525201 - RNA, 64 nt, Homo Sapiens; identical to SEQ ID NO: 430317

SEQ ID NO: 525202 - RNA, 64 nt, Homo Sapiens; identical to SEQ ID NO: 430318

SEQ ID NO: 525203 - RNA, 64 nt, Homo Sapiens; identical to SEQ ID NO: 430319

SEQ ID NO: 525204 - RNA, 64 nt, Homo Sapiens; identical to SEQ ID NO: 430320

SEQ ID NO: 525205 - RNA, 64 nt, Homo Sapiens; identical to SEQ ID NO: 430321

SEQ ID NO: 525206 - RNA, 64 nt, Homo Sapiens; identical to SEQ ID NO: 430322

SEQ ID NO: 525207 - RNA, 64 nt, Homo Sapiens; identical to SEQ ID NO: 430323

SEQ ID NO: 525208 - RNA, 64 nt, Homo Sapiens; identical to SEQ ID NO: 522591

SEQ ID NO: 525209 - RNA, 64 nt, Homo Sapiens; identical to SEQ ID NO: 522592

SEQ ID NO: 525210 - RNA, 64 nt, Homo Sapiens; identical to SEQ ID NO: 522593

SEQ ID NO: 525211 - RNA, 64 nt, Homo Sapiens; identical to SEQ ID NO: 522594

SEQ ID NO: 525212 - RNA, 64 nt, Homo Sapiens; identical to SEQ ID NO: 522595

SEQ ID NO: 525213 - RNA, 64 nt, Homo Sapiens; identical to SEQ ID NO: 522596

SEQ ID NO: 525214 - RNA, 64 nt, Homo Sapiens; identical to SEQ ID NO: 522597

SEQ ID NO: 525215 - RNA, 64 nt, Homo Sapiens; identical to SEQ ID NO: 522598

SEQ ID NO: 525216 - RNA, 64 nt, Homo Sapiens; identical to SEQ ID NO: 522599

SEQ ID NO: 525217 - RNA, 64 nt, Homo Sapiens; identical to SEQ ID NO: 522600

SEQ ID NO: 525218 - RNA, 64 nt, Homo Sapiens; identical to SEQ ID NO: 522601

SEQ ID NO: 525219 - RNA, 64 nt, Homo Sapiens; identical to SEQ ID NO: 522602

SEQ ID NO: 525220 - RNA, 64 nt, Homo Sapiens; identical to SEQ ID NO: 522603

SEQ ID NO: 525221 - RNA, 64 nt, Homo Sapiens; identical to SEQ ID NO: 522604

SEQ ID NO: 525222 - RNA, 64 nt, Homo Sapiens
cuuuguugucccacuuugggaccggguccagucuggggucuagucucgagcaucagggucaggc

SEQ ID NO: 525223 - RNA, 64 nt, Homo Sapiens
ucugaaaucauccauuuggggacaaauccacauuggggucuagaaacauccacguaucucauca

SEQ ID NO: 525224 - RNA, 64 nt, Homo Sapiens
aucaugauaucaggacugguuacuugguuaaggaggggucuaggagaucugucccuuuuagaga

SEQ ID NO: 525225 - RNA, 64 nt, Homo Sapiens
ggagacuagguuauucucugccauagagcuaacuggggucuauaugcugggugcugagacacug

SEQ ID NO: 525226 - RNA, 64 nt, Homo Sapiens
ucaggggcuuuggaagcucuguugcagguguccgggggucuaggacuuuagggaucuggggaag

SEQ ID NO: 525227 - RNA, 64 nt, Homo Sapiens
agaucugucccuuuuagagauacuugguuaaggaggggucuaggauuaugauaucaggacuggu

SEQ ID NO: 525228 - RNA, 64 nt, Homo Sapiens
caaaaauggaugggaugaggccuacccuuuaccuggggucuaacgcaaggaaguauuugggcac

SEQ ID NO: 525229 - RNA, 64 nt, Homo Sapiens
uucugaggggguugguggauaggaacagacagggggggucuagaccccgauccuggccgaggug

SEQ ID NO: 525230 - RNA, 64 nt, Homo Sapiens
aggggcauuuuggagacugccgugaauucucucaggggucuagguguugguuuauugcuggcaa

SEQ ID NO: 525231 - RNA, 64 nt, Homo Sapiens
ccugcaaggacugagaggcuugcaugcaguaugaggggucuacagcugugcagggugagggcca

SEQ ID NO: 525232 - RNA, 64 nt, Homo Sapiens
gguugagggagguuggucaccuggacucugcacgggggucuacacaaccgggaugcgugggcaa

SEQ ID NO: 525233 - RNA, 64 nt, Homo Sapiens
cugugggguggggaggagcagauccaaguuuugcggggucuaaagcuguguguguugaggggga

SEQ ID NO: 525234 - RNA, 64 nt, Homo Sapiens
ucuccaucccucuguuggugcaugugucuguuugggggucuaucuucuaugagucugcuccauc

SEQ ID NO: 525235 - RNA, 64 nt, Homo Sapiens
ucauugguuucugaugcuuggugacuuugcuuuuggggucuauguuucacagaguaagccuguu

SEQ ID NO: 525236 - RNA, 64 nt, Homo Sapiens
cugcuaacuugugugcuaugauccacuccugaugggggucuacauuaaucuuccaguacuccuu

SEQ ID NO: 525237 - RNA, 64 nt, Homo Sapiens
ucuucuugaacacucaugcugaaagcccaaguagggggucuaaaauuuuuaaggacuuuccuuc

SEQ ID NO: 525238 - RNA, 64 nt, Homo Sapiens
uggaagggaccaagcgaccaaggaugggccaucuggggucuaugcccacauacccacguuuguu

SEQ ID NO: 525239 - RNA, 64 nt, Homo Sapiens
uagguuguccuagaaaggguguggagggaggaagggggucuaaggucuaucaagucaaucauuu

SEQ ID NO: 525240 - RNA, 64 nt, Homo Sapiens
ggaggggcuggguucuugaacccacaccgcuacuggggucuaauuagagacaggugucucugcc

SEQ ID NO: 525241 - RNA, 64 nt, Homo Sapiens
cauuccugagauucugggaaugaaguguggggcgggggucuauaaccaaggccuagggcgggua

SEQ ID NO: 525242 - RNA, 64 nt, Homo Sapiens
aagauuuuggcaaaacauauaaagugguuuuaaaggggucuaaauuuccuuuuguccuuguauu

SEQ ID NO: 525243 - RNA, 64 nt, Homo Sapiens
gagucgcgccuuacaaaucaaaauuccuaccuaaggggucuaggcugauuuuuuuaucuugccc

SEQ ID NO: 525244 - RNA, 64 nt, Homo Sapiens
gcagucagcuguuugcaguuuuuagccugauuuuggggucuauagagauugcuuuauuggauac

SEQ ID NO: 525245 - RNA, 64 nt, Homo Sapiens
ucauuuuucuuuuggugcagaaccguugugcaguggggucuaccaugcaauuuucuuucagcac

SEQ ID NO: 525246 - RNA, 64 nt, Homo Sapiens
agcauuuacugacuuccugugugcuagagacaagggggucuaugcccaucucuaaggacuccaa

SEQ ID NO: 525247 - RNA, 64 nt, Homo Sapiens
uuggauguaucuuacuuagucuaaggauuugaagggggucuaaaaccaagugauucccauuugu

SEQ ID NO: 525248 - RNA, 64 nt, Homo Sapiens
uauuagauaauguauaacuugcacccagggaaugggggucuaugagacaaccccacuuggagaa

SEQ ID NO: 525249 - RNA, 64 nt, Homo Sapiens
acuuaugcagcuuucuacagggagaguuugguuuggggucuauaucuagagggaccuucaaagu

SEQ ID NO: 525250 - RNA, 64 nt, Homo Sapiens
uguguugucacuggaaguacugucaaagacuuugggggucuaacuaaaauggccaaaguuccaa

SEQ ID NO: 525251 - RNA, 64 nt, Homo Sapiens
ccugccuuuucaaugauuuaacgguguuuuuaagggggucuaagcaaauuaugguaggcaacua

SEQ ID NO: 525252 - RNA, 64 nt, Homo Sapiens
uuuuaaucccguuauggacucugucuccaggagaggggucuauccaccccugcucauuggugga

SEQ ID NO: 525253 - RNA, 64 nt, Homo Sapiens
gccucuaucuuguuuuuuguuuuuucuucuggggggggucuagaacagugccuggcacauagua

SEQ ID NO: 525254 - RNA, 64 nt, Homo Sapiens
uacagauccucucuuucuuucccuacgucugccuggggucuacuccauaaggguuuacaaaugg

SEQ ID NO: 525255 - RNA, 64 nt, Homo Sapiens
guuaaugagucucuuggcccacuggucccacuugggggucuagaccaggauuauagaggacaca

SEQ ID NO: 525256 - RNA, 64 nt, Homo Sapiens
acugcuaauacagaaacuuaauguagaccuguuuggggucuacuauuguuuuagaaugaaggaa

SEQ ID NO: 525257 - RNA, 64 nt, Homo Sapiens
uuuuuuuuuuuuucuuuuuuggugugaaggugggggggucuauuagacauuuauucaagagcgu

SEQ ID NO: 525258 - RNA, 64 nt, Homo Sapiens
cagaucuaggcaguuucuaaacaacacuuagacuggggucuaacguugacaaauccuucuagaa

SEQ ID NO: 525259 - RNA, 64 nt, Homo Sapiens
uguguaagcaaccaggacuuuuuucccuuccagaggggucuauaaaggaaauguuagaaguuau

SEQ ID NO: 525260 - RNA, 64 nt, Homo Sapiens
agccaugggguuugcuugcugccaaaauacccacggggucuaccgggaggggagcaguguugau

SEQ ID NO: 525261 - RNA, 64 nt, Homo Sapiens
ggugcuucucagugggaagggacugcacaccacuggggucuaugaugcuugcugcagcaagaga

SEQ ID NO: 525262 - RNA, 64 nt, Homo Sapiens
caccaacagcugugauuucaucccgaaguggaagggggucuaaacagaacaggcugagagaggc

SEQ ID NO: 525263 - RNA, 64 nt, Homo Sapiens
agagccaccugggguacauguugaaaacuuauuuggggucuaccccaaaccuaauaacccaaau

SEQ ID NO: 525264 - RNA, 64 nt, Homo Sapiens
uccuaaagcaaaauugaaacuuuaauuauaaacuggggucuaaauaaugugggaaugauuuggu

SEQ ID NO: 525265 - RNA, 64 nt, Homo Sapiens
augaaaugauacacauuuuuaauuugaaaguucaggggucuauuuaaauguauucucacaugua

SEQ ID NO: 525266 - RNA, 64 nt, Homo Sapiens
cucuuaacuguggggaccaaaagggagagagccuggggucuacaagaggagacacaucaucaaa

SEQ ID NO: 525267 - RNA, 64 nt, Homo Sapiens
cugcugggggcucuguggcuccauuccuggcuguggggucuagucaagaggcagagggacuugg

SEQ ID NO: 525268 - RNA, 64 nt, Homo Sapiens
auaggagcaagacuuccuugaggaguauaggacuggggucuagguggugguugccauugggcag

SEQ ID NO: 525269 - RNA, 64 nt, Homo Sapiens
auguagcuuccagaacccaccuggcacagugcuuggggucuaguggacggcagauaugaaaugc

SEQ ID NO: 525270 - RNA, 64 nt, Homo Sapiens
guauaacuaacagcauccccaaaacaaagucuuuggggucuacacugcaaucauaugugaucug

SEQ ID NO: 525271 - RNA, 64 nt, Homo Sapiens
gguaaagugcccaucuggugcucaagagagccugggggucuaacagggagcccggcugccucac

SEQ ID NO: 525272 - RNA, 64 nt, Homo Sapiens
uuaugaguucaugcaaaacucuccaggccaaguaggggucuagccuuuaaugauauuagucaaa

SEQ ID NO: 525273 - RNA, 64 nt, Homo Sapiens
cauccuggugggggagggcagccuucaaacguguggggucuacaguccucaggucuaggcaggg

SEQ ID NO: 525274 - RNA, 64 nt, Homo Sapiens
cccuacagaguuagggaauggagcccaggcaccaggggucuaaagugugagccacugagaagag

SEQ ID NO: 525275 - RNA, 64 nt, Homo Sapiens
uuuggacuauucaggugaacuauuugagggguauggggucuagaaguuaaaagauacgcauguc

SEQ ID NO: 525276 - RNA, 64 nt, Homo Sapiens
ggcuauuccuaggccucagggugugggucagggaggggucuagagggccccagggaacuaaagg

SEQ ID NO: 525277 - RNA, 64 nt, Homo Sapiens
ucagagcucucccugucaaauuuucagagaguuuggggucuaccugagagaggaguagcccccu

SEQ ID NO: 525278 - RNA, 64 nt, Homo Sapiens
uaaauuuguugaacucuuacccgcuuacucuguuggggucuauauucuagucaugcugugcaug

SEQ ID NO: 525279 - RNA, 64 nt, Homo Sapiens
uguguugggagauggguaaagcguuucuucuaaaggggucuacccagaaagcaugauuuccugc

SEQ ID NO: 525280 - RNA, 64 nt, Homo Sapiens
auagggaacaauguuuauagucguguguacagugggggucuacaacaagaaguguauauuuuca

SEQ ID NO: 525281 - RNA, 64 nt, Homo Sapiens
aucugggacgugcagugauggggauuacaggggaggggucuagcuccuuuuucucucucauauu

SEQ ID NO: 525282 - RNA, 64 nt, Homo Sapiens
aaaacagcaauagaaauuaauuucaggggagcggggggucuauaucccaucaccagaaacaucu

SEQ ID NO: 525283 - RNA, 64 nt, Homo Sapiens
ggugacaguccaaaccacucaaaggggccccaccggggucuaaucuugggcuccugaugaggag

SEQ ID NO: 525284 - RNA, 64 nt, Homo Sapiens
agcuguagggugcugccacuugacagcagggaugggggucuaacccugaucccugugggaccuu

SEQ ID NO: 525285 - RNA, 64 nt, Homo Sapiens
auuccucccugaugugguaaacuggcacacuccaggggucuaaaacauaaaacaguuguguuua

SEQ ID NO: 525286 - RNA, 64 nt, Homo Sapiens
gccuugcgccgcauucgcacugggggacaugggaggggucuagcuggccacugcuggaggcagc

SEQ ID NO: 525287 - RNA, 64 nt, Homo Sapiens
guuugugguaguaaucuaauuguggugccaugcaggggucuacgcaucuacuccugaaaauaaa

SEQ ID NO: 525288 - RNA, 64 nt, Homo Sapiens
gagucagggacagaagggaagacccuuccuguggggggucuacaaggaaccucccccuaccuag

SEQ ID NO: 525289 - RNA, 64 nt, Homo Sapiens
uuauaagggcacuaaccccacuagcuaucucuguggggucuauuuccucacaugacugaaggga

SEQ ID NO: 525290 - RNA, 64 nt, Homo Sapiens
uuguuagaggagcauaugauuagaauucuguuugggggucuaguugucuuggagcaaguaugua

SEQ ID NO: 525291 - RNA, 64 nt, Homo Sapiens
ccaaaagaaaugucauuaacuucgagagaaagcaggggucuaauugaauucauuacgaagaaug

SEQ ID NO: 525292 - RNA, 64 nt, Homo Sapiens
ccuuggcacaugaggccggcucuccccacuggcuggggucuaaccuugaacccucaccacgugc

SEQ ID NO: 525293 - RNA, 64 nt, Homo Sapiens
ugaccuuuaguccucuaccuucucuccaaggaguggggucuacggcucaguucaccugccacgu

SEQ ID NO: 525294 - RNA, 64 nt, Homo Sapiens
acuugacccccuugagggugaccuuuuauuacauggggucuagaguacaucuggccuugaaacc

SEQ ID NO: 525295 - RNA, 64 nt, Homo Sapiens
gcagguggacacuuugaaccgcaaaaacaccaauggggucuaguaacacaccacggucugcccu

SEQ ID NO: 525296 - RNA, 64 nt, Homo Sapiens
gcugccugagaugggugugcgguggggaggcguaggggucuacggagccugcaugugccugugg

SEQ ID NO: 525297 - RNA, 64 nt, Homo Sapiens
ucuuauuacuucaacaaauaaggucauuugugauggggucuaauuacaauuaucuucucaguga

SEQ ID NO: 525298 - RNA, 64 nt, Homo Sapiens
uuugguauuucggaaacuaaaguccuuaugggauggggucuagaauugauucuccuuuccugag

SEQ ID NO: 525299 - RNA, 64 nt, Homo Sapiens
uuuucucauguuuacagugcacggaguguggaagggggucuaggagagggagagcuggaaaagg

SEQ ID NO: 525300 - RNA, 64 nt, Homo Sapiens
gccuuguggauggcaccaaaacaucuaugcagcaggggucuaucgaaauuguaccuuucuaaug

SEQ ID NO: 525301 - RNA, 64 nt, Homo Sapiens
ucaccccugcagucucgaccugcuaugggagacuggggucuauucuuccuaauaagccugggag

SEQ ID NO: 525302 - RNA, 64 nt, Homo Sapiens
aauguaucuuauaauaaaaaaucuuuucuucuauggggucuauauuuaacagccucugaaauuu

SEQ ID NO: 525303 - RNA, 64 nt, Homo Sapiens
gagaaggaagugauccacagcauucaggccacuuggggucuagaccaugguggugccagccugg

SEQ ID NO: 525304 - RNA, 64 nt, Homo Sapiens
uuggaaucugacaacuggaaccuugcaauccauuggggucuagucagggcuuucauuuggucau

SEQ ID NO: 525305 - RNA, 64 nt, Homo Sapiens
ccaagagguaacauuuugccccgggccaaauucaggggucuagugcccugcauuccuuugaggc

SEQ ID NO: 525306 - RNA, 64 nt, Homo Sapiens
ucuggacggggcucuuuugcuucccccucaaucuggggucuagaguugugcaaggaauucagcu

SEQ ID NO: 525307 - RNA, 64 nt, Homo Sapiens
agucccgggccccccaguucaggucgugaguccaggggucuacauuucuucgaggaccucagca

SEQ ID NO: 525308 - RNA, 64 nt, Homo Sapiens
gguuugugauuaaaauaauaggaggguauacugaggggucuauauugcuggggccaggccccau

SEQ ID NO: 525309 - RNA, 64 nt, Homo Sapiens
ugguaagcggagggccugaguucagggcacugauggggucuaccgcccugcugacugggaaagu

SEQ ID NO: 525310 - RNA, 64 nt, Homo Sapiens
gucguuacuaugggccauauuacuaaugcccacuggggucuaugauuucucaaaauuuucauuc

SEQ ID NO: 525311 - RNA, 64 nt, Homo Sapiens; identical to SEQ ID NO: 525310

SEQ ID NO: 525312 - RNA, 64 nt, Homo Sapiens; identical to SEQ ID NO: 481345

SEQ ID NO: 525313 - RNA, 64 nt, Homo Sapiens; identical to SEQ ID NO: 481346

SEQ ID NO: 525314 - RNA, 64 nt, Homo Sapiens; identical to SEQ ID NO: 481347

SEQ ID NO: 525315 - RNA, 64 nt, Homo Sapiens; identical to SEQ ID NO: 481348

SEQ ID NO: 525316 - RNA, 64 nt, Homo Sapiens; identical to SEQ ID NO: 481349

SEQ ID NO: 525317 - RNA, 64 nt, Homo Sapiens; identical to SEQ ID NO: 481350

SEQ ID NO: 525318 - RNA, 64 nt, Homo Sapiens; identical to SEQ ID NO: 481351

SEQ ID NO: 525319 - RNA, 63 nt, Homo Sapiens; identical to SEQ ID NO: 481352

SEQ ID NO: 525320 - RNA, 64 nt, Homo Sapiens; identical to SEQ ID NO: 481353

SEQ ID NO: 525321 - RNA, 64 nt, Homo Sapiens; identical to SEQ ID NO: 481354

SEQ ID NO: 525322 - RNA, 64 nt, Homo Sapiens; identical to SEQ ID NO: 481355

SEQ ID NO: 525323 - RNA, 64 nt, Homo Sapiens; identical to SEQ ID NO: 481356

SEQ ID NO: 525324 - RNA, 64 nt, Homo Sapiens; identical to SEQ ID NO: 481357

SEQ ID NO: 525325 - RNA, 64 nt, Homo Sapiens; identical to SEQ ID NO: 481358

SEQ ID NO: 525326 - RNA, 64 nt, Homo Sapiens; identical to SEQ ID NO: 481359

SEQ ID NO: 525327 - RNA, 64 nt, Homo Sapiens; identical to SEQ ID NO: 481360

SEQ ID NO: 525328 - RNA, 64 nt, Homo Sapiens; identical to SEQ ID NO: 481361

SEQ ID NO: 525329 - RNA, 64 nt, Homo Sapiens; identical to SEQ ID NO: 481362

SEQ ID NO: 525330 - RNA, 64 nt, Homo Sapiens; identical to SEQ ID NO: 481363

SEQ ID NO: 525331 - RNA, 64 nt, Homo Sapiens; identical to SEQ ID NO: 481364

SEQ ID NO: 525332 - RNA, 64 nt, Homo Sapiens; identical to SEQ ID NO: 481365

SEQ ID NO: 525333 - RNA, 64 nt, Homo Sapiens; identical to SEQ ID NO: 481366

SEQ ID NO: 525334 - RNA, 64 nt, Homo Sapiens; identical to SEQ ID NO: 481367

SEQ ID NO: 525335 - RNA, 64 nt, Homo Sapiens; identical to SEQ ID NO: 481368

SEQ ID NO: 525336 - RNA, 64 nt, Homo Sapiens; identical to SEQ ID NO: 481369

SEQ ID NO: 525337 - RNA, 64 nt, Homo Sapiens; identical to SEQ ID NO: 481370

SEQ ID NO: 525338 - RNA, 64 nt, Homo Sapiens; identical to SEQ ID NO: 481371

SEQ ID NO: 525339 - RNA, 64 nt, Homo Sapiens; identical to SEQ ID NO: 481372

SEQ ID NO: 525340 - RNA, 64 nt, Homo Sapiens; identical to SEQ ID NO: 481373

SEQ ID NO: 525341 - RNA, 64 nt, Homo Sapiens; identical to SEQ ID NO: 481374

SEQ ID NO: 525342 - RNA, 64 nt, Homo Sapiens; identical to SEQ ID NO: 481375

SEQ ID NO: 525343 - RNA, 64 nt, Homo Sapiens; identical to SEQ ID NO: 481376

SEQ ID NO: 525344 - RNA, 64 nt, Homo Sapiens; identical to SEQ ID NO: 481377

SEQ ID NO: 525345 - RNA, 64 nt, Homo Sapiens; identical to SEQ ID NO: 481378

SEQ ID NO: 525346 - RNA, 64 nt, Homo Sapiens; identical to SEQ ID NO: 481379

SEQ ID NO: 525347 - RNA, 64 nt, Homo Sapiens; identical to SEQ ID NO: 481380

SEQ ID NO: 525348 - RNA, 64 nt, Homo Sapiens; identical to SEQ ID NO: 481381

SEQ ID NO: 525349 - RNA, 64 nt, Homo Sapiens; identical to SEQ ID NO: 481382

SEQ ID NO: 525350 - RNA, 64 nt, Homo Sapiens; identical to SEQ ID NO: 481383

SEQ ID NO: 525351 - RNA, 64 nt, Homo Sapiens; identical to SEQ ID NO: 481384

SEQ ID NO: 525352 - RNA, 64 nt, Homo Sapiens; identical to SEQ ID NO: 481385

SEQ ID NO: 525353 - RNA, 64 nt, Homo Sapiens; identical to SEQ ID NO: 481386

SEQ ID NO: 525354 - RNA, 64 nt, Homo Sapiens; identical to SEQ ID NO: 481387

SEQ ID NO: 525355 - RNA, 64 nt, Homo Sapiens; identical to SEQ ID NO: 481388

SEQ ID NO: 525356 - RNA, 64 nt, Homo Sapiens; identical to SEQ ID NO: 481389

SEQ ID NO: 525357 - RNA, 64 nt, Homo Sapiens; identical to SEQ ID NO: 481390

SEQ ID NO: 525358 - RNA, 64 nt, Homo Sapiens; identical to SEQ ID NO: 481391

SEQ ID NO: 525359 - RNA, 64 nt, Homo Sapiens; identical to SEQ ID NO: 481392

SEQ ID NO: 525360 - RNA, 64 nt, Homo Sapiens; identical to SEQ ID NO: 481393

SEQ ID NO: 525361 - RNA, 64 nt, Homo Sapiens; identical to SEQ ID NO: 481394

SEQ ID NO: 525362 - RNA, 64 nt, Homo Sapiens; identical to SEQ ID NO: 481395

SEQ ID NO: 525363 - RNA, 64 nt, Homo Sapiens; identical to SEQ ID NO: 223145

SEQ ID NO: 525364 - RNA, 64 nt, Homo Sapiens; identical to SEQ ID NO: 223146

SEQ ID NO: 525365 - RNA, 64 nt, Homo Sapiens; identical to SEQ ID NO: 223147

SEQ ID NO: 525366 - RNA, 64 nt, Homo Sapiens; identical to SEQ ID NO: 223148

SEQ ID NO: 525367 - RNA, 64 nt, Homo Sapiens; identical to SEQ ID NO: 223149

SEQ ID NO: 525368 - RNA, 64 nt, Homo Sapiens; identical to SEQ ID NO: 223150

SEQ ID NO: 525369 - RNA, 64 nt, Homo Sapiens; identical to SEQ ID NO: 223151

SEQ ID NO: 525370 - RNA, 64 nt, Homo Sapiens; identical to SEQ ID NO: 223152

SEQ ID NO: 525371 - RNA, 64 nt, Homo Sapiens; identical to SEQ ID NO: 223153

SEQ ID NO: 525372 - RNA, 64 nt, Homo Sapiens; identical to SEQ ID NO: 223154

SEQ ID NO: 525373 - RNA, 64 nt, Homo Sapiens; identical to SEQ ID NO: 223155

SEQ ID NO: 525374 - RNA, 64 nt, Homo Sapiens; identical to SEQ ID NO: 223156

SEQ ID NO: 525375 - RNA, 64 nt, Homo Sapiens; identical to SEQ ID NO: 223157

SEQ ID NO: 525376 - RNA, 64 nt, Homo Sapiens; identical to SEQ ID NO: 223158

SEQ ID NO: 525377 - RNA, 64 nt, Homo Sapiens; identical to SEQ ID NO: 223159

SEQ ID NO: 525378 - RNA, 64 nt, Homo Sapiens; identical to SEQ ID NO: 223160

SEQ ID NO: 525379 - RNA, 64 nt, Homo Sapiens; identical to SEQ ID NO: 223161

SEQ ID NO: 525380 - RNA, 64 nt, Homo Sapiens; identical to SEQ ID NO: 223162

SEQ ID NO: 525381 - RNA, 64 nt, Homo Sapiens; identical to SEQ ID NO: 223163

SEQ ID NO: 525382 - RNA, 64 nt, Homo Sapiens; identical to SEQ ID NO: 223164

SEQ ID NO: 525383 - RNA, 64 nt, Homo Sapiens; identical to SEQ ID NO: 223165

SEQ ID NO: 525384 - RNA, 64 nt, Homo Sapiens; identical to SEQ ID NO: 223166

SEQ ID NO: 525385 - RNA, 64 nt, Homo Sapiens; identical to SEQ ID NO: 223167

SEQ ID NO: 525386 - RNA, 64 nt, Homo Sapiens; identical to SEQ ID NO: 223168

SEQ ID NO: 525387 - RNA, 64 nt, Homo Sapiens; identical to SEQ ID NO: 223169

SEQ ID NO: 525388 - RNA, 64 nt, Homo Sapiens; identical to SEQ ID NO: 223170

SEQ ID NO: 525389 - RNA, 64 nt, Homo Sapiens; identical to SEQ ID NO: 223171

SEQ ID NO: 525390 - RNA, 64 nt, Homo Sapiens; identical to SEQ ID NO: 223172

SEQ ID NO: 525391 - RNA, 64 nt, Homo Sapiens; identical to SEQ ID NO: 223173

SEQ ID NO: 525392 - RNA, 64 nt, Homo Sapiens; identical to SEQ ID NO: 223174

SEQ ID NO: 525393 - RNA, 64 nt, Homo Sapiens; identical to SEQ ID NO: 223175

SEQ ID NO: 525394 - RNA, 64 nt, Homo Sapiens; identical to SEQ ID NO: 223176

SEQ ID NO: 525395 - RNA, 64 nt, Homo Sapiens; identical to SEQ ID NO: 223177

SEQ ID NO: 525396 - RNA, 64 nt, Homo Sapiens; identical to SEQ ID NO: 223178

SEQ ID NO: 525397 - RNA, 64 nt, Homo Sapiens; identical to SEQ ID NO: 223179

SEQ ID NO: 525398 - RNA, 64 nt, Homo Sapiens; identical to SEQ ID NO: 223180

SEQ ID NO: 525399 - RNA, 64 nt, Homo Sapiens; identical to SEQ ID NO: 223181

SEQ ID NO: 525400 - RNA, 64 nt, Homo Sapiens; identical to SEQ ID NO: 223182

SEQ ID NO: 525401 - RNA, 64 nt, Homo Sapiens; identical to SEQ ID NO: 223183

SEQ ID NO: 525402 - RNA, 64 nt, Homo Sapiens; identical to SEQ ID NO: 223184

SEQ ID NO: 525403 - RNA, 64 nt, Homo Sapiens; identical to SEQ ID NO: 223185

SEQ ID NO: 525404 - RNA, 64 nt, Homo Sapiens; identical to SEQ ID NO: 223186

SEQ ID NO: 525405 - RNA, 64 nt, Homo Sapiens; identical to SEQ ID NO: 223187

SEQ ID NO: 525406 - RNA, 64 nt, Homo Sapiens; identical to SEQ ID NO: 223188

SEQ ID NO: 525407 - RNA, 64 nt, Homo Sapiens; identical to SEQ ID NO: 223189

SEQ ID NO: 525408 - RNA, 64 nt, Homo Sapiens; identical to SEQ ID NO: 223190

SEQ ID NO: 525409 - RNA, 64 nt, Homo Sapiens; identical to SEQ ID NO: 223191

SEQ ID NO: 525410 - RNA, 64 nt, Homo Sapiens; identical to SEQ ID NO: 223192

SEQ ID NO: 525411 - RNA, 64 nt, Homo Sapiens; identical to SEQ ID NO: 223193

SEQ ID NO: 525412 - RNA, 64 nt, Homo Sapiens; identical to SEQ ID NO: 223194

SEQ ID NO: 525413 - RNA, 64 nt, Homo Sapiens; identical to SEQ ID NO: 223195

SEQ ID NO: 525414 - RNA, 57 nt, Homo Sapiens; identical to SEQ ID NO: 223196

SEQ ID NO: 525415 - RNA, 64 nt, Homo Sapiens; identical to SEQ ID NO: 223197

SEQ ID NO: 525416 - RNA, 54 nt, Homo Sapiens; identical to SEQ ID NO: 223198

SEQ ID NO: 525417 - RNA, 64 nt, Homo Sapiens; identical to SEQ ID NO: 389979

SEQ ID NO: 525418 - RNA, 64 nt, Homo Sapiens; identical to SEQ ID NO: 389980

SEQ ID NO: 525419 - RNA, 64 nt, Homo Sapiens; identical to SEQ ID NO: 389982

SEQ ID NO: 525420 - RNA, 64 nt, Homo Sapiens; identical to SEQ ID NO: 389983

SEQ ID NO: 525421 - RNA, 64 nt, Homo Sapiens; identical to SEQ ID NO: 390054

SEQ ID NO: 525422 - RNA, 64 nt, Homo Sapiens; identical to SEQ ID NO: 390055

SEQ ID NO: 525423 - RNA, 64 nt, Homo Sapiens; identical to SEQ ID NO: 48048

SEQ ID NO: 525424 - RNA, 64 nt, Homo Sapiens; identical to SEQ ID NO: 48049

SEQ ID NO: 525425 - RNA, 64 nt, Homo Sapiens; identical to SEQ ID NO: 48050

SEQ ID NO: 525426 - RNA, 64 nt, Homo Sapiens; identical to SEQ ID NO: 48051

SEQ ID NO: 525427 - RNA, 64 nt, Homo Sapiens; identical to SEQ ID NO: 48052

SEQ ID NO: 525428 - RNA, 64 nt, Homo Sapiens; identical to SEQ ID NO: 48053

SEQ ID NO: 525429 - RNA, 64 nt, Homo Sapiens; identical to SEQ ID NO: 48054

SEQ ID NO: 525430 - RNA, 64 nt, Homo Sapiens; identical to SEQ ID NO: 48055

SEQ ID NO: 525431 - RNA, 64 nt, Homo Sapiens; identical to SEQ ID NO: 48056

SEQ ID NO: 525432 - RNA, 64 nt, Homo Sapiens; identical to SEQ ID NO: 48057

SEQ ID NO: 525433 - RNA, 64 nt, Homo Sapiens; identical to SEQ ID NO: 48058

SEQ ID NO: 525434 - RNA, 64 nt, Homo Sapiens; identical to SEQ ID NO: 48059

SEQ ID NO: 525435 - RNA, 64 nt, Homo Sapiens; identical to SEQ ID NO: 48060

SEQ ID NO: 525436 - RNA, 64 nt, Homo Sapiens; identical to SEQ ID NO: 48061

SEQ ID NO: 525437 - RNA, 64 nt, Homo Sapiens; identical to SEQ ID NO: 48062

SEQ ID NO: 525438 - RNA, 64 nt, Homo Sapiens; identical to SEQ ID NO: 48063

SEQ ID NO: 525439 - RNA, 64 nt, Homo Sapiens; identical to SEQ ID NO: 48064

SEQ ID NO: 525440 - RNA, 64 nt, Homo Sapiens; identical to SEQ ID NO: 48065

SEQ ID NO: 525441 - RNA, 64 nt, Homo Sapiens; identical to SEQ ID NO: 48066

SEQ ID NO: 525442 - RNA, 64 nt, Homo Sapiens; identical to SEQ ID NO: 48067

SEQ ID NO: 525443 - RNA, 64 nt, Homo Sapiens; identical to SEQ ID NO: 48068

SEQ ID NO: 525444 - RNA, 64 nt, Homo Sapiens; identical to SEQ ID NO: 48069

SEQ ID NO: 525445 - RNA, 64 nt, Homo Sapiens; identical to SEQ ID NO: 48070

SEQ ID NO: 525446 - RNA, 64 nt, Homo Sapiens; identical to SEQ ID NO: 48071

SEQ ID NO: 525447 - RNA, 64 nt, Homo Sapiens; identical to SEQ ID NO: 48072

SEQ ID NO: 525448 - RNA, 64 nt, Homo Sapiens; identical to SEQ ID NO: 48073

SEQ ID NO: 525449 - RNA, 64 nt, Homo Sapiens; identical to SEQ ID NO: 48074

SEQ ID NO: 525450 - RNA, 64 nt, Homo Sapiens; identical to SEQ ID NO: 48075

SEQ ID NO: 525451 - RNA, 64 nt, Homo Sapiens; identical to SEQ ID NO: 48076

SEQ ID NO: 525452 - RNA, 64 nt, Homo Sapiens; identical to SEQ ID NO: 48077

SEQ ID NO: 525453 - RNA, 64 nt, Homo Sapiens; identical to SEQ ID NO: 48078

SEQ ID NO: 525454 - RNA, 64 nt, Homo Sapiens; identical to SEQ ID NO: 48079

SEQ ID NO: 525455 - RNA, 64 nt, Homo Sapiens; identical to SEQ ID NO: 48080

SEQ ID NO: 525456 - RNA, 64 nt, Homo Sapiens; identical to SEQ ID NO: 48081

SEQ ID NO: 525457 - RNA, 64 nt, Homo Sapiens; identical to SEQ ID NO: 48082

SEQ ID NO: 525458 - RNA, 64 nt, Homo Sapiens; identical to SEQ ID NO: 48083

SEQ ID NO: 525459 - RNA, 64 nt, Homo Sapiens; identical to SEQ ID NO: 48084

SEQ ID NO: 525460 - RNA, 64 nt, Homo Sapiens; identical to SEQ ID NO: 48085

SEQ ID NO: 525461 - RNA, 64 nt, Homo Sapiens; identical to SEQ ID NO: 48086

SEQ ID NO: 525462 - RNA, 64 nt, Homo Sapiens; identical to SEQ ID NO: 48087

SEQ ID NO: 525463 - RNA, 64 nt, Homo Sapiens; identical to SEQ ID NO: 48088

SEQ ID NO: 525464 - RNA, 64 nt, Homo Sapiens; identical to SEQ ID NO: 48089

SEQ ID NO: 525465 - RNA, 64 nt, Homo Sapiens; identical to SEQ ID NO: 48090

SEQ ID NO: 525466 - RNA, 64 nt, Homo Sapiens; identical to SEQ ID NO: 48091

SEQ ID NO: 525467 - RNA, 64 nt, Homo Sapiens; identical to SEQ ID NO: 48092

SEQ ID NO: 525468 - RNA, 64 nt, Homo Sapiens; identical to SEQ ID NO: 48093

SEQ ID NO: 525469 - RNA, 64 nt, Homo Sapiens; identical to SEQ ID NO: 48094

SEQ ID NO: 525470 - RNA, 64 nt, Homo Sapiens; identical to SEQ ID NO: 48095

SEQ ID NO: 525471 - RNA, 64 nt, Homo Sapiens; identical to SEQ ID NO: 48096

SEQ ID NO: 525472 - RNA, 64 nt, Homo Sapiens; identical to SEQ ID NO: 48097

SEQ ID NO: 525473 - RNA, 64 nt, Homo Sapiens; identical to SEQ ID NO: 48098

SEQ ID NO: 525474 - RNA, 64 nt, Homo Sapiens; identical to SEQ ID NO: 48099

SEQ ID NO: 525475 - RNA, 64 nt, Homo Sapiens; identical to SEQ ID NO: 48100

SEQ ID NO: 525476 - RNA, 64 nt, Homo Sapiens; identical to SEQ ID NO: 48101

SEQ ID NO: 525477 - RNA, 64 nt, Homo Sapiens; identical to SEQ ID NO: 48102

SEQ ID NO: 525478 - RNA, 64 nt, Homo Sapiens; identical to SEQ ID NO: 48103

SEQ ID NO: 525479 - RNA, 64 nt, Homo Sapiens; identical to SEQ ID NO: 48104

SEQ ID NO: 525480 - RNA, 64 nt, Homo Sapiens; identical to SEQ ID NO: 48105

SEQ ID NO: 525481 - RNA, 64 nt, Homo Sapiens; identical to SEQ ID NO: 48106

SEQ ID NO: 525482 - RNA, 64 nt, Homo Sapiens; identical to SEQ ID NO: 48107

SEQ ID NO: 525483 - RNA, 64 nt, Homo Sapiens; identical to SEQ ID NO: 48108

SEQ ID NO: 525484 - RNA, 64 nt, Homo Sapiens; identical to SEQ ID NO: 48109

SEQ ID NO: 525485 - RNA, 64 nt, Homo Sapiens; identical to SEQ ID NO: 48110

SEQ ID NO: 525486 - RNA, 64 nt, Homo Sapiens; identical to SEQ ID NO: 48111

SEQ ID NO: 525487 - RNA, 64 nt, Homo Sapiens; identical to SEQ ID NO: 48112

SEQ ID NO: 525488 - RNA, 64 nt, Homo Sapiens; identical to SEQ ID NO: 48113

SEQ ID NO: 525489 - RNA, 64 nt, Homo Sapiens; identical to SEQ ID NO: 48114

SEQ ID NO: 525490 - RNA, 64 nt, Homo Sapiens; identical to SEQ ID NO: 48115

SEQ ID NO: 525491 - RNA, 64 nt, Homo Sapiens; identical to SEQ ID NO: 48116

SEQ ID NO: 525492 - RNA, 64 nt, Homo Sapiens; identical to SEQ ID NO: 48117

SEQ ID NO: 525493 - RNA, 64 nt, Homo Sapiens; identical to SEQ ID NO: 48118

SEQ ID NO: 525494 - RNA, 64 nt, Homo Sapiens; identical to SEQ ID NO: 48119

SEQ ID NO: 525495 - RNA, 64 nt, Homo Sapiens; identical to SEQ ID NO: 48120

SEQ ID NO: 525496 - RNA, 64 nt, Homo Sapiens; identical to SEQ ID NO: 48121

SEQ ID NO: 525497 - RNA, 64 nt, Homo Sapiens; identical to SEQ ID NO: 48122

SEQ ID NO: 525498 - RNA, 64 nt, Homo Sapiens; identical to SEQ ID NO: 48123

SEQ ID NO: 525499 - RNA, 64 nt, Homo Sapiens; identical to SEQ ID NO: 48124

SEQ ID NO: 525500 - RNA, 64 nt, Homo Sapiens; identical to SEQ ID NO: 48125

SEQ ID NO: 525501 - RNA, 64 nt, Homo Sapiens; identical to SEQ ID NO: 48126

SEQ ID NO: 525502 - RNA, 64 nt, Homo Sapiens; identical to SEQ ID NO: 48127

SEQ ID NO: 525503 - RNA, 64 nt, Homo Sapiens; identical to SEQ ID NO: 48128

SEQ ID NO: 525504 - RNA, 64 nt, Homo Sapiens; identical to SEQ ID NO: 48129

SEQ ID NO: 525505 - RNA, 64 nt, Homo Sapiens; identical to SEQ ID NO: 48130

SEQ ID NO: 525506 - RNA, 64 nt, Homo Sapiens; identical to SEQ ID NO: 48131

SEQ ID NO: 525507 - RNA, 59 nt, Homo Sapiens; identical to SEQ ID NO: 48132

SEQ ID NO: 525508 - RNA, 64 nt, Homo Sapiens; identical to SEQ ID NO: 48133

SEQ ID NO: 525509 - RNA, 64 nt, Homo Sapiens; identical to SEQ ID NO: 48134

SEQ ID NO: 525510 - RNA, 64 nt, Homo Sapiens; identical to SEQ ID NO: 48135

SEQ ID NO: 525511 - RNA, 64 nt, Homo Sapiens; identical to SEQ ID NO: 48136

SEQ ID NO: 525512 - RNA, 64 nt, Homo Sapiens; identical to SEQ ID NO: 48137

SEQ ID NO: 525513 - RNA, 64 nt, Homo Sapiens; identical to SEQ ID NO: 48138

SEQ ID NO: 525514 - RNA, 64 nt, Homo Sapiens; identical to SEQ ID NO: 48139

SEQ ID NO: 525515 - RNA, 64 nt, Homo Sapiens; identical to SEQ ID NO: 48140

SEQ ID NO: 525516 - RNA, 64 nt, Homo Sapiens; identical to SEQ ID NO: 48141

SEQ ID NO: 525517 - RNA, 64 nt, Homo Sapiens; identical to SEQ ID NO: 48142

SEQ ID NO: 525518 - RNA, 64 nt, Homo Sapiens; identical to SEQ ID NO: 48143

SEQ ID NO: 525519 - RNA, 64 nt, Homo Sapiens; identical to SEQ ID NO: 48144

SEQ ID NO: 525520 - RNA, 64 nt, Homo Sapiens; identical to SEQ ID NO: 48145

SEQ ID NO: 525521 - RNA, 64 nt, Homo Sapiens; identical to SEQ ID NO: 48146

SEQ ID NO: 525522 - RNA, 64 nt, Homo Sapiens; identical to SEQ ID NO: 48147

SEQ ID NO: 525523 - RNA, 64 nt, Homo Sapiens; identical to SEQ ID NO: 48148

SEQ ID NO: 525524 - RNA, 64 nt, Homo Sapiens; identical to SEQ ID NO: 48149

SEQ ID NO: 525525 - RNA, 64 nt, Homo Sapiens; identical to SEQ ID NO: 48150

SEQ ID NO: 525526 - RNA, 64 nt, Homo Sapiens; identical to SEQ ID NO: 48151

SEQ ID NO: 525527 - RNA, 64 nt, Homo Sapiens; identical to SEQ ID NO: 48152

SEQ ID NO: 525528 - RNA, 64 nt, Homo Sapiens; identical to SEQ ID NO: 48153

SEQ ID NO: 525529 - RNA, 64 nt, Homo Sapiens; identical to SEQ ID NO: 48154

SEQ ID NO: 525530 - RNA, 64 nt, Homo Sapiens; identical to SEQ ID NO: 48155

SEQ ID NO: 525531 - RNA, 64 nt, Homo Sapiens; identical to SEQ ID NO: 48156

SEQ ID NO: 525532 - RNA, 64 nt, Homo Sapiens; identical to SEQ ID NO: 48157

SEQ ID NO: 525533 - RNA, 64 nt, Homo Sapiens; identical to SEQ ID NO: 48158

SEQ ID NO: 525534 - RNA, 64 nt, Homo Sapiens; identical to SEQ ID NO: 48159

SEQ ID NO: 525535 - RNA, 64 nt, Homo Sapiens; identical to SEQ ID NO: 48160

SEQ ID NO: 525536 - RNA, 64 nt, Homo Sapiens; identical to SEQ ID NO: 48161

SEQ ID NO: 525537 - RNA, 64 nt, Homo Sapiens; identical to SEQ ID NO: 48162

SEQ ID NO: 525538 - RNA, 64 nt, Homo Sapiens; identical to SEQ ID NO: 48163

SEQ ID NO: 525539 - RNA, 64 nt, Homo Sapiens; identical to SEQ ID NO: 48164

SEQ ID NO: 525540 - RNA, 64 nt, Homo Sapiens; identical to SEQ ID NO: 48165

SEQ ID NO: 525541 - RNA, 64 nt, Homo Sapiens; identical to SEQ ID NO: 48166

SEQ ID NO: 525542 - RNA, 64 nt, Homo Sapiens; identical to SEQ ID NO: 48167

SEQ ID NO: 525543 - RNA, 64 nt, Homo Sapiens; identical to SEQ ID NO: 48168

SEQ ID NO: 525544 - RNA, 64 nt, Homo Sapiens; identical to SEQ ID NO: 48169

SEQ ID NO: 525545 - RNA, 64 nt, Homo Sapiens; identical to SEQ ID NO: 48170

SEQ ID NO: 525546 - RNA, 64 nt, Homo Sapiens; identical to SEQ ID NO: 48171

SEQ ID NO: 525547 - RNA, 64 nt, Homo Sapiens; identical to SEQ ID NO: 48172

SEQ ID NO: 525548 - RNA, 64 nt, Homo Sapiens; identical to SEQ ID NO: 48173

SEQ ID NO: 525549 - RNA, 64 nt, Homo Sapiens; identical to SEQ ID NO: 48174

SEQ ID NO: 525550 - RNA, 64 nt, Homo Sapiens; identical to SEQ ID NO: 48175

SEQ ID NO: 525551 - RNA, 64 nt, Homo Sapiens; identical to SEQ ID NO: 48176

SEQ ID NO: 525552 - RNA, 64 nt, Homo Sapiens; identical to SEQ ID NO: 48177

SEQ ID NO: 525553 - RNA, 64 nt, Homo Sapiens; identical to SEQ ID NO: 48178

SEQ ID NO: 525554 - RNA, 64 nt, Homo Sapiens; identical to SEQ ID NO: 48179

SEQ ID NO: 525555 - RNA, 64 nt, Homo Sapiens; identical to SEQ ID NO: 48180

SEQ ID NO: 525556 - RNA, 64 nt, Homo Sapiens; identical to SEQ ID NO: 48181

SEQ ID NO: 525557 - RNA, 64 nt, Homo Sapiens; identical to SEQ ID NO: 48182

SEQ ID NO: 525558 - RNA, 64 nt, Homo Sapiens; identical to SEQ ID NO: 48183

SEQ ID NO: 525559 - RNA, 64 nt, Homo Sapiens; identical to SEQ ID NO: 48184

SEQ ID NO: 525560 - RNA, 64 nt, Homo Sapiens; identical to SEQ ID NO: 48185

SEQ ID NO: 525561 - RNA, 64 nt, Homo Sapiens; identical to SEQ ID NO: 48186

SEQ ID NO: 525562 - RNA, 64 nt, Homo Sapiens; identical to SEQ ID NO: 48187

SEQ ID NO: 525563 - RNA, 64 nt, Homo Sapiens; identical to SEQ ID NO: 48188

SEQ ID NO: 525564 - RNA, 64 nt, Homo Sapiens; identical to SEQ ID NO: 48189

SEQ ID NO: 525565 - RNA, 64 nt, Homo Sapiens; identical to SEQ ID NO: 48190

SEQ ID NO: 525566 - RNA, 64 nt, Homo Sapiens; identical to SEQ ID NO: 48191

SEQ ID NO: 525567 - RNA, 64 nt, Homo Sapiens; identical to SEQ ID NO: 48192

SEQ ID NO: 525568 - RNA, 64 nt, Homo Sapiens; identical to SEQ ID NO: 48193

SEQ ID NO: 525569 - RNA, 64 nt, Homo Sapiens; identical to SEQ ID NO: 48194

SEQ ID NO: 525570 - RNA, 64 nt, Homo Sapiens; identical to SEQ ID NO: 48195

SEQ ID NO: 525571 - RNA, 64 nt, Homo Sapiens; identical to SEQ ID NO: 48196

SEQ ID NO: 525572 - RNA, 64 nt, Homo Sapiens; identical to SEQ ID NO: 48197

SEQ ID NO: 525573 - RNA, 64 nt, Homo Sapiens; identical to SEQ ID NO: 48198

SEQ ID NO: 525574 - RNA, 64 nt, Homo Sapiens; identical to SEQ ID NO: 48199

SEQ ID NO: 525575 - RNA, 64 nt, Homo Sapiens; identical to SEQ ID NO: 48200

SEQ ID NO: 525576 - RNA, 64 nt, Homo Sapiens; identical to SEQ ID NO: 48201

SEQ ID NO: 525577 - RNA, 64 nt, Homo Sapiens; identical to SEQ ID NO: 48202

SEQ ID NO: 525578 - RNA, 64 nt, Homo Sapiens; identical to SEQ ID NO: 48203

SEQ ID NO: 525579 - RNA, 64 nt, Homo Sapiens; identical to SEQ ID NO: 48204

SEQ ID NO: 525580 - RNA, 64 nt, Homo Sapiens; identical to SEQ ID NO: 48205

SEQ ID NO: 525581 - RNA, 64 nt, Homo Sapiens; identical to SEQ ID NO: 48206

SEQ ID NO: 525582 - RNA, 64 nt, Homo Sapiens; identical to SEQ ID NO: 48207

SEQ ID NO: 525583 - RNA, 64 nt, Homo Sapiens; identical to SEQ ID NO: 48208

SEQ ID NO: 525584 - RNA, 64 nt, Homo Sapiens; identical to SEQ ID NO: 48209

SEQ ID NO: 525585 - RNA, 64 nt, Homo Sapiens; identical to SEQ ID NO: 48210

SEQ ID NO: 525586 - RNA, 64 nt, Homo Sapiens; identical to SEQ ID NO: 48211

SEQ ID NO: 525587 - RNA, 64 nt, Homo Sapiens; identical to SEQ ID NO: 48212

SEQ ID NO: 525588 - RNA, 64 nt, Homo Sapiens; identical to SEQ ID NO: 48213

SEQ ID NO: 525589 - RNA, 64 nt, Homo Sapiens; identical to SEQ ID NO: 48214

SEQ ID NO: 525590 - RNA, 64 nt, Homo Sapiens; identical to SEQ ID NO: 48215

SEQ ID NO: 525591 - RNA, 64 nt, Homo Sapiens; identical to SEQ ID NO: 48216

SEQ ID NO: 525592 - RNA, 64 nt, Homo Sapiens; identical to SEQ ID NO: 48217

SEQ ID NO: 525593 - RNA, 64 nt, Homo Sapiens; identical to SEQ ID NO: 48218

SEQ ID NO: 525594 - RNA, 64 nt, Homo Sapiens; identical to SEQ ID NO: 48219

SEQ ID NO: 525595 - RNA, 64 nt, Homo Sapiens; identical to SEQ ID NO: 48220

SEQ ID NO: 525596 - RNA, 64 nt, Homo Sapiens; identical to SEQ ID NO: 48221

SEQ ID NO: 525597 - RNA, 64 nt, Homo Sapiens; identical to SEQ ID NO: 48222

SEQ ID NO: 525598 - RNA, 64 nt, Homo Sapiens; identical to SEQ ID NO: 48223

SEQ ID NO: 525599 - RNA, 64 nt, Homo Sapiens; identical to SEQ ID NO: 48224

SEQ ID NO: 525600 - RNA, 64 nt, Homo Sapiens; identical to SEQ ID NO: 48225

SEQ ID NO: 525601 - RNA, 64 nt, Homo Sapiens; identical to SEQ ID NO: 48226

SEQ ID NO: 525602 - RNA, 64 nt, Homo Sapiens; identical to SEQ ID NO: 48227

SEQ ID NO: 525603 - RNA, 64 nt, Homo Sapiens; identical to SEQ ID NO: 48228

SEQ ID NO: 525604 - RNA, 64 nt, Homo Sapiens; identical to SEQ ID NO: 48229

SEQ ID NO: 525605 - RNA, 64 nt, Homo Sapiens; identical to SEQ ID NO: 48230

SEQ ID NO: 525606 - RNA, 64 nt, Homo Sapiens; identical to SEQ ID NO: 48231

SEQ ID NO: 525607 - RNA, 64 nt, Homo Sapiens; identical to SEQ ID NO: 48232

SEQ ID NO: 525608 - RNA, 64 nt, Homo Sapiens; identical to SEQ ID NO: 48233

SEQ ID NO: 525609 - RNA, 64 nt, Homo Sapiens; identical to SEQ ID NO: 48234

SEQ ID NO: 525610 - RNA, 64 nt, Homo Sapiens; identical to SEQ ID NO: 48235

SEQ ID NO: 525611 - RNA, 64 nt, Homo Sapiens; identical to SEQ ID NO: 48236

SEQ ID NO: 525612 - RNA, 64 nt, Homo Sapiens; identical to SEQ ID NO: 48237

SEQ ID NO: 525613 - RNA, 64 nt, Homo Sapiens; identical to SEQ ID NO: 48238

SEQ ID NO: 525614 - RNA, 64 nt, Homo Sapiens; identical to SEQ ID NO: 48239

SEQ ID NO: 525615 - RNA, 64 nt, Homo Sapiens; identical to SEQ ID NO: 48240

SEQ ID NO: 525616 - RNA, 64 nt, Homo Sapiens; identical to SEQ ID NO: 48241

SEQ ID NO: 525617 - RNA, 64 nt, Homo Sapiens; identical to SEQ ID NO: 48242

SEQ ID NO: 525618 - RNA, 64 nt, Homo Sapiens; identical to SEQ ID NO: 48243

SEQ ID NO: 525619 - RNA, 64 nt, Homo Sapiens; identical to SEQ ID NO: 48244

SEQ ID NO: 525620 - RNA, 64 nt, Homo Sapiens; identical to SEQ ID NO: 48245

SEQ ID NO: 525621 - RNA, 64 nt, Homo Sapiens; identical to SEQ ID NO: 48246

SEQ ID NO: 525622 - RNA, 64 nt, Homo Sapiens; identical to SEQ ID NO: 48247

SEQ ID NO: 525623 - RNA, 64 nt, Homo Sapiens; identical to SEQ ID NO: 48248

SEQ ID NO: 525624 - RNA, 64 nt, Homo Sapiens; identical to SEQ ID NO: 48249

SEQ ID NO: 525625 - RNA, 64 nt, Homo Sapiens; identical to SEQ ID NO: 48250

SEQ ID NO: 525626 - RNA, 64 nt, Homo Sapiens; identical to SEQ ID NO: 48251

SEQ ID NO: 525627 - RNA, 64 nt, Homo Sapiens; identical to SEQ ID NO: 48252

SEQ ID NO: 525628 - RNA, 64 nt, Homo Sapiens; identical to SEQ ID NO: 48253

SEQ ID NO: 525629 - RNA, 64 nt, Homo Sapiens; identical to SEQ ID NO: 48254

SEQ ID NO: 525630 - RNA, 64 nt, Homo Sapiens; identical to SEQ ID NO: 48255

SEQ ID NO: 525631 - RNA, 64 nt, Homo Sapiens; identical to SEQ ID NO: 48256

SEQ ID NO: 525632 - RNA, 64 nt, Homo Sapiens; identical to SEQ ID NO: 48257

SEQ ID NO: 525633 - RNA, 64 nt, Homo Sapiens; identical to SEQ ID NO: 48258

SEQ ID NO: 525634 - RNA, 64 nt, Homo Sapiens; identical to SEQ ID NO: 48259

SEQ ID NO: 525635 - RNA, 64 nt, Homo Sapiens; identical to SEQ ID NO: 48260

SEQ ID NO: 525636 - RNA, 64 nt, Homo Sapiens; identical to SEQ ID NO: 48261

SEQ ID NO: 525637 - RNA, 64 nt, Homo Sapiens; identical to SEQ ID NO: 48262

SEQ ID NO: 525638 - RNA, 64 nt, Homo Sapiens; identical to SEQ ID NO: 48263

SEQ ID NO: 525639 - RNA, 64 nt, Homo Sapiens; identical to SEQ ID NO: 48264

SEQ ID NO: 525640 - RNA, 64 nt, Homo Sapiens; identical to SEQ ID NO: 48265

SEQ ID NO: 525641 - RNA, 64 nt, Homo Sapiens; identical to SEQ ID NO: 48266

SEQ ID NO: 525642 - RNA, 64 nt, Homo Sapiens; identical to SEQ ID NO: 48267

SEQ ID NO: 525643 - RNA, 64 nt, Homo Sapiens; identical to SEQ ID NO: 48268

SEQ ID NO: 525644 - RNA, 64 nt, Homo Sapiens; identical to SEQ ID NO: 48269

SEQ ID NO: 525645 - RNA, 64 nt, Homo Sapiens; identical to SEQ ID NO: 48270

SEQ ID NO: 525646 - RNA, 64 nt, Homo Sapiens; identical to SEQ ID NO: 48271

SEQ ID NO: 525647 - RNA, 64 nt, Homo Sapiens; identical to SEQ ID NO: 48272

SEQ ID NO: 525648 - RNA, 64 nt, Homo Sapiens; identical to SEQ ID NO: 48273

SEQ ID NO: 525649 - RNA, 64 nt, Homo Sapiens; identical to SEQ ID NO: 48274

SEQ ID NO: 525650 - RNA, 64 nt, Homo Sapiens; identical to SEQ ID NO: 48275

SEQ ID NO: 525651 - RNA, 64 nt, Homo Sapiens; identical to SEQ ID NO: 48276

SEQ ID NO: 525652 - RNA, 64 nt, Homo Sapiens; identical to SEQ ID NO: 48277

SEQ ID NO: 525653 - RNA, 64 nt, Homo Sapiens; identical to SEQ ID NO: 48278

SEQ ID NO: 525654 - RNA, 64 nt, Homo Sapiens; identical to SEQ ID NO: 48279

SEQ ID NO: 525655 - RNA, 64 nt, Homo Sapiens; identical to SEQ ID NO: 48280

SEQ ID NO: 525656 - RNA, 64 nt, Homo Sapiens; identical to SEQ ID NO: 48281

SEQ ID NO: 525657 - RNA, 64 nt, Homo Sapiens; identical to SEQ ID NO: 48282

SEQ ID NO: 525658 - RNA, 64 nt, Homo Sapiens; identical to SEQ ID NO: 48283

SEQ ID NO: 525659 - RNA, 64 nt, Homo Sapiens; identical to SEQ ID NO: 48284

SEQ ID NO: 525660 - RNA, 64 nt, Homo Sapiens; identical to SEQ ID NO: 48285

SEQ ID NO: 525661 - RNA, 64 nt, Homo Sapiens; identical to SEQ ID NO: 48286

SEQ ID NO: 525662 - RNA, 64 nt, Homo Sapiens; identical to SEQ ID NO: 48287

SEQ ID NO: 525663 - RNA, 64 nt, Homo Sapiens; identical to SEQ ID NO: 48288

SEQ ID NO: 525664 - RNA, 64 nt, Homo Sapiens; identical to SEQ ID NO: 48289

SEQ ID NO: 525665 - RNA, 64 nt, Homo Sapiens; identical to SEQ ID NO: 48290

SEQ ID NO: 525666 - RNA, 64 nt, Homo Sapiens; identical to SEQ ID NO: 48291

SEQ ID NO: 525667 - RNA, 64 nt, Homo Sapiens; identical to SEQ ID NO: 48292

SEQ ID NO: 525668 - RNA, 64 nt, Homo Sapiens; identical to SEQ ID NO: 48293

SEQ ID NO: 525669 - RNA, 64 nt, Homo Sapiens; identical to SEQ ID NO: 48294

SEQ ID NO: 525670 - RNA, 64 nt, Homo Sapiens; identical to SEQ ID NO: 48295

SEQ ID NO: 525671 - RNA, 64 nt, Homo Sapiens; identical to SEQ ID NO: 48296

SEQ ID NO: 525672 - RNA, 64 nt, Homo Sapiens; identical to SEQ ID NO: 48297

SEQ ID NO: 525673 - RNA, 64 nt, Homo Sapiens; identical to SEQ ID NO: 48298

SEQ ID NO: 525674 - RNA, 64 nt, Homo Sapiens; identical to SEQ ID NO: 48299

SEQ ID NO: 525675 - RNA, 64 nt, Homo Sapiens; identical to SEQ ID NO: 48300

SEQ ID NO: 525676 - RNA, 64 nt, Homo Sapiens; identical to SEQ ID NO: 48301

SEQ ID NO: 525677 - RNA, 64 nt, Homo Sapiens; identical to SEQ ID NO: 48302

SEQ ID NO: 525678 - RNA, 64 nt, Homo Sapiens
uggaccaaaggcugaggcuuggccaucuagcauuccauacaaaauuguuuccuauaagcauucc

SEQ ID NO: 525679 - RNA, 64 nt, Homo Sapiens
gaguguauuuuccuuguguauauauuaaacacacccauacaaacauugguaaaguugauuacau

SEQ ID NO: 525680 - RNA, 64 nt, Homo Sapiens
uccaucccaggacacagcccagccccuccccacaccauacaagguaucagaaaagucuaggacc

SEQ ID NO: 525681 - RNA, 64 nt, Homo Sapiens
cuuguccuuucagaaaacaugcaaauaccaagauccauacaaaacaauaauuuauuccacugau

SEQ ID NO: 525682 - RNA, 64 nt, Homo Sapiens
cauuuuaaguuaggagucaugaauacuguauugaccauacaaguggauuaugguugucuggaug

SEQ ID NO: 525683 - RNA, 64 nt, Homo Sapiens
ugaggaugguguccuggagucuuguccacccucuccauacaagucucaaaagucauccuccuac

SEQ ID NO: 525684 - RNA, 64 nt, Homo Sapiens
uuuaaaagauuuagauguuuuuucagcaagcuagccauacaaccauuguaucucuuucucuuca

SEQ ID NO: 525685 - RNA, 64 nt, Homo Sapiens
uuggcuacgcccucaaucccagggcuggguuuggccauacaaggcccuugucagcaggggcgua

SEQ ID NO: 525686 - RNA, 64 nt, Homo Sapiens
aacucagcacacaagugacccuaagaaaaugauuccauacaaauuacuccgaaaauuucaucau

SEQ ID NO: 525687 - RNA, 63 nt, Homo Sapiens
uucauaaauucccugaauucauggaauuuuuuacccauacaaacuacauuaguaaaaauaaaa

SEQ ID NO: 525688 - RNA, 64 nt, Homo Sapiens
gaguugggcaaaagcuuggguaggacaagaacuuccauacaaauuugagauagaucucgccugu

SEQ ID NO: 525689 - RNA, 64 nt, Homo Sapiens
uuuaaaaaauauuaaaacgauucuuagcucagagccauacaaaaguaggcuggauucaguccau

SEQ ID NO: 525690 - RNA, 64 nt, Homo Sapiens
acacacauauauauuacaagggauaauuuagaccccauacaaguuuauaaagagucauuguuau

SEQ ID NO: 525691 - RNA, 64 nt, Homo Sapiens
uucuuuuguacauuuugauacuuccacucaacucccauacaacugugcugcucuuaaauccuac

SEQ ID NO: 525692 - RNA, 64 nt, Homo Sapiens
gugcuauccuagggauuuuaguuaaugguucagcccauacaaagccuguauuaauuuuaguuca

SEQ ID NO: 525693 - RNA, 64 nt, Homo Sapiens
cacagugcccacucuggaccuaagucuaguguauccauacaauuggugcagagaaauaaggugu

SEQ ID NO: 525694 - RNA, 64 nt, Homo Sapiens
aaagugauacauguuuuuaauuaaagaguaaagcccauacaaguauucauuuuuucuacccuuu

SEQ ID NO: 525695 - RNA, 64 nt, Homo Sapiens
uuugaggccaaugcugcuuucugguguauauucuccauacaagauuauuauuaacugcucuuuu

SEQ ID NO: 525696 - RNA, 64 nt, Homo Sapiens
gcuauuuuucaaaaauuaauccauuuauacuguuccauacaaaaucaguaucugaacuauaagc

SEQ ID NO: 525697 - RNA, 64 nt, Homo Sapiens
guuucuauuuuauuguuccuccucacugcauuuuccauacaaauucaccugcuucccuaccacu

SEQ ID NO: 525698 - RNA, 64 nt, Homo Sapiens
cccuuaagccucucaaauauaacacuaaaauguaccauacaaauacacuagauguuaucaauca

SEQ ID NO: 525699 - RNA, 64 nt, Homo Sapiens
gacuauauuauucagccauacaaaucugguauauccauacaauggaacuaaugaauagauaaac

SEQ ID NO: 525700 - RNA, 64 nt, Homo Sapiens
gaugaauuguguacaacuuugguuucauuucuagccauacaauugugugucuugguuuaguuau

SEQ ID NO: 525701 - RNA, 64 nt, Homo Sapiens
uaucuuuuuucuuccuauuugaaagcuuucaugaccauacaaauuuuuaaaauagcuuugcagu

SEQ ID NO: 525702 - RNA, 64 nt, Homo Sapiens
ccacagaugaauuaagacaugaaguguguucuguccauacaauggaauauuauuuggccauaaa

SEQ ID NO: 525703 - RNA, 64 nt, Homo Sapiens
caccugaacaccagaauuagaauuaaacauuguaccauacaauuucauuaucuuaucagaauga

SEQ ID NO: 525704 - RNA, 64 nt, Homo Sapiens
cuuaguuaaaucuuuuccaggaaaaagaacuuccccauacaaauaagcaugagacuauguaaaa

SEQ ID NO: 525705 - RNA, 64 nt, Homo Sapiens
uauuaaauuacacaauuacacuugucuuuacuggccauacaaaaugauuuuuuuuuuuuuuuug

SEQ ID NO: 525706 - RNA, 64 nt, Homo Sapiens
acaaaugaaggacaagcauacuacauaauauaauccauacaauucucuucaguuaguguaaacu

SEQ ID NO: 525707 - RNA, 64 nt, Homo Sapiens
auuccuuuucccgaaggaaacaaccuuuucccaaccauacaaaauuuauagaucagccagugac

SEQ ID NO: 525708 - RNA, 64 nt, Homo Sapiens
uguauuuacuuuaauuucacagaaauugagcuauccauacaaccgaauuuacauuuuauauuaa

SEQ ID NO: 525709 - RNA, 64 nt, Homo Sapiens
guuuuuuugccuccuguucuaauaaauuuugucuccauacaaaucugaaccccaaguguguacc

SEQ ID NO: 525710 - RNA, 64 nt, Homo Sapiens
ccacggcagugaaucuucauggaucuucaugcagccauacaaacccugguuccaacagaauggu

SEQ ID NO: 525711 - RNA, 64 nt, Homo Sapiens
uaauauuccuucuagucaguggaaauuuguauucccauacaaacucagaaugcuauauuuuuaa

SEQ ID NO: 525712 - RNA, 64 nt, Homo Sapiens
caugaugagcacaggaacaggcaugaagauauugccauacaauuuuaauuuauacaaguauugg

SEQ ID NO: 525713 - RNA, 64 nt, Homo Sapiens
aguaaacucuguccacgauucuuaggacuaccagccauacaaauucuaauuggacacccugaag

SEQ ID NO: 525714 - RNA, 64 nt, Homo Sapiens
caaccaaacuuaccccugagacucaucacaaagcccauacaacuccaaaaguagaaaucccugc

SEQ ID NO: 525715 - RNA, 64 nt, Homo Sapiens
uacuaaacauaagguaauucauacuggagaaaagccauacaaaugagaagaauguggcaaugcc

SEQ ID NO: 525716 - RNA, 64 nt, Homo Sapiens
ccgcgccccucuuuuuccccuugauggaaauugaccauacaauuucauccuccuucaggggauc

SEQ ID NO: 525717 - RNA, 64 nt, Homo Sapiens
acuuuuuaccaagucuguguucuguuuaaucuguccauacaaguuauuacugagaaaguguuua

SEQ ID NO: 525718 - RNA, 64 nt, Homo Sapiens
cacauuccaaaggagacauuggaccaguuaauucccauacaagucaagguaacagaacaaaagg

SEQ ID NO: 525719 - RNA, 64 nt, Homo Sapiens
ggagaagcagaugcuucccuaaugcuaucaacaaccauacaaguccuucagcugcaagggauug

SEQ ID NO: 525720 - RNA, 64 nt, Homo Sapiens
guuuucuacuuucguugugaauaaaggagaugggccauacaaauuuguuuucuagagcaagaua

SEQ ID NO: 525721 - RNA, 64 nt, Homo Sapiens
cuacuguaacuacccaucaauuuuuuucccuguaccauacaauuauccucccccuaugcauugg

SEQ ID NO: 525722 - RNA, 64 nt, Homo Sapiens
ggugaagauaacgagacuuuuggcuacaaacuuuccauacaacacaaucggggaugcagacaag

SEQ ID NO: 525723 - RNA, 64 nt, Homo Sapiens
auccagucauuguaacacugguucuuuuuuucccccauacaaguguugugaauuauggaucagg

SEQ ID NO: 525724 - RNA, 64 nt, Homo Sapiens
cuaucgguucaaguugauguucuacugcuuggauccauacaaaaguuuaccaaucaacagcaug

SEQ ID NO: 525725 - RNA, 64 nt, Homo Sapiens
acuuaacauuuaaaacugauauauuuauauauugccauacaaaauucagguaauauguuuaaag

SEQ ID NO: 525726 - RNA, 64 nt, Homo Sapiens
gugcugugguuuugucccuuggcuccucguguggccauacaaggcccucccagugcuggcucca

SEQ ID NO: 525727 - RNA, 64 nt, Homo Sapiens
uaguagaauauaagauaaaagaggcugagaauuaccauacaaggguauuacaacuguaaaacaa

SEQ ID NO: 525728 - RNA, 64 nt, Homo Sapiens
cagguguuugccaugugguaccuacauagaaucuccauacaacacacagguaacagguuauaca

SEQ ID NO: 525729 - RNA, 64 nt, Homo Sapiens
caucuguguuuaguacacaugcaugcauacacacccauacaaacaucugugugagggcaguucu

SEQ ID NO: 525730 - RNA, 64 nt, Homo Sapiens
guugauucauuuuaaugcugcugaaccuuacugcccauacaaguaugaauuggcuucuaggggu

SEQ ID NO: 525731 - RNA, 64 nt, Homo Sapiens
aaucuauuauucccaucuuaauguuagguacuuuccauacaacgagucugccacaugccaaaca

SEQ ID NO: 525732 - RNA, 64 nt, Homo Sapiens
ucugcuugggucacauugccaauguccucucagcccauacaaguggcaggaccaggcccaauau

SEQ ID NO: 525733 - RNA, 64 nt, Homo Sapiens
cugugggaucuauuacugcaggccgguguauauaccauacaaaagaggaccacacaucuguugg

SEQ ID NO: 525734 - RNA, 64 nt, Homo Sapiens
caaaucagcuuccacuuagcauuaggaggucaugccauacaacucacguaugcgggcaaacacu

SEQ ID NO: 525735 - RNA, 64 nt, Homo Sapiens
ugaucaagugugagacaguuugaagacugugcuaccauacaaagugaaugaagccagugacuaa

SEQ ID NO: 525736 - RNA, 64 nt, Homo Sapiens
ugggccugguggagucuucgccccaccuuccacuccauacaauccucugcugcuccucccccac

SEQ ID NO: 525737 - RNA, 64 nt, Homo Sapiens
agccauaaggcuuuggaguuaaaccacaguaucaccauacaaguauuuguuuaucauuauuuug

SEQ ID NO: 525738 - RNA, 64 nt, Homo Sapiens
ucuguuuuccauuuccauugcaauacuacuaaagccauacaauaucaagcacccucccucuagg

SEQ ID NO: 525739 - RNA, 64 nt, Homo Sapiens
ucuuccuacuagaacauuuuauuuuccuuguucaccauacaaucauguacucuuuaacagaaau

SEQ ID NO: 525740 - RNA, 64 nt, Homo Sapiens
agcaucagaaaaucagggcaugagggcaugcuucccauacaaagaauacuuuaccuuagaucuu

SEQ ID NO: 525741 - RNA, 64 nt, Homo Sapiens
ucaaaguccccugggccccacuccuuuucccuccccauacaaacgaggggaggagaacugcuca

SEQ ID NO: 525742 - RNA, 64 nt, Homo Sapiens
uuuuuccaccacacauaccccaggaaaaaaagaaccauacaaaaaacugaagaaaaaaaaaaaa

SEQ ID NO: 525743 - RNA, 64 nt, Homo Sapiens
cuacauauuugugguuaagguuagacuauaugauccauacaaauuaaagugagagacaugguua

SEQ ID NO: 525744 - RNA, 64 nt, Homo Sapiens
gauguuuguucaccauggggaccauuacauaugaccauacaaugcacugaauugacagguuaau

SEQ ID NO: 525745 - RNA, 64 nt, Homo Sapiens
uaacauaggucuaauuuauuugccgugucauuuuccauacaaaucaguugauuuaaaaaaguuc

SEQ ID NO: 525746 - RNA, 64 nt, Homo Sapiens
agaauuuggauguuuuccagcuuuuagccaaauuccauacaaaaugugguuugagcacuggguu

SEQ ID NO: 525747 - RNA, 64 nt, Homo Sapiens
uauccaacucuggauucugugcauugaaacuaacccauacaaaaccgacaaagaagacaaaaua

SEQ ID NO: 525748 - RNA, 64 nt, Homo Sapiens
caaccaugugcuauuuaucauaguacaagauacuccauacaacauguacauacacucaggaagg

SEQ ID NO: 525749 - RNA, 64 nt, Homo Sapiens
uagguucugcuuaauguaacccgguucccauuugccauacaaugcagcacgcuuuacuuaguag

SEQ ID NO: 525750 - RNA, 64 nt, Homo Sapiens
ccacugucacucagaagggcaagcuaggcagggcccauacaacagcaggggucugcagguuaga

SEQ ID NO: 525751 - RNA, 64 nt, Homo Sapiens
gauuuaugcugacuuaacuguuuaccuauaaaccccauacaaagcagggucauaauuugugauc

SEQ ID NO: 525752 - RNA, 64 nt, Homo Sapiens
aguuuauggaugucugggcaaugaauuucuuacuccauacaagcaaacaaaucuuucuucauuu

SEQ ID NO: 525753 - RNA, 64 nt, Homo Sapiens
aggaggugaaaucagagauacugucuguacaguuccauacaacauuauuugcucagguaucaug

SEQ ID NO: 525754 - RNA, 64 nt, Homo Sapiens
ggagaugauggccauuccguuucaacuccagacaccauacaaaguguuuucuuauugcacugaa

SEQ ID NO: 525755 - RNA, 64 nt, Homo Sapiens
acaaagugucaaggggagacuaaguugccagaagccauacaaguugagaaacagaguuauuaag

SEQ ID NO: 525756 - RNA, 64 nt, Homo Sapiens
cacacaugguacaaugauagcucgguuauuuucuccauacaauggaagcagugauacucccugg

SEQ ID NO: 525757 - RNA, 64 nt, Homo Sapiens
auugugucauugaggacaauacagguaagguacaccauacaaaacucccauaggaaauagaauu

SEQ ID NO: 525758 - RNA, 64 nt, Homo Sapiens
uccacaacaaagcgcaguggucuccaccccucccccauacaaaaaccuguugaaaaaaacuggu

SEQ ID NO: 525759 - RNA, 64 nt, Homo Sapiens
cuccuauaccgcacauaaauagauuucagagcccccauacaaugggcagugucugcuauagggc

SEQ ID NO: 525760 - RNA, 64 nt, Homo Sapiens
aaaaccacuaaguuagaucucuaccucacaguguccauacaaauuaguuccagagggaagauau

SEQ ID NO: 525761 - RNA, 64 nt, Homo Sapiens
gcacaacauaaagugaacauagaaaugugugcauccauacaaaucacuggaguuaauuagucuu

SEQ ID NO: 525762 - RNA, 64 nt, Homo Sapiens
uagugucaaaaacauaaauguuggcuaaauaauaccauacaaucauuuagcauuauaauacauc

SEQ ID NO: 525763 - RNA, 64 nt, Homo Sapiens
uuguuuacaacauuuuugcaaaucuaaaguugcuccauacaaugacuagucaccuggggggguu

SEQ ID NO: 525764 - RNA, 64 nt, Homo Sapiens
uaaacaugaauauugaauacugacaagagaauacccauacaaaucgucccaccgcccuagaggc

SEQ ID NO: 525765 - RNA, 64 nt, Homo Sapiens
uuacacaauagcagagaauauaaacugaaaaaauccauacaaauauuaaaaauguggcaaauua

SEQ ID NO: 525766 - RNA, 64 nt, Homo Sapiens
aaagagugaccugcacaaacuuggaauuuuuuuuccauacaacccugacccauuuacuguauuu

SEQ ID NO: 525767 - RNA, 64 nt, Homo Sapiens
gucuuauggagguguuagcauuaucuuacucaauccauacaaaauacaagugguuuaacaugca

SEQ ID NO: 525768 - RNA, 64 nt, Homo Sapiens
uauguacaauacaauguacacagccagcuuaaacccauacaaugaacuugaaauauauaauauu

SEQ ID NO: 525769 - RNA, 64 nt, Homo Sapiens
uacaaaaugcuuuguagaccccauugucuuuaaaccauacaacaugcccgugaagcugaucugg

SEQ ID NO: 525770 - RNA, 64 nt, Homo Sapiens
uguuggcaacguagggaugggagaagaaacuaaaccauacaaagucuacgauggagcauuuuuu

SEQ ID NO: 525771 - RNA, 64 nt, Homo Sapiens
aucagaagagcucucuuguuaaaacuccuuaccaccauacaagccuaaaacuuggauauuugug

SEQ ID NO: 525772 - RNA, 64 nt, Homo Sapiens
uugaugagcagguacacacuauuucauuuccuccccauacaaauauucuagacugcuuucacuu

SEQ ID NO: 525773 - RNA, 64 nt, Homo Sapiens
ucaaccaauggcauccagagagggcauggaggcuccauacaaccucuuccacccccacaucuuu

SEQ ID NO: 525774 - RNA, 64 nt, Homo Sapiens
uaccagaugaaaggauaaacaaaauaugguccauccauacaauggaguauuacacagccauaaa

SEQ ID NO: 525775 - RNA, 64 nt, Homo Sapiens
acuccuaguaaacauaauuaaugauggagagaaaccauacaacugugaagaauguggcaaagcu

SEQ ID NO: 525776 - RNA, 64 nt, Homo Sapiens
uccauacaugggugaacucugugugccugggaguccauacaaugaacacacacccauuaucugu

SEQ ID NO: 525777 - RNA, 64 nt, Homo Sapiens
gaguauuacacagccauaaaaaaaugugguccauccauacaauguaccagaugaaaggauaaac

SEQ ID NO: 525778 - RNA, 64 nt, Homo Sapiens
aauaagccaacucugacauuuuccuggcaauguaccauacaaaaagcuuauucugagacagaca

SEQ ID NO: 525779 - RNA, 64 nt, Homo Sapiens
guaacgugcaugcuuaagcucuuuuuugaugaaaccauacaaaugucucacuaggcaucaaaaa

SEQ ID NO: 525780 - RNA, 64 nt, Homo Sapiens
auaauaaauguggcaagguuauaucagagagaaaccauacaaguugugagucaucaaagaauuu

SEQ ID NO: 525781 - RNA, 64 nt, Homo Sapiens
aauaaaaaucaagaagaacacuuuucucccuuuuccauacaaauuaaaacuuaacagcaucaaa

SEQ ID NO: 525782 - RNA, 64 nt, Homo Sapiens
auaagccacaaccagcuucaaguuaauuucagagccauacaaaaacugaggcauagggagagga

SEQ ID NO: 525783 - RNA, 64 nt, Homo Sapiens
ugauuccuggaugaucauacacagaggacuuacaccauacaaaaauauugggcaccgcagugcc

SEQ ID NO: 525784 - RNA, 64 nt, Homo Sapiens
uagaguuacaagccccuggaaaagggagcaggucccauacaaucagccuuucuccucuucucuu

SEQ ID NO: 525785 - RNA, 64 nt, Homo Sapiens
cccacguuguuuauuucaaaaggcucugggcucaccauacaacauucuaaagcaagugaccuga

SEQ ID NO: 525786 - RNA, 64 nt, Homo Sapiens
uauuggagcauacaguacugcggugugucuccucccauacaaagggacacauccuuauuuugag

SEQ ID NO: 525787 - RNA, 64 nt, Homo Sapiens
uggccaacaggaccaaccaagcaccuuaccucucccauacaagaugacccucugagcuuuucau

SEQ ID NO: 525788 - RNA, 64 nt, Homo Sapiens
ucugugccugcauaaugcugacaccugcuuguuuccauacaaauugauaucaaaauaaaauuug

SEQ ID NO: 525789 - RNA, 64 nt, Homo Sapiens
guaugguaccuuaaagcuuuuucauacuuauuuaccauacaaaauuaagaggcuuagauuggua

SEQ ID NO: 525790 - RNA, 64 nt, Homo Sapiens
uuucacaagcaauggaaaagggacauacgcagcaccauacaauaacucccauuugagacuuucc

SEQ ID NO: 525791 - RNA, 64 nt, Homo Sapiens
agucauuuugauuuucaaagcuucuuuuuucagaccauacaagaagguaagugaaugccaaagu

SEQ ID NO: 525792 - RNA, 64 nt, Homo Sapiens; identical to SEQ ID NO: 286377

SEQ ID NO: 525793 - RNA, 64 nt, Homo Sapiens; identical to SEQ ID NO: 286378

SEQ ID NO: 525794 - RNA, 64 nt, Homo Sapiens; identical to SEQ ID NO: 286379

SEQ ID NO: 525795 - RNA, 64 nt, Homo Sapiens; identical to SEQ ID NO: 286380

SEQ ID NO: 525796 - RNA, 64 nt, Homo Sapiens; identical to SEQ ID NO: 286381

SEQ ID NO: 525797 - RNA, 64 nt, Homo Sapiens; identical to SEQ ID NO: 286382

SEQ ID NO: 525798 - RNA, 64 nt, Homo Sapiens; identical to SEQ ID NO: 286383

SEQ ID NO: 525799 - RNA, 64 nt, Homo Sapiens; identical to SEQ ID NO: 286384

SEQ ID NO: 525800 - RNA, 64 nt, Homo Sapiens
ugaaccuguaaaaacaaaacaaacaaaacaaaacaaaaaagacaaaaccuaaaacugagcuauc

SEQ ID NO: 525801 - RNA, 64 nt, Homo Sapiens
gcaauuuuugaagaucuuaaauguuccuuuuuaaaaaaaagaauuguguuauagguuacaaaau

SEQ ID NO: 525802 - RNA, 64 nt, Homo Sapiens
auagauaagaaaagguggggcuauacuagcaacaaaaaaagaaugcuguuccugcaccugccgg

SEQ ID NO: 525803 - RNA, 64 nt, Homo Sapiens
uauauuaaaacagagauaugugcaugaaaucaagaaaaaagaaaugaacaaaagcaaagcauua

SEQ ID NO: 525804 - RNA, 64 nt, Homo Sapiens
cauuuugcuaaagcaugacuaaacugcaaaaaaaaaaaaagagcuacuguauuuagacuuagga

SEQ ID NO: 525805 - RNA, 64 nt, Homo Sapiens
aagagauuaauaucuccaugcauaguuuuagacaaaaaaagauguuucaauaaaauuacugucu

SEQ ID NO: 525806 - RNA, 64 nt, Homo Sapiens
aucuccauuuuuuuuuuaaugauuuuuuaauuaaaaaaaagaacaacaggauagagcuguuggg

SEQ ID NO: 525807 - RNA, 64 nt, Homo Sapiens
gagcccagagaagcccccuacauccccccgggaaaaaaaagaaaacuagacagaaacucaucua

SEQ ID NO: 525808 - RNA, 64 nt, Homo Sapiens
ccaggccaccauauuuagaacuaguuaccuuauuaaaaaagaaaaaacagucuguuggcuucuc

SEQ ID NO: 525809 - RNA, 64 nt, Homo Sapiens
acugagcgagacucuaucucaaaacaaucaaaacaaaaaagaccuguggacucuaguagauuuu

SEQ ID NO: 525810 - RNA, 64 nt, Homo Sapiens
aaaugcacucauguuaggaaggucaaaaaaaaggaaaaaagaaaaauaauaaaaaauaauaaaa

SEQ ID NO: 525811 - RNA, 64 nt, Homo Sapiens
auuuaauaugugcccagauuauucuaaaaucuuaaaaaaagaugcauauagugaaauuuuuuaa

SEQ ID NO: 525812 - RNA, 64 nt, Homo Sapiens
gacaguucagugcauauauaguagaagccuuaagaaaaaagaaaaugagcaagcaaauauuuga

SEQ ID NO: 525813 - RNA, 64 nt, Homo Sapiens
ugugugugugucucugcauguguaaaagaaggguaaaaaagagauggguaggguagaacuacuu

SEQ ID NO: 525814 - RNA, 64 nt, Homo Sapiens
uaauucuuaauauuaccucucuuggaaagacacaaaaaaagagcuguuauuuuuaggcauaaga

SEQ ID NO: 525815 - RNA, 64 nt, Homo Sapiens
gaaccugggcuaaugggagacuguagagaaaaugaaaaaagauccaccagaggacaucuugggg

SEQ ID NO: 525816 - RNA, 64 nt, Homo Sapiens
uguccuaauguugcuacucccauggcaaagaaaaaaaaaagaaugaaaaaaagaaaaaaauuug

SEQ ID NO: 525817 - RNA, 64 nt, Homo Sapiens
gcuacucccauggcaaagaaaaaaaaaagaaugaaaaaaagaaaaaaauuuggaaaaaaaaauc

SEQ ID NO: 525818 - RNA, 64 nt, Homo Sapiens
aaauuguauguuacuuauuuccagaaucucgaagaaaaaagaaaaaagagugguauuauuaugg

SEQ ID NO: 525819 - RNA, 64 nt, Homo Sapiens
auguuacuuauuuccagaaucucgaagaaaaaagaaaaaagagugguauuauuaugggcaaaua

SEQ ID NO: 525820 - RNA, 64 nt, Homo Sapiens
cuccagcuugggcgacagagugagacuccgucucaaaaaagaaaaaaaaaagaugcuccucuga

SEQ ID NO: 525821 - RNA, 64 nt, Homo Sapiens
gcgacagagugagacuccgucucaaaaaagaaaaaaaaaagaugcuccucugaggucccuccgg

SEQ ID NO: 525822 - RNA, 64 nt, Homo Sapiens
uccagccuggguaacagagcaagacuccaucucaaaaaaagaaagaaagaaaaaagaaaguaca

SEQ ID NO: 525823 - RNA, 64 nt, Homo Sapiens
agagcaagacuccaucucaaaaaaagaaagaaagaaaaaagaaaguacaaguuuauaaaguauu

SEQ ID NO: 525824 - RNA, 64 nt, Homo Sapiens
aaguaaucccagaacaauggcuauucaugugggaaaaaaagaaauuuuacuuucucucaccuua

SEQ ID NO: 525825 - RNA, 64 nt, Homo Sapiens
aagcauacguauacaauaaaacuaugcuauuaaaaaaaaagaagguaacugauaaaccaaaauu

SEQ ID NO: 525826 - RNA, 64 nt, Homo Sapiens
gucuuaagaguuuaucuuuuacauaauuuggggcaaaaaagaaagauauauuuuccuuucugac

SEQ ID NO: 525827 - RNA, 64 nt, Homo Sapiens
uaauguauuaaaauuuacauucccguucaaguucaaaaaagaaacuggaucaucccauucuggu

SEQ ID NO: 525828 - RNA, 64 nt, Homo Sapiens
aaagcaagagaucuggcagucuccaaauauaaggaaaaaagacuuaugucaaacucuucuguuu

SEQ ID NO: 525829 - RNA, 64 nt, Homo Sapiens
aaagagcuuucagaaacuuuuuucgcucccagaaaaaaaagaucuauauaagaagaacaaccua

SEQ ID NO: 525830 - RNA, 64 nt, Homo Sapiens
ucagaacuacuuuccucugucuaaaaaaaaaagaaaaaaagaauuagcaaauuaaguuauuuuc

SEQ ID NO: 525831 - RNA, 64 nt, Homo Sapiens
aaaagaauucagaacuacuuuuauuuuccuaaaaaaaaaagaaagaugaauuuagcaaauuaag

SEQ ID NO: 525832 - RNA, 64 nt, Homo Sapiens
ggguaagaaaacuacccaugaauuauugaggaaaaaaaaagaugaacaaugguuucucugcguu

SEQ ID NO: 525833 - RNA, 64 nt, Homo Sapiens
ccgaagccaguauuuuaauagaaauuugaaaggaaaaaaagaaaaauauguaaagcaauuguag

SEQ ID NO: 525834 - RNA, 64 nt, Homo Sapiens
gucuuuugccccauuucuuugcggcucagucaugaaaaaagaagaacacauuagagguacagga

SEQ ID NO: 525835 - RNA, 64 nt, Homo Sapiens
uacauagaguucagucccuacucaaaaaaaagaaaaaaaagaaaguaacacagcaagacucuau

SEQ ID NO: 525836 - RNA, 64 nt, Homo Sapiens
aaaaagaaauacauagaguuagacucuaucucaaaaaaaagaaaccacccuggguaacacagca

SEQ ID NO: 525837 - RNA, 64 nt, Homo Sapiens
uacugaccagugucucuacuuccuaguuccccccaaaaaagaaaucucacuucuacuccugcuc

SEQ ID NO: 525838 - RNA, 64 nt, Homo Sapiens
auucaacacauauuuuuauaaagacccugucuuaaaaaaagagguccagccugggugacagagc

SEQ ID NO: 525839 - RNA, 64 nt, Homo Sapiens
cuauccaggagugguggugugucuccacaaaaauaaaaaagaaaggacaacauagugagaccuu

SEQ ID NO: 525840 - RNA, 64 nt, Homo Sapiens
aaaagaaaaauagaagacauauguaucacccccaaaaaaagagaugaguguaugaauuugucac

SEQ ID NO: 525841 - RNA, 64 nt, Homo Sapiens
aauauuuccuacgucuguucaaacucugccuuuaaaaaaagauauauuaguauaaacucauaau

SEQ ID NO: 525842 - RNA, 64 nt, Homo Sapiens
uuggagacuaccaggguaagcuuuaaaaaaaaaaaaaaaagauucauuacacauaguaaacuuu

SEQ ID NO: 525843 - RNA, 64 nt, Homo Sapiens
agauaagugcuuguucuagcgggcuuaguaauaaaaaaaagaaaugcaugccacgcacuguguu

SEQ ID NO: 525844 - RNA, 64 nt, Homo Sapiens
cuacuuaagauagaacauggaaaagagggaggaaaaaaaagaacaaaaaaagaaaaaaaaagaa

SEQ ID NO: 525845 - RNA, 64 nt, Homo Sapiens
gaggaaaaaaaagaaccuacuuaaaaaaaaaaagaaaaaagagguggucuggggagagauuuua

SEQ ID NO: 525846 - RNA, 64 nt, Homo Sapiens
aaagagggaggaaaaaaaaggauuuuauuaaaaaaaaaaagaaagugaugauggucuggggaga

SEQ ID NO: 525847 - RNA, 64 nt, Homo Sapiens
agucauuuuuaaacuaccuacucaaaaaaaaaagaaaaaagaaugugacagagaaggacuccgu

SEQ ID NO: 525848 - RNA, 64 nt, Homo Sapiens
aaagaauagucauuuuuaaaacuccgucucaaaaaaaaaagaaaagccugggugacagagaagg

SEQ ID NO: 525849 - RNA, 64 nt, Homo Sapiens
auggcuaauaaacuguauuaauauacauugugugaaaaaagaaaaguauuuuuuuuuaauuuug

SEQ ID NO: 525850 - RNA, 64 nt, Homo Sapiens
gaacauguuuacagguuugauaaagauucucuuuaaaaaagacucaauccugguaaccaaauau

SEQ ID NO: 525851 - RNA, 64 nt, Homo Sapiens
gaagcaacuucaguucuuuuacugcaaagaacagaaaaaagaaagaaagcaaacaagaagacuc

SEQ ID NO: 525852 - RNA, 64 nt, Homo Sapiens
aggugaaaaaacaaugcauucuugcuuuaaaaaaaaaaaagaaggcuaaaaaauuaccucuuuu

SEQ ID NO: 525853 - RNA, 64 nt, Homo Sapiens
uuuuucugugggaaucacaagaguuuauccacuaaaaaaagauauguaaaaaagauacuuucca

SEQ ID NO: 525854 - RNA, 64 nt, Homo Sapiens
aucacaagaguuuauccacuaaaaaaagauauguaaaaaagauacuuuccagcacauaaauaaa

SEQ ID NO: 525855 - RNA, 64 nt, Homo Sapiens
uacagaagcaucacauuuaaaccaaugugaauucaaaaaagagaaggaaacuuuuuaaauucaa

SEQ ID NO: 525856 - RNA, 64 nt, Homo Sapiens
aaggaaacuuuuuaaauucaauuuagaguacauaaaaaaagaaauccgcgaagcauugagggga

SEQ ID NO: 525857 - RNA, 64 nt, Homo Sapiens
gaauuauguaaaguuguuaagagacauacccucuaaaaaagaacuuuagcaugguauugaagga

SEQ ID NO: 525858 - RNA, 64 nt, Homo Sapiens
ucgauaaaucuaacaguuacucuuaaaaaaaaaaaaaaaagacuaagguggauuuuaaaaauug

SEQ ID NO: 525859 - RNA, 64 nt, Homo Sapiens
ugauuguucauuuuuuucugcuacuuuuggguagaaaaaagauucaauugcuuggcuguagcuu

SEQ ID NO: 525860 - RNA, 64 nt, Homo Sapiens
uuacauguguuucugggaacaaggaaaauuucucaaaaaagaauauuucacacaucccuucuuu

SEQ ID NO: 525861 - RNA, 64 nt, Homo Sapiens
ugucaggugugcaugaagaaaagacacugaagcuaaaaaagacagcagaacugcuauuuuucau

SEQ ID NO: 525862 - RNA, 64 nt, Homo Sapiens
ggcacuguacuaaccuacagagaugcuaagagaaaaaaaagacuuguuucugaucuaauauccc

SEQ ID NO: 525863 - RNA, 64 nt, Homo Sapiens
uguuuucuuuuuucuagaaaacacuuuccuggauaaaaaagaaaacauuccagaugcaugaucc

SEQ ID NO: 525864 - RNA, 64 nt, Homo Sapiens
guuugacauuuaauaacuuugcuggaaaaucuguaaaaaagaaaaacaaguuugcuagugacua

SEQ ID NO: 525865 - RNA, 64 nt, Homo Sapiens
aaaaaaaaaaaggagcugugaaucaguuuuuuaaaaaaaagaaaagcagccacugcaagcucug

SEQ ID NO: 525866 - RNA, 64 nt, Homo Sapiens
aaaaaguuugaauagcuauugaaucuuguuuuucaaaaaagaauggcuaaaacguuuuuauaga

SEQ ID NO: 525867 - RNA, 64 nt, Homo Sapiens
cuaccuaugauccuggauuuacaaaacauaacacaaaaaagaagggcacaacacaaaaaccaac

SEQ ID NO: 525868 - RNA, 64 nt, Homo Sapiens
aacaaaaaacaaaaaacaggugcucuuguuucucaaaaaagaaaaaauaaaaacaaguaucuca

SEQ ID NO: 525869 - RNA, 64 nt, Homo Sapiens
gaaacaaaaaagugugacauugcuucaaaaaaaaaaaaaagagauauagugcaaauuauuugua

SEQ ID NO: 525870 - RNA, 64 nt, Homo Sapiens
ggcugccacaguauauuuuuuugguaguggaaaaaaaaaagacaaagguaucaauguaccuuuu

SEQ ID NO: 525871 - RNA, 64 nt, Homo Sapiens
agaaagaauuuuaagaguagaugugacauucuuaaaaaaagaaguucuuaagacuugcauuuaa

SEQ ID NO: 525872 - RNA, 64 nt, Homo Sapiens
cuacuucgugcagcaauugcguaaaaaaaaaaaaaaaaaagacuagccuucuuaaaugacaaau

SEQ ID NO: 525873 - RNA, 64 nt, Homo Sapiens
acuuuauaaaauggcacuuucuuucuggcuaauuaaaaaagacaugccauggauaaaauugggu

SEQ ID NO: 525874 - RNA, 64 nt, Homo Sapiens
gaaauagcauugaagaaaauucaaaaaaaaaaaaaaaaaagaaacaauagagcgagacuccguc

SEQ ID NO: 525875 - RNA, 64 nt, Homo Sapiens
cuuuuuugggugcaagucuaaacagcagguuaaaaaaaaagaugagacuucagcagcaaaccaa

SEQ ID NO: 525876 - RNA, 64 nt, Homo Sapiens
agagggaaaguauuucucuugagagaugggggagaaaaaagacauuuucuuuuuuauaaaaaaa

SEQ ID NO: 525877 - RNA, 64 nt, Homo Sapiens
gaugggggagaaaaaagacauuuucuuuuuuauaaaaaaagagacaccuucucucugacugcac

SEQ ID NO: 525878 - RNA, 64 nt, Homo Sapiens
agaaaacuucaauuuucuggaagaaaaagaaaaaaaaaaagaaacaaauguuaugaugcaaaaa

SEQ ID NO: 525879 - RNA, 64 nt, Homo Sapiens
aagaaaaaaaaaaagaaaagaauguuaugaugcaaaaaaagaaaaaaacaaaagauuuuuauca

SEQ ID NO: 525880 - RNA, 64 nt, Homo Sapiens
aaguuucagaagagcagaagaagaaaaaagauagaaaaaagaaaaucgacuggagaagaaaaaa

SEQ ID NO: 525881 - RNA, 64 nt, Homo Sapiens
gaaaaaagaaaaaguuucagagaagaaaaaaaagaaaaaagauacaggaaauuagaucgacugg

SEQ ID NO: 525882 - RNA, 64 nt, Homo Sapiens
aaagauagaaaaaagaaaaacgacuggagaagaaaaaaaagaaaccaauuacaggaaauuagau

SEQ ID NO: 525883 - RNA, 64 nt, Homo Sapiens
acccaggugugguagugcauagaaaaagaaaaagaaaaaagaauuguacuaaaaaaaaaaaaaa

SEQ ID NO: 525884 - RNA, 64 nt, Homo Sapiens
aagaaaaagaaaaaagaauaguacuaaaaaaaaaaaaaaagaaaaacguggugaaacccggucu

SEQ ID NO: 525885 - RNA, 64 nt, Homo Sapiens
aggauaucccuuccuacaguuuaucuacuauuugaaaaaagaagauaaguuccaaaaauaccau

SEQ ID NO: 525886 - RNA, 64 nt, Homo Sapiens
aguguugaaauuggaaaggacuuccuguaguggcaaaaaagaacguuauaacaccaucuggagu

SEQ ID NO: 525887 - RNA, 64 nt, Homo Sapiens
uugcucugcccuuuuauauuauauucaccuuaggaaaaaagacuaaugaauacuuaccuuagaa

SEQ ID NO: 525888 - RNA, 64 nt, Homo Sapiens
aacuauuggaggugguggccaaaaaauaaaaaaaaaaaaagacgaaagagaccaauaaaaauaa

SEQ ID NO: 525889 - RNA, 64 nt, Homo Sapiens
uagcuuuugacugcuuucccaaaggcccugcugcaaaaaagaaguaugucaguuauaauaaccu

SEQ ID NO: 525890 - RNA, 64 nt, Homo Sapiens
guaccacugcacaucauguuuuuuuuuuuaagacaaaaaagauguuuaaagaccaaaaacugug

SEQ ID NO: 525891 - RNA, 64 nt, Homo Sapiens
ugcaaaaucucuacugcuuuggauccugggucaaaaaaaagaaaaaaaaaagaaaugcaaaacu

SEQ ID NO: 525892 - RNA, 64 nt, Homo Sapiens
uacugcuuuggauccugggucaaaaaaaagaaaaaaaaaagaaaugcaaaacuuuaggcccugc

SEQ ID NO: 525893 - RNA, 64 nt, Homo Sapiens
agauacaugucuuucuccagggacauguggaaaaaaaaaagauguuauacaaccaucaaagugg

SEQ ID NO: 525894 - RNA, 64 nt, Homo Sapiens
ggguaucccaaaaauaaaacuauccuuuuggaaaaaaaaagauuuaaaauaauuccugguuuga

SEQ ID NO: 525895 - RNA, 64 nt, Homo Sapiens
acaaacaaacaaaaacaaauuuuaagaacacaacaaaaaagauuugacuuccgaauagaauguu

SEQ ID NO: 525896 - RNA, 64 nt, Homo Sapiens
guguacuguguaagccuugcaaacaaaaaacaacaaaaaagaagcagcagcagcagccugcugu

SEQ ID NO: 525897 - RNA, 64 nt, Homo Sapiens
aaauccaagucugaacgggaaugcccucauucaaaaaaaagaacuuugaaagagaaucuuucug

SEQ ID NO: 525898 - RNA, 64 nt, Homo Sapiens
acacaccaaaaaagugaaagagaaauugaaagggaaaaaagacaaaaagcauaaggcuccaaaa

SEQ ID NO: 525899 - RNA, 64 nt, Homo Sapiens
cacucagggcuggggccaagaggaaaaacagggaaaaaaagaaaaaaaaaagaaaaaggaaaag

SEQ ID NO: 525900 - RNA, 64 nt, Homo Sapiens
ggggccaagaggaaaaacagggaaaaaaagaaaaaaaaaagaaaaaggaaaaggaagcggugug

SEQ ID NO: 525901 - RNA, 64 nt, Homo Sapiens
cacccaccuuaacucuuucuugucaggaguauauaaaaaagaaagaaaacaaaacucgcccuac

SEQ ID NO: 525902 - RNA, 64 nt, Homo Sapiens
uaugcagguagcaaagauguaauaaauuugcuuaaaaaaagaaauuaaaguuuuauuuagaauc

SEQ ID NO: 525903 - RNA, 64 nt, Homo Sapiens
ccagaaagacuauauauuguuuuuuuuuuaaaaaaaaaaagaagaaaaaagagacagagaaaau

SEQ ID NO: 525904 - RNA, 64 nt, Homo Sapiens
uauauauuguuuuuuuuuuaaaaaaaaaaagaagaaaaaagagacagagaaaauugguauuuau

SEQ ID NO: 525905 - RNA, 64 nt, Homo Sapiens
cuaggaaaagguuaaacuggauuuuuuuuuuuaaaaaaaagaaaaaaaaagaagaaaaguauac

SEQ ID NO: 525906 - RNA, 64 nt, Homo Sapiens
guuaaacuggauuuuuuuuuuuaaaaaaaagaaaaaaaaagaagaaaaguauaccagauaccaa

SEQ ID NO: 525907 - RNA, 64 nt, Homo Sapiens
aauguuuauugcuguuuugucuuucuuuuuucuaaaaaaagaaaaaaaagaaaaaaaggaaaag

SEQ ID NO: 525908 - RNA, 64 nt, Homo Sapiens
ugcuguuuugucuuucuuuuuucuaaaaaaagaaaaaaaagaaaaaaaggaaaagaagaacaaa

SEQ ID NO: 525909 - RNA, 64 nt, Homo Sapiens
auaaggugaugucggaaacacgcaaaacaaaacgaaaaaagauuucucaguauacacaacugaa

SEQ ID NO: 525910 - RNA, 64 nt, Homo Sapiens
agaguaucuguaaauaaaaggguuccaaccuuuuaaaaaagaaggaaaaaacuuuuuggugcuc

SEQ ID NO: 525911 - RNA, 64 nt, Homo Sapiens
uuguuacucuauuguauguuaaaaaaaaaaagaaaaaaaagaguggaaacuugccccuuauuua

SEQ ID NO: 525912 - RNA, 64 nt, Homo Sapiens
aaaaagaguuuguuacucuaccuuauuuaaaaaaaaaaaagaaacugaucuuuggaaacuugcc

SEQ ID NO: 525913 - RNA, 64 nt, Homo Sapiens
aagaaaaaaguguauuuuacuaaaaaaaaaaaaaaaaaaagaaacuauaagcuagucuuguuug

SEQ ID NO: 525914 - RNA, 64 nt, Homo Sapiens
gcacuccaggauuaggaggucaaaaacgaugaggaaaaaagauuagacacaaguuuggcccuau

SEQ ID NO: 525915 - RNA, 64 nt, Homo Sapiens
aagaaacaaaaaacacauuaaauuauaucuaaacaaaaaagaauaagaaaagaaacaugguuca

SEQ ID NO: 525916 - RNA, 64 nt, Homo Sapiens
agaaaagaaacaugguucaaugagacucuguuucaaaaaagaaaacuccagccuggugacagag

SEQ ID NO: 525917 - RNA, 64 nt, Homo Sapiens
gagagaugaaaagaguaggacuccaucucaaaaaaaaaaagagagccugggcaacagagugaga

SEQ ID NO: 525918 - RNA, 64 nt, Homo Sapiens
agaaaaagauaaagggauuggucucaaaaaaaaaaaaaaagaaagggugacagagccagacucu

SEQ ID NO: 525919 - RNA, 64 nt, Homo Sapiens
aauuagauuuuacauaucuuuagcaaaaaaaaaaaaaaaagaaacaugcuuagucuaaagacug

SEQ ID NO: 525920 - RNA, 64 nt, Homo Sapiens
gacaaacucuaggaacaaugugaaugacagaaaaaaaaaagagaacguccugccagaaagagaa

SEQ ID NO: 525921 - RNA, 64 nt, Homo Sapiens
aaacagaaauauauccagcuaaaaaaaaaagaaaaaaaaagaaaguucugugacaaaaaaaaaa

SEQ ID NO: 525922 - RNA, 64 nt, Homo Sapiens
aaaaaagaaaaaacagaaauaaaaaaaaaaaaaaaaaaaagaaaugcaaacaguguucugugac

SEQ ID NO: 525923 - RNA, 64 nt, Homo Sapiens
acaaagaaaaacagagagagguuuauuuaaaaaaaaaaaagauguuuggacaaaccuugaaaau

SEQ ID NO: 525924 - RNA, 64 nt, Homo Sapiens
caaaaaaaaaccccacgaaauuuaaagauggggaaaaaaagaugguauaaaaauggcucugguu

SEQ ID NO: 525925 - RNA, 64 nt, Homo Sapiens
cagaacaagugcugggucugucacagagaaguuuaaaaaagaaaacuaagauuauaaauuagca

SEQ ID NO: 525926 - RNA, 64 nt, Homo Sapiens
ucucaaaaaaaaaaaaaaaaaaaaaaaaaaaaaaaaaaaagaaaagagaaaaaaaagacuagcc

SEQ ID NO: 525927 - RNA, 64 nt, Homo Sapiens
aaaaaaaaaaaaaaaaaaaaaaaagaaaagagaaaaaaaagacuagccagccaggaagaugaau

SEQ ID NO: 525928 - RNA, 64 nt, Homo Sapiens
gggugacagaguaacacucugucucagaaaaaaaaaaaaagaaaaauauaugggguaaauacag

SEQ ID NO: 525929 - RNA, 64 nt, Homo Sapiens
guguauaccuauguuaaugaaacaacagaaguacaaaaaagaauaucagauacaaaaaucaauc

SEQ ID NO: 525930 - RNA, 64 nt, Homo Sapiens
aaaacccaaguuuuuaaucguuuuuguuuuaaggaaaaaagauuuuuaaaaugaaucuuaugca

SEQ ID NO: 525931 - RNA, 64 nt, Homo Sapiens
uuuugaccaguuucuuuucuuuuguuuuuuuuuuaaaaaagacauuuaaagacaaagacauuau

SEQ ID NO: 525932 - RNA, 64 nt, Homo Sapiens
caggaagguaaugguuugaguagccuuuguuuaaaaaaaagacuaaauauauuuaaaaggccac

SEQ ID NO: 525933 - RNA, 64 nt, Homo Sapiens
caaccugggugaugaagugagacucuccaaaaaaaaaaaagaaauuauuaaucccugccugugc

SEQ ID NO: 525934 - RNA, 64 nt, Homo Sapiens
ucuagccuagacaacauagugagacuuggucucuaaaaaagaaaaaaaaaaauaaaacugaugu

SEQ ID NO: 525935 - RNA, 64 nt, Homo Sapiens
uaaaaaguguauaugcaguaugauaccacuuuuaaaaaaagauaaauuuauagaaaaaaguuua

SEQ ID NO: 525936 - RNA, 64 nt, Homo Sapiens
caaaaacuucucgaaccgcugugucuccuacguaaaaaaagagauguacaaaucaauaauaauu

SEQ ID NO: 525937 - RNA, 64 nt, Homo Sapiens
uccagccuaggcaacagagugagacuuugucucaaaaaaagagaaauuuuccuuaauaagaaaa

SEQ ID NO: 525938 - RNA, 64 nt, Homo Sapiens
aauuaaaggaggggcuagggaaaaacauaaggaaaaaaaagacacaacaacccagaaagguuua

SEQ ID NO: 525939 - RNA, 64 nt, Homo Sapiens
aaaaaguaaaaauaaaaacaugacuuguuuagaaaaaaaagacagggggccucaaccaacuuag

SEQ ID NO: 525940 - RNA, 64 nt, Homo Sapiens
aggcuacaguucucucacacugccaauucagcauaaaaaagaauaaaauugaaaucugcauuca

SEQ ID NO: 525941 - RNA, 64 nt, Homo Sapiens
guuaauuuguuuuuucuugcaacuuuugugccagaaaaaagacuauuacuaauauuuauguagc

SEQ ID NO: 525942 - RNA, 64 nt, Homo Sapiens
cugucuuauaggguaaaaaaugaaaauauguuggaaaaaagauucuauacuggaaauguaaaau

SEQ ID NO: 525943 - RNA, 64 nt, Homo Sapiens
cacuuugauugaaguauucaauuuauccucacauaaaaaagaaguuuccccuuaauucaguaug

SEQ ID NO: 525944 - RNA, 64 nt, Homo Sapiens
guugcaaauuuguuaaaaugaaacagaaaaagaaaaaaaagaacgcagucuuaaaaaaaaaaaa

SEQ ID NO: 525945 - RNA, 64 nt, Homo Sapiens
gagagagauaauaaacuauauuuacacuaucauuaaaaaagagggggccaggaauuggauucag

SEQ ID NO: 525946 - RNA, 64 nt, Homo Sapiens
uuuugccacugaaacuugaguaguuugguuauggaaaaaagacuacugaauuccaaauuugcuc

SEQ ID NO: 525947 - RNA, 64 nt, Homo Sapiens
agaaaaagaaaaaaaucccuccccugcaaaaagaaaaaaagaaacgauauacucccugcccuuc

SEQ ID NO: 525948 - RNA, 64 nt, Homo Sapiens
uauaugcuauucaaugaucuuagaaguacugaaaaaaaaagacguuuuuaaaacguagaggauu

SEQ ID NO: 525949 - RNA, 64 nt, Homo Sapiens
ugucauuugacauuuuuuguuugcugaagugaaaaaaaaagauaaagguuguacgguggucuuu

SEQ ID NO: 525950 - RNA, 64 nt, Homo Sapiens
ugcaauaaaauauguaaugucuuuuuuauaaagcaaaaaagacaauaauugcauuuaugagcuc

SEQ ID NO: 525951 - RNA, 64 nt, Homo Sapiens
auucacuuauuguauguguguuguaaucuaaaaaaaaaaagaaugacaaacagcuucuuuaaga

SEQ ID NO: 525952 - RNA, 64 nt, Homo Sapiens
ucuuucuuuggaugggacuagagcuuucuuucacaaaaaagaaguaggggaagacaugcagccu

SEQ ID NO: 525953 - RNA, 64 nt, Homo Sapiens
gccugauaagcuucaaagcugcuuuauucaauaaaaaaaagaaaugaaaaagauauaugaauau

SEQ ID NO: 525954 - RNA, 64 nt, Homo Sapiens
cuccagcuugggcaacagagcaagacuccaucucaaaaaagaaaaaagaaaagaaauagaauua

SEQ ID NO: 525955 - RNA, 64 nt, Homo Sapiens
uugggcaacagagcaagacuccaucucaaaaaagaaaaaagaaaagaaauagaauuaucaagcu

SEQ ID NO: 525956 - RNA, 64 nt, Homo Sapiens
uauuugaagauggagcacugcugauuuaugaaggaaaaaagaagaauuuucuaaagauuacaca

SEQ ID NO: 525957 - RNA, 64 nt, Homo Sapiens
uauaaauaauaaaguaggcauuuguuuauuuuguaaaaaagaaaugaaaaucugcuggccagcu

SEQ ID NO: 525958 - RNA, 64 nt, Homo Sapiens
ccuuucuugauacuuagucaugggaggauauuacaaaaaagaaauuuaaauuguguucauaguc

SEQ ID NO: 525959 - RNA, 64 nt, Homo Sapiens
caugguacuccuaaagcauaugccucaccugguuaaaaaagaacaaacauguuuuugugaaagc

SEQ ID NO: 525960 - RNA, 58 nt, Homo Sapiens
gaagauacaaagucuuauagacauccggaaaaaagauuuuuaccugugcuggucuaug

SEQ ID NO: 525961 - RNA, 64 nt, Homo Sapiens
uaaaccaaccacagaucaaaaauagaaaaaaaaaaaaaaagaaaaaaagaauguaaaauuuuaa

SEQ ID NO: 525962 - RNA, 64 nt, Homo Sapiens
ccacagaucaaaaauagaaaaaaaaaaaaaaagaaaaaaagaauguaaaauuuuaaaaauacag

SEQ ID NO: 525963 - RNA, 64 nt, Homo Sapiens
aauuguucuuaaggcaucauaucuagaagcaaagaaaaaagaaaaauaacaauuuaaguugugu

SEQ ID NO: 525964 - RNA, 64 nt, Homo Sapiens
ccaguuacuuauauuaauaauauucagaaaaaaaaaaaaagaaaaggaaaaagaaaaauauaua

SEQ ID NO: 525965 - RNA, 64 nt, Homo Sapiens
cuucuucugagaaugugacuuuuucugguguuguaaaaaagaaaaaaaaaagaaugcucauugu

SEQ ID NO: 525966 - RNA, 64 nt, Homo Sapiens
aaugugacuuuuucugguguuguaaaaaagaaaaaaaaaagaaugcucauuguaaaaauaaaaa

SEQ ID NO: 525967 - RNA, 64 nt, Homo Sapiens
uuucucugaccuuuccauccuugaaaaaauggggaaaaaagaagaaaaaagacaaaaucgacca

SEQ ID NO: 525968 - RNA, 64 nt, Homo Sapiens
cuuuccauccuugaaaaaauggggaaaaaagaagaaaaaagacaaaaucgaccauaaaagacca

SEQ ID NO: 525969 - RNA, 64 nt, Homo Sapiens
agcaaggaaaaggcucuuuaaaagaaaaaaagggaaaaaagaaauuguaagaaaagaaaaaaga

SEQ ID NO: 525970 - RNA, 64 nt, Homo Sapiens
agaaaaaaagggaaaaaagauguuguaagaaaagaaaaaagaaacugauucacgacuuaaugua

SEQ ID NO: 525971 - RNA, 64 nt, Homo Sapiens
gacaaugacaguuuugaguuuuaaaaagaauucaaaaaaagacuuucuggguuuaguuuugucu

SEQ ID NO: 525972 - RNA, 64 nt, Homo Sapiens
ucauugauaauucuaacucauuaaaaagacaaaaaaaaaagaauuuuuuuaaaaucaagaaaau

SEQ ID NO: 525973 - RNA, 64 nt, Homo Sapiens
uaaaaccuuagagaaagccauuuacuguauguagaaaaaagacaagcauuuuuuacaacugcca

SEQ ID NO: 525974 - RNA, 64 nt, Homo Sapiens
uagaagauauuuuggagauauacauuaauaugugaaaaaagauuaauguacuaaauccuauguu

SEQ ID NO: 525975 - RNA, 64 nt, Homo Sapiens
aaaauaaaaauuccuuuuuagucucuacggcccaaaaaaagacaaaggaaucugaccauuuuac

SEQ ID NO: 525976 - RNA, 64 nt, Homo Sapiens
acuaguacuaaucauuguaguuuuuaucaucuuaaaaaaagauaauguccauuggauacuuucc

SEQ ID NO: 525977 - RNA, 64 nt, Homo Sapiens
gcauuguuuuaauugagaggaaaaaaaagaaaagaaaaaagaaaacagagcaagacuccgucuc

SEQ ID NO: 525978 - RNA, 64 nt, Homo Sapiens
agaaaaaagaaagcauuguuagacuccgucucaaaaaaaagaaaccagcccgggugacagagca

SEQ ID NO: 525979 - RNA, 64 nt, Homo Sapiens
ccgggggggguaggagaggagaaaaaaaaagugaaaaaaagaaacgaaaaggacagacgaagag

SEQ ID NO: 525980 - RNA, 64 nt, Homo Sapiens
aaaaggacagacgaagaguuuaaagagaaaagggaaaaaagaaagaaaaaguaagcagggcugg

SEQ ID NO: 525981 - RNA, 64 nt, Homo Sapiens
ggcagucaguggagggcgagugguuucggaaaaaaaaaaagaaaaaaagaaaaaaaaagaaaaa

SEQ ID NO: 525982 - RNA, 64 nt, Homo Sapiens
guggagggcgagugguuucggaaaaaaaaaaagaaaaaaagaaaaaaaaagaaaaaaaaaagau

SEQ ID NO: 525983 - RNA, 64 nt, Homo Sapiens
agugguuucggaaaaaaaaaaagaaaaaaagaaaaaaaaagaaaaaaaaaagauuuuuuucuuc

SEQ ID NO: 525984 - RNA, 64 nt, Homo Sapiens
aaaaaaaaaaagaaaaaaagaaaaaaaaagaaaaaaaaaagauuuuuuucuucucuuaaucgga

SEQ ID NO: 525985 - RNA, 64 nt, Homo Sapiens
uuuaaauguagacuuuugacacuuuuaaaaaacaaaaaaagacaagagagaugaaaacguuuga

SEQ ID NO: 525986 - RNA, 64 nt, Homo Sapiens
aaauucaaggccacaaaaacaauguuugggggaaaaaaaagaaaaaaucaugccagcuaaucau

SEQ ID NO: 525987 - RNA, 64 nt, Homo Sapiens
ggauuguguguauauuugggauaucuauugaagaaaaaaagaaaaccccuuaaagauaauguac

SEQ ID NO: 525988 - RNA, 64 nt, Homo Sapiens
uuauaccauacugguuagugaauaauuacaugaaaaaaaagagucuguacaucuucagaguuuc

SEQ ID NO: 525989 - RNA, 64 nt, Homo Sapiens
aggcaguguuucugggggagguuauggagggaagaaaaaagaaaaaucgauagugagugacuga

SEQ ID NO: 525990 - RNA, 64 nt, Homo Sapiens
aacuuuguuucucuaauagcuuuuuuuuuacauaaaaaaagacccaggaacuuaauaguguaug

SEQ ID NO: 525991 - RNA, 64 nt, Homo Sapiens
cucauuuccuucaauuuccuuugaccuauaggcuaaaaaagaaaggcucauuccagccacaggg

SEQ ID NO: 525992 - RNA, 64 nt, Homo Sapiens
uagcacaauuauggguuacuuccuuuuucuuaacaaaaaagaauguuugauuuccucuggguga

SEQ ID NO: 525993 - RNA, 64 nt, Homo Sapiens
uuuuauauauuuuuucauuagggccauaucuccaaaaaaagaaagaaaaaauacaaaaaacaaa

SEQ ID NO: 525994 - RNA, 64 nt, Homo Sapiens
aaagaaagaaaaaauacaaaaaacaaaaacaaaaaaaaaagaggguaauguacaaguuucugua

SEQ ID NO: 525995 - RNA, 64 nt, Homo Sapiens
uggauugauuuagaaaaugguuaccaguacagucaaaaaagagaaaaugaaaaaaauacaacua

SEQ ID NO: 525996 - RNA, 64 nt, Homo Sapiens
auuuguauuucaagauaauguaguuuaaaaaaaaaaaaaagaaaaaaacuugauguaaauuccu

SEQ ID NO: 525997 - RNA, 64 nt, Homo Sapiens
ugcuacaaaguauagagaagaauuaaauucagcaaaaaaagauuaauuuaaaaaguuuauuaua

SEQ ID NO: 525998 - RNA, 64 nt, Homo Sapiens
gagagauguaauuuaaaaagccuugauuuuaaaaaaaaaagagaaagauuuugacauaaaagag

SEQ ID NO: 525999 - RNA, 64 nt, Homo Sapiens
uugacauaaaagagccuugacuaaaauauagcuaaaaaaagauugggggauguuaaauguuaau

SEQ ID NO: 526000 - RNA, 64 nt, Homo Sapiens
ucccuaauguuuuuauaaauaauagcaaaauacaaaaaaagagcucuucaucauuccccaguga

SEQ ID NO: 526001 - RNA, 64 nt, Homo Sapiens
cucucuucaucauuccccagaauuuauaaguauaaaaaaagacuuaaaugacaucaaagucuga

SEQ ID NO: 526002 - RNA, 64 nt, Homo Sapiens
guacugucugucuuaaauuuaaaaaaaaaaaaagaaaaaagaaaccagaccuugucucaaaaaa

SEQ ID NO: 526003 - RNA, 64 nt, Homo Sapiens
aaagaaaguacugucugucucaaaaaaaaaaaaaaaaaaagaaagacagagccagaccuugucu

SEQ ID NO: 526004 - RNA, 64 nt, Homo Sapiens
ucucucacuauaguauaagaaucuauuuuggagaaaaaaagaaaauaugagggucucgaagcau

SEQ ID NO: 526005 - RNA, 64 nt, Homo Sapiens
ugaagaaucaaaacaaaagcaaaaaaaaaaagcaaaaaaagaaaagagaaaaaaagaaaaaaug

SEQ ID NO: 526006 - RNA, 64 nt, Homo Sapiens
aaagcaaaaaaaaaaagcaaaaaaagaaaagagaaaaaaagaaaaaaugcaaauggaauaauuu

SEQ ID NO: 526007 - RNA, 64 nt, Homo Sapiens
cacuccagccugggugauagagcaagacugucucaaaaaagaaaaaaaagaaaaaauuuuaauu

SEQ ID NO: 526008 - RNA, 64 nt, Homo Sapiens
cugggugauagagcaagacugucucaaaaaagaaaaaaaagaaaaaauuuuaauuuaauccuuc

SEQ ID NO: 526009 - RNA, 64 nt, Homo Sapiens
agcccuacuuuggccaacauccugcuuauuucucaaaaaagagggacagugaaaacaaaaacga

SEQ ID NO: 526010 - RNA, 64 nt, Homo Sapiens
cauguaugaaguuuuuaaucacccccuaacccccaaaaaagauucgguugucaagggauauauu

SEQ ID NO: 526011 - RNA, 64 nt, Homo Sapiens
cugggugacuagcaaaacuccaucucaaaaaaaaaaaaaagaaagaaagaaacugaaaagugag

SEQ ID NO: 526012 - RNA, 64 nt, Homo Sapiens
aacaugguaaaaccccgucucuacuaaaaauagaaaaaaagaaauuagccuagcgugguggcug

SEQ ID NO: 526013 - RNA, 64 nt, Homo Sapiens
gcaagacuccgucucaaaaaaaaaaaaaaaaaaaaaaaaagagugaauguaauagucuugcaga

SEQ ID NO: 526014 - RNA, 64 nt, Homo Sapiens
cgccuggcaacagagcaagagucugucucaaaaaaaaaaagaaaaaaagaaaaaaagaaaaaag

SEQ ID NO: 526015 - RNA, 64 nt, Homo Sapiens
aacagagcaagagucugucucaaaaaaaaaaagaaaaaaagaaaaaaagaaaaaagaaaaaucu

SEQ ID NO: 526016 - RNA, 64 nt, Homo Sapiens
aagagucugucucaaaaaaaaaaagaaaaaaagaaaaaaagaaaaaagaaaaaucucauuauuu

SEQ ID NO: 526017 - RNA, 64 nt, Homo Sapiens
ugucucaaaaaaaaaaagaaaaaaagaaaaaaagaaaaaagaaaaaucucauuauuucaaaaug

SEQ ID NO: 526018 - RNA, 64 nt, Homo Sapiens
gaagcaacgaaaacaaaaugccagagacuggcucaaaaaagaaaggcuguuaaauuggccugcu

SEQ ID NO: 526019 - RNA, 64 nt, Homo Sapiens
cuuuaacacuaauuuuccaaucauguguggguuaaaaaaagaagaaaaaugaaagauugaaugu

SEQ ID NO: 526020 - RNA, 64 nt, Homo Sapiens
gauauuaccauggcaacccucugaucugacaaaaaaaaaagaggugugcuugggucccacguga

SEQ ID NO: 526021 - RNA, 64 nt, Homo Sapiens
cauaaucgugggcaucucuagcugccauuagagaaaaaaagaagcucccagcuuugccgccugu

SEQ ID NO: 526022 - RNA, 64 nt, Homo Sapiens
gagagagagaaagaaauagauccaucucaaaaaaaaaaaagagaccugggucacagagugagac

SEQ ID NO: 526023 - RNA, 64 nt, Homo Sapiens
cugugucagagcccagcccacccugucucaaaaaaaaaaagauugccugggugacagagugaga

SEQ ID NO: 526024 - RNA, 64 nt, Homo Sapiens
cuuguccauuuagcuuucauaacaaccuacauauaaaaaagaaaguugcacaggguggagucaa

SEQ ID NO: 526025 - RNA, 64 nt, Homo Sapiens
agaaagccuuuauuuccuggcagauagauuuuaaaaaaaagaauuagguuuagggaguguaccu

SEQ ID NO: 526026 - RNA, 64 nt, Homo Sapiens
ucuagcccaggagcgguggcacuccaucucaaaaaaaaaagaguagcuugggcaacagagcaag

SEQ ID NO: 526027 - RNA, 64 nt, Homo Sapiens
aucaaaacgcauucuucauuugucuuggauaugcaaaaaagaaaauucagaaacuugagugcaa

SEQ ID NO: 526028 - RNA, 64 nt, Homo Sapiens
uugcaguuguguuguaagcgacaaacaaacaaacaaaaaagauaaaauccccgucuuuacaaaa

SEQ ID NO: 526029 - RNA, 64 nt, Homo Sapiens
agauauuuaggugacuuacaacaauaaaaaguauaaaaaagagauauguuauaccuauuuuacu

SEQ ID NO: 526030 - RNA, 64 nt, Homo Sapiens
aagccgggugagguggugugggaaaaaaaaaaagaaaaaagaaaggugaccucccgucucucuc

SEQ ID NO: 526031 - RNA, 64 nt, Homo Sapiens
aaagaaaaagccgggugaggcucucucggaaaaaaaaaaagaaagcaacauggugaccucccgu

SEQ ID NO: 526032 - RNA, 64 nt, Homo Sapiens
aagaaugaaaacugcugacgugaaaaaaagaaggaaaaaagaauuuaacauugcaaugaaaaaa

SEQ ID NO: 526033 - RNA, 64 nt, Homo Sapiens
gaaaaaagaauaagaaugaacaaugaaaaaaugaaaaaaagaagacucugguguguuaacauug

SEQ ID NO: 526034 - RNA, 64 nt, Homo Sapiens
gguuguuauggacuggacacucaaaaaaaaaaaaaaaaaagaaaugacagagugagacucuauc

SEQ ID NO: 526035 - RNA, 64 nt, Homo Sapiens
aguucuggacuauugaacagcagcccuaaaauagaaaaaagaacuagacuaaauagaaaccccu

SEQ ID NO: 526036 - RNA, 64 nt, Homo Sapiens
cugggcaacaagagugaaacuccaucuccaaaaaaaaaaagaaaaaguaacaaaaggaaauuau

SEQ ID NO: 526037 - RNA, 64 nt, Homo Sapiens
caauguagugacaccucauuucuauuuauuuuaaaaaaaagagagaguaacuacagaagaacuu

SEQ ID NO: 526038 - RNA, 64 nt, Homo Sapiens
cuauaguagaaaaggaaacuaguagggccaaaaaaaaaaagaaaaagaaaaagaaaaaagaaaa

SEQ ID NO: 526039 - RNA, 64 nt, Homo Sapiens
uaguagggccaaaaaaaaaaagaaaaagaaaaagaaaaaagaaaaaaaaagaaaaaacugggac

SEQ ID NO: 526040 - RNA, 64 nt, Homo Sapiens
aaaaaaaaaaagaaaaagaaaaagaaaaaagaaaaaaaaagaaaaaacugggaccuaaguauaa

SEQ ID NO: 526041 - RNA, 64 nt, Homo Sapiens
aaaauaaaaaaaaauuuaaaaaauuaaaaaauaaaaaaaagaggucacuaaaagaccaagaugg

SEQ ID NO: 526042 - RNA, 64 nt, Homo Sapiens
gacuuccgggacagucauuaagugaaacugucucaaaaaagagacauuucagccugagcgacag

SEQ ID NO: 526043 - RNA, 64 nt, Homo Sapiens
auuuugaaucuccuuucccagucucaaacagaaaaaaaaagagagggcagcagagcgagacucc

SEQ ID NO: 526044 - RNA, 64 nt, Homo Sapiens
ucggcaucgacacggacguucaaaaaaagauuuaaaaaaagauucuccguccaaaagauuccuc

SEQ ID NO: 526045 - RNA, 64 nt, Homo Sapiens
uaaaaaaagauuucggcaucaaaagauuccuccaaaaaaagauugaagacuuuugccuccgucc

SEQ ID NO: 526046 - RNA, 64 nt, Homo Sapiens
agcaagagaaaaagcaaauugaaaucagaagaacaaaaaagaaggaugcuuuaaaugaaaaauu

SEQ ID NO: 526047 - RNA, 64 nt, Homo Sapiens
gaaagagggaaaaagagcugagaaaaaaagaaaaaaaaaagaaacuguaggaucguaaaaaaau

SEQ ID NO: 526048 - RNA, 64 nt, Homo Sapiens
aaaaaaagaaagaaagagggcguaaaaaaauagaaaaaaagaaacuggaccaucucuguaggau

SEQ ID NO: 526049 - RNA, 64 nt, Homo Sapiens
uucuggcugaugggugacucaaaaaaaaaaaaaaaaaaaagaguauuuacuuuucuuaaaaaaa

SEQ ID NO: 526050 - RNA, 64 nt, Homo Sapiens
caaaaauauuuuucccccuaauuuuauuuuuuaaaaaaaagaaauuuucucccauugugcgaac

SEQ ID NO: 526051 - RNA, 64 nt, Homo Sapiens
gaaagaaaagguacauguauagacucugucucaaaaaaaagaaauccagccugggcaacgggcg

SEQ ID NO: 526052 - RNA, 64 nt, Homo Sapiens
ccccuucacucuacaggggaaaaaacuaaaaagaaaaaaagaaguuuuaagacucugucuuaaa

SEQ ID NO: 526053 - RNA, 64 nt, Homo Sapiens
cugggcaauuuuuuuaagacuuuuaagacucuuaaaaaaagagcuccagccugggcaagaguuu

SEQ ID NO: 526054 - RNA, 64 nt, Homo Sapiens
cuuuuugguuguccucaagaaaaaaaaaaaaggaaaaaaagacugauauuucucuaguaguuaa

SEQ ID NO: 526055 - RNA, 64 nt, Homo Sapiens
aaaacccucaagggcaugagaauaauggaaaaaaaaaaaagaggucacaauguucuuuauauac

SEQ ID NO: 526056 - RNA, 64 nt, Homo Sapiens
gcaugauauuuacuguuuugaaaauaaaauaauaaaaaaagaaacaaacucauauuacaaaaac

SEQ ID NO: 526057 - RNA, 64 nt, Homo Sapiens
gaaaaagagaauauacaugaucauguaaaacagaaaaaaagagugaugauaaauaugguuaauu

SEQ ID NO: 526058 - RNA, 64 nt, Homo Sapiens
aggauugcauacauguucuaugacagagaggaggaaaaaagaugaauuuuaaugaacgaaugaa

SEQ ID NO: 526059 - RNA, 64 nt, Homo Sapiens
gaagauaguacuagcaaguauggcuucugaaaaaaaaaaagagugcugcagauuuagagaacau

SEQ ID NO: 526060 - RNA, 64 nt, Homo Sapiens
ggagauucccccaaacaacaacaauuaaagaucuaaaaaagagaauagccagacuugagaggug

SEQ ID NO: 526061 - RNA, 64 nt, Homo Sapiens
aaagagaaagcaagagacaguuguuugcauauuaaaaaaagagaauuuucauuuuugcauuuuu

SEQ ID NO: 526062 - RNA, 64 nt, Homo Sapiens
auauacugacagucuaaucaguauuuaaaaaaagaaaaaagacagugccauuuuaauaaaaaau

SEQ ID NO: 526063 - RNA, 64 nt, Homo Sapiens
aaagacaauauacugacaguaaaaaauguauuuaaaaaaagaaacagacaagugccauuuuaau

SEQ ID NO: 526064 - RNA, 64 nt, Homo Sapiens
aacauagggagaccccaucucuaccggaggaaaaaaaaaagagucaggccugguggugugcgcc

SEQ ID NO: 526065 - RNA, 64 nt, Homo Sapiens
gagugagaccuugucucaaaaaaguaacauaaggaaaaaagaagccuugcuuuagcacagguau

SEQ ID NO: 526066 - RNA, 64 nt, Homo Sapiens
ccaaagauacacuauaaaaauagaguuuuuaccaaaaaaagauguuuguucucaucucaguagg

SEQ ID NO: 526067 - RNA, 64 nt, Homo Sapiens
cauggcacaacuaaaaaucuaagccugaaaccugaaaaaagagauaugacaagggaaauuaauc

SEQ ID NO: 526068 - RNA, 64 nt, Homo Sapiens
ucccuuccuauaaccucuagguaaaaagaaaagaaaaaaagaaauuucgagauauuuucaacau

SEQ ID NO: 526069 - RNA, 64 nt, Homo Sapiens
cuaucucaaaccgcagaaaggcuuuaauacuggaaaaaaagaauucaagacuacaggcagcucc

SEQ ID NO: 526070 - RNA, 64 nt, Homo Sapiens
agccugggugacaagagugaaacuccaucucaaaaaaaaagaaaagaagguccagcuuuuggau

SEQ ID NO: 526071 - RNA, 64 nt, Homo Sapiens
cagcccgggugacaaagcaagacccugucucagaaaaaaagaaaauucaaggccaguuaagaca

SEQ ID NO: 526072 - RNA, 64 nt, Homo Sapiens
gggcgacaagagcaaaacuccgucucaaaaaaaaaaaaaagauacaaagucugcauuugauaua

SEQ ID NO: 526073 - RNA, 64 nt, Homo Sapiens
aaugacucgcaaccccucaccccacaauuucuuuaaaaaagaaauuaucuuuaguugaauucca

SEQ ID NO: 526074 - RNA, 64 nt, Homo Sapiens
cacauuuuaggaucucgccuggaaacagagguaaaaaaaagaagugugcgcccggcuaaugcag

SEQ ID NO: 526075 - RNA, 64 nt, Homo Sapiens
acuguauggaaucaacaccaccgagcucugugggaaaaaagaaaaaccugcucccuucgcucug

SEQ ID NO: 526076 - RNA, 64 nt, Homo Sapiens
uaccaacauguaucugucuacuuucucuuguuuaaaaaaagaaaaaaaaacuuaaaaaaauggg

SEQ ID NO: 526077 - RNA, 64 nt, Homo Sapiens
gaaaacagauauuauucaaugugcuuauauaaauaaaaaagagucacuuuuaagcuauguguau

SEQ ID NO: 526078 - RNA, 64 nt, Homo Sapiens
uguucacuuuuaagcuauguuuacccaaggcgguaaaaaagacaagauuauuaaaugugacaaa

SEQ ID NO: 526079 - RNA, 64 nt, Homo Sapiens
aacccguggcacuauguaaaauaaaaaagagaagaaaaaagagauaguaccaucucccccgcca

SEQ ID NO: 526080 - RNA, 64 nt, Homo Sapiens
agaaaaaagagaaacccgugucucccccgccaauaaaaaagagaaauaacaaguuauaguacca

SEQ ID NO: 526081 - RNA, 64 nt, Homo Sapiens
uuuccagcauuguggaacaucauagauugaugccaaaaaagacauacguaaucagaaauuugug

SEQ ID NO: 526082 - RNA, 64 nt, Homo Sapiens
aaaggaaaaaaacaguuugaugaaaaaaaaaggaaaaaaagaaaaaucuuaaaaaaagaaaaaa

SEQ ID NO: 526083 - RNA, 64 nt, Homo Sapiens
aaaugaaaaaaaaaggaaaaaguuugaaaucuuaaaaaaagaaaccuuuuccaguguguaaccc

SEQ ID NO: 526084 - RNA, 64 nt, Homo Sapiens
aaaacauggucuuguuuuuaaaugcacauuuuuaaaaaaagaaauauucauuuauguuagcauu

SEQ ID NO: 526085 - RNA, 64 nt, Homo Sapiens
caaaaaggaacuucuuauagaagggaaaaaaaagaaaaaagaaaacuguugccugcaaaaauaa

SEQ ID NO: 526086 - RNA, 64 nt, Homo Sapiens
aaagaaacaaaaaggaacuuaaaauaaaagggaaaaaaaagaaaacccaugacuguugccugca

SEQ ID NO: 526087 - RNA, 64 nt, Homo Sapiens
caguauuagauuuuggucucaagguguuuaucauaaaaaagaaaugcacacugagauauaauaa

SEQ ID NO: 526088 - RNA, 64 nt, Homo Sapiens
ccuagaaucuaaugcagaagccaguuuugaaaccaaaaaagaaacauuuuuauggauuguagac

SEQ ID NO: 526089 - RNA, 64 nt, Homo Sapiens
ggccacaguuguuugaugcauuaaaagaaaauaaaaaaaagaaaaaagagaaaagaaaaaaaaa

SEQ ID NO: 526090 - RNA, 64 nt, Homo Sapiens
guuguuugaugcauuaaaagaaaauaaaaaaaagaaaaaagagaaaagaaaaaaaaagaaaaaa

SEQ ID NO: 526091 - RNA, 64 nt, Homo Sapiens
aagaaaauaaaaaaaagaaaaaagagaaaagaaaaaaaaagaaaaaaguuguaggcgaaucauu

SEQ ID NO: 526092 - RNA, 64 nt, Homo Sapiens
gaaauaggaaaacaacaaaagaaaaacaauaacaaaaaaagaaagugugauggcugggugcagu

SEQ ID NO: 526093 - RNA, 64 nt, Homo Sapiens
aaaaauaaauaaauagaaagagagagagaggaaaaaaaaagaaaagaacacuucuuuauuugag

SEQ ID NO: 526094 - RNA, 64 nt, Homo Sapiens
caauuuaauuaauugguaagauauaaugcaaaaaaaaaaagagaaauguuugccuuauguauau

SEQ ID NO: 526095 - RNA, 64 nt, Homo Sapiens
aaucuacuguacugucagcuucacuccaccugagaaaaaagaaaaaaaaauugauagcucaaau

SEQ ID NO: 526096 - RNA, 64 nt, Homo Sapiens
aauaauaccaggcuuuuauaaacuuuucuagaagaaaaaagauggaacuuuuccaauucaguuu

SEQ ID NO: 526097 - RNA, 64 nt, Homo Sapiens
uagccuggaagacagagugagaccccaucucaggaaaaaagaaaaaaaaaaagaugucauucag

SEQ ID NO: 526098 - RNA, 64 nt, Homo Sapiens
cagagugagaccccaucucaggaaaaaagaaaaaaaaaaagaugucauucagcagguuaaugga

SEQ ID NO: 526099 - RNA, 63 nt, Homo Sapiens
ccgaacagccugaaaugugaacugaacaggagaaaaaaagaaaagcaaaaaacuccuguaacc

SEQ ID NO: 526100 - RNA, 64 nt, Homo Sapiens
aacacuaaauucaagucauuuguuuuaagucucuaaaaaagaagauugcagucauccauucaua

SEQ ID NO: 526101 - RNA, 64 nt, Homo Sapiens
guuuuuucuuaaguuauauuuguuuuuacuuuuuaaaaaagaagaggaaacaaagcccccuuuu

SEQ ID NO: 526102 - RNA, 64 nt, Homo Sapiens
gcuaguggucccuuuugaauuucaugagccucucaaaaaagaaaaacuuaaaaaaaaaaaaaaa

SEQ ID NO: 526103 - RNA, 64 nt, Homo Sapiens
aacagagcgagacucugucuccccccgcaaaaaaaaaaaagaaagaaagaaagagaaaagaaaa

SEQ ID NO: 526104 - RNA, 64 nt, Homo Sapiens
caaagauuuucuucagguuaaaaaaaaaguuuaaaaaaaagauuuuaaaauaaagcauuuauga

SEQ ID NO: 526105 - RNA, 64 nt, Homo Sapiens
uuuuuauuuccuaagaaauaauuuaauguuuaguaaaaaagaaaacagaaaaaagaaagaugcg

SEQ ID NO: 526106 - RNA, 64 nt, Homo Sapiens
gaaauaauuuaauguuuaguaaaaaagaaaacagaaaaaagaaagaugcguguguuggcuuacg

SEQ ID NO: 526107 - RNA, 64 nt, Homo Sapiens
guuuuauuguuccacuugaauauuucuacuguaaaaaaaagacagugguuuugaaauuguugaa

SEQ ID NO: 526108 - RNA, 64 nt, Homo Sapiens
uuucaucuaagccacuuaacugauaaccaaaaaaaaaaaagacauauuuucacaaaggguuauc

SEQ ID NO: 526109 - RNA, 64 nt, Homo Sapiens
uccuggggccugcccagucucuccgucuccaaaaaaaaaagaaugccugggcaacagagcaaga

SEQ ID NO: 526110 - RNA, 64 nt, Homo Sapiens
ucugcuuuuaauuuauucuuaaguugcagaauuaaaaaaagaaaaaagauguacguuguagaca

SEQ ID NO: 526111 - RNA, 64 nt, Homo Sapiens
agguugcuccugaaacugacuuuaauaaugggggaaaaaagauuuuguguaaaauggacucuag

SEQ ID NO: 526112 - RNA, 64 nt, Homo Sapiens
ucuauuucuuuaaaagauauuguuggugaacaacaaaaaagagaccauacucucaugacaauuu

SEQ ID NO: 526113 - RNA, 64 nt, Homo Sapiens
cuguuauaaagugauuuucuucaaaaagugcaaaaaaaaagauuaaaucagcaaaggcaguguu

SEQ ID NO: 526114 - RNA, 64 nt, Homo Sapiens
guuuaaaaaaaaaaggaaucaaaaaaaaaaaagaaaaaaagauuagguguuuuuuacauuuaag

SEQ ID NO: 526115 - RNA, 64 nt, Homo Sapiens
aaaagauuguuuaaaaaaaacauuuaagaaaaaaaaaaaagaaacuguaccgagguguuuuuua

SEQ ID NO: 526116 - RNA, 64 nt, Homo Sapiens
gaauaaauaaaacaaacuuaaucuucaucuuuaaaaaaaagaaaaaagaaaccaaaaugagaau

SEQ ID NO: 526117 - RNA, 64 nt, Homo Sapiens
uaaaacaaacuuaaucuucaucuuuaaaaaaaagaaaaaagaaaccaaaaugagaaucaacacu

SEQ ID NO: 526118 - RNA, 64 nt, Homo Sapiens
gccguugaaaugaaaagagagacagagagaaaaaaaaaaagagaacccacaugaagcucugaaa

SEQ ID NO: 526119 - RNA, 64 nt, Homo Sapiens
uuguguggaugcgugaccaugggaaaaagaaaaaaaaaaagauccauuuuuuagguucuuuucg

SEQ ID NO: 526120 - RNA, 64 nt, Homo Sapiens
uaaaauugauguugucuuuaccagaaagguagacaaaaaagaagcagcagcagcucuuaaagug

SEQ ID NO: 526121 - RNA, 64 nt, Homo Sapiens
gcucuuggaaagaaugacguuuugcuggaaaaaaaaaaaagaacaguuuguguuucacaaacau

SEQ ID NO: 526122 - RNA, 64 nt, Homo Sapiens
uuuaacuguuugauuauaacugugcaaauacagaaaaaaagaaggcuggcugaaaguugaguua

SEQ ID NO: 526123 - RNA, 64 nt, Homo Sapiens
uaacauuucacaaauguuuagugaaacauuugugaaaaaagaagacuaaauuaagaccugagcu

SEQ ID NO: 526124 - RNA, 64 nt, Homo Sapiens
ugggagacuccaucucaaaaaaaaaaaaaaaaaaaaaaaagauaaaaagucagaaaucugaaaa

SEQ ID NO: 526125 - RNA, 64 nt, Homo Sapiens
uucauuuauuuuaaauaaaugaauaaaauaaaauaaaaaagaauauucagucguuggcacauaa

SEQ ID NO: 526126 - RNA, 64 nt, Homo Sapiens
gaauuguuaaauguucuuaaauguucucacuacaaaaaaagaaaaaagauaacuacgugaggug

SEQ ID NO: 526127 - RNA, 64 nt, Homo Sapiens
uaaauguucuuaaauguucucacuacaaaaaaagaaaaaagauaacuacgugaggugauggaua

SEQ ID NO: 526128 - RNA, 64 nt, Homo Sapiens
gcaccucagaugaaaacucacuuuuauuaaaaaaaaaaaagacaaggguuuauauucauauaca

SEQ ID NO: 526129 - RNA, 64 nt, Homo Sapiens
gugacagagcaacacucugucuuaaaagaaaaaaaaaaaagagagagauaguaaucucuugggc

SEQ ID NO: 526130 - RNA, 64 nt, Homo Sapiens
gaggaccaaaccaugcacauaaagcuuguaguuuaaaaaagaaaagcaaaaaaauaauuaugcc

SEQ ID NO: 526131 - RNA, 64 nt, Homo Sapiens
cagccugggcaacagagggagacucugucucaaaaaaaaagaaguuacuuccaagacagacuuu

SEQ ID NO: 526132 - RNA, 64 nt, Homo Sapiens
agaaauuuauuuauuaaaaacuuuacaaaaaaacaaaaaagaaacuacuguuucaaaaaagugu

SEQ ID NO: 526133 - RNA, 64 nt, Homo Sapiens
guuuauuaaaaaugacacaaaacaaacaaucaaaaaaaaagacaacauuuacagaguuacaaaa

SEQ ID NO: 526134 - RNA, 64 nt, Homo Sapiens
gagagagagaaaaagaaaugcucaaaaaaaaaaaaaaaaagagaaugacagagugagaccuuau

SEQ ID NO: 526135 - RNA, 64 nt, Homo Sapiens
gguaaauguuauauaauuguugguaaaagaaaaaaaaaaagacaucucguaauuguguauagca

SEQ ID NO: 526136 - RNA, 64 nt, Homo Sapiens
auguccucuugcugucuacaguagcugcuaccuaaaaaaagauguuuuauuuugccaguuggac

SEQ ID NO: 526137 - RNA, 64 nt, Homo Sapiens
gaagcuauuuguuaaaauauuugccuuuuuaaguaaaaaagaaaaaucagaacagggcuauuug

SEQ ID NO: 526138 - RNA, 64 nt, Homo Sapiens
ccuuuaguguuggugguaggaggauggggagaggaaaaaagagcuggcaaagaaauggauaggg

SEQ ID NO: 526139 - RNA, 64 nt, Homo Sapiens
cauuguuuuuuugcaugcuuucuuaauaaaaaaaaaaaaagaauguuuacaguuuuaucuuacu

SEQ ID NO: 526140 - RNA, 64 nt, Homo Sapiens
uguugggucuuggcugaaaaaaaaaaaugcuuuuaaaaaagauaaaaugaaaaggagagcucuc

SEQ ID NO: 526141 - RNA, 64 nt, Homo Sapiens
ugaauacauuuuugaaauaggaacucccuuuugcaaaaaagaaaccugggugucagggagguga

SEQ ID NO: 526142 - RNA, 64 nt, Homo Sapiens
agcuuacuugaacuaauuacuugaaaacugguggaaaaaagagaccaacuuuguuauuuuuuaa

SEQ ID NO: 526143 - RNA, 64 nt, Homo Sapiens
ugggcgacagugcaagacucugucuccaaaaaaaaaaaaagaaaaaagaaaaucccccuucauc

SEQ ID NO: 526144 - RNA, 64 nt, Homo Sapiens
cagugcaagacucugucuccaaaaaaaaaaaaagaaaaaagaaaaucccccuucaucccccagg

SEQ ID NO: 526145 - RNA, 64 nt, Homo Sapiens
ugccaucaaauggcuacaguucauuuaaauuuaaaaaaaagaaaaaagaaacagaaaacguguc

SEQ ID NO: 526146 - RNA, 64 nt, Homo Sapiens
aaauggcuacaguucauuuaaauuuaaaaaaaagaaaaaagaaacagaaaacgugucucagaug

SEQ ID NO: 526147 - RNA, 52 nt, Homo Sapiens
aggaagaaaacaaggacuaagcaaaaaagaaagacccccccccccuuagcaa

SEQ ID NO: 526148 - RNA, 64 nt, Homo Sapiens
aaagagaaaaauuuuaaaauccugcuauaggagaaaaaaagagaaaaaaauaaaaaucaaaaaa

SEQ ID NO: 526149 - RNA, 64 nt, Homo Sapiens
gaaaaaaagagaaaaaaauaaaaaucaaaaaaaaaaaaaagaaagaaagaaaccuccagcguau

SEQ ID NO: 526150 - RNA, 64 nt, Homo Sapiens
aaauuauuaaucugaaaauagcaacccagaauguaaaaaagaaaaaacuggggggaaaaagacc

SEQ ID NO: 526151 - RNA, 64 nt, Homo Sapiens
gaaucuuuaagggagguuuaaaaaaaaaaaaaaaaaaaaagauugguugccucugccuuuguga

SEQ ID NO: 526152 - RNA, 64 nt, Homo Sapiens
gagagagagaaagagaacaaucagaaaaaaaaaaaaaaaagagagacaagagcaagacucuguc

SEQ ID NO: 526153 - RNA, 64 nt, Homo Sapiens
gagagagggccgggcgugguaaaaaaaaaaaaaaaaaaaagaaaauaacaagauccugucucuc

SEQ ID NO: 526154 - RNA, 64 nt, Homo Sapiens
cccuuuuauuuuucucucucuuuacauauaaauaaaaaaagaaucaccacccuaaaguuggauu

SEQ ID NO: 526155 - RNA, 64 nt, Homo Sapiens
aaugaauuucucuuuacuucugcaccugacagaaaaaaaagaaauucauuuuuuuucuuuguaa

SEQ ID NO: 526156 - RNA, 64 nt, Homo Sapiens
cauagauuugucucuguguuaauuuaccagaaaaaaaaaagauaacuuuucucauuuuccugag

SEQ ID NO: 526157 - RNA, 64 nt, Homo Sapiens
aaggaaaucaguggcagaaaauaauuuuugaaacaaaaaagaggcccuuucuuuuauucaaaca

SEQ ID NO: 526158 - RNA, 64 nt, Homo Sapiens
gaaagaaaaaaggcagaagcaaaaaaaaaaaaagaaaaaagaaaacagagcgaaccucugucuc

SEQ ID NO: 526159 - RNA, 64 nt, Homo Sapiens
aaagaaagaaagaaaaaaggcugucucaaaaaaaaaaaaagaaacggggugacagagcgaaccu

SEQ ID NO: 526160 - RNA, 64 nt, Homo Sapiens
gaauaaaaaaaccuucagcuaugggcucacuuuaaaaaaagaaaucugggaaagacaccaaauc

SEQ ID NO: 526161 - RNA, 64 nt, Homo Sapiens
auugugcucuuuucuaauccaacagaacaaaacaaaaaaagaaaagcaguaugccacuucuuaa

SEQ ID NO: 526162 - RNA, 64 nt, Homo Sapiens
acaauuuaaaagucagccuaaaaaacuguaguugaaaaaagaugucuucugguuuacuauauac

SEQ ID NO: 526163 - RNA, 64 nt, Homo Sapiens
aaaagauauacagagaagaccuauacaaggcuucaaaaaagacucaaaauguuccuuuugaaga

SEQ ID NO: 526164 - RNA, 64 nt, Homo Sapiens
gcauagacauauuuuuuuaaaaagaaaaaaagaaaaaaaagaaaaaaguacuugacuaaaaaaa

SEQ ID NO: 526165 - RNA, 64 nt, Homo Sapiens
aaaaagaaagcauagacauacuaaaaaaaaaagaaaaaaagaaauucuuuaagaaaguacuuga

SEQ ID NO: 526166 - RNA, 64 nt, Homo Sapiens
aaaagaaaaaaaagaaagcaguacuugacuaaaaaaaaaagaaagcuauuguuucuuuaagaaa

SEQ ID NO: 526167 - RNA, 64 nt, Homo Sapiens
cccuggaucucugaauauaugccaggaaaaaaaaaaaaaagacuggucaccucaaggaucagag

SEQ ID NO: 526168 - RNA, 64 nt, Homo Sapiens
aaugcaaauaguugcaacuucacaucaugcuuacaaaaaagaaugacacaaagcuuuauuuuuc

SEQ ID NO: 526169 - RNA, 64 nt, Homo Sapiens
aaaaagcacgugaccuuauggucucaaaaaagaaaaaaaagaaaggcaacaaaagcgaaacucu

SEQ ID NO: 526170 - RNA, 64 nt, Homo Sapiens
aaaaagaaaaaaaagcacgucgaaacucugucucaaaaaagaaauccagccugggcaacaaaag

SEQ ID NO: 526171 - RNA, 64 nt, Homo Sapiens
uggguggauuacuugaggucugucucaaaaaaaaaaaaaagagggggcaacaagagcgaaacuc

SEQ ID NO: 526172 - RNA, 64 nt, Homo Sapiens
aaaggagagaaaguaacuuuuuacucaaucauucaaaaaagagaaggcuacacacagaaaaugu

SEQ ID NO: 526173 - RNA, 64 nt, Homo Sapiens
caaagaaauaugucucaaaaugggguuaaaaaaaaaaaaagauaguagacuuaaggcuucauug

SEQ ID NO: 526174 - RNA, 64 nt, Homo Sapiens
auacauacacaugaacaaagaaaacaccuugagaaaaaaagauacugauaaacagaauacuuuu

SEQ ID NO: 526175 - RNA, 64 nt, Homo Sapiens
uagagaagaggaagagaauagauauacagagagaaaaaaagacuagaauaaaaacuaccaaagu

SEQ ID NO: 526176 - RNA, 64 nt, Homo Sapiens
uccagccugggcaacaagagcaaaacuccgucucaaaaaagaugaaaauaaaauaaaauauaua

SEQ ID NO: 526177 - RNA, 64 nt, Homo Sapiens
ugcuuaauuuggaauagagaaaccaguauauuuuaaaaaagaaaaauauucuuuguagcaacug

SEQ ID NO: 526178 - RNA, 64 nt, Homo Sapiens
uuuagugauuauuaagcacuucugucagucuuugaaaaaagaacguauuuuuugugcuuugaag

SEQ ID NO: 526179 - RNA, 64 nt, Homo Sapiens
gaucugugcuguagaaaaacauuaacccuuguucaaaaaagaaauggauaaacuuggccuuucu

SEQ ID NO: 526180 - RNA, 64 nt, Homo Sapiens
cagcacauugcauguaguugagccacauuuuuuaaaaaaagaaaauggaugaccauuaauugac

SEQ ID NO: 526181 - RNA, 64 nt, Homo Sapiens
gaugacccuuuugaauauaccuaaugauuuccuuaaaaaagaaauuuuaaacagacuuguuuaa

SEQ ID NO: 526182 - RNA, 64 nt, Homo Sapiens
gccggggaaacgacccuguggcugugagaaagugaaaaaagaaaaaaaaaaaggcauuggcauu

SEQ ID NO: 526183 - RNA, 64 nt, Homo Sapiens
uaggacagaauuaaugaugcuuaaagagaaaagaaaaaaagagagaagaaaaaggagagaugaa

SEQ ID NO: 526184 - RNA, 64 nt, Homo Sapiens
cccagcuauugucuguuguguucagcugagaugcaaaaaagaaauuaagcaaaaaagaaaaaga

SEQ ID NO: 526185 - RNA, 64 nt, Homo Sapiens
uguguucagcugagaugcaaaaaagaaauuaagcaaaaaagaaaaagaugaagacuuuucauga

SEQ ID NO: 526186 - RNA, 64 nt, Homo Sapiens
uuucaaauuuagcaauaaacaauuagcauuaguuaaaaaagaaacauauuccaagggcagguuc

SEQ ID NO: 526187 - RNA, 64 nt, Homo Sapiens
agaugcaccaaccguaucauuauuuguuugaggaaaaaaagaaaucugcauuuuaauucauguu

SEQ ID NO: 526188 - RNA, 64 nt, Homo Sapiens
uaacuugcuuuguagguuugcaucaaaaaaccuuaaaaaagaaguucuaguugugucaccaaau

SEQ ID NO: 526189 - RNA, 64 nt, Homo Sapiens
aaaaaccauauguguauuagaaaaaaggaaaaaaaaaaaagaaaucucaaaaaaaaaaaaaaaa

SEQ ID NO: 526190 - RNA, 64 nt, Homo Sapiens
ugcacuuguaaacagaauguuuaaacauaugauaaaaaaagaaauaaauuaaauuucacccuau

SEQ ID NO: 526191 - RNA, 64 nt, Homo Sapiens
guguugauggcaguuccaaugaucuucaucaccuaaaaaagaguaaauguuuuaacugacuuug

SEQ ID NO: 526192 - RNA, 64 nt, Homo Sapiens
agaaaaacugccuacaggcccugucucaaaaaaaaaaaaagagagccugggugacagaacaaga

SEQ ID NO: 526193 - RNA, 64 nt, Homo Sapiens
agaaaauuagccagguguggcaaaaaaaaaaaaaaaaaaagaaaaugagagugagacuccaucg

SEQ ID NO: 526194 - RNA, 64 nt, Homo Sapiens
auuguaaauauuuuauuuaauucaaagaaaaaggaaaaaagauuauuuuugucauauucuugua

SEQ ID NO: 526195 - RNA, 64 nt, Homo Sapiens
accaccauuauuaccaccuccccccauagaagagaaaaaagagcauaaucugcaacuucauuuu

SEQ ID NO: 526196 - RNA, 64 nt, Homo Sapiens
cuaaaaaaaguguguauuaggaggagagagaggaaaaaaagaggaaagaaggaaaaaaaaaaga

SEQ ID NO: 526197 - RNA, 64 nt, Homo Sapiens
ggagagagaggaaaaaaagaggaaagaaggaaaaaaaaaagaauuaaaaaaaaaaaaaagaaaa

SEQ ID NO: 526198 - RNA, 64 nt, Homo Sapiens
aggaaagaaggaaaaaaaaaagaauuaaaaaaaaaaaaaagaaaaacagaagaugaccuugaug

SEQ ID NO: 526199 - RNA, 64 nt, Homo Sapiens
aagaugaccuugauggaaaaaaaauauuuuuuaaaaaaaagauauacuguggaaggggggagaa

SEQ ID NO: 526200 - RNA, 64 nt, Homo Sapiens
ugcauccagaaaggccagauuuuaccuaccaagaaaaaaagauauuuuuccagagaguuaggua

SEQ ID NO: 526201 - RNA, 64 nt, Homo Sapiens
auauuuuucaguuguuuaugucguuuacuacaaaaaaaaagauucagaguggauggaguacaac

SEQ ID NO: 526202 - RNA, 64 nt, Homo Sapiens
uucccaaaugggaaaggugcugacagaguuggagaaaaaagaauagacucauuuuuccccauua

SEQ ID NO: 526203 - RNA, 64 nt, Homo Sapiens
uccucucucaccccguaaacugacaagcaugaugaaaaaagaagcacauccaaguuucugccuc

SEQ ID NO: 526204 - RNA, 64 nt, Homo Sapiens
guuuaauuauguaaaaaacaaaacuacaacaacaaaaaaagaaaaaaguuaaaaaagaaaaaaa

SEQ ID NO: 526205 - RNA, 64 nt, Homo Sapiens
aacaaaacuacaacaacaaaaaaagaaaaaaguuaaaaaagaaaaaaacaccaaaaaacaaaaa

SEQ ID NO: 526206 - RNA, 64 nt, Homo Sapiens
gcuggaucugugacugauugaaaugcaugcaaauaaaaaagacaauauuaaagucuguuaucaa

SEQ ID NO: 526207 - RNA, 64 nt, Homo Sapiens
aauguguuaagaguuuaauuuuuuuguuaucauuaaaaaagacaggauuauaaagagauaucaa

SEQ ID NO: 526208 - RNA, 64 nt, Homo Sapiens
aauccaacucugaauuuuaaagcaaaagcgucaaaaaaaagauucccuccuuacccccaaccca

SEQ ID NO: 526209 - RNA, 64 nt, Homo Sapiens
gucaaacugugccacacauggugaaugaaaaaaaaaaaaagaggcuguguuuugucacacaggg

SEQ ID NO: 526210 - RNA, 64 nt, Homo Sapiens
cuccaagcuuuugugauuguauauuccuauaggaaaaaaagaauugauuaugcauacccaguau

SEQ ID NO: 526211 - RNA, 64 nt, Homo Sapiens
aaaaaauuuaaaggguguacuuuucuaaaaaaagaaaaaagaagguacaaaaaaaaaguuuuau

SEQ ID NO: 526212 - RNA, 64 nt, Homo Sapiens
aaagaagaaaaaauuuaaagguuuuauuuuucuaaaaaaagaaauauauuuguacaaaaaaaaa

SEQ ID NO: 526213 - RNA, 64 nt, Homo Sapiens
uauagaaauccuugucaaagugaaaaaaagaaaaaaaaaagagcucuggaaaaaaaaaaaaaaa

SEQ ID NO: 526214 - RNA, 64 nt, Homo Sapiens
aaaaaaagagcuauagaaauaaaaaaaaaaaugaaaaaaagaaaucugguugaacucuggaaaa

SEQ ID NO: 526215 - RNA, 64 nt, Homo Sapiens
aaagauuaacuauuugcaccaccagacaaauggaaaaaaagaggagaaaaaguauuuuuucucc

SEQ ID NO: 526216 - RNA, 64 nt, Homo Sapiens
aaaaaguuacguuaaaaaccaaauuauuuucugcaaaaaagaaaccgcgaagugacaguuuaca

SEQ ID NO: 526217 - RNA, 64 nt, Homo Sapiens
uaagaacucaaggucccauaaagugaaaaaaaaaaaaaaagauaauuauuaaacuuuuucuaaa

SEQ ID NO: 526218 - RNA, 64 nt, Homo Sapiens
cuguaaugaauuuuauguguaggggucuguuuucaaaaaagauuaacaaugauuuaucagagaa

SEQ ID NO: 526219 - RNA, 64 nt, Homo Sapiens
uagggagaaaacuagucuaaauuauuucaacuggaaaaaagaaaaaagaguccucuucuuuucc

SEQ ID NO: 526220 - RNA, 64 nt, Homo Sapiens
aaaacuagucuaaauuauuucaacuggaaaaaagaaaaaagaguccucuucuuuucccagccuu

SEQ ID NO: 526221 - RNA, 64 nt, Homo Sapiens
uaaagacuacagaaggaaagagcuagucuagauaaaaaaagagaagaaguaaggaaaaggagag

SEQ ID NO: 526222 - RNA, 64 nt, Homo Sapiens
gcaaggauacuaagaaaauacugagaaaucugaaaaaaaagaaaaaaagaagagaaaagaucgu

SEQ ID NO: 526223 - RNA, 64 nt, Homo Sapiens
agaaaagaucgucugagaaacacaagccucugucaaaaaagaagcuggggcgguauggucagga

SEQ ID NO: 526224 - RNA, 64 nt, Homo Sapiens
ucuuaagcaaacagucccaaaccucuuaggggugaaaaaagaaacaugccacuugauuaggaga

SEQ ID NO: 526225 - RNA, 64 nt, Homo Sapiens
cugggcaagaagagcgaaacugggucucaaguuaaaaaaagaaagcaaggaaagaguaauuuac

SEQ ID NO: 526226 - RNA, 64 nt, Homo Sapiens
aaaagcacuguuucuauuuuuuucuuuuuuuccaaaaaaagaaaguaauaaaaacuuaaauucu

SEQ ID NO: 526227 - RNA, 64 nt, Homo Sapiens
cuccaaggcccaggacacuugucagaaggaugcaaaaaaagaaaaaaguacauccacccucuua

SEQ ID NO: 526228 - RNA, 64 nt, Homo Sapiens
uugggguuuuguuucuguuguuguucaaaugcaaaaaaaagaaaaaaaaagaaaaaaaaaggug

SEQ ID NO: 526229 - RNA, 64 nt, Homo Sapiens
guuucuguuguuguucaaaugcaaaaaaaagaaaaaaaaagaaaaaaaaaggugacucacauug

SEQ ID NO: 526230 - RNA, 64 nt, Homo Sapiens
cuccagccuggcgacagagcaaggcuccacucaaaaaaaagauuuaaaggggaaaaaauugaaa

SEQ ID NO: 526231 - RNA, 64 nt, Homo Sapiens
ucagccugagugacagagagacuuugucucaaaaaaaaaagaaaauuuuaauuuuaauguagac

SEQ ID NO: 526232 - RNA, 64 nt, Homo Sapiens
caacacagugagaccccuucucaaaaaaaaaaaaaaaaaagagagagugugugauuagaagcua

SEQ ID NO: 526233 - RNA, 64 nt, Homo Sapiens
uaggaaaguuuugagcuucaagucagugaggaguaaaaaagauuuuuaaaaagcaaagaaaaca

SEQ ID NO: 526234 - RNA, 64 nt, Homo Sapiens
aaaggaaacaaacagacaacaaaaagaagaaaaaaaaaaagaaccuccuuggaaaaauuaauug

SEQ ID NO: 526235 - RNA, 64 nt, Homo Sapiens
cccacuaugcccucauuuuuuuaaaaaaggaaaaaaaaaagaaacuggguuccagucuuaauuc

SEQ ID NO: 526236 - RNA, 64 nt, Homo Sapiens
uaaauaaaaauaaaaaaaauaaaaaaggaaaaaaaaaaaagaagaaacaagacaugccaccuuu

SEQ ID NO: 526237 - RNA, 64 nt, Homo Sapiens
aaaaaaauccaaaagagagaaaaaaaaaaaaaagaaaaaagaaaaagccaaaaaaaaaaaaaaa

SEQ ID NO: 526238 - RNA, 64 nt, Homo Sapiens
aaagaaaaaaaaaauccaaaaaaaaaaaaaaaaaaaaaaagaaaccuuuaaaagccaaaaaaaa

SEQ ID NO: 526239 - RNA, 64 nt, Homo Sapiens
aaucucugucaccucagccagaguccaacucauuaaaaaagaagccaggcaccauguuuucuuu

SEQ ID NO: 526240 - RNA, 64 nt, Homo Sapiens
guauuuaucguagcauuaguauauauauauuaaaaaaaaagacauuauauauauauauauaaaa

SEQ ID NO: 526241 - RNA, 64 nt, Homo Sapiens
uacaagaguauaauaccuucaaaaaaaaaaagaaaaaaaagaagaggagugaaacuccgucuca

SEQ ID NO: 526242 - RNA, 64 nt, Homo Sapiens
aaaaagaaguacaagaguauuccgucucaaaaaaaaaaaagaaacuggacaacaggagugaaac

SEQ ID NO: 526243 - RNA, 64 nt, Homo Sapiens
gggagucaauauguaguggaaagaagcauguagcaaaaaagacaaccuugaucuuuaauaaaaa

SEQ ID NO: 526244 - RNA, 64 nt, Homo Sapiens
gcauguagcaaaaaagacaaccuugaucuuuaauaaaaaagaaguugguuuauuuccaaaauaa

SEQ ID NO: 526245 - RNA, 64 nt, Homo Sapiens
cagaaaaaaaaagcauuaaaauuuauuugaaaccaaaaaagagcccaaaaagccaaagcaaucc

SEQ ID NO: 526246 - RNA, 64 nt, Homo Sapiens
ugggcaaccaagcgagacucugccuuaaaaaaaaaaaaaagaaaauguggcacauauacaccau

SEQ ID NO: 526247 - RNA, 64 nt, Homo Sapiens
ggcacauauacaccauggaauacuaugcagccauaaaaaagaaugggaucauguccugugcagc

SEQ ID NO: 526248 - RNA, 64 nt, Homo Sapiens
ugguuugcccaaggacuacaaauaaaccaacgggaaaaaagaaagguuccaguuuugucugaaa

SEQ ID NO: 526249 - RNA, 64 nt, Homo Sapiens
cuggcccaacuugggaguggggaaauugcuuaaaaaaaaagaaaaagaaaaaaaaaaagauuau

SEQ ID NO: 526250 - RNA, 64 nt, Homo Sapiens
ggggaaauugcuuaaaaaaaaagaaaaagaaaaaaaaaaagauuauucuaaauaaaaggaaaaa

SEQ ID NO: 526251 - RNA, 64 nt, Homo Sapiens
gccugggcgacagagugagacuccgucucaaaaaaaaaaagaagguuguacccacaguauacgu

SEQ ID NO: 526252 - RNA, 64 nt, Homo Sapiens
cagggagacuccaucucaaaaaaaaaaaaaaaaaaaaaaagacauucaacuugaggcuccuguu

SEQ ID NO: 526253 - RNA, 64 nt, Homo Sapiens
uuuuguuuuuuugcagcuugcugauauuuuauauaaaaaagaaaagcaaagcaaaagagaagcu

SEQ ID NO: 526254 - RNA, 64 nt, Homo Sapiens
ucuaaaaauaugggagcugagauuccguucguggaaaaaagacaaggccacccucucgcccuca

SEQ ID NO: 526255 - RNA, 64 nt, Homo Sapiens
uguggcagaagcgagaaaacuuuguuuauugaaaaaaaaagaaaaagaaagcaagaaaaaaaga

SEQ ID NO: 526256 - RNA, 64 nt, Homo Sapiens
uguuuauugaaaaaaaaagaaaaagaaagcaagaaaaaaagauacuauggggucaaguguaacu

SEQ ID NO: 526257 - RNA, 64 nt, Homo Sapiens
cagaaaacuuuugacuguauuuauuuauuguugcaaaaaagacgcuuuuuuauugcugcccuca

SEQ ID NO: 526258 - RNA, 64 nt, Homo Sapiens
cugcuguggcuagagaguuugaggauugcuuuuuaaaaaagacagcaaacuuuuuuuuuuauuu

SEQ ID NO: 526259 - RNA, 64 nt, Homo Sapiens
uuuaaaaaagacagcaaacuuuuuuuuuuauuuaaaaaaagauauauuaacaguuuuagaaguc

SEQ ID NO: 526260 - RNA, 64 nt, Homo Sapiens
agaaaaagaaaaaucuuaaaaaaaaaaaaaaaaaaaaaaagaaaaaaagaaaaacaggaaaaag

SEQ ID NO: 526261 - RNA, 64 nt, Homo Sapiens
aaaaaucuuaaaaaaaaaaaaaaaaaaaaaaagaaaaaaagaaaaacaggaaaaaggacuuuuu

SEQ ID NO: 526262 - RNA, 64 nt, Homo Sapiens
ggaaaaagaaaugcuuacaugaaaaaaaaaaaaaaaaaaagaaccagagugagacccugucucc

SEQ ID NO: 526263 - RNA, 64 nt, Homo Sapiens
gcagauccucauggcuauagccgucucaaaaaaaaaaaaagaaacugggugacagagcgagacu

SEQ ID NO: 526264 - RNA, 64 nt, Homo Sapiens
aaaaaaaaaaagccaagccgaaaacuuaguuuaaaaaaaagacaaguuaucagacauuauuuau

SEQ ID NO: 526265 - RNA, 64 nt, Homo Sapiens
aaaaaucccuuucuuguaaaaaaaaaaaaagaaaaaaaaagaaauaauagaaacuuugcuaguu

SEQ ID NO: 526266 - RNA, 64 nt, Homo Sapiens
aaaaaagaaaaaaaaucccuuuugcuaguuaaaaaaaaaagaaagaagaaaguauaauagaaac

SEQ ID NO: 526267 - RNA, 64 nt, Homo Sapiens
ugcagaguauuuauaaaacuuuuaaaaguuaaagaaaaaagagcguuauuaaauuaauuauaug

SEQ ID NO: 526268 - RNA, 64 nt, Homo Sapiens
uacaacacuggugacagucauaugguuuugaaaaaaaaaagaaauuuugcuucuucccagcuuu

SEQ ID NO: 526269 - RNA, 64 nt, Homo Sapiens
uaacagauugcuagacaagagaaaaaacuugaagaaaaaagaagcuuaauuucaugcuucauaa

SEQ ID NO: 526270 - RNA, 64 nt, Homo Sapiens
aggcugauuuugaagagaguuuugcucauuaagaaaaaaagacaaggcugaugaugguauaaag

SEQ ID NO: 526271 - RNA, 64 nt, Homo Sapiens
agcuaaaauuuucgacuugaaaaaaaaaaaggaaaaaaaagacccuguaauauuuuuguaaaaa

SEQ ID NO: 526272 - RNA, 64 nt, Homo Sapiens
uguaccuguuggcaggagaaaaaaaaaaaaaagaaaaaaagaaaagcgagacuccgccucaaaa

SEQ ID NO: 526273 - RNA, 64 nt, Homo Sapiens
aaaagaaauguaccuguuggccucaaaaaaaaaaaaaaaagaaaggcgacagagcgagacuccg

SEQ ID NO: 526274 - RNA, 64 nt, Homo Sapiens
aaagcucagugugaaugcaaagaccuuaauaggaaaaaaagagugaucauuaccuguaaaugaa

SEQ ID NO: 526275 - RNA, 64 nt, Homo Sapiens
ucagccaguuaccuucuccacacauccgguguaaaaaaaagagauagcauguccagugacaagu

SEQ ID NO: 526276 - RNA, 64 nt, Homo Sapiens
ccucaaagacucuuguccucuugucccuccugagaaaaaagaaaacgaaaagugggguuuuuuu

SEQ ID NO: 526277 - RNA, 64 nt, Homo Sapiens
gaauuuuaauuguaacauuuuuagaaaaagaacaaaaaaagaaaaaaaaaagaaagaaacacag

SEQ ID NO: 526278 - RNA, 64 nt, Homo Sapiens
guaacauuuuuagaaaaagaacaaaaaaagaaaaaaaaaagaaagaaacacagcaacuguagau

SEQ ID NO: 526279 - RNA, 64 nt, Homo Sapiens
ccgggaagggaccuugcagggaccucucccuccaaaaaaagaaaaaaagaaaaagaaagaaaaa

SEQ ID NO: 526280 - RNA, 64 nt, Homo Sapiens
ggaccuugcagggaccucucccuccaaaaaaagaaaaaaagaaaaagaaagaaaaaauaaauga

SEQ ID NO: 526281 - RNA, 64 nt, Homo Sapiens
agaccuugucucaaaaauaaacaaacuaaaauuaaaaaaagaagacgagagauagugggugugg

SEQ ID NO: 526282 - RNA, 64 nt, Homo Sapiens
uccagccugggcgaaagagcgacucugucuccaaaaaaaagagaagaggagaggacacagagac

SEQ ID NO: 526283 - RNA, 64 nt, Homo Sapiens
gaggaagaucuacgaagcaaauggaaaacaaacaaaaaaagaggcagggguugcaauccuaguc

SEQ ID NO: 526284 - RNA, 64 nt, Homo Sapiens
cuuccuguuaccaaagcugggcagagacaaaaccaaaaaagagaauuuuagaccaauauccuug

SEQ ID NO: 526285 - RNA, 64 nt, Homo Sapiens
uugaaaaacacuacuuuaaaguucauauggaaccaaaaaagagcccacauugccaagucaaucc

SEQ ID NO: 526286 - RNA, 64 nt, Homo Sapiens
aucauucuaauaccaaaaccugacaggcacaaugaaaaaagaaaacuucaggcugguacuccug

SEQ ID NO: 526287 - RNA, 64 nt, Homo Sapiens
gcuacagcaacuaaaacagcaugguacugguauaaaaaaagacacauagaucaauggaauaggu

SEQ ID NO: 526288 - RNA, 64 nt, Homo Sapiens
gguacauauacaccauggaauacuaugcagccauaaaaaagaacaagacuguguccuuuacagc

SEQ ID NO: 526289 - RNA, 64 nt, Homo Sapiens
aaacaaaagacaaaaaaaaaaaaaaaaaaaaaaaaaaaaagacaggaggugauaaaaaacugua

SEQ ID NO: 526290 - RNA, 64 nt, Homo Sapiens
uaaacuggcaccaguuaacuaaaaaaggaaaaaaaaaaaagacacacagaagagauuuaaaaaa

SEQ ID NO: 526291 - RNA, 64 nt, Homo Sapiens
acacacagaagagauuuaaaaaaaaaaagcaacaaaaaaagaaaaaaaacacaaacagaagagg

SEQ ID NO: 526292 - RNA, 64 nt, Homo Sapiens
aaaaucaaaaaagcgacaaacugcugcaaggaacaaaaaagaaaauuaaacgucuguggagcuu

SEQ ID NO: 526293 - RNA, 64 nt, Homo Sapiens
auauuuuggcagguuauguuaaaagacaaaaaaaaaaaaagaaauugaaaaaaaaaaacacaaa

SEQ ID NO: 526294 - RNA, 64 nt, Homo Sapiens
aaaaaaaaaaaagaaaauauaaaaaaaaaacacaaaaaaagacacuggggauucuugaacuuga

SEQ ID NO: 526295 - RNA, 64 nt, Homo Sapiens
agaaaaaaaaucucaucacuaagacaaaaaaaaaaaaaaagaaagaaauggaaaagaaaaaaaa

SEQ ID NO: 526296 - RNA, 64 nt, Homo Sapiens
aaaaaaaaaaaaaagaaaagaauggaaaagaaaaaaaaaagacaugcuguaaauauuucaacga

SEQ ID NO: 526297 - RNA, 64 nt, Homo Sapiens
uuguacuguauuuccuaaacaaagaacaaaaaaaaaaaaagaaccuauuugaaaagguuaaaaa

SEQ ID NO: 526298 - RNA, 64 nt, Homo Sapiens
aaaaaaaaaaaaagaacuuguuugaaaagguuaaaaaaaagaacugcucaaaggguuaagucua

SEQ ID NO: 526299 - RNA, 64 nt, Homo Sapiens
cgacucucagaagccuguuuucuggaaaaaaaagaaaaaagauaaaaguuuuguuuuguuuuuu

SEQ ID NO: 526300 - RNA, 64 nt, Homo Sapiens
aaagauacgacucucagaagguuuuuuucuggaaaaaaaagaaauggcaaaaaaguuuuguuuu

SEQ ID NO: 526301 - RNA, 64 nt, Homo Sapiens
guaaaacugaucaaaagcauaauugaaaguucugaaaaaagaaaaauaauaauauguagaaaaa

SEQ ID NO: 526302 - RNA, 64 nt, Homo Sapiens
auuggacguugugacucuugccuuuuaagaagaaaaaaaagauaggacaaaguauuugaagcuc

SEQ ID NO: 526303 - RNA, 64 nt, Homo Sapiens
uagagacuucuaaaucauaaucauccuuuuuuaaaaaaaagaauuuuaaaaaagauggauuuga

SEQ ID NO: 526304 - RNA, 64 nt, Homo Sapiens
aucauaaucauccuuuuuuaaaaaaaagaauuuuaaaaaagauggauuugacacacucaccauu

SEQ ID NO: 526305 - RNA, 64 nt, Homo Sapiens
uauaucccuugugcgauaaaaaaaaaaaaaaaaaaaaaaagagaaucguacgucgacuuucgau

SEQ ID NO: 526306 - RNA, 64 nt, Homo Sapiens
uccagccugggcaacauagcgagaccucaucuccaaaaaagaaaacaaaaaacaaaaaaaggaa

SEQ ID NO: 526307 - RNA, 64 nt, Homo Sapiens
gaaaaauuuaugcacugauuuaaaacaaaccaaaaaaaaagaaaaaaacaaaaaaaaaaauccc

SEQ ID NO: 526308 - RNA, 64 nt, Homo Sapiens
gcaagcacacccgugguugugaaaauaguauagcaaaaaagaaaaauccccgguuauugaugua

SEQ ID NO: 526309 - RNA, 64 nt, Homo Sapiens
aaccuuaucuuugcuuugugaucaugaacucugaaaaaaagagaagaacacagaaagucuuagg

SEQ ID NO: 526310 - RNA, 64 nt, Homo Sapiens
guuuugguauuggagaagggccaaccccaacaacaaaaaagaauaaaaaaaaaaaaaaaagcaa

SEQ ID NO: 526311 - RNA, 64 nt, Homo Sapiens
aagaaaaacgauuuaaaaaaacuuauuaaaaaaaaaaaaagaaauuauauuuguauuaacuuua

SEQ ID NO: 526312 - RNA, 64 nt, Homo Sapiens
aaaaaaaaccacguuucuuugcaaaaaaaaaaagaaaaaagaaaugcacaagcuaagagagcuu

SEQ ID NO: 526313 - RNA, 64 nt, Homo Sapiens
aaagaaaaaaaaaaaccacgagagcuugcaaaaaaaaaaagaaagucugaaugcacaagcuaag

SEQ ID NO: 526314 - RNA, 64 nt, Homo Sapiens
ucacaaacuuaagaggaaauaaggaaaaggagagaaaaaagaaauugguuaugaauaaaaguga

SEQ ID NO: 526315 - RNA, 64 nt, Homo Sapiens
ggaagggauuccugauuuuacuaaaaaaaaaaaaaaaaaagagagggcggggacaaauaucaaa

SEQ ID NO: 526316 - RNA, 64 nt, Homo Sapiens
cuacugggaauauuuuuguagagcugcauugugaaaaaaagauggucuuaccugaaucuuaggg

SEQ ID NO: 526317 - RNA, 64 nt, Homo Sapiens
caugauuuucaaguuguaaugcagauggacagauaaaaaagauuuuacguuugucuuuuggcca

SEQ ID NO: 526318 - RNA, 64 nt, Homo Sapiens
aggguagauguaguugcuuaguagcauuuuggaaaaaaaagaaaaaaagguuugguuugguuuu

SEQ ID NO: 526319 - RNA, 64 nt, Homo Sapiens
aagagcgaaacuccgucucaaaaaaaaaaaaaaaaaaaaagaaagaaaagaguaacagaaagau

SEQ ID NO: 526320 - RNA, 64 nt, Homo Sapiens
aagaacuguugguuauuugugaaaugaaugugcaaaaaaagaaaucacuuuuuuuguucuaggg

SEQ ID NO: 526321 - RNA, 64 nt, Homo Sapiens
gaguaaugugaucgcuugguugaagaaggcuagaaaaaaagaaucaaaguuaaauguaucacau

SEQ ID NO: 526322 - RNA, 64 nt, Homo Sapiens
agguugucugccuuuauuucugucuaagcgaaauaaaaaagaaaaugagacacucuuugcauuu

SEQ ID NO: 526323 - RNA, 64 nt, Homo Sapiens
aaauacugaaaccacagacaaauauauuaaaaaaaaaaaagagauaauuaaagaaaauugccaa

SEQ ID NO: 526324 - RNA, 64 nt, Homo Sapiens
cagauaucauguaggaaagagaggauaaacaaagaaaaaagaaaaaaaaauaagcucauaccca

SEQ ID NO: 526325 - RNA, 64 nt, Homo Sapiens
auuuugaaugaguauggaaccuccaugggcucagaaaaaagaugcuaauauauuuaucucauug

SEQ ID NO: 526326 - RNA, 64 nt, Homo Sapiens
aaaauauaagaggaacaaagcaaguaaauuuuaaaaaaaagaacaaaaaagagaaaaaacauaa

SEQ ID NO: 526327 - RNA, 64 nt, Homo Sapiens
aaaaacauaacaaguaaauuaacacacacacacaaaaaaagagaaaaaaaacaaaaaacaaaaa

SEQ ID NO: 526328 - RNA, 64 nt, Homo Sapiens
agaaauaaaaccuuuucuccaacaaacuuuaaaaaaaaaagaggaaacauauuuuuucaggaaa

SEQ ID NO: 526329 - RNA, 64 nt, Homo Sapiens
cagcccaggcacggaaugggacucuuacuucuagaaaaaagaucaaaagauuuucgaucuucuc

SEQ ID NO: 526330 - RNA, 64 nt, Homo Sapiens
aaaagaaaaauguacaaaaaaaaggaaaggccaaaaaaaagaggcccaagaccacagaaaagag

SEQ ID NO: 526331 - RNA, 64 nt, Homo Sapiens
ugcaauaaccagcauaauaaaaaggcaaucacauaaaaaagaguuuagucgucuaaacauaagu

SEQ ID NO: 526332 - RNA, 64 nt, Homo Sapiens
cguuaauuuugcuucucuuucuaaaaaaaaaaaaaaaaaagaaagagaagaaagaagugauucc

SEQ ID NO: 526333 - RNA, 64 nt, Homo Sapiens
uuggaucugcggaaguaaccacaaaauauuaucgaaaaaagaaaagaauucuaaugaccagccg

SEQ ID NO: 526334 - RNA, 64 nt, Homo Sapiens
uuuucuguuuuuuaaccuuuuguuccgccauuuaaaaaaagaaaaaaaaaaagcuuauguuucu

SEQ ID NO: 526335 - RNA, 64 nt, Homo Sapiens
gucauggggguggguuuccuggcaccuacaugaaaaaaaagacaaguuauaugggugaugaaga

SEQ ID NO: 526336 - RNA, 64 nt, Homo Sapiens
guuugaauucuggcuacauguuuuaaguaagaaaaaaaaagacguauuuuugcuuacucagaua

SEQ ID NO: 526337 - RNA, 64 nt, Homo Sapiens
ucugucuuuuaauaaaagaacuuuacacauuuguaaaaaagagguucuugguaagauauaaaau

SEQ ID NO: 526338 - RNA, 64 nt, Homo Sapiens
cacauuauuauugcuagaauaauaaaaguuuuauaaaaaagaagcaacaagcagcacguauuag

SEQ ID NO: 526339 - RNA, 64 nt, Homo Sapiens
uuuucacuugcauugucauuagauguccagaaaaaaaaaagaugucaaaauguuuuucuaaaaa

SEQ ID NO: 526340 - RNA, 64 nt, Homo Sapiens
ccagaaaaaaaaaagaugucaaaauguuuuucuaaaaaaagaaagcaaaaaaagcaaggcaaaa

SEQ ID NO: 526341 - RNA, 64 nt, Homo Sapiens
uuaaaacagugaaauuacagcaucucuauauaaaaaaaaagaugugggcagcauagcgagaccc

SEQ ID NO: 526342 - RNA, 64 nt, Homo Sapiens
gcaauggcuuugugcuuuugaaaaaaaaaaaaaaaaaaaagaagacagagugagacccugucca

SEQ ID NO: 526343 - RNA, 64 nt, Homo Sapiens
aaaaaugagaaaaaaguaagucuauaaaaaagagaaaaaagaaagagaaaaaauauacuugcua

SEQ ID NO: 526344 - RNA, 64 nt, Homo Sapiens
aaaaagaaaaaaaaugagaauacuugcuaucuauaaaaaagagagaguucuaugagaaaaaaua

SEQ ID NO: 526345 - RNA, 64 nt, Homo Sapiens
aguguuuuuagaaaugcguaagagugaccucuagaaaaaagaaauagugauauaucaguguuug

SEQ ID NO: 526346 - RNA, 64 nt, Homo Sapiens
aaagcuugccuuugguggggucagggcccugccaaaaaaagaagaggaagaguugcuucccauu

SEQ ID NO: 526347 - RNA, 64 nt, Homo Sapiens
aauguauauagcugugaguuuuaagagacuuuguaaaaaagaaauuugccagccugaacuauau

SEQ ID NO: 526348 - RNA, 64 nt, Homo Sapiens
aaaaauuauuaaauguuucuuccuucauuuucuuaaaaaagaaagccuuuuccucaaguuacuu

SEQ ID NO: 526349 - RNA, 64 nt, Homo Sapiens
aaaagccaugauguacccucaagcuuaagcaucgaaaaaagaaagagucaaggucaguucagga

SEQ ID NO: 526350 - RNA, 64 nt, Homo Sapiens
uagcugugagcucaaacaaaaacugcagacaaacaaaaaagagaaaagcuuuuauuuguguuuu

SEQ ID NO: 526351 - RNA, 64 nt, Homo Sapiens
ugggaagaguugcuuccuauuucaggacccugccaaaaaagaagaaagcuugccuuuggugggg

SEQ ID NO: 526352 - RNA, 64 nt, Homo Sapiens
uagugauauaucaguguuugggagugaccucuagaaaaaagaaaacuguuuuuagaaauacaua

SEQ ID NO: 526353 - RNA, 64 nt, Homo Sapiens; identical to SEQ ID NO: 313156

SEQ ID NO: 526354 - RNA, 64 nt, Homo Sapiens; identical to SEQ ID NO: 313157

SEQ ID NO: 526355 - RNA, 64 nt, Homo Sapiens; identical to SEQ ID NO: 313158

SEQ ID NO: 526356 - RNA, 64 nt, Homo Sapiens; identical to SEQ ID NO: 313159

SEQ ID NO: 526357 - RNA, 64 nt, Homo Sapiens
ucuucuucuuuuuuuuuuucugaaaaaaggaaaaagcacacagcacacaauuucaagccauuuu

SEQ ID NO: 526358 - RNA, 64 nt, Homo Sapiens
cuuuuuuuuuuucugaaaaaaggaaaaagcacacagcacacaauuucaagccauuuucagauca

SEQ ID NO: 526359 - RNA, 64 nt, Homo Sapiens
ggaugcagagaaucagacuggccugaggugaaggagcacacagcccugagggcuuggaacccug

SEQ ID NO: 526360 - RNA, 64 nt, Homo Sapiens
aucccaucugugcuuaaccagaauccagcaagucagcacacaagugauuuuauuguuauuuugu

SEQ ID NO: 526361 - RNA, 64 nt, Homo Sapiens
ggcucaagcagcagagguaagaagcagagagcagagcacacacuagaaggauggcggggcuagg

SEQ ID NO: 526362 - RNA, 64 nt, Homo Sapiens
gcugcccgucuugggaucacugugaggggcgaacagcacacaagaugagaugcugcuccaagcc

SEQ ID NO: 526363 - RNA, 64 nt, Homo Sapiens
ugcagcuguccagccacugcccuuuaacaugcccagcacacaugggaggccuguggcccugugu

SEQ ID NO: 526364 - RNA, 64 nt, Homo Sapiens
acaguaugaacccugcuugauguaaaauggaaauagcacacaggcagauggcccuggguuugga

SEQ ID NO: 526365 - RNA, 64 nt, Homo Sapiens
aagucaaggaacccagggccagcuggaaguguggagcacacaugcuguggagcacacaugcugu

SEQ ID NO: 526366 - RNA, 64 nt, Homo Sapiens
ggccagcuggaaguguggagcacacaugcuguggagcacacaugcuguggagauugcagugugu

SEQ ID NO: 526367 - RNA, 64 nt, Homo Sapiens
cacacacacacacgaacacacacacacacacacgagcacacacacguaaagccucaaaacacag

SEQ ID NO: 526368 - RNA, 64 nt, Homo Sapiens
cacacgagcacacacacacaaagccucaaaacacagcacacacagugccuucaaagcccacgua

SEQ ID NO: 526369 - RNA, 64 nt, Homo Sapiens
agggacuuuuguuuacucuauuuucauuugcucaagcacacaaaguguguuuuucuccucuugg

SEQ ID NO: 526370 - RNA, 64 nt, Homo Sapiens
ugcagugcacacaaagaaaucaagccaugugcacagcacacacgagacaccugggaggagucuc

SEQ ID NO: 526371 - RNA, 64 nt, Homo Sapiens
auuccaucagcccugaaggaacaacuguguccugagcacacaagacagacagcuuggucacaac

SEQ ID NO: 526372 - RNA, 64 nt, Homo Sapiens
cacacacacacacacacacacccuccaauuuaaaagcacacacauuuaacaauccugacaugcu

SEQ ID NO: 526373 - RNA, 64 nt, Homo Sapiens
gugaauggcagacuuuucauauuuucucucaggaagcacacacucagcccccuguauucucaug

SEQ ID NO: 526374 - RNA, 64 nt, Homo Sapiens
uugcuauaaacuguuacuuuuuuguuuuaucaccagcacacagaaauaaugaguaggaucuugu

SEQ ID NO: 526375 - RNA, 64 nt, Homo Sapiens
uuuucugauaauuagcugauauucaugguuguuuagcacacaguucaggaccuuugagaucaug

SEQ ID NO: 526376 - RNA, 64 nt, Homo Sapiens
aaugccuccuuuguuacacacucaagaauuugucagcacacaauuaauugcagccauaguaccu

SEQ ID NO: 526377 - RNA, 64 nt, Homo Sapiens
aacugaagggccugcucuuuccauuguggaucacagcacacacauacauacacccuccaccucc

SEQ ID NO: 526378 - RNA, 64 nt, Homo Sapiens
uuuagggccccuuagcagggugagcuguuaaaacagcacacaucucucauccccucuuccuuua

SEQ ID NO: 526379 - RNA, 64 nt, Homo Sapiens
uaccauuucauuuuuuggcacuaggucauuaaguagcacacagucugaaugcccuuuucuggag

SEQ ID NO: 526380 - RNA, 64 nt, Homo Sapiens
gaccggcaagcuggcuguguacaggaaaauuggaagcacacaguggacugugccucuuaaagau

SEQ ID NO: 526381 - RNA, 64 nt, Homo Sapiens
auuuuauccaaugcaaacaaauauaugguaaacaagcacacacaauauauauauauauauauau

SEQ ID NO: 526382 - RNA, 64 nt, Homo Sapiens
cgcacacacacuugcauucagaccucucuauguaagcacacaugacaguguuccucuacgaccc

SEQ ID NO: 526383 - RNA, 64 nt, Homo Sapiens
gaugaaggcaaaaacuguacuguguuucgcauuaagcacacacaucuggcccugacuucuggag

SEQ ID NO: 526384 - RNA, 64 nt, Homo Sapiens
ggcgcaaaggugccucauagcauagccagcauucagcacacacaaaccuacugcccacauuugg

SEQ ID NO: 526385 - RNA, 64 nt, Homo Sapiens
agugcacagagcacacugcaugcacagaccacacagcacacacaacacagcacaugcacacagg

SEQ ID NO: 526386 - RNA, 64 nt, Homo Sapiens
ugcacugaccacaccuguaucacacagaccacauagcacacaugcaugcacgcuugcacacaug

SEQ ID NO: 526387 - RNA, 64 nt, Homo Sapiens
ucaaggaacuguguguuuccaacaucaugguagcagcacacacuuccaaagcucagccagggac

SEQ ID NO: 526388 - RNA, 64 nt, Homo Sapiens
uauauaaauaugugaaauauuaugaucugaacuuagcacacaugaagcaacauuucuuugcuac

SEQ ID NO: 526389 - RNA, 64 nt, Homo Sapiens; identical to SEQ ID NO: 221340

SEQ ID NO: 526390 - RNA, 64 nt, Homo Sapiens; identical to SEQ ID NO: 221341

SEQ ID NO: 526391 - RNA, 64 nt, Homo Sapiens; identical to SEQ ID NO: 221342

SEQ ID NO: 526392 - RNA, 64 nt, Homo Sapiens; identical to SEQ ID NO: 221343

SEQ ID NO: 526393 - RNA, 64 nt, Homo Sapiens; identical to SEQ ID NO: 221344

SEQ ID NO: 526394 - RNA, 64 nt, Homo Sapiens; identical to SEQ ID NO: 221345

SEQ ID NO: 526395 - RNA, 64 nt, Homo Sapiens; identical to SEQ ID NO: 221346

SEQ ID NO: 526396 - RNA, 64 nt, Homo Sapiens; identical to SEQ ID NO: 221347

SEQ ID NO: 526397 - RNA, 64 nt, Homo Sapiens; identical to SEQ ID NO: 221348

SEQ ID NO: 526398 - RNA, 64 nt, Homo Sapiens; identical to SEQ ID NO: 221349

SEQ ID NO: 526399 - RNA, 64 nt, Homo Sapiens; identical to SEQ ID NO: 221350

SEQ ID NO: 526400 - RNA, 64 nt, Homo Sapiens; identical to SEQ ID NO: 221351

SEQ ID NO: 526401 - RNA, 64 nt, Homo Sapiens; identical to SEQ ID NO: 221352

SEQ ID NO: 526402 - RNA, 64 nt, Homo Sapiens; identical to SEQ ID NO: 221353

SEQ ID NO: 526403 - RNA, 64 nt, Homo Sapiens; identical to SEQ ID NO: 221354

SEQ ID NO: 526404 - RNA, 64 nt, Homo Sapiens; identical to SEQ ID NO: 221355

SEQ ID NO: 526405 - RNA, 64 nt, Homo Sapiens; identical to SEQ ID NO: 221356

SEQ ID NO: 526406 - RNA, 64 nt, Homo Sapiens; identical to SEQ ID NO: 221357

SEQ ID NO: 526407 - RNA, 64 nt, Homo Sapiens; identical to SEQ ID NO: 221358

SEQ ID NO: 526408 - RNA, 64 nt, Homo Sapiens; identical to SEQ ID NO: 221359

SEQ ID NO: 526409 - RNA, 64 nt, Homo Sapiens; identical to SEQ ID NO: 221360

SEQ ID NO: 526410 - RNA, 64 nt, Homo Sapiens; identical to SEQ ID NO: 221361

SEQ ID NO: 526411 - RNA, 64 nt, Homo Sapiens; identical to SEQ ID NO: 221362

SEQ ID NO: 526412 - RNA, 64 nt, Homo Sapiens; identical to SEQ ID NO: 221363

SEQ ID NO: 526413 - RNA, 64 nt, Homo Sapiens; identical to SEQ ID NO: 221364

SEQ ID NO: 526414 - RNA, 64 nt, Homo Sapiens; identical to SEQ ID NO: 221365

SEQ ID NO: 526415 - RNA, 64 nt, Homo Sapiens; identical to SEQ ID NO: 221366

SEQ ID NO: 526416 - RNA, 64 nt, Homo Sapiens; identical to SEQ ID NO: 221367

SEQ ID NO: 526417 - RNA, 64 nt, Homo Sapiens; identical to SEQ ID NO: 221368

SEQ ID NO: 526418 - RNA, 64 nt, Homo Sapiens; identical to SEQ ID NO: 221369

SEQ ID NO: 526419 - RNA, 64 nt, Homo Sapiens; identical to SEQ ID NO: 221370

SEQ ID NO: 526420 - RNA, 64 nt, Homo Sapiens; identical to SEQ ID NO: 221371

SEQ ID NO: 526421 - RNA, 64 nt, Homo Sapiens; identical to SEQ ID NO: 221372

SEQ ID NO: 526422 - RNA, 64 nt, Homo Sapiens; identical to SEQ ID NO: 221373

SEQ ID NO: 526423 - RNA, 64 nt, Homo Sapiens; identical to SEQ ID NO: 221374

SEQ ID NO: 526424 - RNA, 64 nt, Homo Sapiens; identical to SEQ ID NO: 221375

SEQ ID NO: 526425 - RNA, 64 nt, Homo Sapiens; identical to SEQ ID NO: 221376

SEQ ID NO: 526426 - RNA, 64 nt, Homo Sapiens; identical to SEQ ID NO: 221377

SEQ ID NO: 526427 - RNA, 64 nt, Homo Sapiens; identical to SEQ ID NO: 221378

SEQ ID NO: 526428 - RNA, 64 nt, Homo Sapiens; identical to SEQ ID NO: 221379

SEQ ID NO: 526429 - RNA, 64 nt, Homo Sapiens; identical to SEQ ID NO: 221380

SEQ ID NO: 526430 - RNA, 64 nt, Homo Sapiens; identical to SEQ ID NO: 221381

SEQ ID NO: 526431 - RNA, 64 nt, Homo Sapiens; identical to SEQ ID NO: 221382

SEQ ID NO: 526432 - RNA, 64 nt, Homo Sapiens; identical to SEQ ID NO: 221383

SEQ ID NO: 526433 - RNA, 64 nt, Homo Sapiens; identical to SEQ ID NO: 221384

SEQ ID NO: 526434 - RNA, 64 nt, Homo Sapiens; identical to SEQ ID NO: 221385

SEQ ID NO: 526435 - RNA, 64 nt, Homo Sapiens; identical to SEQ ID NO: 221386

SEQ ID NO: 526436 - RNA, 64 nt, Homo Sapiens; identical to SEQ ID NO: 221387

SEQ ID NO: 526437 - RNA, 64 nt, Homo Sapiens; identical to SEQ ID NO: 257800

SEQ ID NO: 526438 - RNA, 64 nt, Homo Sapiens; identical to SEQ ID NO: 257801

SEQ ID NO: 526439 - RNA, 64 nt, Homo Sapiens; identical to SEQ ID NO: 257802

SEQ ID NO: 526440 - RNA, 64 nt, Homo Sapiens; identical to SEQ ID NO: 257803

SEQ ID NO: 526441 - RNA, 64 nt, Homo Sapiens; identical to SEQ ID NO: 257804

SEQ ID NO: 526442 - RNA, 64 nt, Homo Sapiens; identical to SEQ ID NO: 257805

SEQ ID NO: 526443 - RNA, 64 nt, Homo Sapiens; identical to SEQ ID NO: 257806

SEQ ID NO: 526444 - RNA, 64 nt, Homo Sapiens; identical to SEQ ID NO: 257807

SEQ ID NO: 526445 - RNA, 64 nt, Homo Sapiens; identical to SEQ ID NO: 257808

SEQ ID NO: 526446 - RNA, 64 nt, Homo Sapiens; identical to SEQ ID NO: 257809

SEQ ID NO: 526447 - RNA, 64 nt, Homo Sapiens; identical to SEQ ID NO: 257810

SEQ ID NO: 526448 - RNA, 64 nt, Homo Sapiens; identical to SEQ ID NO: 257811

SEQ ID NO: 526449 - RNA, 64 nt, Homo Sapiens; identical to SEQ ID NO: 257812

SEQ ID NO: 526450 - RNA, 64 nt, Homo Sapiens; identical to SEQ ID NO: 257813

SEQ ID NO: 526451 - RNA, 64 nt, Homo Sapiens; identical to SEQ ID NO: 257814

SEQ ID NO: 526452 - RNA, 64 nt, Homo Sapiens; identical to SEQ ID NO: 257815

SEQ ID NO: 526453 - RNA, 64 nt, Homo Sapiens; identical to SEQ ID NO: 257816

SEQ ID NO: 526454 - RNA, 64 nt, Homo Sapiens; identical to SEQ ID NO: 257817

SEQ ID NO: 526455 - RNA, 64 nt, Homo Sapiens; identical to SEQ ID NO: 257818

SEQ ID NO: 526456 - RNA, 64 nt, Homo Sapiens; identical to SEQ ID NO: 257819

SEQ ID NO: 526457 - RNA, 64 nt, Homo Sapiens; identical to SEQ ID NO: 257820

SEQ ID NO: 526458 - RNA, 64 nt, Homo Sapiens; identical to SEQ ID NO: 257821

SEQ ID NO: 526459 - RNA, 64 nt, Homo Sapiens; identical to SEQ ID NO: 257822

SEQ ID NO: 526460 - RNA, 64 nt, Homo Sapiens; identical to SEQ ID NO: 257823

SEQ ID NO: 526461 - RNA, 64 nt, Homo Sapiens; identical to SEQ ID NO: 257824

SEQ ID NO: 526462 - RNA, 64 nt, Homo Sapiens; identical to SEQ ID NO: 257825

SEQ ID NO: 526463 - RNA, 64 nt, Homo Sapiens; identical to SEQ ID NO: 257826

SEQ ID NO: 526464 - RNA, 64 nt, Homo Sapiens; identical to SEQ ID NO: 257827

SEQ ID NO: 526465 - RNA, 64 nt, Homo Sapiens; identical to SEQ ID NO: 257828

SEQ ID NO: 526466 - RNA, 64 nt, Homo Sapiens; identical to SEQ ID NO: 257829

SEQ ID NO: 526467 - RNA, 64 nt, Homo Sapiens; identical to SEQ ID NO: 257830

SEQ ID NO: 526468 - RNA, 64 nt, Homo Sapiens; identical to SEQ ID NO: 257831

SEQ ID NO: 526469 - RNA, 64 nt, Homo Sapiens; identical to SEQ ID NO: 236246

SEQ ID NO: 526470 - RNA, 64 nt, Homo Sapiens; identical to SEQ ID NO: 236247

SEQ ID NO: 526471 - RNA, 64 nt, Homo Sapiens; identical to SEQ ID NO: 236248

SEQ ID NO: 526472 - RNA, 64 nt, Homo Sapiens; identical to SEQ ID NO: 236249

SEQ ID NO: 526473 - RNA, 64 nt, Homo Sapiens; identical to SEQ ID NO: 236250

SEQ ID NO: 526474 - RNA, 64 nt, Homo Sapiens; identical to SEQ ID NO: 236251

SEQ ID NO: 526475 - RNA, 64 nt, Homo Sapiens; identical to SEQ ID NO: 236252

SEQ ID NO: 526476 - RNA, 64 nt, Homo Sapiens; identical to SEQ ID NO: 236253

SEQ ID NO: 526477 - RNA, 64 nt, Homo Sapiens; identical to SEQ ID NO: 236254

SEQ ID NO: 526478 - RNA, 64 nt, Homo Sapiens; identical to SEQ ID NO: 236255

SEQ ID NO: 526479 - RNA, 64 nt, Homo Sapiens; identical to SEQ ID NO: 236256

SEQ ID NO: 526480 - RNA, 64 nt, Homo Sapiens; identical to SEQ ID NO: 236257

SEQ ID NO: 526481 - RNA, 64 nt, Homo Sapiens; identical to SEQ ID NO: 236258

SEQ ID NO: 526482 - RNA, 64 nt, Homo Sapiens; identical to SEQ ID NO: 236259

SEQ ID NO: 526483 - RNA, 64 nt, Homo Sapiens; identical to SEQ ID NO: 236260

SEQ ID NO: 526484 - RNA, 64 nt, Homo Sapiens; identical to SEQ ID NO: 236261

SEQ ID NO: 526485 - RNA, 64 nt, Homo Sapiens; identical to SEQ ID NO: 68405

SEQ ID NO: 526486 - RNA, 64 nt, Homo Sapiens; identical to SEQ ID NO: 68406

SEQ ID NO: 526487 - RNA, 64 nt, Homo Sapiens; identical to SEQ ID NO: 68407

SEQ ID NO: 526488 - RNA, 64 nt, Homo Sapiens; identical to SEQ ID NO: 68408

SEQ ID NO: 526489 - RNA, 64 nt, Homo Sapiens; identical to SEQ ID NO: 68409

SEQ ID NO: 526490 - RNA, 64 nt, Homo Sapiens; identical to SEQ ID NO: 68410

SEQ ID NO: 526491 - RNA, 64 nt, Homo Sapiens; identical to SEQ ID NO: 68411

SEQ ID NO: 526492 - RNA, 64 nt, Homo Sapiens; identical to SEQ ID NO: 68412

SEQ ID NO: 526493 - RNA, 64 nt, Homo Sapiens; identical to SEQ ID NO: 68413

SEQ ID NO: 526494 - RNA, 64 nt, Homo Sapiens; identical to SEQ ID NO: 68414

SEQ ID NO: 526495 - RNA, 64 nt, Homo Sapiens; identical to SEQ ID NO: 68415

SEQ ID NO: 526496 - RNA, 64 nt, Homo Sapiens; identical to SEQ ID NO: 210233

SEQ ID NO: 526497 - RNA, 64 nt, Homo Sapiens; identical to SEQ ID NO: 210234

SEQ ID NO: 526498 - RNA, 64 nt, Homo Sapiens; identical to SEQ ID NO: 210235

SEQ ID NO: 526499 - RNA, 64 nt, Homo Sapiens; identical to SEQ ID NO: 210236

SEQ ID NO: 526500 - RNA, 64 nt, Homo Sapiens; identical to SEQ ID NO: 210237

SEQ ID NO: 526501 - RNA, 64 nt, Homo Sapiens; identical to SEQ ID NO: 210238

SEQ ID NO: 526502 - RNA, 64 nt, Homo Sapiens; identical to SEQ ID NO: 210239

SEQ ID NO: 526503 - RNA, 64 nt, Homo Sapiens; identical to SEQ ID NO: 210240

SEQ ID NO: 526504 - RNA, 64 nt, Homo Sapiens
gcaaacacacuggaaacaaugaaaguaacaaccaugcuaagaugaaacuuaugagugacaucug

SEQ ID NO: 526505 - RNA, 64 nt, Homo Sapiens
uguugaagcagaaggcggcuuaagagaaaucaaaugcuaagaguacaguagauaacgcuggcag

SEQ ID NO: 526506 - RNA, 64 nt, Homo Sapiens
uguccaaggcggagccggggcuugugugcugcucugcuaagagacuggccgguggucucucauc

SEQ ID NO: 526507 - RNA, 64 nt, Homo Sapiens
cacuugaccagacugcaucuggcuccugaccugcugcuaagaguucggcgacaagguugugcgu

SEQ ID NO: 526508 - RNA, 64 nt, Homo Sapiens
gcccagccgcuaucuuagcugucuuucccagcggugcuaagaguggucucagugagaagguaga

SEQ ID NO: 526509 - RNA, 64 nt, Homo Sapiens
aaguggcauuauuuauguugugcugcuguccagcugcuaagaucccuucaucugcacaagcccu

SEQ ID NO: 526510 - RNA, 64 nt, Homo Sapiens
uugagcacauguagcuaauuuguaaggaggggcuugcuaagaauggugcuucucagugggaagg

SEQ ID NO: 526511 - RNA, 64 nt, Homo Sapiens
agauuuggggaagguuauaauuuuuuccaguuaaugcuaagaaaccuaagcuuuuuuuuuuuuu

SEQ ID NO: 526512 - RNA, 64 nt, Homo Sapiens
uauggcaagugucaaaaauaaaauggauuuacuuugcuaagauuuuugccuuugaaacguuaau

SEQ ID NO: 526513 - RNA, 64 nt, Homo Sapiens
uuuauuuucaccuuguguacaacauggcaaagacugcuaagauuaaaauccgucucccauuugu

SEQ ID NO: 526514 - RNA, 64 nt, Homo Sapiens
uugccugaugcucuuucuaaagucaaaauaugaaugcuaagaaggcauaaccuacauccuucuc

SEQ ID NO: 526515 - RNA, 64 nt, Homo Sapiens
cgagcaggaagaggcauccuaguacaacccaugcugcuaagauguuucucuuuucuguuuauga

SEQ ID NO: 526516 - RNA, 64 nt, Homo Sapiens
cgggagcauggaacguguugguccaccaacuaccugcuaagagccccagcugcuauaaccaagu

SEQ ID NO: 526517 - RNA, 64 nt, Homo Sapiens
ugucuugugaaggaagguuuuaaaacugaugaaaugcuaagacaugugucaauauaaaauauac

SEQ ID NO: 526518 - RNA, 64 nt, Homo Sapiens
aggauuuuucugauauggcauauguauauugaucugcuaagaccaugucgaaugaccaaauaac

SEQ ID NO: 526519 - RNA, 64 nt, Homo Sapiens
uguguguguuuuuuuuccuuuaaagaagaaacgcugcuaagaucccacguggcucccacguguc

SEQ ID NO: 526520 - RNA, 64 nt, Homo Sapiens
ugcagaugcuguacuucagcaauaaccuugccuuugcuaagacccccuccgagggcuucagggg

SEQ ID NO: 526521 - RNA, 64 nt, Homo Sapiens
ccggggaaggcacugguuaggaaggauguucaaacggucccacccaagccugucaccucugcuc

SEQ ID NO: 526522 - RNA, 64 nt, Homo Sapiens
guccgcacuccucagccucucccgggaguuccugcggucccagcggaacucagggagucuauuu

SEQ ID NO: 526523 - RNA, 64 nt, Homo Sapiens
cugugugggucaugaggcuggggcccaggagacacggucccaggcacugcacaggccugcagua

SEQ ID NO: 526524 - RNA, 64 nt, Homo Sapiens
uggggggccaacugaggcccugacccucuucucccggucccaucuucugagagggcuucucagc

SEQ ID NO: 526525 - RNA, 64 nt, Homo Sapiens
gcggcgcuggaaggaguucgcgacgugauggacgcggucccagccagccgggcccgcagcucua

SEQ ID NO: 526526 - RNA, 64 nt, Homo Sapiens
guggucccagcuggugggagcuccaggguggucucggucccagggggcgggaaugggaccugcg

SEQ ID NO: 526527 - RNA, 64 nt, Homo Sapiens
ccaagguaggcuggugucauuuuaacauccuuugcggucccaguuuuuaaauucuaggauagau

SEQ ID NO: 526528 - RNA, 64 nt, Homo Sapiens
agcuguccuugcugcaugccccuggcucuguucacggucccaggccuaagaggugaaagagaag

SEQ ID NO: 526529 - RNA, 64 nt, Homo Sapiens
aacaccuacuaauuccucugagccugacuuccagcggucccaagaguugccgcucagaggcuuc

SEQ ID NO: 526530 - RNA, 64 nt, Homo Sapiens
ucccgccugauuggggccucacccagaaggaacccggucccaggccgcauggccccuccaggaa

SEQ ID NO: 526531 - RNA, 64 nt, Homo Sapiens
ugggaggaaccuuauaccauaaagguccugcagacggucccagcgaugccagccccuccagaga

SEQ ID NO: 526532 - RNA, 64 nt, Homo Sapiens
ggguccucacuguccuucccgccaguuucugaaacggucccacuggggacucccugccaccacu

SEQ ID NO: 526533 - RNA, 64 nt, Homo Sapiens
aaaaucuaacacccaaauuuaaagguuacagaaacggucccaaguuuucuauauugugaagggc

SEQ ID NO: 526534 - RNA, 64 nt, Homo Sapiens
guauugguuggguguugguuagcugugagcgggucggucccacaucuguuggcccauaaccuuc

SEQ ID NO: 526535 - RNA, 64 nt, Homo Sapiens
uacaggguccuagcugggggcuuguaucaugccacggucccaacuguccuggugggcccagguc

SEQ ID NO: 526536 - RNA, 64 nt, Homo Sapiens
gugcggaucucccccuucccucccccacgagaaacggucccacgcucuguggggaagccccgac

SEQ ID NO: 526537 - RNA, 64 nt, Homo Sapiens
uaugagcuauaauaaacuugguugacaccuuaaucggucccaggaucuugaguaauuuuaaaau

SEQ ID NO: 526538 - RNA, 64 nt, Homo Sapiens
guuucucccuccacagggccaaagccauaguguccggucccaaggacaaggcucuuccagugcu

SEQ ID NO: 526539 - RNA, 64 nt, Homo Sapiens
gugagcugacacaggcguucccucucugccauuucggucccaagcucagcuccggggagaaggg

SEQ ID NO: 526540 - RNA, 64 nt, Homo Sapiens
ucucccgcuuaucgccuauucucacaccucuucucggucccaucuucugcacccauugcccagu

SEQ ID NO: 526541 - RNA, 64 nt, Homo Sapiens
aauacaaaaaauaauccauuuaggugcugaguuacggucccaucucuucacaggcauggauucu

SEQ ID NO: 526542 - RNA, 64 nt, Homo Sapiens
gcucuccucccagggcagcccucagccggcgaggcggucccacaacggucggcagguaauggcu

SEQ ID NO: 526543 - RNA, 64 nt, Homo Sapiens
ucagccuucugaugaucccaauugccaacuccagcggucccauggccaaccucacacugcuaug

SEQ ID NO: 526544 - RNA, 64 nt, Homo Sapiens
cugcccuucaggagcucgcagcuggugugcuuggcggucccaggccuguguagugucucucccc

SEQ ID NO: 526545 - RNA, 64 nt, Homo Sapiens
cugcuagggaguggucuuuccuaucauggagugacggucccacacuggugacugcgaucuucag

SEQ ID NO: 526546 - RNA, 64 nt, Homo Sapiens
cauggcccgccuuguggccaccgaggagagcggccggucccagcccuccgcuccagguaccaca

SEQ ID NO: 526547 - RNA, 64 nt, Homo Sapiens
ugcucugauaagaggaggcuguagcaugugccugcggucccagcaauaaaaugaaccgggcaua

SEQ ID NO: 526548 - RNA, 64 nt, Homo Sapiens
agagagcaaggauugagucugagacuuaagcacucggucccagcuugccaguuccugguucugu

SEQ ID NO: 526549 - RNA, 64 nt, Homo Sapiens
ucccuugucccuuccacagaagaaggugccaguccggucccagggacgcucagccucagggcuc

SEQ ID NO: 526550 - RNA, 64 nt, Homo Sapiens
uccuuugucccuuccucagaagagagagccaguccggucccagcgagacuuggucucaaagcuc

SEQ ID NO: 526551 - RNA, 64 nt, Homo Sapiens
ccgccccgcccgccaggggcgggggaggggggcccggucccaccggccccuccucacagcaaua

SEQ ID NO: 526552 - RNA, 51 nt, Homo Sapiens
cagcugcauggcgcuccuaggcggucccagcuggaauuacccaaccccaug

SEQ ID NO: 526553 - RNA, 64 nt, Homo Sapiens
ggccuggauuaggagucuuagaguaccuggaauccggucccaucucuaccaccaacuggcuguu

SEQ ID NO: 526554 - RNA, 64 nt, Homo Sapiens
cugggcuccucugcaucuuguguucaggcagaaccggucccagcccccugcuccgaggggcuca

SEQ ID NO: 526555 - RNA, 64 nt, Homo Sapiens
guguguccccuggcgcucuuauucuggaagguuccggucccacugaaaaccugacugaggagac

SEQ ID NO: 526556 - RNA, 64 nt, Homo Sapiens
gguuauuugggggggcgugagacccagugcacuccggucccaaauguagcagguguaaccguaa

SEQ ID NO: 526557 - RNA, 64 nt, Homo Sapiens
aaggaaacaaaauaagaccgucugacagcaacaacggucccacaaacaagucacaaaagauacc

SEQ ID NO: 526558 - RNA, 64 nt, Homo Sapiens
ugguuaacaaaguucuggcaagagaagauguccacggucccaggggaugagggcucaagacacg

SEQ ID NO: 526559 - RNA, 64 nt, Homo Sapiens
cugcugacuggccccacacuuccugucccuuuaccggucccaggcuaccacccucccugcuccu

SEQ ID NO: 526560 - RNA, 64 nt, Homo Sapiens
ugggagaucaagucggcacuggggaagcaggcagcggucccagagccacccugugguccugaua

SEQ ID NO: 526561 - RNA, 64 nt, Homo Sapiens
agagugcagccccagaauaggcggggcuuggaggcggucccaauguccccuggguccacagugg

SEQ ID NO: 526562 - RNA, 64 nt, Homo Sapiens
ggacagggcacggagggagcgagggagagaggaccggucccagcuuuuggauauuuuggguuau

SEQ ID NO: 526563 - RNA, 64 nt, Homo Sapiens
guccucaggcccuucucuggcugccuccagcucucggucccacagagcuacaagcacuaaagug

SEQ ID NO: 526564 - RNA, 64 nt, Homo Sapiens
guccucaggccccucucuggcgucugcuagcucucggucccacagagcuauaagcacuaaagug

SEQ ID NO: 526565 - RNA, 64 nt, Homo Sapiens
ucuuucccaggcaccugggcuggggguuggggcccggucccaccugucuuccugggagccgagc

SEQ ID NO: 526566 - RNA, 64 nt, Homo Sapiens
acgcagugcuucagagccucgggcucagguggcacggucccaggguccaggcugagggcuggga

SEQ ID NO: 526567 - RNA, 64 nt, Homo Sapiens
ccguugaccccaaagccucagggcuuauguccaacggucccauugggagcaacagugauuguuu

SEQ ID NO: 526568 - RNA, 64 nt, Homo Sapiens
gcaggagcccugagcuuguuuuccugcaauuagacggucccauaugggagugaugggagacagu

SEQ ID NO: 526569 - RNA, 64 nt, Homo Sapiens
uuuaguuguuugguuuucuuuucuuuccccccuccggucccauacuucacagcacucuggugcg

SEQ ID NO: 526570 - RNA, 64 nt, Homo Sapiens
cuauuuugcaagacacuaacacaggaguauaucacggucccagccuugaccuggaucagcucuu

SEQ ID NO: 526571 - RNA, 64 nt, Homo Sapiens
ucccuggcucccaugucaagggggaggggugcggcggucccagcgugaccccaggagggaggca

SEQ ID NO: 526572 - RNA, 64 nt, Homo Sapiens
gggugcgucugcagcuccucccaccagcaggcugcggucccagccuccucgacagggagccugu

SEQ ID NO: 526573 - RNA, 64 nt, Homo Sapiens
ccuguuucauaccaguugcaaagcuuguggggagcggucccacaaagcacuuucuuaaaccuug

SEQ ID NO: 526574 - RNA, 64 nt, Homo Sapiens
uaacuguguaggaauguauauguguguguauauacggucccaguuuuaauuuacuuauuaaaag

SEQ ID NO: 526575 - RNA, 64 nt, Homo Sapiens
gccucgcagcccagguccagagcccccggcgagccggucccauaaccggcccccugccccugcc

SEQ ID NO: 526576 - RNA, 64 nt, Homo Sapiens
ccucccucuguccaccagccccucccaucaugcccggucccaccuuccugggucuucagcauuc

SEQ ID NO: 526577 - RNA, 64 nt, Homo Sapiens
cagcuuccuccccccgacuccccccccagagacacggucccaccauguuacccagccuggucuc

SEQ ID NO: 526578 - RNA, 64 nt, Homo Sapiens
uggucuccaacuccugcccucaagugauccgccucggucccauuuuuuauucuuuggguccuuc

SEQ ID NO: 526579 - RNA, 64 nt, Homo Sapiens
cgcaucuccaacgaccucgagcucugagccaccacggucccagggcccuuacucuuccucuccc

SEQ ID NO: 526580 - RNA, 64 nt, Homo Sapiens
acagccucgccucgcacccuucaucccuggcugccggucccauccuuggagggacuaagcuggg

SEQ ID NO: 526581 - RNA, 64 nt, Homo Sapiens
uagauagaggggggcgcaucgcucucagaagucccggucccaugagccccugcucgcuguccuu

SEQ ID NO: 526582 - RNA, 57 nt, Homo Sapiens
aaggucuuacccccucuucugcggcugcggucccaggaugagaagaacgaggacuga

SEQ ID NO: 526583 - RNA, 64 nt, Homo Sapiens
acucucauucacacacacaaaucucaggaacaaacggucccagaguccuccggaccccugccca

SEQ ID NO: 526584 - RNA, 64 nt, Homo Sapiens
uuuagguuccccugucaaauaucaguuacccacucggucccaguuuuguugccccagaaaggga

SEQ ID NO: 526585 - RNA, 64 nt, Homo Sapiens
gaagauaccagaucccuucccaaccccuuugcaccggucccacuaaggggcagggucgagagag

SEQ ID NO: 526586 - RNA, 64 nt, Homo Sapiens
gcaccgggucucucuaagucucaccuggggaauucggucccaccuggggcaccaguucccaccu

SEQ ID NO: 526587 - RNA, 64 nt, Homo Sapiens
ugggaugggcuuuucccugugggccagggaugcucggucccagaggaggaccuagugacaucau

SEQ ID NO: 526588 - RNA, 64 nt, Homo Sapiens
cccaccaggcaacuccuuccccuggucccggucccggucccagugccuuuggucccacccuguu

SEQ ID NO: 526589 - RNA, 62 nt, Homo Sapiens
augaugaggucaaggugugaggggcuggggcacggucccagggccccaccuaggugcagagc

SEQ ID NO: 526590 - RNA, 64 nt, Homo Sapiens
aacugaggccuagaagggaggagugguccacccacggucccagcacaaggcagagcugggauga

SEQ ID NO: 526591 - RNA, 64 nt, Homo Sapiens
cucucuuccuucacaccuuccucugaaucccacccggucccaccuccugaaccuauccagacac

SEQ ID NO: 526592 - RNA, 64 nt, Homo Sapiens
ccggugccuuccacccugcccuguagcccuggcccggucccaguuguggccuggguccucggcc

SEQ ID NO: 526593 - RNA, 64 nt, Homo Sapiens
ggaaagagggagcaggugcccccaggugagacagcggucccaggggccugaaaaggaaggacca

SEQ ID NO: 526594 - RNA, 64 nt, Homo Sapiens
ugcaaggaagugaacaucaacuuuagauauguuccggucccacauuguaguauugcuuuuacau

SEQ ID NO: 526595 - RNA, 64 nt, Homo Sapiens; identical to SEQ ID NO: 159954

SEQ ID NO: 526596 - RNA, 64 nt, Homo Sapiens; identical to SEQ ID NO: 159955

SEQ ID NO: 526597 - RNA, 64 nt, Homo Sapiens; identical to SEQ ID NO: 159956

SEQ ID NO: 526598 - RNA, 64 nt, Homo Sapiens; identical to SEQ ID NO: 159957

SEQ ID NO: 526599 - RNA, 64 nt, Homo Sapiens; identical to SEQ ID NO: 159958

SEQ ID NO: 526600 - RNA, 64 nt, Homo Sapiens; identical to SEQ ID NO: 159959

SEQ ID NO: 526601 - RNA, 64 nt, Homo Sapiens
cguccgggagggaggugggggggucagccccccgcccggccagccgccccguccgggagggagg

SEQ ID NO: 526602 - RNA, 64 nt, Homo Sapiens
ggcugccccuacugggaagugaggagccccucugcccggccagccgccccguccaggagggagg

SEQ ID NO: 526603 - RNA, 64 nt, Homo Sapiens
cguccaggagggaggugggggggucagccccccgcccggccagccgcccgguccgggagggagg

SEQ ID NO: 526604 - RNA, 64 nt, Homo Sapiens
gguccgggagggaggugggggggucagccccccgcccggccagccgccccguccgggagguuag

SEQ ID NO: 526605 - RNA, 64 nt, Homo Sapiens
ggccgccccuacugggaagugaggagccccucugcccggccaccaccccgucugggagguguac

SEQ ID NO: 526606 - RNA, 64 nt, Homo Sapiens
agaacagaaauuauuuuaucugugagccacugugcccggccaaacaaaaugcugggauuacagg

SEQ ID NO: 526607 - RNA, 64 nt, Homo Sapiens
ugagcaucaugggucauuacagggaggccacaggcccggccauaggaagggaaggagaggggcc

SEQ ID NO: 526608 - RNA, 64 nt, Homo Sapiens
ccccagccucagccugcgccuuccaagugcacugcccggccaaggcagaggccuuaggaccccg

SEQ ID NO: 526609 - RNA, 64 nt, Homo Sapiens
ugucuugcuccuauggaguccuggggugggggcucccggccaccccuggcucugccuccccacc

SEQ ID NO: 526610 - RNA, 64 nt, Homo Sapiens; identical to SEQ ID NO: 526601

SEQ ID NO: 526611 - RNA, 64 nt, Homo Sapiens
guccgggagggaggugggggggaucagccccccgcccggccagccgccccguccgggagggagg

SEQ ID NO: 526612 - RNA, 64 nt, Homo Sapiens
cuggaguaggcggugcguacccggugucccgaggcccggccaggggcugggcagggaugccagg

SEQ ID NO: 526613 - RNA, 64 nt, Homo Sapiens
gggaugccaggugggcccagccagcuccuggggucccggccaccuggggaagccgcgccugcca

SEQ ID NO: 526614 - RNA, 64 nt, Homo Sapiens
cagcuucccaggugggcucggaugucuccagcagcccggccacgcugucucccccagggcucgg

SEQ ID NO: 526615 - RNA, 64 nt, Homo Sapiens
aauuuuuuuaucgauaacaucgugagccacugugcccggccaagcaaagugcugggauuacagg

SEQ ID NO: 526616 - RNA, 64 nt, Homo Sapiens
cuccccaacuugauguuuguaauugccugucccccccggccagcuccccagcacccaagcaugc

SEQ ID NO: 526617 - RNA, 64 nt, Homo Sapiens
caccguccccagcacccaagucucaguccccuggcccggccagcgccuggggcucccugugacc

SEQ ID NO: 526618 - RNA, 64 nt, Homo Sapiens
ccccccaggaccccugccccuccugccuccaguucccggccacgccugggaccccgcccccuca

SEQ ID NO: 526619 - RNA, 64 nt, Homo Sapiens
cuccccguccuuggccgccccccaccccgaauaccccggccacgcccgcccccguggacccggc

SEQ ID NO: 526620 - RNA, 64 nt, Homo Sapiens
ggaaccaugaggaggguggcaggucuuugcagcucccggccagggugaggcggaagugagcccu

SEQ ID NO: 526621 - RNA, 64 nt, Homo Sapiens
aacagggauggcacuucccugagcaguccuggcccccggccacugucucggggcccaccucucg

SEQ ID NO: 526622 - RNA, 64 nt, Homo Sapiens
aauaagcuuuugacuuaccccaugaaccaccgugcccggccaggcaaagugcuaggauuacagg

SEQ ID NO: 526623 - RNA, 64 nt, Homo Sapiens
aaauauuuuuacuuaaaaauugugagccaccacgcccggccaugaagugcugggauuacaggcg

SEQ ID NO: 526624 - RNA, 64 nt, Homo Sapiens
accugcaaaaaauauuuuguauauauccaauuuaauaauaaaugcacucauguuaggaagguca

SEQ ID NO: 526625 - RNA, 64 nt, Homo Sapiens
uguuaggaaggucaaaaaaaaggaaaaaagaaaaauaauaaaaaauaauaaaaauccuuaggau

SEQ ID NO: 526626 - RNA, 64 nt, Homo Sapiens
gucaaaaaaaaggaaaaaagaaaaauaauaaaaaauaauaaaaauccuuaggauaacuugaggc

SEQ ID NO: 526627 - RNA, 64 nt, Homo Sapiens
uauagaaaguauauagcaaaguaauuuuacucugauaauaaaaauuguuugacauguauuuugu

SEQ ID NO: 526628 - RNA, 64 nt, Homo Sapiens
uauuuuaaaguguagaagaauacacugcuaauaaauaauaaaaguuuuauucaauuuacuuauu

SEQ ID NO: 526629 - RNA, 64 nt, Homo Sapiens
aaaagcacuuugugcuguguucuauauaaaaaacauaauaaaaauugaaaugaaagaauaauug

SEQ ID NO: 526630 - RNA, 64 nt, Homo Sapiens
uuuuuaaaacacaacuuuuaaaaaauguaucaaaauaauaaacguguucugauauuuuuaaaau

SEQ ID NO: 526631 - RNA, 64 nt, Homo Sapiens
guuaugaacuguaaaauuaaagucaguaugaacuauaauaaauaucuguagcuuaaaaaguagg

SEQ ID NO: 526632 - RNA, 64 nt, Homo Sapiens
uguauuucuguucauuuucuguucauagaguuguauaauaaaacaugauugcuuaaaaacuugu

SEQ ID NO: 526633 - RNA, 64 nt, Homo Sapiens
uggugcacacugaaauuuuacuugaacaguucucauaauaaagcacuugucuuuugcucuuuau

SEQ ID NO: 526634 - RNA, 64 nt, Homo Sapiens
uaaacuauuauuuuugguuacugguauagaauaaauaauaaauguaaaggguuugggacagcac

SEQ ID NO: 526635 - RNA, 64 nt, Homo Sapiens
aucccauccauauauccaauguaaacuuuaaguaauaauaaagaagccuguaauuaugagaaca

SEQ ID NO: 526636 - RNA, 64 nt, Homo Sapiens
aaauuguuuuaaauguuuagauauucuauaauaaauaauaaaacgguuuuacaauuuaaaaagu

SEQ ID NO: 526637 - RNA, 64 nt, Homo Sapiens
auaaaacaaauuguuuuaaaaaaaaguauauucuauaauaaauaauagguugguuuuacaauuu

SEQ ID NO: 526638 - RNA, 64 nt, Homo Sapiens
uauuucuaaugaugaaaacucugcuuuaaaauaaauaauaaaauuugcuaccaguuacauugaa

SEQ ID NO: 526639 - RNA, 64 nt, Homo Sapiens
uuuuaaagaaaagauauucugaucaacuuaaaggauaauaaaauuuucuuuucauaaugaagca

SEQ ID NO: 526640 - RNA, 64 nt, Homo Sapiens
ugaaacaagauuauuuuccauuauauguuaauguauaauaaaacgucucauaaaaugagacuuu

SEQ ID NO: 526641 - RNA, 64 nt, Homo Sapiens
uuuuaauuuaucauaacauauagaucauuuuauaauaauaaauaugcaaugugacaugguucug

SEQ ID NO: 526642 - RNA, 64 nt, Homo Sapiens
accaauuccaauuucaaaaugucucaauggugcuauaauaaauaaacuucaacacucuuuauga

SEQ ID NO: 526643 - RNA, 64 nt, Homo Sapiens
ugguuguugaucuuuuuuuuccuuacagacacccauaauaaaauaucauauuaaaauucuccug

SEQ ID NO: 526644 - RNA, 64 nt, Homo Sapiens
acuugaagauuaccaaugauuuugaggcuuuucuauaauaaaaagagguucuaaccauuauuug

SEQ ID NO: 526645 - RNA, 64 nt, Homo Sapiens
uuaaaugcaaucagguaguguugcuuuuuacagcauaauaaauauauguaucaaaaaaaaaacu

SEQ ID NO: 526646 - RNA, 64 nt, Homo Sapiens
ccccagggccucugcucuccugggagacaaagcaauaauaaaaggaaguguuuguaaucccagc

SEQ ID NO: 526647 - RNA, 64 nt, Homo Sapiens
caaaaauaaacaaauaaauuuuaaaaauaaauaaauaauaaaaggaaguguuagacaauguaau

SEQ ID NO: 526648 - RNA, 64 nt, Homo Sapiens
ccuaaaaggaaacuguauaaagaaguaaucccagauaauaaauuuguguaucauugaaaauaag

SEQ ID NO: 526649 - RNA, 64 nt, Homo Sapiens
ggcagucauaacagggacuguggaugauuuagcaauaauaaaauaaaaucaggucacaauuuug

SEQ ID NO: 526650 - RNA, 64 nt, Homo Sapiens
ucaucuauacaaaagaagucauauuuuauuguuuauaauaaaaauuguaguugagacauuacau

SEQ ID NO: 526651 - RNA, 64 nt, Homo Sapiens
aacucauguuagagacccuuuuuuuugcuucauaauaauaaaaccacugugagauucuuaaaac

SEQ ID NO: 526652 - RNA, 64 nt, Homo Sapiens
gaaaaacacaaacauucaaagcacauaaauugguauaauaaaaagaaguagaagguaacucuuu

SEQ ID NO: 526653 - RNA, 64 nt, Homo Sapiens
uuccauuagaacaaaagaaucaucccuggaaaucauaauaaaguacugaugugugcauauuuag

SEQ ID NO: 526654 - RNA, 64 nt, Homo Sapiens
gcagcuaauggaaaggagagaaaggaccaccaaaauaauaaaaggugggagugguuguguaaug

SEQ ID NO: 526655 - RNA, 64 nt, Homo Sapiens
gaaugccauuaguguagaugaucaauuugugaggauaauaaaugcuaauccaaaguauaacacu

SEQ ID NO: 526656 - RNA, 64 nt, Homo Sapiens
cucaugauagaaaauuuggaauucaauuauaaaaauaauaaauggcagauguuuaguuuuaaaa

SEQ ID NO: 526657 - RNA, 64 nt, Homo Sapiens
caacaauacccucagacugaguaagccacugcuuauaauaaaacgguuuucuuucugugugugu

SEQ ID NO: 526658 - RNA, 64 nt, Homo Sapiens
uucguuuuaagucauguucacaggaauuucuacaauaauaaacccaucaucuccauaggucaga

SEQ ID NO: 526659 - RNA, 64 nt, Homo Sapiens
ucaggaaaaaaguuguuagaagauuuuuuaauguauaauaaaguccaugauuuuuguacagugu

SEQ ID NO: 526660 - RNA, 64 nt, Homo Sapiens
uuuucagacauuuuaguaucuguauauagugcauauaauaaauccaauuaaacauuauuugaua

SEQ ID NO: 526661 - RNA, 64 nt, Homo Sapiens
gaacauaaauaauaugaugugguugaguguuaacauaauaaaucauauacaguaugacauuuua

SEQ ID NO: 526662 - RNA, 64 nt, Homo Sapiens
gaaacucaaaucucagacgccgugguugcaacuuauaauaaagaauggguugggggaaggggga

SEQ ID NO: 526663 - RNA, 64 nt, Homo Sapiens
gggggagaaauaaaagccaagaagaggaaacaagauaauaaauguacaaaacaugaaaauuaaa

SEQ ID NO: 526664 - RNA, 64 nt, Homo Sapiens
uaucuauauauauuuagcauaaaccugcugcaucauaauaaauagccuaaaucccuguauucca

SEQ ID NO: 526665 - RNA, 64 nt, Homo Sapiens
aucaauuacacauuuuugugaauauguaggaccaauaauaaauuucuacagcaugccaguaaau

SEQ ID NO: 526666 - RNA, 64 nt, Homo Sapiens
acaguaaacauucuauuucuuacacagaguaauaauaauaaaacaugauagauaaauauguauc

SEQ ID NO: 526667 - RNA, 64 nt, Homo Sapiens
aucggcagaugaugcuuuggaagaugcagaagcaauaauaaaguacuugacuaccuacuggugu

SEQ ID NO: 526668 - RNA, 64 nt, Homo Sapiens
gcacuuuugaauguccaaaauuuauauuuuagaaauaauaaaaagaaagauacuuacauguucc

SEQ ID NO: 526669 - RNA, 64 nt, Homo Sapiens
uauuuguucauaacauuaaaacaauaaagggcucauaauaaauaaauauauuuuugacacaauu

SEQ ID NO: 526670 - RNA, 64 nt, Homo Sapiens
acuugauguuuauaauuaauaccauuacaacuguauaauaaaagcaauuugaagaaaagcugua

SEQ ID NO: 526671 - RNA, 64 nt, Homo Sapiens
caacguguuucugaaaaacagauuuucauaaguaauaauaaaaauaauaauaaaaaaguuuugg

SEQ ID NO: 526672 - RNA, 64 nt, Homo Sapiens
gaaaaacagauuuucauaaguaauaauaaaaauaauaauaaaaaaguuuugguaugguaagccu

SEQ ID NO: 526673 - RNA, 64 nt, Homo Sapiens
gacuauuaagagcaauaaauucuguuguagaauaauaauaaaaauuucugaauuuugaguaucu

SEQ ID NO: 526674 - RNA, 64 nt, Homo Sapiens
caguggaaauuuucuaccuaaugagaugaugaaaauaauaaagcuagccuauuuauuauaaauu

SEQ ID NO: 526675 - RNA, 64 nt, Homo Sapiens
uagagaauuaaacuaccuaaacuuguauuagaacauaauaaaagcuucaguaaauacuaaaguu

SEQ ID NO: 526676 - RNA, 64 nt, Homo Sapiens
aaaaagcccuuuaaacuuuguuuggaccuaaauaauaauaaaaagugauuuuuaaaaacuuuuu

SEQ ID NO: 526677 - RNA, 64 nt, Homo Sapiens
augccuguuauauuaaauaagcacuuuguuuuauauaauaaaguuaacauuguucaucuuuagu

SEQ ID NO: 526678 - RNA, 64 nt, Homo Sapiens
auauuuugguggggauggugaaagagggagagagauaauaaacucaguuuacacuaucauuaaa

SEQ ID NO: 526679 - RNA, 64 nt, Homo Sapiens
gaguggugucuuuuccauaauuggauguauuucaauaauaaauaagaaacagaaucaccuagua

SEQ ID NO: 526680 - RNA, 64 nt, Homo Sapiens
aacagaaucaccuaguauugcaccaucucuagccauaauaaagauggcuuugaagaagugaugc

SEQ ID NO: 526681 - RNA, 64 nt, Homo Sapiens
uucucugugagaagguuuauuguuaauacaagguauaauaaaauuaucgcaaccccucuccuuc

SEQ ID NO: 526682 - RNA, 64 nt, Homo Sapiens
agcaguuguaccaagugaaauuauuuuggagauuauaauaaauauauacauucaaucugaguug

SEQ ID NO: 526683 - RNA, 64 nt, Homo Sapiens
cacuuuugguuaagucuguuuuaugacuucauuaauaauaaauucccuggccuuucauauuuua

SEQ ID NO: 526684 - RNA, 64 nt, Homo Sapiens
uguuauauaaaugguuaaaagagguuuuucuuaaauaauaaagaucauguaaaaguaacaaaug

SEQ ID NO: 526685 - RNA, 64 nt, Homo Sapiens
agacaaaaaagucuagauuggucuugauauugagauaauaaaaaguaaguagcauuaagaaagg

SEQ ID NO: 526686 - RNA, 64 nt, Homo Sapiens
ugugugguguuucuauauaauuuucuguguauaaauaauaaaguaggcauuuguuuauuuugua

SEQ ID NO: 526687 - RNA, 64 nt, Homo Sapiens
aauaauccaagacuucucacuggggaauaagggaauaauaaauaggguacaaacuccuaauaga

SEQ ID NO: 526688 - RNA, 64 nt, Homo Sapiens
aaaaggaauuuuaaauuuaacucuucacauggaaauaauaaagcucuuuauaugagcuguccca

SEQ ID NO: 526689 - RNA, 64 nt, Homo Sapiens
aacuugaaaguucuaagucauuguacagacuuuuauaauaaaaguugcugugucuggcacuuca

SEQ ID NO: 526690 - RNA, 64 nt, Homo Sapiens
gcaguucuaguacuucacaucaugaaguaguuugauaauaaauagcacuauuacauaguaagca

SEQ ID NO: 526691 - RNA, 64 nt, Homo Sapiens
guugcuuaccuagaagaacuugacaggauaguuaauaauaaaccuuaaaacccaugaagaaauc

SEQ ID NO: 526692 - RNA, 64 nt, Homo Sapiens
aaguaacagguacugagauuuguggccuaaauucauaauaaagugaaauguucaaguucaguca

SEQ ID NO: 526693 - RNA, 64 nt, Homo Sapiens
cagcaagucuaacucucuguuccauuaaacccuuauaauaaaauccuucuguaauaauaaaguu

SEQ ID NO: 526694 - RNA, 64 nt, Homo Sapiens
uuccauuaaacccuuauaauaaaauccuucuguaauaauaaaguuucaaaagaaaauguuuauu

SEQ ID NO: 526695 - RNA, 64 nt, Homo Sapiens
acaguucuuucugcuacugaugacacucauugucauaauaaaacaaauaauuuccucaaauaac

SEQ ID NO: 526696 - RNA, 64 nt, Homo Sapiens
uuaucaucaagguauuaaauauaagacguuaaauauaauaaaguggggauauauagaaaacaca

SEQ ID NO: 526697 - RNA, 64 nt, Homo Sapiens
gagaacucagaaaauuauuuuaaauuucuaaguuauaauaaauuugcacacagauaacaugcau

SEQ ID NO: 526698 - RNA, 64 nt, Homo Sapiens
gagaaaacugaagauuuaguuuccauuuuucuuuauaauaaaauauuugagccacuguauaaac

SEQ ID NO: 526699 - RNA, 64 nt, Homo Sapiens
gauuuuaaacuauccucuaaaaaauggauuuagaauaauaaaugguauaacauguuaauggaaa

SEQ ID NO: 526700 - RNA, 64 nt, Homo Sapiens
uguagauaagauguuuuaacuuuugaacuagcugauaauaaagucuaaaagacuguaauaugau

SEQ ID NO: 526701 - RNA, 64 nt, Homo Sapiens
aauuguggcuuguaaaugauaaugucuuauguaaauaauaaacuaauuaaccugguuaaagaga

SEQ ID NO: 526702 - RNA, 64 nt, Homo Sapiens
uacuaaccagaggagucuauuuugaaagaggugcauaauaaaaccagccaugaggagccucagu

SEQ ID NO: 526703 - RNA, 64 nt, Homo Sapiens
gauagacagggaaggauagaaaagaaugaaggaaauaauaaagucccagagacugucgcuacua

SEQ ID NO: 526704 - RNA, 64 nt, Homo Sapiens
uaaaaucuaaaauguaaaaucuuuuauaauccauauaauaaauuucugaaacaaaugguuauuu

SEQ ID NO: 526705 - RNA, 64 nt, Homo Sapiens
cuuauuuaugucuuauuugauauagcauauugcuauaauaaaacuugaguugucacuuaaaaau

SEQ ID NO: 526706 - RNA, 64 nt, Homo Sapiens
uugggugcauccaaaaauguauaaaaauauuauuauaauaaacuuauuacugcuuguaggguaa

SEQ ID NO: 526707 - RNA, 64 nt, Homo Sapiens
ucuucuaaauuaccacuugccauuaagcuauuucauaauaaauucuguacaguuuccccccaaa

SEQ ID NO: 526708 - RNA, 64 nt, Homo Sapiens
cauuuaucaauaaaagccuuugaaaauacuuuggauaauaaauuggaguuuuaaaaaugcaaau

SEQ ID NO: 526709 - RNA, 64 nt, Homo Sapiens
aauauauuuugaaauauugaugcagacaaaugaaauaauaaagagauuuucaugguuuauaaaa

SEQ ID NO: 526710 - RNA, 64 nt, Homo Sapiens
uuuaaauacagaagucauguuguuucugcacuuuauaauaaagcauggaagaaauuaucuuagu

SEQ ID NO: 526711 - RNA, 64 nt, Homo Sapiens
auguacaauauugauagugagagguaugucuauuauaauaaagauuauggcacaguaaaaccug

SEQ ID NO: 526712 - RNA, 64 nt, Homo Sapiens
uuuuuuaugaugauaaaagaugugauaauuuuuuauaauaaauauuaugcuauguacagagaaa

SEQ ID NO: 526713 - RNA, 64 nt, Homo Sapiens
uacccgugucaauuaacauuuaguaggcuuugagauaauaaacuugccucucacucuuacaaga

SEQ ID NO: 526714 - RNA, 64 nt, Homo Sapiens
uaauagaucuaaucaaauauguugauucauggcuauaauaaagcaggagcaauuauaaaaucuu

SEQ ID NO: 526715 - RNA, 64 nt, Homo Sapiens
auuuuaagcacuaaaaauuuuuucauaaccuuucauaauaaaguuuaauaauagguuuauuaac

SEQ ID NO: 526716 - RNA, 64 nt, Homo Sapiens
auuuauuaagacuuucuucaaauaauuaugcuuaauaauaaaguuucucagucaccaacagaug

SEQ ID NO: 526717 - RNA, 64 nt, Homo Sapiens
caaacagaacacuccaacuuaggacuccgaauacauaauaaaagggccagccagaauggcaaua

SEQ ID NO: 526718 - RNA, 64 nt, Homo Sapiens
aauucuuuuucagaaaauauguugcuagagaacaauaauaaaauaugagaauuguuugagguuu

SEQ ID NO: 526719 - RNA, 64 nt, Homo Sapiens
caucagaauccuuggcugaagcuucauuuuaggaauaauaaauucaucguuuacuuuuuaacug

SEQ ID NO: 526720 - RNA, 64 nt, Homo Sapiens
uauuucagauguauuauaugauugugcccaaguaauaauaaaaccaggaacgggggaccauugc

SEQ ID NO: 526721 - RNA, 64 nt, Homo Sapiens
ggauauaauuucuuaguaaaguauacuugaaaugauaauaaaaaucuaaucuauguugaacuuu

SEQ ID NO: 526722 - RNA, 64 nt, Homo Sapiens
gaucugcuuauuuauuaaaaagacagaaaugaauauaauaaauuaauauguuugcuauccuuag

SEQ ID NO: 526723 - RNA, 64 nt, Homo Sapiens
uaaaauuuaguugaguuuuuaaucagugaccaucauaauaaagaauauuuucauuaauaguuua

SEQ ID NO: 526724 - RNA, 64 nt, Homo Sapiens
aguauaaaauguuuuaugauguuuccaauuauuuauaauaaaucgguuugagaaaugaaauauu

SEQ ID NO: 526725 - RNA, 64 nt, Homo Sapiens
aagaaagcaugauauuuacuaaaaacaaaauaaaauaauaaaaauauuuccaaacucauauuac

SEQ ID NO: 526726 - RNA, 64 nt, Homo Sapiens
acagagcgacccucugucucaaaaaauaauaauaauaauaaauaaaacaacaacaaaaugcauc

SEQ ID NO: 526727 - RNA, 64 nt, Homo Sapiens
uacuauuuccaauguauguuuguuaaaaauaauaauaauaaaaccaaaagccuuuguggaaacc

SEQ ID NO: 526728 - RNA, 64 nt, Homo Sapiens
caucacccaccaucaccgcugcugcaaagaggcaauaauaaaggaacugaagacagcuguauuu

SEQ ID NO: 526729 - RNA, 64 nt, Homo Sapiens
uaugaauuguuaauuaaggugccaaaaaaaauuaauaauaaagcuugguuuuuugaaaaaccca

SEQ ID NO: 526730 - RNA, 64 nt, Homo Sapiens
uaauuuaacuugcauuugcuuaggaucucuuuauauaauaaauguuguuuuucguaucaaguua

SEQ ID NO: 526731 - RNA, 64 nt, Homo Sapiens
ucaggaaccaaggcaaaauguuauugacaaucccauaauaaaacaaucaggaacaacuuucucc

SEQ ID NO: 526732 - RNA, 64 nt, Homo Sapiens
uauuaacuaggaaaaaacaguuacguagacagaaauaauaaaaauucagaauauuugaaguuuc

SEQ ID NO: 526733 - RNA, 64 nt, Homo Sapiens
aaaacggagggacuuugcuacuuguaaaaauaacauaauaaauagaucuuaaacauaggaaaac

SEQ ID NO: 526734 - RNA, 64 nt, Homo Sapiens
uagaucuuaaacauaggaaaaccauacuguucugauaauaaaaugcuuucuaugaaauacguug

SEQ ID NO: 526735 - RNA, 64 nt, Homo Sapiens
auuagcuaacaggaaacaacuacuguguuucaacauaauaaauauaauagaaaaauauuuuauu

SEQ ID NO: 526736 - RNA, 64 nt, Homo Sapiens
uguugaccuuuuacuuccuuuuacaaaaaugaaaauaauaaacauguuuucguauaaaauaaca

SEQ ID NO: 526737 - RNA, 64 nt, Homo Sapiens
gacuugcccaaguggcaauagaguucuaauaucuauaauaaagggagauuugcuauuauuagug

SEQ ID NO: 526738 - RNA, 64 nt, Homo Sapiens
augagcacaaugauauuaaucacuuuuauggugaauaauaaaugcaauaauugccucaugggug

SEQ ID NO: 526739 - RNA, 64 nt, Homo Sapiens
ugauaagcugcugcuccuauauuuuuuaagaaauauaauaaagcacuuagggcaggggaaauca

SEQ ID NO: 526740 - RNA, 64 nt, Homo Sapiens
cuauuuauuuucuuguucacaguaaugcaugucaauaauaaauguuuccccuuacugauaagcg

SEQ ID NO: 526741 - RNA, 64 nt, Homo Sapiens
accacagcaaaagcaaauaauaauaauauuaauaauaauaaagagaaauaaaauaauaaaauaa

SEQ ID NO: 526742 - RNA, 64 nt, Homo Sapiens
aauaauaauauuaauaauaauaaagagaaauaaaauaauaaaauaaaaaacaauagcacagccc

SEQ ID NO: 526743 - RNA, 64 nt, Homo Sapiens
guccucuuucagaaaacagauuaauugugaauugauaauaaacuauaauaaauugcaugcugcu

SEQ ID NO: 526744 - RNA, 64 nt, Homo Sapiens
gcaugcugcuuuaauugugaaaaaguuaaaaaaaauaauaaauuugccaagaacugaaaacaua

SEQ ID NO: 526745 - RNA, 64 nt, Homo Sapiens
aauuaaaaauuuauuuaucaguuuauuuaaaauaauaauaaaauauaacagucugaacuuauuu

SEQ ID NO: 526746 - RNA, 64 nt, Homo Sapiens
guaaucagcaguaaaggaguguggaugaaaagaaauaauaaauuuauaauuugaggaguggaug

SEQ ID NO: 526747 - RNA, 64 nt, Homo Sapiens
ugguagaaaaaugaaaacuuuaaacuuuuuugaaauaauaaaucgaauuaugucugcugaauaa

SEQ ID NO: 526748 - RNA, 64 nt, Homo Sapiens
uuuuugaaauaauaaaucugauuaugucugcugaauaauaaacucuucuguaaagguuuuugga

SEQ ID NO: 526749 - RNA, 64 nt, Homo Sapiens
gugcucagaaaucaccauaaucacgaaaauaauaauaauaaaucuuuaacauacuaccuaaagg

SEQ ID NO: 526750 - RNA, 64 nt, Homo Sapiens
guccaaguacuuuguauuguauacgugagucauaauaauaaaaagaagaagaaaaauaauagaa

SEQ ID NO: 526751 - RNA, 64 nt, Homo Sapiens
cacugugcuuaaacaaaaugccauuaaugggauuauaauaaauauaaugugguagaauucaagu

SEQ ID NO: 526752 - RNA, 64 nt, Homo Sapiens
guauuaacugaggaauaaaagacugaagaaagacauaauaaauaguuaaaggauuauggaaaag

SEQ ID NO: 526753 - RNA, 64 nt, Homo Sapiens
uacugauuuccuuuggagcuagucauauaccuauauaauaaagcacucuuuaacuucucguaaa

SEQ ID NO: 526754 - RNA, 64 nt, Homo Sapiens
cagaaggaaauugagauuagcguaauuuugccaaauaauaaaaagaaauauuuauuuuuuuaag

SEQ ID NO: 526755 - RNA, 64 nt, Homo Sapiens
aacuuuucaaaugacuaugaguguauauugguauauaauaaaugcuucuuuuuuauuacagaaa

SEQ ID NO: 526756 - RNA, 64 nt, Homo Sapiens
accauuuuuuucuucauaacuccuauagugccaaauaauaaagccuucugaauguucaagagca

SEQ ID NO: 526757 - RNA, 64 nt, Homo Sapiens
uuuuucauauguaaaacaaucugaagguauguuuauaauaaacauucaaaaagaaugauacauu

SEQ ID NO: 526758 - RNA, 64 nt, Homo Sapiens
augauaaagauguuucugacucauaauaacaauaauaauaaaugagcagcaauaguagaaguag

SEQ ID NO: 526759 - RNA, 64 nt, Homo Sapiens
auauuuccaagauugguuauaauagauggggcauauaauaaagaagcuacuauuuuggaaaaug

SEQ ID NO: 526760 - RNA, 64 nt, Homo Sapiens
cugcacucuguagcaaauuuguuuaaucuacauuauaauaaaauuucuugcugcagugcaacag

SEQ ID NO: 526761 - RNA, 64 nt, Homo Sapiens
aguucauuuucagaaucaucuaucuguuauuagaauaauaaaggguaacuuagucucaauagag

SEQ ID NO: 526762 - RNA, 64 nt, Homo Sapiens
guuacaggucacuuuaaaaguuguauuaaugauuauaauaaaaaagcacugcuaccuucuuuga

SEQ ID NO: 526763 - RNA, 64 nt, Homo Sapiens
ugcauucaguggcuuuuuaauacuugcauuauuuauaauaaaaugaaacuacacacaaaaagca

SEQ ID NO: 526764 - RNA, 64 nt, Homo Sapiens
cugugaacugccuggugcagaugccagugaccucauaauaaagacauagcuuuacgauggagag

SEQ ID NO: 526765 - RNA, 64 nt, Homo Sapiens
auccccauaugucuguguuuguuugagauuuuuaauaauaaauaauaaauuuuugaagaaugga

SEQ ID NO: 526766 - RNA, 64 nt, Homo Sapiens
uaugucuguguuuguuugagauuuuuaauaauaaauaauaaauuuuugaagaauggaaguggau

SEQ ID NO: 526767 - RNA, 64 nt, Homo Sapiens
uaaugguuugcugcuugacuagccuagggaaauaauaauaaagguaaaguaaacuuuuuuaaug

SEQ ID NO: 526768 - RNA, 64 nt, Homo Sapiens
uggacagacacauuagagcagcuguuuguuauugauaauaaaauauuauaaaacuacuuuuugu

SEQ ID NO: 526769 - RNA, 64 nt, Homo Sapiens
gcaauacuuuauucuccauaucauuuuguguugaauaauaaaguguauguuacuguuggcuaca

SEQ ID NO: 526770 - RNA, 64 nt, Homo Sapiens
uuaaauuguguaccuguauguauauaaaaugcauauaauaaauaacagcuguugaaaaauaaug

SEQ ID NO: 526771 - RNA, 64 nt, Homo Sapiens
uaauuauaguuacauguauuaaaaauuuugcugcauaauaaagaaguuaaaaguuagcaauuua

SEQ ID NO: 526772 - RNA, 64 nt, Homo Sapiens
acuuauaaaauuuuaaauaucuuaauuugaugacauaauaaaucgauauaguuaauggaauugg

SEQ ID NO: 526773 - RNA, 64 nt, Homo Sapiens
ggacauuuauuuuacaugggaaaaauuauuuggaauaauaaagcaggaacuuuuccugaaguug

SEQ ID NO: 526774 - RNA, 64 nt, Homo Sapiens
guuuguacagaugcaugccacaguagauguccacauaauaaaauucauaguuaccaaugcaguu

SEQ ID NO: 526775 - RNA, 64 nt, Homo Sapiens
aaaacucagaauaaaccuguaccuuuacuuuuguauaauaaauuacuauuaauauuaaauuaaa

SEQ ID NO: 526776 - RNA, 64 nt, Homo Sapiens
aacuaagcauuugaggaaaaauuuuaaaaagcaaauaauaaaaucuuuuguuuugacacugaau

SEQ ID NO: 526777 - RNA, 64 nt, Homo Sapiens
cacgucaugucuucuuuugggaagcuugucugcaauaauaaagcugcauucuuuauucacuuaa

SEQ ID NO: 526778 - RNA, 64 nt, Homo Sapiens
ggagugagacuucauuguauuaucaauucauuguauaauaaacauauacuagaaguaauuguuu

SEQ ID NO: 526779 - RNA, 64 nt, Homo Sapiens
gcauuucagagaauaugcauauacaugcauugucauaauaaaauuuuauuguuuuuaugaguaa

SEQ ID NO: 526780 - RNA, 64 nt, Homo Sapiens
cacaaugaauucuucacuuggugauuaacugugaauaauaaauacggauagcauuugguaggua

SEQ ID NO: 526781 - RNA, 64 nt, Homo Sapiens
acaagaaaccaagugggcugccuagcugacgccaauaauaaaaacguuuaaggccacguauagu

SEQ ID NO: 526782 - RNA, 64 nt, Homo Sapiens
gccacuggcaaauguaacugugccaguucuuuccauaauaaaaggcuuugaguuaacucacuga

SEQ ID NO: 526783 - RNA, 64 nt, Homo Sapiens
gaacuuuaaaguuauaguuguuuuauauguugcuauaauaaagaaguguucugcauucguccac

SEQ ID NO: 526784 - RNA, 64 nt, Homo Sapiens
ccauaaaugacaagguuuugacauuuuugaagagauaauaaauguuuuaauuuggcaguuugag

SEQ ID NO: 526785 - RNA, 64 nt, Homo Sapiens
acuuuaauauauaauccaucagacagaggaaucaauaauaaaacugcaacagaacuaucaacug

SEQ ID NO: 526786 - RNA, 64 nt, Homo Sapiens
uggggccaguaaaucaguagacugaacauucaauauaauaaaagaacauggggauuuuguauaa

SEQ ID NO: 526787 - RNA, 64 nt, Homo Sapiens
aauaaaagaacauggggauuuuguauaaccagggauaauaaaaagaaaaaagaaguuaauuuuu

SEQ ID NO: 526788 - RNA, 64 nt, Homo Sapiens
caucagggaauuuauauugaaaaauugugcaaauauaauaaauuuggaaaaacaauuuuucaaa

SEQ ID NO: 526789 - RNA, 64 nt, Homo Sapiens
aauuuuuauuuaccacaguguuauuuuuaucgucauaauaaaaauuauauacgaguauaaauga

SEQ ID NO: 526790 - RNA, 64 nt, Homo Sapiens
uauaacauaauuuuuuuuuuaaauauauacuuauauaauaaaaguauguaacauacuuuuauua

SEQ ID NO: 526791 - RNA, 64 nt, Homo Sapiens
cccuacauuucugaggccugaguuauguagaaguauaauaaaauauuuuuauggucauaauaaa

SEQ ID NO: 526792 - RNA, 64 nt, Homo Sapiens
uuauguagaaguauaauaaauuauuuuuauggucauaauaaaagaauuguuauugauuacagug

SEQ ID NO: 526793 - RNA, 64 nt, Homo Sapiens
guuuaaaaucaaaaccaaaauguuugaaauuucaauaauaaaauaauauuucuacuuuuguaug

SEQ ID NO: 526794 - RNA, 64 nt, Homo Sapiens
uagaaaugccuccugucaccgaagaucuguagacauaauaaauguuagugaauucacguaaaag

SEQ ID NO: 526795 - RNA, 64 nt, Homo Sapiens
uuauauuagagaaagaauaugcucaauuccaagcauaauaaauuuuugagaaaauguguuucau

SEQ ID NO: 526796 - RNA, 64 nt, Homo Sapiens
uaauauaucagacaucgacauauucuauguuuuuauaauaaaaaucugaauuauguaugaaaau

SEQ ID NO: 526797 - RNA, 64 nt, Homo Sapiens
ggaaggacaggaggaagacauauaaauguaucuuauaauaaaaaaucuuuucuucuaugggguc

SEQ ID NO: 526798 - RNA, 64 nt, Homo Sapiens
gauaucugauuaaaauauacaaaugaaugguuccauaauaaauuguuuagugcuaaugagcaga

SEQ ID NO: 526799 - RNA, 64 nt, Homo Sapiens
guaauuuuauacugcuuacuaucccccuggccccauaauaaauuguuuuuaaggaugguuguga

SEQ ID NO: 526800 - RNA, 64 nt, Homo Sapiens
uuuuaagaauaucugaguaaaauaacaauaugaaauaauaaacagaagcucuaacgucagguaa

SEQ ID NO: 526801 - RNA, 64 nt, Homo Sapiens
agagaguugacaaguugcuuguaguuuuaaaaaaauaauaaaguauacccuucugguauaucau

SEQ ID NO: 526802 - RNA, 64 nt, Homo Sapiens
auaguuaaacucuaaggaagugcucucagucaauauaauaaauguuuauaaacuaacaaaaacu

SEQ ID NO: 526803 - RNA, 64 nt, Homo Sapiens
uuggagauuguuacgcuugauuuuuuaaacaagaauaauaaagggugucauaagaaacaaaaua

SEQ ID NO: 526804 - RNA, 64 nt, Homo Sapiens
ggugauucugugcaguaagguauaaaacagauauauaauaaauagccuagcuuagucuaacauc

SEQ ID NO: 526805 - RNA, 64 nt, Homo Sapiens
uaaaauaaaacaaauuuaaacaccaaaauaagauauaauaaaacauuuguuuuugcaaaauaag

SEQ ID NO: 526806 - RNA, 64 nt, Homo Sapiens
cauauuccauaaagugcucagagucacagguuuuauaauaaauuauguuauuauguaaacgaau

SEQ ID NO: 526807 - RNA, 64 nt, Homo Sapiens
uuaucuuccugugcuguacuuuucuaguuaaaauauaauaaauaugaacuugcuaucugcucug

SEQ ID NO: 526808 - RNA, 64 nt, Homo Sapiens
ucucuuucagcuagagaaguggaacuccauucagauaauaaaauuuuuguaccuaaggugaugg

SEQ ID NO: 526809 - RNA, 64 nt, Homo Sapiens
ccuaccuugcaguagugaagaucuguaaaaggagauaauaaacacucugagccuaaguuuccac

SEQ ID NO: 526810 - RNA, 64 nt, Homo Sapiens
auauuggagaccuguuuuagaguauguuugcaaaauaauaaagguauccgcaugugugcaugug

SEQ ID NO: 526811 - RNA, 64 nt, Homo Sapiens
aaauuaccgagaaccccaucaauaauaaacauaaauaauaaacaaauaauuaaugauaaaacau

SEQ ID NO: 526812 - RNA, 64 nt, Homo Sapiens
uaaauaauaaacaaaauuacaaugauaaaacauaauaauaaacauaaaaauuuauugaauaauu

SEQ ID NO: 526813 - RNA, 64 nt, Homo Sapiens
ccugauauuuggcugggcgcaacaauaauaauaaauaauaaaaacaagauugcaucucaaaaca

SEQ ID NO: 526814 - RNA, 64 nt, Homo Sapiens
auaaaaaccugauauuuggccaaaacaaacaauaauaauaaauagacagagcaagauugcaucu

SEQ ID NO: 526815 - RNA, 64 nt, Homo Sapiens
uccuggcuguugacuucccauugcucuuggagccaccaaucaaagagauucaaagagauuccug

SEQ ID NO: 526816 - RNA, 64 nt, Homo Sapiens
cggcucagugacagccaaccugcccccuccccacaccaaucagccaggcugagcccccaccccu

SEQ ID NO: 526817 - RNA, 64 nt, Homo Sapiens
cccuaccuuuuucuucucuucauugaccaaaucaaccaaucacuacagcugcucugcuucugcu

SEQ ID NO: 526818 - RNA, 64 nt, Homo Sapiens
cacggggaucacagcguuucaggaacguugccacaccaaucagagagccuagaacaucccuggg

SEQ ID NO: 526819 - RNA, 64 nt, Homo Sapiens
ucaugagcaaauaugucaagggagucaauuucugaccaaucaaguacacuaaauuagaauauuu

SEQ ID NO: 526820 - RNA, 64 nt, Homo Sapiens
aagaaugguuuuccaccuuuucccccuaaucucuaccaaucagacacauuuuauuauuuaaauc

SEQ ID NO: 526821 - RNA, 64 nt, Homo Sapiens
cacccuccauagccaccaaaccuguuagaacuggaccaaucaaaccucaggcgaucaaaaccga

SEQ ID NO: 526822 - RNA, 64 nt, Homo Sapiens
guaaugcagaaaucuguuuuguucccaugaaaucaccaaucaaggccuccguucuucuaaagau

SEQ ID NO: 526823 - RNA, 64 nt, Homo Sapiens
acuuuuaagaaauauauauaauuauucuuuucucaccaaucaacugagaaaaguuaaccaagga

SEQ ID NO: 526824 - RNA, 64 nt, Homo Sapiens
guggcaugaggcccacgccacccccugucuacugaccaaucaguccugugguguuuggcaugug

SEQ ID NO: 526825 - RNA, 64 nt, Homo Sapiens
auggaauaaaguguugaguuaaucuuacauguauaccaaucacauuuuagucucuugaugucuc

SEQ ID NO: 526826 - RNA, 64 nt, Homo Sapiens
ccuuucacggcccuuuaguucucugugugccaaaaccaaucaugagccaauguaugguuaucca

SEQ ID NO: 526827 - RNA, 64 nt, Homo Sapiens
aauacuaguuuaaaaugaaugcaauuuuuaucuaaccaaucagacaggaucuuucagaucaugu

SEQ ID NO: 526828 - RNA, 64 nt, Homo Sapiens
gaugcuguagcuccuugggguuucuauuccuuggaccaaucagaguuacauuuucccaauaucu

SEQ ID NO: 526829 - RNA, 64 nt, Homo Sapiens
guggccaggaggaugauacaacauguccacccugaccaaucacuacacugauuaggccuggguc

SEQ ID NO: 526830 - RNA, 64 nt, Homo Sapiens
cccucaggaaagggaagaaaauagcagagagcaaaccaaucaguaagugggcuuggggaauuga

SEQ ID NO: 526831 - RNA, 64 nt, Homo Sapiens
ccccugccuuuuuuuuuuuuucucuacccuuccaaccaaucacauacacuguucugggguuugu

SEQ ID NO: 526832 - RNA, 64 nt, Homo Sapiens
uauucguucauuuagcaaauacccacaaacauucaccaaucauuuuuccucuuucuuggcuucu

SEQ ID NO: 526833 - RNA, 64 nt, Homo Sapiens
guguaauucuucugguaguauuuuaggccaguuuaccaaucacuauaaauaaaaagccugauua

SEQ ID NO: 526834 - RNA, 64 nt, Homo Sapiens
augcaaaaguucacuguugcaguguuuucaaaugaccaaucaaguacuacuucuugguuaaaag

SEQ ID NO: 526835 - RNA, 64 nt, Homo Sapiens
uggucucuccccuggcuugcuucauggccacugaaccaaucacuuuguaugcuaugcuccuacu

SEQ ID NO: 526836 - RNA, 64 nt, Homo Sapiens
uuagacaucuucugugauuguuauggcauauuacaccaaucagagaaauagaguuuuaaaguag

SEQ ID NO: 526837 - RNA, 64 nt, Homo Sapiens
cuucauuuagagaccacaguaacaacagcagcccaccaaucagagaagcugguuguuauuaacc

SEQ ID NO: 526838 - RNA, 64 nt, Homo Sapiens
cuuucuuuuucuggaaauuuuguccauuuuaaaaaccaaucauuuuaagaagacaugacaaugc

SEQ ID NO: 526839 - RNA, 64 nt, Homo Sapiens
gugcuuuaucaucuccaucuuuagccuuuacaccaccaaucaaaacucuagguacaccaacaca

SEQ ID NO: 526840 - RNA, 64 nt, Homo Sapiens
aauauuuuuauccuagggccaaguguugccugccaccaaucaguaaguuagucuauaacaaauu

SEQ ID NO: 526841 - RNA, 64 nt, Homo Sapiens
ccuuccuaacagucccccaaccucacuauucaaaaccaaucaugggccccuccaaaucucaugu

SEQ ID NO: 526842 - RNA, 64 nt, Homo Sapiens
ggacacugguuuuuagaccucauccugcuuagagaccaaucaacggguugaggcuugacuguag

SEQ ID NO: 526843 - RNA, 64 nt, Homo Sapiens
auccucuguucauuaaaacuacacaccuuuuuauaccaaucaguugaggacaccucagugacaa

SEQ ID NO: 526844 - RNA, 64 nt, Homo Sapiens
uuaauuauuauucuucauaaauauuuugcauaguaccaaucauuuguuauuuaaagaacacccu

SEQ ID NO: 526845 - RNA, 64 nt, Homo Sapiens
uuaacuuggcuaacauagcacagugcuaggauaaaccaaucauccuguugacaauuugccauag

SEQ ID NO: 526846 - RNA, 64 nt, Homo Sapiens
uuuucucucugucucucaaauucacucaaggagaaccaaucauaauuaggccaaacagauguac

SEQ ID NO: 526847 - RNA, 64 nt, Homo Sapiens
ccaugauuagacguugacugcaucucccugauagaccaaucagcugugucgcacuuaaacugga

SEQ ID NO: 526848 - RNA, 64 nt, Homo Sapiens
cucaauuaagaaaaacagucacaugucacgacaaaccaaucaaucuuuaugagauauuccugua

SEQ ID NO: 526849 - RNA, 64 nt, Homo Sapiens
aguauuauccugcuuccagaccuaugucaccaguaccaaucagucagugucaucacauuucagg

SEQ ID NO: 526850 - RNA, 64 nt, Homo Sapiens
uuguuugcuuguugaauuuuugaacagccaguugaccaaucauagaaaguauuacuuucuuuca

SEQ ID NO: 526851 - RNA, 64 nt, Homo Sapiens
uuuugaacccaacucuaccuuucauuuucuuaagaccaaucacagcuugugccucagaucaucc

SEQ ID NO: 526852 - RNA, 64 nt, Homo Sapiens
ugcccuggcagugacuuggagcccugaagaagggaccaaucaugggaccacagccacugugccc

SEQ ID NO: 526853 - RNA, 64 nt, Homo Sapiens
ucauugcucuggcugaguugugugccuguuucugaccaaucacugagucaggaggaugaaauau

SEQ ID NO: 526854 - RNA, 64 nt, Homo Sapiens
ucaucuggaucaugggacccucucuaauccuuccaccaaucaaauaagcuauugcuauugguuu

SEQ ID NO: 526855 - RNA, 64 nt, Homo Sapiens
ccguguggauuuuucucugacugauauacauaacaccaaucagaagaguagaaaaaucuguugc

SEQ ID NO: 526856 - RNA, 64 nt, Homo Sapiens
ggcauuuuaucuucucugaaggacugcagacucuaccaaucacggauuucaggugcuugcaacu

SEQ ID NO: 526857 - RNA, 64 nt, Homo Sapiens
gaugcuguuuuuauugggcaugggagauaaugaaaccaaucauguggugucaccacuacuuaau

SEQ ID NO: 526858 - RNA, 64 nt, Homo Sapiens
caaacaaagaaaaaauuccaaacccaccaaaccaaccaaucaacuuuuggaagaggaaaacagg

SEQ ID NO: 526859 - RNA, 64 nt, Homo Sapiens
agguugaagaguggccccuugaggcccuggaaagaccaaucacuggacuucuucccuugagagu

SEQ ID NO: 526860 - RNA, 64 nt, Homo Sapiens
gacacugaggcugcagcgggaauucgcacucggcaccaaucagagccccaugccgcggccccuc

SEQ ID NO: 526861 - RNA, 64 nt, Homo Sapiens
uucauuaugaaaggucaagcaaagacagcagaauaccaaucacuucaucauuuaggaaguaugg

SEQ ID NO: 526862 - RNA, 64 nt, Homo Sapiens
uaaggcugguguagaaacaaagggccuaaugagaaccaaucaucauggaagucaguugcggggg

SEQ ID NO: 526863 - RNA, 64 nt, Homo Sapiens
uauuaaguguuauuugcaaaagguagauuauguaaccaaucagguacguaccaggcagugaugu

SEQ ID NO: 526864 - RNA, 64 nt, Homo Sapiens
caggacgcccggggccaccacuugggucggguuuaccaaucagcaggcagagguugcucggggc

SEQ ID NO: 526865 - RNA, 64 nt, Homo Sapiens
guccgauuguaagcuauguucagacccagaaaggaccaaucacuaaagaaaauaaaucucaugu

SEQ ID NO: 526866 - RNA, 64 nt, Homo Sapiens
uuauuguuuuuaaucauugauauuauucugccaaaccaaucaugguauuacuuuuuauguuugg

SEQ ID NO: 526867 - RNA, 64 nt, Homo Sapiens
guuuuaauguuuguguguuccucugcuuucuguaaccaaucagugcuaauguuuuuuccucaaa

SEQ ID NO: 526868 - RNA, 64 nt, Homo Sapiens
uccuuccuguuaaucacauguacgaagaaaacucaccaaucauccuauccacagugaaccuggu

SEQ ID NO: 526869 - RNA, 64 nt, Homo Sapiens
caaaaaauaaauaaaucacuacuuagcauggaucaccaaucaauugagcuccagaaaggacgua

SEQ ID NO: 526870 - RNA, 64 nt, Homo Sapiens
aaguuuuaaauauuuuucuucaaaggcuuguuaaaccaaucauguuaaaaggaaauucuugguu

SEQ ID NO: 526871 - RNA, 64 nt, Homo Sapiens
auaaccauuuguauaaugagaaaucuaggggaaaaccaaucaguccaacaugagauuuuaggaa

SEQ ID NO: 526872 - RNA, 64 nt, Homo Sapiens
cuggagaggauugugcaggcacauuaauauugugaccaaucacagaaucugggaauaugaagcu

SEQ ID NO: 526873 - RNA, 51 nt, Homo Sapiens
cagaaucagaacagaaguaguaccaaucaaugucacaugaacaaacaagcu

SEQ ID NO: 526874 - RNA, 64 nt, Homo Sapiens
ggcccaaauuuuccagccccucucccuuacccugaccaaucaguuccauauccuaaugauucaa

SEQ ID NO: 526875 - RNA, 64 nt, Homo Sapiens
cacauuuuauaauguuugucagaguuaauaaauuaccaaucaggaauauuaucacuugacagau

SEQ ID NO: 526876 - RNA, 64 nt, Homo Sapiens
ccacacaagcauuuauuuuuuuugugcaucauuuaccaaucauggaaggaaaaaagaaccuauu

SEQ ID NO: 526877 - RNA, 64 nt, Homo Sapiens
cagcucagagcugagggccucccccuccacagcaaccaaucacaaccauaaagcuacaagcacg

SEQ ID NO: 526878 - RNA, 64 nt, Homo Sapiens
aauaccauuuggagcuggacaacauuugacaccaaccaaucauacuggacaaggcccuuagagg

SEQ ID NO: 526879 - RNA, 64 nt, Homo Sapiens
aagcaugcaccaaacacugcuuucuuugacauuuaccaaucaccuauauuuuaucuuuuaucuu

SEQ ID NO: 526880 - RNA, 64 nt, Homo Sapiens
guuaagaugagagaucaaccuaugguaaaauugaaccaaucacaaaaugaauuuauucuuucgg

SEQ ID NO: 526881 - RNA, 64 nt, Homo Sapiens
gagcaagcaagcacagccaaauuugccaaauguuaccaaucagucguuugauuucuuguguuuu

SEQ ID NO: 526882 - RNA, 64 nt, Homo Sapiens
uuauugcauugacuucacucgcaguguuaggaaaaccaaucaggacacccacgcugguuucugu

SEQ ID NO: 526883 - RNA, 64 nt, Homo Sapiens
auguguuaccuguacaauuauugcaagauauuuuaccaaucagcaugccuaugugucuugcaga

SEQ ID NO: 526884 - RNA, 64 nt, Homo Sapiens
agccaagucagcaagcaaucuucaaagucaugaaaccaaucaacaauugucauaggagggaagc

SEQ ID NO: 526885 - RNA, 64 nt, Homo Sapiens
ucagaccugguugauuuuguugugugcucuuaucaccaaucaguuccuuaaggaaggacugauc

SEQ ID NO: 526886 - RNA, 64 nt, Homo Sapiens
uacagauuaauuuuuccauaaaaccauuuuuugaaccaaucaguaauuuuaagguuuuguuugu

SEQ ID NO: 526887 - RNA, 64 nt, Homo Sapiens
caugugggcagacauugggauaacaacuuucaucaccaaucauuggacuuuugugaaguugaca

SEQ ID NO: 526888 - RNA, 64 nt, Homo Sapiens
cugggggagaaccacugacccaaaugaauucuaaaccaaucaaaugucugggaagcccuccaag

SEQ ID NO: 526889 - RNA, 64 nt, Homo Sapiens
cuuuuggaccuacauacauuuuccuuuguuuuugaccaaucaaugaagccaaauuuauaugucc

SEQ ID NO: 526890 - RNA, 64 nt, Homo Sapiens
cacuaagagagaaugagagacacacugaagaagcaccaaucaugaauuaguuuuauaugcuucu

SEQ ID NO: 526891 - RNA, 64 nt, Homo Sapiens
uuggcacucaugaugggaccucugggcagccaguaccaaucaauaauucuucccagcacagugu

SEQ ID NO: 526892 - RNA, 64 nt, Homo Sapiens
ugcagcacaugggugaugucccauggcagacaucaccaaucaaggggauggugaauggcuguga

SEQ ID NO: 526893 - RNA, 64 nt, Homo Sapiens
cacagaauuugauuggauuugaguauaaaauaaaaccaaucaaauugugauauaaaauaaagcu

SEQ ID NO: 526894 - RNA, 64 nt, Homo Sapiens
gagcucacuaaaaugcuaauuuagcucacaccugaccaaucagauuaaacacggggcuugcaac

SEQ ID NO: 526895 - RNA, 64 nt, Homo Sapiens
uaguuucuuugucuugcuccaacuuuccacucuaaccaaucaaaucaguuaaccucuaaauaug

SEQ ID NO: 526896 - RNA, 64 nt, Homo Sapiens
aggggauuuuuuuaaaauccggcugcacauucauaccaaucaccgcucagugguuuccaaauuu

SEQ ID NO: 526897 - RNA, 64 nt, Homo Sapiens
uuuuuuuucuuguuuccuuauaaaacagguaauaaccaaucauuuuguguuuguauuuccauuc

SEQ ID NO: 526898 - RNA, 64 nt, Homo Sapiens
guggagaaaguaaucuccuugcaaucauguggacaccaaucacaaaaguaaagcccugguguug

SEQ ID NO: 526899 - RNA, 64 nt, Homo Sapiens
aauuuaagaccauauuauuaucaaaaaccuagagaccaaucauauaucugaaaagaaauaccca

SEQ ID NO: 526900 - RNA, 64 nt, Homo Sapiens
uccuguaagaccuccuaccacauggcgaguauacaccaaucaggagaggguagcugccugcaua

SEQ ID NO: 526901 - RNA, 64 nt, Homo Sapiens
aaaugaucuguaguuccguggcuugcaugggugcaccaaucaucuuuagaacgauguacacuga

SEQ ID NO: 526902 - RNA, 64 nt, Homo Sapiens
gaggggaccugcugggaauggaggacaagacaggaccaaucaaacggaaggccagcucuucuug

SEQ ID NO: 526903 - RNA, 64 nt, Homo Sapiens
auguauuggggauaucuuuguauucauauuuucuaccaaucacuguaaaccaucuuuuauccuc

SEQ ID NO: 526904 - RNA, 64 nt, Homo Sapiens
agcaugucuacugcuuggauuacagauuuaguuuaccaaucaacuaugaaguuaacagucucau

SEQ ID NO: 526905 - RNA, 64 nt, Homo Sapiens
uaguuuuaucaguguauuuaacaaccaauugauaaccaaucacaagugaaaauguugucucuuu

SEQ ID NO: 526906 - RNA, 64 nt, Homo Sapiens
ggcugaaucgaaacauguguaaugucaauguaaaaccaaucacagcugugaacugcaugaaaug

SEQ ID NO: 526907 - RNA, 64 nt, Homo Sapiens
auuaaccuuuucaaauuaauguuccaguuugaagaccaaucaaauauauuauuuagucaacaua

SEQ ID NO: 526908 - RNA, 64 nt, Homo Sapiens
ccaugccacaccuuauccaguuagacacauacauaccaaucauuagaagaacaaguuuagaagg

SEQ ID NO: 526909 - RNA, 64 nt, Homo Sapiens
uauauaguguagcaaaagaguauuuauacaucccaccaaucaaaacacagcuuuauuaccucau

SEQ ID NO: 526910 - RNA, 64 nt, Homo Sapiens
ccuacagugcuuugaagguucccagcuuuccccgaccaaucacgucuuagggcccucucccugc

SEQ ID NO: 526911 - RNA, 64 nt, Homo Sapiens
acuagaugacuuuuaaggcucaguggaacaggcuaccaaucagaaaucugggacagggagguga

SEQ ID NO: 526912 - RNA, 64 nt, Homo Sapiens
aaucuuuguuucagguucagagugcacccaugguaccaaucaugcucggaguguguaugccaag

SEQ ID NO: 526913 - RNA, 64 nt, Homo Sapiens
auucacugugcacuuugcucaaaauuuuaaaaauaccaaucacaaggauaauagaguagccuaa

SEQ ID NO: 526914 - RNA, 64 nt, Homo Sapiens
ucccuagacacuagaacuaaaggauugguaauaaaccaaucagaaagaaauccucugugggguc

SEQ ID NO: 526915 - RNA, 64 nt, Homo Sapiens
ccugacuccagccacaaagcucauacccagcccuaccaaucaugaacuggaacuccauaaggag

SEQ ID NO: 526916 - RNA, 64 nt, Homo Sapiens
ggcaccuccaaaucucauguccucacauuucaaaaccaaucaugccuucccaacagucccccaa

SEQ ID NO: 526917 - RNA, 64 nt, Homo Sapiens
gucucauggucagcucgccucucaaagauggcucaccaaucaccugccuguuuuuacuuagaaa

SEQ ID NO: 526918 - RNA, 64 nt, Homo Sapiens
caaauagcccauacauuugagcugaguccaggccaccaaucaggcugcugcaaaggaaucucuu

SEQ ID NO: 526919 - RNA, 64 nt, Homo Sapiens
gaaguugaagaugaauguugagcagcuugauuccaccaaucagaucaaccaauauaaauccaca

SEQ ID NO: 526920 - RNA, 64 nt, Homo Sapiens
cccagugacaccagcacugauuggacugcccuacaccaaucagaagcucagugcccaaugggcc

SEQ ID NO: 526921 - RNA, 64 nt, Homo Sapiens
gccugcucguaaagcucaauccuucuaucauggcaccaaucacaagaaccuuggacguuugacu

SEQ ID NO: 526922 - RNA, 64 nt, Homo Sapiens
auggaugccauuccuuuugcccaguuaaauguucaccaaucauuuuaacuaaauacucagacuu

SEQ ID NO: 526923 - RNA, 64 nt, Homo Sapiens
auaacaguaauuaauuguguaauucagaauucauaccaaucaguguugaaacucaaacauugca

SEQ ID NO: 526924 - RNA, 64 nt, Homo Sapiens
gcugugcgcuugucagaccaucagaccagggccaaccaaucagaaggcaacuuacuguauaaau

SEQ ID NO: 526925 - RNA, 64 nt, Homo Sapiens
caccaacacaacagcaauggcaacaccgacagcaaccaaucagauauauacaaaugaaauuaga

SEQ ID NO: 526926 - RNA, 64 nt, Homo Sapiens
uauuucaccguuugcacuuuaugacuuccuuggcaccaaucaugaguguucacauucacacuua

SEQ ID NO: 526927 - RNA, 64 nt, Homo Sapiens
uuuuccaaaucaaucaccagguuugucucucuugaccaaucauuuuaccaagugcuuuccucaa

SEQ ID NO: 526928 - RNA, 64 nt, Homo Sapiens
agaaaauaauggcaauaauuuauuuuuaaauuguaccaaucacaucaaugugaaaacauagacu

SEQ ID NO: 526929 - RNA, 64 nt, Homo Sapiens
gacaagaaaacgcuuacacaggggagaugaaccaaccaaucaaugaaaaauugucuccuaauuu

SEQ ID NO: 526930 - RNA, 64 nt, Homo Sapiens
uuguaaaacucugauuguacuuagagaugugacuaccaaucaguuugauacucaaggaaagggg

SEQ ID NO: 526931 - RNA, 64 nt, Homo Sapiens
uggcaccacuuucaagaugcggauggaacaggaaaccaaucacccccuggcuccggagaaugcu

SEQ ID NO: 526932 - RNA, 64 nt, Homo Sapiens
uggaaguuaauuuuauaaaacaggcaaaaacaccaccaaucacgccggaagaucuggcgaagcu

SEQ ID NO: 526933 - RNA, 64 nt, Homo Sapiens
acuugccagcuccucaaaaccaccacugucacacaccaaucagaacugcaaaacugguuuuacc

SEQ ID NO: 526934 - RNA, 64 nt, Homo Sapiens
guagaacaaagaaaauguugguuagggcugaggaaccaaucaagaaacaagacagacucgaguu

SEQ ID NO: 526935 - RNA, 64 nt, Homo Sapiens
uuuuguucuuuuuuccuggagcaaucuuaaggucaccaaucaguuuaguggaauguagaaugug

SEQ ID NO: 526936 - RNA, 64 nt, Homo Sapiens
gguuuguuuacgggagugccagcagcuaccccaaaccaaucaagagcuagcccgaacugacuuc

SEQ ID NO: 526937 - RNA, 64 nt, Homo Sapiens
gacucagaacugaaggcaauccccagccuuucuuaccaaucaagaacaugguuucaagcccagc

SEQ ID NO: 526938 - RNA, 64 nt, Homo Sapiens
uagucaaggaaccucaagucaugcuuuugcuaucaccaaucauaguguacccaucuuuaauuua

SEQ ID NO: 526939 - RNA, 64 nt, Homo Sapiens
ugguauuuucaagggaauuuuuuacugacacaugaccaaucauagugauggggaccgucuuucu

SEQ ID NO: 526940 - RNA, 64 nt, Homo Sapiens
cacauauuuugacccaaguggauauuuucuuaaaaccaaucaauaauagcuagcuauuacugca

SEQ ID NO: 526941 - RNA, 64 nt, Homo Sapiens
ugggguuuuuuuuuuuccuuuguuaagaaagccaaccaaucacaaugauauagucauuguugug

SEQ ID NO: 526942 - RNA, 64 nt, Homo Sapiens
ggauucuguagaaaauacauacuuccugugccauaccaaucaguuacacucaaagcuuucuugg

SEQ ID NO: 526943 - RNA, 64 nt, Homo Sapiens
gaaaccugcucggaauuaaaacaccugcuccaggaccaaucaguacuuaguaaaugucauaacu

SEQ ID NO: 526944 - RNA, 64 nt, Homo Sapiens
ggcaucacuuuccuggauccaggauaauuuuuaaaccaaucaaaugaaaaaaacaaacaaacaa

SEQ ID NO: 526945 - RNA, 64 nt, Homo Sapiens
uguaaaaugcacccaucagugcucuguaaaacacaccaaucagcgcucuguagcuagcaauagg

SEQ ID NO: 526946 - RNA, 64 nt, Homo Sapiens
uguaaaaugcacccaucagcacucuguaaaacgcaccaaucagcacucuguaaaaugcaccaau

SEQ ID NO: 526947 - RNA, 64 nt, Homo Sapiens
uguaaaacgcaccaaucagcacucuguaaaaugcaccaaucagcaggauucuaaaaguagacaa

SEQ ID NO: 526948 - RNA, 64 nt, Homo Sapiens
gaggcagggaggggagcaucugucugccacugagaccaaucacagccucuuugcacagcaugcc

SEQ ID NO: 526949 - RNA, 64 nt, Homo Sapiens
ucuucucuuaagaggcuuccagagaaaacggcacaccaaucaauaaagaacugagcagaaacca

SEQ ID NO: 526950 - RNA, 64 nt, Homo Sapiens
uuacauuuuuauuuuuauuuaggaaagaauggaaaccaaucacuggcaccaaguuaggucucag

SEQ ID NO: 526951 - RNA, 64 nt, Homo Sapiens
uccaagggccugaugacucuuuugguaaccagacaccaaucaaauaaggggaggagacgaaaau

SEQ ID NO: 526952 - RNA, 64 nt, Homo Sapiens
guggauuuaccuguagaguuuauuggauccugaaaccaaucaauuacuuagaacuaggcaaaga

SEQ ID NO: 526953 - RNA, 64 nt, Homo Sapiens
ggcacucuguaucuagcucaagguuuguaaacacaccaaucagcacccugugucuagcucagug

SEQ ID NO: 526954 - RNA, 64 nt, Homo Sapiens
gaaccuuugugucuagcucagggaucguaaacgcaccaaucagcacccugucaaaacagaccac

SEQ ID NO: 526955 - RNA, 64 nt, Homo Sapiens
gucaaaacagaccacuugacucucuguaaaauggaccaaucagcaggauguggguggggcgaga

SEQ ID NO: 526956 - RNA, 64 nt, Homo Sapiens
gacccuggcuucuggaguccucugugagugagggaccaaucaaaauuauuuuucaaaaagcaaa

SEQ ID NO: 526957 - RNA, 64 nt, Homo Sapiens
gggaaaauuuuuagaagaaaagcaaacaugugagaccaaucauuaucaaauacuuuuauuuuuu

SEQ ID NO: 526958 - RNA, 64 nt, Homo Sapiens
uccuucaccacugugccuuaaccacacuugggggaccaaucaugggcugccaugagaccugagg

SEQ ID NO: 526959 - RNA, 64 nt, Homo Sapiens
caaucaaucaaucacuguccagacucugucucaaaccaaucaauccauccuggacgacagagug

SEQ ID NO: 526960 - RNA, 64 nt, Homo Sapiens
gaacuuacucuauucaguggucuauauauguuaaaccaaucaagguuuuuauucucucaggcag

SEQ ID NO: 526961 - RNA, 64 nt, Homo Sapiens
cugcagcccaggggcgucugaccagcaacccgcgaccaaucauggcuccggcccgggacccagg

SEQ ID NO: 526962 - RNA, 64 nt, Homo Sapiens
ucuaaaacuaaagaaucuaggaaccuugccugcgaccaaucauggagccacgugagcugaucgu

SEQ ID NO: 526963 - RNA, 64 nt, Homo Sapiens
uucaguugcuuuugucucccuaggaggcagguaaaccaaucaaaaacagaguuuucuguguuuc

SEQ ID NO: 526964 - RNA, 64 nt, Homo Sapiens
ccuugcaaauaaucacagauuagcuguaauuuuaaccaaucagaugacaacaaagauugauaga

SEQ ID NO: 526965 - RNA, 64 nt, Homo Sapiens
ucugauauucuguggaagguucaagaguggaaggaccaaucaccuuggaauucuuagguucuac

SEQ ID NO: 526966 - RNA, 64 nt, Homo Sapiens
ccagaugguuuugggggaacgugucacuccccucaccaaucacuccuguauucccaucucccca

SEQ ID NO: 526967 - RNA, 64 nt, Homo Sapiens
uacuagaugaguggauggauuacccuuugugaaaaccaaucaaucaaccagggguuucuuuccc

SEQ ID NO: 526968 - RNA, 64 nt, Homo Sapiens
aucuugucaauauagucagcuucuucaacauguaaccaaucaguuguauuuuguauuguauguu

SEQ ID NO: 526969 - RNA, 64 nt, Homo Sapiens
uucaucaaaacagaagaaaaagcaucaagagaaaaccaaucagcauuuucccuuuuuauuuuuc

SEQ ID NO: 526970 - RNA, 64 nt, Homo Sapiens
aguagaacccacuucaaaauaugccagaauuaaaaccaaucauaauaguaguuggcaagaugaa

SEQ ID NO: 526971 - RNA, 64 nt, Homo Sapiens
gcccacccugcugcccaacuccugugagagaaaaaccaaucaauguuuacaaaauggaaaagga

SEQ ID NO: 526972 - RNA, 64 nt, Homo Sapiens
uugucauuaauguuuggaaacuuacaaaugacuaaccaaucaaauacuguauuauuuugguaug

SEQ ID NO: 526973 - RNA, 56 nt, Homo Sapiens
ucccaugaaaagacuuaaugagcuucaccaaucaagguugcucaagcaugucauaa

SEQ ID NO: 526974 - RNA, 64 nt, Homo Sapiens
gcauagcagaugcucguucuugccuccuucaggcaccaaucaggagaaggguucugccucccau

SEQ ID NO: 526975 - RNA, 64 nt, Homo Sapiens
cucccagccugaaucugccuggauggaacugaggaccaaucaugcugcaaggaacacuuccacg

SEQ ID NO: 526976 - RNA, 64 nt, Homo Sapiens
cuccucccuccuccacaccuugagugaugaccacaccaaucacuguauuuuauagcuuuuuuuu

SEQ ID NO: 526977 - RNA, 64 nt, Homo Sapiens
aaaagaaaaaaaggauaugguuaccuguaaucuuaccaaucauagauaaucacugucaaacuuu

SEQ ID NO: 526978 - RNA, 64 nt, Homo Sapiens
cauuggcccaaaugggccaugugauuuucucuaaaccaaucacugugacucuagaguggccaga

SEQ ID NO: 526979 - RNA, 64 nt, Homo Sapiens
augagccaccacgccuggccagaugcauguucaaaccaaucaaaugguguuuucuuaugcagga

SEQ ID NO: 526980 - RNA, 64 nt, Homo Sapiens
cggagccccaggagcccaaggaaagacuuuacugaccaaucagcucgguaauagaaaaaucucu

SEQ ID NO: 526981 - RNA, 60 nt, Homo Sapiens
cuuuauggagaacagaaggggucacuucucaccaaucagaaagauuguggacaaauuuga

SEQ ID NO: 526982 - RNA, 64 nt, Homo Sapiens
uuauuuaaaucaauuuauuuguauucugaaauuaaccaaucaguuuagaaaaaaguaauaugaa

SEQ ID NO: 526983 - RNA, 64 nt, Homo Sapiens
aacuaccauucuauuccaugucuaggcaccucagaccaaucaucgagcuagauuuaacucaguu

SEQ ID NO: 526984 - RNA, 64 nt, Homo Sapiens
ugagccacaucaaagcuaagaugugggguuggugaccaaucaguccaggcucagaucgaccaau

SEQ ID NO: 526985 - RNA, 64 nt, Homo Sapiens
uugguaaagaccuaaaaccaugcccuguugauaaaccaaucaaaauauauuuaaaccaaccuca

SEQ ID NO: 526986 - RNA, 64 nt, Homo Sapiens
aggacaugggcggggacaaugcucuguaaaauggaccaaucagcuguaagauggaccaaucagc

SEQ ID NO: 526987 - RNA, 64 nt, Homo Sapiens
gcucuguaaaauggaccaauacucuguaagauggaccaaucagcuguaaaauggaccaaucagc

SEQ ID NO: 526988 - RNA, 64 nt, Homo Sapiens
acucuguaagauggaccaauggauuguaaaauggaccaaucagcaacuuuucugucuuacaaga

SEQ ID NO: 526989 - RNA, 64 nt, Homo Sapiens
ccaggaguuugagguuacagugagccacaaucacaccaaucacugcacuccagccugggcaaua

SEQ ID NO: 526990 - RNA, 64 nt, Homo Sapiens
acugguuccuccuuaaaaaugugagagauuugucaccaaucaucccuuccacccauuuuuaauu

SEQ ID NO: 526991 - RNA, 64 nt, Homo Sapiens
aaacuccuugagcaauaguuauaucauuaaguaaaccaaucagauuacagaauguaguauuuug

SEQ ID NO: 526992 - RNA, 64 nt, Homo Sapiens
ucaggguuccagaaaucccccguucccaaaccaaaccaaucauggaucuucccuuuaaggggua

SEQ ID NO: 526993 - RNA, 64 nt, Homo Sapiens
ccuauuuuguuacccaacucuuccuauuuuuguuaccaaucacugugcucucugccgcccccug

SEQ ID NO: 526994 - RNA, 64 nt, Homo Sapiens
cacugaaccugccucauggccugcagcaggcaagaccaaucaauucuggagcuggccagguccu

SEQ ID NO: 526995 - RNA, 64 nt, Homo Sapiens
auagaaggaggagagggaaaauguuuuguaagaaaccaaucaagauaaaggacagugaaguaau

SEQ ID NO: 526996 - RNA, 64 nt, Homo Sapiens
uugagaacuuuauuuccaaguuguucaaacauuuaccaaucauauuaauacaaugaugcuauuu

SEQ ID NO: 526997 - RNA, 64 nt, Homo Sapiens
aauggaccaaauacauuuuuaaaagaaaacugagaccaaucagauggaaauggaguuuuaaggc

SEQ ID NO: 526998 - RNA, 64 nt, Homo Sapiens
caguuagccuaaaccuauugacaauggaaauaaaaccaaucagucaggagcccucuugaaauua

SEQ ID NO: 526999 - RNA, 64 nt, Homo Sapiens
uuaguguuuauuucuucuacuugcauuuaguaagaccaaucagcuagccaugaacacagcuugc

SEQ ID NO: 527000 - RNA, 64 nt, Homo Sapiens
gcucuuuaaaauacggaacgauucagaaguguguaccaaucaaggcuugacugauuucagugau

SEQ ID NO: 527001 - RNA, 65 nt, Homo Sapiens
cuccuggcuguugacuucccauugcucuuggagccaccaaucaaagagauucaaagagauuccug

SEQ ID NO: 527002 - RNA, 65 nt, Homo Sapiens
ucggcucagugacagccaaccugcccccuccccacaccaaucagccaggcugagcccccaccccu

SEQ ID NO: 527003 - RNA, 65 nt, Homo Sapiens
ucccuaccuuuuucuucucuucauugaccaaaucaaccaaucacuacagcugcucugcuucugcu

SEQ ID NO: 527004 - RNA, 65 nt, Homo Sapiens
ccacggggaucacagcguuucaggaacguugccacaccaaucagagagccuagaacaucccuggg

SEQ ID NO: 527005 - RNA, 65 nt, Homo Sapiens
gucaugagcaaauaugucaagggagucaauuucugaccaaucaaguacacuaaauuagaauauuu

SEQ ID NO: 527006 - RNA, 65 nt, Homo Sapiens
uaagaaugguuuuccaccuuuucccccuaaucucuaccaaucagacacauuuuauuauuuaaauc

SEQ ID NO: 527007 - RNA, 65 nt, Homo Sapiens
gcacccuccauagccaccaaaccuguuagaacuggaccaaucaaaccucaggcgaucaaaaccga

SEQ ID NO: 527008 - RNA, 65 nt, Homo Sapiens
gguaaugcagaaaucuguuuuguucccaugaaaucaccaaucaaggccuccguucuucuaaagau

SEQ ID NO: 527009 - RNA, 65 nt, Homo Sapiens
acuuuuaagaaauauauauaaauuauucuuuucucaccaaucaacaugagaaaaguuaaccaagg

SEQ ID NO: 527010 - RNA, 65 nt, Homo Sapiens
guggcaugaggcccacgccagcccccugucuacugaccaaucagucccugugguguuuggcaugu

SEQ ID NO: 527011 - RNA, 65 nt, Homo Sapiens
auggaauaaaguguugaguucaaucuuacauguauaccaaucacauuuuuagucucuugaugucu

SEQ ID NO: 527012 - RNA, 65 nt, Homo Sapiens
ccuuucacggcccuuuaguuacucugugugccaaaaccaaucaugcagccaauguaugguuaucc

SEQ ID NO: 527013 - RNA, 65 nt, Homo Sapiens
aauacuaguuuaaaaugaauugcaauuuuuaucuaaccaaucagaacaggaucuuucagaucaug

SEQ ID NO: 527014 - RNA, 65 nt, Homo Sapiens
gaugcuguagcuccuugggguuuucuauuccuuggaccaaucagauguuacauuuucccaauauc

SEQ ID NO: 527015 - RNA, 65 nt, Homo Sapiens
guggccaggaggaugauacacacauguccacccugaccaaucacucacacugauuaggccugggu

SEQ ID NO: 527016 - RNA, 65 nt, Homo Sapiens
cccucaggaaagggaagaaaaauagcagagagcaaaccaaucagucaagugggcuuggggaauug

SEQ ID NO: 527017 - RNA, 65 nt, Homo Sapiens
ccccugccuuuuuuuuuuuuuucucuacccuuccaaccaaucacauuacacuguucugggguuug

SEQ ID NO: 527018 - RNA, 65 nt, Homo Sapiens
uauucguucauuuagcaaauuacccacaaacauucaccaaucauuuuuuccucuuucuuggcuuc

SEQ ID NO: 527019 - RNA, 65 nt, Homo Sapiens
guguaauucuucugguaguaauuuuaggccaguuuaccaaucacuuauaaauaaaaagccugauu

SEQ ID NO: 527020 - RNA, 65 nt, Homo Sapiens
gaugcaaaaguucacuguugcaguguuuucaaaugaccaaucaaguacuacuucuugguuaaaag

SEQ ID NO: 527021 - RNA, 65 nt, Homo Sapiens
guggucucuccccuggcuugcuucauggccacugaaccaaucacuuuguaugcuaugcuccuacu

SEQ ID NO: 527022 - RNA, 65 nt, Homo Sapiens
guuagacaucuucugugauuguuauggcauauuacaccaaucagagaaauagaguuuuaaaguag

SEQ ID NO: 527023 - RNA, 65 nt, Homo Sapiens
gcuucauuuagagaccacaguaacaacagcagcccaccaaucagagaagcugguuguuauuaacc

SEQ ID NO: 527024 - RNA, 65 nt, Homo Sapiens
ucuuucuuuuucuggaaauuuuguccauuuuaaaaaccaaucauuuuaagaagacaugacaaugc

SEQ ID NO: 527025 - RNA, 65 nt, Homo Sapiens
ugugcuuuaucaucuccaucuuuagccuuuacaccaccaaucaaaacucuagguacaccaacaca

SEQ ID NO: 527026 - RNA, 65 nt, Homo Sapiens
aaauauuuuuauccuagggccaaguguugccugccaccaaucaguaaguuagucuauaacaaauu

SEQ ID NO: 527027 - RNA, 65 nt, Homo Sapiens
ccuuccuaacagucccccaauccucacuauucaaaaccaaucauguggccccuccaaaucucaug

SEQ ID NO: 527028 - RNA, 65 nt, Homo Sapiens
ggacacugguuuuuagaccugcauccugcuuagagaccaaucaacuggguugaggcuugacugua

SEQ ID NO: 527029 - RNA, 65 nt, Homo Sapiens
auccucuguucauuaaaacuaacacaccuuuuuauaccaaucaguaugaggacaccucagugaca

SEQ ID NO: 527030 - RNA, 65 nt, Homo Sapiens
uuaauuauuauucuucauaauauauuuugcauaguaccaaucauuuuguuauuuaaagaacaccc

SEQ ID NO: 527031 - RNA, 65 nt, Homo Sapiens
uuaacuuggcuaacauagcagcagugcuaggauaaaccaaucaucucuguugacaauuugccaua

SEQ ID NO: 527032 - RNA, 65 nt, Homo Sapiens
uuuucucucugucucucaaacuucacucaaggagaaccaaucauaaauuaggccaaacagaugua

SEQ ID NO: 527033 - RNA, 65 nt, Homo Sapiens
gccaugauuagacguugacugcaucucccugauagaccaaucagcugugucgcacuuaaacugga

SEQ ID NO: 527034 - RNA, 65 nt, Homo Sapiens
ucucaauuaagaaaaacagucacaugucacgacaaaccaaucaaucuuuaugagauauuccugua

SEQ ID NO: 527035 - RNA, 65 nt, Homo Sapiens
aaguauuauccugcuuccagaccuaugucaccaguaccaaucagucagugucaucacauuucagg

SEQ ID NO: 527036 - RNA, 65 nt, Homo Sapiens
uuuguuugcuuguugaauuuuugaacagccaguugaccaaucauagaaaguauuacuuucuuuca

SEQ ID NO: 527037 - RNA, 65 nt, Homo Sapiens
auuuugaacccaacucuaccuuucauuuucuuaagaccaaucacagcuugugccucagaucaucc

SEQ ID NO: 527038 - RNA, 65 nt, Homo Sapiens
cugcccuggcagugacuuggagcccugaagaagggaccaaucaugggaccacagccacugugccc

SEQ ID NO: 527039 - RNA, 65 nt, Homo Sapiens
cucauugcucuggcugaguugugugccuguuucugaccaaucacugagucaggaggaugaaauau

SEQ ID NO: 527040 - RNA, 65 nt, Homo Sapiens
uucaucuggaucaugggacccucucuaauccuuccaccaaucaaauaagcuauugcuauugguuu

SEQ ID NO: 527041 - RNA, 65 nt, Homo Sapiens
ccguguggauuuuucucugaccugauauacauaacaccaaucagacagaguagaaaaaucuguug

SEQ ID NO: 527042 - RNA, 65 nt, Homo Sapiens
ggcauuuuaucuucucugaauggacugcagacucuaccaaucacgagauuucaggugcuugcaac

SEQ ID NO: 527043 - RNA, 65 nt, Homo Sapiens
gaugcuguuuuuauugggcauugggagauaaugaaaccaaucaugguggugucaccacuacuuaa

SEQ ID NO: 527044 - RNA, 65 nt, Homo Sapiens
caaacaaagaaaaaauuccagaacccaccaaaccaaccaaucaacguuuuggaagaggaaaacag

SEQ ID NO: 527045 - RNA, 65 nt, Homo Sapiens
cagguugaagaguggccccuugaggcccuggaaagaccaaucacuggacuucuucccuugagagu

SEQ ID NO: 527046 - RNA, 65 nt, Homo Sapiens
cgacacugaggcugcagcgggaauucgcacucggcaccaaucagagccccaugccgcggccccuc

SEQ ID NO: 527047 - RNA, 65 nt, Homo Sapiens
auucauuaugaaaggucaagcaaagacagcagaauaccaaucacuucaucauuuaggaaguaugg

SEQ ID NO: 527048 - RNA, 65 nt, Homo Sapiens
cuaaggcugguguagaaacaaagggccuaaugagaaccaaucaucauggaagucaguugcggggg

SEQ ID NO: 527049 - RNA, 65 nt, Homo Sapiens
guauuaaguguuauuugcaaaagguagauuauguaaccaaucagguacguaccaggcagugaugu

SEQ ID NO: 527050 - RNA, 65 nt, Homo Sapiens
caggacgcccggggccaccaccuugggucggguuuaccaaucagccaggcagagguugcucgggg

SEQ ID NO: 527051 - RNA, 65 nt, Homo Sapiens
guccgauuguaagcuauguuucagacccagaaaggaccaaucacuaaaagaaaauaaaucucaug

SEQ ID NO: 527052 - RNA, 65 nt, Homo Sapiens
uuauuguuuuuaaucauugaguauuauucugccaaaccaaucauguguauuacuuuuuauguuug

SEQ ID NO: 527053 - RNA, 65 nt, Homo Sapiens
guuuuaauguuuguguguucacucugcuuucuguaaccaaucaguagcuaauguuuuuuccucaa

SEQ ID NO: 527054 - RNA, 65 nt, Homo Sapiens
uccuuccuguuaaucacauguuacgaagaaaacucaccaaucaucccuauccacagugaaccugg

SEQ ID NO: 527055 - RNA, 65 nt, Homo Sapiens
caaaaaauaaauaaaucacuaacuuagcauggaucaccaaucaaucugagcuccagaaaggacgu

SEQ ID NO: 527056 - RNA, 65 nt, Homo Sapiens
caaguuuuaaauauuuuucuucaaaggcuuguuaaaccaaucauguuaaaaggaaauucuugguu

SEQ ID NO: 527057 - RNA, 65 nt, Homo Sapiens
cauaaccauuuguauaaugagaaaucuaggggaaaaccaaucaguccaacaugagauuuuaggaa

SEQ ID NO: 527058 - RNA, 65 nt, Homo Sapiens
ccuggagaggauugugcaggcacauuaauauugugaccaaucacagaaucugggaauaugaagcu

SEQ ID NO: 527059 - RNA, 51 nt, Homo Sapiens; identical to SEQ ID NO: 526873

SEQ ID NO: 527060 - RNA, 65 nt, Homo Sapiens
ggcccaaauuuuccagccccaucucccuuacccugaccaaucaguuuccauauccuaaugauuca

SEQ ID NO: 527061 - RNA, 65 nt, Homo Sapiens
cacauuuuauaauguuugucuagaguuaauaaauuaccaaucagggaauauuaucacuugacaga

SEQ ID NO: 527062 - RNA, 65 nt, Homo Sapiens
ccacacaagcauuuauuuuuuuuugugcaucauuuaccaaucaugugaaggaaaaaagaaccuau

SEQ ID NO: 527063 - RNA, 65 nt, Homo Sapiens
ccagcucagagcugagggccucccccuccacagcaaccaaucacaaccauaaagcuacaagcacg

SEQ ID NO: 527064 - RNA, 65 nt, Homo Sapiens
uaauaccauuuggagcuggacaacauuugacaccaaccaaucauacuggacaaggcccuuagagg

SEQ ID NO: 527065 - RNA, 65 nt, Homo Sapiens
aagcaugcaccaaacacugcuuuucuuugacauuuaccaaucacccuauauuuuaucuuuuaucu

SEQ ID NO: 527066 - RNA, 65 nt, Homo Sapiens
guuaagaugagagaucaaccguaugguaaaauugaaccaaucacacaaaugaauuuauucuuucg

SEQ ID NO: 527067 - RNA, 65 nt, Homo Sapiens
gagcaagcaagcacagccaauauuugccaaauguuaccaaucaguucguuugauuucuuguguuu

SEQ ID NO: 527068 - RNA, 65 nt, Homo Sapiens
uuauugcauugacuucacucugcaguguuaggaaaaccaaucaggaacacccacgcugguuucug

SEQ ID NO: 527069 - RNA, 65 nt, Homo Sapiens
auguguuaccuguacaauuaauugcaagauauuuuaccaaucagcuaugccuaugugucuugcag

SEQ ID NO: 527070 - RNA, 65 nt, Homo Sapiens
agccaagucagcaagcaauccuucaaagucaugaaaccaaucaacgaauugucauaggagggaag

SEQ ID NO: 527071 - RNA, 65 nt, Homo Sapiens
ucagaccugguugauuuugucugugugcucuuaucaccaaucaguuuccuuaaggaaggacugau

SEQ ID NO: 527072 - RNA, 65 nt, Homo Sapiens
uuacagauuaauuuuuccauaaaaccauuuuuugaaccaaucaguaauuuuaagguuuuguuugu

SEQ ID NO: 527073 - RNA, 65 nt, Homo Sapiens
acaugugggcagacauugggauaacaacuuucaucaccaaucauuggacuuuugugaaguugaca

SEQ ID NO: 527074 - RNA, 65 nt, Homo Sapiens
ccugggggagaaccacugacccaaaugaauucuaaaccaaucaaaugucugggaagcccuccaag

SEQ ID NO: 527075 - RNA, 65 nt, Homo Sapiens
ucuuuuggaccuacauacauuuuccuuuguuuuugaccaaucaaugaagccaaauuuauaugucc

SEQ ID NO: 527076 - RNA, 65 nt, Homo Sapiens
acacuaagagagaaugagagacacacugaagaagcaccaaucaugaauuaguuuuauaugcuucu

SEQ ID NO: 527077 - RNA, 65 nt, Homo Sapiens
uuggcacucaugaugggaccuucugggcagccaguaccaaucaaugaauucuucccagcacagug

SEQ ID NO: 527078 - RNA, 65 nt, Homo Sapiens
ugcagcacaugggugaugucaccauggcagacaucaccaaucaagagggauggugaauggcugug

SEQ ID NO: 527079 - RNA, 65 nt, Homo Sapiens
cacagaauuugauuggauuuugaguauaaaauaaaaccaaucaaauuugugauauaaaauaaagc

SEQ ID NO: 527080 - RNA, 65 nt, Homo Sapiens
gagcucacuaaaaugcuaaucuuagcucacaccugaccaaucagauuuaaacacggggcuugcaa

SEQ ID NO: 527081 - RNA, 65 nt, Homo Sapiens
uaguuucuuugucuugcuccgaacuuuccacucuaaccaaucaaagucaguuaaccucuaaauau

SEQ ID NO: 527082 - RNA, 65 nt, Homo Sapiens
aggggauuuuuuuaaaauccuggcugcacauucauaccaaucaccagcucagugguuuccaaauu

SEQ ID NO: 527083 - RNA, 65 nt, Homo Sapiens
uuuuuuuuucuuguuuccuuauaaaacagguaauaaccaaucauuuuguguuuguauuuccauuc

SEQ ID NO: 527084 - RNA, 65 nt, Homo Sapiens
gguggagaaaguaaucuccuugcaaucauguggacaccaaucacaaaaguaaagcccugguguug

SEQ ID NO: 527085 - RNA, 65 nt, Homo Sapiens
gaauuuaagaccauauuauuaucaaaaaccuagagaccaaucauauaucugaaaagaaauaccca

SEQ ID NO: 527086 - RNA, 65 nt, Homo Sapiens
cuccuguaagaccuccuaccacauggcgaguauacaccaaucaggagaggguagcugccugcaua

SEQ ID NO: 527087 - RNA, 65 nt, Homo Sapiens
uaaaugaucuguaguuccguggcuugcaugggugcaccaaucaucuuuagaacgauguacacuga

SEQ ID NO: 527088 - RNA, 65 nt, Homo Sapiens
gaggggaccugcugggaaugggaggacaagacaggaccaaucaaaucggaaggccagcucuucuu

SEQ ID NO: 527089 - RNA, 65 nt, Homo Sapiens
auguauuggggauaucuuugcuauucauauuuucuaccaaucacuaguaaaccaucuuuuauccu

SEQ ID NO: 527090 - RNA, 65 nt, Homo Sapiens
agcaugucuacugcuuggauuuacagauuuaguuuaccaaucaacuuaugaaguuaacagucuca

SEQ ID NO: 527091 - RNA, 65 nt, Homo Sapiens
uaguuuuaucaguguauuuauacaaccaauugauaaccaaucacacagugaaaauguugucucuu

SEQ ID NO: 527092 - RNA, 65 nt, Homo Sapiens
uggcugaaucgaaacauguguaaugucaauguaaaaccaaucacagcugugaacugcaugaaaug

SEQ ID NO: 527093 - RNA, 65 nt, Homo Sapiens
gauuaaccuuuucaaauuaauguuccaguuugaagaccaaucaaauauauuauuuagucaacaua

SEQ ID NO: 527094 - RNA, 65 nt, Homo Sapiens
uccaugccacaccuuauccaguuagacacauacauaccaaucauuagaagaacaaguuuagaagg

SEQ ID NO: 527095 - RNA, 65 nt, Homo Sapiens
guauauaguguagcaaaagaguauuuauacaucccaccaaucaaaacacagcuuuauuaccucau

SEQ ID NO: 527096 - RNA, 65 nt, Homo Sapiens
ccuacagugcuuugaagguuccccagcuuuccccgaccaaucacguucuuagggcccucucccug

SEQ ID NO: 527097 - RNA, 65 nt, Homo Sapiens
acuagaugacuuuuaaggcuacaguggaacaggcuaccaaucagaaaaucugggacagggaggug

SEQ ID NO: 527098 - RNA, 65 nt, Homo Sapiens
aaucuuuguuucagguucaggagugcacccaugguaccaaucaugucucggaguguguaugccaa

SEQ ID NO: 527099 - RNA, 65 nt, Homo Sapiens
cauucacugugcacuuugcucaaaauuuuaaaaauaccaaucacaaggauaauagaguagccuaa

SEQ ID NO: 527100 - RNA, 65 nt, Homo Sapiens
aucccuagacacuagaacuaaaggauugguaauaaaccaaucagaaagaaauccucugugggguc

SEQ ID NO: 527101 - RNA, 65 nt, Homo Sapiens
cccugacuccagccacaaagcucauacccagcccuaccaaucaugaacuggaacuccauaaggag

SEQ ID NO: 527102 - RNA, 65 nt, Homo Sapiens
uggcaccuccaaaucucauguccucacauuucaaaaccaaucaugccuucccaacagucccccaa

SEQ ID NO: 527103 - RNA, 65 nt, Homo Sapiens
ugucucauggucagcucgccucucaaagauggcucaccaaucaccugccuguuuuuacuuagaaa

SEQ ID NO: 527104 - RNA, 65 nt, Homo Sapiens
caaauagcccauacauuugaugcugaguccaggccaccaaucaggucugcugcaaaggaaucucu

SEQ ID NO: 527105 - RNA, 65 nt, Homo Sapiens
gaaguugaagaugaauguugaagcagcuugauuccaccaaucagaaucaaccaauauaaauccac

SEQ ID NO: 527106 - RNA, 65 nt, Homo Sapiens
acccagugacaccagcacugauuggacugcccuacaccaaucagaagcucagugcccaaugggcc

SEQ ID NO: 527107 - RNA, 65 nt, Homo Sapiens
agccugcucguaaagcucaauccuucuaucauggcaccaaucacaagaaccuuggacguuugacu

SEQ ID NO: 527108 - RNA, 65 nt, Homo Sapiens
gauggaugccauuccuuuugcccaguuaaauguucaccaaucauuuuaacuaaauacucagacuu

SEQ ID NO: 527109 - RNA, 65 nt, Homo Sapiens
aauaacaguaauuaauuguguaauucagaauucauaccaaucaguguugaaacucaaacauugca

SEQ ID NO: 527110 - RNA, 65 nt, Homo Sapiens
ugcugugcgcuugucagaccaucagaccagggccaaccaaucagaaggcaacuuacuguauaaau

SEQ ID NO: 527111 - RNA, 65 nt, Homo Sapiens
ccaccaacacaacagcaauggcaacaccgacagcaaccaaucagauauauacaaaugaaauuaga

SEQ ID NO: 527112 - RNA, 65 nt, Homo Sapiens
uauuucaccguuugcacuuuaaugacuuccuuggcaccaaucaugcaguguucacauucacacuu

SEQ ID NO: 527113 - RNA, 65 nt, Homo Sapiens
uuuuccaaaucaaucaccagaguuugucucucuugaccaaucauucuuaccaagugcuuuccuca

SEQ ID NO: 527114 - RNA, 65 nt, Homo Sapiens
agaaaauaauggcaauaauuuuauuuuuaaauuguaccaaucacaaucaaugugaaaacauagac

SEQ ID NO: 527115 - RNA, 65 nt, Homo Sapiens
gacaagaaaacgcuuacacauggggagaugaaccaaccaaucaauggaaaaauugucuccuaauu

SEQ ID NO: 527116 - RNA, 65 nt, Homo Sapiens
guuguaaaacucugauuguacuuagagaugugacuaccaaucaguuugauacucaaggaaagggg

SEQ ID NO: 527117 - RNA, 65 nt, Homo Sapiens
uggcaccacuuucaagaugcuggauggaacaggaaaccaaucaccccccuggcuccggagaaugc

SEQ ID NO: 527118 - RNA, 65 nt, Homo Sapiens
uggaaguuaauuuuauaaaaucaggcaaaaacaccaccaaucacggccggaagaucuggcgaagc

SEQ ID NO: 527119 - RNA, 65 nt, Homo Sapiens
acuugccagcuccucaaaacccaccacugucacacaccaaucagagacugcaaaacugguuuuac

SEQ ID NO: 527120 - RNA, 65 nt, Homo Sapiens
guagaacaaagaaaauguuguguuagggcugaggaaccaaucaagaaaacaagacagacucgagu

SEQ ID NO: 527121 - RNA, 65 nt, Homo Sapiens
uuuuguucuuuuuuccuggaggcaaucuuaaggucaccaaucaguuuuaguggaauguagaaugu

SEQ ID NO: 527122 - RNA, 65 nt, Homo Sapiens
gguuuguuuacgggagugcccagcagcuaccccaaaccaaucaaggagcuagcccgaacugacuu

SEQ ID NO: 527123 - RNA, 65 nt, Homo Sapiens
gacucagaacugaaggcaaucccccagccuuucuuaccaaucaaguaacaugguuucaagcccag

SEQ ID NO: 527124 - RNA, 65 nt, Homo Sapiens
cuagucaaggaaccucaagucaugcuuuugcuaucaccaaucauaguguacccaucuuuaauuua

SEQ ID NO: 527125 - RNA, 65 nt, Homo Sapiens
ugguauuuucaagggaauuuuuuuacugacacaugaccaaucauaggugauggggaccgucuuuc

SEQ ID NO: 527126 - RNA, 65 nt, Homo Sapiens
acacauauuuugacccaaguggauauuuucuuaaaaccaaucaauaauagcuagcuauuacugca

SEQ ID NO: 527127 - RNA, 65 nt, Homo Sapiens
uugggguuuuuuuuuuuccuuuguuaagaaagccaaccaaucacaaugauauagucauuguugug

SEQ ID NO: 527128 - RNA, 65 nt, Homo Sapiens
cggauucuguagaaaauacauacuuccugugccauaccaaucaguuacacucaaagcuuucuugg

SEQ ID NO: 527129 - RNA, 65 nt, Homo Sapiens
gaaaccugcucggaauuaaauacaccugcuccaggaccaaucagucacuuaguaaaugucauaac

SEQ ID NO: 527130 - RNA, 65 nt, Homo Sapiens
aggcaucacuuuccuggauccaggauaauuuuuaaaccaaucaaaugaaaaaaacaaacaaacaa

SEQ ID NO: 527131 - RNA, 65 nt, Homo Sapiens
uuguaaaaugcacccaucagugcucuguaaaacacaccaaucagcgcucuguagcuagcaauagg

SEQ ID NO: 527132 - RNA, 65 nt, Homo Sapiens
uuguaaaaugcacccaucagcacucuguaaaacgcaccaaucagcacucuguaaaaugcaccaau

SEQ ID NO: 527133 - RNA, 65 nt, Homo Sapiens
cuguaaaacgcaccaaucagcacucuguaaaaugcaccaaucagcaggauucuaaaaguagacaa

SEQ ID NO: 527134 - RNA, 65 nt, Homo Sapiens
ggaggcagggaggggagcaucugucugccacugagaccaaucacagccucuuugcacagcaugcc

SEQ ID NO: 527135 - RNA, 65 nt, Homo Sapiens
uucuucucuuaagaggcuuccagagaaaacggcacaccaaucaauaaagaacugagcagaaacca

SEQ ID NO: 527136 - RNA, 65 nt, Homo Sapiens
uuacauuuuuauuuuuauuugaggaaagaauggaaaccaaucacuuggcaccaaguuaggucuca

SEQ ID NO: 527137 - RNA, 65 nt, Homo Sapiens
auccaagggccugaugacucuuuugguaaccagacaccaaucaaauaaggggaggagacgaaaau

SEQ ID NO: 527138 - RNA, 65 nt, Homo Sapiens
aguggauuuaccuguagaguuuauuggauccugaaaccaaucaauuacuuagaacuaggcaaaga

SEQ ID NO: 527139 - RNA, 65 nt, Homo Sapiens
gggcacucuguaucuagcucaagguuuguaaacacaccaaucagcacccugugucuagcucagug

SEQ ID NO: 527140 - RNA, 65 nt, Homo Sapiens
agaaccuuugugucuagcucagggaucguaaacgcaccaaucagcacccugucaaaacagaccac

SEQ ID NO: 527141 - RNA, 65 nt, Homo Sapiens
ugucaaaacagaccacuugacucucuguaaaauggaccaaucagcaggauguggguggggcgaga

SEQ ID NO: 527142 - RNA, 65 nt, Homo Sapiens
agacccuggcuucuggaguccucugugagugagggaccaaucaaaauuauuuuucaaaaagcaaa

SEQ ID NO: 527143 - RNA, 65 nt, Homo Sapiens
ggggaaaauuuuuagaagaaaagcaaacaugugagaccaaucauuaucaaauacuuuuauuuuuu

SEQ ID NO: 527144 - RNA, 65 nt, Homo Sapiens
uccuucaccacugugccuuagaccacacuugggggaccaaucauguggcugccaugagaccugag

SEQ ID NO: 527145 - RNA, 65 nt, Homo Sapiens
caaucaaucaaucacuguccgagacucugucucaaaccaaucaauuccauccuggacgacagagu

SEQ ID NO: 527146 - RNA, 65 nt, Homo Sapiens
gaacuuacucuauucagugggucuauauauguuaaaccaaucaaguguuuuuauucucucaggca

SEQ ID NO: 527147 - RNA, 65 nt, Homo Sapiens
cugcagcccaggggcgucuggaccagcaacccgcgaccaaucaugggcuccggcccgggacccag

SEQ ID NO: 527148 - RNA, 65 nt, Homo Sapiens
uucuaaaacuaaagaaucuaggaaccuugccugcgaccaaucauggagccacgugagcugaucgu

SEQ ID NO: 527149 - RNA, 65 nt, Homo Sapiens
uuucaguugcuuuugucucccuaggaggcagguaaaccaaucaaaaacagaguuuucuguguuuc

SEQ ID NO: 527150 - RNA, 65 nt, Homo Sapiens
gccuugcaaauaaucacagauuagcuguaauuuuaaccaaucagaugacaacaaagauugauaga

SEQ ID NO: 527151 - RNA, 65 nt, Homo Sapiens
ucugauauucuguggaaggucucaagaguggaaggaccaaucacccuuggaauucuuagguucua

SEQ ID NO: 527152 - RNA, 65 nt, Homo Sapiens
ccagaugguuuugggggaacagugucacuccccucaccaaucacuaccuguauucccaucucccc

SEQ ID NO: 527153 - RNA, 65 nt, Homo Sapiens
uacuagaugaguggauggaucuacccuuugugaaaaccaaucaauccaaccagggguuucuuucc

SEQ ID NO: 527154 - RNA, 65 nt, Homo Sapiens
aucuugucaauauagucagcuuucuucaacauguaaccaaucagucuguauuuuguauuguaugu

SEQ ID NO: 527155 - RNA, 65 nt, Homo Sapiens
uucaucaaaacagaagaaaacagcaucaagagaaaaccaaucagcaauuuucccuuuuuauuuuu

SEQ ID NO: 527156 - RNA, 65 nt, Homo Sapiens
aguagaacccacuucaaaauaaugccagaauuaaaaccaaucauagauaguaguuggcaagauga

SEQ ID NO: 527157 - RNA, 65 nt, Homo Sapiens
ugcccacccugcugcccaacuccugugagagaaaaaccaaucaauguuuacaaaauggaaaagga

SEQ ID NO: 527158 - RNA, 65 nt, Homo Sapiens
uugucauuaauguuuggaaagcuuacaaaugacuaaccaaucaaaauacuguauuauuuugguau

SEQ ID NO: 527159 - RNA, 56 nt, Homo Sapiens; identical to SEQ ID NO: 526973

SEQ ID NO: 527160 - RNA, 65 nt, Homo Sapiens
ggcauagcagaugcucguucuugccuccuucaggcaccaaucaggagaaggguucugccucccau

SEQ ID NO: 527161 - RNA, 65 nt, Homo Sapiens
gcucccagccugaaucugccuggauggaacugaggaccaaucaugcugcaaggaacacuuccacg

SEQ ID NO: 527162 - RNA, 65 nt, Homo Sapiens
ucuccucccuccuccacaccuugagugaugaccacaccaaucacuguauuuuauagcuuuuuuuu

SEQ ID NO: 527163 - RNA, 65 nt, Homo Sapiens
aaaaagaaaaaaaggauaugguuaccuguaaucuuaccaaucauagauaaucacugucaaacuuu

SEQ ID NO: 527164 - RNA, 65 nt, Homo Sapiens
ucauuggcccaaaugggccaugugauuuucucuaaaccaaucacugugacucuagaguggccaga

SEQ ID NO: 527165 - RNA, 65 nt, Homo Sapiens
caugagccaccacgccuggccagaugcauguucaaaccaaucaaaugguguuuucuuaugcagga

SEQ ID NO: 527166 - RNA, 65 nt, Homo Sapiens
cggagccccaggagcccaagugaaagacuuuacugaccaaucagcuucgguaauagaaaaaucuc

SEQ ID NO: 527167 - RNA, 60 nt, Homo Sapiens; identical to SEQ ID NO: 526981

SEQ ID NO: 527168 - RNA, 65 nt, Homo Sapiens
uuauuuaaaucaauuuauuuaguauucugaaauuaaccaaucagucuuagaaaaaaguaauauga

SEQ ID NO: 527169 - RNA, 65 nt, Homo Sapiens
aacuaccauucuauuccauguucuaggcaccucagaccaaucaucagagcuagauuuaacucagu

SEQ ID NO: 527170 - RNA, 65 nt, Homo Sapiens
ugagccacaucaaagcuaaguaugugggguuggugaccaaucagucccaggcucagaucgaccaa

SEQ ID NO: 527171 - RNA, 65 nt, Homo Sapiens
uugguaaagaccuaaaaccaaugcccuguugauaaaccaaucaaagauauauuuaaaccaaccuc

SEQ ID NO: 527172 - RNA, 65 nt, Homo Sapiens
aggacaugggcggggacaaucgcucuguaaaauggaccaaucagccuguaagauggaccaaucag

SEQ ID NO: 527173 - RNA, 65 nt, Homo Sapiens
gcucuguaaaauggaccaaucacucuguaagauggaccaaucagcuuguaaaauggaccaaucag

SEQ ID NO: 527174 - RNA, 65 nt, Homo Sapiens
acucuguaagauggaccaauaggauuguaaaauggaccaaucagcgaacuuuucugucuuacaag

SEQ ID NO: 527175 - RNA, 65 nt, Homo Sapiens
cccaggaguuugagguuacagugagccacaaucacaccaaucacugcacuccagccugggcaaua

SEQ ID NO: 527176 - RNA, 65 nt, Homo Sapiens
acugguuccuccuuaaaaauugugagagauuugucaccaaucauccccuuccacccauuuuuaau

SEQ ID NO: 527177 - RNA, 65 nt, Homo Sapiens
aaacuccuugagcaauaguugauaucauuaaguaaaccaaucagauuuacagaauguaguauuuu

SEQ ID NO: 527178 - RNA, 65 nt, Homo Sapiens
cucaggguuccagaaaucccccguucccaaaccaaaccaaucauggaucuucccuuuaaggggua

SEQ ID NO: 527179 - RNA, 65 nt, Homo Sapiens
uccuauuuuguuacccaacucuuccuauuuuuguuaccaaucacugugcucucugccgcccccug

SEQ ID NO: 527180 - RNA, 65 nt, Homo Sapiens
cacugaaccugccucauggcucugcagcaggcaagaccaaucaauuucuggagcuggccaggucc

SEQ ID NO: 527181 - RNA, 65 nt, Homo Sapiens
cauagaaggaggagagggaaaauguuuuguaagaaaccaaucaagauaaaggacagugaaguaau

SEQ ID NO: 527182 - RNA, 65 nt, Homo Sapiens
cuugagaacuuuauuuccaaguuguucaaacauuuaccaaucauauuaauacaaugaugcuauuu

SEQ ID NO: 527183 - RNA, 65 nt, Homo Sapiens
gaauggaccaaauacauuuuuaaaagaaaacugagaccaaucagauggaaauggaguuuuaaggc

SEQ ID NO: 527184 - RNA, 65 nt, Homo Sapiens
caguuagccuaaaccuauugaacaauggaaauaaaaccaaucagugcaggagcccucuugaaauu

SEQ ID NO: 527185 - RNA, 65 nt, Homo Sapiens
uuaguguuuauuucuucuaccuugcauuuaguaagaccaaucagcguagccaugaacacagcuug

SEQ ID NO: 527186 - RNA, 65 nt, Homo Sapiens
gcucuuuaaaauacggaacguauucagaaguguguaccaaucaagugcuugacugauuucaguga

SEQ ID NO: 527187 - RNA, 64 nt, Homo Sapiens; identical to SEQ ID NO: 218878

SEQ ID NO: 527188 - RNA, 64 nt, Homo Sapiens; identical to SEQ ID NO: 218879

SEQ ID NO: 527189 - RNA, 64 nt, Homo Sapiens; identical to SEQ ID NO: 218880

SEQ ID NO: 527190 - RNA, 64 nt, Homo Sapiens; identical to SEQ ID NO: 218881

SEQ ID NO: 527191 - RNA, 64 nt, Homo Sapiens; identical to SEQ ID NO: 218882

SEQ ID NO: 527192 - RNA, 64 nt, Homo Sapiens; identical to SEQ ID NO: 218883

SEQ ID NO: 527193 - RNA, 64 nt, Homo Sapiens; identical to SEQ ID NO: 218884

SEQ ID NO: 527194 - RNA, 64 nt, Homo Sapiens; identical to SEQ ID NO: 218885

SEQ ID NO: 527195 - RNA, 64 nt, Homo Sapiens; identical to SEQ ID NO: 218886

SEQ ID NO: 527196 - RNA, 64 nt, Homo Sapiens; identical to SEQ ID NO: 218887

SEQ ID NO: 527197 - RNA, 64 nt, Homo Sapiens; identical to SEQ ID NO: 218888

SEQ ID NO: 527198 - RNA, 64 nt, Homo Sapiens; identical to SEQ ID NO: 218889

SEQ ID NO: 527199 - RNA, 64 nt, Homo Sapiens; identical to SEQ ID NO: 218890

SEQ ID NO: 527200 - RNA, 64 nt, Homo Sapiens; identical to SEQ ID NO: 218891

SEQ ID NO: 527201 - RNA, 64 nt, Homo Sapiens; identical to SEQ ID NO: 218892

SEQ ID NO: 527202 - RNA, 64 nt, Homo Sapiens; identical to SEQ ID NO: 218893

SEQ ID NO: 527203 - RNA, 64 nt, Homo Sapiens; identical to SEQ ID NO: 218894

SEQ ID NO: 527204 - RNA, 64 nt, Homo Sapiens; identical to SEQ ID NO: 218895

SEQ ID NO: 527205 - RNA, 64 nt, Homo Sapiens; identical to SEQ ID NO: 218896

SEQ ID NO: 527206 - RNA, 64 nt, Homo Sapiens; identical to SEQ ID NO: 218897

SEQ ID NO: 527207 - RNA, 64 nt, Homo Sapiens; identical to SEQ ID NO: 218898

SEQ ID NO: 527208 - RNA, 64 nt, Homo Sapiens; identical to SEQ ID NO: 218899

SEQ ID NO: 527209 - RNA, 64 nt, Homo Sapiens; identical to SEQ ID NO: 218900

SEQ ID NO: 527210 - RNA, 64 nt, Homo Sapiens; identical to SEQ ID NO: 218901

SEQ ID NO: 527211 - RNA, 64 nt, Homo Sapiens; identical to SEQ ID NO: 218902

SEQ ID NO: 527212 - RNA, 64 nt, Homo Sapiens; identical to SEQ ID NO: 218903

SEQ ID NO: 527213 - RNA, 64 nt, Homo Sapiens; identical to SEQ ID NO: 218904

SEQ ID NO: 527214 - RNA, 64 nt, Homo Sapiens; identical to SEQ ID NO: 218905

SEQ ID NO: 527215 - RNA, 64 nt, Homo Sapiens; identical to SEQ ID NO: 218906

SEQ ID NO: 527216 - RNA, 64 nt, Homo Sapiens; identical to SEQ ID NO: 218907

SEQ ID NO: 527217 - RNA, 64 nt, Homo Sapiens; identical to SEQ ID NO: 218908

SEQ ID NO: 527218 - RNA, 64 nt, Homo Sapiens; identical to SEQ ID NO: 218909

SEQ ID NO: 527219 - RNA, 64 nt, Homo Sapiens; identical to SEQ ID NO: 218910

SEQ ID NO: 527220 - RNA, 64 nt, Homo Sapiens; identical to SEQ ID NO: 218911

SEQ ID NO: 527221 - RNA, 64 nt, Homo Sapiens; identical to SEQ ID NO: 218912

SEQ ID NO: 527222 - RNA, 64 nt, Homo Sapiens; identical to SEQ ID NO: 218913

SEQ ID NO: 527223 - RNA, 60 nt, Homo Sapiens; identical to SEQ ID NO: 218914

SEQ ID NO: 527224 - RNA, 64 nt, Homo Sapiens; identical to SEQ ID NO: 218915

SEQ ID NO: 527225 - RNA, 64 nt, Homo Sapiens; identical to SEQ ID NO: 218916

SEQ ID NO: 527226 - RNA, 64 nt, Homo Sapiens; identical to SEQ ID NO: 218917

SEQ ID NO: 527227 - RNA, 64 nt, Homo Sapiens; identical to SEQ ID NO: 218918

SEQ ID NO: 527228 - RNA, 64 nt, Homo Sapiens; identical to SEQ ID NO: 218919

SEQ ID NO: 527229 - RNA, 64 nt, Homo Sapiens; identical to SEQ ID NO: 218920

SEQ ID NO: 527230 - RNA, 64 nt, Homo Sapiens; identical to SEQ ID NO: 218921

SEQ ID NO: 527231 - RNA, 64 nt, Homo Sapiens; identical to SEQ ID NO: 218922

SEQ ID NO: 527232 - RNA, 64 nt, Homo Sapiens; identical to SEQ ID NO: 218923

SEQ ID NO: 527233 - RNA, 64 nt, Homo Sapiens; identical to SEQ ID NO: 218924

SEQ ID NO: 527234 - RNA, 64 nt, Homo Sapiens; identical to SEQ ID NO: 218925

SEQ ID NO: 527235 - RNA, 64 nt, Homo Sapiens; identical to SEQ ID NO: 218926

SEQ ID NO: 527236 - RNA, 64 nt, Homo Sapiens; identical to SEQ ID NO: 218927

SEQ ID NO: 527237 - RNA, 64 nt, Homo Sapiens; identical to SEQ ID NO: 218928

SEQ ID NO: 527238 - RNA, 64 nt, Homo Sapiens; identical to SEQ ID NO: 218929

SEQ ID NO: 527239 - RNA, 64 nt, Homo Sapiens; identical to SEQ ID NO: 218930

SEQ ID NO: 527240 - RNA, 64 nt, Homo Sapiens; identical to SEQ ID NO: 218931

SEQ ID NO: 527241 - RNA, 64 nt, Homo Sapiens; identical to SEQ ID NO: 218932

SEQ ID NO: 527242 - RNA, 64 nt, Homo Sapiens; identical to SEQ ID NO: 218933

SEQ ID NO: 527243 - RNA, 64 nt, Homo Sapiens; identical to SEQ ID NO: 218934

SEQ ID NO: 527244 - RNA, 64 nt, Homo Sapiens; identical to SEQ ID NO: 218935

SEQ ID NO: 527245 - RNA, 64 nt, Homo Sapiens; identical to SEQ ID NO: 218936

SEQ ID NO: 527246 - RNA, 64 nt, Homo Sapiens; identical to SEQ ID NO: 218937

SEQ ID NO: 527247 - RNA, 64 nt, Homo Sapiens; identical to SEQ ID NO: 218938

SEQ ID NO: 527248 - RNA, 64 nt, Homo Sapiens; identical to SEQ ID NO: 218939

SEQ ID NO: 527249 - RNA, 64 nt, Homo Sapiens; identical to SEQ ID NO: 218940

SEQ ID NO: 527250 - RNA, 64 nt, Homo Sapiens; identical to SEQ ID NO: 218941

SEQ ID NO: 527251 - RNA, 64 nt, Homo Sapiens; identical to SEQ ID NO: 218942

SEQ ID NO: 527252 - RNA, 64 nt, Homo Sapiens; identical to SEQ ID NO: 218943

SEQ ID NO: 527253 - RNA, 64 nt, Homo Sapiens; identical to SEQ ID NO: 218944

SEQ ID NO: 527254 - RNA, 64 nt, Homo Sapiens; identical to SEQ ID NO: 218945

SEQ ID NO: 527255 - RNA, 59 nt, Homo Sapiens; identical to SEQ ID NO: 218946

SEQ ID NO: 527256 - RNA, 64 nt, Homo Sapiens; identical to SEQ ID NO: 218947

SEQ ID NO: 527257 - RNA, 64 nt, Homo Sapiens; identical to SEQ ID NO: 218948

SEQ ID NO: 527258 - RNA, 64 nt, Homo Sapiens; identical to SEQ ID NO: 218949

SEQ ID NO: 527259 - RNA, 64 nt, Homo Sapiens; identical to SEQ ID NO: 218950

SEQ ID NO: 527260 - RNA, 64 nt, Homo Sapiens; identical to SEQ ID NO: 218951

SEQ ID NO: 527261 - RNA, 64 nt, Homo Sapiens; identical to SEQ ID NO: 218952

SEQ ID NO: 527262 - RNA, 64 nt, Homo Sapiens; identical to SEQ ID NO: 218953

SEQ ID NO: 527263 - RNA, 64 nt, Homo Sapiens; identical to SEQ ID NO: 218954

SEQ ID NO: 527264 - RNA, 64 nt, Homo Sapiens; identical to SEQ ID NO: 218955

SEQ ID NO: 527265 - RNA, 64 nt, Homo Sapiens; identical to SEQ ID NO: 166184

SEQ ID NO: 527266 - RNA, 64 nt, Homo Sapiens; identical to SEQ ID NO: 166185

SEQ ID NO: 527267 - RNA, 64 nt, Homo Sapiens; identical to SEQ ID NO: 166186

SEQ ID NO: 527268 - RNA, 64 nt, Homo Sapiens; identical to SEQ ID NO: 166187

SEQ ID NO: 527269 - RNA, 64 nt, Homo Sapiens; identical to SEQ ID NO: 166188

SEQ ID NO: 527270 - RNA, 64 nt, Homo Sapiens; identical to SEQ ID NO: 166189

SEQ ID NO: 527271 - RNA, 64 nt, Homo Sapiens; identical to SEQ ID NO: 166190

SEQ ID NO: 527272 - RNA, 64 nt, Homo Sapiens; identical to SEQ ID NO: 166191

SEQ ID NO: 527273 - RNA, 64 nt, Homo Sapiens; identical to SEQ ID NO: 166192

SEQ ID NO: 527274 - RNA, 64 nt, Homo Sapiens; identical to SEQ ID NO: 166193

SEQ ID NO: 527275 - RNA, 64 nt, Homo Sapiens; identical to SEQ ID NO: 166194

SEQ ID NO: 527276 - RNA, 64 nt, Homo Sapiens; identical to SEQ ID NO: 166195

SEQ ID NO: 527277 - RNA, 64 nt, Homo Sapiens; identical to SEQ ID NO: 166196

SEQ ID NO: 527278 - RNA, 64 nt, Homo Sapiens; identical to SEQ ID NO: 166197

SEQ ID NO: 527279 - RNA, 64 nt, Homo Sapiens; identical to SEQ ID NO: 166198

SEQ ID NO: 527280 - RNA, 64 nt, Homo Sapiens; identical to SEQ ID NO: 166199

SEQ ID NO: 527281 - RNA, 64 nt, Homo Sapiens; identical to SEQ ID NO: 166200

SEQ ID NO: 527282 - RNA, 64 nt, Homo Sapiens; identical to SEQ ID NO: 166201

SEQ ID NO: 527283 - RNA, 64 nt, Homo Sapiens; identical to SEQ ID NO: 166202

SEQ ID NO: 527284 - RNA, 64 nt, Homo Sapiens; identical to SEQ ID NO: 166203

SEQ ID NO: 527285 - RNA, 64 nt, Homo Sapiens; identical to SEQ ID NO: 166204

SEQ ID NO: 527286 - RNA, 64 nt, Homo Sapiens; identical to SEQ ID NO: 166205

SEQ ID NO: 527287 - RNA, 64 nt, Homo Sapiens; identical to SEQ ID NO: 166206

SEQ ID NO: 527288 - RNA, 64 nt, Homo Sapiens; identical to SEQ ID NO: 166207

SEQ ID NO: 527289 - RNA, 64 nt, Homo Sapiens; identical to SEQ ID NO: 166208

SEQ ID NO: 527290 - RNA, 64 nt, Homo Sapiens; identical to SEQ ID NO: 166209

SEQ ID NO: 527291 - RNA, 64 nt, Homo Sapiens; identical to SEQ ID NO: 166210

SEQ ID NO: 527292 - RNA, 64 nt, Homo Sapiens; identical to SEQ ID NO: 166211

SEQ ID NO: 527293 - RNA, 64 nt, Homo Sapiens; identical to SEQ ID NO: 166212

SEQ ID NO: 527294 - RNA, 64 nt, Homo Sapiens; identical to SEQ ID NO: 166213

SEQ ID NO: 527295 - RNA, 64 nt, Homo Sapiens; identical to SEQ ID NO: 166214

SEQ ID NO: 527296 - RNA, 64 nt, Homo Sapiens; identical to SEQ ID NO: 166215

SEQ ID NO: 527297 - RNA, 64 nt, Homo Sapiens; identical to SEQ ID NO: 166216

SEQ ID NO: 527298 - RNA, 64 nt, Homo Sapiens; identical to SEQ ID NO: 166217

SEQ ID NO: 527299 - RNA, 64 nt, Homo Sapiens; identical to SEQ ID NO: 166218

SEQ ID NO: 527300 - RNA, 64 nt, Homo Sapiens; identical to SEQ ID NO: 166219

SEQ ID NO: 527301 - RNA, 64 nt, Homo Sapiens; identical to SEQ ID NO: 166220

SEQ ID NO: 527302 - RNA, 64 nt, Homo Sapiens; identical to SEQ ID NO: 166221

SEQ ID NO: 527303 - RNA, 64 nt, Homo Sapiens; identical to SEQ ID NO: 166222

SEQ ID NO: 527304 - RNA, 64 nt, Homo Sapiens; identical to SEQ ID NO: 166223

SEQ ID NO: 527305 - RNA, 64 nt, Homo Sapiens; identical to SEQ ID NO: 166224

SEQ ID NO: 527306 - RNA, 58 nt, Homo Sapiens; identical to SEQ ID NO: 96080

SEQ ID NO: 527307 - RNA, 64 nt, Homo Sapiens; identical to SEQ ID NO: 166226

SEQ ID NO: 527308 - RNA, 64 nt, Homo Sapiens; identical to SEQ ID NO: 166227

SEQ ID NO: 527309 - RNA, 64 nt, Homo Sapiens; identical to SEQ ID NO: 166228

SEQ ID NO: 527310 - RNA, 64 nt, Homo Sapiens; identical to SEQ ID NO: 166229

SEQ ID NO: 527311 - RNA, 64 nt, Homo Sapiens; identical to SEQ ID NO: 166230

SEQ ID NO: 527312 - RNA, 64 nt, Homo Sapiens; identical to SEQ ID NO: 166231

SEQ ID NO: 527313 - RNA, 64 nt, Homo Sapiens; identical to SEQ ID NO: 166232

SEQ ID NO: 527314 - RNA, 64 nt, Homo Sapiens; identical to SEQ ID NO: 166233

SEQ ID NO: 527315 - RNA, 64 nt, Homo Sapiens; identical to SEQ ID NO: 166234

SEQ ID NO: 527316 - RNA, 64 nt, Homo Sapiens; identical to SEQ ID NO: 166235

SEQ ID NO: 527317 - RNA, 64 nt, Homo Sapiens; identical to SEQ ID NO: 166236

SEQ ID NO: 527318 - RNA, 64 nt, Homo Sapiens; identical to SEQ ID NO: 166237

SEQ ID NO: 527319 - RNA, 64 nt, Homo Sapiens; identical to SEQ ID NO: 166238

SEQ ID NO: 527320 - RNA, 64 nt, Homo Sapiens; identical to SEQ ID NO: 166239

SEQ ID NO: 527321 - RNA, 64 nt, Homo Sapiens; identical to SEQ ID NO: 166240

SEQ ID NO: 527322 - RNA, 64 nt, Homo Sapiens; identical to SEQ ID NO: 166241

SEQ ID NO: 527323 - RNA, 64 nt, Homo Sapiens; identical to SEQ ID NO: 166242

SEQ ID NO: 527324 - RNA, 64 nt, Homo Sapiens; identical to SEQ ID NO: 166243

SEQ ID NO: 527325 - RNA, 64 nt, Homo Sapiens; identical to SEQ ID NO: 166244

SEQ ID NO: 527326 - RNA, 64 nt, Homo Sapiens; identical to SEQ ID NO: 166245

SEQ ID NO: 527327 - RNA, 64 nt, Homo Sapiens; identical to SEQ ID NO: 166246

SEQ ID NO: 527328 - RNA, 64 nt, Homo Sapiens; identical to SEQ ID NO: 166247

SEQ ID NO: 527329 - RNA, 64 nt, Homo Sapiens; identical to SEQ ID NO: 166248

SEQ ID NO: 527330 - RNA, 64 nt, Homo Sapiens; identical to SEQ ID NO: 166249

SEQ ID NO: 527331 - RNA, 64 nt, Homo Sapiens; identical to SEQ ID NO: 166250

SEQ ID NO: 527332 - RNA, 64 nt, Homo Sapiens; identical to SEQ ID NO: 166251

SEQ ID NO: 527333 - RNA, 64 nt, Homo Sapiens; identical to SEQ ID NO: 166252

SEQ ID NO: 527334 - RNA, 64 nt, Homo Sapiens; identical to SEQ ID NO: 166253

SEQ ID NO: 527335 - RNA, 64 nt, Homo Sapiens; identical to SEQ ID NO: 166254

SEQ ID NO: 527336 - RNA, 64 nt, Homo Sapiens; identical to SEQ ID NO: 166255

SEQ ID NO: 527337 - RNA, 64 nt, Homo Sapiens; identical to SEQ ID NO: 166256

SEQ ID NO: 527338 - RNA, 64 nt, Homo Sapiens; identical to SEQ ID NO: 166257

SEQ ID NO: 527339 - RNA, 64 nt, Homo Sapiens; identical to SEQ ID NO: 166258

SEQ ID NO: 527340 - RNA, 64 nt, Homo Sapiens; identical to SEQ ID NO: 166259

SEQ ID NO: 527341 - RNA, 64 nt, Homo Sapiens; identical to SEQ ID NO: 166260

SEQ ID NO: 527342 - RNA, 64 nt, Homo Sapiens; identical to SEQ ID NO: 166261

SEQ ID NO: 527343 - RNA, 64 nt, Homo Sapiens; identical to SEQ ID NO: 166262

SEQ ID NO: 527344 - RNA, 64 nt, Homo Sapiens; identical to SEQ ID NO: 166263

SEQ ID NO: 527345 - RNA, 64 nt, Homo Sapiens; identical to SEQ ID NO: 166264

SEQ ID NO: 527346 - RNA, 64 nt, Homo Sapiens; identical to SEQ ID NO: 166265

SEQ ID NO: 527347 - RNA, 64 nt, Homo Sapiens; identical to SEQ ID NO: 166266

SEQ ID NO: 527348 - RNA, 64 nt, Homo Sapiens; identical to SEQ ID NO: 166267

SEQ ID NO: 527349 - RNA, 64 nt, Homo Sapiens; identical to SEQ ID NO: 166268

SEQ ID NO: 527350 - RNA, 64 nt, Homo Sapiens; identical to SEQ ID NO: 166269

SEQ ID NO: 527351 - RNA, 64 nt, Homo Sapiens; identical to SEQ ID NO: 166270

SEQ ID NO: 527352 - RNA, 64 nt, Homo Sapiens; identical to SEQ ID NO: 166271

SEQ ID NO: 527353 - RNA, 64 nt, Homo Sapiens; identical to SEQ ID NO: 166272

SEQ ID NO: 527354 - RNA, 64 nt, Homo Sapiens; identical to SEQ ID NO: 166273

SEQ ID NO: 527355 - RNA, 64 nt, Homo Sapiens; identical to SEQ ID NO: 166274

SEQ ID NO: 527356 - RNA, 64 nt, Homo Sapiens; identical to SEQ ID NO: 166275

SEQ ID NO: 527357 - RNA, 64 nt, Homo Sapiens; identical to SEQ ID NO: 166276

SEQ ID NO: 527358 - RNA, 64 nt, Homo Sapiens; identical to SEQ ID NO: 166277

SEQ ID NO: 527359 - RNA, 64 nt, Homo Sapiens; identical to SEQ ID NO: 166278

SEQ ID NO: 527360 - RNA, 64 nt, Homo Sapiens; identical to SEQ ID NO: 166279

SEQ ID NO: 527361 - RNA, 64 nt, Homo Sapiens; identical to SEQ ID NO: 166280

SEQ ID NO: 527362 - RNA, 64 nt, Homo Sapiens; identical to SEQ ID NO: 166281

SEQ ID NO: 527363 - RNA, 64 nt, Homo Sapiens; identical to SEQ ID NO: 166282

SEQ ID NO: 527364 - RNA, 64 nt, Homo Sapiens; identical to SEQ ID NO: 166283

SEQ ID NO: 527365 - RNA, 64 nt, Homo Sapiens; identical to SEQ ID NO: 166284

SEQ ID NO: 527366 - RNA, 64 nt, Homo Sapiens; identical to SEQ ID NO: 166285

SEQ ID NO: 527367 - RNA, 64 nt, Homo Sapiens; identical to SEQ ID NO: 166286

SEQ ID NO: 527368 - RNA, 64 nt, Homo Sapiens; identical to SEQ ID NO: 166287

SEQ ID NO: 527369 - RNA, 64 nt, Homo Sapiens; identical to SEQ ID NO: 166288

SEQ ID NO: 527370 - RNA, 64 nt, Homo Sapiens; identical to SEQ ID NO: 166289

SEQ ID NO: 527371 - RNA, 64 nt, Homo Sapiens; identical to SEQ ID NO: 166290

SEQ ID NO: 527372 - RNA, 64 nt, Homo Sapiens; identical to SEQ ID NO: 166291

SEQ ID NO: 527373 - RNA, 64 nt, Homo Sapiens; identical to SEQ ID NO: 166292

SEQ ID NO: 527374 - RNA, 64 nt, Homo Sapiens; identical to SEQ ID NO: 166293

SEQ ID NO: 527375 - RNA, 64 nt, Homo Sapiens; identical to SEQ ID NO: 166294

SEQ ID NO: 527376 - RNA, 64 nt, Homo Sapiens; identical to SEQ ID NO: 166295

SEQ ID NO: 527377 - RNA, 64 nt, Homo Sapiens; identical to SEQ ID NO: 166296

SEQ ID NO: 527378 - RNA, 64 nt, Homo Sapiens; identical to SEQ ID NO: 166297

SEQ ID NO: 527379 - RNA, 64 nt, Homo Sapiens; identical to SEQ ID NO: 166298

SEQ ID NO: 527380 - RNA, 64 nt, Homo Sapiens; identical to SEQ ID NO: 166299

SEQ ID NO: 527381 - RNA, 64 nt, Homo Sapiens; identical to SEQ ID NO: 166300

SEQ ID NO: 527382 - RNA, 64 nt, Homo Sapiens; identical to SEQ ID NO: 166301

SEQ ID NO: 527383 - RNA, 64 nt, Homo Sapiens; identical to SEQ ID NO: 166302

SEQ ID NO: 527384 - RNA, 64 nt, Homo Sapiens; identical to SEQ ID NO: 166303

SEQ ID NO: 527385 - RNA, 64 nt, Homo Sapiens; identical to SEQ ID NO: 166304

SEQ ID NO: 527386 - RNA, 64 nt, Homo Sapiens; identical to SEQ ID NO: 166305

SEQ ID NO: 527387 - RNA, 64 nt, Homo Sapiens; identical to SEQ ID NO: 166306

SEQ ID NO: 527388 - RNA, 64 nt, Homo Sapiens; identical to SEQ ID NO: 166307

SEQ ID NO: 527389 - RNA, 64 nt, Homo Sapiens; identical to SEQ ID NO: 166308

SEQ ID NO: 527390 - RNA, 64 nt, Homo Sapiens; identical to SEQ ID NO: 166309

SEQ ID NO: 527391 - RNA, 64 nt, Homo Sapiens; identical to SEQ ID NO: 166310

SEQ ID NO: 527392 - RNA, 64 nt, Homo Sapiens; identical to SEQ ID NO: 166311

SEQ ID NO: 527393 - RNA, 64 nt, Homo Sapiens; identical to SEQ ID NO: 166312

SEQ ID NO: 527394 - RNA, 64 nt, Homo Sapiens; identical to SEQ ID NO: 166313

SEQ ID NO: 527395 - RNA, 64 nt, Homo Sapiens; identical to SEQ ID NO: 166314

SEQ ID NO: 527396 - RNA, 64 nt, Homo Sapiens; identical to SEQ ID NO: 166315

SEQ ID NO: 527397 - RNA, 64 nt, Homo Sapiens; identical to SEQ ID NO: 155383

SEQ ID NO: 527398 - RNA, 64 nt, Homo Sapiens; identical to SEQ ID NO: 155384

SEQ ID NO: 527399 - RNA, 64 nt, Homo Sapiens; identical to SEQ ID NO: 155385

SEQ ID NO: 527400 - RNA, 64 nt, Homo Sapiens; identical to SEQ ID NO: 155386

SEQ ID NO: 527401 - RNA, 64 nt, Homo Sapiens; identical to SEQ ID NO: 155387

SEQ ID NO: 527402 - RNA, 64 nt, Homo Sapiens; identical to SEQ ID NO: 155388

SEQ ID NO: 527403 - RNA, 64 nt, Homo Sapiens; identical to SEQ ID NO: 155389

SEQ ID NO: 527404 - RNA, 64 nt, Homo Sapiens; identical to SEQ ID NO: 155390

SEQ ID NO: 527405 - RNA, 64 nt, Homo Sapiens; identical to SEQ ID NO: 155391

SEQ ID NO: 527406 - RNA, 64 nt, Homo Sapiens; identical to SEQ ID NO: 155392

SEQ ID NO: 527407 - RNA, 64 nt, Homo Sapiens; identical to SEQ ID NO: 155393

SEQ ID NO: 527408 - RNA, 64 nt, Homo Sapiens; identical to SEQ ID NO: 155394

SEQ ID NO: 527409 - RNA, 64 nt, Homo Sapiens; identical to SEQ ID NO: 155395

SEQ ID NO: 527410 - RNA, 64 nt, Homo Sapiens; identical to SEQ ID NO: 155396

SEQ ID NO: 527411 - RNA, 64 nt, Homo Sapiens; identical to SEQ ID NO: 155397

SEQ ID NO: 527412 - RNA, 64 nt, Homo Sapiens; identical to SEQ ID NO: 155398

SEQ ID NO: 527413 - RNA, 64 nt, Homo Sapiens; identical to SEQ ID NO: 155399

SEQ ID NO: 527414 - RNA, 64 nt, Homo Sapiens; identical to SEQ ID NO: 155400

SEQ ID NO: 527415 - RNA, 64 nt, Homo Sapiens; identical to SEQ ID NO: 155401

SEQ ID NO: 527416 - RNA, 64 nt, Homo Sapiens; identical to SEQ ID NO: 155402

SEQ ID NO: 527417 - RNA, 64 nt, Homo Sapiens; identical to SEQ ID NO: 155403

SEQ ID NO: 527418 - RNA, 64 nt, Homo Sapiens; identical to SEQ ID NO: 155404

SEQ ID NO: 527419 - RNA, 64 nt, Homo Sapiens; identical to SEQ ID NO: 155405

SEQ ID NO: 527420 - RNA, 64 nt, Homo Sapiens; identical to SEQ ID NO: 155406

SEQ ID NO: 527421 - RNA, 64 nt, Homo Sapiens; identical to SEQ ID NO: 155407

SEQ ID NO: 527422 - RNA, 64 nt, Homo Sapiens; identical to SEQ ID NO: 155408

SEQ ID NO: 527423 - RNA, 64 nt, Homo Sapiens; identical to SEQ ID NO: 155409

SEQ ID NO: 527424 - RNA, 64 nt, Homo Sapiens; identical to SEQ ID NO: 155410

SEQ ID NO: 527425 - RNA, 64 nt, Homo Sapiens; identical to SEQ ID NO: 155411

SEQ ID NO: 527426 - RNA, 64 nt, Homo Sapiens; identical to SEQ ID NO: 155412

SEQ ID NO: 527427 - RNA, 64 nt, Homo Sapiens; identical to SEQ ID NO: 155413

SEQ ID NO: 527428 - RNA, 64 nt, Homo Sapiens; identical to SEQ ID NO: 155414

SEQ ID NO: 527429 - RNA, 64 nt, Homo Sapiens; identical to SEQ ID NO: 155415

SEQ ID NO: 527430 - RNA, 64 nt, Homo Sapiens; identical to SEQ ID NO: 155416

SEQ ID NO: 527431 - RNA, 64 nt, Homo Sapiens; identical to SEQ ID NO: 155417

SEQ ID NO: 527432 - RNA, 64 nt, Homo Sapiens; identical to SEQ ID NO: 155418

SEQ ID NO: 527433 - RNA, 64 nt, Homo Sapiens; identical to SEQ ID NO: 155419

SEQ ID NO: 527434 - RNA, 64 nt, Homo Sapiens; identical to SEQ ID NO: 155420

SEQ ID NO: 527435 - RNA, 64 nt, Homo Sapiens; identical to SEQ ID NO: 155421

SEQ ID NO: 527436 - RNA, 64 nt, Homo Sapiens; identical to SEQ ID NO: 155422

SEQ ID NO: 527437 - RNA, 64 nt, Homo Sapiens; identical to SEQ ID NO: 155423

SEQ ID NO: 527438 - RNA, 64 nt, Homo Sapiens; identical to SEQ ID NO: 155424

SEQ ID NO: 527439 - RNA, 64 nt, Homo Sapiens; identical to SEQ ID NO: 155425

SEQ ID NO: 527440 - RNA, 64 nt, Homo Sapiens; identical to SEQ ID NO: 155426

SEQ ID NO: 527441 - RNA, 64 nt, Homo Sapiens; identical to SEQ ID NO: 155427

SEQ ID NO: 527442 - RNA, 64 nt, Homo Sapiens; identical to SEQ ID NO: 155428

SEQ ID NO: 527443 - RNA, 64 nt, Homo Sapiens; identical to SEQ ID NO: 155429

SEQ ID NO: 527444 - RNA, 64 nt, Homo Sapiens; identical to SEQ ID NO: 155430

SEQ ID NO: 527445 - RNA, 64 nt, Homo Sapiens; identical to SEQ ID NO: 155431

SEQ ID NO: 527446 - RNA, 64 nt, Homo Sapiens; identical to SEQ ID NO: 155432

SEQ ID NO: 527447 - RNA, 64 nt, Homo Sapiens; identical to SEQ ID NO: 155433

SEQ ID NO: 527448 - RNA, 64 nt, Homo Sapiens; identical to SEQ ID NO: 155434

SEQ ID NO: 527449 - RNA, 64 nt, Homo Sapiens; identical to SEQ ID NO: 155435

SEQ ID NO: 527450 - RNA, 64 nt, Homo Sapiens; identical to SEQ ID NO: 155436

SEQ ID NO: 527451 - RNA, 64 nt, Homo Sapiens; identical to SEQ ID NO: 155437

SEQ ID NO: 527452 - RNA, 64 nt, Homo Sapiens; identical to SEQ ID NO: 155438

SEQ ID NO: 527453 - RNA, 64 nt, Homo Sapiens; identical to SEQ ID NO: 155439

SEQ ID NO: 527454 - RNA, 64 nt, Homo Sapiens; identical to SEQ ID NO: 155440

SEQ ID NO: 527455 - RNA, 64 nt, Homo Sapiens; identical to SEQ ID NO: 155441

SEQ ID NO: 527456 - RNA, 64 nt, Homo Sapiens; identical to SEQ ID NO: 155442

SEQ ID NO: 527457 - RNA, 64 nt, Homo Sapiens; identical to SEQ ID NO: 155443

SEQ ID NO: 527458 - RNA, 64 nt, Homo Sapiens; identical to SEQ ID NO: 155444

SEQ ID NO: 527459 - RNA, 64 nt, Homo Sapiens; identical to SEQ ID NO: 155445

SEQ ID NO: 527460 - RNA, 64 nt, Homo Sapiens; identical to SEQ ID NO: 155446

SEQ ID NO: 527461 - RNA, 64 nt, Homo Sapiens; identical to SEQ ID NO: 155447

SEQ ID NO: 527462 - RNA, 64 nt, Homo Sapiens; identical to SEQ ID NO: 155448

SEQ ID NO: 527463 - RNA, 64 nt, Homo Sapiens; identical to SEQ ID NO: 155449

SEQ ID NO: 527464 - RNA, 64 nt, Homo Sapiens; identical to SEQ ID NO: 155450

SEQ ID NO: 527465 - RNA, 64 nt, Homo Sapiens; identical to SEQ ID NO: 155451

SEQ ID NO: 527466 - RNA, 64 nt, Homo Sapiens; identical to SEQ ID NO: 155452

SEQ ID NO: 527467 - RNA, 64 nt, Homo Sapiens; identical to SEQ ID NO: 155453

SEQ ID NO: 527468 - RNA, 64 nt, Homo Sapiens; identical to SEQ ID NO: 155454

SEQ ID NO: 527469 - RNA, 64 nt, Homo Sapiens; identical to SEQ ID NO: 155455

SEQ ID NO: 527470 - RNA, 64 nt, Homo Sapiens; identical to SEQ ID NO: 155456

SEQ ID NO: 527471 - RNA, 64 nt, Homo Sapiens; identical to SEQ ID NO: 155457

SEQ ID NO: 527472 - RNA, 64 nt, Homo Sapiens; identical to SEQ ID NO: 155458

SEQ ID NO: 527473 - RNA, 64 nt, Homo Sapiens; identical to SEQ ID NO: 155459

SEQ ID NO: 527474 - RNA, 64 nt, Homo Sapiens; identical to SEQ ID NO: 155460

SEQ ID NO: 527475 - RNA, 64 nt, Homo Sapiens; identical to SEQ ID NO: 155461

SEQ ID NO: 527476 - RNA, 64 nt, Homo Sapiens; identical to SEQ ID NO: 155462

SEQ ID NO: 527477 - RNA, 64 nt, Homo Sapiens; identical to SEQ ID NO: 155463

SEQ ID NO: 527478 - RNA, 64 nt, Homo Sapiens; identical to SEQ ID NO: 155464

SEQ ID NO: 527479 - RNA, 64 nt, Homo Sapiens; identical to SEQ ID NO: 155465

SEQ ID NO: 527480 - RNA, 64 nt, Homo Sapiens; identical to SEQ ID NO: 155466

SEQ ID NO: 527481 - RNA, 64 nt, Homo Sapiens; identical to SEQ ID NO: 155467

SEQ ID NO: 527482 - RNA, 64 nt, Homo Sapiens; identical to SEQ ID NO: 155468

SEQ ID NO: 527483 - RNA, 64 nt, Homo Sapiens; identical to SEQ ID NO: 155469

SEQ ID NO: 527484 - RNA, 64 nt, Homo Sapiens; identical to SEQ ID NO: 155470

SEQ ID NO: 527485 - RNA, 64 nt, Homo Sapiens; identical to SEQ ID NO: 155471

SEQ ID NO: 527486 - RNA, 64 nt, Homo Sapiens; identical to SEQ ID NO: 155472

SEQ ID NO: 527487 - RNA, 64 nt, Homo Sapiens; identical to SEQ ID NO: 155473

SEQ ID NO: 527488 - RNA, 64 nt, Homo Sapiens; identical to SEQ ID NO: 155474

SEQ ID NO: 527489 - RNA, 64 nt, Homo Sapiens; identical to SEQ ID NO: 155475

SEQ ID NO: 527490 - RNA, 64 nt, Homo Sapiens; identical to SEQ ID NO: 155476

SEQ ID NO: 527491 - RNA, 64 nt, Homo Sapiens; identical to SEQ ID NO: 155477

SEQ ID NO: 527492 - RNA, 64 nt, Homo Sapiens; identical to SEQ ID NO: 155478

SEQ ID NO: 527493 - RNA, 64 nt, Homo Sapiens; identical to SEQ ID NO: 155479

SEQ ID NO: 527494 - RNA, 64 nt, Homo Sapiens; identical to SEQ ID NO: 155480

SEQ ID NO: 527495 - RNA, 64 nt, Homo Sapiens; identical to SEQ ID NO: 155481

SEQ ID NO: 527496 - RNA, 64 nt, Homo Sapiens; identical to SEQ ID NO: 155482

SEQ ID NO: 527497 - RNA, 64 nt, Homo Sapiens; identical to SEQ ID NO: 155483

SEQ ID NO: 527498 - RNA, 64 nt, Homo Sapiens; identical to SEQ ID NO: 155484

SEQ ID NO: 527499 - RNA, 64 nt, Homo Sapiens; identical to SEQ ID NO: 155485

SEQ ID NO: 527500 - RNA, 64 nt, Homo Sapiens; identical to SEQ ID NO: 155486

SEQ ID NO: 527501 - RNA, 64 nt, Homo Sapiens; identical to SEQ ID NO: 155487

SEQ ID NO: 527502 - RNA, 64 nt, Homo Sapiens; identical to SEQ ID NO: 155488

SEQ ID NO: 527503 - RNA, 64 nt, Homo Sapiens; identical to SEQ ID NO: 507092

SEQ ID NO: 527504 - RNA, 64 nt, Homo Sapiens; identical to SEQ ID NO: 507093

SEQ ID NO: 527505 - RNA, 64 nt, Homo Sapiens; identical to SEQ ID NO: 507094

SEQ ID NO: 527506 - RNA, 64 nt, Homo Sapiens; identical to SEQ ID NO: 507095

SEQ ID NO: 527507 - RNA, 64 nt, Homo Sapiens
cuagaaucuacucugcuuacgaagguaaggaguuuaggaaaauaauuauauccacauggaagua

SEQ ID NO: 527508 - RNA, 64 nt, Homo Sapiens
cagauuguggcagugucgccacuugaugcacaaauaggaaaaaguucaaacuauuuagauaacc

SEQ ID NO: 527509 - RNA, 64 nt, Homo Sapiens
uaacuccagcaggaaacuguaacugcuaugucuuuaggaaaauguagaagaaagaacauuauug

SEQ ID NO: 527510 - RNA, 64 nt, Homo Sapiens
aaauauuaacuauccugaauauuuuauaauuuuguaggaaaaauaugcaucuauuuuuucuuga

SEQ ID NO: 527511 - RNA, 64 nt, Homo Sapiens
uggcaucaguuugcuacagugagcucagaucaaauaggaaaauacuugaaaugcaugucucaag

SEQ ID NO: 527512 - RNA, 64 nt, Homo Sapiens
uguucaaugaagucuucuguucaucuguugaaacuaggaaaauacccaaacuuaaauggaagaa

SEQ ID NO: 527513 - RNA, 64 nt, Homo Sapiens
uugugaacugaauaauuaaaacuuuggcuucucuuaggaaaagacgacuuccuagucauaggug

SEQ ID NO: 527514 - RNA, 64 nt, Homo Sapiens
uuucagcagguuuuaaaccuucaggaacaccaguuaggaaaauagcuccagaaaauauagauau

SEQ ID NO: 527515 - RNA, 64 nt, Homo Sapiens
gacuacccagccagugaagugcagaggauagacauaggaaaacauuccaggcauuuggagacag

SEQ ID NO: 527516 - RNA, 64 nt, Homo Sapiens
uaagguguuaauguguguguaugugcuuugguuguaggaaaacuugaaaauuccaaaauccuua

SEQ ID NO: 527517 - RNA, 64 nt, Homo Sapiens
acuuuaaacauaauuaaaagaggcuaaacucugauaggaaaagcuagcacauacuacaucuaag

SEQ ID NO: 527518 - RNA, 64 nt, Homo Sapiens
aaugggaaaguaaacccugcaaacuaagugucacuaggaaaaguuaagccacagaacaugguga

SEQ ID NO: 527519 - RNA, 64 nt, Homo Sapiens
aaaaauuucauugagaugagaaaguucuagaaaauaggaaaacgugcuuuguuuccuuuuuuag

SEQ ID NO: 527520 - RNA, 64 nt, Homo Sapiens
uuuccauuucuuaaaguauugcagguauuagauuuaggaaaaccuccaaaguggauuauauuaa

SEQ ID NO: 527521 - RNA, 64 nt, Homo Sapiens
cuucuacccaauagaauauuuucaugccuggaaauaggaaaaugugugaacagcguauucucuu

SEQ ID NO: 527522 - RNA, 64 nt, Homo Sapiens
caggcaggggagcaaaaggacgccaugugagcauuaggaaaaaaaauacucacucuuacuaaca

SEQ ID NO: 527523 - RNA, 64 nt, Homo Sapiens
aucagaauauuccagcucaauguccuaucuagauuaggaaaaugagauugucagcauccagcca

SEQ ID NO: 527524 - RNA, 64 nt, Homo Sapiens
ugauaugucuccugaucauaucggacaaaagggcuaggaaaaggcuuccuuguuaucaagccuc

SEQ ID NO: 527525 - RNA, 64 nt, Homo Sapiens
aaaagugagugaacagcaagaaccccacgccuuuuaggaaaaaguucccugggaucccucuguc

SEQ ID NO: 527526 - RNA, 64 nt, Homo Sapiens
aaucuugccaaauaaugaauaggugauaauuauguaggaaaaacuagcuaauuaaaaagcacuc

SEQ ID NO: 527527 - RNA, 64 nt, Homo Sapiens
uuguuaaugaauaucaggcuauuauuuauuguauuaggaaaauauaauauuuacuguuagaauu

SEQ ID NO: 527528 - RNA, 64 nt, Homo Sapiens
cccccuguuuuuagagcuuccaaaugugucagaauaggaaaacauugcaauaaauggcuugauu

SEQ ID NO: 527529 - RNA, 64 nt, Homo Sapiens
aggguagcacuuauucauucuuuuuaugccuacuuaggaaaaaaacaagaaggaaaugaaaaua

SEQ ID NO: 527530 - RNA, 64 nt, Homo Sapiens
aaaacuuauuuuucuaguaaguugggagaacaaauaggaaaaaauaacuuauuucauuaaagaa

SEQ ID NO: 527531 - RNA, 64 nt, Homo Sapiens
caguagaaauaccuuuggugcuuacugugggacauaggaaaacuuugaguucucucuaacccag

SEQ ID NO: 527532 - RNA, 64 nt, Homo Sapiens
ccucuuccaucguuacagugcccaacccaacccuuaggaaaagcaauuucacagaagcacaacu

SEQ ID NO: 527533 - RNA, 64 nt, Homo Sapiens
ccuccuucaauuccauauauccuuuucuucuauguaggaaaaaaauagucuaguguaguauucu

SEQ ID NO: 527534 - RNA, 64 nt, Homo Sapiens
cuuuaggcuuucagcuuacacaaaucuauuuaauuaggaaaaaaacuauuaaggauguagcuuu

SEQ ID NO: 527535 - RNA, 64 nt, Homo Sapiens
auuacucuguguuuacagaugugacucuuuacuguaggaaaaauaaguaucuuuugagauuaaa

SEQ ID NO: 527536 - RNA, 64 nt, Homo Sapiens
ugcuuaaaauccugucauuuugcuguauuauauauaggaaaaaauuaaauaaaauuuuaaguga

SEQ ID NO: 527537 - RNA, 64 nt, Homo Sapiens
uuaaaucugaacaauccuacagggaaaucagaauuaggaaaaaaaucuggagaacaauaugguu

SEQ ID NO: 527538 - RNA, 64 nt, Homo Sapiens
auuggagugauacauugugggaacccucagaagauaggaaaaaagcauggaauagauucucccu

SEQ ID NO: 527539 - RNA, 64 nt, Homo Sapiens
auaaaguuaaaauuucaacuuguugcuuuuguaauaggaaaauauuuauuauguaaugaauaug

SEQ ID NO: 527540 - RNA, 64 nt, Homo Sapiens
cugauaaaaugaaauauggcuguucaaaaauacauaggaaaagaauagaguaauauuugagcug

SEQ ID NO: 527541 - RNA, 64 nt, Homo Sapiens
aaacaauuuuaacaacaguugagauaucuuauucuaggaaaaugaagcagaauuccggagcuuc

SEQ ID NO: 527542 - RNA, 64 nt, Homo Sapiens
gacuguuucugaccagagacagacgcgggaaggguaggaaaaugucugggguuugggugggggg

SEQ ID NO: 527543 - RNA, 64 nt, Homo Sapiens
guugguugacuguuuuuguuugacgcaauuauauuaggaaaaaaugaucacuuuguucugguau

SEQ ID NO: 527544 - RNA, 64 nt, Homo Sapiens
uuaucuuaaaacuuuggccauuaguuuugugccauaggaaaaaaaauuuuggguauacuugugg

SEQ ID NO: 527545 - RNA, 64 nt, Homo Sapiens
guucagacaucgcuacaauauuucucuuaacacauaggaaaaaaugugauacagcggucacuau

SEQ ID NO: 527546 - RNA, 64 nt, Homo Sapiens
aagacuuagacuucccgagucguuucuuuuguauuaggaaaaacggccaggaaagggaaaugau

SEQ ID NO: 527547 - RNA, 64 nt, Homo Sapiens
uuuguaucauuuccuuuuuagcacaacauuuuuauaggaaaauaucuuuauacuuuauaguaau

SEQ ID NO: 527548 - RNA, 64 nt, Homo Sapiens
uucauuaggaauuuaucagaauauuuuaugaauauaggaaaauccaagaugaaucuuauaaacu

SEQ ID NO: 527549 - RNA, 64 nt, Homo Sapiens
auuaucuaaagaaucauugucuuucagagacucauaggaaaaaaaaacuaggaaaagugucacc

SEQ ID NO: 527550 - RNA, 64 nt, Homo Sapiens
cauugucuuucagagacucauaggaaaaaaaaacuaggaaaagugucaccgcauuguucucuuu

SEQ ID NO: 527551 - RNA, 64 nt, Homo Sapiens
ggaucucaaauagcaugagugccucuugcaaugguaggaaaaaacuguugcauuagcuaaagca

SEQ ID NO: 527552 - RNA, 64 nt, Homo Sapiens
accuacaggagauguaaacauuggcacaaaguuauaggaaaaucaccaaauaguaugacaccaa

SEQ ID NO: 527553 - RNA, 64 nt, Homo Sapiens
aacacuaguucaguuuuauucuucacaggaaauauaggaaaagauuuauucagcuaaaauagua

SEQ ID NO: 527554 - RNA, 64 nt, Homo Sapiens
aggaucaugaguccugcuuuuucaggcacacuuguaggaaaauugaauuucuucaugauacauu

SEQ ID NO: 527555 - RNA, 64 nt, Homo Sapiens
cauaaauagaaugcaguauauucauuuguugauuuaggaaaaagugaucagaaauagaaacguu

SEQ ID NO: 527556 - RNA, 64 nt, Homo Sapiens
ugcucaggagaaagaagcuaaaacucagaggaaauaggaaaaucuucagaguugaauuuaauga

SEQ ID NO: 527557 - RNA, 64 nt, Homo Sapiens
uuaaauagcuucuacucuuacccuuagggugaucuaggaaaauugcauguucccagguccugca

SEQ ID NO: 527558 - RNA, 64 nt, Homo Sapiens
gaaagagguuccgcaacugugucauuuggagagcuaggaaaaauaaacaaccuuaugccaccgg

SEQ ID NO: 527559 - RNA, 64 nt, Homo Sapiens
ucuaagcuauuuacuaauaggcuuuucauauaauuaggaaaaccuaauaucacaucuauaguaa

SEQ ID NO: 527560 - RNA, 64 nt, Homo Sapiens
augauuucauaaauguaaaagugauuugaacuccuaggaaaaauuguuauauaacauuuguuuu

SEQ ID NO: 527561 - RNA, 64 nt, Homo Sapiens
ucccugcuuaauaauguaagcuuaauguacuacuuaggaaaaugauccauuuacuguagcucug

SEQ ID NO: 527562 - RNA, 64 nt, Homo Sapiens
ccucuucuucgugauaauauaaucucuauuuuuuuaggaaaacaaaaaugaaaaacuacuccau

SEQ ID NO: 527563 - RNA, 64 nt, Homo Sapiens
cuccucccuauuggaaucccaauggcuccuggaguaggaaaaaaguuuaaacuacauucauguu

SEQ ID NO: 527564 - RNA, 64 nt, Homo Sapiens; identical to SEQ ID NO: 129516

SEQ ID NO: 527565 - RNA, 64 nt, Homo Sapiens; identical to SEQ ID NO: 129517

SEQ ID NO: 527566 - RNA, 64 nt, Homo Sapiens; identical to SEQ ID NO: 129518

SEQ ID NO: 527567 - RNA, 64 nt, Homo Sapiens; identical to SEQ ID NO: 129519

SEQ ID NO: 527568 - RNA, 64 nt, Homo Sapiens; identical to SEQ ID NO: 129520

SEQ ID NO: 527569 - RNA, 64 nt, Homo Sapiens; identical to SEQ ID NO: 129521

SEQ ID NO: 527570 - RNA, 64 nt, Homo Sapiens; identical to SEQ ID NO: 129522

SEQ ID NO: 527571 - RNA, 64 nt, Homo Sapiens; identical to SEQ ID NO: 129523

SEQ ID NO: 527572 - RNA, 64 nt, Homo Sapiens; identical to SEQ ID NO: 129524

SEQ ID NO: 527573 - RNA, 64 nt, Homo Sapiens; identical to SEQ ID NO: 129525

SEQ ID NO: 527574 - RNA, 59 nt, Homo Sapiens; identical to SEQ ID NO: 129526

SEQ ID NO: 527575 - RNA, 64 nt, Homo Sapiens; identical to SEQ ID NO: 129527

SEQ ID NO: 527576 - RNA, 64 nt, Homo Sapiens; identical to SEQ ID NO: 129528

SEQ ID NO: 527577 - RNA, 64 nt, Homo Sapiens; identical to SEQ ID NO: 129529

SEQ ID NO: 527578 - RNA, 64 nt, Homo Sapiens; identical to SEQ ID NO: 129530

SEQ ID NO: 527579 - RNA, 64 nt, Homo Sapiens; identical to SEQ ID NO: 129531

SEQ ID NO: 527580 - RNA, 64 nt, Homo Sapiens; identical to SEQ ID NO: 129532

SEQ ID NO: 527581 - RNA, 53 nt, Homo Sapiens; identical to SEQ ID NO: 129533

SEQ ID NO: 527582 - RNA, 64 nt, Homo Sapiens; identical to SEQ ID NO: 129534

SEQ ID NO: 527583 - RNA, 64 nt, Homo Sapiens; identical to SEQ ID NO: 129535

SEQ ID NO: 527584 - RNA, 64 nt, Homo Sapiens; identical to SEQ ID NO: 129536

SEQ ID NO: 527585 - RNA, 64 nt, Homo Sapiens; identical to SEQ ID NO: 129537

SEQ ID NO: 527586 - RNA, 64 nt, Homo Sapiens; identical to SEQ ID NO: 129538

SEQ ID NO: 527587 - RNA, 64 nt, Homo Sapiens; identical to SEQ ID NO: 129539

SEQ ID NO: 527588 - RNA, 64 nt, Homo Sapiens; identical to SEQ ID NO: 129540

SEQ ID NO: 527589 - RNA, 64 nt, Homo Sapiens; identical to SEQ ID NO: 129541

SEQ ID NO: 527590 - RNA, 64 nt, Homo Sapiens; identical to SEQ ID NO: 129542

SEQ ID NO: 527591 - RNA, 64 nt, Homo Sapiens; identical to SEQ ID NO: 129543

SEQ ID NO: 527592 - RNA, 64 nt, Homo Sapiens; identical to SEQ ID NO: 129544

SEQ ID NO: 527593 - RNA, 64 nt, Homo Sapiens; identical to SEQ ID NO: 129545

SEQ ID NO: 527594 - RNA, 64 nt, Homo Sapiens; identical to SEQ ID NO: 129546

SEQ ID NO: 527595 - RNA, 64 nt, Homo Sapiens; identical to SEQ ID NO: 129547

SEQ ID NO: 527596 - RNA, 64 nt, Homo Sapiens; identical to SEQ ID NO: 129548

SEQ ID NO: 527597 - RNA, 64 nt, Homo Sapiens; identical to SEQ ID NO: 129549

SEQ ID NO: 527598 - RNA, 64 nt, Homo Sapiens; identical to SEQ ID NO: 129550

SEQ ID NO: 527599 - RNA, 64 nt, Homo Sapiens; identical to SEQ ID NO: 129551

SEQ ID NO: 527600 - RNA, 64 nt, Homo Sapiens; identical to SEQ ID NO: 129552

SEQ ID NO: 527601 - RNA, 64 nt, Homo Sapiens; identical to SEQ ID NO: 129553

SEQ ID NO: 527602 - RNA, 64 nt, Homo Sapiens; identical to SEQ ID NO: 129554

SEQ ID NO: 527603 - RNA, 64 nt, Homo Sapiens; identical to SEQ ID NO: 129555

SEQ ID NO: 527604 - RNA, 64 nt, Homo Sapiens; identical to SEQ ID NO: 129556

SEQ ID NO: 527605 - RNA, 64 nt, Homo Sapiens; identical to SEQ ID NO: 129557

SEQ ID NO: 527606 - RNA, 64 nt, Homo Sapiens
auaagucaguauucuuaugcccagagggcuuucuuaaacggagagaaaaugaccugguaucuug

SEQ ID NO: 527607 - RNA, 64 nt, Homo Sapiens
uugaaaaugaccugguaucuuugcuaagucuuuguaaacggaaauuuggauuuuuuuaagguau

SEQ ID NO: 527608 - RNA, 64 nt, Homo Sapiens
agcuuugagagccaauguguuuuaggccucaugugcuuugaagacuugaugggaccuccacuua

SEQ ID NO: 527609 - RNA, 64 nt, Homo Sapiens
auaaaaugaaguuggugcuuuguggggauggugagcuuugaaucaugaggaauagcauucuuuu

SEQ ID NO: 527610 - RNA, 64 nt, Homo Sapiens
uggagaacuuuuuugaaugguuuuguauuaaauugcuuugaaauagauuucauuucuugugcac

SEQ ID NO: 527611 - RNA, 64 nt, Homo Sapiens
gcaguaucucauccucccccuguaccaggccauagcuuugaaguguauuuuguaaauucaacua

SEQ ID NO: 527612 - RNA, 64 nt, Homo Sapiens
aaguaaugcaugcuuuauuauaaauaaaauucuagcuuugaaaggcguuauguguugaacagua

SEQ ID NO: 527613 - RNA, 64 nt, Homo Sapiens
ugaguuaacaagaaauaacacuguuugagaacuagcuuugaauaauaauuuuucccuuuguaca

SEQ ID NO: 527614 - RNA, 64 nt, Homo Sapiens
caaauuagaaacacauuccugugggaaccagugugcuuugaaacaugucaugaaagugguaaaa

SEQ ID NO: 527615 - RNA, 64 nt, Homo Sapiens
ggcggcgggugccgcgccgugcugaagacaggccgcuuugaagaaagaagcaggaccccuacuu

SEQ ID NO: 527616 - RNA, 64 nt, Homo Sapiens
uuaguuugccugcaguuucuaggcauuucauuaugcuuugaacuuuuaacaaaugacuguaucu

SEQ ID NO: 527617 - RNA, 64 nt, Homo Sapiens
auagcuacaauuuguuuuuguccuuaauuuaauugcuuugaagcggcccaaagaauuggaaucc

SEQ ID NO: 527618 - RNA, 64 nt, Homo Sapiens
aaguucccacacugcuggaccuguggcaaagagugcuuugaauaagucagcuagggauucuugc

SEQ ID NO: 527619 - RNA, 64 nt, Homo Sapiens
agagcagggguuuuggaaggagaggucuuuaauagcuuugaaaugcuuugagaucauuggucaa

SEQ ID NO: 527620 - RNA, 64 nt, Homo Sapiens
guauaaaaagugugaaugagcuguuuuugcuuuugcuuugaaaucuggaguguaucuuacacau

SEQ ID NO: 527621 - RNA, 64 nt, Homo Sapiens
cccggcccaagggccgcauguggcccaggauauggcuuugaauggggccuaacacaaauucaua

SEQ ID NO: 527622 - RNA, 64 nt, Homo Sapiens
cucauagacuuauauuuuauaaucagaauauguugcuuugaaaaagccucuaauggacugaccu

SEQ ID NO: 527623 - RNA, 64 nt, Homo Sapiens
aauguuaaugguuaauguucccaaaccagagaaugcuuugaaaauguaucauucaguguaaauu

SEQ ID NO: 527624 - RNA, 64 nt, Homo Sapiens
accaacagagucaacaaggaaacauaauuagagggcuuugaaaugaucuacugaaauaccuaaa

SEQ ID NO: 527625 - RNA, 64 nt, Homo Sapiens
acuuaaaaaauacuaagacgugauagugaaaauagcuuugaaaagaaacuacauauggcaaagg

SEQ ID NO: 527626 - RNA, 64 nt, Homo Sapiens
uucuaaauuuaucaguaccuaaguaagauguagcgcuuugaauaugaaaucauaggugaagaca

SEQ ID NO: 527627 - RNA, 64 nt, Homo Sapiens
caugucucuguguaguuccagcaaaucaagcugagcuuugaaaaaguuugucuuaguuuuguga

SEQ ID NO: 527628 - RNA, 64 nt, Homo Sapiens; identical to SEQ ID NO: 395715

SEQ ID NO: 527629 - RNA, 64 nt, Homo Sapiens; identical to SEQ ID NO: 395716

SEQ ID NO: 527630 - RNA, 64 nt, Homo Sapiens; identical to SEQ ID NO: 395717

SEQ ID NO: 527631 - RNA, 64 nt, Homo Sapiens; identical to SEQ ID NO: 395718

SEQ ID NO: 527632 - RNA, 64 nt, Homo Sapiens; identical to SEQ ID NO: 395719

SEQ ID NO: 527633 - RNA, 64 nt, Homo Sapiens; identical to SEQ ID NO: 395720

SEQ ID NO: 527634 - RNA, 64 nt, Homo Sapiens; identical to SEQ ID NO: 395721

SEQ ID NO: 527635 - RNA, 64 nt, Homo Sapiens; identical to SEQ ID NO: 395722

SEQ ID NO: 527636 - RNA, 64 nt, Homo Sapiens; identical to SEQ ID NO: 395723

SEQ ID NO: 527637 - RNA, 64 nt, Homo Sapiens; identical to SEQ ID NO: 395724

SEQ ID NO: 527638 - RNA, 64 nt, Homo Sapiens; identical to SEQ ID NO: 395725

SEQ ID NO: 527639 - RNA, 64 nt, Homo Sapiens; identical to SEQ ID NO: 395726

SEQ ID NO: 527640 - RNA, 64 nt, Homo Sapiens; identical to SEQ ID NO: 395727

SEQ ID NO: 527641 - RNA, 64 nt, Homo Sapiens; identical to SEQ ID NO: 395728

SEQ ID NO: 527642 - RNA, 64 nt, Homo Sapiens; identical to SEQ ID NO: 395729

SEQ ID NO: 527643 - RNA, 64 nt, Homo Sapiens; identical to SEQ ID NO: 395730

SEQ ID NO: 527644 - RNA, 64 nt, Homo Sapiens; identical to SEQ ID NO: 395731

SEQ ID NO: 527645 - RNA, 64 nt, Homo Sapiens; identical to SEQ ID NO: 395732

SEQ ID NO: 527646 - RNA, 64 nt, Homo Sapiens; identical to SEQ ID NO: 395733

SEQ ID NO: 527647 - RNA, 64 nt, Homo Sapiens; identical to SEQ ID NO: 395734

SEQ ID NO: 527648 - RNA, 64 nt, Homo Sapiens; identical to SEQ ID NO: 395735

SEQ ID NO: 527649 - RNA, 64 nt, Homo Sapiens; identical to SEQ ID NO: 395736

SEQ ID NO: 527650 - RNA, 64 nt, Homo Sapiens; identical to SEQ ID NO: 395737

SEQ ID NO: 527651 - RNA, 64 nt, Homo Sapiens; identical to SEQ ID NO: 509152

SEQ ID NO: 527652 - RNA, 64 nt, Homo Sapiens; identical to SEQ ID NO: 509153

SEQ ID NO: 527653 - RNA, 64 nt, Homo Sapiens; identical to SEQ ID NO: 509154

SEQ ID NO: 527654 - RNA, 64 nt, Homo Sapiens; identical to SEQ ID NO: 509155

SEQ ID NO: 527655 - RNA, 64 nt, Homo Sapiens; identical to SEQ ID NO: 509156

SEQ ID NO: 527656 - RNA, 64 nt, Homo Sapiens; identical to SEQ ID NO: 509157

SEQ ID NO: 527657 - RNA, 64 nt, Homo Sapiens; identical to SEQ ID NO: 509158

SEQ ID NO: 527658 - RNA, 64 nt, Homo Sapiens; identical to SEQ ID NO: 509159

SEQ ID NO: 527659 - RNA, 64 nt, Homo Sapiens; identical to SEQ ID NO: 509160

SEQ ID NO: 527660 - RNA, 64 nt, Homo Sapiens; identical to SEQ ID NO: 509161

SEQ ID NO: 527661 - RNA, 64 nt, Homo Sapiens; identical to SEQ ID NO: 166169

SEQ ID NO: 527662 - RNA, 64 nt, Homo Sapiens; identical to SEQ ID NO: 166170

SEQ ID NO: 527663 - RNA, 64 nt, Homo Sapiens; identical to SEQ ID NO: 166171

SEQ ID NO: 527664 - RNA, 64 nt, Homo Sapiens; identical to SEQ ID NO: 166172

SEQ ID NO: 527665 - RNA, 64 nt, Homo Sapiens; identical to SEQ ID NO: 166173

SEQ ID NO: 527666 - RNA, 64 nt, Homo Sapiens; identical to SEQ ID NO: 166174

SEQ ID NO: 527667 - RNA, 64 nt, Homo Sapiens; identical to SEQ ID NO: 166175

SEQ ID NO: 527668 - RNA, 64 nt, Homo Sapiens; identical to SEQ ID NO: 166176

SEQ ID NO: 527669 - RNA, 64 nt, Homo Sapiens; identical to SEQ ID NO: 166177

SEQ ID NO: 527670 - RNA, 64 nt, Homo Sapiens; identical to SEQ ID NO: 166178

SEQ ID NO: 527671 - RNA, 64 nt, Homo Sapiens; identical to SEQ ID NO: 166179

SEQ ID NO: 527672 - RNA, 64 nt, Homo Sapiens; identical to SEQ ID NO: 166180

SEQ ID NO: 527673 - RNA, 64 nt, Homo Sapiens; identical to SEQ ID NO: 166181

SEQ ID NO: 527674 - RNA, 64 nt, Homo Sapiens; identical to SEQ ID NO: 166182

SEQ ID NO: 527675 - RNA, 64 nt, Homo Sapiens; identical to SEQ ID NO: 166183

SEQ ID NO: 527676 - RNA, 64 nt, Homo Sapiens; identical to SEQ ID NO: 159261

SEQ ID NO: 527677 - RNA, 64 nt, Homo Sapiens; identical to SEQ ID NO: 159262

SEQ ID NO: 527678 - RNA, 64 nt, Homo Sapiens; identical to SEQ ID NO: 159263

SEQ ID NO: 527679 - RNA, 64 nt, Homo Sapiens; identical to SEQ ID NO: 159264

SEQ ID NO: 527680 - RNA, 64 nt, Homo Sapiens; identical to SEQ ID NO: 159265

SEQ ID NO: 527681 - RNA, 64 nt, Homo Sapiens; identical to SEQ ID NO: 159266

SEQ ID NO: 527682 - RNA, 64 nt, Homo Sapiens; identical to SEQ ID NO: 159267

SEQ ID NO: 527683 - RNA, 64 nt, Homo Sapiens; identical to SEQ ID NO: 159268

SEQ ID NO: 527684 - RNA, 64 nt, Homo Sapiens; identical to SEQ ID NO: 159269

SEQ ID NO: 527685 - RNA, 64 nt, Homo Sapiens; identical to SEQ ID NO: 159270

SEQ ID NO: 527686 - RNA, 64 nt, Homo Sapiens; identical to SEQ ID NO: 159271

SEQ ID NO: 527687 - RNA, 64 nt, Homo Sapiens; identical to SEQ ID NO: 159272

SEQ ID NO: 527688 - RNA, 64 nt, Homo Sapiens; identical to SEQ ID NO: 159273

SEQ ID NO: 527689 - RNA, 64 nt, Homo Sapiens; identical to SEQ ID NO: 159274

SEQ ID NO: 527690 - RNA, 64 nt, Homo Sapiens; identical to SEQ ID NO: 159275

SEQ ID NO: 527691 - RNA, 64 nt, Homo Sapiens; identical to SEQ ID NO: 159276

SEQ ID NO: 527692 - RNA, 59 nt, Homo Sapiens; identical to SEQ ID NO: 159277

SEQ ID NO: 527693 - RNA, 64 nt, Homo Sapiens; identical to SEQ ID NO: 159278

SEQ ID NO: 527694 - RNA, 64 nt, Homo Sapiens; identical to SEQ ID NO: 159279

SEQ ID NO: 527695 - RNA, 58 nt, Homo Sapiens; identical to SEQ ID NO: 159280

SEQ ID NO: 527696 - RNA, 64 nt, Homo Sapiens; identical to SEQ ID NO: 159281

SEQ ID NO: 527697 - RNA, 64 nt, Homo Sapiens; identical to SEQ ID NO: 159282

SEQ ID NO: 527698 - RNA, 64 nt, Homo Sapiens; identical to SEQ ID NO: 159283

SEQ ID NO: 527699 - RNA, 64 nt, Homo Sapiens; identical to SEQ ID NO: 159284

SEQ ID NO: 527700 - RNA, 64 nt, Homo Sapiens; identical to SEQ ID NO: 159285

SEQ ID NO: 527701 - RNA, 64 nt, Homo Sapiens; identical to SEQ ID NO: 159286

SEQ ID NO: 527702 - RNA, 64 nt, Homo Sapiens; identical to SEQ ID NO: 159287

SEQ ID NO: 527703 - RNA, 64 nt, Homo Sapiens; identical to SEQ ID NO: 159288

SEQ ID NO: 527704 - RNA, 64 nt, Homo Sapiens; identical to SEQ ID NO: 159289

SEQ ID NO: 527705 - RNA, 64 nt, Homo Sapiens; identical to SEQ ID NO: 159290

SEQ ID NO: 527706 - RNA, 64 nt, Homo Sapiens; identical to SEQ ID NO: 159291

SEQ ID NO: 527707 - RNA, 64 nt, Homo Sapiens; identical to SEQ ID NO: 159292

SEQ ID NO: 527708 - RNA, 64 nt, Homo Sapiens; identical to SEQ ID NO: 159293

SEQ ID NO: 527709 - RNA, 64 nt, Homo Sapiens; identical to SEQ ID NO: 159294

SEQ ID NO: 527710 - RNA, 64 nt, Homo Sapiens; identical to SEQ ID NO: 159295

SEQ ID NO: 527711 - RNA, 64 nt, Homo Sapiens; identical to SEQ ID NO: 159296

SEQ ID NO: 527712 - RNA, 64 nt, Homo Sapiens; identical to SEQ ID NO: 159297

SEQ ID NO: 527713 - RNA, 64 nt, Homo Sapiens; identical to SEQ ID NO: 159298

SEQ ID NO: 527714 - RNA, 64 nt, Homo Sapiens; identical to SEQ ID NO: 159299

SEQ ID NO: 527715 - RNA, 64 nt, Homo Sapiens; identical to SEQ ID NO: 159300

SEQ ID NO: 527716 - RNA, 64 nt, Homo Sapiens; identical to SEQ ID NO: 159301

SEQ ID NO: 527717 - RNA, 64 nt, Homo Sapiens; identical to SEQ ID NO: 159302

SEQ ID NO: 527718 - RNA, 64 nt, Homo Sapiens; identical to SEQ ID NO: 159303

SEQ ID NO: 527719 - RNA, 64 nt, Homo Sapiens; identical to SEQ ID NO: 159304

SEQ ID NO: 527720 - RNA, 64 nt, Homo Sapiens; identical to SEQ ID NO: 159305

SEQ ID NO: 527721 - RNA, 64 nt, Homo Sapiens; identical to SEQ ID NO: 159306

SEQ ID NO: 527722 - RNA, 64 nt, Homo Sapiens; identical to SEQ ID NO: 159307

SEQ ID NO: 527723 - RNA, 64 nt, Homo Sapiens; identical to SEQ ID NO: 159308

SEQ ID NO: 527724 - RNA, 64 nt, Homo Sapiens; identical to SEQ ID NO: 159309

SEQ ID NO: 527725 - RNA, 64 nt, Homo Sapiens; identical to SEQ ID NO: 159310

SEQ ID NO: 527726 - RNA, 64 nt, Homo Sapiens; identical to SEQ ID NO: 159311

SEQ ID NO: 527727 - RNA, 64 nt, Homo Sapiens; identical to SEQ ID NO: 159312

SEQ ID NO: 527728 - RNA, 64 nt, Homo Sapiens; identical to SEQ ID NO: 159313

SEQ ID NO: 527729 - RNA, 64 nt, Homo Sapiens; identical to SEQ ID NO: 159314

SEQ ID NO: 527730 - RNA, 64 nt, Homo Sapiens; identical to SEQ ID NO: 159315

SEQ ID NO: 527731 - RNA, 64 nt, Homo Sapiens; identical to SEQ ID NO: 159316

SEQ ID NO: 527732 - RNA, 64 nt, Homo Sapiens; identical to SEQ ID NO: 159317

SEQ ID NO: 527733 - RNA, 64 nt, Homo Sapiens; identical to SEQ ID NO: 159318

SEQ ID NO: 527734 - RNA, 64 nt, Homo Sapiens; identical to SEQ ID NO: 159319

SEQ ID NO: 527735 - RNA, 64 nt, Homo Sapiens; identical to SEQ ID NO: 159320

SEQ ID NO: 527736 - RNA, 64 nt, Homo Sapiens; identical to SEQ ID NO: 159321

SEQ ID NO: 527737 - RNA, 64 nt, Homo Sapiens; identical to SEQ ID NO: 412124

SEQ ID NO: 527738 - RNA, 64 nt, Homo Sapiens; identical to SEQ ID NO: 412125

SEQ ID NO: 527739 - RNA, 64 nt, Homo Sapiens; identical to SEQ ID NO: 412126

SEQ ID NO: 527740 - RNA, 64 nt, Homo Sapiens; identical to SEQ ID NO: 412127

SEQ ID NO: 527741 - RNA, 64 nt, Homo Sapiens; identical to SEQ ID NO: 412128

SEQ ID NO: 527742 - RNA, 64 nt, Homo Sapiens; identical to SEQ ID NO: 412129

SEQ ID NO: 527743 - RNA, 64 nt, Homo Sapiens; identical to SEQ ID NO: 412130

SEQ ID NO: 527744 - RNA, 64 nt, Homo Sapiens; identical to SEQ ID NO: 412131

SEQ ID NO: 527745 - RNA, 64 nt, Homo Sapiens; identical to SEQ ID NO: 412132

SEQ ID NO: 527746 - RNA, 64 nt, Homo Sapiens; identical to SEQ ID NO: 412133

SEQ ID NO: 527747 - RNA, 64 nt, Homo Sapiens; identical to SEQ ID NO: 412134

SEQ ID NO: 527748 - RNA, 64 nt, Homo Sapiens; identical to SEQ ID NO: 412135

SEQ ID NO: 527749 - RNA, 64 nt, Homo Sapiens; identical to SEQ ID NO: 412136

SEQ ID NO: 527750 - RNA, 64 nt, Homo Sapiens; identical to SEQ ID NO: 412137

SEQ ID NO: 527751 - RNA, 64 nt, Homo Sapiens; identical to SEQ ID NO: 412138

SEQ ID NO: 527752 - RNA, 64 nt, Homo Sapiens; identical to SEQ ID NO: 412139

SEQ ID NO: 527753 - RNA, 64 nt, Homo Sapiens; identical to SEQ ID NO: 412140

SEQ ID NO: 527754 - RNA, 64 nt, Homo Sapiens; identical to SEQ ID NO: 412141

SEQ ID NO: 527755 - RNA, 64 nt, Homo Sapiens
ccaugugaugucauccugcuuuguuaucuucuuauaacuuuauccugcuauaacuuuauccucu

SEQ ID NO: 527756 - RNA, 64 nt, Homo Sapiens
ugcuuuguuaucuucuuauaacuuuauccugcuauaacuuuauccucuucccagccucaucccu

SEQ ID NO: 527757 - RNA, 64 nt, Homo Sapiens
gaacucauugcucccuaagacugugacaacugucuaacuuuagaagugcauuucugaauagaaa

SEQ ID NO: 527758 - RNA, 64 nt, Homo Sapiens
uugcauaaagcauaaguauacaguucaauaaacuuaacuuuaacugaacaauggcccuguagcc

SEQ ID NO: 527759 - RNA, 64 nt, Homo Sapiens
uuuuauggcuuuuuacuguuagacuaaucaaaaauaacuuuaaaaggaacaaagaaacuccaac

SEQ ID NO: 527760 - RNA, 64 nt, Homo Sapiens
uggauuuuucaauuuucaaaccauauggccuagguaacuuuaauugaaauaauauagauuuagu

SEQ ID NO: 527761 - RNA, 64 nt, Homo Sapiens
agauccuuaucaccaaacauuagaaaagaucucauaacuuuauacagcauguuguaagcauuuu

SEQ ID NO: 527762 - RNA, 64 nt, Homo Sapiens
aaaauauugaagacauuguaauuauauagaaaaauaacuuuagaugcuaugcuguugucuuauu

SEQ ID NO: 527763 - RNA, 64 nt, Homo Sapiens
aauuuuuauaauucagaagagcuuuuuuuggaaguaacuuuauaagauaauuuuuauuuaugua

SEQ ID NO: 527764 - RNA, 64 nt, Homo Sapiens
uuauguuggaaguaguaguuaacucuuuaugaauuaacuuuagcucuucuuaaccaguacauag

SEQ ID NO: 527765 - RNA, 64 nt, Homo Sapiens
cuuaaauauuuuuucuuucuaaacuuaaaauacauaacuuuacccccuuaccauucaguaugca

SEQ ID NO: 527766 - RNA, 64 nt, Homo Sapiens
aaugacagcagagacauuuacuucugcaguuaguuaacuuuauaggaguugugauuuuuuugau

SEQ ID NO: 527767 - RNA, 64 nt, Homo Sapiens
aaaauaaacuaccaauacuaaauaguaagaaaccuaacuuuaguagcaaaucuugauuaauuga

SEQ ID NO: 527768 - RNA, 64 nt, Homo Sapiens
uauuuuuaaaaaaauuuguaggugcuuuuauguauaacuuuaaugauuuauaagaugcuaaaug

SEQ ID NO: 527769 - RNA, 64 nt, Homo Sapiens
cuagccugggggaugggguucauauguguuguuguaacuuuagauuacuaaacaaaacaaacug

SEQ ID NO: 527770 - RNA, 64 nt, Homo Sapiens
uaaaauaaaccaucuucaaauuucccuuucacaguaacuuuaugaaaacuuuucuauuguuuuc

SEQ ID NO: 527771 - RNA, 64 nt, Homo Sapiens
uaaaaaguauaaugugaaaagcauaucaaacguuuaacuuuauucuaaucaagagaaguaggaa

SEQ ID NO: 527772 - RNA, 64 nt, Homo Sapiens
aauaaaccuuaauauuucuuuauugcccaugauauaacuuuagaugugcacuuuuuuucuauau

SEQ ID NO: 527773 - RNA, 64 nt, Homo Sapiens
augcucaaugaaaaggugauugguuauauuuuuuuaacuuuaccagaagagucuauugucuccu

SEQ ID NO: 527774 - RNA, 64 nt, Homo Sapiens
uauuuccuagagaauaguaaccagguuuuguuuuuaacuuuaaaaccuaauuacuuuugugccu

SEQ ID NO: 527775 - RNA, 64 nt, Homo Sapiens
ccuaauuacuuuugugccucucagccguugauuguaacuuuaaagucccaugguuuuggagugu

SEQ ID NO: 527776 - RNA, 64 nt, Homo Sapiens
auguaaagguauauugugaauuggauuucauuuguaacuuuaggcugguauuaacuuuauacac

SEQ ID NO: 527777 - RNA, 64 nt, Homo Sapiens
cacuuggauuucauuuguaagugaucacugguauuaacuuuauaugagaaaugauggggaguga

SEQ ID NO: 527778 - RNA, 64 nt, Homo Sapiens
gcuuaauaaauguaugacacagcugaggguuucauaacuuuaugugcccagaucucuccacaag

SEQ ID NO: 527779 - RNA, 64 nt, Homo Sapiens
gcuuaacagguuuccuuuuaugccauuuuuagaauaacuuuaaauuuuauaccaacgugaaaag

SEQ ID NO: 527780 - RNA, 64 nt, Homo Sapiens
uuacacuuuuucacuuaagugcuuuaguuuagacuaacuuuacaacuucuauaacuuuuggaac

SEQ ID NO: 527781 - RNA, 64 nt, Homo Sapiens
aaguuuaguauagucugauuacauuccauucaccuaacuuuagacauucguuuagacaccauaa

SEQ ID NO: 527782 - RNA, 64 nt, Homo Sapiens
cccaucucugccacuuugauuuugaugcuugcuuuaacuuuaguauuacccuaaaaguaauaac

SEQ ID NO: 527783 - RNA, 64 nt, Homo Sapiens
gguuuauugaguuuccuuugagucagcucaguuuuaacuuuauauacucacacugcaaauaacu

SEQ ID NO: 527784 - RNA, 64 nt, Homo Sapiens
gaaugucaucaagcuuugggcagauacauuuguguaacuuuacaacaagaacagauaacuucuu

SEQ ID NO: 527785 - RNA, 64 nt, Homo Sapiens
aguacuucagauagacgcagaagagcaguuuuaauaacuuuaaaucuaugugacuuauggucaa

SEQ ID NO: 527786 - RNA, 64 nt, Homo Sapiens
auaauacaaacagauuugucuaaacauuuguauauaacuuuaaaaauagaauauuuuuuggagg

SEQ ID NO: 527787 - RNA, 64 nt, Homo Sapiens
cuauugugaauucaaugaaguguucuuaugccacuaacuuuaaccuauucccuuacucaaggau

SEQ ID NO: 527788 - RNA, 64 nt, Homo Sapiens
ggaggcauuccacacaggcacugccccaggacaacacaacaaggacagucacaacaaggacaac

SEQ ID NO: 527789 - RNA, 64 nt, Homo Sapiens
aggcacugccccaggacaacacaacaaggacagucacaacaaggacaacaaggacacaacacaa

SEQ ID NO: 527790 - RNA, 64 nt, Homo Sapiens
gucacaacaaggacaacaaggacacaacacaacacacaacaaggacagucacaacaagccuaga

SEQ ID NO: 527791 - RNA, 64 nt, Homo Sapiens
acaaggacacaacacaacacacaacaaggacagucacaacaagccuagagccagaaagcagaug

SEQ ID NO: 527792 - RNA, 64 nt, Homo Sapiens
caaauucuucuucaagacugacucuauauacaaacacaacaauggcuaauucaugcacugcaau

SEQ ID NO: 527793 - RNA, 64 nt, Homo Sapiens
augccacauugaaacagcauuaguaguauuaagccacaacaauauaguauaaaccucauuuagg

SEQ ID NO: 527794 - RNA, 64 nt, Homo Sapiens
aaauaaagaaagccugaguguguauucuucugcugcugcuuauuagucaguauguagaauggga

SEQ ID NO: 527795 - RNA, 64 nt, Homo Sapiens
acugcuuugcuucuuuuuaucgacaaauuccaccgcugcuuaaucacuuuauaaaaagugaaag

SEQ ID NO: 527796 - RNA, 64 nt, Homo Sapiens
ucauuggacuuuugugaaguugacaccagcuaaggcugcuuaaaauaaguucugaucauuauau

SEQ ID NO: 527797 - RNA, 64 nt, Homo Sapiens
uguauuguacauaguuuaaccaaguguuauuugagcugcuuauuaauauuaacuuguacuuguc

SEQ ID NO: 527798 - RNA, 64 nt, Homo Sapiens
aauuuuauggguuuuuuucuuuuuugcgaagggggcugcuuaggguuucaccuuuuuuuaaucc

SEQ ID NO: 527799 - RNA, 64 nt, Homo Sapiens
aaaaguuguaauuuaaaagucugaauaaccaucugcugcuuaggaaacucaaugaaaugacaug

SEQ ID NO: 527800 - RNA, 64 nt, Homo Sapiens
ggagaaguguggucagaggggagcaaugggcuuugcugcuuaugagcacagaggaauucagucc

SEQ ID NO: 527801 - RNA, 64 nt, Homo Sapiens
acagcuauuggguccaccccagucccuuucagcugcugcuuaaugcccugcucucucccuggcc

SEQ ID NO: 527802 - RNA, 64 nt, Homo Sapiens
uagcuagaugugguggcaugagccuguguucccagcugcuuaggaggcugaagcaggaggauug

SEQ ID NO: 527803 - RNA, 64 nt, Homo Sapiens
uugaaaauuaauaacgagccuaguuuaggaaaaagcugcuuaaaacuguggcucuaagagagua

SEQ ID NO: 527804 - RNA, 64 nt, Homo Sapiens
gucgcaacugggccccuuuccaggcuguuuaaacgcugcuuaaauuaaaugcuggacacggagg

SEQ ID NO: 527805 - RNA, 64 nt, Homo Sapiens
gugggggcugccaugaggggguugcagccggccugcugcuuaagcaaccacccucggaugaugg

SEQ ID NO: 527806 - RNA, 64 nt, Homo Sapiens
ggggauauauguuuguggaauggauuuuccugaagcugcuuaacaguugcuuuggauucucuaa

SEQ ID NO: 527807 - RNA, 64 nt, Homo Sapiens
agagagcacuguccaaggaugucgggagcauccugcugcuuaggggaauguuuucgcaaauguu

SEQ ID NO: 527808 - RNA, 64 nt, Homo Sapiens
aauguugcaaggcuuuuaucccugaaaaucauuuacagauaaccacaauuugcugugguauaua

SEQ ID NO: 527809 - RNA, 64 nt, Homo Sapiens
augauaaaauuuaagauuuuucuaauaaaagaguacagauaaugggacaguugagagagauggc

SEQ ID NO: 527810 - RNA, 64 nt, Homo Sapiens
uaaaaguucuguuacccucauuucauucuuucaaacagauaacaauucaggauuacagugcucc

SEQ ID NO: 527811 - RNA, 64 nt, Homo Sapiens
auuuuguuuugcccugcaaaaacuuucuaucaccacagauaaagcuuccauauauauuacccug

SEQ ID NO: 527812 - RNA, 64 nt, Homo Sapiens
ucauguagccaaaagaccaagaaaaaucuggcccacagauaaguugcagacugccuuuaaaaua

SEQ ID NO: 527813 - RNA, 64 nt, Homo Sapiens
aaucugugauuguuggcagugucaucucugagaaacagauaaauaaaguuuauuuacuauauaa

SEQ ID NO: 527814 - RNA, 64 nt, Homo Sapiens
cacacgcacaugcacagauaugccgccugggcacacagauaagcugcccaaaugcacgcacacg

SEQ ID NO: 527815 - RNA, 64 nt, Homo Sapiens
gacacacacgugcacagauaugcugccuggacacacagauaaugcugccuugacacacacaugc

SEQ ID NO: 527816 - RNA, 64 nt, Homo Sapiens
cacacgcacgcagauaugcugccuggacacacacacagauaaugcugccucaacacucacacac

SEQ ID NO: 527817 - RNA, 64 nt, Homo Sapiens
uaguuauauuuaaaaauauuuuuuuaaauucuuuacagauaauauuauacuuguuacccuucac

SEQ ID NO: 527818 - RNA, 64 nt, Homo Sapiens
agucggcaauuucuuggccauggauguagaaccuacagauaaggugagccaacugcauuaggaa

SEQ ID NO: 527819 - RNA, 64 nt, Homo Sapiens
aaaaaaaaaaggaauccgugacccacagagcuagacagauaagaugcauaguugaccagucaua

SEQ ID NO: 527820 - RNA, 64 nt, Homo Sapiens
cucuuuucucaccaaaaaggagauaaauuugaaaacagauaaauguaacaaccagucaaagaag

SEQ ID NO: 527821 - RNA, 64 nt, Homo Sapiens
cugcuagauuguuauuuuguuuccuaaaaaugcaacagauaauguaacagccaagaauuggucu

SEQ ID NO: 527822 - RNA, 64 nt, Homo Sapiens
gugaauguuuuauacagaaagugcuaugagauggacagauaagucuagcuuccuggucugauca

SEQ ID NO: 527823 - RNA, 64 nt, Homo Sapiens
uuauuuuuaaacagaacuccucuuaccccccaaaacagauaaaccucaguguacaauuuugaaa

SEQ ID NO: 527824 - RNA, 64 nt, Homo Sapiens
gcaucaguaucacaucuagcucccuuacuuguccacagauaauguaaacaaaggagggaaaaac

SEQ ID NO: 527825 - RNA, 64 nt, Homo Sapiens
gaagucguauuauucacuuguaaaaaugauuguaacagauaaaaaauguaucugcagcaacucu

SEQ ID NO: 527826 - RNA, 64 nt, Homo Sapiens
uaucuacaugauuuucaaguuguaaugcagauggacagauaaaaaagauuuuacguuugucuuu

SEQ ID NO: 527827 - RNA, 64 nt, Homo Sapiens
auugugugguguuuuggauuguaacaagaugagaacagauaaagauaugacaaauguuucuaag

SEQ ID NO: 527828 - RNA, 64 nt, Homo Sapiens
gauucaaaaagucacaguuagauauuucagaaauacagauaaaugaguagagguauaauugugu

SEQ ID NO: 527829 - RNA, 64 nt, Homo Sapiens; identical to SEQ ID NO: 147038

SEQ ID NO: 527830 - RNA, 64 nt, Homo Sapiens; identical to SEQ ID NO: 147039

SEQ ID NO: 527831 - RNA, 64 nt, Homo Sapiens; identical to SEQ ID NO: 147040

SEQ ID NO: 527832 - RNA, 64 nt, Homo Sapiens; identical to SEQ ID NO: 147041

SEQ ID NO: 527833 - RNA, 64 nt, Homo Sapiens; identical to SEQ ID NO: 147042

SEQ ID NO: 527834 - RNA, 64 nt, Homo Sapiens; identical to SEQ ID NO: 147043

SEQ ID NO: 527835 - RNA, 64 nt, Homo Sapiens; identical to SEQ ID NO: 147044

SEQ ID NO: 527836 - RNA, 64 nt, Homo Sapiens; identical to SEQ ID NO: 147045

SEQ ID NO: 527837 - RNA, 64 nt, Homo Sapiens; identical to SEQ ID NO: 147046

SEQ ID NO: 527838 - RNA, 64 nt, Homo Sapiens; identical to SEQ ID NO: 147047

SEQ ID NO: 527839 - RNA, 64 nt, Homo Sapiens; identical to SEQ ID NO: 147048

SEQ ID NO: 527840 - RNA, 64 nt, Homo Sapiens; identical to SEQ ID NO: 147049

SEQ ID NO: 527841 - RNA, 64 nt, Homo Sapiens; identical to SEQ ID NO: 147050

SEQ ID NO: 527842 - RNA, 64 nt, Homo Sapiens; identical to SEQ ID NO: 147051

SEQ ID NO: 527843 - RNA, 64 nt, Homo Sapiens; identical to SEQ ID NO: 147052

SEQ ID NO: 527844 - RNA, 64 nt, Homo Sapiens; identical to SEQ ID NO: 147053

SEQ ID NO: 527845 - RNA, 64 nt, Homo Sapiens; identical to SEQ ID NO: 147054

SEQ ID NO: 527846 - RNA, 64 nt, Homo Sapiens; identical to SEQ ID NO: 147055

SEQ ID NO: 527847 - RNA, 64 nt, Homo Sapiens; identical to SEQ ID NO: 147056

SEQ ID NO: 527848 - RNA, 64 nt, Homo Sapiens; identical to SEQ ID NO: 147057

SEQ ID NO: 527849 - RNA, 64 nt, Homo Sapiens; identical to SEQ ID NO: 147058

SEQ ID NO: 527850 - RNA, 64 nt, Homo Sapiens; identical to SEQ ID NO: 147059

SEQ ID NO: 527851 - RNA, 64 nt, Homo Sapiens; identical to SEQ ID NO: 147060

SEQ ID NO: 527852 - RNA, 64 nt, Homo Sapiens; identical to SEQ ID NO: 147061

SEQ ID NO: 527853 - RNA, 64 nt, Homo Sapiens; identical to SEQ ID NO: 147062

SEQ ID NO: 527854 - RNA, 64 nt, Homo Sapiens; identical to SEQ ID NO: 147063

SEQ ID NO: 527855 - RNA, 64 nt, Homo Sapiens; identical to SEQ ID NO: 147064

SEQ ID NO: 527856 - RNA, 64 nt, Homo Sapiens; identical to SEQ ID NO: 147065

SEQ ID NO: 527857 - RNA, 64 nt, Homo Sapiens; identical to SEQ ID NO: 147066

SEQ ID NO: 527858 - RNA, 64 nt, Homo Sapiens; identical to SEQ ID NO: 147067

SEQ ID NO: 527859 - RNA, 64 nt, Homo Sapiens; identical to SEQ ID NO: 147068

SEQ ID NO: 527860 - RNA, 64 nt, Homo Sapiens; identical to SEQ ID NO: 147069

SEQ ID NO: 527861 - RNA, 64 nt, Homo Sapiens; identical to SEQ ID NO: 147070

SEQ ID NO: 527862 - RNA, 64 nt, Homo Sapiens; identical to SEQ ID NO: 147071

SEQ ID NO: 527863 - RNA, 64 nt, Homo Sapiens; identical to SEQ ID NO: 147072

SEQ ID NO: 527864 - RNA, 64 nt, Homo Sapiens; identical to SEQ ID NO: 147073

SEQ ID NO: 527865 - RNA, 64 nt, Homo Sapiens; identical to SEQ ID NO: 147074

SEQ ID NO: 527866 - RNA, 64 nt, Homo Sapiens; identical to SEQ ID NO: 147075

SEQ ID NO: 527867 - RNA, 64 nt, Homo Sapiens; identical to SEQ ID NO: 147076

SEQ ID NO: 527868 - RNA, 64 nt, Homo Sapiens; identical to SEQ ID NO: 147077

SEQ ID NO: 527869 - RNA, 64 nt, Homo Sapiens; identical to SEQ ID NO: 147078

SEQ ID NO: 527870 - RNA, 64 nt, Homo Sapiens; identical to SEQ ID NO: 147079

SEQ ID NO: 527871 - RNA, 64 nt, Homo Sapiens; identical to SEQ ID NO: 147080

SEQ ID NO: 527872 - RNA, 64 nt, Homo Sapiens; identical to SEQ ID NO: 147081

SEQ ID NO: 527873 - RNA, 53 nt, Homo Sapiens; identical to SEQ ID NO: 147082

SEQ ID NO: 527874 - RNA, 64 nt, Homo Sapiens; identical to SEQ ID NO: 147083

SEQ ID NO: 527875 - RNA, 64 nt, Homo Sapiens; identical to SEQ ID NO: 147084

SEQ ID NO: 527876 - RNA, 64 nt, Homo Sapiens; identical to SEQ ID NO: 147085

SEQ ID NO: 527877 - RNA, 64 nt, Homo Sapiens; identical to SEQ ID NO: 147086

SEQ ID NO: 527878 - RNA, 64 nt, Homo Sapiens; identical to SEQ ID NO: 147087

SEQ ID NO: 527879 - RNA, 64 nt, Homo Sapiens
gccuccaaggcaaauagugcuucacccugaccucucacuccaggacagccucuaagggauuuga

SEQ ID NO: 527880 - RNA, 64 nt, Homo Sapiens
gggauuugaucugcucaucuucaguugaaugcccucacuccaagacuggaugcuggaucucaua

SEQ ID NO: 527881 - RNA, 64 nt, Homo Sapiens
gcugggaugccgcccucaguaagcagcuugccaaucacuccaggucugaaaagcaaguccccca

SEQ ID NO: 527882 - RNA, 64 nt, Homo Sapiens
ucaccagugugggucccuucugauaccaccagguucacuccaggcagaguggggcggaaggcug

SEQ ID NO: 527883 - RNA, 64 nt, Homo Sapiens
acccugucccuggagcaccucgcuccaccuggcuucacuccagccaaaggcuccacagcuccac

SEQ ID NO: 527884 - RNA, 64 nt, Homo Sapiens
ggcuuggccuggaaaggcagaggcaggagcacccucacuccaagacuuccacuucucgcccccc

SEQ ID NO: 527885 - RNA, 64 nt, Homo Sapiens
gaggaggaacgggcagccacaggacugagcccucucacuccagccaaagaaaugggccugccug

SEQ ID NO: 527886 - RNA, 64 nt, Homo Sapiens
uguaacugcccagccccuuuucucugcucuuguuucacuccaccaucacucacucacuccccac

SEQ ID NO: 527887 - RNA, 64 nt, Homo Sapiens
gacucagcacuagcacuccaucagcacuagcaccucacuccaucagcacuagcaccucacucca

SEQ ID NO: 527888 - RNA, 64 nt, Homo Sapiens
agcacuagcaccucacuccaucagcacuagcaccucacuccaucggccccggcacccugcucca

SEQ ID NO: 527889 - RNA, 64 nt, Homo Sapiens
cugugagaccacgcccggccgugcccggccccauucacuccaucucacaacaucuuguaagacu

SEQ ID NO: 527890 - RNA, 64 nt, Homo Sapiens
cugugagccccacucccagcacucccggccccacucacuccauccccaccauccugugagcccc

SEQ ID NO: 527891 - RNA, 64 nt, Homo Sapiens
cugugagucccacucccagcaugcccagccccauucacuccaucucacuccaucuuguaagacu

SEQ ID NO: 527892 - RNA, 64 nt, Homo Sapiens
uuguaagacuaugcccagccacucccggccccacucacuccauccacaccaaccugugagcccc

SEQ ID NO: 527893 - RNA, 64 nt, Homo Sapiens
cugugagucccacucccagcgugcccagccccacucacuccaucucccaccaucuuguaagacu

SEQ ID NO: 527894 - RNA, 64 nt, Homo Sapiens
acuacauuuucucauauacaucuuuuuuuuuuuuuccaggaacauaaacuugguaaaauccaag

SEQ ID NO: 527895 - RNA, 64 nt, Homo Sapiens
agaaugcacauugaauggauuggguaacagauauuccaggaaaaguucuuguuccugagaaggg

SEQ ID NO: 527896 - RNA, 64 nt, Homo Sapiens
auuaugcccaaaucaaccucugaaaaaagguuuuuccaggaagauuuacauuuagguuuaauau

SEQ ID NO: 527897 - RNA, 64 nt, Homo Sapiens
cacuauguguugcuaaaacacaugcuaugagcacuccaggaaacacuauauuuuuuccaaaaaa

SEQ ID NO: 527898 - RNA, 64 nt, Homo Sapiens
augcuggaaacugauaguucagagcguacuuuguuccaggaacuucauucgcuacuaguuauuc

SEQ ID NO: 527899 - RNA, 64 nt, Homo Sapiens
augcuagaaacugucucucuagagccuacuguguuccaggaacuuauuuacuacauaguuauuc

SEQ ID NO: 527900 - RNA, 64 nt, Homo Sapiens
ccugggccagagaagauaauguucuuuaauguuguccaggaaacccuggcuugcuugccgagcc

SEQ ID NO: 527901 - RNA, 64 nt, Homo Sapiens
augucucuuguagaagauggacucugaaaaacauuccaggaaaccauggcagcauggagagccu

SEQ ID NO: 527902 - RNA, 64 nt, Homo Sapiens
ccccgccuggaggagauccgcaucuggggaccccuccaggaagaugcugacauccaggucagca

SEQ ID NO: 527903 - RNA, 64 nt, Homo Sapiens
uuccugugcauggacucugcccucagggugccuguccaggaagagcuguguggccuggcaagca

SEQ ID NO: 527904 - RNA, 64 nt, Homo Sapiens
uauugaucaccaugaaagaagaaugccuuuuguuuccaggaaaaucuuaguuaaauuggauuga

SEQ ID NO: 527905 - RNA, 64 nt, Homo Sapiens
aaacuugcagcuuuaaccugaggauuugccauuguccaggaaaguuuuucucucuuagaauugg

SEQ ID NO: 527906 - RNA, 64 nt, Homo Sapiens
cuugccucuuagcauguuugauuuaagaaaagccuccaggaaaucuugagagccugucuuggca

SEQ ID NO: 527907 - RNA, 64 nt, Homo Sapiens
uugcagcuccccagucucuaccugucaggaugacuccaggaagacagcuggaguacugcauuug

SEQ ID NO: 527908 - RNA, 64 nt, Homo Sapiens
uucuguuacauccaccuuugaggcuggucauaccuccaggaacaauacagagccagucaacuuc

SEQ ID NO: 527909 - RNA, 64 nt, Homo Sapiens
caccugagcgcaccaccaccuggcguguagaaucuccaggaagccuggcugcagcuucccauuu

SEQ ID NO: 527910 - RNA, 64 nt, Homo Sapiens
uagacuguuuuaccuccacacugucaugcaggcuuccaggaacacaggauuuagaucuuggcua

SEQ ID NO: 527911 - RNA, 64 nt, Homo Sapiens
guuccuacguuguguauuacuaacuuaauaucccuccaggaaugucauggagaaugcaggcagu

SEQ ID NO: 527912 - RNA, 64 nt, Homo Sapiens
cagagccacauuagaaguucuucgacccacccacuccaggaaccguuucuuccccgaguggagc

SEQ ID NO: 527913 - RNA, 64 nt, Homo Sapiens
ugaacugcaggggcagagccccacugacagccacuccaggaacuacagauuuaaagacaggugg

SEQ ID NO: 527914 - RNA, 64 nt, Homo Sapiens
uacccgcgggaccucuuguaacccaucggcaucuuccaggaauccgccgagugacuugaggaag

SEQ ID NO: 527915 - RNA, 64 nt, Homo Sapiens
gaggccccugguggccuucaguuucaguuucucauccaggaagguaaccuugggcauuggcagu

SEQ ID NO: 527916 - RNA, 64 nt, Homo Sapiens
agaacaaucaucuguuugacuucuuugguuccucaugcagcagaaggaagacagaaagauagaa

SEQ ID NO: 527917 - RNA, 64 nt, Homo Sapiens
auguuguauacuguaaauuacaguauaaugccaaaugcagcaaaaucuuccagcuguacguuac

SEQ ID NO: 527918 - RNA, 64 nt, Homo Sapiens
ucugagauuucuaauuguguugugaaaaugauaaaugcagcaaaucuagcuuucaguauuccua

SEQ ID NO: 527919 - RNA, 64 nt, Homo Sapiens
aauaagcuuggauaaaauugaaccaacuucaagaaugcagcacuucuuaaucuuuagcucuuuc

SEQ ID NO: 527920 - RNA, 64 nt, Homo Sapiens
cuggccgcgcaccggggcucgucagccggcagggaugcagcagggaaugacggucacuccagac

SEQ ID NO: 527921 - RNA, 64 nt, Homo Sapiens
ccccagcuaccuuugcuuaggcugaggcugaggcaugcagcagcgagggagguggacggugcca

SEQ ID NO: 527922 - RNA, 64 nt, Homo Sapiens
aucagagaguucacacuggagaaagaccuuuugaaugcagcauuugugggaaauccuuuagaug

SEQ ID NO: 527923 - RNA, 64 nt, Homo Sapiens
accaaaaaguucacacuagggaaagaacuuacaaaugcagcaaaugugggaaauuuuuuaugga

SEQ ID NO: 527924 - RNA, 64 nt, Homo Sapiens
gacgucacgggccaugucgagacgucacaccgagaugcagcaacagacauggggaacuuggcau

SEQ ID NO: 527925 - RNA, 64 nt, Homo Sapiens
ucgcacacagacauggggaaauggcgucgugcagaugcagcacgcgucacgaagagauauagcg

SEQ ID NO: 527926 - RNA, 64 nt, Homo Sapiens
agcgggccaugcaggacauguguacgacaugaucaugcagcacaugcccugcagaugcagcaga

SEQ ID NO: 527927 - RNA, 64 nt, Homo Sapiens
uguacgacaugaucaugcagaggagcagcaggagaugcagcagacgcccagaagaagcagcuga

SEQ ID NO: 527928 - RNA, 64 nt, Homo Sapiens
aggcagaagccauagucacugggccaucucacccaugcagcauaccagcccaggaaccuuugca

SEQ ID NO: 527929 - RNA, 64 nt, Homo Sapiens
auccccauaccagaaaaauuccaagucaaacuucaugcagcagacuuugugagaaaaucuucag

SEQ ID NO: 527930 - RNA, 64 nt, Homo Sapiens
ccuacaacaccuucaaguacccaacuuugcacucaugcagcagucccgcggggugcagagcacc

SEQ ID NO: 527931 - RNA, 64 nt, Homo Sapiens
ucgugaaggucauccagggcuguucaagcacgagaugcagcauugcaguuccgucagcugcagc

SEQ ID NO: 527932 - RNA, 64 nt, Homo Sapiens; identical to SEQ ID NO: 491366

SEQ ID NO: 527933 - RNA, 64 nt, Homo Sapiens; identical to SEQ ID NO: 491367

SEQ ID NO: 527934 - RNA, 64 nt, Homo Sapiens; identical to SEQ ID NO: 491368

SEQ ID NO: 527935 - RNA, 64 nt, Homo Sapiens; identical to SEQ ID NO: 491369

SEQ ID NO: 527936 - RNA, 64 nt, Homo Sapiens; identical to SEQ ID NO: 491370

SEQ ID NO: 527937 - RNA, 64 nt, Homo Sapiens; identical to SEQ ID NO: 491371

SEQ ID NO: 527938 - RNA, 64 nt, Homo Sapiens; identical to SEQ ID NO: 491372

SEQ ID NO: 527939 - RNA, 64 nt, Homo Sapiens; identical to SEQ ID NO: 491373

SEQ ID NO: 527940 - RNA, 64 nt, Homo Sapiens; identical to SEQ ID NO: 491374

SEQ ID NO: 527941 - RNA, 64 nt, Homo Sapiens; identical to SEQ ID NO: 491375

SEQ ID NO: 527942 - RNA, 64 nt, Homo Sapiens; identical to SEQ ID NO: 491376

SEQ ID NO: 527943 - RNA, 64 nt, Homo Sapiens; identical to SEQ ID NO: 491377

SEQ ID NO: 527944 - RNA, 64 nt, Homo Sapiens; identical to SEQ ID NO: 491378

SEQ ID NO: 527945 - RNA, 64 nt, Homo Sapiens; identical to SEQ ID NO: 491379

SEQ ID NO: 527946 - RNA, 64 nt, Homo Sapiens; identical to SEQ ID NO: 491380

SEQ ID NO: 527947 - RNA, 64 nt, Homo Sapiens; identical to SEQ ID NO: 491381

SEQ ID NO: 527948 - RNA, 64 nt, Homo Sapiens; identical to SEQ ID NO: 491382

SEQ ID NO: 527949 - RNA, 64 nt, Homo Sapiens; identical to SEQ ID NO: 491383

SEQ ID NO: 527950 - RNA, 64 nt, Homo Sapiens; identical to SEQ ID NO: 491384

SEQ ID NO: 527951 - RNA, 64 nt, Homo Sapiens; identical to SEQ ID NO: 491385

SEQ ID NO: 527952 - RNA, 64 nt, Homo Sapiens; identical to SEQ ID NO: 491386

SEQ ID NO: 527953 - RNA, 64 nt, Homo Sapiens; identical to SEQ ID NO: 491387

SEQ ID NO: 527954 - RNA, 64 nt, Homo Sapiens; identical to SEQ ID NO: 491388

SEQ ID NO: 527955 - RNA, 64 nt, Homo Sapiens; identical to SEQ ID NO: 491389

SEQ ID NO: 527956 - RNA, 64 nt, Homo Sapiens; identical to SEQ ID NO: 491390

SEQ ID NO: 527957 - RNA, 64 nt, Homo Sapiens; identical to SEQ ID NO: 491391

SEQ ID NO: 527958 - RNA, 64 nt, Homo Sapiens; identical to SEQ ID NO: 491392

SEQ ID NO: 527959 - RNA, 64 nt, Homo Sapiens; identical to SEQ ID NO: 491393

SEQ ID NO: 527960 - RNA, 64 nt, Homo Sapiens; identical to SEQ ID NO: 491394

SEQ ID NO: 527961 - RNA, 64 nt, Homo Sapiens; identical to SEQ ID NO: 491395

SEQ ID NO: 527962 - RNA, 64 nt, Homo Sapiens; identical to SEQ ID NO: 491396

SEQ ID NO: 527963 - RNA, 64 nt, Homo Sapiens; identical to SEQ ID NO: 491397

SEQ ID NO: 527964 - RNA, 64 nt, Homo Sapiens; identical to SEQ ID NO: 491398

SEQ ID NO: 527965 - RNA, 64 nt, Homo Sapiens; identical to SEQ ID NO: 491399

SEQ ID NO: 527966 - RNA, 64 nt, Homo Sapiens; identical to SEQ ID NO: 491400

SEQ ID NO: 527967 - RNA, 64 nt, Homo Sapiens; identical to SEQ ID NO: 491401

SEQ ID NO: 527968 - RNA, 64 nt, Homo Sapiens; identical to SEQ ID NO: 491402

SEQ ID NO: 527969 - RNA, 64 nt, Homo Sapiens; identical to SEQ ID NO: 491403

SEQ ID NO: 527970 - RNA, 64 nt, Homo Sapiens; identical to SEQ ID NO: 491404

SEQ ID NO: 527971 - RNA, 64 nt, Homo Sapiens; identical to SEQ ID NO: 491405

SEQ ID NO: 527972 - RNA, 64 nt, Homo Sapiens; identical to SEQ ID NO: 491406

SEQ ID NO: 527973 - RNA, 64 nt, Homo Sapiens; identical to SEQ ID NO: 491407

SEQ ID NO: 527974 - RNA, 64 nt, Homo Sapiens; identical to SEQ ID NO: 491408

SEQ ID NO: 527975 - RNA, 64 nt, Homo Sapiens; identical to SEQ ID NO: 491409

SEQ ID NO: 527976 - RNA, 64 nt, Homo Sapiens; identical to SEQ ID NO: 491410

SEQ ID NO: 527977 - RNA, 64 nt, Homo Sapiens; identical to SEQ ID NO: 491411

SEQ ID NO: 527978 - RNA, 64 nt, Homo Sapiens; identical to SEQ ID NO: 491412

SEQ ID NO: 527979 - RNA, 64 nt, Homo Sapiens; identical to SEQ ID NO: 491413

SEQ ID NO: 527980 - RNA, 64 nt, Homo Sapiens; identical to SEQ ID NO: 491414

SEQ ID NO: 527981 - RNA, 64 nt, Homo Sapiens; identical to SEQ ID NO: 491415

SEQ ID NO: 527982 - RNA, 64 nt, Homo Sapiens; identical to SEQ ID NO: 491416

SEQ ID NO: 527983 - RNA, 64 nt, Homo Sapiens; identical to SEQ ID NO: 491417

SEQ ID NO: 527984 - RNA, 64 nt, Homo Sapiens; identical to SEQ ID NO: 491418

SEQ ID NO: 527985 - RNA, 64 nt, Homo Sapiens; identical to SEQ ID NO: 491419

SEQ ID NO: 527986 - RNA, 64 nt, Homo Sapiens; identical to SEQ ID NO: 491420

SEQ ID NO: 527987 - RNA, 64 nt, Homo Sapiens; identical to SEQ ID NO: 491421

SEQ ID NO: 527988 - RNA, 64 nt, Homo Sapiens; identical to SEQ ID NO: 491422

SEQ ID NO: 527989 - RNA, 64 nt, Homo Sapiens; identical to SEQ ID NO: 491423

SEQ ID NO: 527990 - RNA, 64 nt, Homo Sapiens; identical to SEQ ID NO: 491424

SEQ ID NO: 527991 - RNA, 64 nt, Homo Sapiens; identical to SEQ ID NO: 491425

SEQ ID NO: 527992 - RNA, 64 nt, Homo Sapiens; identical to SEQ ID NO: 491426

SEQ ID NO: 527993 - RNA, 64 nt, Homo Sapiens; identical to SEQ ID NO: 491427

SEQ ID NO: 527994 - RNA, 64 nt, Homo Sapiens; identical to SEQ ID NO: 491428

SEQ ID NO: 527995 - RNA, 64 nt, Homo Sapiens; identical to SEQ ID NO: 491429

SEQ ID NO: 527996 - RNA, 64 nt, Homo Sapiens; identical to SEQ ID NO: 491430

SEQ ID NO: 527997 - RNA, 64 nt, Homo Sapiens; identical to SEQ ID NO: 491431

SEQ ID NO: 527998 - RNA, 64 nt, Homo Sapiens; identical to SEQ ID NO: 491432

SEQ ID NO: 527999 - RNA, 64 nt, Homo Sapiens; identical to SEQ ID NO: 491433

SEQ ID NO: 528000 - RNA, 64 nt, Homo Sapiens; identical to SEQ ID NO: 491434

SEQ ID NO: 528001 - RNA, 64 nt, Homo Sapiens; identical to SEQ ID NO: 491435

SEQ ID NO: 528002 - RNA, 64 nt, Homo Sapiens; identical to SEQ ID NO: 491436

SEQ ID NO: 528003 - RNA, 64 nt, Homo Sapiens; identical to SEQ ID NO: 491437

SEQ ID NO: 528004 - RNA, 64 nt, Homo Sapiens; identical to SEQ ID NO: 491438

SEQ ID NO: 528005 - RNA, 64 nt, Homo Sapiens; identical to SEQ ID NO: 491439

SEQ ID NO: 528006 - RNA, 64 nt, Homo Sapiens; identical to SEQ ID NO: 491440

SEQ ID NO: 528007 - RNA, 64 nt, Homo Sapiens; identical to SEQ ID NO: 491441

SEQ ID NO: 528008 - RNA, 64 nt, Homo Sapiens; identical to SEQ ID NO: 491442

SEQ ID NO: 528009 - RNA, 64 nt, Homo Sapiens; identical to SEQ ID NO: 491443

SEQ ID NO: 528010 - RNA, 64 nt, Homo Sapiens; identical to SEQ ID NO: 491444

SEQ ID NO: 528011 - RNA, 64 nt, Homo Sapiens; identical to SEQ ID NO: 491445

SEQ ID NO: 528012 - RNA, 64 nt, Homo Sapiens; identical to SEQ ID NO: 491446

SEQ ID NO: 528013 - RNA, 64 nt, Homo Sapiens; identical to SEQ ID NO: 491447

SEQ ID NO: 528014 - RNA, 64 nt, Homo Sapiens; identical to SEQ ID NO: 491448

SEQ ID NO: 528015 - RNA, 64 nt, Homo Sapiens; identical to SEQ ID NO: 491449

SEQ ID NO: 528016 - RNA, 64 nt, Homo Sapiens; identical to SEQ ID NO: 491450

SEQ ID NO: 528017 - RNA, 64 nt, Homo Sapiens; identical to SEQ ID NO: 491451

SEQ ID NO: 528018 - RNA, 64 nt, Homo Sapiens; identical to SEQ ID NO: 491452

SEQ ID NO: 528019 - RNA, 64 nt, Homo Sapiens; identical to SEQ ID NO: 491453

SEQ ID NO: 528020 - RNA, 64 nt, Homo Sapiens; identical to SEQ ID NO: 491454

SEQ ID NO: 528021 - RNA, 64 nt, Homo Sapiens; identical to SEQ ID NO: 491455

SEQ ID NO: 528022 - RNA, 64 nt, Homo Sapiens; identical to SEQ ID NO: 491456

SEQ ID NO: 528023 - RNA, 64 nt, Homo Sapiens; identical to SEQ ID NO: 491457

SEQ ID NO: 528024 - RNA, 64 nt, Homo Sapiens; identical to SEQ ID NO: 491458

SEQ ID NO: 528025 - RNA, 64 nt, Homo Sapiens; identical to SEQ ID NO: 491459

SEQ ID NO: 528026 - RNA, 64 nt, Homo Sapiens; identical to SEQ ID NO: 491460

SEQ ID NO: 528027 - RNA, 64 nt, Homo Sapiens; identical to SEQ ID NO: 491461

SEQ ID NO: 528028 - RNA, 64 nt, Homo Sapiens; identical to SEQ ID NO: 491462

SEQ ID NO: 528029 - RNA, 64 nt, Homo Sapiens; identical to SEQ ID NO: 491463

SEQ ID NO: 528030 - RNA, 64 nt, Homo Sapiens; identical to SEQ ID NO: 491464

SEQ ID NO: 528031 - RNA, 64 nt, Homo Sapiens; identical to SEQ ID NO: 491465

SEQ ID NO: 528032 - RNA, 64 nt, Homo Sapiens; identical to SEQ ID NO: 491466

SEQ ID NO: 528033 - RNA, 64 nt, Homo Sapiens; identical to SEQ ID NO: 491467

SEQ ID NO: 528034 - RNA, 64 nt, Homo Sapiens; identical to SEQ ID NO: 491468

SEQ ID NO: 528035 - RNA, 64 nt, Homo Sapiens; identical to SEQ ID NO: 491469

SEQ ID NO: 528036 - RNA, 64 nt, Homo Sapiens; identical to SEQ ID NO: 491470

SEQ ID NO: 528037 - RNA, 64 nt, Homo Sapiens; identical to SEQ ID NO: 491471

SEQ ID NO: 528038 - RNA, 64 nt, Homo Sapiens; identical to SEQ ID NO: 491472

SEQ ID NO: 528039 - RNA, 64 nt, Homo Sapiens; identical to SEQ ID NO: 491473

SEQ ID NO: 528040 - RNA, 64 nt, Homo Sapiens; identical to SEQ ID NO: 491474

SEQ ID NO: 528041 - RNA, 64 nt, Homo Sapiens; identical to SEQ ID NO: 491475

SEQ ID NO: 528042 - RNA, 64 nt, Homo Sapiens; identical to SEQ ID NO: 491476

SEQ ID NO: 528043 - RNA, 65 nt, Homo Sapiens; identical to SEQ ID NO: 393598

SEQ ID NO: 528044 - RNA, 65 nt, Homo Sapiens; identical to SEQ ID NO: 393599

SEQ ID NO: 528045 - RNA, 65 nt, Homo Sapiens; identical to SEQ ID NO: 393600

SEQ ID NO: 528046 - RNA, 65 nt, Homo Sapiens; identical to SEQ ID NO: 393601

SEQ ID NO: 528047 - RNA, 65 nt, Homo Sapiens; identical to SEQ ID NO: 393602

SEQ ID NO: 528048 - RNA, 65 nt, Homo Sapiens; identical to SEQ ID NO: 393603

SEQ ID NO: 528049 - RNA, 65 nt, Homo Sapiens; identical to SEQ ID NO: 393604

SEQ ID NO: 528050 - RNA, 65 nt, Homo Sapiens; identical to SEQ ID NO: 393605

SEQ ID NO: 528051 - RNA, 65 nt, Homo Sapiens; identical to SEQ ID NO: 393606

SEQ ID NO: 528052 - RNA, 65 nt, Homo Sapiens; identical to SEQ ID NO: 393607

SEQ ID NO: 528053 - RNA, 65 nt, Homo Sapiens; identical to SEQ ID NO: 393608

SEQ ID NO: 528054 - RNA, 65 nt, Homo Sapiens; identical to SEQ ID NO: 393609

SEQ ID NO: 528055 - RNA, 65 nt, Homo Sapiens; identical to SEQ ID NO: 393610

SEQ ID NO: 528056 - RNA, 65 nt, Homo Sapiens; identical to SEQ ID NO: 393611

SEQ ID NO: 528057 - RNA, 65 nt, Homo Sapiens; identical to SEQ ID NO: 393612

SEQ ID NO: 528058 - RNA, 65 nt, Homo Sapiens; identical to SEQ ID NO: 393613

SEQ ID NO: 528059 - RNA, 65 nt, Homo Sapiens; identical to SEQ ID NO: 393614

SEQ ID NO: 528060 - RNA, 65 nt, Homo Sapiens; identical to SEQ ID NO: 393615

SEQ ID NO: 528061 - RNA, 65 nt, Homo Sapiens; identical to SEQ ID NO: 393616

SEQ ID NO: 528062 - RNA, 65 nt, Homo Sapiens; identical to SEQ ID NO: 393617

SEQ ID NO: 528063 - RNA, 65 nt, Homo Sapiens; identical to SEQ ID NO: 393618

SEQ ID NO: 528064 - RNA, 65 nt, Homo Sapiens; identical to SEQ ID NO: 393619

SEQ ID NO: 528065 - RNA, 65 nt, Homo Sapiens; identical to SEQ ID NO: 393620

SEQ ID NO: 528066 - RNA, 65 nt, Homo Sapiens; identical to SEQ ID NO: 393621

SEQ ID NO: 528067 - RNA, 65 nt, Homo Sapiens; identical to SEQ ID NO: 393622

SEQ ID NO: 528068 - RNA, 65 nt, Homo Sapiens; identical to SEQ ID NO: 393623

SEQ ID NO: 528069 - RNA, 65 nt, Homo Sapiens; identical to SEQ ID NO: 393624

SEQ ID NO: 528070 - RNA, 65 nt, Homo Sapiens; identical to SEQ ID NO: 393625

SEQ ID NO: 528071 - RNA, 65 nt, Homo Sapiens; identical to SEQ ID NO: 393626

SEQ ID NO: 528072 - RNA, 65 nt, Homo Sapiens; identical to SEQ ID NO: 393627

SEQ ID NO: 528073 - RNA, 65 nt, Homo Sapiens; identical to SEQ ID NO: 393628

SEQ ID NO: 528074 - RNA, 65 nt, Homo Sapiens; identical to SEQ ID NO: 393629

SEQ ID NO: 528075 - RNA, 65 nt, Homo Sapiens; identical to SEQ ID NO: 393630

SEQ ID NO: 528076 - RNA, 65 nt, Homo Sapiens; identical to SEQ ID NO: 393631

SEQ ID NO: 528077 - RNA, 65 nt, Homo Sapiens; identical to SEQ ID NO: 393632

SEQ ID NO: 528078 - RNA, 65 nt, Homo Sapiens; identical to SEQ ID NO: 393633

SEQ ID NO: 528079 - RNA, 65 nt, Homo Sapiens; identical to SEQ ID NO: 393634

SEQ ID NO: 528080 - RNA, 65 nt, Homo Sapiens; identical to SEQ ID NO: 393635

SEQ ID NO: 528081 - RNA, 65 nt, Homo Sapiens; identical to SEQ ID NO: 393636

SEQ ID NO: 528082 - RNA, 65 nt, Homo Sapiens; identical to SEQ ID NO: 393637

SEQ ID NO: 528083 - RNA, 65 nt, Homo Sapiens; identical to SEQ ID NO: 393638

SEQ ID NO: 528084 - RNA, 65 nt, Homo Sapiens; identical to SEQ ID NO: 393639

SEQ ID NO: 528085 - RNA, 65 nt, Homo Sapiens; identical to SEQ ID NO: 393640

SEQ ID NO: 528086 - RNA, 65 nt, Homo Sapiens; identical to SEQ ID NO: 393641

SEQ ID NO: 528087 - RNA, 65 nt, Homo Sapiens; identical to SEQ ID NO: 393642

SEQ ID NO: 528088 - RNA, 65 nt, Homo Sapiens; identical to SEQ ID NO: 393643

SEQ ID NO: 528089 - RNA, 65 nt, Homo Sapiens; identical to SEQ ID NO: 393644

SEQ ID NO: 528090 - RNA, 65 nt, Homo Sapiens; identical to SEQ ID NO: 393645

SEQ ID NO: 528091 - RNA, 65 nt, Homo Sapiens; identical to SEQ ID NO: 393646

SEQ ID NO: 528092 - RNA, 65 nt, Homo Sapiens; identical to SEQ ID NO: 393647

SEQ ID NO: 528093 - RNA, 65 nt, Homo Sapiens; identical to SEQ ID NO: 393648

SEQ ID NO: 528094 - RNA, 65 nt, Homo Sapiens; identical to SEQ ID NO: 393649

SEQ ID NO: 528095 - RNA, 65 nt, Homo Sapiens; identical to SEQ ID NO: 393650

SEQ ID NO: 528096 - RNA, 65 nt, Homo Sapiens; identical to SEQ ID NO: 393651

SEQ ID NO: 528097 - RNA, 65 nt, Homo Sapiens; identical to SEQ ID NO: 393652

SEQ ID NO: 528098 - RNA, 65 nt, Homo Sapiens; identical to SEQ ID NO: 393653

SEQ ID NO: 528099 - RNA, 65 nt, Homo Sapiens; identical to SEQ ID NO: 393654

SEQ ID NO: 528100 - RNA, 65 nt, Homo Sapiens; identical to SEQ ID NO: 393655

SEQ ID NO: 528101 - RNA, 65 nt, Homo Sapiens; identical to SEQ ID NO: 393656

SEQ ID NO: 528102 - RNA, 65 nt, Homo Sapiens; identical to SEQ ID NO: 393657

SEQ ID NO: 528103 - RNA, 65 nt, Homo Sapiens; identical to SEQ ID NO: 393658

SEQ ID NO: 528104 - RNA, 65 nt, Homo Sapiens; identical to SEQ ID NO: 393659

SEQ ID NO: 528105 - RNA, 65 nt, Homo Sapiens; identical to SEQ ID NO: 393660

SEQ ID NO: 528106 - RNA, 64 nt, Homo Sapiens; identical to SEQ ID NO: 409180

SEQ ID NO: 528107 - RNA, 64 nt, Homo Sapiens; identical to SEQ ID NO: 409181

SEQ ID NO: 528108 - RNA, 64 nt, Homo Sapiens; identical to SEQ ID NO: 409182

SEQ ID NO: 528109 - RNA, 64 nt, Homo Sapiens; identical to SEQ ID NO: 409183

SEQ ID NO: 528110 - RNA, 64 nt, Homo Sapiens; identical to SEQ ID NO: 409184

SEQ ID NO: 528111 - RNA, 64 nt, Homo Sapiens; identical to SEQ ID NO: 409185

SEQ ID NO: 528112 - RNA, 64 nt, Homo Sapiens; identical to SEQ ID NO: 409186

SEQ ID NO: 528113 - RNA, 64 nt, Homo Sapiens; identical to SEQ ID NO: 409187

SEQ ID NO: 528114 - RNA, 64 nt, Homo Sapiens; identical to SEQ ID NO: 409188

SEQ ID NO: 528115 - RNA, 64 nt, Homo Sapiens; identical to SEQ ID NO: 409189

SEQ ID NO: 528116 - RNA, 64 nt, Homo Sapiens; identical to SEQ ID NO: 409190

SEQ ID NO: 528117 - RNA, 64 nt, Homo Sapiens; identical to SEQ ID NO: 409191

SEQ ID NO: 528118 - RNA, 64 nt, Homo Sapiens; identical to SEQ ID NO: 409192

SEQ ID NO: 528119 - RNA, 64 nt, Homo Sapiens; identical to SEQ ID NO: 409193

SEQ ID NO: 528120 - RNA, 64 nt, Homo Sapiens; identical to SEQ ID NO: 409194

SEQ ID NO: 528121 - RNA, 64 nt, Homo Sapiens; identical to SEQ ID NO: 409195

SEQ ID NO: 528122 - RNA, 64 nt, Homo Sapiens; identical to SEQ ID NO: 409196

SEQ ID NO: 528123 - RNA, 64 nt, Homo Sapiens; identical to SEQ ID NO: 409197

SEQ ID NO: 528124 - RNA, 64 nt, Homo Sapiens; identical to SEQ ID NO: 85524

SEQ ID NO: 528125 - RNA, 64 nt, Homo Sapiens; identical to SEQ ID NO: 85525

SEQ ID NO: 528126 - RNA, 64 nt, Homo Sapiens; identical to SEQ ID NO: 85526

SEQ ID NO: 528127 - RNA, 64 nt, Homo Sapiens; identical to SEQ ID NO: 85527

SEQ ID NO: 528128 - RNA, 64 nt, Homo Sapiens; identical to SEQ ID NO: 85528

SEQ ID NO: 528129 - RNA, 64 nt, Homo Sapiens; identical to SEQ ID NO: 85529

SEQ ID NO: 528130 - RNA, 64 nt, Homo Sapiens; identical to SEQ ID NO: 85530

SEQ ID NO: 528131 - RNA, 64 nt, Homo Sapiens; identical to SEQ ID NO: 85531

SEQ ID NO: 528132 - RNA, 64 nt, Homo Sapiens; identical to SEQ ID NO: 85532

SEQ ID NO: 528133 - RNA, 64 nt, Homo Sapiens; identical to SEQ ID NO: 85533

SEQ ID NO: 528134 - RNA, 64 nt, Homo Sapiens; identical to SEQ ID NO: 85534

SEQ ID NO: 528135 - RNA, 64 nt, Homo Sapiens; identical to SEQ ID NO: 85535

SEQ ID NO: 528136 - RNA, 55 nt, Homo Sapiens; identical to SEQ ID NO: 85536

SEQ ID NO: 528137 - RNA, 64 nt, Homo Sapiens; identical to SEQ ID NO: 85537

SEQ ID NO: 528138 - RNA, 64 nt, Homo Sapiens; identical to SEQ ID NO: 85538

SEQ ID NO: 528139 - RNA, 64 nt, Homo Sapiens; identical to SEQ ID NO: 85539

SEQ ID NO: 528140 - RNA, 64 nt, Homo Sapiens; identical to SEQ ID NO: 85540

SEQ ID NO: 528141 - RNA, 64 nt, Homo Sapiens; identical to SEQ ID NO: 85541

SEQ ID NO: 528142 - RNA, 64 nt, Homo Sapiens; identical to SEQ ID NO: 85542

SEQ ID NO: 528143 - RNA, 64 nt, Homo Sapiens; identical to SEQ ID NO: 85543

SEQ ID NO: 528144 - RNA, 64 nt, Homo Sapiens; identical to SEQ ID NO: 85544

SEQ ID NO: 528145 - RNA, 64 nt, Homo Sapiens; identical to SEQ ID NO: 85545

SEQ ID NO: 528146 - RNA, 64 nt, Homo Sapiens; identical to SEQ ID NO: 85546

SEQ ID NO: 528147 - RNA, 64 nt, Homo Sapiens; identical to SEQ ID NO: 85547

SEQ ID NO: 528148 - RNA, 64 nt, Homo Sapiens; identical to SEQ ID NO: 85548

SEQ ID NO: 528149 - RNA, 64 nt, Homo Sapiens; identical to SEQ ID NO: 85549

SEQ ID NO: 528150 - RNA, 64 nt, Homo Sapiens; identical to SEQ ID NO: 85550

SEQ ID NO: 528151 - RNA, 64 nt, Homo Sapiens; identical to SEQ ID NO: 85551

SEQ ID NO: 528152 - RNA, 64 nt, Homo Sapiens; identical to SEQ ID NO: 85552

SEQ ID NO: 528153 - RNA, 64 nt, Homo Sapiens; identical to SEQ ID NO: 85553

SEQ ID NO: 528154 - RNA, 64 nt, Homo Sapiens; identical to SEQ ID NO: 85554

SEQ ID NO: 528155 - RNA, 64 nt, Homo Sapiens; identical to SEQ ID NO: 85555

SEQ ID NO: 528156 - RNA, 64 nt, Homo Sapiens; identical to SEQ ID NO: 85556

SEQ ID NO: 528157 - RNA, 64 nt, Homo Sapiens; identical to SEQ ID NO: 85557

SEQ ID NO: 528158 - RNA, 64 nt, Homo Sapiens; identical to SEQ ID NO: 85558

SEQ ID NO: 528159 - RNA, 64 nt, Homo Sapiens; identical to SEQ ID NO: 85559

SEQ ID NO: 528160 - RNA, 64 nt, Homo Sapiens; identical to SEQ ID NO: 85560

SEQ ID NO: 528161 - RNA, 64 nt, Homo Sapiens; identical to SEQ ID NO: 85561

SEQ ID NO: 528162 - RNA, 64 nt, Homo Sapiens; identical to SEQ ID NO: 85562

SEQ ID NO: 528163 - RNA, 64 nt, Homo Sapiens; identical to SEQ ID NO: 85563

SEQ ID NO: 528164 - RNA, 62 nt, Homo Sapiens; identical to SEQ ID NO: 85564

SEQ ID NO: 528165 - RNA, 57 nt, Homo Sapiens; identical to SEQ ID NO: 85565

SEQ ID NO: 528166 - RNA, 64 nt, Homo Sapiens; identical to SEQ ID NO: 85566

SEQ ID NO: 528167 - RNA, 64 nt, Homo Sapiens; identical to SEQ ID NO: 85567

SEQ ID NO: 528168 - RNA, 64 nt, Homo Sapiens; identical to SEQ ID NO: 85568

SEQ ID NO: 528169 - RNA, 64 nt, Homo Sapiens; identical to SEQ ID NO: 85569

SEQ ID NO: 528170 - RNA, 64 nt, Homo Sapiens; identical to SEQ ID NO: 85570

SEQ ID NO: 528171 - RNA, 64 nt, Homo Sapiens; identical to SEQ ID NO: 85571

SEQ ID NO: 528172 - RNA, 61 nt, Homo Sapiens
aauuuaagaaauugguuuaaaaaaguaccuuugaauaaaacaagaauaggggcaagacgac

SEQ ID NO: 528173 - RNA, 61 nt, Homo Sapiens
aauguauagauguuuggaugaucugguucugugaauaaaggguauuuuuaguaacagaagc

SEQ ID NO: 528174 - RNA, 61 nt, Homo Sapiens
uuuaccaaggcuucucaguucaaaucuuaagugaauaaaacugggcaucuaacuguuacac

SEQ ID NO: 528175 - RNA, 61 nt, Homo Sapiens
uuauuucaaauugaauuugugcuucuuccauugaauaaaaguaguuuugccaauagaaaau

SEQ ID NO: 528176 - RNA, 61 nt, Homo Sapiens
caaaagccaagguguaugcuaaauaaauaaaugaauaaagaagggcacaaaaugaaugaau

SEQ ID NO: 528177 - RNA, 61 nt, Homo Sapiens
aauaaaugaauaaagacaaacacaaaaugaaugaauaaauacugguucauucccagaaggg

SEQ ID NO: 528178 - RNA, 61 nt, Homo Sapiens
gggacuggcagcccauccaaguguauaugaaugaauaaagcauccaaguauauaugaauga

SEQ ID NO: 528179 - RNA, 61 nt, Homo Sapiens
ugaaugaauaaagcauccaaguauauaugaaugaauaaaguauguaaguaucaccagaaaa

SEQ ID NO: 528180 - RNA, 61 nt, Homo Sapiens
auuuugugauuugucuauauuguugcauuuaugaauaaaucauuuaucugcugcugaguag

SEQ ID NO: 528181 - RNA, 61 nt, Homo Sapiens
gaugauggacauuaauaguucuaggcuauuaugaauaaaguuuccaugaacaucuauguac

SEQ ID NO: 528182 - RNA, 61 nt, Homo Sapiens
ccaagagcuucagugcuggauuuaauucauuugaauaaauagguuuuucuaugggcauguu

SEQ ID NO: 528183 - RNA, 61 nt, Homo Sapiens
uguuguaaacaucuuugugcuuuggcaauuaugaauaaagccuucuuggugguuuccaagu

SEQ ID NO: 528184 - RNA, 61 nt, Homo Sapiens
cauaaaauauuuagccccucaacacaguaaaugaauaaaacaaagaaaaacacagcaugag

SEQ ID NO: 528185 - RNA, 61 nt, Homo Sapiens
cagccugacugaauuuucagguaaagcauucugaauaaauugcaaauaaugaaagagcucg

SEQ ID NO: 528186 - RNA, 61 nt, Homo Sapiens
ccuuaaguauacuucaagacuaaaaaucagcugaauaaauuacuaacugagcuccuucacu

SEQ ID NO: 528187 - RNA, 61 nt, Homo Sapiens
cacacuucugacuauaauuuaucauggacaaugaauaaaugugucauuuguaugagagagg

SEQ ID NO: 528188 - RNA, 61 nt, Homo Sapiens
uucacuuaacuucuccauggcugcuuccugcugaauaaauagggacaggcauaauggauag

SEQ ID NO: 528189 - RNA, 61 nt, Homo Sapiens
gguuuucuuuuucuuaguaugggaguguccaugaauaaauucaugggcauccucauaacuc

SEQ ID NO: 528190 - RNA, 61 nt, Homo Sapiens
gcuuguaaagaaguuuuuccucugugugugcugaauaaaugggaugugcuggucccccuac

SEQ ID NO: 528191 - RNA, 61 nt, Homo Sapiens
ggaugguccgcuuucuauugguccuugugguugaauaaaaauggagucuucuuuagugcca

SEQ ID NO: 528192 - RNA, 61 nt, Homo Sapiens
cuaucucuguugcucacaaacucucugcguuugaauaaagaaguguuuccauguuauggau

SEQ ID NO: 528193 - RNA, 61 nt, Homo Sapiens
gggcgguuucggaagcgucacacuugagaagugaauaaauggggcgcauccaagcgggggc

SEQ ID NO: 528194 - RNA, 61 nt, Homo Sapiens
ucaaugcuauuggauuguuucuuaacaugaaugaauaaaagacagauaucauuucagguga

SEQ ID NO: 528195 - RNA, 61 nt, Homo Sapiens
augcaaguugucaauggauguaauauagcacugaauaaaugcuaucuuccaauacacuguu

SEQ ID NO: 528196 - RNA, 61 nt, Homo Sapiens
uaagaguuggggggaguaucuauaguaaacuugaauaaaggggacaaagcuagaacuuauu

SEQ ID NO: 528197 - RNA, 61 nt, Homo Sapiens
aguuuuaagcacauaauguaauucuaaaagaugaauaaacuagagagguucacuuugugcc

SEQ ID NO: 528198 - RNA, 61 nt, Homo Sapiens
auuauagagaaugauuauaugauguuuguaaugaauaaaauaguaguuucauuauuuggca

SEQ ID NO: 528199 - RNA, 61 nt, Homo Sapiens
uuuuucugugauuaugaaaugcaauaaaaucugaauaaagggcaaaguuucuuccugauca

SEQ ID NO: 528200 - RNA, 61 nt, Homo Sapiens
cuuaguagaauacagagcuuugguaauuacaugaauaaaauuaagaaaauagccauauaca

SEQ ID NO: 528201 - RNA, 61 nt, Homo Sapiens
acuuuauaguuugggagacagaaucaggucuugaauaaaauaauuguaaugagugcuaaau

SEQ ID NO: 528202 - RNA, 61 nt, Homo Sapiens
gguuuuguuauugguuuuuuuuuguaaagugugaauaaaagguauguuuacucauuuuucc

SEQ ID NO: 528203 - RNA, 61 nt, Homo Sapiens
cagacagcucuuugaugagggugaugggaacugaauaaaccauacggacuggcaguaacaa

SEQ ID NO: 528204 - RNA, 61 nt, Homo Sapiens
guuuuuuucugcauuuugaauguguaauuugugaauaaauaaguaauggauguuuguuuuu

SEQ ID NO: 528205 - RNA, 61 nt, Homo Sapiens
acuuaagcacaaaauacauauagagugccaaugaauaaauauaaaaaaguagggcuguuau

SEQ ID NO: 528206 - RNA, 61 nt, Homo Sapiens
gcaugaaguacgugugugugagucugagaaaugaauaaaaauuuuguuucuuagggaaaac

SEQ ID NO: 528207 - RNA, 61 nt, Homo Sapiens
acguucaugagaaaucgacugaacugaaaggugaauaaaggggguuucagcauccaccaau

SEQ ID NO: 528208 - RNA, 61 nt, Homo Sapiens
uacuagauugaauuuauuuagugaaugcuccugaauaaaugugcauuccucuuuuagagua

SEQ ID NO: 528209 - RNA, 61 nt, Homo Sapiens
gugcauguuucuaauugacuuacugggaaacugaauaaaauaugccucuuauuaucauauu

SEQ ID NO: 528210 - RNA, 61 nt, Homo Sapiens
cccagauggaccaaguggggccggggagggaugaauaaacacccuaccccgugcccugucu

SEQ ID NO: 528211 - RNA, 61 nt, Homo Sapiens
gcuuggaccgauguccccauauguacagaacugaauaaagugggucucugagaagucugau

SEQ ID NO: 528212 - RNA, 61 nt, Homo Sapiens
cugcuagugguauauguugaauauuugguaaugaauaaauuagugcuggucucacagcuua

SEQ ID NO: 528213 - RNA, 61 nt, Homo Sapiens
uuuucagugauaugaaaaggcauacaauagaugaauaaaugguuuuuaaaagaucgaucua

SEQ ID NO: 528214 - RNA, 61 nt, Homo Sapiens
guauugggugauuuauuaaagucuuuucuuuugaauaaacauagcuuucguuccuuagaau

SEQ ID NO: 528215 - RNA, 61 nt, Homo Sapiens
uuagcucuucucauugugaacauuuguugauugaauaaauguggccauggcggacacucag

SEQ ID NO: 528216 - RNA, 61 nt, Homo Sapiens
gugaagaacugguuuugguuauuaaaaaaaaugaauaaauuuugaaaccauauggugugug

SEQ ID NO: 528217 - RNA, 61 nt, Homo Sapiens
aaugcauugaaaccauaugguucuuuugaauugaauaaaaaggaaaaguuaacuuguuaaa

SEQ ID NO: 528218 - RNA, 61 nt, Homo Sapiens
auugauuucaugaaaucauuugcuuugacacugaauaaaaucuuacacaauucaguuaaga

SEQ ID NO: 528219 - RNA, 61 nt, Homo Sapiens
cagaauuaacuccuucaauaaacugcauaaaugaauaaauuguaccuaaguggauauagau

SEQ ID NO: 528220 - RNA, 61 nt, Homo Sapiens
cuagcaaucuauaaagugcaccaggucaacuugaauaaaaacacuaugacagacagguuug

SEQ ID NO: 528221 - RNA, 61 nt, Homo Sapiens
aaucugauggcucacugauuuuugaaaagccugaauaaaauuggaaagacuggaaaguuag

SEQ ID NO: 528222 - RNA, 61 nt, Homo Sapiens
uucuguugauuuuuuaagccacaugcuaugaugaauaaacugauuuauuuucuaccauuac

SEQ ID NO: 528223 - RNA, 61 nt, Homo Sapiens
aaacuuuuuuaaagauguuagucuuguagcgugaauaaauuugccaucaccuuuugugugg

SEQ ID NO: 528224 - RNA, 61 nt, Homo Sapiens
auuauuucugcccuagaguuagauguaaagcugaauaaagcgugcuguaguauaugaugaa

SEQ ID NO: 528225 - RNA, 61 nt, Homo Sapiens
gaaagaaauuuuggguuuuuuauuuuuauuuugaauaaacauauuuucauaauucuaugug

SEQ ID NO: 528226 - RNA, 61 nt, Homo Sapiens
uuguaaaucauuauuuucauuuuuuuuagauugaauaaaauuggucuacacauucugauuu

SEQ ID NO: 528227 - RNA, 61 nt, Homo Sapiens
aaaaaccugccaccaaauuaucaaaaauaaaugaauaaaaucaacacagcaagacucuguc

SEQ ID NO: 528228 - RNA, 61 nt, Homo Sapiens
cucuaaaccuagguuauauacuuaguuuauuugaauaaaaggaaaaaaaaauaugcauuug

SEQ ID NO: 528229 - RNA, 61 nt, Homo Sapiens
uguuucgggcccuguaagugcucugaagcagugaauaaaggugugggcugaugcagggaag

SEQ ID NO: 528230 - RNA, 61 nt, Homo Sapiens
aggaaggccccagcccuaguccuaggcgacuugaauaaagugggaggucaaacaugggccu

SEQ ID NO: 528231 - RNA, 61 nt, Homo Sapiens
aagaacgaagcaggauguugucacucccgucugaauaaagcuccaugagcuggguuggaaa

SEQ ID NO: 528232 - RNA, 61 nt, Homo Sapiens
aaaccagcauuagagcuuuacuuguaguguuugaauaaauguguccagcauaugguagaua

SEQ ID NO: 528233 - RNA, 61 nt, Homo Sapiens
caagggcaauuuauucauuuagugauugccuugaauaaauucuggguguuccacagcugau

SEQ ID NO: 528234 - RNA, 61 nt, Homo Sapiens
uauguuuaugaauuuucuaaauuguauuuccugaauaaaugaaauaucaaggauucuagua

SEQ ID NO: 528235 - RNA, 61 nt, Homo Sapiens
uagguacauaguaaguguauuggaugauucgugaauaaaacgggaauuuuuaucuuagaaa

SEQ ID NO: 528236 - RNA, 61 nt, Homo Sapiens
uaggaaaauaagagaaagguaagggcucuuuugaauaaacugcuguuuuauuuguggcaca

SEQ ID NO: 528237 - RNA, 61 nt, Homo Sapiens
uuguuuauaccagucuuaaagauccagguucugaauaaaaaaauuaauugauacaauugau

SEQ ID NO: 528238 - RNA, 61 nt, Homo Sapiens
ugggauauaaaauggacucuuucagaaaaggugaauaaaauguagauuaauguugugacua

SEQ ID NO: 528239 - RNA, 61 nt, Homo Sapiens
aaucauauaagaauguauaguaauaguuaucugaauaaaucuugguaauaauguuggcaag

SEQ ID NO: 528240 - RNA, 61 nt, Homo Sapiens
uuuuggaucaccuccaaagauuuccuuugcuugaauaaacaauuuacacaagagauggcuu

SEQ ID NO: 528241 - RNA, 61 nt, Homo Sapiens
gcaugaacaauagaaaaaugaacacuaaaguugaauaaaaucauggauugccaauuuuuaa

SEQ ID NO: 528242 - RNA, 61 nt, Homo Sapiens
gaauucccuguuaguugauuuaaauccuuucugaauaaagaucagauaaacaguaacugaa

SEQ ID NO: 528243 - RNA, 61 nt, Homo Sapiens
auauaaaagguagacagcugauauguuuucaugaauaaauauugucagccagaaaagguug

SEQ ID NO: 528244 - RNA, 61 nt, Homo Sapiens
cuuuuuuuuuuuuuuuggucaagcuugaggcugaauaaagccuuugaugcacaaaauggga

SEQ ID NO: 528245 - RNA, 61 nt, Homo Sapiens
uuucagacacauuuuuggauuucugugaaguugaauaaacauaaaagcuaauacaguugua

SEQ ID NO: 528246 - RNA, 61 nt, Homo Sapiens
uauggugagagugaugaauuguuggaucauuugaauaaaaucuuuuacuaaccccaugaua

SEQ ID NO: 528247 - RNA, 61 nt, Homo Sapiens
uaugcagaggcagcccucaauaugcagugguugaauaaaugaaugaagaaaccacuaucaa

SEQ ID NO: 528248 - RNA, 61 nt, Homo Sapiens
acugaaaacacuugguguuuaaaaaaaaaugugaauaaacugcauauuaaaauaagcagag

SEQ ID NO: 528249 - RNA, 61 nt, Homo Sapiens
guggaaugugaccagucaaggugaucuaugcugaauaaacacacaucacuguagaauuuga

SEQ ID NO: 528250 - RNA, 61 nt, Homo Sapiens
acuggcaagacaauuccauguaaguuuucagugaauaaaccaauccagaauguucuaacaa

SEQ ID NO: 528251 - RNA, 61 nt, Homo Sapiens
uggugaggugaggccuucaaaaagcugcaacugaauaaauccuugauuuauuauacuuacc

SEQ ID NO: 528252 - RNA, 61 nt, Homo Sapiens
gacuuuccuacaauaacuucaaaagcaauaaugaauaaaagauaaugcgccucuugaggag

SEQ ID NO: 528253 - RNA, 61 nt, Homo Sapiens
auguauugguaaugaugucauuaaaaguauaugaauaaaaauaugaguaacaucauaaaaa

SEQ ID NO: 528254 - RNA, 61 nt, Homo Sapiens
uuguaucauuuguuuuccucaucuaaaaaguugaauaaaaucuguuugauucaguucuccu

SEQ ID NO: 528255 - RNA, 61 nt, Homo Sapiens
cagucuccuacauuagcauuuaaauacuuguugaauaaacuggaacauaguaagggcucag

SEQ ID NO: 528256 - RNA, 61 nt, Homo Sapiens
uggcaacacaauuuuuucucuaaugacuuucugaauaaagacagccccauuuugcugaaaa

SEQ ID NO: 528257 - RNA, 61 nt, Homo Sapiens
aaagugccagcccugaagcuggagccguuugugaauaaacuguucuucaucauugacacug

SEQ ID NO: 528258 - RNA, 61 nt, Homo Sapiens
ggagauggauuuaguuauucaauuuuguggaugaauaaauugaggcacagaaagauuaagu

SEQ ID NO: 528259 - RNA, 61 nt, Homo Sapiens
auucaccaauuuuaauccuugcuugaauacuugaauaaaccuugguuucuuuuacuuaccu

SEQ ID NO: 528260 - RNA, 61 nt, Homo Sapiens
uaccuuagaacuaggauaauuuuggacuuggugaauaaaugcaagaguguuuggcucccag

SEQ ID NO: 528261 - RNA, 61 nt, Homo Sapiens
guuuuuguuaaacccuuuguuuucagaaauaugaauaaauaucauuuuuaaaauuccuaau

SEQ ID NO: 528262 - RNA, 61 nt, Homo Sapiens
aacauccaacccaggucauuaacuacucuccugaauaaaacccuauggucuugucugaaua

SEQ ID NO: 528263 - RNA, 61 nt, Homo Sapiens
acucuccugaauaaaacaacauggucuugucugaauaaacuuuuuucuuuucuuucuuccu

SEQ ID NO: 528264 - RNA, 61 nt, Homo Sapiens
gcugcuuuugcccaacccguuuuguaagacaugaauaaauuaugauguuuguaagaccaug

SEQ ID NO: 528265 - RNA, 61 nt, Homo Sapiens
aauaaacuucaacuagaaaugaauuaguuagugaauaaagauguaccuuugugaaauuguu

SEQ ID NO: 528266 - RNA, 61 nt, Homo Sapiens
caacacuaaccagcccuaguuucugugaauuugaauaaaauugaacauauuguaaugaugc

SEQ ID NO: 528267 - RNA, 61 nt, Homo Sapiens
gugauaguaacauaguagagugugaaauagaugaauaaaaugggaaacaaaugcugucucu

SEQ ID NO: 528268 - RNA, 61 nt, Homo Sapiens
acuuagaggggagagaugaaagccaaacaaaugaauaaacauaaaugauaccaucagugcu

SEQ ID NO: 528269 - RNA, 61 nt, Homo Sapiens
aaggaaaaggagagaaaaaagaaauugguuaugaauaaaagugacaauaaaacaugagaua

SEQ ID NO: 528270 - RNA, 61 nt, Homo Sapiens
aaaggaaaucuugaggucauauacugaaauaugaauaaauuaaaauaaugaauucagaucu

SEQ ID NO: 528271 - RNA, 61 nt, Homo Sapiens
cuuuuucuuaaaagaaaaauauuuugggguuugaauaaaauggaccaccauuucucauugg

SEQ ID NO: 528272 - RNA, 61 nt, Homo Sapiens
aaccagcaugguuugacaccacaugggaacaugaauaaaucugucucaugauuugaaaagu

SEQ ID NO: 528273 - RNA, 61 nt, Homo Sapiens
ucaagugcauugaggggcaguuuuguuugccugaauaaacguaaaggacaaguaaacaauu

SEQ ID NO: 528274 - RNA, 61 nt, Homo Sapiens
uuuguauuuaugucuugagacaguaacuuuuugaauaaaaauaaaccuacaguauguugua

SEQ ID NO: 528275 - RNA, 61 nt, Homo Sapiens
ggagccaaaguugaucagaauguaugcuuccugaauaaaaaaaauguauaaaaagaauuag

SEQ ID NO: 528276 - RNA, 61 nt, Homo Sapiens
ugccaagagagauauugaacuguagagagggugaauaaaaucgggaagggcuuggucugga

SEQ ID NO: 528277 - RNA, 64 nt, Homo Sapiens
gacuaugggcgcacugccuaaaaaaaaaaaaaguaauuggcagugagacuccgucucaaaaaaa

SEQ ID NO: 528278 - RNA, 64 nt, Homo Sapiens
gauuggccaggcgcaguggccucuguucaaaaguaauuggcagucucuaauuacauaugauguu

SEQ ID NO: 528279 - RNA, 64 nt, Homo Sapiens
aaccgagggcuccaguaacaccuucuaaccugugaauuggcagaaaaggguagcgguaucaugu

SEQ ID NO: 528280 - RNA, 64 nt, Homo Sapiens
cugcacacacacccacuuuaguacaguuccugucaauuggcaacauggagagggugaccuggcu

SEQ ID NO: 528281 - RNA, 64 nt, Homo Sapiens
ugaauaaagcccugggaccacagugacacgggcaaauuggcauuugggucagauaacccugugg

SEQ ID NO: 528282 - RNA, 64 nt, Homo Sapiens
ucuuugccaucucucuuugaauggaaggagacauaauuggcagauuaauuaagauuucauuaug

SEQ ID NO: 528283 - RNA, 64 nt, Homo Sapiens
auguugauaauuuaaguggaagagcuggaaacuaaauuggcaacaaaagaaauaauuggcaaag

SEQ ID NO: 528284 - RNA, 64 nt, Homo Sapiens
gagagcuggaaacuaaauugcuagcaaaagaaauaauuggcaaacacauuuggauuaaaauauu

SEQ ID NO: 528285 - RNA, 64 nt, Homo Sapiens
agggccccucuuuucagcacgauuugcugcugcucccuuagagccaaagagugggaaggccugg

SEQ ID NO: 528286 - RNA, 64 nt, Homo Sapiens
ggggcagugagggcuugaggaauauggcccucaacccuuagagucaccauuucugugggccuag

SEQ ID NO: 528287 - RNA, 64 nt, Homo Sapiens
auugaauacuuacauucucuaauaagaaaaccaccccuuagauugaaguaaacugcaguccugg

SEQ ID NO: 528288 - RNA, 64 nt, Homo Sapiens
guggugauauagaauuagcuuuuucauccccuuacccuuagaauccacguauuccccuucccac

SEQ ID NO: 528289 - RNA, 64 nt, Homo Sapiens; identical to SEQ ID NO: 265947

SEQ ID NO: 528290 - RNA, 64 nt, Homo Sapiens; identical to SEQ ID NO: 265948

SEQ ID NO: 528291 - RNA, 64 nt, Homo Sapiens; identical to SEQ ID NO: 265949

SEQ ID NO: 528292 - RNA, 64 nt, Homo Sapiens; identical to SEQ ID NO: 265950

SEQ ID NO: 528293 - RNA, 64 nt, Homo Sapiens; identical to SEQ ID NO: 265951

SEQ ID NO: 528294 - RNA, 64 nt, Homo Sapiens; identical to SEQ ID NO: 265952

SEQ ID NO: 528295 - RNA, 64 nt, Homo Sapiens; identical to SEQ ID NO: 265953

SEQ ID NO: 528296 - RNA, 64 nt, Homo Sapiens; identical to SEQ ID NO: 265954

SEQ ID NO: 528297 - RNA, 64 nt, Homo Sapiens; identical to SEQ ID NO: 265955

SEQ ID NO: 528298 - RNA, 64 nt, Homo Sapiens; identical to SEQ ID NO: 265956

SEQ ID NO: 528299 - RNA, 64 nt, Homo Sapiens; identical to SEQ ID NO: 265957

SEQ ID NO: 528300 - RNA, 64 nt, Homo Sapiens; identical to SEQ ID NO: 265958

SEQ ID NO: 528301 - RNA, 64 nt, Homo Sapiens; identical to SEQ ID NO: 265959

SEQ ID NO: 528302 - RNA, 64 nt, Homo Sapiens; identical to SEQ ID NO: 265960

SEQ ID NO: 528303 - RNA, 64 nt, Homo Sapiens; identical to SEQ ID NO: 265961

SEQ ID NO: 528304 - RNA, 64 nt, Homo Sapiens; identical to SEQ ID NO: 265962

SEQ ID NO: 528305 - RNA, 64 nt, Homo Sapiens; identical to SEQ ID NO: 265963

SEQ ID NO: 528306 - RNA, 64 nt, Homo Sapiens; identical to SEQ ID NO: 265964

SEQ ID NO: 528307 - RNA, 64 nt, Homo Sapiens; identical to SEQ ID NO: 265965

SEQ ID NO: 528308 - RNA, 64 nt, Homo Sapiens; identical to SEQ ID NO: 265966

SEQ ID NO: 528309 - RNA, 64 nt, Homo Sapiens; identical to SEQ ID NO: 265967

SEQ ID NO: 528310 - RNA, 64 nt, Homo Sapiens; identical to SEQ ID NO: 265968

SEQ ID NO: 528311 - RNA, 64 nt, Homo Sapiens; identical to SEQ ID NO: 265969

SEQ ID NO: 528312 - RNA, 64 nt, Homo Sapiens; identical to SEQ ID NO: 265970

SEQ ID NO: 528313 - RNA, 64 nt, Homo Sapiens; identical to SEQ ID NO: 265971

SEQ ID NO: 528314 - RNA, 64 nt, Homo Sapiens; identical to SEQ ID NO: 265972

SEQ ID NO: 528315 - RNA, 64 nt, Homo Sapiens; identical to SEQ ID NO: 265973

SEQ ID NO: 528316 - RNA, 64 nt, Homo Sapiens; identical to SEQ ID NO: 265974

SEQ ID NO: 528317 - RNA, 64 nt, Homo Sapiens; identical to SEQ ID NO: 265975

SEQ ID NO: 528318 - RNA, 64 nt, Homo Sapiens; identical to SEQ ID NO: 265976

SEQ ID NO: 528319 - RNA, 64 nt, Homo Sapiens; identical to SEQ ID NO: 265977

SEQ ID NO: 528320 - RNA, 64 nt, Homo Sapiens; identical to SEQ ID NO: 265978

SEQ ID NO: 528321 - RNA, 64 nt, Homo Sapiens; identical to SEQ ID NO: 265979

SEQ ID NO: 528322 - RNA, 64 nt, Homo Sapiens; identical to SEQ ID NO: 265980

SEQ ID NO: 528323 - RNA, 64 nt, Homo Sapiens; identical to SEQ ID NO: 265981

SEQ ID NO: 528324 - RNA, 64 nt, Homo Sapiens; identical to SEQ ID NO: 265982

SEQ ID NO: 528325 - RNA, 64 nt, Homo Sapiens; identical to SEQ ID NO: 265983

SEQ ID NO: 528326 - RNA, 64 nt, Homo Sapiens; identical to SEQ ID NO: 265984

SEQ ID NO: 528327 - RNA, 64 nt, Homo Sapiens; identical to SEQ ID NO: 265985

SEQ ID NO: 528328 - RNA, 64 nt, Homo Sapiens; identical to SEQ ID NO: 265986

SEQ ID NO: 528329 - RNA, 64 nt, Homo Sapiens; identical to SEQ ID NO: 265987

SEQ ID NO: 528330 - RNA, 64 nt, Homo Sapiens; identical to SEQ ID NO: 265988

SEQ ID NO: 528331 - RNA, 64 nt, Homo Sapiens; identical to SEQ ID NO: 265989

SEQ ID NO: 528332 - RNA, 64 nt, Homo Sapiens; identical to SEQ ID NO: 265990

SEQ ID NO: 528333 - RNA, 64 nt, Homo Sapiens; identical to SEQ ID NO: 265991

SEQ ID NO: 528334 - RNA, 64 nt, Homo Sapiens; identical to SEQ ID NO: 265992

SEQ ID NO: 528335 - RNA, 64 nt, Homo Sapiens; identical to SEQ ID NO: 265993

SEQ ID NO: 528336 - RNA, 64 nt, Homo Sapiens; identical to SEQ ID NO: 265994

SEQ ID NO: 528337 - RNA, 64 nt, Homo Sapiens; identical to SEQ ID NO: 265995

SEQ ID NO: 528338 - RNA, 64 nt, Homo Sapiens; identical to SEQ ID NO: 265996

SEQ ID NO: 528339 - RNA, 64 nt, Homo Sapiens; identical to SEQ ID NO: 265997

SEQ ID NO: 528340 - RNA, 64 nt, Homo Sapiens; identical to SEQ ID NO: 265998

SEQ ID NO: 528341 - RNA, 64 nt, Homo Sapiens; identical to SEQ ID NO: 265999

SEQ ID NO: 528342 - RNA, 64 nt, Homo Sapiens; identical to SEQ ID NO: 266000

SEQ ID NO: 528343 - RNA, 64 nt, Homo Sapiens; identical to SEQ ID NO: 266001

SEQ ID NO: 528344 - RNA, 64 nt, Homo Sapiens; identical to SEQ ID NO: 266002

SEQ ID NO: 528345 - RNA, 64 nt, Homo Sapiens; identical to SEQ ID NO: 266003

SEQ ID NO: 528346 - RNA, 64 nt, Homo Sapiens; identical to SEQ ID NO: 266004

SEQ ID NO: 528347 - RNA, 64 nt, Homo Sapiens; identical to SEQ ID NO: 266005

SEQ ID NO: 528348 - RNA, 64 nt, Homo Sapiens; identical to SEQ ID NO: 266006

SEQ ID NO: 528349 - RNA, 64 nt, Homo Sapiens; identical to SEQ ID NO: 266007

SEQ ID NO: 528350 - RNA, 64 nt, Homo Sapiens; identical to SEQ ID NO: 266008

SEQ ID NO: 528351 - RNA, 64 nt, Homo Sapiens; identical to SEQ ID NO: 266009

SEQ ID NO: 528352 - RNA, 64 nt, Homo Sapiens; identical to SEQ ID NO: 266010

SEQ ID NO: 528353 - RNA, 64 nt, Homo Sapiens; identical to SEQ ID NO: 266011

SEQ ID NO: 528354 - RNA, 64 nt, Homo Sapiens; identical to SEQ ID NO: 266012

SEQ ID NO: 528355 - RNA, 64 nt, Homo Sapiens; identical to SEQ ID NO: 266013

SEQ ID NO: 528356 - RNA, 64 nt, Homo Sapiens; identical to SEQ ID NO: 266014

SEQ ID NO: 528357 - RNA, 64 nt, Homo Sapiens; identical to SEQ ID NO: 266015

SEQ ID NO: 528358 - RNA, 64 nt, Homo Sapiens; identical to SEQ ID NO: 266016

SEQ ID NO: 528359 - RNA, 64 nt, Homo Sapiens; identical to SEQ ID NO: 266017

SEQ ID NO: 528360 - RNA, 64 nt, Homo Sapiens; identical to SEQ ID NO: 266018

SEQ ID NO: 528361 - RNA, 64 nt, Homo Sapiens; identical to SEQ ID NO: 266019

SEQ ID NO: 528362 - RNA, 64 nt, Homo Sapiens; identical to SEQ ID NO: 266020

SEQ ID NO: 528363 - RNA, 64 nt, Homo Sapiens; identical to SEQ ID NO: 266021

SEQ ID NO: 528364 - RNA, 64 nt, Homo Sapiens; identical to SEQ ID NO: 266022

SEQ ID NO: 528365 - RNA, 64 nt, Homo Sapiens; identical to SEQ ID NO: 266023

SEQ ID NO: 528366 - RNA, 64 nt, Homo Sapiens; identical to SEQ ID NO: 266024

SEQ ID NO: 528367 - RNA, 64 nt, Homo Sapiens; identical to SEQ ID NO: 266025

SEQ ID NO: 528368 - RNA, 64 nt, Homo Sapiens; identical to SEQ ID NO: 266026

SEQ ID NO: 528369 - RNA, 64 nt, Homo Sapiens; identical to SEQ ID NO: 266027

SEQ ID NO: 528370 - RNA, 64 nt, Homo Sapiens; identical to SEQ ID NO: 266028

SEQ ID NO: 528371 - RNA, 64 nt, Homo Sapiens; identical to SEQ ID NO: 266029

SEQ ID NO: 528372 - RNA, 64 nt, Homo Sapiens; identical to SEQ ID NO: 266030

SEQ ID NO: 528373 - RNA, 64 nt, Homo Sapiens; identical to SEQ ID NO: 266031

SEQ ID NO: 528374 - RNA, 64 nt, Homo Sapiens; identical to SEQ ID NO: 266032

SEQ ID NO: 528375 - RNA, 64 nt, Homo Sapiens; identical to SEQ ID NO: 266033

SEQ ID NO: 528376 - RNA, 64 nt, Homo Sapiens; identical to SEQ ID NO: 266034

SEQ ID NO: 528377 - RNA, 64 nt, Homo Sapiens; identical to SEQ ID NO: 266035

SEQ ID NO: 528378 - RNA, 64 nt, Homo Sapiens; identical to SEQ ID NO: 266036

SEQ ID NO: 528379 - RNA, 64 nt, Homo Sapiens; identical to SEQ ID NO: 266037

SEQ ID NO: 528380 - RNA, 64 nt, Homo Sapiens; identical to SEQ ID NO: 266038

SEQ ID NO: 528381 - RNA, 64 nt, Homo Sapiens; identical to SEQ ID NO: 266039

SEQ ID NO: 528382 - RNA, 64 nt, Homo Sapiens; identical to SEQ ID NO: 266040

SEQ ID NO: 528383 - RNA, 64 nt, Homo Sapiens; identical to SEQ ID NO: 266041

SEQ ID NO: 528384 - RNA, 64 nt, Homo Sapiens; identical to SEQ ID NO: 266042

SEQ ID NO: 528385 - RNA, 64 nt, Homo Sapiens; identical to SEQ ID NO: 266043

SEQ ID NO: 528386 - RNA, 64 nt, Homo Sapiens; identical to SEQ ID NO: 266044

SEQ ID NO: 528387 - RNA, 64 nt, Homo Sapiens; identical to SEQ ID NO: 266045

SEQ ID NO: 528388 - RNA, 64 nt, Homo Sapiens; identical to SEQ ID NO: 266046

SEQ ID NO: 528389 - RNA, 64 nt, Homo Sapiens; identical to SEQ ID NO: 266047

SEQ ID NO: 528390 - RNA, 64 nt, Homo Sapiens; identical to SEQ ID NO: 266048

SEQ ID NO: 528391 - RNA, 64 nt, Homo Sapiens; identical to SEQ ID NO: 266049

SEQ ID NO: 528392 - RNA, 64 nt, Homo Sapiens; identical to SEQ ID NO: 266050

SEQ ID NO: 528393 - RNA, 64 nt, Homo Sapiens; identical to SEQ ID NO: 266051

SEQ ID NO: 528394 - RNA, 64 nt, Homo Sapiens; identical to SEQ ID NO: 266052

SEQ ID NO: 528395 - RNA, 64 nt, Homo Sapiens; identical to SEQ ID NO: 266053

SEQ ID NO: 528396 - RNA, 64 nt, Homo Sapiens; identical to SEQ ID NO: 266054

SEQ ID NO: 528397 - RNA, 64 nt, Homo Sapiens; identical to SEQ ID NO: 266055

SEQ ID NO: 528398 - RNA, 64 nt, Homo Sapiens; identical to SEQ ID NO: 266056

SEQ ID NO: 528399 - RNA, 64 nt, Homo Sapiens; identical to SEQ ID NO: 266057

SEQ ID NO: 528400 - RNA, 64 nt, Homo Sapiens; identical to SEQ ID NO: 266058

SEQ ID NO: 528401 - RNA, 64 nt, Homo Sapiens; identical to SEQ ID NO: 266059

SEQ ID NO: 528402 - RNA, 64 nt, Homo Sapiens; identical to SEQ ID NO: 266060

SEQ ID NO: 528403 - RNA, 64 nt, Homo Sapiens; identical to SEQ ID NO: 266061

SEQ ID NO: 528404 - RNA, 64 nt, Homo Sapiens; identical to SEQ ID NO: 266062

SEQ ID NO: 528405 - RNA, 64 nt, Homo Sapiens; identical to SEQ ID NO: 266063

SEQ ID NO: 528406 - RNA, 64 nt, Homo Sapiens; identical to SEQ ID NO: 266064

SEQ ID NO: 528407 - RNA, 64 nt, Homo Sapiens; identical to SEQ ID NO: 266065

SEQ ID NO: 528408 - RNA, 64 nt, Homo Sapiens; identical to SEQ ID NO: 266066

SEQ ID NO: 528409 - RNA, 64 nt, Homo Sapiens; identical to SEQ ID NO: 266067

SEQ ID NO: 528410 - RNA, 64 nt, Homo Sapiens; identical to SEQ ID NO: 266068

SEQ ID NO: 528411 - RNA, 64 nt, Homo Sapiens; identical to SEQ ID NO: 266069

SEQ ID NO: 528412 - RNA, 64 nt, Homo Sapiens; identical to SEQ ID NO: 266070

SEQ ID NO: 528413 - RNA, 64 nt, Homo Sapiens; identical to SEQ ID NO: 266071

SEQ ID NO: 528414 - RNA, 64 nt, Homo Sapiens; identical to SEQ ID NO: 266072

SEQ ID NO: 528415 - RNA, 64 nt, Homo Sapiens; identical to SEQ ID NO: 266073

SEQ ID NO: 528416 - RNA, 64 nt, Homo Sapiens; identical to SEQ ID NO: 266074

SEQ ID NO: 528417 - RNA, 64 nt, Homo Sapiens; identical to SEQ ID NO: 266075

SEQ ID NO: 528418 - RNA, 64 nt, Homo Sapiens; identical to SEQ ID NO: 266076

SEQ ID NO: 528419 - RNA, 64 nt, Homo Sapiens; identical to SEQ ID NO: 266077

SEQ ID NO: 528420 - RNA, 64 nt, Homo Sapiens; identical to SEQ ID NO: 266078

SEQ ID NO: 528421 - RNA, 64 nt, Homo Sapiens; identical to SEQ ID NO: 266079

SEQ ID NO: 528422 - RNA, 64 nt, Homo Sapiens; identical to SEQ ID NO: 266080

SEQ ID NO: 528423 - RNA, 64 nt, Homo Sapiens; identical to SEQ ID NO: 266081

SEQ ID NO: 528424 - RNA, 64 nt, Homo Sapiens; identical to SEQ ID NO: 266082

SEQ ID NO: 528425 - RNA, 64 nt, Homo Sapiens; identical to SEQ ID NO: 266083

SEQ ID NO: 528426 - RNA, 64 nt, Homo Sapiens; identical to SEQ ID NO: 266084

SEQ ID NO: 528427 - RNA, 64 nt, Homo Sapiens; identical to SEQ ID NO: 266085

SEQ ID NO: 528428 - RNA, 64 nt, Homo Sapiens; identical to SEQ ID NO: 266086

SEQ ID NO: 528429 - RNA, 64 nt, Homo Sapiens; identical to SEQ ID NO: 266087

SEQ ID NO: 528430 - RNA, 64 nt, Homo Sapiens; identical to SEQ ID NO: 266088

SEQ ID NO: 528431 - RNA, 64 nt, Homo Sapiens; identical to SEQ ID NO: 266089

SEQ ID NO: 528432 - RNA, 64 nt, Homo Sapiens; identical to SEQ ID NO: 266090

SEQ ID NO: 528433 - RNA, 64 nt, Homo Sapiens; identical to SEQ ID NO: 266091

SEQ ID NO: 528434 - RNA, 64 nt, Homo Sapiens; identical to SEQ ID NO: 266092

SEQ ID NO: 528435 - RNA, 64 nt, Homo Sapiens; identical to SEQ ID NO: 266093

SEQ ID NO: 528436 - RNA, 64 nt, Homo Sapiens; identical to SEQ ID NO: 266094

SEQ ID NO: 528437 - RNA, 64 nt, Homo Sapiens; identical to SEQ ID NO: 266095

SEQ ID NO: 528438 - RNA, 64 nt, Homo Sapiens; identical to SEQ ID NO: 266096

SEQ ID NO: 528439 - RNA, 64 nt, Homo Sapiens; identical to SEQ ID NO: 266097

SEQ ID NO: 528440 - RNA, 64 nt, Homo Sapiens; identical to SEQ ID NO: 266098

SEQ ID NO: 528441 - RNA, 64 nt, Homo Sapiens; identical to SEQ ID NO: 266099

SEQ ID NO: 528442 - RNA, 64 nt, Homo Sapiens; identical to SEQ ID NO: 266100

SEQ ID NO: 528443 - RNA, 64 nt, Homo Sapiens; identical to SEQ ID NO: 266101

SEQ ID NO: 528444 - RNA, 64 nt, Homo Sapiens; identical to SEQ ID NO: 266102

SEQ ID NO: 528445 - RNA, 64 nt, Homo Sapiens; identical to SEQ ID NO: 266103

SEQ ID NO: 528446 - RNA, 64 nt, Homo Sapiens; identical to SEQ ID NO: 266104

SEQ ID NO: 528447 - RNA, 64 nt, Homo Sapiens; identical to SEQ ID NO: 266105

SEQ ID NO: 528448 - RNA, 64 nt, Homo Sapiens; identical to SEQ ID NO: 266106

SEQ ID NO: 528449 - RNA, 64 nt, Homo Sapiens; identical to SEQ ID NO: 266107

SEQ ID NO: 528450 - RNA, 64 nt, Homo Sapiens; identical to SEQ ID NO: 266108

SEQ ID NO: 528451 - RNA, 64 nt, Homo Sapiens; identical to SEQ ID NO: 266109

SEQ ID NO: 528452 - RNA, 64 nt, Homo Sapiens; identical to SEQ ID NO: 266110

SEQ ID NO: 528453 - RNA, 64 nt, Homo Sapiens; identical to SEQ ID NO: 266111

SEQ ID NO: 528454 - RNA, 64 nt, Homo Sapiens; identical to SEQ ID NO: 266112

SEQ ID NO: 528455 - RNA, 64 nt, Homo Sapiens; identical to SEQ ID NO: 266113

SEQ ID NO: 528456 - RNA, 64 nt, Homo Sapiens; identical to SEQ ID NO: 266114

SEQ ID NO: 528457 - RNA, 64 nt, Homo Sapiens; identical to SEQ ID NO: 266115

SEQ ID NO: 528458 - RNA, 64 nt, Homo Sapiens; identical to SEQ ID NO: 206029

SEQ ID NO: 528459 - RNA, 64 nt, Homo Sapiens; identical to SEQ ID NO: 206030

SEQ ID NO: 528460 - RNA, 64 nt, Homo Sapiens; identical to SEQ ID NO: 206031

SEQ ID NO: 528461 - RNA, 64 nt, Homo Sapiens; identical to SEQ ID NO: 206032

SEQ ID NO: 528462 - RNA, 64 nt, Homo Sapiens; identical to SEQ ID NO: 206033

SEQ ID NO: 528463 - RNA, 64 nt, Homo Sapiens; identical to SEQ ID NO: 206034

SEQ ID NO: 528464 - RNA, 64 nt, Homo Sapiens; identical to SEQ ID NO: 206035

SEQ ID NO: 528465 - RNA, 64 nt, Homo Sapiens; identical to SEQ ID NO: 206036

SEQ ID NO: 528466 - RNA, 64 nt, Homo Sapiens; identical to SEQ ID NO: 206037

SEQ ID NO: 528467 - RNA, 64 nt, Homo Sapiens; identical to SEQ ID NO: 206038

SEQ ID NO: 528468 - RNA, 64 nt, Homo Sapiens; identical to SEQ ID NO: 206039

SEQ ID NO: 528469 - RNA, 64 nt, Homo Sapiens; identical to SEQ ID NO: 206040

SEQ ID NO: 528470 - RNA, 64 nt, Homo Sapiens; identical to SEQ ID NO: 206041

SEQ ID NO: 528471 - RNA, 64 nt, Homo Sapiens; identical to SEQ ID NO: 206042

SEQ ID NO: 528472 - RNA, 64 nt, Homo Sapiens; identical to SEQ ID NO: 206043

SEQ ID NO: 528473 - RNA, 64 nt, Homo Sapiens; identical to SEQ ID NO: 206044

SEQ ID NO: 528474 - RNA, 64 nt, Homo Sapiens; identical to SEQ ID NO: 206045

SEQ ID NO: 528475 - RNA, 64 nt, Homo Sapiens; identical to SEQ ID NO: 206046

SEQ ID NO: 528476 - RNA, 64 nt, Homo Sapiens; identical to SEQ ID NO: 206047

SEQ ID NO: 528477 - RNA, 64 nt, Homo Sapiens; identical to SEQ ID NO: 206048

SEQ ID NO: 528478 - RNA, 64 nt, Homo Sapiens; identical to SEQ ID NO: 206049

SEQ ID NO: 528479 - RNA, 64 nt, Homo Sapiens; identical to SEQ ID NO: 206050

SEQ ID NO: 528480 - RNA, 64 nt, Homo Sapiens; identical to SEQ ID NO: 206051

SEQ ID NO: 528481 - RNA, 64 nt, Homo Sapiens; identical to SEQ ID NO: 206052

SEQ ID NO: 528482 - RNA, 64 nt, Homo Sapiens; identical to SEQ ID NO: 206053

SEQ ID NO: 528483 - RNA, 64 nt, Homo Sapiens; identical to SEQ ID NO: 206054

SEQ ID NO: 528484 - RNA, 64 nt, Homo Sapiens; identical to SEQ ID NO: 206055

SEQ ID NO: 528485 - RNA, 64 nt, Homo Sapiens; identical to SEQ ID NO: 206056

SEQ ID NO: 528486 - RNA, 64 nt, Homo Sapiens; identical to SEQ ID NO: 206057

SEQ ID NO: 528487 - RNA, 64 nt, Homo Sapiens; identical to SEQ ID NO: 206058

SEQ ID NO: 528488 - RNA, 64 nt, Homo Sapiens; identical to SEQ ID NO: 206059

SEQ ID NO: 528489 - RNA, 64 nt, Homo Sapiens; identical to SEQ ID NO: 206060

SEQ ID NO: 528490 - RNA, 64 nt, Homo Sapiens; identical to SEQ ID NO: 206061

SEQ ID NO: 528491 - RNA, 64 nt, Homo Sapiens; identical to SEQ ID NO: 206062

SEQ ID NO: 528492 - RNA, 64 nt, Homo Sapiens; identical to SEQ ID NO: 206063

SEQ ID NO: 528493 - RNA, 64 nt, Homo Sapiens; identical to SEQ ID NO: 206064

SEQ ID NO: 528494 - RNA, 64 nt, Homo Sapiens; identical to SEQ ID NO: 206065

SEQ ID NO: 528495 - RNA, 64 nt, Homo Sapiens; identical to SEQ ID NO: 206066

SEQ ID NO: 528496 - RNA, 64 nt, Homo Sapiens; identical to SEQ ID NO: 206067

SEQ ID NO: 528497 - RNA, 64 nt, Homo Sapiens; identical to SEQ ID NO: 206068

SEQ ID NO: 528498 - RNA, 64 nt, Homo Sapiens; identical to SEQ ID NO: 206069

SEQ ID NO: 528499 - RNA, 64 nt, Homo Sapiens; identical to SEQ ID NO: 206070

SEQ ID NO: 528500 - RNA, 64 nt, Homo Sapiens; identical to SEQ ID NO: 206071

SEQ ID NO: 528501 - RNA, 64 nt, Homo Sapiens; identical to SEQ ID NO: 206072

SEQ ID NO: 528502 - RNA, 64 nt, Homo Sapiens; identical to SEQ ID NO: 206073

SEQ ID NO: 528503 - RNA, 64 nt, Homo Sapiens; identical to SEQ ID NO: 206074

SEQ ID NO: 528504 - RNA, 64 nt, Homo Sapiens; identical to SEQ ID NO: 206075

SEQ ID NO: 528505 - RNA, 64 nt, Homo Sapiens; identical to SEQ ID NO: 206076

SEQ ID NO: 528506 - RNA, 64 nt, Homo Sapiens; identical to SEQ ID NO: 206077

SEQ ID NO: 528507 - RNA, 64 nt, Homo Sapiens; identical to SEQ ID NO: 206078

SEQ ID NO: 528508 - RNA, 64 nt, Homo Sapiens
agcucaaaagugacaaguccggucucagaaagggggagcucaaucaugucuuaacaaaaugaca

SEQ ID NO: 528509 - RNA, 64 nt, Homo Sapiens
cucaaucaugucuuaacaaaaauauaucuuaucuggagcucagcaguauguguguaccguaaag

SEQ ID NO: 528510 - RNA, 64 nt, Homo Sapiens
uucuucugauauguagacuuuuuuacaggaacguggagcucauggaagaaaaauguguuuaaag

SEQ ID NO: 528511 - RNA, 64 nt, Homo Sapiens
uguguuugacccacauccucaauuugagcugaguggagcucagcuguagucaaaagacucaucu

SEQ ID NO: 528512 - RNA, 64 nt, Homo Sapiens
cccagagacugggcugcucucaugacugaggaaaggagcucacgcuauaugauacaacuguggc

SEQ ID NO: 528513 - RNA, 64 nt, Homo Sapiens
gccuucuguggugucauuuccaacgcaugcuccuggagcucacaccccggucauccggacaucc

SEQ ID NO: 528514 - RNA, 64 nt, Homo Sapiens
uaugccuuauuuugcacaaacgcaagguuaauguggagcucaaacagagcaaguagacgccugc

SEQ ID NO: 528515 - RNA, 64 nt, Homo Sapiens
ucucggagaagaucgaccagcuagagaagagccuggagcucaaguuuggugagggugggcaccg

SEQ ID NO: 528516 - RNA, 64 nt, Homo Sapiens
gggacaucgugggcacugagcugaaguugaagaaggagcucacaggccucaaccacugggugcg

SEQ ID NO: 528517 - RNA, 64 nt, Homo Sapiens
agcuaugagagucgggacucuccugcaccugacuggagcucagaugugggcaggaauucccaaa

SEQ ID NO: 528518 - RNA, 64 nt, Homo Sapiens
cuaaggcugagcaccuccagucucuccuugauuuggagcucaguguuuaagggcuuggaaaagg

SEQ ID NO: 528519 - RNA, 60 nt, Homo Sapiens
cccguagggucguugauuccugaacguaucacaucucaccugcccccuuccucgugggac

SEQ ID NO: 528520 - RNA, 60 nt, Homo Sapiens
uugcgccacuauuaaggcaccugucaccuuacaucucaaucuggaaucaaagugcccugg

SEQ ID NO: 528521 - RNA, 60 nt, Homo Sapiens
acaccacaccgcacugcaccauaccucaccacaucucaccacaccacagcacaccucacc

SEQ ID NO: 528522 - RNA, 60 nt, Homo Sapiens
gcaccgcaccgcaccgcaccguaccucgccacaucucaccacaccacaccacaccacacc

SEQ ID NO: 528523 - RNA, 60 nt, Homo Sapiens
cacccagcucgccaugccuauaaagagagaacaucucacaacaucucaaagcagacaaug

SEQ ID NO: 528524 - RNA, 60 nt, Homo Sapiens
gcagacaauguaaagagagacccucaucccacaucucaaacaggaccaacucucucccuc

SEQ ID NO: 528525 - RNA, 64 nt, Homo Sapiens; identical to SEQ ID NO: 233051

SEQ ID NO: 528526 - RNA, 64 nt, Homo Sapiens; identical to SEQ ID NO: 233052

SEQ ID NO: 528527 - RNA, 64 nt, Homo Sapiens; identical to SEQ ID NO: 233053

SEQ ID NO: 528528 - RNA, 64 nt, Homo Sapiens; identical to SEQ ID NO: 233054

SEQ ID NO: 528529 - RNA, 64 nt, Homo Sapiens; identical to SEQ ID NO: 233055

SEQ ID NO: 528530 - RNA, 64 nt, Homo Sapiens; identical to SEQ ID NO: 233055

SEQ ID NO: 528531 - RNA, 64 nt, Homo Sapiens; identical to SEQ ID NO: 233057

SEQ ID NO: 528532 - RNA, 60 nt, Homo Sapiens
cccaggaucaagucacucaucucagaauguccccaccaauccccgccacagcaggcgccu

SEQ ID NO: 528533 - RNA, 60 nt, Homo Sapiens
cugcccugcuugcaaauccacuagcaccgaccccaccaccugguuccggcucugcacgcu

SEQ ID NO: 528534 - RNA, 60 nt, Homo Sapiens
gccccuggaagcagauucccauugaguuuuccccaccaaggggaccaugcacaugguaga

SEQ ID NO: 528535 - RNA, 60 nt, Homo Sapiens
ccuguggugggaagacgggcaacaaguauaccccaccagggccugagugacuagaggaag

SEQ ID NO: 528536 - RNA, 60 nt, Homo Sapiens
ugcuaaucugagcuacuuagaguguggucuccccaccaacuccaguuuugugcccuaagc

SEQ ID NO: 528537 - RNA, 60 nt, Homo Sapiens
ggugaaaaagagaaaugugagcauccgcucccccaccaccccgcccagccccuagcccca

SEQ ID NO: 528538 - RNA, 60 nt, Homo Sapiens
ucaguggaacacaccauucuggacacccccccccaccaccuucagggacagugggcaaga

SEQ ID NO: 528539 - RNA, 60 nt, Homo Sapiens
uucacuggcuggggggcucuuuucuguaccccccaccauuggggaugcucucauccccuc

SEQ ID NO: 528540 - RNA, 60 nt, Homo Sapiens
uaggagagagccuggaucucuggccccaacccccaccagaccucaugcccuggacacugc

SEQ ID NO: 528541 - RNA, 60 nt, Homo Sapiens
gaugggagguggugaggcguccucaccuccccccaccacagcuguggcugguaaggcaac

SEQ ID NO: 528542 - RNA, 60 nt, Homo Sapiens
cacucagugccauggggaagcgggcgucucccccaccagccccaccaggcgguguagggg

SEQ ID NO: 528543 - RNA, 60 nt, Homo Sapiens
ccauggggaagcgggcgucucccccaccagccccaccaggcgguguaggggcagcaggcu

SEQ ID NO: 528544 - RNA, 60 nt, Homo Sapiens
accucuguggccuccauggucaccccaucuccccaccaccugaucaugccccuucucucc

SEQ ID NO: 528545 - RNA, 60 nt, Homo Sapiens
uguauuuucuaggauuugaguccuuagcuuccccaccauagggaaaagccaauagaaauu

SEQ ID NO: 528546 - RNA, 60 nt, Homo Sapiens
aaugaggccugaccuuuuuugcuauaaccgccccaccacuccccugcccuugccaacauc

SEQ ID NO: 528547 - RNA, 60 nt, Homo Sapiens
gcaagcacacaucacuuuagaggggcugcgccccaccagauaggaaggggaggauuuucu

SEQ ID NO: 528548 - RNA, 60 nt, Homo Sapiens
guggucuaaggaugucuugagcccugugugccccaccauucaugaccucuguauucucua

SEQ ID NO: 528549 - RNA, 60 nt, Homo Sapiens
gggggcagaucccagagccccucucaccccccccaccacaggccugcuccuuccuuagcc

SEQ ID NO: 528550 - RNA, 60 nt, Homo Sapiens
ugcagauuucuugcugcuucaggcuucucuccccaccacccccguuggguagcuggggcc

SEQ ID NO: 528551 - RNA, 60 nt, Homo Sapiens
gcgggugucacucacgcacuucccuagugcccccaccaugacagggagcagccaggagac

SEQ ID NO: 528552 - RNA, 60 nt, Homo Sapiens
gacccagcggcuucuucacuuuuguagcucccccaccaaaagcagccaacaacacccaug

SEQ ID NO: 528553 - RNA, 60 nt, Homo Sapiens
uuccgccaggugugccuggcggggccuccaccccaccaucaugcagccacuucacccugg

SEQ ID NO: 528554 - RNA, 60 nt, Homo Sapiens
ccaaccaccagcagcagcagggcccuccucccccaccagcucuccccacagggccccuca

SEQ ID NO: 528555 - RNA, 60 nt, Homo Sapiens
ccccuuccuugcccgccucuccccccgccgccccaccaguuaaacggaugaccaaagacc

SEQ ID NO: 528556 - RNA, 60 nt, Homo Sapiens
gcuggggagcucagcuuggucucagagucuccccaccagauacuguuuaaaaaaguagca

SEQ ID NO: 528557 - RNA, 60 nt, Homo Sapiens
ugccaggcccggccacugaggcugcugcugccccaccaccuccuggaucuggagagagca

SEQ ID NO: 528558 - RNA, 60 nt, Homo Sapiens
uccuggaagaggagggggccacugugccagccccaccacaggccccuucccccaggaguc

SEQ ID NO: 528559 - RNA, 60 nt, Homo Sapiens
ucccccucccauagggcugccccuguggucccccaccagcccugccuuucuuuggucagu

SEQ ID NO: 528560 - RNA, 60 nt, Homo Sapiens
gugucacaugggcugccagggcucccauccccccaccauugcaguguuggccacguaggg

SEQ ID NO: 528561 - RNA, 60 nt, Homo Sapiens
uggccucuuagacuagucaugauuuguuuuccccaccaaguuaagaccagaauaucagug

SEQ ID NO: 528562 - RNA, 60 nt, Homo Sapiens
cacccccacacacgucaucucucucucuccccccaccacccucucucucugucucuccuu

SEQ ID NO: 528563 - RNA, 60 nt, Homo Sapiens
ccuacacaucuugccagcccggcuaugcacccccaccauuuggccucgggagcggccccu

SEQ ID NO: 528564 - RNA, 60 nt, Homo Sapiens
uuugugaguauuucagaggguccaguauggccccaccaugcacaggcaugcccagugccu

SEQ ID NO: 528565 - RNA, 60 nt, Homo Sapiens
augaccccccaucuuuccuccgccccugacccccaccacccugcugcucggacuaugcuc

SEQ ID NO: 528566 - RNA, 60 nt, Homo Sapiens
agagcaucagggcugcucucugaggagcugccccaccagccauccuugaagagacaauuc

SEQ ID NO: 528567 - RNA, 60 nt, Homo Sapiens
ugcacugccccccacauucuuccugcccuuccccaccaccugcucccgagagccugccuu

SEQ ID NO: 528568 - RNA, 60 nt, Homo Sapiens
ccccaucccagaggccuugccccuacccuaccccaccacaccuucaaaacccacccccac

SEQ ID NO: 528569 - RNA, 60 nt, Homo Sapiens
uuucuaggacagaggggccucccagucuccccccaccacccgugcacgacuuccucacca

SEQ ID NO: 528570 - RNA, 60 nt, Homo Sapiens
ugccuggacuuggagagaugggaggcagacccccaccaccauacaugcugucuguggccc

SEQ ID NO: 528571 - RNA, 60 nt, Homo Sapiens
accacgugcagguggagcucuuccccagcgccccaccaccauuagcgaccaggcuugggc

SEQ ID NO: 528572 - RNA, 60 nt, Homo Sapiens
cgccugccccgcggaagaccuuuccuguccccccaccacccucucuuggauccgccucgg

SEQ ID NO: 528573 - RNA, 60 nt, Homo Sapiens
uccucucccugggaucuggaaaucgcacacccccaccauuaccgaaauuuucugaaauua

SEQ ID NO: 528574 - RNA, 60 nt, Homo Sapiens
ccauugcagggggcagggaaguucacccccccccaccacccccccgcccccccgaagcca

SEQ ID NO: 528575 - RNA, 60 nt, Homo Sapiens
aggccugggggggaugguauauggcccuuuccccaccaggcgcuaaggggaacacccccu

SEQ ID NO: 528576 - RNA, 60 nt, Homo Sapiens
uggaauuuucuggcacuuccucucuauugcccccaccaccaccacccccaucacugcuuu

SEQ ID NO: 528577 - RNA, 60 nt, Homo Sapiens
ggaaugggccggcgauugggaccagcugggccccaccacggccacgccaggcaaagcgcc

SEQ ID NO: 528578 - RNA, 60 nt, Homo Sapiens
cccccacccacccugcaccccucgcccuccccccaccacagaaucuaagaccuuucagcu

SEQ ID NO: 528579 - RNA, 60 nt, Homo Sapiens
uaggccacuccuccaaaggacagcccugggccccaccaccuccuggaaauaucaguuacu

SEQ ID NO: 528580 - RNA, 60 nt, Homo Sapiens
auguggcccuggccugcuggucagacccuaccccaccacgcaccucugccucaaugugaa

SEQ ID NO: 528581 - RNA, 60 nt, Homo Sapiens
cuucugaucuuagggguuggccuuccagugccccaccaccaugggccaaucccauuccug

SEQ ID NO: 528582 - RNA, 60 nt, Homo Sapiens
uucagaucuguuccucuggaacugauccuuccccaccaucuuaucagcuuagaguguuca

SEQ ID NO: 528583 - RNA, 60 nt, Homo Sapiens
ccucuuugcauugcccauuuccauucccgcccccaccaugguuugugcuucuagccaugc

SEQ ID NO: 528584 - RNA, 58 nt, Homo Sapiens; identical to SEQ ID NO: 119962

SEQ ID NO: 528585 - RNA, 60 nt, Homo Sapiens
ugacacuggcguucuccucuccccuccuucccccaccacaggucucuccugcauaggcag

SEQ ID NO: 528586 - RNA, 60 nt, Homo Sapiens
cuguugcaugagccugcgacaggaccucacccccaccaccaggcuucuauuugggauuca

SEQ ID NO: 528587 - RNA, 60 nt, Homo Sapiens
uaaugaucaugucagccuucagaagagaauccccaccaacuucugugccuccucagaugg

SEQ ID NO: 528588 - RNA, 60 nt, Homo Sapiens
cccugccaucuugccuuaggaacagccuucccccaccagcagccauggcuggcuggggcu

SEQ ID NO: 528589 - RNA, 60 nt, Homo Sapiens
uggcccugagcucuauccaccaagccagcaccccaccaucccuuugcaggggagucaaag

SEQ ID NO: 528590 - RNA, 60 nt, Homo Sapiens
cuucuccuuccccuuucugagaaacgucauccccaccaguuaacguuuccuguacacccu

SEQ ID NO: 528591 - RNA, 60 nt, Homo Sapiens
ugucuucacugggagcguggggcccccaggccccaccagcaccguccuccccuaaugagg

SEQ ID NO: 528592 - RNA, 60 nt, Homo Sapiens
aggaaagcacaggcuaagcaguugaagguuccccaccauucagugagagcagaaccccca

SEQ ID NO: 528593 - RNA, 55 nt, Homo Sapiens; identical to SEQ ID NO: 119971

SEQ ID NO: 528594 - RNA, 60 nt, Homo Sapiens
ggggguguggggcugcccuggggcccgugcccccaccaggccagccccugcuggguucag

SEQ ID NO: 528595 - RNA, 60 nt, Homo Sapiens
cucccuaccuccuuaacuuugcccccuccuccccaccauccgcguccugcaggguagucc

SEQ ID NO: 528596 - RNA, 60 nt, Homo Sapiens
cagagccuuccgaagccaacuacauuccggccccaccacuccccauugcuaacaacaugg

SEQ ID NO: 528597 - RNA, 60 nt, Homo Sapiens
ccuuucacuccauccccugcggagcaauacccccaccaccacccuucccccaccacaucg

SEQ ID NO: 528598 - RNA, 60 nt, Homo Sapiens
ucgggagcaauacccccacccagacccuucccccaccacaccccccacccuucucucucc

SEQ ID NO: 528599 - RNA, 60 nt, Homo Sapiens
cccgucagggagaggucaccagcugcugugccccaccacgucuggcucccugccccuuaa

SEQ ID NO: 528600 - RNA, 60 nt, Homo Sapiens
gggaaggauaaagccacuucuggcuucagcccccaccaggggaaggaaggagggcacauu

SEQ ID NO: 528601 - RNA, 60 nt, Homo Sapiens
cucaacaaccauguuacuccacuuccccacccccaccaggccucccuccuccccuccuac

SEQ ID NO: 528602 - RNA, 60 nt, Homo Sapiens
uccccuccuacucccuuuucucacucucauccccaccacagaucccuggauugcugggaa

SEQ ID NO: 528603 - RNA, 60 nt, Homo Sapiens
aacguggauuguuuaaagaagcucuccaggccccaccaagaggguggaucacaccucagu

SEQ ID NO: 528604 - RNA, 60 nt, Homo Sapiens
aacugaaauuuccccacucuguuggggcuuccccaccacauucaugucccucucccgugu

SEQ ID NO: 528605 - RNA, 60 nt, Homo Sapiens
uuucccuucaaaauagcaccuuugggguauccccaccaacauucuacucuucuggugggc

SEQ ID NO: 528606 - RNA, 60 nt, Homo Sapiens
ucugaaugucuaaccugcucuacucacagcccccaccagcauauacuuaaccugaaucuc

SEQ ID NO: 528607 - RNA, 60 nt, Homo Sapiens
accagcucccuggccucccuucccugaaccccccaccacuccuuucaccagaugccaccc

SEQ ID NO: 528608 - RNA, 60 nt, Homo Sapiens
uggagaauuacaaggguuuuuauuuaaaaaccccaccauucagggaguugaaguccaacc

SEQ ID NO: 528609 - RNA, 60 nt, Homo Sapiens
ucugugcccugcacugucccaggccacucuccccaccacguaaaggaacuaugcaaaugc

SEQ ID NO: 528610 - RNA, 55 nt, Homo Sapiens; identical to SEQ ID NO: 119988

SEQ ID NO: 528611 - RNA, 60 nt, Homo Sapiens
aggucgccccagggccucugcccacccgagccccaccacucucagaacccccgcccagcg

SEQ ID NO: 528612 - RNA, 60 nt, Homo Sapiens
ggguggauggagcucagaaggaaaccccagccccaccacggaugacaccaucccucccgu

SEQ ID NO: 528613 - RNA, 60 nt, Homo Sapiens
ugagaccccgguugcccauucauggcugcaccccaccaugucaaacccaagaccagcccc

SEQ ID NO: 528614 - RNA, 60 nt, Homo Sapiens
gggccugagcugagcacugcccccucacccccccaccaccccuucccauuucaucggugg

SEQ ID NO: 528615 - RNA, 60 nt, Homo Sapiens
gcaccccauccucagugcccaaugcuguggccccaccaggcccagagccugguuggccau

SEQ ID NO: 528616 - RNA, 60 nt, Homo Sapiens
acugaccacccucaacccauugcgcccaguccccaccacagugaccacacccucacuggc

SEQ ID NO: 528617 - RNA, 60 nt, Homo Sapiens
uagcuaaaggguggggagagggaagaugggccccaccacgcucucaagagaacgcaccug

SEQ ID NO: 528618 - RNA, 60 nt, Homo Sapiens
uccccuuuucuguucauuucaucuggcuccccccaccaccuccccaccccaccccccacc

SEQ ID NO: 528619 - RNA, 60 nt, Homo Sapiens
ucccggaccccagggagguggcuguccagaccccaccauccagggccuuggguucccuga

SEQ ID NO: 528620 - RNA, 60 nt, Homo Sapiens
cauagcaggaauggcaggaagugugggcguccccaccacggggagccggcaggguuuggg

SEQ ID NO: 528621 - RNA, 58 nt, Homo Sapiens
gcauggcgcccugucucuguauccugcauuccccaccauuccugcaauaaaaaagugg

SEQ ID NO: 528622 - RNA, 60 nt, Homo Sapiens
ugugccccagagagcagggccccacuuccuccccaccaccccggacagaggucugcccca

SEQ ID NO: 528623 - RNA, 60 nt, Homo Sapiens
acagccccagaaggagcagcaucucccucuccccaccaagcagcagggacccacugcccc

SEQ ID NO: 528624 - RNA, 60 nt, Homo Sapiens
gcuuugcagauguccuugaaccaggccccuccccaccaggaguuccaaagagccucuggc

SEQ ID NO: 528625 - RNA, 60 nt, Homo Sapiens
ccauacagcguguguguggaagaaggguguccccaccagcaggucuggagaaaccccugg

SEQ ID NO: 528626 - RNA, 60 nt, Homo Sapiens
gcugcaccccgcagcagcaugugagggucuccccaccaguaggccccuguguguggggug

SEQ ID NO: 528627 - RNA, 60 nt, Homo Sapiens
cagcuaggucggggccccaguuaagcugugccccaccacccuaggcaaugaggggcagga

SEQ ID NO: 528628 - RNA, 60 nt, Homo Sapiens
accucaaagucauuugacugcccccauccaccccaccacccuaaucuuccaccaccucuc

SEQ ID NO: 528629 - RNA, 60 nt, Homo Sapiens
cuccucgagggcuccagcauccucugcuucccccaccacguucccaucacccaccucauu

SEQ ID NO: 528630 - RNA, 60 nt, Homo Sapiens
uaguggccuuuggagaugcccccaccucccccccaccaacucucgcguguuggagagaag

SEQ ID NO: 528631 - RNA, 64 nt, Homo Sapiens
ccuccuagucucuguucgcucgcuuaagcuguuuugaagccaagugaagagugugguuugcauc

SEQ ID NO: 528632 - RNA, 64 nt, Homo Sapiens
caggcuuugcagaccacgcggggcagggcuccacugaagccacccccaccccucgccagcuagc

SEQ ID NO: 528633 - RNA, 64 nt, Homo Sapiens
ccacccccugcccugcacgucaugggagggggcuugaagccaaagaaaaauaacccuuugguuu

SEQ ID NO: 528634 - RNA, 64 nt, Homo Sapiens
gacccugggugggcucugugcagucacuggagguugaagccaaguggggugcugggaggaggga

SEQ ID NO: 528635 - RNA, 64 nt, Homo Sapiens
agucaagggucacaugccaaaaacaaaaugcuaaugaagccaucuauuaaggauccaaaaagaa

SEQ ID NO: 528636 - RNA, 64 nt, Homo Sapiens
aggauuuaaaaccgcugcucauuuucagagaacuugaagccaaauguuguggagagcauaguaa

SEQ ID NO: 528637 - RNA, 64 nt, Homo Sapiens
agauguugcuuacuaugagugucaaggugacggaugaagccagcugcuccuaaggacacagggc

SEQ ID NO: 528638 - RNA, 64 nt, Homo Sapiens
agacgugaugaguuaaaguuguauucugaaaucaugaagccagagccugugccagaccuucugc

SEQ ID NO: 528639 - RNA, 64 nt, Homo Sapiens
uaaguguuauugaacuguaacaacaugagccucaugaagccaaccucugugaagccacauuuuc

SEQ ID NO: 528640 - RNA, 64 nt, Homo Sapiens
uuuuccaacaugagccucauaguauuuuucucugugaagccacaucucuguguauuuaaaugga

SEQ ID NO: 528641 - RNA, 64 nt, Homo Sapiens
ugcuacauguuguccuuaaacaugguuauugaccugaagccagccuaggccuugcccuacaguu

SEQ ID NO: 528642 - RNA, 64 nt, Homo Sapiens
uggcuugugggcuucaccaaagaggaccccacucugaagccagccuggagccaccuaccucugg

SEQ ID NO: 528643 - RNA, 64 nt, Homo Sapiens
ggcagguagugcccucuugagcuggcuggaccugugaagccaugccagcacuucugcuugcugg

SEQ ID NO: 528644 - RNA, 64 nt, Homo Sapiens
cuuuaagaaaccuggguuaaacaguugguucuauugaagccaguuuccucugccccaagucacu

SEQ ID NO: 528645 - RNA, 64 nt, Homo Sapiens
ucuccucuccccuguccugcacccaucccccgccugaagccaccggcuccaauugccagcaacc

SEQ ID NO: 528646 - RNA, 64 nt, Homo Sapiens
uuccuccaucguccugcccuuuggccuuuugguuugaagccacagguguggcuucuggccuuag

SEQ ID NO: 528647 - RNA, 64 nt, Homo Sapiens
auccucagcagcaucgaggaagggccgaggaaugugaagccagaucucgggacucagauuggaa

SEQ ID NO: 528648 - RNA, 64 nt, Homo Sapiens
auuuggucagcauaucuuagguauauaauaacuuugaagccauaacuuuuaacuggagugguuu

SEQ ID NO: 528649 - RNA, 64 nt, Homo Sapiens
uaguuugauuacccugugcauggcugcaaaugucugaagccagucugagagcuauuuuuuccug

SEQ ID NO: 528650 - RNA, 64 nt, Homo Sapiens
uagcuggggacuauggugucggaacgggggcucuugaagccagguuagaagaagaggcgugugg

SEQ ID NO: 528651 - RNA, 64 nt, Homo Sapiens
uaucugaaacuaaaaugaaccaagaguucuuuggugaagccauccucccuaaucaguauucuuu

SEQ ID NO: 528652 - RNA, 64 nt, Homo Sapiens
gaacucauauugacacucaguuuuuaaaggagauugaagccauauuggacccuuaagaauuuua

SEQ ID NO: 528653 - RNA, 64 nt, Homo Sapiens
uucgggccugaaaacaaauaugaccuuuuuuacuugaagccaaugaauuuuaaucuauagauuc

SEQ ID NO: 528654 - RNA, 64 nt, Homo Sapiens
ccuaggcugucccacagucuuugcugcccuuagaugaagccacuuguuucaagaugacuacuuu

SEQ ID NO: 528655 - RNA, 57 nt, Homo Sapiens
cacuuccacugggaucaugagucacucugaagccacucugaaaucacucugaagcca

SEQ ID NO: 528656 - RNA, 64 nt, Homo Sapiens
caugagucacucugaagccacucugaaaucacucugaagccaaagcugggcucaguggggaagg

SEQ ID NO: 528657 - RNA, 64 nt, Homo Sapiens
ggggugggggucucuaaagacuacuggcauucacugaagccacugcguagguguuugcuuccuu

SEQ ID NO: 528658 - RNA, 64 nt, Homo Sapiens
caggcugcccugagacgaggugugaucuccaccuugaagccaggccuaugaccccagaggacgc

SEQ ID NO: 528659 - RNA, 64 nt, Homo Sapiens
uuaaucugagagcagugucguaauauaaaggaaaugaagccaugcaugcuuacacacuaaacua

SEQ ID NO: 528660 - RNA, 64 nt, Homo Sapiens
caugguggcccacaccuguguuaaaaaccaaacuugaagccaggguggguuuugcaaauauugu

SEQ ID NO: 528661 - RNA, 64 nt, Homo Sapiens; identical to SEQ ID NO: 441009

SEQ ID NO: 528662 - RNA, 64 nt, Homo Sapiens; identical to SEQ ID NO: 441010

SEQ ID NO: 528663 - RNA, 64 nt, Homo Sapiens; identical to SEQ ID NO: 441011

SEQ ID NO: 528664 - RNA, 64 nt, Homo Sapiens; identical to SEQ ID NO: 441012

SEQ ID NO: 528665 - RNA, 64 nt, Homo Sapiens; identical to SEQ ID NO: 441013

SEQ ID NO: 528666 - RNA, 64 nt, Homo Sapiens; identical to SEQ ID NO: 441014

SEQ ID NO: 528667 - RNA, 64 nt, Homo Sapiens; identical to SEQ ID NO: 441015

SEQ ID NO: 528668 - RNA, 64 nt, Homo Sapiens
cuuggcccaggagcauugcugugcuggccaagagccaacacauuucuuagaguuaaaggagggg

SEQ ID NO: 528669 - RNA, 64 nt, Homo Sapiens
gaaaacggaugggaccugggagagggugcuaguaccaacacaggacccagagacucagagggga

SEQ ID NO: 528670 - RNA, 64 nt, Homo Sapiens
agcaauauugaauuguucauacaaugcagcaagaccaacacaaggacaagccaugggcaugcau

SEQ ID NO: 528671 - RNA, 64 nt, Homo Sapiens
cagcaucccugggaacugaggguucaagugaaaaccaacacacuagucacagaaucugccaggc

SEQ ID NO: 528672 - RNA, 64 nt, Homo Sapiens
cccuagcugccaaccugcucuggaccgaaagccuccaacacaaaguuguaggacugcaagacac

SEQ ID NO: 528673 - RNA, 64 nt, Homo Sapiens
ccagagcuuuccaaguccuuuugggggggaaaaaccaacacauuuacccuccuuaggacccauu

SEQ ID NO: 528674 - RNA, 64 nt, Homo Sapiens
ucccuuuuccaugacuguggaaugacaggccuguccaacacaucuaccaccaacuacuaccugu

SEQ ID NO: 528675 - RNA, 64 nt, Homo Sapiens
gauucugaccuuaaaugcaagucgcuagcauuucccaacacaaaugcucagcugucaaggcuca

SEQ ID NO: 528676 - RNA, 64 nt, Homo Sapiens
cccagcugcggaugggagcucucuuguguaagagccaacacaugucuucaaguaaaauuaaagu

SEQ ID NO: 528677 - RNA, 64 nt, Homo Sapiens
ccugggccacuuuccccaccucuacaagugugucccaacacaguccagcaucacaaggcacuug

SEQ ID NO: 528678 - RNA, 64 nt, Homo Sapiens
uucugccugagccuccuuauagauucugccugguccaacacagagagucuggcugguccaacac

SEQ ID NO: 528679 - RNA, 64 nt, Homo Sapiens
uucugccugguccaacacagggagucuggcugguccaacacagaccuggccacugggcugggcu

SEQ ID NO: 528680 - RNA, 64 nt, Homo Sapiens
aauuaaaucucuuuaagaauccuccccuuuuaugcacuucaaauuagcagagguuuaaauguac

SEQ ID NO: 528681 - RNA, 64 nt, Homo Sapiens
cucaaaucagucuuccuugugaauguuggcaaaucacuucaaucuuuuaaaauaagcuuucuca

SEQ ID NO: 528682 - RNA, 64 nt, Homo Sapiens
augcccucaggcuuggggauggcccuccucuggucacuucaaaccaccccuggugucccugccu

SEQ ID NO: 528683 - RNA, 64 nt, Homo Sapiens
ucacccugcuccuaccuaucucuuuugaaaagcucacuucaagcgugcuggcaugucugggucg

SEQ ID NO: 528684 - RNA, 64 nt, Homo Sapiens
auacugacauuuauaaaugaaccuuuauuaaagacacuucaaugccauuuguuagacacuucaa

SEQ ID NO: 528685 - RNA, 64 nt, Homo Sapiens
cuuuauuaaagacacuucaaugccauuuguuagacacuucaauauuuuacaugguuuucaaugu

SEQ ID NO: 528686 - RNA, 64 nt, Homo Sapiens
uugugugacaaguguguuuacagauuauugguuacacuucaauuuacagggcauaaacaaugau

SEQ ID NO: 528687 - RNA, 64 nt, Homo Sapiens
uuaacauguaauuaguuuacagauuguagggcaucacuucaauucaccaagcauguaguucuag

SEQ ID NO: 528688 - RNA, 64 nt, Homo Sapiens
ccugccauuacgggagcuguggacagagcucccucacuucaagauuccuaguguuuuugcacaa

SEQ ID NO: 528689 - RNA, 64 nt, Homo Sapiens
acaaaccucacuguucagaugggcuguaaguucucacuucaaagcuauggaauggauuuuagca

SEQ ID NO: 528690 - RNA, 64 nt, Homo Sapiens
gguuuuaauuuugaagugaauauguauauguauacacuucaauauggaagugauuuuuucugug

SEQ ID NO: 528691 - RNA, 64 nt, Homo Sapiens
ugaaaauauauguucaaagaaaaaaauaucuuuucacuucaaaaugaauuagauguuaucccaa

SEQ ID NO: 528692 - RNA, 64 nt, Homo Sapiens
uugugauaauccuucacagcgggugaacagccaucacuucaacaugaugacggugaugacgacu

SEQ ID NO: 528693 - RNA, 64 nt, Homo Sapiens
gaagauggacaaauuccagaggcaauaauaauggcacuucaauauuuucuuuuuuaguuccccu

SEQ ID NO: 528694 - RNA, 64 nt, Homo Sapiens
uagcuggugauacccuguccuguggaaggacuuccacuucaacacuuccacuucaacaguuccc

SEQ ID NO: 528695 - RNA, 64 nt, Homo Sapiens
cuguccuguggaaggacuuccacuucaacacuuccacuucaacaguucccgcacggccugaacg

SEQ ID NO: 528696 - RNA, 60 nt, Homo Sapiens
aaacuaugaagcaacacugagauguccaggaucugugacugaagacauuucugauuauuu

SEQ ID NO: 528697 - RNA, 64 nt, Homo Sapiens
aggagcaguccuaugcuuuuauucagcauccuuuaucugugacuucaugcucugauaacugccu

SEQ ID NO: 528698 - RNA, 64 nt, Homo Sapiens
cugugcgucagaauccaccuugcgugcugugcguaucugugaaccuggagcgguuacuuauuuu

SEQ ID NO: 528699 - RNA, 64 nt, Homo Sapiens
uuucuuauguccucauaaaagcucagaugaugguaucugugaguauguuuugcaaauucaaaau

SEQ ID NO: 528700 - RNA, 64 nt, Homo Sapiens
gaaaugugaagggucaacuccaacguaugugguuaucugugaaaguugcacagcguggcuuuuc

SEQ ID NO: 528701 - RNA, 64 nt, Homo Sapiens
acuguggaaggccucccucugucggcuuuuugccaucugugauaugccauaggugugacaaucc

SEQ ID NO: 528702 - RNA, 64 nt, Homo Sapiens
cugaaccugguccugugggccauugaaaaguuagaucugugaucucugggguuuuuguggcuuu

SEQ ID NO: 528703 - RNA, 64 nt, Homo Sapiens
gccugcuugaccuccaaguagagcugauacagagaucugugaauauugugauagaaauucuuug

SEQ ID NO: 528704 - RNA, 64 nt, Homo Sapiens
ucuucuacugaaucuauaaaaacugcaguuuuacaucugugaacuauggcuuaagggacaggau

SEQ ID NO: 528705 - RNA, 64 nt, Homo Sapiens
uggaguuaacuggaauagcaguacacuagcaaguaucugugaauccuuagcacugacggguuaa

SEQ ID NO: 528706 - RNA, 64 nt, Homo Sapiens
aaauaauggccucauuuuucaaccugccaaugagaucugugaaauaaauauauugagccauguu

SEQ ID NO: 528707 - RNA, 64 nt, Homo Sapiens
ucuuuucuuuauccuguuucuuuuucuuucucaaaucugugaucgaauuugcugaauugaauug

SEQ ID NO: 528708 - RNA, 64 nt, Homo Sapiens
guucuauuacuugaauaguuugcguaccagagacaucugugauuuggcaaauaacccaauagcc

SEQ ID NO: 528709 - RNA, 64 nt, Homo Sapiens
aaugaggugucauuuuuugagggaaauaaugagcaucugugaauauaauguaaagauuaaaaug

SEQ ID NO: 528710 - RNA, 64 nt, Homo Sapiens
agauccuacuacucuuccuuucaaaagaauaaaaaucugugaaggccaaauuuuaggaacagaa

SEQ ID NO: 528711 - RNA, 64 nt, Homo Sapiens
ggaacugaagugaacgugaaggaagcugaaauccaucugugaauauucaagcagugcacccggu

SEQ ID NO: 528712 - RNA, 64 nt, Homo Sapiens
cccgccaacuccuauacccaucuucccuaggugaaucugugaaugguccuuucuggcagcaauc

SEQ ID NO: 528713 - RNA, 64 nt, Homo Sapiens
uuuuauauaacuaaaauaaaauagauguggagggaucugugaucauauaaaaagggaggguuac

SEQ ID NO: 528714 - RNA, 64 nt, Homo Sapiens
gaaaauccaguuucaagaacuuaguagauaaaacaucugugagucaaaguaucacauuauaaag

SEQ ID NO: 528715 - RNA, 64 nt, Homo Sapiens
aucaugauucuuuuaguucacuccuuucccucacaucugugauccaucucucaaaaagccucca

SEQ ID NO: 528716 - RNA, 64 nt, Homo Sapiens
ucacuuagagcuuaucuucccuaugaaucuccagaucugugagucgagcagauuucauguugca

SEQ ID NO: 528717 - RNA, 64 nt, Homo Sapiens
uucccacucccaacuccugaaaugaagucuugcuaucugugacuaguuuuauuuuugugcuuuu

SEQ ID NO: 528718 - RNA, 64 nt, Homo Sapiens
cucugucucauccuccuggaaccuugcuguccugaucugugauaguucacccccugagaucccc

SEQ ID NO: 528719 - RNA, 64 nt, Homo Sapiens
auuauaaaaggggguccguggaagaaugaucagcaucugugaugggagcgucaggguuggugug

SEQ ID NO: 528720 - RNA, 64 nt, Homo Sapiens
uggugagggcuggaaauccaaacucaccaccaugaucugugaaauaaagcccuuagcgguguga

SEQ ID NO: 528721 - RNA, 64 nt, Homo Sapiens
aaaguugucauuugaggucgcacuuggaaguuacaucugugaaguuucugucauucguccagau

SEQ ID NO: 528722 - RNA, 64 nt, Homo Sapiens
uguuuuuuguuuuuaauuacuugccuuucuguucaucugugaacucucccuccugggaauuguu

SEQ ID NO: 528723 - RNA, 64 nt, Homo Sapiens
aagucugagggucuuccuuucgcaucaagaagcaaucugugacauuuguacauuuuuugccgga

SEQ ID NO: 528724 - RNA, 64 nt, Homo Sapiens
aacagggcaacuggaaccuagauaucaacagcucaucugugaccuauuuauuuggggucugaag

SEQ ID NO: 528725 - RNA, 64 nt, Homo Sapiens
aacuugguaaaaacccacaggugcugcugcuuauaucugugaagcacuagcuuauucuaggaau

SEQ ID NO: 528726 - RNA, 64 nt, Homo Sapiens
aagaauaaugaggucaugucauuuguuaauaaguaucugugauaaauccgugguucaagguuaa

SEQ ID NO: 528727 - RNA, 64 nt, Homo Sapiens
acacacacacacacacacacacucugagcacauuaucugugauucuuucauccucccagaaagg

SEQ ID NO: 528728 - RNA, 64 nt, Homo Sapiens
ccucuuccccacgugcucccaucuguaacucuccaucugugauuugcaacaggucuuccacugg

SEQ ID NO: 528729 - RNA, 64 nt, Homo Sapiens; identical to SEQ ID NO: 97587

SEQ ID NO: 528730 - RNA, 64 nt, Homo Sapiens; identical to SEQ ID NO: 97588

SEQ ID NO: 528731 - RNA, 64 nt, Homo Sapiens; identical to SEQ ID NO: 97589

SEQ ID NO: 528732 - RNA, 64 nt, Homo Sapiens; identical to SEQ ID NO: 97590

SEQ ID NO: 528733 - RNA, 64 nt, Homo Sapiens; identical to SEQ ID NO: 97591

SEQ ID NO: 528734 - RNA, 64 nt, Homo Sapiens; identical to SEQ ID NO: 97592

SEQ ID NO: 528735 - RNA, 64 nt, Homo Sapiens; identical to SEQ ID NO: 97593

SEQ ID NO: 528736 - RNA, 61 nt, Homo Sapiens; identical to SEQ ID NO: 97594

SEQ ID NO: 528737 - RNA, 64 nt, Homo Sapiens; identical to SEQ ID NO: 97595

SEQ ID NO: 528738 - RNA, 64 nt, Homo Sapiens; identical to SEQ ID NO: 97596

SEQ ID NO: 528739 - RNA, 64 nt, Homo Sapiens; identical to SEQ ID NO: 97597

SEQ ID NO: 528740 - RNA, 64 nt, Homo Sapiens; identical to SEQ ID NO: 97598

SEQ ID NO: 528741 - RNA, 64 nt, Homo Sapiens; identical to SEQ ID NO: 97599

SEQ ID NO: 528742 - RNA, 64 nt, Homo Sapiens; identical to SEQ ID NO: 97600

SEQ ID NO: 528743 - RNA, 64 nt, Homo Sapiens; identical to SEQ ID NO: 97601

SEQ ID NO: 528744 - RNA, 64 nt, Homo Sapiens; identical to SEQ ID NO: 97602

SEQ ID NO: 528745 - RNA, 64 nt, Homo Sapiens; identical to SEQ ID NO: 97603

SEQ ID NO: 528746 - RNA, 64 nt, Homo Sapiens; identical to SEQ ID NO: 97604

SEQ ID NO: 528747 - RNA, 64 nt, Homo Sapiens; identical to SEQ ID NO: 97605

SEQ ID NO: 528748 - RNA, 64 nt, Homo Sapiens; identical to SEQ ID NO: 97606

SEQ ID NO: 528749 - RNA, 64 nt, Homo Sapiens; identical to SEQ ID NO: 97607

SEQ ID NO: 528750 - RNA, 64 nt, Homo Sapiens; identical to SEQ ID NO: 97608

SEQ ID NO: 528751 - RNA, 64 nt, Homo Sapiens; identical to SEQ ID NO: 97609

SEQ ID NO: 528752 - RNA, 64 nt, Homo Sapiens; identical to SEQ ID NO: 97610

SEQ ID NO: 528753 - RNA, 64 nt, Homo Sapiens; identical to SEQ ID NO: 97611

SEQ ID NO: 528754 - RNA, 64 nt, Homo Sapiens; identical to SEQ ID NO: 97612

SEQ ID NO: 528755 - RNA, 64 nt, Homo Sapiens; identical to SEQ ID NO: 97613

SEQ ID NO: 528756 - RNA, 64 nt, Homo Sapiens; identical to SEQ ID NO: 97614

SEQ ID NO: 528757 - RNA, 64 nt, Homo Sapiens; identical to SEQ ID NO: 97615

SEQ ID NO: 528758 - RNA, 64 nt, Homo Sapiens; identical to SEQ ID NO: 97616

SEQ ID NO: 528759 - RNA, 64 nt, Homo Sapiens; identical to SEQ ID NO: 97617

SEQ ID NO: 528760 - RNA, 64 nt, Homo Sapiens; identical to SEQ ID NO: 97618

SEQ ID NO: 528761 - RNA, 64 nt, Homo Sapiens; identical to SEQ ID NO: 97619

SEQ ID NO: 528762 - RNA, 64 nt, Homo Sapiens; identical to SEQ ID NO: 97620

SEQ ID NO: 528763 - RNA, 64 nt, Homo Sapiens; identical to SEQ ID NO: 97621

SEQ ID NO: 528764 - RNA, 64 nt, Homo Sapiens; identical to SEQ ID NO: 97622

SEQ ID NO: 528765 - RNA, 64 nt, Homo Sapiens; identical to SEQ ID NO: 97623

SEQ ID NO: 528766 - RNA, 64 nt, Homo Sapiens; identical to SEQ ID NO: 97624

SEQ ID NO: 528767 - RNA, 64 nt, Homo Sapiens; identical to SEQ ID NO: 97625

SEQ ID NO: 528768 - RNA, 64 nt, Homo Sapiens; identical to SEQ ID NO: 97626

SEQ ID NO: 528769 - RNA, 64 nt, Homo Sapiens; identical to SEQ ID NO: 97627

SEQ ID NO: 528770 - RNA, 64 nt, Homo Sapiens; identical to SEQ ID NO: 97628

SEQ ID NO: 528771 - RNA, 64 nt, Homo Sapiens; identical to SEQ ID NO: 97629

SEQ ID NO: 528772 - RNA, 64 nt, Homo Sapiens; identical to SEQ ID NO: 97630

SEQ ID NO: 528773 - RNA, 64 nt, Homo Sapiens; identical to SEQ ID NO: 97631

SEQ ID NO: 528774 - RNA, 64 nt, Homo Sapiens; identical to SEQ ID NO: 97632

SEQ ID NO: 528775 - RNA, 64 nt, Homo Sapiens; identical to SEQ ID NO: 97633

SEQ ID NO: 528776 - RNA, 64 nt, Homo Sapiens; identical to SEQ ID NO: 97634

SEQ ID NO: 528777 - RNA, 64 nt, Homo Sapiens; identical to SEQ ID NO: 97635

SEQ ID NO: 528778 - RNA, 64 nt, Homo Sapiens; identical to SEQ ID NO: 97636

SEQ ID NO: 528779 - RNA, 64 nt, Homo Sapiens; identical to SEQ ID NO: 97637

SEQ ID NO: 528780 - RNA, 64 nt, Homo Sapiens; identical to SEQ ID NO: 97638

SEQ ID NO: 528781 - RNA, 64 nt, Homo Sapiens; identical to SEQ ID NO: 97639

SEQ ID NO: 528782 - RNA, 64 nt, Homo Sapiens; identical to SEQ ID NO: 97640

SEQ ID NO: 528783 - RNA, 64 nt, Homo Sapiens; identical to SEQ ID NO: 97641

SEQ ID NO: 528784 - RNA, 64 nt, Homo Sapiens; identical to SEQ ID NO: 97642

SEQ ID NO: 528785 - RNA, 64 nt, Homo Sapiens; identical to SEQ ID NO: 97643

SEQ ID NO: 528786 - RNA, 64 nt, Homo Sapiens; identical to SEQ ID NO: 97644

SEQ ID NO: 528787 - RNA, 64 nt, Homo Sapiens; identical to SEQ ID NO: 97645

SEQ ID NO: 528788 - RNA, 64 nt, Homo Sapiens; identical to SEQ ID NO: 97646

SEQ ID NO: 528789 - RNA, 64 nt, Homo Sapiens; identical to SEQ ID NO: 97647

SEQ ID NO: 528790 - RNA, 64 nt, Homo Sapiens; identical to SEQ ID NO: 97648

SEQ ID NO: 528791 - RNA, 64 nt, Homo Sapiens; identical to SEQ ID NO: 97649

SEQ ID NO: 528792 - RNA, 64 nt, Homo Sapiens; identical to SEQ ID NO: 97650

SEQ ID NO: 528793 - RNA, 64 nt, Homo Sapiens; identical to SEQ ID NO: 97651

SEQ ID NO: 528794 - RNA, 64 nt, Homo Sapiens; identical to SEQ ID NO: 97652

SEQ ID NO: 528795 - RNA, 64 nt, Homo Sapiens; identical to SEQ ID NO: 97653

SEQ ID NO: 528796 - RNA, 64 nt, Homo Sapiens; identical to SEQ ID NO: 97654

SEQ ID NO: 528797 - RNA, 64 nt, Homo Sapiens; identical to SEQ ID NO: 97655

SEQ ID NO: 528798 - RNA, 64 nt, Homo Sapiens; identical to SEQ ID NO: 97656

SEQ ID NO: 528799 - RNA, 64 nt, Homo Sapiens; identical to SEQ ID NO: 97657

SEQ ID NO: 528800 - RNA, 64 nt, Homo Sapiens; identical to SEQ ID NO: 97658

SEQ ID NO: 528801 - RNA, 64 nt, Homo Sapiens; identical to SEQ ID NO: 97659

SEQ ID NO: 528802 - RNA, 58 nt, Homo Sapiens; identical to SEQ ID NO: 97660

SEQ ID NO: 528803 - RNA, 64 nt, Homo Sapiens; identical to SEQ ID NO: 97661

SEQ ID NO: 528804 - RNA, 64 nt, Homo Sapiens; identical to SEQ ID NO: 97662

SEQ ID NO: 528805 - RNA, 64 nt, Homo Sapiens; identical to SEQ ID NO: 97663

SEQ ID NO: 528806 - RNA, 64 nt, Homo Sapiens; identical to SEQ ID NO: 97664

SEQ ID NO: 528807 - RNA, 64 nt, Homo Sapiens; identical to SEQ ID NO: 97665

SEQ ID NO: 528808 - RNA, 64 nt, Homo Sapiens; identical to SEQ ID NO: 97666

SEQ ID NO: 528809 - RNA, 64 nt, Homo Sapiens; identical to SEQ ID NO: 97667

SEQ ID NO: 528810 - RNA, 64 nt, Homo Sapiens; identical to SEQ ID NO: 97668

SEQ ID NO: 528811 - RNA, 64 nt, Homo Sapiens; identical to SEQ ID NO: 97669

SEQ ID NO: 528812 - RNA, 64 nt, Homo Sapiens; identical to SEQ ID NO: 97670

SEQ ID NO: 528813 - RNA, 64 nt, Homo Sapiens; identical to SEQ ID NO: 266984

SEQ ID NO: 528814 - RNA, 64 nt, Homo Sapiens; identical to SEQ ID NO: 266985

SEQ ID NO: 528815 - RNA, 64 nt, Homo Sapiens; identical to SEQ ID NO: 266986

SEQ ID NO: 528816 - RNA, 64 nt, Homo Sapiens; identical to SEQ ID NO: 266987

SEQ ID NO: 528817 - RNA, 64 nt, Homo Sapiens; identical to SEQ ID NO: 266988

SEQ ID NO: 528818 - RNA, 64 nt, Homo Sapiens; identical to SEQ ID NO: 266989

SEQ ID NO: 528819 - RNA, 64 nt, Homo Sapiens; identical to SEQ ID NO: 266990

SEQ ID NO: 528820 - RNA, 64 nt, Homo Sapiens; identical to SEQ ID NO: 266991

SEQ ID NO: 528821 - RNA, 64 nt, Homo Sapiens; identical to SEQ ID NO: 266992

SEQ ID NO: 528822 - RNA, 64 nt, Homo Sapiens; identical to SEQ ID NO: 266993

SEQ ID NO: 528823 - RNA, 64 nt, Homo Sapiens; identical to SEQ ID NO: 266994

SEQ ID NO: 528824 - RNA, 64 nt, Homo Sapiens; identical to SEQ ID NO: 266995

SEQ ID NO: 528825 - RNA, 64 nt, Homo Sapiens; identical to SEQ ID NO: 266996

SEQ ID NO: 528826 - RNA, 64 nt, Homo Sapiens; identical to SEQ ID NO: 266997

SEQ ID NO: 528827 - RNA, 64 nt, Homo Sapiens; identical to SEQ ID NO: 266998

SEQ ID NO: 528828 - RNA, 64 nt, Homo Sapiens; identical to SEQ ID NO: 266999

SEQ ID NO: 528829 - RNA, 64 nt, Homo Sapiens; identical to SEQ ID NO: 267000

SEQ ID NO: 528830 - RNA, 64 nt, Homo Sapiens; identical to SEQ ID NO: 267001

SEQ ID NO: 528831 - RNA, 64 nt, Homo Sapiens; identical to SEQ ID NO: 267002

SEQ ID NO: 528832 - RNA, 64 nt, Homo Sapiens; identical to SEQ ID NO: 267003

SEQ ID NO: 528833 - RNA, 64 nt, Homo Sapiens; identical to SEQ ID NO: 267004

SEQ ID NO: 528834 - RNA, 64 nt, Homo Sapiens; identical to SEQ ID NO: 267005

SEQ ID NO: 528835 - RNA, 64 nt, Homo Sapiens; identical to SEQ ID NO: 267006

SEQ ID NO: 528836 - RNA, 64 nt, Homo Sapiens; identical to SEQ ID NO: 267007

SEQ ID NO: 528837 - RNA, 64 nt, Homo Sapiens; identical to SEQ ID NO: 267008

SEQ ID NO: 528838 - RNA, 64 nt, Homo Sapiens; identical to SEQ ID NO: 267009

SEQ ID NO: 528839 - RNA, 64 nt, Homo Sapiens; identical to SEQ ID NO: 267010

SEQ ID NO: 528840 - RNA, 64 nt, Homo Sapiens; identical to SEQ ID NO: 267011

SEQ ID NO: 528841 - RNA, 64 nt, Homo Sapiens; identical to SEQ ID NO: 267012

SEQ ID NO: 528842 - RNA, 64 nt, Homo Sapiens; identical to SEQ ID NO: 267013

SEQ ID NO: 528843 - RNA, 64 nt, Homo Sapiens; identical to SEQ ID NO: 267014

SEQ ID NO: 528844 - RNA, 64 nt, Homo Sapiens; identical to SEQ ID NO: 267015

SEQ ID NO: 528845 - RNA, 64 nt, Homo Sapiens; identical to SEQ ID NO: 267016

SEQ ID NO: 528846 - RNA, 64 nt, Homo Sapiens; identical to SEQ ID NO: 267017

SEQ ID NO: 528847 - RNA, 64 nt, Homo Sapiens; identical to SEQ ID NO: 267018

SEQ ID NO: 528848 - RNA, 64 nt, Homo Sapiens; identical to SEQ ID NO: 267019

SEQ ID NO: 528849 - RNA, 64 nt, Homo Sapiens; identical to SEQ ID NO: 267020

SEQ ID NO: 528850 - RNA, 64 nt, Homo Sapiens; identical to SEQ ID NO: 267021

SEQ ID NO: 528851 - RNA, 64 nt, Homo Sapiens; identical to SEQ ID NO: 267022

SEQ ID NO: 528852 - RNA, 64 nt, Homo Sapiens; identical to SEQ ID NO: 267023

SEQ ID NO: 528853 - RNA, 64 nt, Homo Sapiens; identical to SEQ ID NO: 267024

SEQ ID NO: 528854 - RNA, 64 nt, Homo Sapiens
guucgccaucauaccgccagcgcgacagccaccuggugccaacucacugagccgccugccgcug

SEQ ID NO: 528855 - RNA, 64 nt, Homo Sapiens
uuacaguggaguauauuuuuuaaagcacaaaauuggugccaagacugggugagaaauguacauu

SEQ ID NO: 528856 - RNA, 64 nt, Homo Sapiens
acauaucaccucauuucuaagaaauaaacuacaaggugccaagaagguuuuauuuccuuuuauu

SEQ ID NO: 528857 - RNA, 64 nt, Homo Sapiens
aagaugacaaauguacagauguuaauauauuuuuggugccaauggcgauguuuuuaagaguggg

SEQ ID NO: 528858 - RNA, 64 nt, Homo Sapiens
uaccuggagguuugacucuaauuuuugcacugauggugccaaagggcccugagucaaaaggaua

SEQ ID NO: 528859 - RNA, 64 nt, Homo Sapiens
accuccuagaaggaagccuuccccaccauuuccaggugccaacugcuaagcagauauauuccaa

SEQ ID NO: 528860 - RNA, 64 nt, Homo Sapiens
cuucaucccccauguuuuccaucuggucacugcaggugccaaccgcugccugcauuguaucucc

SEQ ID NO: 528861 - RNA, 64 nt, Homo Sapiens
gcagccagggucuucccugcagcuggugucugugggugccaaggcaaggacgugagccaguggg

SEQ ID NO: 528862 - RNA, 64 nt, Homo Sapiens
ggcagaggaagagaggucgacuguggggucauuuggugccaaacauggaggugggcaggcucac

SEQ ID NO: 528863 - RNA, 64 nt, Homo Sapiens
uuuauaggcaggagccccacugcuuccagccucuggugccaacacaguugccaaacccauugag

SEQ ID NO: 528864 - RNA, 64 nt, Homo Sapiens
cuaagaaggucgaccucaucaucugggagaucgaggugccaaagguaggggcggagucccccag

SEQ ID NO: 528865 - RNA, 64 nt, Homo Sapiens
ggggcgcuaugugaguuuucugaagcaaacaucuggugccaagaucuacauuucaacccugccu

SEQ ID NO: 528866 - RNA, 64 nt, Homo Sapiens
gcaguacaagaaccucuccaucaucuuccgcgcaggugccaacccagccuuugaagaggcugug

SEQ ID NO: 528867 - RNA, 64 nt, Homo Sapiens
cgcuauuccucacucagaggaagacuuugauccaggugccaaguuccacuuuucugcaggugug

SEQ ID NO: 528868 - RNA, 64 nt, Homo Sapiens
uaaggguuucucaaauuggaggauugggacugguggugccaagaggggaggcuaaggaaaguug

SEQ ID NO: 528869 - RNA, 64 nt, Homo Sapiens
accagcaagugucuuuccugccggccaucuccauggugccaauugagccauguccagaacccag

SEQ ID NO: 528870 - RNA, 64 nt, Homo Sapiens; identical to SEQ ID NO: 113667

SEQ ID NO: 528871 - RNA, 64 nt, Homo Sapiens; identical to SEQ ID NO: 113668

SEQ ID NO: 528872 - RNA, 64 nt, Homo Sapiens; identical to SEQ ID NO: 113669

SEQ ID NO: 528873 - RNA, 64 nt, Homo Sapiens; identical to SEQ ID NO: 113670

SEQ ID NO: 528874 - RNA, 64 nt, Homo Sapiens; identical to SEQ ID NO: 113671

SEQ ID NO: 528875 - RNA, 64 nt, Homo Sapiens; identical to SEQ ID NO: 113672

SEQ ID NO: 528876 - RNA, 64 nt, Homo Sapiens; identical to SEQ ID NO: 113673

SEQ ID NO: 528877 - RNA, 64 nt, Homo Sapiens; identical to SEQ ID NO: 113674

SEQ ID NO: 528878 - RNA, 64 nt, Homo Sapiens; identical to SEQ ID NO: 113675

SEQ ID NO: 528879 - RNA, 64 nt, Homo Sapiens; identical to SEQ ID NO: 113676

SEQ ID NO: 528880 - RNA, 64 nt, Homo Sapiens; identical to SEQ ID NO: 113677

SEQ ID NO: 528881 - RNA, 64 nt, Homo Sapiens; identical to SEQ ID NO: 113678

SEQ ID NO: 528882 - RNA, 64 nt, Homo Sapiens; identical to SEQ ID NO: 113679

SEQ ID NO: 528883 - RNA, 64 nt, Homo Sapiens; identical to SEQ ID NO: 113680

SEQ ID NO: 528884 - RNA, 64 nt, Homo Sapiens; identical to SEQ ID NO: 113681

SEQ ID NO: 528885 - RNA, 64 nt, Homo Sapiens; identical to SEQ ID NO: 113682

SEQ ID NO: 528886 - RNA, 64 nt, Homo Sapiens; identical to SEQ ID NO: 113683

SEQ ID NO: 528887 - RNA, 64 nt, Homo Sapiens; identical to SEQ ID NO: 113684

SEQ ID NO: 528888 - RNA, 64 nt, Homo Sapiens; identical to SEQ ID NO: 113685

SEQ ID NO: 528889 - RNA, 64 nt, Homo Sapiens; identical to SEQ ID NO: 113686

SEQ ID NO: 528890 - RNA, 64 nt, Homo Sapiens; identical to SEQ ID NO: 113687

SEQ ID NO: 528891 - RNA, 64 nt, Homo Sapiens; identical to SEQ ID NO: 113688

SEQ ID NO: 528892 - RNA, 64 nt, Homo Sapiens; identical to SEQ ID NO: 113689

SEQ ID NO: 528893 - RNA, 62 nt, Homo Sapiens; identical to SEQ ID NO: 113690

SEQ ID NO: 528894 - RNA, 64 nt, Homo Sapiens; identical to SEQ ID NO: 113691

SEQ ID NO: 528895 - RNA, 59 nt, Homo Sapiens; identical to SEQ ID NO: 113692

SEQ ID NO: 528896 - RNA, 64 nt, Homo Sapiens; identical to SEQ ID NO: 113693

SEQ ID NO: 528897 - RNA, 64 nt, Homo Sapiens; identical to SEQ ID NO: 113694

SEQ ID NO: 528898 - RNA, 64 nt, Homo Sapiens; identical to SEQ ID NO: 113695

SEQ ID NO: 528899 - RNA, 64 nt, Homo Sapiens; identical to SEQ ID NO: 113696

SEQ ID NO: 528900 - RNA, 64 nt, Homo Sapiens; identical to SEQ ID NO: 113697

SEQ ID NO: 528901 - RNA, 64 nt, Homo Sapiens; identical to SEQ ID NO: 113698

SEQ ID NO: 528902 - RNA, 64 nt, Homo Sapiens; identical to SEQ ID NO: 113699

SEQ ID NO: 528903 - RNA, 64 nt, Homo Sapiens; identical to SEQ ID NO: 113700

SEQ ID NO: 528904 - RNA, 64 nt, Homo Sapiens; identical to SEQ ID NO: 113701

SEQ ID NO: 528905 - RNA, 64 nt, Homo Sapiens; identical to SEQ ID NO: 113702

SEQ ID NO: 528906 - RNA, 64 nt, Homo Sapiens; identical to SEQ ID NO: 113703

SEQ ID NO: 528907 - RNA, 64 nt, Homo Sapiens; identical to SEQ ID NO: 113704

SEQ ID NO: 528908 - RNA, 64 nt, Homo Sapiens; identical to SEQ ID NO: 113705

SEQ ID NO: 528909 - RNA, 64 nt, Homo Sapiens; identical to SEQ ID NO: 113706

SEQ ID NO: 528910 - RNA, 64 nt, Homo Sapiens; identical to SEQ ID NO: 113707

SEQ ID NO: 528911 - RNA, 64 nt, Homo Sapiens; identical to SEQ ID NO: 113708

SEQ ID NO: 528912 - RNA, 64 nt, Homo Sapiens; identical to SEQ ID NO: 113709

SEQ ID NO: 528913 - RNA, 64 nt, Homo Sapiens; identical to SEQ ID NO: 113710

SEQ ID NO: 528914 - RNA, 64 nt, Homo Sapiens; identical to SEQ ID NO: 113711

SEQ ID NO: 528915 - RNA, 64 nt, Homo Sapiens; identical to SEQ ID NO: 113712

SEQ ID NO: 528916 - RNA, 64 nt, Homo Sapiens; identical to SEQ ID NO: 113713

SEQ ID NO: 528917 - RNA, 64 nt, Homo Sapiens; identical to SEQ ID NO: 113714

SEQ ID NO: 528918 - RNA, 64 nt, Homo Sapiens; identical to SEQ ID NO: 113715

SEQ ID NO: 528919 - RNA, 64 nt, Homo Sapiens; identical to SEQ ID NO: 113716

SEQ ID NO: 528920 - RNA, 64 nt, Homo Sapiens; identical to SEQ ID NO: 113717

SEQ ID NO: 528921 - RNA, 64 nt, Homo Sapiens; identical to SEQ ID NO: 113718

SEQ ID NO: 528922 - RNA, 64 nt, Homo Sapiens; identical to SEQ ID NO: 113719

SEQ ID NO: 528923 - RNA, 64 nt, Homo Sapiens; identical to SEQ ID NO: 113720

SEQ ID NO: 528924 - RNA, 64 nt, Homo Sapiens; identical to SEQ ID NO: 113721

SEQ ID NO: 528925 - RNA, 64 nt, Homo Sapiens; identical to SEQ ID NO: 113722

SEQ ID NO: 528926 - RNA, 64 nt, Homo Sapiens; identical to SEQ ID NO: 113723

SEQ ID NO: 528927 - RNA, 64 nt, Homo Sapiens; identical to SEQ ID NO: 113724

SEQ ID NO: 528928 - RNA, 64 nt, Homo Sapiens; identical to SEQ ID NO: 113725

SEQ ID NO: 528929 - RNA, 64 nt, Homo Sapiens; identical to SEQ ID NO: 113726

SEQ ID NO: 528930 - RNA, 64 nt, Homo Sapiens; identical to SEQ ID NO: 113727

SEQ ID NO: 528931 - RNA, 64 nt, Homo Sapiens; identical to SEQ ID NO: 113728

SEQ ID NO: 528932 - RNA, 64 nt, Homo Sapiens; identical to SEQ ID NO: 113729

SEQ ID NO: 528933 - RNA, 64 nt, Homo Sapiens; identical to SEQ ID NO: 113730

SEQ ID NO: 528934 - RNA, 64 nt, Homo Sapiens; identical to SEQ ID NO: 113731

SEQ ID NO: 528935 - RNA, 64 nt, Homo Sapiens; identical to SEQ ID NO: 113732

SEQ ID NO: 528936 - RNA, 64 nt, Homo Sapiens; identical to SEQ ID NO: 113733

SEQ ID NO: 528937 - RNA, 64 nt, Homo Sapiens; identical to SEQ ID NO: 113734

SEQ ID NO: 528938 - RNA, 64 nt, Homo Sapiens; identical to SEQ ID NO: 113735

SEQ ID NO: 528939 - RNA, 64 nt, Homo Sapiens; identical to SEQ ID NO: 113736

SEQ ID NO: 528940 - RNA, 64 nt, Homo Sapiens; identical to SEQ ID NO: 113737

SEQ ID NO: 528941 - RNA, 64 nt, Homo Sapiens; identical to SEQ ID NO: 113738

SEQ ID NO: 528942 - RNA, 64 nt, Homo Sapiens; identical to SEQ ID NO: 113739

SEQ ID NO: 528943 - RNA, 64 nt, Homo Sapiens; identical to SEQ ID NO: 113740

SEQ ID NO: 528944 - RNA, 64 nt, Homo Sapiens; identical to SEQ ID NO: 113741

SEQ ID NO: 528945 - RNA, 64 nt, Homo Sapiens; identical to SEQ ID NO: 113742

SEQ ID NO: 528946 - RNA, 64 nt, Homo Sapiens; identical to SEQ ID NO: 113743

SEQ ID NO: 528947 - RNA, 64 nt, Homo Sapiens; identical to SEQ ID NO: 113744

SEQ ID NO: 528948 - RNA, 64 nt, Homo Sapiens; identical to SEQ ID NO: 113745

SEQ ID NO: 528949 - RNA, 64 nt, Homo Sapiens; identical to SEQ ID NO: 113746

SEQ ID NO: 528950 - RNA, 64 nt, Homo Sapiens; identical to SEQ ID NO: 113747

SEQ ID NO: 528951 - RNA, 64 nt, Homo Sapiens; identical to SEQ ID NO: 113748

SEQ ID NO: 528952 - RNA, 64 nt, Homo Sapiens; identical to SEQ ID NO: 113749

SEQ ID NO: 528953 - RNA, 64 nt, Homo Sapiens; identical to SEQ ID NO: 113750

SEQ ID NO: 528954 - RNA, 64 nt, Homo Sapiens; identical to SEQ ID NO: 113751

SEQ ID NO: 528955 - RNA, 64 nt, Homo Sapiens; identical to SEQ ID NO: 113752

SEQ ID NO: 528956 - RNA, 64 nt, Homo Sapiens; identical to SEQ ID NO: 113753

SEQ ID NO: 528957 - RNA, 64 nt, Homo Sapiens; identical to SEQ ID NO: 113754

SEQ ID NO: 528958 - RNA, 64 nt, Homo Sapiens; identical to SEQ ID NO: 113755

SEQ ID NO: 528959 - RNA, 64 nt, Homo Sapiens; identical to SEQ ID NO: 113756

SEQ ID NO: 528960 - RNA, 64 nt, Homo Sapiens; identical to SEQ ID NO: 113757

SEQ ID NO: 528961 - RNA, 64 nt, Homo Sapiens; identical to SEQ ID NO: 113758

SEQ ID NO: 528962 - RNA, 64 nt, Homo Sapiens; identical to SEQ ID NO: 113759

SEQ ID NO: 528963 - RNA, 64 nt, Homo Sapiens; identical to SEQ ID NO: 113760

SEQ ID NO: 528964 - RNA, 64 nt, Homo Sapiens; identical to SEQ ID NO: 113761

SEQ ID NO: 528965 - RNA, 64 nt, Homo Sapiens; identical to SEQ ID NO: 113762

SEQ ID NO: 528966 - RNA, 64 nt, Homo Sapiens; identical to SEQ ID NO: 113763

SEQ ID NO: 528967 - RNA, 64 nt, Homo Sapiens; identical to SEQ ID NO: 113764

SEQ ID NO: 528968 - RNA, 61 nt, Homo Sapiens; identical to SEQ ID NO: 113765

SEQ ID NO: 528969 - RNA, 64 nt, Homo Sapiens; identical to SEQ ID NO: 113766

SEQ ID NO: 528970 - RNA, 64 nt, Homo Sapiens; identical to SEQ ID NO: 113767

SEQ ID NO: 528971 - RNA, 64 nt, Homo Sapiens; identical to SEQ ID NO: 113768

SEQ ID NO: 528972 - RNA, 64 nt, Homo Sapiens; identical to SEQ ID NO: 113769

SEQ ID NO: 528973 - RNA, 64 nt, Homo Sapiens; identical to SEQ ID NO: 113770

SEQ ID NO: 528974 - RNA, 64 nt, Homo Sapiens; identical to SEQ ID NO: 113771

SEQ ID NO: 528975 - RNA, 64 nt, Homo Sapiens; identical to SEQ ID NO: 113772

SEQ ID NO: 528976 - RNA, 64 nt, Homo Sapiens; identical to SEQ ID NO: 113773

SEQ ID NO: 528977 - RNA, 64 nt, Homo Sapiens; identical to SEQ ID NO: 113774

SEQ ID NO: 528978 - RNA, 64 nt, Homo Sapiens; identical to SEQ ID NO: 113775

SEQ ID NO: 528979 - RNA, 64 nt, Homo Sapiens; identical to SEQ ID NO: 113776

SEQ ID NO: 528980 - RNA, 64 nt, Homo Sapiens; identical to SEQ ID NO: 113777

SEQ ID NO: 528981 - RNA, 64 nt, Homo Sapiens; identical to SEQ ID NO: 113778

SEQ ID NO: 528982 - RNA, 64 nt, Homo Sapiens; identical to SEQ ID NO: 113779

SEQ ID NO: 528983 - RNA, 64 nt, Homo Sapiens; identical to SEQ ID NO: 113780

SEQ ID NO: 528984 - RNA, 64 nt, Homo Sapiens; identical to SEQ ID NO: 113781

SEQ ID NO: 528985 - RNA, 64 nt, Homo Sapiens; identical to SEQ ID NO: 113782

SEQ ID NO: 528986 - RNA, 64 nt, Homo Sapiens; identical to SEQ ID NO: 113783

SEQ ID NO: 528987 - RNA, 64 nt, Homo Sapiens; identical to SEQ ID NO: 113784

SEQ ID NO: 528988 - RNA, 64 nt, Homo Sapiens; identical to SEQ ID NO: 113785

SEQ ID NO: 528989 - RNA, 64 nt, Homo Sapiens; identical to SEQ ID NO: 113786

SEQ ID NO: 528990 - RNA, 64 nt, Homo Sapiens; identical to SEQ ID NO: 113787

SEQ ID NO: 528991 - RNA, 64 nt, Homo Sapiens; identical to SEQ ID NO: 113788

SEQ ID NO: 528992 - RNA, 64 nt, Homo Sapiens; identical to SEQ ID NO: 113789

SEQ ID NO: 528993 - RNA, 64 nt, Homo Sapiens; identical to SEQ ID NO: 113790

SEQ ID NO: 528994 - RNA, 64 nt, Homo Sapiens; identical to SEQ ID NO: 113791

SEQ ID NO: 528995 - RNA, 64 nt, Homo Sapiens; identical to SEQ ID NO: 113792

SEQ ID NO: 528996 - RNA, 64 nt, Homo Sapiens; identical to SEQ ID NO: 113793

SEQ ID NO: 528997 - RNA, 64 nt, Homo Sapiens; identical to SEQ ID NO: 113794

SEQ ID NO: 528998 - RNA, 64 nt, Homo Sapiens; identical to SEQ ID NO: 113795

SEQ ID NO: 528999 - RNA, 64 nt, Homo Sapiens; identical to SEQ ID NO: 113796

SEQ ID NO: 529000 - RNA, 64 nt, Homo Sapiens; identical to SEQ ID NO: 113797

SEQ ID NO: 529001 - RNA, 64 nt, Homo Sapiens; identical to SEQ ID NO: 113798

SEQ ID NO: 529002 - RNA, 64 nt, Homo Sapiens; identical to SEQ ID NO: 113799

SEQ ID NO: 529003 - RNA, 64 nt, Homo Sapiens; identical to SEQ ID NO: 113800

SEQ ID NO: 529004 - RNA, 64 nt, Homo Sapiens; identical to SEQ ID NO: 113801

SEQ ID NO: 529005 - RNA, 64 nt, Homo Sapiens; identical to SEQ ID NO: 113802

SEQ ID NO: 529006 - RNA, 64 nt, Homo Sapiens; identical to SEQ ID NO: 113803

SEQ ID NO: 529007 - RNA, 64 nt, Homo Sapiens; identical to SEQ ID NO: 113804

SEQ ID NO: 529008 - RNA, 64 nt, Homo Sapiens; identical to SEQ ID NO: 113805

SEQ ID NO: 529009 - RNA, 64 nt, Homo Sapiens; identical to SEQ ID NO: 113806

SEQ ID NO: 529010 - RNA, 64 nt, Homo Sapiens; identical to SEQ ID NO: 113807

SEQ ID NO: 529011 - RNA, 64 nt, Homo Sapiens; identical to SEQ ID NO: 113808

SEQ ID NO: 529012 - RNA, 64 nt, Homo Sapiens; identical to SEQ ID NO: 113809

SEQ ID NO: 529013 - RNA, 64 nt, Homo Sapiens; identical to SEQ ID NO: 113810

SEQ ID NO: 529014 - RNA, 64 nt, Homo Sapiens; identical to SEQ ID NO: 113811

SEQ ID NO: 529015 - RNA, 64 nt, Homo Sapiens
guguuagauggaaaaugcugugugcugccaugguaaucagaaauaauaaccuguuagggaugua

SEQ ID NO: 529016 - RNA, 64 nt, Homo Sapiens
agaaauaauaaccuguuagggauguauucuaggaaaucagaaguaguucucuuuucuugcugga

SEQ ID NO: 529017 - RNA, 64 nt, Homo Sapiens
uguaaaaccuucuauuugaugucauuccauuuauaaucagaaaaaaaacuuauuucuuaaucaa

SEQ ID NO: 529018 - RNA, 64 nt, Homo Sapiens
cgucucauguuuggcccuuuagaauugggguagaaaucagaaaugagaugaggggaagaagcaa

SEQ ID NO: 529019 - RNA, 64 nt, Homo Sapiens
acugguuggugaaauaaagaaguaucaagaagaaaaucagaaaucuucuaagguuuuaaaaucc

SEQ ID NO: 529020 - RNA, 64 nt, Homo Sapiens
ccauuuucuggcugaauaaauuaccauuaaacugaaucagaaauguacgguuuuacacaacucc

SEQ ID NO: 529021 - RNA, 64 nt, Homo Sapiens
ccucauuguguuucuaccggcagauuacugcuuuaaucagaaacaauuuggaggcuggaguaau

SEQ ID NO: 529022 - RNA, 64 nt, Homo Sapiens
uagucuuggaagcuguuugguuuuggaaagucagaaucagaagaaguuaacauuaaugccugcu

SEQ ID NO: 529023 - RNA, 64 nt, Homo Sapiens
uaauugugaaauuauaugauucauauauuuuaugaaucagaauaaccuucaaauaaaauaaauc

SEQ ID NO: 529024 - RNA, 64 nt, Homo Sapiens
gcaguaugauuuguacaugccauugaaaauuauuaaucagaagaaaauuaagcagggucuuugc

SEQ ID NO: 529025 - RNA, 64 nt, Homo Sapiens
cagcuuguucacuguuagaacacuugcaaaugauaaucagaaguuaacuuugaauccauccagc

SEQ ID NO: 529026 - RNA, 64 nt, Homo Sapiens
aaagauaauccaagagcaaaagcauugcccuaagaaucagaagucagaccucuccacagcucaa

SEQ ID NO: 529027 - RNA, 64 nt, Homo Sapiens
aaaguacacccauuauuuauuuaaaaugcauuucaaucagaagcuagauaaaucagaacucucc

SEQ ID NO: 529028 - RNA, 64 nt, Homo Sapiens
cuccuuaaaaugcauuucaaaacgcuuuuagauaaaucagaacuugaauucaaucaaugcagag

SEQ ID NO: 529029 - RNA, 64 nt, Homo Sapiens
uaaaguaaaguuccuuuccuaaaaauaaaaaaguaaucagaagcaauaauaauaaaguaaaaau

SEQ ID NO: 529030 - RNA, 64 nt, Homo Sapiens
uaagcugggugcaguggcucgauacugaggucauaaucagaagcuuccucaguaucuauuccaa

SEQ ID NO: 529031 - RNA, 64 nt, Homo Sapiens
aaggccaaggugcuggacugcaucagccuucaagaaucagaagacucaucuuucugcccggcua

SEQ ID NO: 529032 - RNA, 64 nt, Homo Sapiens
ucaggugugacucuagcaaggagaugcuuggagcaaucagaacuaagcagcaacagccuacaaa

SEQ ID NO: 529033 - RNA, 64 nt, Homo Sapiens
gauugcauuggaagaucauugaaauaaucagaaaaaucagaaauggaccugacuaugagaagua

SEQ ID NO: 529034 - RNA, 64 nt, Homo Sapiens
aucagaaaugauugcauuggugagaaguagaaauaaucagaaaauuguggcuuggaccugacua

SEQ ID NO: 529035 - RNA, 64 nt, Homo Sapiens
cugaauuuuuauaaaacauaaauuuuuaauguauaaucagaaguacccuguagugcaaaauguc

SEQ ID NO: 529036 - RNA, 64 nt, Homo Sapiens
auugauacccuguagugcaaaaaaauauuuuuaaaaucagaauuugaauucauggagccaucau

SEQ ID NO: 529037 - RNA, 64 nt, Homo Sapiens
ucuggugagacggagaccccgguggcaguggaaaaaucagaagcacaaaggaaaacucuuggcc

SEQ ID NO: 529038 - RNA, 64 nt, Homo Sapiens
ggcgaacacagguguuggaagccaggacugugauaaucagaagcuauaagagaacuuucggagc

SEQ ID NO: 529039 - RNA, 64 nt, Homo Sapiens
caucugugucuuuuguccuuuuauuuguacagauaaucagaagaugauacugaauagauauaaa

SEQ ID NO: 529040 - RNA, 64 nt, Homo Sapiens
auaaaaagggauuaaucugcuaaaauguaaucuaaaucagaauuuugauaaauuuuuuuuguaa

SEQ ID NO: 529041 - RNA, 64 nt, Homo Sapiens
uaauuuuuaaguguuuguaauucuaagugaacagaaucagaagucucaaauguagcauuaguau

SEQ ID NO: 529042 - RNA, 64 nt, Homo Sapiens
aaaguggaagguuugguuucucacgugcucauugaaucagaaaaaugauauuaagcaucuagga

SEQ ID NO: 529043 - RNA, 64 nt, Homo Sapiens
uuuaucucuaaguacaggcuagcuucaccaugcaaaucagaaauagcuguauagcuggguucua

SEQ ID NO: 529044 - RNA, 64 nt, Homo Sapiens
ucccaucacuccagcagcugcaggaagagauggaaaucagaaaaaagagaacucgacuggcuau

SEQ ID NO: 529045 - RNA, 64 nt, Homo Sapiens
cuuaccaugguuugaacaaaggaaauucugcagaaaucagaacuuuuuuuuuauuuuuaauuuu

SEQ ID NO: 529046 - RNA, 64 nt, Homo Sapiens
gaaaauucucaaggccuuuuugcuauuuuuucuuaaucagaaagugacuuuaaaaauauugcag

SEQ ID NO: 529047 - RNA, 64 nt, Homo Sapiens
gauuuaaccccgguggaauaacccuccugagggaaaucagaaauuagugcuaguagauauuacu

SEQ ID NO: 529048 - RNA, 64 nt, Homo Sapiens
cuuagaagacugauagauguagguauauauaaguaaucagaacaacaaagcuguuuaaagaaaa

SEQ ID NO: 529049 - RNA, 64 nt, Homo Sapiens
uagacagguacacuaaagggacacauuucccaucaaucagaaaacuagcggcuaaguaccuccu

SEQ ID NO: 529050 - RNA, 64 nt, Homo Sapiens
cacaaucuuaaccacucgguccucauucugcagcaaucagaauaaucgaauuuaauuuccuuuc

SEQ ID NO: 529051 - RNA, 64 nt, Homo Sapiens
ucugaauguagcacauaauguuauacuaaaacuaaaucagaaaggacggguuaccaaugucagg

SEQ ID NO: 529052 - RNA, 64 nt, Homo Sapiens
caaaauagaggcagcuuuuguuuuuugcguuuuuaaucagaaaagguuuguuugguuuguccuu

SEQ ID NO: 529053 - RNA, 64 nt, Homo Sapiens
uuuggcccaggcuccacggcgacaguugggcccaaaucagaaaggagagagggggccaaugagg

SEQ ID NO: 529054 - RNA, 64 nt, Homo Sapiens
uuuauuuuggagucuaguauuucaauaauuuaagaaucagaagcacugaccuuucuacauuuua

SEQ ID NO: 529055 - RNA, 64 nt, Homo Sapiens
guggucacauauaguguucucaagcuuuacugugaaucagaaacauccaguaagcuugugacaa

SEQ ID NO: 529056 - RNA, 64 nt, Homo Sapiens
agucccauuauauacuuuuggggacaguguuauaaaucagaauuuuacgacaguuugcagaaca

SEQ ID NO: 529057 - RNA, 64 nt, Homo Sapiens
gaacauaaaggacuccagaggguccaaaauugucaaucagaaauuuagggggccucuuggccuu

SEQ ID NO: 529058 - RNA, 64 nt, Homo Sapiens
ggaaucacauucuguuuaucgagucucacuuuggaaucagaauuaagacauggaugaucuggga

SEQ ID NO: 529059 - RNA, 64 nt, Homo Sapiens
auacuaauuuguaagccccaccucaggccuacugaaucagaagcucuggggguuggguccagaa

SEQ ID NO: 529060 - RNA, 64 nt, Homo Sapiens
gcauuuuuacuuuugaaccaaaaagagaaaaaaaaaucagaaguguugcaucuugaggcgaauu

SEQ ID NO: 529061 - RNA, 64 nt, Homo Sapiens
uuucacaccuugcaaaaggagaucuaaaaaacacaaucagaaaugacaaaggggacauuaccac

SEQ ID NO: 529062 - RNA, 64 nt, Homo Sapiens
ucuacaaugagaauuacaaagcagugcacaaagaaaucagaaacaauaaaaauugaaaaauauc

SEQ ID NO: 529063 - RNA, 64 nt, Homo Sapiens
auuucuaucaaacuaccaauggcauuuuucacagaaucagaagaaaacauucugaaauuuauuu

SEQ ID NO: 529064 - RNA, 64 nt, Homo Sapiens
agggaccacugaaugccccgaucccaaucagguuaaucagaaucacuuagagaacuuaaaaaua

SEQ ID NO: 529065 - RNA, 64 nt, Homo Sapiens
uccaagaccuacugagugagaaucuugaggguggaaucagaaucuauuuugaaaaggcaucccc

SEQ ID NO: 529066 - RNA, 64 nt, Homo Sapiens
cuccuugagcaauaguuguuucauuaaguaaaccaaucagaaaacagaauguaguauuuugaua

SEQ ID NO: 529067 - RNA, 64 nt, Homo Sapiens
uucuaccguuccacacccaauaaucucaccacagaaucagaauuuuuuguuuucaaaacuagaa

SEQ ID NO: 529068 - RNA, 64 nt, Homo Sapiens
acugacauuaaauucuagauguugacaauuacugaaucagaaggcaugaaagaguauaauuuua

SEQ ID NO: 529069 - RNA, 64 nt, Homo Sapiens
cuuuaaaaaaguauauagaacaguuacuucuaauaaucagaaagagauguuuuauagaacauuu

SEQ ID NO: 529070 - RNA, 64 nt, Homo Sapiens
gaauuccacugccagugacccacugccuccggccguacacgacagugccuugacccaacagcca

SEQ ID NO: 529071 - RNA, 64 nt, Homo Sapiens
caagcuaaaagaaucgaagacaucccuagugcauguacacgaaugcccuacgucauccuuccag

SEQ ID NO: 529072 - RNA, 64 nt, Homo Sapiens
acuuacuacccaagcccccucagcagaccaauguguacacgacugagccaacuucuacccauug

SEQ ID NO: 529073 - RNA, 64 nt, Homo Sapiens
acaacgugcagguuaguuaccuucgaauuuuaggguacacgagccacaauucuuuuuuauuaca

SEQ ID NO: 529074 - RNA, 64 nt, Homo Sapiens
gcugcacaugcaucaacaaauuacaacauguuuuguacacgaauaaacccauuacaagaaugua

SEQ ID NO: 529075 - RNA, 64 nt, Homo Sapiens
gugggguucggcggccugguuacgggccucucugguacacgagcacccggccaggagacaaggg

SEQ ID NO: 529076 - RNA, 64 nt, Homo Sapiens
cacuacuucugauuuauugcaaauaguuaaguauguacacgagguaaugccuguuuucaucugu

SEQ ID NO: 529077 - RNA, 64 nt, Homo Sapiens
acccacucuuaccugcucgggcucugacaccugaguacacgauccugcccacgcuccuucuuua

SEQ ID NO: 529078 - RNA, 64 nt, Homo Sapiens
ggugaaaaauaacaggugcuaaucuagauguauuguacacgaaaguuuaaaauauacugaaugc

SEQ ID NO: 529079 - RNA, 64 nt, Homo Sapiens
guuuuuuaggggggcagauaaaucaacucaagauguacacgaaguggcagugggcugcagugga

SEQ ID NO: 529080 - RNA, 64 nt, Homo Sapiens
cuucaauaaagcuauccagagaaauguaugcuuuguacacgacauuuaaucauuuuaagugcau

SEQ ID NO: 529081 - RNA, 64 nt, Homo Sapiens
gugugugagacuacuaagaggcauggccccaacgguacacgacucaguauccaugcucuugacc

SEQ ID NO: 529082 - RNA, 64 nt, Homo Sapiens
aaacccagcuuucaucuuuuauguuuuguacuugguacacgagaguauguuaacuuuuuagcac

SEQ ID NO: 529083 - RNA, 64 nt, Homo Sapiens
gggcgcugguuggcauucuugacuaccugucccaguacacgaaaguucccuguuuuaaucacau

SEQ ID NO: 529084 - RNA, 64 nt, Homo Sapiens
ggaacugucugcccaggagcauuucguccuccugguacacgaaguaauguuuauccguuuaaac

SEQ ID NO: 529085 - RNA, 64 nt, Homo Sapiens
acggcccagcagcuccuguggccacagcagcuuuguacacgaagaccauccauccucccuucgu

SEQ ID NO: 529086 - RNA, 64 nt, Homo Sapiens
cagguauguaccaaguaggcaucccguguaccgaguacacgaccaguacacaggcaugacuggg

SEQ ID NO: 529087 - RNA, 64 nt, Homo Sapiens
aucagguagaacaacaaaagcacuuuuccaucuuguacacgagauacaccaacauagcuacaau

SEQ ID NO: 529088 - RNA, 64 nt, Homo Sapiens
cccaucuaggcugaaaaccuuuuugccaagguuuguacacgacucuccugcuccuccaaccuuu

SEQ ID NO: 529089 - RNA, 64 nt, Homo Sapiens
auaaaacucugcuuuguccgacauuugcaaagagguacacgaggaaauggaauugguauuucau

SEQ ID NO: 529090 - RNA, 64 nt, Homo Sapiens
cuaacauuguucaggcgcauggccccugcgguguguacacgaacucggcuucuuuuguccuagg

SEQ ID NO: 529091 - RNA, 64 nt, Homo Sapiens; identical to SEQ ID NO: 115977

SEQ ID NO: 529092 - RNA, 64 nt, Homo Sapiens; identical to SEQ ID NO: 115978

SEQ ID NO: 529093 - RNA, 64 nt, Homo Sapiens; identical to SEQ ID NO: 115979

SEQ ID NO: 529094 - RNA, 64 nt, Homo Sapiens; identical to SEQ ID NO: 115980

SEQ ID NO: 529095 - RNA, 64 nt, Homo Sapiens; identical to SEQ ID NO: 115981

SEQ ID NO: 529096 - RNA, 64 nt, Homo Sapiens; identical to SEQ ID NO: 115982

SEQ ID NO: 529097 - RNA, 64 nt, Homo Sapiens; identical to SEQ ID NO: 115983

SEQ ID NO: 529098 - RNA, 64 nt, Homo Sapiens; identical to SEQ ID NO: 115984

SEQ ID NO: 529099 - RNA, 64 nt, Homo Sapiens; identical to SEQ ID NO: 115985

SEQ ID NO: 529100 - RNA, 64 nt, Homo Sapiens; identical to SEQ ID NO: 115986

SEQ ID NO: 529101 - RNA, 64 nt, Homo Sapiens; identical to SEQ ID NO: 115987

SEQ ID NO: 529102 - RNA, 64 nt, Homo Sapiens; identical to SEQ ID NO: 115988

SEQ ID NO: 529103 - RNA, 64 nt, Homo Sapiens; identical to SEQ ID NO: 115989

SEQ ID NO: 529104 - RNA, 64 nt, Homo Sapiens; identical to SEQ ID NO: 115990

SEQ ID NO: 529105 - RNA, 64 nt, Homo Sapiens; identical to SEQ ID NO: 115991

SEQ ID NO: 529106 - RNA, 64 nt, Homo Sapiens; identical to SEQ ID NO: 115992

SEQ ID NO: 529107 - RNA, 64 nt, Homo Sapiens; identical to SEQ ID NO: 115993

SEQ ID NO: 529108 - RNA, 64 nt, Homo Sapiens; identical to SEQ ID NO: 115994

SEQ ID NO: 529109 - RNA, 64 nt, Homo Sapiens; identical to SEQ ID NO: 115995

SEQ ID NO: 529110 - RNA, 64 nt, Homo Sapiens; identical to SEQ ID NO: 115996

SEQ ID NO: 529111 - RNA, 64 nt, Homo Sapiens; identical to SEQ ID NO: 115997

SEQ ID NO: 529112 - RNA, 64 nt, Homo Sapiens; identical to SEQ ID NO: 115998

SEQ ID NO: 529113 - RNA, 64 nt, Homo Sapiens; identical to SEQ ID NO: 115999

SEQ ID NO: 529114 - RNA, 64 nt, Homo Sapiens; identical to SEQ ID NO: 116000

SEQ ID NO: 529115 - RNA, 64 nt, Homo Sapiens; identical to SEQ ID NO: 116001

SEQ ID NO: 529116 - RNA, 64 nt, Homo Sapiens; identical to SEQ ID NO: 116002

SEQ ID NO: 529117 - RNA, 64 nt, Homo Sapiens; identical to SEQ ID NO: 116003

SEQ ID NO: 529118 - RNA, 64 nt, Homo Sapiens; identical to SEQ ID NO: 116004

SEQ ID NO: 529119 - RNA, 64 nt, Homo Sapiens; identical to SEQ ID NO: 116005

SEQ ID NO: 529120 - RNA, 64 nt, Homo Sapiens; identical to SEQ ID NO: 116006

SEQ ID NO: 529121 - RNA, 64 nt, Homo Sapiens; identical to SEQ ID NO: 116007

SEQ ID NO: 529122 - RNA, 64 nt, Homo Sapiens; identical to SEQ ID NO: 116008

SEQ ID NO: 529123 - RNA, 64 nt, Homo Sapiens; identical to SEQ ID NO: 116009

SEQ ID NO: 529124 - RNA, 64 nt, Homo Sapiens; identical to SEQ ID NO: 116010

SEQ ID NO: 529125 - RNA, 64 nt, Homo Sapiens; identical to SEQ ID NO: 116011

SEQ ID NO: 529126 - RNA, 64 nt, Homo Sapiens; identical to SEQ ID NO: 116012

SEQ ID NO: 529127 - RNA, 64 nt, Homo Sapiens; identical to SEQ ID NO: 116013

SEQ ID NO: 529128 - RNA, 64 nt, Homo Sapiens; identical to SEQ ID NO: 116014

SEQ ID NO: 529129 - RNA, 64 nt, Homo Sapiens; identical to SEQ ID NO: 116015

SEQ ID NO: 529130 - RNA, 64 nt, Homo Sapiens; identical to SEQ ID NO: 116016

SEQ ID NO: 529131 - RNA, 64 nt, Homo Sapiens; identical to SEQ ID NO: 116017

SEQ ID NO: 529132 - RNA, 64 nt, Homo Sapiens; identical to SEQ ID NO: 116018

SEQ ID NO: 529133 - RNA, 64 nt, Homo Sapiens; identical to SEQ ID NO: 116019

SEQ ID NO: 529134 - RNA, 64 nt, Homo Sapiens; identical to SEQ ID NO: 116020

SEQ ID NO: 529135 - RNA, 64 nt, Homo Sapiens; identical to SEQ ID NO: 116021

SEQ ID NO: 529136 - RNA, 64 nt, Homo Sapiens; identical to SEQ ID NO: 116022

SEQ ID NO: 529137 - RNA, 64 nt, Homo Sapiens; identical to SEQ ID NO: 116023

SEQ ID NO: 529138 - RNA, 64 nt, Homo Sapiens; identical to SEQ ID NO: 116024

SEQ ID NO: 529139 - RNA, 64 nt, Homo Sapiens; identical to SEQ ID NO: 116025

SEQ ID NO: 529140 - RNA, 64 nt, Homo Sapiens; identical to SEQ ID NO: 116026

SEQ ID NO: 529141 - RNA, 64 nt, Homo Sapiens; identical to SEQ ID NO: 116027

SEQ ID NO: 529142 - RNA, 64 nt, Homo Sapiens; identical to SEQ ID NO: 116028

SEQ ID NO: 529143 - RNA, 64 nt, Homo Sapiens; identical to SEQ ID NO: 116029

SEQ ID NO: 529144 - RNA, 64 nt, Homo Sapiens; identical to SEQ ID NO: 116030

SEQ ID NO: 529145 - RNA, 64 nt, Homo Sapiens; identical to SEQ ID NO: 116031

SEQ ID NO: 529146 - RNA, 64 nt, Homo Sapiens; identical to SEQ ID NO: 116032

SEQ ID NO: 529147 - RNA, 64 nt, Homo Sapiens; identical to SEQ ID NO: 116033

SEQ ID NO: 529148 - RNA, 64 nt, Homo Sapiens; identical to SEQ ID NO: 116034

SEQ ID NO: 529149 - RNA, 64 nt, Homo Sapiens; identical to SEQ ID NO: 116035

SEQ ID NO: 529150 - RNA, 64 nt, Homo Sapiens; identical to SEQ ID NO: 116036

SEQ ID NO: 529151 - RNA, 64 nt, Homo Sapiens; identical to SEQ ID NO: 116037

SEQ ID NO: 529152 - RNA, 64 nt, Homo Sapiens; identical to SEQ ID NO: 116038

SEQ ID NO: 529153 - RNA, 64 nt, Homo Sapiens; identical to SEQ ID NO: 116039

SEQ ID NO: 529154 - RNA, 64 nt, Homo Sapiens; identical to SEQ ID NO: 116040

SEQ ID NO: 529155 - RNA, 64 nt, Homo Sapiens; identical to SEQ ID NO: 116041

SEQ ID NO: 529156 - RNA, 64 nt, Homo Sapiens; identical to SEQ ID NO: 116042

SEQ ID NO: 529157 - RNA, 64 nt, Homo Sapiens; identical to SEQ ID NO: 116043

SEQ ID NO: 529158 - RNA, 64 nt, Homo Sapiens; identical to SEQ ID NO: 116044

SEQ ID NO: 529159 - RNA, 64 nt, Homo Sapiens; identical to SEQ ID NO: 116045

SEQ ID NO: 529160 - RNA, 64 nt, Homo Sapiens; identical to SEQ ID NO: 116046

SEQ ID NO: 529161 - RNA, 64 nt, Homo Sapiens; identical to SEQ ID NO: 116047

SEQ ID NO: 529162 - RNA, 64 nt, Homo Sapiens; identical to SEQ ID NO: 116048

SEQ ID NO: 529163 - RNA, 64 nt, Homo Sapiens; identical to SEQ ID NO: 116049

SEQ ID NO: 529164 - RNA, 64 nt, Homo Sapiens; identical to SEQ ID NO: 116050

SEQ ID NO: 529165 - RNA, 64 nt, Homo Sapiens; identical to SEQ ID NO: 116051

SEQ ID NO: 529166 - RNA, 64 nt, Homo Sapiens; identical to SEQ ID NO: 116052

SEQ ID NO: 529167 - RNA, 64 nt, Homo Sapiens; identical to SEQ ID NO: 116053

SEQ ID NO: 529168 - RNA, 64 nt, Homo Sapiens; identical to SEQ ID NO: 116054

SEQ ID NO: 529169 - RNA, 64 nt, Homo Sapiens; identical to SEQ ID NO: 116055

SEQ ID NO: 529170 - RNA, 64 nt, Homo Sapiens; identical to SEQ ID NO: 116056

SEQ ID NO: 529171 - RNA, 64 nt, Homo Sapiens; identical to SEQ ID NO: 116057

SEQ ID NO: 529172 - RNA, 64 nt, Homo Sapiens; identical to SEQ ID NO: 116058

SEQ ID NO: 529173 - RNA, 64 nt, Homo Sapiens; identical to SEQ ID NO: 116059

SEQ ID NO: 529174 - RNA, 64 nt, Homo Sapiens; identical to SEQ ID NO: 116060

SEQ ID NO: 529175 - RNA, 64 nt, Homo Sapiens; identical to SEQ ID NO: 116061

SEQ ID NO: 529176 - RNA, 64 nt, Homo Sapiens; identical to SEQ ID NO: 116062

SEQ ID NO: 529177 - RNA, 64 nt, Homo Sapiens; identical to SEQ ID NO: 116063

SEQ ID NO: 529178 - RNA, 64 nt, Homo Sapiens; identical to SEQ ID NO: 116064

SEQ ID NO: 529179 - RNA, 64 nt, Homo Sapiens; identical to SEQ ID NO: 116065

SEQ ID NO: 529180 - RNA, 64 nt, Homo Sapiens; identical to SEQ ID NO: 116066

SEQ ID NO: 529181 - RNA, 64 nt, Homo Sapiens; identical to SEQ ID NO: 116067

SEQ ID NO: 529182 - RNA, 64 nt, Homo Sapiens; identical to SEQ ID NO: 116068

SEQ ID NO: 529183 - RNA, 64 nt, Homo Sapiens; identical to SEQ ID NO: 116069

SEQ ID NO: 529184 - RNA, 64 nt, Homo Sapiens; identical to SEQ ID NO: 116070

SEQ ID NO: 529185 - RNA, 64 nt, Homo Sapiens; identical to SEQ ID NO: 116071

SEQ ID NO: 529186 - RNA, 64 nt, Homo Sapiens; identical to SEQ ID NO: 116072

SEQ ID NO: 529187 - RNA, 64 nt, Homo Sapiens; identical to SEQ ID NO: 116073

SEQ ID NO: 529188 - RNA, 64 nt, Homo Sapiens; identical to SEQ ID NO: 116074

SEQ ID NO: 529189 - RNA, 64 nt, Homo Sapiens; identical to SEQ ID NO: 116075

SEQ ID NO: 529190 - RNA, 64 nt, Homo Sapiens; identical to SEQ ID NO: 116076

SEQ ID NO: 529191 - RNA, 64 nt, Homo Sapiens; identical to SEQ ID NO: 116077

SEQ ID NO: 529192 - RNA, 64 nt, Homo Sapiens; identical to SEQ ID NO: 116078

SEQ ID NO: 529193 - RNA, 64 nt, Homo Sapiens; identical to SEQ ID NO: 116079

SEQ ID NO: 529194 - RNA, 64 nt, Homo Sapiens; identical to SEQ ID NO: 116080

SEQ ID NO: 529195 - RNA, 64 nt, Homo Sapiens; identical to SEQ ID NO: 116081

SEQ ID NO: 529196 - RNA, 64 nt, Homo Sapiens; identical to SEQ ID NO: 116082

SEQ ID NO: 529197 - RNA, 64 nt, Homo Sapiens; identical to SEQ ID NO: 116083

SEQ ID NO: 529198 - RNA, 64 nt, Homo Sapiens; identical to SEQ ID NO: 116084

SEQ ID NO: 529199 - RNA, 64 nt, Homo Sapiens; identical to SEQ ID NO: 116085

SEQ ID NO: 529200 - RNA, 64 nt, Homo Sapiens; identical to SEQ ID NO: 116086

SEQ ID NO: 529201 - RNA, 64 nt, Homo Sapiens; identical to SEQ ID NO: 116087

SEQ ID NO: 529202 - RNA, 64 nt, Homo Sapiens; identical to SEQ ID NO: 116088

SEQ ID NO: 529203 - RNA, 64 nt, Homo Sapiens; identical to SEQ ID NO: 116089

SEQ ID NO: 529204 - RNA, 64 nt, Homo Sapiens; identical to SEQ ID NO: 116090

SEQ ID NO: 529205 - RNA, 64 nt, Homo Sapiens; identical to SEQ ID NO: 116091

SEQ ID NO: 529206 - RNA, 64 nt, Homo Sapiens; identical to SEQ ID NO: 116092

SEQ ID NO: 529207 - RNA, 64 nt, Homo Sapiens; identical to SEQ ID NO: 116093

SEQ ID NO: 529208 - RNA, 64 nt, Homo Sapiens; identical to SEQ ID NO: 116094

SEQ ID NO: 529209 - RNA, 64 nt, Homo Sapiens; identical to SEQ ID NO: 116095

SEQ ID NO: 529210 - RNA, 64 nt, Homo Sapiens; identical to SEQ ID NO: 116096

SEQ ID NO: 529211 - RNA, 64 nt, Homo Sapiens; identical to SEQ ID NO: 116097

SEQ ID NO: 529212 - RNA, 64 nt, Homo Sapiens; identical to SEQ ID NO: 116098

SEQ ID NO: 529213 - RNA, 64 nt, Homo Sapiens; identical to SEQ ID NO: 116099

SEQ ID NO: 529214 - RNA, 64 nt, Homo Sapiens; identical to SEQ ID NO: 116100

SEQ ID NO: 529215 - RNA, 64 nt, Homo Sapiens; identical to SEQ ID NO: 116101

SEQ ID NO: 529216 - RNA, 64 nt, Homo Sapiens; identical to SEQ ID NO: 116102

SEQ ID NO: 529217 - RNA, 64 nt, Homo Sapiens; identical to SEQ ID NO: 116103

SEQ ID NO: 529218 - RNA, 64 nt, Homo Sapiens; identical to SEQ ID NO: 116104

SEQ ID NO: 529219 - RNA, 64 nt, Homo Sapiens; identical to SEQ ID NO: 116105

SEQ ID NO: 529220 - RNA, 64 nt, Homo Sapiens; identical to SEQ ID NO: 116106

SEQ ID NO: 529221 - RNA, 64 nt, Homo Sapiens; identical to SEQ ID NO: 116107

SEQ ID NO: 529222 - RNA, 64 nt, Homo Sapiens; identical to SEQ ID NO: 116108

SEQ ID NO: 529223 - RNA, 64 nt, Homo Sapiens; identical to SEQ ID NO: 116109

SEQ ID NO: 529224 - RNA, 64 nt, Homo Sapiens; identical to SEQ ID NO: 116110

SEQ ID NO: 529225 - RNA, 64 nt, Homo Sapiens; identical to SEQ ID NO: 116111

SEQ ID NO: 529226 - RNA, 64 nt, Homo Sapiens; identical to SEQ ID NO: 116112

SEQ ID NO: 529227 - RNA, 64 nt, Homo Sapiens; identical to SEQ ID NO: 116113

SEQ ID NO: 529228 - RNA, 64 nt, Homo Sapiens; identical to SEQ ID NO: 116114

SEQ ID NO: 529229 - RNA, 64 nt, Homo Sapiens; identical to SEQ ID NO: 116115

SEQ ID NO: 529230 - RNA, 64 nt, Homo Sapiens; identical to SEQ ID NO: 116116

SEQ ID NO: 529231 - RNA, 64 nt, Homo Sapiens; identical to SEQ ID NO: 116117

SEQ ID NO: 529232 - RNA, 64 nt, Homo Sapiens; identical to SEQ ID NO: 116118

SEQ ID NO: 529233 - RNA, 64 nt, Homo Sapiens; identical to SEQ ID NO: 116119

SEQ ID NO: 529234 - RNA, 64 nt, Homo Sapiens; identical to SEQ ID NO: 116120

SEQ ID NO: 529235 - RNA, 64 nt, Homo Sapiens; identical to SEQ ID NO: 116121

SEQ ID NO: 529236 - RNA, 64 nt, Homo Sapiens; identical to SEQ ID NO: 116122

SEQ ID NO: 529237 - RNA, 64 nt, Homo Sapiens; identical to SEQ ID NO: 116123

SEQ ID NO: 529238 - RNA, 64 nt, Homo Sapiens; identical to SEQ ID NO: 116124

SEQ ID NO: 529239 - RNA, 64 nt, Homo Sapiens; identical to SEQ ID NO: 116125

SEQ ID NO: 529240 - RNA, 64 nt, Homo Sapiens; identical to SEQ ID NO: 116126

SEQ ID NO: 529241 - RNA, 64 nt, Homo Sapiens; identical to SEQ ID NO: 116127

SEQ ID NO: 529242 - RNA, 64 nt, Homo Sapiens; identical to SEQ ID NO: 116128

SEQ ID NO: 529243 - RNA, 64 nt, Homo Sapiens; identical to SEQ ID NO: 116129

SEQ ID NO: 529244 - RNA, 64 nt, Homo Sapiens; identical to SEQ ID NO: 116130

SEQ ID NO: 529245 - RNA, 64 nt, Homo Sapiens; identical to SEQ ID NO: 116131

SEQ ID NO: 529246 - RNA, 64 nt, Homo Sapiens; identical to SEQ ID NO: 116132

SEQ ID NO: 529247 - RNA, 64 nt, Homo Sapiens; identical to SEQ ID NO: 116133

SEQ ID NO: 529248 - RNA, 64 nt, Homo Sapiens; identical to SEQ ID NO: 116134

SEQ ID NO: 529249 - RNA, 64 nt, Homo Sapiens; identical to SEQ ID NO: 116135

SEQ ID NO: 529250 - RNA, 64 nt, Homo Sapiens; identical to SEQ ID NO: 116136

SEQ ID NO: 529251 - RNA, 64 nt, Homo Sapiens; identical to SEQ ID NO: 116137

SEQ ID NO: 529252 - RNA, 64 nt, Homo Sapiens; identical to SEQ ID NO: 116138

SEQ ID NO: 529253 - RNA, 64 nt, Homo Sapiens; identical to SEQ ID NO: 116139

SEQ ID NO: 529254 - RNA, 64 nt, Homo Sapiens; identical to SEQ ID NO: 116140

SEQ ID NO: 529255 - RNA, 64 nt, Homo Sapiens; identical to SEQ ID NO: 116141

SEQ ID NO: 529256 - RNA, 64 nt, Homo Sapiens; identical to SEQ ID NO: 116142

SEQ ID NO: 529257 - RNA, 64 nt, Homo Sapiens; identical to SEQ ID NO: 116143

SEQ ID NO: 529258 - RNA, 64 nt, Homo Sapiens; identical to SEQ ID NO: 116144

SEQ ID NO: 529259 - RNA, 64 nt, Homo Sapiens; identical to SEQ ID NO: 116145

SEQ ID NO: 529260 - RNA, 64 nt, Homo Sapiens; identical to SEQ ID NO: 116146

SEQ ID NO: 529261 - RNA, 64 nt, Homo Sapiens; identical to SEQ ID NO: 116147

SEQ ID NO: 529262 - RNA, 64 nt, Homo Sapiens; identical to SEQ ID NO: 116148

SEQ ID NO: 529263 - RNA, 64 nt, Homo Sapiens; identical to SEQ ID NO: 116149

SEQ ID NO: 529264 - RNA, 64 nt, Homo Sapiens; identical to SEQ ID NO: 116150

SEQ ID NO: 529265 - RNA, 64 nt, Homo Sapiens; identical to SEQ ID NO: 116151

SEQ ID NO: 529266 - RNA, 64 nt, Homo Sapiens; identical to SEQ ID NO: 116152

SEQ ID NO: 529267 - RNA, 64 nt, Homo Sapiens; identical to SEQ ID NO: 116153

SEQ ID NO: 529268 - RNA, 64 nt, Homo Sapiens; identical to SEQ ID NO: 116154

SEQ ID NO: 529269 - RNA, 64 nt, Homo Sapiens; identical to SEQ ID NO: 116155

SEQ ID NO: 529270 - RNA, 64 nt, Homo Sapiens; identical to SEQ ID NO: 116156

SEQ ID NO: 529271 - RNA, 64 nt, Homo Sapiens; identical to SEQ ID NO: 116157

SEQ ID NO: 529272 - RNA, 64 nt, Homo Sapiens; identical to SEQ ID NO: 116158

SEQ ID NO: 529273 - RNA, 64 nt, Homo Sapiens; identical to SEQ ID NO: 116159

SEQ ID NO: 529274 - RNA, 64 nt, Homo Sapiens; identical to SEQ ID NO: 116160

SEQ ID NO: 529275 - RNA, 64 nt, Homo Sapiens; identical to SEQ ID NO: 116161

SEQ ID NO: 529276 - RNA, 64 nt, Homo Sapiens; identical to SEQ ID NO: 116162

SEQ ID NO: 529277 - RNA, 64 nt, Homo Sapiens; identical to SEQ ID NO: 116163

SEQ ID NO: 529278 - RNA, 64 nt, Homo Sapiens; identical to SEQ ID NO: 116164

SEQ ID NO: 529279 - RNA, 64 nt, Homo Sapiens; identical to SEQ ID NO: 116165

SEQ ID NO: 529280 - RNA, 64 nt, Homo Sapiens; identical to SEQ ID NO: 116166

SEQ ID NO: 529281 - RNA, 64 nt, Homo Sapiens; identical to SEQ ID NO: 116167

SEQ ID NO: 529282 - RNA, 64 nt, Homo Sapiens; identical to SEQ ID NO: 116168

SEQ ID NO: 529283 - RNA, 64 nt, Homo Sapiens; identical to SEQ ID NO: 116169

SEQ ID NO: 529284 - RNA, 64 nt, Homo Sapiens; identical to SEQ ID NO: 116170

SEQ ID NO: 529285 - RNA, 64 nt, Homo Sapiens; identical to SEQ ID NO: 116171

SEQ ID NO: 529286 - RNA, 64 nt, Homo Sapiens; identical to SEQ ID NO: 116172

SEQ ID NO: 529287 - RNA, 64 nt, Homo Sapiens; identical to SEQ ID NO: 116173

SEQ ID NO: 529288 - RNA, 64 nt, Homo Sapiens; identical to SEQ ID NO: 116174

SEQ ID NO: 529289 - RNA, 64 nt, Homo Sapiens; identical to SEQ ID NO: 116175

SEQ ID NO: 529290 - RNA, 64 nt, Homo Sapiens; identical to SEQ ID NO: 116176

SEQ ID NO: 529291 - RNA, 64 nt, Homo Sapiens; identical to SEQ ID NO: 116177

SEQ ID NO: 529292 - RNA, 64 nt, Homo Sapiens; identical to SEQ ID NO: 116178

SEQ ID NO: 529293 - RNA, 64 nt, Homo Sapiens; identical to SEQ ID NO: 116179

SEQ ID NO: 529294 - RNA, 64 nt, Homo Sapiens; identical to SEQ ID NO: 116180

SEQ ID NO: 529295 - RNA, 64 nt, Homo Sapiens; identical to SEQ ID NO: 116181

SEQ ID NO: 529296 - RNA, 64 nt, Homo Sapiens; identical to SEQ ID NO: 116182

SEQ ID NO: 529297 - RNA, 64 nt, Homo Sapiens; identical to SEQ ID NO: 116183

SEQ ID NO: 529298 - RNA, 64 nt, Homo Sapiens; identical to SEQ ID NO: 116184

SEQ ID NO: 529299 - RNA, 64 nt, Homo Sapiens; identical to SEQ ID NO: 116185

SEQ ID NO: 529300 - RNA, 64 nt, Homo Sapiens; identical to SEQ ID NO: 116186

SEQ ID NO: 529301 - RNA, 64 nt, Homo Sapiens; identical to SEQ ID NO: 116187

SEQ ID NO: 529302 - RNA, 64 nt, Homo Sapiens; identical to SEQ ID NO: 116188

SEQ ID NO: 529303 - RNA, 64 nt, Homo Sapiens; identical to SEQ ID NO: 116189

SEQ ID NO: 529304 - RNA, 64 nt, Homo Sapiens; identical to SEQ ID NO: 116190

SEQ ID NO: 529305 - RNA, 64 nt, Homo Sapiens; identical to SEQ ID NO: 116191

SEQ ID NO: 529306 - RNA, 64 nt, Homo Sapiens; identical to SEQ ID NO: 116192

SEQ ID NO: 529307 - RNA, 64 nt, Homo Sapiens; identical to SEQ ID NO: 116193

SEQ ID NO: 529308 - RNA, 64 nt, Homo Sapiens; identical to SEQ ID NO: 116194

SEQ ID NO: 529309 - RNA, 64 nt, Homo Sapiens; identical to SEQ ID NO: 116195

SEQ ID NO: 529310 - RNA, 64 nt, Homo Sapiens; identical to SEQ ID NO: 116196

SEQ ID NO: 529311 - RNA, 64 nt, Homo Sapiens; identical to SEQ ID NO: 116197

SEQ ID NO: 529312 - RNA, 64 nt, Homo Sapiens; identical to SEQ ID NO: 116198

SEQ ID NO: 529313 - RNA, 64 nt, Homo Sapiens; identical to SEQ ID NO: 116199

SEQ ID NO: 529314 - RNA, 64 nt, Homo Sapiens; identical to SEQ ID NO: 116200

SEQ ID NO: 529315 - RNA, 64 nt, Homo Sapiens; identical to SEQ ID NO: 116201

SEQ ID NO: 529316 - RNA, 64 nt, Homo Sapiens; identical to SEQ ID NO: 116202

SEQ ID NO: 529317 - RNA, 64 nt, Homo Sapiens; identical to SEQ ID NO: 116203

SEQ ID NO: 529318 - RNA, 64 nt, Homo Sapiens; identical to SEQ ID NO: 116204

SEQ ID NO: 529319 - RNA, 64 nt, Homo Sapiens; identical to SEQ ID NO: 116205

SEQ ID NO: 529320 - RNA, 64 nt, Homo Sapiens; identical to SEQ ID NO: 116206

SEQ ID NO: 529321 - RNA, 64 nt, Homo Sapiens; identical to SEQ ID NO: 116207

SEQ ID NO: 529322 - RNA, 64 nt, Homo Sapiens; identical to SEQ ID NO: 116208

SEQ ID NO: 529323 - RNA, 64 nt, Homo Sapiens; identical to SEQ ID NO: 116209

SEQ ID NO: 529324 - RNA, 64 nt, Homo Sapiens; identical to SEQ ID NO: 116210

SEQ ID NO: 529325 - RNA, 64 nt, Homo Sapiens; identical to SEQ ID NO: 116211

SEQ ID NO: 529326 - RNA, 64 nt, Homo Sapiens; identical to SEQ ID NO: 116212

SEQ ID NO: 529327 - RNA, 64 nt, Homo Sapiens; identical to SEQ ID NO: 116213

SEQ ID NO: 529328 - RNA, 64 nt, Homo Sapiens; identical to SEQ ID NO: 116214

SEQ ID NO: 529329 - RNA, 64 nt, Homo Sapiens; identical to SEQ ID NO: 116215

SEQ ID NO: 529330 - RNA, 64 nt, Homo Sapiens; identical to SEQ ID NO: 116216

SEQ ID NO: 529331 - RNA, 64 nt, Homo Sapiens; identical to SEQ ID NO: 116217

SEQ ID NO: 529332 - RNA, 64 nt, Homo Sapiens; identical to SEQ ID NO: 116218

SEQ ID NO: 529333 - RNA, 64 nt, Homo Sapiens; identical to SEQ ID NO: 116219

SEQ ID NO: 529334 - RNA, 64 nt, Homo Sapiens; identical to SEQ ID NO: 116220

SEQ ID NO: 529335 - RNA, 64 nt, Homo Sapiens; identical to SEQ ID NO: 116221

SEQ ID NO: 529336 - RNA, 64 nt, Homo Sapiens; identical to SEQ ID NO: 116222

SEQ ID NO: 529337 - RNA, 64 nt, Homo Sapiens; identical to SEQ ID NO: 116223

SEQ ID NO: 529338 - RNA, 64 nt, Homo Sapiens; identical to SEQ ID NO: 116224

SEQ ID NO: 529339 - RNA, 64 nt, Homo Sapiens; identical to SEQ ID NO: 116225

SEQ ID NO: 529340 - RNA, 64 nt, Homo Sapiens; identical to SEQ ID NO: 116226

SEQ ID NO: 529341 - RNA, 64 nt, Homo Sapiens; identical to SEQ ID NO: 116227

SEQ ID NO: 529342 - RNA, 64 nt, Homo Sapiens; identical to SEQ ID NO: 116228

SEQ ID NO: 529343 - RNA, 64 nt, Homo Sapiens; identical to SEQ ID NO: 116229

SEQ ID NO: 529344 - RNA, 64 nt, Homo Sapiens; identical to SEQ ID NO: 116230

SEQ ID NO: 529345 - RNA, 64 nt, Homo Sapiens; identical to SEQ ID NO: 116231

SEQ ID NO: 529346 - RNA, 64 nt, Homo Sapiens; identical to SEQ ID NO: 116232

SEQ ID NO: 529347 - RNA, 64 nt, Homo Sapiens; identical to SEQ ID NO: 116233

SEQ ID NO: 529348 - RNA, 64 nt, Homo Sapiens; identical to SEQ ID NO: 116234

SEQ ID NO: 529349 - RNA, 64 nt, Homo Sapiens; identical to SEQ ID NO: 116235

SEQ ID NO: 529350 - RNA, 64 nt, Homo Sapiens; identical to SEQ ID NO: 116236

SEQ ID NO: 529351 - RNA, 64 nt, Homo Sapiens; identical to SEQ ID NO: 116237

SEQ ID NO: 529352 - RNA, 64 nt, Homo Sapiens; identical to SEQ ID NO: 116238

SEQ ID NO: 529353 - RNA, 64 nt, Homo Sapiens; identical to SEQ ID NO: 116239

SEQ ID NO: 529354 - RNA, 64 nt, Homo Sapiens; identical to SEQ ID NO: 116240

SEQ ID NO: 529355 - RNA, 64 nt, Homo Sapiens; identical to SEQ ID NO: 116241

SEQ ID NO: 529356 - RNA, 64 nt, Homo Sapiens; identical to SEQ ID NO: 116242

SEQ ID NO: 529357 - RNA, 64 nt, Homo Sapiens; identical to SEQ ID NO: 116243

SEQ ID NO: 529358 - RNA, 64 nt, Homo Sapiens; identical to SEQ ID NO: 116244

SEQ ID NO: 529359 - RNA, 64 nt, Homo Sapiens; identical to SEQ ID NO: 116245

SEQ ID NO: 529360 - RNA, 64 nt, Homo Sapiens; identical to SEQ ID NO: 116246

SEQ ID NO: 529361 - RNA, 64 nt, Homo Sapiens; identical to SEQ ID NO: 116247

SEQ ID NO: 529362 - RNA, 64 nt, Homo Sapiens; identical to SEQ ID NO: 116248

SEQ ID NO: 529363 - RNA, 64 nt, Homo Sapiens; identical to SEQ ID NO: 116249

SEQ ID NO: 529364 - RNA, 64 nt, Homo Sapiens; identical to SEQ ID NO: 116250

SEQ ID NO: 529365 - RNA, 64 nt, Homo Sapiens; identical to SEQ ID NO: 116251

SEQ ID NO: 529366 - RNA, 64 nt, Homo Sapiens; identical to SEQ ID NO: 116252

SEQ ID NO: 529367 - RNA, 64 nt, Homo Sapiens; identical to SEQ ID NO: 116253

SEQ ID NO: 529368 - RNA, 64 nt, Homo Sapiens; identical to SEQ ID NO: 116254

SEQ ID NO: 529369 - RNA, 64 nt, Homo Sapiens; identical to SEQ ID NO: 116255

SEQ ID NO: 529370 - RNA, 64 nt, Homo Sapiens; identical to SEQ ID NO: 116256

SEQ ID NO: 529371 - RNA, 64 nt, Homo Sapiens; identical to SEQ ID NO: 116257
